United States Patent 8,178,503 (RIBONUCLEIC ACID INTERFERENCE MOLECULES AND BINDING SITES DERIVED BY ANALYZING INTERGENIC AND INTRONIC REGIONS OF GENOMES) - sequence listing, part 5

SEQ ID NO: 179068 - DNA, 16 bp, H. sapiens
tttttctgagccattt

SEQ ID NO: 179069 - DNA, 16 bp, H. sapiens
tttttctgataattag

SEQ ID NO: 179070 - DNA, 16 bp, H. sapiens
tttttctgattactaa

SEQ ID NO: 179071 - DNA, 16 bp, H. sapiens
tttttctgcaaatatt

SEQ ID NO: 179072 - DNA, 16 bp, H. sapiens
tttttctgcagctatt

SEQ ID NO: 179073 - DNA, 16 bp, H. sapiens
tttttctgcatataga

SEQ ID NO: 179074 - DNA, 16 bp, H. sapiens
tttttctgcatcaatt

SEQ ID NO: 179075 - DNA, 16 bp, H. sapiens
tttttctgcatctgtt

SEQ ID NO: 179076 - DNA, 16 bp, H. sapiens
tttttctgccattctg

SEQ ID NO: 179077 - DNA, 16 bp, H. sapiens
tttttctgcttctgaa

SEQ ID NO: 179078 - DNA, 16 bp, H. sapiens
tttttctgcttttgaa

SEQ ID NO: 179079 - DNA, 16 bp, H. sapiens
tttttctggaaaaaga

SEQ ID NO: 179080 - DNA, 16 bp, H. sapiens
tttttctggaataaat

SEQ ID NO: 179081 - DNA, 16 bp, H. sapiens
tttttctggccaggtg

SEQ ID NO: 179082 - DNA, 16 bp, H. sapiens
tttttctggccgggcg

SEQ ID NO: 179083 - DNA, 16 bp, H. sapiens
tttttctgggaagaaa

SEQ ID NO: 179084 - DNA, 16 bp, H. sapiens
tttttctggtaaattt

SEQ ID NO: 179085 - DNA, 16 bp, H. sapiens
tttttctggttttaaa

SEQ ID NO: 179086 - DNA, 16 bp, H. sapiens
tttttctgtaaaggtc

SEQ ID NO: 179087 - DNA, 16 bp, H. sapiens
tttttctgtaaatcta

SEQ ID NO: 179088 - DNA, 16 bp, H. sapiens
tttttctgtaagaaat

SEQ ID NO: 179089 - DNA, 16 bp, H. sapiens
tttttctgtcccttta

SEQ ID NO: 179090 - DNA, 16 bp, H. sapiens
tttttctgtgaactta

SEQ ID NO: 179091 - DNA, 16 bp, H. sapiens
tttttctgtgcattta

SEQ ID NO: 179092 - DNA, 16 bp, H. sapiens
tttttctgtggaaata

SEQ ID NO: 179093 - DNA, 16 bp, H. sapiens
tttttctgtgtatata

SEQ ID NO: 179094 - DNA, 16 bp, H. sapiens
tttttctgttaaaaat

SEQ ID NO: 179095 - DNA, 16 bp, H. sapiens
tttttctgttcaaatt

SEQ ID NO: 179096 - DNA, 16 bp, H. sapiens
tttttctgttgaaaat

SEQ ID NO: 179097 - DNA, 16 bp, H. sapiens
tttttcttaaaaagtt

SEQ ID NO: 179098 - DNA, 16 bp, H. sapiens
tttttcttaaaagaga

SEQ ID NO: 179099 - DNA, 16 bp, H. sapiens
tttttcttaaagaagg

SEQ ID NO: 179100 - DNA, 16 bp, H. sapiens
tttttcttaaagacaa

SEQ ID NO: 179101 - DNA, 16 bp, H. sapiens
tttttcttaaagagga

SEQ ID NO: 179102 - DNA, 16 bp, H. sapiens
tttttcttaaagcact

SEQ ID NO: 179103 - DNA, 16 bp, H. sapiens
tttttcttaaattgaa

SEQ ID NO: 179104 - DNA, 16 bp, H. sapiens
tttttcttaattatga

SEQ ID NO: 179105 - DNA, 16 bp, H. sapiens
tttttcttaattgaaa

SEQ ID NO: 179106 - DNA, 16 bp, H. sapiens
tttttcttacagttct

SEQ ID NO: 179107 - DNA, 16 bp, H. sapiens
tttttcttactgtaaa

SEQ ID NO: 179108 - DNA, 16 bp, H. sapiens
tttttcttagaaaaat

SEQ ID NO: 179109 - DNA, 16 bp, H. sapiens
tttttcttagagatgg

SEQ ID NO: 179110 - DNA, 16 bp, H. sapiens
tttttcttaggaaata

SEQ ID NO: 179111 - DNA, 16 bp, H. sapiens
tttttcttataagaaa

SEQ ID NO: 179112 - DNA, 16 bp, H. sapiens
tttttcttattgtaaa

SEQ ID NO: 179113 - DNA, 16 bp, H. sapiens
tttttcttcaaaattg

SEQ ID NO: 179114 - DNA, 16 bp, H. sapiens
tttttcttcaaataaa

SEQ ID NO: 179115 - DNA, 16 bp, H. sapiens
tttttcttcagagtct

SEQ ID NO: 179116 - DNA, 16 bp, H. sapiens
tttttcttcagcattt

SEQ ID NO: 179117 - DNA, 16 bp, H. sapiens
tttttcttcagcttta

SEQ ID NO: 179118 - DNA, 16 bp, H. sapiens
tttttcttcatggcac

SEQ ID NO: 179119 - DNA, 16 bp, H. sapiens
tttttcttcatgtgga

SEQ ID NO: 179120 - DNA, 16 bp, H. sapiens
tttttcttccaaaatt

SEQ ID NO: 179121 - DNA, 16 bp, H. sapiens
tttttcttccagtttc

SEQ ID NO: 179122 - DNA, 16 bp, H. sapiens
tttttcttcccagtct

SEQ ID NO: 179123 - DNA, 16 bp, H. sapiens
tttttcttccccaaag

SEQ ID NO: 179124 - DNA, 16 bp, H. sapiens
tttttcttccctgaga

SEQ ID NO: 179125 - DNA, 16 bp, H. sapiens
tttttcttcctaaaaa

SEQ ID NO: 179126 - DNA, 16 bp, H. sapiens
tttttcttcctaaaat

SEQ ID NO: 179127 - DNA, 16 bp, H. sapiens
tttttcttcctcaaat

SEQ ID NO: 179128 - DNA, 16 bp, H. sapiens
tttttcttcctgcatt

SEQ ID NO: 179129 - DNA, 16 bp, H. sapiens
tttttcttctctaaaa

SEQ ID NO: 179130 - DNA, 16 bp, H. sapiens
tttttcttctctactg

SEQ ID NO: 179131 - DNA, 16 bp, H. sapiens
tttttcttctgcctaa

SEQ ID NO: 179132 - DNA, 16 bp, H. sapiens
tttttcttctgtgaat

SEQ ID NO: 179133 - DNA, 16 bp, H. sapiens
tttttcttctgttaaa

SEQ ID NO: 179134 - DNA, 16 bp, H. sapiens
tttttcttcttcagaa

SEQ ID NO: 179135 - DNA, 16 bp, H. sapiens
tttttcttcttgagac

SEQ ID NO: 179136 - DNA, 16 bp, H. sapiens
tttttcttcttggtca

SEQ ID NO: 179137 - DNA, 16 bp, H. sapiens
tttttcttgagacgga

SEQ ID NO: 179138 - DNA, 16 bp, H. sapiens
tttttcttgccaaaaa

SEQ ID NO: 179139 - DNA, 16 bp, H. sapiens
tttttcttgcctaact

SEQ ID NO: 179140 - DNA, 16 bp, H. sapiens
tttttcttgcctgatt

SEQ ID NO: 179141 - DNA, 16 bp, H. sapiens
tttttcttgctttcca

SEQ ID NO: 179142 - DNA, 16 bp, H. sapiens
tttttcttggaaaaat

SEQ ID NO: 179143 - DNA, 16 bp, H. sapiens
tttttcttgtaaatat

SEQ ID NO: 179144 - DNA, 16 bp, H. sapiens
tttttcttgtaaatgt

SEQ ID NO: 179145 - DNA, 16 bp, H. sapiens
tttttcttgtagaggt

SEQ ID NO: 179146 - DNA, 16 bp, H. sapiens
tttttcttgtataaat

SEQ ID NO: 179147 - DNA, 16 bp, H. sapiens
tttttcttgtgatgtc

SEQ ID NO: 179148 - DNA, 16 bp, H. sapiens
tttttctttaaaagga

SEQ ID NO: 179149 - DNA, 16 bp, H. sapiens
tttttctttaaattga

SEQ ID NO: 179150 - DNA, 16 bp, H. sapiens
tttttctttaagaaag

SEQ ID NO: 179151 - DNA, 16 bp, H. sapiens
tttttctttaagaatg

SEQ ID NO: 179152 - DNA, 16 bp, H. sapiens
tttttctttaatgtaa

SEQ ID NO: 179153 - DNA, 16 bp, H. sapiens
tttttctttagaaaaa

SEQ ID NO: 179154 - DNA, 16 bp, H. sapiens
tttttctttagtagag

SEQ ID NO: 179155 - DNA, 16 bp, H. sapiens
tttttctttatcccaa

SEQ ID NO: 179156 - DNA, 16 bp, H. sapiens
tttttctttcacaaat

SEQ ID NO: 179157 - DNA, 16 bp, H. sapiens
tttttctttcactgaa

SEQ ID NO: 179158 - DNA, 16 bp, H. sapiens
tttttctttcactgat

SEQ ID NO: 179159 - DNA, 16 bp, H. sapiens
tttttctttcagaaat

SEQ ID NO: 179160 - DNA, 16 bp, H. sapiens
tttttctttccagaaa

SEQ ID NO: 179161 - DNA, 16 bp, H. sapiens
tttttctttgaaaata

SEQ ID NO: 179162 - DNA, 16 bp, H. sapiens
tttttctttgaaataa

SEQ ID NO: 179163 - DNA, 16 bp, H. sapiens
tttttctttgaacatg

SEQ ID NO: 179164 - DNA, 16 bp, H. sapiens
tttttctttgagaatt

SEQ ID NO: 179165 - DNA, 16 bp, H. sapiens
tttttctttgtaacat

SEQ ID NO: 179166 - DNA, 16 bp, H. sapiens
tttttcttttaaaaga

SEQ ID NO: 179167 - DNA, 16 bp, H. sapiens
tttttcttttaaagaa

SEQ ID NO: 179168 - DNA, 16 bp, H. sapiens
tttttcttttaagaaa

SEQ ID NO: 179169 - DNA, 16 bp, H. sapiens
tttttcttttaagaga

SEQ ID NO: 179170 - DNA, 16 bp, H. sapiens
tttttcttttaataga

SEQ ID NO: 179171 - DNA, 16 bp, H. sapiens
tttttcttttatcaga

SEQ ID NO: 179172 - DNA, 16 bp, H. sapiens
tttttcttttgaaaat

SEQ ID NO: 179173 - DNA, 16 bp, H. sapiens
tttttcttttgaagta

SEQ ID NO: 179174 - DNA, 16 bp, H. sapiens
tttttcttttgaataa

SEQ ID NO: 179175 - DNA, 16 bp, H. sapiens
tttttcttttgaggaa

SEQ ID NO: 179176 - DNA, 16 bp, H. sapiens
tttttcttttgaggca

SEQ ID NO: 179177 - DNA, 16 bp, H. sapiens
tttttcttttggaaat

SEQ ID NO: 179178 - DNA, 16 bp, H. sapiens
tttttctttttaaaga

SEQ ID NO: 179179 - DNA, 16 bp, H. sapiens
tttttctttttagaga

SEQ ID NO: 179180 - DNA, 16 bp, H. sapiens
tttttctttttcaaga

SEQ ID NO: 179181 - DNA, 16 bp, H. sapiens
tttttctttttcagaa

SEQ ID NO: 179182 - DNA, 16 bp, H. sapiens
tttttctttttggaaa

SEQ ID NO: 179183 - DNA, 16 bp, H. sapiens
tttttctttttggcag

SEQ ID NO: 179184 - DNA, 16 bp, H. sapiens
tttttgaaaacatcaa

SEQ ID NO: 179185 - DNA, 16 bp, H. sapiens
tttttgaaaagatgaa

SEQ ID NO: 179186 - DNA, 16 bp, H. sapiens
tttttgaaaagcaatt

SEQ ID NO: 179187 - DNA, 16 bp, H. sapiens
tttttgaaaatacaaa

SEQ ID NO: 179188 - DNA, 16 bp, H. sapiens
tttttgaaaatatcaa

SEQ ID NO: 179189 - DNA, 16 bp, H. sapiens
tttttgaaaatatgca

SEQ ID NO: 179190 - DNA, 16 bp, H. sapiens
tttttgaaaatcattt

SEQ ID NO: 179191 - DNA, 16 bp, H. sapiens
tttttgaaaatgagaa

SEQ ID NO: 179192 - DNA, 16 bp, H. sapiens
tttttgaaaattctat

SEQ ID NO: 179193 - DNA, 16 bp, H. sapiens
tttttgaaaattgaat

SEQ ID NO: 179194 - DNA, 16 bp, H. sapiens
tttttgaaaattttca

SEQ ID NO: 179195 - DNA, 16 bp, H. sapiens
tttttgaaacaaatga

SEQ ID NO: 179196 - DNA, 16 bp, H. sapiens
tttttgaaacaaattt

SEQ ID NO: 179197 - DNA, 16 bp, H. sapiens
tttttgaaaccaatga

SEQ ID NO: 179198 - DNA, 16 bp, H. sapiens
tttttgaaacttttat

SEQ ID NO: 179199 - DNA, 16 bp, H. sapiens
tttttgaaacttttct

SEQ ID NO: 179200 - DNA, 16 bp, H. sapiens
tttttgaaagaaatta

SEQ ID NO: 179201 - DNA, 16 bp, H. sapiens
tttttgaaagactttt

SEQ ID NO: 179202 - DNA, 16 bp, H. sapiens
tttttgaaagatcact

SEQ ID NO: 179203 - DNA, 16 bp, H. sapiens
tttttgaaataaagaa

SEQ ID NO: 179204 - DNA, 16 bp, H. sapiens
tttttgaaataagatt

SEQ ID NO: 179205 - DNA, 16 bp, H. sapiens
tttttgaaatgattaa

SEQ ID NO: 179206 - DNA, 16 bp, H. sapiens
tttttgaaatgtaaat

SEQ ID NO: 179207 - DNA, 16 bp, H. sapiens
tttttgaaatgtagtc

SEQ ID NO: 179208 - DNA, 16 bp, H. sapiens
tttttgaaattgaaaa

SEQ ID NO: 179209 - DNA, 16 bp, H. sapiens
tttttgaacaattttt

SEQ ID NO: 179210 - DNA, 16 bp, H. sapiens
tttttgaactttaaat

SEQ ID NO: 179211 - DNA, 16 bp, H. sapiens
tttttgaagaaataaa

SEQ ID NO: 179212 - DNA, 16 bp, H. sapiens
tttttgaagaatgttt

SEQ ID NO: 179213 - DNA, 16 bp, H. sapiens
tttttgaagggatttt

SEQ ID NO: 179214 - DNA, 16 bp, H. sapiens
tttttgaagggctttt

SEQ ID NO: 179215 - DNA, 16 bp, H. sapiens
tttttgaagtgctgct

SEQ ID NO: 179216 - DNA, 16 bp, H. sapiens
tttttgaataaaagaa

SEQ ID NO: 179217 - DNA, 16 bp, H. sapiens
tttttgaataaacttt

SEQ ID NO: 179218 - DNA, 16 bp, H. sapiens
tttttgaatgaataaa

SEQ ID NO: 179219 - DNA, 16 bp, H. sapiens
tttttgaatgtattga

SEQ ID NO: 179220 - DNA, 16 bp, H. sapiens
tttttgacaaataaat

SEQ ID NO: 179221 - DNA, 16 bp, H. sapiens
tttttgacaaggtctc

SEQ ID NO: 179222 - DNA, 16 bp, H. sapiens
tttttgacaattttgt

SEQ ID NO: 179223 - DNA, 16 bp, H. sapiens
tttttgacagaatttt

SEQ ID NO: 179224 - DNA, 16 bp, H. sapiens
tttttgacatgctgtt

SEQ ID NO: 179225 - DNA, 16 bp, H. sapiens
tttttgacattaaaag

SEQ ID NO: 179226 - DNA, 16 bp, H. sapiens
tttttgacttcttaat

SEQ ID NO: 179227 - DNA, 16 bp, H. sapiens
tttttgactttgtaat

SEQ ID NO: 179228 - DNA, 16 bp, H. sapiens
tttttgacttttcagt

SEQ ID NO: 179229 - DNA, 16 bp, H. sapiens
tttttgagaaaaaata

SEQ ID NO: 179230 - DNA, 16 bp, H. sapiens
tttttgagaaacctct

SEQ ID NO: 179231 - DNA, 16 bp, H. sapiens
tttttgagaaactgtt

SEQ ID NO: 179232 - DNA, 16 bp, H. sapiens
tttttgagaaatatcc

SEQ ID NO: 179233 - DNA, 16 bp, H. sapiens
tttttgagaagtttta

SEQ ID NO: 179234 - DNA, 16 bp, H. sapiens
tttttgagaataaaat

SEQ ID NO: 179235 - DNA, 16 bp, H. sapiens
tttttgagacaagagt

SEQ ID NO: 179236 - DNA, 16 bp, H. sapiens
tttttgagacacagtt

SEQ ID NO: 179237 - DNA, 16 bp, H. sapiens
tttttgagacagactg

SEQ ID NO: 179238 - DNA, 16 bp, H. sapiens
tttttgagagtcttgc

SEQ ID NO: 179239 - DNA, 16 bp, H. sapiens
tttttgagatagagtt

SEQ ID NO: 179240 - DNA, 16 bp, H. sapiens
tttttgagcacctact

SEQ ID NO: 179241 - DNA, 16 bp, H. sapiens
tttttgaggaagcttc

SEQ ID NO: 179242 - DNA, 16 bp, H. sapiens
tttttgaggagtcaaa

SEQ ID NO: 179243 - DNA, 17 bp, H. sapiens
tttttgaggcagggtct

SEQ ID NO: 179244 - DNA, 16 bp, H. sapiens
tttttgaggccaaggc

SEQ ID NO: 179245 - DNA, 16 bp, H. sapiens
tttttgagggacctcc

SEQ ID NO: 179246 - DNA, 16 bp, H. sapiens
tttttgagggttttca

SEQ ID NO: 179247 - DNA, 18 bp, H. sapiens
tttttgaggtggagtctc

SEQ ID NO: 179248 - DNA, 16 bp, H. sapiens
tttttgatgaagttgt

SEQ ID NO: 179249 - DNA, 16 bp, H. sapiens
tttttgatgatcttga

SEQ ID NO: 179250 - DNA, 16 bp, H. sapiens
tttttgatgatgatga

SEQ ID NO: 179251 - DNA, 16 bp, H. sapiens
tttttgatggctgcat

SEQ ID NO: 179252 - DNA, 16 bp, H. sapiens
tttttgatgtgatgct

SEQ ID NO: 179253 - DNA, 16 bp, H. sapiens
tttttgatgtgcagct

SEQ ID NO: 179254 - DNA, 16 bp, H. sapiens
tttttgattttacagg

SEQ ID NO: 179255 - DNA, 16 bp, H. sapiens
tttttgcaaataaaat

SEQ ID NO: 179256 - DNA, 16 bp, H. sapiens
tttttgcaaattttaa

SEQ ID NO: 179257 - DNA, 16 bp, H. sapiens
tttttgcaactttttg

SEQ ID NO: 179258 - DNA, 16 bp, H. sapiens
tttttgcaagatgaaa

SEQ ID NO: 179259 - DNA, 16 bp, H. sapiens
tttttgcaagtatttt

SEQ ID NO: 179260 - DNA, 16 bp, H. sapiens
tttttgcaatctatct

SEQ ID NO: 179261 - DNA, 16 bp, H. sapiens
tttttgcaattacttt

SEQ ID NO: 179262 - DNA, 16 bp, H. sapiens
tttttgcaattataaa

SEQ ID NO: 179263 - DNA, 16 bp, H. sapiens
tttttgcactggtttc

SEQ ID NO: 179264 - DNA, 16 bp, H. sapiens
tttttgcagaaatggg

SEQ ID NO: 179265 - DNA, 16 bp, H. sapiens
tttttgcagagatggg

SEQ ID NO: 179266 - DNA, 16 bp, H. sapiens
tttttgcataattaaa

SEQ ID NO: 179267 - DNA, 16 bp, H. sapiens
tttttgcatatgtaag

SEQ ID NO: 179268 - DNA, 16 bp, H. sapiens
tttttgcatcaaagga

SEQ ID NO: 179269 - DNA, 16 bp, H. sapiens
tttttgcatcagtatt

SEQ ID NO: 179270 - DNA, 16 bp, H. sapiens
tttttgcatgtatatt

SEQ ID NO: 179271 - DNA, 16 bp, H. sapiens
tttttgcattgttgga

SEQ ID NO: 179272 - DNA, 16 bp, H. sapiens
tttttgccaaaaaata

SEQ ID NO: 179273 - DNA, 16 bp, H. sapiens
tttttgccaccccaac

SEQ ID NO: 179274 - DNA, 16 bp, H. sapiens
tttttgccagtgtttt

SEQ ID NO: 179275 - DNA, 16 bp, H. sapiens
tttttgccattaaaaa

SEQ ID NO: 179276 - DNA, 16 bp, H. sapiens
tttttgccattaaaag

SEQ ID NO: 179277 - DNA, 16 bp, H. sapiens
tttttgccattctgat

SEQ ID NO: 179278 - DNA, 16 bp, H. sapiens
tttttgcccatgccta

SEQ ID NO: 179279 - DNA, 16 bp, H. sapiens
tttttgcctgtgttta

SEQ ID NO: 179280 - DNA, 16 bp, H. sapiens
tttttgccttaatttc

SEQ ID NO: 179281 - DNA, 16 bp, H. sapiens
tttttgccttatatat

SEQ ID NO: 179282 - DNA, 16 bp, H. sapiens
tttttgccttctttca

SEQ ID NO: 179283 - DNA, 16 bp, H. sapiens
tttttgcctttttaaa

SEQ ID NO: 179284 - DNA, 16 bp, H. sapiens
tttttgctaatttgat

SEQ ID NO: 179285 - DNA, 16 bp, H. sapiens
tttttgctattaaaaa

SEQ ID NO: 179286 - DNA, 16 bp, H. sapiens
tttttgctctccattt

SEQ ID NO: 179287 - DNA, 16 bp, H. sapiens
tttttgctgctgtaac

SEQ ID NO: 179288 - DNA, 16 bp, H. sapiens
tttttgctgtctccat

SEQ ID NO: 179289 - DNA, 16 bp, H. sapiens
tttttgctgttgtaaa

SEQ ID NO: 179290 - DNA, 16 bp, H. sapiens
tttttgcttaatgaaa

SEQ ID NO: 179291 - DNA, 16 bp, H. sapiens
tttttgcttagaatag

SEQ ID NO: 179292 - DNA, 16 bp, H. sapiens
tttttgcttagtattg

SEQ ID NO: 179293 - DNA, 16 bp, H. sapiens
tttttgcttttaaaaa

SEQ ID NO: 179294 - DNA, 16 bp, H. sapiens
tttttgcttttatgaa

SEQ ID NO: 179295 - DNA, 16 bp, H. sapiens
tttttggaaaaaaaat

SEQ ID NO: 179296 - DNA, 16 bp, H. sapiens
tttttggaaaaataaa

SEQ ID NO: 179297 - DNA, 16 bp, H. sapiens
tttttggaaaacaaaa

SEQ ID NO: 179298 - DNA, 16 bp, H. sapiens
tttttggaaaagaaat

SEQ ID NO: 179299 - DNA, 16 bp, H. sapiens
tttttggaaaatacag

SEQ ID NO: 179300 - DNA, 16 bp, H. sapiens
tttttggaaaatttaa

SEQ ID NO: 179301 - DNA, 16 bp, H. sapiens
tttttggaagaaaata

SEQ ID NO: 179302 - DNA, 16 bp, H. sapiens
tttttggaagaaaatg

SEQ ID NO: 179303 - DNA, 16 bp, H. sapiens
tttttggaattttctg

SEQ ID NO: 179304 - DNA, 16 bp, H. sapiens
tttttggaccatggtt

SEQ ID NO: 179305 - DNA, 16 bp, H. sapiens
tttttggacggagtct

SEQ ID NO: 179306 - DNA, 16 bp, H. sapiens
tttttggagaaagaaa

SEQ ID NO: 179307 - DNA, 16 bp, H. sapiens
tttttggagacacagt

SEQ ID NO: 179308 - DNA, 16 bp, H. sapiens
tttttggagatgcagt

SEQ ID NO: 179309 - DNA, 16 bp, H. sapiens
tttttggagttttgct

SEQ ID NO: 179310 - DNA, 16 bp, H. sapiens
tttttggattaggaat

SEQ ID NO: 179311 - DNA, 16 bp, H. sapiens
tttttggattagggat

SEQ ID NO: 179312 - DNA, 16 bp, H. sapiens
tttttggcaagaacac

SEQ ID NO: 179313 - DNA, 16 bp, H. sapiens
tttttggcaagaatac

SEQ ID NO: 179314 - DNA, 16 bp, H. sapiens
tttttggcaagaatat

SEQ ID NO: 179315 - DNA, 16 bp, H. sapiens
tttttggcaccaggga

SEQ ID NO: 179316 - DNA, 16 bp, H. sapiens
tttttggctattatga

SEQ ID NO: 179317 - DNA, 16 bp, H. sapiens
tttttggctgataatt

SEQ ID NO: 179318 - DNA, 16 bp, H. sapiens
tttttgggaaaaaaaa

SEQ ID NO: 179319 - DNA, 16 bp, H. sapiens
tttttgggaagagttt

SEQ ID NO: 179320 - DNA, 16 bp, H. sapiens
tttttggggaaaaaaa

SEQ ID NO: 179321 - DNA, 16 bp, H. sapiens
tttttggggacggagt

SEQ ID NO: 179322 - DNA, 16 bp, H. sapiens
tttttgggggaacagg

SEQ ID NO: 179323 - DNA, 16 bp, H. sapiens
tttttggggggcaggg

SEQ ID NO: 179324 - DNA, 16 bp, H. sapiens
tttttggtagagatga

SEQ ID NO: 179325 - DNA, 16 bp, H. sapiens
tttttggtcatgaaat

SEQ ID NO: 179326 - DNA, 16 bp, H. sapiens
tttttggtctttaaaa

SEQ ID NO: 179327 - DNA, 16 bp, H. sapiens
tttttggtgaatcagt

SEQ ID NO: 179328 - DNA, 16 bp, H. sapiens
tttttggtgatggagt

SEQ ID NO: 179329 - DNA, 16 bp, H. sapiens
tttttggtgctattat

SEQ ID NO: 179330 - DNA, 16 bp, H. sapiens
tttttggtggattctt

SEQ ID NO: 179331 - DNA, 16 bp, H. sapiens
tttttggtgtatagaa

SEQ ID NO: 179332 - DNA, 16 bp, H. sapiens
tttttggttactatga

SEQ ID NO: 179333 - DNA, 16 bp, H. sapiens
tttttggttactgtag

SEQ ID NO: 179334 - DNA, 16 bp, H. sapiens
tttttggttccatctg

SEQ ID NO: 179335 - DNA, 16 bp, H. sapiens
tttttggttgtcacaa

SEQ ID NO: 179336 - DNA, 16 bp, H. sapiens
tttttgtaaaaataca

SEQ ID NO: 179337 - DNA, 16 bp, H. sapiens
tttttgtaaaacagaa

SEQ ID NO: 179338 - DNA, 16 bp, H. sapiens
tttttgtaaaatcttt

SEQ ID NO: 179339 - DNA, 16 bp, H. sapiens
tttttgtaaagatagg

SEQ ID NO: 179340 - DNA, 16 bp, H. sapiens
tttttgtaaatacagt

SEQ ID NO: 179341 - DNA, 16 bp, H. sapiens
tttttgtaaatcattt

SEQ ID NO: 179342 - DNA, 16 bp, H. sapiens
tttttgtaagaagaaa

SEQ ID NO: 179343 - DNA, 16 bp, H. sapiens
tttttgtaaggaatta

SEQ ID NO: 179344 - DNA, 16 bp, H. sapiens
tttttgtaattgcaaa

SEQ ID NO: 179345 - DNA, 16 bp, H. sapiens
tttttgtaattgtgaa

SEQ ID NO: 179346 - DNA, 16 bp, H. sapiens
tttttgtacaagtctt

SEQ ID NO: 179347 - DNA, 16 bp, H. sapiens
tttttgtacaatgatt

SEQ ID NO: 179348 - DNA, 16 bp, H. sapiens
tttttgtacagctata

SEQ ID NO: 179349 - DNA, 16 bp, H. sapiens
tttttgtactttaaaa

SEQ ID NO: 179350 - DNA, 16 bp, H. sapiens
tttttgtagaaacagg

SEQ ID NO: 179351 - DNA, 16 bp, H. sapiens
tttttgtagaaatggg

SEQ ID NO: 179352 - DNA, 16 bp, H. sapiens
tttttgtagaatctct

SEQ ID NO: 179353 - DNA, 16 bp, H. sapiens
tttttgtagacacagg

SEQ ID NO: 179354 - DNA, 16 bp, H. sapiens
tttttgtagacatggg

SEQ ID NO: 179355 - DNA, 16 bp, H. sapiens
tttttgtagagaaggg

SEQ ID NO: 179356 - DNA, 16 bp, H. sapiens
tttttgtagagacaga

SEQ ID NO: 179357 - DNA, 16 bp, H. sapiens
tttttgtagagacagg

SEQ ID NO: 179358 - DNA, 16 bp, H. sapiens
tttttgtagagacagt

SEQ ID NO: 179359 - DNA, 16 bp, H. sapiens
tttttgtagagaccag

SEQ ID NO: 179360 - DNA, 16 bp, H. sapiens
tttttgtagagacgga

SEQ ID NO: 179361 - DNA, 16 bp, H. sapiens
tttttgtagagacggg

SEQ ID NO: 179362 - DNA, 16 bp, H. sapiens
tttttgtagagatgag

SEQ ID NO: 179363 - DNA, 16 bp, H. sapiens
tttttgtagagatggg

SEQ ID NO: 179364 - DNA, 16 bp, H. sapiens
tttttgtagaggcaaa

SEQ ID NO: 179365 - DNA, 16 bp, H. sapiens
tttttgtagaggcagg

SEQ ID NO: 179366 - DNA, 16 bp, H. sapiens
tttttgtaggtcaaaa

SEQ ID NO: 179367 - DNA, 16 bp, H. sapiens
tttttgtagtgatgag

SEQ ID NO: 179368 - DNA, 16 bp, H. sapiens
tttttgtagtgatggg

SEQ ID NO: 179369 - DNA, 16 bp, H. sapiens
tttttgtataaaatga

SEQ ID NO: 179370 - DNA, 16 bp, H. sapiens
tttttgtataatctgt

SEQ ID NO: 179371 - DNA, 16 bp, H. sapiens
tttttgtatatggata

SEQ ID NO: 179372 - DNA, 16 bp, H. sapiens
tttttgtatttcaata

SEQ ID NO: 179373 - DNA, 16 bp, H. sapiens
tttttgtcaaataaaa

SEQ ID NO: 179374 - DNA, 16 bp, H. sapiens
tttttgtcaattaaaa

SEQ ID NO: 179375 - DNA, 16 bp, H. sapiens
tttttgtcagccttgt

SEQ ID NO: 179376 - DNA, 16 bp, H. sapiens
tttttgtgaaaaatgt

SEQ ID NO: 179377 - DNA, 16 bp, H. sapiens
tttttgtgaaatcttt

SEQ ID NO: 179378 - DNA, 16 bp, H. sapiens
tttttgtgactgactt

SEQ ID NO: 179379 - DNA, 16 bp, H. sapiens
tttttgtgcatatata

SEQ ID NO: 179380 - DNA, 16 bp, H. sapiens
tttttgtgccagtacc

SEQ ID NO: 179381 - DNA, 16 bp, H. sapiens
tttttgtggaaaaaaa

SEQ ID NO: 179382 - DNA, 16 bp, H. sapiens
tttttgtggagatgag

SEQ ID NO: 179383 - DNA, 16 bp, H. sapiens
tttttgtggagatggg

SEQ ID NO: 179384 - DNA, 16 bp, H. sapiens
tttttgtgggtacata

SEQ ID NO: 179385 - DNA, 16 bp, H. sapiens
tttttgtgtagacata

SEQ ID NO: 179386 - DNA, 16 bp, H. sapiens
tttttgtgtcatctat

SEQ ID NO: 179387 - DNA, 16 bp, H. sapiens
tttttgtgtgaatgta

SEQ ID NO: 179388 - DNA, 16 bp, H. sapiens
tttttgtgtgtgaaaa

SEQ ID NO: 179389 - DNA, 16 bp, H. sapiens
tttttgtgtgtgcata

SEQ ID NO: 179390 - DNA, 16 bp, H. sapiens
tttttgtgtgtggaca

SEQ ID NO: 179391 - DNA, 16 bp, H. sapiens
tttttgttaaaaagta

SEQ ID NO: 179392 - DNA, 16 bp, H. sapiens
tttttgttaaaacaaa

SEQ ID NO: 179393 - DNA, 16 bp, H. sapiens
tttttgttaaagagca

SEQ ID NO: 179394 - DNA, 16 bp, H. sapiens
tttttgttctaaaaat

SEQ ID NO: 179395 - DNA, 16 bp, H. sapiens
tttttgttgaaaaatg

SEQ ID NO: 179396 - DNA, 16 bp, H. sapiens
tttttgttgaaagctg

SEQ ID NO: 179397 - DNA, 16 bp, H. sapiens
tttttgttgagtctct

SEQ ID NO: 179398 - DNA, 16 bp, H. sapiens
tttttgttgatgctga

SEQ ID NO: 179399 - DNA, 16 bp, H. sapiens
tttttgttgctgagta

SEQ ID NO: 179400 - DNA, 16 bp, H. sapiens
tttttgttggagtctt

SEQ ID NO: 179401 - DNA, 16 bp, H. sapiens
tttttgttggtaactt

SEQ ID NO: 179402 - DNA, 16 bp, H. sapiens
tttttgtttcaaaata

SEQ ID NO: 179403 - DNA, 16 bp, H. sapiens
tttttgttttaaacag

SEQ ID NO: 179404 - DNA, 16 bp, H. sapiens
tttttgttttaagaga

SEQ ID NO: 179405 - DNA, 16 bp, H. sapiens
tttttgttttcagaga

SEQ ID NO: 179406 - DNA, 16 bp, H. sapiens
tttttgttttcccaaa

SEQ ID NO: 179407 - DNA, 16 bp, H. sapiens
tttttgttttggaaaa

SEQ ID NO: 179408 - DNA, 16 bp, H. sapiens
tttttgtttttaaaca

SEQ ID NO: 179409 - DNA, 16 bp, H. sapiens
tttttgtttttaacaa

SEQ ID NO: 179410 - DNA, 16 bp, H. sapiens
tttttgtttttcaaga

SEQ ID NO: 179411 - DNA, 16 bp, H. sapiens
tttttgtttttgaggc

SEQ ID NO: 179412 - DNA, 16 bp, H. sapiens
ttttttaaaaaaaacc

SEQ ID NO: 179413 - DNA, 16 bp, H. sapiens
ttttttaaaaaaacag

SEQ ID NO: 179414 - DNA, 16 bp, H. sapiens
ttttttaaaaaaacca

SEQ ID NO: 179415 - DNA, 16 bp, H. sapiens
ttttttaaaaaaacct

SEQ ID NO: 179416 - DNA, 16 bp, H. sapiens
ttttttaaaaaaactc

SEQ ID NO: 179417 - DNA, 16 bp, H. sapiens
ttttttaaaaaaagag

SEQ ID NO: 179418 - DNA, 16 bp, H. sapiens
ttttttaaaaaaaggg

SEQ ID NO: 179419 - DNA, 16 bp, H. sapiens
ttttttaaaaaaaggt

SEQ ID NO: 179420 - DNA, 16 bp, H. sapiens
ttttttaaaaaactct

SEQ ID NO: 179421 - DNA, 16 bp, H. sapiens
ttttttaaaaaagaag

SEQ ID NO: 179422 - DNA, 16 bp, H. sapiens
ttttttaaaaaagcag

SEQ ID NO: 179423 - DNA, 16 bp, H. sapiens
ttttttaaaaaatcac

SEQ ID NO: 179424 - DNA, 16 bp, H. sapiens
ttttttaaaaacaaca

SEQ ID NO: 179425 - DNA, 16 bp, H. sapiens
ttttttaaaaacaact

SEQ ID NO: 179426 - DNA, 16 bp, H. sapiens
ttttttaaaaaccaag

SEQ ID NO: 179427 - DNA, 16 bp, H. sapiens
ttttttaaaaaccatc

SEQ ID NO: 179428 - DNA, 16 bp, H. sapiens
ttttttaaaaacctaa

SEQ ID NO: 179429 - DNA, 16 bp, H. sapiens
ttttttaaaaactact

SEQ ID NO: 179430 - DNA, 16 bp, H. sapiens
ttttttaaaaactcca

SEQ ID NO: 179431 - DNA, 16 bp, H. sapiens
ttttttaaaaagacat

SEQ ID NO: 179432 - DNA, 16 bp, H. sapiens
ttttttaaaaagagac

SEQ ID NO: 179433 - DNA, 16 bp, H. sapiens
ttttttaaaaagcaac

SEQ ID NO: 179434 - DNA, 16 bp, H. sapiens
ttttttaaaaaggaaa

SEQ ID NO: 179435 - DNA, 16 bp, H. sapiens
ttttttaaaaagggat

SEQ ID NO: 179436 - DNA, 16 bp, H. sapiens
ttttttaaaaagtgaa

SEQ ID NO: 179437 - DNA, 16 bp, H. sapiens
ttttttaaaaatcagt

SEQ ID NO: 179438 - DNA, 16 bp, H. sapiens
ttttttaaaaatctgt

SEQ ID NO: 179439 - DNA, 16 bp, H. sapiens
ttttttaaaacaaaca

SEQ ID NO: 179440 - DNA, 16 bp, H. sapiens
ttttttaaaacacaaa

SEQ ID NO: 179441 - DNA, 16 bp, H. sapiens
ttttttaaaacacagt

SEQ ID NO: 179442 - DNA, 16 bp, H. sapiens
ttttttaaaacagctt

SEQ ID NO: 179443 - DNA, 16 bp, H. sapiens
ttttttaaaacatgaa

SEQ ID NO: 179444 - DNA, 16 bp, H. sapiens
ttttttaaaacccaaa

SEQ ID NO: 179445 - DNA, 16 bp, H. sapiens
ttttttaaaacttcaa

SEQ ID NO: 179446 - DNA, 16 bp, H. sapiens
ttttttaaaagagatt

SEQ ID NO: 179447 - DNA, 16 bp, H. sapiens
ttttttaaaagcaaaa

SEQ ID NO: 179448 - DNA, 16 bp, H. sapiens
ttttttaaaagcttct

SEQ ID NO: 179449 - DNA, 16 bp, H. sapiens
ttttttaaaaggaaaa

SEQ ID NO: 179450 - DNA, 16 bp, H. sapiens
ttttttaaaaggaagt

SEQ ID NO: 179451 - DNA, 16 bp, H. sapiens
ttttttaaaataactg

SEQ ID NO: 179452 - DNA, 16 bp, H. sapiens
ttttttaaaatccaaa

SEQ ID NO: 179453 - DNA, 16 bp, H. sapiens
ttttttaaaatctttg

SEQ ID NO: 179454 - DNA, 16 bp, H. sapiens
ttttttaaaatgaagt

SEQ ID NO: 179455 - DNA, 16 bp, H. sapiens
ttttttaaaatgcaca

SEQ ID NO: 179456 - DNA, 16 bp, H. sapiens
ttttttaaaatgtaca

SEQ ID NO: 179457 - DNA, 16 bp, H. sapiens
ttttttaaaatgtcag

SEQ ID NO: 179458 - DNA, 16 bp, H. sapiens
ttttttaaaatgtggt

SEQ ID NO: 179459 - DNA, 16 bp, H. sapiens
ttttttaaaattccag

SEQ ID NO: 179460 - DNA, 16 bp, H. sapiens
ttttttaaacaaaaag

SEQ ID NO: 179461 - DNA, 16 bp, H. sapiens
ttttttaaacaaattg

SEQ ID NO: 179462 - DNA, 16 bp, H. sapiens
ttttttaaacatagat

SEQ ID NO: 179463 - DNA, 16 bp, H. sapiens
ttttttaaacatcaaa

SEQ ID NO: 179464 - DNA, 16 bp, H. sapiens
ttttttaaacttttag

SEQ ID NO: 179465 - DNA, 16 bp, H. sapiens
ttttttaaagaaaaga

SEQ ID NO: 179466 - DNA, 16 bp, H. sapiens
ttttttaaagaaactg

SEQ ID NO: 179467 - DNA, 16 bp, H. sapiens
ttttttaaagaaagta

SEQ ID NO: 179468 - DNA, 16 bp, H. sapiens
ttttttaaagaaatag

SEQ ID NO: 179469 - DNA, 16 bp, H. sapiens
ttttttaaagaaatca

SEQ ID NO: 179470 - DNA, 16 bp, H. sapiens
ttttttaaagaaatga

SEQ ID NO: 179471 - DNA, 16 bp, H. sapiens
ttttttaaagaacaaa

SEQ ID NO: 179472 - DNA, 16 bp, H. sapiens
ttttttaaagaacaac

SEQ ID NO: 179473 - DNA, 16 bp, H. sapiens
ttttttaaagaatgac

SEQ ID NO: 179474 - DNA, 16 bp, H. sapiens
ttttttaaagacacat

SEQ ID NO: 179475 - DNA, 16 bp, H. sapiens
ttttttaaagagaaaa

SEQ ID NO: 179476 - DNA, 16 bp, H. sapiens
ttttttaaagagacgg

SEQ ID NO: 179477 - DNA, 16 bp, H. sapiens
ttttttaaagatagga

SEQ ID NO: 179478 - DNA, 16 bp, H. sapiens
ttttttaaagatcttt

SEQ ID NO: 179479 - DNA, 16 bp, H. sapiens
ttttttaaagatggaa

SEQ ID NO: 179480 - DNA, 16 bp, H. sapiens
ttttttaaagcacttt

SEQ ID NO: 179481 - DNA, 16 bp, H. sapiens
ttttttaaagcagttt

SEQ ID NO: 179482 - DNA, 16 bp, H. sapiens
ttttttaaagcataag

SEQ ID NO: 179483 - DNA, 16 bp, H. sapiens
ttttttaaagcatgaa

SEQ ID NO: 179484 - DNA, 16 bp, H. sapiens
ttttttaaagcattga

SEQ ID NO: 179485 - DNA, 16 bp, H. sapiens
ttttttaaagccacta

SEQ ID NO: 179486 - DNA, 16 bp, H. sapiens
ttttttaaagctcttt

SEQ ID NO: 179487 - DNA, 16 bp, H. sapiens
ttttttaaaggaaact

SEQ ID NO: 179488 - DNA, 16 bp, H. sapiens
ttttttaaaggaaagt

SEQ ID NO: 179489 - DNA, 16 bp, H. sapiens
ttttttaaaggaaggg

SEQ ID NO: 179490 - DNA, 16 bp, H. sapiens
ttttttaaaggacttt

SEQ ID NO: 179491 - DNA, 16 bp, H. sapiens
ttttttaaaggatgaa

SEQ ID NO: 179492 - DNA, 16 bp, H. sapiens
ttttttaaaggcacat

SEQ ID NO: 179493 - DNA, 16 bp, H. sapiens
ttttttaaagtaactt

SEQ ID NO: 179494 - DNA, 16 bp, H. sapiens
ttttttaaagtgtctt

SEQ ID NO: 179495 - DNA, 16 bp, H. sapiens
ttttttaaagtgtgtg

SEQ ID NO: 179496 - DNA, 16 bp, H. sapiens
ttttttaaagtgttca

SEQ ID NO: 179497 - DNA, 16 bp, H. sapiens
ttttttaaagttagaa

SEQ ID NO: 179498 - DNA, 16 bp, H. sapiens
ttttttaaataaagga

SEQ ID NO: 179499 - DNA, 16 bp, H. sapiens
ttttttaaataacagt

SEQ ID NO: 179500 - DNA, 16 bp, H. sapiens
ttttttaaataaggta

SEQ ID NO: 179501 - DNA, 16 bp, H. sapiens
ttttttaaatagacaa

SEQ ID NO: 179502 - DNA, 16 bp, H. sapiens
ttttttaaatagctat

SEQ ID NO: 179503 - DNA, 16 bp, H. sapiens
ttttttaaatagtaag

SEQ ID NO: 179504 - DNA, 16 bp, H. sapiens
ttttttaaatatggaa

SEQ ID NO: 179505 - DNA, 16 bp, H. sapiens
ttttttaaatcacaag

SEQ ID NO: 179506 - DNA, 16 bp, H. sapiens
ttttttaaatcacaga

SEQ ID NO: 179507 - DNA, 16 bp, H. sapiens
ttttttaaatcaggaa

SEQ ID NO: 179508 - DNA, 16 bp, H. sapiens
ttttttaaatcattga

SEQ ID NO: 179509 - DNA, 16 bp, H. sapiens
ttttttaaatcctaaa

SEQ ID NO: 179510 - DNA, 16 bp, H. sapiens
ttttttaaatcttgaa

SEQ ID NO: 179511 - DNA, 16 bp, H. sapiens
ttttttaaatctttgg

SEQ ID NO: 179512 - DNA, 16 bp, H. sapiens
ttttttaaatgaaagt

SEQ ID NO: 179513 - DNA, 16 bp, H. sapiens
ttttttaaatgaagta

SEQ ID NO: 179514 - DNA, 16 bp, H. sapiens
ttttttaaatgacctt

SEQ ID NO: 179515 - DNA, 16 bp, H. sapiens
ttttttaaatgcagat

SEQ ID NO: 179516 - DNA, 16 bp, H. sapiens
ttttttaaatgcctct

SEQ ID NO: 179517 - DNA, 16 bp, H. sapiens
ttttttaaatgctcaa

SEQ ID NO: 179518 - DNA, 16 bp, H. sapiens
ttttttaaatggagtt

SEQ ID NO: 179519 - DNA, 16 bp, H. sapiens
ttttttaaatgtaaac

SEQ ID NO: 179520 - DNA, 16 bp, H. sapiens
ttttttaaatgtacaa

SEQ ID NO: 179521 - DNA, 16 bp, H. sapiens
ttttttaaatgtatac

SEQ ID NO: 179522 - DNA, 16 bp, H. sapiens
ttttttaaatgtccat

SEQ ID NO: 179523 - DNA, 16 bp, H. sapiens
ttttttaaatgtctag

SEQ ID NO: 179524 - DNA, 16 bp, H. sapiens
ttttttaaatgtgaag

SEQ ID NO: 179525 - DNA, 16 bp, H. sapiens
ttttttaaattaagga

SEQ ID NO: 179526 - DNA, 16 bp, H. sapiens
ttttttaaatttctga

SEQ ID NO: 179527 - DNA, 16 bp, H. sapiens
ttttttaacaaacatt

SEQ ID NO: 179528 - DNA, 16 bp, H. sapiens
ttttttaacaaagaaa

SEQ ID NO: 179529 - DNA, 16 bp, H. sapiens
ttttttaacaagtaaa

SEQ ID NO: 179530 - DNA, 16 bp, H. sapiens
ttttttaacagctttg

SEQ ID NO: 179531 - DNA, 16 bp, H. sapiens
ttttttaacatagaaa

SEQ ID NO: 179532 - DNA, 16 bp, H. sapiens
ttttttaactgaaaat

SEQ ID NO: 179533 - DNA, 16 bp, H. sapiens
ttttttaactggaaaa

SEQ ID NO: 179534 - DNA, 16 bp, H. sapiens
ttttttaactgttaaa

SEQ ID NO: 179535 - DNA, 16 bp, H. sapiens
ttttttaacttcctaa

SEQ ID NO: 179536 - DNA, 16 bp, H. sapiens
ttttttaactttagaa

SEQ ID NO: 179537 - DNA, 16 bp, H. sapiens
ttttttaactttctga

SEQ ID NO: 179538 - DNA, 16 bp, H. sapiens
ttttttaactttgtaa

SEQ ID NO: 179539 - DNA, 16 bp, H. sapiens
ttttttaagaaaacca

SEQ ID NO: 179540 - DNA, 16 bp, H. sapiens
ttttttaagaaagagt

SEQ ID NO: 179541 - DNA, 16 bp, H. sapiens
ttttttaagaaagcag

SEQ ID NO: 179542 - DNA, 16 bp, H. sapiens
ttttttaagaaatcaa

SEQ ID NO: 179543 - DNA, 16 bp, H. sapiens
ttttttaagacagaat

SEQ ID NO: 179544 - DNA, 16 bp, H. sapiens
ttttttaagacgaagt

SEQ ID NO: 179545 - DNA, 16 bp, H. sapiens
ttttttaagagaaatg

SEQ ID NO: 179546 - DNA, 16 bp, H. sapiens
ttttttaagagacaaa

SEQ ID NO: 179547 - DNA, 16 bp, H. sapiens
ttttttaagagacaga

SEQ ID NO: 179548 - DNA, 16 bp, H. sapiens
ttttttaagaggaaaa

SEQ ID NO: 179549 - DNA, 16 bp, H. sapiens
ttttttaagccattaa

SEQ ID NO: 179550 - DNA, 16 bp, H. sapiens
ttttttaaggaaatat

SEQ ID NO: 179551 - DNA, 16 bp, H. sapiens
ttttttaaggaataaa

SEQ ID NO: 179552 - DNA, 16 bp, H. sapiens
ttttttaagtataaag

SEQ ID NO: 179553 - DNA, 16 bp, H. sapiens
ttttttaataaaagga

SEQ ID NO: 179554 - DNA, 16 bp, H. sapiens
ttttttaataaccaaa

SEQ ID NO: 179555 - DNA, 16 bp, H. sapiens
ttttttaataagatga

SEQ ID NO: 179556 - DNA, 16 bp, H. sapiens
ttttttaatacatgaa

SEQ ID NO: 179557 - DNA, 16 bp, H. sapiens
ttttttaatagaaaac

SEQ ID NO: 179558 - DNA, 16 bp, H. sapiens
ttttttaatatggaaa

SEQ ID NO: 179559 - DNA, 16 bp, H. sapiens
ttttttaatatttgca

SEQ ID NO: 179560 - DNA, 16 bp, H. sapiens
ttttttaatcaaatga

SEQ ID NO: 179561 - DNA, 16 bp, H. sapiens
ttttttaatcagttct

SEQ ID NO: 179562 - DNA, 16 bp, H. sapiens
ttttttaatccagaaa

SEQ ID NO: 179563 - DNA, 16 bp, H. sapiens
ttttttaatcctaaaa

SEQ ID NO: 179564 - DNA, 16 bp, H. sapiens
ttttttaatcttaaag

SEQ ID NO: 179565 - DNA, 16 bp, H. sapiens
ttttttaatcttgaaa

SEQ ID NO: 179566 - DNA, 16 bp, H. sapiens
ttttttaatgaaagga

SEQ ID NO: 179567 - DNA, 16 bp, H. sapiens
ttttttaatgaaatga

SEQ ID NO: 179568 - DNA, 16 bp, H. sapiens
ttttttaatgaagaga

SEQ ID NO: 179569 - DNA, 16 bp, H. sapiens
ttttttaatgagaaaa

SEQ ID NO: 179570 - DNA, 16 bp, H. sapiens
ttttttaatgagcaaa

SEQ ID NO: 179571 - DNA, 16 bp, H. sapiens
ttttttaatgcagaat

SEQ ID NO: 179572 - DNA, 16 bp, H. sapiens
ttttttaatgtaggca

SEQ ID NO: 179573 - DNA, 16 bp, H. sapiens
ttttttaatgtgtcta

SEQ ID NO: 179574 - DNA, 16 bp, H. sapiens
ttttttacaaactgaa

SEQ ID NO: 179575 - DNA, 16 bp, H. sapiens
ttttttacaaattgga

SEQ ID NO: 179576 - DNA, 16 bp, H. sapiens
ttttttacattttaga

SEQ ID NO: 179577 - DNA, 16 bp, H. sapiens
ttttttactattatga

SEQ ID NO: 179578 - DNA, 16 bp, H. sapiens
ttttttactgtctcca

SEQ ID NO: 179579 - DNA, 16 bp, H. sapiens
ttttttagaaaaatga

SEQ ID NO: 179580 - DNA, 16 bp, H. sapiens
ttttttagaagagatg

SEQ ID NO: 179581 - DNA, 16 bp, H. sapiens
ttttttagatgaagaa

SEQ ID NO: 179582 - DNA, 16 bp, H. sapiens
ttttttaggctgaata

SEQ ID NO: 179583 - DNA, 16 bp, H. sapiens
ttttttaggggaaaaa

SEQ ID NO: 179584 - DNA, 16 bp, H. sapiens
ttttttagtagagaca

SEQ ID NO: 179585 - DNA, 16 bp, H. sapiens
ttttttagtagagacg

SEQ ID NO: 179586 - DNA, 32 bp, H. sapiens
ttttttagtagagacggggtttcaccatgttg

SEQ ID NO: 179587 - DNA, 16 bp, H. sapiens
ttttttagtagagatg

SEQ ID NO: 179588 - DNA, 27 bp, H. sapiens
ttttttagtagagatggggtttcaccg

SEQ ID NO: 179589 - DNA, 16 bp, H. sapiens
ttttttataagtagaa

SEQ ID NO: 179590 - DNA, 16 bp, H. sapiens
ttttttatagaaacag

SEQ ID NO: 179591 - DNA, 16 bp, H. sapiens
ttttttatagagatgg

SEQ ID NO: 179592 - DNA, 16 bp, H. sapiens
ttttttatcttgaaaa

SEQ ID NO: 179593 - DNA, 16 bp, H. sapiens
ttttttatggagatgg

SEQ ID NO: 179594 - DNA, 16 bp, H. sapiens
ttttttatggctacat

SEQ ID NO: 179595 - DNA, 16 bp, H. sapiens
ttttttatggttgcat

SEQ ID NO: 179596 - DNA, 16 bp, H. sapiens
ttttttattacagaaa

SEQ ID NO: 179597 - DNA, 16 bp, H. sapiens
ttttttattatggcca

SEQ ID NO: 179598 - DNA, 16 bp, H. sapiens
ttttttattcaacaaa

SEQ ID NO: 179599 - DNA, 16 bp, H. sapiens
ttttttattgaggtaa

SEQ ID NO: 179600 - DNA, 16 bp, H. sapiens
ttttttattgcaaaat

SEQ ID NO: 179601 - DNA, 16 bp, H. sapiens
ttttttattgcgtctg

SEQ ID NO: 179602 - DNA, 16 bp, H. sapiens
ttttttattgctgcat

SEQ ID NO: 179603 - DNA, 16 bp, H. sapiens
ttttttcaaaaaatgt

SEQ ID NO: 179604 - DNA, 16 bp, H. sapiens
ttttttcaaaaacaca

SEQ ID NO: 179605 - DNA, 16 bp, H. sapiens
ttttttcaaacaaaat

SEQ ID NO: 179606 - DNA, 16 bp, H. sapiens
ttttttcaaagagaca

SEQ ID NO: 179607 - DNA, 16 bp, H. sapiens
ttttttcaaagcattt

SEQ ID NO: 179608 - DNA, 16 bp, H. sapiens
ttttttcaaagctttt

SEQ ID NO: 179609 - DNA, 16 bp, H. sapiens
ttttttcaaagtaaat

SEQ ID NO: 179610 - DNA, 16 bp, H. sapiens
ttttttcaaatacata

SEQ ID NO: 179611 - DNA, 16 bp, H. sapiens
ttttttcaacaatgtt

SEQ ID NO: 179612 - DNA, 16 bp, H. sapiens
ttttttcaagaaaatt

SEQ ID NO: 179613 - DNA, 16 bp, H. sapiens
ttttttcaagacagga

SEQ ID NO: 179614 - DNA, 16 bp, H. sapiens
ttttttcaagatttta

SEQ ID NO: 179615 - DNA, 16 bp, H. sapiens
ttttttcaataagtat

SEQ ID NO: 179616 - DNA, 16 bp, H. sapiens
ttttttcacaaaatat

SEQ ID NO: 179617 - DNA, 16 bp, H. sapiens
ttttttcacatagtcc

SEQ ID NO: 179618 - DNA, 16 bp, H. sapiens
ttttttcactcagaat

SEQ ID NO: 179619 - DNA, 16 bp, H. sapiens
ttttttcagaaaatat

SEQ ID NO: 179620 - DNA, 16 bp, H. sapiens
ttttttcagaaattga

SEQ ID NO: 179621 - DNA, 16 bp, H. sapiens
ttttttcagaatattt

SEQ ID NO: 179622 - DNA, 16 bp, H. sapiens
ttttttcagagatgag

SEQ ID NO: 179623 - DNA, 16 bp, H. sapiens
ttttttcagagatgga

SEQ ID NO: 179624 - DNA, 16 bp, H. sapiens
ttttttcagataattt

SEQ ID NO: 179625 - DNA, 16 bp, H. sapiens
ttttttcagatgaaaa

SEQ ID NO: 179626 - DNA, 16 bp, H. sapiens
ttttttcatagaaaca

SEQ ID NO: 179627 - DNA, 16 bp, H. sapiens
ttttttcatctgtaat

SEQ ID NO: 179628 - DNA, 16 bp, H. sapiens
ttttttcatcttcagt

SEQ ID NO: 179629 - DNA, 16 bp, H. sapiens
ttttttcatgaaagat

SEQ ID NO: 179630 - DNA, 17 bp, H. sapiens
ttttttcatgtgtctgt

SEQ ID NO: 179631 - DNA, 16 bp, H. sapiens
ttttttcattatgtaa

SEQ ID NO: 179632 - DNA, 16 bp, H. sapiens
ttttttcatttatgaa

SEQ ID NO: 179633 - DNA, 16 bp, H. sapiens
ttttttcatttcagaa

SEQ ID NO: 179634 - DNA, 16 bp, H. sapiens
ttttttcattttggca

SEQ ID NO: 179635 - DNA, 16 bp, H. sapiens
ttttttccaaaaatta

SEQ ID NO: 179636 - DNA, 16 bp, H. sapiens
ttttttccaaaacaat

SEQ ID NO: 179637 - DNA, 16 bp, H. sapiens
ttttttccagaaattt

SEQ ID NO: 179638 - DNA, 16 bp, H. sapiens
ttttttccagagacag

SEQ ID NO: 179639 - DNA, 16 bp, H. sapiens
ttttttccagagatgg

SEQ ID NO: 179640 - DNA, 16 bp, H. sapiens
ttttttccagcttcta

SEQ ID NO: 179641 - DNA, 16 bp, H. sapiens
ttttttccaggaaaaa

SEQ ID NO: 179642 - DNA, 16 bp, H. sapiens
ttttttccatgctgtt

SEQ ID NO: 179643 - DNA, 16 bp, H. sapiens
ttttttccattgtaaa

SEQ ID NO: 179644 - DNA, 16 bp, H. sapiens
ttttttcccaaaaaga

SEQ ID NO: 179645 - DNA, 16 bp, H. sapiens
ttttttcccagacaga

SEQ ID NO: 179646 - DNA, 16 bp, H. sapiens
ttttttcccattaaat

SEQ ID NO: 179647 - DNA, 16 bp, H. sapiens
ttttttcccattggtt

SEQ ID NO: 179648 - DNA, 16 bp, H. sapiens
ttttttccccaaacac

SEQ ID NO: 179649 - DNA, 16 bp, H. sapiens
ttttttccccaaagga

SEQ ID NO: 179650 - DNA, 16 bp, H. sapiens
ttttttccccaagaca

SEQ ID NO: 179651 - DNA, 16 bp, H. sapiens
ttttttccccaataat

SEQ ID NO: 179652 - DNA, 16 bp, H. sapiens
ttttttccccacaaat

SEQ ID NO: 179653 - DNA, 16 bp, H. sapiens
ttttttcccccaaaat

SEQ ID NO: 179654 - DNA, 16 bp, H. sapiens
ttttttcccccaagaa

SEQ ID NO: 179655 - DNA, 16 bp, H. sapiens
ttttttcccccacaaa

SEQ ID NO: 179656 - DNA, 16 bp, H. sapiens
ttttttcccccactgt

SEQ ID NO: 179657 - DNA, 16 bp, H. sapiens
ttttttcccccagtat

SEQ ID NO: 179658 - DNA, 16 bp, H. sapiens
ttttttccccccacaa

SEQ ID NO: 179659 - DNA, 16 bp, H. sapiens
ttttttcccccctgag

SEQ ID NO: 179660 - DNA, 16 bp, H. sapiens
ttttttccccctctaa

SEQ ID NO: 179661 - DNA, 16 bp, H. sapiens
ttttttcccccttcaa

SEQ ID NO: 179662 - DNA, 16 bp, H. sapiens
ttttttcccctgattt

SEQ ID NO: 179663 - DNA, 16 bp, H. sapiens
ttttttcccctttaaa

SEQ ID NO: 179664 - DNA, 16 bp, H. sapiens
ttttttcccctttcag

SEQ ID NO: 179665 - DNA, 16 bp, H. sapiens
ttttttcccctttgat

SEQ ID NO: 179666 - DNA, 16 bp, H. sapiens
ttttttccctaaatat

SEQ ID NO: 179667 - DNA, 16 bp, H. sapiens
ttttttccctaagaaa

SEQ ID NO: 179668 - DNA, 16 bp, H. sapiens
ttttttccctgaattt

SEQ ID NO: 179669 - DNA, 16 bp, H. sapiens
ttttttcccttctcag

SEQ ID NO: 179670 - DNA, 16 bp, H. sapiens
ttttttcctaaataaa

SEQ ID NO: 179671 - DNA, 16 bp, H. sapiens
ttttttcctaagagtt

SEQ ID NO: 179672 - DNA, 16 bp, H. sapiens
ttttttcctaaggaaa

SEQ ID NO: 179673 - DNA, 16 bp, H. sapiens
ttttttcctagtctgt

SEQ ID NO: 179674 - DNA, 16 bp, H. sapiens
ttttttcctatacagt

SEQ ID NO: 179675 - DNA, 16 bp, H. sapiens
ttttttcctatgcata

SEQ ID NO: 179676 - DNA, 16 bp, H. sapiens
ttttttcctcaaaata

SEQ ID NO: 179677 - DNA, 16 bp, H. sapiens
ttttttcctcataaaa

SEQ ID NO: 179678 - DNA, 16 bp, H. sapiens
ttttttcctcccaaaa

SEQ ID NO: 179679 - DNA, 16 bp, H. sapiens
ttttttcctcctctga

SEQ ID NO: 179680 - DNA, 16 bp, H. sapiens
ttttttcctcctgtat

SEQ ID NO: 179681 - DNA, 16 bp, H. sapiens
ttttttcctctgaatt

SEQ ID NO: 179682 - DNA, 16 bp, H. sapiens
ttttttcctgagacaa

SEQ ID NO: 179683 - DNA, 16 bp, H. sapiens
ttttttcctgtaaaat

SEQ ID NO: 179684 - DNA, 16 bp, H. sapiens
ttttttcctgtgaatt

SEQ ID NO: 179685 - DNA, 16 bp, H. sapiens
ttttttccttaaaaag

SEQ ID NO: 179686 - DNA, 16 bp, H. sapiens
ttttttccttcaaagt

SEQ ID NO: 179687 - DNA, 16 bp, H. sapiens
ttttttccttctggca

SEQ ID NO: 179688 - DNA, 16 bp, H. sapiens
ttttttccttgaagaa

SEQ ID NO: 179689 - DNA, 16 bp, H. sapiens
ttttttccttgcaaaa

SEQ ID NO: 179690 - DNA, 16 bp, H. sapiens
ttttttccttgcaaat

SEQ ID NO: 179691 - DNA, 16 bp, H. sapiens
ttttttcctttcagtg

SEQ ID NO: 179692 - DNA, 16 bp, H. sapiens
ttttttcctttctgaa

SEQ ID NO: 179693 - DNA, 16 bp, H. sapiens
ttttttcctttgaatg

SEQ ID NO: 179694 - DNA, 16 bp, H. sapiens
ttttttccttttaaga

SEQ ID NO: 179695 - DNA, 16 bp, H. sapiens
ttttttccttttgaaa

SEQ ID NO: 179696 - DNA, 16 bp, H. sapiens
ttttttctaaacttcc

SEQ ID NO: 179697 - DNA, 16 bp, H. sapiens
ttttttctaaatttga

SEQ ID NO: 179698 - DNA, 16 bp, H. sapiens
ttttttctaattccgt

SEQ ID NO: 179699 - DNA, 16 bp, H. sapiens
ttttttctactttaag

SEQ ID NO: 179700 - DNA, 16 bp, H. sapiens
ttttttctagaaacag

SEQ ID NO: 179701 - DNA, 16 bp, H. sapiens
ttttttctagagacaa

SEQ ID NO: 179702 - DNA, 16 bp, H. sapiens
ttttttctaggaattt

SEQ ID NO: 179703 - DNA, 16 bp, H. sapiens
ttttttctagtcccat

SEQ ID NO: 179704 - DNA, 16 bp, H. sapiens
ttttttctatttaaag

SEQ ID NO: 179705 - DNA, 16 bp, H. sapiens
ttttttctcaaagttt

SEQ ID NO: 179706 - DNA, 16 bp, H. sapiens
ttttttctcagtcaac

SEQ ID NO: 179707 - DNA, 16 bp, H. sapiens
ttttttctcatgatta

SEQ ID NO: 179708 - DNA, 16 bp, H. sapiens
ttttttctccaaaaga

SEQ ID NO: 179709 - DNA, 16 bp, H. sapiens
ttttttctccaaatga

SEQ ID NO: 179710 - DNA, 16 bp, H. sapiens
ttttttctcccagaaa

SEQ ID NO: 179711 - DNA, 16 bp, H. sapiens
ttttttctccccaaaa

SEQ ID NO: 179712 - DNA, 16 bp, H. sapiens
ttttttctgaaagaaa

SEQ ID NO: 179713 - DNA, 16 bp, H. sapiens
ttttttctgaattctg

SEQ ID NO: 179714 - DNA, 16 bp, H. sapiens
ttttttctgatataaa

SEQ ID NO: 179715 - DNA, 16 bp, H. sapiens
ttttttctgattgaag

SEQ ID NO: 179716 - DNA, 16 bp, H. sapiens
ttttttctgctctgat

SEQ ID NO: 179717 - DNA, 16 bp, H. sapiens
ttttttctgctttaaa

SEQ ID NO: 179718 - DNA, 16 bp, H. sapiens
ttttttctggagtctt

SEQ ID NO: 179719 - DNA, 16 bp, H. sapiens
ttttttctgggaaaaa

SEQ ID NO: 179720 - DNA, 16 bp, H. sapiens
ttttttctgtaaactt

SEQ ID NO: 179721 - DNA, 16 bp, H. sapiens
ttttttctgtgaaatt

SEQ ID NO: 179722 - DNA, 16 bp, H. sapiens
ttttttctgtgtagat

SEQ ID NO: 179723 - DNA, 16 bp, H. sapiens
ttttttcttaaaaaga

SEQ ID NO: 179724 - DNA, 16 bp, H. sapiens
ttttttcttaaaacag

SEQ ID NO: 179725 - DNA, 16 bp, H. sapiens
ttttttcttaaaatgc

SEQ ID NO: 179726 - DNA, 16 bp, H. sapiens
ttttttcttaaataga

SEQ ID NO: 179727 - DNA, 16 bp, H. sapiens
ttttttcttaagaaat

SEQ ID NO: 179728 - DNA, 16 bp, H. sapiens
ttttttcttaatggaa

SEQ ID NO: 179729 - DNA, 16 bp, H. sapiens
ttttttcttaatgtaa

SEQ ID NO: 179730 - DNA, 16 bp, H. sapiens
ttttttcttaatgtca

SEQ ID NO: 179731 - DNA, 16 bp, H. sapiens
ttttttcttacaaaaa

SEQ ID NO: 179732 - DNA, 16 bp, H. sapiens
ttttttcttagaaaaa

SEQ ID NO: 179733 - DNA, 16 bp, H. sapiens
ttttttcttatgaaaa

SEQ ID NO: 179734 - DNA, 16 bp, H. sapiens
ttttttcttcaaagaa

SEQ ID NO: 179735 - DNA, 16 bp, H. sapiens
ttttttcttcacataa

SEQ ID NO: 179736 - DNA, 16 bp, H. sapiens
ttttttcttcagttaa

SEQ ID NO: 179737 - DNA, 16 bp, H. sapiens
ttttttcttctaaaag

SEQ ID NO: 179738 - DNA, 16 bp, H. sapiens
ttttttcttgccaatt

SEQ ID NO: 179739 - DNA, 16 bp, H. sapiens
ttttttcttgtagaaa

SEQ ID NO: 179740 - DNA, 16 bp, H. sapiens
ttttttctttaaagct

SEQ ID NO: 179741 - DNA, 16 bp, H. sapiens
ttttttctttaaatga

SEQ ID NO: 179742 - DNA, 16 bp, H. sapiens
ttttttctttaacaag

SEQ ID NO: 179743 - DNA, 16 bp, H. sapiens
ttttttctttaacctg

SEQ ID NO: 179744 - DNA, 16 bp, H. sapiens
ttttttctttaagata

SEQ ID NO: 179745 - DNA, 16 bp, H. sapiens
ttttttctttagaaaa

SEQ ID NO: 179746 - DNA, 16 bp, H. sapiens
ttttttctttagaaac

SEQ ID NO: 179747 - DNA, 16 bp, H. sapiens
ttttttctttcagaga

SEQ ID NO: 179748 - DNA, 16 bp, H. sapiens
ttttttctttgaaaaa

SEQ ID NO: 179749 - DNA, 16 bp, H. sapiens
ttttttctttgaaatg

SEQ ID NO: 179750 - DNA, 16 bp, H. sapiens
ttttttctttgaagat

SEQ ID NO: 179751 - DNA, 16 bp, H. sapiens
ttttttctttgactca

SEQ ID NO: 179752 - DNA, 16 bp, H. sapiens
ttttttctttgagaat

SEQ ID NO: 179753 - DNA, 16 bp, H. sapiens
ttttttcttttggaaa

SEQ ID NO: 179754 - DNA, 16 bp, H. sapiens
ttttttgaaaaagata

SEQ ID NO: 179755 - DNA, 16 bp, H. sapiens
ttttttgaaaagacaa

SEQ ID NO: 179756 - DNA, 16 bp, H. sapiens
ttttttgaaaagcaaa

SEQ ID NO: 179757 - DNA, 16 bp, H. sapiens
ttttttgaaacaaagt

SEQ ID NO: 179758 - DNA, 16 bp, H. sapiens
ttttttgaaacaggtt

SEQ ID NO: 179759 - DNA, 16 bp, H. sapiens
ttttttgaaagcaaat

SEQ ID NO: 179760 - DNA, 16 bp, H. sapiens
ttttttgaaataaatg

SEQ ID NO: 179761 - DNA, 16 bp, H. sapiens
ttttttgaaatagaga

SEQ ID NO: 179762 - DNA, 16 bp, H. sapiens
ttttttgaagaaaata

SEQ ID NO: 179763 - DNA, 16 bp, H. sapiens
ttttttgaagaaataa

SEQ ID NO: 179764 - DNA, 16 bp, H. sapiens
ttttttgaagaaatta

SEQ ID NO: 179765 - DNA, 16 bp, H. sapiens
ttttttgaagagatgg

SEQ ID NO: 179766 - DNA, 16 bp, H. sapiens
ttttttgaagagtttg

SEQ ID NO: 179767 - DNA, 16 bp, H. sapiens
ttttttgaagcacaaa

SEQ ID NO: 179768 - DNA, 16 bp, H. sapiens
ttttttgaaggaaaaa

SEQ ID NO: 179769 - DNA, 16 bp, H. sapiens
ttttttgaatgaaaaa

SEQ ID NO: 179770 - DNA, 16 bp, H. sapiens
ttttttgacggagtct

SEQ ID NO: 179771 - DNA, 16 bp, H. sapiens
ttttttgagaaatagt

SEQ ID NO: 179772 - DNA, 16 bp, H. sapiens
ttttttgagaaggagt

SEQ ID NO: 179773 - DNA, 16 bp, H. sapiens
ttttttgagacagaga

SEQ ID NO: 179774 - DNA, 20 bp, H. sapiens
ttttttgagacagggtctta

SEQ ID NO: 179775 - DNA, 16 bp, H. sapiens
ttttttgagacagtct

SEQ ID NO: 179776 - DNA, 16 bp, H. sapiens
ttttttgagacagtgt

SEQ ID NO: 179777 - DNA, 16 bp, H. sapiens
ttttttgagacagttt

SEQ ID NO: 179778 - DNA, 16 bp, H. sapiens
ttttttgagacatagt

SEQ ID NO: 179779 - DNA, 16 bp, H. sapiens
ttttttgagaccaagt

SEQ ID NO: 179780 - DNA, 16 bp, H. sapiens
ttttttgagacggagc

SEQ ID NO: 179781 - DNA, 16 bp, H. sapiens
ttttttgagacggagt

SEQ ID NO: 179782 - DNA, 16 bp, H. sapiens
ttttttgagacggtgt

SEQ ID NO: 179783 - DNA, 16 bp, H. sapiens
ttttttgagactgaat

SEQ ID NO: 179784 - DNA, 20 bp, H. sapiens
ttttttgagactgagtttca

SEQ ID NO: 179785 - DNA, 16 bp, H. sapiens
ttttttgagagacaga

SEQ ID NO: 179786 - DNA, 16 bp, H. sapiens
ttttttgagaggcagt

SEQ ID NO: 179787 - DNA, 16 bp, H. sapiens
ttttttgagatagagt

SEQ ID NO: 179788 - DNA, 16 bp, H. sapiens
ttttttgagatggagc

SEQ ID NO: 179789 - DNA, 16 bp, H. sapiens
ttttttgaggaatcac

SEQ ID NO: 179790 - DNA, 16 bp, H. sapiens
ttttttgaggaatctc

SEQ ID NO: 179791 - DNA, 19 bp, H. sapiens
ttttttgaggcagagtctc

SEQ ID NO: 179792 - DNA, 16 bp, H. sapiens
ttttttgaggtggagt

SEQ ID NO: 179793 - DNA, 16 bp, H. sapiens
ttttttgatatgaagt

SEQ ID NO: 179794 - DNA, 16 bp, H. sapiens
ttttttgatggagcct

SEQ ID NO: 179795 - DNA, 16 bp, H. sapiens
ttttttgatgtgcctt

SEQ ID NO: 179796 - DNA, 16 bp, H. sapiens
ttttttgatgtgggca

SEQ ID NO: 179797 - DNA, 16 bp, H. sapiens
ttttttgcagatgaca

SEQ ID NO: 179798 - DNA, 16 bp, H. sapiens
ttttttgcatatggat

SEQ ID NO: 179799 - DNA, 16 bp, H. sapiens
ttttttgcgggggagg

SEQ ID NO: 179800 - DNA, 16 bp, H. sapiens
ttttttgctcatcagc

SEQ ID NO: 179801 - DNA, 16 bp, H. sapiens
ttttttgctgctataa

SEQ ID NO: 179802 - DNA, 16 bp, H. sapiens
ttttttgctttaaaat

SEQ ID NO: 179803 - DNA, 16 bp, H. sapiens
ttttttggaaaaagaa

SEQ ID NO: 179804 - DNA, 16 bp, H. sapiens
ttttttggaaaagttt

SEQ ID NO: 179805 - DNA, 16 bp, H. sapiens
ttttttggaacagggt

SEQ ID NO: 179806 - DNA, 16 bp, H. sapiens
ttttttggaatcattt

SEQ ID NO: 179807 - DNA, 16 bp, H. sapiens
ttttttggagaaacag

SEQ ID NO: 179808 - DNA, 16 bp, H. sapiens
ttttttggagacaaaa

SEQ ID NO: 179809 - DNA, 16 bp, H. sapiens
ttttttggagaggcag

SEQ ID NO: 179810 - DNA, 16 bp, H. sapiens
ttttttgggacaaggt

SEQ ID NO: 179811 - DNA, 16 bp, H. sapiens
ttttttgggacagggt

SEQ ID NO: 179812 - DNA, 16 bp, H. sapiens
ttttttgggacggagt

SEQ ID NO: 179813 - DNA, 16 bp, H. sapiens
ttttttgggatggagt

SEQ ID NO: 179814 - DNA, 16 bp, H. sapiens
ttttttgggggaaaaa

SEQ ID NO: 179815 - DNA, 16 bp, H. sapiens
ttttttggggggatag

SEQ ID NO: 179816 - DNA, 16 bp, H. sapiens
ttttttggtaagaaaa

SEQ ID NO: 179817 - DNA, 18 bp, H. sapiens
ttttttggtagagacagg

SEQ ID NO: 179818 - DNA, 16 bp, H. sapiens
ttttttggtgaaaatt

SEQ ID NO: 179819 - DNA, 16 bp, H. sapiens
ttttttgtaaaggcaa

SEQ ID NO: 179820 - DNA, 16 bp, H. sapiens
ttttttgtacagacgg

SEQ ID NO: 179821 - DNA, 16 bp, H. sapiens
ttttttgtacatctgg

SEQ ID NO: 179822 - DNA, 16 bp, H. sapiens
ttttttgtacttaaaa

SEQ ID NO: 179823 - DNA, 16 bp, H. sapiens
ttttttgtagagatgt

SEQ ID NO: 179824 - DNA, 16 bp, H. sapiens
ttttttgtagcaatgg

SEQ ID NO: 179825 - DNA, 16 bp, H. sapiens
ttttttgtatagatgg

SEQ ID NO: 179826 - DNA, 16 bp, H. sapiens
ttttttgtcattaaaa

SEQ ID NO: 179827 - DNA, 16 bp, H. sapiens
ttttttgtccttgaga

SEQ ID NO: 179828 - DNA, 16 bp, H. sapiens
ttttttgtctgaaaat

SEQ ID NO: 179829 - DNA, 16 bp, H. sapiens
ttttttgtctgagaaa

SEQ ID NO: 179830 - DNA, 16 bp, H. sapiens
ttttttgtctgttaaa

SEQ ID NO: 179831 - DNA, 16 bp, H. sapiens
ttttttgtgataagaa

SEQ ID NO: 179832 - DNA, 16 bp, H. sapiens
ttttttgtggagacag

SEQ ID NO: 179833 - DNA, 16 bp, H. sapiens
ttttttgtggtgagaa

SEQ ID NO: 179834 - DNA, 16 bp, H. sapiens
ttttttgttacataaa

SEQ ID NO: 179835 - DNA, 16 bp, H. sapiens
ttttttgtttgagaga

SEQ ID NO: 179836 - DNA, 16 bp, H. sapiens
tttttttaaaaaaggt

SEQ ID NO: 179837 - DNA, 16 bp, H. sapiens
tttttttaaaaagatg

SEQ ID NO: 179838 - DNA, 16 bp, H. sapiens
tttttttaaaaagcaa

SEQ ID NO: 179839 - DNA, 16 bp, H. sapiens
tttttttaaaaaggac

SEQ ID NO: 179840 - DNA, 16 bp, H. sapiens
tttttttaaaaaggca

SEQ ID NO: 179841 - DNA, 16 bp, H. sapiens
tttttttaaaaagtca

SEQ ID NO: 179842 - DNA, 16 bp, H. sapiens
tttttttaaaaccaca

SEQ ID NO: 179843 - DNA, 16 bp, H. sapiens
tttttttaaaagaatg

SEQ ID NO: 179844 - DNA, 16 bp, H. sapiens
tttttttaaaagacta

SEQ ID NO: 179845 - DNA, 16 bp, H. sapiens
tttttttaaaagatca

SEQ ID NO: 179846 - DNA, 16 bp, H. sapiens
tttttttaaaatacca

SEQ ID NO: 179847 - DNA, 16 bp, H. sapiens
tttttttaaaatcaca

SEQ ID NO: 179848 - DNA, 16 bp, H. sapiens
tttttttaaaatcaga

SEQ ID NO: 179849 - DNA, 16 bp, H. sapiens
tttttttaaaatcatg

SEQ ID NO: 179850 - DNA, 16 bp, H. sapiens
tttttttaaacatctg

SEQ ID NO: 179851 - DNA, 16 bp, H. sapiens
tttttttaaagaaacc

SEQ ID NO: 179852 - DNA, 16 bp, H. sapiens
tttttttaaagaaagg

SEQ ID NO: 179853 - DNA, 16 bp, H. sapiens
tttttttaaagaacac

SEQ ID NO: 179854 - DNA, 16 bp, H. sapiens
tttttttaaagaacag

SEQ ID NO: 179855 - DNA, 16 bp, H. sapiens
tttttttaaagaagat

SEQ ID NO: 179856 - DNA, 16 bp, H. sapiens
tttttttaaagaatca

SEQ ID NO: 179857 - DNA, 16 bp, H. sapiens
tttttttaaagaatga

SEQ ID NO: 179858 - DNA, 16 bp, H. sapiens
tttttttaaagagata

SEQ ID NO: 179859 - DNA, 16 bp, H. sapiens
tttttttaaagcaggg

SEQ ID NO: 179860 - DNA, 16 bp, H. sapiens
tttttttaaagccttc

SEQ ID NO: 179861 - DNA, 16 bp, H. sapiens
tttttttaaagctccc

SEQ ID NO: 179862 - DNA, 16 bp, H. sapiens
tttttttaaagcttca

SEQ ID NO: 179863 - DNA, 16 bp, H. sapiens
tttttttaaaggacat

SEQ ID NO: 179864 - DNA, 16 bp, H. sapiens
tttttttaaaggagaa

SEQ ID NO: 179865 - DNA, 16 bp, H. sapiens
tttttttaaaggtaaa

SEQ ID NO: 179866 - DNA, 16 bp, H. sapiens
tttttttaaagtgaaa

SEQ ID NO: 179867 - DNA, 16 bp, H. sapiens
tttttttaaataagga

SEQ ID NO: 179868 - DNA, 16 bp, H. sapiens
tttttttaaatagaag

SEQ ID NO: 179869 - DNA, 16 bp, H. sapiens
tttttttaaatagaga

SEQ ID NO: 179870 - DNA, 16 bp, H. sapiens
tttttttaaatagagg

SEQ ID NO: 179871 - DNA, 17 bp, H. sapiens
tttttttaaatcaagaa

SEQ ID NO: 179872 - DNA, 16 bp, H. sapiens
tttttttaaatgcagt

SEQ ID NO: 179873 - DNA, 16 bp, H. sapiens
tttttttaaatgccag

SEQ ID NO: 179874 - DNA, 16 bp, H. sapiens
tttttttaaatgtgac

SEQ ID NO: 179875 - DNA, 16 bp, H. sapiens
tttttttaaattagca

SEQ ID NO: 179876 - DNA, 16 bp, H. sapiens
tttttttaaattgctg

SEQ ID NO: 179877 - DNA, 16 bp, H. sapiens
tttttttaacaaaaac

SEQ ID NO: 179878 - DNA, 16 bp, H. sapiens
tttttttaacatttgg

SEQ ID NO: 179879 - DNA, 16 bp, H. sapiens
tttttttaaccacaga

SEQ ID NO: 179880 - DNA, 16 bp, H. sapiens
tttttttaacccaaag

SEQ ID NO: 179881 - DNA, 16 bp, H. sapiens
tttttttaacctgttg

SEQ ID NO: 179882 - DNA, 16 bp, H. sapiens
tttttttaactcagca

SEQ ID NO: 179883 - DNA, 16 bp, H. sapiens
tttttttaactgaatt

SEQ ID NO: 179884 - DNA, 16 bp, H. sapiens
tttttttaactgtaaa

SEQ ID NO: 179885 - DNA, 16 bp, H. sapiens
tttttttaacttgaga

SEQ ID NO: 179886 - DNA, 16 bp, H. sapiens
tttttttaagaagctg

SEQ ID NO: 179887 - DNA, 16 bp, H. sapiens
tttttttaagatagaa

SEQ ID NO: 179888 - DNA, 16 bp, H. sapiens
tttttttaagatagag

SEQ ID NO: 179889 - DNA, 16 bp, H. sapiens
tttttttaagcaataa

SEQ ID NO: 179890 - DNA, 16 bp, H. sapiens
tttttttaagcagtaa

SEQ ID NO: 179891 - DNA, 16 bp, H. sapiens
tttttttaaggcaaaa

SEQ ID NO: 179892 - DNA, 16 bp, H. sapiens
tttttttaaggcagtt

SEQ ID NO: 179893 - DNA, 16 bp, H. sapiens
tttttttaagtaactt

SEQ ID NO: 179894 - DNA, 16 bp, H. sapiens
tttttttaagtaatca

SEQ ID NO: 179895 - DNA, 16 bp, H. sapiens
tttttttaagtagaga

SEQ ID NO: 179896 - DNA, 16 bp, H. sapiens
tttttttaagtgactt

SEQ ID NO: 179897 - DNA, 16 bp, H. sapiens
tttttttaagtggaaa

SEQ ID NO: 179898 - DNA, 16 bp, H. sapiens
tttttttaagtgtcaa

SEQ ID NO: 179899 - DNA, 16 bp, H. sapiens
tttttttaatagaaag

SEQ ID NO: 179900 - DNA, 16 bp, H. sapiens
tttttttaatatgaca

SEQ ID NO: 179901 - DNA, 16 bp, H. sapiens
tttttttaatattcag

SEQ ID NO: 179902 - DNA, 16 bp, H. sapiens
tttttttaatcactga

SEQ ID NO: 179903 - DNA, 16 bp, H. sapiens
tttttttaatcaggtt

SEQ ID NO: 179904 - DNA, 16 bp, H. sapiens
tttttttaatccaaaa

SEQ ID NO: 179905 - DNA, 16 bp, H. sapiens
tttttttaatgaagca

SEQ ID NO: 179906 - DNA, 16 bp, H. sapiens
tttttttaatgacaat

SEQ ID NO: 179907 - DNA, 16 bp, H. sapiens
tttttttaatgacata

SEQ ID NO: 179908 - DNA, 16 bp, H. sapiens
tttttttaatgaggaa

SEQ ID NO: 179909 - DNA, 16 bp, H. sapiens
tttttttaatgaggca

SEQ ID NO: 179910 - DNA, 16 bp, H. sapiens
tttttttaatgccaat

SEQ ID NO: 179911 - DNA, 16 bp, H. sapiens
tttttttaatggaaaa

SEQ ID NO: 179912 - DNA, 16 bp, H. sapiens
tttttttaatggactt

SEQ ID NO: 179913 - DNA, 16 bp, H. sapiens
tttttttaatgggaca

SEQ ID NO: 179914 - DNA, 16 bp, H. sapiens
tttttttaatgtcaga

SEQ ID NO: 179915 - DNA, 16 bp, H. sapiens
tttttttaattagctg

SEQ ID NO: 179916 - DNA, 16 bp, H. sapiens
tttttttaattctgca

SEQ ID NO: 179917 - DNA, 16 bp, H. sapiens
tttttttaattgcaaa

SEQ ID NO: 179918 - DNA, 16 bp, H. sapiens
tttttttaatttcaga

SEQ ID NO: 179919 - DNA, 16 bp, H. sapiens
tttttttactagagat

SEQ ID NO: 179920 - DNA, 16 bp, H. sapiens
tttttttagaaaaact

SEQ ID NO: 179921 - DNA, 16 bp, H. sapiens
tttttttagaaacagt

SEQ ID NO: 179922 - DNA, 16 bp, H. sapiens
tttttttagacggaat

SEQ ID NO: 179923 - DNA, 16 bp, H. sapiens
tttttttagagacagg

SEQ ID NO: 179924 - DNA, 16 bp, H. sapiens
tttttttagagcagtt

SEQ ID NO: 179925 - DNA, 16 bp, H. sapiens
tttttttatacagggt

SEQ ID NO: 179926 - DNA, 16 bp, H. sapiens
tttttttattcagcag

SEQ ID NO: 179927 - DNA, 16 bp, H. sapiens
tttttttcaaaaaaag

SEQ ID NO: 179928 - DNA, 16 bp, H. sapiens
tttttttcaaacaaac

SEQ ID NO: 179929 - DNA, 16 bp, H. sapiens
tttttttcaaagcttt

SEQ ID NO: 179930 - DNA, 16 bp, H. sapiens
tttttttcaagaaaca

SEQ ID NO: 179931 - DNA, 16 bp, H. sapiens
tttttttcaagaattt

SEQ ID NO: 179932 - DNA, 16 bp, H. sapiens
tttttttcaatctgaa

SEQ ID NO: 179933 - DNA, 16 bp, H. sapiens
tttttttcaattgaca

SEQ ID NO: 179934 - DNA, 16 bp, H. sapiens
tttttttcacctgtaa

SEQ ID NO: 179935 - DNA, 16 bp, H. sapiens
tttttttcacttagca

SEQ ID NO: 179936 - DNA, 16 bp, H. sapiens
tttttttcagagaaat

SEQ ID NO: 179937 - DNA, 16 bp, H. sapiens
tttttttcagagagag

SEQ ID NO: 179938 - DNA, 16 bp, H. sapiens
tttttttcagatatgt

SEQ ID NO: 179939 - DNA, 16 bp, H. sapiens
tttttttcatctgtaa

SEQ ID NO: 179940 - DNA, 16 bp, H. sapiens
tttttttcatgaaaat

SEQ ID NO: 179941 - DNA, 16 bp, H. sapiens
tttttttcatttcaag

SEQ ID NO: 179942 - DNA, 16 bp, H. sapiens
tttttttccaaaataa

SEQ ID NO: 179943 - DNA, 16 bp, H. sapiens
tttttttccaaataaa

SEQ ID NO: 179944 - DNA, 16 bp, H. sapiens
tttttttccaaattga

SEQ ID NO: 179945 - DNA, 16 bp, H. sapiens
tttttttccacagaaa

SEQ ID NO: 179946 - DNA, 16 bp, H. sapiens
tttttttccagatata

SEQ ID NO: 179947 - DNA, 16 bp, H. sapiens
tttttttccagattat

SEQ ID NO: 179948 - DNA, 16 bp, H. sapiens
tttttttccagttgaa

SEQ ID NO: 179949 - DNA, 16 bp, H. sapiens
tttttttccattagaa

SEQ ID NO: 179950 - DNA, 16 bp, H. sapiens
tttttttcccaaacag

SEQ ID NO: 179951 - DNA, 16 bp, H. sapiens
tttttttcccaaggca

SEQ ID NO: 179952 - DNA, 16 bp, H. sapiens
tttttttccccaaaaa

SEQ ID NO: 179953 - DNA, 16 bp, H. sapiens
tttttttccccaaaat

SEQ ID NO: 179954 - DNA, 16 bp, H. sapiens
tttttttccccagagt

SEQ ID NO: 179955 - DNA, 16 bp, H. sapiens
tttttttccccagtat

SEQ ID NO: 179956 - DNA, 16 bp, H. sapiens
tttttttccccattaa

SEQ ID NO: 179957 - DNA, 16 bp, H. sapiens
tttttttccccattgc

SEQ ID NO: 179958 - DNA, 16 bp, H. sapiens
tttttttcccccaaat

SEQ ID NO: 179959 - DNA, 16 bp, H. sapiens
tttttttcccccacat

SEQ ID NO: 179960 - DNA, 16 bp, H. sapiens
tttttttcccccactg

SEQ ID NO: 179961 - DNA, 16 bp, H. sapiens
tttttttccccccaaa

SEQ ID NO: 179962 - DNA, 16 bp, H. sapiens
tttttttccccccaga

SEQ ID NO: 179963 - DNA, 16 bp, H. sapiens
tttttttcccccctaa

SEQ ID NO: 179964 - DNA, 16 bp, H. sapiens
tttttttcccccttag

SEQ ID NO: 179965 - DNA, 16 bp, H. sapiens
tttttttcccctgaaa

SEQ ID NO: 179966 - DNA, 16 bp, H. sapiens
tttttttccccttaga

SEQ ID NO: 179967 - DNA, 16 bp, H. sapiens
tttttttccctaggaa

SEQ ID NO: 179968 - DNA, 16 bp, H. sapiens
tttttttccctgaaag

SEQ ID NO: 179969 - DNA, 16 bp, H. sapiens
tttttttcccttgaaa

SEQ ID NO: 179970 - DNA, 16 bp, H. sapiens
tttttttcccttgaga

SEQ ID NO: 179971 - DNA, 16 bp, H. sapiens
tttttttcctaaagat

SEQ ID NO: 179972 - DNA, 16 bp, H. sapiens
tttttttcctaagaaa

SEQ ID NO: 179973 - DNA, 16 bp, H. sapiens
tttttttcctaagaca

SEQ ID NO: 179974 - DNA, 16 bp, H. sapiens
tttttttcctagagaa

SEQ ID NO: 179975 - DNA, 16 bp, H. sapiens
tttttttcctatagat

SEQ ID NO: 179976 - DNA, 16 bp, H. sapiens
tttttttcctcaaaag

SEQ ID NO: 179977 - DNA, 16 bp, H. sapiens
tttttttcctccaagg

SEQ ID NO: 179978 - DNA, 16 bp, H. sapiens
tttttttcctccagag

SEQ ID NO: 179979 - DNA, 16 bp, H. sapiens
tttttttcctccatgt

SEQ ID NO: 179980 - DNA, 16 bp, H. sapiens
tttttttcctcccaag

SEQ ID NO: 179981 - DNA, 16 bp, H. sapiens
tttttttcctccccaa

SEQ ID NO: 179982 - DNA, 16 bp, H. sapiens
tttttttcctcctcag

SEQ ID NO: 179983 - DNA, 16 bp, H. sapiens
tttttttcctctagaa

SEQ ID NO: 179984 - DNA, 16 bp, H. sapiens
tttttttcctcttaga

SEQ ID NO: 179985 - DNA, 16 bp, H. sapiens
tttttttcctgctcca

SEQ ID NO: 179986 - DNA, 16 bp, H. sapiens
tttttttcctggagac

SEQ ID NO: 179987 - DNA, 16 bp, H. sapiens
tttttttcctgtaaga

SEQ ID NO: 179988 - DNA, 16 bp, H. sapiens
tttttttccttaagaa

SEQ ID NO: 179989 - DNA, 16 bp, H. sapiens
tttttttccttaagga

SEQ ID NO: 179990 - DNA, 16 bp, H. sapiens
tttttttccttactga

SEQ ID NO: 179991 - DNA, 16 bp, H. sapiens
tttttttccttcaaga

SEQ ID NO: 179992 - DNA, 16 bp, H. sapiens
tttttttccttccaaa

SEQ ID NO: 179993 - DNA, 16 bp, H. sapiens
tttttttccttccaga

SEQ ID NO: 179994 - DNA, 16 bp, H. sapiens
tttttttccttctgaa

SEQ ID NO: 179995 - DNA, 16 bp, H. sapiens
tttttttccttctgag

SEQ ID NO: 179996 - DNA, 16 bp, H. sapiens
tttttttcctttaaag

SEQ ID NO: 179997 - DNA, 16 bp, H. sapiens
tttttttcgagatgga

SEQ ID NO: 179998 - DNA, 16 bp, H. sapiens
tttttttctaaaagta

SEQ ID NO: 179999 - DNA, 16 bp, H. sapiens
tttttttctaacacaa

SEQ ID NO: 180000 - DNA, 16 bp, H. sapiens
tttttttctaataatg

SEQ ID NO: 180001 - DNA, 16 bp, H. sapiens
tttttttctagacaga

SEQ ID NO: 180002 - DNA, 16 bp, H. sapiens
tttttttctataaaag

SEQ ID NO: 180003 - DNA, 16 bp, H. sapiens
tttttttctatgcata

SEQ ID NO: 180004 - DNA, 16 bp, H. sapiens
tttttttctatgtaga

SEQ ID NO: 180005 - DNA, 16 bp, H. sapiens
tttttttctcagacat

SEQ ID NO: 180006 - DNA, 16 bp, H. sapiens
tttttttctcagcaaa

SEQ ID NO: 180007 - DNA, 16 bp, H. sapiens
tttttttctcagtctc

SEQ ID NO: 180008 - DNA, 16 bp, H. sapiens
tttttttctcatcaga

SEQ ID NO: 180009 - DNA, 16 bp, H. sapiens
tttttttctccaaata

SEQ ID NO: 180010 - DNA, 16 bp, H. sapiens
tttttttctccttcag

SEQ ID NO: 180011 - DNA, 16 bp, H. sapiens
tttttttctctccaaa

SEQ ID NO: 180012 - DNA, 16 bp, H. sapiens
tttttttctctgaagt

SEQ ID NO: 180013 - DNA, 16 bp, H. sapiens
tttttttctcttgaaa

SEQ ID NO: 180014 - DNA, 16 bp, H. sapiens
tttttttctgaaaaaa

SEQ ID NO: 180015 - DNA, 16 bp, H. sapiens
tttttttctgaaactg

SEQ ID NO: 180016 - DNA, 16 bp, H. sapiens
tttttttctgaaccat

SEQ ID NO: 180017 - DNA, 16 bp, H. sapiens
tttttttctgaaggct

SEQ ID NO: 180018 - DNA, 16 bp, H. sapiens
tttttttctgagaaat

SEQ ID NO: 180019 - DNA, 16 bp, H. sapiens
tttttttctgagatga

SEQ ID NO: 180020 - DNA, 16 bp, H. sapiens
tttttttctgattcaa

SEQ ID NO: 180021 - DNA, 16 bp, H. sapiens
tttttttctgcctcat

SEQ ID NO: 180022 - DNA, 16 bp, H. sapiens
tttttttctggaaaag

SEQ ID NO: 180023 - DNA, 16 bp, H. sapiens
tttttttctggaaaca

SEQ ID NO: 180024 - DNA, 16 bp, H. sapiens
tttttttctggaagaa

SEQ ID NO: 180025 - DNA, 16 bp, H. sapiens
tttttttctggaagta

SEQ ID NO: 180026 - DNA, 16 bp, H. sapiens
tttttttctgggaaag

SEQ ID NO: 180027 - DNA, 16 bp, H. sapiens
tttttttctggtagag

SEQ ID NO: 180028 - DNA, 16 bp, H. sapiens
tttttttctggtgaga

SEQ ID NO: 180029 - DNA, 16 bp, H. sapiens
tttttttctgtaaaag

SEQ ID NO: 180030 - DNA, 16 bp, H. sapiens
tttttttctgtaaaat

SEQ ID NO: 180031 - DNA, 16 bp, H. sapiens
tttttttctgtgaaat

SEQ ID NO: 180032 - DNA, 16 bp, H. sapiens
tttttttctgtgtaaa

SEQ ID NO: 180033 - DNA, 16 bp, H. sapiens
tttttttcttaaaagt

SEQ ID NO: 180034 - DNA, 16 bp, H. sapiens
tttttttcttagaaaa

SEQ ID NO: 180035 - DNA, 16 bp, H. sapiens
tttttttcttagaaat

SEQ ID NO: 180036 - DNA, 16 bp, H. sapiens
tttttttcttaggaaa

SEQ ID NO: 180037 - DNA, 16 bp, H. sapiens
tttttttcttagtaaa

SEQ ID NO: 180038 - DNA, 16 bp, H. sapiens
tttttttcttatgaaa

SEQ ID NO: 180039 - DNA, 16 bp, H. sapiens
tttttttcttcaaatg

SEQ ID NO: 180040 - DNA, 16 bp, H. sapiens
tttttttcttcagcaa

SEQ ID NO: 180041 - DNA, 16 bp, H. sapiens
tttttttcttccagaa

SEQ ID NO: 180042 - DNA, 16 bp, H. sapiens
tttttttcttccaggt

SEQ ID NO: 180043 - DNA, 16 bp, H. sapiens
tttttttcttgaaaaa

SEQ ID NO: 180044 - DNA, 16 bp, H. sapiens
tttttttcttggcaaa

SEQ ID NO: 180045 - DNA, 16 bp, H. sapiens
tttttttcttggtaaa

SEQ ID NO: 180046 - DNA, 16 bp, H. sapiens
tttttttctttaaaga

SEQ ID NO: 180047 - DNA, 16 bp, H. sapiens
tttttttctttaagag

SEQ ID NO: 180048 - DNA, 16 bp, H. sapiens
tttttttctttgagac

SEQ ID NO: 180049 - DNA, 16 bp, H. sapiens
tttttttgaaatacat

SEQ ID NO: 180050 - DNA, 16 bp, H. sapiens
tttttttgaaatgggg

SEQ ID NO: 180051 - DNA, 16 bp, H. sapiens
tttttttgaaggaaaa

SEQ ID NO: 180052 - DNA, 16 bp, H. sapiens
tttttttgagacaaga

SEQ ID NO: 180053 - DNA, 23 bp, H. sapiens
tttttttgagacagagtctcatt

SEQ ID NO: 180054 - DNA, 16 bp, H. sapiens
tttttttgagacagat

SEQ ID NO: 180055 - DNA, 16 bp, H. sapiens
tttttttgagacagca

SEQ ID NO: 180056 - DNA, 16 bp, H. sapiens
tttttttgagacggat

SEQ ID NO: 180057 - DNA, 16 bp, H. sapiens
tttttttgaggagaaa

SEQ ID NO: 180058 - DNA, 17 bp, H. sapiens
tttttttgaggcagagt

SEQ ID NO: 180059 - DNA, 16 bp, H. sapiens
tttttttgaggggagg

SEQ ID NO: 180060 - DNA, 16 bp, H. sapiens
tttttttgagtcaaag

SEQ ID NO: 180061 - DNA, 16 bp, H. sapiens
tttttttgcaaagaaa

SEQ ID NO: 180062 - DNA, 16 bp, H. sapiens
tttttttgcagaaaca

SEQ ID NO: 180063 - DNA, 16 bp, H. sapiens
tttttttgcctttaaa

SEQ ID NO: 180064 - DNA, 16 bp, H. sapiens
tttttttggacagagt

SEQ ID NO: 180065 - DNA, 16 bp, H. sapiens
tttttttggacagggt

SEQ ID NO: 180066 - DNA, 16 bp, H. sapiens
tttttttggagacaga

SEQ ID NO: 180067 - DNA, 16 bp, H. sapiens
tttttttggagacagg

SEQ ID NO: 180068 - DNA, 16 bp, H. sapiens
tttttttggagagata

SEQ ID NO: 180069 - DNA, 16 bp, H. sapiens
tttttttggaggggga

SEQ ID NO: 180070 - DNA, 16 bp, H. sapiens
tttttttggagtgcag

SEQ ID NO: 180071 - DNA, 16 bp, H. sapiens
tttttttggcctggca

SEQ ID NO: 180072 - DNA, 16 bp, H. sapiens
tttttttggtagaaat

SEQ ID NO: 180073 - DNA, 16 bp, H. sapiens
tttttttggtcaaaat

SEQ ID NO: 180074 - DNA, 16 bp, H. sapiens
tttttttggtcaaata

SEQ ID NO: 180075 - DNA, 16 bp, H. sapiens
tttttttggtcttaaa

SEQ ID NO: 180076 - DNA, 16 bp, H. sapiens
tttttttgtaaaagaa

SEQ ID NO: 180077 - DNA, 16 bp, H. sapiens
tttttttgtaaattgc

SEQ ID NO: 180078 - DNA, 16 bp, H. sapiens
tttttttgtaagaaaa

SEQ ID NO: 180079 - DNA, 16 bp, H. sapiens
tttttttgtacagata

SEQ ID NO: 180080 - DNA, 16 bp, H. sapiens
tttttttgtagggata

SEQ ID NO: 180081 - DNA, 16 bp, H. sapiens
tttttttgtagtgaca

SEQ ID NO: 180082 - DNA, 16 bp, H. sapiens
tttttttgtgacaaag

SEQ ID NO: 180083 - DNA, 16 bp, H. sapiens
tttttttgtgatgaga

SEQ ID NO: 180084 - DNA, 16 bp, H. sapiens
tttttttgtggagtct

SEQ ID NO: 180085 - DNA, 16 bp, H. sapiens
tttttttgttaaaaac

SEQ ID NO: 180086 - DNA, 16 bp, H. sapiens
ttttttttaaaaacag

SEQ ID NO: 180087 - DNA, 16 bp, H. sapiens
ttttttttaaaaatgc

SEQ ID NO: 180088 - DNA, 16 bp, H. sapiens
ttttttttaaaagaag

SEQ ID NO: 180089 - DNA, 16 bp, H. sapiens
ttttttttaaaagaga

SEQ ID NO: 180090 - DNA, 16 bp, H. sapiens
ttttttttaaacaaac

SEQ ID NO: 180091 - DNA, 16 bp, H. sapiens
ttttttttaaacaagc

SEQ ID NO: 180092 - DNA, 16 bp, H. sapiens
ttttttttaaacatga

SEQ ID NO: 180093 - DNA, 16 bp, H. sapiens
ttttttttaaaccaaa

SEQ ID NO: 180094 - DNA, 16 bp, H. sapiens
ttttttttaaactgca

SEQ ID NO: 180095 - DNA, 16 bp, H. sapiens
ttttttttaaagacac

SEQ ID NO: 180096 - DNA, 16 bp, H. sapiens
ttttttttaaagagaa

SEQ ID NO: 180097 - DNA, 16 bp, H. sapiens
ttttttttaaagagtg

SEQ ID NO: 180098 - DNA, 16 bp, H. sapiens
ttttttttaaagatac

SEQ ID NO: 180099 - DNA, 16 bp, H. sapiens
ttttttttaaagctca

SEQ ID NO: 180100 - DNA, 16 bp, H. sapiens
ttttttttaaagctga

SEQ ID NO: 180101 - DNA, 16 bp, H. sapiens
ttttttttaaaggaga

SEQ ID NO: 180102 - DNA, 16 bp, H. sapiens
ttttttttaaaggcag

SEQ ID NO: 180103 - DNA, 16 bp, H. sapiens
ttttttttaaaggcat

SEQ ID NO: 180104 - DNA, 16 bp, H. sapiens
ttttttttaaagtcaa

SEQ ID NO: 180105 - DNA, 16 bp, H. sapiens
ttttttttaaagttcc

SEQ ID NO: 180106 - DNA, 16 bp, H. sapiens
ttttttttaaatgagg

SEQ ID NO: 180107 - DNA, 16 bp, H. sapiens
ttttttttaaatgcta

SEQ ID NO: 180108 - DNA, 16 bp, H. sapiens
ttttttttaaatgtca

SEQ ID NO: 180109 - DNA, 16 bp, H. sapiens
ttttttttaaccaaag

SEQ ID NO: 180110 - DNA, 16 bp, H. sapiens
ttttttttaaccagca

SEQ ID NO: 180111 - DNA, 16 bp, H. sapiens
ttttttttaaccagtc

SEQ ID NO: 180112 - DNA, 16 bp, H. sapiens
ttttttttaacctctg

SEQ ID NO: 180113 - DNA, 16 bp, H. sapiens
ttttttttaactgaaa

SEQ ID NO: 180114 - DNA, 16 bp, H. sapiens
ttttttttaactgaag

SEQ ID NO: 180115 - DNA, 16 bp, H. sapiens
ttttttttaactgact

SEQ ID NO: 180116 - DNA, 16 bp, H. sapiens
ttttttttaagaaaga

SEQ ID NO: 180117 - DNA, 16 bp, H. sapiens
ttttttttaagaccaa

SEQ ID NO: 180118 - DNA, 16 bp, H. sapiens
ttttttttaagaggtg

SEQ ID NO: 180119 - DNA, 16 bp, H. sapiens
ttttttttaagcaaat

SEQ ID NO: 180120 - DNA, 16 bp, H. sapiens
ttttttttaagcagtt

SEQ ID NO: 180121 - DNA, 16 bp, H. sapiens
ttttttttaagcctga

SEQ ID NO: 180122 - DNA, 16 bp, H. sapiens
ttttttttaaggacaa

SEQ ID NO: 180123 - DNA, 16 bp, H. sapiens
ttttttttaaggctga

SEQ ID NO: 180124 - DNA, 16 bp, H. sapiens
ttttttttaagggaaa

SEQ ID NO: 180125 - DNA, 16 bp, H. sapiens
ttttttttaagtcaaa

SEQ ID NO: 180126 - DNA, 16 bp, H. sapiens
ttttttttaagtcaca

SEQ ID NO: 180127 - DNA, 16 bp, H. sapiens
ttttttttaagtggag

SEQ ID NO: 180128 - DNA, 16 bp, H. sapiens
ttttttttaagtggga

SEQ ID NO: 180129 - DNA, 16 bp, H. sapiens
ttttttttaagttcca

SEQ ID NO: 180130 - DNA, 16 bp, H. sapiens
ttttttttaatactga

SEQ ID NO: 180131 - DNA, 16 bp, H. sapiens
ttttttttaattaagc

SEQ ID NO: 180132 - DNA, 16 bp, H. sapiens
ttttttttacacaaaa

SEQ ID NO: 180133 - DNA, 16 bp, H. sapiens
ttttttttacagaaat

SEQ ID NO: 180134 - DNA, 16 bp, H. sapiens
ttttttttacatgaat

SEQ ID NO: 180135 - DNA, 16 bp, H. sapiens
ttttttttactctgaa

SEQ ID NO: 180136 - DNA, 16 bp, H. sapiens
ttttttttagaagaaa

SEQ ID NO: 180137 - DNA, 16 bp, H. sapiens
ttttttttagagagag

SEQ ID NO: 180138 - DNA, 16 bp, H. sapiens
ttttttttcaaagaat

SEQ ID NO: 180139 - DNA, 16 bp, H. sapiens
ttttttttcaagaagg

SEQ ID NO: 180140 - DNA, 16 bp, H. sapiens
ttttttttcaagacag

SEQ ID NO: 180141 - DNA, 16 bp, H. sapiens
ttttttttcagaagtt

SEQ ID NO: 180142 - DNA, 16 bp, H. sapiens
ttttttttccaaaaaa

SEQ ID NO: 180143 - DNA, 16 bp, H. sapiens
ttttttttccaaaaac

SEQ ID NO: 180144 - DNA, 16 bp, H. sapiens
ttttttttccaaagta

SEQ ID NO: 180145 - DNA, 16 bp, H. sapiens
ttttttttccacagtg

SEQ ID NO: 180146 - DNA, 16 bp, H. sapiens
ttttttttccaggaag

SEQ ID NO: 180147 - DNA, 16 bp, H. sapiens
ttttttttccaggaga

SEQ ID NO: 180148 - DNA, 16 bp, H. sapiens
ttttttttccagttgg

SEQ ID NO: 180149 - DNA, 16 bp, H. sapiens
ttttttttcccaaaat

SEQ ID NO: 180150 - DNA, 16 bp, H. sapiens
ttttttttcccaagac

SEQ ID NO: 180151 - DNA, 16 bp, H. sapiens
ttttttttccccagag

SEQ ID NO: 180152 - DNA, 16 bp, H. sapiens
ttttttttccccagca

SEQ ID NO: 180153 - DNA, 16 bp, H. sapiens
ttttttttccccataa

SEQ ID NO: 180154 - DNA, 16 bp, H. sapiens
ttttttttccccattg

SEQ ID NO: 180155 - DNA, 16 bp, H. sapiens
ttttttttcccccagt

SEQ ID NO: 180156 - DNA, 16 bp, H. sapiens
ttttttttcccctaga

SEQ ID NO: 180157 - DNA, 16 bp, H. sapiens
ttttttttccctagaa

SEQ ID NO: 180158 - DNA, 16 bp, H. sapiens
ttttttttccctcagc

SEQ ID NO: 180159 - DNA, 16 bp, H. sapiens
ttttttttcctcaaaa

SEQ ID NO: 180160 - DNA, 16 bp, H. sapiens
ttttttttcctccaaa

SEQ ID NO: 180161 - DNA, 16 bp, H. sapiens
ttttttttcctcctga

SEQ ID NO: 180162 - DNA, 16 bp, H. sapiens
ttttttttcctctaag

SEQ ID NO: 180163 - DNA, 16 bp, H. sapiens
ttttttttcctgaaca

SEQ ID NO: 180164 - DNA, 16 bp, H. sapiens
ttttttttcctgaaga

SEQ ID NO: 180165 - DNA, 16 bp, H. sapiens
ttttttttccttgaag

SEQ ID NO: 180166 - DNA, 16 bp, H. sapiens
ttttttttctaaatag

SEQ ID NO: 180167 - DNA, 16 bp, H. sapiens
ttttttttctaagaca

SEQ ID NO: 180168 - DNA, 16 bp, H. sapiens
ttttttttctcagaaa

SEQ ID NO: 180169 - DNA, 16 bp, H. sapiens
ttttttttctcagtgg

SEQ ID NO: 180170 - DNA, 16 bp, H. sapiens
ttttttttctcatgaa

SEQ ID NO: 180171 - DNA, 16 bp, H. sapiens
ttttttttctgaaata

SEQ ID NO: 180172 - DNA, 16 bp, H. sapiens
ttttttttctgaggtg

SEQ ID NO: 180173 - DNA, 16 bp, H. sapiens
ttttttttctgataaa

SEQ ID NO: 180174 - DNA, 16 bp, H. sapiens
ttttttttctggaatg

SEQ ID NO: 180175 - DNA, 16 bp, H. sapiens
ttttttttcttagaca

SEQ ID NO: 180176 - DNA, 16 bp, H. sapiens
ttttttttgaaaggaa

SEQ ID NO: 180177 - DNA, 16 bp, H. sapiens
ttttttttgaaagtct

SEQ ID NO: 180178 - DNA, 16 bp, H. sapiens
ttttttttgaagaaaa

SEQ ID NO: 180179 - DNA, 16 bp, H. sapiens
ttttttttgacaaaaa

SEQ ID NO: 180180 - DNA, 16 bp, H. sapiens
ttttttttgacagagt

SEQ ID NO: 180181 - DNA, 16 bp, H. sapiens
ttttttttgagaagag

SEQ ID NO: 180182 - DNA, 24 bp, H. sapiens
ttttttttgagacagagtctcacc

SEQ ID NO: 180183 - DNA, 16 bp, H. sapiens
ttttttttgagacagg

SEQ ID NO: 180184 - DNA, 25 bp, H. sapiens
ttttttttgagacagggtcttgctc

SEQ ID NO: 180185 - DNA, 16 bp, H. sapiens
ttttttttgagacagt

SEQ ID NO: 180186 - DNA, 17 bp, H. sapiens
ttttttttgagacagtg

SEQ ID NO: 180187 - DNA, 16 bp, H. sapiens
ttttttttgagacggc

SEQ ID NO: 180188 - DNA, 16 bp, H. sapiens
ttttttttgagagaaa

SEQ ID NO: 180189 - DNA, 22 bp, H. sapiens
ttttttttgagatgaagtctcg

SEQ ID NO: 180190 - DNA, 26 bp, H. sapiens
ttttttttgagatggagtcttgctcc

SEQ ID NO: 180191 - DNA, 16 bp, H. sapiens
ttttttttgccttcaa

SEQ ID NO: 180192 - DNA, 16 bp, H. sapiens
ttttttttgctaaatg

SEQ ID NO: 180193 - DNA, 16 bp, H. sapiens
ttttttttggaaagca

SEQ ID NO: 180194 - DNA, 16 bp, H. sapiens
ttttttttggagaagg

SEQ ID NO: 180195 - DNA, 22 bp, H. sapiens
ttttttttggagacagagtctt

SEQ ID NO: 180196 - DNA, 16 bp, H. sapiens
ttttttttggagggaa

SEQ ID NO: 180197 - DNA, 16 bp, H. sapiens
ttttttttggagggag

SEQ ID NO: 180198 - DNA, 16 bp, H. sapiens
ttttttttggatacag

SEQ ID NO: 180199 - DNA, 16 bp, H. sapiens
ttttttttggatgaag

SEQ ID NO: 180200 - DNA, 16 bp, H. sapiens
ttttttttggcaaatg

SEQ ID NO: 180201 - DNA, 16 bp, H. sapiens
ttttttttggtagaaa

SEQ ID NO: 180202 - DNA, 16 bp, H. sapiens
ttttttttggtcaaat

SEQ ID NO: 180203 - DNA, 16 bp, H. sapiens
ttttttttggtgcaaa

SEQ ID NO: 180204 - DNA, 16 bp, H. sapiens
ttttttttgtaaacat

SEQ ID NO: 180205 - DNA, 16 bp, H. sapiens
ttttttttgtaaactg

SEQ ID NO: 180206 - DNA, 16 bp, H. sapiens
ttttttttgtccctca

SEQ ID NO: 180207 - DNA, 18 bp, H. sapiens
ttttttttgttgagacgg

SEQ ID NO: 180208 - DNA, 16 bp, H. sapiens
tttttttttaaaaggc

SEQ ID NO: 180209 - DNA, 16 bp, H. sapiens
tttttttttaaagact

SEQ ID NO: 180210 - DNA, 16 bp, H. sapiens
tttttttttaaagcca

SEQ ID NO: 180211 - DNA, 16 bp, H. sapiens
tttttttttaaagtac

SEQ ID NO: 180212 - DNA, 16 bp, H. sapiens
tttttttttaaatcag

SEQ ID NO: 180213 - DNA, 16 bp, H. sapiens
tttttttttaaatcga

SEQ ID NO: 180214 - DNA, 16 bp, H. sapiens
tttttttttaacactg

SEQ ID NO: 180215 - DNA, 16 bp, H. sapiens
tttttttttaacccaa

SEQ ID NO: 180216 - DNA, 16 bp, H. sapiens
tttttttttaagacga

SEQ ID NO: 180217 - DNA, 16 bp, H. sapiens
tttttttttaaggaac

SEQ ID NO: 180218 - DNA, 16 bp, H. sapiens
tttttttttaaggact

SEQ ID NO: 180219 - DNA, 16 bp, H. sapiens
tttttttttaaggcag

SEQ ID NO: 180220 - DNA, 16 bp, H. sapiens
tttttttttaatagca

SEQ ID NO: 180221 - DNA, 16 bp, H. sapiens
tttttttttacaaaga

SEQ ID NO: 180222 - DNA, 16 bp, H. sapiens
tttttttttacaaatg

SEQ ID NO: 180223 - DNA, 16 bp, H. sapiens
tttttttttatcaaga

SEQ ID NO: 180224 - DNA, 16 bp, H. sapiens
tttttttttatgagac

SEQ ID NO: 180225 - DNA, 16 bp, H. sapiens
tttttttttcagaaaa

SEQ ID NO: 180226 - DNA, 16 bp, H. sapiens
tttttttttcagacag

SEQ ID NO: 180227 - DNA, 16 bp, H. sapiens
tttttttttcagccag

SEQ ID NO: 180228 - DNA, 16 bp, H. sapiens
tttttttttccaaaca

SEQ ID NO: 180229 - DNA, 16 bp, H. sapiens
tttttttttccaaagt

SEQ ID NO: 180230 - DNA, 16 bp, H. sapiens
tttttttttccagaaa

SEQ ID NO: 180231 - DNA, 16 bp, H. sapiens
tttttttttccagata

SEQ ID NO: 180232 - DNA, 16 bp, H. sapiens
tttttttttccaggaa

SEQ ID NO: 180233 - DNA, 16 bp, H. sapiens
tttttttttccagtag

SEQ ID NO: 180234 - DNA, 16 bp, H. sapiens
tttttttttcccctga

SEQ ID NO: 180235 - DNA, 16 bp, H. sapiens
tttttttttccctgag

SEQ ID NO: 180236 - DNA, 16 bp, H. sapiens
tttttttttccctgca

SEQ ID NO: 180237 - DNA, 16 bp, H. sapiens
tttttttttccgagac

SEQ ID NO: 180238 - DNA, 16 bp, H. sapiens
tttttttttcctgaga

SEQ ID NO: 180239 - DNA, 16 bp, H. sapiens
tttttttttcctgcaa

SEQ ID NO: 180240 - DNA, 16 bp, H. sapiens
tttttttttcctggaa

SEQ ID NO: 180241 - DNA, 16 bp, H. sapiens
tttttttttctaagaa

SEQ ID NO: 180242 - DNA, 16 bp, H. sapiens
tttttttttctaagag

SEQ ID NO: 180243 - DNA, 16 bp, H. sapiens
tttttttttctcacag

SEQ ID NO: 180244 - DNA, 16 bp, H. sapiens
tttttttttctggaag

SEQ ID NO: 180245 - DNA, 16 bp, H. sapiens
tttttttttctgggag

SEQ ID NO: 180246 - DNA, 16 bp, H. sapiens
tttttttttgaaagag

SEQ ID NO: 180247 - DNA, 16 bp, H. sapiens
tttttttttgaggaga

SEQ ID NO: 180248 - DNA, 16 bp, H. sapiens
tttttttttgcagtaa

SEQ ID NO: 180249 - DNA, 16 bp, H. sapiens
tttttttttgcctgac

SEQ ID NO: 180250 - DNA, 16 bp, H. sapiens
tttttttttgctaaac

SEQ ID NO: 180251 - DNA, 16 bp, H. sapiens
tttttttttggacatg

SEQ ID NO: 180252 - DNA, 16 bp, H. sapiens
tttttttttggcagat

SEQ ID NO: 180253 - DNA, 16 bp, H. sapiens
tttttttttggcaggg

SEQ ID NO: 180254 - DNA, 16 bp, H. sapiens
tttttttttggctcac

SEQ ID NO: 180255 - DNA, 16 bp, H. sapiens
ttttttttttaacaga

SEQ ID NO: 180256 - DNA, 17 bp, H. sapiens
ttttttttttaagagcc

SEQ ID NO: 180257 - DNA, 16 bp, H. sapiens
ttttttttttacagga

SEQ ID NO: 180258 - DNA, 16 bp, H. sapiens
ttttttttttcaagag

SEQ ID NO: 180259 - DNA, 16 bp, H. sapiens
ttttttttttcagaga

SEQ ID NO: 180260 - DNA, 16 bp, H. sapiens
ttttttttttccagac

SEQ ID NO: 180261 - DNA, 16 bp, H. sapiens
ttttttttttccagag

SEQ ID NO: 180262 - DNA, 16 bp, H. sapiens
ttttttttttccagca

SEQ ID NO: 180263 - DNA, 16 bp, H. sapiens
ttttttttttcggaga

SEQ ID NO: 180264 - DNA, 16 bp, H. sapiens
ttttttttttgacagc

SEQ ID NO: 180265 - DNA, 16 bp, H. sapiens
ttttttttttgcaggg

SEQ ID NO: 180266 - DNA, 16 bp, H. sapiens
ttttttttttgccaag

SEQ ID NO: 180267 - DNA, 16 bp, H. sapiens
ttttttttttggcaag

SEQ ID NO: 180268 - DNA, 16 bp, H. sapiens
ttttttttttggcaga

SEQ ID NO: 180269 - DNA, 16 bp, H. sapiens
ttttttttttgggacg

SEQ ID NO: 180270 - DNA, 16 bp, P. troglodytes
aaaaaaaaaacttgct

SEQ ID NO: 180271 - DNA, 17 bp, P. troglodytes
aaaaaaaaaagcctggg

SEQ ID NO: 180272 - DNA, 16 bp, P. troglodytes
aaaaaaaaaagctttc

SEQ ID NO: 180273 - DNA, 16 bp, P. troglodytes
aaaaaaaaaaggcttg

SEQ ID NO: 180274 - DNA, 16 bp, P. troglodytes
aaaaaaaaaaggttct

SEQ ID NO: 180275 - DNA, 16 bp, P. troglodytes
aaaaaaaaaagtgcgt

SEQ ID NO: 180276 - DNA, 16 bp, P. troglodytes
aaaaaaaaaagtttcc

SEQ ID NO: 180277 - DNA, 16 bp, P. troglodytes
aaaaaaaaaagtttgc

SEQ ID NO: 180278 - DNA, 16 bp, P. troglodytes
aaaaaaaaaagttttc

SEQ ID NO: 180279 - DNA, 16 bp, P. troglodytes
aaaaaaaaaatccttg

SEQ ID NO: 180280 - DNA, 16 bp, P. troglodytes
aaaaaaaaaatctgtg

SEQ ID NO: 180281 - DNA, 16 bp, P. troglodytes
aaaaaaaaaatggctg

SEQ ID NO: 180282 - DNA, 16 bp, P. troglodytes
aaaaaaaaaattgctg

SEQ ID NO: 180283 - DNA, 16 bp, P. troglodytes
aaaaaaaaacactgtg

SEQ ID NO: 180284 - DNA, 16 bp, P. troglodytes
aaaaaaaaacagcctc

SEQ ID NO: 180285 - DNA, 16 bp, P. troglodytes
aaaaaaaaacagctct

SEQ ID NO: 180286 - DNA, 16 bp, P. troglodytes
aaaaaaaaacagtcct

SEQ ID NO: 180287 - DNA, 16 bp, P. troglodytes
aaaaaaaaacagtggg

SEQ ID NO: 180288 - DNA, 16 bp, P. troglodytes
aaaaaaaaacccatgt

SEQ ID NO: 180289 - DNA, 16 bp, P. troglodytes
aaaaaaaaaccctgca

SEQ ID NO: 180290 - DNA, 16 bp, P. troglodytes
aaaaaaaaaccctgtg

SEQ ID NO: 180291 - DNA, 16 bp, P. troglodytes
aaaaaaaaacctattg

SEQ ID NO: 180292 - DNA, 16 bp, P. troglodytes
aaaaaaaaacctggtg

SEQ ID NO: 180293 - DNA, 16 bp, P. troglodytes
aaaaaaaaacctttga

SEQ ID NO: 180294 - DNA, 16 bp, P. troglodytes
aaaaaaaaactttgac

SEQ ID NO: 180295 - DNA, 16 bp, P. troglodytes
aaaaaaaaactttggg

SEQ ID NO: 180296 - DNA, 16 bp, P. troglodytes
aaaaaaaaacttttga

SEQ ID NO: 180297 - DNA, 16 bp, P. troglodytes
aaaaaaaaagacttct

SEQ ID NO: 180298 - DNA, 16 bp, P. troglodytes
aaaaaaaaagactttg

SEQ ID NO: 180299 - DNA, 16 bp, P. troglodytes
aaaaaaaaagatctgt

SEQ ID NO: 180300 - DNA, 16 bp, P. troglodytes
aaaaaaaaagatgccc

SEQ ID NO: 180301 - DNA, 16 bp, P. troglodytes
aaaaaaaaagatgctt

SEQ ID NO: 180302 - DNA, 16 bp, P. troglodytes
aaaaaaaaagattctg

SEQ ID NO: 180303 - DNA, 16 bp, P. troglodytes
aaaaaaaaagcagctc

SEQ ID NO: 180304 - DNA, 16 bp, P. troglodytes
aaaaaaaaagcagttt

SEQ ID NO: 180305 - DNA, 16 bp, P. troglodytes
aaaaaaaaagccaggt

SEQ ID NO: 180306 - DNA, 16 bp, P. troglodytes
aaaaaaaaagccctat

SEQ ID NO: 180307 - DNA, 16 bp, P. troglodytes
aaaaaaaaagcctttt

SEQ ID NO: 180308 - DNA, 16 bp, P. troglodytes
aaaaaaaaagctcctg

SEQ ID NO: 180309 - DNA, 16 bp, P. troglodytes
aaaaaaaaagctgtta

SEQ ID NO: 180310 - DNA, 16 bp, P. troglodytes
aaaaaaaaagcttttc

SEQ ID NO: 180311 - DNA, 16 bp, P. troglodytes
aaaaaaaaaggctggt

SEQ ID NO: 180312 - DNA, 16 bp, P. troglodytes
aaaaaaaaaggtcatt

SEQ ID NO: 180313 - DNA, 16 bp, P. troglodytes
aaaaaaaaaggtgtgt

SEQ ID NO: 180314 - DNA, 16 bp, P. troglodytes
aaaaaaaaaggtttct

SEQ ID NO: 180315 - DNA, 16 bp, P. troglodytes
aaaaaaaaagtacttt

SEQ ID NO: 180316 - DNA, 16 bp, P. troglodytes
aaaaaaaaagtcccat

SEQ ID NO: 180317 - DNA, 16 bp, P. troglodytes
aaaaaaaaagtcctga

SEQ ID NO: 180318 - DNA, 16 bp, P. troglodytes
aaaaaaaaagtctacc

SEQ ID NO: 180319 - DNA, 16 bp, P. troglodytes
aaaaaaaaagtctagt

SEQ ID NO: 180320 - DNA, 16 bp, P. troglodytes
aaaaaaaaagtctatg

SEQ ID NO: 180321 - DNA, 16 bp, P. troglodytes
aaaaaaaaagtctttt

SEQ ID NO: 180322 - DNA, 16 bp, P. troglodytes
aaaaaaaaagtgctca

SEQ ID NO: 180323 - DNA, 16 bp, P. troglodytes
aaaaaaaaagtggctg

SEQ ID NO: 180324 - DNA, 16 bp, P. troglodytes
aaaaaaaaagtgtggc

SEQ ID NO: 180325 - DNA, 16 bp, P. troglodytes
aaaaaaaaagttccag

SEQ ID NO: 180326 - DNA, 16 bp, P. troglodytes
aaaaaaaaagtttcag

SEQ ID NO: 180327 - DNA, 16 bp, P. troglodytes
aaaaaaaaagtttctc

SEQ ID NO: 180328 - DNA, 16 bp, P. troglodytes
aaaaaaaaatcaggct

SEQ ID NO: 180329 - DNA, 16 bp, P. troglodytes
aaaaaaaaatcatgtg

SEQ ID NO: 180330 - DNA, 16 bp, P. troglodytes
aaaaaaaaatccctag

SEQ ID NO: 180331 - DNA, 16 bp, P. troglodytes
aaaaaaaaatctaggc

SEQ ID NO: 180332 - DNA, 16 bp, P. troglodytes
aaaaaaaaatctgcta

SEQ ID NO: 180333 - DNA, 16 bp, P. troglodytes
aaaaaaaaatctgggt

SEQ ID NO: 180334 - DNA, 16 bp, P. troglodytes
aaaaaaaaatgaccct

SEQ ID NO: 180335 - DNA, 16 bp, P. troglodytes
aaaaaaaaatgtgttc

SEQ ID NO: 180336 - DNA, 16 bp, P. troglodytes
aaaaaaaaattacctg

SEQ ID NO: 180337 - DNA, 16 bp, P. troglodytes
aaaaaaaaattactgt

SEQ ID NO: 180338 - DNA, 16 bp, P. troglodytes
aaaaaaaaattaggtc

SEQ ID NO: 180339 - DNA, 16 bp, P. troglodytes
aaaaaaaaattccatg

SEQ ID NO: 180340 - DNA, 16 bp, P. troglodytes
aaaaaaaaattctgct

SEQ ID NO: 180341 - DNA, 16 bp, P. troglodytes
aaaaaaaaattgatgc

SEQ ID NO: 180342 - DNA, 16 bp, P. troglodytes
aaaaaaaaattgcatt

SEQ ID NO: 180343 - DNA, 16 bp, P. troglodytes
aaaaaaaaattgctgc

SEQ ID NO: 180344 - DNA, 16 bp, P. troglodytes
aaaaaaaaattggggc

SEQ ID NO: 180345 - DNA, 16 bp, P. troglodytes
aaaaaaaaattggtgt

SEQ ID NO: 180346 - DNA, 16 bp, P. troglodytes
aaaaaaaaattgtttc

SEQ ID NO: 180347 - DNA, 16 bp, P. troglodytes
aaaaaaaaatttctag

SEQ ID NO: 180348 - DNA, 16 bp, P. troglodytes
aaaaaaaacagatttc

SEQ ID NO: 180349 - DNA, 16 bp, P. troglodytes
aaaaaaaaccctcagg

SEQ ID NO: 180350 - DNA, 16 bp, P. troglodytes
aaaaaaaacctccttt

SEQ ID NO: 180351 - DNA, 16 bp, P. troglodytes
aaaaaaaacctttgaa

SEQ ID NO: 180352 - DNA, 16 bp, P. troglodytes
aaaaaaaacttgttta

SEQ ID NO: 180353 - DNA, 16 bp, P. troglodytes
aaaaaaaactttattg

SEQ ID NO: 180354 - DNA, 16 bp, P. troglodytes
aaaaaaaagaattctt

SEQ ID NO: 180355 - DNA, 16 bp, P. troglodytes
aaaaaaaagacagttt

SEQ ID NO: 180356 - DNA, 16 bp, P. troglodytes
aaaaaaaagacattct

SEQ ID NO: 180357 - DNA, 16 bp, P. troglodytes
aaaaaaaagacatttc

SEQ ID NO: 180358 - DNA, 16 bp, P. troglodytes
aaaaaaaagacttctt

SEQ ID NO: 180359 - DNA, 16 bp, P. troglodytes
aaaaaaaagagtctgt

SEQ ID NO: 180360 - DNA, 16 bp, P. troglodytes
aaaaaaaagagttgct

SEQ ID NO: 180361 - DNA, 16 bp, P. troglodytes
aaaaaaaagatctcag

SEQ ID NO: 180362 - DNA, 16 bp, P. troglodytes
aaaaaaaagatgctgt

SEQ ID NO: 180363 - DNA, 16 bp, P. troglodytes
aaaaaaaagattccct

SEQ ID NO: 180364 - DNA, 16 bp, P. troglodytes
aaaaaaaagcaagggt

SEQ ID NO: 180365 - DNA, 16 bp, P. troglodytes
aaaaaaaagcagccat

SEQ ID NO: 180366 - DNA, 16 bp, P. troglodytes
aaaaaaaagcatttac

SEQ ID NO: 180367 - DNA, 16 bp, P. troglodytes
aaaaaaaagccacatt

SEQ ID NO: 180368 - DNA, 16 bp, P. troglodytes
aaaaaaaagccagcat

SEQ ID NO: 180369 - DNA, 16 bp, P. troglodytes
aaaaaaaagccagtgt

SEQ ID NO: 180370 - DNA, 16 bp, P. troglodytes
aaaaaaaagccattgt

SEQ ID NO: 180371 - DNA, 16 bp, P. troglodytes
aaaaaaaagcccaggg

SEQ ID NO: 180372 - DNA, 16 bp, P. troglodytes
aaaaaaaagcttaatt

SEQ ID NO: 180373 - DNA, 16 bp, P. troglodytes
aaaaaaaaggcatttt

SEQ ID NO: 180374 - DNA, 16 bp, P. troglodytes
aaaaaaaagtatcagt

SEQ ID NO: 180375 - DNA, 16 bp, P. troglodytes
aaaaaaaagtatctct

SEQ ID NO: 180376 - DNA, 16 bp, P. troglodytes
aaaaaaaagtattctt

SEQ ID NO: 180377 - DNA, 16 bp, P. troglodytes
aaaaaaaagtcatcca

SEQ ID NO: 180378 - DNA, 16 bp, P. troglodytes
aaaaaaaagtccacag

SEQ ID NO: 180379 - DNA, 16 bp, P. troglodytes
aaaaaaaagtctatat

SEQ ID NO: 180380 - DNA, 16 bp, P. troglodytes
aaaaaaaagtctattt

SEQ ID NO: 180381 - DNA, 16 bp, P. troglodytes
aaaaaaaagtctgctt

SEQ ID NO: 180382 - DNA, 16 bp, P. troglodytes
aaaaaaaagtctgtgt

SEQ ID NO: 180383 - DNA, 16 bp, P. troglodytes
aaaaaaaagtctttca

SEQ ID NO: 180384 - DNA, 16 bp, P. troglodytes
aaaaaaaagtgtattc

SEQ ID NO: 180385 - DNA, 16 bp, P. troglodytes
aaaaaaaagtgttggt

SEQ ID NO: 180386 - DNA, 16 bp, P. troglodytes
aaaaaaaagtgttttg

SEQ ID NO: 180387 - DNA, 16 bp, P. troglodytes
aaaaaaaagttcatga

SEQ ID NO: 180388 - DNA, 16 bp, P. troglodytes
aaaaaaaagttcattc

SEQ ID NO: 180389 - DNA, 16 bp, P. troglodytes
aaaaaaaagttgatct

SEQ ID NO: 180390 - DNA, 16 bp, P. troglodytes
aaaaaaaagtttcttt

SEQ ID NO: 180391 - DNA, 16 bp, P. troglodytes
aaaaaaaagtttgcca

SEQ ID NO: 180392 - DNA, 16 bp, P. troglodytes
aaaaaaaagtttgctg

SEQ ID NO: 180393 - DNA, 16 bp, P. troglodytes
aaaaaaaagtttgttg

SEQ ID NO: 180394 - DNA, 16 bp, P. troglodytes
aaaaaaaatagctggg

SEQ ID NO: 180395 - DNA, 16 bp, P. troglodytes
aaaaaaaatcaagtgc

SEQ ID NO: 180396 - DNA, 16 bp, P. troglodytes
aaaaaaaatcactggc

SEQ ID NO: 180397 - DNA, 16 bp, P. troglodytes
aaaaaaaatcagtatt

SEQ ID NO: 180398 - DNA, 16 bp, P. troglodytes
aaaaaaaatcagtgtg

SEQ ID NO: 180399 - DNA, 16 bp, P. troglodytes
aaaaaaaatcagttga

SEQ ID NO: 180400 - DNA, 16 bp, P. troglodytes
aaaaaaaatcatgact

SEQ ID NO: 180401 - DNA, 16 bp, P. troglodytes
aaaaaaaatcatgatg

SEQ ID NO: 180402 - DNA, 16 bp, P. troglodytes
aaaaaaaatccatcct

SEQ ID NO: 180403 - DNA, 16 bp, P. troglodytes
aaaaaaaatccatgtt

SEQ ID NO: 180404 - DNA, 16 bp, P. troglodytes
aaaaaaaatccctgtt

SEQ ID NO: 180405 - DNA, 16 bp, P. troglodytes
aaaaaaaatcctgact

SEQ ID NO: 180406 - DNA, 16 bp, P. troglodytes
aaaaaaaatcctgatt

SEQ ID NO: 180407 - DNA, 16 bp, P. troglodytes
aaaaaaaatctatcct

SEQ ID NO: 180408 - DNA, 16 bp, P. troglodytes
aaaaaaaatctgaatt

SEQ ID NO: 180409 - DNA, 16 bp, P. troglodytes
aaaaaaaatctgttgt

SEQ ID NO: 180410 - DNA, 16 bp, P. troglodytes
aaaaaaaatcttgtaa

SEQ ID NO: 180411 - DNA, 16 bp, P. troglodytes
aaaaaaaatctttctt

SEQ ID NO: 180412 - DNA, 16 bp, P. troglodytes
aaaaaaaatctttgaa

SEQ ID NO: 180413 - DNA, 16 bp, P. troglodytes
aaaaaaaatgcaagtt

SEQ ID NO: 180414 - DNA, 16 bp, P. troglodytes
aaaaaaaatgctgcag

SEQ ID NO: 180415 - DNA, 16 bp, P. troglodytes
aaaaaaaatgctggaa

SEQ ID NO: 180416 - DNA, 16 bp, P. troglodytes
aaaaaaaatggttttc

SEQ ID NO: 180417 - DNA, 16 bp, P. troglodytes
aaaaaaaatgtatctt

SEQ ID NO: 180418 - DNA, 16 bp, P. troglodytes
aaaaaaaatgttcaat

SEQ ID NO: 180419 - DNA, 16 bp, P. troglodytes
aaaaaaaatgttgact

SEQ ID NO: 180420 - DNA, 16 bp, P. troglodytes
aaaaaaaattactctg

SEQ ID NO: 180421 - DNA, 16 bp, P. troglodytes
aaaaaaaattactgca

SEQ ID NO: 180422 - DNA, 16 bp, P. troglodytes
aaaaaaaattactttg

SEQ ID NO: 180423 - DNA, 16 bp, P. troglodytes
aaaaaaaattagccag

SEQ ID NO: 180424 - DNA, 16 bp, P. troglodytes
aaaaaaaattagtcag

SEQ ID NO: 180425 - DNA, 16 bp, P. troglodytes
aaaaaaaattcagctt

SEQ ID NO: 180426 - DNA, 16 bp, P. troglodytes
aaaaaaaattcaggcc

SEQ ID NO: 180427 - DNA, 16 bp, P. troglodytes
aaaaaaaattcagtat

SEQ ID NO: 180428 - DNA, 16 bp, P. troglodytes
aaaaaaaattcccttt

SEQ ID NO: 180429 - DNA, 16 bp, P. troglodytes
aaaaaaaattcctttc

SEQ ID NO: 180430 - DNA, 16 bp, P. troglodytes
aaaaaaaattctgatt

SEQ ID NO: 180431 - DNA, 16 bp, P. troglodytes
aaaaaaaattctgtaa

SEQ ID NO: 180432 - DNA, 16 bp, P. troglodytes
aaaaaaaattgacctt

SEQ ID NO: 180433 - DNA, 16 bp, P. troglodytes
aaaaaaaattgatttc

SEQ ID NO: 180434 - DNA, 16 bp, P. troglodytes
aaaaaaaattgcagta

SEQ ID NO: 180435 - DNA, 16 bp, P. troglodytes
aaaaaaaattgccttt

SEQ ID NO: 180436 - DNA, 16 bp, P. troglodytes
aaaaaaaattgtactt

SEQ ID NO: 180437 - DNA, 16 bp, P. troglodytes
aaaaaaaattgtagct

SEQ ID NO: 180438 - DNA, 16 bp, P. troglodytes
aaaaaaaattgtcttc

SEQ ID NO: 180439 - DNA, 16 bp, P. troglodytes
aaaaaaaattgttctt

SEQ ID NO: 180440 - DNA, 16 bp, P. troglodytes
aaaaaaaattgttggg

SEQ ID NO: 180441 - DNA, 16 bp, P. troglodytes
aaaaaaaattttgctt

SEQ ID NO: 180442 - DNA, 16 bp, P. troglodytes
aaaaaaacaaatgctg

SEQ ID NO: 180443 - DNA, 16 bp, P. troglodytes
aaaaaaacaagttatt

SEQ ID NO: 180444 - DNA, 16 bp, P. troglodytes
aaaaaaacaagtttat

SEQ ID NO: 180445 - DNA, 16 bp, P. troglodytes
aaaaaaacagtaattt

SEQ ID NO: 180446 - DNA, 16 bp, P. troglodytes
aaaaaaacagtttatt

SEQ ID NO: 180447 - DNA, 16 bp, P. troglodytes
aaaaaaacccacagtg

SEQ ID NO: 180448 - DNA, 16 bp, P. troglodytes
aaaaaaacccactgaa

SEQ ID NO: 180449 - DNA, 16 bp, P. troglodytes
aaaaaaacctctgaaa

SEQ ID NO: 180450 - DNA, 16 bp, P. troglodytes
aaaaaaactccaggac

SEQ ID NO: 180451 - DNA, 16 bp, P. troglodytes
aaaaaaactttcagaa

SEQ ID NO: 180452 - DNA, 16 bp, P. troglodytes
aaaaaaactttgtaaa

SEQ ID NO: 180453 - DNA, 16 bp, P. troglodytes
aaaaaaactttttgtt

SEQ ID NO: 180454 - DNA, 16 bp, P. troglodytes
aaaaaaagaaactgcc

SEQ ID NO: 180455 - DNA, 16 bp, P. troglodytes
aaaaaaagaaactgtg

SEQ ID NO: 180456 - DNA, 16 bp, P. troglodytes
aaaaaaagaaagcctt

SEQ ID NO: 180457 - DNA, 16 bp, P. troglodytes
aaaaaaagaacatttt

SEQ ID NO: 180458 - DNA, 16 bp, P. troglodytes
aaaaaaagaactttgg

SEQ ID NO: 180459 - DNA, 16 bp, P. troglodytes
aaaaaaagaagtgtgt

SEQ ID NO: 180460 - DNA, 16 bp, P. troglodytes
aaaaaaagaatagctt

SEQ ID NO: 180461 - DNA, 16 bp, P. troglodytes
aaaaaaagaatcattt

SEQ ID NO: 180462 - DNA, 16 bp, P. troglodytes
aaaaaaagaatcccag

SEQ ID NO: 180463 - DNA, 16 bp, P. troglodytes
aaaaaaagaatctctt

SEQ ID NO: 180464 - DNA, 16 bp, P. troglodytes
aaaaaaagaatgctca

SEQ ID NO: 180465 - DNA, 16 bp, P. troglodytes
aaaaaaagaatgctgt

SEQ ID NO: 180466 - DNA, 16 bp, P. troglodytes
aaaaaaagaatgtcag

SEQ ID NO: 180467 - DNA, 16 bp, P. troglodytes
aaaaaaagaatttttc

SEQ ID NO: 180468 - DNA, 16 bp, P. troglodytes
aaaaaaagacagggtc

SEQ ID NO: 180469 - DNA, 16 bp, P. troglodytes
aaaaaaagacagttga

SEQ ID NO: 180470 - DNA, 16 bp, P. troglodytes
aaaaaaagactggaga

SEQ ID NO: 180471 - DNA, 16 bp, P. troglodytes
aaaaaaagactgtttt

SEQ ID NO: 180472 - DNA, 16 bp, P. troglodytes
aaaaaaagagagacct

SEQ ID NO: 180473 - DNA, 16 bp, P. troglodytes
aaaaaaagagatttca

SEQ ID NO: 180474 - DNA, 16 bp, P. troglodytes
aaaaaaagagttcaag

SEQ ID NO: 180475 - DNA, 16 bp, P. troglodytes
aaaaaaagcaactttt

SEQ ID NO: 180476 - DNA, 16 bp, P. troglodytes
aaaaaaagcaagattt

SEQ ID NO: 180477 - DNA, 16 bp, P. troglodytes
aaaaaaagcagcagct

SEQ ID NO: 180478 - DNA, 16 bp, P. troglodytes
aaaaaaagcattttca

SEQ ID NO: 180479 - DNA, 16 bp, P. troglodytes
aaaaaaagccaaattt

SEQ ID NO: 180480 - DNA, 16 bp, P. troglodytes
aaaaaaagcccacatt

SEQ ID NO: 180481 - DNA, 16 bp, P. troglodytes
aaaaaaagctgtattt

SEQ ID NO: 180482 - DNA, 16 bp, P. troglodytes
aaaaaaagctttaaat

SEQ ID NO: 180483 - DNA, 16 bp, P. troglodytes
aaaaaaaggaagcttt

SEQ ID NO: 180484 - DNA, 16 bp, P. troglodytes
aaaaaaagggacattt

SEQ ID NO: 180485 - DNA, 16 bp, P. troglodytes
aaaaaaagggtattca

SEQ ID NO: 180486 - DNA, 16 bp, P. troglodytes
aaaaaaaggtttttat

SEQ ID NO: 180487 - DNA, 16 bp, P. troglodytes
aaaaaaagtcaatttt

SEQ ID NO: 180488 - DNA, 16 bp, P. troglodytes
aaaaaaagtgttcatt

SEQ ID NO: 180489 - DNA, 16 bp, P. troglodytes
aaaaaaagtgtttgca

SEQ ID NO: 180490 - DNA, 16 bp, P. troglodytes
aaaaaaagtgttttta

SEQ ID NO: 180491 - DNA, 16 bp, P. troglodytes
aaaaaaagttaatctc

SEQ ID NO: 180492 - DNA, 16 bp, P. troglodytes
aaaaaaagttaatttc

SEQ ID NO: 180493 - DNA, 16 bp, P. troglodytes
aaaaaaagttcaaatg

SEQ ID NO: 180494 - DNA, 16 bp, P. troglodytes
aaaaaaagttgatctc

SEQ ID NO: 180495 - DNA, 16 bp, P. troglodytes
aaaaaaagttgatttt

SEQ ID NO: 180496 - DNA, 16 bp, P. troglodytes
aaaaaaagttgtattt

SEQ ID NO: 180497 - DNA, 16 bp, P. troglodytes
aaaaaaagttgttttt

SEQ ID NO: 180498 - DNA, 16 bp, P. troglodytes
aaaaaaagtttcaact

SEQ ID NO: 180499 - DNA, 16 bp, P. troglodytes
aaaaaaagtttgctaa

SEQ ID NO: 180500 - DNA, 16 bp, P. troglodytes
aaaaaaagtttgtctt

SEQ ID NO: 180501 - DNA, 16 bp, P. troglodytes
aaaaaaagtttgtgtt

SEQ ID NO: 180502 - DNA, 16 bp, P. troglodytes
aaaaaaataaagctgt

SEQ ID NO: 180503 - DNA, 16 bp, P. troglodytes
aaaaaaataaagcttt

SEQ ID NO: 180504 - DNA, 16 bp, P. troglodytes
aaaaaaataagcattt

SEQ ID NO: 180505 - DNA, 16 bp, P. troglodytes
aaaaaaatacattcag

SEQ ID NO: 180506 - DNA, 16 bp, P. troglodytes
aaaaaaataccctttt

SEQ ID NO: 180507 - DNA, 16 bp, P. troglodytes
aaaaaaatagctgaat

SEQ ID NO: 180508 - DNA, 18 bp, P. troglodytes
aaaaaaatagctgggcgt

SEQ ID NO: 180509 - DNA, 16 bp, P. troglodytes
aaaaaaatatcctttt

SEQ ID NO: 180510 - DNA, 16 bp, P. troglodytes
aaaaaaatattttccc

SEQ ID NO: 180511 - DNA, 16 bp, P. troglodytes
aaaaaaatcaaagttc

SEQ ID NO: 180512 - DNA, 16 bp, P. troglodytes
aaaaaaatcaaggttt

SEQ ID NO: 180513 - DNA, 16 bp, P. troglodytes
aaaaaaatcaatttag

SEQ ID NO: 180514 - DNA, 16 bp, P. troglodytes
aaaaaaatcagacatt

SEQ ID NO: 180515 - DNA, 16 bp, P. troglodytes
aaaaaaatcagagttt

SEQ ID NO: 180516 - DNA, 16 bp, P. troglodytes
aaaaaaatcagtcaat

SEQ ID NO: 180517 - DNA, 16 bp, P. troglodytes
aaaaaaatcatcttct

SEQ ID NO: 180518 - DNA, 16 bp, P. troglodytes
aaaaaaatcatgattt

SEQ ID NO: 180519 - DNA, 16 bp, P. troglodytes
aaaaaaatcatgttct

SEQ ID NO: 180520 - DNA, 16 bp, P. troglodytes
aaaaaaatcattcaag

SEQ ID NO: 180521 - DNA, 16 bp, P. troglodytes
aaaaaaatcattcagt

SEQ ID NO: 180522 - DNA, 16 bp, P. troglodytes
aaaaaaatcattctga

SEQ ID NO: 180523 - DNA, 16 bp, P. troglodytes
aaaaaaatcattgttt

SEQ ID NO: 180524 - DNA, 16 bp, P. troglodytes
aaaaaaatcatttgta

SEQ ID NO: 180525 - DNA, 16 bp, P. troglodytes
aaaaaaatccatgtgt

SEQ ID NO: 180526 - DNA, 16 bp, P. troglodytes
aaaaaaatccctgctt

SEQ ID NO: 180527 - DNA, 16 bp, P. troglodytes
aaaaaaatctagaatt

SEQ ID NO: 180528 - DNA, 16 bp, P. troglodytes
aaaaaaatctagtatt

SEQ ID NO: 180529 - DNA, 16 bp, P. troglodytes
aaaaaaatctctgctg

SEQ ID NO: 180530 - DNA, 16 bp, P. troglodytes
aaaaaaatctgaagtt

SEQ ID NO: 180531 - DNA, 16 bp, P. troglodytes
aaaaaaatctggtttt

SEQ ID NO: 180532 - DNA, 16 bp, P. troglodytes
aaaaaaatctgtcatt

SEQ ID NO: 180533 - DNA, 16 bp, P. troglodytes
aaaaaaatctgttgaa

SEQ ID NO: 180534 - DNA, 16 bp, P. troglodytes
aaaaaaatcttgaaag

SEQ ID NO: 180535 - DNA, 16 bp, P. troglodytes
aaaaaaatgaagactt

SEQ ID NO: 180536 - DNA, 16 bp, P. troglodytes
aaaaaaatgaatctag

SEQ ID NO: 180537 - DNA, 16 bp, P. troglodytes
aaaaaaatgaatcttt

SEQ ID NO: 180538 - DNA, 16 bp, P. troglodytes
aaaaaaatgacagatg

SEQ ID NO: 180539 - DNA, 16 bp, P. troglodytes
aaaaaaatgagttttt

SEQ ID NO: 180540 - DNA, 16 bp, P. troglodytes
aaaaaaatgcactgaa

SEQ ID NO: 180541 - DNA, 16 bp, P. troglodytes
aaaaaaatgcagattc

SEQ ID NO: 180542 - DNA, 16 bp, P. troglodytes
aaaaaaatgcattctt

SEQ ID NO: 180543 - DNA, 16 bp, P. troglodytes
aaaaaaatgccaaatt

SEQ ID NO: 180544 - DNA, 16 bp, P. troglodytes
aaaaaaatggaatctt

SEQ ID NO: 180545 - DNA, 16 bp, P. troglodytes
aaaaaaatggatttca

SEQ ID NO: 180546 - DNA, 16 bp, P. troglodytes
aaaaaaatgggtaact

SEQ ID NO: 180547 - DNA, 16 bp, P. troglodytes
aaaaaaatgtacattc

SEQ ID NO: 180548 - DNA, 16 bp, P. troglodytes
aaaaaaatgtatcttt

SEQ ID NO: 180549 - DNA, 16 bp, P. troglodytes
aaaaaaatgtattcaa

SEQ ID NO: 180550 - DNA, 16 bp, P. troglodytes
aaaaaaatgtattctg

SEQ ID NO: 180551 - DNA, 16 bp, P. troglodytes
aaaaaaatgtatttca

SEQ ID NO: 180552 - DNA, 16 bp, P. troglodytes
aaaaaaatgtgtttga

SEQ ID NO: 180553 - DNA, 16 bp, P. troglodytes
aaaaaaatgttaagtg

SEQ ID NO: 180554 - DNA, 16 bp, P. troglodytes
aaaaaaattaacctgg

SEQ ID NO: 180555 - DNA, 16 bp, P. troglodytes
aaaaaaattaagtctt

SEQ ID NO: 180556 - DNA, 16 bp, P. troglodytes
aaaaaaattacagttt

SEQ ID NO: 180557 - DNA, 16 bp, P. troglodytes
aaaaaaattagctagg

SEQ ID NO: 180558 - DNA, 16 bp, P. troglodytes
aaaaaaattagctggg

SEQ ID NO: 180559 - DNA, 16 bp, P. troglodytes
aaaaaaattatttcct

SEQ ID NO: 180560 - DNA, 16 bp, P. troglodytes
aaaaaaattcaagtca

SEQ ID NO: 180561 - DNA, 16 bp, P. troglodytes
aaaaaaattcatgtaa

SEQ ID NO: 180562 - DNA, 16 bp, P. troglodytes
aaaaaaattcatgtat

SEQ ID NO: 180563 - DNA, 16 bp, P. troglodytes
aaaaaaattcattgtt

SEQ ID NO: 180564 - DNA, 16 bp, P. troglodytes
aaaaaaattccaggaa

SEQ ID NO: 180565 - DNA, 16 bp, P. troglodytes
aaaaaaattctacaga

SEQ ID NO: 180566 - DNA, 16 bp, P. troglodytes
aaaaaaattctatgaa

SEQ ID NO: 180567 - DNA, 16 bp, P. troglodytes
aaaaaaattctgctga

SEQ ID NO: 180568 - DNA, 16 bp, P. troglodytes
aaaaaaattcttcaga

SEQ ID NO: 180569 - DNA, 16 bp, P. troglodytes
aaaaaaattgaaactt

SEQ ID NO: 180570 - DNA, 16 bp, P. troglodytes
aaaaaaattgcagaat

SEQ ID NO: 180571 - DNA, 16 bp, P. troglodytes
aaaaaaattgttttag

SEQ ID NO: 180572 - DNA, 16 bp, P. troglodytes
aaaaaaatttccattt

SEQ ID NO: 180573 - DNA, 16 bp, P. troglodytes
aaaaaaatttgttttc

SEQ ID NO: 180574 - DNA, 16 bp, P. troglodytes
aaaaaacaaattagtt

SEQ ID NO: 180575 - DNA, 16 bp, P. troglodytes
aaaaaacaagctacag

SEQ ID NO: 180576 - DNA, 16 bp, P. troglodytes
aaaaaacaattttctt

SEQ ID NO: 180577 - DNA, 16 bp, P. troglodytes
aaaaaacagaatgcct

SEQ ID NO: 180578 - DNA, 16 bp, P. troglodytes
aaaaaacagatatttt

SEQ ID NO: 180579 - DNA, 16 bp, P. troglodytes
aaaaaacagcagatgc

SEQ ID NO: 180580 - DNA, 16 bp, P. troglodytes
aaaaaacattgttttt

SEQ ID NO: 180581 - DNA, 16 bp, P. troglodytes
aaaaaaccctgaaatt

SEQ ID NO: 180582 - DNA, 17 bp, P. troglodytes
aaaaaactagctgggca

SEQ ID NO: 180583 - DNA, 17 bp, P. troglodytes
aaaaaactccaggacca

SEQ ID NO: 180584 - DNA, 16 bp, P. troglodytes
aaaaaactcttctgga

SEQ ID NO: 180585 - DNA, 16 bp, P. troglodytes
aaaaaactgataaatt

SEQ ID NO: 180586 - DNA, 16 bp, P. troglodytes
aaaaaactgctttaaa

SEQ ID NO: 180587 - DNA, 16 bp, P. troglodytes
aaaaaactggaggaat

SEQ ID NO: 180588 - DNA, 16 bp, P. troglodytes
aaaaaactgtatttta

SEQ ID NO: 180589 - DNA, 16 bp, P. troglodytes
aaaaaactgtgtgtgt

SEQ ID NO: 180590 - DNA, 16 bp, P. troglodytes
aaaaaacttcaaaagt

SEQ ID NO: 180591 - DNA, 16 bp, P. troglodytes
aaaaaactttcatttt

SEQ ID NO: 180592 - DNA, 16 bp, P. troglodytes
aaaaaacttttaaaag

SEQ ID NO: 180593 - DNA, 16 bp, P. troglodytes
aaaaaacttttttgta

SEQ ID NO: 180594 - DNA, 16 bp, P. troglodytes
aaaaaagaaaagtctg

SEQ ID NO: 180595 - DNA, 16 bp, P. troglodytes
aaaaaagaaaatcttt

SEQ ID NO: 180596 - DNA, 16 bp, P. troglodytes
aaaaaagaaaatggct

SEQ ID NO: 180597 - DNA, 16 bp, P. troglodytes
aaaaaagaaaattctg

SEQ ID NO: 180598 - DNA, 16 bp, P. troglodytes
aaaaaagaaacatttc

SEQ ID NO: 180599 - DNA, 16 bp, P. troglodytes
aaaaaagaaagctgag

SEQ ID NO: 180600 - DNA, 16 bp, P. troglodytes
aaaaaagaaaggctca

SEQ ID NO: 180601 - DNA, 16 bp, P. troglodytes
aaaaaagaaagtgctt

SEQ ID NO: 180602 - DNA, 16 bp, P. troglodytes
aaaaaagaaatctcca

SEQ ID NO: 180603 - DNA, 16 bp, P. troglodytes
aaaaaagaaatctgtt

SEQ ID NO: 180604 - DNA, 16 bp, P. troglodytes
aaaaaagaaatgcttt

SEQ ID NO: 180605 - DNA, 16 bp, P. troglodytes
aaaaaagaaattccat

SEQ ID NO: 180606 - DNA, 16 bp, P. troglodytes
aaaaaagaaattcctg

SEQ ID NO: 180607 - DNA, 16 bp, P. troglodytes
aaaaaagaaattctct

SEQ ID NO: 180608 - DNA, 16 bp, P. troglodytes
aaaaaagaaatttctg

SEQ ID NO: 180609 - DNA, 16 bp, P. troglodytes
aaaaaagaagtttctt

SEQ ID NO: 180610 - DNA, 16 bp, P. troglodytes
aaaaaagaatatttca

SEQ ID NO: 180611 - DNA, 16 bp, P. troglodytes
aaaaaagaatcatttg

SEQ ID NO: 180612 - DNA, 16 bp, P. troglodytes
aaaaaagaatgtgtgt

SEQ ID NO: 180613 - DNA, 16 bp, P. troglodytes
aaaaaagaattcagag

SEQ ID NO: 180614 - DNA, 16 bp, P. troglodytes
aaaaaagaattcttaa

SEQ ID NO: 180615 - DNA, 16 bp, P. troglodytes
aaaaaagaattttctt

SEQ ID NO: 180616 - DNA, 16 bp, P. troglodytes
aaaaaagagaaagtct

SEQ ID NO: 180617 - DNA, 16 bp, P. troglodytes
aaaaaagagaagatcc

SEQ ID NO: 180618 - DNA, 16 bp, P. troglodytes
aaaaaagagactttta

SEQ ID NO: 180619 - DNA, 16 bp, P. troglodytes
aaaaaagagagagact

SEQ ID NO: 180620 - DNA, 16 bp, P. troglodytes
aaaaaagagagagctt

SEQ ID NO: 180621 - DNA, 16 bp, P. troglodytes
aaaaaagagcaggagt

SEQ ID NO: 180622 - DNA, 16 bp, P. troglodytes
aaaaaagagcccttat

SEQ ID NO: 180623 - DNA, 16 bp, P. troglodytes
aaaaaagagcctggat

SEQ ID NO: 180624 - DNA, 16 bp, P. troglodytes
aaaaaagagcctgtat

SEQ ID NO: 180625 - DNA, 16 bp, P. troglodytes
aaaaaagaggctgaat

SEQ ID NO: 180626 - DNA, 16 bp, P. troglodytes
aaaaaagatcattttt

SEQ ID NO: 180627 - DNA, 16 bp, P. troglodytes
aaaaaagattactttc

SEQ ID NO: 180628 - DNA, 16 bp, P. troglodytes
aaaaaagattcctttt

SEQ ID NO: 180629 - DNA, 16 bp, P. troglodytes
aaaaaagattctgaaa

SEQ ID NO: 180630 - DNA, 16 bp, P. troglodytes
aaaaaagcaaggtgca

SEQ ID NO: 180631 - DNA, 16 bp, P. troglodytes
aaaaaagcaattttta

SEQ ID NO: 180632 - DNA, 16 bp, P. troglodytes
aaaaaagcagagattg

SEQ ID NO: 180633 - DNA, 16 bp, P. troglodytes
aaaaaagcagttattt

SEQ ID NO: 180634 - DNA, 16 bp, P. troglodytes
aaaaaagcattttaaa

SEQ ID NO: 180635 - DNA, 16 bp, P. troglodytes
aaaaaagcattttcta

SEQ ID NO: 180636 - DNA, 16 bp, P. troglodytes
aaaaaagccagtctca

SEQ ID NO: 180637 - DNA, 16 bp, P. troglodytes
aaaaaagccctgattt

SEQ ID NO: 180638 - DNA, 16 bp, P. troglodytes
aaaaaagccctggacc

SEQ ID NO: 180639 - DNA, 16 bp, P. troglodytes
aaaaaagccttttttt

SEQ ID NO: 180640 - DNA, 16 bp, P. troglodytes
aaaaaagctattttta

SEQ ID NO: 180641 - DNA, 16 bp, P. troglodytes
aaaaaagctggagaca

SEQ ID NO: 180642 - DNA, 16 bp, P. troglodytes
aaaaaagcttatagaa

SEQ ID NO: 180643 - DNA, 16 bp, P. troglodytes
aaaaaagctttcaaaa

SEQ ID NO: 180644 - DNA, 16 bp, P. troglodytes
aaaaaaggaaaacttc

SEQ ID NO: 180645 - DNA, 16 bp, P. troglodytes
aaaaaaggaaactgag

SEQ ID NO: 180646 - DNA, 16 bp, P. troglodytes
aaaaaaggaaatctga

SEQ ID NO: 180647 - DNA, 16 bp, P. troglodytes
aaaaaaggaaattttg

SEQ ID NO: 180648 - DNA, 16 bp, P. troglodytes
aaaaaaggaattgttt

SEQ ID NO: 180649 - DNA, 16 bp, P. troglodytes
aaaaaaggtgaaattt

SEQ ID NO: 180650 - DNA, 16 bp, P. troglodytes
aaaaaaggtttatttt

SEQ ID NO: 180651 - DNA, 16 bp, P. troglodytes
aaaaaagtaaaactgt

SEQ ID NO: 180652 - DNA, 16 bp, P. troglodytes
aaaaaagtatgtattt

SEQ ID NO: 180653 - DNA, 16 bp, P. troglodytes
aaaaaagtatttattg

SEQ ID NO: 180654 - DNA, 16 bp, P. troglodytes
aaaaaagtattttcat

SEQ ID NO: 180655 - DNA, 16 bp, P. troglodytes
aaaaaagtccaggagc

SEQ ID NO: 180656 - DNA, 16 bp, P. troglodytes
aaaaaagtctgaaaga

SEQ ID NO: 180657 - DNA, 16 bp, P. troglodytes
aaaaaagtctttttct

SEQ ID NO: 180658 - DNA, 16 bp, P. troglodytes
aaaaaagtgaagattt

SEQ ID NO: 180659 - DNA, 16 bp, P. troglodytes
aaaaaagttgatttca

SEQ ID NO: 180660 - DNA, 16 bp, P. troglodytes
aaaaaagttgttttaa

SEQ ID NO: 180661 - DNA, 16 bp, P. troglodytes
aaaaaagttgttttat

SEQ ID NO: 180662 - DNA, 16 bp, P. troglodytes
aaaaaagtttatttca

SEQ ID NO: 180663 - DNA, 16 bp, P. troglodytes
aaaaaagtttatttct

SEQ ID NO: 180664 - DNA, 16 bp, P. troglodytes
aaaaaagtttcagaaa

SEQ ID NO: 180665 - DNA, 16 bp, P. troglodytes
aaaaaagtttcctttc

SEQ ID NO: 180666 - DNA, 16 bp, P. troglodytes
aaaaaagttttcaaaa

SEQ ID NO: 180667 - DNA, 16 bp, P. troglodytes
aaaaaagttttggatt

SEQ ID NO: 180668 - DNA, 16 bp, P. troglodytes
aaaaaataacatgctg

SEQ ID NO: 180669 - DNA, 16 bp, P. troglodytes
aaaaaataatagctga

SEQ ID NO: 180670 - DNA, 16 bp, P. troglodytes
aaaaaatacagaagtt

SEQ ID NO: 180671 - DNA, 16 bp, P. troglodytes
aaaaaatacagtttga

SEQ ID NO: 180672 - DNA, 16 bp, P. troglodytes
aaaaaatacatatgta

SEQ ID NO: 180673 - DNA, 16 bp, P. troglodytes
aaaaaatacattgaac

SEQ ID NO: 180674 - DNA, 16 bp, P. troglodytes
aaaaaatacatttgaa

SEQ ID NO: 180675 - DNA, 16 bp, P. troglodytes
aaaaaatactgctgga

SEQ ID NO: 180676 - DNA, 16 bp, P. troglodytes
aaaaaatagacatttt

SEQ ID NO: 180677 - DNA, 16 bp, P. troglodytes
aaaaaatagactttat

SEQ ID NO: 180678 - DNA, 16 bp, P. troglodytes
aaaaaatagcatttct

SEQ ID NO: 180679 - DNA, 16 bp, P. troglodytes
aaaaaatagtatttca

SEQ ID NO: 180680 - DNA, 16 bp, P. troglodytes
aaaaaatatgtatgtg

SEQ ID NO: 180681 - DNA, 16 bp, P. troglodytes
aaaaaatatgtttctt

SEQ ID NO: 180682 - DNA, 16 bp, P. troglodytes
aaaaaatatttcttgt

SEQ ID NO: 180683 - DNA, 16 bp, P. troglodytes
aaaaaatcaaatgtat

SEQ ID NO: 180684 - DNA, 16 bp, P. troglodytes
aaaaaatcaagaaggc

SEQ ID NO: 180685 - DNA, 16 bp, P. troglodytes
aaaaaatcacaaggca

SEQ ID NO: 180686 - DNA, 16 bp, P. troglodytes
aaaaaatcagccgggt

SEQ ID NO: 180687 - DNA, 16 bp, P. troglodytes
aaaaaatcagtatttt

SEQ ID NO: 180688 - DNA, 16 bp, P. troglodytes
aaaaaatcagtgaaat

SEQ ID NO: 180689 - DNA, 16 bp, P. troglodytes
aaaaaatcagtgtttt

SEQ ID NO: 180690 - DNA, 16 bp, P. troglodytes
aaaaaatcataagtca

SEQ ID NO: 180691 - DNA, 16 bp, P. troglodytes
aaaaaatcattgtttt

SEQ ID NO: 180692 - DNA, 16 bp, P. troglodytes
aaaaaatcattttcca

SEQ ID NO: 180693 - DNA, 16 bp, P. troglodytes
aaaaaatccatgctca

SEQ ID NO: 180694 - DNA, 16 bp, P. troglodytes
aaaaaatctacatttt

SEQ ID NO: 180695 - DNA, 16 bp, P. troglodytes
aaaaaatctgtatata

SEQ ID NO: 180696 - DNA, 16 bp, P. troglodytes
aaaaaatcttactttt

SEQ ID NO: 180697 - DNA, 16 bp, P. troglodytes
aaaaaatcttgaaaat

SEQ ID NO: 180698 - DNA, 16 bp, P. troglodytes
aaaaaatgaaaacttt

SEQ ID NO: 180699 - DNA, 16 bp, P. troglodytes
aaaaaatgaacagagc

SEQ ID NO: 180700 - DNA, 16 bp, P. troglodytes
aaaaaatgaacttcaa

SEQ ID NO: 180701 - DNA, 16 bp, P. troglodytes
aaaaaatgaagcagag

SEQ ID NO: 180702 - DNA, 16 bp, P. troglodytes
aaaaaatgaagctgaa

SEQ ID NO: 180703 - DNA, 16 bp, P. troglodytes
aaaaaatgaagtcatt

SEQ ID NO: 180704 - DNA, 16 bp, P. troglodytes
aaaaaatgaatgaact

SEQ ID NO: 180705 - DNA, 16 bp, P. troglodytes
aaaaaatgaattttct

SEQ ID NO: 180706 - DNA, 16 bp, P. troglodytes
aaaaaatgataactat

SEQ ID NO: 180707 - DNA, 16 bp, P. troglodytes
aaaaaatgatttcaaa

SEQ ID NO: 180708 - DNA, 16 bp, P. troglodytes
aaaaaatgcactttta

SEQ ID NO: 180709 - DNA, 16 bp, P. troglodytes
aaaaaatgcatttttc

SEQ ID NO: 180710 - DNA, 16 bp, P. troglodytes
aaaaaatgctaaatat

SEQ ID NO: 180711 - DNA, 16 bp, P. troglodytes
aaaaaatgctgggcac

SEQ ID NO: 180712 - DNA, 16 bp, P. troglodytes
aaaaaatgctgggcat

SEQ ID NO: 180713 - DNA, 16 bp, P. troglodytes
aaaaaatgcttaatat

SEQ ID NO: 180714 - DNA, 16 bp, P. troglodytes
aaaaaatgcttgaaaa

SEQ ID NO: 180715 - DNA, 16 bp, P. troglodytes
aaaaaatgctttaaaa

SEQ ID NO: 180716 - DNA, 16 bp, P. troglodytes
aaaaaatggaagcaac

SEQ ID NO: 180717 - DNA, 16 bp, P. troglodytes
aaaaaatggaattttt

SEQ ID NO: 180718 - DNA, 16 bp, P. troglodytes
aaaaaatggagatttt

SEQ ID NO: 180719 - DNA, 16 bp, P. troglodytes
aaaaaatggatacatt

SEQ ID NO: 180720 - DNA, 16 bp, P. troglodytes
aaaaaatggcaaatat

SEQ ID NO: 180721 - DNA, 16 bp, P. troglodytes
aaaaaatggcattttt

SEQ ID NO: 180722 - DNA, 16 bp, P. troglodytes
aaaaaatggttttttt

SEQ ID NO: 180723 - DNA, 16 bp, P. troglodytes
aaaaaatgtacattct

SEQ ID NO: 180724 - DNA, 16 bp, P. troglodytes
aaaaaatgtagctggg

SEQ ID NO: 180725 - DNA, 16 bp, P. troglodytes
aaaaaatgtattttct

SEQ ID NO: 180726 - DNA, 16 bp, P. troglodytes
aaaaaatgtcattttt

SEQ ID NO: 180727 - DNA, 16 bp, P. troglodytes
aaaaaatgtgattttt

SEQ ID NO: 180728 - DNA, 16 bp, P. troglodytes
aaaaaatgtttaacat

SEQ ID NO: 180729 - DNA, 16 bp, P. troglodytes
aaaaaatgtttccaga

SEQ ID NO: 180730 - DNA, 16 bp, P. troglodytes
aaaaaatgtttccttt

SEQ ID NO: 180731 - DNA, 16 bp, P. troglodytes
aaaaaatgtttttcaa

SEQ ID NO: 180732 - DNA, 16 bp, P. troglodytes
aaaaaattaaagcatt

SEQ ID NO: 180733 - DNA, 16 bp, P. troglodytes
aaaaaattaaatgtct

SEQ ID NO: 180734 - DNA, 16 bp, P. troglodytes
aaaaaattaagctttt

SEQ ID NO: 180735 - DNA, 16 bp, P. troglodytes
aaaaaattaattgaca

SEQ ID NO: 180736 - DNA, 16 bp, P. troglodytes
aaaaaattacagtttt

SEQ ID NO: 180737 - DNA, 16 bp, P. troglodytes
aaaaaattacccgggc

SEQ ID NO: 180738 - DNA, 16 bp, P. troglodytes
aaaaaattactttgaa

SEQ ID NO: 180739 - DNA, 23 bp, P. troglodytes
aaaaaattagccaagtgtggtgg

SEQ ID NO: 180740 - DNA, 18 bp, P. troglodytes
aaaaaattagccgggtat

SEQ ID NO: 180741 - DNA, 16 bp, P. troglodytes
aaaaaattagctgagc

SEQ ID NO: 180742 - DNA, 16 bp, P. troglodytes
aaaaaattagctgggc

SEQ ID NO: 180743 - DNA, 17 bp, P. troglodytes
aaaaaattagctgggca

SEQ ID NO: 180744 - DNA, 16 bp, P. troglodytes
aaaaaattagctgggt

SEQ ID NO: 180745 - DNA, 16 bp, P. troglodytes
aaaaaattaggcatgg

SEQ ID NO: 180746 - DNA, 16 bp, P. troglodytes
aaaaaattatgttcaa

SEQ ID NO: 180747 - DNA, 16 bp, P. troglodytes
aaaaaattatgtttca

SEQ ID NO: 180748 - DNA, 16 bp, P. troglodytes
aaaaaattattcagaa

SEQ ID NO: 180749 - DNA, 16 bp, P. troglodytes
aaaaaattcaaatgca

SEQ ID NO: 180750 - DNA, 16 bp, P. troglodytes
aaaaaattcctagaaa

SEQ ID NO: 180751 - DNA, 16 bp, P. troglodytes
aaaaaattcctggaaa

SEQ ID NO: 180752 - DNA, 16 bp, P. troglodytes
aaaaaattcctgtttt

SEQ ID NO: 180753 - DNA, 16 bp, P. troglodytes
aaaaaattctcttttc

SEQ ID NO: 180754 - DNA, 16 bp, P. troglodytes
aaaaaattctgttatt

SEQ ID NO: 180755 - DNA, 16 bp, P. troglodytes
aaaaaattctttgaaa

SEQ ID NO: 180756 - DNA, 16 bp, P. troglodytes
aaaaaattgaaaatct

SEQ ID NO: 180757 - DNA, 16 bp, P. troglodytes
aaaaaattgcaaatta

SEQ ID NO: 180758 - DNA, 16 bp, P. troglodytes
aaaaaattgcaacctc

SEQ ID NO: 180759 - DNA, 16 bp, P. troglodytes
aaaaaattgccgggcg

SEQ ID NO: 180760 - DNA, 16 bp, P. troglodytes
aaaaaattgctcctaa

SEQ ID NO: 180761 - DNA, 16 bp, P. troglodytes
aaaaaattggccgggc

SEQ ID NO: 180762 - DNA, 16 bp, P. troglodytes
aaaaaattgtcatttt

SEQ ID NO: 180763 - DNA, 16 bp, P. troglodytes
aaaaaattgtttccaa

SEQ ID NO: 180764 - DNA, 16 bp, P. troglodytes
aaaaaatttattttgc

SEQ ID NO: 180765 - DNA, 16 bp, P. troglodytes
aaaaaatttcagtaaa

SEQ ID NO: 180766 - DNA, 16 bp, P. troglodytes
aaaaaatttcatttca

SEQ ID NO: 180767 - DNA, 16 bp, P. troglodytes
aaaaaatttgaaatca

SEQ ID NO: 180768 - DNA, 16 bp, P. troglodytes
aaaaaatttgttttct

SEQ ID NO: 180769 - DNA, 16 bp, P. troglodytes
aaaaaattttacagaa

SEQ ID NO: 180770 - DNA, 16 bp, P. troglodytes
aaaaacaaaaccctgt

SEQ ID NO: 180771 - DNA, 16 bp, P. troglodytes
aaaaacaaaactcttt

SEQ ID NO: 180772 - DNA, 16 bp, P. troglodytes
aaaaacaaaagatgtt

SEQ ID NO: 180773 - DNA, 16 bp, P. troglodytes
aaaaacaaacatttgt

SEQ ID NO: 180774 - DNA, 16 bp, P. troglodytes
aaaaacaaaccctgaa

SEQ ID NO: 180775 - DNA, 16 bp, P. troglodytes
aaaaacaaagcctcca

SEQ ID NO: 180776 - DNA, 16 bp, P. troglodytes
aaaaacaaaggttttt

SEQ ID NO: 180777 - DNA, 16 bp, P. troglodytes
aaaaacaaatgttttt

SEQ ID NO: 180778 - DNA, 16 bp, P. troglodytes
aaaaacaacaaatctg

SEQ ID NO: 180779 - DNA, 16 bp, P. troglodytes
aaaaacaacacatttt

SEQ ID NO: 180780 - DNA, 16 bp, P. troglodytes
aaaaacaacttttatt

SEQ ID NO: 180781 - DNA, 20 bp, P. troglodytes
aaaaacaagaaatggggaaa

SEQ ID NO: 180782 - DNA, 16 bp, P. troglodytes
aaaaacaagaaattgg

SEQ ID NO: 180783 - DNA, 16 bp, P. troglodytes
aaaaacaagcaatccc

SEQ ID NO: 180784 - DNA, 20 bp, P. troglodytes
aaaaacaagcaatggggaaa

SEQ ID NO: 180785 - DNA, 16 bp, P. troglodytes
aaaaacaagttgacct

SEQ ID NO: 180786 - DNA, 16 bp, P. troglodytes
aaaaacaatatggagg

SEQ ID NO: 180787 - DNA, 16 bp, P. troglodytes
aaaaacaatcctgaaa

SEQ ID NO: 180788 - DNA, 16 bp, P. troglodytes
aaaaacaatgagatca

SEQ ID NO: 180789 - DNA, 16 bp, P. troglodytes
aaaaacaatgcaattt

SEQ ID NO: 180790 - DNA, 16 bp, P. troglodytes
aaaaacaatgtttaaa

SEQ ID NO: 180791 - DNA, 16 bp, P. troglodytes
aaaaacaatgtttttt

SEQ ID NO: 180792 - DNA, 16 bp, P. troglodytes
aaaaacaattttcttt

SEQ ID NO: 180793 - DNA, 16 bp, P. troglodytes
aaaaacaatttttgtt

SEQ ID NO: 180794 - DNA, 16 bp, P. troglodytes
aaaaacaatttttttc

SEQ ID NO: 180795 - DNA, 16 bp, P. troglodytes
aaaaacacaactgatt

SEQ ID NO: 180796 - DNA, 16 bp, P. troglodytes
aaaaacacattatttt

SEQ ID NO: 180797 - DNA, 16 bp, P. troglodytes
aaaaacactgaatttt

SEQ ID NO: 180798 - DNA, 16 bp, P. troglodytes
aaaaacactttgggag

SEQ ID NO: 180799 - DNA, 16 bp, P. troglodytes
aaaaacagaataattt

SEQ ID NO: 180800 - DNA, 16 bp, P. troglodytes
aaaaacagaatatttt

SEQ ID NO: 180801 - DNA, 16 bp, P. troglodytes
aaaaacagacatgtag

SEQ ID NO: 180802 - DNA, 16 bp, P. troglodytes
aaaaacagatatttta

SEQ ID NO: 180803 - DNA, 16 bp, P. troglodytes
aaaaacagatttgaaa

SEQ ID NO: 180804 - DNA, 16 bp, P. troglodytes
aaaaacagtagatatt

SEQ ID NO: 180805 - DNA, 16 bp, P. troglodytes
aaaaacagtatatttt

SEQ ID NO: 180806 - DNA, 16 bp, P. troglodytes
aaaaacagtgtttcaa

SEQ ID NO: 180807 - DNA, 16 bp, P. troglodytes
aaaaacagtttggcag

SEQ ID NO: 180808 - DNA, 16 bp, P. troglodytes
aaaaacagttttaaaa

SEQ ID NO: 180809 - DNA, 16 bp, P. troglodytes
aaaaacatattttgat

SEQ ID NO: 180810 - DNA, 16 bp, P. troglodytes
aaaaacatgacaaatt

SEQ ID NO: 180811 - DNA, 16 bp, P. troglodytes
aaaaacatgacctcac

SEQ ID NO: 180812 - DNA, 16 bp, P. troglodytes
aaaaacatggaaatta

SEQ ID NO: 180813 - DNA, 16 bp, P. troglodytes
aaaaacatggaatcaa

SEQ ID NO: 180814 - DNA, 16 bp, P. troglodytes
aaaaacatggtttgag

SEQ ID NO: 180815 - DNA, 16 bp, P. troglodytes
aaaaacatgtttcttt

SEQ ID NO: 180816 - DNA, 16 bp, P. troglodytes
aaaaacattcagtaaa

SEQ ID NO: 180817 - DNA, 16 bp, P. troglodytes
aaaaacattgtttcca

SEQ ID NO: 180818 - DNA, 16 bp, P. troglodytes
aaaaacatttaacttt

SEQ ID NO: 180819 - DNA, 16 bp, P. troglodytes
aaaaacatttcagaaa

SEQ ID NO: 180820 - DNA, 16 bp, P. troglodytes
aaaaacatttctcttt

SEQ ID NO: 180821 - DNA, 16 bp, P. troglodytes
aaaaacatttgatttt

SEQ ID NO: 180822 - DNA, 16 bp, P. troglodytes
aaaaacattttaagaa

SEQ ID NO: 180823 - DNA, 16 bp, P. troglodytes
aaaaacattttctaag

SEQ ID NO: 180824 - DNA, 16 bp, P. troglodytes
aaaaaccacaatgaga

SEQ ID NO: 180825 - DNA, 16 bp, P. troglodytes
aaaaaccacatgatca

SEQ ID NO: 180826 - DNA, 16 bp, P. troglodytes
aaaaaccactgaactg

SEQ ID NO: 180827 - DNA, 16 bp, P. troglodytes
aaaaaccagccaggca

SEQ ID NO: 180828 - DNA, 16 bp, P. troglodytes
aaaaaccaggctgggc

SEQ ID NO: 180829 - DNA, 16 bp, P. troglodytes
aaaaaccagtgcaaaa

SEQ ID NO: 180830 - DNA, 16 bp, P. troglodytes
aaaaaccattgaattg

SEQ ID NO: 180831 - DNA, 16 bp, P. troglodytes
aaaaacccaacttttt

SEQ ID NO: 180832 - DNA, 16 bp, P. troglodytes
aaaaacccacacattt

SEQ ID NO: 180833 - DNA, 16 bp, P. troglodytes
aaaaaccccatctcta

SEQ ID NO: 180834 - DNA, 16 bp, P. troglodytes
aaaaaccctggaaggc

SEQ ID NO: 180835 - DNA, 16 bp, P. troglodytes
aaaaaccctgtctcta

SEQ ID NO: 180836 - DNA, 16 bp, P. troglodytes
aaaaacctattttttt

SEQ ID NO: 180837 - DNA, 16 bp, P. troglodytes
aaaaacctggcagaga

SEQ ID NO: 180838 - DNA, 16 bp, P. troglodytes
aaaaaccttttatttt

SEQ ID NO: 180839 - DNA, 16 bp, P. troglodytes
aaaaacgttttttaaa

SEQ ID NO: 180840 - DNA, 16 bp, P. troglodytes
aaaaactacaaattgg

SEQ ID NO: 180841 - DNA, 16 bp, P. troglodytes
aaaaactaggaataga

SEQ ID NO: 180842 - DNA, 16 bp, P. troglodytes
aaaaactattgggtac

SEQ ID NO: 180843 - DNA, 16 bp, P. troglodytes
aaaaactattttaaga

SEQ ID NO: 180844 - DNA, 16 bp, P. troglodytes
aaaaactcctgcagct

SEQ ID NO: 180845 - DNA, 16 bp, P. troglodytes
aaaaactctagaagaa

SEQ ID NO: 180846 - DNA, 16 bp, P. troglodytes
aaaaactctcagaaaa

SEQ ID NO: 180847 - DNA, 16 bp, P. troglodytes
aaaaactctcagcaaa

SEQ ID NO: 180848 - DNA, 16 bp, P. troglodytes
aaaaactgaaataatt

SEQ ID NO: 180849 - DNA, 16 bp, P. troglodytes
aaaaactgaagaattt

SEQ ID NO: 180850 - DNA, 16 bp, P. troglodytes
aaaaactgaataattt

SEQ ID NO: 180851 - DNA, 16 bp, P. troglodytes
aaaaactgaattttta

SEQ ID NO: 180852 - DNA, 16 bp, P. troglodytes
aaaaactgactttaaa

SEQ ID NO: 180853 - DNA, 21 bp, P. troglodytes
aaaaactgagggaactcagag

SEQ ID NO: 180854 - DNA, 16 bp, P. troglodytes
aaaaactgatagaaat

SEQ ID NO: 180855 - DNA, 16 bp, P. troglodytes
aaaaactgccaaccaa

SEQ ID NO: 180856 - DNA, 16 bp, P. troglodytes
aaaaactgctttaaat

SEQ ID NO: 180857 - DNA, 16 bp, P. troglodytes
aaaaactggaaactaa

SEQ ID NO: 180858 - DNA, 16 bp, P. troglodytes
aaaaactggaaagaat

SEQ ID NO: 180859 - DNA, 16 bp, P. troglodytes
aaaaactggaaataac

SEQ ID NO: 180860 - DNA, 16 bp, P. troglodytes
aaaaactggaaattct

SEQ ID NO: 180861 - DNA, 16 bp, P. troglodytes
aaaaactggaagaatt

SEQ ID NO: 180862 - DNA, 16 bp, P. troglodytes
aaaaactggaaggaaa

SEQ ID NO: 180863 - DNA, 16 bp, P. troglodytes
aaaaactggagaaaat

SEQ ID NO: 180864 - DNA, 16 bp, P. troglodytes
aaaaactggatattca

SEQ ID NO: 180865 - DNA, 16 bp, P. troglodytes
aaaaactgggcaaagg

SEQ ID NO: 180866 - DNA, 16 bp, P. troglodytes
aaaaactggtaaaatc

SEQ ID NO: 180867 - DNA, 16 bp, P. troglodytes
aaaaactgtatgatca

SEQ ID NO: 180868 - DNA, 16 bp, P. troglodytes
aaaaactgtattattt

SEQ ID NO: 180869 - DNA, 16 bp, P. troglodytes
aaaaactgtgagtgcc

SEQ ID NO: 180870 - DNA, 16 bp, P. troglodytes
aaaaactgttttcttt

SEQ ID NO: 180871 - DNA, 16 bp, P. troglodytes
aaaaacttaaaaatgg

SEQ ID NO: 180872 - DNA, 16 bp, P. troglodytes
aaaaacttagaaatat

SEQ ID NO: 180873 - DNA, 16 bp, P. troglodytes
aaaaacttatccatgt

SEQ ID NO: 180874 - DNA, 16 bp, P. troglodytes
aaaaacttcagacaaa

SEQ ID NO: 180875 - DNA, 16 bp, P. troglodytes
aaaaacttcagccgaa

SEQ ID NO: 180876 - DNA, 16 bp, P. troglodytes
aaaaacttctgatttt

SEQ ID NO: 180877 - DNA, 16 bp, P. troglodytes
aaaaacttctgttcat

SEQ ID NO: 180878 - DNA, 16 bp, P. troglodytes
aaaaacttcttatttt

SEQ ID NO: 180879 - DNA, 16 bp, P. troglodytes
aaaaacttgaaagaag

SEQ ID NO: 180880 - DNA, 16 bp, P. troglodytes
aaaaacttgctttatg

SEQ ID NO: 180881 - DNA, 16 bp, P. troglodytes
aaaaacttggaaaata

SEQ ID NO: 180882 - DNA, 16 bp, P. troglodytes
aaaaactttcattttt

SEQ ID NO: 180883 - DNA, 16 bp, P. troglodytes
aaaaactttgaaatat

SEQ ID NO: 180884 - DNA, 16 bp, P. troglodytes
aaaaactttgttttgt

SEQ ID NO: 180885 - DNA, 16 bp, P. troglodytes
aaaaacttttagaact

SEQ ID NO: 180886 - DNA, 16 bp, P. troglodytes
aaaaactttttgtaga

SEQ ID NO: 180887 - DNA, 16 bp, P. troglodytes
aaaaacttttttcatt

SEQ ID NO: 180888 - DNA, 16 bp, P. troglodytes
aaaaagaaaaactgct

SEQ ID NO: 180889 - DNA, 16 bp, P. troglodytes
aaaaagaaaacttcag

SEQ ID NO: 180890 - DNA, 16 bp, P. troglodytes
aaaaagaaaactttag

SEQ ID NO: 180891 - DNA, 16 bp, P. troglodytes
aaaaagaaaagattct

SEQ ID NO: 180892 - DNA, 16 bp, P. troglodytes
aaaaagaaaagcttct

SEQ ID NO: 180893 - DNA, 16 bp, P. troglodytes
aaaaagaaaaggctgg

SEQ ID NO: 180894 - DNA, 16 bp, P. troglodytes
aaaaagaaaagtctat

SEQ ID NO: 180895 - DNA, 16 bp, P. troglodytes
aaaaagaaaatcagct

SEQ ID NO: 180896 - DNA, 16 bp, P. troglodytes
aaaaagaaaatcattt

SEQ ID NO: 180897 - DNA, 16 bp, P. troglodytes
aaaaagaaaatccagg

SEQ ID NO: 180898 - DNA, 16 bp, P. troglodytes
aaaaagaaaatcctca

SEQ ID NO: 180899 - DNA, 16 bp, P. troglodytes
aaaaagaaaatcttta

SEQ ID NO: 180900 - DNA, 16 bp, P. troglodytes
aaaaagaaaatgactt

SEQ ID NO: 180901 - DNA, 16 bp, P. troglodytes
aaaaagaaaattccag

SEQ ID NO: 180902 - DNA, 16 bp, P. troglodytes
aaaaagaaaccctata

SEQ ID NO: 180903 - DNA, 16 bp, P. troglodytes
aaaaagaaactcattt

SEQ ID NO: 180904 - DNA, 16 bp, P. troglodytes
aaaaagaaactctgta

SEQ ID NO: 180905 - DNA, 16 bp, P. troglodytes
aaaaagaaactgagat

SEQ ID NO: 180906 - DNA, 16 bp, P. troglodytes
aaaaagaaacttttct

SEQ ID NO: 180907 - DNA, 16 bp, P. troglodytes
aaaaagaaagaactct

SEQ ID NO: 180908 - DNA, 16 bp, P. troglodytes
aaaaagaaagacttca

SEQ ID NO: 180909 - DNA, 16 bp, P. troglodytes
aaaaagaaagcttttt

SEQ ID NO: 180910 - DNA, 16 bp, P. troglodytes
aaaaagaaaggcattt

SEQ ID NO: 180911 - DNA, 16 bp, P. troglodytes
aaaaagaaatactttt

SEQ ID NO: 180912 - DNA, 16 bp, P. troglodytes
aaaaagaaatatctca

SEQ ID NO: 180913 - DNA, 16 bp, P. troglodytes
aaaaagaaatatttca

SEQ ID NO: 180914 - DNA, 16 bp, P. troglodytes
aaaaagaaatatttct

SEQ ID NO: 180915 - DNA, 16 bp, P. troglodytes
aaaaagaaatcacatt

SEQ ID NO: 180916 - DNA, 16 bp, P. troglodytes
aaaaagaaatcactga

SEQ ID NO: 180917 - DNA, 16 bp, P. troglodytes
aaaaagaaatcatgtc

SEQ ID NO: 180918 - DNA, 16 bp, P. troglodytes
aaaaagaaatgagatc

SEQ ID NO: 180919 - DNA, 16 bp, P. troglodytes
aaaaagaaatgcaagt

SEQ ID NO: 180920 - DNA, 16 bp, P. troglodytes
aaaaagaaatgctaca

SEQ ID NO: 180921 - DNA, 16 bp, P. troglodytes
aaaaagaaatgctttc

SEQ ID NO: 180922 - DNA, 16 bp, P. troglodytes
aaaaagaaatggggtc

SEQ ID NO: 180923 - DNA, 16 bp, P. troglodytes
aaaaagaaatgtttca

SEQ ID NO: 180924 - DNA, 16 bp, P. troglodytes
aaaaagaaatgttttt

SEQ ID NO: 180925 - DNA, 16 bp, P. troglodytes
aaaaagaaattcagga

SEQ ID NO: 180926 - DNA, 16 bp, P. troglodytes
aaaaagaaattctgtt

SEQ ID NO: 180927 - DNA, 16 bp, P. troglodytes
aaaaagaaattgtttt

SEQ ID NO: 180928 - DNA, 16 bp, P. troglodytes
aaaaagaaatttgcaa

SEQ ID NO: 180929 - DNA, 16 bp, P. troglodytes
aaaaagaaatttttgt

SEQ ID NO: 180930 - DNA, 16 bp, P. troglodytes
aaaaagaacaaagctg

SEQ ID NO: 180931 - DNA, 16 bp, P. troglodytes
aaaaagaacctgaata

SEQ ID NO: 180932 - DNA, 16 bp, P. troglodytes
aaaaagaacttcagag

SEQ ID NO: 180933 - DNA, 16 bp, P. troglodytes
aaaaagaactttttaa

SEQ ID NO: 180934 - DNA, 16 bp, P. troglodytes
aaaaagaagaaatctg

SEQ ID NO: 180935 - DNA, 16 bp, P. troglodytes
aaaaagaagacattat

SEQ ID NO: 180936 - DNA, 16 bp, P. troglodytes
aaaaagaagagctggt

SEQ ID NO: 180937 - DNA, 16 bp, P. troglodytes
aaaaagaaggaatcct

SEQ ID NO: 180938 - DNA, 16 bp, P. troglodytes
aaaaagaatacatact

SEQ ID NO: 180939 - DNA, 16 bp, P. troglodytes
aaaaagaatcattttg

SEQ ID NO: 180940 - DNA, 16 bp, P. troglodytes
aaaaagaatgaactac

SEQ ID NO: 180941 - DNA, 16 bp, P. troglodytes
aaaaagaatgacatcc

SEQ ID NO: 180942 - DNA, 16 bp, P. troglodytes
aaaaagaatgtcattt

SEQ ID NO: 180943 - DNA, 16 bp, P. troglodytes
aaaaagaattattctt

SEQ ID NO: 180944 - DNA, 16 bp, P. troglodytes
aaaaagaattcatttt

SEQ ID NO: 180945 - DNA, 16 bp, P. troglodytes
aaaaagaattttctca

SEQ ID NO: 180946 - DNA, 16 bp, P. troglodytes
aaaaagacaaatttca

SEQ ID NO: 180947 - DNA, 16 bp, P. troglodytes
aaaaagacacttgtac

SEQ ID NO: 180948 - DNA, 16 bp, P. troglodytes
aaaaagacatccaaat

SEQ ID NO: 180949 - DNA, 16 bp, P. troglodytes
aaaaagacatttttga

SEQ ID NO: 180950 - DNA, 16 bp, P. troglodytes
aaaaagactatatttt

SEQ ID NO: 180951 - DNA, 16 bp, P. troglodytes
aaaaagactgaaagag

SEQ ID NO: 180952 - DNA, 16 bp, P. troglodytes
aaaaagactgttttca

SEQ ID NO: 180953 - DNA, 16 bp, P. troglodytes
aaaaagacttcatttt

SEQ ID NO: 180954 - DNA, 16 bp, P. troglodytes
aaaaagactttaaaac

SEQ ID NO: 180955 - DNA, 16 bp, P. troglodytes
aaaaagagaaagatct

SEQ ID NO: 180956 - DNA, 16 bp, P. troglodytes
aaaaagagaccaaggc

SEQ ID NO: 180957 - DNA, 16 bp, P. troglodytes
aaaaagagcccaggac

SEQ ID NO: 180958 - DNA, 16 bp, P. troglodytes
aaaaagaggcagctca

SEQ ID NO: 180959 - DNA, 16 bp, P. troglodytes
aaaaagagtttatttt

SEQ ID NO: 180960 - DNA, 16 bp, P. troglodytes
aaaaagagtttcaaaa

SEQ ID NO: 180961 - DNA, 16 bp, P. troglodytes
aaaaagataaaatctt

SEQ ID NO: 180962 - DNA, 16 bp, P. troglodytes
aaaaagatacctgcac

SEQ ID NO: 180963 - DNA, 16 bp, P. troglodytes
aaaaagatatttcaaa

SEQ ID NO: 180964 - DNA, 16 bp, P. troglodytes
aaaaagatatttcata

SEQ ID NO: 180965 - DNA, 16 bp, P. troglodytes
aaaaagatattttcct

SEQ ID NO: 180966 - DNA, 16 bp, P. troglodytes
aaaaagatcaaaattc

SEQ ID NO: 180967 - DNA, 16 bp, P. troglodytes
aaaaagatcagtgttt

SEQ ID NO: 180968 - DNA, 16 bp, P. troglodytes
aaaaagatcctgaata

SEQ ID NO: 180969 - DNA, 16 bp, P. troglodytes
aaaaagatgctcaaaa

SEQ ID NO: 180970 - DNA, 16 bp, P. troglodytes
aaaaagatgctcagca

SEQ ID NO: 180971 - DNA, 16 bp, P. troglodytes
aaaaagatgttcaata

SEQ ID NO: 180972 - DNA, 16 bp, P. troglodytes
aaaaagattcttttca

SEQ ID NO: 180973 - DNA, 16 bp, P. troglodytes
aaaaagattttgtttt

SEQ ID NO: 180974 - DNA, 16 bp, P. troglodytes
aaaaagcaaaactgtg

SEQ ID NO: 180975 - DNA, 16 bp, P. troglodytes
aaaaagcaaaatggca

SEQ ID NO: 180976 - DNA, 16 bp, P. troglodytes
aaaaagcaatattttt

SEQ ID NO: 180977 - DNA, 16 bp, P. troglodytes
aaaaagcaatcctaaa

SEQ ID NO: 180978 - DNA, 16 bp, P. troglodytes
aaaaagcagaactact

SEQ ID NO: 180979 - DNA, 16 bp, P. troglodytes
aaaaagcagcagcagc

SEQ ID NO: 180980 - DNA, 16 bp, P. troglodytes
aaaaagcaggaaagat

SEQ ID NO: 180981 - DNA, 16 bp, P. troglodytes
aaaaagcaggcaacat

SEQ ID NO: 180982 - DNA, 16 bp, P. troglodytes
aaaaagcatatttaaa

SEQ ID NO: 180983 - DNA, 16 bp, P. troglodytes
aaaaagcattattaaa

SEQ ID NO: 180984 - DNA, 16 bp, P. troglodytes
aaaaagcatttaataa

SEQ ID NO: 180985 - DNA, 16 bp, P. troglodytes
aaaaagcatttatttt

SEQ ID NO: 180986 - DNA, 16 bp, P. troglodytes
aaaaagcattttgaaa

SEQ ID NO: 180987 - DNA, 16 bp, P. troglodytes
aaaaagccaaactcat

SEQ ID NO: 180988 - DNA, 16 bp, P. troglodytes
aaaaagccagacatgg

SEQ ID NO: 180989 - DNA, 16 bp, P. troglodytes
aaaaagccagatgtgg

SEQ ID NO: 180990 - DNA, 16 bp, P. troglodytes
aaaaagccaggtgcag

SEQ ID NO: 180991 - DNA, 16 bp, P. troglodytes
aaaaagccagtcacaa

SEQ ID NO: 180992 - DNA, 16 bp, P. troglodytes
aaaaagcctttttaaa

SEQ ID NO: 180993 - DNA, 16 bp, P. troglodytes
aaaaagctacctattg

SEQ ID NO: 180994 - DNA, 16 bp, P. troglodytes
aaaaagctagttcttt

SEQ ID NO: 180995 - DNA, 16 bp, P. troglodytes
aaaaagctcaacataa

SEQ ID NO: 180996 - DNA, 16 bp, P. troglodytes
aaaaagctcaacatca

SEQ ID NO: 180997 - DNA, 16 bp, P. troglodytes
aaaaagctcaatatta

SEQ ID NO: 180998 - DNA, 16 bp, P. troglodytes
aaaaagctcaccatca

SEQ ID NO: 180999 - DNA, 16 bp, P. troglodytes
aaaaagctggaaacaa

SEQ ID NO: 181000 - DNA, 16 bp, P. troglodytes
aaaaagctttataaaa

SEQ ID NO: 181001 - DNA, 16 bp, P. troglodytes
aaaaagctttatattt

SEQ ID NO: 181002 - DNA, 16 bp, P. troglodytes
aaaaaggaaaatttgg

SEQ ID NO: 181003 - DNA, 16 bp, P. troglodytes
aaaaaggaaacttcag

SEQ ID NO: 181004 - DNA, 16 bp, P. troglodytes
aaaaaggaaagacatt

SEQ ID NO: 181005 - DNA, 16 bp, P. troglodytes
aaaaaggaaatgacag

SEQ ID NO: 181006 - DNA, 16 bp, P. troglodytes
aaaaaggaaatgtctt

SEQ ID NO: 181007 - DNA, 16 bp, P. troglodytes
aaaaaggaaattctgc

SEQ ID NO: 181008 - DNA, 16 bp, P. troglodytes
aaaaaggaatgacatc

SEQ ID NO: 181009 - DNA, 16 bp, P. troglodytes
aaaaaggaatttattg

SEQ ID NO: 181010 - DNA, 16 bp, P. troglodytes
aaaaaggaattttttt

SEQ ID NO: 181011 - DNA, 16 bp, P. troglodytes
aaaaaggagaaactga

SEQ ID NO: 181012 - DNA, 16 bp, P. troglodytes
aaaaaggagatattat

SEQ ID NO: 181013 - DNA, 16 bp, P. troglodytes
aaaaaggagccaggca

SEQ ID NO: 181014 - DNA, 16 bp, P. troglodytes
aaaaaggagctcaaat

SEQ ID NO: 181015 - DNA, 16 bp, P. troglodytes
aaaaaggaggagttca

SEQ ID NO: 181016 - DNA, 16 bp, P. troglodytes
aaaaaggagtgcttaa

SEQ ID NO: 181017 - DNA, 16 bp, P. troglodytes
aaaaaggatgagtttg

SEQ ID NO: 181018 - DNA, 16 bp, P. troglodytes
aaaaaggcaaaattat

SEQ ID NO: 181019 - DNA, 16 bp, P. troglodytes
aaaaaggcaaataatg

SEQ ID NO: 181020 - DNA, 16 bp, P. troglodytes
aaaaaggcaaatgaca

SEQ ID NO: 181021 - DNA, 16 bp, P. troglodytes
aaaaaggcagaaaatg

SEQ ID NO: 181022 - DNA, 16 bp, P. troglodytes
aaaaaggcaggaaaat

SEQ ID NO: 181023 - DNA, 16 bp, P. troglodytes
aaaaaggcatttaaaa

SEQ ID NO: 181024 - DNA, 16 bp, P. troglodytes
aaaaaggctggggact

SEQ ID NO: 181025 - DNA, 16 bp, P. troglodytes
aaaaagggaaaatgtt

SEQ ID NO: 181026 - DNA, 16 bp, P. troglodytes
aaaaagggaaattttt

SEQ ID NO: 181027 - DNA, 16 bp, P. troglodytes
aaaaagggaatcctcc

SEQ ID NO: 181028 - DNA, 16 bp, P. troglodytes
aaaaagggaatccttt

SEQ ID NO: 181029 - DNA, 16 bp, P. troglodytes
aaaaagggggaatttt

SEQ ID NO: 181030 - DNA, 16 bp, P. troglodytes
aaaaaggtattttatt

SEQ ID NO: 181031 - DNA, 16 bp, P. troglodytes
aaaaaggtcatggtca

SEQ ID NO: 181032 - DNA, 16 bp, P. troglodytes
aaaaaggtcattatat

SEQ ID NO: 181033 - DNA, 16 bp, P. troglodytes
aaaaaggtttatttgg

SEQ ID NO: 181034 - DNA, 16 bp, P. troglodytes
aaaaagtaaaatcttt

SEQ ID NO: 181035 - DNA, 16 bp, P. troglodytes
aaaaagtaaacaactt

SEQ ID NO: 181036 - DNA, 16 bp, P. troglodytes
aaaaagtaaatatctt

SEQ ID NO: 181037 - DNA, 16 bp, P. troglodytes
aaaaagtaatcatttt

SEQ ID NO: 181038 - DNA, 16 bp, P. troglodytes
aaaaagtactaaaatt

SEQ ID NO: 181039 - DNA, 16 bp, P. troglodytes
aaaaagtactttaaag

SEQ ID NO: 181040 - DNA, 16 bp, P. troglodytes
aaaaagtagccaggca

SEQ ID NO: 181041 - DNA, 16 bp, P. troglodytes
aaaaagtagctgagtg

SEQ ID NO: 181042 - DNA, 16 bp, P. troglodytes
aaaaagtaggccgggc

SEQ ID NO: 181043 - DNA, 16 bp, P. troglodytes
aaaaagtataaaactc

SEQ ID NO: 181044 - DNA, 16 bp, P. troglodytes
aaaaagtattcaaaat

SEQ ID NO: 181045 - DNA, 16 bp, P. troglodytes
aaaaagtatttctttt

SEQ ID NO: 181046 - DNA, 16 bp, P. troglodytes
aaaaagtattttcaaa

SEQ ID NO: 181047 - DNA, 16 bp, P. troglodytes
aaaaagtatttttcaa

SEQ ID NO: 181048 - DNA, 16 bp, P. troglodytes
aaaaagtattttttca

SEQ ID NO: 181049 - DNA, 16 bp, P. troglodytes
aaaaagtcaaaattca

SEQ ID NO: 181050 - DNA, 16 bp, P. troglodytes
aaaaagtcataaaatt

SEQ ID NO: 181051 - DNA, 16 bp, P. troglodytes
aaaaagtcattttttt

SEQ ID NO: 181052 - DNA, 16 bp, P. troglodytes
aaaaagtctccagaga

SEQ ID NO: 181053 - DNA, 16 bp, P. troglodytes
aaaaagtctgtatttt

SEQ ID NO: 181054 - DNA, 16 bp, P. troglodytes
aaaaagtcttcaaaat

SEQ ID NO: 181055 - DNA, 16 bp, P. troglodytes
aaaaagtgaaatgtat

SEQ ID NO: 181056 - DNA, 16 bp, P. troglodytes
aaaaagtgagcaaaga

SEQ ID NO: 181057 - DNA, 16 bp, P. troglodytes
aaaaagtgattttttt

SEQ ID NO: 181058 - DNA, 16 bp, P. troglodytes
aaaaagtgcaaggttt

SEQ ID NO: 181059 - DNA, 16 bp, P. troglodytes
aaaaagtgcagcttgc

SEQ ID NO: 181060 - DNA, 16 bp, P. troglodytes
aaaaagtgtattttaa

SEQ ID NO: 181061 - DNA, 16 bp, P. troglodytes
aaaaagtgttttttct

SEQ ID NO: 181062 - DNA, 16 bp, P. troglodytes
aaaaagttacaaagat

SEQ ID NO: 181063 - DNA, 16 bp, P. troglodytes
aaaaagttagccaggc

SEQ ID NO: 181064 - DNA, 16 bp, P. troglodytes
aaaaagttagctgggg

SEQ ID NO: 181065 - DNA, 16 bp, P. troglodytes
aaaaagttatttacaa

SEQ ID NO: 181066 - DNA, 16 bp, P. troglodytes
aaaaagttattttcca

SEQ ID NO: 181067 - DNA, 16 bp, P. troglodytes
aaaaagttcatagaaa

SEQ ID NO: 181068 - DNA, 16 bp, P. troglodytes
aaaaagttctattttt

SEQ ID NO: 181069 - DNA, 16 bp, P. troglodytes
aaaaagttctttgaaa

SEQ ID NO: 181070 - DNA, 16 bp, P. troglodytes
aaaaagttgaaaactt

SEQ ID NO: 181071 - DNA, 16 bp, P. troglodytes
aaaaagttgaaagctt

SEQ ID NO: 181072 - DNA, 16 bp, P. troglodytes
aaaaagttgacctcat

SEQ ID NO: 181073 - DNA, 16 bp, P. troglodytes
aaaaagttgacttttt

SEQ ID NO: 181074 - DNA, 16 bp, P. troglodytes
aaaaagttgccttttg

SEQ ID NO: 181075 - DNA, 16 bp, P. troglodytes
aaaaagtttattttga

SEQ ID NO: 181076 - DNA, 16 bp, P. troglodytes
aaaaagtttctgcaca

SEQ ID NO: 181077 - DNA, 16 bp, P. troglodytes
aaaaagtttcttttct

SEQ ID NO: 181078 - DNA, 16 bp, P. troglodytes
aaaaagttttagtttt

SEQ ID NO: 181079 - DNA, 16 bp, P. troglodytes
aaaaagttttcaaata

SEQ ID NO: 181080 - DNA, 16 bp, P. troglodytes
aaaaagttttcaaatt

SEQ ID NO: 181081 - DNA, 16 bp, P. troglodytes
aaaaagttttcaataa

SEQ ID NO: 181082 - DNA, 16 bp, P. troglodytes
aaaaataaaaatggct

SEQ ID NO: 181083 - DNA, 16 bp, P. troglodytes
aaaaataaaaccctga

SEQ ID NO: 181084 - DNA, 16 bp, P. troglodytes
aaaaataaaacttgtt

SEQ ID NO: 181085 - DNA, 16 bp, P. troglodytes
aaaaataaaatccttc

SEQ ID NO: 181086 - DNA, 16 bp, P. troglodytes
aaaaataaaatgtgtg

SEQ ID NO: 181087 - DNA, 16 bp, P. troglodytes
aaaaataaactgttaa

SEQ ID NO: 181088 - DNA, 16 bp, P. troglodytes
aaaaataaagattctg

SEQ ID NO: 181089 - DNA, 16 bp, P. troglodytes
aaaaataaagctgaat

SEQ ID NO: 181090 - DNA, 16 bp, P. troglodytes
aaaaataaagtgtttt

SEQ ID NO: 181091 - DNA, 16 bp, P. troglodytes
aaaaataaagttttgt

SEQ ID NO: 181092 - DNA, 16 bp, P. troglodytes
aaaaataaatagcttt

SEQ ID NO: 181093 - DNA, 16 bp, P. troglodytes
aaaaataaatgagcta

SEQ ID NO: 181094 - DNA, 16 bp, P. troglodytes
aaaaataaatgcttaa

SEQ ID NO: 181095 - DNA, 16 bp, P. troglodytes
aaaaataaatgtaact

SEQ ID NO: 181096 - DNA, 16 bp, P. troglodytes
aaaaataaatgtacag

SEQ ID NO: 181097 - DNA, 16 bp, P. troglodytes
aaaaataaatgtacat

SEQ ID NO: 181098 - DNA, 16 bp, P. troglodytes
aaaaataaatgtcata

SEQ ID NO: 181099 - DNA, 16 bp, P. troglodytes
aaaaataaatgtgtca

SEQ ID NO: 181100 - DNA, 16 bp, P. troglodytes
aaaaataaattcagtg

SEQ ID NO: 181101 - DNA, 16 bp, P. troglodytes
aaaaataaattggact

SEQ ID NO: 181102 - DNA, 16 bp, P. troglodytes
aaaaataaatttggct

SEQ ID NO: 181103 - DNA, 16 bp, P. troglodytes
aaaaataacaggtgct

SEQ ID NO: 181104 - DNA, 16 bp, P. troglodytes
aaaaataacatgaatt

SEQ ID NO: 181105 - DNA, 16 bp, P. troglodytes
aaaaataaccttttta

SEQ ID NO: 181106 - DNA, 16 bp, P. troglodytes
aaaaataagaatttca

SEQ ID NO: 181107 - DNA, 16 bp, P. troglodytes
aaaaataagacatttt

SEQ ID NO: 181108 - DNA, 16 bp, P. troglodytes
aaaaataagagttttt

SEQ ID NO: 181109 - DNA, 16 bp, P. troglodytes
aaaaataagcattttt

SEQ ID NO: 181110 - DNA, 16 bp, P. troglodytes
aaaaataagctttatt

SEQ ID NO: 181111 - DNA, 16 bp, P. troglodytes
aaaaataagtagcatt

SEQ ID NO: 181112 - DNA, 16 bp, P. troglodytes
aaaaataagtcagaag

SEQ ID NO: 181113 - DNA, 16 bp, P. troglodytes
aaaaataagtctttaa

SEQ ID NO: 181114 - DNA, 16 bp, P. troglodytes
aaaaataatacatgct

SEQ ID NO: 181115 - DNA, 16 bp, P. troglodytes
aaaaataatcagtttt

SEQ ID NO: 181116 - DNA, 16 bp, P. troglodytes
aaaaataatgctgaca

SEQ ID NO: 181117 - DNA, 16 bp, P. troglodytes
aaaaataatggcataa

SEQ ID NO: 181118 - DNA, 16 bp, P. troglodytes
aaaaataattctgata

SEQ ID NO: 181119 - DNA, 16 bp, P. troglodytes
aaaaatacaaaggatc

SEQ ID NO: 181120 - DNA, 16 bp, P. troglodytes
aaaaatacaaaggtta

SEQ ID NO: 181121 - DNA, 16 bp, P. troglodytes
aaaaatacaaatatgt

SEQ ID NO: 181122 - DNA, 16 bp, P. troglodytes
aaaaatacaaatgact

SEQ ID NO: 181123 - DNA, 16 bp, P. troglodytes
aaaaatacaaccaagg

SEQ ID NO: 181124 - DNA, 16 bp, P. troglodytes
aaaaatacaagatgag

SEQ ID NO: 181125 - DNA, 16 bp, P. troglodytes
aaaaatacagaaagtt

SEQ ID NO: 181126 - DNA, 16 bp, P. troglodytes
aaaaatacagtattat

SEQ ID NO: 181127 - DNA, 16 bp, P. troglodytes
aaaaatacagtattta

SEQ ID NO: 181128 - DNA, 16 bp, P. troglodytes
aaaaatacagttacat

SEQ ID NO: 181129 - DNA, 16 bp, P. troglodytes
aaaaatacatatttct

SEQ ID NO: 181130 - DNA, 16 bp, P. troglodytes
aaaaatacatgatatt

SEQ ID NO: 181131 - DNA, 16 bp, P. troglodytes
aaaaatacatgtttat

SEQ ID NO: 181132 - DNA, 16 bp, P. troglodytes
aaaaatacatgttttt

SEQ ID NO: 181133 - DNA, 16 bp, P. troglodytes
aaaaatacatttcttt

SEQ ID NO: 181134 - DNA, 16 bp, P. troglodytes
aaaaatactcagcaaa

SEQ ID NO: 181135 - DNA, 16 bp, P. troglodytes
aaaaatactcattttt

SEQ ID NO: 181136 - DNA, 16 bp, P. troglodytes
aaaaatactgattttt

SEQ ID NO: 181137 - DNA, 16 bp, P. troglodytes
aaaaatactgtatttt

SEQ ID NO: 181138 - DNA, 16 bp, P. troglodytes
aaaaatacttgaagaa

SEQ ID NO: 181139 - DNA, 16 bp, P. troglodytes
aaaaatacttgcaaac

SEQ ID NO: 181140 - DNA, 16 bp, P. troglodytes
aaaaatactttctctt

SEQ ID NO: 181141 - DNA, 16 bp, P. troglodytes
aaaaatactttgtaaa

SEQ ID NO: 181142 - DNA, 16 bp, P. troglodytes
aaaaatagaatggttg

SEQ ID NO: 181143 - DNA, 16 bp, P. troglodytes
aaaaatagacatgtag

SEQ ID NO: 181144 - DNA, 16 bp, P. troglodytes
aaaaatagcattttct

SEQ ID NO: 181145 - DNA, 16 bp, P. troglodytes
aaaaatagccaggcgt

SEQ ID NO: 181146 - DNA, 16 bp, P. troglodytes
aaaaatagctttaaaa

SEQ ID NO: 181147 - DNA, 16 bp, P. troglodytes
aaaaatagctttattt

SEQ ID NO: 181148 - DNA, 16 bp, P. troglodytes
aaaaatagggctgggc

SEQ ID NO: 181149 - DNA, 16 bp, P. troglodytes
aaaaataggtaaattg

SEQ ID NO: 181150 - DNA, 16 bp, P. troglodytes
aaaaatataattctga

SEQ ID NO: 181151 - DNA, 16 bp, P. troglodytes
aaaaatatataaatgc

SEQ ID NO: 181152 - DNA, 16 bp, P. troglodytes
aaaaatatatattgct

SEQ ID NO: 181153 - DNA, 16 bp, P. troglodytes
aaaaatatattgcaaa

SEQ ID NO: 181154 - DNA, 16 bp, P. troglodytes
aaaaatatcttaaaga

SEQ ID NO: 181155 - DNA, 16 bp, P. troglodytes
aaaaatatctttagaa

SEQ ID NO: 181156 - DNA, 16 bp, P. troglodytes
aaaaatatgcaaatgt

SEQ ID NO: 181157 - DNA, 16 bp, P. troglodytes
aaaaatatgcatgtat

SEQ ID NO: 181158 - DNA, 16 bp, P. troglodytes
aaaaatatgctcaaaa

SEQ ID NO: 181159 - DNA, 16 bp, P. troglodytes
aaaaatatgcttattt

SEQ ID NO: 181160 - DNA, 16 bp, P. troglodytes
aaaaatatgctttaaa

SEQ ID NO: 181161 - DNA, 16 bp, P. troglodytes
aaaaatatggttttat

SEQ ID NO: 181162 - DNA, 16 bp, P. troglodytes
aaaaatatgtacaaat

SEQ ID NO: 181163 - DNA, 16 bp, P. troglodytes
aaaaatatgtatatgt

SEQ ID NO: 181164 - DNA, 16 bp, P. troglodytes
aaaaatatgtcttttt

SEQ ID NO: 181165 - DNA, 16 bp, P. troglodytes
aaaaatatgtgtatat

SEQ ID NO: 181166 - DNA, 16 bp, P. troglodytes
aaaaatatgttgaatt

SEQ ID NO: 181167 - DNA, 22 bp, P. troglodytes
aaaaatattaagggcagccaga

SEQ ID NO: 181168 - DNA, 16 bp, P. troglodytes
aaaaatattcaaagat

SEQ ID NO: 181169 - DNA, 16 bp, P. troglodytes
aaaaatattcaagtaa

SEQ ID NO: 181170 - DNA, 16 bp, P. troglodytes
aaaaatattcacattt

SEQ ID NO: 181171 - DNA, 16 bp, P. troglodytes
aaaaatattcagtttt

SEQ ID NO: 181172 - DNA, 16 bp, P. troglodytes
aaaaatatttcagaaa

SEQ ID NO: 181173 - DNA, 16 bp, P. troglodytes
aaaaatatttcatgaa

SEQ ID NO: 181174 - DNA, 16 bp, P. troglodytes
aaaaatatttcccaaa

SEQ ID NO: 181175 - DNA, 16 bp, P. troglodytes
aaaaatatttccccaa

SEQ ID NO: 181176 - DNA, 16 bp, P. troglodytes
aaaaatatttcctgtt

SEQ ID NO: 181177 - DNA, 16 bp, P. troglodytes
aaaaatatttccttca

SEQ ID NO: 181178 - DNA, 16 bp, P. troglodytes
aaaaatatttctgaaa

SEQ ID NO: 181179 - DNA, 16 bp, P. troglodytes
aaaaatatttgcaaga

SEQ ID NO: 181180 - DNA, 16 bp, P. troglodytes
aaaaatattttcctga

SEQ ID NO: 181181 - DNA, 16 bp, P. troglodytes
aaaaatattttctcta

SEQ ID NO: 181182 - DNA, 16 bp, P. troglodytes
aaaaatattttgagat

SEQ ID NO: 181183 - DNA, 16 bp, P. troglodytes
aaaaatatttttccaa

SEQ ID NO: 181184 - DNA, 16 bp, P. troglodytes
aaaaatcaagacattt

SEQ ID NO: 181185 - DNA, 16 bp, P. troglodytes
aaaaatcaataaagtt

SEQ ID NO: 181186 - DNA, 16 bp, P. troglodytes
aaaaatcaataccaag

SEQ ID NO: 181187 - DNA, 16 bp, P. troglodytes
aaaaatcaatcatttt

SEQ ID NO: 181188 - DNA, 16 bp, P. troglodytes
aaaaatcacaagcctt

SEQ ID NO: 181189 - DNA, 16 bp, P. troglodytes
aaaaatcacaagcttt

SEQ ID NO: 181190 - DNA, 16 bp, P. troglodytes
aaaaatcacaattttt

SEQ ID NO: 181191 - DNA, 16 bp, P. troglodytes
aaaaatcacagatatt

SEQ ID NO: 181192 - DNA, 16 bp, P. troglodytes
aaaaatcacaggcatt

SEQ ID NO: 181193 - DNA, 16 bp, P. troglodytes
aaaaatcacttttttt

SEQ ID NO: 181194 - DNA, 16 bp, P. troglodytes
aaaaatcagaatttaa

SEQ ID NO: 181195 - DNA, 17 bp, P. troglodytes
aaaaatcagagcttagt

SEQ ID NO: 181196 - DNA, 16 bp, P. troglodytes
aaaaatcagattattt

SEQ ID NO: 181197 - DNA, 16 bp, P. troglodytes
aaaaatcagatttagt

SEQ ID NO: 181198 - DNA, 16 bp, P. troglodytes
aaaaatcagtattatt

SEQ ID NO: 181199 - DNA, 16 bp, P. troglodytes
aaaaatcataaaactg

SEQ ID NO: 181200 - DNA, 16 bp, P. troglodytes
aaaaatcatgtgatca

SEQ ID NO: 181201 - DNA, 16 bp, P. troglodytes
aaaaatcattgaaatg

SEQ ID NO: 181202 - DNA, 16 bp, P. troglodytes
aaaaatccaaaaagtt

SEQ ID NO: 181203 - DNA, 16 bp, P. troglodytes
aaaaatccagaaaatt

SEQ ID NO: 181204 - DNA, 16 bp, P. troglodytes
aaaaatccatgcttca

SEQ ID NO: 181205 - DNA, 16 bp, P. troglodytes
aaaaatccattcatct

SEQ ID NO: 181206 - DNA, 16 bp, P. troglodytes
aaaaatcctcaaagaa

SEQ ID NO: 181207 - DNA, 16 bp, P. troglodytes
aaaaatcctgaacaaa

SEQ ID NO: 181208 - DNA, 16 bp, P. troglodytes
aaaaatccttaagaaa

SEQ ID NO: 181209 - DNA, 16 bp, P. troglodytes
aaaaatcgaggaggag

SEQ ID NO: 181210 - DNA, 16 bp, P. troglodytes
aaaaatctcaaggaaa

SEQ ID NO: 181211 - DNA, 16 bp, P. troglodytes
aaaaatctctgaaaaa

SEQ ID NO: 181212 - DNA, 16 bp, P. troglodytes
aaaaatctgaaaaact

SEQ ID NO: 181213 - DNA, 16 bp, P. troglodytes
aaaaatctgaaatcca

SEQ ID NO: 181214 - DNA, 16 bp, P. troglodytes
aaaaatctgaatttct

SEQ ID NO: 181215 - DNA, 16 bp, P. troglodytes
aaaaatctgatttttc

SEQ ID NO: 181216 - DNA, 16 bp, P. troglodytes
aaaaatctgcatataa

SEQ ID NO: 181217 - DNA, 16 bp, P. troglodytes
aaaaatctggaaaaat

SEQ ID NO: 181218 - DNA, 16 bp, P. troglodytes
aaaaatctgtatttca

SEQ ID NO: 181219 - DNA, 16 bp, P. troglodytes
aaaaatctgttctttt

SEQ ID NO: 181220 - DNA, 16 bp, P. troglodytes
aaaaatctgttttaaa

SEQ ID NO: 181221 - DNA, 16 bp, P. troglodytes
aaaaatcttataaatg

SEQ ID NO: 181222 - DNA, 16 bp, P. troglodytes
aaaaatcttcattttt

SEQ ID NO: 181223 - DNA, 16 bp, P. troglodytes
aaaaatcttgagaaaa

SEQ ID NO: 181224 - DNA, 16 bp, P. troglodytes
aaaaatcttggctggg

SEQ ID NO: 181225 - DNA, 16 bp, P. troglodytes
aaaaatgaaaaattct

SEQ ID NO: 181226 - DNA, 16 bp, P. troglodytes
aaaaatgaaaaccttt

SEQ ID NO: 181227 - DNA, 16 bp, P. troglodytes
aaaaatgaaaaggttt

SEQ ID NO: 181228 - DNA, 16 bp, P. troglodytes
aaaaatgaaacaattt

SEQ ID NO: 181229 - DNA, 16 bp, P. troglodytes
aaaaatgaaactagac

SEQ ID NO: 181230 - DNA, 16 bp, P. troglodytes
aaaaatgaaatgtgtt

SEQ ID NO: 181231 - DNA, 16 bp, P. troglodytes
aaaaatgaaattctta

SEQ ID NO: 181232 - DNA, 16 bp, P. troglodytes
aaaaatgaacaaatgg

SEQ ID NO: 181233 - DNA, 16 bp, P. troglodytes
aaaaatgaacttttaa

SEQ ID NO: 181234 - DNA, 16 bp, P. troglodytes
aaaaatgaagcaggga

SEQ ID NO: 181235 - DNA, 16 bp, P. troglodytes
aaaaatgaagctgaaa

SEQ ID NO: 181236 - DNA, 16 bp, P. troglodytes
aaaaatgaagtactga

SEQ ID NO: 181237 - DNA, 16 bp, P. troglodytes
aaaaatgaatattctg

SEQ ID NO: 181238 - DNA, 16 bp, P. troglodytes
aaaaatgaatattttg

SEQ ID NO: 181239 - DNA, 16 bp, P. troglodytes
aaaaatgaatgcaatt

SEQ ID NO: 181240 - DNA, 16 bp, P. troglodytes
aaaaatgacaaagatg

SEQ ID NO: 181241 - DNA, 16 bp, P. troglodytes
aaaaatgacactgata

SEQ ID NO: 181242 - DNA, 16 bp, P. troglodytes
aaaaatgacatatata

SEQ ID NO: 181243 - DNA, 16 bp, P. troglodytes
aaaaatgacattttat

SEQ ID NO: 181244 - DNA, 16 bp, P. troglodytes
aaaaatgactaaaatg

SEQ ID NO: 181245 - DNA, 16 bp, P. troglodytes
aaaaatgactttggta

SEQ ID NO: 181246 - DNA, 16 bp, P. troglodytes
aaaaatgagaacatgt

SEQ ID NO: 181247 - DNA, 16 bp, P. troglodytes
aaaaatgagaattttt

SEQ ID NO: 181248 - DNA, 16 bp, P. troglodytes
aaaaatgagccaaaga

SEQ ID NO: 181249 - DNA, 16 bp, P. troglodytes
aaaaatgagtattttt

SEQ ID NO: 181250 - DNA, 20 bp, P. troglodytes
aaaaatgatgaaggggatat

SEQ ID NO: 181251 - DNA, 16 bp, P. troglodytes
aaaaatgatttcttct

SEQ ID NO: 181252 - DNA, 16 bp, P. troglodytes
aaaaatgcaaaaagtt

SEQ ID NO: 181253 - DNA, 16 bp, P. troglodytes
aaaaatgcaaaatatt

SEQ ID NO: 181254 - DNA, 16 bp, P. troglodytes
aaaaatgcaaaatgtg

SEQ ID NO: 181255 - DNA, 16 bp, P. troglodytes
aaaaatgcaaaattta

SEQ ID NO: 181256 - DNA, 16 bp, P. troglodytes
aaaaatgcaataatta

SEQ ID NO: 181257 - DNA, 16 bp, P. troglodytes
aaaaatgcaattgaca

SEQ ID NO: 181258 - DNA, 16 bp, P. troglodytes
aaaaatgcaatttaaa

SEQ ID NO: 181259 - DNA, 16 bp, P. troglodytes
aaaaatgcacaaaagt

SEQ ID NO: 181260 - DNA, 16 bp, P. troglodytes
aaaaatgcacattttt

SEQ ID NO: 181261 - DNA, 16 bp, P. troglodytes
aaaaatgcagagaaat

SEQ ID NO: 181262 - DNA, 16 bp, P. troglodytes
aaaaatgcataatttt

SEQ ID NO: 181263 - DNA, 16 bp, P. troglodytes
aaaaatgcatatcaaa

SEQ ID NO: 181264 - DNA, 16 bp, P. troglodytes
aaaaatgcatgtattt

SEQ ID NO: 181265 - DNA, 16 bp, P. troglodytes
aaaaatgcattttaaa

SEQ ID NO: 181266 - DNA, 16 bp, P. troglodytes
aaaaatgcctttaaaa

SEQ ID NO: 181267 - DNA, 16 bp, P. troglodytes
aaaaatgctaaaatta

SEQ ID NO: 181268 - DNA, 16 bp, P. troglodytes
aaaaatgctaagggca

SEQ ID NO: 181269 - DNA, 16 bp, P. troglodytes
aaaaatgctcaacttc

SEQ ID NO: 181270 - DNA, 16 bp, P. troglodytes
aaaaatgctcaatatc

SEQ ID NO: 181271 - DNA, 16 bp, P. troglodytes
aaaaatgctcagaaaa

SEQ ID NO: 181272 - DNA, 16 bp, P. troglodytes
aaaaatgctccacatt

SEQ ID NO: 181273 - DNA, 16 bp, P. troglodytes
aaaaatgctgccagtc

SEQ ID NO: 181274 - DNA, 16 bp, P. troglodytes
aaaaatggaaaacatt

SEQ ID NO: 181275 - DNA, 16 bp, P. troglodytes
aaaaatggaaagacag

SEQ ID NO: 181276 - DNA, 16 bp, P. troglodytes
aaaaatggaactatca

SEQ ID NO: 181277 - DNA, 16 bp, P. troglodytes
aaaaatggaagaattt

SEQ ID NO: 181278 - DNA, 16 bp, P. troglodytes
aaaaatggacaaaagg

SEQ ID NO: 181279 - DNA, 16 bp, P. troglodytes
aaaaatggacaaaatg

SEQ ID NO: 181280 - DNA, 16 bp, P. troglodytes
aaaaatggagaaattt

SEQ ID NO: 181281 - DNA, 16 bp, P. troglodytes
aaaaatggagctacca

SEQ ID NO: 181282 - DNA, 16 bp, P. troglodytes
aaaaatggcaaagaat

SEQ ID NO: 181283 - DNA, 16 bp, P. troglodytes
aaaaatgggcaaaaga

SEQ ID NO: 181284 - DNA, 16 bp, P. troglodytes
aaaaatgggcaaagga

SEQ ID NO: 181285 - DNA, 16 bp, P. troglodytes
aaaaatgggcaaataa

SEQ ID NO: 181286 - DNA, 16 bp, P. troglodytes
aaaaatgggcaagaga

SEQ ID NO: 181287 - DNA, 16 bp, P. troglodytes
aaaaatggggaaaaca

SEQ ID NO: 181288 - DNA, 16 bp, P. troglodytes
aaaaatggtgctgata

SEQ ID NO: 181289 - DNA, 16 bp, P. troglodytes
aaaaatggttaaaaca

SEQ ID NO: 181290 - DNA, 16 bp, P. troglodytes
aaaaatggtttgaaaa

SEQ ID NO: 181291 - DNA, 16 bp, P. troglodytes
aaaaatgtaaaactta

SEQ ID NO: 181292 - DNA, 16 bp, P. troglodytes
aaaaatgtaaaagcat

SEQ ID NO: 181293 - DNA, 16 bp, P. troglodytes
aaaaatgtaaactttt

SEQ ID NO: 181294 - DNA, 16 bp, P. troglodytes
aaaaatgtacacattt

SEQ ID NO: 181295 - DNA, 16 bp, P. troglodytes
aaaaatgtacagtttt

SEQ ID NO: 181296 - DNA, 16 bp, P. troglodytes
aaaaatgtatgcaaat

SEQ ID NO: 181297 - DNA, 16 bp, P. troglodytes
aaaaatgtatttcaag

SEQ ID NO: 181298 - DNA, 16 bp, P. troglodytes
aaaaatgtcaatatca

SEQ ID NO: 181299 - DNA, 16 bp, P. troglodytes
aaaaatgtcaggaaaa

SEQ ID NO: 181300 - DNA, 16 bp, P. troglodytes
aaaaatgtcattttaa

SEQ ID NO: 181301 - DNA, 16 bp, P. troglodytes
aaaaatgtctaaaaag

SEQ ID NO: 181302 - DNA, 16 bp, P. troglodytes
aaaaatgtcttcattt

SEQ ID NO: 181303 - DNA, 16 bp, P. troglodytes
aaaaatgtctttaaaa

SEQ ID NO: 181304 - DNA, 16 bp, P. troglodytes
aaaaatgtgaagatat

SEQ ID NO: 181305 - DNA, 16 bp, P. troglodytes
aaaaatgtgattttta

SEQ ID NO: 181306 - DNA, 16 bp, P. troglodytes
aaaaatgtgcaaaaga

SEQ ID NO: 181307 - DNA, 16 bp, P. troglodytes
aaaaatgtgcaaagga

SEQ ID NO: 181308 - DNA, 16 bp, P. troglodytes
aaaaatgtggaaatga

SEQ ID NO: 181309 - DNA, 16 bp, P. troglodytes
aaaaatgtggaaccaa

SEQ ID NO: 181310 - DNA, 16 bp, P. troglodytes
aaaaatgtggtacata

SEQ ID NO: 181311 - DNA, 16 bp, P. troglodytes
aaaaatgtggtatata

SEQ ID NO: 181312 - DNA, 16 bp, P. troglodytes
aaaaatgtgtaatttt

SEQ ID NO: 181313 - DNA, 16 bp, P. troglodytes
aaaaatgtgtacatga

SEQ ID NO: 181314 - DNA, 16 bp, P. troglodytes
aaaaatgtgtatatat

SEQ ID NO: 181315 - DNA, 16 bp, P. troglodytes
aaaaatgtgtatattt

SEQ ID NO: 181316 - DNA, 16 bp, P. troglodytes
aaaaatgtgtgaaata

SEQ ID NO: 181317 - DNA, 16 bp, P. troglodytes
aaaaatgtgtttattt

SEQ ID NO: 181318 - DNA, 16 bp, P. troglodytes
aaaaatgtgtttttta

SEQ ID NO: 181319 - DNA, 16 bp, P. troglodytes
aaaaatgttaaaacag

SEQ ID NO: 181320 - DNA, 16 bp, P. troglodytes
aaaaatgttaaaatca

SEQ ID NO: 181321 - DNA, 16 bp, P. troglodytes
aaaaatgttaaacata

SEQ ID NO: 181322 - DNA, 16 bp, P. troglodytes
aaaaatgttaaatgga

SEQ ID NO: 181323 - DNA, 16 bp, P. troglodytes
aaaaatgttacaaaat

SEQ ID NO: 181324 - DNA, 16 bp, P. troglodytes
aaaaatgttcaaataa

SEQ ID NO: 181325 - DNA, 16 bp, P. troglodytes
aaaaatgttcatcatt

SEQ ID NO: 181326 - DNA, 16 bp, P. troglodytes
aaaaatgttcatttct

SEQ ID NO: 181327 - DNA, 16 bp, P. troglodytes
aaaaatgttctttaaa

SEQ ID NO: 181328 - DNA, 16 bp, P. troglodytes
aaaaatgttgaatttt

SEQ ID NO: 181329 - DNA, 16 bp, P. troglodytes
aaaaatgttgtataat

SEQ ID NO: 181330 - DNA, 16 bp, P. troglodytes
aaaaatgtttacaaat

SEQ ID NO: 181331 - DNA, 16 bp, P. troglodytes
aaaaatgtttcagaaa

SEQ ID NO: 181332 - DNA, 16 bp, P. troglodytes
aaaaatgtttccagat

SEQ ID NO: 181333 - DNA, 16 bp, P. troglodytes
aaaaatgtttctaata

SEQ ID NO: 181334 - DNA, 16 bp, P. troglodytes
aaaaatgtttgaaaca

SEQ ID NO: 181335 - DNA, 16 bp, P. troglodytes
aaaaatgttttcactg

SEQ ID NO: 181336 - DNA, 16 bp, P. troglodytes
aaaaatgttttcatgt

SEQ ID NO: 181337 - DNA, 16 bp, P. troglodytes
aaaaatgttttctatt

SEQ ID NO: 181338 - DNA, 16 bp, P. troglodytes
aaaaatgttttctttt

SEQ ID NO: 181339 - DNA, 16 bp, P. troglodytes
aaaaatgttttgaaag

SEQ ID NO: 181340 - DNA, 16 bp, P. troglodytes
aaaaatgtttttcaga

SEQ ID NO: 181341 - DNA, 16 bp, P. troglodytes
aaaaatgtttttccaa

SEQ ID NO: 181342 - DNA, 16 bp, P. troglodytes
aaaaatgttttttctt

SEQ ID NO: 181343 - DNA, 16 bp, P. troglodytes
aaaaatgttttttgaa

SEQ ID NO: 181344 - DNA, 16 bp, P. troglodytes
aaaaattaaaaagcct

SEQ ID NO: 181345 - DNA, 16 bp, P. troglodytes
aaaaattaaactcttt

SEQ ID NO: 181346 - DNA, 16 bp, P. troglodytes
aaaaattaaagcaatt

SEQ ID NO: 181347 - DNA, 16 bp, P. troglodytes
aaaaattaaccagatg

SEQ ID NO: 181348 - DNA, 16 bp, P. troglodytes
aaaaattaaccaggct

SEQ ID NO: 181349 - DNA, 16 bp, P. troglodytes
aaaaattaactcatga

SEQ ID NO: 181350 - DNA, 16 bp, P. troglodytes
aaaaattaagctgaaa

SEQ ID NO: 181351 - DNA, 16 bp, P. troglodytes
aaaaattaagtgagat

SEQ ID NO: 181352 - DNA, 16 bp, P. troglodytes
aaaaattaatcaggtg

SEQ ID NO: 181353 - DNA, 16 bp, P. troglodytes
aaaaattaatccaaga

SEQ ID NO: 181354 - DNA, 21 bp, P. troglodytes
aaaaattaatgaatccaggag

SEQ ID NO: 181355 - DNA, 16 bp, P. troglodytes
aaaaattaatggcatt

SEQ ID NO: 181356 - DNA, 16 bp, P. troglodytes
aaaaattacaagcatt

SEQ ID NO: 181357 - DNA, 16 bp, P. troglodytes
aaaaattacagaatat

SEQ ID NO: 181358 - DNA, 16 bp, P. troglodytes
aaaaattacagatttt

SEQ ID NO: 181359 - DNA, 16 bp, P. troglodytes
aaaaattacttgaaaa

SEQ ID NO: 181360 - DNA, 16 bp, P. troglodytes
aaaaattacttggaaa

SEQ ID NO: 181361 - DNA, 16 bp, P. troglodytes
aaaaattagagcagaa

SEQ ID NO: 181362 - DNA, 16 bp, P. troglodytes
aaaaattagccacatg

SEQ ID NO: 181363 - DNA, 16 bp, P. troglodytes
aaaaattagccagata

SEQ ID NO: 181364 - DNA, 16 bp, P. troglodytes
aaaaattagccaggca

SEQ ID NO: 181365 - DNA, 16 bp, P. troglodytes
aaaaattagccagggt

SEQ ID NO: 181366 - DNA, 16 bp, P. troglodytes
aaaaattagccaggtt

SEQ ID NO: 181367 - DNA, 16 bp, P. troglodytes
aaaaattagccagtat

SEQ ID NO: 181368 - DNA, 16 bp, P. troglodytes
aaaaattagcccagca

SEQ ID NO: 181369 - DNA, 16 bp, P. troglodytes
aaaaattagcccgaca

SEQ ID NO: 181370 - DNA, 16 bp, P. troglodytes
aaaaattagcccggtg

SEQ ID NO: 181371 - DNA, 16 bp, P. troglodytes
aaaaattagccggggc

SEQ ID NO: 181372 - DNA, 16 bp, P. troglodytes
aaaaattagccggggg

SEQ ID NO: 181373 - DNA, 16 bp, P. troglodytes
aaaaattagccggtca

SEQ ID NO: 181374 - DNA, 16 bp, P. troglodytes
aaaaattagcctgatg

SEQ ID NO: 181375 - DNA, 16 bp, P. troglodytes
aaaaattagcctgggg

SEQ ID NO: 181376 - DNA, 16 bp, P. troglodytes
aaaaattagctaggcc

SEQ ID NO: 181377 - DNA, 16 bp, P. troglodytes
aaaaattagctgagca

SEQ ID NO: 181378 - DNA, 16 bp, P. troglodytes
aaaaattagctgatca

SEQ ID NO: 181379 - DNA, 16 bp, P. troglodytes
aaaaattagctgggct

SEQ ID NO: 181380 - DNA, 16 bp, P. troglodytes
aaaaattagctggggc

SEQ ID NO: 181381 - DNA, 16 bp, P. troglodytes
aaaaattagctggggg

SEQ ID NO: 181382 - DNA, 16 bp, P. troglodytes
aaaaattaggccgggc

SEQ ID NO: 181383 - DNA, 16 bp, P. troglodytes
aaaaattaggctgggc

SEQ ID NO: 181384 - DNA, 16 bp, P. troglodytes
aaaaattataaaactg

SEQ ID NO: 181385 - DNA, 16 bp, P. troglodytes
aaaaattatcccagca

SEQ ID NO: 181386 - DNA, 16 bp, P. troglodytes
aaaaattatcttgatt

SEQ ID NO: 181387 - DNA, 16 bp, P. troglodytes
aaaaattatgtgaatg

SEQ ID NO: 181388 - DNA, 16 bp, P. troglodytes
aaaaattatgttttct

SEQ ID NO: 181389 - DNA, 16 bp, P. troglodytes
aaaaattattatctca

SEQ ID NO: 181390 - DNA, 16 bp, P. troglodytes
aaaaattattattctg

SEQ ID NO: 181391 - DNA, 16 bp, P. troglodytes
aaaaattattggccag

SEQ ID NO: 181392 - DNA, 16 bp, P. troglodytes
aaaaattatttcagat

SEQ ID NO: 181393 - DNA, 16 bp, P. troglodytes
aaaaattatttccaga

SEQ ID NO: 181394 - DNA, 16 bp, P. troglodytes
aaaaattatttcttgt

SEQ ID NO: 181395 - DNA, 16 bp, P. troglodytes
aaaaattatttgggca

SEQ ID NO: 181396 - DNA, 16 bp, P. troglodytes
aaaaattatttgtaga

SEQ ID NO: 181397 - DNA, 16 bp, P. troglodytes
aaaaattatttgtgtt

SEQ ID NO: 181398 - DNA, 16 bp, P. troglodytes
aaaaattatttgttgt

SEQ ID NO: 181399 - DNA, 16 bp, P. troglodytes
aaaaattattttccat

SEQ ID NO: 181400 - DNA, 16 bp, P. troglodytes
aaaaattattttctgt

SEQ ID NO: 181401 - DNA, 16 bp, P. troglodytes
aaaaattattttgtct

SEQ ID NO: 181402 - DNA, 16 bp, P. troglodytes
aaaaattcaaaatgtt

SEQ ID NO: 181403 - DNA, 16 bp, P. troglodytes
aaaaattcaagaaact

SEQ ID NO: 181404 - DNA, 16 bp, P. troglodytes
aaaaattcaagaatta

SEQ ID NO: 181405 - DNA, 16 bp, P. troglodytes
aaaaattcaatagagg

SEQ ID NO: 181406 - DNA, 16 bp, P. troglodytes
aaaaattcacttattt

SEQ ID NO: 181407 - DNA, 16 bp, P. troglodytes
aaaaattcacttttat

SEQ ID NO: 181408 - DNA, 16 bp, P. troglodytes
aaaaattcaggaaact

SEQ ID NO: 181409 - DNA, 16 bp, P. troglodytes
aaaaattcagtttata

SEQ ID NO: 181410 - DNA, 16 bp, P. troglodytes
aaaaattcatattctt

SEQ ID NO: 181411 - DNA, 16 bp, P. troglodytes
aaaaattcatttttct

SEQ ID NO: 181412 - DNA, 16 bp, P. troglodytes
aaaaattccaaatgaa

SEQ ID NO: 181413 - DNA, 16 bp, P. troglodytes
aaaaattccagaagaa

SEQ ID NO: 181414 - DNA, 16 bp, P. troglodytes
aaaaattccatgttca

SEQ ID NO: 181415 - DNA, 16 bp, P. troglodytes
aaaaattcgccgggtg

SEQ ID NO: 181416 - DNA, 16 bp, P. troglodytes
aaaaattctcagtaaa

SEQ ID NO: 181417 - DNA, 16 bp, P. troglodytes
aaaaattctgaaagaa

SEQ ID NO: 181418 - DNA, 16 bp, P. troglodytes
aaaaattcttatcctg

SEQ ID NO: 181419 - DNA, 16 bp, P. troglodytes
aaaaattcttcaaact

SEQ ID NO: 181420 - DNA, 16 bp, P. troglodytes
aaaaattcttgaaaca

SEQ ID NO: 181421 - DNA, 16 bp, P. troglodytes
aaaaattctttccaaa

SEQ ID NO: 181422 - DNA, 16 bp, P. troglodytes
aaaaattctttgcaaa

SEQ ID NO: 181423 - DNA, 16 bp, P. troglodytes
aaaaattgaaagcaag

SEQ ID NO: 181424 - DNA, 16 bp, P. troglodytes
aaaaattgaaagtttt

SEQ ID NO: 181425 - DNA, 16 bp, P. troglodytes
aaaaattgaaatcata

SEQ ID NO: 181426 - DNA, 16 bp, P. troglodytes
aaaaattgaagaggat

SEQ ID NO: 181427 - DNA, 16 bp, P. troglodytes
aaaaattgacaaattg

SEQ ID NO: 181428 - DNA, 16 bp, P. troglodytes
aaaaattgattcaaga

SEQ ID NO: 181429 - DNA, 16 bp, P. troglodytes
aaaaattgcaagcatt

SEQ ID NO: 181430 - DNA, 16 bp, P. troglodytes
aaaaattgccaaaaat

SEQ ID NO: 181431 - DNA, 16 bp, P. troglodytes
aaaaattgccaagaaa

SEQ ID NO: 181432 - DNA, 16 bp, P. troglodytes
aaaaattgcttgaacc

SEQ ID NO: 181433 - DNA, 16 bp, P. troglodytes
aaaaattgcttttttt

SEQ ID NO: 181434 - DNA, 16 bp, P. troglodytes
aaaaattggaaacaac

SEQ ID NO: 181435 - DNA, 16 bp, P. troglodytes
aaaaattggaatattt

SEQ ID NO: 181436 - DNA, 16 bp, P. troglodytes
aaaaattggccaggtg

SEQ ID NO: 181437 - DNA, 16 bp, P. troglodytes
aaaaattggctaggtg

SEQ ID NO: 181438 - DNA, 16 bp, P. troglodytes
aaaaattgtaaagggt

SEQ ID NO: 181439 - DNA, 16 bp, P. troglodytes
aaaaattgtacaaata

SEQ ID NO: 181440 - DNA, 16 bp, P. troglodytes
aaaaattgtcatttaa

SEQ ID NO: 181441 - DNA, 16 bp, P. troglodytes
aaaaattgtctaaaat

SEQ ID NO: 181442 - DNA, 16 bp, P. troglodytes
aaaaattgtgacattt

SEQ ID NO: 181443 - DNA, 16 bp, P. troglodytes
aaaaattgtgtgactt

SEQ ID NO: 181444 - DNA, 16 bp, P. troglodytes
aaaaattgtgttattt

SEQ ID NO: 181445 - DNA, 16 bp, P. troglodytes
aaaaattgtttacttt

SEQ ID NO: 181446 - DNA, 16 bp, P. troglodytes
aaaaattgtttctaaa

SEQ ID NO: 181447 - DNA, 16 bp, P. troglodytes
aaaaattgttttaaac

SEQ ID NO: 181448 - DNA, 16 bp, P. troglodytes
aaaaattgttttctgt

SEQ ID NO: 181449 - DNA, 16 bp, P. troglodytes
aaaaattgttttctta

SEQ ID NO: 181450 - DNA, 16 bp, P. troglodytes
aaaaattgttttttct

SEQ ID NO: 181451 - DNA, 16 bp, P. troglodytes
aaaaatttagccaggc

SEQ ID NO: 181452 - DNA, 16 bp, P. troglodytes
aaaaatttatatgttg

SEQ ID NO: 181453 - DNA, 16 bp, P. troglodytes
aaaaatttattcaaga

SEQ ID NO: 181454 - DNA, 16 bp, P. troglodytes
aaaaatttattgaatg

SEQ ID NO: 181455 - DNA, 16 bp, P. troglodytes
aaaaatttcagaaatt

SEQ ID NO: 181456 - DNA, 16 bp, P. troglodytes
aaaaatttcagatttt

SEQ ID NO: 181457 - DNA, 16 bp, P. troglodytes
aaaaatttcaggccaa

SEQ ID NO: 181458 - DNA, 16 bp, P. troglodytes
aaaaatttcttccaaa

SEQ ID NO: 181459 - DNA, 16 bp, P. troglodytes
aaaaatttgaaaacat

SEQ ID NO: 181460 - DNA, 16 bp, P. troglodytes
aaaaatttgaaatgtt

SEQ ID NO: 181461 - DNA, 16 bp, P. troglodytes
aaaaatttgaagagga

SEQ ID NO: 181462 - DNA, 16 bp, P. troglodytes
aaaaatttgcaaaaca

SEQ ID NO: 181463 - DNA, 16 bp, P. troglodytes
aaaaatttgttctttt

SEQ ID NO: 181464 - DNA, 16 bp, P. troglodytes
aaaaatttgttttctt

SEQ ID NO: 181465 - DNA, 16 bp, P. troglodytes
aaaaattttcagaaaa

SEQ ID NO: 181466 - DNA, 16 bp, P. troglodytes
aaaaattttcctttaa

SEQ ID NO: 181467 - DNA, 16 bp, P. troglodytes
aaaaattttgcaaact

SEQ ID NO: 181468 - DNA, 16 bp, P. troglodytes
aaaaattttgtagaga

SEQ ID NO: 181469 - DNA, 16 bp, P. troglodytes
aaaaatttttcagaaa

SEQ ID NO: 181470 - DNA, 16 bp, P. troglodytes
aaaaatttttggagat

SEQ ID NO: 181471 - DNA, 16 bp, P. troglodytes
aaaaattttttagaag

SEQ ID NO: 181472 - DNA, 16 bp, P. troglodytes
aaaaatttttttccaa

SEQ ID NO: 181473 - DNA, 16 bp, P. troglodytes
aaaaatttttttgcca

SEQ ID NO: 181474 - DNA, 16 bp, P. troglodytes
aaaaattttttttagc

SEQ ID NO: 181475 - DNA, 16 bp, P. troglodytes
aaaacaaaaaacctgt

SEQ ID NO: 181476 - DNA, 16 bp, P. troglodytes
aaaacaaaaaactgcc

SEQ ID NO: 181477 - DNA, 16 bp, P. troglodytes
aaaacaaaaaacttgg

SEQ ID NO: 181478 - DNA, 16 bp, P. troglodytes
aaaacaaaaacctatg

SEQ ID NO: 181479 - DNA, 16 bp, P. troglodytes
aaaacaaaaagcactt

SEQ ID NO: 181480 - DNA, 16 bp, P. troglodytes
aaaacaaaaatgcttt

SEQ ID NO: 181481 - DNA, 16 bp, P. troglodytes
aaaacaaaacagtttt

SEQ ID NO: 181482 - DNA, 16 bp, P. troglodytes
aaaacaaaacctgttt

SEQ ID NO: 181483 - DNA, 16 bp, P. troglodytes
aaaacaaaagatattt

SEQ ID NO: 181484 - DNA, 16 bp, P. troglodytes
aaaacaaaagtttaat

SEQ ID NO: 181485 - DNA, 16 bp, P. troglodytes
aaaacaaaatgcacag

SEQ ID NO: 181486 - DNA, 16 bp, P. troglodytes
aaaacaaaatgcattt

SEQ ID NO: 181487 - DNA, 16 bp, P. troglodytes
aaaacaaaattctgaa

SEQ ID NO: 181488 - DNA, 16 bp, P. troglodytes
aaaacaaaattctgca

SEQ ID NO: 181489 - DNA, 16 bp, P. troglodytes
aaaacaaacactgcat

SEQ ID NO: 181490 - DNA, 16 bp, P. troglodytes
aaaacaaacttttcat

SEQ ID NO: 181491 - DNA, 16 bp, P. troglodytes
aaaacaaagacattct

SEQ ID NO: 181492 - DNA, 16 bp, P. troglodytes
aaaacaaagagaattt

SEQ ID NO: 181493 - DNA, 16 bp, P. troglodytes
aaaacaaagatttttt

SEQ ID NO: 181494 - DNA, 16 bp, P. troglodytes
aaaacaaagctgaagg

SEQ ID NO: 181495 - DNA, 16 bp, P. troglodytes
aaaacaaaggttaatg

SEQ ID NO: 181496 - DNA, 16 bp, P. troglodytes
aaaacaaatattcaga

SEQ ID NO: 181497 - DNA, 16 bp, P. troglodytes
aaaacaaatattttga

SEQ ID NO: 181498 - DNA, 16 bp, P. troglodytes
aaaacaaatgaatttt

SEQ ID NO: 181499 - DNA, 16 bp, P. troglodytes
aaaacaaatgattttt

SEQ ID NO: 181500 - DNA, 16 bp, P. troglodytes
aaaacaaatgttttat

SEQ ID NO: 181501 - DNA, 16 bp, P. troglodytes
aaaacaaattatttga

SEQ ID NO: 181502 - DNA, 16 bp, P. troglodytes
aaaacaaattgtttaa

SEQ ID NO: 181503 - DNA, 16 bp, P. troglodytes
aaaacaaatttgtttt

SEQ ID NO: 181504 - DNA, 16 bp, P. troglodytes
aaaacaacagaaatgt

SEQ ID NO: 181505 - DNA, 16 bp, P. troglodytes
aaaacaacatttatct

SEQ ID NO: 181506 - DNA, 16 bp, P. troglodytes
aaaacaacattttttt

SEQ ID NO: 181507 - DNA, 16 bp, P. troglodytes
aaaacaacccaaatgt

SEQ ID NO: 181508 - DNA, 16 bp, P. troglodytes
aaaacaactatatttt

SEQ ID NO: 181509 - DNA, 16 bp, P. troglodytes
aaaacaactttttttt

SEQ ID NO: 181510 - DNA, 16 bp, P. troglodytes
aaaacaagatattttt

SEQ ID NO: 181511 - DNA, 16 bp, P. troglodytes
aaaacaagattatttt

SEQ ID NO: 181512 - DNA, 16 bp, P. troglodytes
aaaacaagcaatgtgg

SEQ ID NO: 181513 - DNA, 16 bp, P. troglodytes
aaaacaagcattgggg

SEQ ID NO: 181514 - DNA, 16 bp, P. troglodytes
aaaacaagctcctgga

SEQ ID NO: 181515 - DNA, 16 bp, P. troglodytes
aaaacaagcttttaaa

SEQ ID NO: 181516 - DNA, 16 bp, P. troglodytes
aaaacaaggagaatga

SEQ ID NO: 181517 - DNA, 16 bp, P. troglodytes
aaaacaagtctttttt

SEQ ID NO: 181518 - DNA, 16 bp, P. troglodytes
aaaacaagttctgaaa

SEQ ID NO: 181519 - DNA, 16 bp, P. troglodytes
aaaacaagtttattaa

SEQ ID NO: 181520 - DNA, 16 bp, P. troglodytes
aaaacaagttttaaca

SEQ ID NO: 181521 - DNA, 16 bp, P. troglodytes
aaaacaagttttataa

SEQ ID NO: 181522 - DNA, 16 bp, P. troglodytes
aaaacaagtttttttt

SEQ ID NO: 181523 - DNA, 16 bp, P. troglodytes
aaaacaataatgatga

SEQ ID NO: 181524 - DNA, 16 bp, P. troglodytes
aaaacaataatgcaat

SEQ ID NO: 181525 - DNA, 16 bp, P. troglodytes
aaaacaatagatattt

SEQ ID NO: 181526 - DNA, 16 bp, P. troglodytes
aaaacaatatgaagat

SEQ ID NO: 181527 - DNA, 16 bp, P. troglodytes
aaaacaatatggaagt

SEQ ID NO: 181528 - DNA, 16 bp, P. troglodytes
aaaacaatcttgaaca

SEQ ID NO: 181529 - DNA, 16 bp, P. troglodytes
aaaacaatgagaatga

SEQ ID NO: 181530 - DNA, 16 bp, P. troglodytes
aaaacaatgatttaaa

SEQ ID NO: 181531 - DNA, 16 bp, P. troglodytes
aaaacaatggcaacaa

SEQ ID NO: 181532 - DNA, 16 bp, P. troglodytes
aaaacaatgtttaaaa

SEQ ID NO: 181533 - DNA, 16 bp, P. troglodytes
aaaacaatgtttttat

SEQ ID NO: 181534 - DNA, 16 bp, P. troglodytes
aaaacaatgttttttt

SEQ ID NO: 181535 - DNA, 16 bp, P. troglodytes
aaaacaattatgtaat

SEQ ID NO: 181536 - DNA, 16 bp, P. troglodytes
aaaacaattcaaatgt

SEQ ID NO: 181537 - DNA, 16 bp, P. troglodytes
aaaacaattcagaaat

SEQ ID NO: 181538 - DNA, 16 bp, P. troglodytes
aaaacaattcagaata

SEQ ID NO: 181539 - DNA, 16 bp, P. troglodytes
aaaacaattccttttt

SEQ ID NO: 181540 - DNA, 16 bp, P. troglodytes
aaaacaattgagctca

SEQ ID NO: 181541 - DNA, 16 bp, P. troglodytes
aaaacaattgtttaaa

SEQ ID NO: 181542 - DNA, 16 bp, P. troglodytes
aaaacaatttaaatgt

SEQ ID NO: 181543 - DNA, 16 bp, P. troglodytes
aaaacaatttgaatga

SEQ ID NO: 181544 - DNA, 16 bp, P. troglodytes
aaaacaatttgcattt

SEQ ID NO: 181545 - DNA, 16 bp, P. troglodytes
aaaacaattttaagaa

SEQ ID NO: 181546 - DNA, 16 bp, P. troglodytes
aaaacaattttagaat

SEQ ID NO: 181547 - DNA, 16 bp, P. troglodytes
aaaacaattttatttg

SEQ ID NO: 181548 - DNA, 16 bp, P. troglodytes
aaaacacaaaatcttt

SEQ ID NO: 181549 - DNA, 16 bp, P. troglodytes
aaaacacaaagacatt

SEQ ID NO: 181550 - DNA, 16 bp, P. troglodytes
aaaacacaaagctttt

SEQ ID NO: 181551 - DNA, 16 bp, P. troglodytes
aaaacacaatttattt

SEQ ID NO: 181552 - DNA, 16 bp, P. troglodytes
aaaacacagaatattt

SEQ ID NO: 181553 - DNA, 16 bp, P. troglodytes
aaaacacagatataga

SEQ ID NO: 181554 - DNA, 16 bp, P. troglodytes
aaaacacagattttta

SEQ ID NO: 181555 - DNA, 16 bp, P. troglodytes
aaaacacagtatctgc

SEQ ID NO: 181556 - DNA, 16 bp, P. troglodytes
aaaacacatgtatttt

SEQ ID NO: 181557 - DNA, 16 bp, P. troglodytes
aaaacacatttaattt

SEQ ID NO: 181558 - DNA, 16 bp, P. troglodytes
aaaacacatttttctt

SEQ ID NO: 181559 - DNA, 16 bp, P. troglodytes
aaaacacatttttttt

SEQ ID NO: 181560 - DNA, 16 bp, P. troglodytes
aaaacaccagacaaat

SEQ ID NO: 181561 - DNA, 16 bp, P. troglodytes
aaaacaccctcacaga

SEQ ID NO: 181562 - DNA, 16 bp, P. troglodytes
aaaacaccgtctctac

SEQ ID NO: 181563 - DNA, 16 bp, P. troglodytes
aaaacacgaaaattag

SEQ ID NO: 181564 - DNA, 16 bp, P. troglodytes
aaaacacgctgcagga

SEQ ID NO: 181565 - DNA, 16 bp, P. troglodytes
aaaacactactgaaaa

SEQ ID NO: 181566 - DNA, 16 bp, P. troglodytes
aaaacactgcagaaag

SEQ ID NO: 181567 - DNA, 16 bp, P. troglodytes
aaaacactgctcagag

SEQ ID NO: 181568 - DNA, 16 bp, P. troglodytes
aaaacactgggaaaaa

SEQ ID NO: 181569 - DNA, 16 bp, P. troglodytes
aaaacactgtaaaaat

SEQ ID NO: 181570 - DNA, 16 bp, P. troglodytes
aaaacactgtaaaata

SEQ ID NO: 181571 - DNA, 16 bp, P. troglodytes
aaaacagaaaacctga

SEQ ID NO: 181572 - DNA, 16 bp, P. troglodytes
aaaacagaaaatgatt

SEQ ID NO: 181573 - DNA, 16 bp, P. troglodytes
aaaacagaaaatgttt

SEQ ID NO: 181574 - DNA, 16 bp, P. troglodytes
aaaacagaaaatttca

SEQ ID NO: 181575 - DNA, 16 bp, P. troglodytes
aaaacagaaagatatt

SEQ ID NO: 181576 - DNA, 16 bp, P. troglodytes
aaaacagaactgccat

SEQ ID NO: 181577 - DNA, 16 bp, P. troglodytes
aaaacagaaggaaatt

SEQ ID NO: 181578 - DNA, 16 bp, P. troglodytes
aaaacagaataccaca

SEQ ID NO: 181579 - DNA, 16 bp, P. troglodytes
aaaacagaatatttaa

SEQ ID NO: 181580 - DNA, 16 bp, P. troglodytes
aaaacagaatctcttt

SEQ ID NO: 181581 - DNA, 16 bp, P. troglodytes
aaaacagacaaaattc

SEQ ID NO: 181582 - DNA, 16 bp, P. troglodytes
aaaacagacacataga

SEQ ID NO: 181583 - DNA, 16 bp, P. troglodytes
aaaacagacattaaac

SEQ ID NO: 181584 - DNA, 16 bp, P. troglodytes
aaaacagaccttaaac

SEQ ID NO: 181585 - DNA, 16 bp, P. troglodytes
aaaacagactttaaag

SEQ ID NO: 181586 - DNA, 16 bp, P. troglodytes
aaaacagagatatgtg

SEQ ID NO: 181587 - DNA, 16 bp, P. troglodytes
aaaacagagatcttaa

SEQ ID NO: 181588 - DNA, 16 bp, P. troglodytes
aaaacagagatgataa

SEQ ID NO: 181589 - DNA, 16 bp, P. troglodytes
aaaacagatatataga

SEQ ID NO: 181590 - DNA, 16 bp, P. troglodytes
aaaacagatatatata

SEQ ID NO: 181591 - DNA, 16 bp, P. troglodytes
aaaacagatggaaaat

SEQ ID NO: 181592 - DNA, 16 bp, P. troglodytes
aaaacagattaaaatt

SEQ ID NO: 181593 - DNA, 16 bp, P. troglodytes
aaaacagattaagaca

SEQ ID NO: 181594 - DNA, 16 bp, P. troglodytes
aaaacagcaaatattt

SEQ ID NO: 181595 - DNA, 16 bp, P. troglodytes
aaaacagcagcagcag

SEQ ID NO: 181596 - DNA, 16 bp, P. troglodytes
aaaacagcatagtact

SEQ ID NO: 181597 - DNA, 16 bp, P. troglodytes
aaaacagcatgatatt

SEQ ID NO: 181598 - DNA, 16 bp, P. troglodytes
aaaacagcatggtact

SEQ ID NO: 181599 - DNA, 16 bp, P. troglodytes
aaaacagcattaatct

SEQ ID NO: 181600 - DNA, 16 bp, P. troglodytes
aaaacagccacagatg

SEQ ID NO: 181601 - DNA, 16 bp, P. troglodytes
aaaacagcctttaaac

SEQ ID NO: 181602 - DNA, 16 bp, P. troglodytes
aaaacagctagaagag

SEQ ID NO: 181603 - DNA, 16 bp, P. troglodytes
aaaacagctttcaaaa

SEQ ID NO: 181604 - DNA, 16 bp, P. troglodytes
aaaacagctttgaaaa

SEQ ID NO: 181605 - DNA, 16 bp, P. troglodytes
aaaacaggaaatcaat

SEQ ID NO: 181606 - DNA, 16 bp, P. troglodytes
aaaacaggaactcaaa

SEQ ID NO: 181607 - DNA, 16 bp, P. troglodytes
aaaacaggcaaaacta

SEQ ID NO: 181608 - DNA, 16 bp, P. troglodytes
aaaacaggcaaatcca

SEQ ID NO: 181609 - DNA, 16 bp, P. troglodytes
aaaacaggccctggtg

SEQ ID NO: 181610 - DNA, 16 bp, P. troglodytes
aaaacaggctctgaaa

SEQ ID NO: 181611 - DNA, 16 bp, P. troglodytes
aaaacagtaaaatgtg

SEQ ID NO: 181612 - DNA, 16 bp, P. troglodytes
aaaacagtcagaaaac

SEQ ID NO: 181613 - DNA, 16 bp, P. troglodytes
aaaacagtcttgaatt

SEQ ID NO: 181614 - DNA, 16 bp, P. troglodytes
aaaacagtctttccaa

SEQ ID NO: 181615 - DNA, 16 bp, P. troglodytes
aaaacagtgctgaaag

SEQ ID NO: 181616 - DNA, 16 bp, P. troglodytes
aaaacagtgtggtggt

SEQ ID NO: 181617 - DNA, 16 bp, P. troglodytes
aaaacagtgtgtagag

SEQ ID NO: 181618 - DNA, 16 bp, P. troglodytes
aaaacagtgtttagag

SEQ ID NO: 181619 - DNA, 16 bp, P. troglodytes
aaaacagtgtttcaaa

SEQ ID NO: 181620 - DNA, 16 bp, P. troglodytes
aaaacagtgtttccag

SEQ ID NO: 181621 - DNA, 16 bp, P. troglodytes
aaaacagtgttttaaa

SEQ ID NO: 181622 - DNA, 16 bp, P. troglodytes
aaaacagttatttttc

SEQ ID NO: 181623 - DNA, 16 bp, P. troglodytes
aaaacagtttcatttt

SEQ ID NO: 181624 - DNA, 16 bp, P. troglodytes
aaaacagtttgcagta

SEQ ID NO: 181625 - DNA, 16 bp, P. troglodytes
aaaacagttttaaaaa

SEQ ID NO: 181626 - DNA, 16 bp, P. troglodytes
aaaacagttttatttt

SEQ ID NO: 181627 - DNA, 16 bp, P. troglodytes
aaaacagtttttaaaa

SEQ ID NO: 181628 - DNA, 16 bp, P. troglodytes
aaaacagtttttgaaa

SEQ ID NO: 181629 - DNA, 16 bp, P. troglodytes
aaaacataaatgtatt

SEQ ID NO: 181630 - DNA, 16 bp, P. troglodytes
aaaacataattttcat

SEQ ID NO: 181631 - DNA, 16 bp, P. troglodytes
aaaacatacaaatgga

SEQ ID NO: 181632 - DNA, 16 bp, P. troglodytes
aaaacataccaaaatg

SEQ ID NO: 181633 - DNA, 16 bp, P. troglodytes
aaaacatagatttaaa

SEQ ID NO: 181634 - DNA, 16 bp, P. troglodytes
aaaacatagatttttt

SEQ ID NO: 181635 - DNA, 16 bp, P. troglodytes
aaaacatatatatgtt

SEQ ID NO: 181636 - DNA, 16 bp, P. troglodytes
aaaacatatgtttaca

SEQ ID NO: 181637 - DNA, 16 bp, P. troglodytes
aaaacatattttgaaa

SEQ ID NO: 181638 - DNA, 16 bp, P. troglodytes
aaaacatcaaaaagtg

SEQ ID NO: 181639 - DNA, 16 bp, P. troglodytes
aaaacatcatattgta

SEQ ID NO: 181640 - DNA, 16 bp, P. troglodytes
aaaacatccagaaaag

SEQ ID NO: 181641 - DNA, 16 bp, P. troglodytes
aaaacatccagaaaat

SEQ ID NO: 181642 - DNA, 16 bp, P. troglodytes
aaaacatctattttaa

SEQ ID NO: 181643 - DNA, 16 bp, P. troglodytes
aaaacatgaaaatatt

SEQ ID NO: 181644 - DNA, 16 bp, P. troglodytes
aaaacatgaaaattat

SEQ ID NO: 181645 - DNA, 16 bp, P. troglodytes
aaaacatgaaatactt

SEQ ID NO: 181646 - DNA, 16 bp, P. troglodytes
aaaacatgacaaattg

SEQ ID NO: 181647 - DNA, 16 bp, P. troglodytes
aaaacatgatccaact

SEQ ID NO: 181648 - DNA, 16 bp, P. troglodytes
aaaacatgatgaaaat

SEQ ID NO: 181649 - DNA, 16 bp, P. troglodytes
aaaacatgcaaaatat

SEQ ID NO: 181650 - DNA, 16 bp, P. troglodytes
aaaacatgcattttta

SEQ ID NO: 181651 - DNA, 16 bp, P. troglodytes
aaaacatgctattttt

SEQ ID NO: 181652 - DNA, 16 bp, P. troglodytes
aaaacatggatgaacc

SEQ ID NO: 181653 - DNA, 16 bp, P. troglodytes
aaaacatgggggaaaa

SEQ ID NO: 181654 - DNA, 16 bp, P. troglodytes
aaaacatgtaaaaatt

SEQ ID NO: 181655 - DNA, 16 bp, P. troglodytes
aaaacatgtaatattt

SEQ ID NO: 181656 - DNA, 16 bp, P. troglodytes
aaaacatgtatttaaa

SEQ ID NO: 181657 - DNA, 16 bp, P. troglodytes
aaaacatgtatttctt

SEQ ID NO: 181658 - DNA, 16 bp, P. troglodytes
aaaacatgtgagcaaa

SEQ ID NO: 181659 - DNA, 16 bp, P. troglodytes
aaaacatgttatttta

SEQ ID NO: 181660 - DNA, 16 bp, P. troglodytes
aaaacatgttgaattt

SEQ ID NO: 181661 - DNA, 16 bp, P. troglodytes
aaaacatgtttaattt

SEQ ID NO: 181662 - DNA, 16 bp, P. troglodytes
aaaacatgtttctttg

SEQ ID NO: 181663 - DNA, 16 bp, P. troglodytes
aaaacatgtttgaaaa

SEQ ID NO: 181664 - DNA, 16 bp, P. troglodytes
aaaacatgttttattt

SEQ ID NO: 181665 - DNA, 17 bp, P. troglodytes
aaaacattacatgctca

SEQ ID NO: 181666 - DNA, 16 bp, P. troglodytes
aaaacattactgagag

SEQ ID NO: 181667 - DNA, 16 bp, P. troglodytes
aaaacattcatttatt

SEQ ID NO: 181668 - DNA, 16 bp, P. troglodytes
aaaacattctgaaatt

SEQ ID NO: 181669 - DNA, 16 bp, P. troglodytes
aaaacattcttgaaaa

SEQ ID NO: 181670 - DNA, 16 bp, P. troglodytes
aaaacattgaaaatat

SEQ ID NO: 181671 - DNA, 16 bp, P. troglodytes
aaaacattgaattgta

SEQ ID NO: 181672 - DNA, 16 bp, P. troglodytes
aaaacattgattttta

SEQ ID NO: 181673 - DNA, 16 bp, P. troglodytes
aaaacattggggaaaa

SEQ ID NO: 181674 - DNA, 16 bp, P. troglodytes
aaaacatttacatatt

SEQ ID NO: 181675 - DNA, 16 bp, P. troglodytes
aaaacatttattttag

SEQ ID NO: 181676 - DNA, 16 bp, P. troglodytes
aaaacatttcatccaa

SEQ ID NO: 181677 - DNA, 16 bp, P. troglodytes
aaaacatttctgaaaa

SEQ ID NO: 181678 - DNA, 16 bp, P. troglodytes
aaaacatttctttatt

SEQ ID NO: 181679 - DNA, 16 bp, P. troglodytes
aaaacatttgaaaaga

SEQ ID NO: 181680 - DNA, 16 bp, P. troglodytes
aaaacatttgaagaaa

SEQ ID NO: 181681 - DNA, 16 bp, P. troglodytes
aaaacatttgaagaga

SEQ ID NO: 181682 - DNA, 16 bp, P. troglodytes
aaaacatttgacaaaa

SEQ ID NO: 181683 - DNA, 16 bp, P. troglodytes
aaaacatttggaaaaa

SEQ ID NO: 181684 - DNA, 16 bp, P. troglodytes
aaaacatttgttttat

SEQ ID NO: 181685 - DNA, 16 bp, P. troglodytes
aaaacattttaaagaa

SEQ ID NO: 181686 - DNA, 16 bp, P. troglodytes
aaaacattttaacttt

SEQ ID NO: 181687 - DNA, 16 bp, P. troglodytes
aaaacattttagaaat

SEQ ID NO: 181688 - DNA, 16 bp, P. troglodytes
aaaacattttcatata

SEQ ID NO: 181689 - DNA, 16 bp, P. troglodytes
aaaacattttcatcac

SEQ ID NO: 181690 - DNA, 16 bp, P. troglodytes
aaaacattttcatttt

SEQ ID NO: 181691 - DNA, 16 bp, P. troglodytes
aaaacattttctaatt

SEQ ID NO: 181692 - DNA, 16 bp, P. troglodytes
aaaacattttctattt

SEQ ID NO: 181693 - DNA, 16 bp, P. troglodytes
aaaacattttctcatt

SEQ ID NO: 181694 - DNA, 16 bp, P. troglodytes
aaaacattttctcttt

SEQ ID NO: 181695 - DNA, 16 bp, P. troglodytes
aaaacattttctgaaa

SEQ ID NO: 181696 - DNA, 16 bp, P. troglodytes
aaaacattttgaaaag

SEQ ID NO: 181697 - DNA, 16 bp, P. troglodytes
aaaacattttgaaaat

SEQ ID NO: 181698 - DNA, 16 bp, P. troglodytes
aaaacattttgagaaa

SEQ ID NO: 181699 - DNA, 16 bp, P. troglodytes
aaaacattttgatttt

SEQ ID NO: 181700 - DNA, 16 bp, P. troglodytes
aaaacattttgcaaaa

SEQ ID NO: 181701 - DNA, 16 bp, P. troglodytes
aaaacattttgtgttt

SEQ ID NO: 181702 - DNA, 16 bp, P. troglodytes
aaaacatttttcttct

SEQ ID NO: 181703 - DNA, 16 bp, P. troglodytes
aaaacatttttgaaaa

SEQ ID NO: 181704 - DNA, 16 bp, P. troglodytes
aaaacatttttgtttt

SEQ ID NO: 181705 - DNA, 16 bp, P. troglodytes
aaaacattttttaaag

SEQ ID NO: 181706 - DNA, 16 bp, P. troglodytes
aaaacatttttttcaa

SEQ ID NO: 181707 - DNA, 16 bp, P. troglodytes
aaaacatttttttgtt

SEQ ID NO: 181708 - DNA, 16 bp, P. troglodytes
aaaaccaaatattgca

SEQ ID NO: 181709 - DNA, 16 bp, P. troglodytes
aaaaccaagtatcaca

SEQ ID NO: 181710 - DNA, 16 bp, P. troglodytes
aaaaccacaatgccat

SEQ ID NO: 181711 - DNA, 16 bp, P. troglodytes
aaaaccacagtgatat

SEQ ID NO: 181712 - DNA, 16 bp, P. troglodytes
aaaaccacattgagat

SEQ ID NO: 181713 - DNA, 16 bp, P. troglodytes
aaaaccaccattgtca

SEQ ID NO: 181714 - DNA, 16 bp, P. troglodytes
aaaaccagaaatacca

SEQ ID NO: 181715 - DNA, 16 bp, P. troglodytes
aaaaccagagatgaaa

SEQ ID NO: 181716 - DNA, 21 bp, P. troglodytes
aaaaccagcaagtttttatta

SEQ ID NO: 181717 - DNA, 16 bp, P. troglodytes
aaaaccagcaggtttt

SEQ ID NO: 181718 - DNA, 16 bp, P. troglodytes
aaaaccagccaggcac

SEQ ID NO: 181719 - DNA, 16 bp, P. troglodytes
aaaaccagggaagcca

SEQ ID NO: 181720 - DNA, 16 bp, P. troglodytes
aaaaccatctctacaa

SEQ ID NO: 181721 - DNA, 16 bp, P. troglodytes
aaaaccatcttttaaa

SEQ ID NO: 181722 - DNA, 16 bp, P. troglodytes
aaaaccatgggaaaag

SEQ ID NO: 181723 - DNA, 16 bp, P. troglodytes
aaaaccattctaaaat

SEQ ID NO: 181724 - DNA, 16 bp, P. troglodytes
aaaaccatttgttgaa

SEQ ID NO: 181725 - DNA, 16 bp, P. troglodytes
aaaaccattttataat

SEQ ID NO: 181726 - DNA, 16 bp, P. troglodytes
aaaacccaaaactatg

SEQ ID NO: 181727 - DNA, 16 bp, P. troglodytes
aaaacccaggaggtgg

SEQ ID NO: 181728 - DNA, 16 bp, P. troglodytes
aaaacccatcagatct

SEQ ID NO: 181729 - DNA, 20 bp, P. troglodytes
aaaacccatctctactaaaa

SEQ ID NO: 181730 - DNA, 16 bp, P. troglodytes
aaaacccatctcttct

SEQ ID NO: 181731 - DNA, 16 bp, P. troglodytes
aaaaccccgtctgtac

SEQ ID NO: 181732 - DNA, 16 bp, P. troglodytes
aaaaccctaaaaattc

SEQ ID NO: 181733 - DNA, 16 bp, P. troglodytes
aaaaccctatttccaa

SEQ ID NO: 181734 - DNA, 16 bp, P. troglodytes
aaaaccctcagcaaaa

SEQ ID NO: 181735 - DNA, 16 bp, P. troglodytes
aaaaccctggacacca

SEQ ID NO: 181736 - DNA, 16 bp, P. troglodytes
aaaaccctgtatctac

SEQ ID NO: 181737 - DNA, 16 bp, P. troglodytes
aaaaccctgtctccaa

SEQ ID NO: 181738 - DNA, 16 bp, P. troglodytes
aaaacccttctagaca

SEQ ID NO: 181739 - DNA, 16 bp, P. troglodytes
aaaacctaccaagcaa

SEQ ID NO: 181740 - DNA, 16 bp, P. troglodytes
aaaacctagaagaaat

SEQ ID NO: 181741 - DNA, 16 bp, P. troglodytes
aaaacctagaggaaaa

SEQ ID NO: 181742 - DNA, 16 bp, P. troglodytes
aaaacctagcagaaga

SEQ ID NO: 181743 - DNA, 16 bp, P. troglodytes
aaaacctagtatttga

SEQ ID NO: 181744 - DNA, 17 bp, P. troglodytes
aaaacctatcagattaa

SEQ ID NO: 181745 - DNA, 16 bp, P. troglodytes
aaaacctcagcaaaat

SEQ ID NO: 181746 - DNA, 16 bp, P. troglodytes
aaaacctggaagacaa

SEQ ID NO: 181747 - DNA, 16 bp, P. troglodytes
aaaacctggcagagat

SEQ ID NO: 181748 - DNA, 16 bp, P. troglodytes
aaaacctgttagaact

SEQ ID NO: 181749 - DNA, 16 bp, P. troglodytes
aaaacctgttcaggca

SEQ ID NO: 181750 - DNA, 16 bp, P. troglodytes
aaaaccttatttacaa

SEQ ID NO: 181751 - DNA, 16 bp, P. troglodytes
aaaaccttcccactcc

SEQ ID NO: 181752 - DNA, 16 bp, P. troglodytes
aaaaccttgaaaaaag

SEQ ID NO: 181753 - DNA, 16 bp, P. troglodytes
aaaaccttgaaaaata

SEQ ID NO: 181754 - DNA, 16 bp, P. troglodytes
aaaaccttgaagaaat

SEQ ID NO: 181755 - DNA, 21 bp, P. troglodytes
aaaaccttgtctctaccaaaa

SEQ ID NO: 181756 - DNA, 16 bp, P. troglodytes
aaaacctttatatttt

SEQ ID NO: 181757 - DNA, 17 bp, P. troglodytes
aaaacggaccaatcagc

SEQ ID NO: 181758 - DNA, 16 bp, P. troglodytes
aaaacgtttttaaaaa

SEQ ID NO: 181759 - DNA, 16 bp, P. troglodytes
aaaactaaaatgcaga

SEQ ID NO: 181760 - DNA, 16 bp, P. troglodytes
aaaactaaacatgcaa

SEQ ID NO: 181761 - DNA, 16 bp, P. troglodytes
aaaactaaagtttaaa

SEQ ID NO: 181762 - DNA, 16 bp, P. troglodytes
aaaactaactcaagaa

SEQ ID NO: 181763 - DNA, 16 bp, P. troglodytes
aaaactaagaattttt

SEQ ID NO: 181764 - DNA, 16 bp, P. troglodytes
aaaactaagctgtgct

SEQ ID NO: 181765 - DNA, 16 bp, P. troglodytes
aaaactaaggctcaga

SEQ ID NO: 181766 - DNA, 16 bp, P. troglodytes
aaaactaatttttctt

SEQ ID NO: 181767 - DNA, 16 bp, P. troglodytes
aaaactacaaaacttc

SEQ ID NO: 181768 - DNA, 16 bp, P. troglodytes
aaaactacagaaacag

SEQ ID NO: 181769 - DNA, 16 bp, P. troglodytes
aaaactacagactgat

SEQ ID NO: 181770 - DNA, 16 bp, P. troglodytes
aaaactacagatcaat

SEQ ID NO: 181771 - DNA, 16 bp, P. troglodytes
aaaactacttttattt

SEQ ID NO: 181772 - DNA, 16 bp, P. troglodytes
aaaactagaaaacttt

SEQ ID NO: 181773 - DNA, 16 bp, P. troglodytes
aaaactagaaataatc

SEQ ID NO: 181774 - DNA, 16 bp, P. troglodytes
aaaactagaagaaatg

SEQ ID NO: 181775 - DNA, 16 bp, P. troglodytes
aaaactagacagagaa

SEQ ID NO: 181776 - DNA, 16 bp, P. troglodytes
aaaactagccaggcgt

SEQ ID NO: 181777 - DNA, 16 bp, P. troglodytes
aaaactataaaacctt

SEQ ID NO: 181778 - DNA, 16 bp, P. troglodytes
aaaactataaagcatt

SEQ ID NO: 181779 - DNA, 16 bp, P. troglodytes
aaaactatagtgacag

SEQ ID NO: 181780 - DNA, 16 bp, P. troglodytes
aaaactatcattattt

SEQ ID NO: 181781 - DNA, 16 bp, P. troglodytes
aaaactatctattggg

SEQ ID NO: 181782 - DNA, 16 bp, P. troglodytes
aaaactatgttaaaat

SEQ ID NO: 181783 - DNA, 16 bp, P. troglodytes
aaaactattttaagaa

SEQ ID NO: 181784 - DNA, 16 bp, P. troglodytes
aaaactcaacagcaaa

SEQ ID NO: 181785 - DNA, 16 bp, P. troglodytes
aaaactcaatagcaaa

SEQ ID NO: 181786 - DNA, 16 bp, P. troglodytes
aaaactcaggcaaagg

SEQ ID NO: 181787 - DNA, 16 bp, P. troglodytes
aaaactcagttgtatg

SEQ ID NO: 181788 - DNA, 16 bp, P. troglodytes
aaaactcatgtggaaa

SEQ ID NO: 181789 - DNA, 16 bp, P. troglodytes
aaaactcatgttgaaa

SEQ ID NO: 181790 - DNA, 16 bp, P. troglodytes
aaaactcattaaaaag

SEQ ID NO: 181791 - DNA, 16 bp, P. troglodytes
aaaactcattttgttt

SEQ ID NO: 181792 - DNA, 16 bp, P. troglodytes
aaaactccactgtaca

SEQ ID NO: 181793 - DNA, 16 bp, P. troglodytes
aaaactccatactgtt

SEQ ID NO: 181794 - DNA, 16 bp, P. troglodytes
aaaactccatttaaaa

SEQ ID NO: 181795 - DNA, 16 bp, P. troglodytes
aaaactccgtctctac

SEQ ID NO: 181796 - DNA, 16 bp, P. troglodytes
aaaactcctacaactc

SEQ ID NO: 181797 - DNA, 16 bp, P. troglodytes
aaaactcctcaatcaa

SEQ ID NO: 181798 - DNA, 16 bp, P. troglodytes
aaaactccttatctga

SEQ ID NO: 181799 - DNA, 16 bp, P. troglodytes
aaaactctcagaaaac

SEQ ID NO: 181800 - DNA, 16 bp, P. troglodytes
aaaactctgaaataaa

SEQ ID NO: 181801 - DNA, 16 bp, P. troglodytes
aaaactctgaataaat

SEQ ID NO: 181802 - DNA, 16 bp, P. troglodytes
aaaactctgccaaaaa

SEQ ID NO: 181803 - DNA, 16 bp, P. troglodytes
aaaactctgtcaaaaa

SEQ ID NO: 181804 - DNA, 16 bp, P. troglodytes
aaaactcttagaagaa

SEQ ID NO: 181805 - DNA, 16 bp, P. troglodytes
aaaactctttcttttg

SEQ ID NO: 181806 - DNA, 16 bp, P. troglodytes
aaaactgaaaacaacc

SEQ ID NO: 181807 - DNA, 16 bp, P. troglodytes
aaaactgaaaaccttt

SEQ ID NO: 181808 - DNA, 16 bp, P. troglodytes
aaaactgaaaactcta

SEQ ID NO: 181809 - DNA, 16 bp, P. troglodytes
aaaactgaaactggaa

SEQ ID NO: 181810 - DNA, 16 bp, P. troglodytes
aaaactgaaagaattc

SEQ ID NO: 181811 - DNA, 16 bp, P. troglodytes
aaaactgaaatgaaat

SEQ ID NO: 181812 - DNA, 16 bp, P. troglodytes
aaaactgaacaccaca

SEQ ID NO: 181813 - DNA, 16 bp, P. troglodytes
aaaactgaagcaagaa

SEQ ID NO: 181814 - DNA, 16 bp, P. troglodytes
aaaactgaagctggac

SEQ ID NO: 181815 - DNA, 16 bp, P. troglodytes
aaaactgaagttcaga

SEQ ID NO: 181816 - DNA, 16 bp, P. troglodytes
aaaactgacatcttaa

SEQ ID NO: 181817 - DNA, 16 bp, P. troglodytes
aaaactgacattttta

SEQ ID NO: 181818 - DNA, 16 bp, P. troglodytes
aaaactgacttttttt

SEQ ID NO: 181819 - DNA, 16 bp, P. troglodytes
aaaactgagaaattta

SEQ ID NO: 181820 - DNA, 16 bp, P. troglodytes
aaaactgagactcaga

SEQ ID NO: 181821 - DNA, 16 bp, P. troglodytes
aaaactgagatttgaa

SEQ ID NO: 181822 - DNA, 16 bp, P. troglodytes
aaaactgaggcacaag

SEQ ID NO: 181823 - DNA, 16 bp, P. troglodytes
aaaactgaggcccaag

SEQ ID NO: 181824 - DNA, 16 bp, P. troglodytes
aaaactgatagaacta

SEQ ID NO: 181825 - DNA, 16 bp, P. troglodytes
aaaactgattatttta

SEQ ID NO: 181826 - DNA, 16 bp, P. troglodytes
aaaactgattttaaaa

SEQ ID NO: 181827 - DNA, 16 bp, P. troglodytes
aaaactgcaaaaagag

SEQ ID NO: 181828 - DNA, 16 bp, P. troglodytes
aaaactgcaatgcctg

SEQ ID NO: 181829 - DNA, 16 bp, P. troglodytes
aaaactgcaattactt

SEQ ID NO: 181830 - DNA, 16 bp, P. troglodytes
aaaactgcagaagcag

SEQ ID NO: 181831 - DNA, 16 bp, P. troglodytes
aaaactgctctgaaaa

SEQ ID NO: 181832 - DNA, 16 bp, P. troglodytes
aaaactgctgaatcaa

SEQ ID NO: 181833 - DNA, 16 bp, P. troglodytes
aaaactgctgggatta

SEQ ID NO: 181834 - DNA, 16 bp, P. troglodytes
aaaactgcttttgctg

SEQ ID NO: 181835 - DNA, 16 bp, P. troglodytes
aaaactggaaaatgta

SEQ ID NO: 181836 - DNA, 16 bp, P. troglodytes
aaaactggaaaccatc

SEQ ID NO: 181837 - DNA, 16 bp, P. troglodytes
aaaactggaaatgacc

SEQ ID NO: 181838 - DNA, 16 bp, P. troglodytes
aaaactggaaattaat

SEQ ID NO: 181839 - DNA, 16 bp, P. troglodytes
aaaactggaagctttc

SEQ ID NO: 181840 - DNA, 16 bp, P. troglodytes
aaaactggacaaaata

SEQ ID NO: 181841 - DNA, 16 bp, P. troglodytes
aaaactggacagaagc

SEQ ID NO: 181842 - DNA, 16 bp, P. troglodytes
aaaactggagaaaata

SEQ ID NO: 181843 - DNA, 16 bp, P. troglodytes
aaaactggaggaaaaa

SEQ ID NO: 181844 - DNA, 16 bp, P. troglodytes
aaaactggctatccat

SEQ ID NO: 181845 - DNA, 16 bp, P. troglodytes
aaaactgggaaaataa

SEQ ID NO: 181846 - DNA, 16 bp, P. troglodytes
aaaactggggctcaga

SEQ ID NO: 181847 - DNA, 16 bp, P. troglodytes
aaaactggtaataaaa

SEQ ID NO: 181848 - DNA, 16 bp, P. troglodytes
aaaactgtaaaataat

SEQ ID NO: 181849 - DNA, 16 bp, P. troglodytes
aaaactgtaagataat

SEQ ID NO: 181850 - DNA, 16 bp, P. troglodytes
aaaactgtacagcatg

SEQ ID NO: 181851 - DNA, 16 bp, P. troglodytes
aaaactgtataaaata

SEQ ID NO: 181852 - DNA, 16 bp, P. troglodytes
aaaactgtattttatt

SEQ ID NO: 181853 - DNA, 16 bp, P. troglodytes
aaaactgtcacagcca

SEQ ID NO: 181854 - DNA, 16 bp, P. troglodytes
aaaactgtcagaatca

SEQ ID NO: 181855 - DNA, 16 bp, P. troglodytes
aaaactgtctattttt

SEQ ID NO: 181856 - DNA, 16 bp, P. troglodytes
aaaactgtcttaaaaa

SEQ ID NO: 181857 - DNA, 16 bp, P. troglodytes
aaaactgtgttttttt

SEQ ID NO: 181858 - DNA, 16 bp, P. troglodytes
aaaactgttaaaatat

SEQ ID NO: 181859 - DNA, 16 bp, P. troglodytes
aaaactgttcctattt

SEQ ID NO: 181860 - DNA, 16 bp, P. troglodytes
aaaactgttttcaaaa

SEQ ID NO: 181861 - DNA, 16 bp, P. troglodytes
aaaactgttttctttc

SEQ ID NO: 181862 - DNA, 16 bp, P. troglodytes
aaaacttaaaagttta

SEQ ID NO: 181863 - DNA, 16 bp, P. troglodytes
aaaacttaagtataat

SEQ ID NO: 181864 - DNA, 16 bp, P. troglodytes
aaaacttacaacaaag

SEQ ID NO: 181865 - DNA, 16 bp, P. troglodytes
aaaacttacatccaca

SEQ ID NO: 181866 - DNA, 16 bp, P. troglodytes
aaaacttactgcaaag

SEQ ID NO: 181867 - DNA, 16 bp, P. troglodytes
aaaacttactttttaa

SEQ ID NO: 181868 - DNA, 16 bp, P. troglodytes
aaaacttagccaagtg

SEQ ID NO: 181869 - DNA, 16 bp, P. troglodytes
aaaacttagccaggca

SEQ ID NO: 181870 - DNA, 16 bp, P. troglodytes
aaaacttagccaggcg

SEQ ID NO: 181871 - DNA, 16 bp, P. troglodytes
aaaacttagctgggtg

SEQ ID NO: 181872 - DNA, 16 bp, P. troglodytes
aaaacttatttaaaga

SEQ ID NO: 181873 - DNA, 16 bp, P. troglodytes
aaaacttcaatttttt

SEQ ID NO: 181874 - DNA, 16 bp, P. troglodytes
aaaacttcacattaaa

SEQ ID NO: 181875 - DNA, 16 bp, P. troglodytes
aaaacttcagaaaatt

SEQ ID NO: 181876 - DNA, 16 bp, P. troglodytes
aaaacttcagtttaaa

SEQ ID NO: 181877 - DNA, 16 bp, P. troglodytes
aaaacttctagaaata

SEQ ID NO: 181878 - DNA, 16 bp, P. troglodytes
aaaacttctcaaaaga

SEQ ID NO: 181879 - DNA, 16 bp, P. troglodytes
aaaacttgaaattatt

SEQ ID NO: 181880 - DNA, 16 bp, P. troglodytes
aaaacttgattttaaa

SEQ ID NO: 181881 - DNA, 16 bp, P. troglodytes
aaaacttggaaaaaat

SEQ ID NO: 181882 - DNA, 16 bp, P. troglodytes
aaaactttaaaaattg

SEQ ID NO: 181883 - DNA, 16 bp, P. troglodytes
aaaactttaaaatgtt

SEQ ID NO: 181884 - DNA, 16 bp, P. troglodytes
aaaactttactgaatt

SEQ ID NO: 181885 - DNA, 16 bp, P. troglodytes
aaaactttatttctaa

SEQ ID NO: 181886 - DNA, 16 bp, P. troglodytes
aaaactttatttgaaa

SEQ ID NO: 181887 - DNA, 16 bp, P. troglodytes
aaaactttcagaaaaa

SEQ ID NO: 181888 - DNA, 16 bp, P. troglodytes
aaaactttctggaaag

SEQ ID NO: 181889 - DNA, 16 bp, P. troglodytes
aaaactttgtaaaata

SEQ ID NO: 181890 - DNA, 16 bp, P. troglodytes
aaaactttgtttttat

SEQ ID NO: 181891 - DNA, 16 bp, P. troglodytes
aaaacttttaaaagaa

SEQ ID NO: 181892 - DNA, 16 bp, P. troglodytes
aaaacttttaagtatg

SEQ ID NO: 181893 - DNA, 16 bp, P. troglodytes
aaaacttttagaaaaa

SEQ ID NO: 181894 - DNA, 16 bp, P. troglodytes
aaaacttttattttga

SEQ ID NO: 181895 - DNA, 16 bp, P. troglodytes
aaaacttttctcaaaa

SEQ ID NO: 181896 - DNA, 16 bp, P. troglodytes
aaaacttttctgaaaa

SEQ ID NO: 181897 - DNA, 16 bp, P. troglodytes
aaaacttttctgtttt

SEQ ID NO: 181898 - DNA, 16 bp, P. troglodytes
aaaacttttcttttga

SEQ ID NO: 181899 - DNA, 16 bp, P. troglodytes
aaaacttttgaatttt

SEQ ID NO: 181900 - DNA, 16 bp, P. troglodytes
aaaacttttgtttttt

SEQ ID NO: 181901 - DNA, 16 bp, P. troglodytes
aaaactttttaaaaag

SEQ ID NO: 181902 - DNA, 16 bp, P. troglodytes
aaaacttttttaaaga

SEQ ID NO: 181903 - DNA, 16 bp, P. troglodytes
aaaagaaaaaactttt

SEQ ID NO: 181904 - DNA, 16 bp, P. troglodytes
aaaagaaaaaatgctt

SEQ ID NO: 181905 - DNA, 16 bp, P. troglodytes
aaaagaaaaacattct

SEQ ID NO: 181906 - DNA, 16 bp, P. troglodytes
aaaagaaaaaccttag

SEQ ID NO: 181907 - DNA, 16 bp, P. troglodytes
aaaagaaaaactactg

SEQ ID NO: 181908 - DNA, 16 bp, P. troglodytes
aaaagaaaaactgttt

SEQ ID NO: 181909 - DNA, 16 bp, P. troglodytes
aaaagaaaaacttatt

SEQ ID NO: 181910 - DNA, 16 bp, P. troglodytes
aaaagaaaaacttcag

SEQ ID NO: 181911 - DNA, 16 bp, P. troglodytes
aaaagaaaaagagtct

SEQ ID NO: 181912 - DNA, 16 bp, P. troglodytes
aaaagaaaaagctatt

SEQ ID NO: 181913 - DNA, 16 bp, P. troglodytes
aaaagaaaaagctgag

SEQ ID NO: 181914 - DNA, 16 bp, P. troglodytes
aaaagaaaaagctgga

SEQ ID NO: 181915 - DNA, 16 bp, P. troglodytes
aaaagaaaaagttcct

SEQ ID NO: 181916 - DNA, 16 bp, P. troglodytes
aaaagaaaaagttggt

SEQ ID NO: 181917 - DNA, 16 bp, P. troglodytes
aaaagaaaaatcattt

SEQ ID NO: 181918 - DNA, 16 bp, P. troglodytes
aaaagaaaaatctttt

SEQ ID NO: 181919 - DNA, 16 bp, P. troglodytes
aaaagaaaaatgtctg

SEQ ID NO: 181920 - DNA, 16 bp, P. troglodytes
aaaagaaaaattacct

SEQ ID NO: 181921 - DNA, 16 bp, P. troglodytes
aaaagaaaaattactt

SEQ ID NO: 181922 - DNA, 16 bp, P. troglodytes
aaaagaaaaattgcac

SEQ ID NO: 181923 - DNA, 16 bp, P. troglodytes
aaaagaaaacacagct

SEQ ID NO: 181924 - DNA, 16 bp, P. troglodytes
aaaagaaaacataggt

SEQ ID NO: 181925 - DNA, 16 bp, P. troglodytes
aaaagaaaacatcatt

SEQ ID NO: 181926 - DNA, 16 bp, P. troglodytes
aaaagaaaacatttat

SEQ ID NO: 181927 - DNA, 16 bp, P. troglodytes
aaaagaaaacatttta

SEQ ID NO: 181928 - DNA, 16 bp, P. troglodytes
aaaagaaaaccatttt

SEQ ID NO: 181929 - DNA, 16 bp, P. troglodytes
aaaagaaaacctacag

SEQ ID NO: 181930 - DNA, 16 bp, P. troglodytes
aaaagaaaactgaatt

SEQ ID NO: 181931 - DNA, 16 bp, P. troglodytes
aaaagaaaagaacttt

SEQ ID NO: 181932 - DNA, 16 bp, P. troglodytes
aaaagaaaagaaggct

SEQ ID NO: 181933 - DNA, 16 bp, P. troglodytes
aaaagaaaagcatcca

SEQ ID NO: 181934 - DNA, 16 bp, P. troglodytes
aaaagaaaagcatttc

SEQ ID NO: 181935 - DNA, 16 bp, P. troglodytes
aaaagaaaaggtttta

SEQ ID NO: 181936 - DNA, 16 bp, P. troglodytes
aaaagaaaaggttttt

SEQ ID NO: 181937 - DNA, 16 bp, P. troglodytes
aaaagaaaagtttcct

SEQ ID NO: 181938 - DNA, 16 bp, P. troglodytes
aaaagaaaataacttt

SEQ ID NO: 181939 - DNA, 16 bp, P. troglodytes
aaaagaaaatctatta

SEQ ID NO: 181940 - DNA, 16 bp, P. troglodytes
aaaagaaaatctttta

SEQ ID NO: 181941 - DNA, 16 bp, P. troglodytes
aaaagaaaatgagtct

SEQ ID NO: 181942 - DNA, 16 bp, P. troglodytes
aaaagaaaatggtttg

SEQ ID NO: 181943 - DNA, 16 bp, P. troglodytes
aaaagaaaattaatgc

SEQ ID NO: 181944 - DNA, 16 bp, P. troglodytes
aaaagaaaattacagg

SEQ ID NO: 181945 - DNA, 16 bp, P. troglodytes
aaaagaaaattatctt

SEQ ID NO: 181946 - DNA, 16 bp, P. troglodytes
aaaagaaaattattct

SEQ ID NO: 181947 - DNA, 16 bp, P. troglodytes
aaaagaaaattttcca

SEQ ID NO: 181948 - DNA, 16 bp, P. troglodytes
aaaagaaacaaacttt

SEQ ID NO: 181949 - DNA, 16 bp, P. troglodytes
aaaagaaacagggttt

SEQ ID NO: 181950 - DNA, 16 bp, P. troglodytes
aaaagaaacaggtgaa

SEQ ID NO: 181951 - DNA, 16 bp, P. troglodytes
aaaagaaacatatttt

SEQ ID NO: 181952 - DNA, 16 bp, P. troglodytes
aaaagaaaccccatac

SEQ ID NO: 181953 - DNA, 16 bp, P. troglodytes
aaaagaaactatcaat

SEQ ID NO: 181954 - DNA, 16 bp, P. troglodytes
aaaagaaactgaagag

SEQ ID NO: 181955 - DNA, 16 bp, P. troglodytes
aaaagaaagaattcta

SEQ ID NO: 181956 - DNA, 16 bp, P. troglodytes
aaaagaaagagagatc

SEQ ID NO: 181957 - DNA, 16 bp, P. troglodytes
aaaagaaagagatttt

SEQ ID NO: 181958 - DNA, 16 bp, P. troglodytes
aaaagaaagaggttta

SEQ ID NO: 181959 - DNA, 16 bp, P. troglodytes
aaaagaaagatgattt

SEQ ID NO: 181960 - DNA, 16 bp, P. troglodytes
aaaagaaagcaattta

SEQ ID NO: 181961 - DNA, 16 bp, P. troglodytes
aaaagaaagctacaga

SEQ ID NO: 181962 - DNA, 16 bp, P. troglodytes
aaaagaaagctgcatt

SEQ ID NO: 181963 - DNA, 16 bp, P. troglodytes
aaaagaaagctgtaag

SEQ ID NO: 181964 - DNA, 16 bp, P. troglodytes
aaaagaaagtattttt

SEQ ID NO: 181965 - DNA, 16 bp, P. troglodytes
aaaagaaagttttttt

SEQ ID NO: 181966 - DNA, 16 bp, P. troglodytes
aaaagaaataaagggc

SEQ ID NO: 181967 - DNA, 16 bp, P. troglodytes
aaaagaaatacatatt

SEQ ID NO: 181968 - DNA, 16 bp, P. troglodytes
aaaagaaatatttttg

SEQ ID NO: 181969 - DNA, 16 bp, P. troglodytes
aaaagaaatcagaatt

SEQ ID NO: 181970 - DNA, 16 bp, P. troglodytes
aaaagaaatcagacat

SEQ ID NO: 181971 - DNA, 16 bp, P. troglodytes
aaaagaaatcatttaa

SEQ ID NO: 181972 - DNA, 16 bp, P. troglodytes
aaaagaaatctatgaa

SEQ ID NO: 181973 - DNA, 16 bp, P. troglodytes
aaaagaaatctctgga

SEQ ID NO: 181974 - DNA, 16 bp, P. troglodytes
aaaagaaatgagccat

SEQ ID NO: 181975 - DNA, 16 bp, P. troglodytes
aaaagaaatgatttgg

SEQ ID NO: 181976 - DNA, 16 bp, P. troglodytes
aaaagaaatgcaagtt

SEQ ID NO: 181977 - DNA, 16 bp, P. troglodytes
aaaagaaatgcttaaa

SEQ ID NO: 181978 - DNA, 16 bp, P. troglodytes
aaaagaaatgttcaaa

SEQ ID NO: 181979 - DNA, 16 bp, P. troglodytes
aaaagaaatgttcatt

SEQ ID NO: 181980 - DNA, 16 bp, P. troglodytes
aaaagaaatgttttta

SEQ ID NO: 181981 - DNA, 16 bp, P. troglodytes
aaaagaaatgtttttt

SEQ ID NO: 181982 - DNA, 16 bp, P. troglodytes
aaaagaaattatatca

SEQ ID NO: 181983 - DNA, 16 bp, P. troglodytes
aaaagaaattatccaa

SEQ ID NO: 181984 - DNA, 16 bp, P. troglodytes
aaaagaaattattctg

SEQ ID NO: 181985 - DNA, 16 bp, P. troglodytes
aaaagaaattcagttt

SEQ ID NO: 181986 - DNA, 16 bp, P. troglodytes
aaaagaaattccaact

SEQ ID NO: 181987 - DNA, 16 bp, P. troglodytes
aaaagaaattctggaa

SEQ ID NO: 181988 - DNA, 16 bp, P. troglodytes
aaaagaaattcttaaa

SEQ ID NO: 181989 - DNA, 16 bp, P. troglodytes
aaaagaaattcttaat

SEQ ID NO: 181990 - DNA, 16 bp, P. troglodytes
aaaagaaatttcagaa

SEQ ID NO: 181991 - DNA, 16 bp, P. troglodytes
aaaagaaatttcattt

SEQ ID NO: 181992 - DNA, 16 bp, P. troglodytes
aaaagaaatttcttca

SEQ ID NO: 181993 - DNA, 24 bp, P. troglodytes
aaaagaacaaagctggaggcatca

SEQ ID NO: 181994 - DNA, 16 bp, P. troglodytes
aaaagaacaaagttgg

SEQ ID NO: 181995 - DNA, 16 bp, P. troglodytes
aaaagaacaatttttt

SEQ ID NO: 181996 - DNA, 16 bp, P. troglodytes
aaaagaacagcaggtg

SEQ ID NO: 181997 - DNA, 16 bp, P. troglodytes
aaaagaacatttgttt

SEQ ID NO: 181998 - DNA, 16 bp, P. troglodytes
aaaagaactacagaag

SEQ ID NO: 181999 - DNA, 16 bp, P. troglodytes
aaaagaactgaaaatg

SEQ ID NO: 182000 - DNA, 16 bp, P. troglodytes
aaaagaactttcaaaa

SEQ ID NO: 182001 - DNA, 16 bp, P. troglodytes
aaaagaagaaaatcct

SEQ ID NO: 182002 - DNA, 16 bp, P. troglodytes
aaaagaagaaaatctt

SEQ ID NO: 182003 - DNA, 16 bp, P. troglodytes
aaaagaagaaactgag

SEQ ID NO: 182004 - DNA, 16 bp, P. troglodytes
aaaagaagaaagttct

SEQ ID NO: 182005 - DNA, 16 bp, P. troglodytes
aaaagaagaaatactg

SEQ ID NO: 182006 - DNA, 16 bp, P. troglodytes
aaaagaagaaatatct

SEQ ID NO: 182007 - DNA, 16 bp, P. troglodytes
aaaagaagaagaagct

SEQ ID NO: 182008 - DNA, 16 bp, P. troglodytes
aaaagaagacaattat

SEQ ID NO: 182009 - DNA, 16 bp, P. troglodytes
aaaagaagacatatat

SEQ ID NO: 182010 - DNA, 16 bp, P. troglodytes
aaaagaagacattcaa

SEQ ID NO: 182011 - DNA, 16 bp, P. troglodytes
aaaagaagacattttt

SEQ ID NO: 182012 - DNA, 16 bp, P. troglodytes
aaaagaagcagaaatt

SEQ ID NO: 182013 - DNA, 16 bp, P. troglodytes
aaaagaagctgaaaat

SEQ ID NO: 182014 - DNA, 16 bp, P. troglodytes
aaaagaagctttctga

SEQ ID NO: 182015 - DNA, 16 bp, P. troglodytes
aaaagaaggcattttt

SEQ ID NO: 182016 - DNA, 16 bp, P. troglodytes
aaaagaaggtatacaa

SEQ ID NO: 182017 - DNA, 16 bp, P. troglodytes
aaaagaagtaaaaggc

SEQ ID NO: 182018 - DNA, 16 bp, P. troglodytes
aaaagaagtatttttt

SEQ ID NO: 182019 - DNA, 16 bp, P. troglodytes
aaaagaagtcattaca

SEQ ID NO: 182020 - DNA, 16 bp, P. troglodytes
aaaagaagtcattatt

SEQ ID NO: 182021 - DNA, 16 bp, P. troglodytes
aaaagaagttatttta

SEQ ID NO: 182022 - DNA, 16 bp, P. troglodytes
aaaagaagttcttcaa

SEQ ID NO: 182023 - DNA, 16 bp, P. troglodytes
aaaagaataaaactct

SEQ ID NO: 182024 - DNA, 16 bp, P. troglodytes
aaaagaataaaactgg

SEQ ID NO: 182025 - DNA, 16 bp, P. troglodytes
aaaagaataaatgctt

SEQ ID NO: 182026 - DNA, 16 bp, P. troglodytes
aaaagaataaatgtgt

SEQ ID NO: 182027 - DNA, 16 bp, P. troglodytes
aaaagaatactatgaa

SEQ ID NO: 182028 - DNA, 16 bp, P. troglodytes
aaaagaatagtctttt

SEQ ID NO: 182029 - DNA, 16 bp, P. troglodytes
aaaagaatattttctt

SEQ ID NO: 182030 - DNA, 16 bp, P. troglodytes
aaaagaatcaaactct

SEQ ID NO: 182031 - DNA, 16 bp, P. troglodytes
aaaagaatcacttgaa

SEQ ID NO: 182032 - DNA, 16 bp, P. troglodytes
aaaagaatcacttgag

SEQ ID NO: 182033 - DNA, 16 bp, P. troglodytes
aaaagaatgaaatcag

SEQ ID NO: 182034 - DNA, 16 bp, P. troglodytes
aaaagaatgaaattct

SEQ ID NO: 182035 - DNA, 16 bp, P. troglodytes
aaaagaatgaagagca

SEQ ID NO: 182036 - DNA, 16 bp, P. troglodytes
aaaagaatgaagttgg

SEQ ID NO: 182037 - DNA, 16 bp, P. troglodytes
aaaagaatgaatggat

SEQ ID NO: 182038 - DNA, 16 bp, P. troglodytes
aaaagaatgaggttgg

SEQ ID NO: 182039 - DNA, 16 bp, P. troglodytes
aaaagaatggaaagca

SEQ ID NO: 182040 - DNA, 16 bp, P. troglodytes
aaaagaatgggatcat

SEQ ID NO: 182041 - DNA, 16 bp, P. troglodytes
aaaagaatgtgtgtgt

SEQ ID NO: 182042 - DNA, 16 bp, P. troglodytes
aaaagaatgtgtgttt

SEQ ID NO: 182043 - DNA, 16 bp, P. troglodytes
aaaagaattcagaagg

SEQ ID NO: 182044 - DNA, 16 bp, P. troglodytes
aaaagaattcagtaaa

SEQ ID NO: 182045 - DNA, 16 bp, P. troglodytes
aaaagaattctggaga

SEQ ID NO: 182046 - DNA, 16 bp, P. troglodytes
aaaagaattgaaatca

SEQ ID NO: 182047 - DNA, 16 bp, P. troglodytes
aaaagaatttaaagca

SEQ ID NO: 182048 - DNA, 16 bp, P. troglodytes
aaaagaatttcatttt

SEQ ID NO: 182049 - DNA, 16 bp, P. troglodytes
aaaagaatttcttaaa

SEQ ID NO: 182050 - DNA, 16 bp, P. troglodytes
aaaagaatttgttttt

SEQ ID NO: 182051 - DNA, 16 bp, P. troglodytes
aaaagaattttctttc

SEQ ID NO: 182052 - DNA, 16 bp, P. troglodytes
aaaagacaaaatattt

SEQ ID NO: 182053 - DNA, 16 bp, P. troglodytes
aaaagacaaatgaatt

SEQ ID NO: 182054 - DNA, 16 bp, P. troglodytes
aaaagacaaattctgt

SEQ ID NO: 182055 - DNA, 16 bp, P. troglodytes
aaaagacaacctgcag

SEQ ID NO: 182056 - DNA, 16 bp, P. troglodytes
aaaagacaattatttt

SEQ ID NO: 182057 - DNA, 16 bp, P. troglodytes
aaaagacacaaaattt

SEQ ID NO: 182058 - DNA, 16 bp, P. troglodytes
aaaagacacatttttt

SEQ ID NO: 182059 - DNA, 16 bp, P. troglodytes
aaaagacataatttta

SEQ ID NO: 182060 - DNA, 16 bp, P. troglodytes
aaaagacatgaacaga

SEQ ID NO: 182061 - DNA, 16 bp, P. troglodytes
aaaagacatgaatgaa

SEQ ID NO: 182062 - DNA, 16 bp, P. troglodytes
aaaagacatgagcaga

SEQ ID NO: 182063 - DNA, 16 bp, P. troglodytes
aaaagacatggagaaa

SEQ ID NO: 182064 - DNA, 16 bp, P. troglodytes
aaaagacatggatgaa

SEQ ID NO: 182065 - DNA, 16 bp, P. troglodytes
aaaagacattaaattt

SEQ ID NO: 182066 - DNA, 16 bp, P. troglodytes
aaaagacatttgaaaa

SEQ ID NO: 182067 - DNA, 16 bp, P. troglodytes
aaaagacattttaaaa

SEQ ID NO: 182068 - DNA, 16 bp, P. troglodytes
aaaagacattttaaat

SEQ ID NO: 182069 - DNA, 18 bp, P. troglodytes
aaaagaccaaatctacat

SEQ ID NO: 182070 - DNA, 16 bp, P. troglodytes
aaaagacctgtacttt

SEQ ID NO: 182071 - DNA, 16 bp, P. troglodytes
aaaagactacatattg

SEQ ID NO: 182072 - DNA, 16 bp, P. troglodytes
aaaagactctgcaaaa

SEQ ID NO: 182073 - DNA, 16 bp, P. troglodytes
aaaagactgataaaat

SEQ ID NO: 182074 - DNA, 16 bp, P. troglodytes
aaaagactgataaatt

SEQ ID NO: 182075 - DNA, 16 bp, P. troglodytes
aaaagacttgaataga

SEQ ID NO: 182076 - DNA, 16 bp, P. troglodytes
aaaagagaaaggattt

SEQ ID NO: 182077 - DNA, 16 bp, P. troglodytes
aaaagagaacccttgt

SEQ ID NO: 182078 - DNA, 16 bp, P. troglodytes
aaaagagaaggaaatc

SEQ ID NO: 182079 - DNA, 16 bp, P. troglodytes
aaaagagaatttcaaa

SEQ ID NO: 182080 - DNA, 16 bp, P. troglodytes
aaaagagaattttagg

SEQ ID NO: 182081 - DNA, 16 bp, P. troglodytes
aaaagagaattttgaa

SEQ ID NO: 182082 - DNA, 16 bp, P. troglodytes
aaaagagagaaaactc

SEQ ID NO: 182083 - DNA, 23 bp, P. troglodytes
aaaagagagaagaatcaaataga

SEQ ID NO: 182084 - DNA, 16 bp, P. troglodytes
aaaagagagattcaaa

SEQ ID NO: 182085 - DNA, 16 bp, P. troglodytes
aaaagagagcagaggt

SEQ ID NO: 182086 - DNA, 18 bp, P. troglodytes
aaaagagagtcagcaaag

SEQ ID NO: 182087 - DNA, 16 bp, P. troglodytes
aaaagagatttcaaga

SEQ ID NO: 182088 - DNA, 17 bp, P. troglodytes
aaaagagcaaagctgga

SEQ ID NO: 182089 - DNA, 16 bp, P. troglodytes
aaaagagcaggagtaa

SEQ ID NO: 182090 - DNA, 16 bp, P. troglodytes
aaaagagcagtggttc

SEQ ID NO: 182091 - DNA, 16 bp, P. troglodytes
aaaagagctctggaga

SEQ ID NO: 182092 - DNA, 16 bp, P. troglodytes
aaaagaggaaacattt

SEQ ID NO: 182093 - DNA, 16 bp, P. troglodytes
aaaagaggaaagattt

SEQ ID NO: 182094 - DNA, 16 bp, P. troglodytes
aaaagaggaagtccaa

SEQ ID NO: 182095 - DNA, 16 bp, P. troglodytes
aaaagaggaagttgct

SEQ ID NO: 182096 - DNA, 16 bp, P. troglodytes
aaaagaggatgatatt

SEQ ID NO: 182097 - DNA, 16 bp, P. troglodytes
aaaagagggactcctt

SEQ ID NO: 182098 - DNA, 16 bp, P. troglodytes
aaaagagtataattgt

SEQ ID NO: 182099 - DNA, 16 bp, P. troglodytes
aaaagagtgtgtgtgt

SEQ ID NO: 182100 - DNA, 16 bp, P. troglodytes
aaaagagttaatattt

SEQ ID NO: 182101 - DNA, 16 bp, P. troglodytes
aaaagagtttttcaaa

SEQ ID NO: 182102 - DNA, 16 bp, P. troglodytes
aaaagataattcacca

SEQ ID NO: 182103 - DNA, 16 bp, P. troglodytes
aaaagataattttcaa

SEQ ID NO: 182104 - DNA, 16 bp, P. troglodytes
aaaagatacattttta

SEQ ID NO: 182105 - DNA, 16 bp, P. troglodytes
aaaagatacatttttt

SEQ ID NO: 182106 - DNA, 16 bp, P. troglodytes
aaaagatatgatttca

SEQ ID NO: 182107 - DNA, 16 bp, P. troglodytes
aaaagatatgttaaag

SEQ ID NO: 182108 - DNA, 16 bp, P. troglodytes
aaaagatatgttgaag

SEQ ID NO: 182109 - DNA, 16 bp, P. troglodytes
aaaagatattctaaaa

SEQ ID NO: 182110 - DNA, 16 bp, P. troglodytes
aaaagatatttctttt

SEQ ID NO: 182111 - DNA, 16 bp, P. troglodytes
aaaagatatttgatat

SEQ ID NO: 182112 - DNA, 16 bp, P. troglodytes
aaaagatattttcaaa

SEQ ID NO: 182113 - DNA, 16 bp, P. troglodytes
aaaagatcaacaacat

SEQ ID NO: 182114 - DNA, 16 bp, P. troglodytes
aaaagatcactctggt

SEQ ID NO: 182115 - DNA, 16 bp, P. troglodytes
aaaagatcattagaga

SEQ ID NO: 182116 - DNA, 16 bp, P. troglodytes
aaaagatcatttacca

SEQ ID NO: 182117 - DNA, 16 bp, P. troglodytes
aaaagatgaaaatctt

SEQ ID NO: 182118 - DNA, 16 bp, P. troglodytes
aaaagatgaacctatc

SEQ ID NO: 182119 - DNA, 16 bp, P. troglodytes
aaaagatgcccaacat

SEQ ID NO: 182120 - DNA, 16 bp, P. troglodytes
aaaagatgctcaacat

SEQ ID NO: 182121 - DNA, 16 bp, P. troglodytes
aaaagatgtattttta

SEQ ID NO: 182122 - DNA, 16 bp, P. troglodytes
aaaagatgttggcatg

SEQ ID NO: 182123 - DNA, 16 bp, P. troglodytes
aaaagatgtttatttt

SEQ ID NO: 182124 - DNA, 16 bp, P. troglodytes
aaaagatgtttgtttt

SEQ ID NO: 182125 - DNA, 16 bp, P. troglodytes
aaaagattataatgga

SEQ ID NO: 182126 - DNA, 16 bp, P. troglodytes
aaaagattctaaaatt

SEQ ID NO: 182127 - DNA, 16 bp, P. troglodytes
aaaagattggacacct

SEQ ID NO: 182128 - DNA, 16 bp, P. troglodytes
aaaagattggggacca

SEQ ID NO: 182129 - DNA, 16 bp, P. troglodytes
aaaagattgttttaaa

SEQ ID NO: 182130 - DNA, 16 bp, P. troglodytes
aaaagatttaaaatgg

SEQ ID NO: 182131 - DNA, 16 bp, P. troglodytes
aaaagatttctttcaa

SEQ ID NO: 182132 - DNA, 16 bp, P. troglodytes
aaaagatttgaacaga

SEQ ID NO: 182133 - DNA, 16 bp, P. troglodytes
aaaagatttgaagaga

SEQ ID NO: 182134 - DNA, 16 bp, P. troglodytes
aaaagatttgcaaact

SEQ ID NO: 182135 - DNA, 16 bp, P. troglodytes
aaaagattttacattt

SEQ ID NO: 182136 - DNA, 16 bp, P. troglodytes
aaaagattttctgatt

SEQ ID NO: 182137 - DNA, 16 bp, P. troglodytes
aaaagatttttaaaca

SEQ ID NO: 182138 - DNA, 16 bp, P. troglodytes
aaaagcaaaaattttt

SEQ ID NO: 182139 - DNA, 16 bp, P. troglodytes
aaaagcaaaactatag

SEQ ID NO: 182140 - DNA, 16 bp, P. troglodytes
aaaagcaaaacttcat

SEQ ID NO: 182141 - DNA, 16 bp, P. troglodytes
aaaagcaaaagttttt

SEQ ID NO: 182142 - DNA, 16 bp, P. troglodytes
aaaagcaaacaacttt

SEQ ID NO: 182143 - DNA, 16 bp, P. troglodytes
aaaagcaaatatttct

SEQ ID NO: 182144 - DNA, 16 bp, P. troglodytes
aaaagcaaatgcagca

SEQ ID NO: 182145 - DNA, 16 bp, P. troglodytes
aaaagcaaatgggaga

SEQ ID NO: 182146 - DNA, 16 bp, P. troglodytes
aaaagcaaattcaagc

SEQ ID NO: 182147 - DNA, 16 bp, P. troglodytes
aaaagcaacagatgtt

SEQ ID NO: 182148 - DNA, 16 bp, P. troglodytes
aaaagcaacttcagca

SEQ ID NO: 182149 - DNA, 16 bp, P. troglodytes
aaaagcaagcaggaat

SEQ ID NO: 182150 - DNA, 16 bp, P. troglodytes
aaaagcaatgcaacaa

SEQ ID NO: 182151 - DNA, 16 bp, P. troglodytes
aaaagcaatgctaaga

SEQ ID NO: 182152 - DNA, 16 bp, P. troglodytes
aaaagcaattcagaaa

SEQ ID NO: 182153 - DNA, 16 bp, P. troglodytes
aaaagcaatttataga

SEQ ID NO: 182154 - DNA, 16 bp, P. troglodytes
aaaagcaatttgaaaa

SEQ ID NO: 182155 - DNA, 16 bp, P. troglodytes
aaaagcaattttcaaa

SEQ ID NO: 182156 - DNA, 16 bp, P. troglodytes
aaaagcacaattcata

SEQ ID NO: 182157 - DNA, 16 bp, P. troglodytes
aaaagcacagcctgga

SEQ ID NO: 182158 - DNA, 16 bp, P. troglodytes
aaaagcacaggcagca

SEQ ID NO: 182159 - DNA, 16 bp, P. troglodytes
aaaagcacatacagaa

SEQ ID NO: 182160 - DNA, 16 bp, P. troglodytes
aaaagcacattttaaa

SEQ ID NO: 182161 - DNA, 16 bp, P. troglodytes
aaaagcacttgacaaa

SEQ ID NO: 182162 - DNA, 16 bp, P. troglodytes
aaaagcactttgaaaa

SEQ ID NO: 182163 - DNA, 16 bp, P. troglodytes
aaaagcagaaactcct

SEQ ID NO: 182164 - DNA, 16 bp, P. troglodytes
aaaagcagaaagtaga

SEQ ID NO: 182165 - DNA, 16 bp, P. troglodytes
aaaagcagaaatgaga

SEQ ID NO: 182166 - DNA, 16 bp, P. troglodytes
aaaagcagaatttaaa

SEQ ID NO: 182167 - DNA, 16 bp, P. troglodytes
aaaagcagaattttaa

SEQ ID NO: 182168 - DNA, 16 bp, P. troglodytes
aaaagcagagtgcctc

SEQ ID NO: 182169 - DNA, 16 bp, P. troglodytes
aaaagcagattttatt

SEQ ID NO: 182170 - DNA, 16 bp, P. troglodytes
aaaagcagcagcaaca

SEQ ID NO: 182171 - DNA, 16 bp, P. troglodytes
aaaagcagccatggac

SEQ ID NO: 182172 - DNA, 16 bp, P. troglodytes
aaaagcaggaggtaaa

SEQ ID NO: 182173 - DNA, 16 bp, P. troglodytes
aaaagcaggcagtggg

SEQ ID NO: 182174 - DNA, 16 bp, P. troglodytes
aaaagcaggttacaaa

SEQ ID NO: 182175 - DNA, 16 bp, P. troglodytes
aaaagcataaaatact

SEQ ID NO: 182176 - DNA, 16 bp, P. troglodytes
aaaagcatatatttaa

SEQ ID NO: 182177 - DNA, 16 bp, P. troglodytes
aaaagcatatgataaa

SEQ ID NO: 182178 - DNA, 16 bp, P. troglodytes
aaaagcatatttttat

SEQ ID NO: 182179 - DNA, 16 bp, P. troglodytes
aaaagcatcagatctt

SEQ ID NO: 182180 - DNA, 16 bp, P. troglodytes
aaaagcatccagattg

SEQ ID NO: 182181 - DNA, 16 bp, P. troglodytes
aaaagcattctgagaa

SEQ ID NO: 182182 - DNA, 16 bp, P. troglodytes
aaaagcatttaaaaag

SEQ ID NO: 182183 - DNA, 16 bp, P. troglodytes
aaaagcatttatattt

SEQ ID NO: 182184 - DNA, 16 bp, P. troglodytes
aaaagcatttcaaaaa

SEQ ID NO: 182185 - DNA, 16 bp, P. troglodytes
aaaagcatttccattt

SEQ ID NO: 182186 - DNA, 16 bp, P. troglodytes
aaaagcatttcttttt

SEQ ID NO: 182187 - DNA, 16 bp, P. troglodytes
aaaagcatttgacaaa

SEQ ID NO: 182188 - DNA, 16 bp, P. troglodytes
aaaagcatttgacaca

SEQ ID NO: 182189 - DNA, 16 bp, P. troglodytes
aaaagcatttgatgaa

SEQ ID NO: 182190 - DNA, 16 bp, P. troglodytes
aaaagcattttcacag

SEQ ID NO: 182191 - DNA, 16 bp, P. troglodytes
aaaagcatttttaaaa

SEQ ID NO: 182192 - DNA, 16 bp, P. troglodytes
aaaagccaaaaggtgg

SEQ ID NO: 182193 - DNA, 16 bp, P. troglodytes
aaaagccaaaatattt

SEQ ID NO: 182194 - DNA, 16 bp, P. troglodytes
aaaagccaaagtcttt

SEQ ID NO: 182195 - DNA, 16 bp, P. troglodytes
aaaagccagagtgcct

SEQ ID NO: 182196 - DNA, 16 bp, P. troglodytes
aaaagccagtgccctt

SEQ ID NO: 182197 - DNA, 16 bp, P. troglodytes
aaaagccatctgtgac

SEQ ID NO: 182198 - DNA, 16 bp, P. troglodytes
aaaagccattctaaca

SEQ ID NO: 182199 - DNA, 16 bp, P. troglodytes
aaaagccattgaattg

SEQ ID NO: 182200 - DNA, 16 bp, P. troglodytes
aaaagccatttaaaaa

SEQ ID NO: 182201 - DNA, 16 bp, P. troglodytes
aaaagcccaggaactg

SEQ ID NO: 182202 - DNA, 16 bp, P. troglodytes
aaaagccttatttttt

SEQ ID NO: 182203 - DNA, 16 bp, P. troglodytes
aaaagccttttatttt

SEQ ID NO: 182204 - DNA, 16 bp, P. troglodytes
aaaagctacatacctc

SEQ ID NO: 182205 - DNA, 16 bp, P. troglodytes
aaaagctagaagagaa

SEQ ID NO: 182206 - DNA, 16 bp, P. troglodytes
aaaagctatttttaaa

SEQ ID NO: 182207 - DNA, 16 bp, P. troglodytes
aaaagctcaacaaaat

SEQ ID NO: 182208 - DNA, 16 bp, P. troglodytes
aaaagctcagaaaatt

SEQ ID NO: 182209 - DNA, 16 bp, P. troglodytes
aaaagctccctgaagc

SEQ ID NO: 182210 - DNA, 16 bp, P. troglodytes
aaaagctgaaggattt

SEQ ID NO: 182211 - DNA, 16 bp, P. troglodytes
aaaagctgaataaaat

SEQ ID NO: 182212 - DNA, 16 bp, P. troglodytes
aaaagctgaataattt

SEQ ID NO: 182213 - DNA, 16 bp, P. troglodytes
aaaagctgacagtata

SEQ ID NO: 182214 - DNA, 16 bp, P. troglodytes
aaaagctgaggaaatt

SEQ ID NO: 182215 - DNA, 16 bp, P. troglodytes
aaaagctgcaggcatt

SEQ ID NO: 182216 - DNA, 16 bp, P. troglodytes
aaaagctggaaatatt

SEQ ID NO: 182217 - DNA, 16 bp, P. troglodytes
aaaagctggaagcatt

SEQ ID NO: 182218 - DNA, 17 bp, P. troglodytes
aaaagctggaggcatca

SEQ ID NO: 182219 - DNA, 17 bp, P. troglodytes
aaaagcttatccaccac

SEQ ID NO: 182220 - DNA, 16 bp, P. troglodytes
aaaagcttatttaaag

SEQ ID NO: 182221 - DNA, 16 bp, P. troglodytes
aaaagcttctgcacaa

SEQ ID NO: 182222 - DNA, 16 bp, P. troglodytes
aaaagcttcttcacag

SEQ ID NO: 182223 - DNA, 16 bp, P. troglodytes
aaaagctttaaaaaat

SEQ ID NO: 182224 - DNA, 16 bp, P. troglodytes
aaaagctttaaaaaca

SEQ ID NO: 182225 - DNA, 16 bp, P. troglodytes
aaaagctttaattttt

SEQ ID NO: 182226 - DNA, 16 bp, P. troglodytes
aaaagctttcattttt

SEQ ID NO: 182227 - DNA, 16 bp, P. troglodytes
aaaagctttcctattt

SEQ ID NO: 182228 - DNA, 16 bp, P. troglodytes
aaaagctttgaaaaaa

SEQ ID NO: 182229 - DNA, 16 bp, P. troglodytes
aaaagctttggatttt

SEQ ID NO: 182230 - DNA, 16 bp, P. troglodytes
aaaagcttttaataaa

SEQ ID NO: 182231 - DNA, 16 bp, P. troglodytes
aaaagcttttgataaa

SEQ ID NO: 182232 - DNA, 16 bp, P. troglodytes
aaaagctttttaaaaa

SEQ ID NO: 182233 - DNA, 16 bp, P. troglodytes
aaaagctttttaaaat

SEQ ID NO: 182234 - DNA, 16 bp, P. troglodytes
aaaagctttttaactt

SEQ ID NO: 182235 - DNA, 16 bp, P. troglodytes
aaaagctttttttaaa

SEQ ID NO: 182236 - DNA, 16 bp, P. troglodytes
aaaagctttttttttt

SEQ ID NO: 182237 - DNA, 16 bp, P. troglodytes
aaaaggaaaaacttca

SEQ ID NO: 182238 - DNA, 16 bp, P. troglodytes
aaaaggaaaaatctta

SEQ ID NO: 182239 - DNA, 16 bp, P. troglodytes
aaaaggaaaacaatgt

SEQ ID NO: 182240 - DNA, 16 bp, P. troglodytes
aaaaggaaaagctttt

SEQ ID NO: 182241 - DNA, 16 bp, P. troglodytes
aaaaggaaaaggattt

SEQ ID NO: 182242 - DNA, 16 bp, P. troglodytes
aaaaggaaaatacttt

SEQ ID NO: 182243 - DNA, 16 bp, P. troglodytes
aaaaggaaaatgtgta

SEQ ID NO: 182244 - DNA, 16 bp, P. troglodytes
aaaaggaaacacttat

SEQ ID NO: 182245 - DNA, 16 bp, P. troglodytes
aaaaggaaaccctgta

SEQ ID NO: 182246 - DNA, 16 bp, P. troglodytes
aaaaggaaacctccag

SEQ ID NO: 182247 - DNA, 16 bp, P. troglodytes
aaaaggaaactgttga

SEQ ID NO: 182248 - DNA, 16 bp, P. troglodytes
aaaaggaaagtgacat

SEQ ID NO: 182249 - DNA, 16 bp, P. troglodytes
aaaaggaaataacttt

SEQ ID NO: 182250 - DNA, 16 bp, P. troglodytes
aaaaggaaataccttc

SEQ ID NO: 182251 - DNA, 16 bp, P. troglodytes
aaaaggaaatattttc

SEQ ID NO: 182252 - DNA, 16 bp, P. troglodytes
aaaaggaaatgtattt

SEQ ID NO: 182253 - DNA, 16 bp, P. troglodytes
aaaaggaaatgtttat

SEQ ID NO: 182254 - DNA, 16 bp, P. troglodytes
aaaaggaaatttattg

SEQ ID NO: 182255 - DNA, 16 bp, P. troglodytes
aaaaggaagaaattct

SEQ ID NO: 182256 - DNA, 16 bp, P. troglodytes
aaaaggaagaagctga

SEQ ID NO: 182257 - DNA, 16 bp, P. troglodytes
aaaaggaagaggctga

SEQ ID NO: 182258 - DNA, 16 bp, P. troglodytes
aaaaggaaggaaactc

SEQ ID NO: 182259 - DNA, 16 bp, P. troglodytes
aaaaggaagtttcaac

SEQ ID NO: 182260 - DNA, 16 bp, P. troglodytes
aaaaggaagttttaaa

SEQ ID NO: 182261 - DNA, 16 bp, P. troglodytes
aaaaggaatacttata

SEQ ID NO: 182262 - DNA, 16 bp, P. troglodytes
aaaaggaatatcttca

SEQ ID NO: 182263 - DNA, 16 bp, P. troglodytes
aaaaggaatggcaaca

SEQ ID NO: 182264 - DNA, 16 bp, P. troglodytes
aaaaggaattctaaaa

SEQ ID NO: 182265 - DNA, 16 bp, P. troglodytes
aaaaggacatttaaaa

SEQ ID NO: 182266 - DNA, 16 bp, P. troglodytes
aaaaggacttttaaaa

SEQ ID NO: 182267 - DNA, 16 bp, P. troglodytes
aaaaggagaaagattt

SEQ ID NO: 182268 - DNA, 16 bp, P. troglodytes
aaaaggagagatgggc

SEQ ID NO: 182269 - DNA, 16 bp, P. troglodytes
aaaaggagatattaca

SEQ ID NO: 182270 - DNA, 16 bp, P. troglodytes
aaaaggagattatttt

SEQ ID NO: 182271 - DNA, 16 bp, P. troglodytes
aaaaggagttcccctg

SEQ ID NO: 182272 - DNA, 16 bp, P. troglodytes
aaaaggatatccagga

SEQ ID NO: 182273 - DNA, 16 bp, P. troglodytes
aaaaggatgagctcag

SEQ ID NO: 182274 - DNA, 16 bp, P. troglodytes
aaaaggatgctggatt

SEQ ID NO: 182275 - DNA, 16 bp, P. troglodytes
aaaaggatgtgtttgc

SEQ ID NO: 182276 - DNA, 16 bp, P. troglodytes
aaaaggattccctatt

SEQ ID NO: 182277 - DNA, 16 bp, P. troglodytes
aaaaggattttcttaa

SEQ ID NO: 182278 - DNA, 16 bp, P. troglodytes
aaaaggcaaaactgta

SEQ ID NO: 182279 - DNA, 16 bp, P. troglodytes
aaaaggcaagccacag

SEQ ID NO: 182280 - DNA, 16 bp, P. troglodytes
aaaaggcacatgaaaa

SEQ ID NO: 182281 - DNA, 16 bp, P. troglodytes
aaaaggcagcagacaa

SEQ ID NO: 182282 - DNA, 16 bp, P. troglodytes
aaaaggcaggaaaatg

SEQ ID NO: 182283 - DNA, 16 bp, P. troglodytes
aaaaggcaggagttgc

SEQ ID NO: 182284 - DNA, 16 bp, P. troglodytes
aaaaggcagttcccct

SEQ ID NO: 182285 - DNA, 16 bp, P. troglodytes
aaaaggcattattcag

SEQ ID NO: 182286 - DNA, 16 bp, P. troglodytes
aaaaggcatttgataa

SEQ ID NO: 182287 - DNA, 16 bp, P. troglodytes
aaaaggcatttgccaa

SEQ ID NO: 182288 - DNA, 16 bp, P. troglodytes
aaaaggcattttaaaa

SEQ ID NO: 182289 - DNA, 16 bp, P. troglodytes
aaaaggcattttaaat

SEQ ID NO: 182290 - DNA, 16 bp, P. troglodytes
aaaaggcatttttaaa

SEQ ID NO: 182291 - DNA, 16 bp, P. troglodytes
aaaaggccaggagcag

SEQ ID NO: 182292 - DNA, 16 bp, P. troglodytes
aaaaggctcaacatca

SEQ ID NO: 182293 - DNA, 16 bp, P. troglodytes
aaaaggctgaccctcc

SEQ ID NO: 182294 - DNA, 16 bp, P. troglodytes
aaaaggctgggattac

SEQ ID NO: 182295 - DNA, 16 bp, P. troglodytes
aaaagggaaaattttt

SEQ ID NO: 182296 - DNA, 16 bp, P. troglodytes
aaaagggaaattattt

SEQ ID NO: 182297 - DNA, 16 bp, P. troglodytes
aaaagggaaattgagg

SEQ ID NO: 182298 - DNA, 16 bp, P. troglodytes
aaaagggaacacttct

SEQ ID NO: 182299 - DNA, 16 bp, P. troglodytes
aaaagggacaggaatt

SEQ ID NO: 182300 - DNA, 16 bp, P. troglodytes
aaaagggactttgtag

SEQ ID NO: 182301 - DNA, 16 bp, P. troglodytes
aaaagggccaggtgcg

SEQ ID NO: 182302 - DNA, 16 bp, P. troglodytes
aaaaggggctgggcac

SEQ ID NO: 182303 - DNA, 16 bp, P. troglodytes
aaaaggtaaaattcac

SEQ ID NO: 182304 - DNA, 16 bp, P. troglodytes
aaaaggtatttatttt

SEQ ID NO: 182305 - DNA, 16 bp, P. troglodytes
aaaaggtatttgaaaa

SEQ ID NO: 182306 - DNA, 16 bp, P. troglodytes
aaaaggtgaaattaat

SEQ ID NO: 182307 - DNA, 16 bp, P. troglodytes
aaaaggtgctgtgctt

SEQ ID NO: 182308 - DNA, 16 bp, P. troglodytes
aaaaggtgtgtgtgtg

SEQ ID NO: 182309 - DNA, 16 bp, P. troglodytes
aaaaggttagaggaat

SEQ ID NO: 182310 - DNA, 16 bp, P. troglodytes
aaaaggttattaagaa

SEQ ID NO: 182311 - DNA, 16 bp, P. troglodytes
aaaaggtttatgaaaa

SEQ ID NO: 182312 - DNA, 16 bp, P. troglodytes
aaaaggttttcatttt

SEQ ID NO: 182313 - DNA, 16 bp, P. troglodytes
aaaaggttttttaaaa

SEQ ID NO: 182314 - DNA, 16 bp, P. troglodytes
aaaagtaaaaacttta

SEQ ID NO: 182315 - DNA, 16 bp, P. troglodytes
aaaagtaaaaatcatt

SEQ ID NO: 182316 - DNA, 16 bp, P. troglodytes
aaaagtaaaacttgaa

SEQ ID NO: 182317 - DNA, 16 bp, P. troglodytes
aaaagtaaaagggact

SEQ ID NO: 182318 - DNA, 16 bp, P. troglodytes
aaaagtaaacatgtaa

SEQ ID NO: 182319 - DNA, 16 bp, P. troglodytes
aaaagtaaactatttt

SEQ ID NO: 182320 - DNA, 16 bp, P. troglodytes
aaaagtaaatgtttta

SEQ ID NO: 182321 - DNA, 16 bp, P. troglodytes
aaaagtaaatgttttt

SEQ ID NO: 182322 - DNA, 16 bp, P. troglodytes
aaaagtaaattttact

SEQ ID NO: 182323 - DNA, 16 bp, P. troglodytes
aaaagtaacttaaaat

SEQ ID NO: 182324 - DNA, 16 bp, P. troglodytes
aaaagtaacttttttt

SEQ ID NO: 182325 - DNA, 16 bp, P. troglodytes
aaaagtaagatatttt

SEQ ID NO: 182326 - DNA, 16 bp, P. troglodytes
aaaagtacaaaacatt

SEQ ID NO: 182327 - DNA, 16 bp, P. troglodytes
aaaagtacaaaatatt

SEQ ID NO: 182328 - DNA, 16 bp, P. troglodytes
aaaagtacacaaaatt

SEQ ID NO: 182329 - DNA, 16 bp, P. troglodytes
aaaagtagaagaagca

SEQ ID NO: 182330 - DNA, 16 bp, P. troglodytes
aaaagtagccaagcat

SEQ ID NO: 182331 - DNA, 16 bp, P. troglodytes
aaaagtagctgagcat

SEQ ID NO: 182332 - DNA, 16 bp, P. troglodytes
aaaagtataataactg

SEQ ID NO: 182333 - DNA, 16 bp, P. troglodytes
aaaagtatctgagaca

SEQ ID NO: 182334 - DNA, 16 bp, P. troglodytes
aaaagtatctgtttat

SEQ ID NO: 182335 - DNA, 16 bp, P. troglodytes
aaaagtattttcataa

SEQ ID NO: 182336 - DNA, 16 bp, P. troglodytes
aaaagtatttttttct

SEQ ID NO: 182337 - DNA, 16 bp, P. troglodytes
aaaagtcaaaagaatt

SEQ ID NO: 182338 - DNA, 18 bp, P. troglodytes
aaaagtcaaaattgacaa

SEQ ID NO: 182339 - DNA, 16 bp, P. troglodytes
aaaagtcaagctggga

SEQ ID NO: 182340 - DNA, 16 bp, P. troglodytes
aaaagtcaaggaaata

SEQ ID NO: 182341 - DNA, 16 bp, P. troglodytes
aaaagtcaagtgctgt

SEQ ID NO: 182342 - DNA, 24 bp, P. troglodytes
aaaagtcaggaaacaacagatgct

SEQ ID NO: 182343 - DNA, 20 bp, P. troglodytes
aaaagtcaggaaacaacagg

SEQ ID NO: 182344 - DNA, 16 bp, P. troglodytes
aaaagtcattaaaata

SEQ ID NO: 182345 - DNA, 16 bp, P. troglodytes
aaaagtcattattttt

SEQ ID NO: 182346 - DNA, 16 bp, P. troglodytes
aaaagtcattcaagag

SEQ ID NO: 182347 - DNA, 16 bp, P. troglodytes
aaaagtcattcaggag

SEQ ID NO: 182348 - DNA, 16 bp, P. troglodytes
aaaagtcattgccatt

SEQ ID NO: 182349 - DNA, 16 bp, P. troglodytes
aaaagtcattttgaaa

SEQ ID NO: 182350 - DNA, 16 bp, P. troglodytes
aaaagtcatttttctt

SEQ ID NO: 182351 - DNA, 16 bp, P. troglodytes
aaaagtccattttaaa

SEQ ID NO: 182352 - DNA, 16 bp, P. troglodytes
aaaagtctattttatt

SEQ ID NO: 182353 - DNA, 16 bp, P. troglodytes
aaaagtctccagagaa

SEQ ID NO: 182354 - DNA, 16 bp, P. troglodytes
aaaagtctgttgccag

SEQ ID NO: 182355 - DNA, 16 bp, P. troglodytes
aaaagtcttcaaaaaa

SEQ ID NO: 182356 - DNA, 16 bp, P. troglodytes
aaaagtctttaagtat

SEQ ID NO: 182357 - DNA, 16 bp, P. troglodytes
aaaagtctttgaaatg

SEQ ID NO: 182358 - DNA, 16 bp, P. troglodytes
aaaagtctttttcttt

SEQ ID NO: 182359 - DNA, 16 bp, P. troglodytes
aaaagtgaatatcaca

SEQ ID NO: 182360 - DNA, 16 bp, P. troglodytes
aaaagtgagaacatgt

SEQ ID NO: 182361 - DNA, 16 bp, P. troglodytes
aaaagtgagccaggca

SEQ ID NO: 182362 - DNA, 16 bp, P. troglodytes
aaaagtgagtttggcc

SEQ ID NO: 182363 - DNA, 16 bp, P. troglodytes
aaaagtgataaagggg

SEQ ID NO: 182364 - DNA, 16 bp, P. troglodytes
aaaagtgccactccag

SEQ ID NO: 182365 - DNA, 16 bp, P. troglodytes
aaaagtgctgagatta

SEQ ID NO: 182366 - DNA, 16 bp, P. troglodytes
aaaagtgctggaatta

SEQ ID NO: 182367 - DNA, 16 bp, P. troglodytes
aaaagtgctgggacta

SEQ ID NO: 182368 - DNA, 16 bp, P. troglodytes
aaaagtgctgggatta

SEQ ID NO: 182369 - DNA, 16 bp, P. troglodytes
aaaagtgctttgtaaa

SEQ ID NO: 182370 - DNA, 16 bp, P. troglodytes
aaaagtggaattactg

SEQ ID NO: 182371 - DNA, 16 bp, P. troglodytes
aaaagtggattttata

SEQ ID NO: 182372 - DNA, 16 bp, P. troglodytes
aaaagtggattttttt

SEQ ID NO: 182373 - DNA, 18 bp, P. troglodytes
aaaagtgggcaaaggaca

SEQ ID NO: 182374 - DNA, 16 bp, P. troglodytes
aaaagtgggccaggtg

SEQ ID NO: 182375 - DNA, 16 bp, P. troglodytes
aaaagtgggctaagaa

SEQ ID NO: 182376 - DNA, 16 bp, P. troglodytes
aaaagtgggtgaaaga

SEQ ID NO: 182377 - DNA, 16 bp, P. troglodytes
aaaagtgttccaattt

SEQ ID NO: 182378 - DNA, 16 bp, P. troglodytes
aaaagtgttttcattt

SEQ ID NO: 182379 - DNA, 16 bp, P. troglodytes
aaaagtgttttttaaa

SEQ ID NO: 182380 - DNA, 16 bp, P. troglodytes
aaaagttaaaacaatt

SEQ ID NO: 182381 - DNA, 16 bp, P. troglodytes
aaaagttaaaattatc

SEQ ID NO: 182382 - DNA, 16 bp, P. troglodytes
aaaagttaacattttt

SEQ ID NO: 182383 - DNA, 16 bp, P. troglodytes
aaaagttaaccaggtg

SEQ ID NO: 182384 - DNA, 16 bp, P. troglodytes
aaaagttaagtgactt

SEQ ID NO: 182385 - DNA, 16 bp, P. troglodytes
aaaagttacatactgt

SEQ ID NO: 182386 - DNA, 16 bp, P. troglodytes
aaaagttacttaaaaa

SEQ ID NO: 182387 - DNA, 16 bp, P. troglodytes
aaaagttactttaaaa

SEQ ID NO: 182388 - DNA, 16 bp, P. troglodytes
aaaagttacttttaaa

SEQ ID NO: 182389 - DNA, 17 bp, P. troglodytes
aaaagttagctgagcgt

SEQ ID NO: 182390 - DNA, 16 bp, P. troglodytes
aaaagttattttaact

SEQ ID NO: 182391 - DNA, 16 bp, P. troglodytes
aaaagttattttatgt

SEQ ID NO: 182392 - DNA, 16 bp, P. troglodytes
aaaagttattttcata

SEQ ID NO: 182393 - DNA, 16 bp, P. troglodytes
aaaagttattttgaaa

SEQ ID NO: 182394 - DNA, 16 bp, P. troglodytes
aaaagttatttttcta

SEQ ID NO: 182395 - DNA, 16 bp, P. troglodytes
aaaagttcatggaaaa

SEQ ID NO: 182396 - DNA, 16 bp, P. troglodytes
aaaagttcattgatat

SEQ ID NO: 182397 - DNA, 16 bp, P. troglodytes
aaaagttcatttataa

SEQ ID NO: 182398 - DNA, 16 bp, P. troglodytes
aaaagttcccttttct

SEQ ID NO: 182399 - DNA, 16 bp, P. troglodytes
aaaagttctgaagatg

SEQ ID NO: 182400 - DNA, 16 bp, P. troglodytes
aaaagttctgggatta

SEQ ID NO: 182401 - DNA, 16 bp, P. troglodytes
aaaagttgaaagcatt

SEQ ID NO: 182402 - DNA, 16 bp, P. troglodytes
aaaagttgaaagtttt

SEQ ID NO: 182403 - DNA, 16 bp, P. troglodytes
aaaagttgaaatttat

SEQ ID NO: 182404 - DNA, 16 bp, P. troglodytes
aaaagttgaatgaatt

SEQ ID NO: 182405 - DNA, 16 bp, P. troglodytes
aaaagttgacaaaaat

SEQ ID NO: 182406 - DNA, 16 bp, P. troglodytes
aaaagttgagaaaatt

SEQ ID NO: 182407 - DNA, 16 bp, P. troglodytes
aaaagttgatctcaca

SEQ ID NO: 182408 - DNA, 16 bp, P. troglodytes
aaaagttgctttaaaa

SEQ ID NO: 182409 - DNA, 16 bp, P. troglodytes
aaaagttggccaggcg

SEQ ID NO: 182410 - DNA, 16 bp, P. troglodytes
aaaagttggtttttga

SEQ ID NO: 182411 - DNA, 16 bp, P. troglodytes
aaaagttgtcaagatg

SEQ ID NO: 182412 - DNA, 16 bp, P. troglodytes
aaaagttgttaaacaa

SEQ ID NO: 182413 - DNA, 16 bp, P. troglodytes
aaaagttgttttaaaa

SEQ ID NO: 182414 - DNA, 16 bp, P. troglodytes
aaaagttgtttttaaa

SEQ ID NO: 182415 - DNA, 16 bp, P. troglodytes
aaaagtttaaaacaca

SEQ ID NO: 182416 - DNA, 16 bp, P. troglodytes
aaaagtttaaacaatt

SEQ ID NO: 182417 - DNA, 16 bp, P. troglodytes
aaaagtttacattaaa

SEQ ID NO: 182418 - DNA, 16 bp, P. troglodytes
aaaagtttatggaaaa

SEQ ID NO: 182419 - DNA, 16 bp, P. troglodytes
aaaagtttatttggct

SEQ ID NO: 182420 - DNA, 16 bp, P. troglodytes
aaaagtttccaatttt

SEQ ID NO: 182421 - DNA, 16 bp, P. troglodytes
aaaagtttcctttcaa

SEQ ID NO: 182422 - DNA, 16 bp, P. troglodytes
aaaagtttcttttaaa

SEQ ID NO: 182423 - DNA, 16 bp, P. troglodytes
aaaagtttgaaaaaca

SEQ ID NO: 182424 - DNA, 16 bp, P. troglodytes
aaaagtttgaaaaatg

SEQ ID NO: 182425 - DNA, 16 bp, P. troglodytes
aaaagtttgagaagaa

SEQ ID NO: 182426 - DNA, 16 bp, P. troglodytes
aaaagtttggaaaata

SEQ ID NO: 182427 - DNA, 16 bp, P. troglodytes
aaaagtttgggatttt

SEQ ID NO: 182428 - DNA, 16 bp, P. troglodytes
aaaagttttaaaacaa

SEQ ID NO: 182429 - DNA, 16 bp, P. troglodytes
aaaagttttagaagaa

SEQ ID NO: 182430 - DNA, 16 bp, P. troglodytes
aaaagttttattttct

SEQ ID NO: 182431 - DNA, 16 bp, P. troglodytes
aaaagttttccaaaat

SEQ ID NO: 182432 - DNA, 16 bp, P. troglodytes
aaaagttttccatttt

SEQ ID NO: 182433 - DNA, 16 bp, P. troglodytes
aaaagttttcttattt

SEQ ID NO: 182434 - DNA, 16 bp, P. troglodytes
aaaagttttgaaaaca

SEQ ID NO: 182435 - DNA, 16 bp, P. troglodytes
aaaagttttgaaattt

SEQ ID NO: 182436 - DNA, 16 bp, P. troglodytes
aaaagtttttaaaact

SEQ ID NO: 182437 - DNA, 16 bp, P. troglodytes
aaaagtttttaaaagt

SEQ ID NO: 182438 - DNA, 16 bp, P. troglodytes
aaaagtttttaaatca

SEQ ID NO: 182439 - DNA, 16 bp, P. troglodytes
aaaagttttttctttc

SEQ ID NO: 182440 - DNA, 16 bp, P. troglodytes
aaaagttttttgtttg

SEQ ID NO: 182441 - DNA, 16 bp, P. troglodytes
aaaataaaaacccttt

SEQ ID NO: 182442 - DNA, 16 bp, P. troglodytes
aaaataaaaactggag

SEQ ID NO: 182443 - DNA, 16 bp, P. troglodytes
aaaataaaaactgtag

SEQ ID NO: 182444 - DNA, 16 bp, P. troglodytes
aaaataaaaagcatct

SEQ ID NO: 182445 - DNA, 16 bp, P. troglodytes
aaaataaaaagctttt

SEQ ID NO: 182446 - DNA, 16 bp, P. troglodytes
aaaataaaaagtcttt

SEQ ID NO: 182447 - DNA, 16 bp, P. troglodytes
aaaataaaaatgttca

SEQ ID NO: 182448 - DNA, 16 bp, P. troglodytes
aaaataaaactgattt

SEQ ID NO: 182449 - DNA, 16 bp, P. troglodytes
aaaataaaactgcttt

SEQ ID NO: 182450 - DNA, 16 bp, P. troglodytes
aaaataaaacttagat

SEQ ID NO: 182451 - DNA, 16 bp, P. troglodytes
aaaataaaacttcttt

SEQ ID NO: 182452 - DNA, 16 bp, P. troglodytes
aaaataaaacttgaag

SEQ ID NO: 182453 - DNA, 16 bp, P. troglodytes
aaaataaaagcactta

SEQ ID NO: 182454 - DNA, 16 bp, P. troglodytes
aaaataaaaggcatta

SEQ ID NO: 182455 - DNA, 16 bp, P. troglodytes
aaaataaaataacttg

SEQ ID NO: 182456 - DNA, 16 bp, P. troglodytes
aaaataaaatactatg

SEQ ID NO: 182457 - DNA, 16 bp, P. troglodytes
aaaataaaatcctttt

SEQ ID NO: 182458 - DNA, 16 bp, P. troglodytes
aaaataaaatctcaag

SEQ ID NO: 182459 - DNA, 16 bp, P. troglodytes
aaaataaaatctttct

SEQ ID NO: 182460 - DNA, 16 bp, P. troglodytes
aaaataaaatgcattt

SEQ ID NO: 182461 - DNA, 16 bp, P. troglodytes
aaaataaaatgtttct

SEQ ID NO: 182462 - DNA, 16 bp, P. troglodytes
aaaataaaattctgtg

SEQ ID NO: 182463 - DNA, 16 bp, P. troglodytes
aaaataaaattgactt

SEQ ID NO: 182464 - DNA, 16 bp, P. troglodytes
aaaataaacatgtatt

SEQ ID NO: 182465 - DNA, 16 bp, P. troglodytes
aaaataaacatgtttt

SEQ ID NO: 182466 - DNA, 16 bp, P. troglodytes
aaaataaacattgttt

SEQ ID NO: 182467 - DNA, 16 bp, P. troglodytes
aaaataaacatttgga

SEQ ID NO: 182468 - DNA, 16 bp, P. troglodytes
aaaataaacattttcc

SEQ ID NO: 182469 - DNA, 16 bp, P. troglodytes
aaaataaactatcagc

SEQ ID NO: 182470 - DNA, 16 bp, P. troglodytes
aaaataaactgtaaat

SEQ ID NO: 182471 - DNA, 16 bp, P. troglodytes
aaaataaacttcattt

SEQ ID NO: 182472 - DNA, 16 bp, P. troglodytes
aaaataaacttggaaa

SEQ ID NO: 182473 - DNA, 16 bp, P. troglodytes
aaaataaactttattc

SEQ ID NO: 182474 - DNA, 16 bp, P. troglodytes
aaaataaactttgaaa

SEQ ID NO: 182475 - DNA, 16 bp, P. troglodytes
aaaataaagatacttt

SEQ ID NO: 182476 - DNA, 16 bp, P. troglodytes
aaaataaagatgttct

SEQ ID NO: 182477 - DNA, 16 bp, P. troglodytes
aaaataaagcctattt

SEQ ID NO: 182478 - DNA, 16 bp, P. troglodytes
aaaataaaggcatatt

SEQ ID NO: 182479 - DNA, 16 bp, P. troglodytes
aaaataaaggggctac

SEQ ID NO: 182480 - DNA, 16 bp, P. troglodytes
aaaataaagggtattc

SEQ ID NO: 182481 - DNA, 16 bp, P. troglodytes
aaaataaagtatttgt

SEQ ID NO: 182482 - DNA, 16 bp, P. troglodytes
aaaataaagtctgtta

SEQ ID NO: 182483 - DNA, 16 bp, P. troglodytes
aaaataaagtgatgga

SEQ ID NO: 182484 - DNA, 16 bp, P. troglodytes
aaaataaagtgtattt

SEQ ID NO: 182485 - DNA, 16 bp, P. troglodytes
aaaataaagttcttca

SEQ ID NO: 182486 - DNA, 16 bp, P. troglodytes
aaaataaagtttcttt

SEQ ID NO: 182487 - DNA, 16 bp, P. troglodytes
aaaataaatacagtga

SEQ ID NO: 182488 - DNA, 16 bp, P. troglodytes
aaaataaatatcagtt

SEQ ID NO: 182489 - DNA, 16 bp, P. troglodytes
aaaataaatcatcttt

SEQ ID NO: 182490 - DNA, 16 bp, P. troglodytes
aaaataaatcattctt

SEQ ID NO: 182491 - DNA, 16 bp, P. troglodytes
aaaataaatcattgtt

SEQ ID NO: 182492 - DNA, 16 bp, P. troglodytes
aaaataaatctcagaa

SEQ ID NO: 182493 - DNA, 16 bp, P. troglodytes
aaaataaatctgtctt

SEQ ID NO: 182494 - DNA, 16 bp, P. troglodytes
aaaataaatgacttta

SEQ ID NO: 182495 - DNA, 16 bp, P. troglodytes
aaaataaatgagctat

SEQ ID NO: 182496 - DNA, 16 bp, P. troglodytes
aaaataaatgcatttg

SEQ ID NO: 182497 - DNA, 16 bp, P. troglodytes
aaaataaatgccattt

SEQ ID NO: 182498 - DNA, 16 bp, P. troglodytes
aaaataaatgctttaa

SEQ ID NO: 182499 - DNA, 16 bp, P. troglodytes
aaaataaatgcttttt

SEQ ID NO: 182500 - DNA, 16 bp, P. troglodytes
aaaataaatggttttt

SEQ ID NO: 182501 - DNA, 16 bp, P. troglodytes
aaaataaatgtgtatt

SEQ ID NO: 182502 - DNA, 16 bp, P. troglodytes
aaaataaattacccag

SEQ ID NO: 182503 - DNA, 16 bp, P. troglodytes
aaaataaattagctgg

SEQ ID NO: 182504 - DNA, 16 bp, P. troglodytes
aaaataaattatctga

SEQ ID NO: 182505 - DNA, 16 bp, P. troglodytes
aaaataaattatggtt

SEQ ID NO: 182506 - DNA, 16 bp, P. troglodytes
aaaataaattctagat

SEQ ID NO: 182507 - DNA, 16 bp, P. troglodytes
aaaataaatttctgaa

SEQ ID NO: 182508 - DNA, 16 bp, P. troglodytes
aaaataaattttgttg

SEQ ID NO: 182509 - DNA, 16 bp, P. troglodytes
aaaataacaaatctgg

SEQ ID NO: 182510 - DNA, 16 bp, P. troglodytes
aaaataacaaatgtta

SEQ ID NO: 182511 - DNA, 16 bp, P. troglodytes
aaaataactgattaat

SEQ ID NO: 182512 - DNA, 16 bp, P. troglodytes
aaaataactgttttaa

SEQ ID NO: 182513 - DNA, 16 bp, P. troglodytes
aaaataactttgaaaa

SEQ ID NO: 182514 - DNA, 16 bp, P. troglodytes
aaaataactttggaaa

SEQ ID NO: 182515 - DNA, 16 bp, P. troglodytes
aaaataagaaattagc

SEQ ID NO: 182516 - DNA, 16 bp, P. troglodytes
aaaataagaatttcaa

SEQ ID NO: 182517 - DNA, 16 bp, P. troglodytes
aaaataagacattaat

SEQ ID NO: 182518 - DNA, 16 bp, P. troglodytes
aaaataagactttttt

SEQ ID NO: 182519 - DNA, 16 bp, P. troglodytes
aaaataaggaattttt

SEQ ID NO: 182520 - DNA, 16 bp, P. troglodytes
aaaataaggccaggtg

SEQ ID NO: 182521 - DNA, 16 bp, P. troglodytes
aaaataagggttattt

SEQ ID NO: 182522 - DNA, 16 bp, P. troglodytes
aaaataagtatttcca

SEQ ID NO: 182523 - DNA, 16 bp, P. troglodytes
aaaataagtatttgtt

SEQ ID NO: 182524 - DNA, 16 bp, P. troglodytes
aaaataagtcaaattt

SEQ ID NO: 182525 - DNA, 16 bp, P. troglodytes
aaaataagtctcaaca

SEQ ID NO: 182526 - DNA, 16 bp, P. troglodytes
aaaataagtcttaaaa

SEQ ID NO: 182527 - DNA, 16 bp, P. troglodytes
aaaataagtgtgtgtg

SEQ ID NO: 182528 - DNA, 16 bp, P. troglodytes
aaaataagttcactgt

SEQ ID NO: 182529 - DNA, 16 bp, P. troglodytes
aaaataagtttctttt

SEQ ID NO: 182530 - DNA, 16 bp, P. troglodytes
aaaataataaatactg

SEQ ID NO: 182531 - DNA, 16 bp, P. troglodytes
aaaataataaatgcta

SEQ ID NO: 182532 - DNA, 16 bp, P. troglodytes
aaaataataaatgctt

SEQ ID NO: 182533 - DNA, 16 bp, P. troglodytes
aaaataataagcattt

SEQ ID NO: 182534 - DNA, 16 bp, P. troglodytes
aaaataataattgcaa

SEQ ID NO: 182535 - DNA, 16 bp, P. troglodytes
aaaataatagacattt

SEQ ID NO: 182536 - DNA, 16 bp, P. troglodytes
aaaataatagtttctt

SEQ ID NO: 182537 - DNA, 16 bp, P. troglodytes
aaaataatatatcatg

SEQ ID NO: 182538 - DNA, 16 bp, P. troglodytes
aaaataatcaaatgga

SEQ ID NO: 182539 - DNA, 16 bp, P. troglodytes
aaaataatcattgaaa

SEQ ID NO: 182540 - DNA, 16 bp, P. troglodytes
aaaataatcattttct

SEQ ID NO: 182541 - DNA, 16 bp, P. troglodytes
aaaataatctcctttg

SEQ ID NO: 182542 - DNA, 16 bp, P. troglodytes
aaaataatctgtattt

SEQ ID NO: 182543 - DNA, 16 bp, P. troglodytes
aaaataatgaaacatt

SEQ ID NO: 182544 - DNA, 16 bp, P. troglodytes
aaaataatgacataat

SEQ ID NO: 182545 - DNA, 16 bp, P. troglodytes
aaaataatgacttttt

SEQ ID NO: 182546 - DNA, 16 bp, P. troglodytes
aaaataatgagtcatc

SEQ ID NO: 182547 - DNA, 16 bp, P. troglodytes
aaaataatgatagcaa

SEQ ID NO: 182548 - DNA, 16 bp, P. troglodytes
aaaataatgtatgtat

SEQ ID NO: 182549 - DNA, 16 bp, P. troglodytes
aaaataatgtggtttt

SEQ ID NO: 182550 - DNA, 16 bp, P. troglodytes
aaaataatgttttaag

SEQ ID NO: 182551 - DNA, 16 bp, P. troglodytes
aaaataattagcaaat

SEQ ID NO: 182552 - DNA, 16 bp, P. troglodytes
aaaataattcagaaat

SEQ ID NO: 182553 - DNA, 16 bp, P. troglodytes
aaaataattcatcttt

SEQ ID NO: 182554 - DNA, 16 bp, P. troglodytes
aaaataattctgtaaa

SEQ ID NO: 182555 - DNA, 16 bp, P. troglodytes
aaaataattcttgttt

SEQ ID NO: 182556 - DNA, 16 bp, P. troglodytes
aaaataattgaaagca

SEQ ID NO: 182557 - DNA, 16 bp, P. troglodytes
aaaataattgatgaag

SEQ ID NO: 182558 - DNA, 16 bp, P. troglodytes
aaaataattgtgtttt

SEQ ID NO: 182559 - DNA, 16 bp, P. troglodytes
aaaataatttacattc

SEQ ID NO: 182560 - DNA, 16 bp, P. troglodytes
aaaataatttcaactt

SEQ ID NO: 182561 - DNA, 16 bp, P. troglodytes
aaaataatttcacatt

SEQ ID NO: 182562 - DNA, 16 bp, P. troglodytes
aaaataatttcacttt

SEQ ID NO: 182563 - DNA, 16 bp, P. troglodytes
aaaataatttcagaat

SEQ ID NO: 182564 - DNA, 16 bp, P. troglodytes
aaaataatttctggaa

SEQ ID NO: 182565 - DNA, 16 bp, P. troglodytes
aaaataatttgccaaa

SEQ ID NO: 182566 - DNA, 16 bp, P. troglodytes
aaaataattttatggt

SEQ ID NO: 182567 - DNA, 16 bp, P. troglodytes
aaaataattttcagat

SEQ ID NO: 182568 - DNA, 16 bp, P. troglodytes
aaaataattttcctaa

SEQ ID NO: 182569 - DNA, 16 bp, P. troglodytes
aaaataatttttagag

SEQ ID NO: 182570 - DNA, 16 bp, P. troglodytes
aaaataatttttgtgt

SEQ ID NO: 182571 - DNA, 16 bp, P. troglodytes
aaaatacaaaactgag

SEQ ID NO: 182572 - DNA, 18 bp, P. troglodytes
aaaatacaaaacttagct

SEQ ID NO: 182573 - DNA, 16 bp, P. troglodytes
aaaatacaaaagttag

SEQ ID NO: 182574 - DNA, 17 bp, P. troglodytes
aaaatacaaaattagca

SEQ ID NO: 182575 - DNA, 16 bp, P. troglodytes
aaaatacaaaatttgc

SEQ ID NO: 182576 - DNA, 19 bp, P. troglodytes
aaaatacaaacattagcca

SEQ ID NO: 182577 - DNA, 16 bp, P. troglodytes
aaaatacaaagtattt

SEQ ID NO: 182578 - DNA, 16 bp, P. troglodytes
aaaatacaaatgtctt

SEQ ID NO: 182579 - DNA, 16 bp, P. troglodytes
aaaatacaagaattac

SEQ ID NO: 182580 - DNA, 16 bp, P. troglodytes
aaaatacaagttttta

SEQ ID NO: 182581 - DNA, 16 bp, P. troglodytes
aaaatacaagtttttt

SEQ ID NO: 182582 - DNA, 16 bp, P. troglodytes
aaaatacacagacaca

SEQ ID NO: 182583 - DNA, 16 bp, P. troglodytes
aaaatacacattgaaa

SEQ ID NO: 182584 - DNA, 16 bp, P. troglodytes
aaaatacacatttttt

SEQ ID NO: 182585 - DNA, 16 bp, P. troglodytes
aaaatacacttatttt

SEQ ID NO: 182586 - DNA, 16 bp, P. troglodytes
aaaatacagaaattag

SEQ ID NO: 182587 - DNA, 16 bp, P. troglodytes
aaaatacagaagaatt

SEQ ID NO: 182588 - DNA, 16 bp, P. troglodytes
aaaatacagaatatat

SEQ ID NO: 182589 - DNA, 16 bp, P. troglodytes
aaaatacagaatttag

SEQ ID NO: 182590 - DNA, 16 bp, P. troglodytes
aaaatacagacatttt

SEQ ID NO: 182591 - DNA, 16 bp, P. troglodytes
aaaatacagatcataa

SEQ ID NO: 182592 - DNA, 16 bp, P. troglodytes
aaaatacagatgcctg

SEQ ID NO: 182593 - DNA, 16 bp, P. troglodytes
aaaatacagattctga

SEQ ID NO: 182594 - DNA, 16 bp, P. troglodytes
aaaatacagatttctg

SEQ ID NO: 182595 - DNA, 16 bp, P. troglodytes
aaaatacagtcagagg

SEQ ID NO: 182596 - DNA, 16 bp, P. troglodytes
aaaatacagttaaaat

SEQ ID NO: 182597 - DNA, 16 bp, P. troglodytes
aaaatacatagaaatt

SEQ ID NO: 182598 - DNA, 16 bp, P. troglodytes
aaaatacatattctta

SEQ ID NO: 182599 - DNA, 16 bp, P. troglodytes
aaaatacatatttctt

SEQ ID NO: 182600 - DNA, 16 bp, P. troglodytes
aaaatacatgaacaga

SEQ ID NO: 182601 - DNA, 16 bp, P. troglodytes
aaaatacatggaaatt

SEQ ID NO: 182602 - DNA, 16 bp, P. troglodytes
aaaatacatgtaaaat

SEQ ID NO: 182603 - DNA, 16 bp, P. troglodytes
aaaatacatgtattat

SEQ ID NO: 182604 - DNA, 16 bp, P. troglodytes
aaaatacattcttttt

SEQ ID NO: 182605 - DNA, 16 bp, P. troglodytes
aaaatacattgcaaaa

SEQ ID NO: 182606 - DNA, 16 bp, P. troglodytes
aaaatacattgttatt

SEQ ID NO: 182607 - DNA, 16 bp, P. troglodytes
aaaatacatttaaaga

SEQ ID NO: 182608 - DNA, 16 bp, P. troglodytes
aaaatacatttagaaa

SEQ ID NO: 182609 - DNA, 16 bp, P. troglodytes
aaaatacatttctatt

SEQ ID NO: 182610 - DNA, 16 bp, P. troglodytes
aaaatacatttgaaat

SEQ ID NO: 182611 - DNA, 16 bp, P. troglodytes
aaaatacatttgtaaa

SEQ ID NO: 182612 - DNA, 16 bp, P. troglodytes
aaaatacatttgtgtt

SEQ ID NO: 182613 - DNA, 16 bp, P. troglodytes
aaaatacattttcttt

SEQ ID NO: 182614 - DNA, 16 bp, P. troglodytes
aaaatacattttgaaa

SEQ ID NO: 182615 - DNA, 16 bp, P. troglodytes
aaaataccacagattg

SEQ ID NO: 182616 - DNA, 16 bp, P. troglodytes
aaaataccatttttaa

SEQ ID NO: 182617 - DNA, 16 bp, P. troglodytes
aaaatacctaggaata

SEQ ID NO: 182618 - DNA, 16 bp, P. troglodytes
aaaatacctctttatt

SEQ ID NO: 182619 - DNA, 16 bp, P. troglodytes
aaaataccttcacaag

SEQ ID NO: 182620 - DNA, 16 bp, P. troglodytes
aaaatactaggaaact

SEQ ID NO: 182621 - DNA, 16 bp, P. troglodytes
aaaatactcatttcta

SEQ ID NO: 182622 - DNA, 16 bp, P. troglodytes
aaaatactggcaaatc

SEQ ID NO: 182623 - DNA, 16 bp, P. troglodytes
aaaatactggggaaaa

SEQ ID NO: 182624 - DNA, 16 bp, P. troglodytes
aaaatactgggtagaa

SEQ ID NO: 182625 - DNA, 16 bp, P. troglodytes
aaaatacttaggaaca

SEQ ID NO: 182626 - DNA, 16 bp, P. troglodytes
aaaatacttgaagaaa

SEQ ID NO: 182627 - DNA, 16 bp, P. troglodytes
aaaatacttgaccagt

SEQ ID NO: 182628 - DNA, 16 bp, P. troglodytes
aaaatacttggaaata

SEQ ID NO: 182629 - DNA, 16 bp, P. troglodytes
aaaatactttatttct

SEQ ID NO: 182630 - DNA, 16 bp, P. troglodytes
aaaatactttcatttc

SEQ ID NO: 182631 - DNA, 16 bp, P. troglodytes
aaaatactttgaaaaa

SEQ ID NO: 182632 - DNA, 16 bp, P. troglodytes
aaaatacttttatttc

SEQ ID NO: 182633 - DNA, 16 bp, P. troglodytes
aaaatacttttctctt

SEQ ID NO: 182634 - DNA, 16 bp, P. troglodytes
aaaatacttttgtaca

SEQ ID NO: 182635 - DNA, 16 bp, P. troglodytes
aaaatacttttgtttt

SEQ ID NO: 182636 - DNA, 16 bp, P. troglodytes
aaaatagaaaactttt

SEQ ID NO: 182637 - DNA, 16 bp, P. troglodytes
aaaatagaaaaggacc

SEQ ID NO: 182638 - DNA, 16 bp, P. troglodytes
aaaatagaaaatctag

SEQ ID NO: 182639 - DNA, 16 bp, P. troglodytes
aaaatagaaaatctga

SEQ ID NO: 182640 - DNA, 16 bp, P. troglodytes
aaaatagaaactttaa

SEQ ID NO: 182641 - DNA, 16 bp, P. troglodytes
aaaatagaaatgtttt

SEQ ID NO: 182642 - DNA, 16 bp, P. troglodytes
aaaatagaaattctga

SEQ ID NO: 182643 - DNA, 16 bp, P. troglodytes
aaaatagaacaatttt

SEQ ID NO: 182644 - DNA, 16 bp, P. troglodytes
aaaatagaactgccat

SEQ ID NO: 182645 - DNA, 16 bp, P. troglodytes
aaaatagaagtcaaga

SEQ ID NO: 182646 - DNA, 16 bp, P. troglodytes
aaaatagacaaatatg

SEQ ID NO: 182647 - DNA, 16 bp, P. troglodytes
aaaatagacattttaa

SEQ ID NO: 182648 - DNA, 16 bp, P. troglodytes
aaaatagactaataca

SEQ ID NO: 182649 - DNA, 16 bp, P. troglodytes
aaaatagactttattt

SEQ ID NO: 182650 - DNA, 16 bp, P. troglodytes
aaaatagattcttatt

SEQ ID NO: 182651 - DNA, 16 bp, P. troglodytes
aaaatagcatatttta

SEQ ID NO: 182652 - DNA, 16 bp, P. troglodytes
aaaatagcatttaaaa

SEQ ID NO: 182653 - DNA, 16 bp, P. troglodytes
aaaatagccaaaaagt

SEQ ID NO: 182654 - DNA, 16 bp, P. troglodytes
aaaatagccagatgtg

SEQ ID NO: 182655 - DNA, 16 bp, P. troglodytes
aaaatagccttattgc

SEQ ID NO: 182656 - DNA, 16 bp, P. troglodytes
aaaatagcttggcatg

SEQ ID NO: 182657 - DNA, 16 bp, P. troglodytes
aaaatagctttgaaaa

SEQ ID NO: 182658 - DNA, 16 bp, P. troglodytes
aaaataggagaaaatc

SEQ ID NO: 182659 - DNA, 16 bp, P. troglodytes
aaaataggcaaatcta

SEQ ID NO: 182660 - DNA, 16 bp, P. troglodytes
aaaataggcatataga

SEQ ID NO: 182661 - DNA, 16 bp, P. troglodytes
aaaataggcctcaaag

SEQ ID NO: 182662 - DNA, 16 bp, P. troglodytes
aaaatagtaaatttca

SEQ ID NO: 182663 - DNA, 16 bp, P. troglodytes
aaaatagtacatttta

SEQ ID NO: 182664 - DNA, 16 bp, P. troglodytes
aaaatagtagatttta

SEQ ID NO: 182665 - DNA, 16 bp, P. troglodytes
aaaatagtcaaattca

SEQ ID NO: 182666 - DNA, 16 bp, P. troglodytes
aaaatagtcatatttt

SEQ ID NO: 182667 - DNA, 16 bp, P. troglodytes
aaaatagttactattt

SEQ ID NO: 182668 - DNA, 16 bp, P. troglodytes
aaaatagtttattcta

SEQ ID NO: 182669 - DNA, 16 bp, P. troglodytes
aaaatagtttgagtag

SEQ ID NO: 182670 - DNA, 16 bp, P. troglodytes
aaaatagttttgcttt

SEQ ID NO: 182671 - DNA, 16 bp, P. troglodytes
aaaatagtttttttct

SEQ ID NO: 182672 - DNA, 17 bp, P. troglodytes
aaaatataaaattagcc

SEQ ID NO: 182673 - DNA, 16 bp, P. troglodytes
aaaatataacagaatt

SEQ ID NO: 182674 - DNA, 16 bp, P. troglodytes
aaaatatacacatttt

SEQ ID NO: 182675 - DNA, 16 bp, P. troglodytes
aaaatatacatacatg

SEQ ID NO: 182676 - DNA, 16 bp, P. troglodytes
aaaatatacatgttaa

SEQ ID NO: 182677 - DNA, 16 bp, P. troglodytes
aaaatatactgtattt

SEQ ID NO: 182678 - DNA, 16 bp, P. troglodytes
aaaatatagcattaaa

SEQ ID NO: 182679 - DNA, 16 bp, P. troglodytes
aaaatatagtaattct

SEQ ID NO: 182680 - DNA, 16 bp, P. troglodytes
aaaatatataatgaca

SEQ ID NO: 182681 - DNA, 16 bp, P. troglodytes
aaaatatatacagttt

SEQ ID NO: 182682 - DNA, 16 bp, P. troglodytes
aaaatatatatcagat

SEQ ID NO: 182683 - DNA, 16 bp, P. troglodytes
aaaatatatatgtagt

SEQ ID NO: 182684 - DNA, 16 bp, P. troglodytes
aaaatatatcactttt

SEQ ID NO: 182685 - DNA, 16 bp, P. troglodytes
aaaatatatgaagaac

SEQ ID NO: 182686 - DNA, 16 bp, P. troglodytes
aaaatatatgcatttt

SEQ ID NO: 182687 - DNA, 16 bp, P. troglodytes
aaaatatatgtatatg

SEQ ID NO: 182688 - DNA, 16 bp, P. troglodytes
aaaatatatgtgtata

SEQ ID NO: 182689 - DNA, 16 bp, P. troglodytes
aaaatatatgtgtatg

SEQ ID NO: 182690 - DNA, 16 bp, P. troglodytes
aaaatatatgttttct

SEQ ID NO: 182691 - DNA, 16 bp, P. troglodytes
aaaatatattcaactt

SEQ ID NO: 182692 - DNA, 16 bp, P. troglodytes
aaaatatattgtgtta

SEQ ID NO: 182693 - DNA, 16 bp, P. troglodytes
aaaatatatttcctat

SEQ ID NO: 182694 - DNA, 16 bp, P. troglodytes
aaaatatattttggga

SEQ ID NO: 182695 - DNA, 16 bp, P. troglodytes
aaaatatattttgtct

SEQ ID NO: 182696 - DNA, 16 bp, P. troglodytes
aaaatatcagaaatca

SEQ ID NO: 182697 - DNA, 16 bp, P. troglodytes
aaaatatcagaaatta

SEQ ID NO: 182698 - DNA, 16 bp, P. troglodytes
aaaatatcagtaaaat

SEQ ID NO: 182699 - DNA, 16 bp, P. troglodytes
aaaatatcataaattg

SEQ ID NO: 182700 - DNA, 16 bp, P. troglodytes
aaaatatcatttgaaa

SEQ ID NO: 182701 - DNA, 16 bp, P. troglodytes
aaaatatcattttgta

SEQ ID NO: 182702 - DNA, 16 bp, P. troglodytes
aaaatatccaggcatg

SEQ ID NO: 182703 - DNA, 16 bp, P. troglodytes
aaaatatcctttgtaa

SEQ ID NO: 182704 - DNA, 16 bp, P. troglodytes
aaaatatctattcata

SEQ ID NO: 182705 - DNA, 16 bp, P. troglodytes
aaaatatctcatgcac

SEQ ID NO: 182706 - DNA, 16 bp, P. troglodytes
aaaatatctcatgtaa

SEQ ID NO: 182707 - DNA, 16 bp, P. troglodytes
aaaatatctgaaaaat

SEQ ID NO: 182708 - DNA, 16 bp, P. troglodytes
aaaatatctgaacaga

SEQ ID NO: 182709 - DNA, 16 bp, P. troglodytes
aaaatatctgcaaact

SEQ ID NO: 182710 - DNA, 16 bp, P. troglodytes
aaaatatctttgtttt

SEQ ID NO: 182711 - DNA, 16 bp, P. troglodytes
aaaatatgaacattaa

SEQ ID NO: 182712 - DNA, 16 bp, P. troglodytes
aaaatatgaatttgga

SEQ ID NO: 182713 - DNA, 16 bp, P. troglodytes
aaaatatgactttttt

SEQ ID NO: 182714 - DNA, 16 bp, P. troglodytes
aaaatatgaggccagt

SEQ ID NO: 182715 - DNA, 16 bp, P. troglodytes
aaaatatgcaaaatga

SEQ ID NO: 182716 - DNA, 16 bp, P. troglodytes
aaaatatgcaaagcaa

SEQ ID NO: 182717 - DNA, 16 bp, P. troglodytes
aaaatatgcagagaaa

SEQ ID NO: 182718 - DNA, 16 bp, P. troglodytes
aaaatatgcatataaa

SEQ ID NO: 182719 - DNA, 16 bp, P. troglodytes
aaaatatgccaaagaa

SEQ ID NO: 182720 - DNA, 16 bp, P. troglodytes
aaaatatgctactttg

SEQ ID NO: 182721 - DNA, 16 bp, P. troglodytes
aaaatatgctatatat

SEQ ID NO: 182722 - DNA, 16 bp, P. troglodytes
aaaatatgctttaaaa

SEQ ID NO: 182723 - DNA, 16 bp, P. troglodytes
aaaatatggaatattt

SEQ ID NO: 182724 - DNA, 16 bp, P. troglodytes
aaaatatggtattata

SEQ ID NO: 182725 - DNA, 16 bp, P. troglodytes
aaaatatggttatttt

SEQ ID NO: 182726 - DNA, 16 bp, P. troglodytes
aaaatatgtaaaatgc

SEQ ID NO: 182727 - DNA, 16 bp, P. troglodytes
aaaatatgtaaattgt

SEQ ID NO: 182728 - DNA, 16 bp, P. troglodytes
aaaatatgtaagtttt

SEQ ID NO: 182729 - DNA, 16 bp, P. troglodytes
aaaatatgtatgtata

SEQ ID NO: 182730 - DNA, 16 bp, P. troglodytes
aaaatatgtatgtgtg

SEQ ID NO: 182731 - DNA, 16 bp, P. troglodytes
aaaatatgtcttttaa

SEQ ID NO: 182732 - DNA, 16 bp, P. troglodytes
aaaatatgtgaaaaca

SEQ ID NO: 182733 - DNA, 16 bp, P. troglodytes
aaaatatgtgtatgta

SEQ ID NO: 182734 - DNA, 16 bp, P. troglodytes
aaaatatgttcaaaat

SEQ ID NO: 182735 - DNA, 16 bp, P. troglodytes
aaaatatgttcttttt

SEQ ID NO: 182736 - DNA, 16 bp, P. troglodytes
aaaatatgttgaattt

SEQ ID NO: 182737 - DNA, 16 bp, P. troglodytes
aaaatatgtttacatt

SEQ ID NO: 182738 - DNA, 16 bp, P. troglodytes
aaaatatgtttcattt

SEQ ID NO: 182739 - DNA, 16 bp, P. troglodytes
aaaatatgttttagat

SEQ ID NO: 182740 - DNA, 16 bp, P. troglodytes
aaaatatgttttcaaa

SEQ ID NO: 182741 - DNA, 16 bp, P. troglodytes
aaaatattcagggaaa

SEQ ID NO: 182742 - DNA, 16 bp, P. troglodytes
aaaatattcagttttc

SEQ ID NO: 182743 - DNA, 16 bp, P. troglodytes
aaaatattccagaaaa

SEQ ID NO: 182744 - DNA, 16 bp, P. troglodytes
aaaatattctatgttt

SEQ ID NO: 182745 - DNA, 16 bp, P. troglodytes
aaaatattctgaaatt

SEQ ID NO: 182746 - DNA, 16 bp, P. troglodytes
aaaatattctgcaaaa

SEQ ID NO: 182747 - DNA, 16 bp, P. troglodytes
aaaatattctggaaaa

SEQ ID NO: 182748 - DNA, 16 bp, P. troglodytes
aaaatattcttattct

SEQ ID NO: 182749 - DNA, 16 bp, P. troglodytes
aaaatattcttgaaaa

SEQ ID NO: 182750 - DNA, 16 bp, P. troglodytes
aaaatattgaaagcat

SEQ ID NO: 182751 - DNA, 16 bp, P. troglodytes
aaaatattgctaaaat

SEQ ID NO: 182752 - DNA, 16 bp, P. troglodytes
aaaatattgctgagag

SEQ ID NO: 182753 - DNA, 16 bp, P. troglodytes
aaaatattgtatgatt

SEQ ID NO: 182754 - DNA, 16 bp, P. troglodytes
aaaatattgtcaaatt

SEQ ID NO: 182755 - DNA, 16 bp, P. troglodytes
aaaatattgtttcttt

SEQ ID NO: 182756 - DNA, 16 bp, P. troglodytes
aaaatattgttttgaa

SEQ ID NO: 182757 - DNA, 16 bp, P. troglodytes
aaaatattgtttttct

SEQ ID NO: 182758 - DNA, 16 bp, P. troglodytes
aaaatatttaaaagca

SEQ ID NO: 182759 - DNA, 16 bp, P. troglodytes
aaaatatttaatgctt

SEQ ID NO: 182760 - DNA, 16 bp, P. troglodytes
aaaatatttattgtct

SEQ ID NO: 182761 - DNA, 16 bp, P. troglodytes
aaaatatttatttctg

SEQ ID NO: 182762 - DNA, 16 bp, P. troglodytes
aaaatatttcacagaa

SEQ ID NO: 182763 - DNA, 16 bp, P. troglodytes
aaaatatttcacatat

SEQ ID NO: 182764 - DNA, 16 bp, P. troglodytes
aaaatatttcagaaaa

SEQ ID NO: 182765 - DNA, 16 bp, P. troglodytes
aaaatatttcagcaaa

SEQ ID NO: 182766 - DNA, 16 bp, P. troglodytes
aaaatatttcagtgaa

SEQ ID NO: 182767 - DNA, 16 bp, P. troglodytes
aaaatatttcatcata

SEQ ID NO: 182768 - DNA, 16 bp, P. troglodytes
aaaatatttcatgata

SEQ ID NO: 182769 - DNA, 16 bp, P. troglodytes
aaaatatttcatgctc

SEQ ID NO: 182770 - DNA, 16 bp, P. troglodytes
aaaatatttccaaact

SEQ ID NO: 182771 - DNA, 16 bp, P. troglodytes
aaaatatttccagaat

SEQ ID NO: 182772 - DNA, 16 bp, P. troglodytes
aaaatatttctaattc

SEQ ID NO: 182773 - DNA, 16 bp, P. troglodytes
aaaatatttctcatct

SEQ ID NO: 182774 - DNA, 16 bp, P. troglodytes
aaaatatttctcattt

SEQ ID NO: 182775 - DNA, 16 bp, P. troglodytes
aaaatatttctgtgaa

SEQ ID NO: 182776 - DNA, 16 bp, P. troglodytes
aaaatatttcttttgt

SEQ ID NO: 182777 - DNA, 16 bp, P. troglodytes
aaaatatttgaaagca

SEQ ID NO: 182778 - DNA, 16 bp, P. troglodytes
aaaatatttgagaaga

SEQ ID NO: 182779 - DNA, 16 bp, P. troglodytes
aaaatatttgcaaaat

SEQ ID NO: 182780 - DNA, 16 bp, P. troglodytes
aaaatatttgcaaata

SEQ ID NO: 182781 - DNA, 16 bp, P. troglodytes
aaaatatttgcaatct

SEQ ID NO: 182782 - DNA, 16 bp, P. troglodytes
aaaatatttgcagact

SEQ ID NO: 182783 - DNA, 16 bp, P. troglodytes
aaaatatttgccatct

SEQ ID NO: 182784 - DNA, 16 bp, P. troglodytes
aaaatatttgctatat

SEQ ID NO: 182785 - DNA, 16 bp, P. troglodytes
aaaatatttgggaaaa

SEQ ID NO: 182786 - DNA, 16 bp, P. troglodytes
aaaatatttgtaatgt

SEQ ID NO: 182787 - DNA, 16 bp, P. troglodytes
aaaatatttgtgaaag

SEQ ID NO: 182788 - DNA, 16 bp, P. troglodytes
aaaatatttgtggaat

SEQ ID NO: 182789 - DNA, 16 bp, P. troglodytes
aaaatatttgtgtaat

SEQ ID NO: 182790 - DNA, 16 bp, P. troglodytes
aaaatatttgtttcct

SEQ ID NO: 182791 - DNA, 16 bp, P. troglodytes
aaaatatttgttttct

SEQ ID NO: 182792 - DNA, 16 bp, P. troglodytes
aaaatattttatgtga

SEQ ID NO: 182793 - DNA, 16 bp, P. troglodytes
aaaatattttcagaaa

SEQ ID NO: 182794 - DNA, 16 bp, P. troglodytes
aaaatattttcagata

SEQ ID NO: 182795 - DNA, 16 bp, P. troglodytes
aaaatattttcagctt

SEQ ID NO: 182796 - DNA, 16 bp, P. troglodytes
aaaatattttcagtgt

SEQ ID NO: 182797 - DNA, 16 bp, P. troglodytes
aaaatattttcatgtg

SEQ ID NO: 182798 - DNA, 16 bp, P. troglodytes
aaaatattttctcaaa

SEQ ID NO: 182799 - DNA, 16 bp, P. troglodytes
aaaatattttgaatca

SEQ ID NO: 182800 - DNA, 16 bp, P. troglodytes
aaaatattttgagata

SEQ ID NO: 182801 - DNA, 16 bp, P. troglodytes
aaaatattttgattct

SEQ ID NO: 182802 - DNA, 16 bp, P. troglodytes
aaaatattttggaaag

SEQ ID NO: 182803 - DNA, 16 bp, P. troglodytes
aaaatattttggaaga

SEQ ID NO: 182804 - DNA, 16 bp, P. troglodytes
aaaatattttgtgaaa

SEQ ID NO: 182805 - DNA, 16 bp, P. troglodytes
aaaatattttgtttct

SEQ ID NO: 182806 - DNA, 16 bp, P. troglodytes
aaaatatttttatcct

SEQ ID NO: 182807 - DNA, 16 bp, P. troglodytes
aaaatatttttcacaa

SEQ ID NO: 182808 - DNA, 16 bp, P. troglodytes
aaaatatttttcttcc

SEQ ID NO: 182809 - DNA, 16 bp, P. troglodytes
aaaatattttttgcaa

SEQ ID NO: 182810 - DNA, 16 bp, P. troglodytes
aaaatatttttttcca

SEQ ID NO: 182811 - DNA, 16 bp, P. troglodytes
aaaatcaaaaccacag

SEQ ID NO: 182812 - DNA, 16 bp, P. troglodytes
aaaatcaaaagcaggt

SEQ ID NO: 182813 - DNA, 16 bp, P. troglodytes
aaaatcaaaagctttt

SEQ ID NO: 182814 - DNA, 16 bp, P. troglodytes
aaaatcaaaagtattt

SEQ ID NO: 182815 - DNA, 16 bp, P. troglodytes
aaaatcaaaatgtatt

SEQ ID NO: 182816 - DNA, 16 bp, P. troglodytes
aaaatcaaaattactc

SEQ ID NO: 182817 - DNA, 16 bp, P. troglodytes
aaaatcaaactgtttt

SEQ ID NO: 182818 - DNA, 16 bp, P. troglodytes
aaaatcaaacttcagt

SEQ ID NO: 182819 - DNA, 16 bp, P. troglodytes
aaaatcaaagccacaa

SEQ ID NO: 182820 - DNA, 16 bp, P. troglodytes
aaaatcaaatatttct

SEQ ID NO: 182821 - DNA, 16 bp, P. troglodytes
aaaatcaaatggaaat

SEQ ID NO: 182822 - DNA, 16 bp, P. troglodytes
aaaatcaaatgtaaat

SEQ ID NO: 182823 - DNA, 16 bp, P. troglodytes
aaaatcaacaaggata

SEQ ID NO: 182824 - DNA, 16 bp, P. troglodytes
aaaatcaacacatttt

SEQ ID NO: 182825 - DNA, 16 bp, P. troglodytes
aaaatcaacagcattt

SEQ ID NO: 182826 - DNA, 16 bp, P. troglodytes
aaaatcaactctaaat

SEQ ID NO: 182827 - DNA, 16 bp, P. troglodytes
aaaatcaactgataaa

SEQ ID NO: 182828 - DNA, 16 bp, P. troglodytes
aaaatcaataaaagtt

SEQ ID NO: 182829 - DNA, 16 bp, P. troglodytes
aaaatcaataaatgta

SEQ ID NO: 182830 - DNA, 16 bp, P. troglodytes
aaaatcaatgaaacca

SEQ ID NO: 182831 - DNA, 16 bp, P. troglodytes
aaaatcaatgaaatta

SEQ ID NO: 182832 - DNA, 16 bp, P. troglodytes
aaaatcaatgtgaaaa

SEQ ID NO: 182833 - DNA, 16 bp, P. troglodytes
aaaatcaattatgttt

SEQ ID NO: 182834 - DNA, 16 bp, P. troglodytes
aaaatcaattccagat

SEQ ID NO: 182835 - DNA, 16 bp, P. troglodytes
aaaatcaattgactat

SEQ ID NO: 182836 - DNA, 16 bp, P. troglodytes
aaaatcaattgcattt

SEQ ID NO: 182837 - DNA, 16 bp, P. troglodytes
aaaatcaattgtgttt

SEQ ID NO: 182838 - DNA, 16 bp, P. troglodytes
aaaatcacaagcatgc

SEQ ID NO: 182839 - DNA, 16 bp, P. troglodytes
aaaatcacaagcattt

SEQ ID NO: 182840 - DNA, 16 bp, P. troglodytes
aaaatcacaaggaaga

SEQ ID NO: 182841 - DNA, 16 bp, P. troglodytes
aaaatcacagaaaatt

SEQ ID NO: 182842 - DNA, 16 bp, P. troglodytes
aaaatcacagtgaaat

SEQ ID NO: 182843 - DNA, 16 bp, P. troglodytes
aaaatcacatgataat

SEQ ID NO: 182844 - DNA, 16 bp, P. troglodytes
aaaatcactggaaccc

SEQ ID NO: 182845 - DNA, 16 bp, P. troglodytes
aaaatcagaaaattta

SEQ ID NO: 182846 - DNA, 16 bp, P. troglodytes
aaaatcagaaatgcaa

SEQ ID NO: 182847 - DNA, 16 bp, P. troglodytes
aaaatcagaattattt

SEQ ID NO: 182848 - DNA, 16 bp, P. troglodytes
aaaatcagaatttatt

SEQ ID NO: 182849 - DNA, 16 bp, P. troglodytes
aaaatcagacaaagat

SEQ ID NO: 182850 - DNA, 16 bp, P. troglodytes
aaaatcagattattta

SEQ ID NO: 182851 - DNA, 16 bp, P. troglodytes
aaaatcagattgtttt

SEQ ID NO: 182852 - DNA, 16 bp, P. troglodytes
aaaatcagcaaaatat

SEQ ID NO: 182853 - DNA, 16 bp, P. troglodytes
aaaatcagccgggcat

SEQ ID NO: 182854 - DNA, 16 bp, P. troglodytes
aaaatcagccgggcgt

SEQ ID NO: 182855 - DNA, 16 bp, P. troglodytes
aaaatcagcctggcca

SEQ ID NO: 182856 - DNA, 16 bp, P. troglodytes
aaaatcaggaaattta

SEQ ID NO: 182857 - DNA, 16 bp, P. troglodytes
aaaatcaggaagaaga

SEQ ID NO: 182858 - DNA, 16 bp, P. troglodytes
aaaatcagtaaagata

SEQ ID NO: 182859 - DNA, 16 bp, P. troglodytes
aaaatcagtagcattt

SEQ ID NO: 182860 - DNA, 16 bp, P. troglodytes
aaaatcagtagccttt

SEQ ID NO: 182861 - DNA, 16 bp, P. troglodytes
aaaatcagtgaaacca

SEQ ID NO: 182862 - DNA, 16 bp, P. troglodytes
aaaatcagtgagaaaa

SEQ ID NO: 182863 - DNA, 16 bp, P. troglodytes
aaaatcagttagctgt

SEQ ID NO: 182864 - DNA, 16 bp, P. troglodytes
aaaatcagttggctat

SEQ ID NO: 182865 - DNA, 16 bp, P. troglodytes
aaaatcagttgtccat

SEQ ID NO: 182866 - DNA, 16 bp, P. troglodytes
aaaatcagttttaaaa

SEQ ID NO: 182867 - DNA, 16 bp, P. troglodytes
aaaatcataacagtct

SEQ ID NO: 182868 - DNA, 16 bp, P. troglodytes
aaaatcataatgacag

SEQ ID NO: 182869 - DNA, 16 bp, P. troglodytes
aaaatcatacagaaag

SEQ ID NO: 182870 - DNA, 16 bp, P. troglodytes
aaaatcatattctttt

SEQ ID NO: 182871 - DNA, 16 bp, P. troglodytes
aaaatcatcttcagag

SEQ ID NO: 182872 - DNA, 16 bp, P. troglodytes
aaaatcatctttttaa

SEQ ID NO: 182873 - DNA, 16 bp, P. troglodytes
aaaatcatgaatgaac

SEQ ID NO: 182874 - DNA, 16 bp, P. troglodytes
aaaatcatgagaaaat

SEQ ID NO: 182875 - DNA, 16 bp, P. troglodytes
aaaatcatggaatcaa

SEQ ID NO: 182876 - DNA, 16 bp, P. troglodytes
aaaatcatgtcctttt

SEQ ID NO: 182877 - DNA, 16 bp, P. troglodytes
aaaatcattaaggaaa

SEQ ID NO: 182878 - DNA, 16 bp, P. troglodytes
aaaatcattagcattt

SEQ ID NO: 182879 - DNA, 16 bp, P. troglodytes
aaaatcattatttttg

SEQ ID NO: 182880 - DNA, 16 bp, P. troglodytes
aaaatcattcattcat

SEQ ID NO: 182881 - DNA, 16 bp, P. troglodytes
aaaatcattgcaaaat

SEQ ID NO: 182882 - DNA, 16 bp, P. troglodytes
aaaatcatttaacaca

SEQ ID NO: 182883 - DNA, 16 bp, P. troglodytes
aaaatcatttgataaa

SEQ ID NO: 182884 - DNA, 16 bp, P. troglodytes
aaaatcattttcttct

SEQ ID NO: 182885 - DNA, 16 bp, P. troglodytes
aaaatcattttgtttt

SEQ ID NO: 182886 - DNA, 16 bp, P. troglodytes
aaaatccaaaattttt

SEQ ID NO: 182887 - DNA, 16 bp, P. troglodytes
aaaatccaaataacct

SEQ ID NO: 182888 - DNA, 16 bp, P. troglodytes
aaaatccaaataatct

SEQ ID NO: 182889 - DNA, 16 bp, P. troglodytes
aaaatccaaattcttt

SEQ ID NO: 182890 - DNA, 16 bp, P. troglodytes
aaaatccaaatttctt

SEQ ID NO: 182891 - DNA, 16 bp, P. troglodytes
aaaatccagatcatgg

SEQ ID NO: 182892 - DNA, 16 bp, P. troglodytes
aaaatccatattttaa

SEQ ID NO: 182893 - DNA, 16 bp, P. troglodytes
aaaatccattatttta

SEQ ID NO: 182894 - DNA, 16 bp, P. troglodytes
aaaatccattcattca

SEQ ID NO: 182895 - DNA, 16 bp, P. troglodytes
aaaatccattttattt

SEQ ID NO: 182896 - DNA, 16 bp, P. troglodytes
aaaatcccaagtcaaa

SEQ ID NO: 182897 - DNA, 16 bp, P. troglodytes
aaaatcccacagctaa

SEQ ID NO: 182898 - DNA, 16 bp, P. troglodytes
aaaatcccagaaatca

SEQ ID NO: 182899 - DNA, 16 bp, P. troglodytes
aaaatcccatctctac

SEQ ID NO: 182900 - DNA, 16 bp, P. troglodytes
aaaatccccaaatact

SEQ ID NO: 182901 - DNA, 16 bp, P. troglodytes
aaaatcccccacattt

SEQ ID NO: 182902 - DNA, 16 bp, P. troglodytes
aaaatccctgccctca

SEQ ID NO: 182903 - DNA, 16 bp, P. troglodytes
aaaatcctaggagaaa

SEQ ID NO: 182904 - DNA, 16 bp, P. troglodytes
aaaatcctcaagaaaa

SEQ ID NO: 182905 - DNA, 16 bp, P. troglodytes
aaaatcctcagcaaaa

SEQ ID NO: 182906 - DNA, 16 bp, P. troglodytes
aaaatcctcctctgct

SEQ ID NO: 182907 - DNA, 16 bp, P. troglodytes
aaaatcctctgtgctt

SEQ ID NO: 182908 - DNA, 16 bp, P. troglodytes
aaaatcctgaaagaca

SEQ ID NO: 182909 - DNA, 16 bp, P. troglodytes
aaaatcctggaagaaa

SEQ ID NO: 182910 - DNA, 16 bp, P. troglodytes
aaaatcctgtctctat

SEQ ID NO: 182911 - DNA, 16 bp, P. troglodytes
aaaatccttttaaaat

SEQ ID NO: 182912 - DNA, 16 bp, P. troglodytes
aaaatctaaaatctga

SEQ ID NO: 182913 - DNA, 16 bp, P. troglodytes
aaaatctaaaatgttt

SEQ ID NO: 182914 - DNA, 16 bp, P. troglodytes
aaaatctaaatgaaat

SEQ ID NO: 182915 - DNA, 16 bp, P. troglodytes
aaaatctaagaaaatt

SEQ ID NO: 182916 - DNA, 16 bp, P. troglodytes
aaaatctaagctgttg

SEQ ID NO: 182917 - DNA, 16 bp, P. troglodytes
aaaatctacttattta

SEQ ID NO: 182918 - DNA, 16 bp, P. troglodytes
aaaatctagaaatgga

SEQ ID NO: 182919 - DNA, 16 bp, P. troglodytes
aaaatctagaagataa

SEQ ID NO: 182920 - DNA, 16 bp, P. troglodytes
aaaatctagctaagat

SEQ ID NO: 182921 - DNA, 16 bp, P. troglodytes
aaaatctatttttgtt

SEQ ID NO: 182922 - DNA, 16 bp, P. troglodytes
aaaatctcaagcattc

SEQ ID NO: 182923 - DNA, 16 bp, P. troglodytes
aaaatctcagaaatga

SEQ ID NO: 182924 - DNA, 16 bp, P. troglodytes
aaaatctcagcaagtt

SEQ ID NO: 182925 - DNA, 16 bp, P. troglodytes
aaaatctccagagaaa

SEQ ID NO: 182926 - DNA, 16 bp, P. troglodytes
aaaatctccagtgaaa

SEQ ID NO: 182927 - DNA, 16 bp, P. troglodytes
aaaatctcttaaaatt

SEQ ID NO: 182928 - DNA, 16 bp, P. troglodytes
aaaatctgaaaaaatt

SEQ ID NO: 182929 - DNA, 16 bp, P. troglodytes
aaaatctgaaaaatat

SEQ ID NO: 182930 - DNA, 16 bp, P. troglodytes
aaaatctgaaacattt

SEQ ID NO: 182931 - DNA, 16 bp, P. troglodytes
aaaatctgaaatgaaa

SEQ ID NO: 182932 - DNA, 16 bp, P. troglodytes
aaaatctgattaaaaa

SEQ ID NO: 182933 - DNA, 16 bp, P. troglodytes
aaaatctgatttattt

SEQ ID NO: 182934 - DNA, 16 bp, P. troglodytes
aaaatctgattttaaa

SEQ ID NO: 182935 - DNA, 16 bp, P. troglodytes
aaaatctgcagatgct

SEQ ID NO: 182936 - DNA, 16 bp, P. troglodytes
aaaatctgcattttaa

SEQ ID NO: 182937 - DNA, 16 bp, P. troglodytes
aaaatctgctttttaa

SEQ ID NO: 182938 - DNA, 16 bp, P. troglodytes
aaaatctggattttta

SEQ ID NO: 182939 - DNA, 16 bp, P. troglodytes
aaaatctgttttaaaa

SEQ ID NO: 182940 - DNA, 16 bp, P. troglodytes
aaaatctgttttgttt

SEQ ID NO: 182941 - DNA, 16 bp, P. troglodytes
aaaatcttaaaagcag

SEQ ID NO: 182942 - DNA, 16 bp, P. troglodytes
aaaatcttaagtcaaa

SEQ ID NO: 182943 - DNA, 16 bp, P. troglodytes
aaaatcttaattcatt

SEQ ID NO: 182944 - DNA, 16 bp, P. troglodytes
aaaatcttcaacaaag

SEQ ID NO: 182945 - DNA, 16 bp, P. troglodytes
aaaatcttcaagaaaa

SEQ ID NO: 182946 - DNA, 16 bp, P. troglodytes
aaaatcttcatttaaa

SEQ ID NO: 182947 - DNA, 16 bp, P. troglodytes
aaaatcttggctattg

SEQ ID NO: 182948 - DNA, 16 bp, P. troglodytes
aaaatctttcagtttt

SEQ ID NO: 182949 - DNA, 16 bp, P. troglodytes
aaaatctttctttctt

SEQ ID NO: 182950 - DNA, 16 bp, P. troglodytes
aaaatctttgtaaaaa

SEQ ID NO: 182951 - DNA, 16 bp, P. troglodytes
aaaatctttgttcttt

SEQ ID NO: 182952 - DNA, 16 bp, P. troglodytes
aaaatcttttcccaga

SEQ ID NO: 182953 - DNA, 16 bp, P. troglodytes
aaaatgaaaaacttct

SEQ ID NO: 182954 - DNA, 16 bp, P. troglodytes
aaaatgaaaacacatt

SEQ ID NO: 182955 - DNA, 16 bp, P. troglodytes
aaaatgaaaacattta

SEQ ID NO: 182956 - DNA, 16 bp, P. troglodytes
aaaatgaaaacatttt

SEQ ID NO: 182957 - DNA, 16 bp, P. troglodytes
aaaatgaaaactcaga

SEQ ID NO: 182958 - DNA, 16 bp, P. troglodytes
aaaatgaaaactgaag

SEQ ID NO: 182959 - DNA, 16 bp, P. troglodytes
aaaatgaaaacttcag

SEQ ID NO: 182960 - DNA, 16 bp, P. troglodytes
aaaatgaaaagcaagt

SEQ ID NO: 182961 - DNA, 16 bp, P. troglodytes
aaaatgaaaaggcaac

SEQ ID NO: 182962 - DNA, 16 bp, P. troglodytes
aaaatgaaaagtgttt

SEQ ID NO: 182963 - DNA, 16 bp, P. troglodytes
aaaatgaaaatgtgga

SEQ ID NO: 182964 - DNA, 16 bp, P. troglodytes
aaaatgaaaattctat

SEQ ID NO: 182965 - DNA, 16 bp, P. troglodytes
aaaatgaaacatttta

SEQ ID NO: 182966 - DNA, 16 bp, P. troglodytes
aaaatgaaacattttt

SEQ ID NO: 182967 - DNA, 16 bp, P. troglodytes
aaaatgaaaccatttt

SEQ ID NO: 182968 - DNA, 16 bp, P. troglodytes
aaaatgaaactatttt

SEQ ID NO: 182969 - DNA, 16 bp, P. troglodytes
aaaatgaaactgtttc

SEQ ID NO: 182970 - DNA, 16 bp, P. troglodytes
aaaatgaaactttttt

SEQ ID NO: 182971 - DNA, 16 bp, P. troglodytes
aaaatgaaagattttt

SEQ ID NO: 182972 - DNA, 16 bp, P. troglodytes
aaaatgaaagtaacag

SEQ ID NO: 182973 - DNA, 16 bp, P. troglodytes
aaaatgaaagtatact

SEQ ID NO: 182974 - DNA, 16 bp, P. troglodytes
aaaatgaaagttgaag

SEQ ID NO: 182975 - DNA, 16 bp, P. troglodytes
aaaatgaaatactttt

SEQ ID NO: 182976 - DNA, 16 bp, P. troglodytes
aaaatgaaatcaattt

SEQ ID NO: 182977 - DNA, 16 bp, P. troglodytes
aaaatgaaatcatata

SEQ ID NO: 182978 - DNA, 16 bp, P. troglodytes
aaaatgaaatgtattt

SEQ ID NO: 182979 - DNA, 16 bp, P. troglodytes
aaaatgaaattacttt

SEQ ID NO: 182980 - DNA, 16 bp, P. troglodytes
aaaatgaaattgcaaa

SEQ ID NO: 182981 - DNA, 16 bp, P. troglodytes
aaaatgaaatttggaa

SEQ ID NO: 182982 - DNA, 16 bp, P. troglodytes
aaaatgaacagaaatt

SEQ ID NO: 182983 - DNA, 16 bp, P. troglodytes
aaaatgaacagagcct

SEQ ID NO: 182984 - DNA, 16 bp, P. troglodytes
aaaatgaacatatttc

SEQ ID NO: 182985 - DNA, 16 bp, P. troglodytes
aaaatgaacattttgt

SEQ ID NO: 182986 - DNA, 16 bp, P. troglodytes
aaaatgaactaagaca

SEQ ID NO: 182987 - DNA, 16 bp, P. troglodytes
aaaatgaagaatttca

SEQ ID NO: 182988 - DNA, 16 bp, P. troglodytes
aaaatgaagacaattt

SEQ ID NO: 182989 - DNA, 16 bp, P. troglodytes
aaaatgaagactcaaa

SEQ ID NO: 182990 - DNA, 17 bp, P. troglodytes
aaaatgaaggcagaaat

SEQ ID NO: 182991 - DNA, 16 bp, P. troglodytes
aaaatgaaggcctcag

SEQ ID NO: 182992 - DNA, 16 bp, P. troglodytes
aaaatgaagtattttt

SEQ ID NO: 182993 - DNA, 16 bp, P. troglodytes
aaaatgaatacattat

SEQ ID NO: 182994 - DNA, 16 bp, P. troglodytes
aaaatgaatacatttt

SEQ ID NO: 182995 - DNA, 16 bp, P. troglodytes
aaaatgaatattttga

SEQ ID NO: 182996 - DNA, 16 bp, P. troglodytes
aaaatgaatgtttttt

SEQ ID NO: 182997 - DNA, 16 bp, P. troglodytes
aaaatgaattttatct

SEQ ID NO: 182998 - DNA, 16 bp, P. troglodytes
aaaatgaatttttctt

SEQ ID NO: 182999 - DNA, 16 bp, P. troglodytes
aaaatgaatttttgaa

SEQ ID NO: 183000 - DNA, 16 bp, P. troglodytes
aaaatgacaaatactg

SEQ ID NO: 183001 - DNA, 16 bp, P. troglodytes
aaaatgacaataatga

SEQ ID NO: 183002 - DNA, 16 bp, P. troglodytes
aaaatgacataaattt

SEQ ID NO: 183003 - DNA, 16 bp, P. troglodytes
aaaatgacatagtatt

SEQ ID NO: 183004 - DNA, 16 bp, P. troglodytes
aaaatgacatgaaatt

SEQ ID NO: 183005 - DNA, 16 bp, P. troglodytes
aaaatgaccatactgc

SEQ ID NO: 183006 - DNA, 16 bp, P. troglodytes
aaaatgaccattttta

SEQ ID NO: 183007 - DNA, 16 bp, P. troglodytes
aaaatgaccttttaaa

SEQ ID NO: 183008 - DNA, 16 bp, P. troglodytes
aaaatgaccttttttt

SEQ ID NO: 183009 - DNA, 16 bp, P. troglodytes
aaaatgactgaaaata

SEQ ID NO: 183010 - DNA, 16 bp, P. troglodytes
aaaatgacttaaaatt

SEQ ID NO: 183011 - DNA, 16 bp, P. troglodytes
aaaatgactttatttt

SEQ ID NO: 183012 - DNA, 16 bp, P. troglodytes
aaaatgactttgaaaa

SEQ ID NO: 183013 - DNA, 16 bp, P. troglodytes
aaaatgactttttttt

SEQ ID NO: 183014 - DNA, 16 bp, P. troglodytes
aaaatgagaaaactga

SEQ ID NO: 183015 - DNA, 16 bp, P. troglodytes
aaaatgagaaaatact

SEQ ID NO: 183016 - DNA, 16 bp, P. troglodytes
aaaatgagaaatttga

SEQ ID NO: 183017 - DNA, 16 bp, P. troglodytes
aaaatgagaacatttt

SEQ ID NO: 183018 - DNA, 16 bp, P. troglodytes
aaaatgagagaaaact

SEQ ID NO: 183019 - DNA, 16 bp, P. troglodytes
aaaatgagcaaaatac

SEQ ID NO: 183020 - DNA, 16 bp, P. troglodytes
aaaatgagcaacagaa

SEQ ID NO: 183021 - DNA, 16 bp, P. troglodytes
aaaatgagctgggtgt

SEQ ID NO: 183022 - DNA, 16 bp, P. troglodytes
aaaatgagctttccta

SEQ ID NO: 183023 - DNA, 16 bp, P. troglodytes
aaaatgaggataatga

SEQ ID NO: 183024 - DNA, 16 bp, P. troglodytes
aaaatgaggctgagac

SEQ ID NO: 183025 - DNA, 16 bp, P. troglodytes
aaaatgaggctggaga

SEQ ID NO: 183026 - DNA, 16 bp, P. troglodytes
aaaatgaggttttttt

SEQ ID NO: 183027 - DNA, 16 bp, P. troglodytes
aaaatgagtgattttt

SEQ ID NO: 183028 - DNA, 16 bp, P. troglodytes
aaaatgagtgtttcca

SEQ ID NO: 183029 - DNA, 16 bp, P. troglodytes
aaaatgataattttgt

SEQ ID NO: 183030 - DNA, 16 bp, P. troglodytes
aaaatgatacttaaaa

SEQ ID NO: 183031 - DNA, 16 bp, P. troglodytes
aaaatgatcaaaatat

SEQ ID NO: 183032 - DNA, 16 bp, P. troglodytes
aaaatgatcatcatca

SEQ ID NO: 183033 - DNA, 16 bp, P. troglodytes
aaaatgatgaagatga

SEQ ID NO: 183034 - DNA, 16 bp, P. troglodytes
aaaatgatgaatattt

SEQ ID NO: 183035 - DNA, 16 bp, P. troglodytes
aaaatgatggtttcca

SEQ ID NO: 183036 - DNA, 16 bp, P. troglodytes
aaaatgatgtaaattt

SEQ ID NO: 183037 - DNA, 16 bp, P. troglodytes
aaaatgatgtattttt

SEQ ID NO: 183038 - DNA, 16 bp, P. troglodytes
aaaatgatgttatttt

SEQ ID NO: 183039 - DNA, 16 bp, P. troglodytes
aaaatgatgtttattt

SEQ ID NO: 183040 - DNA, 16 bp, P. troglodytes
aaaatgattgtttaaa

SEQ ID NO: 183041 - DNA, 16 bp, P. troglodytes
aaaatgatttgtttta

SEQ ID NO: 183042 - DNA, 16 bp, P. troglodytes
aaaatgattttaaagt

SEQ ID NO: 183043 - DNA, 16 bp, P. troglodytes
aaaatgattttgaaat

SEQ ID NO: 183044 - DNA, 16 bp, P. troglodytes
aaaatgcaaaattaca

SEQ ID NO: 183045 - DNA, 16 bp, P. troglodytes
aaaatgcaaacttggg

SEQ ID NO: 183046 - DNA, 16 bp, P. troglodytes
aaaatgcaaagaaatg

SEQ ID NO: 183047 - DNA, 16 bp, P. troglodytes
aaaatgcaaatgagaa

SEQ ID NO: 183048 - DNA, 16 bp, P. troglodytes
aaaatgcaaatggaaa

SEQ ID NO: 183049 - DNA, 16 bp, P. troglodytes
aaaatgcaaattacaa

SEQ ID NO: 183050 - DNA, 16 bp, P. troglodytes
aaaatgcaaattatga

SEQ ID NO: 183051 - DNA, 16 bp, P. troglodytes
aaaatgcaaattctaa

SEQ ID NO: 183052 - DNA, 16 bp, P. troglodytes
aaaatgcaaattttat

SEQ ID NO: 183053 - DNA, 16 bp, P. troglodytes
aaaatgcaataaaatt

SEQ ID NO: 183054 - DNA, 16 bp, P. troglodytes
aaaatgcaatatttgt

SEQ ID NO: 183055 - DNA, 16 bp, P. troglodytes
aaaatgcaattacttt

SEQ ID NO: 183056 - DNA, 16 bp, P. troglodytes
aaaatgcaattcaaaa

SEQ ID NO: 183057 - DNA, 16 bp, P. troglodytes
aaaatgcaattggcat

SEQ ID NO: 183058 - DNA, 16 bp, P. troglodytes
aaaatgcacaaatcat

SEQ ID NO: 183059 - DNA, 16 bp, P. troglodytes
aaaatgcacttttttt

SEQ ID NO: 183060 - DNA, 16 bp, P. troglodytes
aaaatgcagaatattt

SEQ ID NO: 183061 - DNA, 16 bp, P. troglodytes
aaaatgcagattcact

SEQ ID NO: 183062 - DNA, 16 bp, P. troglodytes
aaaatgcagattcccc

SEQ ID NO: 183063 - DNA, 16 bp, P. troglodytes
aaaatgcagattcctg

SEQ ID NO: 183064 - DNA, 16 bp, P. troglodytes
aaaatgcagattttca

SEQ ID NO: 183065 - DNA, 16 bp, P. troglodytes
aaaatgcagcaagaca

SEQ ID NO: 183066 - DNA, 16 bp, P. troglodytes
aaaatgcagtagaaaa

SEQ ID NO: 183067 - DNA, 16 bp, P. troglodytes
aaaatgcagttttaaa

SEQ ID NO: 183068 - DNA, 16 bp, P. troglodytes
aaaatgcagttttatt

SEQ ID NO: 183069 - DNA, 16 bp, P. troglodytes
aaaatgcataaaatat

SEQ ID NO: 183070 - DNA, 16 bp, P. troglodytes
aaaatgcatatatata

SEQ ID NO: 183071 - DNA, 16 bp, P. troglodytes
aaaatgcatatatgta

SEQ ID NO: 183072 - DNA, 16 bp, P. troglodytes
aaaatgcatattgaga

SEQ ID NO: 183073 - DNA, 16 bp, P. troglodytes
aaaatgcattattttt

SEQ ID NO: 183074 - DNA, 16 bp, P. troglodytes
aaaatgcatttaaata

SEQ ID NO: 183075 - DNA, 16 bp, P. troglodytes
aaaatgcatttagaaa

SEQ ID NO: 183076 - DNA, 16 bp, P. troglodytes
aaaatgcatttggaaa

SEQ ID NO: 183077 - DNA, 16 bp, P. troglodytes
aaaatgcattttattt

SEQ ID NO: 183078 - DNA, 16 bp, P. troglodytes
aaaatgcattttcaaa

SEQ ID NO: 183079 - DNA, 16 bp, P. troglodytes
aaaatgcatttttcaa

SEQ ID NO: 183080 - DNA, 16 bp, P. troglodytes
aaaatgccaaaaaatt

SEQ ID NO: 183081 - DNA, 16 bp, P. troglodytes
aaaatgccatcagtct

SEQ ID NO: 183082 - DNA, 16 bp, P. troglodytes
aaaatgccattttatt

SEQ ID NO: 183083 - DNA, 16 bp, P. troglodytes
aaaatgccatttttaa

SEQ ID NO: 183084 - DNA, 16 bp, P. troglodytes
aaaatgcccacccagt

SEQ ID NO: 183085 - DNA, 16 bp, P. troglodytes
aaaatgccttcaataa

SEQ ID NO: 183086 - DNA, 16 bp, P. troglodytes
aaaatgccttgaaggc

SEQ ID NO: 183087 - DNA, 16 bp, P. troglodytes
aaaatgccttttaaaa

SEQ ID NO: 183088 - DNA, 16 bp, P. troglodytes
aaaatgctaaaattta

SEQ ID NO: 183089 - DNA, 16 bp, P. troglodytes
aaaatgctaaaatttt

SEQ ID NO: 183090 - DNA, 16 bp, P. troglodytes
aaaatgctactaattt

SEQ ID NO: 183091 - DNA, 16 bp, P. troglodytes
aaaatgctagaaaaat

SEQ ID NO: 183092 - DNA, 16 bp, P. troglodytes
aaaatgctatcaaaca

SEQ ID NO: 183093 - DNA, 16 bp, P. troglodytes
aaaatgctatcaaata

SEQ ID NO: 183094 - DNA, 16 bp, P. troglodytes
aaaatgctatgtaaat

SEQ ID NO: 183095 - DNA, 16 bp, P. troglodytes
aaaatgctattttgaa

SEQ ID NO: 183096 - DNA, 16 bp, P. troglodytes
aaaatgctattttttt

SEQ ID NO: 183097 - DNA, 16 bp, P. troglodytes
aaaatgctcaacctca

SEQ ID NO: 183098 - DNA, 16 bp, P. troglodytes
aaaatgctgaaaacaa

SEQ ID NO: 183099 - DNA, 16 bp, P. troglodytes
aaaatgctgaaaataa

SEQ ID NO: 183100 - DNA, 16 bp, P. troglodytes
aaaatgctgaaaggaa

SEQ ID NO: 183101 - DNA, 16 bp, P. troglodytes
aaaatgctgaaataaa

SEQ ID NO: 183102 - DNA, 16 bp, P. troglodytes
aaaatgctgataatga

SEQ ID NO: 183103 - DNA, 16 bp, P. troglodytes
aaaatgctgatgaaat

SEQ ID NO: 183104 - DNA, 16 bp, P. troglodytes
aaaatgctgccagtct

SEQ ID NO: 183105 - DNA, 16 bp, P. troglodytes
aaaatgctgctagtct

SEQ ID NO: 183106 - DNA, 16 bp, P. troglodytes
aaaatgcttaaagaaa

SEQ ID NO: 183107 - DNA, 16 bp, P. troglodytes
aaaatgcttaacaaaa

SEQ ID NO: 183108 - DNA, 16 bp, P. troglodytes
aaaatgcttctgcaca

SEQ ID NO: 183109 - DNA, 16 bp, P. troglodytes
aaaatgctttattttt

SEQ ID NO: 183110 - DNA, 16 bp, P. troglodytes
aaaatgctttctaaaa

SEQ ID NO: 183111 - DNA, 16 bp, P. troglodytes
aaaatgctttctaaat

SEQ ID NO: 183112 - DNA, 16 bp, P. troglodytes
aaaatgctttgaaaag

SEQ ID NO: 183113 - DNA, 16 bp, P. troglodytes
aaaatgctttgtaaac

SEQ ID NO: 183114 - DNA, 16 bp, P. troglodytes
aaaatgcttttataaa

SEQ ID NO: 183115 - DNA, 16 bp, P. troglodytes
aaaatgcttttatttc

SEQ ID NO: 183116 - DNA, 16 bp, P. troglodytes
aaaatgcttttatttt

SEQ ID NO: 183117 - DNA, 16 bp, P. troglodytes
aaaatggaaaaatact

SEQ ID NO: 183118 - DNA, 16 bp, P. troglodytes
aaaatggaaaactttt

SEQ ID NO: 183119 - DNA, 16 bp, P. troglodytes
aaaatggaaaatacat

SEQ ID NO: 183120 - DNA, 16 bp, P. troglodytes
aaaatggaaacaatct

SEQ ID NO: 183121 - DNA, 16 bp, P. troglodytes
aaaatggaaacacagc

SEQ ID NO: 183122 - DNA, 16 bp, P. troglodytes
aaaatggaaactgaaa

SEQ ID NO: 183123 - DNA, 16 bp, P. troglodytes
aaaatggaaatatcaa

SEQ ID NO: 183124 - DNA, 16 bp, P. troglodytes
aaaatggaaatcatat

SEQ ID NO: 183125 - DNA, 16 bp, P. troglodytes
aaaatggaaggaaatt

SEQ ID NO: 183126 - DNA, 16 bp, P. troglodytes
aaaatggaagtgagat

SEQ ID NO: 183127 - DNA, 16 bp, P. troglodytes
aaaatggaataatttt

SEQ ID NO: 183128 - DNA, 16 bp, P. troglodytes
aaaatggaatatttta

SEQ ID NO: 183129 - DNA, 16 bp, P. troglodytes
aaaatggaatttctta

SEQ ID NO: 183130 - DNA, 16 bp, P. troglodytes
aaaatggaattttata

SEQ ID NO: 183131 - DNA, 16 bp, P. troglodytes
aaaatggacaaaggat

SEQ ID NO: 183132 - DNA, 16 bp, P. troglodytes
aaaatggaccaatcag

SEQ ID NO: 183133 - DNA, 20 bp, P. troglodytes
aaaatggaccaatcagtgct

SEQ ID NO: 183134 - DNA, 16 bp, P. troglodytes
aaaatggactaacaca

SEQ ID NO: 183135 - DNA, 16 bp, P. troglodytes
aaaatggagaaatcag

SEQ ID NO: 183136 - DNA, 16 bp, P. troglodytes
aaaatggagacaataa

SEQ ID NO: 183137 - DNA, 16 bp, P. troglodytes
aaaatggagatgatag

SEQ ID NO: 183138 - DNA, 16 bp, P. troglodytes
aaaatggagatttttt

SEQ ID NO: 183139 - DNA, 16 bp, P. troglodytes
aaaatggaggcagaaa

SEQ ID NO: 183140 - DNA, 16 bp, P. troglodytes
aaaatggatatatttt

SEQ ID NO: 183141 - DNA, 16 bp, P. troglodytes
aaaatggatattttta

SEQ ID NO: 183142 - DNA, 16 bp, P. troglodytes
aaaatggattaaaaac

SEQ ID NO: 183143 - DNA, 16 bp, P. troglodytes
aaaatggcaaaaactg

SEQ ID NO: 183144 - DNA, 16 bp, P. troglodytes
aaaatggcaaatctaa

SEQ ID NO: 183145 - DNA, 16 bp, P. troglodytes
aaaatggcaataataa

SEQ ID NO: 183146 - DNA, 16 bp, P. troglodytes
aaaatggcaattatta

SEQ ID NO: 183147 - DNA, 16 bp, P. troglodytes
aaaatggcaatttcat

SEQ ID NO: 183148 - DNA, 16 bp, P. troglodytes
aaaatggcacagaaat

SEQ ID NO: 183149 - DNA, 16 bp, P. troglodytes
aaaatggcagagtaga

SEQ ID NO: 183150 - DNA, 16 bp, P. troglodytes
aaaatggcatcctgct

SEQ ID NO: 183151 - DNA, 16 bp, P. troglodytes
aaaatggcattaaaaa

SEQ ID NO: 183152 - DNA, 16 bp, P. troglodytes
aaaatggcattaaaat

SEQ ID NO: 183153 - DNA, 16 bp, P. troglodytes
aaaatggcatttttct

SEQ ID NO: 183154 - DNA, 20 bp, P. troglodytes
aaaatggccacactgcccaa

SEQ ID NO: 183155 - DNA, 16 bp, P. troglodytes
aaaatggccaggcaca

SEQ ID NO: 183156 - DNA, 20 bp, P. troglodytes
aaaatggccatactgcccaa

SEQ ID NO: 183157 - DNA, 19 bp, P. troglodytes
aaaatggccatactgcccc

SEQ ID NO: 183158 - DNA, 16 bp, P. troglodytes
aaaatggccatacttc

SEQ ID NO: 183159 - DNA, 16 bp, P. troglodytes
aaaatggccatagtgc

SEQ ID NO: 183160 - DNA, 16 bp, P. troglodytes
aaaatggccgtactgc

SEQ ID NO: 183161 - DNA, 16 bp, P. troglodytes
aaaatgggaaacaaag

SEQ ID NO: 183162 - DNA, 16 bp, P. troglodytes
aaaatgggcaaaatat

SEQ ID NO: 183163 - DNA, 16 bp, P. troglodytes
aaaatgggcaaaatgt

SEQ ID NO: 183164 - DNA, 16 bp, P. troglodytes
aaaatgggcaaagaaa

SEQ ID NO: 183165 - DNA, 16 bp, P. troglodytes
aaaatgggcaagagac

SEQ ID NO: 183166 - DNA, 16 bp, P. troglodytes
aaaatggggaaaaaac

SEQ ID NO: 183167 - DNA, 16 bp, P. troglodytes
aaaatggggaaactga

SEQ ID NO: 183168 - DNA, 16 bp, P. troglodytes
aaaatggggataataa

SEQ ID NO: 183169 - DNA, 16 bp, P. troglodytes
aaaatggggataatag

SEQ ID NO: 183170 - DNA, 16 bp, P. troglodytes
aaaatggggatgacaa

SEQ ID NO: 183171 - DNA, 16 bp, P. troglodytes
aaaatggggattaaaa

SEQ ID NO: 183172 - DNA, 16 bp, P. troglodytes
aaaatggtaaagggga

SEQ ID NO: 183173 - DNA, 16 bp, P. troglodytes
aaaatggtaaatatgt

SEQ ID NO: 183174 - DNA, 16 bp, P. troglodytes
aaaatggtaaattttt

SEQ ID NO: 183175 - DNA, 16 bp, P. troglodytes
aaaatggtacagacac

SEQ ID NO: 183176 - DNA, 16 bp, P. troglodytes
aaaatggtgataaaat

SEQ ID NO: 183177 - DNA, 16 bp, P. troglodytes
aaaatggtgataatga

SEQ ID NO: 183178 - DNA, 16 bp, P. troglodytes
aaaatggtggagtatg

SEQ ID NO: 183179 - DNA, 16 bp, P. troglodytes
aaaatggttaagatgg

SEQ ID NO: 183180 - DNA, 16 bp, P. troglodytes
aaaatggttaattttt

SEQ ID NO: 183181 - DNA, 16 bp, P. troglodytes
aaaatggttcatttta

SEQ ID NO: 183182 - DNA, 16 bp, P. troglodytes
aaaatggtttatttta

SEQ ID NO: 183183 - DNA, 16 bp, P. troglodytes
aaaatggttttctggg

SEQ ID NO: 183184 - DNA, 16 bp, P. troglodytes
aaaatgtaaaacttag

SEQ ID NO: 183185 - DNA, 16 bp, P. troglodytes
aaaatgtaaaatatct

SEQ ID NO: 183186 - DNA, 16 bp, P. troglodytes
aaaatgtaaacaatat

SEQ ID NO: 183187 - DNA, 16 bp, P. troglodytes
aaaatgtaaacacatt

SEQ ID NO: 183188 - DNA, 16 bp, P. troglodytes
aaaatgtaaactttaa

SEQ ID NO: 183189 - DNA, 16 bp, P. troglodytes
aaaatgtaaagactat

SEQ ID NO: 183190 - DNA, 16 bp, P. troglodytes
aaaatgtaaatacata

SEQ ID NO: 183191 - DNA, 16 bp, P. troglodytes
aaaatgtaaatctgat

SEQ ID NO: 183192 - DNA, 16 bp, P. troglodytes
aaaatgtaaattatgt

SEQ ID NO: 183193 - DNA, 16 bp, P. troglodytes
aaaatgtaagaatttt

SEQ ID NO: 183194 - DNA, 16 bp, P. troglodytes
aaaatgtaatgaattt

SEQ ID NO: 183195 - DNA, 16 bp, P. troglodytes
aaaatgtaatgttttt

SEQ ID NO: 183196 - DNA, 16 bp, P. troglodytes
aaaatgtaatttcatt

SEQ ID NO: 183197 - DNA, 16 bp, P. troglodytes
aaaatgtacaaaatat

SEQ ID NO: 183198 - DNA, 16 bp, P. troglodytes
aaaatgtacaatattt

SEQ ID NO: 183199 - DNA, 16 bp, P. troglodytes
aaaatgtacataattt

SEQ ID NO: 183200 - DNA, 16 bp, P. troglodytes
aaaatgtacatatttt

SEQ ID NO: 183201 - DNA, 16 bp, P. troglodytes
aaaatgtacattattt

SEQ ID NO: 183202 - DNA, 16 bp, P. troglodytes
aaaatgtactttcttt

SEQ ID NO: 183203 - DNA, 16 bp, P. troglodytes
aaaatgtactttgaaa

SEQ ID NO: 183204 - DNA, 16 bp, P. troglodytes
aaaatgtagacaaaat

SEQ ID NO: 183205 - DNA, 16 bp, P. troglodytes
aaaatgtagcagaaaa

SEQ ID NO: 183206 - DNA, 16 bp, P. troglodytes
aaaatgtagcttttat

SEQ ID NO: 183207 - DNA, 16 bp, P. troglodytes
aaaatgtagttttaaa

SEQ ID NO: 183208 - DNA, 16 bp, P. troglodytes
aaaatgtatatacaca

SEQ ID NO: 183209 - DNA, 16 bp, P. troglodytes
aaaatgtatatacttt

SEQ ID NO: 183210 - DNA, 16 bp, P. troglodytes
aaaatgtatattttga

SEQ ID NO: 183211 - DNA, 16 bp, P. troglodytes
aaaatgtatcaaaaat

SEQ ID NO: 183212 - DNA, 16 bp, P. troglodytes
aaaatgtatcttaaaa

SEQ ID NO: 183213 - DNA, 16 bp, P. troglodytes
aaaatgtatctttaaa

SEQ ID NO: 183214 - DNA, 16 bp, P. troglodytes
aaaatgtatgcttttt

SEQ ID NO: 183215 - DNA, 16 bp, P. troglodytes
aaaatgtatttatgaa

SEQ ID NO: 183216 - DNA, 16 bp, P. troglodytes
aaaatgtatttcagaa

SEQ ID NO: 183217 - DNA, 16 bp, P. troglodytes
aaaatgtatttctgta

SEQ ID NO: 183218 - DNA, 16 bp, P. troglodytes
aaaatgtatttgaaat

SEQ ID NO: 183219 - DNA, 16 bp, P. troglodytes
aaaatgtatttgacaa

SEQ ID NO: 183220 - DNA, 16 bp, P. troglodytes
aaaatgtatttggaaa

SEQ ID NO: 183221 - DNA, 16 bp, P. troglodytes
aaaatgtattttactt

SEQ ID NO: 183222 - DNA, 16 bp, P. troglodytes
aaaatgtattttatga

SEQ ID NO: 183223 - DNA, 16 bp, P. troglodytes
aaaatgtattttgaaa

SEQ ID NO: 183224 - DNA, 16 bp, P. troglodytes
aaaatgtcaaaaatat

SEQ ID NO: 183225 - DNA, 16 bp, P. troglodytes
aaaatgtcaacattta

SEQ ID NO: 183226 - DNA, 16 bp, P. troglodytes
aaaatgtcagaagaaa

SEQ ID NO: 183227 - DNA, 16 bp, P. troglodytes
aaaatgtcagtagtgc

SEQ ID NO: 183228 - DNA, 16 bp, P. troglodytes
aaaatgtcagtatttt

SEQ ID NO: 183229 - DNA, 16 bp, P. troglodytes
aaaatgtcagttcttc

SEQ ID NO: 183230 - DNA, 16 bp, P. troglodytes
aaaatgtcattgaaat

SEQ ID NO: 183231 - DNA, 16 bp, P. troglodytes
aaaatgtcatttatat

SEQ ID NO: 183232 - DNA, 16 bp, P. troglodytes
aaaatgtcatttttaa

SEQ ID NO: 183233 - DNA, 16 bp, P. troglodytes
aaaatgtcctaaaatt

SEQ ID NO: 183234 - DNA, 16 bp, P. troglodytes
aaaatgtctaaaataa

SEQ ID NO: 183235 - DNA, 16 bp, P. troglodytes
aaaatgtctccagaca

SEQ ID NO: 183236 - DNA, 16 bp, P. troglodytes
aaaatgtctccagggc

SEQ ID NO: 183237 - DNA, 16 bp, P. troglodytes
aaaatgtctctggaca

SEQ ID NO: 183238 - DNA, 16 bp, P. troglodytes
aaaatgtcttatttta

SEQ ID NO: 183239 - DNA, 16 bp, P. troglodytes
aaaatgtctttaaaaa

SEQ ID NO: 183240 - DNA, 16 bp, P. troglodytes
aaaatgtctttcattt

SEQ ID NO: 183241 - DNA, 16 bp, P. troglodytes
aaaatgtcttttaaat

SEQ ID NO: 183242 - DNA, 16 bp, P. troglodytes
aaaatgtcttttattt

SEQ ID NO: 183243 - DNA, 16 bp, P. troglodytes
aaaatgtcttttgaaa

SEQ ID NO: 183244 - DNA, 16 bp, P. troglodytes
aaaatgtcttttgttt

SEQ ID NO: 183245 - DNA, 16 bp, P. troglodytes
aaaatgtctttttttt

SEQ ID NO: 183246 - DNA, 16 bp, P. troglodytes
aaaatgtgaaaacaat

SEQ ID NO: 183247 - DNA, 16 bp, P. troglodytes
aaaatgtgaaacattt

SEQ ID NO: 183248 - DNA, 16 bp, P. troglodytes
aaaatgtgaaactttt

SEQ ID NO: 183249 - DNA, 16 bp, P. troglodytes
aaaatgtgaaagcaac

SEQ ID NO: 183250 - DNA, 16 bp, P. troglodytes
aaaatgtgaagaattt

SEQ ID NO: 183251 - DNA, 16 bp, P. troglodytes
aaaatgtgaattattt

SEQ ID NO: 183252 - DNA, 16 bp, P. troglodytes
aaaatgtgaatttttt

SEQ ID NO: 183253 - DNA, 16 bp, P. troglodytes
aaaatgtgactgtatt

SEQ ID NO: 183254 - DNA, 16 bp, P. troglodytes
aaaatgtgacttttaa

SEQ ID NO: 183255 - DNA, 16 bp, P. troglodytes
aaaatgtgatattttg

SEQ ID NO: 183256 - DNA, 16 bp, P. troglodytes
aaaatgtgattatttt

SEQ ID NO: 183257 - DNA, 16 bp, P. troglodytes
aaaatgtgatttattt

SEQ ID NO: 183258 - DNA, 16 bp, P. troglodytes
aaaatgtgccaggcat

SEQ ID NO: 183259 - DNA, 16 bp, P. troglodytes
aaaatgtgcttttaaa

SEQ ID NO: 183260 - DNA, 16 bp, P. troglodytes
aaaatgtgctttttaa

SEQ ID NO: 183261 - DNA, 16 bp, P. troglodytes
aaaatgtggaaaacaa

SEQ ID NO: 183262 - DNA, 16 bp, P. troglodytes
aaaatgtggaaacagc

SEQ ID NO: 183263 - DNA, 16 bp, P. troglodytes
aaaatgtggaagaaac

SEQ ID NO: 183264 - DNA, 16 bp, P. troglodytes
aaaatgtggaagcaac

SEQ ID NO: 183265 - DNA, 16 bp, P. troglodytes
aaaatgtggaagtgaa

SEQ ID NO: 183266 - DNA, 16 bp, P. troglodytes
aaaatgtggacacaga

SEQ ID NO: 183267 - DNA, 16 bp, P. troglodytes
aaaatgtggaggtgga

SEQ ID NO: 183268 - DNA, 17 bp, P. troglodytes
aaaatgtgggaaagttt

SEQ ID NO: 183269 - DNA, 16 bp, P. troglodytes
aaaatgtgtaataatt

SEQ ID NO: 183270 - DNA, 16 bp, P. troglodytes
aaaatgtgtatacatt

SEQ ID NO: 183271 - DNA, 16 bp, P. troglodytes
aaaatgtgtatttctt

SEQ ID NO: 183272 - DNA, 16 bp, P. troglodytes
aaaatgtgtgattttt

SEQ ID NO: 183273 - DNA, 16 bp, P. troglodytes
aaaatgtgtgtataca

SEQ ID NO: 183274 - DNA, 16 bp, P. troglodytes
aaaatgtgtgtttttt

SEQ ID NO: 183275 - DNA, 16 bp, P. troglodytes
aaaatgtgtttagaaa

SEQ ID NO: 183276 - DNA, 16 bp, P. troglodytes
aaaatgtgtttcatat

SEQ ID NO: 183277 - DNA, 16 bp, P. troglodytes
aaaatgtgtttgaaaa

SEQ ID NO: 183278 - DNA, 16 bp, P. troglodytes
aaaatgtgtttgtttc

SEQ ID NO: 183279 - DNA, 16 bp, P. troglodytes
aaaatgtgtttgtttt

SEQ ID NO: 183280 - DNA, 16 bp, P. troglodytes
aaaatgtgttttaata

SEQ ID NO: 183281 - DNA, 16 bp, P. troglodytes
aaaatgttaaaaagtg

SEQ ID NO: 183282 - DNA, 16 bp, P. troglodytes
aaaatgttaaaacatt

SEQ ID NO: 183283 - DNA, 16 bp, P. troglodytes
aaaatgttaaatacat

SEQ ID NO: 183284 - DNA, 16 bp, P. troglodytes
aaaatgttaaatggaa

SEQ ID NO: 183285 - DNA, 16 bp, P. troglodytes
aaaatgttaacagtgg

SEQ ID NO: 183286 - DNA, 16 bp, P. troglodytes
aaaatgttaacatttg

SEQ ID NO: 183287 - DNA, 16 bp, P. troglodytes
aaaatgttaatagtgc

SEQ ID NO: 183288 - DNA, 16 bp, P. troglodytes
aaaatgttaccatttt

SEQ ID NO: 183289 - DNA, 16 bp, P. troglodytes
aaaatgttactaaaat

SEQ ID NO: 183290 - DNA, 16 bp, P. troglodytes
aaaatgttagcaaact

SEQ ID NO: 183291 - DNA, 16 bp, P. troglodytes
aaaatgttataaaatc

SEQ ID NO: 183292 - DNA, 16 bp, P. troglodytes
aaaatgttataaatgt

SEQ ID NO: 183293 - DNA, 16 bp, P. troglodytes
aaaatgttattttgaa

SEQ ID NO: 183294 - DNA, 16 bp, P. troglodytes
aaaatgttcaacacca

SEQ ID NO: 183295 - DNA, 16 bp, P. troglodytes
aaaatgttcatgtcct

SEQ ID NO: 183296 - DNA, 16 bp, P. troglodytes
aaaatgttcattaaaa

SEQ ID NO: 183297 - DNA, 16 bp, P. troglodytes
aaaatgttcattttgt

SEQ ID NO: 183298 - DNA, 16 bp, P. troglodytes
aaaatgttcctgtttc

SEQ ID NO: 183299 - DNA, 16 bp, P. troglodytes
aaaatgttctaaaatt

SEQ ID NO: 183300 - DNA, 16 bp, P. troglodytes
aaaatgttctatttta

SEQ ID NO: 183301 - DNA, 16 bp, P. troglodytes
aaaatgttctgtaatt

SEQ ID NO: 183302 - DNA, 16 bp, P. troglodytes
aaaatgttctttgaaa

SEQ ID NO: 183303 - DNA, 16 bp, P. troglodytes
aaaatgttcttttctt

SEQ ID NO: 183304 - DNA, 16 bp, P. troglodytes
aaaatgttggagaaaa

SEQ ID NO: 183305 - DNA, 16 bp, P. troglodytes
aaaatgtttaaagtga

SEQ ID NO: 183306 - DNA, 16 bp, P. troglodytes
aaaatgtttaacaaaa

SEQ ID NO: 183307 - DNA, 16 bp, P. troglodytes
aaaatgtttaatatca

SEQ ID NO: 183308 - DNA, 16 bp, P. troglodytes
aaaatgtttacaatct

SEQ ID NO: 183309 - DNA, 16 bp, P. troglodytes
aaaatgtttacatttt

SEQ ID NO: 183310 - DNA, 16 bp, P. troglodytes
aaaatgtttattcttt

SEQ ID NO: 183311 - DNA, 16 bp, P. troglodytes
aaaatgtttatttaga

SEQ ID NO: 183312 - DNA, 16 bp, P. troglodytes
aaaatgtttattttcc

SEQ ID NO: 183313 - DNA, 16 bp, P. troglodytes
aaaatgtttcataatt

SEQ ID NO: 183314 - DNA, 16 bp, P. troglodytes
aaaatgtttcattttt

SEQ ID NO: 183315 - DNA, 16 bp, P. troglodytes
aaaatgtttccaaatt

SEQ ID NO: 183316 - DNA, 16 bp, P. troglodytes
aaaatgtttcctcttt

SEQ ID NO: 183317 - DNA, 16 bp, P. troglodytes
aaaatgtttctgcaca

SEQ ID NO: 183318 - DNA, 16 bp, P. troglodytes
aaaatgtttctgtttt

SEQ ID NO: 183319 - DNA, 16 bp, P. troglodytes
aaaatgtttgaaatat

SEQ ID NO: 183320 - DNA, 16 bp, P. troglodytes
aaaatgtttgaagaaa

SEQ ID NO: 183321 - DNA, 16 bp, P. troglodytes
aaaatgtttgcaaatg

SEQ ID NO: 183322 - DNA, 16 bp, P. troglodytes
aaaatgtttgcaaatt

SEQ ID NO: 183323 - DNA, 16 bp, P. troglodytes
aaaatgtttgcctttt

SEQ ID NO: 183324 - DNA, 16 bp, P. troglodytes
aaaatgtttgctgacc

SEQ ID NO: 183325 - DNA, 16 bp, P. troglodytes
aaaatgtttgtaaatt

SEQ ID NO: 183326 - DNA, 16 bp, P. troglodytes
aaaatgtttgtaattt

SEQ ID NO: 183327 - DNA, 16 bp, P. troglodytes
aaaatgtttgtttaaa

SEQ ID NO: 183328 - DNA, 16 bp, P. troglodytes
aaaatgtttgtttgtt

SEQ ID NO: 183329 - DNA, 16 bp, P. troglodytes
aaaatgttttaaaatg

SEQ ID NO: 183330 - DNA, 16 bp, P. troglodytes
aaaatgttttaaatgg

SEQ ID NO: 183331 - DNA, 16 bp, P. troglodytes
aaaatgttttagattt

SEQ ID NO: 183332 - DNA, 16 bp, P. troglodytes
aaaatgttttataaga

SEQ ID NO: 183333 - DNA, 16 bp, P. troglodytes
aaaatgttttattaca

SEQ ID NO: 183334 - DNA, 16 bp, P. troglodytes
aaaatgttttattctt

SEQ ID NO: 183335 - DNA, 16 bp, P. troglodytes
aaaatgttttcaaatt

SEQ ID NO: 183336 - DNA, 16 bp, P. troglodytes
aaaatgttttcatatt

SEQ ID NO: 183337 - DNA, 16 bp, P. troglodytes
aaaatgttttccattt

SEQ ID NO: 183338 - DNA, 16 bp, P. troglodytes
aaaatgttttcctttt

SEQ ID NO: 183339 - DNA, 16 bp, P. troglodytes
aaaatgttttctgttt

SEQ ID NO: 183340 - DNA, 16 bp, P. troglodytes
aaaatgttttcttaat

SEQ ID NO: 183341 - DNA, 16 bp, P. troglodytes
aaaatgttttgcaaat

SEQ ID NO: 183342 - DNA, 16 bp, P. troglodytes
aaaatgttttggagat

SEQ ID NO: 183343 - DNA, 16 bp, P. troglodytes
aaaatgttttgttttg

SEQ ID NO: 183344 - DNA, 16 bp, P. troglodytes
aaaatgtttttaaagt

SEQ ID NO: 183345 - DNA, 16 bp, P. troglodytes
aaaatgtttttaagaa

SEQ ID NO: 183346 - DNA, 16 bp, P. troglodytes
aaaatgtttttcaaat

SEQ ID NO: 183347 - DNA, 16 bp, P. troglodytes
aaaatgtttttcttcc

SEQ ID NO: 183348 - DNA, 16 bp, P. troglodytes
aaaatgtttttcttgt

SEQ ID NO: 183349 - DNA, 16 bp, P. troglodytes
aaaatgtttttgaaaa

SEQ ID NO: 183350 - DNA, 16 bp, P. troglodytes
aaaattaaaaatgctt

SEQ ID NO: 183351 - DNA, 16 bp, P. troglodytes
aaaattaaaactattg

SEQ ID NO: 183352 - DNA, 16 bp, P. troglodytes
aaaattaaaagtttca

SEQ ID NO: 183353 - DNA, 16 bp, P. troglodytes
aaaattaaagaatttc

SEQ ID NO: 183354 - DNA, 16 bp, P. troglodytes
aaaattaaagcaatta

SEQ ID NO: 183355 - DNA, 16 bp, P. troglodytes
aaaattaaagttcaaa

SEQ ID NO: 183356 - DNA, 16 bp, P. troglodytes
aaaattaaatctcatt

SEQ ID NO: 183357 - DNA, 16 bp, P. troglodytes
aaaattaaatgcatat

SEQ ID NO: 183358 - DNA, 16 bp, P. troglodytes
aaaattaacattttca

SEQ ID NO: 183359 - DNA, 16 bp, P. troglodytes
aaaattaaccaggcat

SEQ ID NO: 183360 - DNA, 16 bp, P. troglodytes
aaaattaaccaggcgt

SEQ ID NO: 183361 - DNA, 16 bp, P. troglodytes
aaaattaaccaggtat

SEQ ID NO: 183362 - DNA, 16 bp, P. troglodytes
aaaattaactgggcat

SEQ ID NO: 183363 - DNA, 16 bp, P. troglodytes
aaaattaacttggcat

SEQ ID NO: 183364 - DNA, 16 bp, P. troglodytes
aaaattaagaattttg

SEQ ID NO: 183365 - DNA, 16 bp, P. troglodytes
aaaattaaggctgggc

SEQ ID NO: 183366 - DNA, 16 bp, P. troglodytes
aaaattaatgaactat

SEQ ID NO: 183367 - DNA, 16 bp, P. troglodytes
aaaattaatgcaaaag

SEQ ID NO: 183368 - DNA, 16 bp, P. troglodytes
aaaattaattcatgat

SEQ ID NO: 183369 - DNA, 16 bp, P. troglodytes
aaaattaattccattt

SEQ ID NO: 183370 - DNA, 16 bp, P. troglodytes
aaaattaattctagat

SEQ ID NO: 183371 - DNA, 16 bp, P. troglodytes
aaaattacaaaaatgt

SEQ ID NO: 183372 - DNA, 16 bp, P. troglodytes
aaaattacaaaattag

SEQ ID NO: 183373 - DNA, 16 bp, P. troglodytes
aaaattacagtaatta

SEQ ID NO: 183374 - DNA, 16 bp, P. troglodytes
aaaattacatttgaaa

SEQ ID NO: 183375 - DNA, 17 bp, P. troglodytes
aaaattacccaggcgtg

SEQ ID NO: 183376 - DNA, 16 bp, P. troglodytes
aaaattacccaggtgt

SEQ ID NO: 183377 - DNA, 16 bp, P. troglodytes
aaaattacctgggcat

SEQ ID NO: 183378 - DNA, 16 bp, P. troglodytes
aaaattacctgggcgt

SEQ ID NO: 183379 - DNA, 16 bp, P. troglodytes
aaaattactgaaagaa

SEQ ID NO: 183380 - DNA, 16 bp, P. troglodytes
aaaattacttaatttc

SEQ ID NO: 183381 - DNA, 16 bp, P. troglodytes
aaaattacttcaagat

SEQ ID NO: 183382 - DNA, 16 bp, P. troglodytes
aaaattactttaaagt

SEQ ID NO: 183383 - DNA, 16 bp, P. troglodytes
aaaattagaaagtgac

SEQ ID NO: 183384 - DNA, 16 bp, P. troglodytes
aaaattagaaatgttt

SEQ ID NO: 183385 - DNA, 16 bp, P. troglodytes
aaaattagaagaatgt

SEQ ID NO: 183386 - DNA, 16 bp, P. troglodytes
aaaattagaagtgcca

SEQ ID NO: 183387 - DNA, 16 bp, P. troglodytes
aaaattagaattttgg

SEQ ID NO: 183388 - DNA, 16 bp, P. troglodytes
aaaattagacaggcat

SEQ ID NO: 183389 - DNA, 16 bp, P. troglodytes
aaaattagatgggtgt

SEQ ID NO: 183390 - DNA, 16 bp, P. troglodytes
aaaattagcagggcat

SEQ ID NO: 183391 - DNA, 17 bp, P. troglodytes
aaaattagcagggcgtg

SEQ ID NO: 183392 - DNA, 16 bp, P. troglodytes
aaaattagcatatttt

SEQ ID NO: 183393 - DNA, 16 bp, P. troglodytes
aaaattagccaagcat

SEQ ID NO: 183394 - DNA, 16 bp, P. troglodytes
aaaattagccaagcgt

SEQ ID NO: 183395 - DNA, 16 bp, P. troglodytes
aaaattagccacgcat

SEQ ID NO: 183396 - DNA, 16 bp, P. troglodytes
aaaattagccagacac

SEQ ID NO: 183397 - DNA, 16 bp, P. troglodytes
aaaattagccagacat

SEQ ID NO: 183398 - DNA, 16 bp, P. troglodytes
aaaattagccagacgt

SEQ ID NO: 183399 - DNA, 16 bp, P. troglodytes
aaaattagccagatgt

SEQ ID NO: 183400 - DNA, 16 bp, P. troglodytes
aaaattagccagccat

SEQ ID NO: 183401 - DNA, 16 bp, P. troglodytes
aaaattagccagccgt

SEQ ID NO: 183402 - DNA, 16 bp, P. troglodytes
aaaattagccagcgtg

SEQ ID NO: 183403 - DNA, 16 bp, P. troglodytes
aaaattagccaggagt

SEQ ID NO: 183404 - DNA, 16 bp, P. troglodytes
aaaattagccaggcac

SEQ ID NO: 183405 - DNA, 16 bp, P. troglodytes
aaaattagccaggcat

SEQ ID NO: 183406 - DNA, 19 bp, P. troglodytes
aaaattagccaggcctgat

SEQ ID NO: 183407 - DNA, 16 bp, P. troglodytes
aaaattagccaggcga

SEQ ID NO: 183408 - DNA, 16 bp, P. troglodytes
aaaattagccaggcgc

SEQ ID NO: 183409 - DNA, 16 bp, P. troglodytes
aaaattagccaggcgt

SEQ ID NO: 183410 - DNA, 16 bp, P. troglodytes
aaaattagccaggggt

SEQ ID NO: 183411 - DNA, 16 bp, P. troglodytes
aaaattagccaggtat

SEQ ID NO: 183412 - DNA, 16 bp, P. troglodytes
aaaattagccaggtgc

SEQ ID NO: 183413 - DNA, 16 bp, P. troglodytes
aaaattagccaggtgg

SEQ ID NO: 183414 - DNA, 16 bp, P. troglodytes
aaaattagccaggtgt

SEQ ID NO: 183415 - DNA, 16 bp, P. troglodytes
aaaattagccagtcat

SEQ ID NO: 183416 - DNA, 16 bp, P. troglodytes
aaaattagccatgcgt

SEQ ID NO: 183417 - DNA, 16 bp, P. troglodytes
aaaattagcccagcat

SEQ ID NO: 183418 - DNA, 16 bp, P. troglodytes
aaaattagcccagcgt

SEQ ID NO: 183419 - DNA, 16 bp, P. troglodytes
aaaattagcccggcat

SEQ ID NO: 183420 - DNA, 19 bp, P. troglodytes
aaaattagcccggcgtggt

SEQ ID NO: 183421 - DNA, 16 bp, P. troglodytes
aaaattagcccggtgt

SEQ ID NO: 183422 - DNA, 16 bp, P. troglodytes
aaaattagccgagcat

SEQ ID NO: 183423 - DNA, 16 bp, P. troglodytes
aaaattagccgagcgt

SEQ ID NO: 183424 - DNA, 16 bp, P. troglodytes
aaaattagccgagtat

SEQ ID NO: 183425 - DNA, 16 bp, P. troglodytes
aaaattagccgagtgt

SEQ ID NO: 183426 - DNA, 19 bp, P. troglodytes
aaaattagccgcgtgtggt

SEQ ID NO: 183427 - DNA, 16 bp, P. troglodytes
aaaattagccggacat

SEQ ID NO: 183428 - DNA, 16 bp, P. troglodytes
aaaattagccggacgt

SEQ ID NO: 183429 - DNA, 16 bp, P. troglodytes
aaaattagccggccgt

SEQ ID NO: 183430 - DNA, 16 bp, P. troglodytes
aaaattagccgggagt

SEQ ID NO: 183431 - DNA, 16 bp, P. troglodytes
aaaattagccgggcat

SEQ ID NO: 183432 - DNA, 17 bp, P. troglodytes
aaaattagccgggcgta

SEQ ID NO: 183433 - DNA, 17 bp, P. troglodytes
aaaattagccgggcgtc

SEQ ID NO: 183434 - DNA, 19 bp, P. troglodytes
aaaattagccgggcgtgat

SEQ ID NO: 183435 - DNA, 20 bp, P. troglodytes
aaaattagccgggcgtggcg

SEQ ID NO: 183436 - DNA, 18 bp, P. troglodytes
aaaattagccgggcgtgt

SEQ ID NO: 183437 - DNA, 16 bp, P. troglodytes
aaaattagccgggctt

SEQ ID NO: 183438 - DNA, 16 bp, P. troglodytes
aaaattagccgggtgg

SEQ ID NO: 183439 - DNA, 16 bp, P. troglodytes
aaaattagccgggtgt

SEQ ID NO: 183440 - DNA, 16 bp, P. troglodytes
aaaattagcctgacat

SEQ ID NO: 183441 - DNA, 17 bp, P. troglodytes
aaaattagcctggcgta

SEQ ID NO: 183442 - DNA, 16 bp, P. troglodytes
aaaattagcctggtgt

SEQ ID NO: 183443 - DNA, 17 bp, P. troglodytes
aaaattagcgaggtgtg

SEQ ID NO: 183444 - DNA, 16 bp, P. troglodytes
aaaattagctaggcat

SEQ ID NO: 183445 - DNA, 16 bp, P. troglodytes
aaaattagctaggcgt

SEQ ID NO: 183446 - DNA, 16 bp, P. troglodytes
aaaattagctaggtgt

SEQ ID NO: 183447 - DNA, 16 bp, P. troglodytes
aaaattagctcggcgt

SEQ ID NO: 183448 - DNA, 16 bp, P. troglodytes
aaaattagctgagtgg

SEQ ID NO: 183449 - DNA, 20 bp, P. troglodytes
aaaattagctggacatggtg

SEQ ID NO: 183450 - DNA, 17 bp, P. troglodytes
aaaattagctggacatt

SEQ ID NO: 183451 - DNA, 16 bp, P. troglodytes
aaaattagctggacct

SEQ ID NO: 183452 - DNA, 16 bp, P. troglodytes
aaaattagctggacgt

SEQ ID NO: 183453 - DNA, 16 bp, P. troglodytes
aaaattagctggatgc

SEQ ID NO: 183454 - DNA, 16 bp, P. troglodytes
aaaattagctggatgt

SEQ ID NO: 183455 - DNA, 16 bp, P. troglodytes
aaaattagctggctgt

SEQ ID NO: 183456 - DNA, 16 bp, P. troglodytes
aaaattagctgggagt

SEQ ID NO: 183457 - DNA, 16 bp, P. troglodytes
aaaattagctgggcat

SEQ ID NO: 183458 - DNA, 16 bp, P. troglodytes
aaaattagctgggcgt

SEQ ID NO: 183459 - DNA, 16 bp, P. troglodytes
aaaattagctgggtat

SEQ ID NO: 183460 - DNA, 16 bp, P. troglodytes
aaaattagctgggtgc

SEQ ID NO: 183461 - DNA, 16 bp, P. troglodytes
aaaattagctgggtgt

SEQ ID NO: 183462 - DNA, 17 bp, P. troglodytes
aaaattagctgggttta

SEQ ID NO: 183463 - DNA, 16 bp, P. troglodytes
aaaattagctgtgcat

SEQ ID NO: 183464 - DNA, 16 bp, P. troglodytes
aaaattagctgtgtgt

SEQ ID NO: 183465 - DNA, 16 bp, P. troglodytes
aaaattagcttggcat

SEQ ID NO: 183466 - DNA, 16 bp, P. troglodytes
aaaattaggcaggcac

SEQ ID NO: 183467 - DNA, 16 bp, P. troglodytes
aaaattaggtggacat

SEQ ID NO: 183468 - DNA, 16 bp, P. troglodytes
aaaattagtcgggcat

SEQ ID NO: 183469 - DNA, 19 bp, P. troglodytes
aaaattagtcgggcgtggt

SEQ ID NO: 183470 - DNA, 16 bp, P. troglodytes
aaaattagtcgggtat

SEQ ID NO: 183471 - DNA, 16 bp, P. troglodytes
aaaattagttgggagt

SEQ ID NO: 183472 - DNA, 16 bp, P. troglodytes
aaaattagttgggcat

SEQ ID NO: 183473 - DNA, 16 bp, P. troglodytes
aaaattagttgggctt

SEQ ID NO: 183474 - DNA, 16 bp, P. troglodytes
aaaattagttgggtgt

SEQ ID NO: 183475 - DNA, 16 bp, P. troglodytes
aaaattataaaagcag

SEQ ID NO: 183476 - DNA, 16 bp, P. troglodytes
aaaattataaacttct

SEQ ID NO: 183477 - DNA, 16 bp, P. troglodytes
aaaattataaagcatt

SEQ ID NO: 183478 - DNA, 16 bp, P. troglodytes
aaaattatatcagaaa

SEQ ID NO: 183479 - DNA, 16 bp, P. troglodytes
aaaattatatttctca

SEQ ID NO: 183480 - DNA, 16 bp, P. troglodytes
aaaattatccaggcat

SEQ ID NO: 183481 - DNA, 16 bp, P. troglodytes
aaaattatccttgaaa

SEQ ID NO: 183482 - DNA, 16 bp, P. troglodytes
aaaattatctctgttt

SEQ ID NO: 183483 - DNA, 16 bp, P. troglodytes
aaaattatctgggcat

SEQ ID NO: 183484 - DNA, 16 bp, P. troglodytes
aaaattatctgggcgt

SEQ ID NO: 183485 - DNA, 16 bp, P. troglodytes
aaaattatgagaattt

SEQ ID NO: 183486 - DNA, 16 bp, P. troglodytes
aaaattatgcaaaatt

SEQ ID NO: 183487 - DNA, 16 bp, P. troglodytes
aaaattatgctttcat

SEQ ID NO: 183488 - DNA, 16 bp, P. troglodytes
aaaattatgggaaact

SEQ ID NO: 183489 - DNA, 16 bp, P. troglodytes
aaaattattcacattt

SEQ ID NO: 183490 - DNA, 16 bp, P. troglodytes
aaaattattcagcttt

SEQ ID NO: 183491 - DNA, 16 bp, P. troglodytes
aaaattattctgtatt

SEQ ID NO: 183492 - DNA, 16 bp, P. troglodytes
aaaattattgagactt

SEQ ID NO: 183493 - DNA, 16 bp, P. troglodytes
aaaattattgagatat

SEQ ID NO: 183494 - DNA, 16 bp, P. troglodytes
aaaattatttattgag

SEQ ID NO: 183495 - DNA, 16 bp, P. troglodytes
aaaattatttcagaaa

SEQ ID NO: 183496 - DNA, 16 bp, P. troglodytes
aaaattatttcagtct

SEQ ID NO: 183497 - DNA, 16 bp, P. troglodytes
aaaattatttcctaat

SEQ ID NO: 183498 - DNA, 16 bp, P. troglodytes
aaaattatttccttta

SEQ ID NO: 183499 - DNA, 16 bp, P. troglodytes
aaaattatttgaagtt

SEQ ID NO: 183500 - DNA, 16 bp, P. troglodytes
aaaattatttgaatga

SEQ ID NO: 183501 - DNA, 16 bp, P. troglodytes
aaaattatttgctttt

SEQ ID NO: 183502 - DNA, 16 bp, P. troglodytes
aaaattatttgtcttt

SEQ ID NO: 183503 - DNA, 16 bp, P. troglodytes
aaaattattttgagaa

SEQ ID NO: 183504 - DNA, 16 bp, P. troglodytes
aaaattattttggaaa

SEQ ID NO: 183505 - DNA, 16 bp, P. troglodytes
aaaattattttggtta

SEQ ID NO: 183506 - DNA, 16 bp, P. troglodytes
aaaattattttgtcaa

SEQ ID NO: 183507 - DNA, 16 bp, P. troglodytes
aaaattcaaaactttt

SEQ ID NO: 183508 - DNA, 16 bp, P. troglodytes
aaaattcaaatataag

SEQ ID NO: 183509 - DNA, 16 bp, P. troglodytes
aaaattcaaatgttaa

SEQ ID NO: 183510 - DNA, 17 bp, P. troglodytes
aaaattcaacacccctt

SEQ ID NO: 183511 - DNA, 16 bp, P. troglodytes
aaaattcaacatactt

SEQ ID NO: 183512 - DNA, 16 bp, P. troglodytes
aaaattcaacattcct

SEQ ID NO: 183513 - DNA, 16 bp, P. troglodytes
aaaattcaagctttca

SEQ ID NO: 183514 - DNA, 16 bp, P. troglodytes
aaaattcaattcctca

SEQ ID NO: 183515 - DNA, 16 bp, P. troglodytes
aaaattcacagatgct

SEQ ID NO: 183516 - DNA, 16 bp, P. troglodytes
aaaattcacatggaaa

SEQ ID NO: 183517 - DNA, 16 bp, P. troglodytes
aaaattcacattattt

SEQ ID NO: 183518 - DNA, 16 bp, P. troglodytes
aaaattcaccaagaaa

SEQ ID NO: 183519 - DNA, 16 bp, P. troglodytes
aaaattcaccctttta

SEQ ID NO: 183520 - DNA, 16 bp, P. troglodytes
aaaattcactcatttt

SEQ ID NO: 183521 - DNA, 16 bp, P. troglodytes
aaaattcagaaatata

SEQ ID NO: 183522 - DNA, 16 bp, P. troglodytes
aaaattcagaattcta

SEQ ID NO: 183523 - DNA, 16 bp, P. troglodytes
aaaattcagaatttta

SEQ ID NO: 183524 - DNA, 16 bp, P. troglodytes
aaaattcagatgttga

SEQ ID NO: 183525 - DNA, 16 bp, P. troglodytes
aaaattcagcagggca

SEQ ID NO: 183526 - DNA, 16 bp, P. troglodytes
aaaattcagtaagaaa

SEQ ID NO: 183527 - DNA, 16 bp, P. troglodytes
aaaattcagtatttta

SEQ ID NO: 183528 - DNA, 16 bp, P. troglodytes
aaaattcagtggtttt

SEQ ID NO: 183529 - DNA, 16 bp, P. troglodytes
aaaattcatacagaac

SEQ ID NO: 183530 - DNA, 16 bp, P. troglodytes
aaaattcatagaaatg

SEQ ID NO: 183531 - DNA, 16 bp, P. troglodytes
aaaattcatagaacta

SEQ ID NO: 183532 - DNA, 16 bp, P. troglodytes
aaaattcatatggaat

SEQ ID NO: 183533 - DNA, 16 bp, P. troglodytes
aaaattcatccatttt

SEQ ID NO: 183534 - DNA, 16 bp, P. troglodytes
aaaattcatgctgaaa

SEQ ID NO: 183535 - DNA, 16 bp, P. troglodytes
aaaattcattttaaag

SEQ ID NO: 183536 - DNA, 16 bp, P. troglodytes
aaaattcattttctaa

SEQ ID NO: 183537 - DNA, 16 bp, P. troglodytes
aaaattcattttgaaa

SEQ ID NO: 183538 - DNA, 16 bp, P. troglodytes
aaaattccaaaaagca

SEQ ID NO: 183539 - DNA, 16 bp, P. troglodytes
aaaattccagaaacaa

SEQ ID NO: 183540 - DNA, 16 bp, P. troglodytes
aaaattccagaaatta

SEQ ID NO: 183541 - DNA, 16 bp, P. troglodytes
aaaattccagaagata

SEQ ID NO: 183542 - DNA, 16 bp, P. troglodytes
aaaattccatttataa

SEQ ID NO: 183543 - DNA, 16 bp, P. troglodytes
aaaattcctattgtct

SEQ ID NO: 183544 - DNA, 16 bp, P. troglodytes
aaaattcctcttttta

SEQ ID NO: 183545 - DNA, 16 bp, P. troglodytes
aaaattcctgaaaatt

SEQ ID NO: 183546 - DNA, 16 bp, P. troglodytes
aaaattctaaaaagca

SEQ ID NO: 183547 - DNA, 16 bp, P. troglodytes
aaaattctaaagattt

SEQ ID NO: 183548 - DNA, 16 bp, P. troglodytes
aaaattctagaagaaa

SEQ ID NO: 183549 - DNA, 16 bp, P. troglodytes
aaaattctaggaaatg

SEQ ID NO: 183550 - DNA, 16 bp, P. troglodytes
aaaattctatcatttt

SEQ ID NO: 183551 - DNA, 16 bp, P. troglodytes
aaaattctattttgtt

SEQ ID NO: 183552 - DNA, 16 bp, P. troglodytes
aaaattctcaacagaa

SEQ ID NO: 183553 - DNA, 16 bp, P. troglodytes
aaaattctcaagaaaa

SEQ ID NO: 183554 - DNA, 16 bp, P. troglodytes
aaaattctcagaaaac

SEQ ID NO: 183555 - DNA, 16 bp, P. troglodytes
aaaattctcttctttt

SEQ ID NO: 183556 - DNA, 16 bp, P. troglodytes
aaaattctgaaaaaat

SEQ ID NO: 183557 - DNA, 16 bp, P. troglodytes
aaaattctgaaaaatg

SEQ ID NO: 183558 - DNA, 16 bp, P. troglodytes
aaaattctgaacaaaa

SEQ ID NO: 183559 - DNA, 16 bp, P. troglodytes
aaaattctgaagaaaa

SEQ ID NO: 183560 - DNA, 16 bp, P. troglodytes
aaaattctggaagata

SEQ ID NO: 183561 - DNA, 16 bp, P. troglodytes
aaaattctgtttctta

SEQ ID NO: 183562 - DNA, 16 bp, P. troglodytes
aaaattctgtttttaa

SEQ ID NO: 183563 - DNA, 16 bp, P. troglodytes
aaaattcttctctgcc

SEQ ID NO: 183564 - DNA, 16 bp, P. troglodytes
aaaattcttctggaca

SEQ ID NO: 183565 - DNA, 16 bp, P. troglodytes
aaaattctttttttgt

SEQ ID NO: 183566 - DNA, 16 bp, P. troglodytes
aaaattgaaacatttg

SEQ ID NO: 183567 - DNA, 16 bp, P. troglodytes
aaaattgaagaggaca

SEQ ID NO: 183568 - DNA, 16 bp, P. troglodytes
aaaattgaattaccat

SEQ ID NO: 183569 - DNA, 16 bp, P. troglodytes
aaaattgacaaatggc

SEQ ID NO: 183570 - DNA, 23 bp, P. troglodytes
aaaattgacaaatgggatctaaa

SEQ ID NO: 183571 - DNA, 27 bp, P. troglodytes
aaaattgacaaatgggatctaattaaa

SEQ ID NO: 183572 - DNA, 17 bp, P. troglodytes
aaaattgacaagtggga

SEQ ID NO: 183573 - DNA, 16 bp, P. troglodytes
aaaattgacacatggg

SEQ ID NO: 183574 - DNA, 16 bp, P. troglodytes
aaaattgaccatctta

SEQ ID NO: 183575 - DNA, 16 bp, P. troglodytes
aaaattgactcaagaa

SEQ ID NO: 183576 - DNA, 16 bp, P. troglodytes
aaaattgacttatttt

SEQ ID NO: 183577 - DNA, 16 bp, P. troglodytes
aaaattgagaagatag

SEQ ID NO: 183578 - DNA, 16 bp, P. troglodytes
aaaattgagacccaga

SEQ ID NO: 183579 - DNA, 16 bp, P. troglodytes
aaaattgagatatttt

SEQ ID NO: 183580 - DNA, 16 bp, P. troglodytes
aaaattgaggcacaga

SEQ ID NO: 183581 - DNA, 16 bp, P. troglodytes
aaaattgcattttaaa

SEQ ID NO: 183582 - DNA, 16 bp, P. troglodytes
aaaattgcattttatt

SEQ ID NO: 183583 - DNA, 16 bp, P. troglodytes
aaaattgccaagagag

SEQ ID NO: 183584 - DNA, 16 bp, P. troglodytes
aaaattgcctacagta

SEQ ID NO: 183585 - DNA, 16 bp, P. troglodytes
aaaattgccttttttt

SEQ ID NO: 183586 - DNA, 16 bp, P. troglodytes
aaaattggaaaatgta

SEQ ID NO: 183587 - DNA, 16 bp, P. troglodytes
aaaattggaaacaatg

SEQ ID NO: 183588 - DNA, 16 bp, P. troglodytes
aaaattgtacatattt

SEQ ID NO: 183589 - DNA, 16 bp, P. troglodytes
aaaattgtatttctat

SEQ ID NO: 183590 - DNA, 16 bp, P. troglodytes
aaaattgtcattattt

SEQ ID NO: 183591 - DNA, 16 bp, P. troglodytes
aaaattgtctgggtgt

SEQ ID NO: 183592 - DNA, 16 bp, P. troglodytes
aaaattgtgactgaga

SEQ ID NO: 183593 - DNA, 16 bp, P. troglodytes
aaaattgtttaaaatg

SEQ ID NO: 183594 - DNA, 16 bp, P. troglodytes
aaaattgtttcaaaat

SEQ ID NO: 183595 - DNA, 16 bp, P. troglodytes
aaaattgttttatttc

SEQ ID NO: 183596 - DNA, 16 bp, P. troglodytes
aaaattgttttccttt

SEQ ID NO: 183597 - DNA, 16 bp, P. troglodytes
aaaattgttttcttaa

SEQ ID NO: 183598 - DNA, 16 bp, P. troglodytes
aaaattgttttttctt

SEQ ID NO: 183599 - DNA, 16 bp, P. troglodytes
aaaatttaaagcaaca

SEQ ID NO: 183600 - DNA, 16 bp, P. troglodytes
aaaatttaaatgtaca

SEQ ID NO: 183601 - DNA, 16 bp, P. troglodytes
aaaatttaactctgtg

SEQ ID NO: 183602 - DNA, 16 bp, P. troglodytes
aaaatttaagtcttta

SEQ ID NO: 183603 - DNA, 16 bp, P. troglodytes
aaaatttacatgttga

SEQ ID NO: 183604 - DNA, 16 bp, P. troglodytes
aaaatttagccatgtg

SEQ ID NO: 183605 - DNA, 16 bp, P. troglodytes
aaaatttatgtggaaa

SEQ ID NO: 183606 - DNA, 25 bp, P. troglodytes
aaaatttattaggtgggaatttcct

SEQ ID NO: 183607 - DNA, 16 bp, P. troglodytes
aaaatttattcattca

SEQ ID NO: 183608 - DNA, 16 bp, P. troglodytes
aaaatttattgtctca

SEQ ID NO: 183609 - DNA, 16 bp, P. troglodytes
aaaatttatttctcac

SEQ ID NO: 183610 - DNA, 16 bp, P. troglodytes
aaaatttatttgaaag

SEQ ID NO: 183611 - DNA, 16 bp, P. troglodytes
aaaatttattttgaag

SEQ ID NO: 183612 - DNA, 16 bp, P. troglodytes
aaaatttcaaaaaagt

SEQ ID NO: 183613 - DNA, 16 bp, P. troglodytes
aaaatttcaaaaatgt

SEQ ID NO: 183614 - DNA, 16 bp, P. troglodytes
aaaatttcaaagtaaa

SEQ ID NO: 183615 - DNA, 16 bp, P. troglodytes
aaaatttcaaatatct

SEQ ID NO: 183616 - DNA, 16 bp, P. troglodytes
aaaatttcaacttttt

SEQ ID NO: 183617 - DNA, 16 bp, P. troglodytes
aaaatttcaaggaaaa

SEQ ID NO: 183618 - DNA, 16 bp, P. troglodytes
aaaatttcaagtatat

SEQ ID NO: 183619 - DNA, 16 bp, P. troglodytes
aaaatttcaatggcat

SEQ ID NO: 183620 - DNA, 16 bp, P. troglodytes
aaaatttcagaaataa

SEQ ID NO: 183621 - DNA, 16 bp, P. troglodytes
aaaatttcagattttt

SEQ ID NO: 183622 - DNA, 16 bp, P. troglodytes
aaaatttcaggaaaca

SEQ ID NO: 183623 - DNA, 16 bp, P. troglodytes
aaaatttcagtatttt

SEQ ID NO: 183624 - DNA, 16 bp, P. troglodytes
aaaatttcattttgtt

SEQ ID NO: 183625 - DNA, 16 bp, P. troglodytes
aaaatttccaaaattt

SEQ ID NO: 183626 - DNA, 16 bp, P. troglodytes
aaaatttccaatttct

SEQ ID NO: 183627 - DNA, 16 bp, P. troglodytes
aaaatttccaattttt

SEQ ID NO: 183628 - DNA, 16 bp, P. troglodytes
aaaatttccaggaaaa

SEQ ID NO: 183629 - DNA, 16 bp, P. troglodytes
aaaatttccatttgtt

SEQ ID NO: 183630 - DNA, 16 bp, P. troglodytes
aaaatttcctaatttt

SEQ ID NO: 183631 - DNA, 16 bp, P. troglodytes
aaaatttctcaaaaca

SEQ ID NO: 183632 - DNA, 16 bp, P. troglodytes
aaaatttctgcacagc

SEQ ID NO: 183633 - DNA, 16 bp, P. troglodytes
aaaatttctgtgaaga

SEQ ID NO: 183634 - DNA, 16 bp, P. troglodytes
aaaatttcttaagaaa

SEQ ID NO: 183635 - DNA, 16 bp, P. troglodytes
aaaatttcttccacca

SEQ ID NO: 183636 - DNA, 16 bp, P. troglodytes
aaaatttcttgaaata

SEQ ID NO: 183637 - DNA, 16 bp, P. troglodytes
aaaatttctttcaaaa

SEQ ID NO: 183638 - DNA, 16 bp, P. troglodytes
aaaatttgaaaaacag

SEQ ID NO: 183639 - DNA, 16 bp, P. troglodytes
aaaatttgaaaactta

SEQ ID NO: 183640 - DNA, 16 bp, P. troglodytes
aaaatttgaaacatat

SEQ ID NO: 183641 - DNA, 16 bp, P. troglodytes
aaaatttgaagcatat

SEQ ID NO: 183642 - DNA, 16 bp, P. troglodytes
aaaatttgaatatgga

SEQ ID NO: 183643 - DNA, 16 bp, P. troglodytes
aaaatttgaggctggg

SEQ ID NO: 183644 - DNA, 16 bp, P. troglodytes
aaaatttgcattaaaa

SEQ ID NO: 183645 - DNA, 16 bp, P. troglodytes
aaaatttgcatttcta

SEQ ID NO: 183646 - DNA, 16 bp, P. troglodytes
aaaatttgctttaaat

SEQ ID NO: 183647 - DNA, 16 bp, P. troglodytes
aaaatttggaaaatgt

SEQ ID NO: 183648 - DNA, 16 bp, P. troglodytes
aaaatttggaaactat

SEQ ID NO: 183649 - DNA, 16 bp, P. troglodytes
aaaatttggaaacttt

SEQ ID NO: 183650 - DNA, 16 bp, P. troglodytes
aaaatttggagaaaat

SEQ ID NO: 183651 - DNA, 16 bp, P. troglodytes
aaaatttggaggaaaa

SEQ ID NO: 183652 - DNA, 16 bp, P. troglodytes
aaaatttggggaaaaa

SEQ ID NO: 183653 - DNA, 16 bp, P. troglodytes
aaaatttgggggaaaa

SEQ ID NO: 183654 - DNA, 16 bp, P. troglodytes
aaaatttgtatgaaat

SEQ ID NO: 183655 - DNA, 16 bp, P. troglodytes
aaaatttgtatggaat

SEQ ID NO: 183656 - DNA, 16 bp, P. troglodytes
aaaatttgtcttttta

SEQ ID NO: 183657 - DNA, 16 bp, P. troglodytes
aaaatttgtttaaatg

SEQ ID NO: 183658 - DNA, 16 bp, P. troglodytes
aaaatttgtttcttta

SEQ ID NO: 183659 - DNA, 16 bp, P. troglodytes
aaaatttgttttcaat

SEQ ID NO: 183660 - DNA, 16 bp, P. troglodytes
aaaattttaaagcaaa

SEQ ID NO: 183661 - DNA, 16 bp, P. troglodytes
aaaattttaaagcaat

SEQ ID NO: 183662 - DNA, 16 bp, P. troglodytes
aaaattttaaatgcat

SEQ ID NO: 183663 - DNA, 16 bp, P. troglodytes
aaaattttaaatttcc

SEQ ID NO: 183664 - DNA, 16 bp, P. troglodytes
aaaattttaagtcaaa

SEQ ID NO: 183665 - DNA, 16 bp, P. troglodytes
aaaattttagaaacag

SEQ ID NO: 183666 - DNA, 16 bp, P. troglodytes
aaaattttatttgcaa

SEQ ID NO: 183667 - DNA, 16 bp, P. troglodytes
aaaattttcacaaact

SEQ ID NO: 183668 - DNA, 16 bp, P. troglodytes
aaaattttcaggaaaa

SEQ ID NO: 183669 - DNA, 16 bp, P. troglodytes
aaaattttcagttttt

SEQ ID NO: 183670 - DNA, 16 bp, P. troglodytes
aaaattttccagaaat

SEQ ID NO: 183671 - DNA, 16 bp, P. troglodytes
aaaattttctagaaat

SEQ ID NO: 183672 - DNA, 16 bp, P. troglodytes
aaaattttctagtttt

SEQ ID NO: 183673 - DNA, 16 bp, P. troglodytes
aaaattttcttttaga

SEQ ID NO: 183674 - DNA, 16 bp, P. troglodytes
aaaattttcttttgta

SEQ ID NO: 183675 - DNA, 16 bp, P. troglodytes
aaaattttgaaaatca

SEQ ID NO: 183676 - DNA, 16 bp, P. troglodytes
aaaattttgaacaaaa

SEQ ID NO: 183677 - DNA, 16 bp, P. troglodytes
aaaattttgcaaatca

SEQ ID NO: 183678 - DNA, 16 bp, P. troglodytes
aaaattttgcaatata

SEQ ID NO: 183679 - DNA, 16 bp, P. troglodytes
aaaattttgtgtatat

SEQ ID NO: 183680 - DNA, 16 bp, P. troglodytes
aaaattttgtttgaaa

SEQ ID NO: 183681 - DNA, 16 bp, P. troglodytes
aaaattttgttttcct

SEQ ID NO: 183682 - DNA, 16 bp, P. troglodytes
aaaatttttaaatgct

SEQ ID NO: 183683 - DNA, 16 bp, P. troglodytes
aaaatttttaaatgga

SEQ ID NO: 183684 - DNA, 16 bp, P. troglodytes
aaaatttttggccagg

SEQ ID NO: 183685 - DNA, 16 bp, P. troglodytes
aaaatttttggtagag

SEQ ID NO: 183686 - DNA, 16 bp, P. troglodytes
aaaatttttgtaaaga

SEQ ID NO: 183687 - DNA, 16 bp, P. troglodytes
aaaattttttaaaagg

SEQ ID NO: 183688 - DNA, 16 bp, P. troglodytes
aaaattttttgaagat

SEQ ID NO: 183689 - DNA, 16 bp, P. troglodytes
aaaattttttgagact

SEQ ID NO: 183690 - DNA, 16 bp, P. troglodytes
aaaatttttttaatgg

SEQ ID NO: 183691 - DNA, 16 bp, P. troglodytes
aaaattttttttcaag

SEQ ID NO: 183692 - DNA, 16 bp, P. troglodytes
aaaattttttttgtac

SEQ ID NO: 183693 - DNA, 16 bp, P. troglodytes
aaacaaaaaacattgc

SEQ ID NO: 183694 - DNA, 16 bp, P. troglodytes
aaacaaaaaacctggc

SEQ ID NO: 183695 - DNA, 16 bp, P. troglodytes
aaacaaaaaagctttt

SEQ ID NO: 183696 - DNA, 16 bp, P. troglodytes
aaacaaaaaattagcc

SEQ ID NO: 183697 - DNA, 16 bp, P. troglodytes
aaacaaaaacaagttt

SEQ ID NO: 183698 - DNA, 16 bp, P. troglodytes
aaacaaaaacacattg

SEQ ID NO: 183699 - DNA, 16 bp, P. troglodytes
aaacaaaaactgagag

SEQ ID NO: 183700 - DNA, 16 bp, P. troglodytes
aaacaaaaactgtttt

SEQ ID NO: 183701 - DNA, 16 bp, P. troglodytes
aaacaaaaaggtattt

SEQ ID NO: 183702 - DNA, 16 bp, P. troglodytes
aaacaaaaagtagatt

SEQ ID NO: 183703 - DNA, 16 bp, P. troglodytes
aaacaaaaatagtttt

SEQ ID NO: 183704 - DNA, 16 bp, P. troglodytes
aaacaaaaatatttgg

SEQ ID NO: 183705 - DNA, 16 bp, P. troglodytes
aaacaaaaatattttg

SEQ ID NO: 183706 - DNA, 16 bp, P. troglodytes
aaacaaaaatgaagtt

SEQ ID NO: 183707 - DNA, 16 bp, P. troglodytes
aaacaaaaatgatttt

SEQ ID NO: 183708 - DNA, 16 bp, P. troglodytes
aaacaaaaatgtaatt

SEQ ID NO: 183709 - DNA, 16 bp, P. troglodytes
aaacaaaaatgtatat

SEQ ID NO: 183710 - DNA, 16 bp, P. troglodytes
aaacaaaaatgtcatt

SEQ ID NO: 183711 - DNA, 16 bp, P. troglodytes
aaacaaaaatgtttct

SEQ ID NO: 183712 - DNA, 16 bp, P. troglodytes
aaacaaaaattaactg

SEQ ID NO: 183713 - DNA, 16 bp, P. troglodytes
aaacaaaactttttta

SEQ ID NO: 183714 - DNA, 16 bp, P. troglodytes
aaacaaaacttttttt

SEQ ID NO: 183715 - DNA, 16 bp, P. troglodytes
aaacaaaagacatcat

SEQ ID NO: 183716 - DNA, 16 bp, P. troglodytes
aaacaaaagagattta

SEQ ID NO: 183717 - DNA, 16 bp, P. troglodytes
aaacaaaagaggatac

SEQ ID NO: 183718 - DNA, 16 bp, P. troglodytes
aaacaaaagcaattgt

SEQ ID NO: 183719 - DNA, 16 bp, P. troglodytes
aaacaaaagctgaaga

SEQ ID NO: 183720 - DNA, 16 bp, P. troglodytes
aaacaaaagttgaaat

SEQ ID NO: 183721 - DNA, 16 bp, P. troglodytes
aaacaaaagttttatt

SEQ ID NO: 183722 - DNA, 16 bp, P. troglodytes
aaacaaaatctctgca

SEQ ID NO: 183723 - DNA, 16 bp, P. troglodytes
aaacaaaatgatttta

SEQ ID NO: 183724 - DNA, 16 bp, P. troglodytes
aaacaaaatgtgaaat

SEQ ID NO: 183725 - DNA, 16 bp, P. troglodytes
aaacaaaatgttttat

SEQ ID NO: 183726 - DNA, 16 bp, P. troglodytes
aaacaaaatgtttttt

SEQ ID NO: 183727 - DNA, 16 bp, P. troglodytes
aaacaaaattatgtat

SEQ ID NO: 183728 - DNA, 16 bp, P. troglodytes
aaacaaaatttgacaa

SEQ ID NO: 183729 - DNA, 16 bp, P. troglodytes
aaacaaacaactttat

SEQ ID NO: 183730 - DNA, 16 bp, P. troglodytes
aaacaaacagagagcc

SEQ ID NO: 183731 - DNA, 16 bp, P. troglodytes
aaacaaacatggcaca

SEQ ID NO: 183732 - DNA, 16 bp, P. troglodytes
aaacaaagaatatttt

SEQ ID NO: 183733 - DNA, 16 bp, P. troglodytes
aaacaaagaattatct

SEQ ID NO: 183734 - DNA, 16 bp, P. troglodytes
aaacaaagacagtttt

SEQ ID NO: 183735 - DNA, 16 bp, P. troglodytes
aaacaaagaggctggg

SEQ ID NO: 183736 - DNA, 16 bp, P. troglodytes
aaacaaagatagtttt

SEQ ID NO: 183737 - DNA, 16 bp, P. troglodytes
aaacaaagcaaatatt

SEQ ID NO: 183738 - DNA, 16 bp, P. troglodytes
aaacaaagttttattt

SEQ ID NO: 183739 - DNA, 16 bp, P. troglodytes
aaacaaataagcatgg

SEQ ID NO: 183740 - DNA, 16 bp, P. troglodytes
aaacaaataatttgaa

SEQ ID NO: 183741 - DNA, 16 bp, P. troglodytes
aaacaaatccttgaaa

SEQ ID NO: 183742 - DNA, 16 bp, P. troglodytes
aaacaaatgggaagaa

SEQ ID NO: 183743 - DNA, 16 bp, P. troglodytes
aaacaaatggtgctgg

SEQ ID NO: 183744 - DNA, 16 bp, P. troglodytes
aaacaaatgtaagaac

SEQ ID NO: 183745 - DNA, 16 bp, P. troglodytes
aaacaaatgttattta

SEQ ID NO: 183746 - DNA, 16 bp, P. troglodytes
aaacaaattctggaaa

SEQ ID NO: 183747 - DNA, 16 bp, P. troglodytes
aaacaaatttattttc

SEQ ID NO: 183748 - DNA, 16 bp, P. troglodytes
aaacaaattttaaagt

SEQ ID NO: 183749 - DNA, 16 bp, P. troglodytes
aaacaaatttttattg

SEQ ID NO: 183750 - DNA, 16 bp, P. troglodytes
aaacaacaaaggtgac

SEQ ID NO: 183751 - DNA, 16 bp, P. troglodytes
aaacaacacacactgg

SEQ ID NO: 183752 - DNA, 16 bp, P. troglodytes
aaacaacacagattta

SEQ ID NO: 183753 - DNA, 16 bp, P. troglodytes
aaacaacagatgctgg

SEQ ID NO: 183754 - DNA, 16 bp, P. troglodytes
aaacaacagcagcagc

SEQ ID NO: 183755 - DNA, 16 bp, P. troglodytes
aaacaacatattttta

SEQ ID NO: 183756 - DNA, 16 bp, P. troglodytes
aaacaacatggtgctg

SEQ ID NO: 183757 - DNA, 16 bp, P. troglodytes
aaacaaccaaatcttg

SEQ ID NO: 183758 - DNA, 16 bp, P. troglodytes
aaacaaccagatctcg

SEQ ID NO: 183759 - DNA, 16 bp, P. troglodytes
aaacaacccaaatgtc

SEQ ID NO: 183760 - DNA, 16 bp, P. troglodytes
aaacaacccaagtgtc

SEQ ID NO: 183761 - DNA, 18 bp, P. troglodytes
aaacaaccccatcagaaa

SEQ ID NO: 183762 - DNA, 16 bp, P. troglodytes
aaacaaccccattgaa

SEQ ID NO: 183763 - DNA, 16 bp, P. troglodytes
aaacaacctacagaat

SEQ ID NO: 183764 - DNA, 16 bp, P. troglodytes
aaacaacctcaatgtc

SEQ ID NO: 183765 - DNA, 16 bp, P. troglodytes
aaacaaccttttattt

SEQ ID NO: 183766 - DNA, 16 bp, P. troglodytes
aaacaactcaagtgtc

SEQ ID NO: 183767 - DNA, 16 bp, P. troglodytes
aaacaactcaataaga

SEQ ID NO: 183768 - DNA, 16 bp, P. troglodytes
aaacaactgaaatttt

SEQ ID NO: 183769 - DNA, 16 bp, P. troglodytes
aaacaacttcagaaaa

SEQ ID NO: 183770 - DNA, 16 bp, P. troglodytes
aaacaacttcaggaaa

SEQ ID NO: 183771 - DNA, 16 bp, P. troglodytes
aaacaacttgaaaaca

SEQ ID NO: 183772 - DNA, 16 bp, P. troglodytes
aaacaagaaatgtgga

SEQ ID NO: 183773 - DNA, 16 bp, P. troglodytes
aaacaagaagtgggga

SEQ ID NO: 183774 - DNA, 16 bp, P. troglodytes
aaacaagagcaaaact

SEQ ID NO: 183775 - DNA, 17 bp, P. troglodytes
aaacaagagcaaactaa

SEQ ID NO: 183776 - DNA, 16 bp, P. troglodytes
aaacaagcaatgagaa

SEQ ID NO: 183777 - DNA, 16 bp, P. troglodytes
aaacaagctggaaaac

SEQ ID NO: 183778 - DNA, 16 bp, P. troglodytes
aaacaaggaagtgaaa

SEQ ID NO: 183779 - DNA, 16 bp, P. troglodytes
aaacaaggacaatttg

SEQ ID NO: 183780 - DNA, 16 bp, P. troglodytes
aaacaagggtaatttg

SEQ ID NO: 183781 - DNA, 16 bp, P. troglodytes
aaacaaggtcacattc

SEQ ID NO: 183782 - DNA, 16 bp, P. troglodytes
aaacaaggttttaaaa

SEQ ID NO: 183783 - DNA, 16 bp, P. troglodytes
aaacaagtgtgtgtgt

SEQ ID NO: 183784 - DNA, 16 bp, P. troglodytes
aaacaagttttaaaat

SEQ ID NO: 183785 - DNA, 16 bp, P. troglodytes
aaacaagtttttaaat

SEQ ID NO: 183786 - DNA, 16 bp, P. troglodytes
aaacaataaaacattg

SEQ ID NO: 183787 - DNA, 16 bp, P. troglodytes
aaacaataaaatattg

SEQ ID NO: 183788 - DNA, 16 bp, P. troglodytes
aaacaataaaatgtta

SEQ ID NO: 183789 - DNA, 16 bp, P. troglodytes
aaacaataaattcctg

SEQ ID NO: 183790 - DNA, 16 bp, P. troglodytes
aaacaatatattgttt

SEQ ID NO: 183791 - DNA, 16 bp, P. troglodytes
aaacaatatgctcctg

SEQ ID NO: 183792 - DNA, 16 bp, P. troglodytes
aaacaatcaagaaagt

SEQ ID NO: 183793 - DNA, 16 bp, P. troglodytes
aaacaatctacagaat

SEQ ID NO: 183794 - DNA, 16 bp, P. troglodytes
aaacaatctttatttt

SEQ ID NO: 183795 - DNA, 16 bp, P. troglodytes
aaacaatgccattctt

SEQ ID NO: 183796 - DNA, 16 bp, P. troglodytes
aaacaatggaaatgta

SEQ ID NO: 183797 - DNA, 16 bp, P. troglodytes
aaacaatggaattaaa

SEQ ID NO: 183798 - DNA, 16 bp, P. troglodytes
aaacaatgttaaataa

SEQ ID NO: 183799 - DNA, 16 bp, P. troglodytes
aaacaattaccagcca

SEQ ID NO: 183800 - DNA, 16 bp, P. troglodytes
aaacaattagcaaaat

SEQ ID NO: 183801 - DNA, 16 bp, P. troglodytes
aaacaattattttcaa

SEQ ID NO: 183802 - DNA, 16 bp, P. troglodytes
aaacaattgaaaagga

SEQ ID NO: 183803 - DNA, 16 bp, P. troglodytes
aaacaattgctttgct

SEQ ID NO: 183804 - DNA, 16 bp, P. troglodytes
aaacaatttaaaaatg

SEQ ID NO: 183805 - DNA, 16 bp, P. troglodytes
aaacaatttaaaagga

SEQ ID NO: 183806 - DNA, 16 bp, P. troglodytes
aaacaatttagaaaat

SEQ ID NO: 183807 - DNA, 16 bp, P. troglodytes
aaacaatttatttctt

SEQ ID NO: 183808 - DNA, 16 bp, P. troglodytes
aaacaatttgaagaaa

SEQ ID NO: 183809 - DNA, 16 bp, P. troglodytes
aaacaattttacagaa

SEQ ID NO: 183810 - DNA, 16 bp, P. troglodytes
aaacaattttagaatt

SEQ ID NO: 183811 - DNA, 16 bp, P. troglodytes
aaacaattttgagaaa

SEQ ID NO: 183812 - DNA, 16 bp, P. troglodytes
aaacaatttttgaaaa

SEQ ID NO: 183813 - DNA, 16 bp, P. troglodytes
aaacaatttttttcca

SEQ ID NO: 183814 - DNA, 16 bp, P. troglodytes
aaacacaaaaatgtga

SEQ ID NO: 183815 - DNA, 16 bp, P. troglodytes
aaacacaaaacatttt

SEQ ID NO: 183816 - DNA, 16 bp, P. troglodytes
aaacacaaaactgtaa

SEQ ID NO: 183817 - DNA, 16 bp, P. troglodytes
aaacacaaacatattg

SEQ ID NO: 183818 - DNA, 16 bp, P. troglodytes
aaacacaacttttttt

SEQ ID NO: 183819 - DNA, 16 bp, P. troglodytes
aaacacaatcatggtg

SEQ ID NO: 183820 - DNA, 16 bp, P. troglodytes
aaacacacacacgtgc

SEQ ID NO: 183821 - DNA, 16 bp, P. troglodytes
aaacacacacagagat

SEQ ID NO: 183822 - DNA, 16 bp, P. troglodytes
aaacacacatgctgta

SEQ ID NO: 183823 - DNA, 16 bp, P. troglodytes
aaacacacttcacata

SEQ ID NO: 183824 - DNA, 16 bp, P. troglodytes
aaacacagattgctgg

SEQ ID NO: 183825 - DNA, 16 bp, P. troglodytes
aaacacaggagaattc

SEQ ID NO: 183826 - DNA, 16 bp, P. troglodytes
aaacacagtctttcca

SEQ ID NO: 183827 - DNA, 16 bp, P. troglodytes
aaacacatacatttat

SEQ ID NO: 183828 - DNA, 16 bp, P. troglodytes
aaacacatatattttt

SEQ ID NO: 183829 - DNA, 16 bp, P. troglodytes
aaacacatgaaaaatg

SEQ ID NO: 183830 - DNA, 16 bp, P. troglodytes
aaacacatgaagcaaa

SEQ ID NO: 183831 - DNA, 16 bp, P. troglodytes
aaacacatgtaaaaat

SEQ ID NO: 183832 - DNA, 16 bp, P. troglodytes
aaacacatttaagaaa

SEQ ID NO: 183833 - DNA, 16 bp, P. troglodytes
aaacacattttacaaa

SEQ ID NO: 183834 - DNA, 16 bp, P. troglodytes
aaacacattttatttt

SEQ ID NO: 183835 - DNA, 16 bp, P. troglodytes
aaacacattttcagat

SEQ ID NO: 183836 - DNA, 16 bp, P. troglodytes
aaacacattttctaag

SEQ ID NO: 183837 - DNA, 27 bp, P. troglodytes
aaacaccaaaagcaatggcaacagaag

SEQ ID NO: 183838 - DNA, 16 bp, P. troglodytes
aaacaccatctgttcc

SEQ ID NO: 183839 - DNA, 16 bp, P. troglodytes
aaacaccatttcatat

SEQ ID NO: 183840 - DNA, 16 bp, P. troglodytes
aaacaccgtctctaca

SEQ ID NO: 183841 - DNA, 20 bp, P. troglodytes
aaacaccgtctctactaaaa

SEQ ID NO: 183842 - DNA, 16 bp, P. troglodytes
aaacacctacatcaag

SEQ ID NO: 183843 - DNA, 16 bp, P. troglodytes
aaacacctcccaccag

SEQ ID NO: 183844 - DNA, 16 bp, P. troglodytes
aaacacctcccagcag

SEQ ID NO: 183845 - DNA, 17 bp, P. troglodytes
aaacacctggatgtcca

SEQ ID NO: 183846 - DNA, 20 bp, P. troglodytes
aaacacgtgaacaaaggtct

SEQ ID NO: 183847 - DNA, 16 bp, P. troglodytes
aaacactagacagaag

SEQ ID NO: 183848 - DNA, 16 bp, P. troglodytes
aaacactatttatttt

SEQ ID NO: 183849 - DNA, 16 bp, P. troglodytes
aaacactcctgaaaga

SEQ ID NO: 183850 - DNA, 16 bp, P. troglodytes
aaacactctgcaggtt

SEQ ID NO: 183851 - DNA, 16 bp, P. troglodytes
aaacactgcctctact

SEQ ID NO: 183852 - DNA, 16 bp, P. troglodytes
aaacactggaattaca

SEQ ID NO: 183853 - DNA, 16 bp, P. troglodytes
aaacacttattttaaa

SEQ ID NO: 183854 - DNA, 16 bp, P. troglodytes
aaacacttatttttaa

SEQ ID NO: 183855 - DNA, 16 bp, P. troglodytes
aaacacttatttttat

SEQ ID NO: 183856 - DNA, 16 bp, P. troglodytes
aaacacttcaagacat

SEQ ID NO: 183857 - DNA, 16 bp, P. troglodytes
aaacacttgatattat

SEQ ID NO: 183858 - DNA, 16 bp, P. troglodytes
aaacacttttcaggat

SEQ ID NO: 183859 - DNA, 16 bp, P. troglodytes
aaacagaaaaccaagt

SEQ ID NO: 183860 - DNA, 16 bp, P. troglodytes
aaacagaaaagaattt

SEQ ID NO: 183861 - DNA, 16 bp, P. troglodytes
aaacagaaaaggcttt

SEQ ID NO: 183862 - DNA, 16 bp, P. troglodytes
aaacagaaaatcacca

SEQ ID NO: 183863 - DNA, 16 bp, P. troglodytes
aaacagaaaattttaa

SEQ ID NO: 183864 - DNA, 16 bp, P. troglodytes
aaacagaaacatagac

SEQ ID NO: 183865 - DNA, 16 bp, P. troglodytes
aaacagaaagaaattt

SEQ ID NO: 183866 - DNA, 16 bp, P. troglodytes
aaacagaaaggaaatg

SEQ ID NO: 183867 - DNA, 16 bp, P. troglodytes
aaacagaaaggaatag

SEQ ID NO: 183868 - DNA, 16 bp, P. troglodytes
aaacagaaaggacacc

SEQ ID NO: 183869 - DNA, 16 bp, P. troglodytes
aaacagaaaggacatt

SEQ ID NO: 183870 - DNA, 16 bp, P. troglodytes
aaacagaaatagaatt

SEQ ID NO: 183871 - DNA, 16 bp, P. troglodytes
aaacagaaatattttg

SEQ ID NO: 183872 - DNA, 16 bp, P. troglodytes
aaacagaaatcttgga

SEQ ID NO: 183873 - DNA, 16 bp, P. troglodytes
aaacagaaatgctttt

SEQ ID NO: 183874 - DNA, 16 bp, P. troglodytes
aaacagaaatgtttaa

SEQ ID NO: 183875 - DNA, 16 bp, P. troglodytes
aaacagaaccaatgat

SEQ ID NO: 183876 - DNA, 16 bp, P. troglodytes
aaacagaaccagtgac

SEQ ID NO: 183877 - DNA, 16 bp, P. troglodytes
aaacagaactttaaaa

SEQ ID NO: 183878 - DNA, 16 bp, P. troglodytes
aaacagaacttttaaa

SEQ ID NO: 183879 - DNA, 16 bp, P. troglodytes
aaacagaagaaaatgt

SEQ ID NO: 183880 - DNA, 16 bp, P. troglodytes
aaacagaagcacagag

SEQ ID NO: 183881 - DNA, 16 bp, P. troglodytes
aaacagaagtttaaaa

SEQ ID NO: 183882 - DNA, 16 bp, P. troglodytes
aaacagaatatttgaa

SEQ ID NO: 183883 - DNA, 16 bp, P. troglodytes
aaacagaatgaaatca

SEQ ID NO: 183884 - DNA, 16 bp, P. troglodytes
aaacagaatttatttt

SEQ ID NO: 183885 - DNA, 16 bp, P. troglodytes
aaacagacaaaaattc

SEQ ID NO: 183886 - DNA, 16 bp, P. troglodytes
aaacagacacagagac

SEQ ID NO: 183887 - DNA, 16 bp, P. troglodytes
aaacagacacatcaac

SEQ ID NO: 183888 - DNA, 16 bp, P. troglodytes
aaacagactcagtgct

SEQ ID NO: 183889 - DNA, 16 bp, P. troglodytes
aaacagactttaaaaa

SEQ ID NO: 183890 - DNA, 30 bp, P. troglodytes
aaacagactttaaaccaacaaagatcaaaa

SEQ ID NO: 183891 - DNA, 16 bp, P. troglodytes
aaacagagacaatttt

SEQ ID NO: 183892 - DNA, 16 bp, P. troglodytes
aaacagagactcagag

SEQ ID NO: 183893 - DNA, 16 bp, P. troglodytes
aaacagagagagagat

SEQ ID NO: 183894 - DNA, 17 bp, P. troglodytes
aaacagagccaaagaca

SEQ ID NO: 183895 - DNA, 16 bp, P. troglodytes
aaacagataaaaatcc

SEQ ID NO: 183896 - DNA, 16 bp, P. troglodytes
aaacagatattttaaa

SEQ ID NO: 183897 - DNA, 16 bp, P. troglodytes
aaacagatcagtagtt

SEQ ID NO: 183898 - DNA, 16 bp, P. troglodytes
aaacagatggaaaaag

SEQ ID NO: 183899 - DNA, 16 bp, P. troglodytes
aaacagatggcacact

SEQ ID NO: 183900 - DNA, 16 bp, P. troglodytes
aaacagatgtgttgtc

SEQ ID NO: 183901 - DNA, 16 bp, P. troglodytes
aaacagattttaaaaa

SEQ ID NO: 183902 - DNA, 16 bp, P. troglodytes
aaacagattttaaaag

SEQ ID NO: 183903 - DNA, 16 bp, P. troglodytes
aaacagattttaaatg

SEQ ID NO: 183904 - DNA, 16 bp, P. troglodytes
aaacagattttaaatt

SEQ ID NO: 183905 - DNA, 16 bp, P. troglodytes
aaacagattttgaaaa

SEQ ID NO: 183906 - DNA, 16 bp, P. troglodytes
aaacagattttgtttt

SEQ ID NO: 183907 - DNA, 16 bp, P. troglodytes
aaacagcaaactgttt

SEQ ID NO: 183908 - DNA, 16 bp, P. troglodytes
aaacagcaaagcattc

SEQ ID NO: 183909 - DNA, 16 bp, P. troglodytes
aaacagcaaatttcaa

SEQ ID NO: 183910 - DNA, 16 bp, P. troglodytes
aaacagcagaaactta

SEQ ID NO: 183911 - DNA, 16 bp, P. troglodytes
aaacagcagatattta

SEQ ID NO: 183912 - DNA, 16 bp, P. troglodytes
aaacagcagcagcaac

SEQ ID NO: 183913 - DNA, 16 bp, P. troglodytes
aaacagcagcagcagc

SEQ ID NO: 183914 - DNA, 16 bp, P. troglodytes
aaacagcatgagaact

SEQ ID NO: 183915 - DNA, 16 bp, P. troglodytes
aaacagcatgggaaag

SEQ ID NO: 183916 - DNA, 16 bp, P. troglodytes
aaacagcatttaaaaa

SEQ ID NO: 183917 - DNA, 16 bp, P. troglodytes
aaacagcctggcacct

SEQ ID NO: 183918 - DNA, 16 bp, P. troglodytes
aaacagccttattgct

SEQ ID NO: 183919 - DNA, 16 bp, P. troglodytes
aaacagccttctattg

SEQ ID NO: 183920 - DNA, 16 bp, P. troglodytes
aaacagccttgttgct

SEQ ID NO: 183921 - DNA, 16 bp, P. troglodytes
aaacagctttaaaaat

SEQ ID NO: 183922 - DNA, 16 bp, P. troglodytes
aaacagcttttttttt

SEQ ID NO: 183923 - DNA, 16 bp, P. troglodytes
aaacaggaaaatgaca

SEQ ID NO: 183924 - DNA, 16 bp, P. troglodytes
aaacaggaagaagttg

SEQ ID NO: 183925 - DNA, 16 bp, P. troglodytes
aaacaggaataatttt

SEQ ID NO: 183926 - DNA, 16 bp, P. troglodytes
aaacaggattttgcca

SEQ ID NO: 183927 - DNA, 16 bp, P. troglodytes
aaacaggcaaaatgaa

SEQ ID NO: 183928 - DNA, 16 bp, P. troglodytes
aaacaggcaaaggaca

SEQ ID NO: 183929 - DNA, 16 bp, P. troglodytes
aaacaggcagcaggcc

SEQ ID NO: 183930 - DNA, 16 bp, P. troglodytes
aaacaggcccagagaa

SEQ ID NO: 183931 - DNA, 16 bp, P. troglodytes
aaacaggcttagagag

SEQ ID NO: 183932 - DNA, 16 bp, P. troglodytes
aaacagggaaaatttg

SEQ ID NO: 183933 - DNA, 16 bp, P. troglodytes
aaacagggtttctcca

SEQ ID NO: 183934 - DNA, 16 bp, P. troglodytes
aaacaggtgaatttta

SEQ ID NO: 183935 - DNA, 16 bp, P. troglodytes
aaacaggttctggagt

SEQ ID NO: 183936 - DNA, 16 bp, P. troglodytes
aaacagtaaaatattt

SEQ ID NO: 183937 - DNA, 16 bp, P. troglodytes
aaacagtattttttaa

SEQ ID NO: 183938 - DNA, 16 bp, P. troglodytes
aaacagtcatttaaaa

SEQ ID NO: 183939 - DNA, 16 bp, P. troglodytes
aaacagtgcttccaaa

SEQ ID NO: 183940 - DNA, 16 bp, P. troglodytes
aaacagtgtaaaccag

SEQ ID NO: 183941 - DNA, 16 bp, P. troglodytes
aaacagtgtttgcaaa

SEQ ID NO: 183942 - DNA, 16 bp, P. troglodytes
aaacagttaaataaat

SEQ ID NO: 183943 - DNA, 16 bp, P. troglodytes
aaacagttgttttaaa

SEQ ID NO: 183944 - DNA, 17 bp, P. troglodytes
aaacagtttgcagtaaa

SEQ ID NO: 183945 - DNA, 16 bp, P. troglodytes
aaacagtttgctgttt

SEQ ID NO: 183946 - DNA, 16 bp, P. troglodytes
aaacagtttggcagtt

SEQ ID NO: 183947 - DNA, 16 bp, P. troglodytes
aaacagttttattttc

SEQ ID NO: 183948 - DNA, 16 bp, P. troglodytes
aaacagttttcaaaag

SEQ ID NO: 183949 - DNA, 16 bp, P. troglodytes
aaacagttttccaaag

SEQ ID NO: 183950 - DNA, 16 bp, P. troglodytes
aaacagttttgaaaaa

SEQ ID NO: 183951 - DNA, 17 bp, P. troglodytes
aaacataaatgacctga

SEQ ID NO: 183952 - DNA, 16 bp, P. troglodytes
aaacataaatgtaaat

SEQ ID NO: 183953 - DNA, 16 bp, P. troglodytes
aaacataattatttct

SEQ ID NO: 183954 - DNA, 16 bp, P. troglodytes
aaacataattcatcac

SEQ ID NO: 183955 - DNA, 16 bp, P. troglodytes
aaacataatttgaaaa

SEQ ID NO: 183956 - DNA, 16 bp, P. troglodytes
aaacataatttttcta

SEQ ID NO: 183957 - DNA, 16 bp, P. troglodytes
aaacatacagaaaagt

SEQ ID NO: 183958 - DNA, 16 bp, P. troglodytes
aaacatagaaatggta

SEQ ID NO: 183959 - DNA, 16 bp, P. troglodytes
aaacatagcaagacct

SEQ ID NO: 183960 - DNA, 16 bp, P. troglodytes
aaacataggaaaatat

SEQ ID NO: 183961 - DNA, 16 bp, P. troglodytes
aaacatataaaatgta

SEQ ID NO: 183962 - DNA, 16 bp, P. troglodytes
aaacatatacattttt

SEQ ID NO: 183963 - DNA, 16 bp, P. troglodytes
aaacatatataaaatg

SEQ ID NO: 183964 - DNA, 16 bp, P. troglodytes
aaacatatatacatgt

SEQ ID NO: 183965 - DNA, 16 bp, P. troglodytes
aaacatatttaaaagt

SEQ ID NO: 183966 - DNA, 16 bp, P. troglodytes
aaacatattttctctt

SEQ ID NO: 183967 - DNA, 16 bp, P. troglodytes
aaacatatttttgaaa

SEQ ID NO: 183968 - DNA, 16 bp, P. troglodytes
aaacatcaattttttt

SEQ ID NO: 183969 - DNA, 16 bp, P. troglodytes
aaacatcacatgttct

SEQ ID NO: 183970 - DNA, 16 bp, P. troglodytes
aaacatcagaaggaac

SEQ ID NO: 183971 - DNA, 16 bp, P. troglodytes
aaacatcagacaaatt

SEQ ID NO: 183972 - DNA, 16 bp, P. troglodytes
aaacatccagaaaaga

SEQ ID NO: 183973 - DNA, 16 bp, P. troglodytes
aaacatcctacaaggc

SEQ ID NO: 183974 - DNA, 16 bp, P. troglodytes
aaacatcttaaatttt

SEQ ID NO: 183975 - DNA, 16 bp, P. troglodytes
aaacatctttttcttc

SEQ ID NO: 183976 - DNA, 16 bp, P. troglodytes
aaacatgaaaaacatt

SEQ ID NO: 183977 - DNA, 16 bp, P. troglodytes
aaacatgaaattcatt

SEQ ID NO: 183978 - DNA, 16 bp, P. troglodytes
aaacatgaaatttaaa

SEQ ID NO: 183979 - DNA, 16 bp, P. troglodytes
aaacatgaaatttatg

SEQ ID NO: 183980 - DNA, 16 bp, P. troglodytes
aaacatgaagaaaagc

SEQ ID NO: 183981 - DNA, 16 bp, P. troglodytes
aaacatgatgaaaccc

SEQ ID NO: 183982 - DNA, 16 bp, P. troglodytes
aaacatgatgctaagt

SEQ ID NO: 183983 - DNA, 16 bp, P. troglodytes
aaacatgcacatatac

SEQ ID NO: 183984 - DNA, 16 bp, P. troglodytes
aaacatggaaaatatt

SEQ ID NO: 183985 - DNA, 16 bp, P. troglodytes
aaacatggaaagaaac

SEQ ID NO: 183986 - DNA, 16 bp, P. troglodytes
aaacatggagaaaata

SEQ ID NO: 183987 - DNA, 16 bp, P. troglodytes
aaacatggtgaaaccc

SEQ ID NO: 183988 - DNA, 16 bp, P. troglodytes
aaacatgtaaagaaga

SEQ ID NO: 183989 - DNA, 16 bp, P. troglodytes
aaacatgtacaaaaat

SEQ ID NO: 183990 - DNA, 16 bp, P. troglodytes
aaacatgtacacacac

SEQ ID NO: 183991 - DNA, 16 bp, P. troglodytes
aaacatgtatataaaa

SEQ ID NO: 183992 - DNA, 16 bp, P. troglodytes
aaacatgtatatacat

SEQ ID NO: 183993 - DNA, 16 bp, P. troglodytes
aaacatgtattatttc

SEQ ID NO: 183994 - DNA, 16 bp, P. troglodytes
aaacatgttttatttt

SEQ ID NO: 183995 - DNA, 16 bp, P. troglodytes
aaacatgtttttattt

SEQ ID NO: 183996 - DNA, 16 bp, P. troglodytes
aaacattaaaaagatt

SEQ ID NO: 183997 - DNA, 16 bp, P. troglodytes
aaacattacattttta

SEQ ID NO: 183998 - DNA, 16 bp, P. troglodytes
aaacattacttctggg

SEQ ID NO: 183999 - DNA, 16 bp, P. troglodytes
aaacattatgctgaat

SEQ ID NO: 184000 - DNA, 16 bp, P. troglodytes
aaacattattgaaaaa

SEQ ID NO: 184001 - DNA, 16 bp, P. troglodytes
aaacattattttgaaa

SEQ ID NO: 184002 - DNA, 16 bp, P. troglodytes
aaacattcagtttcca

SEQ ID NO: 184003 - DNA, 16 bp, P. troglodytes
aaacattcattctttt

SEQ ID NO: 184004 - DNA, 16 bp, P. troglodytes
aaacattcatttttaa

SEQ ID NO: 184005 - DNA, 16 bp, P. troglodytes
aaacattcccattcca

SEQ ID NO: 184006 - DNA, 16 bp, P. troglodytes
aaacattgaaaaatat

SEQ ID NO: 184007 - DNA, 16 bp, P. troglodytes
aaacattgaaataaat

SEQ ID NO: 184008 - DNA, 16 bp, P. troglodytes
aaacattgattttttt

SEQ ID NO: 184009 - DNA, 16 bp, P. troglodytes
aaacattgcatgttct

SEQ ID NO: 184010 - DNA, 16 bp, P. troglodytes
aaacattgttgaaaga

SEQ ID NO: 184011 - DNA, 16 bp, P. troglodytes
aaacatttaaaaagta

SEQ ID NO: 184012 - DNA, 16 bp, P. troglodytes
aaacatttaatgaaaa

SEQ ID NO: 184013 - DNA, 16 bp, P. troglodytes
aaacatttaatgaaga

SEQ ID NO: 184014 - DNA, 16 bp, P. troglodytes
aaacatttacatattt

SEQ ID NO: 184015 - DNA, 16 bp, P. troglodytes
aaacatttactgaaca

SEQ ID NO: 184016 - DNA, 16 bp, P. troglodytes
aaacatttactgagtg

SEQ ID NO: 184017 - DNA, 16 bp, P. troglodytes
aaacatttagaaaatg

SEQ ID NO: 184018 - DNA, 16 bp, P. troglodytes
aaacatttagaagaaa

SEQ ID NO: 184019 - DNA, 16 bp, P. troglodytes
aaacatttagggaaaa

SEQ ID NO: 184020 - DNA, 16 bp, P. troglodytes
aaacatttatctttgt

SEQ ID NO: 184021 - DNA, 16 bp, P. troglodytes
aaacatttattatctt

SEQ ID NO: 184022 - DNA, 16 bp, P. troglodytes
aaacatttattgagca

SEQ ID NO: 184023 - DNA, 16 bp, P. troglodytes
aaacatttatttccca

SEQ ID NO: 184024 - DNA, 16 bp, P. troglodytes
aaacatttatttgtat

SEQ ID NO: 184025 - DNA, 16 bp, P. troglodytes
aaacatttattttgat

SEQ ID NO: 184026 - DNA, 16 bp, P. troglodytes
aaacatttcaagaaaa

SEQ ID NO: 184027 - DNA, 16 bp, P. troglodytes
aaacatttcaagaaga

SEQ ID NO: 184028 - DNA, 16 bp, P. troglodytes
aaacatttcataattt

SEQ ID NO: 184029 - DNA, 16 bp, P. troglodytes
aaacatttccaaaaat

SEQ ID NO: 184030 - DNA, 16 bp, P. troglodytes
aaacatttctcaaaag

SEQ ID NO: 184031 - DNA, 16 bp, P. troglodytes
aaacatttctggagct

SEQ ID NO: 184032 - DNA, 16 bp, P. troglodytes
aaacatttcttgagca

SEQ ID NO: 184033 - DNA, 16 bp, P. troglodytes
aaacatttgaaacaaa

SEQ ID NO: 184034 - DNA, 16 bp, P. troglodytes
aaacatttgaaataaa

SEQ ID NO: 184035 - DNA, 16 bp, P. troglodytes
aaacatttggaaaaaa

SEQ ID NO: 184036 - DNA, 16 bp, P. troglodytes
aaacatttggaaaaat

SEQ ID NO: 184037 - DNA, 16 bp, P. troglodytes
aaacatttgtcaaatg

SEQ ID NO: 184038 - DNA, 16 bp, P. troglodytes
aaacatttgtgaaaaa

SEQ ID NO: 184039 - DNA, 16 bp, P. troglodytes
aaacatttgttgaaat

SEQ ID NO: 184040 - DNA, 16 bp, P. troglodytes
aaacatttgttgagtt

SEQ ID NO: 184041 - DNA, 16 bp, P. troglodytes
aaacattttaaaaaga

SEQ ID NO: 184042 - DNA, 16 bp, P. troglodytes
aaacattttaaaaagc

SEQ ID NO: 184043 - DNA, 16 bp, P. troglodytes
aaacattttaaagtaa

SEQ ID NO: 184044 - DNA, 16 bp, P. troglodytes
aaacattttaaatatg

SEQ ID NO: 184045 - DNA, 16 bp, P. troglodytes
aaacattttaaatgtt

SEQ ID NO: 184046 - DNA, 16 bp, P. troglodytes
aaacattttaaattca

SEQ ID NO: 184047 - DNA, 16 bp, P. troglodytes
aaacattttaagtttt

SEQ ID NO: 184048 - DNA, 16 bp, P. troglodytes
aaacattttaatatgt

SEQ ID NO: 184049 - DNA, 16 bp, P. troglodytes
aaacattttacagagt

SEQ ID NO: 184050 - DNA, 16 bp, P. troglodytes
aaacattttacatgca

SEQ ID NO: 184051 - DNA, 16 bp, P. troglodytes
aaacattttacatttt

SEQ ID NO: 184052 - DNA, 16 bp, P. troglodytes
aaacattttatcattt

SEQ ID NO: 184053 - DNA, 16 bp, P. troglodytes
aaacattttcaagaaa

SEQ ID NO: 184054 - DNA, 16 bp, P. troglodytes
aaacattttcattacc

SEQ ID NO: 184055 - DNA, 16 bp, P. troglodytes
aaacattttcctattt

SEQ ID NO: 184056 - DNA, 16 bp, P. troglodytes
aaacattttctaaatg

SEQ ID NO: 184057 - DNA, 16 bp, P. troglodytes
aaacattttcttctct

SEQ ID NO: 184058 - DNA, 16 bp, P. troglodytes
aaacattttcttcttt

SEQ ID NO: 184059 - DNA, 16 bp, P. troglodytes
aaacattttctttata

SEQ ID NO: 184060 - DNA, 16 bp, P. troglodytes
aaacattttgctaagt

SEQ ID NO: 184061 - DNA, 16 bp, P. troglodytes
aaacatttttaaaggg

SEQ ID NO: 184062 - DNA, 16 bp, P. troglodytes
aaacatttttaaagtt

SEQ ID NO: 184063 - DNA, 16 bp, P. troglodytes
aaacatttttaaatag

SEQ ID NO: 184064 - DNA, 16 bp, P. troglodytes
aaacatttttaagaag

SEQ ID NO: 184065 - DNA, 16 bp, P. troglodytes
aaacatttttagagaa

SEQ ID NO: 184066 - DNA, 16 bp, P. troglodytes
aaacatttttcaaaat

SEQ ID NO: 184067 - DNA, 16 bp, P. troglodytes
aaacatttttgaaaaa

SEQ ID NO: 184068 - DNA, 16 bp, P. troglodytes
aaacatttttgaaatg

SEQ ID NO: 184069 - DNA, 16 bp, P. troglodytes
aaacatttttggtttt

SEQ ID NO: 184070 - DNA, 16 bp, P. troglodytes
aaacatttttgtaaaa

SEQ ID NO: 184071 - DNA, 16 bp, P. troglodytes
aaacatttttgttaat

SEQ ID NO: 184072 - DNA, 16 bp, P. troglodytes
aaacattttttcttct

SEQ ID NO: 184073 - DNA, 16 bp, P. troglodytes
aaacatttttttctaa

SEQ ID NO: 184074 - DNA, 16 bp, P. troglodytes
aaacatttttttctct

SEQ ID NO: 184075 - DNA, 16 bp, P. troglodytes
aaaccaaaaacatttt

SEQ ID NO: 184076 - DNA, 16 bp, P. troglodytes
aaaccaaaaagtatct

SEQ ID NO: 184077 - DNA, 16 bp, P. troglodytes
aaaccaaaagctgttt

SEQ ID NO: 184078 - DNA, 16 bp, P. troglodytes
aaaccaaaatatttca

SEQ ID NO: 184079 - DNA, 16 bp, P. troglodytes
aaaccaaaatgaagtc

SEQ ID NO: 184080 - DNA, 16 bp, P. troglodytes
aaaccaaacactgtat

SEQ ID NO: 184081 - DNA, 16 bp, P. troglodytes
aaaccaaacacttcat

SEQ ID NO: 184082 - DNA, 16 bp, P. troglodytes
aaaccaaagactgcat

SEQ ID NO: 184083 - DNA, 16 bp, P. troglodytes
aaaccaaagcccagag

SEQ ID NO: 184084 - DNA, 16 bp, P. troglodytes
aaaccaaagtttaaaa

SEQ ID NO: 184085 - DNA, 16 bp, P. troglodytes
aaaccaacaaaggtca

SEQ ID NO: 184086 - DNA, 16 bp, P. troglodytes
aaaccaacctggacaa

SEQ ID NO: 184087 - DNA, 16 bp, P. troglodytes
aaaccaagaagaagtc

SEQ ID NO: 184088 - DNA, 16 bp, P. troglodytes
aaaccaagatgaaatc

SEQ ID NO: 184089 - DNA, 16 bp, P. troglodytes
aaaccaaggaaccaga

SEQ ID NO: 184090 - DNA, 16 bp, P. troglodytes
aaaccaaggcccagag

SEQ ID NO: 184091 - DNA, 16 bp, P. troglodytes
aaaccaaggctcagag

SEQ ID NO: 184092 - DNA, 16 bp, P. troglodytes
aaaccaaggtggctat

SEQ ID NO: 184093 - DNA, 16 bp, P. troglodytes
aaaccaaggttcagag

SEQ ID NO: 184094 - DNA, 16 bp, P. troglodytes
aaaccaataacaagta

SEQ ID NO: 184095 - DNA, 17 bp, P. troglodytes
aaaccaatcatgccttt

SEQ ID NO: 184096 - DNA, 16 bp, P. troglodytes
aaaccaatgctcccaa

SEQ ID NO: 184097 - DNA, 16 bp, P. troglodytes
aaaccaatttacaaga

SEQ ID NO: 184098 - DNA, 16 bp, P. troglodytes
aaaccaattttaccat

SEQ ID NO: 184099 - DNA, 16 bp, P. troglodytes
aaaccaattttttgtt

SEQ ID NO: 184100 - DNA, 16 bp, P. troglodytes
aaaccacagaaagtga

SEQ ID NO: 184101 - DNA, 16 bp, P. troglodytes
aaaccacagataaggg

SEQ ID NO: 184102 - DNA, 16 bp, P. troglodytes
aaaccacagatagtac

SEQ ID NO: 184103 - DNA, 16 bp, P. troglodytes
aaaccacatctctact

SEQ ID NO: 184104 - DNA, 16 bp, P. troglodytes
aaaccacatgagtatc

SEQ ID NO: 184105 - DNA, 16 bp, P. troglodytes
aaaccaccatgacaca

SEQ ID NO: 184106 - DNA, 17 bp, P. troglodytes
aaaccaccatggcacac

SEQ ID NO: 184107 - DNA, 16 bp, P. troglodytes
aaaccacctcagcctg

SEQ ID NO: 184108 - DNA, 16 bp, P. troglodytes
aaaccaccttttgaag

SEQ ID NO: 184109 - DNA, 16 bp, P. troglodytes
aaaccactggagtgtg

SEQ ID NO: 184110 - DNA, 16 bp, P. troglodytes
aaaccactttaaagtt

SEQ ID NO: 184111 - DNA, 16 bp, P. troglodytes
aaaccactttttcctc

SEQ ID NO: 184112 - DNA, 16 bp, P. troglodytes
aaaccagaactcagga

SEQ ID NO: 184113 - DNA, 16 bp, P. troglodytes
aaaccagaagagattg

SEQ ID NO: 184114 - DNA, 16 bp, P. troglodytes
aaaccagacaaggata

SEQ ID NO: 184115 - DNA, 16 bp, P. troglodytes
aaaccagaccaaactc

SEQ ID NO: 184116 - DNA, 16 bp, P. troglodytes
aaaccagcctggccaa

SEQ ID NO: 184117 - DNA, 16 bp, P. troglodytes
aaaccagctcctggaa

SEQ ID NO: 184118 - DNA, 16 bp, P. troglodytes
aaaccagctcctggag

SEQ ID NO: 184119 - DNA, 16 bp, P. troglodytes
aaaccagctcctggtt

SEQ ID NO: 184120 - DNA, 16 bp, P. troglodytes
aaaccaggaaattgac

SEQ ID NO: 184121 - DNA, 16 bp, P. troglodytes
aaaccaggcacggtgg

SEQ ID NO: 184122 - DNA, 22 bp, P. troglodytes
aaaccaggcctgggcctgcctg

SEQ ID NO: 184123 - DNA, 16 bp, P. troglodytes
aaaccagtgcaaaaag

SEQ ID NO: 184124 - DNA, 16 bp, P. troglodytes
aaaccagttaggaggc

SEQ ID NO: 184125 - DNA, 16 bp, P. troglodytes
aaaccatatcaagcac

SEQ ID NO: 184126 - DNA, 16 bp, P. troglodytes
aaaccatatcaatgtg

SEQ ID NO: 184127 - DNA, 16 bp, P. troglodytes
aaaccatatcacatgc

SEQ ID NO: 184128 - DNA, 16 bp, P. troglodytes
aaaccatatcagagat

SEQ ID NO: 184129 - DNA, 16 bp, P. troglodytes
aaaccatatctttgtg

SEQ ID NO: 184130 - DNA, 16 bp, P. troglodytes
aaaccatcaccacaat

SEQ ID NO: 184131 - DNA, 16 bp, P. troglodytes
aaaccatcagatttca

SEQ ID NO: 184132 - DNA, 16 bp, P. troglodytes
aaaccatcatcagagt

SEQ ID NO: 184133 - DNA, 16 bp, P. troglodytes
aaaccatcattcacag

SEQ ID NO: 184134 - DNA, 16 bp, P. troglodytes
aaaccatccaaatgtc

SEQ ID NO: 184135 - DNA, 16 bp, P. troglodytes
aaaccatctttttttt

SEQ ID NO: 184136 - DNA, 16 bp, P. troglodytes
aaaccatggaaaatga

SEQ ID NO: 184137 - DNA, 18 bp, P. troglodytes
aaaccattacatctgaga

SEQ ID NO: 184138 - DNA, 16 bp, P. troglodytes
aaaccattctgccctc

SEQ ID NO: 184139 - DNA, 16 bp, P. troglodytes
aaaccatttttaaaag

SEQ ID NO: 184140 - DNA, 16 bp, P. troglodytes
aaaccattttttttct

SEQ ID NO: 184141 - DNA, 16 bp, P. troglodytes
aaacccaaagcaagta

SEQ ID NO: 184142 - DNA, 16 bp, P. troglodytes
aaacccaaagttagca

SEQ ID NO: 184143 - DNA, 16 bp, P. troglodytes
aaacccaatgggaaaa

SEQ ID NO: 184144 - DNA, 16 bp, P. troglodytes
aaacccacagccagca

SEQ ID NO: 184145 - DNA, 16 bp, P. troglodytes
aaacccacctcttgca

SEQ ID NO: 184146 - DNA, 16 bp, P. troglodytes
aaacccagaaacatca

SEQ ID NO: 184147 - DNA, 16 bp, P. troglodytes
aaacccagagccaaca

SEQ ID NO: 184148 - DNA, 16 bp, P. troglodytes
aaacccagagccctgg

SEQ ID NO: 184149 - DNA, 16 bp, P. troglodytes
aaacccagctactcgg

SEQ ID NO: 184150 - DNA, 16 bp, P. troglodytes
aaacccatctctacaa

SEQ ID NO: 184151 - DNA, 19 bp, P. troglodytes
aaacccatctctactaaaa

SEQ ID NO: 184152 - DNA, 16 bp, P. troglodytes
aaacccattcttagct

SEQ ID NO: 184153 - DNA, 20 bp, P. troglodytes
aaaccccaactctactaaaa

SEQ ID NO: 184154 - DNA, 16 bp, P. troglodytes
aaaccccaggaccaga

SEQ ID NO: 184155 - DNA, 16 bp, P. troglodytes
aaaccccaggctccac

SEQ ID NO: 184156 - DNA, 20 bp, P. troglodytes
aaaccccatatctactaaaa

SEQ ID NO: 184157 - DNA, 16 bp, P. troglodytes
aaaccccatcctctac

SEQ ID NO: 184158 - DNA, 16 bp, P. troglodytes
aaaccccatctatatt

SEQ ID NO: 184159 - DNA, 24 bp, P. troglodytes
aaaccccatctctactaaaaataa

SEQ ID NO: 184160 - DNA, 20 bp, P. troglodytes
aaaccccatctctactaaac

SEQ ID NO: 184161 - DNA, 20 bp, P. troglodytes
aaaccccatctctactagaa

SEQ ID NO: 184162 - DNA, 17 bp, P. troglodytes
aaaccccatctctactc

SEQ ID NO: 184163 - DNA, 17 bp, P. troglodytes
aaaccccatctctactt

SEQ ID NO: 184164 - DNA, 16 bp, P. troglodytes
aaaccccatctgtaca

SEQ ID NO: 184165 - DNA, 16 bp, P. troglodytes
aaacccccaagagtat

SEQ ID NO: 184166 - DNA, 20 bp, P. troglodytes
aaaccccgtctctactaaaa

SEQ ID NO: 184167 - DNA, 20 bp, P. troglodytes
aaaccccgtctctactaaag

SEQ ID NO: 184168 - DNA, 22 bp, P. troglodytes
aaaccccgtctctactataaaa

SEQ ID NO: 184169 - DNA, 17 bp, P. troglodytes
aaaccccgtctctactg

SEQ ID NO: 184170 - DNA, 16 bp, P. troglodytes
aaaccccgtctctata

SEQ ID NO: 184171 - DNA, 20 bp, P. troglodytes
aaaccccgtctctattaaaa

SEQ ID NO: 184172 - DNA, 16 bp, P. troglodytes
aaaccccgtttctaca

SEQ ID NO: 184173 - DNA, 16 bp, P. troglodytes
aaacccctggactcaa

SEQ ID NO: 184174 - DNA, 16 bp, P. troglodytes
aaacccctgtctctac

SEQ ID NO: 184175 - DNA, 20 bp, P. troglodytes
aaaccccttctctactaaaa

SEQ ID NO: 184176 - DNA, 16 bp, P. troglodytes
aaaccccttctttact

SEQ ID NO: 184177 - DNA, 18 bp, P. troglodytes
aaacccgggaggtggagg

SEQ ID NO: 184178 - DNA, 16 bp, P. troglodytes
aaaccctacaatccag

SEQ ID NO: 184179 - DNA, 16 bp, P. troglodytes
aaaccctatgaatgta

SEQ ID NO: 184180 - DNA, 16 bp, P. troglodytes
aaaccctcaagggcat

SEQ ID NO: 184181 - DNA, 16 bp, P. troglodytes
aaaccctcagcaaact

SEQ ID NO: 184182 - DNA, 18 bp, P. troglodytes
aaaccctgactctactaa

SEQ ID NO: 184183 - DNA, 16 bp, P. troglodytes
aaaccctgccttcaag

SEQ ID NO: 184184 - DNA, 20 bp, P. troglodytes
aaaccctgtctatactaaaa

SEQ ID NO: 184185 - DNA, 16 bp, P. troglodytes
aaaccctgtctctaaa

SEQ ID NO: 184186 - DNA, 19 bp, P. troglodytes
aaaccctgtctctacaaaa

SEQ ID NO: 184187 - DNA, 16 bp, P. troglodytes
aaaccctgtctttaca

SEQ ID NO: 184188 - DNA, 20 bp, P. troglodytes
aaaccctgtctttactaaaa

SEQ ID NO: 184189 - DNA, 16 bp, P. troglodytes
aaaccctgtttctaca

SEQ ID NO: 184190 - DNA, 16 bp, P. troglodytes
aaacccttgtgacatg

SEQ ID NO: 184191 - DNA, 16 bp, P. troglodytes
aaaccgaggctcagag

SEQ ID NO: 184192 - DNA, 18 bp, P. troglodytes
aaaccgatgttattcata

SEQ ID NO: 184193 - DNA, 16 bp, P. troglodytes
aaaccggccgggcgcg

SEQ ID NO: 184194 - DNA, 16 bp, P. troglodytes
aaacctaaaattagta

SEQ ID NO: 184195 - DNA, 16 bp, P. troglodytes
aaacctacaaaatggg

SEQ ID NO: 184196 - DNA, 16 bp, P. troglodytes
aaacctacaaagagac

SEQ ID NO: 184197 - DNA, 16 bp, P. troglodytes
aaacctacttgatcat

SEQ ID NO: 184198 - DNA, 16 bp, P. troglodytes
aaacctagaagagatg

SEQ ID NO: 184199 - DNA, 16 bp, P. troglodytes
aaacctattttttaaa

SEQ ID NO: 184200 - DNA, 16 bp, P. troglodytes
aaacctcaattcttaa

SEQ ID NO: 184201 - DNA, 16 bp, P. troglodytes
aaacctcagttcttga

SEQ ID NO: 184202 - DNA, 16 bp, P. troglodytes
aaacctcatcatctca

SEQ ID NO: 184203 - DNA, 16 bp, P. troglodytes
aaacctcatctctacc

SEQ ID NO: 184204 - DNA, 16 bp, P. troglodytes
aaacctccacctccag

SEQ ID NO: 184205 - DNA, 16 bp, P. troglodytes
aaacctccagaggaac

SEQ ID NO: 184206 - DNA, 16 bp, P. troglodytes
aaacctcctgcagcta

SEQ ID NO: 184207 - DNA, 16 bp, P. troglodytes
aaacctcctttccttt

SEQ ID NO: 184208 - DNA, 16 bp, P. troglodytes
aaacctctttcttcat

SEQ ID NO: 184209 - DNA, 16 bp, P. troglodytes
aaacctcttttataaa

SEQ ID NO: 184210 - DNA, 16 bp, P. troglodytes
aaacctcttttataag

SEQ ID NO: 184211 - DNA, 16 bp, P. troglodytes
aaacctctttttaaaa

SEQ ID NO: 184212 - DNA, 16 bp, P. troglodytes
aaacctctttttataa

SEQ ID NO: 184213 - DNA, 16 bp, P. troglodytes
aaacctgaaactatga

SEQ ID NO: 184214 - DNA, 16 bp, P. troglodytes
aaacctgaagagacca

SEQ ID NO: 184215 - DNA, 16 bp, P. troglodytes
aaacctgacaaaagca

SEQ ID NO: 184216 - DNA, 16 bp, P. troglodytes
aaacctgaggaaaaca

SEQ ID NO: 184217 - DNA, 16 bp, P. troglodytes
aaacctgcatgctgtg

SEQ ID NO: 184218 - DNA, 16 bp, P. troglodytes
aaacctgcctcccatt

SEQ ID NO: 184219 - DNA, 16 bp, P. troglodytes
aaacctggaggcatca

SEQ ID NO: 184220 - DNA, 16 bp, P. troglodytes
aaacctggatggagaa

SEQ ID NO: 184221 - DNA, 16 bp, P. troglodytes
aaacctggcaaagaca

SEQ ID NO: 184222 - DNA, 16 bp, P. troglodytes
aaacctggtctttact

SEQ ID NO: 184223 - DNA, 16 bp, P. troglodytes
aaacctgtccctggtg

SEQ ID NO: 184224 - DNA, 16 bp, P. troglodytes
aaacctgtctctatta

SEQ ID NO: 184225 - DNA, 16 bp, P. troglodytes
aaacctgttttatcag

SEQ ID NO: 184226 - DNA, 16 bp, P. troglodytes
aaaccttaaaaaccct

SEQ ID NO: 184227 - DNA, 16 bp, P. troglodytes
aaaccttacaaatgta

SEQ ID NO: 184228 - DNA, 16 bp, P. troglodytes
aaaccttacaagtgta

SEQ ID NO: 184229 - DNA, 16 bp, P. troglodytes
aaaccttgttaatctg

SEQ ID NO: 184230 - DNA, 16 bp, P. troglodytes
aaacctttagccagat

SEQ ID NO: 184231 - DNA, 16 bp, P. troglodytes
aaaccttttaaaaagt

SEQ ID NO: 184232 - DNA, 16 bp, P. troglodytes
aaacctttttcctttg

SEQ ID NO: 184233 - DNA, 16 bp, P. troglodytes
aaacgcaccaatcagc

SEQ ID NO: 184234 - DNA, 16 bp, P. troglodytes
aaacgctgggattaca

SEQ ID NO: 184235 - DNA, 16 bp, P. troglodytes
aaacggtatggaggtt

SEQ ID NO: 184236 - DNA, 16 bp, P. troglodytes
aaacgtaattcatcac

SEQ ID NO: 184237 - DNA, 16 bp, P. troglodytes
aaactaaaaacttttg

SEQ ID NO: 184238 - DNA, 16 bp, P. troglodytes
aaactaaacttttttt

SEQ ID NO: 184239 - DNA, 16 bp, P. troglodytes
aaactaaagcccagag

SEQ ID NO: 184240 - DNA, 19 bp, P. troglodytes
aaactaaaggcaggtagcc

SEQ ID NO: 184241 - DNA, 16 bp, P. troglodytes
aaactaaagggcttct

SEQ ID NO: 184242 - DNA, 16 bp, P. troglodytes
aaactaagactcagag

SEQ ID NO: 184243 - DNA, 16 bp, P. troglodytes
aaactaagatttaaaa

SEQ ID NO: 184244 - DNA, 16 bp, P. troglodytes
aaactaagattttttt

SEQ ID NO: 184245 - DNA, 16 bp, P. troglodytes
aaactaaggctcagaa

SEQ ID NO: 184246 - DNA, 16 bp, P. troglodytes
aaactaatacaggaat

SEQ ID NO: 184247 - DNA, 16 bp, P. troglodytes
aaactaatctgtggtg

SEQ ID NO: 184248 - DNA, 16 bp, P. troglodytes
aaactaatggaagata

SEQ ID NO: 184249 - DNA, 16 bp, P. troglodytes
aaactacaatgtctga

SEQ ID NO: 184250 - DNA, 16 bp, P. troglodytes
aaactacacactagac

SEQ ID NO: 184251 - DNA, 16 bp, P. troglodytes
aaactacatttcacct

SEQ ID NO: 184252 - DNA, 16 bp, P. troglodytes
aaactacctttgaaaa

SEQ ID NO: 184253 - DNA, 16 bp, P. troglodytes
aaactactagaagaaa

SEQ ID NO: 184254 - DNA, 16 bp, P. troglodytes
aaactacttgaaattt

SEQ ID NO: 184255 - DNA, 17 bp, P. troglodytes
aaactagaaaacctaga

SEQ ID NO: 184256 - DNA, 16 bp, P. troglodytes
aaactagaaaagcaag

SEQ ID NO: 184257 - DNA, 16 bp, P. troglodytes
aaactagaaaatcaag

SEQ ID NO: 184258 - DNA, 16 bp, P. troglodytes
aaactaggaagaagcc

SEQ ID NO: 184259 - DNA, 16 bp, P. troglodytes
aaactaggagtagaag

SEQ ID NO: 184260 - DNA, 16 bp, P. troglodytes
aaactaggcatagaag

SEQ ID NO: 184261 - DNA, 17 bp, P. troglodytes
aaactagttccaccatt

SEQ ID NO: 184262 - DNA, 16 bp, P. troglodytes
aaactataaaaaccct

SEQ ID NO: 184263 - DNA, 16 bp, P. troglodytes
aaactatcctaaatat

SEQ ID NO: 184264 - DNA, 16 bp, P. troglodytes
aaactatctcaagaac

SEQ ID NO: 184265 - DNA, 16 bp, P. troglodytes
aaactatgaaaattct

SEQ ID NO: 184266 - DNA, 16 bp, P. troglodytes
aaactattaaactatt

SEQ ID NO: 184267 - DNA, 16 bp, P. troglodytes
aaactattacaagaaa

SEQ ID NO: 184268 - DNA, 16 bp, P. troglodytes
aaactattagaaatga

SEQ ID NO: 184269 - DNA, 16 bp, P. troglodytes
aaactattcaaaatga

SEQ ID NO: 184270 - DNA, 16 bp, P. troglodytes
aaactattcatttgac

SEQ ID NO: 184271 - DNA, 16 bp, P. troglodytes
aaactattccaataaa

SEQ ID NO: 184272 - DNA, 16 bp, P. troglodytes
aaactattcttagctc

SEQ ID NO: 184273 - DNA, 16 bp, P. troglodytes
aaactatttttcagag

SEQ ID NO: 184274 - DNA, 16 bp, P. troglodytes
aaactcaaatgccttt

SEQ ID NO: 184275 - DNA, 16 bp, P. troglodytes
aaactcaacagcaaaa

SEQ ID NO: 184276 - DNA, 16 bp, P. troglodytes
aaactcacagaagcag

SEQ ID NO: 184277 - DNA, 16 bp, P. troglodytes
aaactcagaaagccaa

SEQ ID NO: 184278 - DNA, 16 bp, P. troglodytes
aaactcagagaaaaat

SEQ ID NO: 184279 - DNA, 16 bp, P. troglodytes
aaactcagagaaattc

SEQ ID NO: 184280 - DNA, 16 bp, P. troglodytes
aaactcatagaagaaa

SEQ ID NO: 184281 - DNA, 16 bp, P. troglodytes
aaactcattcttcatc

SEQ ID NO: 184282 - DNA, 16 bp, P. troglodytes
aaactcattttctttt

SEQ ID NO: 184283 - DNA, 16 bp, P. troglodytes
aaactccatctcaaaa

SEQ ID NO: 184284 - DNA, 18 bp, P. troglodytes
aaactccatctcaaaaat

SEQ ID NO: 184285 - DNA, 16 bp, P. troglodytes
aaactccatcttaaaa

SEQ ID NO: 184286 - DNA, 16 bp, P. troglodytes
aaactcccaggctcaa

SEQ ID NO: 184287 - DNA, 16 bp, P. troglodytes
aaactcccattcacaa

SEQ ID NO: 184288 - DNA, 18 bp, P. troglodytes
aaactccgtctctaccaa

SEQ ID NO: 184289 - DNA, 17 bp, P. troglodytes
aaactcctgacctcaga

SEQ ID NO: 184290 - DNA, 16 bp, P. troglodytes
aaactcctgcagctag

SEQ ID NO: 184291 - DNA, 16 bp, P. troglodytes
aaactcctggactcat

SEQ ID NO: 184292 - DNA, 16 bp, P. troglodytes
aaactcctggactcca

SEQ ID NO: 184293 - DNA, 16 bp, P. troglodytes
aaactcctggccgcaa

SEQ ID NO: 184294 - DNA, 16 bp, P. troglodytes
aaactcctggccttaa

SEQ ID NO: 184295 - DNA, 16 bp, P. troglodytes
aaactcctgggcacaa

SEQ ID NO: 184296 - DNA, 17 bp, P. troglodytes
aaactcctgggctcagt

SEQ ID NO: 184297 - DNA, 16 bp, P. troglodytes
aaactcctgttaatgt

SEQ ID NO: 184298 - DNA, 16 bp, P. troglodytes
aaactccttgagggca

SEQ ID NO: 184299 - DNA, 16 bp, P. troglodytes
aaactcctttttaaaa

SEQ ID NO: 184300 - DNA, 16 bp, P. troglodytes
aaactctaaacagacc

SEQ ID NO: 184301 - DNA, 16 bp, P. troglodytes
aaactctgaaaagcag

SEQ ID NO: 184302 - DNA, 16 bp, P. troglodytes
aaactctgcttttaaa

SEQ ID NO: 184303 - DNA, 16 bp, P. troglodytes
aaactctgtccctact

SEQ ID NO: 184304 - DNA, 16 bp, P. troglodytes
aaactctgtctcaaca

SEQ ID NO: 184305 - DNA, 16 bp, P. troglodytes
aaactctgtctcaatt

SEQ ID NO: 184306 - DNA, 16 bp, P. troglodytes
aaactctgtctcagaa

SEQ ID NO: 184307 - DNA, 16 bp, P. troglodytes
aaactctgtctctatt

SEQ ID NO: 184308 - DNA, 16 bp, P. troglodytes
aaactctgtttaaaaa

SEQ ID NO: 184309 - DNA, 16 bp, P. troglodytes
aaactcttagaagata

SEQ ID NO: 184310 - DNA, 16 bp, P. troglodytes
aaactcttcagtttaa

SEQ ID NO: 184311 - DNA, 16 bp, P. troglodytes
aaactcttgacctcag

SEQ ID NO: 184312 - DNA, 16 bp, P. troglodytes
aaactcttgggcccaa

SEQ ID NO: 184313 - DNA, 16 bp, P. troglodytes
aaactcttgggctgaa

SEQ ID NO: 184314 - DNA, 16 bp, P. troglodytes
aaactcttgtgctcaa

SEQ ID NO: 184315 - DNA, 16 bp, P. troglodytes
aaactctttgaagaaa

SEQ ID NO: 184316 - DNA, 16 bp, P. troglodytes
aaactgaaaaattagc

SEQ ID NO: 184317 - DNA, 16 bp, P. troglodytes
aaactgaaaaggagaa

SEQ ID NO: 184318 - DNA, 16 bp, P. troglodytes
aaactgaaaatagagc

SEQ ID NO: 184319 - DNA, 16 bp, P. troglodytes
aaactgaaaatgaaat

SEQ ID NO: 184320 - DNA, 16 bp, P. troglodytes
aaactgaaacagagag

SEQ ID NO: 184321 - DNA, 16 bp, P. troglodytes
aaactgaaactctgca

SEQ ID NO: 184322 - DNA, 16 bp, P. troglodytes
aaactgaaagagaaat

SEQ ID NO: 184323 - DNA, 16 bp, P. troglodytes
aaactgaaagcagaaa

SEQ ID NO: 184324 - DNA, 16 bp, P. troglodytes
aaactgaaataaaatt

SEQ ID NO: 184325 - DNA, 16 bp, P. troglodytes
aaactgaaatgaagaa

SEQ ID NO: 184326 - DNA, 16 bp, P. troglodytes
aaactgaaatggaaaa

SEQ ID NO: 184327 - DNA, 16 bp, P. troglodytes
aaactgaaattttaaa

SEQ ID NO: 184328 - DNA, 16 bp, P. troglodytes
aaactgaaatttttat

SEQ ID NO: 184329 - DNA, 16 bp, P. troglodytes
aaactgaactcctgat

SEQ ID NO: 184330 - DNA, 16 bp, P. troglodytes
aaactgaagaaagaat

SEQ ID NO: 184331 - DNA, 16 bp, P. troglodytes
aaactgaagaagacac

SEQ ID NO: 184332 - DNA, 16 bp, P. troglodytes
aaactgaagaatgcat

SEQ ID NO: 184333 - DNA, 16 bp, P. troglodytes
aaactgaagcacaggg

SEQ ID NO: 184334 - DNA, 16 bp, P. troglodytes
aaactgaagcccagag

SEQ ID NO: 184335 - DNA, 16 bp, P. troglodytes
aaactgaagctaagag

SEQ ID NO: 184336 - DNA, 16 bp, P. troglodytes
aaactgaagctcagag

SEQ ID NO: 184337 - DNA, 16 bp, P. troglodytes
aaactgaaggagaaat

SEQ ID NO: 184338 - DNA, 16 bp, P. troglodytes
aaactgaagtacaaag

SEQ ID NO: 184339 - DNA, 16 bp, P. troglodytes
aaactgaagtttaaaa

SEQ ID NO: 184340 - DNA, 16 bp, P. troglodytes
aaactgaatacagcag

SEQ ID NO: 184341 - DNA, 16 bp, P. troglodytes
aaactgaatgcattta

SEQ ID NO: 184342 - DNA, 16 bp, P. troglodytes
aaactgaatttttctt

SEQ ID NO: 184343 - DNA, 16 bp, P. troglodytes
aaactgacaaacagaa

SEQ ID NO: 184344 - DNA, 16 bp, P. troglodytes
aaactgacaaaccttt

SEQ ID NO: 184345 - DNA, 16 bp, P. troglodytes
aaactgaccacatagt

SEQ ID NO: 184346 - DNA, 16 bp, P. troglodytes
aaactgagacccagag

SEQ ID NO: 184347 - DNA, 16 bp, P. troglodytes
aaactgagatttagag

SEQ ID NO: 184348 - DNA, 16 bp, P. troglodytes
aaactgagcagaaggt

SEQ ID NO: 184349 - DNA, 16 bp, P. troglodytes
aaactgaggaagaaag

SEQ ID NO: 184350 - DNA, 16 bp, P. troglodytes
aaactgaggaggaggg

SEQ ID NO: 184351 - DNA, 16 bp, P. troglodytes
aaactgaggcacacag

SEQ ID NO: 184352 - DNA, 16 bp, P. troglodytes
aaactgaggcacaggg

SEQ ID NO: 184353 - DNA, 16 bp, P. troglodytes
aaactgaggcaccaag

SEQ ID NO: 184354 - DNA, 16 bp, P. troglodytes
aaactgaggcaggagg

SEQ ID NO: 184355 - DNA, 16 bp, P. troglodytes
aaactgaggcccagag

SEQ ID NO: 184356 - DNA, 16 bp, P. troglodytes
aaactgaggctcaaag

SEQ ID NO: 184357 - DNA, 16 bp, P. troglodytes
aaactgaggctcagag

SEQ ID NO: 184358 - DNA, 16 bp, P. troglodytes
aaactgaggctcagga

SEQ ID NO: 184359 - DNA, 16 bp, P. troglodytes
aaactgaggctcgggg

SEQ ID NO: 184360 - DNA, 16 bp, P. troglodytes
aaactgaggctctgag

SEQ ID NO: 184361 - DNA, 16 bp, P. troglodytes
aaactgaggctggagg

SEQ ID NO: 184362 - DNA, 16 bp, P. troglodytes
aaactgaggcttaaag

SEQ ID NO: 184363 - DNA, 16 bp, P. troglodytes
aaactgaggcttagtg

SEQ ID NO: 184364 - DNA, 16 bp, P. troglodytes
aaactgaggtacaaag

SEQ ID NO: 184365 - DNA, 16 bp, P. troglodytes
aaactgaggtctggag

SEQ ID NO: 184366 - DNA, 16 bp, P. troglodytes
aaactgaggttcagag

SEQ ID NO: 184367 - DNA, 16 bp, P. troglodytes
aaactgagtccaacac

SEQ ID NO: 184368 - DNA, 16 bp, P. troglodytes
aaactgagtctcagag

SEQ ID NO: 184369 - DNA, 16 bp, P. troglodytes
aaactgatattttaaa

SEQ ID NO: 184370 - DNA, 16 bp, P. troglodytes
aaactgatgcacagag

SEQ ID NO: 184371 - DNA, 16 bp, P. troglodytes
aaactgattttaaaaa

SEQ ID NO: 184372 - DNA, 17 bp, P. troglodytes
aaactgcaattactttt

SEQ ID NO: 184373 - DNA, 16 bp, P. troglodytes
aaactgcatatattta

SEQ ID NO: 184374 - DNA, 16 bp, P. troglodytes
aaactgcatctctaca

SEQ ID NO: 184375 - DNA, 16 bp, P. troglodytes
aaactgcatgtcatgg

SEQ ID NO: 184376 - DNA, 16 bp, P. troglodytes
aaactgccaacaaaaa

SEQ ID NO: 184377 - DNA, 16 bp, P. troglodytes
aaactgcccccattat

SEQ ID NO: 184378 - DNA, 16 bp, P. troglodytes
aaactgcctttccctg

SEQ ID NO: 184379 - DNA, 16 bp, P. troglodytes
aaactgctaaatcaaa

SEQ ID NO: 184380 - DNA, 16 bp, P. troglodytes
aaactgctctgtgatg

SEQ ID NO: 184381 - DNA, 16 bp, P. troglodytes
aaactgctgaaagaaa

SEQ ID NO: 184382 - DNA, 16 bp, P. troglodytes
aaactgctgaataaaa

SEQ ID NO: 184383 - DNA, 17 bp, P. troglodytes
aaactgctgggattaca

SEQ ID NO: 184384 - DNA, 16 bp, P. troglodytes
aaactgctggtgcctt

SEQ ID NO: 184385 - DNA, 16 bp, P. troglodytes
aaactgctttgggatg

SEQ ID NO: 184386 - DNA, 16 bp, P. troglodytes
aaactgctttgtgaag

SEQ ID NO: 184387 - DNA, 16 bp, P. troglodytes
aaactggaaaagacaa

SEQ ID NO: 184388 - DNA, 16 bp, P. troglodytes
aaactggaaaagagga

SEQ ID NO: 184389 - DNA, 16 bp, P. troglodytes
aaactggaaagaagaa

SEQ ID NO: 184390 - DNA, 16 bp, P. troglodytes
aaactggacttcatta

SEQ ID NO: 184391 - DNA, 16 bp, P. troglodytes
aaactggagaaatcac

SEQ ID NO: 184392 - DNA, 16 bp, P. troglodytes
aaactggagaaccagg

SEQ ID NO: 184393 - DNA, 16 bp, P. troglodytes
aaactggaggcatcac

SEQ ID NO: 184394 - DNA, 16 bp, P. troglodytes
aaactggatttaaaaa

SEQ ID NO: 184395 - DNA, 16 bp, P. troglodytes
aaactggattttaaaa

SEQ ID NO: 184396 - DNA, 20 bp, P. troglodytes
aaactggccataaacaaaat

SEQ ID NO: 184397 - DNA, 16 bp, P. troglodytes
aaactgggaggtggaa

SEQ ID NO: 184398 - DNA, 16 bp, P. troglodytes
aaactgggggaaaaaa

SEQ ID NO: 184399 - DNA, 16 bp, P. troglodytes
aaactgggtaatttat

SEQ ID NO: 184400 - DNA, 16 bp, P. troglodytes
aaactgggtgaagggt

SEQ ID NO: 184401 - DNA, 16 bp, P. troglodytes
aaactgggtgacagag

SEQ ID NO: 184402 - DNA, 16 bp, P. troglodytes
aaactgtaaatatttt

SEQ ID NO: 184403 - DNA, 16 bp, P. troglodytes
aaactgtagaaaataa

SEQ ID NO: 184404 - DNA, 16 bp, P. troglodytes
aaactgtagaagaaaa

SEQ ID NO: 184405 - DNA, 16 bp, P. troglodytes
aaactgtatcaactaa

SEQ ID NO: 184406 - DNA, 16 bp, P. troglodytes
aaactgtcacagtcaa

SEQ ID NO: 184407 - DNA, 16 bp, P. troglodytes
aaactgtctttttttt

SEQ ID NO: 184408 - DNA, 16 bp, P. troglodytes
aaactgtggctcagag

SEQ ID NO: 184409 - DNA, 16 bp, P. troglodytes
aaactgtgttcaaata

SEQ ID NO: 184410 - DNA, 16 bp, P. troglodytes
aaactgtgtttccaaa

SEQ ID NO: 184411 - DNA, 17 bp, P. troglodytes
aaactgttccaacctct

SEQ ID NO: 184412 - DNA, 16 bp, P. troglodytes
aaactgtttaaataaa

SEQ ID NO: 184413 - DNA, 16 bp, P. troglodytes
aaactgtttcttcagt

SEQ ID NO: 184414 - DNA, 16 bp, P. troglodytes
aaactgttttcatttt

SEQ ID NO: 184415 - DNA, 16 bp, P. troglodytes
aaactgttttcttttt

SEQ ID NO: 184416 - DNA, 16 bp, P. troglodytes
aaactgttttgttttg

SEQ ID NO: 184417 - DNA, 16 bp, P. troglodytes
aaactgtttttcaaaa

SEQ ID NO: 184418 - DNA, 16 bp, P. troglodytes
aaactgttttttcttt

SEQ ID NO: 184419 - DNA, 16 bp, P. troglodytes
aaactgtttttttaaa

SEQ ID NO: 184420 - DNA, 16 bp, P. troglodytes
aaacttaaaagttttt

SEQ ID NO: 184421 - DNA, 16 bp, P. troglodytes
aaacttaaatgtccct

SEQ ID NO: 184422 - DNA, 16 bp, P. troglodytes
aaacttaactcaaaat

SEQ ID NO: 184423 - DNA, 16 bp, P. troglodytes
aaacttaattgataaa

SEQ ID NO: 184424 - DNA, 16 bp, P. troglodytes
aaacttagaagcttaa

SEQ ID NO: 184425 - DNA, 16 bp, P. troglodytes
aaacttagtggctaaa

SEQ ID NO: 184426 - DNA, 16 bp, P. troglodytes
aaacttagtggcttaa

SEQ ID NO: 184427 - DNA, 16 bp, P. troglodytes
aaacttatttctcatt

SEQ ID NO: 184428 - DNA, 16 bp, P. troglodytes
aaacttcagaagaaaa

SEQ ID NO: 184429 - DNA, 16 bp, P. troglodytes
aaacttcatactgttt

SEQ ID NO: 184430 - DNA, 16 bp, P. troglodytes
aaacttcattgctgtc

SEQ ID NO: 184431 - DNA, 16 bp, P. troglodytes
aaacttccaggctcaa

SEQ ID NO: 184432 - DNA, 16 bp, P. troglodytes
aaacttccccaggtct

SEQ ID NO: 184433 - DNA, 16 bp, P. troglodytes
aaacttcgtctcaaaa

SEQ ID NO: 184434 - DNA, 16 bp, P. troglodytes
aaacttctaaaaacta

SEQ ID NO: 184435 - DNA, 16 bp, P. troglodytes
aaacttctagaaataa

SEQ ID NO: 184436 - DNA, 16 bp, P. troglodytes
aaacttctgcctcctg

SEQ ID NO: 184437 - DNA, 16 bp, P. troglodytes
aaacttctgctctgtg

SEQ ID NO: 184438 - DNA, 16 bp, P. troglodytes
aaacttctgctcttca

SEQ ID NO: 184439 - DNA, 16 bp, P. troglodytes
aaacttctgggataca

SEQ ID NO: 184440 - DNA, 16 bp, P. troglodytes
aaacttcttctcaaaa

SEQ ID NO: 184441 - DNA, 16 bp, P. troglodytes
aaacttctttctcttt

SEQ ID NO: 184442 - DNA, 16 bp, P. troglodytes
aaacttgaagaaaata

SEQ ID NO: 184443 - DNA, 16 bp, P. troglodytes
aaacttgaaggaaaaa

SEQ ID NO: 184444 - DNA, 16 bp, P. troglodytes
aaacttgaatgtaaat

SEQ ID NO: 184445 - DNA, 16 bp, P. troglodytes
aaacttgattttattt

SEQ ID NO: 184446 - DNA, 16 bp, P. troglodytes
aaacttggaaaataaa

SEQ ID NO: 184447 - DNA, 16 bp, P. troglodytes
aaacttggaaagaaaa

SEQ ID NO: 184448 - DNA, 16 bp, P. troglodytes
aaacttggaaataaaa

SEQ ID NO: 184449 - DNA, 16 bp, P. troglodytes
aaacttggcagagaca

SEQ ID NO: 184450 - DNA, 16 bp, P. troglodytes
aaacttgtatatattt

SEQ ID NO: 184451 - DNA, 16 bp, P. troglodytes
aaacttgtttttattt

SEQ ID NO: 184452 - DNA, 16 bp, P. troglodytes
aaacttgtttttcttt

SEQ ID NO: 184453 - DNA, 16 bp, P. troglodytes
aaacttgtttttttaa

SEQ ID NO: 184454 - DNA, 16 bp, P. troglodytes
aaactttaaaaactag

SEQ ID NO: 184455 - DNA, 16 bp, P. troglodytes
aaactttaaaaagcat

SEQ ID NO: 184456 - DNA, 16 bp, P. troglodytes
aaactttaaaagttaa

SEQ ID NO: 184457 - DNA, 16 bp, P. troglodytes
aaactttaccttttga

SEQ ID NO: 184458 - DNA, 16 bp, P. troglodytes
aaactttagaatcagc

SEQ ID NO: 184459 - DNA, 16 bp, P. troglodytes
aaactttatttgtaaa

SEQ ID NO: 184460 - DNA, 16 bp, P. troglodytes
aaactttatttttgtt

SEQ ID NO: 184461 - DNA, 16 bp, P. troglodytes
aaactttcaaagaaaa

SEQ ID NO: 184462 - DNA, 16 bp, P. troglodytes
aaactttcacacattt

SEQ ID NO: 184463 - DNA, 16 bp, P. troglodytes
aaactttcatcttaga

SEQ ID NO: 184464 - DNA, 16 bp, P. troglodytes
aaactttcatgctctg

SEQ ID NO: 184465 - DNA, 16 bp, P. troglodytes
aaactttccaaacttt

SEQ ID NO: 184466 - DNA, 16 bp, P. troglodytes
aaactttccctgttca

SEQ ID NO: 184467 - DNA, 16 bp, P. troglodytes
aaactttcctcttaac

SEQ ID NO: 184468 - DNA, 16 bp, P. troglodytes
aaactttctccatgtc

SEQ ID NO: 184469 - DNA, 16 bp, P. troglodytes
aaactttctgtaaagg

SEQ ID NO: 184470 - DNA, 16 bp, P. troglodytes
aaactttcttttaaaa

SEQ ID NO: 184471 - DNA, 16 bp, P. troglodytes
aaactttcttttcatt

SEQ ID NO: 184472 - DNA, 16 bp, P. troglodytes
aaactttgaaaaataa

SEQ ID NO: 184473 - DNA, 16 bp, P. troglodytes
aaactttgaaaacatt

SEQ ID NO: 184474 - DNA, 16 bp, P. troglodytes
aaactttgcctcccgg

SEQ ID NO: 184475 - DNA, 16 bp, P. troglodytes
aaactttgtacacttt

SEQ ID NO: 184476 - DNA, 18 bp, P. troglodytes
aaactttgtctcaaaaaa

SEQ ID NO: 184477 - DNA, 16 bp, P. troglodytes
aaacttttaaaagata

SEQ ID NO: 184478 - DNA, 16 bp, P. troglodytes
aaacttttaaaataga

SEQ ID NO: 184479 - DNA, 16 bp, P. troglodytes
aaacttttaaactttt

SEQ ID NO: 184480 - DNA, 16 bp, P. troglodytes
aaacttttaaatttct

SEQ ID NO: 184481 - DNA, 16 bp, P. troglodytes
aaacttttagaaaaca

SEQ ID NO: 184482 - DNA, 16 bp, P. troglodytes
aaacttttatactctg

SEQ ID NO: 184483 - DNA, 16 bp, P. troglodytes
aaacttttatttcaaa

SEQ ID NO: 184484 - DNA, 16 bp, P. troglodytes
aaacttttattttgaa

SEQ ID NO: 184485 - DNA, 16 bp, P. troglodytes
aaacttttcaaaattt

SEQ ID NO: 184486 - DNA, 16 bp, P. troglodytes
aaacttttcaaacttt

SEQ ID NO: 184487 - DNA, 16 bp, P. troglodytes
aaacttttccaaaaaa

SEQ ID NO: 184488 - DNA, 16 bp, P. troglodytes
aaacttttcctgtaaa

SEQ ID NO: 184489 - DNA, 16 bp, P. troglodytes
aaacttttcctttgca

SEQ ID NO: 184490 - DNA, 16 bp, P. troglodytes
aaacttttctataaaa

SEQ ID NO: 184491 - DNA, 16 bp, P. troglodytes
aaacttttctttaaaa

SEQ ID NO: 184492 - DNA, 16 bp, P. troglodytes
aaacttttcttttgat

SEQ ID NO: 184493 - DNA, 16 bp, P. troglodytes
aaactttttagttttt

SEQ ID NO: 184494 - DNA, 16 bp, P. troglodytes
aaactttttatctgag

SEQ ID NO: 184495 - DNA, 16 bp, P. troglodytes
aaactttttattttgg

SEQ ID NO: 184496 - DNA, 16 bp, P. troglodytes
aaactttttccaaaaa

SEQ ID NO: 184497 - DNA, 16 bp, P. troglodytes
aaactttttccataaa

SEQ ID NO: 184498 - DNA, 16 bp, P. troglodytes
aaactttttctataaa

SEQ ID NO: 184499 - DNA, 16 bp, P. troglodytes
aaactttttctgtaaa

SEQ ID NO: 184500 - DNA, 16 bp, P. troglodytes
aaactttttgttgttt

SEQ ID NO: 184501 - DNA, 16 bp, P. troglodytes
aaacttttttaaacat

SEQ ID NO: 184502 - DNA, 16 bp, P. troglodytes
aaacttttttgttaaa

SEQ ID NO: 184503 - DNA, 16 bp, P. troglodytes
aaacttttttgttatt

SEQ ID NO: 184504 - DNA, 16 bp, P. troglodytes
aaacttttttgtttgt

SEQ ID NO: 184505 - DNA, 16 bp, P. troglodytes
aaagaaaaaaaccttg

SEQ ID NO: 184506 - DNA, 16 bp, P. troglodytes
aaagaaaaaaatttct

SEQ ID NO: 184507 - DNA, 16 bp, P. troglodytes
aaagaaaaaagtcttg

SEQ ID NO: 184508 - DNA, 16 bp, P. troglodytes
aaagaaaaaagtgact

SEQ ID NO: 184509 - DNA, 16 bp, P. troglodytes
aaagaaaaaatattcc

SEQ ID NO: 184510 - DNA, 16 bp, P. troglodytes
aaagaaaaaatgatct

SEQ ID NO: 184511 - DNA, 16 bp, P. troglodytes
aaagaaaaaatgcttt

SEQ ID NO: 184512 - DNA, 16 bp, P. troglodytes
aaagaaaaaattagct

SEQ ID NO: 184513 - DNA, 16 bp, P. troglodytes
aaagaaaaacatattt

SEQ ID NO: 184514 - DNA, 16 bp, P. troglodytes
aaagaaaaacatttta

SEQ ID NO: 184515 - DNA, 16 bp, P. troglodytes
aaagaaaaacttattt

SEQ ID NO: 184516 - DNA, 16 bp, P. troglodytes
aaagaaaaacttcaca

SEQ ID NO: 184517 - DNA, 16 bp, P. troglodytes
aaagaaaaacttcaga

SEQ ID NO: 184518 - DNA, 16 bp, P. troglodytes
aaagaaaaacttcttt

SEQ ID NO: 184519 - DNA, 16 bp, P. troglodytes
aaagaaaaagaatctt

SEQ ID NO: 184520 - DNA, 16 bp, P. troglodytes
aaagaaaaagaatgct

SEQ ID NO: 184521 - DNA, 16 bp, P. troglodytes
aaagaaaaagacattt

SEQ ID NO: 184522 - DNA, 16 bp, P. troglodytes
aaagaaaaagactttt

SEQ ID NO: 184523 - DNA, 16 bp, P. troglodytes
aaagaaaaagatattc

SEQ ID NO: 184524 - DNA, 16 bp, P. troglodytes
aaagaaaaagattttc

SEQ ID NO: 184525 - DNA, 16 bp, P. troglodytes
aaagaaaaagcactga

SEQ ID NO: 184526 - DNA, 16 bp, P. troglodytes
aaagaaaaagcatttg

SEQ ID NO: 184527 - DNA, 16 bp, P. troglodytes
aaagaaaaagcccagg

SEQ ID NO: 184528 - DNA, 16 bp, P. troglodytes
aaagaaaaagctttct

SEQ ID NO: 184529 - DNA, 16 bp, P. troglodytes
aaagaaaaaggatttt

SEQ ID NO: 184530 - DNA, 16 bp, P. troglodytes
aaagaaaaagggttta

SEQ ID NO: 184531 - DNA, 16 bp, P. troglodytes
aaagaaaaagtggttt

SEQ ID NO: 184532 - DNA, 16 bp, P. troglodytes
aaagaaaaatacaggt

SEQ ID NO: 184533 - DNA, 16 bp, P. troglodytes
aaagaaaaatatccac

SEQ ID NO: 184534 - DNA, 16 bp, P. troglodytes
aaagaaaaatatcttg

SEQ ID NO: 184535 - DNA, 16 bp, P. troglodytes
aaagaaaaatatcttt

SEQ ID NO: 184536 - DNA, 16 bp, P. troglodytes
aaagaaaaatctattt

SEQ ID NO: 184537 - DNA, 16 bp, P. troglodytes
aaagaaaaatctgtat

SEQ ID NO: 184538 - DNA, 16 bp, P. troglodytes
aaagaaaaatctgttt

SEQ ID NO: 184539 - DNA, 16 bp, P. troglodytes
aaagaaaaattactga

SEQ ID NO: 184540 - DNA, 16 bp, P. troglodytes
aaagaaaaattcacat

SEQ ID NO: 184541 - DNA, 16 bp, P. troglodytes
aaagaaaaattcttca

SEQ ID NO: 184542 - DNA, 16 bp, P. troglodytes
aaagaaaaattctttt

SEQ ID NO: 184543 - DNA, 16 bp, P. troglodytes
aaagaaaaatttcttt

SEQ ID NO: 184544 - DNA, 16 bp, P. troglodytes
aaagaaaacaaagttt

SEQ ID NO: 184545 - DNA, 16 bp, P. troglodytes
aaagaaaacaaatctt

SEQ ID NO: 184546 - DNA, 16 bp, P. troglodytes
aaagaaaacaactttt

SEQ ID NO: 184547 - DNA, 16 bp, P. troglodytes
aaagaaaacaatttct

SEQ ID NO: 184548 - DNA, 16 bp, P. troglodytes
aaagaaaacagaagtg

SEQ ID NO: 184549 - DNA, 16 bp, P. troglodytes
aaagaaaacagtttca

SEQ ID NO: 184550 - DNA, 16 bp, P. troglodytes
aaagaaaacataggga

SEQ ID NO: 184551 - DNA, 16 bp, P. troglodytes
aaagaaaacatatttt

SEQ ID NO: 184552 - DNA, 16 bp, P. troglodytes
aaagaaaacatgatat

SEQ ID NO: 184553 - DNA, 16 bp, P. troglodytes
aaagaaaacatggtaa

SEQ ID NO: 184554 - DNA, 16 bp, P. troglodytes
aaagaaaacatggtat

SEQ ID NO: 184555 - DNA, 16 bp, P. troglodytes
aaagaaaacatgtttt

SEQ ID NO: 184556 - DNA, 16 bp, P. troglodytes
aaagaaaacattagga

SEQ ID NO: 184557 - DNA, 16 bp, P. troglodytes
aaagaaaacattgttt

SEQ ID NO: 184558 - DNA, 16 bp, P. troglodytes
aaagaaaacatttaca

SEQ ID NO: 184559 - DNA, 16 bp, P. troglodytes
aaagaaaacatttcaa

SEQ ID NO: 184560 - DNA, 16 bp, P. troglodytes
aaagaaaacatttgct

SEQ ID NO: 184561 - DNA, 16 bp, P. troglodytes
aaagaaaacatttgga

SEQ ID NO: 184562 - DNA, 16 bp, P. troglodytes
aaagaaaacatttgtt

SEQ ID NO: 184563 - DNA, 16 bp, P. troglodytes
aaagaaaacatttttg

SEQ ID NO: 184564 - DNA, 16 bp, P. troglodytes
aaagaaaaccacattt

SEQ ID NO: 184565 - DNA, 16 bp, P. troglodytes
aaagaaaaccccatca

SEQ ID NO: 184566 - DNA, 16 bp, P. troglodytes
aaagaaaactaattta

SEQ ID NO: 184567 - DNA, 16 bp, P. troglodytes
aaagaaaactgaggaa

SEQ ID NO: 184568 - DNA, 16 bp, P. troglodytes
aaagaaaactgtcttt

SEQ ID NO: 184569 - DNA, 16 bp, P. troglodytes
aaagaaaacttccaaa

SEQ ID NO: 184570 - DNA, 16 bp, P. troglodytes
aaagaaaacttttttt

SEQ ID NO: 184571 - DNA, 16 bp, P. troglodytes
aaagaaaagaaagctg

SEQ ID NO: 184572 - DNA, 16 bp, P. troglodytes
aaagaaaagaaaggct

SEQ ID NO: 184573 - DNA, 16 bp, P. troglodytes
aaagaaaagaaatctc

SEQ ID NO: 184574 - DNA, 16 bp, P. troglodytes
aaagaaaagaaattct

SEQ ID NO: 184575 - DNA, 16 bp, P. troglodytes
aaagaaaagaaatttc

SEQ ID NO: 184576 - DNA, 16 bp, P. troglodytes
aaagaaaagaatttct

SEQ ID NO: 184577 - DNA, 16 bp, P. troglodytes
aaagaaaagacatcca

SEQ ID NO: 184578 - DNA, 16 bp, P. troglodytes
aaagaaaagagtttta

SEQ ID NO: 184579 - DNA, 16 bp, P. troglodytes
aaagaaaagcattttt

SEQ ID NO: 184580 - DNA, 16 bp, P. troglodytes
aaagaaaaggacatta

SEQ ID NO: 184581 - DNA, 16 bp, P. troglodytes
aaagaaaaggattttt

SEQ ID NO: 184582 - DNA, 16 bp, P. troglodytes
aaagaaaaggcaatat

SEQ ID NO: 184583 - DNA, 16 bp, P. troglodytes
aaagaaaaggctttca

SEQ ID NO: 184584 - DNA, 16 bp, P. troglodytes
aaagaaaaggtttaat

SEQ ID NO: 184585 - DNA, 16 bp, P. troglodytes
aaagaaaagtctcaaa

SEQ ID NO: 184586 - DNA, 16 bp, P. troglodytes
aaagaaaagttcttaa

SEQ ID NO: 184587 - DNA, 16 bp, P. troglodytes
aaagaaaagtttattt

SEQ ID NO: 184588 - DNA, 16 bp, P. troglodytes
aaagaaaataattctt

SEQ ID NO: 184589 - DNA, 16 bp, P. troglodytes
aaagaaaatacatttg

SEQ ID NO: 184590 - DNA, 16 bp, P. troglodytes
aaagaaaatactgcat

SEQ ID NO: 184591 - DNA, 16 bp, P. troglodytes
aaagaaaatatctgaa

SEQ ID NO: 184592 - DNA, 16 bp, P. troglodytes
aaagaaaatatgcata

SEQ ID NO: 184593 - DNA, 16 bp, P. troglodytes
aaagaaaatattagca

SEQ ID NO: 184594 - DNA, 16 bp, P. troglodytes
aaagaaaatattgttt

SEQ ID NO: 184595 - DNA, 16 bp, P. troglodytes
aaagaaaatatttcat

SEQ ID NO: 184596 - DNA, 16 bp, P. troglodytes
aaagaaaatcattttg

SEQ ID NO: 184597 - DNA, 16 bp, P. troglodytes
aaagaaaatccacaga

SEQ ID NO: 184598 - DNA, 16 bp, P. troglodytes
aaagaaaatctatgaa

SEQ ID NO: 184599 - DNA, 16 bp, P. troglodytes
aaagaaaatctttgaa

SEQ ID NO: 184600 - DNA, 16 bp, P. troglodytes
aaagaaaatctttgag

SEQ ID NO: 184601 - DNA, 16 bp, P. troglodytes
aaagaaaatgaactca

SEQ ID NO: 184602 - DNA, 16 bp, P. troglodytes
aaagaaaatgaagttt

SEQ ID NO: 184603 - DNA, 16 bp, P. troglodytes
aaagaaaatgaatgtg

SEQ ID NO: 184604 - DNA, 16 bp, P. troglodytes
aaagaaaatgacagat

SEQ ID NO: 184605 - DNA, 16 bp, P. troglodytes
aaagaaaatgaggaac

SEQ ID NO: 184606 - DNA, 16 bp, P. troglodytes
aaagaaaatgatcaag

SEQ ID NO: 184607 - DNA, 16 bp, P. troglodytes
aaagaaaatgcttata

SEQ ID NO: 184608 - DNA, 16 bp, P. troglodytes
aaagaaaatggtacat

SEQ ID NO: 184609 - DNA, 16 bp, P. troglodytes
aaagaaaatgtcttat

SEQ ID NO: 184610 - DNA, 16 bp, P. troglodytes
aaagaaaatgtgccac

SEQ ID NO: 184611 - DNA, 16 bp, P. troglodytes
aaagaaaatgtgggac

SEQ ID NO: 184612 - DNA, 16 bp, P. troglodytes
aaagaaaatgtggtta

SEQ ID NO: 184613 - DNA, 16 bp, P. troglodytes
aaagaaaatgtttatg

SEQ ID NO: 184614 - DNA, 16 bp, P. troglodytes
aaagaaaatgttttat

SEQ ID NO: 184615 - DNA, 16 bp, P. troglodytes
aaagaaaatgttttgt

SEQ ID NO: 184616 - DNA, 16 bp, P. troglodytes
aaagaaaattattttc

SEQ ID NO: 184617 - DNA, 16 bp, P. troglodytes
aaagaaaattcaaatt

SEQ ID NO: 184618 - DNA, 16 bp, P. troglodytes
aaagaaaattcttcag

SEQ ID NO: 184619 - DNA, 16 bp, P. troglodytes
aaagaaacaaaacttg

SEQ ID NO: 184620 - DNA, 16 bp, P. troglodytes
aaagaaacaaactatt

SEQ ID NO: 184621 - DNA, 16 bp, P. troglodytes
aaagaaacaaagtatt

SEQ ID NO: 184622 - DNA, 16 bp, P. troglodytes
aaagaaacaatcatca

SEQ ID NO: 184623 - DNA, 16 bp, P. troglodytes
aaagaaacacaaatgg

SEQ ID NO: 184624 - DNA, 16 bp, P. troglodytes
aaagaaacacctgaga

SEQ ID NO: 184625 - DNA, 16 bp, P. troglodytes
aaagaaacagcagagt

SEQ ID NO: 184626 - DNA, 16 bp, P. troglodytes
aaagaaacagtcaaca

SEQ ID NO: 184627 - DNA, 16 bp, P. troglodytes
aaagaaacattaaatt

SEQ ID NO: 184628 - DNA, 16 bp, P. troglodytes
aaagaaacatttaata

SEQ ID NO: 184629 - DNA, 16 bp, P. troglodytes
aaagaaacatttcaaa

SEQ ID NO: 184630 - DNA, 16 bp, P. troglodytes
aaagaaacatttgaaa

SEQ ID NO: 184631 - DNA, 16 bp, P. troglodytes
aaagaaacattttaag

SEQ ID NO: 184632 - DNA, 16 bp, P. troglodytes
aaagaaacattttaat

SEQ ID NO: 184633 - DNA, 16 bp, P. troglodytes
aaagaaacattttctg

SEQ ID NO: 184634 - DNA, 16 bp, P. troglodytes
aaagaaacatttttca

SEQ ID NO: 184635 - DNA, 16 bp, P. troglodytes
aaagaaaccaccatca

SEQ ID NO: 184636 - DNA, 16 bp, P. troglodytes
aaagaaaccctcaaaa

SEQ ID NO: 184637 - DNA, 16 bp, P. troglodytes
aaagaaactagcaaca

SEQ ID NO: 184638 - DNA, 16 bp, P. troglodytes
aaagaaactatccaca

SEQ ID NO: 184639 - DNA, 16 bp, P. troglodytes
aaagaaactgaagaag

SEQ ID NO: 184640 - DNA, 16 bp, P. troglodytes
aaagaaactgaatttg

SEQ ID NO: 184641 - DNA, 16 bp, P. troglodytes
aaagaaactggaagaa

SEQ ID NO: 184642 - DNA, 16 bp, P. troglodytes
aaagaaactgtatttt

SEQ ID NO: 184643 - DNA, 16 bp, P. troglodytes
aaagaaactgtcaaaa

SEQ ID NO: 184644 - DNA, 16 bp, P. troglodytes
aaagaaactgtcaaca

SEQ ID NO: 184645 - DNA, 16 bp, P. troglodytes
aaagaaactgtggtgt

SEQ ID NO: 184646 - DNA, 16 bp, P. troglodytes
aaagaaactttctaaa

SEQ ID NO: 184647 - DNA, 16 bp, P. troglodytes
aaagaaagaaaacctt

SEQ ID NO: 184648 - DNA, 16 bp, P. troglodytes
aaagaaagaaaagttc

SEQ ID NO: 184649 - DNA, 16 bp, P. troglodytes
aaagaaagaaaatctc

SEQ ID NO: 184650 - DNA, 16 bp, P. troglodytes
aaagaaagaaactgat

SEQ ID NO: 184651 - DNA, 16 bp, P. troglodytes
aaagaaagaaactgtg

SEQ ID NO: 184652 - DNA, 16 bp, P. troglodytes
aaagaaagaaagtcat

SEQ ID NO: 184653 - DNA, 16 bp, P. troglodytes
aaagaaagaaagtgac

SEQ ID NO: 184654 - DNA, 16 bp, P. troglodytes
aaagaaagaaatctgc

SEQ ID NO: 184655 - DNA, 16 bp, P. troglodytes
aaagaaagaaatgtgt

SEQ ID NO: 184656 - DNA, 16 bp, P. troglodytes
aaagaaagaaatgttt

SEQ ID NO: 184657 - DNA, 16 bp, P. troglodytes
aaagaaagaaattact

SEQ ID NO: 184658 - DNA, 16 bp, P. troglodytes
aaagaaagaaattctt

SEQ ID NO: 184659 - DNA, 16 bp, P. troglodytes
aaagaaagaaattttg

SEQ ID NO: 184660 - DNA, 16 bp, P. troglodytes
aaagaaagaacttcag

SEQ ID NO: 184661 - DNA, 16 bp, P. troglodytes
aaagaaagaagattca

SEQ ID NO: 184662 - DNA, 16 bp, P. troglodytes
aaagaaagaatcagca

SEQ ID NO: 184663 - DNA, 16 bp, P. troglodytes
aaagaaagaattttca

SEQ ID NO: 184664 - DNA, 16 bp, P. troglodytes
aaagaaagaattttct

SEQ ID NO: 184665 - DNA, 16 bp, P. troglodytes
aaagaaagactgagga

SEQ ID NO: 184666 - DNA, 16 bp, P. troglodytes
aaagaaagaggccagg

SEQ ID NO: 184667 - DNA, 16 bp, P. troglodytes
aaagaaagaggtcatc

SEQ ID NO: 184668 - DNA, 16 bp, P. troglodytes
aaagaaagatgttctt

SEQ ID NO: 184669 - DNA, 16 bp, P. troglodytes
aaagaaaggaaattct

SEQ ID NO: 184670 - DNA, 16 bp, P. troglodytes
aaagaaaggaagattt

SEQ ID NO: 184671 - DNA, 16 bp, P. troglodytes
aaagaaaggacatcag

SEQ ID NO: 184672 - DNA, 16 bp, P. troglodytes
aaagaaaggatatttt

SEQ ID NO: 184673 - DNA, 16 bp, P. troglodytes
aaagaaaggctgagaa

SEQ ID NO: 184674 - DNA, 16 bp, P. troglodytes
aaagaaaggtttacct

SEQ ID NO: 184675 - DNA, 16 bp, P. troglodytes
aaagaaagtaaatcat

SEQ ID NO: 184676 - DNA, 16 bp, P. troglodytes
aaagaaagtaccatca

SEQ ID NO: 184677 - DNA, 16 bp, P. troglodytes
aaagaaagtggtttcc

SEQ ID NO: 184678 - DNA, 16 bp, P. troglodytes
aaagaaataaacattt

SEQ ID NO: 184679 - DNA, 16 bp, P. troglodytes
aaagaaataaacttct

SEQ ID NO: 184680 - DNA, 16 bp, P. troglodytes
aaagaaataaaggcat

SEQ ID NO: 184681 - DNA, 16 bp, P. troglodytes
aaagaaataatcatca

SEQ ID NO: 184682 - DNA, 16 bp, P. troglodytes
aaagaaatacacattt

SEQ ID NO: 184683 - DNA, 16 bp, P. troglodytes
aaagaaatacagaatt

SEQ ID NO: 184684 - DNA, 16 bp, P. troglodytes
aaagaaatacatgaga

SEQ ID NO: 184685 - DNA, 16 bp, P. troglodytes
aaagaaatacatgttt

SEQ ID NO: 184686 - DNA, 16 bp, P. troglodytes
aaagaaatactggaga

SEQ ID NO: 184687 - DNA, 16 bp, P. troglodytes
aaagaaatacttgaga

SEQ ID NO: 184688 - DNA, 16 bp, P. troglodytes
aaagaaatagcatcaa

SEQ ID NO: 184689 - DNA, 16 bp, P. troglodytes
aaagaaatagctgaga

SEQ ID NO: 184690 - DNA, 16 bp, P. troglodytes
aaagaaatagtcaaat

SEQ ID NO: 184691 - DNA, 16 bp, P. troglodytes
aaagaaatatatacat

SEQ ID NO: 184692 - DNA, 16 bp, P. troglodytes
aaagaaatatattcaa

SEQ ID NO: 184693 - DNA, 16 bp, P. troglodytes
aaagaaatatatttgg

SEQ ID NO: 184694 - DNA, 16 bp, P. troglodytes
aaagaaatcagaaatg

SEQ ID NO: 184695 - DNA, 16 bp, P. troglodytes
aaagaaatcagagaca

SEQ ID NO: 184696 - DNA, 16 bp, P. troglodytes
aaagaaatcagccagg

SEQ ID NO: 184697 - DNA, 16 bp, P. troglodytes
aaagaaatcataaatg

SEQ ID NO: 184698 - DNA, 16 bp, P. troglodytes
aaagaaatcatgtcct

SEQ ID NO: 184699 - DNA, 16 bp, P. troglodytes
aaagaaatcatttaaa

SEQ ID NO: 184700 - DNA, 16 bp, P. troglodytes
aaagaaatcctaaaat

SEQ ID NO: 184701 - DNA, 16 bp, P. troglodytes
aaagaaatcttaaaag

SEQ ID NO: 184702 - DNA, 16 bp, P. troglodytes
aaagaaatcttatttt

SEQ ID NO: 184703 - DNA, 16 bp, P. troglodytes
aaagaaatctttattt

SEQ ID NO: 184704 - DNA, 16 bp, P. troglodytes
aaagaaatgaaattca

SEQ ID NO: 184705 - DNA, 16 bp, P. troglodytes
aaagaaatgaagacag

SEQ ID NO: 184706 - DNA, 16 bp, P. troglodytes
aaagaaatgaattttc

SEQ ID NO: 184707 - DNA, 16 bp, P. troglodytes
aaagaaatgactgaaa

SEQ ID NO: 184708 - DNA, 16 bp, P. troglodytes
aaagaaatgcaagtca

SEQ ID NO: 184709 - DNA, 16 bp, P. troglodytes
aaagaaatgtattttt

SEQ ID NO: 184710 - DNA, 16 bp, P. troglodytes
aaagaaatgtgatttt

SEQ ID NO: 184711 - DNA, 16 bp, P. troglodytes
aaagaaatgtttattt

SEQ ID NO: 184712 - DNA, 16 bp, P. troglodytes
aaagaaatgtttttat

SEQ ID NO: 184713 - DNA, 16 bp, P. troglodytes
aaagaaattagccggg

SEQ ID NO: 184714 - DNA, 16 bp, P. troglodytes
aaagaaattataccaa

SEQ ID NO: 184715 - DNA, 16 bp, P. troglodytes
aaagaaattcaagaag

SEQ ID NO: 184716 - DNA, 16 bp, P. troglodytes
aaagaaattcagaatt

SEQ ID NO: 184717 - DNA, 16 bp, P. troglodytes
aaagaaattcaggaaa

SEQ ID NO: 184718 - DNA, 16 bp, P. troglodytes
aaagaaattcatttct

SEQ ID NO: 184719 - DNA, 16 bp, P. troglodytes
aaagaaattctgtttt

SEQ ID NO: 184720 - DNA, 16 bp, P. troglodytes
aaagaaattgaaaccc

SEQ ID NO: 184721 - DNA, 16 bp, P. troglodytes
aaagaaattgtggttt

SEQ ID NO: 184722 - DNA, 16 bp, P. troglodytes
aaagaaatttaaaggt

SEQ ID NO: 184723 - DNA, 16 bp, P. troglodytes
aaagaaatttcaaatt

SEQ ID NO: 184724 - DNA, 16 bp, P. troglodytes
aaagaaatttcaacca

SEQ ID NO: 184725 - DNA, 16 bp, P. troglodytes
aaagaaatttcaaccc

SEQ ID NO: 184726 - DNA, 16 bp, P. troglodytes
aaagaaatttctgaga

SEQ ID NO: 184727 - DNA, 16 bp, P. troglodytes
aaagaaatttctttaa

SEQ ID NO: 184728 - DNA, 16 bp, P. troglodytes
aaagaaatttcttttt

SEQ ID NO: 184729 - DNA, 16 bp, P. troglodytes
aaagaaattttacaaa

SEQ ID NO: 184730 - DNA, 16 bp, P. troglodytes
aaagaaatttttttct

SEQ ID NO: 184731 - DNA, 16 bp, P. troglodytes
aaagaacaaaactcca

SEQ ID NO: 184732 - DNA, 16 bp, P. troglodytes
aaagaacaaaactgta

SEQ ID NO: 184733 - DNA, 16 bp, P. troglodytes
aaagaacaaagaattt

SEQ ID NO: 184734 - DNA, 16 bp, P. troglodytes
aaagaacaaagccagg

SEQ ID NO: 184735 - DNA, 16 bp, P. troglodytes
aaagaacaaagctaga

SEQ ID NO: 184736 - DNA, 17 bp, P. troglodytes
aaagaacaaagcttcca

SEQ ID NO: 184737 - DNA, 16 bp, P. troglodytes
aaagaacaaatctgaa

SEQ ID NO: 184738 - DNA, 16 bp, P. troglodytes
aaagaacaagatcatg

SEQ ID NO: 184739 - DNA, 16 bp, P. troglodytes
aaagaacaagctggag

SEQ ID NO: 184740 - DNA, 16 bp, P. troglodytes
aaagaacacctacaaa

SEQ ID NO: 184741 - DNA, 16 bp, P. troglodytes
aaagaacacctggaaa

SEQ ID NO: 184742 - DNA, 18 bp, P. troglodytes
aaagaacacctgggaaat

SEQ ID NO: 184743 - DNA, 16 bp, P. troglodytes
aaagaacagaattttt

SEQ ID NO: 184744 - DNA, 16 bp, P. troglodytes
aaagaacaggctgact

SEQ ID NO: 184745 - DNA, 16 bp, P. troglodytes
aaagaacagtaaattt

SEQ ID NO: 184746 - DNA, 16 bp, P. troglodytes
aaagaacataatttca

SEQ ID NO: 184747 - DNA, 16 bp, P. troglodytes
aaagaacatattttaa

SEQ ID NO: 184748 - DNA, 16 bp, P. troglodytes
aaagaacatattttta

SEQ ID NO: 184749 - DNA, 16 bp, P. troglodytes
aaagaacatctttctt

SEQ ID NO: 184750 - DNA, 16 bp, P. troglodytes
aaagaacatgagattt

SEQ ID NO: 184751 - DNA, 16 bp, P. troglodytes
aaagaacatgggcttt

SEQ ID NO: 184752 - DNA, 16 bp, P. troglodytes
aaagaacatttctaaa

SEQ ID NO: 184753 - DNA, 16 bp, P. troglodytes
aaagaacatttttttt

SEQ ID NO: 184754 - DNA, 16 bp, P. troglodytes
aaagaaccaatgcaag

SEQ ID NO: 184755 - DNA, 19 bp, P. troglodytes
aaagaaccttcttaagggt

SEQ ID NO: 184756 - DNA, 16 bp, P. troglodytes
aaagaacctttttttt

SEQ ID NO: 184757 - DNA, 16 bp, P. troglodytes
aaagaactaaaaatgg

SEQ ID NO: 184758 - DNA, 16 bp, P. troglodytes
aaagaactctcaaaac

SEQ ID NO: 184759 - DNA, 16 bp, P. troglodytes
aaagaactgaaggaaa

SEQ ID NO: 184760 - DNA, 16 bp, P. troglodytes
aaagaactgcccaaga

SEQ ID NO: 184761 - DNA, 16 bp, P. troglodytes
aaagaactgcttgaac

SEQ ID NO: 184762 - DNA, 16 bp, P. troglodytes
aaagaactggagaagc

SEQ ID NO: 184763 - DNA, 16 bp, P. troglodytes
aaagaacttaaaatgg

SEQ ID NO: 184764 - DNA, 16 bp, P. troglodytes
aaagaacttaaattta

SEQ ID NO: 184765 - DNA, 16 bp, P. troglodytes
aaagaacttcagcaaa

SEQ ID NO: 184766 - DNA, 16 bp, P. troglodytes
aaagaagaaaaacttt

SEQ ID NO: 184767 - DNA, 16 bp, P. troglodytes
aaagaagaaaacattt

SEQ ID NO: 184768 - DNA, 16 bp, P. troglodytes
aaagaagaaaactgga

SEQ ID NO: 184769 - DNA, 16 bp, P. troglodytes
aaagaagaaaatgtca

SEQ ID NO: 184770 - DNA, 16 bp, P. troglodytes
aaagaagaaaatttca

SEQ ID NO: 184771 - DNA, 16 bp, P. troglodytes
aaagaagaaagaattc

SEQ ID NO: 184772 - DNA, 16 bp, P. troglodytes
aaagaagaaagctctc

SEQ ID NO: 184773 - DNA, 16 bp, P. troglodytes
aaagaagaaagctgga

SEQ ID NO: 184774 - DNA, 16 bp, P. troglodytes
aaagaagaaagtccag

SEQ ID NO: 184775 - DNA, 16 bp, P. troglodytes
aaagaagaaagtttta

SEQ ID NO: 184776 - DNA, 16 bp, P. troglodytes
aaagaagaaatctgaa

SEQ ID NO: 184777 - DNA, 16 bp, P. troglodytes
aaagaagaaatctgga

SEQ ID NO: 184778 - DNA, 16 bp, P. troglodytes
aaagaagaaattcaga

SEQ ID NO: 184779 - DNA, 16 bp, P. troglodytes
aaagaagaaatttatg

SEQ ID NO: 184780 - DNA, 16 bp, P. troglodytes
aaagaagaatgtgttt

SEQ ID NO: 184781 - DNA, 16 bp, P. troglodytes
aaagaagaattttttt

SEQ ID NO: 184782 - DNA, 16 bp, P. troglodytes
aaagaagacatacatg

SEQ ID NO: 184783 - DNA, 16 bp, P. troglodytes
aaagaagacatggaaa

SEQ ID NO: 184784 - DNA, 16 bp, P. troglodytes
aaagaagacattataa

SEQ ID NO: 184785 - DNA, 16 bp, P. troglodytes
aaagaagacattgatg

SEQ ID NO: 184786 - DNA, 25 bp, P. troglodytes
aaagaagacatttatgcagccaaga

SEQ ID NO: 184787 - DNA, 16 bp, P. troglodytes
aaagaagacctaaata

SEQ ID NO: 184788 - DNA, 16 bp, P. troglodytes
aaagaagactgagaag

SEQ ID NO: 184789 - DNA, 16 bp, P. troglodytes
aaagaagagaaatcag

SEQ ID NO: 184790 - DNA, 16 bp, P. troglodytes
aaagaagagctggtac

SEQ ID NO: 184791 - DNA, 16 bp, P. troglodytes
aaagaagagctggtgc

SEQ ID NO: 184792 - DNA, 16 bp, P. troglodytes
aaagaagatatacaca

SEQ ID NO: 184793 - DNA, 16 bp, P. troglodytes
aaagaagatatctgtg

SEQ ID NO: 184794 - DNA, 16 bp, P. troglodytes
aaagaagatatgcaaa

SEQ ID NO: 184795 - DNA, 16 bp, P. troglodytes
aaagaagatatttatg

SEQ ID NO: 184796 - DNA, 16 bp, P. troglodytes
aaagaagatcattttg

SEQ ID NO: 184797 - DNA, 16 bp, P. troglodytes
aaagaagattctcaga

SEQ ID NO: 184798 - DNA, 16 bp, P. troglodytes
aaagaagcaaataact

SEQ ID NO: 184799 - DNA, 16 bp, P. troglodytes
aaagaagcagagaaat

SEQ ID NO: 184800 - DNA, 16 bp, P. troglodytes
aaagaagcaggaaaat

SEQ ID NO: 184801 - DNA, 16 bp, P. troglodytes
aaagaagccagacaca

SEQ ID NO: 184802 - DNA, 16 bp, P. troglodytes
aaagaagccagaggga

SEQ ID NO: 184803 - DNA, 16 bp, P. troglodytes
aaagaagccagccaaa

SEQ ID NO: 184804 - DNA, 16 bp, P. troglodytes
aaagaagccagtcaca

SEQ ID NO: 184805 - DNA, 16 bp, P. troglodytes
aaagaagctaaaaact

SEQ ID NO: 184806 - DNA, 16 bp, P. troglodytes
aaagaagctaaagcta

SEQ ID NO: 184807 - DNA, 16 bp, P. troglodytes
aaagaagctcaaagaa

SEQ ID NO: 184808 - DNA, 16 bp, P. troglodytes
aaagaagctctaaatc

SEQ ID NO: 184809 - DNA, 16 bp, P. troglodytes
aaagaagctgaaaact

SEQ ID NO: 184810 - DNA, 16 bp, P. troglodytes
aaagaagctgaaataa

SEQ ID NO: 184811 - DNA, 16 bp, P. troglodytes
aaagaaggaaagatct

SEQ ID NO: 184812 - DNA, 16 bp, P. troglodytes
aaagaaggaaggagct

SEQ ID NO: 184813 - DNA, 16 bp, P. troglodytes
aaagaaggacatttta

SEQ ID NO: 184814 - DNA, 16 bp, P. troglodytes
aaagaaggattttttt

SEQ ID NO: 184815 - DNA, 16 bp, P. troglodytes
aaagaaggccattact

SEQ ID NO: 184816 - DNA, 16 bp, P. troglodytes
aaagaagtaaacattt

SEQ ID NO: 184817 - DNA, 16 bp, P. troglodytes
aaagaagtcagagaaa

SEQ ID NO: 184818 - DNA, 16 bp, P. troglodytes
aaagaagtcattattt

SEQ ID NO: 184819 - DNA, 16 bp, P. troglodytes
aaagaagtgaaagatc

SEQ ID NO: 184820 - DNA, 16 bp, P. troglodytes
aaagaagtgaaagatt

SEQ ID NO: 184821 - DNA, 16 bp, P. troglodytes
aaagaagtgataaatg

SEQ ID NO: 184822 - DNA, 16 bp, P. troglodytes
aaagaagttaaaaact

SEQ ID NO: 184823 - DNA, 16 bp, P. troglodytes
aaagaagttcttcaga

SEQ ID NO: 184824 - DNA, 16 bp, P. troglodytes
aaagaagttgaaaatt

SEQ ID NO: 184825 - DNA, 17 bp, P. troglodytes
aaagaagttgaatctct

SEQ ID NO: 184826 - DNA, 16 bp, P. troglodytes
aaagaagtttggttat

SEQ ID NO: 184827 - DNA, 16 bp, P. troglodytes
aaagaagttttttcca

SEQ ID NO: 184828 - DNA, 16 bp, P. troglodytes
aaagaataaaagcagg

SEQ ID NO: 184829 - DNA, 16 bp, P. troglodytes
aaagaatacatttaaa

SEQ ID NO: 184830 - DNA, 16 bp, P. troglodytes
aaagaatactacctga

SEQ ID NO: 184831 - DNA, 16 bp, P. troglodytes
aaagaatagttttttt

SEQ ID NO: 184832 - DNA, 16 bp, P. troglodytes
aaagaatatctgagac

SEQ ID NO: 184833 - DNA, 16 bp, P. troglodytes
aaagaatatgtatttt

SEQ ID NO: 184834 - DNA, 16 bp, P. troglodytes
aaagaatattttcaaa

SEQ ID NO: 184835 - DNA, 16 bp, P. troglodytes
aaagaatcaaatggaa

SEQ ID NO: 184836 - DNA, 16 bp, P. troglodytes
aaagaatcatttaaaa

SEQ ID NO: 184837 - DNA, 16 bp, P. troglodytes
aaagaatctcagagct

SEQ ID NO: 184838 - DNA, 16 bp, P. troglodytes
aaagaatctttaaaaa

SEQ ID NO: 184839 - DNA, 16 bp, P. troglodytes
aaagaatgaaattatg

SEQ ID NO: 184840 - DNA, 16 bp, P. troglodytes
aaagaatgaagttgga

SEQ ID NO: 184841 - DNA, 16 bp, P. troglodytes
aaagaatgaattaaca

SEQ ID NO: 184842 - DNA, 16 bp, P. troglodytes
aaagaatgccacaaag

SEQ ID NO: 184843 - DNA, 17 bp, P. troglodytes
aaagaatggctactcca

SEQ ID NO: 184844 - DNA, 16 bp, P. troglodytes
aaagaatggctgaaaa

SEQ ID NO: 184845 - DNA, 16 bp, P. troglodytes
aaagaatgtctattct

SEQ ID NO: 184846 - DNA, 16 bp, P. troglodytes
aaagaatgtcttgatt

SEQ ID NO: 184847 - DNA, 16 bp, P. troglodytes
aaagaatgtgtatttt

SEQ ID NO: 184848 - DNA, 16 bp, P. troglodytes
aaagaatgtgtgtttt

SEQ ID NO: 184849 - DNA, 16 bp, P. troglodytes
aaagaattaagcagaa

SEQ ID NO: 184850 - DNA, 16 bp, P. troglodytes
aaagaattagctgggc

SEQ ID NO: 184851 - DNA, 16 bp, P. troglodytes
aaagaattatttttca

SEQ ID NO: 184852 - DNA, 16 bp, P. troglodytes
aaagaattcagaaaat

SEQ ID NO: 184853 - DNA, 16 bp, P. troglodytes
aaagaattcagaattc

SEQ ID NO: 184854 - DNA, 16 bp, P. troglodytes
aaagaattcatactgg

SEQ ID NO: 184855 - DNA, 16 bp, P. troglodytes
aaagaattctgaggct

SEQ ID NO: 184856 - DNA, 16 bp, P. troglodytes
aaagaattgaaagcag

SEQ ID NO: 184857 - DNA, 16 bp, P. troglodytes
aaagaattgaaatcag

SEQ ID NO: 184858 - DNA, 16 bp, P. troglodytes
aaagaatttcaagaaa

SEQ ID NO: 184859 - DNA, 16 bp, P. troglodytes
aaagaatttgtggaca

SEQ ID NO: 184860 - DNA, 16 bp, P. troglodytes
aaagaattttaaagag

SEQ ID NO: 184861 - DNA, 16 bp, P. troglodytes
aaagaattttcatttt

SEQ ID NO: 184862 - DNA, 16 bp, P. troglodytes
aaagaattttgtgttt

SEQ ID NO: 184863 - DNA, 16 bp, P. troglodytes
aaagacaaaaatgtta

SEQ ID NO: 184864 - DNA, 16 bp, P. troglodytes
aaagacaaaagaattt

SEQ ID NO: 184865 - DNA, 16 bp, P. troglodytes
aaagacaaaataattt

SEQ ID NO: 184866 - DNA, 16 bp, P. troglodytes
aaagacaaacattgca

SEQ ID NO: 184867 - DNA, 16 bp, P. troglodytes
aaagacaaactttgca

SEQ ID NO: 184868 - DNA, 16 bp, P. troglodytes
aaagacaaagaagatc

SEQ ID NO: 184869 - DNA, 16 bp, P. troglodytes
aaagacaaatacttca

SEQ ID NO: 184870 - DNA, 16 bp, P. troglodytes
aaagacaaatacttta

SEQ ID NO: 184871 - DNA, 16 bp, P. troglodytes
aaagacaaatatttaa

SEQ ID NO: 184872 - DNA, 16 bp, P. troglodytes
aaagacaaatgcacat

SEQ ID NO: 184873 - DNA, 16 bp, P. troglodytes
aaagacaaatgtgaaa

SEQ ID NO: 184874 - DNA, 16 bp, P. troglodytes
aaagacaaattttgca

SEQ ID NO: 184875 - DNA, 16 bp, P. troglodytes
aaagacaacaagtgtt

SEQ ID NO: 184876 - DNA, 16 bp, P. troglodytes
aaagacaagaaaatgt

SEQ ID NO: 184877 - DNA, 16 bp, P. troglodytes
aaagacaaggaaatgg

SEQ ID NO: 184878 - DNA, 16 bp, P. troglodytes
aaagacaattttactt

SEQ ID NO: 184879 - DNA, 16 bp, P. troglodytes
aaagacaatttttttt

SEQ ID NO: 184880 - DNA, 16 bp, P. troglodytes
aaagacacatgaagaa

SEQ ID NO: 184881 - DNA, 16 bp, P. troglodytes
aaagacacatgcatgt

SEQ ID NO: 184882 - DNA, 16 bp, P. troglodytes
aaagacaccactcaaa

SEQ ID NO: 184883 - DNA, 16 bp, P. troglodytes
aaagacaccattaaga

SEQ ID NO: 184884 - DNA, 16 bp, P. troglodytes
aaagacactcatcact

SEQ ID NO: 184885 - DNA, 16 bp, P. troglodytes
aaagacactgactaca

SEQ ID NO: 184886 - DNA, 16 bp, P. troglodytes
aaagacactgtctcaa

SEQ ID NO: 184887 - DNA, 16 bp, P. troglodytes
aaagacagaaatgcca

SEQ ID NO: 184888 - DNA, 16 bp, P. troglodytes
aaagacagaaattata

SEQ ID NO: 184889 - DNA, 16 bp, P. troglodytes
aaagacagacacacag

SEQ ID NO: 184890 - DNA, 16 bp, P. troglodytes
aaagacaggaaataac

SEQ ID NO: 184891 - DNA, 16 bp, P. troglodytes
aaagacagggaataac

SEQ ID NO: 184892 - DNA, 16 bp, P. troglodytes
aaagacagtcttgaat

SEQ ID NO: 184893 - DNA, 16 bp, P. troglodytes
aaagacagttattcaa

SEQ ID NO: 184894 - DNA, 16 bp, P. troglodytes
aaagacagttttaaag

SEQ ID NO: 184895 - DNA, 16 bp, P. troglodytes
aaagacagtttttaaa

SEQ ID NO: 184896 - DNA, 16 bp, P. troglodytes
aaagacataagagact

SEQ ID NO: 184897 - DNA, 16 bp, P. troglodytes
aaagacatacaaattt

SEQ ID NO: 184898 - DNA, 16 bp, P. troglodytes
aaagacatacagattg

SEQ ID NO: 184899 - DNA, 16 bp, P. troglodytes
aaagacatatgcaaga

SEQ ID NO: 184900 - DNA, 16 bp, P. troglodytes
aaagacatatgcactt

SEQ ID NO: 184901 - DNA, 16 bp, P. troglodytes
aaagacatattttatt

SEQ ID NO: 184902 - DNA, 16 bp, P. troglodytes
aaagacatcaaaagca

SEQ ID NO: 184903 - DNA, 16 bp, P. troglodytes
aaagacatgaaaagac

SEQ ID NO: 184904 - DNA, 16 bp, P. troglodytes
aaagacatgaaaatta

SEQ ID NO: 184905 - DNA, 16 bp, P. troglodytes
aaagacatgaagaaag

SEQ ID NO: 184906 - DNA, 16 bp, P. troglodytes
aaagacatgaaggcaa

SEQ ID NO: 184907 - DNA, 16 bp, P. troglodytes
aaagacatgcccaaga

SEQ ID NO: 184908 - DNA, 16 bp, P. troglodytes
aaagacatggaataaa

SEQ ID NO: 184909 - DNA, 16 bp, P. troglodytes
aaagacatggaggaaa

SEQ ID NO: 184910 - DNA, 16 bp, P. troglodytes
aaagacatgggtgtca

SEQ ID NO: 184911 - DNA, 16 bp, P. troglodytes
aaagacattattttat

SEQ ID NO: 184912 - DNA, 16 bp, P. troglodytes
aaagacatttcaaata

SEQ ID NO: 184913 - DNA, 16 bp, P. troglodytes
aaagacatttcttttt

SEQ ID NO: 184914 - DNA, 16 bp, P. troglodytes
aaagacatttggaaaa

SEQ ID NO: 184915 - DNA, 16 bp, P. troglodytes
aaagacattttcttct

SEQ ID NO: 184916 - DNA, 16 bp, P. troglodytes
aaagacatttttaaaa

SEQ ID NO: 184917 - DNA, 16 bp, P. troglodytes
aaagacatttttattt

SEQ ID NO: 184918 - DNA, 16 bp, P. troglodytes
aaagaccacattcaca

SEQ ID NO: 184919 - DNA, 16 bp, P. troglodytes
aaagaccagcttgggc

SEQ ID NO: 184920 - DNA, 16 bp, P. troglodytes
aaagacccagaatagc

SEQ ID NO: 184921 - DNA, 16 bp, P. troglodytes
aaagacccagaatggc

SEQ ID NO: 184922 - DNA, 16 bp, P. troglodytes
aaagaccccacctctt

SEQ ID NO: 184923 - DNA, 16 bp, P. troglodytes
aaagaccctattttca

SEQ ID NO: 184924 - DNA, 16 bp, P. troglodytes
aaagaccctgtctcaa

SEQ ID NO: 184925 - DNA, 16 bp, P. troglodytes
aaagacctcattttaa

SEQ ID NO: 184926 - DNA, 16 bp, P. troglodytes
aaagacctgaaggaag

SEQ ID NO: 184927 - DNA, 16 bp, P. troglodytes
aaagacctgaaggaga

SEQ ID NO: 184928 - DNA, 16 bp, P. troglodytes
aaagacctggaatcaa

SEQ ID NO: 184929 - DNA, 16 bp, P. troglodytes
aaagacggggtttcgc

SEQ ID NO: 184930 - DNA, 16 bp, P. troglodytes
aaagactaaaatattt

SEQ ID NO: 184931 - DNA, 16 bp, P. troglodytes
aaagactaaataatga

SEQ ID NO: 184932 - DNA, 16 bp, P. troglodytes
aaagactaaatgagat

SEQ ID NO: 184933 - DNA, 16 bp, P. troglodytes
aaagactacatattgg

SEQ ID NO: 184934 - DNA, 16 bp, P. troglodytes
aaagactatcctttcc

SEQ ID NO: 184935 - DNA, 16 bp, P. troglodytes
aaagactcctccaaaa

SEQ ID NO: 184936 - DNA, 17 bp, P. troglodytes
aaagactctgtctcaaa

SEQ ID NO: 184937 - DNA, 16 bp, P. troglodytes
aaagactgaaatcttt

SEQ ID NO: 184938 - DNA, 16 bp, P. troglodytes
aaagactgaagaaaca

SEQ ID NO: 184939 - DNA, 16 bp, P. troglodytes
aaagactgaaggaaca

SEQ ID NO: 184940 - DNA, 16 bp, P. troglodytes
aaagactggcagagac

SEQ ID NO: 184941 - DNA, 16 bp, P. troglodytes
aaagactgtttgcaaa

SEQ ID NO: 184942 - DNA, 16 bp, P. troglodytes
aaagacttaaaggtaa

SEQ ID NO: 184943 - DNA, 16 bp, P. troglodytes
aaagacttaaatatga

SEQ ID NO: 184944 - DNA, 16 bp, P. troglodytes
aaagacttaaatgtca

SEQ ID NO: 184945 - DNA, 16 bp, P. troglodytes
aaagacttaaatttaa

SEQ ID NO: 184946 - DNA, 16 bp, P. troglodytes
aaagacttatatgtaa

SEQ ID NO: 184947 - DNA, 16 bp, P. troglodytes
aaagacttcttgagca

SEQ ID NO: 184948 - DNA, 16 bp, P. troglodytes
aaagacttgaaggaaa

SEQ ID NO: 184949 - DNA, 16 bp, P. troglodytes
aaagacttgaaggaga

SEQ ID NO: 184950 - DNA, 24 bp, P. troglodytes
aaagacttggaaccaacccaaatg

SEQ ID NO: 184951 - DNA, 16 bp, P. troglodytes
aaagactttaaaacaa

SEQ ID NO: 184952 - DNA, 16 bp, P. troglodytes
aaagactttatatttt

SEQ ID NO: 184953 - DNA, 16 bp, P. troglodytes
aaagactttcagcttt

SEQ ID NO: 184954 - DNA, 16 bp, P. troglodytes
aaagactttggctttt

SEQ ID NO: 184955 - DNA, 16 bp, P. troglodytes
aaagactttttaaaaa

SEQ ID NO: 184956 - DNA, 16 bp, P. troglodytes
aaagactttttaaaat

SEQ ID NO: 184957 - DNA, 16 bp, P. troglodytes
aaagagaaaaacttca

SEQ ID NO: 184958 - DNA, 16 bp, P. troglodytes
aaagagaaaaatctga

SEQ ID NO: 184959 - DNA, 16 bp, P. troglodytes
aaagagaaaatgcttt

SEQ ID NO: 184960 - DNA, 16 bp, P. troglodytes
aaagagaaaatgtatt

SEQ ID NO: 184961 - DNA, 16 bp, P. troglodytes
aaagagaaacagcttc

SEQ ID NO: 184962 - DNA, 16 bp, P. troglodytes
aaagagaaactggagg

SEQ ID NO: 184963 - DNA, 16 bp, P. troglodytes
aaagagaaagaaactt

SEQ ID NO: 184964 - DNA, 16 bp, P. troglodytes
aaagagaaagcagaat

SEQ ID NO: 184965 - DNA, 16 bp, P. troglodytes
aaagagaaagtcaaat

SEQ ID NO: 184966 - DNA, 16 bp, P. troglodytes
aaagagaagaatcaag

SEQ ID NO: 184967 - DNA, 16 bp, P. troglodytes
aaagagaagactgaaa

SEQ ID NO: 184968 - DNA, 16 bp, P. troglodytes
aaagagaagcccagga

SEQ ID NO: 184969 - DNA, 16 bp, P. troglodytes
aaagagaagttttttt

SEQ ID NO: 184970 - DNA, 16 bp, P. troglodytes
aaagagaatacatttt

SEQ ID NO: 184971 - DNA, 16 bp, P. troglodytes
aaagagaatgaaatca

SEQ ID NO: 184972 - DNA, 16 bp, P. troglodytes
aaagagaattttatac

SEQ ID NO: 184973 - DNA, 16 bp, P. troglodytes
aaagagacagaaatta

SEQ ID NO: 184974 - DNA, 16 bp, P. troglodytes
aaagagacagggtctc

SEQ ID NO: 184975 - DNA, 16 bp, P. troglodytes
aaagagacagggtctt

SEQ ID NO: 184976 - DNA, 16 bp, P. troglodytes
aaagagaccaaattta

SEQ ID NO: 184977 - DNA, 16 bp, P. troglodytes
aaagagacccagagag

SEQ ID NO: 184978 - DNA, 23 bp, P. troglodytes
aaagagacttagactcccacaca

SEQ ID NO: 184979 - DNA, 16 bp, P. troglodytes
aaagagacttcagaga

SEQ ID NO: 184980 - DNA, 16 bp, P. troglodytes
aaagagagaagaatcc

SEQ ID NO: 184981 - DNA, 16 bp, P. troglodytes
aaagagagaagaatct

SEQ ID NO: 184982 - DNA, 16 bp, P. troglodytes
aaagagagaagatcca

SEQ ID NO: 184983 - DNA, 18 bp, P. troglodytes
aaagagagaatcctccct

SEQ ID NO: 184984 - DNA, 16 bp, P. troglodytes
aaagagagagaatatt

SEQ ID NO: 184985 - DNA, 16 bp, P. troglodytes
aaagagagagagagtc

SEQ ID NO: 184986 - DNA, 16 bp, P. troglodytes
aaagagagagcttgtg

SEQ ID NO: 184987 - DNA, 16 bp, P. troglodytes
aaagagagcaggggtg

SEQ ID NO: 184988 - DNA, 16 bp, P. troglodytes
aaagagaggaaatcag

SEQ ID NO: 184989 - DNA, 16 bp, P. troglodytes
aaagagagtaaaatac

SEQ ID NO: 184990 - DNA, 16 bp, P. troglodytes
aaagagatgaacattt

SEQ ID NO: 184991 - DNA, 16 bp, P. troglodytes
aaagagatttgtaaaa

SEQ ID NO: 184992 - DNA, 16 bp, P. troglodytes
aaagagcaaaactctg

SEQ ID NO: 184993 - DNA, 16 bp, P. troglodytes
aaagagcaaatctaag

SEQ ID NO: 184994 - DNA, 16 bp, P. troglodytes
aaagagcaagacccca

SEQ ID NO: 184995 - DNA, 16 bp, P. troglodytes
aaagagcatctatgaa

SEQ ID NO: 184996 - DNA, 16 bp, P. troglodytes
aaagagcccaaacagc

SEQ ID NO: 184997 - DNA, 16 bp, P. troglodytes
aaagagcctgaacagc

SEQ ID NO: 184998 - DNA, 16 bp, P. troglodytes
aaagagcctggcacct

SEQ ID NO: 184999 - DNA, 16 bp, P. troglodytes
aaagagctaaaggaaa

SEQ ID NO: 185000 - DNA, 16 bp, P. troglodytes
aaagagctcttagaaa

SEQ ID NO: 185001 - DNA, 16 bp, P. troglodytes
aaagagctcttggaaa

SEQ ID NO: 185002 - DNA, 17 bp, P. troglodytes
aaagagctgggattaca

SEQ ID NO: 185003 - DNA, 16 bp, P. troglodytes
aaagagcttagaacag

SEQ ID NO: 185004 - DNA, 16 bp, P. troglodytes
aaagagcttttaaaaa

SEQ ID NO: 185005 - DNA, 16 bp, P. troglodytes
aaagaggaaaatttat

SEQ ID NO: 185006 - DNA, 16 bp, P. troglodytes
aaagaggaacactttt

SEQ ID NO: 185007 - DNA, 16 bp, P. troglodytes
aaagaggaagcaggca

SEQ ID NO: 185008 - DNA, 16 bp, P. troglodytes
aaagaggaagccaaac

SEQ ID NO: 185009 - DNA, 17 bp, P. troglodytes
aaagaggaagtcaaatc

SEQ ID NO: 185010 - DNA, 16 bp, P. troglodytes
aaagaggaagtcagat

SEQ ID NO: 185011 - DNA, 16 bp, P. troglodytes
aaagaggaattttttt

SEQ ID NO: 185012 - DNA, 16 bp, P. troglodytes
aaagaggatgagttca

SEQ ID NO: 185013 - DNA, 16 bp, P. troglodytes
aaagaggatgtcaaat

SEQ ID NO: 185014 - DNA, 16 bp, P. troglodytes
aaagaggcaatcagat

SEQ ID NO: 185015 - DNA, 16 bp, P. troglodytes
aaagaggcactgaaaa

SEQ ID NO: 185016 - DNA, 16 bp, P. troglodytes
aaagaggcactgaaga

SEQ ID NO: 185017 - DNA, 16 bp, P. troglodytes
aaagaggcaggggctg

SEQ ID NO: 185018 - DNA, 16 bp, P. troglodytes
aaagagggaaatttgg

SEQ ID NO: 185019 - DNA, 16 bp, P. troglodytes
aaagagggaagaatca

SEQ ID NO: 185020 - DNA, 16 bp, P. troglodytes
aaagagggagtcaaat

SEQ ID NO: 185021 - DNA, 16 bp, P. troglodytes
aaagaggttaaataac

SEQ ID NO: 185022 - DNA, 16 bp, P. troglodytes
aaagaggttttaaaaa

SEQ ID NO: 185023 - DNA, 16 bp, P. troglodytes
aaagaggtttttaaaa

SEQ ID NO: 185024 - DNA, 16 bp, P. troglodytes
aaagagtcaagatcca

SEQ ID NO: 185025 - DNA, 16 bp, P. troglodytes
aaagagtgttttaaaa

SEQ ID NO: 185026 - DNA, 16 bp, P. troglodytes
aaagagttgaaaactt

SEQ ID NO: 185027 - DNA, 16 bp, P. troglodytes
aaagagtttattcaag

SEQ ID NO: 185028 - DNA, 16 bp, P. troglodytes
aaagagtttttaaaat

SEQ ID NO: 185029 - DNA, 16 bp, P. troglodytes
aaagataaaatgtttt

SEQ ID NO: 185030 - DNA, 16 bp, P. troglodytes
aaagataaacatattt

SEQ ID NO: 185031 - DNA, 16 bp, P. troglodytes
aaagataaataactca

SEQ ID NO: 185032 - DNA, 16 bp, P. troglodytes
aaagataaatatgtga

SEQ ID NO: 185033 - DNA, 16 bp, P. troglodytes
aaagataaatgtttta

SEQ ID NO: 185034 - DNA, 16 bp, P. troglodytes
aaagatacagattggc

SEQ ID NO: 185035 - DNA, 16 bp, P. troglodytes
aaagatacataaatat

SEQ ID NO: 185036 - DNA, 16 bp, P. troglodytes
aaagataccaagaaca

SEQ ID NO: 185037 - DNA, 17 bp, P. troglodytes
aaagatacccaggaatt

SEQ ID NO: 185038 - DNA, 16 bp, P. troglodytes
aaagatacctgaagat

SEQ ID NO: 185039 - DNA, 16 bp, P. troglodytes
aaagatacctgcacat

SEQ ID NO: 185040 - DNA, 16 bp, P. troglodytes
aaagataccttaaaat

SEQ ID NO: 185041 - DNA, 16 bp, P. troglodytes
aaagatacttaaaaat

SEQ ID NO: 185042 - DNA, 16 bp, P. troglodytes
aaagatagatagatag

SEQ ID NO: 185043 - DNA, 16 bp, P. troglodytes
aaagatagttttattt

SEQ ID NO: 185044 - DNA, 16 bp, P. troglodytes
aaagatattttcactg

SEQ ID NO: 185045 - DNA, 16 bp, P. troglodytes
aaagatattttcctat

SEQ ID NO: 185046 - DNA, 16 bp, P. troglodytes
aaagatattttgaaat

SEQ ID NO: 185047 - DNA, 16 bp, P. troglodytes
aaagatcaagagacaa

SEQ ID NO: 185048 - DNA, 16 bp, P. troglodytes
aaagatcacatattgt

SEQ ID NO: 185049 - DNA, 16 bp, P. troglodytes
aaagatcagatggtgg

SEQ ID NO: 185050 - DNA, 16 bp, P. troglodytes
aaagatcattaaaatt

SEQ ID NO: 185051 - DNA, 16 bp, P. troglodytes
aaagatctcaaataaa

SEQ ID NO: 185052 - DNA, 16 bp, P. troglodytes
aaagatctgaaagaaa

SEQ ID NO: 185053 - DNA, 16 bp, P. troglodytes
aaagatgaagaaacag

SEQ ID NO: 185054 - DNA, 16 bp, P. troglodytes
aaagatgaaggctgga

SEQ ID NO: 185055 - DNA, 16 bp, P. troglodytes
aaagatgaatgagaca

SEQ ID NO: 185056 - DNA, 16 bp, P. troglodytes
aaagatgactttaaaa

SEQ ID NO: 185057 - DNA, 16 bp, P. troglodytes
aaagatgagaaagaac

SEQ ID NO: 185058 - DNA, 16 bp, P. troglodytes
aaagatgagatagttg

SEQ ID NO: 185059 - DNA, 16 bp, P. troglodytes
aaagatgaggagaaac

SEQ ID NO: 185060 - DNA, 16 bp, P. troglodytes
aaagatgataaagggg

SEQ ID NO: 185061 - DNA, 16 bp, P. troglodytes
aaagatgatatacaaa

SEQ ID NO: 185062 - DNA, 16 bp, P. troglodytes
aaagatgcaaaggaaa

SEQ ID NO: 185063 - DNA, 16 bp, P. troglodytes
aaagatgctcaaagaa

SEQ ID NO: 185064 - DNA, 16 bp, P. troglodytes
aaagatgctctacatc

SEQ ID NO: 185065 - DNA, 16 bp, P. troglodytes
aaagatgcttatctaa

SEQ ID NO: 185066 - DNA, 16 bp, P. troglodytes
aaagatggaatttata

SEQ ID NO: 185067 - DNA, 16 bp, P. troglodytes
aaagatggctttgcag

SEQ ID NO: 185068 - DNA, 16 bp, P. troglodytes
aaagatgggcaaaaga

SEQ ID NO: 185069 - DNA, 16 bp, P. troglodytes
aaagatggtcttttca

SEQ ID NO: 185070 - DNA, 16 bp, P. troglodytes
aaagatgtctttaaaa

SEQ ID NO: 185071 - DNA, 16 bp, P. troglodytes
aaagatgtggaaccaa

SEQ ID NO: 185072 - DNA, 16 bp, P. troglodytes
aaagatgtggagaaat

SEQ ID NO: 185073 - DNA, 16 bp, P. troglodytes
aaagatgttaaatttt

SEQ ID NO: 185074 - DNA, 16 bp, P. troglodytes
aaagatgttcactgca

SEQ ID NO: 185075 - DNA, 16 bp, P. troglodytes
aaagatgtttattgca

SEQ ID NO: 185076 - DNA, 16 bp, P. troglodytes
aaagatgttttaaatt

SEQ ID NO: 185077 - DNA, 16 bp, P. troglodytes
aaagattaaaaacatt

SEQ ID NO: 185078 - DNA, 16 bp, P. troglodytes
aaagattaagtaattt

SEQ ID NO: 185079 - DNA, 16 bp, P. troglodytes
aaagattatttttcta

SEQ ID NO: 185080 - DNA, 16 bp, P. troglodytes
aaagattatttttctt

SEQ ID NO: 185081 - DNA, 16 bp, P. troglodytes
aaagattcatttaaaa

SEQ ID NO: 185082 - DNA, 16 bp, P. troglodytes
aaagattcctccaaaa

SEQ ID NO: 185083 - DNA, 16 bp, P. troglodytes
aaagattctagaagat

SEQ ID NO: 185084 - DNA, 16 bp, P. troglodytes
aaagattcttttcaaa

SEQ ID NO: 185085 - DNA, 16 bp, P. troglodytes
aaagattgtcctttcc

SEQ ID NO: 185086 - DNA, 16 bp, P. troglodytes
aaagattgtgtttctg

SEQ ID NO: 185087 - DNA, 16 bp, P. troglodytes
aaagatttaagtgtaa

SEQ ID NO: 185088 - DNA, 16 bp, P. troglodytes
aaagatttcaaataaa

SEQ ID NO: 185089 - DNA, 16 bp, P. troglodytes
aaagatttcaaatatt

SEQ ID NO: 185090 - DNA, 16 bp, P. troglodytes
aaagatttctctgtag

SEQ ID NO: 185091 - DNA, 16 bp, P. troglodytes
aaagatttcttaagta

SEQ ID NO: 185092 - DNA, 16 bp, P. troglodytes
aaagatttctttcaaa

SEQ ID NO: 185093 - DNA, 16 bp, P. troglodytes
aaagatttctttttaa

SEQ ID NO: 185094 - DNA, 17 bp, P. troglodytes
aaagattttatgacaaa

SEQ ID NO: 185095 - DNA, 16 bp, P. troglodytes
aaagattttcttctgt

SEQ ID NO: 185096 - DNA, 16 bp, P. troglodytes
aaagattttcttcttt

SEQ ID NO: 185097 - DNA, 16 bp, P. troglodytes
aaagattttgagatga

SEQ ID NO: 185098 - DNA, 16 bp, P. troglodytes
aaagattttgagatgg

SEQ ID NO: 185099 - DNA, 16 bp, P. troglodytes
aaagatttttatcttt

SEQ ID NO: 185100 - DNA, 16 bp, P. troglodytes
aaagatttttgtttgc

SEQ ID NO: 185101 - DNA, 16 bp, P. troglodytes
aaagatttttttcaaa

SEQ ID NO: 185102 - DNA, 16 bp, P. troglodytes
aaagatttttttctct

SEQ ID NO: 185103 - DNA, 16 bp, P. troglodytes
aaagatttttttttcc

SEQ ID NO: 185104 - DNA, 16 bp, P. troglodytes
aaagcaaaaaatattt

SEQ ID NO: 185105 - DNA, 16 bp, P. troglodytes
aaagcaaaaacctgta

SEQ ID NO: 185106 - DNA, 16 bp, P. troglodytes
aaagcaaaaatagatg

SEQ ID NO: 185107 - DNA, 16 bp, P. troglodytes
aaagcaaaaatggaca

SEQ ID NO: 185108 - DNA, 16 bp, P. troglodytes
aaagcaaaaattcaca

SEQ ID NO: 185109 - DNA, 16 bp, P. troglodytes
aaagcaaaaatttaca

SEQ ID NO: 185110 - DNA, 16 bp, P. troglodytes
aaagcaaaaattttaa

SEQ ID NO: 185111 - DNA, 16 bp, P. troglodytes
aaagcaaaacaaattt

SEQ ID NO: 185112 - DNA, 16 bp, P. troglodytes
aaagcaaaacctgaaa

SEQ ID NO: 185113 - DNA, 16 bp, P. troglodytes
aaagcaaaagtggaaa

SEQ ID NO: 185114 - DNA, 16 bp, P. troglodytes
aaagcaaaatgaaatg

SEQ ID NO: 185115 - DNA, 16 bp, P. troglodytes
aaagcaaaatgtataa

SEQ ID NO: 185116 - DNA, 16 bp, P. troglodytes
aaagcaaaatgttaaa

SEQ ID NO: 185117 - DNA, 16 bp, P. troglodytes
aaagcaaaattatttt

SEQ ID NO: 185118 - DNA, 16 bp, P. troglodytes
aaagcaaaatttaaat

SEQ ID NO: 185119 - DNA, 16 bp, P. troglodytes
aaagcaaaattttgaa

SEQ ID NO: 185120 - DNA, 16 bp, P. troglodytes
aaagcaaacagaaatt

SEQ ID NO: 185121 - DNA, 16 bp, P. troglodytes
aaagcaaagttttaaa

SEQ ID NO: 185122 - DNA, 16 bp, P. troglodytes
aaagcaaataagtaat

SEQ ID NO: 185123 - DNA, 16 bp, P. troglodytes
aaagcaaatatcacat

SEQ ID NO: 185124 - DNA, 16 bp, P. troglodytes
aaagcaaatatttctt

SEQ ID NO: 185125 - DNA, 16 bp, P. troglodytes
aaagcaaatgattttt

SEQ ID NO: 185126 - DNA, 16 bp, P. troglodytes
aaagcaaatgcaagaa

SEQ ID NO: 185127 - DNA, 16 bp, P. troglodytes
aaagcaaatgctgaga

SEQ ID NO: 185128 - DNA, 16 bp, P. troglodytes
aaagcaaatggaaaag

SEQ ID NO: 185129 - DNA, 16 bp, P. troglodytes
aaagcaaattaaaatt

SEQ ID NO: 185130 - DNA, 16 bp, P. troglodytes
aaagcaaatttttttt

SEQ ID NO: 185131 - DNA, 16 bp, P. troglodytes
aaagcaacaacagcag

SEQ ID NO: 185132 - DNA, 16 bp, P. troglodytes
aaagcaacatggaaaa

SEQ ID NO: 185133 - DNA, 16 bp, P. troglodytes
aaagcaagaaaatgga

SEQ ID NO: 185134 - DNA, 16 bp, P. troglodytes
aaagcaagaccctgtg

SEQ ID NO: 185135 - DNA, 16 bp, P. troglodytes
aaagcaagcccttaga

SEQ ID NO: 185136 - DNA, 16 bp, P. troglodytes
aaagcaaggaaataat

SEQ ID NO: 185137 - DNA, 16 bp, P. troglodytes
aaagcaagggcaacaa

SEQ ID NO: 185138 - DNA, 16 bp, P. troglodytes
aaagcaagtagaagaa

SEQ ID NO: 185139 - DNA, 16 bp, P. troglodytes
aaagcaagtcatatgg

SEQ ID NO: 185140 - DNA, 16 bp, P. troglodytes
aaagcaataaatattt

SEQ ID NO: 185141 - DNA, 16 bp, P. troglodytes
aaagcaataaatgtaa

SEQ ID NO: 185142 - DNA, 16 bp, P. troglodytes
aaagcaatagcatcaa

SEQ ID NO: 185143 - DNA, 16 bp, P. troglodytes
aaagcaattatttaaa

SEQ ID NO: 185144 - DNA, 18 bp, P. troglodytes
aaagcaattgcaacaaaa

SEQ ID NO: 185145 - DNA, 16 bp, P. troglodytes
aaagcaatttaaaaag

SEQ ID NO: 185146 - DNA, 16 bp, P. troglodytes
aaagcaattttcaaaa

SEQ ID NO: 185147 - DNA, 16 bp, P. troglodytes
aaagcaattttcattt

SEQ ID NO: 185148 - DNA, 16 bp, P. troglodytes
aaagcacaaagctgga

SEQ ID NO: 185149 - DNA, 16 bp, P. troglodytes
aaagcacagaggattt

SEQ ID NO: 185150 - DNA, 16 bp, P. troglodytes
aaagcacaggcaacca

SEQ ID NO: 185151 - DNA, 16 bp, P. troglodytes
aaagcacaggcagagt

SEQ ID NO: 185152 - DNA, 16 bp, P. troglodytes
aaagcacagggaacaa

SEQ ID NO: 185153 - DNA, 16 bp, P. troglodytes
aaagcacatttattaa

SEQ ID NO: 185154 - DNA, 16 bp, P. troglodytes
aaagcacattttaaaa

SEQ ID NO: 185155 - DNA, 16 bp, P. troglodytes
aaagcacctagcacag

SEQ ID NO: 185156 - DNA, 16 bp, P. troglodytes
aaagcactaggattac

SEQ ID NO: 185157 - DNA, 16 bp, P. troglodytes
aaagcactgctgaaag

SEQ ID NO: 185158 - DNA, 16 bp, P. troglodytes
aaagcactgggattat

SEQ ID NO: 185159 - DNA, 16 bp, P. troglodytes
aaagcacttagaacag

SEQ ID NO: 185160 - DNA, 16 bp, P. troglodytes
aaagcacttgaaaaaa

SEQ ID NO: 185161 - DNA, 16 bp, P. troglodytes
aaagcactttgtaaat

SEQ ID NO: 185162 - DNA, 16 bp, P. troglodytes
aaagcagaaaataatt

SEQ ID NO: 185163 - DNA, 16 bp, P. troglodytes
aaagcagaaatatttt

SEQ ID NO: 185164 - DNA, 16 bp, P. troglodytes
aaagcagaaatggaaa

SEQ ID NO: 185165 - DNA, 16 bp, P. troglodytes
aaagcagaaattgaca

SEQ ID NO: 185166 - DNA, 16 bp, P. troglodytes
aaagcagaaatttaaa

SEQ ID NO: 185167 - DNA, 16 bp, P. troglodytes
aaagcagaaattttta

SEQ ID NO: 185168 - DNA, 16 bp, P. troglodytes
aaagcagaatttattt

SEQ ID NO: 185169 - DNA, 16 bp, P. troglodytes
aaagcagacatttatg

SEQ ID NO: 185170 - DNA, 16 bp, P. troglodytes
aaagcagagaatagaa

SEQ ID NO: 185171 - DNA, 16 bp, P. troglodytes
aaagcagagagaaaat

SEQ ID NO: 185172 - DNA, 16 bp, P. troglodytes
aaagcagatatacaaa

SEQ ID NO: 185173 - DNA, 16 bp, P. troglodytes
aaagcagattttaaaa

SEQ ID NO: 185174 - DNA, 16 bp, P. troglodytes
aaagcagcagcaaggt

SEQ ID NO: 185175 - DNA, 16 bp, P. troglodytes
aaagcagcagcaggtt

SEQ ID NO: 185176 - DNA, 16 bp, P. troglodytes
aaagcagccacagaca

SEQ ID NO: 185177 - DNA, 16 bp, P. troglodytes
aaagcagccagaggaa

SEQ ID NO: 185178 - DNA, 16 bp, P. troglodytes
aaagcagccaggaagc

SEQ ID NO: 185179 - DNA, 16 bp, P. troglodytes
aaagcagccaggaagg

SEQ ID NO: 185180 - DNA, 16 bp, P. troglodytes
aaagcagccagggaag

SEQ ID NO: 185181 - DNA, 16 bp, P. troglodytes
aaagcagccatagaca

SEQ ID NO: 185182 - DNA, 16 bp, P. troglodytes
aaagcagcctgaaaaa

SEQ ID NO: 185183 - DNA, 16 bp, P. troglodytes
aaagcagctgggagga

SEQ ID NO: 185184 - DNA, 16 bp, P. troglodytes
aaagcagctgtagaca

SEQ ID NO: 185185 - DNA, 16 bp, P. troglodytes
aaagcagctgtgctgt

SEQ ID NO: 185186 - DNA, 16 bp, P. troglodytes
aaagcaggaaagatcc

SEQ ID NO: 185187 - DNA, 16 bp, P. troglodytes
aaagcagggactcaaa

SEQ ID NO: 185188 - DNA, 16 bp, P. troglodytes
aaagcaggggtcccca

SEQ ID NO: 185189 - DNA, 16 bp, P. troglodytes
aaagcagggttttatt

SEQ ID NO: 185190 - DNA, 16 bp, P. troglodytes
aaagcaggttataaaa

SEQ ID NO: 185191 - DNA, 16 bp, P. troglodytes
aaagcagtcagaaaaa

SEQ ID NO: 185192 - DNA, 16 bp, P. troglodytes
aaagcagtctacagat

SEQ ID NO: 185193 - DNA, 16 bp, P. troglodytes
aaagcagtgtgcagag

SEQ ID NO: 185194 - DNA, 16 bp, P. troglodytes
aaagcagtttaacaga

SEQ ID NO: 185195 - DNA, 16 bp, P. troglodytes
aaagcagttttaattt

SEQ ID NO: 185196 - DNA, 16 bp, P. troglodytes
aaagcagttttctttt

SEQ ID NO: 185197 - DNA, 16 bp, P. troglodytes
aaagcagtttttaaaa

SEQ ID NO: 185198 - DNA, 16 bp, P. troglodytes
aaagcagttttttttt

SEQ ID NO: 185199 - DNA, 16 bp, P. troglodytes
aaagcataaaatattt

SEQ ID NO: 185200 - DNA, 16 bp, P. troglodytes
aaagcataggagaaaa

SEQ ID NO: 185201 - DNA, 16 bp, P. troglodytes
aaagcatataaaattt

SEQ ID NO: 185202 - DNA, 16 bp, P. troglodytes
aaagcatatttaaaag

SEQ ID NO: 185203 - DNA, 16 bp, P. troglodytes
aaagcatatttaaaga

SEQ ID NO: 185204 - DNA, 16 bp, P. troglodytes
aaagcatattttaaaa

SEQ ID NO: 185205 - DNA, 16 bp, P. troglodytes
aaagcatattttattt

SEQ ID NO: 185206 - DNA, 16 bp, P. troglodytes
aaagcatcagaaaaat

SEQ ID NO: 185207 - DNA, 16 bp, P. troglodytes
aaagcatcagataacc

SEQ ID NO: 185208 - DNA, 16 bp, P. troglodytes
aaagcattattattat

SEQ ID NO: 185209 - DNA, 16 bp, P. troglodytes
aaagcattattttaaa

SEQ ID NO: 185210 - DNA, 16 bp, P. troglodytes
aaagcattattttggg

SEQ ID NO: 185211 - DNA, 16 bp, P. troglodytes
aaagcattccctttga

SEQ ID NO: 185212 - DNA, 16 bp, P. troglodytes
aaagcatttaaaagaa

SEQ ID NO: 185213 - DNA, 16 bp, P. troglodytes
aaagcatttgaaaaaa

SEQ ID NO: 185214 - DNA, 16 bp, P. troglodytes
aaagcattttaaatgt

SEQ ID NO: 185215 - DNA, 16 bp, P. troglodytes
aaagcattttataaat

SEQ ID NO: 185216 - DNA, 16 bp, P. troglodytes
aaagcattttatgaaa

SEQ ID NO: 185217 - DNA, 16 bp, P. troglodytes
aaagcattttcatttt

SEQ ID NO: 185218 - DNA, 16 bp, P. troglodytes
aaagcattttctcaga

SEQ ID NO: 185219 - DNA, 16 bp, P. troglodytes
aaagcattttctttct

SEQ ID NO: 185220 - DNA, 16 bp, P. troglodytes
aaagcattttgatttt

SEQ ID NO: 185221 - DNA, 16 bp, P. troglodytes
aaagcatttttatttc

SEQ ID NO: 185222 - DNA, 16 bp, P. troglodytes
aaagcattttttaaaa

SEQ ID NO: 185223 - DNA, 16 bp, P. troglodytes
aaagccaaaattaaca

SEQ ID NO: 185224 - DNA, 16 bp, P. troglodytes
aaagccaaaattgaga

SEQ ID NO: 185225 - DNA, 16 bp, P. troglodytes
aaagccaaagccaaag

SEQ ID NO: 185226 - DNA, 16 bp, P. troglodytes
aaagccaaatatattt

SEQ ID NO: 185227 - DNA, 16 bp, P. troglodytes
aaagccaaatatttac

SEQ ID NO: 185228 - DNA, 16 bp, P. troglodytes
aaagccaagcccagcc

SEQ ID NO: 185229 - DNA, 16 bp, P. troglodytes
aaagccacagggatgg

SEQ ID NO: 185230 - DNA, 16 bp, P. troglodytes
aaagccactttggaaa

SEQ ID NO: 185231 - DNA, 16 bp, P. troglodytes
aaagccagcaggctgg

SEQ ID NO: 185232 - DNA, 16 bp, P. troglodytes
aaagccaggcacagtg

SEQ ID NO: 185233 - DNA, 16 bp, P. troglodytes
aaagccatcaggtcct

SEQ ID NO: 185234 - DNA, 16 bp, P. troglodytes
aaagccatctatgaca

SEQ ID NO: 185235 - DNA, 17 bp, P. troglodytes
aaagccattcagcaagt

SEQ ID NO: 185236 - DNA, 16 bp, P. troglodytes
aaagccattttaaaaa

SEQ ID NO: 185237 - DNA, 16 bp, P. troglodytes
aaagcccaaactcctt

SEQ ID NO: 185238 - DNA, 16 bp, P. troglodytes
aaagcccaagaccaga

SEQ ID NO: 185239 - DNA, 16 bp, P. troglodytes
aaagcccaggacccag

SEQ ID NO: 185240 - DNA, 16 bp, P. troglodytes
aaagcccaggatctga

SEQ ID NO: 185241 - DNA, 16 bp, P. troglodytes
aaagccctgatttgta

SEQ ID NO: 185242 - DNA, 16 bp, P. troglodytes
aaagccctgggctcag

SEQ ID NO: 185243 - DNA, 18 bp, P. troglodytes
aaagcccttccttctaca

SEQ ID NO: 185244 - DNA, 16 bp, P. troglodytes
aaagcctacagctttt

SEQ ID NO: 185245 - DNA, 16 bp, P. troglodytes
aaagcctagaggaaat

SEQ ID NO: 185246 - DNA, 16 bp, P. troglodytes
aaagcctatgtgaaaa

SEQ ID NO: 185247 - DNA, 16 bp, P. troglodytes
aaagcctattttaaaa

SEQ ID NO: 185248 - DNA, 16 bp, P. troglodytes
aaagcctcaaagaaat

SEQ ID NO: 185249 - DNA, 16 bp, P. troglodytes
aaagcctcagaaccag

SEQ ID NO: 185250 - DNA, 16 bp, P. troglodytes
aaagcctcatcttcag

SEQ ID NO: 185251 - DNA, 23 bp, P. troglodytes
aaagcctccaagaaatatgggaa

SEQ ID NO: 185252 - DNA, 36 bp, P. troglodytes
aaagcctccaagaaatatgggactatgtgaaaagac

SEQ ID NO: 185253 - DNA, 40 bp, P. troglodytes; identical to SEQ ID NO: 7866

SEQ ID NO: 185254 - DNA, 16 bp, P. troglodytes
aaagcctccaggaaat

SEQ ID NO: 185255 - DNA, 16 bp, P. troglodytes
aaagcctggcaaagac

SEQ ID NO: 185256 - DNA, 16 bp, P. troglodytes
aaagcctgggtgccca

SEQ ID NO: 185257 - DNA, 16 bp, P. troglodytes
aaagccttaaaaatat

SEQ ID NO: 185258 - DNA, 16 bp, P. troglodytes
aaagccttcctttttc

SEQ ID NO: 185259 - DNA, 16 bp, P. troglodytes
aaagccttttctacat

SEQ ID NO: 185260 - DNA, 16 bp, P. troglodytes
aaagcctttttttttt

SEQ ID NO: 185261 - DNA, 16 bp, P. troglodytes
aaagcgagattccatc

SEQ ID NO: 185262 - DNA, 16 bp, P. troglodytes
aaagctaaaattttaa

SEQ ID NO: 185263 - DNA, 16 bp, P. troglodytes
aaagctaaggaccctc

SEQ ID NO: 185264 - DNA, 16 bp, P. troglodytes
aaagctactgaaataa

SEQ ID NO: 185265 - DNA, 16 bp, P. troglodytes
aaagctagcagaaaac

SEQ ID NO: 185266 - DNA, 16 bp, P. troglodytes
aaagctataaaaatta

SEQ ID NO: 185267 - DNA, 16 bp, P. troglodytes
aaagctatggtaacca

SEQ ID NO: 185268 - DNA, 16 bp, P. troglodytes
aaagctattgaaatta

SEQ ID NO: 185269 - DNA, 16 bp, P. troglodytes
aaagctatttaaataa

SEQ ID NO: 185270 - DNA, 16 bp, P. troglodytes
aaagctatttattttt

SEQ ID NO: 185271 - DNA, 16 bp, P. troglodytes
aaagctattttaaata

SEQ ID NO: 185272 - DNA, 16 bp, P. troglodytes
aaagctcaaataaata

SEQ ID NO: 185273 - DNA, 16 bp, P. troglodytes
aaagctcaacatcact

SEQ ID NO: 185274 - DNA, 16 bp, P. troglodytes
aaagctcaacatccct

SEQ ID NO: 185275 - DNA, 16 bp, P. troglodytes
aaagctcagacttcac

SEQ ID NO: 185276 - DNA, 16 bp, P. troglodytes
aaagctcagcatcact

SEQ ID NO: 185277 - DNA, 16 bp, P. troglodytes
aaagctcagctcaagc

SEQ ID NO: 185278 - DNA, 16 bp, P. troglodytes
aaagctcagctccagc

SEQ ID NO: 185279 - DNA, 16 bp, P. troglodytes
aaagctcaggacctga

SEQ ID NO: 185280 - DNA, 16 bp, P. troglodytes
aaagctcaggcaacaa

SEQ ID NO: 185281 - DNA, 16 bp, P. troglodytes
aaagctcatgatcact

SEQ ID NO: 185282 - DNA, 16 bp, P. troglodytes
aaagctcatttttaaa

SEQ ID NO: 185283 - DNA, 16 bp, P. troglodytes
aaagctcctaaaactg

SEQ ID NO: 185284 - DNA, 16 bp, P. troglodytes
aaagctctgatggaga

SEQ ID NO: 185285 - DNA, 16 bp, P. troglodytes
aaagctcttattattt

SEQ ID NO: 185286 - DNA, 16 bp, P. troglodytes
aaagctgaaaacattt

SEQ ID NO: 185287 - DNA, 16 bp, P. troglodytes
aaagctgaaaataaat

SEQ ID NO: 185288 - DNA, 16 bp, P. troglodytes
aaagctgaagaatttg

SEQ ID NO: 185289 - DNA, 16 bp, P. troglodytes
aaagctgaagcaggag

SEQ ID NO: 185290 - DNA, 16 bp, P. troglodytes
aaagctgacaaaaaca

SEQ ID NO: 185291 - DNA, 16 bp, P. troglodytes
aaagctgaccagcatt

SEQ ID NO: 185292 - DNA, 16 bp, P. troglodytes
aaagctgagagaggtg

SEQ ID NO: 185293 - DNA, 16 bp, P. troglodytes
aaagctgagattcaaa

SEQ ID NO: 185294 - DNA, 16 bp, P. troglodytes
aaagctgatttttaaa

SEQ ID NO: 185295 - DNA, 16 bp, P. troglodytes
aaagctgcagaagaaa

SEQ ID NO: 185296 - DNA, 16 bp, P. troglodytes
aaagctgctatcaaca

SEQ ID NO: 185297 - DNA, 16 bp, P. troglodytes
aaagctgctatgaata

SEQ ID NO: 185298 - DNA, 16 bp, P. troglodytes
aaagctgcttccacat

SEQ ID NO: 185299 - DNA, 16 bp, P. troglodytes
aaagctgctttaaaaa

SEQ ID NO: 185300 - DNA, 16 bp, P. troglodytes
aaagctggaaaagaaa

SEQ ID NO: 185301 - DNA, 16 bp, P. troglodytes
aaagctggaaagatct

SEQ ID NO: 185302 - DNA, 16 bp, P. troglodytes
aaagctggaagaaaaa

SEQ ID NO: 185303 - DNA, 16 bp, P. troglodytes
aaagctggaagaattc

SEQ ID NO: 185304 - DNA, 16 bp, P. troglodytes
aaagctggaggtatca

SEQ ID NO: 185305 - DNA, 16 bp, P. troglodytes
aaagctggcagagaca

SEQ ID NO: 185306 - DNA, 16 bp, P. troglodytes
aaagctggccaggcac

SEQ ID NO: 185307 - DNA, 16 bp, P. troglodytes
aaagctgggcatgatg

SEQ ID NO: 185308 - DNA, 16 bp, P. troglodytes
aaagctgggcctcttg

SEQ ID NO: 185309 - DNA, 16 bp, P. troglodytes
aaagctggtggtgtag

SEQ ID NO: 185310 - DNA, 16 bp, P. troglodytes
aaagctgtacatattt

SEQ ID NO: 185311 - DNA, 16 bp, P. troglodytes
aaagctgtaggcatca

SEQ ID NO: 185312 - DNA, 16 bp, P. troglodytes
aaagctgtcacactgg

SEQ ID NO: 185313 - DNA, 16 bp, P. troglodytes
aaagctgtgacagatg

SEQ ID NO: 185314 - DNA, 16 bp, P. troglodytes
aaagctgtttcacaga

SEQ ID NO: 185315 - DNA, 16 bp, P. troglodytes
aaagctgtttttcttt

SEQ ID NO: 185316 - DNA, 16 bp, P. troglodytes
aaagcttagaagaaaa

SEQ ID NO: 185317 - DNA, 16 bp, P. troglodytes
aaagcttataaaataa

SEQ ID NO: 185318 - DNA, 16 bp, P. troglodytes
aaagcttatagaataa

SEQ ID NO: 185319 - DNA, 16 bp, P. troglodytes
aaagcttatttatttt

SEQ ID NO: 185320 - DNA, 16 bp, P. troglodytes
aaagcttattttaaaa

SEQ ID NO: 185321 - DNA, 16 bp, P. troglodytes
aaagcttcaaaatgat

SEQ ID NO: 185322 - DNA, 16 bp, P. troglodytes
aaagcttccaaaggaa

SEQ ID NO: 185323 - DNA, 16 bp, P. troglodytes
aaagcttctagaagaa

SEQ ID NO: 185324 - DNA, 16 bp, P. troglodytes
aaagctttaaaaagtt

SEQ ID NO: 185325 - DNA, 16 bp, P. troglodytes
aaagctttatttttat

SEQ ID NO: 185326 - DNA, 16 bp, P. troglodytes
aaagctttcagaagaa

SEQ ID NO: 185327 - DNA, 16 bp, P. troglodytes
aaagctttcattaaaa

SEQ ID NO: 185328 - DNA, 16 bp, P. troglodytes
aaagctttcttttttc

SEQ ID NO: 185329 - DNA, 16 bp, P. troglodytes
aaagcttttaaaaaaa

SEQ ID NO: 185330 - DNA, 16 bp, P. troglodytes
aaagcttttaaaattt

SEQ ID NO: 185331 - DNA, 16 bp, P. troglodytes
aaagcttttaattttg

SEQ ID NO: 185332 - DNA, 16 bp, P. troglodytes
aaagcttttagaaaat

SEQ ID NO: 185333 - DNA, 16 bp, P. troglodytes
aaagctttttatttct

SEQ ID NO: 185334 - DNA, 16 bp, P. troglodytes
aaagctttttctttaa

SEQ ID NO: 185335 - DNA, 16 bp, P. troglodytes
aaagcttttttaaaaa

SEQ ID NO: 185336 - DNA, 16 bp, P. troglodytes
aaaggaaaaaaattct

SEQ ID NO: 185337 - DNA, 16 bp, P. troglodytes
aaaggaaaaatgattt

SEQ ID NO: 185338 - DNA, 16 bp, P. troglodytes
aaaggaaaaccagacc

SEQ ID NO: 185339 - DNA, 16 bp, P. troglodytes
aaaggaaaacccattt

SEQ ID NO: 185340 - DNA, 16 bp, P. troglodytes
aaaggaaaaccctaac

SEQ ID NO: 185341 - DNA, 16 bp, P. troglodytes
aaaggaaaactggacc

SEQ ID NO: 185342 - DNA, 16 bp, P. troglodytes
aaaggaaaagaagtca

SEQ ID NO: 185343 - DNA, 16 bp, P. troglodytes
aaaggaaaagactgat

SEQ ID NO: 185344 - DNA, 16 bp, P. troglodytes
aaaggaaaagattgat

SEQ ID NO: 185345 - DNA, 16 bp, P. troglodytes
aaaggaaaagcatttt

SEQ ID NO: 185346 - DNA, 16 bp, P. troglodytes
aaaggaaaaggaaact

SEQ ID NO: 185347 - DNA, 16 bp, P. troglodytes
aaaggaaaagttattg

SEQ ID NO: 185348 - DNA, 16 bp, P. troglodytes
aaaggaaaataagttt

SEQ ID NO: 185349 - DNA, 16 bp, P. troglodytes
aaaggaaaatacattt

SEQ ID NO: 185350 - DNA, 16 bp, P. troglodytes
aaaggaaaatatccaa

SEQ ID NO: 185351 - DNA, 16 bp, P. troglodytes
aaaggaaaatggaaac

SEQ ID NO: 185352 - DNA, 16 bp, P. troglodytes
aaaggaaaattattca

SEQ ID NO: 185353 - DNA, 16 bp, P. troglodytes
aaaggaaaatttcttg

SEQ ID NO: 185354 - DNA, 16 bp, P. troglodytes
aaaggaaacatttaaa

SEQ ID NO: 185355 - DNA, 16 bp, P. troglodytes
aaaggaaacatttcaa

SEQ ID NO: 185356 - DNA, 16 bp, P. troglodytes
aaaggaaacattttaa

SEQ ID NO: 185357 - DNA, 16 bp, P. troglodytes
aaaggaaacttttaaa

SEQ ID NO: 185358 - DNA, 16 bp, P. troglodytes
aaaggaaagaaaattc

SEQ ID NO: 185359 - DNA, 16 bp, P. troglodytes
aaaggaaagaacattt

SEQ ID NO: 185360 - DNA, 16 bp, P. troglodytes
aaaggaaagaggttta

SEQ ID NO: 185361 - DNA, 16 bp, P. troglodytes
aaaggaaagaggtttc

SEQ ID NO: 185362 - DNA, 16 bp, P. troglodytes
aaaggaaagcaaatat

SEQ ID NO: 185363 - DNA, 16 bp, P. troglodytes
aaaggaaaggggttta

SEQ ID NO: 185364 - DNA, 16 bp, P. troglodytes
aaaggaaatacttttt

SEQ ID NO: 185365 - DNA, 16 bp, P. troglodytes
aaaggaaatatctgca

SEQ ID NO: 185366 - DNA, 16 bp, P. troglodytes
aaaggaaatgaaacca

SEQ ID NO: 185367 - DNA, 16 bp, P. troglodytes
aaaggaaatgaagtca

SEQ ID NO: 185368 - DNA, 16 bp, P. troglodytes
aaaggaaatgttgaaa

SEQ ID NO: 185369 - DNA, 16 bp, P. troglodytes
aaaggaaattaaatgt

SEQ ID NO: 185370 - DNA, 16 bp, P. troglodytes
aaaggaaattattttg

SEQ ID NO: 185371 - DNA, 16 bp, P. troglodytes
aaaggaaattctaaag

SEQ ID NO: 185372 - DNA, 16 bp, P. troglodytes
aaaggaaattttgaaa

SEQ ID NO: 185373 - DNA, 16 bp, P. troglodytes
aaaggaacaattggta

SEQ ID NO: 185374 - DNA, 16 bp, P. troglodytes
aaaggaacatcagccc

SEQ ID NO: 185375 - DNA, 16 bp, P. troglodytes
aaaggaacatgttcta

SEQ ID NO: 185376 - DNA, 16 bp, P. troglodytes
aaaggaactctcaaaa

SEQ ID NO: 185377 - DNA, 16 bp, P. troglodytes
aaaggaagaaaaatct

SEQ ID NO: 185378 - DNA, 16 bp, P. troglodytes
aaaggaagaaaatcct

SEQ ID NO: 185379 - DNA, 16 bp, P. troglodytes
aaaggaagaaaatgct

SEQ ID NO: 185380 - DNA, 16 bp, P. troglodytes
aaaggaagaaaatgtt

SEQ ID NO: 185381 - DNA, 16 bp, P. troglodytes
aaaggaagaaatcaga

SEQ ID NO: 185382 - DNA, 16 bp, P. troglodytes
aaaggaagaacaaagt

SEQ ID NO: 185383 - DNA, 16 bp, P. troglodytes
aaaggaagacaaaagt

SEQ ID NO: 185384 - DNA, 16 bp, P. troglodytes
aaaggaagacaaagat

SEQ ID NO: 185385 - DNA, 16 bp, P. troglodytes
aaaggaagacaaaggt

SEQ ID NO: 185386 - DNA, 16 bp, P. troglodytes
aaaggaagagtcaact

SEQ ID NO: 185387 - DNA, 16 bp, P. troglodytes
aaaggaaggaaatctt

SEQ ID NO: 185388 - DNA, 16 bp, P. troglodytes
aaaggaaggaaattct

SEQ ID NO: 185389 - DNA, 16 bp, P. troglodytes
aaaggaaggaaatttt

SEQ ID NO: 185390 - DNA, 16 bp, P. troglodytes
aaaggaaggaagccag

SEQ ID NO: 185391 - DNA, 16 bp, P. troglodytes
aaaggaagtaaaacta

SEQ ID NO: 185392 - DNA, 16 bp, P. troglodytes
aaaggaagttcttcaa

SEQ ID NO: 185393 - DNA, 16 bp, P. troglodytes
aaaggaataaaattct

SEQ ID NO: 185394 - DNA, 16 bp, P. troglodytes
aaaggaatacaaaatt

SEQ ID NO: 185395 - DNA, 16 bp, P. troglodytes
aaaggaatatctgaga

SEQ ID NO: 185396 - DNA, 16 bp, P. troglodytes
aaaggaatgaaacaat

SEQ ID NO: 185397 - DNA, 16 bp, P. troglodytes
aaaggaatgaaatgct

SEQ ID NO: 185398 - DNA, 16 bp, P. troglodytes
aaaggaatgaagcact

SEQ ID NO: 185399 - DNA, 16 bp, P. troglodytes
aaaggaatggaggaat

SEQ ID NO: 185400 - DNA, 16 bp, P. troglodytes
aaaggaatgtgagctg

SEQ ID NO: 185401 - DNA, 16 bp, P. troglodytes
aaaggaattcaaaata

SEQ ID NO: 185402 - DNA, 16 bp, P. troglodytes
aaaggaattcagtaaa

SEQ ID NO: 185403 - DNA, 16 bp, P. troglodytes
aaaggaattgaaatta

SEQ ID NO: 185404 - DNA, 16 bp, P. troglodytes
aaaggacaaatatcca

SEQ ID NO: 185405 - DNA, 16 bp, P. troglodytes
aaaggacaagatctca

SEQ ID NO: 185406 - DNA, 16 bp, P. troglodytes
aaaggacacaaataga

SEQ ID NO: 185407 - DNA, 16 bp, P. troglodytes
aaaggacatccacaca

SEQ ID NO: 185408 - DNA, 16 bp, P. troglodytes
aaaggacatccacatc

SEQ ID NO: 185409 - DNA, 20 bp, P. troglodytes
aaaggacatgaactcatcct

SEQ ID NO: 185410 - DNA, 16 bp, P. troglodytes
aaaggacatgatttct

SEQ ID NO: 185411 - DNA, 16 bp, P. troglodytes
aaaggacttagaaaag

SEQ ID NO: 185412 - DNA, 16 bp, P. troglodytes
aaaggactttgcagat

SEQ ID NO: 185413 - DNA, 16 bp, P. troglodytes
aaaggacttttttttt

SEQ ID NO: 185414 - DNA, 16 bp, P. troglodytes
aaaggagaaaaacagt

SEQ ID NO: 185415 - DNA, 16 bp, P. troglodytes
aaaggagaaaaatcac

SEQ ID NO: 185416 - DNA, 16 bp, P. troglodytes
aaaggagaaaaatcat

SEQ ID NO: 185417 - DNA, 16 bp, P. troglodytes
aaaggagaaacatgca

SEQ ID NO: 185418 - DNA, 16 bp, P. troglodytes
aaaggagaaactgagg

SEQ ID NO: 185419 - DNA, 16 bp, P. troglodytes
aaaggagaaatatttt

SEQ ID NO: 185420 - DNA, 16 bp, P. troglodytes
aaaggagaattttttt

SEQ ID NO: 185421 - DNA, 16 bp, P. troglodytes
aaaggagacattaaaa

SEQ ID NO: 185422 - DNA, 16 bp, P. troglodytes
aaaggagacattataa

SEQ ID NO: 185423 - DNA, 16 bp, P. troglodytes
aaaggagactgagaag

SEQ ID NO: 185424 - DNA, 16 bp, P. troglodytes
aaaggagatagacaaa

SEQ ID NO: 185425 - DNA, 17 bp, P. troglodytes
aaaggagatatcaccac

SEQ ID NO: 185426 - DNA, 16 bp, P. troglodytes
aaaggagattaacgtt

SEQ ID NO: 185427 - DNA, 16 bp, P. troglodytes
aaaggagattatttta

SEQ ID NO: 185428 - DNA, 16 bp, P. troglodytes
aaaggagattggaagg

SEQ ID NO: 185429 - DNA, 16 bp, P. troglodytes
aaaggagattttaaaa

SEQ ID NO: 185430 - DNA, 16 bp, P. troglodytes
aaaggagccaagaaca

SEQ ID NO: 185431 - DNA, 16 bp, P. troglodytes
aaaggagctacccact

SEQ ID NO: 185432 - DNA, 16 bp, P. troglodytes
aaaggagtccaggacc

SEQ ID NO: 185433 - DNA, 16 bp, P. troglodytes
aaaggatacagatgaa

SEQ ID NO: 185434 - DNA, 16 bp, P. troglodytes
aaaggatacatgcttg

SEQ ID NO: 185435 - DNA, 16 bp, P. troglodytes
aaaggatatattttaa

SEQ ID NO: 185436 - DNA, 16 bp, P. troglodytes
aaaggatatgaaatca

SEQ ID NO: 185437 - DNA, 16 bp, P. troglodytes
aaaggatatttattta

SEQ ID NO: 185438 - DNA, 16 bp, P. troglodytes
aaaggatattttaaag

SEQ ID NO: 185439 - DNA, 16 bp, P. troglodytes
aaaggatatttttgct

SEQ ID NO: 185440 - DNA, 20 bp, P. troglodytes
aaaggatcacaactcctcgc

SEQ ID NO: 185441 - DNA, 16 bp, P. troglodytes
aaaggatctgaataaa

SEQ ID NO: 185442 - DNA, 16 bp, P. troglodytes
aaaggatgattttttt

SEQ ID NO: 185443 - DNA, 16 bp, P. troglodytes
aaaggatgcaaaattt

SEQ ID NO: 185444 - DNA, 16 bp, P. troglodytes
aaaggatggaaaatat

SEQ ID NO: 185445 - DNA, 16 bp, P. troglodytes
aaaggattataaaaca

SEQ ID NO: 185446 - DNA, 16 bp, P. troglodytes
aaaggattataaagca

SEQ ID NO: 185447 - DNA, 16 bp, P. troglodytes
aaaggattcaaaataa

SEQ ID NO: 185448 - DNA, 16 bp, P. troglodytes
aaaggattggtaccaa

SEQ ID NO: 185449 - DNA, 17 bp, P. troglodytes
aaaggatttcctattta

SEQ ID NO: 185450 - DNA, 16 bp, P. troglodytes
aaaggattttcttaaa

SEQ ID NO: 185451 - DNA, 16 bp, P. troglodytes
aaaggattttgttttt

SEQ ID NO: 185452 - DNA, 16 bp, P. troglodytes
aaaggattttttaaaa

SEQ ID NO: 185453 - DNA, 16 bp, P. troglodytes
aaaggcaaaaaccttt

SEQ ID NO: 185454 - DNA, 16 bp, P. troglodytes
aaaggcaaaaataatt

SEQ ID NO: 185455 - DNA, 16 bp, P. troglodytes
aaaggcaaatcaaaac

SEQ ID NO: 185456 - DNA, 16 bp, P. troglodytes
aaaggcaaattatttt

SEQ ID NO: 185457 - DNA, 16 bp, P. troglodytes
aaaggcaacatttgag

SEQ ID NO: 185458 - DNA, 16 bp, P. troglodytes
aaaggcaacttttggg

SEQ ID NO: 185459 - DNA, 16 bp, P. troglodytes
aaaggcaagaaaatga

SEQ ID NO: 185460 - DNA, 16 bp, P. troglodytes
aaaggcacacacacac

SEQ ID NO: 185461 - DNA, 16 bp, P. troglodytes
aaaggcacaggcaaca

SEQ ID NO: 185462 - DNA, 18 bp, P. troglodytes
aaaggcacttcttacatg

SEQ ID NO: 185463 - DNA, 16 bp, P. troglodytes
aaaggcactttttttt

SEQ ID NO: 185464 - DNA, 16 bp, P. troglodytes
aaaggcaggaaacaac

SEQ ID NO: 185465 - DNA, 16 bp, P. troglodytes
aaaggcaggcaggcct

SEQ ID NO: 185466 - DNA, 16 bp, P. troglodytes
aaaggcataagaatta

SEQ ID NO: 185467 - DNA, 16 bp, P. troglodytes
aaaggcatcaaggaag

SEQ ID NO: 185468 - DNA, 16 bp, P. troglodytes
aaaggcatgagaatga

SEQ ID NO: 185469 - DNA, 16 bp, P. troglodytes
aaaggcattaaataaa

SEQ ID NO: 185470 - DNA, 16 bp, P. troglodytes
aaaggcattttctttt

SEQ ID NO: 185471 - DNA, 16 bp, P. troglodytes
aaaggcatttttaaat

SEQ ID NO: 185472 - DNA, 16 bp, P. troglodytes
aaaggccacatactgt

SEQ ID NO: 185473 - DNA, 16 bp, P. troglodytes
aaaggccacgtgagga

SEQ ID NO: 185474 - DNA, 16 bp, P. troglodytes
aaaggccatgaacaga

SEQ ID NO: 185475 - DNA, 16 bp, P. troglodytes
aaaggccatgtgaaga

SEQ ID NO: 185476 - DNA, 16 bp, P. troglodytes
aaaggccatttatgaa

SEQ ID NO: 185477 - DNA, 16 bp, P. troglodytes
aaaggcccaggaccag

SEQ ID NO: 185478 - DNA, 20 bp, P. troglodytes
aaaggccgggcgcagtggct

SEQ ID NO: 185479 - DNA, 16 bp, P. troglodytes
aaaggccttcagtaaa

SEQ ID NO: 185480 - DNA, 16 bp, P. troglodytes
aaaggctacctggggg

SEQ ID NO: 185481 - DNA, 16 bp, P. troglodytes
aaaggctcagatgatc

SEQ ID NO: 185482 - DNA, 16 bp, P. troglodytes
aaaggctctgaaaagt

SEQ ID NO: 185483 - DNA, 16 bp, P. troglodytes
aaaggctgaaaaacta

SEQ ID NO: 185484 - DNA, 16 bp, P. troglodytes
aaaggctgaaaattca

SEQ ID NO: 185485 - DNA, 16 bp, P. troglodytes
aaaggctgtcaccctg

SEQ ID NO: 185486 - DNA, 16 bp, P. troglodytes
aaaggcttgtcaattt

SEQ ID NO: 185487 - DNA, 16 bp, P. troglodytes
aaaggctttattttta

SEQ ID NO: 185488 - DNA, 16 bp, P. troglodytes
aaaggctttcaataaa

SEQ ID NO: 185489 - DNA, 16 bp, P. troglodytes
aaaggctttcagtttt

SEQ ID NO: 185490 - DNA, 16 bp, P. troglodytes
aaaggcttttattttt

SEQ ID NO: 185491 - DNA, 16 bp, P. troglodytes
aaaggctttttaaaaa

SEQ ID NO: 185492 - DNA, 16 bp, P. troglodytes
aaagggaaaaatcaag

SEQ ID NO: 185493 - DNA, 16 bp, P. troglodytes
aaagggaaaagtcagg

SEQ ID NO: 185494 - DNA, 16 bp, P. troglodytes
aaagggaaaattcaag

SEQ ID NO: 185495 - DNA, 16 bp, P. troglodytes
aaagggaaatcagaaa

SEQ ID NO: 185496 - DNA, 16 bp, P. troglodytes
aaagggaacacatata

SEQ ID NO: 185497 - DNA, 16 bp, P. troglodytes
aaagggaagcagaact

SEQ ID NO: 185498 - DNA, 24 bp, P. troglodytes
aaagggaagcccatcagactaaca

SEQ ID NO: 185499 - DNA, 21 bp, P. troglodytes
aaagggaagcccatcagactg

SEQ ID NO: 185500 - DNA, 17 bp, P. troglodytes
aaagggaatgcctccag

SEQ ID NO: 185501 - DNA, 16 bp, P. troglodytes
aaagggaatgcttaaa

SEQ ID NO: 185502 - DNA, 16 bp, P. troglodytes
aaagggaatgctttca

SEQ ID NO: 185503 - DNA, 23 bp, P. troglodytes
aaagggaattccctgaccccttg

SEQ ID NO: 185504 - DNA, 16 bp, P. troglodytes
aaagggaattttttaa

SEQ ID NO: 185505 - DNA, 16 bp, P. troglodytes
aaagggacatttcaga

SEQ ID NO: 185506 - DNA, 16 bp, P. troglodytes
aaagggactttgcaga

SEQ ID NO: 185507 - DNA, 16 bp, P. troglodytes
aaagggagaaattggc

SEQ ID NO: 185508 - DNA, 16 bp, P. troglodytes
aaagggagaagtcaaa

SEQ ID NO: 185509 - DNA, 16 bp, P. troglodytes
aaagggagaccctcct

SEQ ID NO: 185510 - DNA, 16 bp, P. troglodytes
aaagggatccagtttc

SEQ ID NO: 185511 - DNA, 16 bp, P. troglodytes
aaagggatgctggatt

SEQ ID NO: 185512 - DNA, 16 bp, P. troglodytes
aaagggattttttttt

SEQ ID NO: 185513 - DNA, 16 bp, P. troglodytes
aaagggcagttcccct

SEQ ID NO: 185514 - DNA, 16 bp, P. troglodytes
aaagggccaggtgcgg

SEQ ID NO: 185515 - DNA, 16 bp, P. troglodytes
aaaggggaaaataatt

SEQ ID NO: 185516 - DNA, 16 bp, P. troglodytes
aaaggggactttgcag

SEQ ID NO: 185517 - DNA, 16 bp, P. troglodytes
aaaggggattttgtct

SEQ ID NO: 185518 - DNA, 16 bp, P. troglodytes
aaaggggctgcaggcc

SEQ ID NO: 185519 - DNA, 16 bp, P. troglodytes
aaagggggaaaagccc

SEQ ID NO: 185520 - DNA, 16 bp, P. troglodytes
aaaggggttacagggc

SEQ ID NO: 185521 - DNA, 16 bp, P. troglodytes
aaagggttttttttgt

SEQ ID NO: 185522 - DNA, 16 bp, P. troglodytes
aaaggtaaatttttaa

SEQ ID NO: 185523 - DNA, 16 bp, P. troglodytes
aaaggtaacaagtgtt

SEQ ID NO: 185524 - DNA, 18 bp, P. troglodytes
aaaggtataattgccctg

SEQ ID NO: 185525 - DNA, 16 bp, P. troglodytes
aaaggtatatatatat

SEQ ID NO: 185526 - DNA, 16 bp, P. troglodytes
aaaggtatattttaaa

SEQ ID NO: 185527 - DNA, 16 bp, P. troglodytes
aaaggtatgttgaagt

SEQ ID NO: 185528 - DNA, 16 bp, P. troglodytes
aaaggtcaaagacaaa

SEQ ID NO: 185529 - DNA, 16 bp, P. troglodytes
aaaggtcacatatttc

SEQ ID NO: 185530 - DNA, 16 bp, P. troglodytes
aaaggtcactcttgct

SEQ ID NO: 185531 - DNA, 16 bp, P. troglodytes
aaaggtctaatatcca

SEQ ID NO: 185532 - DNA, 16 bp, P. troglodytes
aaaggtctcaaattaa

SEQ ID NO: 185533 - DNA, 16 bp, P. troglodytes
aaaggtctcactctgt

SEQ ID NO: 185534 - DNA, 16 bp, P. troglodytes
aaaggtcttttaaaaa

SEQ ID NO: 185535 - DNA, 16 bp, P. troglodytes
aaaggtgaggaaactg

SEQ ID NO: 185536 - DNA, 16 bp, P. troglodytes
aaaggtgccaaaaata

SEQ ID NO: 185537 - DNA, 16 bp, P. troglodytes
aaaggtggaaacaaac

SEQ ID NO: 185538 - DNA, 16 bp, P. troglodytes
aaaggtgtaggctggg

SEQ ID NO: 185539 - DNA, 16 bp, P. troglodytes
aaaggtgttttgtttt

SEQ ID NO: 185540 - DNA, 16 bp, P. troglodytes
aaaggtgttttttgtt

SEQ ID NO: 185541 - DNA, 16 bp, P. troglodytes
aaaggttaagtaactt

SEQ ID NO: 185542 - DNA, 16 bp, P. troglodytes
aaaggttctccacgtc

SEQ ID NO: 185543 - DNA, 16 bp, P. troglodytes
aaaggttgaataatat

SEQ ID NO: 185544 - DNA, 17 bp, P. troglodytes
aaaggttggggaccgct

SEQ ID NO: 185545 - DNA, 16 bp, P. troglodytes
aaaggtttaaacaagt

SEQ ID NO: 185546 - DNA, 16 bp, P. troglodytes
aaaggtttagctctgt

SEQ ID NO: 185547 - DNA, 16 bp, P. troglodytes
aaaggtttataagaat

SEQ ID NO: 185548 - DNA, 16 bp, P. troglodytes
aaaggtttcactgaat

SEQ ID NO: 185549 - DNA, 16 bp, P. troglodytes
aaaggtttgctgaaaa

SEQ ID NO: 185550 - DNA, 16 bp, P. troglodytes
aaaggttttctttctt

SEQ ID NO: 185551 - DNA, 16 bp, P. troglodytes
aaaggttttgttttgt

SEQ ID NO: 185552 - DNA, 16 bp, P. troglodytes
aaaggtttttgctttt

SEQ ID NO: 185553 - DNA, 16 bp, P. troglodytes
aaaggttttttaaaaa

SEQ ID NO: 185554 - DNA, 16 bp, P. troglodytes
aaaggttttttctttt

SEQ ID NO: 185555 - DNA, 16 bp, P. troglodytes
aaagtaaaagaggttt

SEQ ID NO: 185556 - DNA, 16 bp, P. troglodytes
aaagtaaacatttaaa

SEQ ID NO: 185557 - DNA, 16 bp, P. troglodytes
aaagtaaactttaaaa

SEQ ID NO: 185558 - DNA, 16 bp, P. troglodytes
aaagtaaatgcaataa

SEQ ID NO: 185559 - DNA, 16 bp, P. troglodytes
aaagtaaattgaaagc

SEQ ID NO: 185560 - DNA, 16 bp, P. troglodytes
aaagtaaatttatttc

SEQ ID NO: 185561 - DNA, 16 bp, P. troglodytes
aaagtaacttttaaaa

SEQ ID NO: 185562 - DNA, 16 bp, P. troglodytes
aaagtaagcaacttgg

SEQ ID NO: 185563 - DNA, 16 bp, P. troglodytes
aaagtaagttgaaaac

SEQ ID NO: 185564 - DNA, 16 bp, P. troglodytes
aaagtaagtttttaaa

SEQ ID NO: 185565 - DNA, 16 bp, P. troglodytes
aaagtaataaaacatt

SEQ ID NO: 185566 - DNA, 16 bp, P. troglodytes
aaagtaatcccattta

SEQ ID NO: 185567 - DNA, 16 bp, P. troglodytes
aaagtaatggcaaaaa

SEQ ID NO: 185568 - DNA, 16 bp, P. troglodytes
aaagtaattgcatttt

SEQ ID NO: 185569 - DNA, 16 bp, P. troglodytes
aaagtaattgtgtttt

SEQ ID NO: 185570 - DNA, 16 bp, P. troglodytes
aaagtaattttttcta

SEQ ID NO: 185571 - DNA, 16 bp, P. troglodytes
aaagtacaaaaattta

SEQ ID NO: 185572 - DNA, 16 bp, P. troglodytes
aaagtacaaagctgga

SEQ ID NO: 185573 - DNA, 16 bp, P. troglodytes
aaagtacatttaaaat

SEQ ID NO: 185574 - DNA, 16 bp, P. troglodytes
aaagtaccacagactg

SEQ ID NO: 185575 - DNA, 16 bp, P. troglodytes
aaagtactcaacatca

SEQ ID NO: 185576 - DNA, 16 bp, P. troglodytes
aaagtacttttaaatt

SEQ ID NO: 185577 - DNA, 16 bp, P. troglodytes
aaagtagaaggcaaag

SEQ ID NO: 185578 - DNA, 16 bp, P. troglodytes
aaagtagactttaaga

SEQ ID NO: 185579 - DNA, 16 bp, P. troglodytes
aaagtagattttaagt

SEQ ID NO: 185580 - DNA, 16 bp, P. troglodytes
aaagtagcaaatatgt

SEQ ID NO: 185581 - DNA, 16 bp, P. troglodytes
aaagtataaaaatggc

SEQ ID NO: 185582 - DNA, 16 bp, P. troglodytes
aaagtatacctcaata

SEQ ID NO: 185583 - DNA, 16 bp, P. troglodytes
aaagtatattttctaa

SEQ ID NO: 185584 - DNA, 16 bp, P. troglodytes
aaagtatattttgtct

SEQ ID NO: 185585 - DNA, 16 bp, P. troglodytes
aaagtatgatttttaa

SEQ ID NO: 185586 - DNA, 16 bp, P. troglodytes
aaagtatggacagcca

SEQ ID NO: 185587 - DNA, 16 bp, P. troglodytes
aaagtattaaacattt

SEQ ID NO: 185588 - DNA, 16 bp, P. troglodytes
aaagtattcaagatgt

SEQ ID NO: 185589 - DNA, 16 bp, P. troglodytes
aaagtattctaaaata

SEQ ID NO: 185590 - DNA, 16 bp, P. troglodytes
aaagtatttattgagt

SEQ ID NO: 185591 - DNA, 16 bp, P. troglodytes
aaagtatttcagaaaa

SEQ ID NO: 185592 - DNA, 16 bp, P. troglodytes
aaagtatttctaaaat

SEQ ID NO: 185593 - DNA, 16 bp, P. troglodytes
aaagtatttgaagaaa

SEQ ID NO: 185594 - DNA, 16 bp, P. troglodytes
aaagtatttgcaaact

SEQ ID NO: 185595 - DNA, 16 bp, P. troglodytes
aaagtattttatcttt

SEQ ID NO: 185596 - DNA, 16 bp, P. troglodytes
aaagtattttgtaaaa

SEQ ID NO: 185597 - DNA, 16 bp, P. troglodytes
aaagtattttttcaaa

SEQ ID NO: 185598 - DNA, 16 bp, P. troglodytes
aaagtcaaaaaattat

SEQ ID NO: 185599 - DNA, 16 bp, P. troglodytes
aaagtcaaaagataat

SEQ ID NO: 185600 - DNA, 16 bp, P. troglodytes
aaagtcaacttttttt

SEQ ID NO: 185601 - DNA, 16 bp, P. troglodytes
aaagtcaagaaacaga

SEQ ID NO: 185602 - DNA, 16 bp, P. troglodytes
aaagtcaagctgggaa

SEQ ID NO: 185603 - DNA, 16 bp, P. troglodytes
aaagtcaaggagaaaa

SEQ ID NO: 185604 - DNA, 16 bp, P. troglodytes
aaagtcaataaatatt

SEQ ID NO: 185605 - DNA, 16 bp, P. troglodytes
aaagtcaatattttaa

SEQ ID NO: 185606 - DNA, 16 bp, P. troglodytes
aaagtcaatttttaaa

SEQ ID NO: 185607 - DNA, 16 bp, P. troglodytes
aaagtcacacagctga

SEQ ID NO: 185608 - DNA, 16 bp, P. troglodytes
aaagtcacagagctag

SEQ ID NO: 185609 - DNA, 16 bp, P. troglodytes
aaagtcactttttaaa

SEQ ID NO: 185610 - DNA, 16 bp, P. troglodytes
aaagtcaggaaacaaa

SEQ ID NO: 185611 - DNA, 16 bp, P. troglodytes
aaagtcagtttgaaaa

SEQ ID NO: 185612 - DNA, 16 bp, P. troglodytes
aaagtcataaaaatat

SEQ ID NO: 185613 - DNA, 16 bp, P. troglodytes
aaagtcatattttatt

SEQ ID NO: 185614 - DNA, 16 bp, P. troglodytes
aaagtcatccataagg

SEQ ID NO: 185615 - DNA, 16 bp, P. troglodytes
aaagtcatgaagatat

SEQ ID NO: 185616 - DNA, 16 bp, P. troglodytes
aaagtcattggaattt

SEQ ID NO: 185617 - DNA, 16 bp, P. troglodytes
aaagtcatttatattt

SEQ ID NO: 185618 - DNA, 16 bp, P. troglodytes
aaagtcatttttcaaa

SEQ ID NO: 185619 - DNA, 16 bp, P. troglodytes
aaagtcattttttaaa

SEQ ID NO: 185620 - DNA, 16 bp, P. troglodytes
aaagtccaaagtccaa

SEQ ID NO: 185621 - DNA, 16 bp, P. troglodytes
aaagtccaaagtccag

SEQ ID NO: 185622 - DNA, 16 bp, P. troglodytes
aaagtccaagcatgtt

SEQ ID NO: 185623 - DNA, 16 bp, P. troglodytes
aaagtccacagtccaa

SEQ ID NO: 185624 - DNA, 16 bp, P. troglodytes
aaagtccaggaacaga

SEQ ID NO: 185625 - DNA, 16 bp, P. troglodytes
aaagtccaggacctga

SEQ ID NO: 185626 - DNA, 16 bp, P. troglodytes
aaagtcctagaagaaa

SEQ ID NO: 185627 - DNA, 17 bp, P. troglodytes
aaagtcctaggattata

SEQ ID NO: 185628 - DNA, 16 bp, P. troglodytes
aaagtctcacaaatca

SEQ ID NO: 185629 - DNA, 16 bp, P. troglodytes
aaagtctcactctgtc

SEQ ID NO: 185630 - DNA, 16 bp, P. troglodytes
aaagtctcatctgaga

SEQ ID NO: 185631 - DNA, 16 bp, P. troglodytes
aaagtctccctctgtc

SEQ ID NO: 185632 - DNA, 16 bp, P. troglodytes
aaagtctctcatcaaa

SEQ ID NO: 185633 - DNA, 16 bp, P. troglodytes
aaagtctggaagaaaa

SEQ ID NO: 185634 - DNA, 16 bp, P. troglodytes
aaagtctggcagagac

SEQ ID NO: 185635 - DNA, 16 bp, P. troglodytes
aaagtctgtacatatt

SEQ ID NO: 185636 - DNA, 16 bp, P. troglodytes
aaagtcttaactcatt

SEQ ID NO: 185637 - DNA, 16 bp, P. troglodytes
aaagtcttaactcttt

SEQ ID NO: 185638 - DNA, 16 bp, P. troglodytes
aaagtcttagaagaaa

SEQ ID NO: 185639 - DNA, 16 bp, P. troglodytes
aaagtcttatctgaga

SEQ ID NO: 185640 - DNA, 16 bp, P. troglodytes
aaagtcttcccaagaa

SEQ ID NO: 185641 - DNA, 16 bp, P. troglodytes
aaagtcttgctgtgtc

SEQ ID NO: 185642 - DNA, 16 bp, P. troglodytes
aaagtctttaaatatt

SEQ ID NO: 185643 - DNA, 16 bp, P. troglodytes
aaagtctttttttctt

SEQ ID NO: 185644 - DNA, 16 bp, P. troglodytes
aaagtgaaaagacagc

SEQ ID NO: 185645 - DNA, 16 bp, P. troglodytes
aaagtgaaacagcttt

SEQ ID NO: 185646 - DNA, 16 bp, P. troglodytes
aaagtgaaaccccatc

SEQ ID NO: 185647 - DNA, 16 bp, P. troglodytes
aaagtgaaatattcaa

SEQ ID NO: 185648 - DNA, 16 bp, P. troglodytes
aaagtgaaattttatt

SEQ ID NO: 185649 - DNA, 16 bp, P. troglodytes
aaagtgaacattttaa

SEQ ID NO: 185650 - DNA, 16 bp, P. troglodytes
aaagtgaagaaaatgt

SEQ ID NO: 185651 - DNA, 16 bp, P. troglodytes
aaagtgaagacacaac

SEQ ID NO: 185652 - DNA, 16 bp, P. troglodytes
aaagtgaagatgtaga

SEQ ID NO: 185653 - DNA, 16 bp, P. troglodytes
aaagtgaagcccatca

SEQ ID NO: 185654 - DNA, 16 bp, P. troglodytes
aaagtgaatatatttt

SEQ ID NO: 185655 - DNA, 16 bp, P. troglodytes
aaagtgaattttattt

SEQ ID NO: 185656 - DNA, 16 bp, P. troglodytes
aaagtgaatttttaaa

SEQ ID NO: 185657 - DNA, 16 bp, P. troglodytes
aaagtgacaggaaaca

SEQ ID NO: 185658 - DNA, 16 bp, P. troglodytes
aaagtgagaaagatct

SEQ ID NO: 185659 - DNA, 16 bp, P. troglodytes
aaagtgaggaaacaac

SEQ ID NO: 185660 - DNA, 16 bp, P. troglodytes
aaagtgaggctcaaag

SEQ ID NO: 185661 - DNA, 16 bp, P. troglodytes
aaagtgagtctcttat

SEQ ID NO: 185662 - DNA, 16 bp, P. troglodytes
aaagtgatattttaaa

SEQ ID NO: 185663 - DNA, 16 bp, P. troglodytes
aaagtgatctgcccac

SEQ ID NO: 185664 - DNA, 16 bp, P. troglodytes
aaagtgattattgata

SEQ ID NO: 185665 - DNA, 16 bp, P. troglodytes
aaagtgatttacagat

SEQ ID NO: 185666 - DNA, 16 bp, P. troglodytes
aaagtgccacctccca

SEQ ID NO: 185667 - DNA, 20 bp, P. troglodytes
aaagtgccgggattacaggc

SEQ ID NO: 185668 - DNA, 16 bp, P. troglodytes
aaagtgcctgctccca

SEQ ID NO: 185669 - DNA, 16 bp, P. troglodytes
aaagtgcgggattaca

SEQ ID NO: 185670 - DNA, 16 bp, P. troglodytes
aaagtgctaaaggaaa

SEQ ID NO: 185671 - DNA, 16 bp, P. troglodytes
aaagtgctgaagaaaa

SEQ ID NO: 185672 - DNA, 16 bp, P. troglodytes
aaagtgctgagactat

SEQ ID NO: 185673 - DNA, 16 bp, P. troglodytes
aaagtgctgagattag

SEQ ID NO: 185674 - DNA, 16 bp, P. troglodytes
aaagtgctgcgattac

SEQ ID NO: 185675 - DNA, 16 bp, P. troglodytes
aaagtgctgctccagt

SEQ ID NO: 185676 - DNA, 16 bp, P. troglodytes
aaagtgctggaataca

SEQ ID NO: 185677 - DNA, 18 bp, P. troglodytes
aaagtgctggaattacaa

SEQ ID NO: 185678 - DNA, 16 bp, P. troglodytes
aaagtgcttaaaacag

SEQ ID NO: 185679 - DNA, 16 bp, P. troglodytes
aaagtgcttagaacag

SEQ ID NO: 185680 - DNA, 16 bp, P. troglodytes
aaagtgcttagcacag

SEQ ID NO: 185681 - DNA, 16 bp, P. troglodytes
aaagtgcttagcagag

SEQ ID NO: 185682 - DNA, 16 bp, P. troglodytes
aaagtgctttataaat

SEQ ID NO: 185683 - DNA, 16 bp, P. troglodytes
aaagtgctttgaaaat

SEQ ID NO: 185684 - DNA, 16 bp, P. troglodytes
aaagtggaagcattcc

SEQ ID NO: 185685 - DNA, 16 bp, P. troglodytes
aaagtggaatcataca

SEQ ID NO: 185686 - DNA, 16 bp, P. troglodytes
aaagtgggaccagggg

SEQ ID NO: 185687 - DNA, 16 bp, P. troglodytes
aaagtgggcaaaatat

SEQ ID NO: 185688 - DNA, 16 bp, P. troglodytes
aaagtgggcaaaggcc

SEQ ID NO: 185689 - DNA, 16 bp, P. troglodytes
aaagtggggtattgaa

SEQ ID NO: 185690 - DNA, 16 bp, P. troglodytes
aaagtggtaaaagtat

SEQ ID NO: 185691 - DNA, 16 bp, P. troglodytes
aaagtggtatctcatt

SEQ ID NO: 185692 - DNA, 16 bp, P. troglodytes
aaagtggtgggataac

SEQ ID NO: 185693 - DNA, 16 bp, P. troglodytes
aaagtggttaatttta

SEQ ID NO: 185694 - DNA, 16 bp, P. troglodytes
aaagtgtgaagacaag

SEQ ID NO: 185695 - DNA, 16 bp, P. troglodytes
aaagtgtgcggcacct

SEQ ID NO: 185696 - DNA, 16 bp, P. troglodytes
aaagtgtgtgtggggg

SEQ ID NO: 185697 - DNA, 16 bp, P. troglodytes
aaagtgttggggatta

SEQ ID NO: 185698 - DNA, 16 bp, P. troglodytes
aaagtgtttaataaat

SEQ ID NO: 185699 - DNA, 16 bp, P. troglodytes
aaagtgtttagaacag

SEQ ID NO: 185700 - DNA, 16 bp, P. troglodytes
aaagtgttttaaaaat

SEQ ID NO: 185701 - DNA, 16 bp, P. troglodytes
aaagttaaaacatttt

SEQ ID NO: 185702 - DNA, 16 bp, P. troglodytes
aaagttaaaactataa

SEQ ID NO: 185703 - DNA, 16 bp, P. troglodytes
aaagttagccaggcat

SEQ ID NO: 185704 - DNA, 23 bp, P. troglodytes
aaagttagccaggcgtggtggca

SEQ ID NO: 185705 - DNA, 24 bp, P. troglodytes
aaagttagccgggcgtggtggcag

SEQ ID NO: 185706 - DNA, 16 bp, P. troglodytes
aaagttagtagaagga

SEQ ID NO: 185707 - DNA, 16 bp, P. troglodytes
aaagttataaaaatca

SEQ ID NO: 185708 - DNA, 16 bp, P. troglodytes
aaagttatacatgaat

SEQ ID NO: 185709 - DNA, 16 bp, P. troglodytes
aaagttatatgtggat

SEQ ID NO: 185710 - DNA, 16 bp, P. troglodytes
aaagttattctttttc

SEQ ID NO: 185711 - DNA, 16 bp, P. troglodytes
aaagttattgaagaaa

SEQ ID NO: 185712 - DNA, 16 bp, P. troglodytes
aaagttatttatttct

SEQ ID NO: 185713 - DNA, 16 bp, P. troglodytes
aaagttcaaaaatatt

SEQ ID NO: 185714 - DNA, 16 bp, P. troglodytes
aaagttcaacatcact

SEQ ID NO: 185715 - DNA, 16 bp, P. troglodytes
aaagttcaggaccaga

SEQ ID NO: 185716 - DNA, 16 bp, P. troglodytes
aaagttccttttaaaa

SEQ ID NO: 185717 - DNA, 16 bp, P. troglodytes
aaagttctgagacatt

SEQ ID NO: 185718 - DNA, 16 bp, P. troglodytes
aaagttctggaagaaa

SEQ ID NO: 185719 - DNA, 16 bp, P. troglodytes
aaagttctgggatttc

SEQ ID NO: 185720 - DNA, 16 bp, P. troglodytes
aaagttctgtagatgt

SEQ ID NO: 185721 - DNA, 16 bp, P. troglodytes
aaagttcttaaaaata

SEQ ID NO: 185722 - DNA, 16 bp, P. troglodytes
aaagttctttatatat

SEQ ID NO: 185723 - DNA, 16 bp, P. troglodytes
aaagttcttttttaaa

SEQ ID NO: 185724 - DNA, 16 bp, P. troglodytes
aaagttgaacaaattg

SEQ ID NO: 185725 - DNA, 16 bp, P. troglodytes
aaagttgaacttctga

SEQ ID NO: 185726 - DNA, 16 bp, P. troglodytes
aaagttgaattttaaa

SEQ ID NO: 185727 - DNA, 16 bp, P. troglodytes
aaagttgcaaagacag

SEQ ID NO: 185728 - DNA, 16 bp, P. troglodytes
aaagttgccaaaaaca

SEQ ID NO: 185729 - DNA, 16 bp, P. troglodytes
aaagttgccatgaaca

SEQ ID NO: 185730 - DNA, 16 bp, P. troglodytes
aaagttgctttttttt

SEQ ID NO: 185731 - DNA, 16 bp, P. troglodytes
aaagttgtacatattt

SEQ ID NO: 185732 - DNA, 16 bp, P. troglodytes
aaagttgtatatattt

SEQ ID NO: 185733 - DNA, 17 bp, P. troglodytes
aaagttgtcaagatgct

SEQ ID NO: 185734 - DNA, 16 bp, P. troglodytes
aaagttgtttctttga

SEQ ID NO: 185735 - DNA, 16 bp, P. troglodytes
aaagttgttttaaaaa

SEQ ID NO: 185736 - DNA, 16 bp, P. troglodytes
aaagtttaaaaagtga

SEQ ID NO: 185737 - DNA, 16 bp, P. troglodytes
aaagtttaaatgtttt

SEQ ID NO: 185738 - DNA, 16 bp, P. troglodytes
aaagtttaagtaactt

SEQ ID NO: 185739 - DNA, 16 bp, P. troglodytes
aaagtttaatttgaaa

SEQ ID NO: 185740 - DNA, 16 bp, P. troglodytes
aaagtttacatttttt

SEQ ID NO: 185741 - DNA, 16 bp, P. troglodytes
aaagtttacttttaaa

SEQ ID NO: 185742 - DNA, 16 bp, P. troglodytes
aaagtttagtttataa

SEQ ID NO: 185743 - DNA, 16 bp, P. troglodytes
aaagtttattttctat

SEQ ID NO: 185744 - DNA, 16 bp, P. troglodytes
aaagtttcagaaagaa

SEQ ID NO: 185745 - DNA, 16 bp, P. troglodytes
aaagtttcagattttg

SEQ ID NO: 185746 - DNA, 16 bp, P. troglodytes
aaagtttcaggataaa

SEQ ID NO: 185747 - DNA, 16 bp, P. troglodytes
aaagtttcatttcttt

SEQ ID NO: 185748 - DNA, 16 bp, P. troglodytes
aaagtttcccttcttg

SEQ ID NO: 185749 - DNA, 16 bp, P. troglodytes
aaagtttctttaaaaa

SEQ ID NO: 185750 - DNA, 16 bp, P. troglodytes
aaagtttctttctttc

SEQ ID NO: 185751 - DNA, 16 bp, P. troglodytes
aaagtttctttgaaaa

SEQ ID NO: 185752 - DNA, 16 bp, P. troglodytes
aaagtttgagaactgc

SEQ ID NO: 185753 - DNA, 16 bp, P. troglodytes
aaagtttgagaagcat

SEQ ID NO: 185754 - DNA, 16 bp, P. troglodytes
aaagtttggaaaattt

SEQ ID NO: 185755 - DNA, 16 bp, P. troglodytes
aaagtttgtgttttct

SEQ ID NO: 185756 - DNA, 16 bp, P. troglodytes
aaagttttaaagtatt

SEQ ID NO: 185757 - DNA, 16 bp, P. troglodytes
aaagttttaactttta

SEQ ID NO: 185758 - DNA, 16 bp, P. troglodytes
aaagttttaagttttc

SEQ ID NO: 185759 - DNA, 16 bp, P. troglodytes
aaagttttagggtaca

SEQ ID NO: 185760 - DNA, 16 bp, P. troglodytes
aaagttttatctctgt

SEQ ID NO: 185761 - DNA, 16 bp, P. troglodytes
aaagttttattctttt

SEQ ID NO: 185762 - DNA, 16 bp, P. troglodytes
aaagttttattggaac

SEQ ID NO: 185763 - DNA, 16 bp, P. troglodytes
aaagttttatttcaaa

SEQ ID NO: 185764 - DNA, 16 bp, P. troglodytes
aaagttttcacttttt

SEQ ID NO: 185765 - DNA, 16 bp, P. troglodytes
aaagttttcagctttt

SEQ ID NO: 185766 - DNA, 16 bp, P. troglodytes
aaagttttcattttca

SEQ ID NO: 185767 - DNA, 16 bp, P. troglodytes
aaagttttctgctatt

SEQ ID NO: 185768 - DNA, 16 bp, P. troglodytes
aaagttttcttcattt

SEQ ID NO: 185769 - DNA, 16 bp, P. troglodytes
aaagtttttaaaaagt

SEQ ID NO: 185770 - DNA, 16 bp, P. troglodytes
aaagtttttatctttt

SEQ ID NO: 185771 - DNA, 16 bp, P. troglodytes
aaagtttttctgtttt

SEQ ID NO: 185772 - DNA, 16 bp, P. troglodytes
aaagtttttctttctt

SEQ ID NO: 185773 - DNA, 16 bp, P. troglodytes
aaagttttttttaaag

SEQ ID NO: 185774 - DNA, 16 bp, P. troglodytes
aaagttttttttcctt

SEQ ID NO: 185775 - DNA, 16 bp, P. troglodytes
aaagtttttttttcct

SEQ ID NO: 185776 - DNA, 16 bp, P. troglodytes
aaataaaaaatactgt

SEQ ID NO: 185777 - DNA, 16 bp, P. troglodytes
aaataaaaaatgagct

SEQ ID NO: 185778 - DNA, 16 bp, P. troglodytes
aaataaaaacactgtt

SEQ ID NO: 185779 - DNA, 16 bp, P. troglodytes
aaataaaaactgattt

SEQ ID NO: 185780 - DNA, 16 bp, P. troglodytes
aaataaaaacttttgt

SEQ ID NO: 185781 - DNA, 16 bp, P. troglodytes
aaataaaaagcagtga

SEQ ID NO: 185782 - DNA, 16 bp, P. troglodytes
aaataaaaagcatcca

SEQ ID NO: 185783 - DNA, 16 bp, P. troglodytes
aaataaaaagcattat

SEQ ID NO: 185784 - DNA, 16 bp, P. troglodytes
aaataaaaagggtttt

SEQ ID NO: 185785 - DNA, 16 bp, P. troglodytes
aaataaaaagtgctat

SEQ ID NO: 185786 - DNA, 16 bp, P. troglodytes
aaataaaaatcacatg

SEQ ID NO: 185787 - DNA, 16 bp, P. troglodytes
aaataaaaatcacctt

SEQ ID NO: 185788 - DNA, 16 bp, P. troglodytes
aaataaaaatcatgat

SEQ ID NO: 185789 - DNA, 16 bp, P. troglodytes
aaataaaaatctgtaa

SEQ ID NO: 185790 - DNA, 16 bp, P. troglodytes
aaataaaaatgttaca

SEQ ID NO: 185791 - DNA, 16 bp, P. troglodytes
aaataaaaattagcca

SEQ ID NO: 185792 - DNA, 16 bp, P. troglodytes
aaataaaaattcaagt

SEQ ID NO: 185793 - DNA, 16 bp, P. troglodytes
aaataaaacaggacac

SEQ ID NO: 185794 - DNA, 16 bp, P. troglodytes
aaataaaacagggtga

SEQ ID NO: 185795 - DNA, 16 bp, P. troglodytes
aaataaaacatctttt

SEQ ID NO: 185796 - DNA, 16 bp, P. troglodytes
aaataaaacatgttaa

SEQ ID NO: 185797 - DNA, 16 bp, P. troglodytes
aaataaaacattcagt

SEQ ID NO: 185798 - DNA, 16 bp, P. troglodytes
aaataaaacattttct

SEQ ID NO: 185799 - DNA, 16 bp, P. troglodytes
aaataaaacatttttc

SEQ ID NO: 185800 - DNA, 16 bp, P. troglodytes
aaataaaacctcagct

SEQ ID NO: 185801 - DNA, 16 bp, P. troglodytes
aaataaaaccttattt

SEQ ID NO: 185802 - DNA, 16 bp, P. troglodytes
aaataaaactaaatgt

SEQ ID NO: 185803 - DNA, 16 bp, P. troglodytes
aaataaaactcatttt

SEQ ID NO: 185804 - DNA, 16 bp, P. troglodytes
aaataaaactgatttt

SEQ ID NO: 185805 - DNA, 16 bp, P. troglodytes
aaataaaactggcttt

SEQ ID NO: 185806 - DNA, 16 bp, P. troglodytes
aaataaaactgtcttt

SEQ ID NO: 185807 - DNA, 16 bp, P. troglodytes
aaataaaactgtttct

SEQ ID NO: 185808 - DNA, 16 bp, P. troglodytes
aaataaaactttgaat

SEQ ID NO: 185809 - DNA, 16 bp, P. troglodytes
aaataaaacttttaag

SEQ ID NO: 185810 - DNA, 16 bp, P. troglodytes
aaataaaagaattttc

SEQ ID NO: 185811 - DNA, 16 bp, P. troglodytes
aaataaaagacatttt

SEQ ID NO: 185812 - DNA, 16 bp, P. troglodytes
aaataaaagactattt

SEQ ID NO: 185813 - DNA, 29 bp, P. troglodytes
aaataaaagaggatacaaacaaatggaag

SEQ ID NO: 185814 - DNA, 16 bp, P. troglodytes
aaataaaagatttttg

SEQ ID NO: 185815 - DNA, 16 bp, P. troglodytes
aaataaaagcatttaa

SEQ ID NO: 185816 - DNA, 16 bp, P. troglodytes
aaataaaagcatttat

SEQ ID NO: 185817 - DNA, 16 bp, P. troglodytes
aaataaaagcatttct

SEQ ID NO: 185818 - DNA, 16 bp, P. troglodytes
aaataaaagctaattt

SEQ ID NO: 185819 - DNA, 16 bp, P. troglodytes
aaataaaaggaaattc

SEQ ID NO: 185820 - DNA, 16 bp, P. troglodytes
aaataaaaggcatcca

SEQ ID NO: 185821 - DNA, 16 bp, P. troglodytes
aaataaaaggcttcca

SEQ ID NO: 185822 - DNA, 16 bp, P. troglodytes
aaataaaaggtatcca

SEQ ID NO: 185823 - DNA, 16 bp, P. troglodytes
aaataaaaggtattca

SEQ ID NO: 185824 - DNA, 16 bp, P. troglodytes
aaataaaagtgttatt

SEQ ID NO: 185825 - DNA, 16 bp, P. troglodytes
aaataaaagttcattt

SEQ ID NO: 185826 - DNA, 16 bp, P. troglodytes
aaataaaagttttcat

SEQ ID NO: 185827 - DNA, 16 bp, P. troglodytes
aaataaaatacacatg

SEQ ID NO: 185828 - DNA, 16 bp, P. troglodytes
aaataaaatacagatt

SEQ ID NO: 185829 - DNA, 16 bp, P. troglodytes
aaataaaatacttaag

SEQ ID NO: 185830 - DNA, 16 bp, P. troglodytes
aaataaaatagtgttg

SEQ ID NO: 185831 - DNA, 16 bp, P. troglodytes
aaataaaatattctga

SEQ ID NO: 185832 - DNA, 16 bp, P. troglodytes
aaataaaatcaatgca

SEQ ID NO: 185833 - DNA, 16 bp, P. troglodytes
aaataaaatcagaagt

SEQ ID NO: 185834 - DNA, 16 bp, P. troglodytes
aaataaaatcagtttt

SEQ ID NO: 185835 - DNA, 16 bp, P. troglodytes
aaataaaatcatgtct

SEQ ID NO: 185836 - DNA, 16 bp, P. troglodytes
aaataaaatcctttct

SEQ ID NO: 185837 - DNA, 16 bp, P. troglodytes
aaataaaatctgaata

SEQ ID NO: 185838 - DNA, 16 bp, P. troglodytes
aaataaaatctgtttt

SEQ ID NO: 185839 - DNA, 16 bp, P. troglodytes
aaataaaatgaaactt

SEQ ID NO: 185840 - DNA, 16 bp, P. troglodytes
aaataaaatgaggtat

SEQ ID NO: 185841 - DNA, 16 bp, P. troglodytes
aaataaaatgatatct

SEQ ID NO: 185842 - DNA, 16 bp, P. troglodytes
aaataaaatgcacata

SEQ ID NO: 185843 - DNA, 16 bp, P. troglodytes
aaataaaatgtatact

SEQ ID NO: 185844 - DNA, 16 bp, P. troglodytes
aaataaaatgtgtcat

SEQ ID NO: 185845 - DNA, 16 bp, P. troglodytes
aaataaaatgttctat

SEQ ID NO: 185846 - DNA, 16 bp, P. troglodytes
aaataaaatgttctgt

SEQ ID NO: 185847 - DNA, 16 bp, P. troglodytes
aaataaaatgtttact

SEQ ID NO: 185848 - DNA, 16 bp, P. troglodytes
aaataaaatgtttgtt

SEQ ID NO: 185849 - DNA, 16 bp, P. troglodytes
aaataaaatgttttca

SEQ ID NO: 185850 - DNA, 16 bp, P. troglodytes
aaataaaattcagaat

SEQ ID NO: 185851 - DNA, 16 bp, P. troglodytes
aaataaaattccattt

SEQ ID NO: 185852 - DNA, 16 bp, P. troglodytes
aaataaaattctcatt

SEQ ID NO: 185853 - DNA, 16 bp, P. troglodytes
aaataaaattctcttt

SEQ ID NO: 185854 - DNA, 16 bp, P. troglodytes
aaataaaattctttca

SEQ ID NO: 185855 - DNA, 16 bp, P. troglodytes
aaataaaattgcataa

SEQ ID NO: 185856 - DNA, 16 bp, P. troglodytes
aaataaaattgtgtat

SEQ ID NO: 185857 - DNA, 16 bp, P. troglodytes
aaataaaatttccttt

SEQ ID NO: 185858 - DNA, 16 bp, P. troglodytes
aaataaaatttgaact

SEQ ID NO: 185859 - DNA, 16 bp, P. troglodytes
aaataaaatttgtttc

SEQ ID NO: 185860 - DNA, 16 bp, P. troglodytes
aaataaaattttctca

SEQ ID NO: 185861 - DNA, 16 bp, P. troglodytes
aaataaacaaatggga

SEQ ID NO: 185862 - DNA, 18 bp, P. troglodytes
aaataaacacaatcagaa

SEQ ID NO: 185863 - DNA, 16 bp, P. troglodytes
aaataaacacatagat

SEQ ID NO: 185864 - DNA, 16 bp, P. troglodytes
aaataaacagattttt

SEQ ID NO: 185865 - DNA, 16 bp, P. troglodytes
aaataaacagtatttt

SEQ ID NO: 185866 - DNA, 16 bp, P. troglodytes
aaataaacatcagttt

SEQ ID NO: 185867 - DNA, 16 bp, P. troglodytes
aaataaacatgtgaaa

SEQ ID NO: 185868 - DNA, 16 bp, P. troglodytes
aaataaacattgaaat

SEQ ID NO: 185869 - DNA, 16 bp, P. troglodytes
aaataaacctctttat

SEQ ID NO: 185870 - DNA, 16 bp, P. troglodytes
aaataaacctcttttc

SEQ ID NO: 185871 - DNA, 16 bp, P. troglodytes
aaataaacctttttaa

SEQ ID NO: 185872 - DNA, 16 bp, P. troglodytes
aaataaaccttttttt

SEQ ID NO: 185873 - DNA, 16 bp, P. troglodytes
aaataaactagaagat

SEQ ID NO: 185874 - DNA, 16 bp, P. troglodytes
aaataaactagagaat

SEQ ID NO: 185875 - DNA, 16 bp, P. troglodytes
aaataaactaggaaat

SEQ ID NO: 185876 - DNA, 16 bp, P. troglodytes
aaataaactattagaa

SEQ ID NO: 185877 - DNA, 16 bp, P. troglodytes
aaataaactcaaaatg

SEQ ID NO: 185878 - DNA, 16 bp, P. troglodytes
aaataaactgaaattt

SEQ ID NO: 185879 - DNA, 16 bp, P. troglodytes
aaataaactgtaaaat

SEQ ID NO: 185880 - DNA, 16 bp, P. troglodytes
aaataaacttgaaaat

SEQ ID NO: 185881 - DNA, 16 bp, P. troglodytes
aaataaacttttcatt

SEQ ID NO: 185882 - DNA, 16 bp, P. troglodytes
aaataaacttttctaa

SEQ ID NO: 185883 - DNA, 16 bp, P. troglodytes
aaataaagaacaattt

SEQ ID NO: 185884 - DNA, 16 bp, P. troglodytes
aaataaagaacattta

SEQ ID NO: 185885 - DNA, 16 bp, P. troglodytes
aaataaagacattttt

SEQ ID NO: 185886 - DNA, 16 bp, P. troglodytes
aaataaagatgatttt

SEQ ID NO: 185887 - DNA, 16 bp, P. troglodytes
aaataaagatgttatt

SEQ ID NO: 185888 - DNA, 16 bp, P. troglodytes
aaataaagccaggaaa

SEQ ID NO: 185889 - DNA, 16 bp, P. troglodytes
aaataaagctaattaa

SEQ ID NO: 185890 - DNA, 16 bp, P. troglodytes
aaataaagctgtcttt

SEQ ID NO: 185891 - DNA, 16 bp, P. troglodytes
aaataaagcttatttt

SEQ ID NO: 185892 - DNA, 16 bp, P. troglodytes
aaataaagctttattg

SEQ ID NO: 185893 - DNA, 16 bp, P. troglodytes
aaataaagctttattt

SEQ ID NO: 185894 - DNA, 16 bp, P. troglodytes
aaataaagcttttaaa

SEQ ID NO: 185895 - DNA, 16 bp, P. troglodytes
aaataaaggcagaaat

SEQ ID NO: 185896 - DNA, 16 bp, P. troglodytes
aaataaaggctattca

SEQ ID NO: 185897 - DNA, 16 bp, P. troglodytes
aaataaagggacagaa

SEQ ID NO: 185898 - DNA, 16 bp, P. troglodytes
aaataaagggcattca

SEQ ID NO: 185899 - DNA, 16 bp, P. troglodytes
aaataaagggtatttg

SEQ ID NO: 185900 - DNA, 16 bp, P. troglodytes
aaataaagtacatttt

SEQ ID NO: 185901 - DNA, 16 bp, P. troglodytes
aaataaagtagtattg

SEQ ID NO: 185902 - DNA, 16 bp, P. troglodytes
aaataaagtcaatttt

SEQ ID NO: 185903 - DNA, 16 bp, P. troglodytes
aaataaagtcactttt

SEQ ID NO: 185904 - DNA, 16 bp, P. troglodytes
aaataaagtctatttt

SEQ ID NO: 185905 - DNA, 16 bp, P. troglodytes
aaataaagtctttaaa

SEQ ID NO: 185906 - DNA, 16 bp, P. troglodytes
aaataaagttcatttt

SEQ ID NO: 185907 - DNA, 16 bp, P. troglodytes
aaataaagtttaattg

SEQ ID NO: 185908 - DNA, 16 bp, P. troglodytes
aaataaagtttactaa

SEQ ID NO: 185909 - DNA, 16 bp, P. troglodytes
aaataaagttttcttt

SEQ ID NO: 185910 - DNA, 16 bp, P. troglodytes
aaataaataaagctta

SEQ ID NO: 185911 - DNA, 16 bp, P. troglodytes
aaataaataaaggcca

SEQ ID NO: 185912 - DNA, 16 bp, P. troglodytes
aaataaataaatggct

SEQ ID NO: 185913 - DNA, 16 bp, P. troglodytes
aaataaataatgactg

SEQ ID NO: 185914 - DNA, 16 bp, P. troglodytes
aaataaatacctattt

SEQ ID NO: 185915 - DNA, 16 bp, P. troglodytes
aaataaatacttttca

SEQ ID NO: 185916 - DNA, 16 bp, P. troglodytes
aaataaatagctgggc

SEQ ID NO: 185917 - DNA, 16 bp, P. troglodytes
aaataaatatgctaaa

SEQ ID NO: 185918 - DNA, 16 bp, P. troglodytes
aaataaatattggcaa

SEQ ID NO: 185919 - DNA, 16 bp, P. troglodytes
aaataaatatttgttg

SEQ ID NO: 185920 - DNA, 16 bp, P. troglodytes
aaataaatccatgtat

SEQ ID NO: 185921 - DNA, 16 bp, P. troglodytes
aaataaatgaatgaac

SEQ ID NO: 185922 - DNA, 16 bp, P. troglodytes
aaataaatgaatttca

SEQ ID NO: 185923 - DNA, 16 bp, P. troglodytes
aaataaatgcattttg

SEQ ID NO: 185924 - DNA, 16 bp, P. troglodytes
aaataaatgcattttt

SEQ ID NO: 185925 - DNA, 16 bp, P. troglodytes
aaataaatgcctgttg

SEQ ID NO: 185926 - DNA, 16 bp, P. troglodytes
aaataaatgctcattt

SEQ ID NO: 185927 - DNA, 16 bp, P. troglodytes
aaataaatgcttaaat

SEQ ID NO: 185928 - DNA, 16 bp, P. troglodytes
aaataaatgcttattt

SEQ ID NO: 185929 - DNA, 16 bp, P. troglodytes
aaataaatggaacaga

SEQ ID NO: 185930 - DNA, 16 bp, P. troglodytes
aaataaatggaagaac

SEQ ID NO: 185931 - DNA, 16 bp, P. troglodytes
aaataaatggagatat

SEQ ID NO: 185932 - DNA, 16 bp, P. troglodytes
aaataaatggctgttg

SEQ ID NO: 185933 - DNA, 16 bp, P. troglodytes
aaataaatgtacaatt

SEQ ID NO: 185934 - DNA, 16 bp, P. troglodytes
aaataaatgtatgtat

SEQ ID NO: 185935 - DNA, 16 bp, P. troglodytes
aaataaatgtcttcaa

SEQ ID NO: 185936 - DNA, 16 bp, P. troglodytes
aaataaatgtgcattt

SEQ ID NO: 185937 - DNA, 16 bp, P. troglodytes
aaataaatgtgtatat

SEQ ID NO: 185938 - DNA, 16 bp, P. troglodytes
aaataaatgttattct

SEQ ID NO: 185939 - DNA, 16 bp, P. troglodytes
aaataaatgtttaact

SEQ ID NO: 185940 - DNA, 16 bp, P. troglodytes
aaataaatgtttcttt

SEQ ID NO: 185941 - DNA, 16 bp, P. troglodytes
aaataaatgttttcct

SEQ ID NO: 185942 - DNA, 16 bp, P. troglodytes
aaataaattatgtcat

SEQ ID NO: 185943 - DNA, 16 bp, P. troglodytes
aaataaattatttctg

SEQ ID NO: 185944 - DNA, 16 bp, P. troglodytes
aaataaattcacattt

SEQ ID NO: 185945 - DNA, 16 bp, P. troglodytes
aaataaattcagtaaa

SEQ ID NO: 185946 - DNA, 16 bp, P. troglodytes
aaataaattcagtaat

SEQ ID NO: 185947 - DNA, 16 bp, P. troglodytes
aaataaattcctttct

SEQ ID NO: 185948 - DNA, 16 bp, P. troglodytes
aaataaattgaaaact

SEQ ID NO: 185949 - DNA, 16 bp, P. troglodytes
aaataaattgctttta

SEQ ID NO: 185950 - DNA, 16 bp, P. troglodytes
aaataaatttcctttt

SEQ ID NO: 185951 - DNA, 16 bp, P. troglodytes
aaataaatttcttttg

SEQ ID NO: 185952 - DNA, 16 bp, P. troglodytes
aaataaatttgagaag

SEQ ID NO: 185953 - DNA, 16 bp, P. troglodytes
aaataaatttgtgtgc

SEQ ID NO: 185954 - DNA, 16 bp, P. troglodytes
aaataaatttgttttg

SEQ ID NO: 185955 - DNA, 16 bp, P. troglodytes
aaataaattttagttg

SEQ ID NO: 185956 - DNA, 16 bp, P. troglodytes
aaataacacacattta

SEQ ID NO: 185957 - DNA, 16 bp, P. troglodytes
aaataacagaaaactt

SEQ ID NO: 185958 - DNA, 16 bp, P. troglodytes
aaataacagtggctta

SEQ ID NO: 185959 - DNA, 16 bp, P. troglodytes
aaataacataagctat

SEQ ID NO: 185960 - DNA, 16 bp, P. troglodytes
aaataacatatgtaaa

SEQ ID NO: 185961 - DNA, 16 bp, P. troglodytes
aaataacatatttgaa

SEQ ID NO: 185962 - DNA, 16 bp, P. troglodytes
aaataacattttcttt

SEQ ID NO: 185963 - DNA, 16 bp, P. troglodytes
aaataacatttttcaa

SEQ ID NO: 185964 - DNA, 16 bp, P. troglodytes
aaataaccataaaagt

SEQ ID NO: 185965 - DNA, 16 bp, P. troglodytes
aaataaccatgaaaat

SEQ ID NO: 185966 - DNA, 16 bp, P. troglodytes
aaataactgaaatgaa

SEQ ID NO: 185967 - DNA, 16 bp, P. troglodytes
aaataactgagactgg

SEQ ID NO: 185968 - DNA, 16 bp, P. troglodytes
aaataactgttttaaa

SEQ ID NO: 185969 - DNA, 16 bp, P. troglodytes
aaataacttaaaatag

SEQ ID NO: 185970 - DNA, 16 bp, P. troglodytes
aaataacttgctcaaa

SEQ ID NO: 185971 - DNA, 16 bp, P. troglodytes
aaataacttgttttaa

SEQ ID NO: 185972 - DNA, 16 bp, P. troglodytes
aaataacttgtttttt

SEQ ID NO: 185973 - DNA, 16 bp, P. troglodytes
aaataactttgaaaaa

SEQ ID NO: 185974 - DNA, 16 bp, P. troglodytes
aaataacttttttctc

SEQ ID NO: 185975 - DNA, 16 bp, P. troglodytes
aaataactttttttca

SEQ ID NO: 185976 - DNA, 16 bp, P. troglodytes
aaataagaaaatggca

SEQ ID NO: 185977 - DNA, 17 bp, P. troglodytes
aaataagaacactttta

SEQ ID NO: 185978 - DNA, 16 bp, P. troglodytes
aaataagaatgatttt

SEQ ID NO: 185979 - DNA, 16 bp, P. troglodytes
aaataagacagacaag

SEQ ID NO: 185980 - DNA, 16 bp, P. troglodytes
aaataagagccatcta

SEQ ID NO: 185981 - DNA, 16 bp, P. troglodytes
aaataagcaagtcaca

SEQ ID NO: 185982 - DNA, 16 bp, P. troglodytes
aaataagcatatatat

SEQ ID NO: 185983 - DNA, 16 bp, P. troglodytes
aaataagccaaatttc

SEQ ID NO: 185984 - DNA, 16 bp, P. troglodytes
aaataagctttaaaat

SEQ ID NO: 185985 - DNA, 16 bp, P. troglodytes
aaataaggaatccttt

SEQ ID NO: 185986 - DNA, 16 bp, P. troglodytes
aaataaggttttattt

SEQ ID NO: 185987 - DNA, 16 bp, P. troglodytes
aaataagtcaatcaca

SEQ ID NO: 185988 - DNA, 16 bp, P. troglodytes
aaataagtcattattc

SEQ ID NO: 185989 - DNA, 16 bp, P. troglodytes
aaataagtgaacaaat

SEQ ID NO: 185990 - DNA, 16 bp, P. troglodytes
aaataagtgatttttt

SEQ ID NO: 185991 - DNA, 16 bp, P. troglodytes
aaataagtgtttttaa

SEQ ID NO: 185992 - DNA, 16 bp, P. troglodytes
aaataagttattttct

SEQ ID NO: 185993 - DNA, 16 bp, P. troglodytes
aaataagtttaatgga

SEQ ID NO: 185994 - DNA, 16 bp, P. troglodytes
aaataagttttttgaa

SEQ ID NO: 185995 - DNA, 16 bp, P. troglodytes
aaataataaaagccat

SEQ ID NO: 185996 - DNA, 16 bp, P. troglodytes
aaataataaaagctgt

SEQ ID NO: 185997 - DNA, 16 bp, P. troglodytes
aaataataaagctgga

SEQ ID NO: 185998 - DNA, 16 bp, P. troglodytes
aaataataaagtctat

SEQ ID NO: 185999 - DNA, 16 bp, P. troglodytes
aaataataaatacttg

SEQ ID NO: 186000 - DNA, 16 bp, P. troglodytes
aaataatacagataat

SEQ ID NO: 186001 - DNA, 16 bp, P. troglodytes
aaataatacagatcag

SEQ ID NO: 186002 - DNA, 16 bp, P. troglodytes
aaataatacagatttt

SEQ ID NO: 186003 - DNA, 16 bp, P. troglodytes
aaataatactgatttt

SEQ ID NO: 186004 - DNA, 16 bp, P. troglodytes
aaataatagaaatcat

SEQ ID NO: 186005 - DNA, 16 bp, P. troglodytes
aaataatagaattgct

SEQ ID NO: 186006 - DNA, 16 bp, P. troglodytes
aaataatagcaatgta

SEQ ID NO: 186007 - DNA, 16 bp, P. troglodytes
aaataatagccatcct

SEQ ID NO: 186008 - DNA, 16 bp, P. troglodytes
aaataatagctaatat

SEQ ID NO: 186009 - DNA, 16 bp, P. troglodytes
aaataatatgatgtct

SEQ ID NO: 186010 - DNA, 16 bp, P. troglodytes
aaataatatgcttata

SEQ ID NO: 186011 - DNA, 16 bp, P. troglodytes
aaataatatgtacaca

SEQ ID NO: 186012 - DNA, 16 bp, P. troglodytes
aaataatattccattg

SEQ ID NO: 186013 - DNA, 16 bp, P. troglodytes
aaataatattttccaa

SEQ ID NO: 186014 - DNA, 16 bp, P. troglodytes
aaataatcaaaaggat

SEQ ID NO: 186015 - DNA, 16 bp, P. troglodytes
aaataatcagacaaat

SEQ ID NO: 186016 - DNA, 16 bp, P. troglodytes
aaataatcagattttt

SEQ ID NO: 186017 - DNA, 16 bp, P. troglodytes
aaataatcattttcat

SEQ ID NO: 186018 - DNA, 16 bp, P. troglodytes
aaataatcctatcaaa

SEQ ID NO: 186019 - DNA, 16 bp, P. troglodytes
aaataatctgatttta

SEQ ID NO: 186020 - DNA, 16 bp, P. troglodytes
aaataatgaaaacttt

SEQ ID NO: 186021 - DNA, 16 bp, P. troglodytes
aaataatgacaattat

SEQ ID NO: 186022 - DNA, 16 bp, P. troglodytes
aaataatgagatcaaa

SEQ ID NO: 186023 - DNA, 16 bp, P. troglodytes
aaataatgcaaaaatt

SEQ ID NO: 186024 - DNA, 16 bp, P. troglodytes
aaataatgcattttct

SEQ ID NO: 186025 - DNA, 16 bp, P. troglodytes
aaataatgctgaaata

SEQ ID NO: 186026 - DNA, 16 bp, P. troglodytes
aaataatggcatttgt

SEQ ID NO: 186027 - DNA, 16 bp, P. troglodytes
aaataatggctgaaaa

SEQ ID NO: 186028 - DNA, 16 bp, P. troglodytes
aaataatgtaaacatt

SEQ ID NO: 186029 - DNA, 16 bp, P. troglodytes
aaataatgtcattttc

SEQ ID NO: 186030 - DNA, 16 bp, P. troglodytes
aaataatgtgattttt

SEQ ID NO: 186031 - DNA, 16 bp, P. troglodytes
aaataatgtgtatata

SEQ ID NO: 186032 - DNA, 16 bp, P. troglodytes
aaataatgtgtgtgtg

SEQ ID NO: 186033 - DNA, 16 bp, P. troglodytes
aaataatgttcttttt

SEQ ID NO: 186034 - DNA, 16 bp, P. troglodytes
aaataatgtttctaaa

SEQ ID NO: 186035 - DNA, 16 bp, P. troglodytes
aaataatgtttctttt

SEQ ID NO: 186036 - DNA, 16 bp, P. troglodytes
aaataatgttttcaaa

SEQ ID NO: 186037 - DNA, 16 bp, P. troglodytes
aaataatgttttcaat

SEQ ID NO: 186038 - DNA, 16 bp, P. troglodytes
aaataattactttgaa

SEQ ID NO: 186039 - DNA, 16 bp, P. troglodytes
aaataattcaaaatgg

SEQ ID NO: 186040 - DNA, 16 bp, P. troglodytes
aaataattcagaaaca

SEQ ID NO: 186041 - DNA, 16 bp, P. troglodytes
aaataattcagaagaa

SEQ ID NO: 186042 - DNA, 16 bp, P. troglodytes
aaataattcatttctg

SEQ ID NO: 186043 - DNA, 16 bp, P. troglodytes
aaataattctttcaaa

SEQ ID NO: 186044 - DNA, 16 bp, P. troglodytes
aaataattgcaaaata

SEQ ID NO: 186045 - DNA, 16 bp, P. troglodytes
aaataattgctttatt

SEQ ID NO: 186046 - DNA, 16 bp, P. troglodytes
aaataattggaaattt

SEQ ID NO: 186047 - DNA, 16 bp, P. troglodytes
aaataattgtatttct

SEQ ID NO: 186048 - DNA, 16 bp, P. troglodytes
aaataattgtcagatt

SEQ ID NO: 186049 - DNA, 16 bp, P. troglodytes
aaataattgtgtatat

SEQ ID NO: 186050 - DNA, 16 bp, P. troglodytes
aaataatttaaaaggc

SEQ ID NO: 186051 - DNA, 16 bp, P. troglodytes
aaataatttatgtaga

SEQ ID NO: 186052 - DNA, 16 bp, P. troglodytes
aaataatttcaagaaa

SEQ ID NO: 186053 - DNA, 16 bp, P. troglodytes
aaataatttcaagttt

SEQ ID NO: 186054 - DNA, 16 bp, P. troglodytes
aaataatttcagaaaa

SEQ ID NO: 186055 - DNA, 16 bp, P. troglodytes
aaataatttcagttat

SEQ ID NO: 186056 - DNA, 16 bp, P. troglodytes
aaataatttgcttttt

SEQ ID NO: 186057 - DNA, 16 bp, P. troglodytes
aaataatttggtaaat

SEQ ID NO: 186058 - DNA, 16 bp, P. troglodytes
aaataattttatgcca

SEQ ID NO: 186059 - DNA, 16 bp, P. troglodytes
aaataattttcaacac

SEQ ID NO: 186060 - DNA, 16 bp, P. troglodytes
aaataattttcaagtt

SEQ ID NO: 186061 - DNA, 16 bp, P. troglodytes
aaataattttccattt

SEQ ID NO: 186062 - DNA, 16 bp, P. troglodytes
aaataattttctaaga

SEQ ID NO: 186063 - DNA, 16 bp, P. troglodytes
aaataattttggagaa

SEQ ID NO: 186064 - DNA, 16 bp, P. troglodytes
aaataatttttgcctt

SEQ ID NO: 186065 - DNA, 16 bp, P. troglodytes
aaataatttttgtaga

SEQ ID NO: 186066 - DNA, 17 bp, P. troglodytes
aaatacaaaaaatttgc

SEQ ID NO: 186067 - DNA, 16 bp, P. troglodytes
aaatacaaaaatgagt

SEQ ID NO: 186068 - DNA, 17 bp, P. troglodytes
aaatacaaaaattggtt

SEQ ID NO: 186069 - DNA, 16 bp, P. troglodytes
aaatacaaaagaattt

SEQ ID NO: 186070 - DNA, 16 bp, P. troglodytes
aaatacaaaataagct

SEQ ID NO: 186071 - DNA, 16 bp, P. troglodytes
aaatacaaaatattag

SEQ ID NO: 186072 - DNA, 16 bp, P. troglodytes
aaatacaaaatgtttt

SEQ ID NO: 186073 - DNA, 18 bp, P. troglodytes
aaatacaaaatttagccg

SEQ ID NO: 186074 - DNA, 16 bp, P. troglodytes
aaatacaaacattttt

SEQ ID NO: 186075 - DNA, 16 bp, P. troglodytes
aaatacaaatgtgaaa

SEQ ID NO: 186076 - DNA, 16 bp, P. troglodytes
aaatacaatgaaaatg

SEQ ID NO: 186077 - DNA, 16 bp, P. troglodytes
aaatacaatgtatttt

SEQ ID NO: 186078 - DNA, 16 bp, P. troglodytes
aaatacaatttcattt

SEQ ID NO: 186079 - DNA, 16 bp, P. troglodytes
aaatacaatttgaaat

SEQ ID NO: 186080 - DNA, 16 bp, P. troglodytes
aaatacacaaaattag

SEQ ID NO: 186081 - DNA, 16 bp, P. troglodytes
aaatacacaattattt

SEQ ID NO: 186082 - DNA, 16 bp, P. troglodytes
aaatacacagaccagt

SEQ ID NO: 186083 - DNA, 16 bp, P. troglodytes
aaatacacatatacat

SEQ ID NO: 186084 - DNA, 16 bp, P. troglodytes
aaatacacatttgaaa

SEQ ID NO: 186085 - DNA, 16 bp, P. troglodytes
aaatacactaacacta

SEQ ID NO: 186086 - DNA, 16 bp, P. troglodytes
aaatacagaacatttt

SEQ ID NO: 186087 - DNA, 16 bp, P. troglodytes
aaatacagaattttaa

SEQ ID NO: 186088 - DNA, 17 bp, P. troglodytes
aaatacagagaccacca

SEQ ID NO: 186089 - DNA, 16 bp, P. troglodytes
aaatacagatcaaaac

SEQ ID NO: 186090 - DNA, 17 bp, P. troglodytes
aaatacagatgaagctt

SEQ ID NO: 186091 - DNA, 16 bp, P. troglodytes
aaatacagatgcaaaa

SEQ ID NO: 186092 - DNA, 16 bp, P. troglodytes
aaatacagattcccag

SEQ ID NO: 186093 - DNA, 16 bp, P. troglodytes
aaatacagattcctag

SEQ ID NO: 186094 - DNA, 16 bp, P. troglodytes
aaatacagtagtcccc

SEQ ID NO: 186095 - DNA, 16 bp, P. troglodytes
aaatacagtcacatta

SEQ ID NO: 186096 - DNA, 16 bp, P. troglodytes
aaatacagtcatccct

SEQ ID NO: 186097 - DNA, 16 bp, P. troglodytes
aaatacagtcattcca

SEQ ID NO: 186098 - DNA, 16 bp, P. troglodytes
aaatacagttacattg

SEQ ID NO: 186099 - DNA, 16 bp, P. troglodytes
aaatacagttattttt

SEQ ID NO: 186100 - DNA, 16 bp, P. troglodytes
aaatacagttgatcct

SEQ ID NO: 186101 - DNA, 16 bp, P. troglodytes
aaatacatatgtattt

SEQ ID NO: 186102 - DNA, 16 bp, P. troglodytes
aaatacatccattcca

SEQ ID NO: 186103 - DNA, 16 bp, P. troglodytes
aaatacatgaaaaatg

SEQ ID NO: 186104 - DNA, 16 bp, P. troglodytes
aaatacatgaaaatca

SEQ ID NO: 186105 - DNA, 16 bp, P. troglodytes
aaatacatgaaattga

SEQ ID NO: 186106 - DNA, 16 bp, P. troglodytes
aaatacatgcacacac

SEQ ID NO: 186107 - DNA, 16 bp, P. troglodytes
aaatacatgtatatgt

SEQ ID NO: 186108 - DNA, 16 bp, P. troglodytes
aaatacatgtatttca

SEQ ID NO: 186109 - DNA, 16 bp, P. troglodytes
aaatacatgtgtatat

SEQ ID NO: 186110 - DNA, 16 bp, P. troglodytes
aaatacatgtttgttg

SEQ ID NO: 186111 - DNA, 16 bp, P. troglodytes
aaatacatgttttaaa

SEQ ID NO: 186112 - DNA, 16 bp, P. troglodytes
aaatacattgaaaaat

SEQ ID NO: 186113 - DNA, 16 bp, P. troglodytes
aaatacattgaaaata

SEQ ID NO: 186114 - DNA, 16 bp, P. troglodytes
aaatacattgattttt

SEQ ID NO: 186115 - DNA, 16 bp, P. troglodytes
aaatacatttcatttc

SEQ ID NO: 186116 - DNA, 16 bp, P. troglodytes
aaatacatttcttaag

SEQ ID NO: 186117 - DNA, 16 bp, P. troglodytes
aaatacatttctttga

SEQ ID NO: 186118 - DNA, 16 bp, P. troglodytes
aaatacatttgaaaaa

SEQ ID NO: 186119 - DNA, 16 bp, P. troglodytes
aaatacatttgtttta

SEQ ID NO: 186120 - DNA, 16 bp, P. troglodytes
aaatacattttatctt

SEQ ID NO: 186121 - DNA, 16 bp, P. troglodytes
aaatacattttgaaaa

SEQ ID NO: 186122 - DNA, 16 bp, P. troglodytes
aaatacattttgtttt

SEQ ID NO: 186123 - DNA, 16 bp, P. troglodytes
aaatacatttttctta

SEQ ID NO: 186124 - DNA, 16 bp, P. troglodytes
aaatacatttttgctt

SEQ ID NO: 186125 - DNA, 16 bp, P. troglodytes
aaataccatttcatat

SEQ ID NO: 186126 - DNA, 16 bp, P. troglodytes
aaatacctaaaaatgt

SEQ ID NO: 186127 - DNA, 16 bp, P. troglodytes
aaatacctaagaataa

SEQ ID NO: 186128 - DNA, 16 bp, P. troglodytes
aaatacctaggaaata

SEQ ID NO: 186129 - DNA, 16 bp, P. troglodytes
aaatacctaggaataa

SEQ ID NO: 186130 - DNA, 16 bp, P. troglodytes
aaatacctcatgttct

SEQ ID NO: 186131 - DNA, 24 bp, P. troglodytes
aaatacctgagactgggtaattta

SEQ ID NO: 186132 - DNA, 16 bp, P. troglodytes
aaataccttaaaatgt

SEQ ID NO: 186133 - DNA, 16 bp, P. troglodytes
aaatactaaaaatcag

SEQ ID NO: 186134 - DNA, 16 bp, P. troglodytes
aaatactaaacatttt

SEQ ID NO: 186135 - DNA, 16 bp, P. troglodytes
aaatactaaaggaaat

SEQ ID NO: 186136 - DNA, 16 bp, P. troglodytes
aaatactacacaagaa

SEQ ID NO: 186137 - DNA, 16 bp, P. troglodytes
aaatactacatcattt

SEQ ID NO: 186138 - DNA, 16 bp, P. troglodytes
aaatactatgaacaat

SEQ ID NO: 186139 - DNA, 16 bp, P. troglodytes
aaatactatgtatttt

SEQ ID NO: 186140 - DNA, 16 bp, P. troglodytes
aaatactgaaagaaat

SEQ ID NO: 186141 - DNA, 16 bp, P. troglodytes
aaatactgaaatatta

SEQ ID NO: 186142 - DNA, 16 bp, P. troglodytes
aaatactgaatatttt

SEQ ID NO: 186143 - DNA, 16 bp, P. troglodytes
aaatactgaatgttct

SEQ ID NO: 186144 - DNA, 16 bp, P. troglodytes
aaatactgatttaaaa

SEQ ID NO: 186145 - DNA, 16 bp, P. troglodytes
aaatactgattttctt

SEQ ID NO: 186146 - DNA, 16 bp, P. troglodytes
aaatactgcatggtct

SEQ ID NO: 186147 - DNA, 16 bp, P. troglodytes
aaatactgcattttct

SEQ ID NO: 186148 - DNA, 16 bp, P. troglodytes
aaatactggaaataaa

SEQ ID NO: 186149 - DNA, 16 bp, P. troglodytes
aaatactggaagaaaa

SEQ ID NO: 186150 - DNA, 16 bp, P. troglodytes
aaatactggcaaatca

SEQ ID NO: 186151 - DNA, 16 bp, P. troglodytes
aaatactgtctttaaa

SEQ ID NO: 186152 - DNA, 16 bp, P. troglodytes
aaatacttaaaatgta

SEQ ID NO: 186153 - DNA, 16 bp, P. troglodytes
aaatacttaaggataa

SEQ ID NO: 186154 - DNA, 16 bp, P. troglodytes
aaatacttagaaatga

SEQ ID NO: 186155 - DNA, 16 bp, P. troglodytes
aaatacttagaagaaa

SEQ ID NO: 186156 - DNA, 16 bp, P. troglodytes
aaatacttagagacaa

SEQ ID NO: 186157 - DNA, 16 bp, P. troglodytes
aaatacttctttttaa

SEQ ID NO: 186158 - DNA, 16 bp, P. troglodytes
aaatacttgaaaaaat

SEQ ID NO: 186159 - DNA, 16 bp, P. troglodytes
aaatacttgcaaacta

SEQ ID NO: 186160 - DNA, 16 bp, P. troglodytes
aaatacttgttaaata

SEQ ID NO: 186161 - DNA, 16 bp, P. troglodytes
aaatactttatcagaa

SEQ ID NO: 186162 - DNA, 16 bp, P. troglodytes
aaatactttcatttat

SEQ ID NO: 186163 - DNA, 16 bp, P. troglodytes
aaatacttttaagaaa

SEQ ID NO: 186164 - DNA, 16 bp, P. troglodytes
aaatacttttacattt

SEQ ID NO: 186165 - DNA, 16 bp, P. troglodytes
aaatacttttctttaa

SEQ ID NO: 186166 - DNA, 16 bp, P. troglodytes
aaatagaaaatccaga

SEQ ID NO: 186167 - DNA, 16 bp, P. troglodytes
aaatagaaacattttt

SEQ ID NO: 186168 - DNA, 16 bp, P. troglodytes
aaatagaaagtctgaa

SEQ ID NO: 186169 - DNA, 16 bp, P. troglodytes
aaatagaaatgctttt

SEQ ID NO: 186170 - DNA, 16 bp, P. troglodytes
aaatagaaatgtattt

SEQ ID NO: 186171 - DNA, 16 bp, P. troglodytes
aaatagaagagaactt

SEQ ID NO: 186172 - DNA, 16 bp, P. troglodytes
aaatagaaggcatcca

SEQ ID NO: 186173 - DNA, 16 bp, P. troglodytes
aaatagaattagaagt

SEQ ID NO: 186174 - DNA, 16 bp, P. troglodytes
aaatagaattcagcaa

SEQ ID NO: 186175 - DNA, 16 bp, P. troglodytes
aaatagacacaataga

SEQ ID NO: 186176 - DNA, 16 bp, P. troglodytes
aaatagacacacacac

SEQ ID NO: 186177 - DNA, 16 bp, P. troglodytes
aaatagacacatagac

SEQ ID NO: 186178 - DNA, 16 bp, P. troglodytes
aaatagaccaataaca

SEQ ID NO: 186179 - DNA, 16 bp, P. troglodytes
aaatagaccaatggaa

SEQ ID NO: 186180 - DNA, 16 bp, P. troglodytes
aaatagactacaaatc

SEQ ID NO: 186181 - DNA, 16 bp, P. troglodytes
aaatagacttttaaaa

SEQ ID NO: 186182 - DNA, 16 bp, P. troglodytes
aaatagagatgaggtc

SEQ ID NO: 186183 - DNA, 16 bp, P. troglodytes
aaatagagccaccata

SEQ ID NO: 186184 - DNA, 16 bp, P. troglodytes
aaatagaggcaataat

SEQ ID NO: 186185 - DNA, 16 bp, P. troglodytes
aaatagaggcacagag

SEQ ID NO: 186186 - DNA, 16 bp, P. troglodytes
aaatagataacctgaa

SEQ ID NO: 186187 - DNA, 16 bp, P. troglodytes
aaatagatgattctga

SEQ ID NO: 186188 - DNA, 16 bp, P. troglodytes
aaatagatgttttaaa

SEQ ID NO: 186189 - DNA, 16 bp, P. troglodytes
aaatagatttcatttt

SEQ ID NO: 186190 - DNA, 16 bp, P. troglodytes
aaatagattttaaatg

SEQ ID NO: 186191 - DNA, 16 bp, P. troglodytes
aaatagatttttcttt

SEQ ID NO: 186192 - DNA, 16 bp, P. troglodytes
aaatagcatttattaa

SEQ ID NO: 186193 - DNA, 16 bp, P. troglodytes
aaatagcatttattga

SEQ ID NO: 186194 - DNA, 16 bp, P. troglodytes
aaatagcattttcttt

SEQ ID NO: 186195 - DNA, 16 bp, P. troglodytes
aaatagccaaaaagta

SEQ ID NO: 186196 - DNA, 16 bp, P. troglodytes
aaatagccaaagccat

SEQ ID NO: 186197 - DNA, 16 bp, P. troglodytes
aaatagccaataagca

SEQ ID NO: 186198 - DNA, 16 bp, P. troglodytes
aaatagcctcaaaaga

SEQ ID NO: 186199 - DNA, 16 bp, P. troglodytes
aaatagctagaagaga

SEQ ID NO: 186200 - DNA, 16 bp, P. troglodytes
aaatagctattattat

SEQ ID NO: 186201 - DNA, 16 bp, P. troglodytes
aaatagcttttaaaat

SEQ ID NO: 186202 - DNA, 16 bp, P. troglodytes
aaataggaaatctgaa

SEQ ID NO: 186203 - DNA, 16 bp, P. troglodytes
aaataggaataatttt

SEQ ID NO: 186204 - DNA, 16 bp, P. troglodytes
aaataggaatgatttt

SEQ ID NO: 186205 - DNA, 16 bp, P. troglodytes
aaataggatttttaaa

SEQ ID NO: 186206 - DNA, 16 bp, P. troglodytes
aaataggcaaaagaca

SEQ ID NO: 186207 - DNA, 16 bp, P. troglodytes
aaataggttttttaaa

SEQ ID NO: 186208 - DNA, 16 bp, P. troglodytes
aaatagtagagtgagt

SEQ ID NO: 186209 - DNA, 16 bp, P. troglodytes
aaatagtcaaagtaat

SEQ ID NO: 186210 - DNA, 16 bp, P. troglodytes
aaatagttcagaaaaa

SEQ ID NO: 186211 - DNA, 16 bp, P. troglodytes
aaatagttgtttttaa

SEQ ID NO: 186212 - DNA, 16 bp, P. troglodytes
aaatagtttacaaatt

SEQ ID NO: 186213 - DNA, 16 bp, P. troglodytes
aaatagtttcaaaatt

SEQ ID NO: 186214 - DNA, 16 bp, P. troglodytes
aaatagtttcagtagg

SEQ ID NO: 186215 - DNA, 16 bp, P. troglodytes
aaatagttttccaaag

SEQ ID NO: 186216 - DNA, 16 bp, P. troglodytes
aaatataaaaactgtt

SEQ ID NO: 186217 - DNA, 16 bp, P. troglodytes
aaatataaaaatagcc

SEQ ID NO: 186218 - DNA, 16 bp, P. troglodytes
aaatataaaaatcagt

SEQ ID NO: 186219 - DNA, 16 bp, P. troglodytes
aaatataaaatgcata

SEQ ID NO: 186220 - DNA, 16 bp, P. troglodytes
aaatataaacttgaaa

SEQ ID NO: 186221 - DNA, 16 bp, P. troglodytes
aaatataaatgggcta

SEQ ID NO: 186222 - DNA, 16 bp, P. troglodytes
aaatataacacatttt

SEQ ID NO: 186223 - DNA, 16 bp, P. troglodytes
aaatataacatttgaa

SEQ ID NO: 186224 - DNA, 16 bp, P. troglodytes
aaatataatcagaaat

SEQ ID NO: 186225 - DNA, 16 bp, P. troglodytes
aaatatacaaacatgt

SEQ ID NO: 186226 - DNA, 16 bp, P. troglodytes
aaatatacaaatatag

SEQ ID NO: 186227 - DNA, 16 bp, P. troglodytes
aaatatacaatgaatt

SEQ ID NO: 186228 - DNA, 16 bp, P. troglodytes
aaatatacaattcagt

SEQ ID NO: 186229 - DNA, 16 bp, P. troglodytes
aaatatacacatacat

SEQ ID NO: 186230 - DNA, 16 bp, P. troglodytes
aaatatacacatgtat

SEQ ID NO: 186231 - DNA, 16 bp, P. troglodytes
aaatatacatgaaata

SEQ ID NO: 186232 - DNA, 16 bp, P. troglodytes
aaatatacatgtttat

SEQ ID NO: 186233 - DNA, 16 bp, P. troglodytes
aaatatacatttttca

SEQ ID NO: 186234 - DNA, 16 bp, P. troglodytes
aaatatacctttgcag

SEQ ID NO: 186235 - DNA, 16 bp, P. troglodytes
aaatatacttaaaatg

SEQ ID NO: 186236 - DNA, 16 bp, P. troglodytes
aaatatagaatatttc

SEQ ID NO: 186237 - DNA, 16 bp, P. troglodytes
aaatatatacacacac

SEQ ID NO: 186238 - DNA, 16 bp, P. troglodytes
aaatatatacacaccc

SEQ ID NO: 186239 - DNA, 16 bp, P. troglodytes
aaatatatacagtaaa

SEQ ID NO: 186240 - DNA, 16 bp, P. troglodytes
aaatatatagcaataa

SEQ ID NO: 186241 - DNA, 16 bp, P. troglodytes
aaatatatattatgca

SEQ ID NO: 186242 - DNA, 16 bp, P. troglodytes
aaatatatattcacct

SEQ ID NO: 186243 - DNA, 16 bp, P. troglodytes
aaatatatatttggtc

SEQ ID NO: 186244 - DNA, 16 bp, P. troglodytes
aaatatatcctgaatc

SEQ ID NO: 186245 - DNA, 16 bp, P. troglodytes
aaatatatcttcaaga

SEQ ID NO: 186246 - DNA, 16 bp, P. troglodytes
aaatatatgaaaacat

SEQ ID NO: 186247 - DNA, 16 bp, P. troglodytes
aaatatatgaagcaaa

SEQ ID NO: 186248 - DNA, 16 bp, P. troglodytes
aaatatatgacatata

SEQ ID NO: 186249 - DNA, 16 bp, P. troglodytes
aaatatatgcaaaatt

SEQ ID NO: 186250 - DNA, 16 bp, P. troglodytes
aaatatatgcaaataa

SEQ ID NO: 186251 - DNA, 16 bp, P. troglodytes
aaatatatgcacatat

SEQ ID NO: 186252 - DNA, 16 bp, P. troglodytes
aaatatatgcatattt

SEQ ID NO: 186253 - DNA, 16 bp, P. troglodytes
aaatatatgcatgtat

SEQ ID NO: 186254 - DNA, 16 bp, P. troglodytes
aaatatatgcttttta

SEQ ID NO: 186255 - DNA, 16 bp, P. troglodytes
aaatatatggaggaaa

SEQ ID NO: 186256 - DNA, 17 bp, P. troglodytes
aaatatatgtgcaccca

SEQ ID NO: 186257 - DNA, 16 bp, P. troglodytes
aaatatatgttaattg

SEQ ID NO: 186258 - DNA, 16 bp, P. troglodytes
aaatatattacaaagg

SEQ ID NO: 186259 - DNA, 16 bp, P. troglodytes
aaatatattccatgct

SEQ ID NO: 186260 - DNA, 16 bp, P. troglodytes
aaatatattcctttta

SEQ ID NO: 186261 - DNA, 16 bp, P. troglodytes
aaatatattctctcat

SEQ ID NO: 186262 - DNA, 16 bp, P. troglodytes
aaatatattgcaaaaa

SEQ ID NO: 186263 - DNA, 16 bp, P. troglodytes
aaatatatttcataag

SEQ ID NO: 186264 - DNA, 16 bp, P. troglodytes
aaatatatttcattca

SEQ ID NO: 186265 - DNA, 16 bp, P. troglodytes
aaatatatttgcatat

SEQ ID NO: 186266 - DNA, 16 bp, P. troglodytes
aaatatatttggaata

SEQ ID NO: 186267 - DNA, 16 bp, P. troglodytes
aaatatattttcactg

SEQ ID NO: 186268 - DNA, 16 bp, P. troglodytes
aaatatattttctagt

SEQ ID NO: 186269 - DNA, 16 bp, P. troglodytes
aaatatattttctgtt

SEQ ID NO: 186270 - DNA, 16 bp, P. troglodytes
aaatatattttgcaaa

SEQ ID NO: 186271 - DNA, 16 bp, P. troglodytes
aaatatatttttggaa

SEQ ID NO: 186272 - DNA, 16 bp, P. troglodytes
aaatatcaatgaaatt

SEQ ID NO: 186273 - DNA, 16 bp, P. troglodytes
aaatatcagttttatt

SEQ ID NO: 186274 - DNA, 16 bp, P. troglodytes
aaatatcatgaaaatg

SEQ ID NO: 186275 - DNA, 16 bp, P. troglodytes
aaatatccagaacagg

SEQ ID NO: 186276 - DNA, 16 bp, P. troglodytes
aaatatccatttattt

SEQ ID NO: 186277 - DNA, 16 bp, P. troglodytes
aaatatccctttgaag

SEQ ID NO: 186278 - DNA, 16 bp, P. troglodytes
aaatatctagcagaga

SEQ ID NO: 186279 - DNA, 16 bp, P. troglodytes
aaatatctctagacat

SEQ ID NO: 186280 - DNA, 16 bp, P. troglodytes
aaatatctgaaaatgt

SEQ ID NO: 186281 - DNA, 16 bp, P. troglodytes
aaatatctgcaaatca

SEQ ID NO: 186282 - DNA, 16 bp, P. troglodytes
aaatatctggaaaaaa

SEQ ID NO: 186283 - DNA, 16 bp, P. troglodytes
aaatatctggaagaaa

SEQ ID NO: 186284 - DNA, 16 bp, P. troglodytes
aaatatctgttgaata

SEQ ID NO: 186285 - DNA, 16 bp, P. troglodytes
aaatatctgtttaata

SEQ ID NO: 186286 - DNA, 16 bp, P. troglodytes
aaatatcttcagagaa

SEQ ID NO: 186287 - DNA, 16 bp, P. troglodytes
aaatatcttgaaacaa

SEQ ID NO: 186288 - DNA, 16 bp, P. troglodytes
aaatatctttcaaata

SEQ ID NO: 186289 - DNA, 16 bp, P. troglodytes
aaatatctttctatat

SEQ ID NO: 186290 - DNA, 16 bp, P. troglodytes
aaatatcttttccttt

SEQ ID NO: 186291 - DNA, 16 bp, P. troglodytes
aaatatcttttttgtt

SEQ ID NO: 186292 - DNA, 16 bp, P. troglodytes
aaatatgaaaacatga

SEQ ID NO: 186293 - DNA, 16 bp, P. troglodytes
aaatatgaaaatacat

SEQ ID NO: 186294 - DNA, 16 bp, P. troglodytes
aaatatgaaacatttt

SEQ ID NO: 186295 - DNA, 16 bp, P. troglodytes
aaatatgaaatccaaa

SEQ ID NO: 186296 - DNA, 16 bp, P. troglodytes
aaatatgaagatattt

SEQ ID NO: 186297 - DNA, 16 bp, P. troglodytes
aaatatgaagatttat

SEQ ID NO: 186298 - DNA, 16 bp, P. troglodytes
aaatatgacacagaaa

SEQ ID NO: 186299 - DNA, 16 bp, P. troglodytes
aaatatgacattttat

SEQ ID NO: 186300 - DNA, 16 bp, P. troglodytes
aaatatgagactatgt

SEQ ID NO: 186301 - DNA, 16 bp, P. troglodytes
aaatatgatttgcaaa

SEQ ID NO: 186302 - DNA, 16 bp, P. troglodytes
aaatatgatttttttc

SEQ ID NO: 186303 - DNA, 16 bp, P. troglodytes
aaatatgcaataaatt

SEQ ID NO: 186304 - DNA, 16 bp, P. troglodytes
aaatatgcaattaaaa

SEQ ID NO: 186305 - DNA, 16 bp, P. troglodytes
aaatatgcacatacat

SEQ ID NO: 186306 - DNA, 16 bp, P. troglodytes
aaatatgcagaaatta

SEQ ID NO: 186307 - DNA, 16 bp, P. troglodytes
aaatatgcattatttt

SEQ ID NO: 186308 - DNA, 16 bp, P. troglodytes
aaatatgctattattt

SEQ ID NO: 186309 - DNA, 16 bp, P. troglodytes
aaatatggaaactgag

SEQ ID NO: 186310 - DNA, 16 bp, P. troglodytes
aaatatggaagaaatg

SEQ ID NO: 186311 - DNA, 16 bp, P. troglodytes
aaatatggaatatttt

SEQ ID NO: 186312 - DNA, 16 bp, P. troglodytes
aaatatggcaaaatgt

SEQ ID NO: 186313 - DNA, 16 bp, P. troglodytes
aaatatgggaacaaca

SEQ ID NO: 186314 - DNA, 16 bp, P. troglodytes
aaatatggtagatatt

SEQ ID NO: 186315 - DNA, 16 bp, P. troglodytes
aaatatgtacaaatat

SEQ ID NO: 186316 - DNA, 16 bp, P. troglodytes
aaatatgtacatatgt

SEQ ID NO: 186317 - DNA, 16 bp, P. troglodytes
aaatatgtactatata

SEQ ID NO: 186318 - DNA, 16 bp, P. troglodytes
aaatatgtatgattat

SEQ ID NO: 186319 - DNA, 16 bp, P. troglodytes
aaatatgtatgtattt

SEQ ID NO: 186320 - DNA, 16 bp, P. troglodytes
aaatatgtattaatca

SEQ ID NO: 186321 - DNA, 16 bp, P. troglodytes
aaatatgtattatgta

SEQ ID NO: 186322 - DNA, 16 bp, P. troglodytes
aaatatgtattgagta

SEQ ID NO: 186323 - DNA, 16 bp, P. troglodytes
aaatatgtatttcata

SEQ ID NO: 186324 - DNA, 16 bp, P. troglodytes
aaatatgtattttaag

SEQ ID NO: 186325 - DNA, 16 bp, P. troglodytes
aaatatgtatttttca

SEQ ID NO: 186326 - DNA, 16 bp, P. troglodytes
aaatatgtgaaatttt

SEQ ID NO: 186327 - DNA, 16 bp, P. troglodytes
aaatatgtgtaaatat

SEQ ID NO: 186328 - DNA, 16 bp, P. troglodytes
aaatatgtgtatatgt

SEQ ID NO: 186329 - DNA, 16 bp, P. troglodytes
aaatatgtgtgtgtgt

SEQ ID NO: 186330 - DNA, 16 bp, P. troglodytes
aaatatgtgtgttaaa

SEQ ID NO: 186331 - DNA, 16 bp, P. troglodytes
aaatatgtgttaaatt

SEQ ID NO: 186332 - DNA, 16 bp, P. troglodytes
aaatatgtgttgattg

SEQ ID NO: 186333 - DNA, 16 bp, P. troglodytes
aaatatgtgttgtttt

SEQ ID NO: 186334 - DNA, 16 bp, P. troglodytes
aaatatgtttacattt

SEQ ID NO: 186335 - DNA, 16 bp, P. troglodytes
aaatatgtttactttt

SEQ ID NO: 186336 - DNA, 16 bp, P. troglodytes
aaatatgtttccattt

SEQ ID NO: 186337 - DNA, 16 bp, P. troglodytes
aaatatgtttgtaaat

SEQ ID NO: 186338 - DNA, 16 bp, P. troglodytes
aaatatgttttaagta

SEQ ID NO: 186339 - DNA, 16 bp, P. troglodytes
aaatatgttttccaaa

SEQ ID NO: 186340 - DNA, 16 bp, P. troglodytes
aaatatgttttcttat

SEQ ID NO: 186341 - DNA, 16 bp, P. troglodytes
aaatatgttttgaatt

SEQ ID NO: 186342 - DNA, 16 bp, P. troglodytes
aaatatgttttgtaaa

SEQ ID NO: 186343 - DNA, 16 bp, P. troglodytes
aaatattaaaacagta

SEQ ID NO: 186344 - DNA, 16 bp, P. troglodytes
aaatattaaatgcaaa

SEQ ID NO: 186345 - DNA, 16 bp, P. troglodytes
aaatattaacagtaaa

SEQ ID NO: 186346 - DNA, 16 bp, P. troglodytes
aaatattaagagctat

SEQ ID NO: 186347 - DNA, 16 bp, P. troglodytes
aaatattacaaatgaa

SEQ ID NO: 186348 - DNA, 16 bp, P. troglodytes
aaatattacagagaaa

SEQ ID NO: 186349 - DNA, 16 bp, P. troglodytes
aaatattacatgtttt

SEQ ID NO: 186350 - DNA, 16 bp, P. troglodytes
aaatattacctcattt

SEQ ID NO: 186351 - DNA, 16 bp, P. troglodytes
aaatattagctattat

SEQ ID NO: 186352 - DNA, 16 bp, P. troglodytes
aaatattagttctttt

SEQ ID NO: 186353 - DNA, 16 bp, P. troglodytes
aaatattagttgaatg

SEQ ID NO: 186354 - DNA, 16 bp, P. troglodytes
aaatattatcacttca

SEQ ID NO: 186355 - DNA, 16 bp, P. troglodytes
aaatattatctcattt

SEQ ID NO: 186356 - DNA, 16 bp, P. troglodytes
aaatattatgcaaata

SEQ ID NO: 186357 - DNA, 16 bp, P. troglodytes
aaatattatgtatcaa

SEQ ID NO: 186358 - DNA, 16 bp, P. troglodytes
aaatattattcaacca

SEQ ID NO: 186359 - DNA, 16 bp, P. troglodytes
aaatattatttcaaca

SEQ ID NO: 186360 - DNA, 16 bp, P. troglodytes
aaatattatttcctaa

SEQ ID NO: 186361 - DNA, 16 bp, P. troglodytes
aaatattcaaaaatga

SEQ ID NO: 186362 - DNA, 16 bp, P. troglodytes
aaatattcaaactgta

SEQ ID NO: 186363 - DNA, 16 bp, P. troglodytes
aaatattcaaagaaga

SEQ ID NO: 186364 - DNA, 16 bp, P. troglodytes
aaatattcaaatgaat

SEQ ID NO: 186365 - DNA, 16 bp, P. troglodytes
aaatattcaacaaatg

SEQ ID NO: 186366 - DNA, 16 bp, P. troglodytes
aaatattcaagaaaat

SEQ ID NO: 186367 - DNA, 16 bp, P. troglodytes
aaatattcaatgaaat

SEQ ID NO: 186368 - DNA, 16 bp, P. troglodytes
aaatattcactttatt

SEQ ID NO: 186369 - DNA, 16 bp, P. troglodytes
aaatattcagaaaaat

SEQ ID NO: 186370 - DNA, 16 bp, P. troglodytes
aaatattcagaaaata

SEQ ID NO: 186371 - DNA, 16 bp, P. troglodytes
aaatattcagaaaatg

SEQ ID NO: 186372 - DNA, 16 bp, P. troglodytes
aaatattcagaaatat

SEQ ID NO: 186373 - DNA, 16 bp, P. troglodytes
aaatattcaggaaaat

SEQ ID NO: 186374 - DNA, 16 bp, P. troglodytes
aaatattccaaaagaa

SEQ ID NO: 186375 - DNA, 16 bp, P. troglodytes
aaatattccagaaaaa

SEQ ID NO: 186376 - DNA, 16 bp, P. troglodytes
aaatattcctgatgaa

SEQ ID NO: 186377 - DNA, 16 bp, P. troglodytes
aaatattcctttttct

SEQ ID NO: 186378 - DNA, 16 bp, P. troglodytes
aaatattctatatttg

SEQ ID NO: 186379 - DNA, 16 bp, P. troglodytes
aaatattctctaattt

SEQ ID NO: 186380 - DNA, 16 bp, P. troglodytes
aaatattctcttaaaa

SEQ ID NO: 186381 - DNA, 16 bp, P. troglodytes
aaatattctgaaattt

SEQ ID NO: 186382 - DNA, 16 bp, P. troglodytes
aaatattctggatatt

SEQ ID NO: 186383 - DNA, 16 bp, P. troglodytes
aaatattctgtatttt

SEQ ID NO: 186384 - DNA, 16 bp, P. troglodytes
aaatattcttcagaaa

SEQ ID NO: 186385 - DNA, 16 bp, P. troglodytes
aaatattgaaaatgtt

SEQ ID NO: 186386 - DNA, 16 bp, P. troglodytes
aaatattgaatgtttt

SEQ ID NO: 186387 - DNA, 16 bp, P. troglodytes
aaatattgatgtattt

SEQ ID NO: 186388 - DNA, 16 bp, P. troglodytes
aaatattgcaaaaatt

SEQ ID NO: 186389 - DNA, 16 bp, P. troglodytes
aaatattgcaagaatt

SEQ ID NO: 186390 - DNA, 16 bp, P. troglodytes
aaatattggtgaggat

SEQ ID NO: 186391 - DNA, 16 bp, P. troglodytes
aaatattggttgaatg

SEQ ID NO: 186392 - DNA, 16 bp, P. troglodytes
aaatattgtatgattt

SEQ ID NO: 186393 - DNA, 16 bp, P. troglodytes
aaatattgtctttaaa

SEQ ID NO: 186394 - DNA, 16 bp, P. troglodytes
aaatatttaaatgagt

SEQ ID NO: 186395 - DNA, 16 bp, P. troglodytes
aaatatttaaatgtct

SEQ ID NO: 186396 - DNA, 16 bp, P. troglodytes
aaatatttaaccccaa

SEQ ID NO: 186397 - DNA, 16 bp, P. troglodytes
aaatatttaactcttt

SEQ ID NO: 186398 - DNA, 16 bp, P. troglodytes
aaatatttaagcaaat

SEQ ID NO: 186399 - DNA, 16 bp, P. troglodytes
aaatatttaaggaaga

SEQ ID NO: 186400 - DNA, 16 bp, P. troglodytes
aaatatttaatgaatg

SEQ ID NO: 186401 - DNA, 16 bp, P. troglodytes
aaatatttacaaaatg

SEQ ID NO: 186402 - DNA, 16 bp, P. troglodytes
aaatatttacaaagca

SEQ ID NO: 186403 - DNA, 16 bp, P. troglodytes
aaatatttacaaagta

SEQ ID NO: 186404 - DNA, 16 bp, P. troglodytes
aaatatttacagaaaa

SEQ ID NO: 186405 - DNA, 16 bp, P. troglodytes
aaatatttactatctg

SEQ ID NO: 186406 - DNA, 16 bp, P. troglodytes
aaatatttactctttg

SEQ ID NO: 186407 - DNA, 16 bp, P. troglodytes
aaatatttactgtctg

SEQ ID NO: 186408 - DNA, 16 bp, P. troglodytes
aaatatttactgtttt

SEQ ID NO: 186409 - DNA, 16 bp, P. troglodytes
aaatatttacttgaaa

SEQ ID NO: 186410 - DNA, 16 bp, P. troglodytes
aaatatttagcaaata

SEQ ID NO: 186411 - DNA, 16 bp, P. troglodytes
aaatatttatatgcat

SEQ ID NO: 186412 - DNA, 16 bp, P. troglodytes
aaatatttatgaagca

SEQ ID NO: 186413 - DNA, 16 bp, P. troglodytes
aaatatttatgaagta

SEQ ID NO: 186414 - DNA, 16 bp, P. troglodytes
aaatatttatgctttt

SEQ ID NO: 186415 - DNA, 16 bp, P. troglodytes
aaatatttatggaatg

SEQ ID NO: 186416 - DNA, 16 bp, P. troglodytes
aaatatttatgtagaa

SEQ ID NO: 186417 - DNA, 16 bp, P. troglodytes
aaatatttatgtgtat

SEQ ID NO: 186418 - DNA, 16 bp, P. troglodytes
aaatatttattaagtg

SEQ ID NO: 186419 - DNA, 16 bp, P. troglodytes
aaatatttattgagca

SEQ ID NO: 186420 - DNA, 16 bp, P. troglodytes
aaatatttattgagtg

SEQ ID NO: 186421 - DNA, 16 bp, P. troglodytes
aaatatttatttcaga

SEQ ID NO: 186422 - DNA, 16 bp, P. troglodytes
aaatatttatttgaag

SEQ ID NO: 186423 - DNA, 16 bp, P. troglodytes
aaatatttcagaaaat

SEQ ID NO: 186424 - DNA, 16 bp, P. troglodytes
aaatatttcagacata

SEQ ID NO: 186425 - DNA, 16 bp, P. troglodytes
aaatatttcagagaaa

SEQ ID NO: 186426 - DNA, 16 bp, P. troglodytes
aaatatttcagataaa

SEQ ID NO: 186427 - DNA, 16 bp, P. troglodytes
aaatatttcaggaaga

SEQ ID NO: 186428 - DNA, 16 bp, P. troglodytes
aaatatttcaggatat

SEQ ID NO: 186429 - DNA, 16 bp, P. troglodytes
aaatatttcaggcttt

SEQ ID NO: 186430 - DNA, 16 bp, P. troglodytes
aaatatttcagtaaaa

SEQ ID NO: 186431 - DNA, 16 bp, P. troglodytes
aaatatttcatcatat

SEQ ID NO: 186432 - DNA, 16 bp, P. troglodytes
aaatatttcattaaca

SEQ ID NO: 186433 - DNA, 16 bp, P. troglodytes
aaatatttcattagaa

SEQ ID NO: 186434 - DNA, 16 bp, P. troglodytes
aaatatttcattttgt

SEQ ID NO: 186435 - DNA, 16 bp, P. troglodytes
aaatatttcatttttg

SEQ ID NO: 186436 - DNA, 16 bp, P. troglodytes
aaatatttccaaattt

SEQ ID NO: 186437 - DNA, 16 bp, P. troglodytes
aaatatttccattaaa

SEQ ID NO: 186438 - DNA, 16 bp, P. troglodytes
aaatatttcctcttct

SEQ ID NO: 186439 - DNA, 16 bp, P. troglodytes
aaatatttctttcaat

SEQ ID NO: 186440 - DNA, 16 bp, P. troglodytes
aaatatttgaaaacat

SEQ ID NO: 186441 - DNA, 16 bp, P. troglodytes
aaatatttgaaaacta

SEQ ID NO: 186442 - DNA, 16 bp, P. troglodytes
aaatatttgaagaaac

SEQ ID NO: 186443 - DNA, 16 bp, P. troglodytes
aaatatttgacaaaat

SEQ ID NO: 186444 - DNA, 16 bp, P. troglodytes
aaatatttgacatttt

SEQ ID NO: 186445 - DNA, 16 bp, P. troglodytes
aaatatttgagaaaca

SEQ ID NO: 186446 - DNA, 16 bp, P. troglodytes
aaatatttgaggaaag

SEQ ID NO: 186447 - DNA, 16 bp, P. troglodytes
aaatatttgaggattt

SEQ ID NO: 186448 - DNA, 16 bp, P. troglodytes
aaatatttgagtattt

SEQ ID NO: 186449 - DNA, 16 bp, P. troglodytes
aaatatttgcaaaaga

SEQ ID NO: 186450 - DNA, 16 bp, P. troglodytes
aaatatttgcaaacaa

SEQ ID NO: 186451 - DNA, 16 bp, P. troglodytes
aaatatttgcaaatca

SEQ ID NO: 186452 - DNA, 16 bp, P. troglodytes
aaatatttgcaagaaa

SEQ ID NO: 186453 - DNA, 16 bp, P. troglodytes
aaatatttgcaatcca

SEQ ID NO: 186454 - DNA, 16 bp, P. troglodytes
aaatatttgcataatt

SEQ ID NO: 186455 - DNA, 16 bp, P. troglodytes
aaatatttgctaattt

SEQ ID NO: 186456 - DNA, 16 bp, P. troglodytes
aaatatttgctatctg

SEQ ID NO: 186457 - DNA, 16 bp, P. troglodytes
aaatatttgctgaaca

SEQ ID NO: 186458 - DNA, 16 bp, P. troglodytes
aaatatttgctgaatg

SEQ ID NO: 186459 - DNA, 16 bp, P. troglodytes
aaatatttgctgagtg

SEQ ID NO: 186460 - DNA, 16 bp, P. troglodytes
aaatatttgcttattt

SEQ ID NO: 186461 - DNA, 16 bp, P. troglodytes
aaatatttggaaacaa

SEQ ID NO: 186462 - DNA, 16 bp, P. troglodytes
aaatatttggaaatta

SEQ ID NO: 186463 - DNA, 16 bp, P. troglodytes
aaatatttggagagat

SEQ ID NO: 186464 - DNA, 16 bp, P. troglodytes
aaatatttggggtttt

SEQ ID NO: 186465 - DNA, 16 bp, P. troglodytes
aaatatttggtcattt

SEQ ID NO: 186466 - DNA, 16 bp, P. troglodytes
aaatatttgtaaaaca

SEQ ID NO: 186467 - DNA, 16 bp, P. troglodytes
aaatatttgtaaatca

SEQ ID NO: 186468 - DNA, 16 bp, P. troglodytes
aaatatttgtacaaaa

SEQ ID NO: 186469 - DNA, 16 bp, P. troglodytes
aaatatttgtatatgt

SEQ ID NO: 186470 - DNA, 16 bp, P. troglodytes
aaatatttgtctttta

SEQ ID NO: 186471 - DNA, 16 bp, P. troglodytes
aaatatttgtgtatat

SEQ ID NO: 186472 - DNA, 16 bp, P. troglodytes
aaatatttgttacata

SEQ ID NO: 186473 - DNA, 16 bp, P. troglodytes
aaatatttgttcaatg

SEQ ID NO: 186474 - DNA, 16 bp, P. troglodytes
aaatatttgttcaatt

SEQ ID NO: 186475 - DNA, 16 bp, P. troglodytes
aaatatttgtttcttt

SEQ ID NO: 186476 - DNA, 16 bp, P. troglodytes
aaatattttaaaagcc

SEQ ID NO: 186477 - DNA, 16 bp, P. troglodytes
aaatattttaaagttg

SEQ ID NO: 186478 - DNA, 16 bp, P. troglodytes
aaatattttaccccaa

SEQ ID NO: 186479 - DNA, 16 bp, P. troglodytes
aaatattttagaaatg

SEQ ID NO: 186480 - DNA, 16 bp, P. troglodytes
aaatattttagaactt

SEQ ID NO: 186481 - DNA, 16 bp, P. troglodytes
aaatattttagacttt

SEQ ID NO: 186482 - DNA, 16 bp, P. troglodytes
aaatattttaggcatt

SEQ ID NO: 186483 - DNA, 16 bp, P. troglodytes
aaatattttaggcttt

SEQ ID NO: 186484 - DNA, 16 bp, P. troglodytes
aaatattttatactgt

SEQ ID NO: 186485 - DNA, 16 bp, P. troglodytes
aaatattttatgtaca

SEQ ID NO: 186486 - DNA, 16 bp, P. troglodytes
aaatattttattcact

SEQ ID NO: 186487 - DNA, 16 bp, P. troglodytes
aaatattttattctgt

SEQ ID NO: 186488 - DNA, 16 bp, P. troglodytes
aaatattttcaacatt

SEQ ID NO: 186489 - DNA, 16 bp, P. troglodytes
aaatattttcaacttt

SEQ ID NO: 186490 - DNA, 16 bp, P. troglodytes
aaatattttcaagata

SEQ ID NO: 186491 - DNA, 16 bp, P. troglodytes
aaatattttcaagttt

SEQ ID NO: 186492 - DNA, 16 bp, P. troglodytes
aaatattttcaatgaa

SEQ ID NO: 186493 - DNA, 16 bp, P. troglodytes
aaatattttcactttg

SEQ ID NO: 186494 - DNA, 16 bp, P. troglodytes
aaatattttcagcaaa

SEQ ID NO: 186495 - DNA, 16 bp, P. troglodytes
aaatattttcatacat

SEQ ID NO: 186496 - DNA, 16 bp, P. troglodytes
aaatattttcatcacc

SEQ ID NO: 186497 - DNA, 16 bp, P. troglodytes
aaatattttcatgaaa

SEQ ID NO: 186498 - DNA, 16 bp, P. troglodytes
aaatattttcatgtaa

SEQ ID NO: 186499 - DNA, 16 bp, P. troglodytes
aaatattttccaaaca

SEQ ID NO: 186500 - DNA, 16 bp, P. troglodytes
aaatattttcccactt

SEQ ID NO: 186501 - DNA, 16 bp, P. troglodytes
aaatattttcctaata

SEQ ID NO: 186502 - DNA, 16 bp, P. troglodytes
aaatattttccttaaa

SEQ ID NO: 186503 - DNA, 16 bp, P. troglodytes
aaatattttcctttgt

SEQ ID NO: 186504 - DNA, 16 bp, P. troglodytes
aaatattttctaagtt

SEQ ID NO: 186505 - DNA, 16 bp, P. troglodytes
aaatattttctaggaa

SEQ ID NO: 186506 - DNA, 16 bp, P. troglodytes
aaatattttctatttg

SEQ ID NO: 186507 - DNA, 16 bp, P. troglodytes
aaatattttctcaatg

SEQ ID NO: 186508 - DNA, 16 bp, P. troglodytes
aaatattttctccatt

SEQ ID NO: 186509 - DNA, 16 bp, P. troglodytes
aaatattttctctcag

SEQ ID NO: 186510 - DNA, 16 bp, P. troglodytes
aaatattttctctcct

SEQ ID NO: 186511 - DNA, 16 bp, P. troglodytes
aaatattttctgattt

SEQ ID NO: 186512 - DNA, 16 bp, P. troglodytes
aaatattttctgtttt

SEQ ID NO: 186513 - DNA, 16 bp, P. troglodytes
aaatattttcttcaaa

SEQ ID NO: 186514 - DNA, 16 bp, P. troglodytes
aaatattttcttcctg

SEQ ID NO: 186515 - DNA, 16 bp, P. troglodytes
aaatattttctttcct

SEQ ID NO: 186516 - DNA, 16 bp, P. troglodytes
aaatattttgaaatga

SEQ ID NO: 186517 - DNA, 16 bp, P. troglodytes
aaatattttgagcttt

SEQ ID NO: 186518 - DNA, 16 bp, P. troglodytes
aaatattttgatttct

SEQ ID NO: 186519 - DNA, 16 bp, P. troglodytes
aaatattttgctttct

SEQ ID NO: 186520 - DNA, 16 bp, P. troglodytes
aaatattttgcttttt

SEQ ID NO: 186521 - DNA, 16 bp, P. troglodytes
aaatattttggaaata

SEQ ID NO: 186522 - DNA, 16 bp, P. troglodytes
aaatattttggaaatg

SEQ ID NO: 186523 - DNA, 16 bp, P. troglodytes
aaatattttgtctttt

SEQ ID NO: 186524 - DNA, 16 bp, P. troglodytes
aaatattttgttcttt

SEQ ID NO: 186525 - DNA, 16 bp, P. troglodytes
aaatattttgttgaat

SEQ ID NO: 186526 - DNA, 16 bp, P. troglodytes
aaatattttgtttctc

SEQ ID NO: 186527 - DNA, 16 bp, P. troglodytes
aaatattttgtttctt

SEQ ID NO: 186528 - DNA, 16 bp, P. troglodytes
aaatattttgttttct

SEQ ID NO: 186529 - DNA, 16 bp, P. troglodytes
aaatatttttacatca

SEQ ID NO: 186530 - DNA, 16 bp, P. troglodytes
aaatatttttagagaa

SEQ ID NO: 186531 - DNA, 16 bp, P. troglodytes
aaatatttttcagtgt

SEQ ID NO: 186532 - DNA, 16 bp, P. troglodytes
aaatatttttcatttg

SEQ ID NO: 186533 - DNA, 16 bp, P. troglodytes
aaatatttttccccat

SEQ ID NO: 186534 - DNA, 16 bp, P. troglodytes
aaatatttttcctcct

SEQ ID NO: 186535 - DNA, 16 bp, P. troglodytes
aaatatttttccttaa

SEQ ID NO: 186536 - DNA, 16 bp, P. troglodytes
aaatatttttctgact

SEQ ID NO: 186537 - DNA, 16 bp, P. troglodytes
aaatatttttcttcct

SEQ ID NO: 186538 - DNA, 16 bp, P. troglodytes
aaatatttttctttga

SEQ ID NO: 186539 - DNA, 16 bp, P. troglodytes
aaatatttttgagaaa

SEQ ID NO: 186540 - DNA, 16 bp, P. troglodytes
aaatatttttgcttct

SEQ ID NO: 186541 - DNA, 16 bp, P. troglodytes
aaatatttttgtacaa

SEQ ID NO: 186542 - DNA, 16 bp, P. troglodytes
aaatatttttgtacat

SEQ ID NO: 186543 - DNA, 16 bp, P. troglodytes
aaatatttttgtagat

SEQ ID NO: 186544 - DNA, 16 bp, P. troglodytes
aaatatttttgtgcat

SEQ ID NO: 186545 - DNA, 16 bp, P. troglodytes
aaatatttttgttgaa

SEQ ID NO: 186546 - DNA, 16 bp, P. troglodytes
aaatattttttccaaa

SEQ ID NO: 186547 - DNA, 16 bp, P. troglodytes
aaatatttttttctga

SEQ ID NO: 186548 - DNA, 16 bp, P. troglodytes
aaatcaaaaccgcaat

SEQ ID NO: 186549 - DNA, 16 bp, P. troglodytes
aaatcaaaagaaatgt

SEQ ID NO: 186550 - DNA, 16 bp, P. troglodytes
aaatcaaaagaatatt

SEQ ID NO: 186551 - DNA, 16 bp, P. troglodytes
aaatcaaaatgataat

SEQ ID NO: 186552 - DNA, 16 bp, P. troglodytes
aaatcaaaatggacta

SEQ ID NO: 186553 - DNA, 16 bp, P. troglodytes
aaatcaaagaaaatgt

SEQ ID NO: 186554 - DNA, 16 bp, P. troglodytes
aaatcaaagaagaact

SEQ ID NO: 186555 - DNA, 16 bp, P. troglodytes
aaatcaaagaatattt

SEQ ID NO: 186556 - DNA, 16 bp, P. troglodytes
aaatcaaagatttaaa

SEQ ID NO: 186557 - DNA, 16 bp, P. troglodytes
aaatcaaataatgcat

SEQ ID NO: 186558 - DNA, 16 bp, P. troglodytes
aaatcaaatcattttt

SEQ ID NO: 186559 - DNA, 16 bp, P. troglodytes
aaatcaaatgaaaatg

SEQ ID NO: 186560 - DNA, 16 bp, P. troglodytes
aaatcaaatggaaatg

SEQ ID NO: 186561 - DNA, 20 bp, P. troglodytes
aaatcaacagaatatacatt

SEQ ID NO: 186562 - DNA, 16 bp, P. troglodytes
aaatcaactctctcaa

SEQ ID NO: 186563 - DNA, 16 bp, P. troglodytes
aaatcaagaaggtaat

SEQ ID NO: 186564 - DNA, 16 bp, P. troglodytes
aaatcaataaattgga

SEQ ID NO: 186565 - DNA, 16 bp, P. troglodytes
aaatcaatacatgtaa

SEQ ID NO: 186566 - DNA, 16 bp, P. troglodytes
aaatcaatcaatgtga

SEQ ID NO: 186567 - DNA, 16 bp, P. troglodytes
aaatcaatgaaacaga

SEQ ID NO: 186568 - DNA, 16 bp, P. troglodytes
aaatcaatgaaactga

SEQ ID NO: 186569 - DNA, 16 bp, P. troglodytes
aaatcaatggaaaaat

SEQ ID NO: 186570 - DNA, 16 bp, P. troglodytes
aaatcaattaatgtaa

SEQ ID NO: 186571 - DNA, 16 bp, P. troglodytes
aaatcaattgactata

SEQ ID NO: 186572 - DNA, 16 bp, P. troglodytes
aaatcaatttagtggg

SEQ ID NO: 186573 - DNA, 16 bp, P. troglodytes
aaatcaatttctgttg

SEQ ID NO: 186574 - DNA, 16 bp, P. troglodytes
aaatcacaacaaattg

SEQ ID NO: 186575 - DNA, 16 bp, P. troglodytes
aaatcacaagaatatt

SEQ ID NO: 186576 - DNA, 16 bp, P. troglodytes
aaatcacagataccac

SEQ ID NO: 186577 - DNA, 16 bp, P. troglodytes
aaatcacaggcattct

SEQ ID NO: 186578 - DNA, 16 bp, P. troglodytes
aaatcacatttatttt

SEQ ID NO: 186579 - DNA, 16 bp, P. troglodytes
aaatcacatttcaaca

SEQ ID NO: 186580 - DNA, 16 bp, P. troglodytes
aaatcacctcccacca

SEQ ID NO: 186581 - DNA, 16 bp, P. troglodytes
aaatcactaagccaaa

SEQ ID NO: 186582 - DNA, 16 bp, P. troglodytes
aaatcactgaagaaaa

SEQ ID NO: 186583 - DNA, 16 bp, P. troglodytes
aaatcacttgaatcca

SEQ ID NO: 186584 - DNA, 16 bp, P. troglodytes
aaatcactttgaaaaa

SEQ ID NO: 186585 - DNA, 16 bp, P. troglodytes
aaatcagaaaatattt

SEQ ID NO: 186586 - DNA, 16 bp, P. troglodytes
aaatcagaaaattaat

SEQ ID NO: 186587 - DNA, 16 bp, P. troglodytes
aaatcagaaacttttt

SEQ ID NO: 186588 - DNA, 16 bp, P. troglodytes
aaatcagaaagtatga

SEQ ID NO: 186589 - DNA, 16 bp, P. troglodytes
aaatcagaaatgagaa

SEQ ID NO: 186590 - DNA, 16 bp, P. troglodytes
aaatcagaactcagga

SEQ ID NO: 186591 - DNA, 16 bp, P. troglodytes
aaatcagaagaaaatg

SEQ ID NO: 186592 - DNA, 16 bp, P. troglodytes
aaatcagacaccgcct

SEQ ID NO: 186593 - DNA, 16 bp, P. troglodytes
aaatcagacatgaaaa

SEQ ID NO: 186594 - DNA, 16 bp, P. troglodytes
aaatcagagagaacac

SEQ ID NO: 186595 - DNA, 16 bp, P. troglodytes
aaatcagattttttaa

SEQ ID NO: 186596 - DNA, 16 bp, P. troglodytes
aaatcagatttttttt

SEQ ID NO: 186597 - DNA, 16 bp, P. troglodytes
aaatcagcaagaacaa

SEQ ID NO: 186598 - DNA, 16 bp, P. troglodytes
aaatcagcaagaagaa

SEQ ID NO: 186599 - DNA, 16 bp, P. troglodytes
aaatcagcaagagaaa

SEQ ID NO: 186600 - DNA, 16 bp, P. troglodytes
aaatcagcaaggatat

SEQ ID NO: 186601 - DNA, 16 bp, P. troglodytes
aaatcagccaaaggaa

SEQ ID NO: 186602 - DNA, 16 bp, P. troglodytes
aaatcagcctggccaa

SEQ ID NO: 186603 - DNA, 16 bp, P. troglodytes
aaatcagctgtgaatc

SEQ ID NO: 186604 - DNA, 16 bp, P. troglodytes
aaatcaggaagaaaca

SEQ ID NO: 186605 - DNA, 16 bp, P. troglodytes
aaatcaggaagtatga

SEQ ID NO: 186606 - DNA, 16 bp, P. troglodytes
aaatcaggtagtgtga

SEQ ID NO: 186607 - DNA, 16 bp, P. troglodytes
aaatcagtatttaaaa

SEQ ID NO: 186608 - DNA, 16 bp, P. troglodytes
aaatcagtatttcaaa

SEQ ID NO: 186609 - DNA, 16 bp, P. troglodytes
aaatcagtattttgaa

SEQ ID NO: 186610 - DNA, 16 bp, P. troglodytes
aaatcagtatttttaa

SEQ ID NO: 186611 - DNA, 16 bp, P. troglodytes
aaatcagtgagaaaaa

SEQ ID NO: 186612 - DNA, 16 bp, P. troglodytes
aaatcagtgggaaaaa

SEQ ID NO: 186613 - DNA, 16 bp, P. troglodytes
aaatcagtttttaaaa

SEQ ID NO: 186614 - DNA, 16 bp, P. troglodytes
aaatcatccttttttt

SEQ ID NO: 186615 - DNA, 16 bp, P. troglodytes
aaatcatctgtcttct

SEQ ID NO: 186616 - DNA, 24 bp, P. troglodytes
aaatcatgagtgaacttccattca

SEQ ID NO: 186617 - DNA, 16 bp, P. troglodytes
aaatcatgcagtatgt

SEQ ID NO: 186618 - DNA, 16 bp, P. troglodytes
aaatcatgtatttatt

SEQ ID NO: 186619 - DNA, 16 bp, P. troglodytes
aaatcatgtcttttgc

SEQ ID NO: 186620 - DNA, 16 bp, P. troglodytes
aaatcattccatgctc

SEQ ID NO: 186621 - DNA, 16 bp, P. troglodytes
aaatcattgaaaaaat

SEQ ID NO: 186622 - DNA, 16 bp, P. troglodytes
aaatcatttagaaaaa

SEQ ID NO: 186623 - DNA, 16 bp, P. troglodytes
aaatcatttatctgat

SEQ ID NO: 186624 - DNA, 16 bp, P. troglodytes
aaatcatttctctttt

SEQ ID NO: 186625 - DNA, 16 bp, P. troglodytes
aaatcatttgaaattt

SEQ ID NO: 186626 - DNA, 16 bp, P. troglodytes
aaatcatttgacaaaa

SEQ ID NO: 186627 - DNA, 16 bp, P. troglodytes
aaatcattttatgaaa

SEQ ID NO: 186628 - DNA, 16 bp, P. troglodytes
aaatcattttgaaaat

SEQ ID NO: 186629 - DNA, 16 bp, P. troglodytes
aaatcattttgatttt

SEQ ID NO: 186630 - DNA, 16 bp, P. troglodytes
aaatcatttttttcct

SEQ ID NO: 186631 - DNA, 16 bp, P. troglodytes
aaatccaaaacacttc

SEQ ID NO: 186632 - DNA, 16 bp, P. troglodytes
aaatccaaaacatgaa

SEQ ID NO: 186633 - DNA, 16 bp, P. troglodytes
aaatccaaatactgca

SEQ ID NO: 186634 - DNA, 16 bp, P. troglodytes
aaatccaacaatatat

SEQ ID NO: 186635 - DNA, 16 bp, P. troglodytes
aaatccaacatccctt

SEQ ID NO: 186636 - DNA, 16 bp, P. troglodytes
aaatccacagaatgta

SEQ ID NO: 186637 - DNA, 16 bp, P. troglodytes
aaatccagcaacacat

SEQ ID NO: 186638 - DNA, 16 bp, P. troglodytes
aaatccaggctgaggt

SEQ ID NO: 186639 - DNA, 16 bp, P. troglodytes
aaatccagtgtttctt

SEQ ID NO: 186640 - DNA, 16 bp, P. troglodytes
aaatccatgaagatga

SEQ ID NO: 186641 - DNA, 16 bp, P. troglodytes
aaatccatggctgggc

SEQ ID NO: 186642 - DNA, 16 bp, P. troglodytes
aaatcccaaaatattt

SEQ ID NO: 186643 - DNA, 16 bp, P. troglodytes
aaatcccagcactctg

SEQ ID NO: 186644 - DNA, 19 bp, P. troglodytes
aaatcccagcactttggga

SEQ ID NO: 186645 - DNA, 16 bp, P. troglodytes
aaatcccagccctgcc

SEQ ID NO: 186646 - DNA, 16 bp, P. troglodytes
aaatcccagctacttg

SEQ ID NO: 186647 - DNA, 16 bp, P. troglodytes
aaatcccagctttgct

SEQ ID NO: 186648 - DNA, 16 bp, P. troglodytes
aaatcccagtactttg

SEQ ID NO: 186649 - DNA, 16 bp, P. troglodytes
aaatcccatctctgct

SEQ ID NO: 186650 - DNA, 16 bp, P. troglodytes
aaatcccatgtctact

SEQ ID NO: 186651 - DNA, 16 bp, P. troglodytes
aaatcccattttctgg

SEQ ID NO: 186652 - DNA, 17 bp, P. troglodytes
aaatccctagaagaaaa

SEQ ID NO: 186653 - DNA, 16 bp, P. troglodytes
aaatccctcagctttt

SEQ ID NO: 186654 - DNA, 16 bp, P. troglodytes
aaatccctgtcctgtt

SEQ ID NO: 186655 - DNA, 16 bp, P. troglodytes
aaatcctagaaaatgt

SEQ ID NO: 186656 - DNA, 16 bp, P. troglodytes
aaatcctagatggcat

SEQ ID NO: 186657 - DNA, 20 bp, P. troglodytes
aaatcctatctctactaaaa

SEQ ID NO: 186658 - DNA, 16 bp, P. troglodytes
aaatcctcaatacaat

SEQ ID NO: 186659 - DNA, 16 bp, P. troglodytes
aaatcctggcctcaag

SEQ ID NO: 186660 - DNA, 16 bp, P. troglodytes
aaatcctgggctcaag

SEQ ID NO: 186661 - DNA, 17 bp, P. troglodytes
aaatcctgtctctacta

SEQ ID NO: 186662 - DNA, 16 bp, P. troglodytes
aaatcctgttttaaaa

SEQ ID NO: 186663 - DNA, 16 bp, P. troglodytes
aaatccttgagcttga

SEQ ID NO: 186664 - DNA, 16 bp, P. troglodytes
aaatcctttatcagat

SEQ ID NO: 186665 - DNA, 16 bp, P. troglodytes
aaatccttttcagaaa

SEQ ID NO: 186666 - DNA, 16 bp, P. troglodytes
aaatcggtaaaattta

SEQ ID NO: 186667 - DNA, 16 bp, P. troglodytes
aaatctaaaactgttt

SEQ ID NO: 186668 - DNA, 16 bp, P. troglodytes
aaatctaaaggaaatg

SEQ ID NO: 186669 - DNA, 16 bp, P. troglodytes
aaatctaacaaaagat

SEQ ID NO: 186670 - DNA, 16 bp, P. troglodytes
aaatctaatgcctgat

SEQ ID NO: 186671 - DNA, 16 bp, P. troglodytes
aaatctacacacacac

SEQ ID NO: 186672 - DNA, 16 bp, P. troglodytes
aaatctagaagaaata

SEQ ID NO: 186673 - DNA, 16 bp, P. troglodytes
aaatctagagatctaa

SEQ ID NO: 186674 - DNA, 16 bp, P. troglodytes
aaatctagttttaaaa

SEQ ID NO: 186675 - DNA, 16 bp, P. troglodytes
aaatctataaaacttt

SEQ ID NO: 186676 - DNA, 16 bp, P. troglodytes
aaatctatagataaca

SEQ ID NO: 186677 - DNA, 16 bp, P. troglodytes
aaatctatcagattaa

SEQ ID NO: 186678 - DNA, 16 bp, P. troglodytes
aaatctattttatctg

SEQ ID NO: 186679 - DNA, 16 bp, P. troglodytes
aaatctcaagaaaaat

SEQ ID NO: 186680 - DNA, 17 bp, P. troglodytes
aaatctcaccttgaatt

SEQ ID NO: 186681 - DNA, 16 bp, P. troglodytes
aaatctcagaaatcat

SEQ ID NO: 186682 - DNA, 16 bp, P. troglodytes
aaatctcaggtcctca

SEQ ID NO: 186683 - DNA, 16 bp, P. troglodytes
aaatctcatatcaaat

SEQ ID NO: 186684 - DNA, 17 bp, P. troglodytes
aaatctcatcttgaatt

SEQ ID NO: 186685 - DNA, 23 bp, P. troglodytes
aaatctcatcttgaattgtagct

SEQ ID NO: 186686 - DNA, 16 bp, P. troglodytes
aaatctcatgatgaaa

SEQ ID NO: 186687 - DNA, 16 bp, P. troglodytes
aaatctccaaaataat

SEQ ID NO: 186688 - DNA, 16 bp, P. troglodytes
aaatctccaaaatgat

SEQ ID NO: 186689 - DNA, 16 bp, P. troglodytes
aaatctccaaatattt

SEQ ID NO: 186690 - DNA, 16 bp, P. troglodytes
aaatctcctcaagctg

SEQ ID NO: 186691 - DNA, 16 bp, P. troglodytes
aaatctctagaagaaa

SEQ ID NO: 186692 - DNA, 16 bp, P. troglodytes
aaatctctaggaagtt

SEQ ID NO: 186693 - DNA, 16 bp, P. troglodytes
aaatctctattttaaa

SEQ ID NO: 186694 - DNA, 16 bp, P. troglodytes
aaatctctcaaaacca

SEQ ID NO: 186695 - DNA, 16 bp, P. troglodytes
aaatctctccctatcc

SEQ ID NO: 186696 - DNA, 16 bp, P. troglodytes
aaatctctccctctct

SEQ ID NO: 186697 - DNA, 16 bp, P. troglodytes
aaatctctgtaccttc

SEQ ID NO: 186698 - DNA, 16 bp, P. troglodytes
aaatctgaaaatccaa

SEQ ID NO: 186699 - DNA, 16 bp, P. troglodytes
aaatctgaaataaaat

SEQ ID NO: 186700 - DNA, 16 bp, P. troglodytes
aaatctgaaatgtttt

SEQ ID NO: 186701 - DNA, 16 bp, P. troglodytes
aaatctgaaattattt

SEQ ID NO: 186702 - DNA, 16 bp, P. troglodytes
aaatctgaaattcaaa

SEQ ID NO: 186703 - DNA, 16 bp, P. troglodytes
aaatctgaaatttgaa

SEQ ID NO: 186704 - DNA, 16 bp, P. troglodytes
aaatctgaagaagaaa

SEQ ID NO: 186705 - DNA, 16 bp, P. troglodytes
aaatctgaatttcaaa

SEQ ID NO: 186706 - DNA, 16 bp, P. troglodytes
aaatctgctgtcattc

SEQ ID NO: 186707 - DNA, 16 bp, P. troglodytes
aaatctgctgttgagc

SEQ ID NO: 186708 - DNA, 16 bp, P. troglodytes
aaatctgctttttaaa

SEQ ID NO: 186709 - DNA, 16 bp, P. troglodytes
aaatctggaagaaatg

SEQ ID NO: 186710 - DNA, 16 bp, P. troglodytes
aaatctggggaagagg

SEQ ID NO: 186711 - DNA, 16 bp, P. troglodytes
aaatctgtaatttgaa

SEQ ID NO: 186712 - DNA, 16 bp, P. troglodytes
aaatctgtatatattt

SEQ ID NO: 186713 - DNA, 16 bp, P. troglodytes
aaatctgtgaagaaag

SEQ ID NO: 186714 - DNA, 16 bp, P. troglodytes
aaatctgtttccttgc

SEQ ID NO: 186715 - DNA, 16 bp, P. troglodytes
aaatctgttttgtcag

SEQ ID NO: 186716 - DNA, 16 bp, P. troglodytes
aaatcttaaagctcaa

SEQ ID NO: 186717 - DNA, 16 bp, P. troglodytes
aaatcttaacattttg

SEQ ID NO: 186718 - DNA, 16 bp, P. troglodytes
aaatcttacaaatcac

SEQ ID NO: 186719 - DNA, 16 bp, P. troglodytes
aaatcttagcaagcat

SEQ ID NO: 186720 - DNA, 16 bp, P. troglodytes
aaatcttagtggctta

SEQ ID NO: 186721 - DNA, 16 bp, P. troglodytes
aaatcttattttgaat

SEQ ID NO: 186722 - DNA, 16 bp, P. troglodytes
aaatcttcaacaaaat

SEQ ID NO: 186723 - DNA, 16 bp, P. troglodytes
aaatcttcaattttta

SEQ ID NO: 186724 - DNA, 16 bp, P. troglodytes
aaatcttcattttaaa

SEQ ID NO: 186725 - DNA, 16 bp, P. troglodytes
aaatcttcatttttaa

SEQ ID NO: 186726 - DNA, 16 bp, P. troglodytes
aaatcttctaagattg

SEQ ID NO: 186727 - DNA, 16 bp, P. troglodytes
aaatcttcttctacca

SEQ ID NO: 186728 - DNA, 16 bp, P. troglodytes
aaatcttcttggtgtt

SEQ ID NO: 186729 - DNA, 16 bp, P. troglodytes
aaatcttgccatttgt

SEQ ID NO: 186730 - DNA, 16 bp, P. troglodytes
aaatcttggccattgt

SEQ ID NO: 186731 - DNA, 16 bp, P. troglodytes
aaatctttatttacaa

SEQ ID NO: 186732 - DNA, 16 bp, P. troglodytes
aaatctttcagaaaat

SEQ ID NO: 186733 - DNA, 16 bp, P. troglodytes
aaatctttcttcagtt

SEQ ID NO: 186734 - DNA, 16 bp, P. troglodytes
aaatctttgacaaaat

SEQ ID NO: 186735 - DNA, 16 bp, P. troglodytes
aaatctttgtttttaa

SEQ ID NO: 186736 - DNA, 16 bp, P. troglodytes
aaatcttttgtgaaag

SEQ ID NO: 186737 - DNA, 16 bp, P. troglodytes
aaatctttttgttgtt

SEQ ID NO: 186738 - DNA, 16 bp, P. troglodytes
aaatgaaaaacaattt

SEQ ID NO: 186739 - DNA, 16 bp, P. troglodytes
aaatgaaaaagcttct

SEQ ID NO: 186740 - DNA, 16 bp, P. troglodytes
aaatgaaaaatgtcaa

SEQ ID NO: 186741 - DNA, 16 bp, P. troglodytes
aaatgaaaacaattct

SEQ ID NO: 186742 - DNA, 16 bp, P. troglodytes
aaatgaaaacaattta

SEQ ID NO: 186743 - DNA, 16 bp, P. troglodytes
aaatgaaaacaatttt

SEQ ID NO: 186744 - DNA, 16 bp, P. troglodytes
aaatgaaaacagattc

SEQ ID NO: 186745 - DNA, 16 bp, P. troglodytes
aaatgaaaacatgttt

SEQ ID NO: 186746 - DNA, 16 bp, P. troglodytes
aaatgaaaacatttta

SEQ ID NO: 186747 - DNA, 16 bp, P. troglodytes
aaatgaaaactcagaa

SEQ ID NO: 186748 - DNA, 16 bp, P. troglodytes
aaatgaaaactgcaat

SEQ ID NO: 186749 - DNA, 16 bp, P. troglodytes
aaatgaaaactttgat

SEQ ID NO: 186750 - DNA, 16 bp, P. troglodytes
aaatgaaaacttttgt

SEQ ID NO: 186751 - DNA, 16 bp, P. troglodytes
aaatgaaaagcaagca

SEQ ID NO: 186752 - DNA, 16 bp, P. troglodytes
aaatgaaaagtatttt

SEQ ID NO: 186753 - DNA, 16 bp, P. troglodytes
aaatgaaaagttattt

SEQ ID NO: 186754 - DNA, 16 bp, P. troglodytes
aaatgaaaagttgttt

SEQ ID NO: 186755 - DNA, 16 bp, P. troglodytes
aaatgaaaatacagga

SEQ ID NO: 186756 - DNA, 16 bp, P. troglodytes
aaatgaaaatacatcc

SEQ ID NO: 186757 - DNA, 16 bp, P. troglodytes
aaatgaaaatactttt

SEQ ID NO: 186758 - DNA, 16 bp, P. troglodytes
aaatgaaaatatgcaa

SEQ ID NO: 186759 - DNA, 16 bp, P. troglodytes
aaatgaaaatattctc

SEQ ID NO: 186760 - DNA, 16 bp, P. troglodytes
aaatgaaaatattttc

SEQ ID NO: 186761 - DNA, 16 bp, P. troglodytes
aaatgaaaatgatttt

SEQ ID NO: 186762 - DNA, 16 bp, P. troglodytes
aaatgaaaatgcattt

SEQ ID NO: 186763 - DNA, 16 bp, P. troglodytes
aaatgaaaatgtcaaa

SEQ ID NO: 186764 - DNA, 16 bp, P. troglodytes
aaatgaaaatgtttca

SEQ ID NO: 186765 - DNA, 16 bp, P. troglodytes
aaatgaaaattctaaa

SEQ ID NO: 186766 - DNA, 16 bp, P. troglodytes
aaatgaaacaaaatgg

SEQ ID NO: 186767 - DNA, 16 bp, P. troglodytes
aaatgaaacaaatatg

SEQ ID NO: 186768 - DNA, 16 bp, P. troglodytes
aaatgaaacatttaaa

SEQ ID NO: 186769 - DNA, 16 bp, P. troglodytes
aaatgaaacattttca

SEQ ID NO: 186770 - DNA, 16 bp, P. troglodytes
aaatgaaactgaaaca

SEQ ID NO: 186771 - DNA, 16 bp, P. troglodytes
aaatgaaaggaaatca

SEQ ID NO: 186772 - DNA, 16 bp, P. troglodytes
aaatgaaaggcagaaa

SEQ ID NO: 186773 - DNA, 16 bp, P. troglodytes
aaatgaaataaaacct

SEQ ID NO: 186774 - DNA, 16 bp, P. troglodytes
aaatgaaataaaccag

SEQ ID NO: 186775 - DNA, 16 bp, P. troglodytes
aaatgaaataaagacc

SEQ ID NO: 186776 - DNA, 16 bp, P. troglodytes
aaatgaaataacattt

SEQ ID NO: 186777 - DNA, 16 bp, P. troglodytes
aaatgaaataatgtac

SEQ ID NO: 186778 - DNA, 16 bp, P. troglodytes
aaatgaaatacatgta

SEQ ID NO: 186779 - DNA, 16 bp, P. troglodytes
aaatgaaatactgtat

SEQ ID NO: 186780 - DNA, 16 bp, P. troglodytes
aaatgaaatatctcta

SEQ ID NO: 186781 - DNA, 16 bp, P. troglodytes
aaatgaaatcatgtca

SEQ ID NO: 186782 - DNA, 16 bp, P. troglodytes
aaatgaaatcattttt

SEQ ID NO: 186783 - DNA, 16 bp, P. troglodytes
aaatgaaatctatttt

SEQ ID NO: 186784 - DNA, 16 bp, P. troglodytes
aaatgaaatctttaaa

SEQ ID NO: 186785 - DNA, 16 bp, P. troglodytes
aaatgaaatgaagaca

SEQ ID NO: 186786 - DNA, 16 bp, P. troglodytes
aaatgaaatgattttt

SEQ ID NO: 186787 - DNA, 16 bp, P. troglodytes
aaatgaaatgcttagg

SEQ ID NO: 186788 - DNA, 16 bp, P. troglodytes
aaatgaaatggaaatt

SEQ ID NO: 186789 - DNA, 16 bp, P. troglodytes
aaatgaaatgttttta

SEQ ID NO: 186790 - DNA, 16 bp, P. troglodytes
aaatgaaattatttct

SEQ ID NO: 186791 - DNA, 16 bp, P. troglodytes
aaatgaaattcagaaa

SEQ ID NO: 186792 - DNA, 16 bp, P. troglodytes
aaatgaaattgtattt

SEQ ID NO: 186793 - DNA, 16 bp, P. troglodytes
aaatgaaatttcattt

SEQ ID NO: 186794 - DNA, 16 bp, P. troglodytes
aaatgaaatttggaaa

SEQ ID NO: 186795 - DNA, 16 bp, P. troglodytes
aaatgaaattttcaaa

SEQ ID NO: 186796 - DNA, 16 bp, P. troglodytes
aaatgaacaaaacctc

SEQ ID NO: 186797 - DNA, 16 bp, P. troglodytes
aaatgaacaaaggaat

SEQ ID NO: 186798 - DNA, 16 bp, P. troglodytes
aaatgaacaattagaa

SEQ ID NO: 186799 - DNA, 16 bp, P. troglodytes
aaatgaacacaaaatt

SEQ ID NO: 186800 - DNA, 16 bp, P. troglodytes
aaatgaacactggctt

SEQ ID NO: 186801 - DNA, 16 bp, P. troglodytes
aaatgaacatttaaaa

SEQ ID NO: 186802 - DNA, 16 bp, P. troglodytes
aaatgaacattttcta

SEQ ID NO: 186803 - DNA, 16 bp, P. troglodytes
aaatgaactgaaaaat

SEQ ID NO: 186804 - DNA, 16 bp, P. troglodytes
aaatgaactttaaaaa

SEQ ID NO: 186805 - DNA, 16 bp, P. troglodytes
aaatgaagaaaactga

SEQ ID NO: 186806 - DNA, 16 bp, P. troglodytes
aaatgaagaaaacttt

SEQ ID NO: 186807 - DNA, 16 bp, P. troglodytes
aaatgaagaaactgaa

SEQ ID NO: 186808 - DNA, 16 bp, P. troglodytes
aaatgaagaacacaat

SEQ ID NO: 186809 - DNA, 16 bp, P. troglodytes
aaatgaagaatgtgtt

SEQ ID NO: 186810 - DNA, 16 bp, P. troglodytes
aaatgaagaatttttt

SEQ ID NO: 186811 - DNA, 16 bp, P. troglodytes
aaatgaagacagagaa

SEQ ID NO: 186812 - DNA, 16 bp, P. troglodytes
aaatgaagactgagaa

SEQ ID NO: 186813 - DNA, 16 bp, P. troglodytes
aaatgaagactttaaa

SEQ ID NO: 186814 - DNA, 16 bp, P. troglodytes
aaatgaagagcaaagt

SEQ ID NO: 186815 - DNA, 16 bp, P. troglodytes
aaatgaagatgttctt

SEQ ID NO: 186816 - DNA, 16 bp, P. troglodytes
aaatgaagattataga

SEQ ID NO: 186817 - DNA, 16 bp, P. troglodytes
aaatgaagattttatt

SEQ ID NO: 186818 - DNA, 16 bp, P. troglodytes
aaatgaagccagtcag

SEQ ID NO: 186819 - DNA, 16 bp, P. troglodytes
aaatgaaggaaaagca

SEQ ID NO: 186820 - DNA, 16 bp, P. troglodytes
aaatgaaggaaatcct

SEQ ID NO: 186821 - DNA, 16 bp, P. troglodytes
aaatgaaggaaattct

SEQ ID NO: 186822 - DNA, 16 bp, P. troglodytes
aaatgaaggcacagag

SEQ ID NO: 186823 - DNA, 36 bp, P. troglodytes; identical to SEQ ID NO: 10333

SEQ ID NO: 186824 - DNA, 16 bp, P. troglodytes
aaatgaagggatgggc

SEQ ID NO: 186825 - DNA, 16 bp, P. troglodytes
aaatgaagtgtgaaga

SEQ ID NO: 186826 - DNA, 16 bp, P. troglodytes
aaatgaagtttttaaa

SEQ ID NO: 186827 - DNA, 16 bp, P. troglodytes
aaatgaataaacaagt

SEQ ID NO: 186828 - DNA, 16 bp, P. troglodytes
aaatgaatacatacat

SEQ ID NO: 186829 - DNA, 16 bp, P. troglodytes
aaatgaatatttcatt

SEQ ID NO: 186830 - DNA, 16 bp, P. troglodytes
aaatgaatattttgat

SEQ ID NO: 186831 - DNA, 16 bp, P. troglodytes
aaatgaatcaaagacc

SEQ ID NO: 186832 - DNA, 16 bp, P. troglodytes
aaatgaatcagaaaca

SEQ ID NO: 186833 - DNA, 16 bp, P. troglodytes
aaatgaatcatttaaa

SEQ ID NO: 186834 - DNA, 16 bp, P. troglodytes
aaatgaatccagcagc

SEQ ID NO: 186835 - DNA, 16 bp, P. troglodytes
aaatgaatctttaaaa

SEQ ID NO: 186836 - DNA, 16 bp, P. troglodytes
aaatgaatgaatacag

SEQ ID NO: 186837 - DNA, 16 bp, P. troglodytes
aaatgaatgacagcaa

SEQ ID NO: 186838 - DNA, 16 bp, P. troglodytes
aaatgaatgagataat

SEQ ID NO: 186839 - DNA, 16 bp, P. troglodytes
aaatgaatgagcaaat

SEQ ID NO: 186840 - DNA, 16 bp, P. troglodytes
aaatgaatgagtgtgg

SEQ ID NO: 186841 - DNA, 16 bp, P. troglodytes
aaatgaatgattttta

SEQ ID NO: 186842 - DNA, 16 bp, P. troglodytes
aaatgaatgcatttta

SEQ ID NO: 186843 - DNA, 16 bp, P. troglodytes
aaatgaatgcattttt

SEQ ID NO: 186844 - DNA, 16 bp, P. troglodytes
aaatgaatgtgaatgt

SEQ ID NO: 186845 - DNA, 16 bp, P. troglodytes
aaatgaatgttgtttt

SEQ ID NO: 186846 - DNA, 16 bp, P. troglodytes
aaatgaatgtttttct

SEQ ID NO: 186847 - DNA, 16 bp, P. troglodytes
aaatgaattcagtgaa

SEQ ID NO: 186848 - DNA, 16 bp, P. troglodytes
aaatgaattctgccaa

SEQ ID NO: 186849 - DNA, 16 bp, P. troglodytes
aaatgaatttatttct

SEQ ID NO: 186850 - DNA, 16 bp, P. troglodytes
aaatgaatttggaaat

SEQ ID NO: 186851 - DNA, 16 bp, P. troglodytes
aaatgaattttaaatg

SEQ ID NO: 186852 - DNA, 16 bp, P. troglodytes
aaatgaatttttgaaa

SEQ ID NO: 186853 - DNA, 16 bp, P. troglodytes
aaatgacaaaggagac

SEQ ID NO: 186854 - DNA, 16 bp, P. troglodytes
aaatgacaagaaagga

SEQ ID NO: 186855 - DNA, 16 bp, P. troglodytes
aaatgacaatgataat

SEQ ID NO: 186856 - DNA, 16 bp, P. troglodytes
aaatgacaatggaaac

SEQ ID NO: 186857 - DNA, 16 bp, P. troglodytes
aaatgacagaaacaga

SEQ ID NO: 186858 - DNA, 16 bp, P. troglodytes
aaatgacagagaaaga

SEQ ID NO: 186859 - DNA, 16 bp, P. troglodytes
aaatgacataaaaatg

SEQ ID NO: 186860 - DNA, 16 bp, P. troglodytes
aaatgacatagtattt

SEQ ID NO: 186861 - DNA, 16 bp, P. troglodytes
aaatgacatgatggag

SEQ ID NO: 186862 - DNA, 16 bp, P. troglodytes
aaatgacatttctgtt

SEQ ID NO: 186863 - DNA, 16 bp, P. troglodytes
aaatgacatttttaga

SEQ ID NO: 186864 - DNA, 16 bp, P. troglodytes
aaatgacatttttata

SEQ ID NO: 186865 - DNA, 16 bp, P. troglodytes
aaatgaccaaggtcct

SEQ ID NO: 186866 - DNA, 16 bp, P. troglodytes
aaatgaccagatctca

SEQ ID NO: 186867 - DNA, 16 bp, P. troglodytes
aaatgactaaaatttt

SEQ ID NO: 186868 - DNA, 16 bp, P. troglodytes
aaatgactcagaaaaa

SEQ ID NO: 186869 - DNA, 16 bp, P. troglodytes
aaatgacttgcccagg

SEQ ID NO: 186870 - DNA, 16 bp, P. troglodytes
aaatgacttggccaag

SEQ ID NO: 186871 - DNA, 16 bp, P. troglodytes
aaatgactttagtaaa

SEQ ID NO: 186872 - DNA, 16 bp, P. troglodytes
aaatgactttatttct

SEQ ID NO: 186873 - DNA, 20 bp, P. troglodytes
aaatgactttcttcacagaa

SEQ ID NO: 186874 - DNA, 16 bp, P. troglodytes
aaatgagaaaaatcag

SEQ ID NO: 186875 - DNA, 16 bp, P. troglodytes
aaatgagaaaacatgt

SEQ ID NO: 186876 - DNA, 16 bp, P. troglodytes
aaatgagaaaacattt

SEQ ID NO: 186877 - DNA, 16 bp, P. troglodytes
aaatgagaaaactgag

SEQ ID NO: 186878 - DNA, 16 bp, P. troglodytes
aaatgagaaaatgtat

SEQ ID NO: 186879 - DNA, 16 bp, P. troglodytes
aaatgagaaacatttt

SEQ ID NO: 186880 - DNA, 16 bp, P. troglodytes
aaatgagaaagaacca

SEQ ID NO: 186881 - DNA, 16 bp, P. troglodytes
aaatgagaaatgtgtt

SEQ ID NO: 186882 - DNA, 16 bp, P. troglodytes
aaatgagaaggaagca

SEQ ID NO: 186883 - DNA, 16 bp, P. troglodytes
aaatgagacaatgcat

SEQ ID NO: 186884 - DNA, 16 bp, P. troglodytes
aaatgagacagacagc

SEQ ID NO: 186885 - DNA, 16 bp, P. troglodytes
aaatgagagactgagt

SEQ ID NO: 186886 - DNA, 16 bp, P. troglodytes
aaatgagataattcag

SEQ ID NO: 186887 - DNA, 16 bp, P. troglodytes
aaatgagatactgtat

SEQ ID NO: 186888 - DNA, 16 bp, P. troglodytes
aaatgagatcatgtgg

SEQ ID NO: 186889 - DNA, 18 bp, P. troglodytes
aaatgagatctaattaaa

SEQ ID NO: 186890 - DNA, 16 bp, P. troglodytes
aaatgagccagatgtg

SEQ ID NO: 186891 - DNA, 16 bp, P. troglodytes
aaatgagctaatgtat

SEQ ID NO: 186892 - DNA, 16 bp, P. troglodytes
aaatgaggaaaccaag

SEQ ID NO: 186893 - DNA, 16 bp, P. troglodytes
aaatgaggaaaccgag

SEQ ID NO: 186894 - DNA, 16 bp, P. troglodytes
aaatgaggaaactgag

SEQ ID NO: 186895 - DNA, 16 bp, P. troglodytes
aaatgaggaaattgag

SEQ ID NO: 186896 - DNA, 16 bp, P. troglodytes
aaatgaggaggattac

SEQ ID NO: 186897 - DNA, 16 bp, P. troglodytes
aaatgaggagttattg

SEQ ID NO: 186898 - DNA, 16 bp, P. troglodytes
aaatgaggataataat

SEQ ID NO: 186899 - DNA, 16 bp, P. troglodytes
aaatgaggatgatgat

SEQ ID NO: 186900 - DNA, 16 bp, P. troglodytes
aaatgaggcccagaaa

SEQ ID NO: 186901 - DNA, 16 bp, P. troglodytes
aaatgaggcccagaga

SEQ ID NO: 186902 - DNA, 16 bp, P. troglodytes
aaatgaggtttttttt

SEQ ID NO: 186903 - DNA, 16 bp, P. troglodytes
aaatgagtaagtgaat

SEQ ID NO: 186904 - DNA, 16 bp, P. troglodytes
aaatgagttaatgaat

SEQ ID NO: 186905 - DNA, 16 bp, P. troglodytes
aaatgagttattttaa

SEQ ID NO: 186906 - DNA, 16 bp, P. troglodytes
aaatgagttggaaaat

SEQ ID NO: 186907 - DNA, 16 bp, P. troglodytes
aaatgagtttttgttt

SEQ ID NO: 186908 - DNA, 16 bp, P. troglodytes
aaatgataacaaactg

SEQ ID NO: 186909 - DNA, 16 bp, P. troglodytes
aaatgataagaactta

SEQ ID NO: 186910 - DNA, 16 bp, P. troglodytes
aaatgatacagctgct

SEQ ID NO: 186911 - DNA, 16 bp, P. troglodytes
aaatgatactaatttt

SEQ ID NO: 186912 - DNA, 16 bp, P. troglodytes
aaatgatatttcaaga

SEQ ID NO: 186913 - DNA, 16 bp, P. troglodytes
aaatgatatttgtaaa

SEQ ID NO: 186914 - DNA, 16 bp, P. troglodytes
aaatgatcatatgttt

SEQ ID NO: 186915 - DNA, 16 bp, P. troglodytes
aaatgatgaaatattt

SEQ ID NO: 186916 - DNA, 16 bp, P. troglodytes
aaatgatgaatgaatg

SEQ ID NO: 186917 - DNA, 16 bp, P. troglodytes
aaatgatgagagattt

SEQ ID NO: 186918 - DNA, 16 bp, P. troglodytes
aaatgatgataatgat

SEQ ID NO: 186919 - DNA, 16 bp, P. troglodytes
aaatgatggtgatgat

SEQ ID NO: 186920 - DNA, 16 bp, P. troglodytes
aaatgatgttagacaa

SEQ ID NO: 186921 - DNA, 16 bp, P. troglodytes
aaatgatgttttgaaa

SEQ ID NO: 186922 - DNA, 16 bp, P. troglodytes
aaatgatgtttttaaa

SEQ ID NO: 186923 - DNA, 16 bp, P. troglodytes
aaatgattataaatca

SEQ ID NO: 186924 - DNA, 16 bp, P. troglodytes
aaatgattatttttca

SEQ ID NO: 186925 - DNA, 16 bp, P. troglodytes
aaatgattcaagaaaa

SEQ ID NO: 186926 - DNA, 16 bp, P. troglodytes
aaatgattcattttta

SEQ ID NO: 186927 - DNA, 16 bp, P. troglodytes
aaatgattctttttct

SEQ ID NO: 186928 - DNA, 16 bp, P. troglodytes
aaatgattgaatacat

SEQ ID NO: 186929 - DNA, 16 bp, P. troglodytes
aaatgatttaaaacaa

SEQ ID NO: 186930 - DNA, 16 bp, P. troglodytes
aaatgatttcagcaaa

SEQ ID NO: 186931 - DNA, 16 bp, P. troglodytes
aaatgatttcatttta

SEQ ID NO: 186932 - DNA, 16 bp, P. troglodytes
aaatgatttcttattt

SEQ ID NO: 186933 - DNA, 16 bp, P. troglodytes
aaatgatttgcttttt

SEQ ID NO: 186934 - DNA, 16 bp, P. troglodytes
aaatgattttcaaaat

SEQ ID NO: 186935 - DNA, 16 bp, P. troglodytes
aaatgattttcctttt

SEQ ID NO: 186936 - DNA, 16 bp, P. troglodytes
aaatgattttctttct

SEQ ID NO: 186937 - DNA, 16 bp, P. troglodytes
aaatgattttgggaaa

SEQ ID NO: 186938 - DNA, 16 bp, P. troglodytes
aaatgatttttctaaa

SEQ ID NO: 186939 - DNA, 16 bp, P. troglodytes
aaatgattttttttct

SEQ ID NO: 186940 - DNA, 16 bp, P. troglodytes
aaatgcaaaaatattc

SEQ ID NO: 186941 - DNA, 16 bp, P. troglodytes
aaatgcaaaagttagc

SEQ ID NO: 186942 - DNA, 16 bp, P. troglodytes
aaatgcaaaatataat

SEQ ID NO: 186943 - DNA, 16 bp, P. troglodytes
aaatgcaaaatattaa

SEQ ID NO: 186944 - DNA, 16 bp, P. troglodytes
aaatgcaaaccaaagc

SEQ ID NO: 186945 - DNA, 16 bp, P. troglodytes
aaatgcaaactgaaac

SEQ ID NO: 186946 - DNA, 16 bp, P. troglodytes
aaatgcaaaggaagaa

SEQ ID NO: 186947 - DNA, 16 bp, P. troglodytes
aaatgcaaataaaact

SEQ ID NO: 186948 - DNA, 16 bp, P. troglodytes
aaatgcaaatatttta

SEQ ID NO: 186949 - DNA, 16 bp, P. troglodytes
aaatgcaaatcaaaac

SEQ ID NO: 186950 - DNA, 16 bp, P. troglodytes
aaatgcaaatcgaaac

SEQ ID NO: 186951 - DNA, 16 bp, P. troglodytes
aaatgcaaatgcaaat

SEQ ID NO: 186952 - DNA, 16 bp, P. troglodytes
aaatgcaacagaaaca

SEQ ID NO: 186953 - DNA, 16 bp, P. troglodytes
aaatgcaagaaatgaa

SEQ ID NO: 186954 - DNA, 16 bp, P. troglodytes
aaatgcaagtcaaaac

SEQ ID NO: 186955 - DNA, 16 bp, P. troglodytes
aaatgcaatatctgtg

SEQ ID NO: 186956 - DNA, 16 bp, P. troglodytes
aaatgcaatccagcat

SEQ ID NO: 186957 - DNA, 16 bp, P. troglodytes
aaatgcaatcccattt

SEQ ID NO: 186958 - DNA, 16 bp, P. troglodytes
aaatgcaattattatt

SEQ ID NO: 186959 - DNA, 16 bp, P. troglodytes
aaatgcaattcatttt

SEQ ID NO: 186960 - DNA, 16 bp, P. troglodytes
aaatgcaattttaaaa

SEQ ID NO: 186961 - DNA, 16 bp, P. troglodytes
aaatgcaatttttata

SEQ ID NO: 186962 - DNA, 16 bp, P. troglodytes
aaatgcacacaaaaat

SEQ ID NO: 186963 - DNA, 16 bp, P. troglodytes
aaatgcacagatctta

SEQ ID NO: 186964 - DNA, 16 bp, P. troglodytes
aaatgcacatggaaca

SEQ ID NO: 186965 - DNA, 16 bp, P. troglodytes
aaatgcacattcctgg

SEQ ID NO: 186966 - DNA, 16 bp, P. troglodytes
aaatgcagaaaaggcc

SEQ ID NO: 186967 - DNA, 16 bp, P. troglodytes
aaatgcagaaaatgaa

SEQ ID NO: 186968 - DNA, 17 bp, P. troglodytes
aaatgcagaaatcacct

SEQ ID NO: 186969 - DNA, 16 bp, P. troglodytes
aaatgcagaatatcag

SEQ ID NO: 186970 - DNA, 16 bp, P. troglodytes
aaatgcagaatctctg

SEQ ID NO: 186971 - DNA, 16 bp, P. troglodytes
aaatgcagattcccag

SEQ ID NO: 186972 - DNA, 16 bp, P. troglodytes
aaatgcagattctgac

SEQ ID NO: 186973 - DNA, 16 bp, P. troglodytes
aaatgcaggaaaaaat

SEQ ID NO: 186974 - DNA, 16 bp, P. troglodytes
aaatgcagggcccctt

SEQ ID NO: 186975 - DNA, 16 bp, P. troglodytes
aaatgcagtggaaagt

SEQ ID NO: 186976 - DNA, 16 bp, P. troglodytes
aaatgcagtttatttt

SEQ ID NO: 186977 - DNA, 16 bp, P. troglodytes
aaatgcagtttttttt

SEQ ID NO: 186978 - DNA, 16 bp, P. troglodytes
aaatgcataaaatgaa

SEQ ID NO: 186979 - DNA, 16 bp, P. troglodytes
aaatgcataattaaaa

SEQ ID NO: 186980 - DNA, 16 bp, P. troglodytes
aaatgcatacacacat

SEQ ID NO: 186981 - DNA, 16 bp, P. troglodytes
aaatgcatatatattt

SEQ ID NO: 186982 - DNA, 16 bp, P. troglodytes
aaatgcatatattaat

SEQ ID NO: 186983 - DNA, 16 bp, P. troglodytes
aaatgcatattaaaac

SEQ ID NO: 186984 - DNA, 16 bp, P. troglodytes
aaatgcatattgcaaa

SEQ ID NO: 186985 - DNA, 16 bp, P. troglodytes
aaatgcatatttttaa

SEQ ID NO: 186986 - DNA, 16 bp, P. troglodytes
aaatgcattaattaaa

SEQ ID NO: 186987 - DNA, 16 bp, P. troglodytes
aaatgcattcttttta

SEQ ID NO: 186988 - DNA, 16 bp, P. troglodytes
aaatgcatttaatacc

SEQ ID NO: 186989 - DNA, 16 bp, P. troglodytes
aaatgcatttcaaaat

SEQ ID NO: 186990 - DNA, 16 bp, P. troglodytes
aaatgcatttcctttt

SEQ ID NO: 186991 - DNA, 16 bp, P. troglodytes
aaatgcatttcttttt

SEQ ID NO: 186992 - DNA, 16 bp, P. troglodytes
aaatgcattttaaaaa

SEQ ID NO: 186993 - DNA, 16 bp, P. troglodytes
aaatgcattttgaagt

SEQ ID NO: 186994 - DNA, 16 bp, P. troglodytes
aaatgcattttgctaa

SEQ ID NO: 186995 - DNA, 16 bp, P. troglodytes
aaatgcatttttaaaa

SEQ ID NO: 186996 - DNA, 16 bp, P. troglodytes
aaatgcatttttattt

SEQ ID NO: 186997 - DNA, 16 bp, P. troglodytes
aaatgcattttttaaa

SEQ ID NO: 186998 - DNA, 16 bp, P. troglodytes
aaatgcattttttttt

SEQ ID NO: 186999 - DNA, 16 bp, P. troglodytes
aaatgccaagagaaaa

SEQ ID NO: 187000 - DNA, 16 bp, P. troglodytes
aaatgccaatctcttc

SEQ ID NO: 187001 - DNA, 16 bp, P. troglodytes
aaatgccacctcctca

SEQ ID NO: 187002 - DNA, 16 bp, P. troglodytes
aaatgccattttaaaa

SEQ ID NO: 187003 - DNA, 16 bp, P. troglodytes
aaatgcccaattaaaa

SEQ ID NO: 187004 - DNA, 16 bp, P. troglodytes
aaatgcccatcaaaga

SEQ ID NO: 187005 - DNA, 16 bp, P. troglodytes
aaatgcccatcagtga

SEQ ID NO: 187006 - DNA, 16 bp, P. troglodytes
aaatgcctactgtgtg

SEQ ID NO: 187007 - DNA, 16 bp, P. troglodytes
aaatgcctcactttct

SEQ ID NO: 187008 - DNA, 16 bp, P. troglodytes
aaatgcctctgacaca

SEQ ID NO: 187009 - DNA, 17 bp, P. troglodytes
aaatgcctggatgccca

SEQ ID NO: 187010 - DNA, 16 bp, P. troglodytes
aaatgcctttaaaaaa

SEQ ID NO: 187011 - DNA, 16 bp, P. troglodytes
aaatgccttttcttca

SEQ ID NO: 187012 - DNA, 16 bp, P. troglodytes
aaatgcctttttctcc

SEQ ID NO: 187013 - DNA, 16 bp, P. troglodytes
aaatgcctttttctct

SEQ ID NO: 187014 - DNA, 16 bp, P. troglodytes
aaatgctaaaagaagt

SEQ ID NO: 187015 - DNA, 16 bp, P. troglodytes
aaatgctaaaggaaaa

SEQ ID NO: 187016 - DNA, 16 bp, P. troglodytes
aaatgctaatttaaaa

SEQ ID NO: 187017 - DNA, 16 bp, P. troglodytes
aaatgctacaaagaga

SEQ ID NO: 187018 - DNA, 16 bp, P. troglodytes
aaatgctacagagaaa

SEQ ID NO: 187019 - DNA, 16 bp, P. troglodytes
aaatgctactgctttt

SEQ ID NO: 187020 - DNA, 16 bp, P. troglodytes
aaatgctactggtttt

SEQ ID NO: 187021 - DNA, 16 bp, P. troglodytes
aaatgctagaagaaaa

SEQ ID NO: 187022 - DNA, 16 bp, P. troglodytes
aaatgctagctattat

SEQ ID NO: 187023 - DNA, 16 bp, P. troglodytes
aaatgctataaatatt

SEQ ID NO: 187024 - DNA, 16 bp, P. troglodytes
aaatgctatgaagaaa

SEQ ID NO: 187025 - DNA, 16 bp, P. troglodytes
aaatgctatggaaata

SEQ ID NO: 187026 - DNA, 16 bp, P. troglodytes
aaatgctatgtaaatg

SEQ ID NO: 187027 - DNA, 16 bp, P. troglodytes
aaatgctatttatttt

SEQ ID NO: 187028 - DNA, 16 bp, P. troglodytes
aaatgctattttaatt

SEQ ID NO: 187029 - DNA, 16 bp, P. troglodytes
aaatgctatttttatt

SEQ ID NO: 187030 - DNA, 16 bp, P. troglodytes
aaatgctcattttaaa

SEQ ID NO: 187031 - DNA, 16 bp, P. troglodytes
aaatgctccaaaatct

SEQ ID NO: 187032 - DNA, 16 bp, P. troglodytes
aaatgctgaaaaaata

SEQ ID NO: 187033 - DNA, 16 bp, P. troglodytes
aaatgctgaaaagaaa

SEQ ID NO: 187034 - DNA, 16 bp, P. troglodytes
aaatgctgaaagaaaa

SEQ ID NO: 187035 - DNA, 16 bp, P. troglodytes
aaatgctgacagattt

SEQ ID NO: 187036 - DNA, 16 bp, P. troglodytes
aaatgctgagagaaaa

SEQ ID NO: 187037 - DNA, 16 bp, P. troglodytes
aaatgctgagagatat

SEQ ID NO: 187038 - DNA, 19 bp, P. troglodytes
aaatgctgagattacaggc

SEQ ID NO: 187039 - DNA, 16 bp, P. troglodytes
aaatgctgccagtctt

SEQ ID NO: 187040 - DNA, 16 bp, P. troglodytes
aaatgctggggttaca

SEQ ID NO: 187041 - DNA, 17 bp, P. troglodytes
aaatgctggtatatcca

SEQ ID NO: 187042 - DNA, 16 bp, P. troglodytes
aaatgctgtgattata

SEQ ID NO: 187043 - DNA, 16 bp, P. troglodytes
aaatgctgtgctggga

SEQ ID NO: 187044 - DNA, 16 bp, P. troglodytes
aaatgcttaataaatg

SEQ ID NO: 187045 - DNA, 16 bp, P. troglodytes
aaatgcttaggaccag

SEQ ID NO: 187046 - DNA, 16 bp, P. troglodytes
aaatgcttattaaata

SEQ ID NO: 187047 - DNA, 16 bp, P. troglodytes
aaatgcttattaaatg

SEQ ID NO: 187048 - DNA, 16 bp, P. troglodytes
aaatgcttattaaatt

SEQ ID NO: 187049 - DNA, 16 bp, P. troglodytes
aaatgcttattttatt

SEQ ID NO: 187050 - DNA, 16 bp, P. troglodytes
aaatgcttcaaaatcc

SEQ ID NO: 187051 - DNA, 16 bp, P. troglodytes
aaatgcttcaaagaga

SEQ ID NO: 187052 - DNA, 16 bp, P. troglodytes
aaatgcttcctctgtg

SEQ ID NO: 187053 - DNA, 16 bp, P. troglodytes
aaatgcttctaaaaat

SEQ ID NO: 187054 - DNA, 16 bp, P. troglodytes
aaatgcttctttaaaa

SEQ ID NO: 187055 - DNA, 16 bp, P. troglodytes
aaatgcttggaaccag

SEQ ID NO: 187056 - DNA, 16 bp, P. troglodytes
aaatgcttgggaccag

SEQ ID NO: 187057 - DNA, 16 bp, P. troglodytes
aaatgctttaaaaatt

SEQ ID NO: 187058 - DNA, 16 bp, P. troglodytes
aaatgctttaaaatat

SEQ ID NO: 187059 - DNA, 16 bp, P. troglodytes
aaatgctttcagaaaa

SEQ ID NO: 187060 - DNA, 16 bp, P. troglodytes
aaatgctttcttttct

SEQ ID NO: 187061 - DNA, 16 bp, P. troglodytes
aaatgctttgaaaaaa

SEQ ID NO: 187062 - DNA, 16 bp, P. troglodytes
aaatgctttgaaaatg

SEQ ID NO: 187063 - DNA, 16 bp, P. troglodytes
aaatgctttgaagaaa

SEQ ID NO: 187064 - DNA, 16 bp, P. troglodytes
aaatgcttttaaaaat

SEQ ID NO: 187065 - DNA, 16 bp, P. troglodytes
aaatgcttttagagaa

SEQ ID NO: 187066 - DNA, 16 bp, P. troglodytes
aaatgcttttcaaatt

SEQ ID NO: 187067 - DNA, 16 bp, P. troglodytes
aaatgcttttcagcat

SEQ ID NO: 187068 - DNA, 16 bp, P. troglodytes
aaatgcttttctgaaa

SEQ ID NO: 187069 - DNA, 16 bp, P. troglodytes
aaatgcttttgtaaaa

SEQ ID NO: 187070 - DNA, 16 bp, P. troglodytes
aaatgctttttaaaaa

SEQ ID NO: 187071 - DNA, 16 bp, P. troglodytes
aaatgctttttcatca

SEQ ID NO: 187072 - DNA, 16 bp, P. troglodytes
aaatgctttttgtgca

SEQ ID NO: 187073 - DNA, 16 bp, P. troglodytes
aaatgcttttttattt

SEQ ID NO: 187074 - DNA, 16 bp, P. troglodytes
aaatggaaaaacattt

SEQ ID NO: 187075 - DNA, 16 bp, P. troglodytes
aaatggaaaaactgag

SEQ ID NO: 187076 - DNA, 16 bp, P. troglodytes
aaatggaaaacatatt

SEQ ID NO: 187077 - DNA, 16 bp, P. troglodytes
aaatggaaaacatgaa

SEQ ID NO: 187078 - DNA, 16 bp, P. troglodytes
aaatggaaaacccaaa

SEQ ID NO: 187079 - DNA, 16 bp, P. troglodytes
aaatggaaaaggcaaa

SEQ ID NO: 187080 - DNA, 16 bp, P. troglodytes
aaatggaaaatcattt

SEQ ID NO: 187081 - DNA, 16 bp, P. troglodytes
aaatggaaacaaatac

SEQ ID NO: 187082 - DNA, 16 bp, P. troglodytes
aaatggaaacaaatat

SEQ ID NO: 187083 - DNA, 16 bp, P. troglodytes
aaatggaaacaataat

SEQ ID NO: 187084 - DNA, 16 bp, P. troglodytes
aaatggaaacattaaa

SEQ ID NO: 187085 - DNA, 16 bp, P. troglodytes
aaatggaaacatttat

SEQ ID NO: 187086 - DNA, 16 bp, P. troglodytes
aaatggaaactaaaag

SEQ ID NO: 187087 - DNA, 16 bp, P. troglodytes
aaatggaaactcagag

SEQ ID NO: 187088 - DNA, 16 bp, P. troglodytes
aaatggaaacttaaaa

SEQ ID NO: 187089 - DNA, 16 bp, P. troglodytes
aaatggaaagacagaa

SEQ ID NO: 187090 - DNA, 16 bp, P. troglodytes
aaatggaaagatatat

SEQ ID NO: 187091 - DNA, 16 bp, P. troglodytes
aaatggaaataatagt

SEQ ID NO: 187092 - DNA, 16 bp, P. troglodytes
aaatggaaataatatc

SEQ ID NO: 187093 - DNA, 16 bp, P. troglodytes
aaatggaaatcaaaac

SEQ ID NO: 187094 - DNA, 16 bp, P. troglodytes
aaatggaaatgaaaac

SEQ ID NO: 187095 - DNA, 16 bp, P. troglodytes
aaatggaaattaattt

SEQ ID NO: 187096 - DNA, 16 bp, P. troglodytes
aaatggaagccaaaag

SEQ ID NO: 187097 - DNA, 16 bp, P. troglodytes
aaatggaagtggatca

SEQ ID NO: 187098 - DNA, 16 bp, P. troglodytes
aaatggaatatttaat

SEQ ID NO: 187099 - DNA, 16 bp, P. troglodytes
aaatggaatcatacag

SEQ ID NO: 187100 - DNA, 16 bp, P. troglodytes
aaatggaatcatacca

SEQ ID NO: 187101 - DNA, 16 bp, P. troglodytes
aaatggaatcatatca

SEQ ID NO: 187102 - DNA, 16 bp, P. troglodytes
aaatggaatgctttta

SEQ ID NO: 187103 - DNA, 16 bp, P. troglodytes
aaatggaattacatca

SEQ ID NO: 187104 - DNA, 16 bp, P. troglodytes
aaatggaattatatga

SEQ ID NO: 187105 - DNA, 16 bp, P. troglodytes
aaatggaattgctttt

SEQ ID NO: 187106 - DNA, 16 bp, P. troglodytes
aaatggaatttgaaat

SEQ ID NO: 187107 - DNA, 16 bp, P. troglodytes
aaatggacaaatggat

SEQ ID NO: 187108 - DNA, 16 bp, P. troglodytes
aaatggacaaatttct

SEQ ID NO: 187109 - DNA, 16 bp, P. troglodytes
aaatggacacattcct

SEQ ID NO: 187110 - DNA, 16 bp, P. troglodytes
aaatggaccaattcct

SEQ ID NO: 187111 - DNA, 16 bp, P. troglodytes
aaatggactaagataa

SEQ ID NO: 187112 - DNA, 16 bp, P. troglodytes
aaatggagaaaacaga

SEQ ID NO: 187113 - DNA, 16 bp, P. troglodytes
aaatggagaaaatatt

SEQ ID NO: 187114 - DNA, 16 bp, P. troglodytes
aaatggagaaactgaa

SEQ ID NO: 187115 - DNA, 16 bp, P. troglodytes
aaatggagaaactgag

SEQ ID NO: 187116 - DNA, 16 bp, P. troglodytes
aaatggagaaataatt

SEQ ID NO: 187117 - DNA, 16 bp, P. troglodytes
aaatggagaaatattc

SEQ ID NO: 187118 - DNA, 16 bp, P. troglodytes
aaatggagaaattcct

SEQ ID NO: 187119 - DNA, 16 bp, P. troglodytes
aaatggagaaattggc

SEQ ID NO: 187120 - DNA, 16 bp, P. troglodytes
aaatggagaacaaatt

SEQ ID NO: 187121 - DNA, 16 bp, P. troglodytes
aaatggagagtgactg

SEQ ID NO: 187122 - DNA, 16 bp, P. troglodytes
aaatggagataatgat

SEQ ID NO: 187123 - DNA, 16 bp, P. troglodytes
aaatggagataatttt

SEQ ID NO: 187124 - DNA, 16 bp, P. troglodytes
aaatggagatcataat

SEQ ID NO: 187125 - DNA, 16 bp, P. troglodytes
aaatggagattttttt

SEQ ID NO: 187126 - DNA, 16 bp, P. troglodytes
aaatggagcaggccaa

SEQ ID NO: 187127 - DNA, 16 bp, P. troglodytes
aaatggaggcccagag

SEQ ID NO: 187128 - DNA, 16 bp, P. troglodytes
aaatggaggctcaggg

SEQ ID NO: 187129 - DNA, 16 bp, P. troglodytes
aaatggaggttgcagt

SEQ ID NO: 187130 - DNA, 16 bp, P. troglodytes
aaatggagtcttgctt

SEQ ID NO: 187131 - DNA, 16 bp, P. troglodytes
aaatggataaacagaa

SEQ ID NO: 187132 - DNA, 16 bp, P. troglodytes
aaatggataaattatt

SEQ ID NO: 187133 - DNA, 16 bp, P. troglodytes
aaatggatattttctt

SEQ ID NO: 187134 - DNA, 16 bp, P. troglodytes
aaatggatcacagacc

SEQ ID NO: 187135 - DNA, 16 bp, P. troglodytes
aaatggatgaacaaat

SEQ ID NO: 187136 - DNA, 16 bp, P. troglodytes
aaatggatggagctgg

SEQ ID NO: 187137 - DNA, 16 bp, P. troglodytes
aaatggatgttgtttt

SEQ ID NO: 187138 - DNA, 16 bp, P. troglodytes
aaatggattaatgcca

SEQ ID NO: 187139 - DNA, 16 bp, P. troglodytes
aaatggattattttct

SEQ ID NO: 187140 - DNA, 16 bp, P. troglodytes
aaatggcaaaacccca

SEQ ID NO: 187141 - DNA, 16 bp, P. troglodytes
aaatggcaaacagata

SEQ ID NO: 187142 - DNA, 16 bp, P. troglodytes
aaatggcaaatatttt

SEQ ID NO: 187143 - DNA, 16 bp, P. troglodytes
aaatggcaatgcagat

SEQ ID NO: 187144 - DNA, 16 bp, P. troglodytes
aaatggcacagctgct

SEQ ID NO: 187145 - DNA, 16 bp, P. troglodytes
aaatggcagagctggg

SEQ ID NO: 187146 - DNA, 16 bp, P. troglodytes
aaatggcagctccatc

SEQ ID NO: 187147 - DNA, 16 bp, P. troglodytes
aaatggcaggatttct

SEQ ID NO: 187148 - DNA, 16 bp, P. troglodytes
aaatggcatgatcttg

SEQ ID NO: 187149 - DNA, 16 bp, P. troglodytes
aaatggccaaaaagca

SEQ ID NO: 187150 - DNA, 16 bp, P. troglodytes
aaatggccaagaagca

SEQ ID NO: 187151 - DNA, 16 bp, P. troglodytes
aaatggccacactgct

SEQ ID NO: 187152 - DNA, 16 bp, P. troglodytes
aaatggcctaaatgcc

SEQ ID NO: 187153 - DNA, 16 bp, P. troglodytes
aaatggctaacaggta

SEQ ID NO: 187154 - DNA, 16 bp, P. troglodytes
aaatggctcatgcctg

SEQ ID NO: 187155 - DNA, 16 bp, P. troglodytes
aaatggctgattccag

SEQ ID NO: 187156 - DNA, 16 bp, P. troglodytes
aaatggcttttatcca

SEQ ID NO: 187157 - DNA, 16 bp, P. troglodytes
aaatgggaaaaagatt

SEQ ID NO: 187158 - DNA, 16 bp, P. troglodytes
aaatgggaaaatgtta

SEQ ID NO: 187159 - DNA, 16 bp, P. troglodytes
aaatgggaaaatgttt

SEQ ID NO: 187160 - DNA, 16 bp, P. troglodytes
aaatgggaacaacaga

SEQ ID NO: 187161 - DNA, 16 bp, P. troglodytes
aaatgggaacactttt

SEQ ID NO: 187162 - DNA, 16 bp, P. troglodytes
aaatgggaataatatc

SEQ ID NO: 187163 - DNA, 16 bp, P. troglodytes
aaatgggagaatattt

SEQ ID NO: 187164 - DNA, 16 bp, P. troglodytes
aaatgggagctgaaca

SEQ ID NO: 187165 - DNA, 16 bp, P. troglodytes
aaatgggataaaatat

SEQ ID NO: 187166 - DNA, 16 bp, P. troglodytes
aaatgggattagtgcc

SEQ ID NO: 187167 - DNA, 16 bp, P. troglodytes
aaatgggatttcatca

SEQ ID NO: 187168 - DNA, 16 bp, P. troglodytes
aaatgggcaaaaaaca

SEQ ID NO: 187169 - DNA, 16 bp, P. troglodytes
aaatgggcaaagaacc

SEQ ID NO: 187170 - DNA, 16 bp, P. troglodytes
aaatggggataatagt

SEQ ID NO: 187171 - DNA, 16 bp, P. troglodytes
aaatggggatgacaat

SEQ ID NO: 187172 - DNA, 16 bp, P. troglodytes
aaatggggtatccacc

SEQ ID NO: 187173 - DNA, 16 bp, P. troglodytes
aaatgggtaaaggaca

SEQ ID NO: 187174 - DNA, 16 bp, P. troglodytes
aaatgggtgtaataat

SEQ ID NO: 187175 - DNA, 16 bp, P. troglodytes
aaatgggtttttcttt

SEQ ID NO: 187176 - DNA, 16 bp, P. troglodytes
aaatggtaaattgtat

SEQ ID NO: 187177 - DNA, 16 bp, P. troglodytes
aaatggtacagccact

SEQ ID NO: 187178 - DNA, 16 bp, P. troglodytes
aaatggtactggaaca

SEQ ID NO: 187179 - DNA, 16 bp, P. troglodytes
aaatggtatttctatt

SEQ ID NO: 187180 - DNA, 16 bp, P. troglodytes
aaatggtctaaataca

SEQ ID NO: 187181 - DNA, 16 bp, P. troglodytes
aaatggtgaaacccca

SEQ ID NO: 187182 - DNA, 16 bp, P. troglodytes
aaatggtgagattaca

SEQ ID NO: 187183 - DNA, 16 bp, P. troglodytes
aaatggtgatttaaaa

SEQ ID NO: 187184 - DNA, 16 bp, P. troglodytes
aaatggtgattttttt

SEQ ID NO: 187185 - DNA, 16 bp, P. troglodytes
aaatggtgcagccact

SEQ ID NO: 187186 - DNA, 16 bp, P. troglodytes
aaatggtgctaagaaa

SEQ ID NO: 187187 - DNA, 17 bp, P. troglodytes
aaatggtgctggcaaaa

SEQ ID NO: 187188 - DNA, 18 bp, P. troglodytes
aaatggtgtgaacccagg

SEQ ID NO: 187189 - DNA, 16 bp, P. troglodytes
aaatggtgttggaaaa

SEQ ID NO: 187190 - DNA, 16 bp, P. troglodytes
aaatggtgtttggctt

SEQ ID NO: 187191 - DNA, 16 bp, P. troglodytes
aaatggttaaacatag

SEQ ID NO: 187192 - DNA, 16 bp, P. troglodytes
aaatggttctgaatca

SEQ ID NO: 187193 - DNA, 16 bp, P. troglodytes
aaatggttctggaaaa

SEQ ID NO: 187194 - DNA, 16 bp, P. troglodytes
aaatggttgaaatggt

SEQ ID NO: 187195 - DNA, 16 bp, P. troglodytes
aaatggttgcattctt

SEQ ID NO: 187196 - DNA, 16 bp, P. troglodytes
aaatggttgcattttt

SEQ ID NO: 187197 - DNA, 16 bp, P. troglodytes
aaatggtttggctgtg

SEQ ID NO: 187198 - DNA, 16 bp, P. troglodytes
aaatggtttttaaaaa

SEQ ID NO: 187199 - DNA, 16 bp, P. troglodytes
aaatggtttttaaaat

SEQ ID NO: 187200 - DNA, 16 bp, P. troglodytes
aaatggtttttaaatt

SEQ ID NO: 187201 - DNA, 16 bp, P. troglodytes
aaatgtaaaaactgtt

SEQ ID NO: 187202 - DNA, 16 bp, P. troglodytes
aaatgtaaaaataact

SEQ ID NO: 187203 - DNA, 16 bp, P. troglodytes
aaatgtaaaaatattc

SEQ ID NO: 187204 - DNA, 16 bp, P. troglodytes
aaatgtaaaacaatgt

SEQ ID NO: 187205 - DNA, 16 bp, P. troglodytes
aaatgtaaaactctaa

SEQ ID NO: 187206 - DNA, 16 bp, P. troglodytes
aaatgtaaaatctgaa

SEQ ID NO: 187207 - DNA, 16 bp, P. troglodytes
aaatgtaaaatgtgaa

SEQ ID NO: 187208 - DNA, 16 bp, P. troglodytes
aaatgtaaaattcagt

SEQ ID NO: 187209 - DNA, 16 bp, P. troglodytes
aaatgtaaacaaacat

SEQ ID NO: 187210 - DNA, 16 bp, P. troglodytes
aaatgtaaatatgtat

SEQ ID NO: 187211 - DNA, 16 bp, P. troglodytes
aaatgtaaatattcct

SEQ ID NO: 187212 - DNA, 16 bp, P. troglodytes
aaatgtaaatatttgt

SEQ ID NO: 187213 - DNA, 16 bp, P. troglodytes
aaatgtaaatgaaaac

SEQ ID NO: 187214 - DNA, 16 bp, P. troglodytes
aaatgtaaatgcatat

SEQ ID NO: 187215 - DNA, 16 bp, P. troglodytes
aaatgtaaatgttttt

SEQ ID NO: 187216 - DNA, 16 bp, P. troglodytes
aaatgtaaatttcaaa

SEQ ID NO: 187217 - DNA, 16 bp, P. troglodytes
aaatgtaacattttaa

SEQ ID NO: 187218 - DNA, 16 bp, P. troglodytes
aaatgtaactaaaaat

SEQ ID NO: 187219 - DNA, 16 bp, P. troglodytes
aaatgtaacttttaaa

SEQ ID NO: 187220 - DNA, 16 bp, P. troglodytes
aaatgtaactttttaa

SEQ ID NO: 187221 - DNA, 16 bp, P. troglodytes
aaatgtaagacttaaa

SEQ ID NO: 187222 - DNA, 16 bp, P. troglodytes
aaatgtaaggtattat

SEQ ID NO: 187223 - DNA, 16 bp, P. troglodytes
aaatgtaataaataca

SEQ ID NO: 187224 - DNA, 16 bp, P. troglodytes
aaatgtaatattcttt

SEQ ID NO: 187225 - DNA, 16 bp, P. troglodytes
aaatgtaatgttttta

SEQ ID NO: 187226 - DNA, 16 bp, P. troglodytes
aaatgtaattgccatt

SEQ ID NO: 187227 - DNA, 16 bp, P. troglodytes
aaatgtaattttcaaa

SEQ ID NO: 187228 - DNA, 16 bp, P. troglodytes
aaatgtaattttgaat

SEQ ID NO: 187229 - DNA, 16 bp, P. troglodytes
aaatgtacaaaaatgt

SEQ ID NO: 187230 - DNA, 16 bp, P. troglodytes
aaatgtacaattaaat

SEQ ID NO: 187231 - DNA, 16 bp, P. troglodytes
aaatgtacaattcagt

SEQ ID NO: 187232 - DNA, 16 bp, P. troglodytes
aaatgtacacaataaa

SEQ ID NO: 187233 - DNA, 16 bp, P. troglodytes
aaatgtacacattaaa

SEQ ID NO: 187234 - DNA, 16 bp, P. troglodytes
aaatgtacatatgtat

SEQ ID NO: 187235 - DNA, 16 bp, P. troglodytes
aaatgtacatcaaaac

SEQ ID NO: 187236 - DNA, 16 bp, P. troglodytes
aaatgtacattttctt

SEQ ID NO: 187237 - DNA, 16 bp, P. troglodytes
aaatgtactattttta

SEQ ID NO: 187238 - DNA, 16 bp, P. troglodytes
aaatgtacttatttat

SEQ ID NO: 187239 - DNA, 16 bp, P. troglodytes
aaatgtactttttaaa

SEQ ID NO: 187240 - DNA, 16 bp, P. troglodytes
aaatgtagaaaaagca

SEQ ID NO: 187241 - DNA, 16 bp, P. troglodytes
aaatgtagagttttta

SEQ ID NO: 187242 - DNA, 16 bp, P. troglodytes
aaatgtagattcactg

SEQ ID NO: 187243 - DNA, 16 bp, P. troglodytes
aaatgtataattacat

SEQ ID NO: 187244 - DNA, 16 bp, P. troglodytes
aaatgtatatgctttt

SEQ ID NO: 187245 - DNA, 16 bp, P. troglodytes
aaatgtatattactaa

SEQ ID NO: 187246 - DNA, 16 bp, P. troglodytes
aaatgtatattgtaaa

SEQ ID NO: 187247 - DNA, 16 bp, P. troglodytes
aaatgtatatttgtat

SEQ ID NO: 187248 - DNA, 16 bp, P. troglodytes
aaatgtatccatttta

SEQ ID NO: 187249 - DNA, 16 bp, P. troglodytes
aaatgtatcttttaaa

SEQ ID NO: 187250 - DNA, 16 bp, P. troglodytes
aaatgtatgcaaattt

SEQ ID NO: 187251 - DNA, 16 bp, P. troglodytes
aaatgtatgcatttat

SEQ ID NO: 187252 - DNA, 16 bp, P. troglodytes
aaatgtatgtgtgcat

SEQ ID NO: 187253 - DNA, 16 bp, P. troglodytes
aaatgtattctttttt

SEQ ID NO: 187254 - DNA, 16 bp, P. troglodytes
aaatgtattgagattt

SEQ ID NO: 187255 - DNA, 16 bp, P. troglodytes
aaatgtatttattttc

SEQ ID NO: 187256 - DNA, 16 bp, P. troglodytes
aaatgtatttcatatt

SEQ ID NO: 187257 - DNA, 16 bp, P. troglodytes
aaatgtatttctaata

SEQ ID NO: 187258 - DNA, 16 bp, P. troglodytes
aaatgtatttctataa

SEQ ID NO: 187259 - DNA, 16 bp, P. troglodytes
aaatgtatttctttct

SEQ ID NO: 187260 - DNA, 16 bp, P. troglodytes
aaatgtatttgcaaat

SEQ ID NO: 187261 - DNA, 16 bp, P. troglodytes
aaatgtattttaaaag

SEQ ID NO: 187262 - DNA, 16 bp, P. troglodytes
aaatgtattttccttt

SEQ ID NO: 187263 - DNA, 16 bp, P. troglodytes
aaatgtattttctcat

SEQ ID NO: 187264 - DNA, 16 bp, P. troglodytes
aaatgtattttgaaaa

SEQ ID NO: 187265 - DNA, 16 bp, P. troglodytes
aaatgtattttgcaaa

SEQ ID NO: 187266 - DNA, 16 bp, P. troglodytes
aaatgtatttttcaaa

SEQ ID NO: 187267 - DNA, 16 bp, P. troglodytes
aaatgtatttttcatt

SEQ ID NO: 187268 - DNA, 16 bp, P. troglodytes
aaatgtattttttctt

SEQ ID NO: 187269 - DNA, 16 bp, P. troglodytes
aaatgtcaaaaatata

SEQ ID NO: 187270 - DNA, 16 bp, P. troglodytes
aaatgtcaaattattt

SEQ ID NO: 187271 - DNA, 16 bp, P. troglodytes
aaatgtcaacatttta

SEQ ID NO: 187272 - DNA, 16 bp, P. troglodytes
aaatgtcacttcctca

SEQ ID NO: 187273 - DNA, 16 bp, P. troglodytes
aaatgtcactttttct

SEQ ID NO: 187274 - DNA, 16 bp, P. troglodytes
aaatgtcagaagaaaa

SEQ ID NO: 187275 - DNA, 16 bp, P. troglodytes
aaatgtcagcagtgcc

SEQ ID NO: 187276 - DNA, 16 bp, P. troglodytes
aaatgtcagttaggtc

SEQ ID NO: 187277 - DNA, 16 bp, P. troglodytes
aaatgtcataaaatat

SEQ ID NO: 187278 - DNA, 16 bp, P. troglodytes
aaatgtcatccaagag

SEQ ID NO: 187279 - DNA, 16 bp, P. troglodytes
aaatgtcattatgtag

SEQ ID NO: 187280 - DNA, 16 bp, P. troglodytes
aaatgtcatttaaaaa

SEQ ID NO: 187281 - DNA, 16 bp, P. troglodytes
aaatgtcattttaatt

SEQ ID NO: 187282 - DNA, 16 bp, P. troglodytes
aaatgtcatttttttc

SEQ ID NO: 187283 - DNA, 16 bp, P. troglodytes
aaatgtccaataagca

SEQ ID NO: 187284 - DNA, 16 bp, P. troglodytes
aaatgtccattaatga

SEQ ID NO: 187285 - DNA, 16 bp, P. troglodytes
aaatgtctacattttt

SEQ ID NO: 187286 - DNA, 16 bp, P. troglodytes
aaatgtctatttaagt

SEQ ID NO: 187287 - DNA, 16 bp, P. troglodytes
aaatgtctattttaat

SEQ ID NO: 187288 - DNA, 16 bp, P. troglodytes
aaatgtctccagaaat

SEQ ID NO: 187289 - DNA, 19 bp, P. troglodytes
aaatgtctccagggcatgt

SEQ ID NO: 187290 - DNA, 16 bp, P. troglodytes
aaatgtctctgcatca

SEQ ID NO: 187291 - DNA, 16 bp, P. troglodytes
aaatgtctgtttatat

SEQ ID NO: 187292 - DNA, 16 bp, P. troglodytes
aaatgtctgtttttat

SEQ ID NO: 187293 - DNA, 16 bp, P. troglodytes
aaatgtctgtttttct

SEQ ID NO: 187294 - DNA, 16 bp, P. troglodytes
aaatgtcttaaaatat

SEQ ID NO: 187295 - DNA, 16 bp, P. troglodytes
aaatgtcttcttaaaa

SEQ ID NO: 187296 - DNA, 16 bp, P. troglodytes
aaatgtctttatttta

SEQ ID NO: 187297 - DNA, 16 bp, P. troglodytes
aaatgtctttggaatt

SEQ ID NO: 187298 - DNA, 16 bp, P. troglodytes
aaatgtcttttcattt

SEQ ID NO: 187299 - DNA, 16 bp, P. troglodytes
aaatgtcttttgaaaa

SEQ ID NO: 187300 - DNA, 16 bp, P. troglodytes
aaatgtctttttctat

SEQ ID NO: 187301 - DNA, 16 bp, P. troglodytes
aaatgtcttttttctt

SEQ ID NO: 187302 - DNA, 16 bp, P. troglodytes
aaatgtgaaaaatgtg

SEQ ID NO: 187303 - DNA, 16 bp, P. troglodytes
aaatgtgaaaactgaa

SEQ ID NO: 187304 - DNA, 16 bp, P. troglodytes
aaatgtgaaaatattt

SEQ ID NO: 187305 - DNA, 16 bp, P. troglodytes
aaatgtgaaacatttt

SEQ ID NO: 187306 - DNA, 16 bp, P. troglodytes
aaatgtgaacatttta

SEQ ID NO: 187307 - DNA, 16 bp, P. troglodytes
aaatgtgaagaatgtg

SEQ ID NO: 187308 - DNA, 16 bp, P. troglodytes
aaatgtgaatatttaa

SEQ ID NO: 187309 - DNA, 16 bp, P. troglodytes
aaatgtgaatttcaga

SEQ ID NO: 187310 - DNA, 16 bp, P. troglodytes
aaatgtgacccccagt

SEQ ID NO: 187311 - DNA, 16 bp, P. troglodytes
aaatgtgagaaaaaca

SEQ ID NO: 187312 - DNA, 16 bp, P. troglodytes
aaatgtgaggtcagag

SEQ ID NO: 187313 - DNA, 16 bp, P. troglodytes
aaatgtgataatatat

SEQ ID NO: 187314 - DNA, 16 bp, P. troglodytes
aaatgtgatatatgca

SEQ ID NO: 187315 - DNA, 16 bp, P. troglodytes
aaatgtgattatatat

SEQ ID NO: 187316 - DNA, 16 bp, P. troglodytes
aaatgtgattgtattt

SEQ ID NO: 187317 - DNA, 16 bp, P. troglodytes
aaatgtgatttaaaat

SEQ ID NO: 187318 - DNA, 16 bp, P. troglodytes
aaatgtgatttttctt

SEQ ID NO: 187319 - DNA, 16 bp, P. troglodytes
aaatgtgcaaaataaa

SEQ ID NO: 187320 - DNA, 16 bp, P. troglodytes
aaatgtgctatataca

SEQ ID NO: 187321 - DNA, 16 bp, P. troglodytes
aaatgtggaaatgaaa

SEQ ID NO: 187322 - DNA, 16 bp, P. troglodytes
aaatgtggaattgact

SEQ ID NO: 187323 - DNA, 16 bp, P. troglodytes
aaatgtggagttggag

SEQ ID NO: 187324 - DNA, 16 bp, P. troglodytes
aaatgtggataataac

SEQ ID NO: 187325 - DNA, 16 bp, P. troglodytes
aaatgtggcatacaca

SEQ ID NO: 187326 - DNA, 16 bp, P. troglodytes
aaatgtggccaggtgc

SEQ ID NO: 187327 - DNA, 16 bp, P. troglodytes
aaatgtggctggtgca

SEQ ID NO: 187328 - DNA, 16 bp, P. troglodytes
aaatgtggcttttaaa

SEQ ID NO: 187329 - DNA, 16 bp, P. troglodytes
aaatgtgggaaagttt

SEQ ID NO: 187330 - DNA, 16 bp, P. troglodytes
aaatgtgggaaatttt

SEQ ID NO: 187331 - DNA, 16 bp, P. troglodytes
aaatgtggtctatcca

SEQ ID NO: 187332 - DNA, 16 bp, P. troglodytes
aaatgtggttttattt

SEQ ID NO: 187333 - DNA, 16 bp, P. troglodytes
aaatgtgtaaatgttt

SEQ ID NO: 187334 - DNA, 16 bp, P. troglodytes
aaatgtgtagatttat

SEQ ID NO: 187335 - DNA, 16 bp, P. troglodytes
aaatgtgtattttaaa

SEQ ID NO: 187336 - DNA, 16 bp, P. troglodytes
aaatgtgtattttata

SEQ ID NO: 187337 - DNA, 17 bp, P. troglodytes
aaatgtgtcattaggca

SEQ ID NO: 187338 - DNA, 16 bp, P. troglodytes
aaatgtgtctggaatt

SEQ ID NO: 187339 - DNA, 16 bp, P. troglodytes
aaatgtgtgaatttat

SEQ ID NO: 187340 - DNA, 16 bp, P. troglodytes
aaatgtgtgtatttta

SEQ ID NO: 187341 - DNA, 16 bp, P. troglodytes
aaatgtgtgtgttttt

SEQ ID NO: 187342 - DNA, 16 bp, P. troglodytes
aaatgtgtgttgaatt

SEQ ID NO: 187343 - DNA, 16 bp, P. troglodytes
aaatgtgtttctttat

SEQ ID NO: 187344 - DNA, 16 bp, P. troglodytes
aaatgtgtttctttct

SEQ ID NO: 187345 - DNA, 16 bp, P. troglodytes
aaatgtgtttgagttc

SEQ ID NO: 187346 - DNA, 16 bp, P. troglodytes
aaatgtgttttatgaa

SEQ ID NO: 187347 - DNA, 16 bp, P. troglodytes
aaatgtgttttcttta

SEQ ID NO: 187348 - DNA, 16 bp, P. troglodytes
aaatgtgttttttaaa

SEQ ID NO: 187349 - DNA, 16 bp, P. troglodytes
aaatgttaaaagtttt

SEQ ID NO: 187350 - DNA, 16 bp, P. troglodytes
aaatgttaaaatacaa

SEQ ID NO: 187351 - DNA, 16 bp, P. troglodytes
aaatgttaaaatattg

SEQ ID NO: 187352 - DNA, 16 bp, P. troglodytes
aaatgttaaaatgtga

SEQ ID NO: 187353 - DNA, 16 bp, P. troglodytes
aaatgttaaacataaa

SEQ ID NO: 187354 - DNA, 16 bp, P. troglodytes
aaatgttaaacatttt

SEQ ID NO: 187355 - DNA, 16 bp, P. troglodytes
aaatgttaacatttta

SEQ ID NO: 187356 - DNA, 16 bp, P. troglodytes
aaatgttaactattgt

SEQ ID NO: 187357 - DNA, 16 bp, P. troglodytes
aaatgttaagtaattt

SEQ ID NO: 187358 - DNA, 16 bp, P. troglodytes
aaatgttaatacattt

SEQ ID NO: 187359 - DNA, 16 bp, P. troglodytes
aaatgttactttaaaa

SEQ ID NO: 187360 - DNA, 16 bp, P. troglodytes
aaatgttactttcttt

SEQ ID NO: 187361 - DNA, 16 bp, P. troglodytes
aaatgttagccaggca

SEQ ID NO: 187362 - DNA, 16 bp, P. troglodytes
aaatgttagttattat

SEQ ID NO: 187363 - DNA, 16 bp, P. troglodytes
aaatgttataaaacaa

SEQ ID NO: 187364 - DNA, 16 bp, P. troglodytes
aaatgttatctattat

SEQ ID NO: 187365 - DNA, 16 bp, P. troglodytes
aaatgttattttctaa

SEQ ID NO: 187366 - DNA, 16 bp, P. troglodytes
aaatgttattttctga

SEQ ID NO: 187367 - DNA, 16 bp, P. troglodytes
aaatgttcaaataatt

SEQ ID NO: 187368 - DNA, 16 bp, P. troglodytes
aaatgttcaaatattt

SEQ ID NO: 187369 - DNA, 16 bp, P. troglodytes
aaatgttcaactctgt

SEQ ID NO: 187370 - DNA, 16 bp, P. troglodytes
aaatgttcacagcagc

SEQ ID NO: 187371 - DNA, 16 bp, P. troglodytes
aaatgttcacatttta

SEQ ID NO: 187372 - DNA, 16 bp, P. troglodytes
aaatgttcactttaaa

SEQ ID NO: 187373 - DNA, 16 bp, P. troglodytes
aaatgttcagttttaa

SEQ ID NO: 187374 - DNA, 16 bp, P. troglodytes
aaatgttcatattatt

SEQ ID NO: 187375 - DNA, 16 bp, P. troglodytes
aaatgttcattattat

SEQ ID NO: 187376 - DNA, 16 bp, P. troglodytes
aaatgttcattcattc

SEQ ID NO: 187377 - DNA, 16 bp, P. troglodytes
aaatgttcattttttt

SEQ ID NO: 187378 - DNA, 16 bp, P. troglodytes
aaatgttccatgtgca

SEQ ID NO: 187379 - DNA, 16 bp, P. troglodytes
aaatgttccctggggg

SEQ ID NO: 187380 - DNA, 16 bp, P. troglodytes
aaatgttctaaaaatg

SEQ ID NO: 187381 - DNA, 16 bp, P. troglodytes
aaatgttctgaaattt

SEQ ID NO: 187382 - DNA, 16 bp, P. troglodytes
aaatgttctgtgtctg

SEQ ID NO: 187383 - DNA, 16 bp, P. troglodytes
aaatgttctttccttt

SEQ ID NO: 187384 - DNA, 16 bp, P. troglodytes
aaatgttcttttaaaa

SEQ ID NO: 187385 - DNA, 16 bp, P. troglodytes
aaatgttctttttaaa

SEQ ID NO: 187386 - DNA, 16 bp, P. troglodytes
aaatgttgaaaatttt

SEQ ID NO: 187387 - DNA, 16 bp, P. troglodytes
aaatgttgaaagcttt

SEQ ID NO: 187388 - DNA, 16 bp, P. troglodytes
aaatgttgacttttta

SEQ ID NO: 187389 - DNA, 16 bp, P. troglodytes
aaatgttgatacattt

SEQ ID NO: 187390 - DNA, 16 bp, P. troglodytes
aaatgttgatattttg

SEQ ID NO: 187391 - DNA, 16 bp, P. troglodytes
aaatgttggctgggca

SEQ ID NO: 187392 - DNA, 16 bp, P. troglodytes
aaatgttggggaaaat

SEQ ID NO: 187393 - DNA, 16 bp, P. troglodytes
aaatgttgtataattt

SEQ ID NO: 187394 - DNA, 16 bp, P. troglodytes
aaatgttgttatgtgg

SEQ ID NO: 187395 - DNA, 16 bp, P. troglodytes
aaatgtttaaaaacat

SEQ ID NO: 187396 - DNA, 16 bp, P. troglodytes
aaatgtttaaaaatac

SEQ ID NO: 187397 - DNA, 16 bp, P. troglodytes
aaatgtttaaaaatgt

SEQ ID NO: 187398 - DNA, 16 bp, P. troglodytes
aaatgtttaaaaattc

SEQ ID NO: 187399 - DNA, 16 bp, P. troglodytes
aaatgtttaaaacaat

SEQ ID NO: 187400 - DNA, 16 bp, P. troglodytes
aaatgtttaaaacatt

SEQ ID NO: 187401 - DNA, 16 bp, P. troglodytes
aaatgtttaaaatatg

SEQ ID NO: 187402 - DNA, 16 bp, P. troglodytes
aaatgtttaaaattgt

SEQ ID NO: 187403 - DNA, 16 bp, P. troglodytes
aaatgtttaaacattt

SEQ ID NO: 187404 - DNA, 16 bp, P. troglodytes
aaatgtttaaatatct

SEQ ID NO: 187405 - DNA, 16 bp, P. troglodytes
aaatgtttaaatatgt

SEQ ID NO: 187406 - DNA, 16 bp, P. troglodytes
aaatgtttaattcatt

SEQ ID NO: 187407 - DNA, 16 bp, P. troglodytes
aaatgtttaattttga

SEQ ID NO: 187408 - DNA, 16 bp, P. troglodytes
aaatgtttacatattt

SEQ ID NO: 187409 - DNA, 16 bp, P. troglodytes
aaatgtttacattttt

SEQ ID NO: 187410 - DNA, 16 bp, P. troglodytes
aaatgtttactgaatt

SEQ ID NO: 187411 - DNA, 16 bp, P. troglodytes
aaatgtttactgtttt

SEQ ID NO: 187412 - DNA, 16 bp, P. troglodytes
aaatgtttacttttat

SEQ ID NO: 187413 - DNA, 16 bp, P. troglodytes
aaatgtttagaaaaca

SEQ ID NO: 187414 - DNA, 16 bp, P. troglodytes
aaatgtttagaagaat

SEQ ID NO: 187415 - DNA, 16 bp, P. troglodytes
aaatgtttatatacat

SEQ ID NO: 187416 - DNA, 16 bp, P. troglodytes
aaatgtttatcatttt

SEQ ID NO: 187417 - DNA, 16 bp, P. troglodytes
aaatgtttattcatat

SEQ ID NO: 187418 - DNA, 16 bp, P. troglodytes
aaatgtttattgttgt

SEQ ID NO: 187419 - DNA, 16 bp, P. troglodytes
aaatgtttatttcttt

SEQ ID NO: 187420 - DNA, 16 bp, P. troglodytes
aaatgtttcaaataat

SEQ ID NO: 187421 - DNA, 16 bp, P. troglodytes
aaatgtttcaaattaa

SEQ ID NO: 187422 - DNA, 16 bp, P. troglodytes
aaatgtttcagatttt

SEQ ID NO: 187423 - DNA, 16 bp, P. troglodytes
aaatgtttccattttt

SEQ ID NO: 187424 - DNA, 16 bp, P. troglodytes
aaatgtttctaagaaa

SEQ ID NO: 187425 - DNA, 16 bp, P. troglodytes
aaatgtttctgaaaat

SEQ ID NO: 187426 - DNA, 16 bp, P. troglodytes
aaatgtttctgcacag

SEQ ID NO: 187427 - DNA, 16 bp, P. troglodytes
aaatgtttctttcaga

SEQ ID NO: 187428 - DNA, 16 bp, P. troglodytes
aaatgtttgaaaatga

SEQ ID NO: 187429 - DNA, 16 bp, P. troglodytes
aaatgtttgaaatgtt

SEQ ID NO: 187430 - DNA, 16 bp, P. troglodytes
aaatgtttgataaaat

SEQ ID NO: 187431 - DNA, 16 bp, P. troglodytes
aaatgtttgctgaaca

SEQ ID NO: 187432 - DNA, 16 bp, P. troglodytes
aaatgtttgctgaact

SEQ ID NO: 187433 - DNA, 16 bp, P. troglodytes
aaatgtttgctgaatg

SEQ ID NO: 187434 - DNA, 16 bp, P. troglodytes
aaatgtttgctgagtg

SEQ ID NO: 187435 - DNA, 16 bp, P. troglodytes
aaatgtttgctttata

SEQ ID NO: 187436 - DNA, 16 bp, P. troglodytes
aaatgtttggaaaatt

SEQ ID NO: 187437 - DNA, 16 bp, P. troglodytes
aaatgtttgtaaatca

SEQ ID NO: 187438 - DNA, 16 bp, P. troglodytes
aaatgtttgtgaaatt

SEQ ID NO: 187439 - DNA, 16 bp, P. troglodytes
aaatgtttgttgaatt

SEQ ID NO: 187440 - DNA, 16 bp, P. troglodytes
aaatgtttgtttataa

SEQ ID NO: 187441 - DNA, 16 bp, P. troglodytes
aaatgtttgttttcta

SEQ ID NO: 187442 - DNA, 16 bp, P. troglodytes
aaatgttttaaaactg

SEQ ID NO: 187443 - DNA, 16 bp, P. troglodytes
aaatgttttaaaattg

SEQ ID NO: 187444 - DNA, 16 bp, P. troglodytes
aaatgttttaaagttt

SEQ ID NO: 187445 - DNA, 16 bp, P. troglodytes
aaatgttttaccagct

SEQ ID NO: 187446 - DNA, 16 bp, P. troglodytes
aaatgttttatatcat

SEQ ID NO: 187447 - DNA, 16 bp, P. troglodytes
aaatgttttatttcta

SEQ ID NO: 187448 - DNA, 16 bp, P. troglodytes
aaatgttttattttct

SEQ ID NO: 187449 - DNA, 16 bp, P. troglodytes
aaatgttttcaaaatt

SEQ ID NO: 187450 - DNA, 16 bp, P. troglodytes
aaatgttttcactttt

SEQ ID NO: 187451 - DNA, 16 bp, P. troglodytes
aaatgttttcaggaaa

SEQ ID NO: 187452 - DNA, 16 bp, P. troglodytes
aaatgttttcataaaa

SEQ ID NO: 187453 - DNA, 16 bp, P. troglodytes
aaatgttttccagagt

SEQ ID NO: 187454 - DNA, 16 bp, P. troglodytes
aaatgttttccataat

SEQ ID NO: 187455 - DNA, 16 bp, P. troglodytes
aaatgttttctacttt

SEQ ID NO: 187456 - DNA, 16 bp, P. troglodytes
aaatgttttctctctt

SEQ ID NO: 187457 - DNA, 16 bp, P. troglodytes
aaatgttttctctgca

SEQ ID NO: 187458 - DNA, 16 bp, P. troglodytes
aaatgttttcttctat

SEQ ID NO: 187459 - DNA, 16 bp, P. troglodytes
aaatgttttgaaaatg

SEQ ID NO: 187460 - DNA, 16 bp, P. troglodytes
aaatgttttgaaatat

SEQ ID NO: 187461 - DNA, 16 bp, P. troglodytes
aaatgttttgaaatga

SEQ ID NO: 187462 - DNA, 16 bp, P. troglodytes
aaatgttttgagaaaa

SEQ ID NO: 187463 - DNA, 16 bp, P. troglodytes
aaatgttttgatacag

SEQ ID NO: 187464 - DNA, 16 bp, P. troglodytes
aaatgttttggaatta

SEQ ID NO: 187465 - DNA, 16 bp, P. troglodytes
aaatgttttggtttcc

SEQ ID NO: 187466 - DNA, 16 bp, P. troglodytes
aaatgttttgtaaaat

SEQ ID NO: 187467 - DNA, 16 bp, P. troglodytes
aaatgttttgtctttt

SEQ ID NO: 187468 - DNA, 16 bp, P. troglodytes
aaatgtttttaaaaag

SEQ ID NO: 187469 - DNA, 16 bp, P. troglodytes
aaatgtttttaaaatg

SEQ ID NO: 187470 - DNA, 16 bp, P. troglodytes
aaatgtttttcaaagt

SEQ ID NO: 187471 - DNA, 16 bp, P. troglodytes
aaatgtttttcatttc

SEQ ID NO: 187472 - DNA, 16 bp, P. troglodytes
aaatgtttttctaaaa

SEQ ID NO: 187473 - DNA, 16 bp, P. troglodytes
aaatgtttttctcttt

SEQ ID NO: 187474 - DNA, 16 bp, P. troglodytes
aaatgtttttcttcca

SEQ ID NO: 187475 - DNA, 16 bp, P. troglodytes
aaatgtttttgaagaa

SEQ ID NO: 187476 - DNA, 16 bp, P. troglodytes
aaatgtttttgaagtt

SEQ ID NO: 187477 - DNA, 16 bp, P. troglodytes
aaatgttttttaaagt

SEQ ID NO: 187478 - DNA, 16 bp, P. troglodytes
aaatgttttttatctt

SEQ ID NO: 187479 - DNA, 16 bp, P. troglodytes
aaatgttttttctaat

SEQ ID NO: 187480 - DNA, 16 bp, P. troglodytes
aaatgttttttgagca

SEQ ID NO: 187481 - DNA, 16 bp, P. troglodytes
aaatgtttttttaaag

SEQ ID NO: 187482 - DNA, 16 bp, P. troglodytes
aaattaaaaaattgca

SEQ ID NO: 187483 - DNA, 16 bp, P. troglodytes
aaattaaaaagtctga

SEQ ID NO: 187484 - DNA, 16 bp, P. troglodytes
aaattaaaaatagcca

SEQ ID NO: 187485 - DNA, 16 bp, P. troglodytes
aaattaaaaatggaca

SEQ ID NO: 187486 - DNA, 16 bp, P. troglodytes
aaattaaaaatgggca

SEQ ID NO: 187487 - DNA, 16 bp, P. troglodytes
aaattaaaacaacagt

SEQ ID NO: 187488 - DNA, 16 bp, P. troglodytes
aaattaaaacaattga

SEQ ID NO: 187489 - DNA, 16 bp, P. troglodytes
aaattaaaacattttc

SEQ ID NO: 187490 - DNA, 16 bp, P. troglodytes
aaattaaaacattttg

SEQ ID NO: 187491 - DNA, 16 bp, P. troglodytes
aaattaaaactagaac

SEQ ID NO: 187492 - DNA, 16 bp, P. troglodytes
aaattaaaactgcttt

SEQ ID NO: 187493 - DNA, 16 bp, P. troglodytes
aaattaaaagcaaagt

SEQ ID NO: 187494 - DNA, 16 bp, P. troglodytes
aaattaaaaggcaaat

SEQ ID NO: 187495 - DNA, 16 bp, P. troglodytes
aaattaaaagtgattt

SEQ ID NO: 187496 - DNA, 16 bp, P. troglodytes
aaattaaaagttgttt

SEQ ID NO: 187497 - DNA, 16 bp, P. troglodytes
aaattaaaatcagaat

SEQ ID NO: 187498 - DNA, 16 bp, P. troglodytes
aaattaaaatcttttg

SEQ ID NO: 187499 - DNA, 16 bp, P. troglodytes
aaattaaaatgttaca

SEQ ID NO: 187500 - DNA, 16 bp, P. troglodytes
aaattaaagcaattaa

SEQ ID NO: 187501 - DNA, 16 bp, P. troglodytes
aaattaaagcagaaat

SEQ ID NO: 187502 - DNA, 16 bp, P. troglodytes
aaattaaagccataat

SEQ ID NO: 187503 - DNA, 16 bp, P. troglodytes
aaattaaatgtgtttt

SEQ ID NO: 187504 - DNA, 16 bp, P. troglodytes
aaattaaatttggcct

SEQ ID NO: 187505 - DNA, 16 bp, P. troglodytes
aaattaacaaatgttt

SEQ ID NO: 187506 - DNA, 17 bp, P. troglodytes
aaattaacacatctcct

SEQ ID NO: 187507 - DNA, 16 bp, P. troglodytes
aaattaacataaaatg

SEQ ID NO: 187508 - DNA, 16 bp, P. troglodytes
aaattaaccaaaggct

SEQ ID NO: 187509 - DNA, 16 bp, P. troglodytes
aaattaaccgggcatg

SEQ ID NO: 187510 - DNA, 16 bp, P. troglodytes
aaattaacttgtaaat

SEQ ID NO: 187511 - DNA, 16 bp, P. troglodytes
aaattaagcaaaatat

SEQ ID NO: 187512 - DNA, 16 bp, P. troglodytes
aaattaaggcaaaata

SEQ ID NO: 187513 - DNA, 16 bp, P. troglodytes
aaattaagtgacttgc

SEQ ID NO: 187514 - DNA, 16 bp, P. troglodytes
aaattaagttttaaag

SEQ ID NO: 187515 - DNA, 16 bp, P. troglodytes
aaattaataaatccag

SEQ ID NO: 187516 - DNA, 16 bp, P. troglodytes
aaattaatcaaactca

SEQ ID NO: 187517 - DNA, 16 bp, P. troglodytes
aaattaatcaatgtaa

SEQ ID NO: 187518 - DNA, 16 bp, P. troglodytes
aaattaatgaaactga

SEQ ID NO: 187519 - DNA, 16 bp, P. troglodytes
aaattaatgagaacaa

SEQ ID NO: 187520 - DNA, 16 bp, P. troglodytes
aaattaatgcagaaat

SEQ ID NO: 187521 - DNA, 16 bp, P. troglodytes
aaattaattcaagaaa

SEQ ID NO: 187522 - DNA, 16 bp, P. troglodytes
aaattaattttatctg

SEQ ID NO: 187523 - DNA, 16 bp, P. troglodytes
aaattaattttctgaa

SEQ ID NO: 187524 - DNA, 16 bp, P. troglodytes
aaattacaaaaattag

SEQ ID NO: 187525 - DNA, 16 bp, P. troglodytes
aaattacacattttat

SEQ ID NO: 187526 - DNA, 16 bp, P. troglodytes
aaattacagaaattta

SEQ ID NO: 187527 - DNA, 16 bp, P. troglodytes
aaattacagaatttta

SEQ ID NO: 187528 - DNA, 16 bp, P. troglodytes
aaattacatatttgaa

SEQ ID NO: 187529 - DNA, 16 bp, P. troglodytes
aaattacatgaaatta

SEQ ID NO: 187530 - DNA, 16 bp, P. troglodytes
aaattacattattttc

SEQ ID NO: 187531 - DNA, 16 bp, P. troglodytes
aaattaccatttcagt

SEQ ID NO: 187532 - DNA, 16 bp, P. troglodytes
aaattactaagaattt

SEQ ID NO: 187533 - DNA, 16 bp, P. troglodytes
aaattacttagcctct

SEQ ID NO: 187534 - DNA, 16 bp, P. troglodytes
aaattacttcacctct

SEQ ID NO: 187535 - DNA, 16 bp, P. troglodytes
aaattacttcatctct

SEQ ID NO: 187536 - DNA, 16 bp, P. troglodytes
aaattactttcaggct

SEQ ID NO: 187537 - DNA, 16 bp, P. troglodytes
aaattactttttgttt

SEQ ID NO: 187538 - DNA, 16 bp, P. troglodytes
aaattagaaaacaatt

SEQ ID NO: 187539 - DNA, 16 bp, P. troglodytes
aaattagaaaacattt

SEQ ID NO: 187540 - DNA, 16 bp, P. troglodytes
aaattagaaaactgaa

SEQ ID NO: 187541 - DNA, 16 bp, P. troglodytes
aaattagaaaatacat

SEQ ID NO: 187542 - DNA, 16 bp, P. troglodytes
aaattagaaatatctt

SEQ ID NO: 187543 - DNA, 16 bp, P. troglodytes
aaattagaagtcagga

SEQ ID NO: 187544 - DNA, 16 bp, P. troglodytes
aaattagaagttattt

SEQ ID NO: 187545 - DNA, 16 bp, P. troglodytes
aaattagcagaaggaa

SEQ ID NO: 187546 - DNA, 16 bp, P. troglodytes
aaattagcatttaaat

SEQ ID NO: 187547 - DNA, 22 bp, P. troglodytes
aaattagccaagcgtggtggcg

SEQ ID NO: 187548 - DNA, 18 bp, P. troglodytes
aaattagccaggcttggg

SEQ ID NO: 187549 - DNA, 16 bp, P. troglodytes
aaattagcccgatgtg

SEQ ID NO: 187550 - DNA, 18 bp, P. troglodytes
aaattagccgggtgtggt

SEQ ID NO: 187551 - DNA, 16 bp, P. troglodytes
aaattagcctggcatg

SEQ ID NO: 187552 - DNA, 16 bp, P. troglodytes
aaattagcctggcgtg

SEQ ID NO: 187553 - DNA, 16 bp, P. troglodytes
aaattagctgagtgtg

SEQ ID NO: 187554 - DNA, 16 bp, P. troglodytes
aaattagctgggcctt

SEQ ID NO: 187555 - DNA, 16 bp, P. troglodytes
aaattaggattgcaac

SEQ ID NO: 187556 - DNA, 16 bp, P. troglodytes
aaattaggctgggcac

SEQ ID NO: 187557 - DNA, 16 bp, P. troglodytes
aaattaggtataaaag

SEQ ID NO: 187558 - DNA, 16 bp, P. troglodytes
aaattagtaaagccat

SEQ ID NO: 187559 - DNA, 16 bp, P. troglodytes
aaattagtacatttta

SEQ ID NO: 187560 - DNA, 16 bp, P. troglodytes
aaattagtcagacatg

SEQ ID NO: 187561 - DNA, 16 bp, P. troglodytes
aaattagttacttcca

SEQ ID NO: 187562 - DNA, 16 bp, P. troglodytes
aaattagtttcttttt

SEQ ID NO: 187563 - DNA, 16 bp, P. troglodytes
aaattataaatgcaaa

SEQ ID NO: 187564 - DNA, 16 bp, P. troglodytes
aaattataacaccatc

SEQ ID NO: 187565 - DNA, 16 bp, P. troglodytes
aaattatagaacaaat

SEQ ID NO: 187566 - DNA, 16 bp, P. troglodytes
aaattatatcaagtat

SEQ ID NO: 187567 - DNA, 16 bp, P. troglodytes
aaattatcaaagaaat

SEQ ID NO: 187568 - DNA, 16 bp, P. troglodytes
aaattatcattgtttg

SEQ ID NO: 187569 - DNA, 16 bp, P. troglodytes
aaattatccagatgtg

SEQ ID NO: 187570 - DNA, 16 bp, P. troglodytes
aaattatctgaaaaat

SEQ ID NO: 187571 - DNA, 16 bp, P. troglodytes
aaattatctgggcata

SEQ ID NO: 187572 - DNA, 16 bp, P. troglodytes
aaattatctttttttg

SEQ ID NO: 187573 - DNA, 16 bp, P. troglodytes
aaattatgaaagtatt

SEQ ID NO: 187574 - DNA, 16 bp, P. troglodytes
aaattatgaaattatg

SEQ ID NO: 187575 - DNA, 16 bp, P. troglodytes
aaattatgaactattt

SEQ ID NO: 187576 - DNA, 16 bp, P. troglodytes
aaattatgaataaaac

SEQ ID NO: 187577 - DNA, 16 bp, P. troglodytes
aaattatgacaaactg

SEQ ID NO: 187578 - DNA, 16 bp, P. troglodytes
aaattatgttctttgc

SEQ ID NO: 187579 - DNA, 16 bp, P. troglodytes
aaattatgttgaattt

SEQ ID NO: 187580 - DNA, 16 bp, P. troglodytes
aaattatgtttcagaa

SEQ ID NO: 187581 - DNA, 16 bp, P. troglodytes
aaattatgttttcatt

SEQ ID NO: 187582 - DNA, 16 bp, P. troglodytes
aaattatgttttcttt

SEQ ID NO: 187583 - DNA, 16 bp, P. troglodytes
aaattatgtttttctt

SEQ ID NO: 187584 - DNA, 16 bp, P. troglodytes
aaattattcaagaaaa

SEQ ID NO: 187585 - DNA, 16 bp, P. troglodytes
aaattattccaaaatt

SEQ ID NO: 187586 - DNA, 16 bp, P. troglodytes
aaattattccaatcaa

SEQ ID NO: 187587 - DNA, 16 bp, P. troglodytes
aaattattctgaaaaa

SEQ ID NO: 187588 - DNA, 16 bp, P. troglodytes
aaattattcttcaaaa

SEQ ID NO: 187589 - DNA, 16 bp, P. troglodytes
aaattattcttcataa

SEQ ID NO: 187590 - DNA, 16 bp, P. troglodytes
aaattatttaacctct

SEQ ID NO: 187591 - DNA, 16 bp, P. troglodytes
aaattatttcagaaaa

SEQ ID NO: 187592 - DNA, 16 bp, P. troglodytes
aaattatttcagtttt

SEQ ID NO: 187593 - DNA, 16 bp, P. troglodytes
aaattatttcatcaaa

SEQ ID NO: 187594 - DNA, 16 bp, P. troglodytes
aaattatttccttctt

SEQ ID NO: 187595 - DNA, 16 bp, P. troglodytes
aaattatttcctttca

SEQ ID NO: 187596 - DNA, 16 bp, P. troglodytes
aaattatttcttcaaa

SEQ ID NO: 187597 - DNA, 16 bp, P. troglodytes
aaattatttgcaaaat

SEQ ID NO: 187598 - DNA, 16 bp, P. troglodytes
aaattatttgcccatt

SEQ ID NO: 187599 - DNA, 16 bp, P. troglodytes
aaattatttgctgttt

SEQ ID NO: 187600 - DNA, 16 bp, P. troglodytes
aaattatttgggaaaa

SEQ ID NO: 187601 - DNA, 16 bp, P. troglodytes
aaattatttgtaaaga

SEQ ID NO: 187602 - DNA, 16 bp, P. troglodytes
aaattatttgtagaga

SEQ ID NO: 187603 - DNA, 16 bp, P. troglodytes
aaattattttccaatt

SEQ ID NO: 187604 - DNA, 16 bp, P. troglodytes
aaattattttctccaa

SEQ ID NO: 187605 - DNA, 16 bp, P. troglodytes
aaattattttctgcat

SEQ ID NO: 187606 - DNA, 16 bp, P. troglodytes
aaattattttgctttt

SEQ ID NO: 187607 - DNA, 16 bp, P. troglodytes
aaattattttgttcat

SEQ ID NO: 187608 - DNA, 16 bp, P. troglodytes
aaattatttttagctt

SEQ ID NO: 187609 - DNA, 16 bp, P. troglodytes
aaattatttttatcag

SEQ ID NO: 187610 - DNA, 16 bp, P. troglodytes
aaattatttttccaat

SEQ ID NO: 187611 - DNA, 16 bp, P. troglodytes
aaattatttttctctg

SEQ ID NO: 187612 - DNA, 16 bp, P. troglodytes
aaattatttttggaaa

SEQ ID NO: 187613 - DNA, 16 bp, P. troglodytes
aaattcaaaacaattg

SEQ ID NO: 187614 - DNA, 16 bp, P. troglodytes
aaattcaaaacctgaa

SEQ ID NO: 187615 - DNA, 16 bp, P. troglodytes
aaattcaaaagtgaaa

SEQ ID NO: 187616 - DNA, 16 bp, P. troglodytes
aaattcaaaatccatt

SEQ ID NO: 187617 - DNA, 16 bp, P. troglodytes
aaattcaaaccatatc

SEQ ID NO: 187618 - DNA, 16 bp, P. troglodytes
aaattcaaagtgccat

SEQ ID NO: 187619 - DNA, 16 bp, P. troglodytes
aaattcaaataaagtc

SEQ ID NO: 187620 - DNA, 16 bp, P. troglodytes
aaattcaaatgtcagt

SEQ ID NO: 187621 - DNA, 16 bp, P. troglodytes
aaattcaaattcaact

SEQ ID NO: 187622 - DNA, 16 bp, P. troglodytes
aaattcaaatttcatt

SEQ ID NO: 187623 - DNA, 16 bp, P. troglodytes
aaattcaacacttgac

SEQ ID NO: 187624 - DNA, 16 bp, P. troglodytes
aaattcaacagaactg

SEQ ID NO: 187625 - DNA, 16 bp, P. troglodytes
aaattcaacagccatt

SEQ ID NO: 187626 - DNA, 16 bp, P. troglodytes
aaattcaacattttta

SEQ ID NO: 187627 - DNA, 16 bp, P. troglodytes
aaattcaagaaaaatt

SEQ ID NO: 187628 - DNA, 16 bp, P. troglodytes
aaattcacaaatacat

SEQ ID NO: 187629 - DNA, 16 bp, P. troglodytes
aaattcacaattttaa

SEQ ID NO: 187630 - DNA, 16 bp, P. troglodytes
aaattcacagaaaaag

SEQ ID NO: 187631 - DNA, 16 bp, P. troglodytes
aaattcacataacata

SEQ ID NO: 187632 - DNA, 16 bp, P. troglodytes
aaattcacatataatt

SEQ ID NO: 187633 - DNA, 16 bp, P. troglodytes
aaattcacattttaaa

SEQ ID NO: 187634 - DNA, 16 bp, P. troglodytes
aaattcacttttcttt

SEQ ID NO: 187635 - DNA, 16 bp, P. troglodytes
aaattcagaaaattca

SEQ ID NO: 187636 - DNA, 16 bp, P. troglodytes
aaattcagaagaaaat

SEQ ID NO: 187637 - DNA, 16 bp, P. troglodytes
aaattcagaatttaaa

SEQ ID NO: 187638 - DNA, 16 bp, P. troglodytes
aaattcagagaaaata

SEQ ID NO: 187639 - DNA, 16 bp, P. troglodytes
aaattcagagagaaaa

SEQ ID NO: 187640 - DNA, 16 bp, P. troglodytes
aaattcagagaggtta

SEQ ID NO: 187641 - DNA, 16 bp, P. troglodytes
aaattcagatgttgaa

SEQ ID NO: 187642 - DNA, 16 bp, P. troglodytes
aaattcagcaatgaag

SEQ ID NO: 187643 - DNA, 16 bp, P. troglodytes
aaattcaggaaacttt

SEQ ID NO: 187644 - DNA, 16 bp, P. troglodytes
aaattcaggaaatgta

SEQ ID NO: 187645 - DNA, 16 bp, P. troglodytes
aaattcagggaaaaaa

SEQ ID NO: 187646 - DNA, 16 bp, P. troglodytes
aaattcagggaataca

SEQ ID NO: 187647 - DNA, 16 bp, P. troglodytes
aaattcagtttaaaaa

SEQ ID NO: 187648 - DNA, 16 bp, P. troglodytes
aaattcagttttatat

SEQ ID NO: 187649 - DNA, 16 bp, P. troglodytes
aaattcatatggaaga

SEQ ID NO: 187650 - DNA, 16 bp, P. troglodytes
aaattcatatgttgaa

SEQ ID NO: 187651 - DNA, 16 bp, P. troglodytes
aaattcatcaagctgt

SEQ ID NO: 187652 - DNA, 16 bp, P. troglodytes
aaattcatgtattgaa

SEQ ID NO: 187653 - DNA, 16 bp, P. troglodytes
aaattcatgtttttct

SEQ ID NO: 187654 - DNA, 16 bp, P. troglodytes
aaattcatgttttttt

SEQ ID NO: 187655 - DNA, 16 bp, P. troglodytes
aaattcattaaaatgt

SEQ ID NO: 187656 - DNA, 16 bp, P. troglodytes
aaattcattaaagaaa

SEQ ID NO: 187657 - DNA, 16 bp, P. troglodytes
aaattcattgtttttt

SEQ ID NO: 187658 - DNA, 16 bp, P. troglodytes
aaattcatttatttca

SEQ ID NO: 187659 - DNA, 16 bp, P. troglodytes
aaattcatttgtgttt

SEQ ID NO: 187660 - DNA, 16 bp, P. troglodytes
aaattccaacccagaa

SEQ ID NO: 187661 - DNA, 16 bp, P. troglodytes
aaattccagaaagaaa

SEQ ID NO: 187662 - DNA, 16 bp, P. troglodytes
aaattccagcctggca

SEQ ID NO: 187663 - DNA, 16 bp, P. troglodytes
aaattccatttacaat

SEQ ID NO: 187664 - DNA, 16 bp, P. troglodytes
aaattccatttttaaa

SEQ ID NO: 187665 - DNA, 16 bp, P. troglodytes
aaattccatttttctc

SEQ ID NO: 187666 - DNA, 16 bp, P. troglodytes
aaattcctatgttaaa

SEQ ID NO: 187667 - DNA, 16 bp, P. troglodytes
aaattcctctctttat

SEQ ID NO: 187668 - DNA, 16 bp, P. troglodytes
aaattcctgaaaatat

SEQ ID NO: 187669 - DNA, 16 bp, P. troglodytes
aaattcctgagttcaa

SEQ ID NO: 187670 - DNA, 16 bp, P. troglodytes
aaattcctgttccctg

SEQ ID NO: 187671 - DNA, 16 bp, P. troglodytes
aaattccttaaaatat

SEQ ID NO: 187672 - DNA, 16 bp, P. troglodytes
aaattccttgagggca

SEQ ID NO: 187673 - DNA, 16 bp, P. troglodytes
aaattccttgtgggcc

SEQ ID NO: 187674 - DNA, 16 bp, P. troglodytes
aaattcctttctcatt

SEQ ID NO: 187675 - DNA, 16 bp, P. troglodytes
aaattccttttccttt

SEQ ID NO: 187676 - DNA, 16 bp, P. troglodytes
aaattctaagaataaa

SEQ ID NO: 187677 - DNA, 16 bp, P. troglodytes
aaattctaatttaact

SEQ ID NO: 187678 - DNA, 16 bp, P. troglodytes
aaattctactttaaaa

SEQ ID NO: 187679 - DNA, 16 bp, P. troglodytes
aaattctagaaagaaa

SEQ ID NO: 187680 - DNA, 16 bp, P. troglodytes
aaattctagaagacaa

SEQ ID NO: 187681 - DNA, 16 bp, P. troglodytes
aaattctagaattgaa

SEQ ID NO: 187682 - DNA, 16 bp, P. troglodytes
aaattctataaagaaa

SEQ ID NO: 187683 - DNA, 16 bp, P. troglodytes
aaattctatcttaaaa

SEQ ID NO: 187684 - DNA, 16 bp, P. troglodytes
aaattctcaaagaaaa

SEQ ID NO: 187685 - DNA, 16 bp, P. troglodytes
aaattctcaacagaat

SEQ ID NO: 187686 - DNA, 16 bp, P. troglodytes
aaattctcagaaaaat

SEQ ID NO: 187687 - DNA, 16 bp, P. troglodytes
aaattctcagaaaaca

SEQ ID NO: 187688 - DNA, 16 bp, P. troglodytes
aaattctcaggcctca

SEQ ID NO: 187689 - DNA, 16 bp, P. troglodytes
aaattctcatcagatg

SEQ ID NO: 187690 - DNA, 16 bp, P. troglodytes
aaattctccagtgaaa

SEQ ID NO: 187691 - DNA, 16 bp, P. troglodytes
aaattctcttcatttt

SEQ ID NO: 187692 - DNA, 16 bp, P. troglodytes
aaattctcttttttgg

SEQ ID NO: 187693 - DNA, 16 bp, P. troglodytes
aaattctgaaaataat

SEQ ID NO: 187694 - DNA, 16 bp, P. troglodytes
aaattctgaaataaaa

SEQ ID NO: 187695 - DNA, 16 bp, P. troglodytes
aaattctgaataaaat

SEQ ID NO: 187696 - DNA, 16 bp, P. troglodytes
aaattctgaattttga

SEQ ID NO: 187697 - DNA, 16 bp, P. troglodytes
aaattctgagatttta

SEQ ID NO: 187698 - DNA, 16 bp, P. troglodytes
aaattctgatacatgc

SEQ ID NO: 187699 - DNA, 16 bp, P. troglodytes
aaattctgatttttaa

SEQ ID NO: 187700 - DNA, 16 bp, P. troglodytes
aaattctggaaagaaa

SEQ ID NO: 187701 - DNA, 16 bp, P. troglodytes
aaattctggaattgaa

SEQ ID NO: 187702 - DNA, 16 bp, P. troglodytes
aaattctgggattaca

SEQ ID NO: 187703 - DNA, 16 bp, P. troglodytes
aaattctgtatttatt

SEQ ID NO: 187704 - DNA, 16 bp, P. troglodytes
aaattctgtatttctt

SEQ ID NO: 187705 - DNA, 16 bp, P. troglodytes
aaattctgtctcaaaa

SEQ ID NO: 187706 - DNA, 16 bp, P. troglodytes
aaattctgttgtttat

SEQ ID NO: 187707 - DNA, 16 bp, P. troglodytes
aaattctgtttataaa

SEQ ID NO: 187708 - DNA, 16 bp, P. troglodytes
aaattctgttttaaat

SEQ ID NO: 187709 - DNA, 16 bp, P. troglodytes
aaattctgttttatct

SEQ ID NO: 187710 - DNA, 16 bp, P. troglodytes
aaattcttaaaatgaa

SEQ ID NO: 187711 - DNA, 16 bp, P. troglodytes
aaattcttaatcattt

SEQ ID NO: 187712 - DNA, 16 bp, P. troglodytes
aaattcttatccattc

SEQ ID NO: 187713 - DNA, 18 bp, P. troglodytes
aaattcttatctctgtat

SEQ ID NO: 187714 - DNA, 16 bp, P. troglodytes
aaattcttatgttgaa

SEQ ID NO: 187715 - DNA, 16 bp, P. troglodytes
aaattcttatttttgt

SEQ ID NO: 187716 - DNA, 16 bp, P. troglodytes
aaattcttcaaaatat

SEQ ID NO: 187717 - DNA, 16 bp, P. troglodytes
aaattcttcaaaattt

SEQ ID NO: 187718 - DNA, 16 bp, P. troglodytes
aaattcttcaacaaaa

SEQ ID NO: 187719 - DNA, 16 bp, P. troglodytes
aaattcttcagttttt

SEQ ID NO: 187720 - DNA, 16 bp, P. troglodytes
aaattcttccaaattt

SEQ ID NO: 187721 - DNA, 16 bp, P. troglodytes
aaattcttcccttccc

SEQ ID NO: 187722 - DNA, 16 bp, P. troglodytes
aaattcttcctctttt

SEQ ID NO: 187723 - DNA, 16 bp, P. troglodytes
aaattcttctctgccc

SEQ ID NO: 187724 - DNA, 16 bp, P. troglodytes
aaattcttgaagtgag

SEQ ID NO: 187725 - DNA, 16 bp, P. troglodytes
aaattcttggaaatat

SEQ ID NO: 187726 - DNA, 16 bp, P. troglodytes
aaattcttggctggta

SEQ ID NO: 187727 - DNA, 16 bp, P. troglodytes
aaattctttcagattt

SEQ ID NO: 187728 - DNA, 16 bp, P. troglodytes
aaattctttccaaatt

SEQ ID NO: 187729 - DNA, 16 bp, P. troglodytes
aaattctttgaaacca

SEQ ID NO: 187730 - DNA, 16 bp, P. troglodytes
aaattctttgacactc

SEQ ID NO: 187731 - DNA, 16 bp, P. troglodytes
aaattctttgccaaag

SEQ ID NO: 187732 - DNA, 16 bp, P. troglodytes
aaattcttttagaaaa

SEQ ID NO: 187733 - DNA, 16 bp, P. troglodytes
aaattcttttccttaa

SEQ ID NO: 187734 - DNA, 16 bp, P. troglodytes
aaattcttttggattt

SEQ ID NO: 187735 - DNA, 16 bp, P. troglodytes
aaattgaaaaatattc

SEQ ID NO: 187736 - DNA, 16 bp, P. troglodytes
aaattgaaaaatggga

SEQ ID NO: 187737 - DNA, 16 bp, P. troglodytes
aaattgaaaacctgaa

SEQ ID NO: 187738 - DNA, 16 bp, P. troglodytes
aaattgaaaacttttt

SEQ ID NO: 187739 - DNA, 16 bp, P. troglodytes
aaattgaaaatacata

SEQ ID NO: 187740 - DNA, 16 bp, P. troglodytes
aaattgaaaatctgaa

SEQ ID NO: 187741 - DNA, 16 bp, P. troglodytes
aaattgaaacaaatga

SEQ ID NO: 187742 - DNA, 16 bp, P. troglodytes
aaattgaaactctgta

SEQ ID NO: 187743 - DNA, 16 bp, P. troglodytes
aaattgaaagcttttt

SEQ ID NO: 187744 - DNA, 16 bp, P. troglodytes
aaattgaaatccaaaa

SEQ ID NO: 187745 - DNA, 16 bp, P. troglodytes
aaattgaacaattttt

SEQ ID NO: 187746 - DNA, 16 bp, P. troglodytes
aaattgaacatttaaa

SEQ ID NO: 187747 - DNA, 16 bp, P. troglodytes
aaattgaacattttat

SEQ ID NO: 187748 - DNA, 16 bp, P. troglodytes
aaattgaagacataaa

SEQ ID NO: 187749 - DNA, 16 bp, P. troglodytes
aaattgaaggagaaat

SEQ ID NO: 187750 - DNA, 16 bp, P. troglodytes
aaattgaattattttc

SEQ ID NO: 187751 - DNA, 16 bp, P. troglodytes
aaattgacaaatgggg

SEQ ID NO: 187752 - DNA, 16 bp, P. troglodytes
aaattgacaagctgat

SEQ ID NO: 187753 - DNA, 16 bp, P. troglodytes
aaattgacacataaaa

SEQ ID NO: 187754 - DNA, 16 bp, P. troglodytes
aaattgactgagactt

SEQ ID NO: 187755 - DNA, 16 bp, P. troglodytes
aaattgagaaaacaat

SEQ ID NO: 187756 - DNA, 16 bp, P. troglodytes
aaattgagaaggaaat

SEQ ID NO: 187757 - DNA, 16 bp, P. troglodytes
aaattgataaattctt

SEQ ID NO: 187758 - DNA, 16 bp, P. troglodytes
aaattgataaattgta

SEQ ID NO: 187759 - DNA, 16 bp, P. troglodytes
aaattgatagcactaa

SEQ ID NO: 187760 - DNA, 16 bp, P. troglodytes
aaattgatagcttatc

SEQ ID NO: 187761 - DNA, 16 bp, P. troglodytes
aaattgatcaagcaga

SEQ ID NO: 187762 - DNA, 16 bp, P. troglodytes
aaattgatcatttaaa

SEQ ID NO: 187763 - DNA, 16 bp, P. troglodytes
aaattgatttcttttt

SEQ ID NO: 187764 - DNA, 16 bp, P. troglodytes
aaattgattttctttt

SEQ ID NO: 187765 - DNA, 16 bp, P. troglodytes
aaattgattttgaaaa

SEQ ID NO: 187766 - DNA, 16 bp, P. troglodytes
aaattgcaaaattttt

SEQ ID NO: 187767 - DNA, 16 bp, P. troglodytes
aaattgcaaagaaaat

SEQ ID NO: 187768 - DNA, 16 bp, P. troglodytes
aaattgcaaaggaaga

SEQ ID NO: 187769 - DNA, 16 bp, P. troglodytes
aaattgcaataaaaat

SEQ ID NO: 187770 - DNA, 16 bp, P. troglodytes
aaattgcatatattta

SEQ ID NO: 187771 - DNA, 16 bp, P. troglodytes
aaattgcatgttgcag

SEQ ID NO: 187772 - DNA, 16 bp, P. troglodytes
aaattgcattttgttt

SEQ ID NO: 187773 - DNA, 16 bp, P. troglodytes
aaattgccaaaacaaa

SEQ ID NO: 187774 - DNA, 16 bp, P. troglodytes
aaattgccacaaactt

SEQ ID NO: 187775 - DNA, 16 bp, P. troglodytes
aaattgccacagtcac

SEQ ID NO: 187776 - DNA, 17 bp, P. troglodytes
aaattgccttgctgaga

SEQ ID NO: 187777 - DNA, 16 bp, P. troglodytes
aaattgctgagattat

SEQ ID NO: 187778 - DNA, 16 bp, P. troglodytes
aaattgcttaacttct

SEQ ID NO: 187779 - DNA, 16 bp, P. troglodytes
aaattgcttctggtgg

SEQ ID NO: 187780 - DNA, 16 bp, P. troglodytes
aaattgctttataaaa

SEQ ID NO: 187781 - DNA, 16 bp, P. troglodytes
aaattgctttgtgatg

SEQ ID NO: 187782 - DNA, 16 bp, P. troglodytes
aaattgcttttaaaaa

SEQ ID NO: 187783 - DNA, 16 bp, P. troglodytes
aaattgcttttatttt

SEQ ID NO: 187784 - DNA, 16 bp, P. troglodytes
aaattgcttttcctct

SEQ ID NO: 187785 - DNA, 16 bp, P. troglodytes
aaattgcttttgaaaa

SEQ ID NO: 187786 - DNA, 16 bp, P. troglodytes
aaattggaaaatactt

SEQ ID NO: 187787 - DNA, 16 bp, P. troglodytes
aaattggaaaatattt

SEQ ID NO: 187788 - DNA, 16 bp, P. troglodytes
aaattggaaatcacca

SEQ ID NO: 187789 - DNA, 16 bp, P. troglodytes
aaattggaactcttgt

SEQ ID NO: 187790 - DNA, 16 bp, P. troglodytes
aaattggacttcatca

SEQ ID NO: 187791 - DNA, 16 bp, P. troglodytes
aaattggataaggagt

SEQ ID NO: 187792 - DNA, 16 bp, P. troglodytes
aaattggcaaatattt

SEQ ID NO: 187793 - DNA, 16 bp, P. troglodytes
aaattggccagaagcc

SEQ ID NO: 187794 - DNA, 16 bp, P. troglodytes
aaattggcctggcgtg

SEQ ID NO: 187795 - DNA, 16 bp, P. troglodytes
aaattggtcaaaacaa

SEQ ID NO: 187796 - DNA, 16 bp, P. troglodytes
aaattggtttcattct

SEQ ID NO: 187797 - DNA, 16 bp, P. troglodytes
aaattgtaaaatacat

SEQ ID NO: 187798 - DNA, 16 bp, P. troglodytes
aaattgtactttttaa

SEQ ID NO: 187799 - DNA, 16 bp, P. troglodytes
aaattgtatacatttt

SEQ ID NO: 187800 - DNA, 16 bp, P. troglodytes
aaattgtatttactta

SEQ ID NO: 187801 - DNA, 16 bp, P. troglodytes
aaattgtcaaggtcat

SEQ ID NO: 187802 - DNA, 16 bp, P. troglodytes
aaattgtcattatttt

SEQ ID NO: 187803 - DNA, 16 bp, P. troglodytes
aaattgtcatttttat

SEQ ID NO: 187804 - DNA, 16 bp, P. troglodytes
aaattgtcatttttgt

SEQ ID NO: 187805 - DNA, 16 bp, P. troglodytes
aaattgtccttgtttg

SEQ ID NO: 187806 - DNA, 16 bp, P. troglodytes
aaattgtcttccaaaa

SEQ ID NO: 187807 - DNA, 16 bp, P. troglodytes
aaattgtctttaaaaa

SEQ ID NO: 187808 - DNA, 16 bp, P. troglodytes
aaattgtgaaatattt

SEQ ID NO: 187809 - DNA, 16 bp, P. troglodytes
aaattgtgaagaagga

SEQ ID NO: 187810 - DNA, 16 bp, P. troglodytes
aaattgtgtgtgtgtg

SEQ ID NO: 187811 - DNA, 16 bp, P. troglodytes
aaattgtgttaaaata

SEQ ID NO: 187812 - DNA, 16 bp, P. troglodytes
aaattgttacatttta

SEQ ID NO: 187813 - DNA, 16 bp, P. troglodytes
aaattgttatatctac

SEQ ID NO: 187814 - DNA, 16 bp, P. troglodytes
aaattgttcctctttg

SEQ ID NO: 187815 - DNA, 16 bp, P. troglodytes
aaattgtttaaaaagt

SEQ ID NO: 187816 - DNA, 16 bp, P. troglodytes
aaattgtttcttcttt

SEQ ID NO: 187817 - DNA, 16 bp, P. troglodytes
aaattgttttagaaaa

SEQ ID NO: 187818 - DNA, 16 bp, P. troglodytes
aaattgttttatttct

SEQ ID NO: 187819 - DNA, 16 bp, P. troglodytes
aaattgttttcaaaga

SEQ ID NO: 187820 - DNA, 16 bp, P. troglodytes
aaattgttttctcatt

SEQ ID NO: 187821 - DNA, 16 bp, P. troglodytes
aaattgttttctgaaa

SEQ ID NO: 187822 - DNA, 16 bp, P. troglodytes
aaattgttttcttaat

SEQ ID NO: 187823 - DNA, 16 bp, P. troglodytes
aaattgttttgtaaaa

SEQ ID NO: 187824 - DNA, 16 bp, P. troglodytes
aaattgtttttacttt

SEQ ID NO: 187825 - DNA, 16 bp, P. troglodytes
aaattgtttttgcttt

SEQ ID NO: 187826 - DNA, 16 bp, P. troglodytes
aaatttaaaaattcag

SEQ ID NO: 187827 - DNA, 16 bp, P. troglodytes
aaatttaaaactgtaa

SEQ ID NO: 187828 - DNA, 16 bp, P. troglodytes
aaatttaaaactttgt

SEQ ID NO: 187829 - DNA, 16 bp, P. troglodytes
aaatttaaacagtttt

SEQ ID NO: 187830 - DNA, 16 bp, P. troglodytes
aaatttaaagacaaat

SEQ ID NO: 187831 - DNA, 16 bp, P. troglodytes
aaatttaaagtgctac

SEQ ID NO: 187832 - DNA, 16 bp, P. troglodytes
aaatttaaatagctac

SEQ ID NO: 187833 - DNA, 16 bp, P. troglodytes
aaatttaaatgcaaat

SEQ ID NO: 187834 - DNA, 16 bp, P. troglodytes
aaatttaaattagcca

SEQ ID NO: 187835 - DNA, 16 bp, P. troglodytes
aaatttaaatttcaga

SEQ ID NO: 187836 - DNA, 16 bp, P. troglodytes
aaatttaacaaaatga

SEQ ID NO: 187837 - DNA, 16 bp, P. troglodytes
aaatttaagttttcaa

SEQ ID NO: 187838 - DNA, 16 bp, P. troglodytes
aaatttacaaggaaaa

SEQ ID NO: 187839 - DNA, 16 bp, P. troglodytes
aaatttacagaaaagt

SEQ ID NO: 187840 - DNA, 16 bp, P. troglodytes
aaatttacatttcatt

SEQ ID NO: 187841 - DNA, 16 bp, P. troglodytes
aaatttactgaattta

SEQ ID NO: 187842 - DNA, 16 bp, P. troglodytes
aaatttactgtcttaa

SEQ ID NO: 187843 - DNA, 16 bp, P. troglodytes
aaatttactgttcttt

SEQ ID NO: 187844 - DNA, 16 bp, P. troglodytes
aaatttacttgaaaat

SEQ ID NO: 187845 - DNA, 16 bp, P. troglodytes
aaatttactttcttaa

SEQ ID NO: 187846 - DNA, 16 bp, P. troglodytes
aaatttagccgggtgt

SEQ ID NO: 187847 - DNA, 16 bp, P. troglodytes
aaatttagtgagaaga

SEQ ID NO: 187848 - DNA, 16 bp, P. troglodytes
aaatttatacaaagaa

SEQ ID NO: 187849 - DNA, 16 bp, P. troglodytes
aaatttatactagaaa

SEQ ID NO: 187850 - DNA, 16 bp, P. troglodytes
aaatttatatgttgaa

SEQ ID NO: 187851 - DNA, 16 bp, P. troglodytes
aaatttatcaaaatgt

SEQ ID NO: 187852 - DNA, 16 bp, P. troglodytes
aaatttatcaaagaaa

SEQ ID NO: 187853 - DNA, 16 bp, P. troglodytes
aaatttatcaagggct

SEQ ID NO: 187854 - DNA, 16 bp, P. troglodytes
aaatttatggggaaga

SEQ ID NO: 187855 - DNA, 16 bp, P. troglodytes
aaatttatgtgaaaat

SEQ ID NO: 187856 - DNA, 16 bp, P. troglodytes
aaatttatttaatgtg

SEQ ID NO: 187857 - DNA, 16 bp, P. troglodytes
aaatttattttcccaa

SEQ ID NO: 187858 - DNA, 16 bp, P. troglodytes
aaatttattttgccaa

SEQ ID NO: 187859 - DNA, 16 bp, P. troglodytes
aaatttattttgctta

SEQ ID NO: 187860 - DNA, 16 bp, P. troglodytes
aaatttattttgcttt

SEQ ID NO: 187861 - DNA, 16 bp, P. troglodytes
aaatttatttttccct

SEQ ID NO: 187862 - DNA, 16 bp, P. troglodytes
aaatttcaaaatgaat

SEQ ID NO: 187863 - DNA, 16 bp, P. troglodytes
aaatttcaaaattttg

SEQ ID NO: 187864 - DNA, 16 bp, P. troglodytes
aaatttcaaacataca

SEQ ID NO: 187865 - DNA, 16 bp, P. troglodytes
aaatttcaaggaaaaa

SEQ ID NO: 187866 - DNA, 16 bp, P. troglodytes
aaatttcaatatgaaa

SEQ ID NO: 187867 - DNA, 16 bp, P. troglodytes
aaatttcaatgtccat

SEQ ID NO: 187868 - DNA, 16 bp, P. troglodytes
aaatttcagaaaaaga

SEQ ID NO: 187869 - DNA, 16 bp, P. troglodytes
aaatttcagaaaatat

SEQ ID NO: 187870 - DNA, 16 bp, P. troglodytes
aaatttcagaaaatta

SEQ ID NO: 187871 - DNA, 16 bp, P. troglodytes
aaatttcagaagaaaa

SEQ ID NO: 187872 - DNA, 16 bp, P. troglodytes
aaatttcagaagtttt

SEQ ID NO: 187873 - DNA, 16 bp, P. troglodytes
aaatttcagttattat

SEQ ID NO: 187874 - DNA, 16 bp, P. troglodytes
aaatttcagttgtttt

SEQ ID NO: 187875 - DNA, 16 bp, P. troglodytes
aaatttcagttttaaa

SEQ ID NO: 187876 - DNA, 16 bp, P. troglodytes
aaatttcataaatgaa

SEQ ID NO: 187877 - DNA, 16 bp, P. troglodytes
aaatttcatacagaac

SEQ ID NO: 187878 - DNA, 16 bp, P. troglodytes
aaatttcatgttaaaa

SEQ ID NO: 187879 - DNA, 16 bp, P. troglodytes
aaatttcatgttcttt

SEQ ID NO: 187880 - DNA, 16 bp, P. troglodytes
aaatttcatgttgaat

SEQ ID NO: 187881 - DNA, 16 bp, P. troglodytes
aaatttcattttcaaa

SEQ ID NO: 187882 - DNA, 16 bp, P. troglodytes
aaatttccaaatttta

SEQ ID NO: 187883 - DNA, 16 bp, P. troglodytes
aaatttccagaaataa

SEQ ID NO: 187884 - DNA, 16 bp, P. troglodytes
aaatttccagaagaaa

SEQ ID NO: 187885 - DNA, 16 bp, P. troglodytes
aaatttcccacatttt

SEQ ID NO: 187886 - DNA, 16 bp, P. troglodytes
aaatttccctttaaac

SEQ ID NO: 187887 - DNA, 16 bp, P. troglodytes
aaatttcctgaaaatt

SEQ ID NO: 187888 - DNA, 16 bp, P. troglodytes
aaatttcctttaaatt

SEQ ID NO: 187889 - DNA, 16 bp, P. troglodytes
aaatttccttttttgt

SEQ ID NO: 187890 - DNA, 16 bp, P. troglodytes
aaatttctaaaaatga

SEQ ID NO: 187891 - DNA, 18 bp, P. troglodytes
aaatttctaagtggcaaa

SEQ ID NO: 187892 - DNA, 16 bp, P. troglodytes
aaatttctagaaaaag

SEQ ID NO: 187893 - DNA, 16 bp, P. troglodytes
aaatttctagaagaaa

SEQ ID NO: 187894 - DNA, 16 bp, P. troglodytes
aaatttctagaagtgg

SEQ ID NO: 187895 - DNA, 16 bp, P. troglodytes
aaatttctattgtttt

SEQ ID NO: 187896 - DNA, 16 bp, P. troglodytes
aaatttctgaaaacca

SEQ ID NO: 187897 - DNA, 16 bp, P. troglodytes
aaatttctgaaaatgt

SEQ ID NO: 187898 - DNA, 16 bp, P. troglodytes
aaatttctgagctcaa

SEQ ID NO: 187899 - DNA, 16 bp, P. troglodytes
aaatttctgttgttca

SEQ ID NO: 187900 - DNA, 16 bp, P. troglodytes
aaatttcttcttccag

SEQ ID NO: 187901 - DNA, 16 bp, P. troglodytes
aaatttcttctttaaa

SEQ ID NO: 187902 - DNA, 16 bp, P. troglodytes
aaatttcttcttttga

SEQ ID NO: 187903 - DNA, 16 bp, P. troglodytes
aaatttcttgagtaat

SEQ ID NO: 187904 - DNA, 16 bp, P. troglodytes
aaatttcttttacaaa

SEQ ID NO: 187905 - DNA, 16 bp, P. troglodytes
aaatttcttttgagac

SEQ ID NO: 187906 - DNA, 16 bp, P. troglodytes
aaatttctttttgaaa

SEQ ID NO: 187907 - DNA, 16 bp, P. troglodytes
aaatttgaaaactgaa

SEQ ID NO: 187908 - DNA, 16 bp, P. troglodytes
aaatttgaaaataaac

SEQ ID NO: 187909 - DNA, 16 bp, P. troglodytes
aaatttgaaatccaaa

SEQ ID NO: 187910 - DNA, 16 bp, P. troglodytes
aaatttgaacacagac

SEQ ID NO: 187911 - DNA, 16 bp, P. troglodytes
aaatttgaacttaaaa

SEQ ID NO: 187912 - DNA, 16 bp, P. troglodytes
aaatttgaatgtgaaa

SEQ ID NO: 187913 - DNA, 16 bp, P. troglodytes
aaatttgaatttcata

SEQ ID NO: 187914 - DNA, 16 bp, P. troglodytes
aaatttgaatttgaaa

SEQ ID NO: 187915 - DNA, 16 bp, P. troglodytes
aaatttgagaaccatt

SEQ ID NO: 187916 - DNA, 16 bp, P. troglodytes
aaatttgagaactgct

SEQ ID NO: 187917 - DNA, 16 bp, P. troglodytes
aaatttgagaatcatt

SEQ ID NO: 187918 - DNA, 16 bp, P. troglodytes
aaatttgataacttag

SEQ ID NO: 187919 - DNA, 16 bp, P. troglodytes
aaatttgcagcctgac

SEQ ID NO: 187920 - DNA, 16 bp, P. troglodytes
aaatttgcattaattt

SEQ ID NO: 187921 - DNA, 16 bp, P. troglodytes
aaatttgcgtaagtaa

SEQ ID NO: 187922 - DNA, 16 bp, P. troglodytes
aaatttgctcaaagaa

SEQ ID NO: 187923 - DNA, 16 bp, P. troglodytes
aaatttgctgattctt

SEQ ID NO: 187924 - DNA, 16 bp, P. troglodytes
aaatttgctgtttgat

SEQ ID NO: 187925 - DNA, 16 bp, P. troglodytes
aaatttggaaaatgtg

SEQ ID NO: 187926 - DNA, 16 bp, P. troglodytes
aaatttggaaaatttg

SEQ ID NO: 187927 - DNA, 16 bp, P. troglodytes
aaatttggaaattttt

SEQ ID NO: 187928 - DNA, 16 bp, P. troglodytes
aaatttggaagataaa

SEQ ID NO: 187929 - DNA, 16 bp, P. troglodytes
aaatttggcttatttg

SEQ ID NO: 187930 - DNA, 16 bp, P. troglodytes
aaatttggcttttttt

SEQ ID NO: 187931 - DNA, 16 bp, P. troglodytes
aaatttgggaaatata

SEQ ID NO: 187932 - DNA, 16 bp, P. troglodytes
aaatttgggacatttt

SEQ ID NO: 187933 - DNA, 16 bp, P. troglodytes
aaatttggggaagagg

SEQ ID NO: 187934 - DNA, 16 bp, P. troglodytes
aaatttggggagtttt

SEQ ID NO: 187935 - DNA, 16 bp, P. troglodytes
aaatttgggtgggaac

SEQ ID NO: 187936 - DNA, 16 bp, P. troglodytes
aaatttgtaaactttt

SEQ ID NO: 187937 - DNA, 16 bp, P. troglodytes
aaatttgtactttttt

SEQ ID NO: 187938 - DNA, 16 bp, P. troglodytes
aaatttgtagttaaaa

SEQ ID NO: 187939 - DNA, 16 bp, P. troglodytes
aaatttgtatttttca

SEQ ID NO: 187940 - DNA, 16 bp, P. troglodytes
aaatttgtcattaaaa

SEQ ID NO: 187941 - DNA, 16 bp, P. troglodytes
aaatttgtccatttca

SEQ ID NO: 187942 - DNA, 16 bp, P. troglodytes
aaatttgtgaaaatta

SEQ ID NO: 187943 - DNA, 16 bp, P. troglodytes
aaatttgttcatttca

SEQ ID NO: 187944 - DNA, 16 bp, P. troglodytes
aaatttgttgaaattt

SEQ ID NO: 187945 - DNA, 16 bp, P. troglodytes
aaatttgttttacatt

SEQ ID NO: 187946 - DNA, 16 bp, P. troglodytes
aaatttgtttttactt

SEQ ID NO: 187947 - DNA, 16 bp, P. troglodytes
aaatttgtttttcaca

SEQ ID NO: 187948 - DNA, 16 bp, P. troglodytes
aaattttaaaaactct

SEQ ID NO: 187949 - DNA, 16 bp, P. troglodytes
aaattttaaaaatgtg

SEQ ID NO: 187950 - DNA, 16 bp, P. troglodytes
aaattttaaaagtgga

SEQ ID NO: 187951 - DNA, 16 bp, P. troglodytes
aaattttaaaagttct

SEQ ID NO: 187952 - DNA, 16 bp, P. troglodytes
aaattttaaaatctgt

SEQ ID NO: 187953 - DNA, 16 bp, P. troglodytes
aaattttaaagacaga

SEQ ID NO: 187954 - DNA, 16 bp, P. troglodytes
aaattttaaagcttca

SEQ ID NO: 187955 - DNA, 16 bp, P. troglodytes
aaattttaaagtttct

SEQ ID NO: 187956 - DNA, 16 bp, P. troglodytes
aaattttaactcattt

SEQ ID NO: 187957 - DNA, 16 bp, P. troglodytes
aaattttaagtcattt

SEQ ID NO: 187958 - DNA, 16 bp, P. troglodytes
aaattttaccaatttt

SEQ ID NO: 187959 - DNA, 16 bp, P. troglodytes
aaattttaccttaaaa

SEQ ID NO: 187960 - DNA, 16 bp, P. troglodytes
aaattttacctttgaa

SEQ ID NO: 187961 - DNA, 16 bp, P. troglodytes
aaattttagaaaatgt

SEQ ID NO: 187962 - DNA, 16 bp, P. troglodytes
aaattttaggagaaaa

SEQ ID NO: 187963 - DNA, 16 bp, P. troglodytes
aaattttaggctgggc

SEQ ID NO: 187964 - DNA, 16 bp, P. troglodytes
aaattttatagcttta

SEQ ID NO: 187965 - DNA, 16 bp, P. troglodytes
aaattttatgttacat

SEQ ID NO: 187966 - DNA, 16 bp, P. troglodytes
aaattttattagaaca

SEQ ID NO: 187967 - DNA, 16 bp, P. troglodytes
aaattttattgaaaca

SEQ ID NO: 187968 - DNA, 16 bp, P. troglodytes
aaattttattgctttt

SEQ ID NO: 187969 - DNA, 16 bp, P. troglodytes
aaattttattgtgaaa

SEQ ID NO: 187970 - DNA, 16 bp, P. troglodytes
aaattttatttctgta

SEQ ID NO: 187971 - DNA, 16 bp, P. troglodytes
aaattttcaaagaaaa

SEQ ID NO: 187972 - DNA, 16 bp, P. troglodytes
aaattttcaaagaaat

SEQ ID NO: 187973 - DNA, 16 bp, P. troglodytes
aaattttcaacattta

SEQ ID NO: 187974 - DNA, 16 bp, P. troglodytes
aaattttcagaaaaga

SEQ ID NO: 187975 - DNA, 16 bp, P. troglodytes
aaattttcagcatttt

SEQ ID NO: 187976 - DNA, 16 bp, P. troglodytes
aaattttcagttttaa

SEQ ID NO: 187977 - DNA, 16 bp, P. troglodytes
aaattttcattgttta

SEQ ID NO: 187978 - DNA, 16 bp, P. troglodytes
aaattttcatttcaaa

SEQ ID NO: 187979 - DNA, 16 bp, P. troglodytes
aaattttccaaatttt

SEQ ID NO: 187980 - DNA, 16 bp, P. troglodytes
aaattttccattaaaa

SEQ ID NO: 187981 - DNA, 16 bp, P. troglodytes
aaattttcccttttta

SEQ ID NO: 187982 - DNA, 16 bp, P. troglodytes
aaattttcctctatcc

SEQ ID NO: 187983 - DNA, 16 bp, P. troglodytes
aaattttcctttaaaa

SEQ ID NO: 187984 - DNA, 16 bp, P. troglodytes
aaattttcctttgttt

SEQ ID NO: 187985 - DNA, 16 bp, P. troglodytes
aaattttctcaaataa

SEQ ID NO: 187986 - DNA, 16 bp, P. troglodytes
aaattttctgaaagaa

SEQ ID NO: 187987 - DNA, 16 bp, P. troglodytes
aaattttctttaaaag

SEQ ID NO: 187988 - DNA, 16 bp, P. troglodytes
aaattttcttttgaaa

SEQ ID NO: 187989 - DNA, 16 bp, P. troglodytes
aaattttctttttcac

SEQ ID NO: 187990 - DNA, 16 bp, P. troglodytes
aaattttgaaaaacat

SEQ ID NO: 187991 - DNA, 16 bp, P. troglodytes
aaattttgaaaattca

SEQ ID NO: 187992 - DNA, 16 bp, P. troglodytes
aaattttgaaacaatt

SEQ ID NO: 187993 - DNA, 16 bp, P. troglodytes
aaattttgaaagcatt

SEQ ID NO: 187994 - DNA, 16 bp, P. troglodytes
aaattttgaaatacat

SEQ ID NO: 187995 - DNA, 16 bp, P. troglodytes
aaattttgaaattttc

SEQ ID NO: 187996 - DNA, 16 bp, P. troglodytes
aaattttgaagacatt

SEQ ID NO: 187997 - DNA, 16 bp, P. troglodytes
aaattttgaatgaaat

SEQ ID NO: 187998 - DNA, 16 bp, P. troglodytes
aaattttgacttaaaa

SEQ ID NO: 187999 - DNA, 16 bp, P. troglodytes
aaattttgagagaaaa

SEQ ID NO: 188000 - DNA, 16 bp, P. troglodytes
aaattttgatgaagtc

SEQ ID NO: 188001 - DNA, 16 bp, P. troglodytes
aaattttgatgaattt

SEQ ID NO: 188002 - DNA, 16 bp, P. troglodytes
aaattttgcaaaatat

SEQ ID NO: 188003 - DNA, 16 bp, P. troglodytes
aaattttgcatgttct

SEQ ID NO: 188004 - DNA, 16 bp, P. troglodytes
aaattttgctaaattt

SEQ ID NO: 188005 - DNA, 16 bp, P. troglodytes
aaattttgcttctaag

SEQ ID NO: 188006 - DNA, 16 bp, P. troglodytes
aaattttggaaaatgt

SEQ ID NO: 188007 - DNA, 16 bp, P. troglodytes
aaattttgtatttctt

SEQ ID NO: 188008 - DNA, 16 bp, P. troglodytes
aaattttgtcatgctg

SEQ ID NO: 188009 - DNA, 16 bp, P. troglodytes
aaattttgttgaaaat

SEQ ID NO: 188010 - DNA, 16 bp, P. troglodytes
aaattttgtttcaaaa

SEQ ID NO: 188011 - DNA, 16 bp, P. troglodytes
aaattttgtttctgtt

SEQ ID NO: 188012 - DNA, 16 bp, P. troglodytes
aaatttttaaaaatcc

SEQ ID NO: 188013 - DNA, 16 bp, P. troglodytes
aaatttttaaagaaac

SEQ ID NO: 188014 - DNA, 16 bp, P. troglodytes
aaatttttaagcattt

SEQ ID NO: 188015 - DNA, 16 bp, P. troglodytes
aaatttttagaaatca

SEQ ID NO: 188016 - DNA, 16 bp, P. troglodytes
aaatttttatagagat

SEQ ID NO: 188017 - DNA, 16 bp, P. troglodytes
aaatttttattggaaa

SEQ ID NO: 188018 - DNA, 16 bp, P. troglodytes
aaatttttcaagaaaa

SEQ ID NO: 188019 - DNA, 16 bp, P. troglodytes
aaatttttccaaataa

SEQ ID NO: 188020 - DNA, 16 bp, P. troglodytes
aaatttttctcagttt

SEQ ID NO: 188021 - DNA, 16 bp, P. troglodytes
aaatttttctgtaaaa

SEQ ID NO: 188022 - DNA, 16 bp, P. troglodytes
aaatttttggtagaat

SEQ ID NO: 188023 - DNA, 16 bp, P. troglodytes
aaatttttgtattttc

SEQ ID NO: 188024 - DNA, 16 bp, P. troglodytes
aaattttttggggggg

SEQ ID NO: 188025 - DNA, 18 bp, P. troglodytes
aaattttttgtagagata

SEQ ID NO: 188026 - DNA, 16 bp, P. troglodytes
aaatttttttaagtga

SEQ ID NO: 188027 - DNA, 16 bp, P. troglodytes
aaatttttttcaaagt

SEQ ID NO: 188028 - DNA, 16 bp, P. troglodytes
aaatttttttctgaat

SEQ ID NO: 188029 - DNA, 16 bp, P. troglodytes
aaatttttttgtaaag

SEQ ID NO: 188030 - DNA, 18 bp, P. troglodytes
aaatttttttgtagagat

SEQ ID NO: 188031 - DNA, 16 bp, P. troglodytes
aacaaaaaccacatga

SEQ ID NO: 188032 - DNA, 16 bp, P. troglodytes
aacaaaaactttattt

SEQ ID NO: 188033 - DNA, 16 bp, P. troglodytes
aacaaaaagaaagctg

SEQ ID NO: 188034 - DNA, 16 bp, P. troglodytes
aacaaaaagaaatctt

SEQ ID NO: 188035 - DNA, 16 bp, P. troglodytes
aacaaaaagaagttta

SEQ ID NO: 188036 - DNA, 16 bp, P. troglodytes
aacaaaaataaatgtt

SEQ ID NO: 188037 - DNA, 16 bp, P. troglodytes
aacaaaaatattttct

SEQ ID NO: 188038 - DNA, 16 bp, P. troglodytes
aacaaaaatgaatttt

SEQ ID NO: 188039 - DNA, 16 bp, P. troglodytes
aacaaaacaaaatttg

SEQ ID NO: 188040 - DNA, 16 bp, P. troglodytes
aacaaaacattttgaa

SEQ ID NO: 188041 - DNA, 16 bp, P. troglodytes
aacaaaaccaaaagtt

SEQ ID NO: 188042 - DNA, 16 bp, P. troglodytes
aacaaaacctctaaga

SEQ ID NO: 188043 - DNA, 16 bp, P. troglodytes
aacaaaacctggatga

SEQ ID NO: 188044 - DNA, 16 bp, P. troglodytes
aacaaaactccgtctc

SEQ ID NO: 188045 - DNA, 16 bp, P. troglodytes
aacaaaactgcacatt

SEQ ID NO: 188046 - DNA, 16 bp, P. troglodytes
aacaaaactggacaga

SEQ ID NO: 188047 - DNA, 16 bp, P. troglodytes
aacaaaactggacgga

SEQ ID NO: 188048 - DNA, 16 bp, P. troglodytes
aacaaaactttattta

SEQ ID NO: 188049 - DNA, 16 bp, P. troglodytes
aacaaaagaaaacttt

SEQ ID NO: 188050 - DNA, 16 bp, P. troglodytes
aacaaaagaaaatttc

SEQ ID NO: 188051 - DNA, 16 bp, P. troglodytes
aacaaaagaaatgtat

SEQ ID NO: 188052 - DNA, 16 bp, P. troglodytes
aacaaaagaaatttta

SEQ ID NO: 188053 - DNA, 16 bp, P. troglodytes
aacaaaagattttaaa

SEQ ID NO: 188054 - DNA, 16 bp, P. troglodytes
aacaaaagccaaattg

SEQ ID NO: 188055 - DNA, 16 bp, P. troglodytes
aacaaaagccaagatt

SEQ ID NO: 188056 - DNA, 18 bp, P. troglodytes
aacaaaagtcaaaattga

SEQ ID NO: 188057 - DNA, 16 bp, P. troglodytes
aacaaaagtgaaactt

SEQ ID NO: 188058 - DNA, 16 bp, P. troglodytes
aacaaaagttgaaaat

SEQ ID NO: 188059 - DNA, 16 bp, P. troglodytes
aacaaaataaaggcca

SEQ ID NO: 188060 - DNA, 16 bp, P. troglodytes
aacaaaataaagtatt

SEQ ID NO: 188061 - DNA, 16 bp, P. troglodytes
aacaaaataaatttga

SEQ ID NO: 188062 - DNA, 16 bp, P. troglodytes
aacaaaatagcccaga

SEQ ID NO: 188063 - DNA, 16 bp, P. troglodytes
aacaaaatattttctg

SEQ ID NO: 188064 - DNA, 16 bp, P. troglodytes
aacaaaatcaatagac

SEQ ID NO: 188065 - DNA, 16 bp, P. troglodytes
aacaaaatcaattttt

SEQ ID NO: 188066 - DNA, 16 bp, P. troglodytes
aacaaaatcacatgat

SEQ ID NO: 188067 - DNA, 16 bp, P. troglodytes
aacaaaatcatgcctt

SEQ ID NO: 188068 - DNA, 16 bp, P. troglodytes
aacaaaatgaaaatgt

SEQ ID NO: 188069 - DNA, 16 bp, P. troglodytes
aacaaaatgaaattat

SEQ ID NO: 188070 - DNA, 16 bp, P. troglodytes
aacaaaatgaaggaca

SEQ ID NO: 188071 - DNA, 16 bp, P. troglodytes
aacaaaatgcattttt

SEQ ID NO: 188072 - DNA, 16 bp, P. troglodytes
aacaaaattattttca

SEQ ID NO: 188073 - DNA, 16 bp, P. troglodytes
aacaaacaaaactttg

SEQ ID NO: 188074 - DNA, 16 bp, P. troglodytes
aacaaacaaacatttt

SEQ ID NO: 188075 - DNA, 16 bp, P. troglodytes
aacaaacacttactga

SEQ ID NO: 188076 - DNA, 16 bp, P. troglodytes
aacaaacatatgaaga

SEQ ID NO: 188077 - DNA, 16 bp, P. troglodytes
aacaaacatttattga

SEQ ID NO: 188078 - DNA, 16 bp, P. troglodytes
aacaaacatttcctga

SEQ ID NO: 188079 - DNA, 16 bp, P. troglodytes
aacaaacctgcacatg

SEQ ID NO: 188080 - DNA, 16 bp, P. troglodytes
aacaaactatggtata

SEQ ID NO: 188081 - DNA, 16 bp, P. troglodytes
aacaaactattttttt

SEQ ID NO: 188082 - DNA, 16 bp, P. troglodytes
aacaaactgaaaaatc

SEQ ID NO: 188083 - DNA, 16 bp, P. troglodytes
aacaaactgaaaacca

SEQ ID NO: 188084 - DNA, 16 bp, P. troglodytes
aacaaactttaaagta

SEQ ID NO: 188085 - DNA, 16 bp, P. troglodytes
aacaaagaaaagccta

SEQ ID NO: 188086 - DNA, 16 bp, P. troglodytes
aacaaagaaaattttt

SEQ ID NO: 188087 - DNA, 16 bp, P. troglodytes
aacaaagaaacactgg

SEQ ID NO: 188088 - DNA, 16 bp, P. troglodytes
aacaaagaaatatatt

SEQ ID NO: 188089 - DNA, 16 bp, P. troglodytes
aacaaagaattaccca

SEQ ID NO: 188090 - DNA, 16 bp, P. troglodytes
aacaaagaattatcca

SEQ ID NO: 188091 - DNA, 16 bp, P. troglodytes
aacaaagaatttagaa

SEQ ID NO: 188092 - DNA, 16 bp, P. troglodytes
aacaaagagagaccct

SEQ ID NO: 188093 - DNA, 17 bp, P. troglodytes
aacaaagatacaacata

SEQ ID NO: 188094 - DNA, 16 bp, P. troglodytes
aacaaagcaagaccct

SEQ ID NO: 188095 - DNA, 16 bp, P. troglodytes
aacaaagcttatctaa

SEQ ID NO: 188096 - DNA, 16 bp, P. troglodytes
aacaaaggcagtttta

SEQ ID NO: 188097 - DNA, 16 bp, P. troglodytes
aacaaagtaccacaaa

SEQ ID NO: 188098 - DNA, 16 bp, P. troglodytes
aacaaagtatcacaga

SEQ ID NO: 188099 - DNA, 16 bp, P. troglodytes
aacaaagtccaggctg

SEQ ID NO: 188100 - DNA, 16 bp, P. troglodytes
aacaaagtcgacaaaa

SEQ ID NO: 188101 - DNA, 17 bp, P. troglodytes
aacaaagtctccaagaa

SEQ ID NO: 188102 - DNA, 16 bp, P. troglodytes
aacaaagtgaagagaa

SEQ ID NO: 188103 - DNA, 16 bp, P. troglodytes
aacaaagtgagacctg

SEQ ID NO: 188104 - DNA, 16 bp, P. troglodytes
aacaaagttcaaaaga

SEQ ID NO: 188105 - DNA, 16 bp, P. troglodytes
aacaaatacttgaaaa

SEQ ID NO: 188106 - DNA, 16 bp, P. troglodytes
aacaaatacttgctga

SEQ ID NO: 188107 - DNA, 16 bp, P. troglodytes
aacaaatattgattga

SEQ ID NO: 188108 - DNA, 16 bp, P. troglodytes
aacaaatatttactta

SEQ ID NO: 188109 - DNA, 16 bp, P. troglodytes
aacaaatatttattga

SEQ ID NO: 188110 - DNA, 16 bp, P. troglodytes
aacaaatatttattgc

SEQ ID NO: 188111 - DNA, 16 bp, P. troglodytes
aacaaatatttcctga

SEQ ID NO: 188112 - DNA, 16 bp, P. troglodytes
aacaaatatttcttca

SEQ ID NO: 188113 - DNA, 16 bp, P. troglodytes
aacaaatatttgatga

SEQ ID NO: 188114 - DNA, 16 bp, P. troglodytes
aacaaatatttgttaa

SEQ ID NO: 188115 - DNA, 16 bp, P. troglodytes
aacaaatattttaaag

SEQ ID NO: 188116 - DNA, 16 bp, P. troglodytes
aacaaatatttttgta

SEQ ID NO: 188117 - DNA, 18 bp, P. troglodytes
aacaaatcacaatggtgg

SEQ ID NO: 188118 - DNA, 16 bp, P. troglodytes
aacaaatccaggagct

SEQ ID NO: 188119 - DNA, 16 bp, P. troglodytes
aacaaatccttgaaat

SEQ ID NO: 188120 - DNA, 16 bp, P. troglodytes
aacaaatctctaggaa

SEQ ID NO: 188121 - DNA, 16 bp, P. troglodytes
aacaaatctctaggag

SEQ ID NO: 188122 - DNA, 16 bp, P. troglodytes
aacaaatgaccacaaa

SEQ ID NO: 188123 - DNA, 16 bp, P. troglodytes
aacaaatgctgacaag

SEQ ID NO: 188124 - DNA, 16 bp, P. troglodytes
aacaaatgcttgttga

SEQ ID NO: 188125 - DNA, 16 bp, P. troglodytes
aacaaatggaaaaatg

SEQ ID NO: 188126 - DNA, 16 bp, P. troglodytes
aacaaatggaaaaatt

SEQ ID NO: 188127 - DNA, 16 bp, P. troglodytes
aacaaatggaaaagca

SEQ ID NO: 188128 - DNA, 16 bp, P. troglodytes
aacaaatggaaaatat

SEQ ID NO: 188129 - DNA, 16 bp, P. troglodytes
aacaaatggaaaggaa

SEQ ID NO: 188130 - DNA, 16 bp, P. troglodytes
aacaaatggaaattct

SEQ ID NO: 188131 - DNA, 16 bp, P. troglodytes
aacaaatgtaaaagta

SEQ ID NO: 188132 - DNA, 16 bp, P. troglodytes
aacaaatgtgtatttt

SEQ ID NO: 188133 - DNA, 16 bp, P. troglodytes
aacaaatgttgatgag

SEQ ID NO: 188134 - DNA, 16 bp, P. troglodytes
aacaaatgtttcttct

SEQ ID NO: 188135 - DNA, 16 bp, P. troglodytes
aacaaatgtttgttaa

SEQ ID NO: 188136 - DNA, 16 bp, P. troglodytes
aacaaattgtggtata

SEQ ID NO: 188137 - DNA, 16 bp, P. troglodytes
aacaaatttagaagaa

SEQ ID NO: 188138 - DNA, 16 bp, P. troglodytes
aacaacaaagatgggg

SEQ ID NO: 188139 - DNA, 16 bp, P. troglodytes
aacaacaacaaactga

SEQ ID NO: 188140 - DNA, 16 bp, P. troglodytes
aacaacaacagaatat

SEQ ID NO: 188141 - DNA, 16 bp, P. troglodytes
aacaacaactcctttc

SEQ ID NO: 188142 - DNA, 16 bp, P. troglodytes
aacaacaatgacaaca

SEQ ID NO: 188143 - DNA, 16 bp, P. troglodytes
aacaacaatttacata

SEQ ID NO: 188144 - DNA, 16 bp, P. troglodytes
aacaacacacactggg

SEQ ID NO: 188145 - DNA, 16 bp, P. troglodytes
aacaacacacagtggg

SEQ ID NO: 188146 - DNA, 16 bp, P. troglodytes
aacaacacacatcagg

SEQ ID NO: 188147 - DNA, 16 bp, P. troglodytes
aacaacagaaatttct

SEQ ID NO: 188148 - DNA, 16 bp, P. troglodytes
aacaacagaaatttgt

SEQ ID NO: 188149 - DNA, 16 bp, P. troglodytes
aacaacagacactggg

SEQ ID NO: 188150 - DNA, 16 bp, P. troglodytes
aacaacagcaacaata

SEQ ID NO: 188151 - DNA, 16 bp, P. troglodytes
aacaacagcagcaata

SEQ ID NO: 188152 - DNA, 16 bp, P. troglodytes
aacaacagcagcatca

SEQ ID NO: 188153 - DNA, 16 bp, P. troglodytes
aacaacagccaagctg

SEQ ID NO: 188154 - DNA, 16 bp, P. troglodytes
aacaacatagatgaaa

SEQ ID NO: 188155 - DNA, 16 bp, P. troglodytes
aacaacatatttttaa

SEQ ID NO: 188156 - DNA, 16 bp, P. troglodytes
aacaacatgaataaat

SEQ ID NO: 188157 - DNA, 16 bp, P. troglodytes
aacaacatgctaaatg

SEQ ID NO: 188158 - DNA, 16 bp, P. troglodytes
aacaacatttcagtca

SEQ ID NO: 188159 - DNA, 16 bp, P. troglodytes
aacaaccagatctccc

SEQ ID NO: 188160 - DNA, 16 bp, P. troglodytes
aacaaccccatcaata

SEQ ID NO: 188161 - DNA, 16 bp, P. troglodytes
aacaaccccatcgaaa

SEQ ID NO: 188162 - DNA, 16 bp, P. troglodytes
aacaaccctgtgagat

SEQ ID NO: 188163 - DNA, 16 bp, P. troglodytes
aacaaccctgtgaggt

SEQ ID NO: 188164 - DNA, 16 bp, P. troglodytes
aacaacctgaatgtcc

SEQ ID NO: 188165 - DNA, 16 bp, P. troglodytes
aacaacctgcccctga

SEQ ID NO: 188166 - DNA, 16 bp, P. troglodytes
aacaactatttattga

SEQ ID NO: 188167 - DNA, 16 bp, P. troglodytes
aacaactcaaatgtcc

SEQ ID NO: 188168 - DNA, 16 bp, P. troglodytes
aacaactctatagaaa

SEQ ID NO: 188169 - DNA, 16 bp, P. troglodytes
aacaactctcaataaa

SEQ ID NO: 188170 - DNA, 16 bp, P. troglodytes
aacaacttagaagaaa

SEQ ID NO: 188171 - DNA, 16 bp, P. troglodytes
aacaacttcagtaaaa

SEQ ID NO: 188172 - DNA, 16 bp, P. troglodytes
aacaacttgaaaaaca

SEQ ID NO: 188173 - DNA, 16 bp, P. troglodytes
aacaactttttgaaaa

SEQ ID NO: 188174 - DNA, 16 bp, P. troglodytes
aacaacttttttcttt

SEQ ID NO: 188175 - DNA, 16 bp, P. troglodytes
aacaagaaatgggaaa

SEQ ID NO: 188176 - DNA, 16 bp, P. troglodytes
aacaagaagccaaatg

SEQ ID NO: 188177 - DNA, 16 bp, P. troglodytes
aacaagaatgaaattc

SEQ ID NO: 188178 - DNA, 16 bp, P. troglodytes
aacaagacagaaaatt

SEQ ID NO: 188179 - DNA, 16 bp, P. troglodytes
aacaagaccctatctc

SEQ ID NO: 188180 - DNA, 16 bp, P. troglodytes
aacaagaccctgtctc

SEQ ID NO: 188181 - DNA, 16 bp, P. troglodytes
aacaagagacatttat

SEQ ID NO: 188182 - DNA, 16 bp, P. troglodytes
aacaagagcaaaaact

SEQ ID NO: 188183 - DNA, 16 bp, P. troglodytes
aacaagagggaaactt

SEQ ID NO: 188184 - DNA, 16 bp, P. troglodytes
aacaagagtcaccttt

SEQ ID NO: 188185 - DNA, 16 bp, P. troglodytes
aacaagagtgacactc

SEQ ID NO: 188186 - DNA, 17 bp, P. troglodytes
aacaagagtgagactcc

SEQ ID NO: 188187 - DNA, 16 bp, P. troglodytes
aacaagatccccagat

SEQ ID NO: 188188 - DNA, 16 bp, P. troglodytes
aacaagatgaattttt

SEQ ID NO: 188189 - DNA, 16 bp, P. troglodytes
aacaagatggaggcct

SEQ ID NO: 188190 - DNA, 16 bp, P. troglodytes
aacaagattctgtctc

SEQ ID NO: 188191 - DNA, 16 bp, P. troglodytes
aacaagcaagcaagca

SEQ ID NO: 188192 - DNA, 16 bp, P. troglodytes
aacaagcaattacaaa

SEQ ID NO: 188193 - DNA, 16 bp, P. troglodytes
aacaagcccttcaggt

SEQ ID NO: 188194 - DNA, 16 bp, P. troglodytes
aacaaggaaactgagg

SEQ ID NO: 188195 - DNA, 16 bp, P. troglodytes
aacaaggacatccagg

SEQ ID NO: 188196 - DNA, 16 bp, P. troglodytes
aacaaggatatgaaaa

SEQ ID NO: 188197 - DNA, 16 bp, P. troglodytes
aacaaggatgccaaga

SEQ ID NO: 188198 - DNA, 18 bp, P. troglodytes
aacaaggcagcattgctg

SEQ ID NO: 188199 - DNA, 16 bp, P. troglodytes
aacaaggtcttgctat

SEQ ID NO: 188200 - DNA, 16 bp, P. troglodytes
aacaagtatttattga

SEQ ID NO: 188201 - DNA, 16 bp, P. troglodytes
aacaagtggaaacaca

SEQ ID NO: 188202 - DNA, 16 bp, P. troglodytes
aacaagtggggagaaa

SEQ ID NO: 188203 - DNA, 16 bp, P. troglodytes
aacaagtgtatgaaaa

SEQ ID NO: 188204 - DNA, 16 bp, P. troglodytes
aacaagtttttaaaaa

SEQ ID NO: 188205 - DNA, 16 bp, P. troglodytes
aacaagttttttgttt

SEQ ID NO: 188206 - DNA, 16 bp, P. troglodytes
aacaataaagtatttt

SEQ ID NO: 188207 - DNA, 16 bp, P. troglodytes
aacaataaagtttgcc

SEQ ID NO: 188208 - DNA, 16 bp, P. troglodytes
aacaataaagtttgct

SEQ ID NO: 188209 - DNA, 16 bp, P. troglodytes
aacaataagcatttat

SEQ ID NO: 188210 - DNA, 16 bp, P. troglodytes
aacaatacacaccagg

SEQ ID NO: 188211 - DNA, 16 bp, P. troglodytes
aacaataggcactggg

SEQ ID NO: 188212 - DNA, 16 bp, P. troglodytes
aacaatatggatggaa

SEQ ID NO: 188213 - DNA, 16 bp, P. troglodytes
aacaatattacagggg

SEQ ID NO: 188214 - DNA, 16 bp, P. troglodytes
aacaatattagttctt

SEQ ID NO: 188215 - DNA, 16 bp, P. troglodytes
aacaatattttgaaaa

SEQ ID NO: 188216 - DNA, 16 bp, P. troglodytes
aacaatcactgcagtt

SEQ ID NO: 188217 - DNA, 17 bp, P. troglodytes
aacaatcatcagagtga

SEQ ID NO: 188218 - DNA, 16 bp, P. troglodytes
aacaatgaatattttt

SEQ ID NO: 188219 - DNA, 16 bp, P. troglodytes
aacaatgacaacaaca

SEQ ID NO: 188220 - DNA, 16 bp, P. troglodytes
aacaatgacaataata

SEQ ID NO: 188221 - DNA, 16 bp, P. troglodytes
aacaatgagaacacaa

SEQ ID NO: 188222 - DNA, 16 bp, P. troglodytes
aacaatgagaacacat

SEQ ID NO: 188223 - DNA, 16 bp, P. troglodytes
aacaatgagaacattt

SEQ ID NO: 188224 - DNA, 16 bp, P. troglodytes
aacaatgatgataata

SEQ ID NO: 188225 - DNA, 16 bp, P. troglodytes
aacaatgcatctgaca

SEQ ID NO: 188226 - DNA, 16 bp, P. troglodytes
aacaatggaataaaac

SEQ ID NO: 188227 - DNA, 16 bp, P. troglodytes
aacaatggggaaaatg

SEQ ID NO: 188228 - DNA, 16 bp, P. troglodytes
aacaatgtaaaagcgt

SEQ ID NO: 188229 - DNA, 16 bp, P. troglodytes
aacaatgtattttata

SEQ ID NO: 188230 - DNA, 16 bp, P. troglodytes
aacaatgtgtattctg

SEQ ID NO: 188231 - DNA, 16 bp, P. troglodytes
aacaatgttcacaaca

SEQ ID NO: 188232 - DNA, 16 bp, P. troglodytes
aacaattaaaagaact

SEQ ID NO: 188233 - DNA, 16 bp, P. troglodytes
aacaattcagtcacat

SEQ ID NO: 188234 - DNA, 16 bp, P. troglodytes
aacaattcagtggcat

SEQ ID NO: 188235 - DNA, 16 bp, P. troglodytes
aacaattgcaacaaaa

SEQ ID NO: 188236 - DNA, 16 bp, P. troglodytes
aacaattgcagaatat

SEQ ID NO: 188237 - DNA, 16 bp, P. troglodytes
aacaatttaacatttt

SEQ ID NO: 188238 - DNA, 16 bp, P. troglodytes
aacaatttgaagaaat

SEQ ID NO: 188239 - DNA, 16 bp, P. troglodytes
aacaatttggcaattt

SEQ ID NO: 188240 - DNA, 16 bp, P. troglodytes
aacaatttgtaagttt

SEQ ID NO: 188241 - DNA, 16 bp, P. troglodytes
aacacaaaaataagcc

SEQ ID NO: 188242 - DNA, 16 bp, P. troglodytes
aacacaaaattagccg

SEQ ID NO: 188243 - DNA, 16 bp, P. troglodytes
aacacaaacacattgt

SEQ ID NO: 188244 - DNA, 16 bp, P. troglodytes
aacacaaagaaacttc

SEQ ID NO: 188245 - DNA, 16 bp, P. troglodytes
aacacaaagaaatgat

SEQ ID NO: 188246 - DNA, 16 bp, P. troglodytes
aacacaaatgaactaa

SEQ ID NO: 188247 - DNA, 16 bp, P. troglodytes
aacacaatcagaaata

SEQ ID NO: 188248 - DNA, 16 bp, P. troglodytes
aacacaatcatgccct

SEQ ID NO: 188249 - DNA, 16 bp, P. troglodytes
aacacaatggcaagta

SEQ ID NO: 188250 - DNA, 16 bp, P. troglodytes
aacacaatggtatttg

SEQ ID NO: 188251 - DNA, 16 bp, P. troglodytes
aacacaattccattta

SEQ ID NO: 188252 - DNA, 16 bp, P. troglodytes
aacacaattctaaata

SEQ ID NO: 188253 - DNA, 16 bp, P. troglodytes
aacacacatatgcaca

SEQ ID NO: 188254 - DNA, 16 bp, P. troglodytes
aacacacatgtacaca

SEQ ID NO: 188255 - DNA, 16 bp, P. troglodytes
aacacacattcaggtg

SEQ ID NO: 188256 - DNA, 16 bp, P. troglodytes
aacacacatttattat

SEQ ID NO: 188257 - DNA, 16 bp, P. troglodytes
aacacaccaatcagct

SEQ ID NO: 188258 - DNA, 16 bp, P. troglodytes
aacacacgtgcacaca

SEQ ID NO: 188259 - DNA, 16 bp, P. troglodytes
aacacactttgagaaa

SEQ ID NO: 188260 - DNA, 16 bp, P. troglodytes
aacacagaaaaattag

SEQ ID NO: 188261 - DNA, 16 bp, P. troglodytes
aacacagaaataaatt

SEQ ID NO: 188262 - DNA, 16 bp, P. troglodytes
aacacagaatgtcttt

SEQ ID NO: 188263 - DNA, 16 bp, P. troglodytes
aacacagacacaacat

SEQ ID NO: 188264 - DNA, 16 bp, P. troglodytes
aacacagagaaaatat

SEQ ID NO: 188265 - DNA, 16 bp, P. troglodytes
aacacagagaaagaat

SEQ ID NO: 188266 - DNA, 16 bp, P. troglodytes
aacacagagaagaaat

SEQ ID NO: 188267 - DNA, 16 bp, P. troglodytes
aacacagagaaggaat

SEQ ID NO: 188268 - DNA, 16 bp, P. troglodytes
aacacagcaagaccct

SEQ ID NO: 188269 - DNA, 16 bp, P. troglodytes
aacacagcaagactgt

SEQ ID NO: 188270 - DNA, 16 bp, P. troglodytes
aacacagccatgccca

SEQ ID NO: 188271 - DNA, 16 bp, P. troglodytes
aacacagctctgcacc

SEQ ID NO: 188272 - DNA, 16 bp, P. troglodytes
aacacagtgaaaaccc

SEQ ID NO: 188273 - DNA, 16 bp, P. troglodytes
aacacagtgcctggca

SEQ ID NO: 188274 - DNA, 16 bp, P. troglodytes
aacacagtgtctggca

SEQ ID NO: 188275 - DNA, 16 bp, P. troglodytes
aacacatgaattttag

SEQ ID NO: 188276 - DNA, 16 bp, P. troglodytes
aacacatgaattttgg

SEQ ID NO: 188277 - DNA, 16 bp, P. troglodytes
aacacatgagaattca

SEQ ID NO: 188278 - DNA, 16 bp, P. troglodytes
aacacatgctggagag

SEQ ID NO: 188279 - DNA, 16 bp, P. troglodytes
aacacattaaaaatgt

SEQ ID NO: 188280 - DNA, 16 bp, P. troglodytes
aacacattattttctt

SEQ ID NO: 188281 - DNA, 16 bp, P. troglodytes
aacacattcttttttt

SEQ ID NO: 188282 - DNA, 16 bp, P. troglodytes
aacacatttattgatt

SEQ ID NO: 188283 - DNA, 16 bp, P. troglodytes
aacacatttcactttt

SEQ ID NO: 188284 - DNA, 16 bp, P. troglodytes
aacacattttatattt

SEQ ID NO: 188285 - DNA, 16 bp, P. troglodytes
aacacatttttcttct

SEQ ID NO: 188286 - DNA, 16 bp, P. troglodytes
aacacatttttgccaa

SEQ ID NO: 188287 - DNA, 16 bp, P. troglodytes
aacaccaaaagaaatg

SEQ ID NO: 188288 - DNA, 16 bp, P. troglodytes
aacaccaaaagcatga

SEQ ID NO: 188289 - DNA, 16 bp, P. troglodytes
aacaccacatggaagc

SEQ ID NO: 188290 - DNA, 16 bp, P. troglodytes
aacaccagaaattatt

SEQ ID NO: 188291 - DNA, 16 bp, P. troglodytes
aacaccatcaccatca

SEQ ID NO: 188292 - DNA, 16 bp, P. troglodytes
aacaccatgcccggct

SEQ ID NO: 188293 - DNA, 16 bp, P. troglodytes
aacaccatggaatact

SEQ ID NO: 188294 - DNA, 16 bp, P. troglodytes
aacacccactgtcaat

SEQ ID NO: 188295 - DNA, 16 bp, P. troglodytes
aacaccccactctcag

SEQ ID NO: 188296 - DNA, 16 bp, P. troglodytes
aacaccctcacagaca

SEQ ID NO: 188297 - DNA, 16 bp, P. troglodytes
aacacctacctcacag

SEQ ID NO: 188298 - DNA, 16 bp, P. troglodytes
aacacctcccaccagg

SEQ ID NO: 188299 - DNA, 16 bp, P. troglodytes
aacacctggcctgccc

SEQ ID NO: 188300 - DNA, 16 bp, P. troglodytes
aacacctgggcttaag

SEQ ID NO: 188301 - DNA, 16 bp, P. troglodytes
aacacctttacatgca

SEQ ID NO: 188302 - DNA, 16 bp, P. troglodytes
aacacgaggtcaggag

SEQ ID NO: 188303 - DNA, 19 bp, P. troglodytes
aacacggtgaaaccccatc

SEQ ID NO: 188304 - DNA, 16 bp, P. troglodytes
aacactaaaacttatt

SEQ ID NO: 188305 - DNA, 16 bp, P. troglodytes
aacactaaacagacta

SEQ ID NO: 188306 - DNA, 16 bp, P. troglodytes
aacactaatgatagct

SEQ ID NO: 188307 - DNA, 16 bp, P. troglodytes
aacactaatttttaaa

SEQ ID NO: 188308 - DNA, 16 bp, P. troglodytes
aacactagaacttatt

SEQ ID NO: 188309 - DNA, 16 bp, P. troglodytes
aacactatttttgtag

SEQ ID NO: 188310 - DNA, 16 bp, P. troglodytes
aacactgaaaatattt

SEQ ID NO: 188311 - DNA, 16 bp, P. troglodytes
aacactgatgcaagaa

SEQ ID NO: 188312 - DNA, 16 bp, P. troglodytes
aacactgctctaaaaa

SEQ ID NO: 188313 - DNA, 16 bp, P. troglodytes
aacactgctgctgggg

SEQ ID NO: 188314 - DNA, 16 bp, P. troglodytes
aacactgcttcatgct

SEQ ID NO: 188315 - DNA, 16 bp, P. troglodytes
aacactggaacaccca

SEQ ID NO: 188316 - DNA, 16 bp, P. troglodytes
aacactggaacagaaa

SEQ ID NO: 188317 - DNA, 16 bp, P. troglodytes
aacactgtgaatgtaa

SEQ ID NO: 188318 - DNA, 16 bp, P. troglodytes
aacactgtttattgaa

SEQ ID NO: 188319 - DNA, 16 bp, P. troglodytes
aacactgttttagctg

SEQ ID NO: 188320 - DNA, 16 bp, P. troglodytes
aacacttaaagaagaa

SEQ ID NO: 188321 - DNA, 16 bp, P. troglodytes
aacacttaataaactc

SEQ ID NO: 188322 - DNA, 16 bp, P. troglodytes
aacacttagcttaaaa

SEQ ID NO: 188323 - DNA, 17 bp, P. troglodytes
aacacttctacactgct

SEQ ID NO: 188324 - DNA, 16 bp, P. troglodytes
aacacttctggtccca

SEQ ID NO: 188325 - DNA, 16 bp, P. troglodytes
aacacttgaaatatgg

SEQ ID NO: 188326 - DNA, 16 bp, P. troglodytes
aacacttgttattttc

SEQ ID NO: 188327 - DNA, 16 bp, P. troglodytes
aacactttaaatatgt

SEQ ID NO: 188328 - DNA, 16 bp, P. troglodytes
aacacttttttaaaaa

SEQ ID NO: 188329 - DNA, 16 bp, P. troglodytes
aacagaaaaccacata

SEQ ID NO: 188330 - DNA, 16 bp, P. troglodytes
aacagaaaacctacag

SEQ ID NO: 188331 - DNA, 16 bp, P. troglodytes
aacagaaaaggtacag

SEQ ID NO: 188332 - DNA, 16 bp, P. troglodytes
aacagaaaattcagaa

SEQ ID NO: 188333 - DNA, 16 bp, P. troglodytes
aacagaaacacagtct

SEQ ID NO: 188334 - DNA, 16 bp, P. troglodytes
aacagaaagaaggcca

SEQ ID NO: 188335 - DNA, 16 bp, P. troglodytes
aacagaaatatatttt

SEQ ID NO: 188336 - DNA, 16 bp, P. troglodytes
aacagaaattctggag

SEQ ID NO: 188337 - DNA, 16 bp, P. troglodytes
aacagaaatttgtttt

SEQ ID NO: 188338 - DNA, 16 bp, P. troglodytes
aacagaacaagatcct

SEQ ID NO: 188339 - DNA, 16 bp, P. troglodytes
aacagaacagagactt

SEQ ID NO: 188340 - DNA, 16 bp, P. troglodytes
aacagaacaggggcct

SEQ ID NO: 188341 - DNA, 18 bp, P. troglodytes
aacagaaccaaagataaa

SEQ ID NO: 188342 - DNA, 16 bp, P. troglodytes
aacagaagaaaatatt

SEQ ID NO: 188343 - DNA, 16 bp, P. troglodytes
aacagaagaaaatgtt

SEQ ID NO: 188344 - DNA, 16 bp, P. troglodytes
aacagaagacaaaatt

SEQ ID NO: 188345 - DNA, 16 bp, P. troglodytes
aacagaagatgaaaca

SEQ ID NO: 188346 - DNA, 16 bp, P. troglodytes
aacagaagctcagaga

SEQ ID NO: 188347 - DNA, 16 bp, P. troglodytes
aacagaagttttaaaa

SEQ ID NO: 188348 - DNA, 16 bp, P. troglodytes
aacagaataaaggaga

SEQ ID NO: 188349 - DNA, 16 bp, P. troglodytes
aacagaataccataga

SEQ ID NO: 188350 - DNA, 16 bp, P. troglodytes
aacagaatatgcattc

SEQ ID NO: 188351 - DNA, 16 bp, P. troglodytes
aacagaatatggcaaa

SEQ ID NO: 188352 - DNA, 16 bp, P. troglodytes
aacagaatgaaataat

SEQ ID NO: 188353 - DNA, 16 bp, P. troglodytes
aacagaatgaagaaca

SEQ ID NO: 188354 - DNA, 16 bp, P. troglodytes
aacagaatgagacctt

SEQ ID NO: 188355 - DNA, 16 bp, P. troglodytes
aacagaatggaatgga

SEQ ID NO: 188356 - DNA, 16 bp, P. troglodytes
aacagaattaaaaacc

SEQ ID NO: 188357 - DNA, 16 bp, P. troglodytes
aacagaattaaagaca

SEQ ID NO: 188358 - DNA, 16 bp, P. troglodytes
aacagaattatttgac

SEQ ID NO: 188359 - DNA, 16 bp, P. troglodytes
aacagacatgtacaga

SEQ ID NO: 188360 - DNA, 16 bp, P. troglodytes
aacagacatttacaaa

SEQ ID NO: 188361 - DNA, 16 bp, P. troglodytes
aacagacatttctcca

SEQ ID NO: 188362 - DNA, 16 bp, P. troglodytes
aacagaccaataagaa

SEQ ID NO: 188363 - DNA, 16 bp, P. troglodytes
aacagacctaagaaat

SEQ ID NO: 188364 - DNA, 16 bp, P. troglodytes
aacagagaaatgcaaa

SEQ ID NO: 188365 - DNA, 16 bp, P. troglodytes
aacagagaactttcca

SEQ ID NO: 188366 - DNA, 16 bp, P. troglodytes
aacagagaagtgacag

SEQ ID NO: 188367 - DNA, 16 bp, P. troglodytes
aacagagaccccatct

SEQ ID NO: 188368 - DNA, 17 bp, P. troglodytes
aacagagacctcagaaa

SEQ ID NO: 188369 - DNA, 16 bp, P. troglodytes
aacagagagaaaccct

SEQ ID NO: 188370 - DNA, 16 bp, P. troglodytes
aacagagagaaactcc

SEQ ID NO: 188371 - DNA, 16 bp, P. troglodytes
aacagagatgcaaaaa

SEQ ID NO: 188372 - DNA, 16 bp, P. troglodytes
aacagagatttttaaa

SEQ ID NO: 188373 - DNA, 18 bp, P. troglodytes
aacagagcaaaactccgt

SEQ ID NO: 188374 - DNA, 21 bp, P. troglodytes
aacagagcaagaccctgtctt

SEQ ID NO: 188375 - DNA, 16 bp, P. troglodytes
aacagagcaagactcc

SEQ ID NO: 188376 - DNA, 17 bp, P. troglodytes
aacagagcaagactcta

SEQ ID NO: 188377 - DNA, 16 bp, P. troglodytes
aacagagccagactct

SEQ ID NO: 188378 - DNA, 18 bp, P. troglodytes
aacagagcgagacactgt

SEQ ID NO: 188379 - DNA, 16 bp, P. troglodytes
aacagagcgagactca

SEQ ID NO: 188380 - DNA, 16 bp, P. troglodytes
aacagagcgagactcc

SEQ ID NO: 188381 - DNA, 16 bp, P. troglodytes
aacagagcgagattcc

SEQ ID NO: 188382 - DNA, 16 bp, P. troglodytes
aacagaggagaccctg

SEQ ID NO: 188383 - DNA, 16 bp, P. troglodytes
aacagaggatactaga

SEQ ID NO: 188384 - DNA, 16 bp, P. troglodytes
aacagaggcccagaga

SEQ ID NO: 188385 - DNA, 16 bp, P. troglodytes
aacagaggccccagaa

SEQ ID NO: 188386 - DNA, 20 bp, P. troglodytes
aacagaggcctcagaaataa

SEQ ID NO: 188387 - DNA, 16 bp, P. troglodytes
aacagaggctgcagaa

SEQ ID NO: 188388 - DNA, 16 bp, P. troglodytes
aacagagtaaacaaac

SEQ ID NO: 188389 - DNA, 16 bp, P. troglodytes
aacagagtaagacccc

SEQ ID NO: 188390 - DNA, 16 bp, P. troglodytes
aacagagtaagactcc

SEQ ID NO: 188391 - DNA, 16 bp, P. troglodytes
aacagagtagatttta

SEQ ID NO: 188392 - DNA, 16 bp, P. troglodytes
aacagagtctcactat

SEQ ID NO: 188393 - DNA, 16 bp, P. troglodytes
aacagagtgagacccc

SEQ ID NO: 188394 - DNA, 16 bp, P. troglodytes
aacagagtgagactcc

SEQ ID NO: 188395 - DNA, 18 bp, P. troglodytes
aacagagtgagactctgc

SEQ ID NO: 188396 - DNA, 17 bp, P. troglodytes
aacagagtgagactgtg

SEQ ID NO: 188397 - DNA, 16 bp, P. troglodytes
aacagagtgttggaag

SEQ ID NO: 188398 - DNA, 16 bp, P. troglodytes
aacagataaatggatt

SEQ ID NO: 188399 - DNA, 16 bp, P. troglodytes
aacagataataataat

SEQ ID NO: 188400 - DNA, 16 bp, P. troglodytes
aacagatatatacaaa

SEQ ID NO: 188401 - DNA, 16 bp, P. troglodytes
aacagatatttattga

SEQ ID NO: 188402 - DNA, 16 bp, P. troglodytes
aacagatatttgtaca

SEQ ID NO: 188403 - DNA, 16 bp, P. troglodytes
aacagatcaagaccct

SEQ ID NO: 188404 - DNA, 16 bp, P. troglodytes
aacagatgaaaagata

SEQ ID NO: 188405 - DNA, 16 bp, P. troglodytes
aacagatgagaaaaca

SEQ ID NO: 188406 - DNA, 16 bp, P. troglodytes
aacagatgagaaaatg

SEQ ID NO: 188407 - DNA, 16 bp, P. troglodytes
aacagatgaggaagaa

SEQ ID NO: 188408 - DNA, 16 bp, P. troglodytes
aacagatgaggagttg

SEQ ID NO: 188409 - DNA, 16 bp, P. troglodytes
aacagatgaggatgaa

SEQ ID NO: 188410 - DNA, 17 bp, P. troglodytes
aacagatgctggagaag

SEQ ID NO: 188411 - DNA, 16 bp, P. troglodytes
aacagatgctggtgag

SEQ ID NO: 188412 - DNA, 16 bp, P. troglodytes
aacagatgtgtgtgtg

SEQ ID NO: 188413 - DNA, 16 bp, P. troglodytes
aacagattctgaaatt

SEQ ID NO: 188414 - DNA, 16 bp, P. troglodytes
aacagattttaaatca

SEQ ID NO: 188415 - DNA, 16 bp, P. troglodytes
aacagatttttaatgt

SEQ ID NO: 188416 - DNA, 16 bp, P. troglodytes
aacagatttttgtttt

SEQ ID NO: 188417 - DNA, 16 bp, P. troglodytes
aacagcaaaagaaact

SEQ ID NO: 188418 - DNA, 16 bp, P. troglodytes
aacagcaaagatggca

SEQ ID NO: 188419 - DNA, 16 bp, P. troglodytes
aacagcaaaggcaaag

SEQ ID NO: 188420 - DNA, 16 bp, P. troglodytes
aacagcaaataatttt

SEQ ID NO: 188421 - DNA, 16 bp, P. troglodytes
aacagcaaccaagctg

SEQ ID NO: 188422 - DNA, 16 bp, P. troglodytes
aacagcaactccaaga

SEQ ID NO: 188423 - DNA, 16 bp, P. troglodytes
aacagcacaaacaata

SEQ ID NO: 188424 - DNA, 16 bp, P. troglodytes
aacagcagaatacaca

SEQ ID NO: 188425 - DNA, 16 bp, P. troglodytes
aacagcagagctggga

SEQ ID NO: 188426 - DNA, 16 bp, P. troglodytes
aacagcagatctctct

SEQ ID NO: 188427 - DNA, 16 bp, P. troglodytes
aacagcaggctattag

SEQ ID NO: 188428 - DNA, 16 bp, P. troglodytes
aacagcatatgcaaag

SEQ ID NO: 188429 - DNA, 16 bp, P. troglodytes
aacagcatggagaaaa

SEQ ID NO: 188430 - DNA, 16 bp, P. troglodytes
aacagcatgggaaagg

SEQ ID NO: 188431 - DNA, 16 bp, P. troglodytes
aacagcatggtaccag

SEQ ID NO: 188432 - DNA, 16 bp, P. troglodytes
aacagcatgtgcaaag

SEQ ID NO: 188433 - DNA, 16 bp, P. troglodytes
aacagccaaatggaag

SEQ ID NO: 188434 - DNA, 16 bp, P. troglodytes
aacagccagatgaaga

SEQ ID NO: 188435 - DNA, 16 bp, P. troglodytes
aacagcccaccacaga

SEQ ID NO: 188436 - DNA, 16 bp, P. troglodytes
aacagcccaggaaaga

SEQ ID NO: 188437 - DNA, 16 bp, P. troglodytes
aacagccctttcccaa

SEQ ID NO: 188438 - DNA, 16 bp, P. troglodytes
aacagccctttcctga

SEQ ID NO: 188439 - DNA, 16 bp, P. troglodytes
aacagcctcacagaca

SEQ ID NO: 188440 - DNA, 16 bp, P. troglodytes
aacagcctcaggcaag

SEQ ID NO: 188441 - DNA, 16 bp, P. troglodytes
aacagcctcaggcagg

SEQ ID NO: 188442 - DNA, 16 bp, P. troglodytes
aacagcctgaaaaatc

SEQ ID NO: 188443 - DNA, 16 bp, P. troglodytes
aacagcctgctcctga

SEQ ID NO: 188444 - DNA, 16 bp, P. troglodytes
aacagccttcccaaaa

SEQ ID NO: 188445 - DNA, 16 bp, P. troglodytes
aacagcgagaccctgt

SEQ ID NO: 188446 - DNA, 18 bp, P. troglodytes
aacagcgagactccatct

SEQ ID NO: 188447 - DNA, 16 bp, P. troglodytes
aacagcgtgagactct

SEQ ID NO: 188448 - DNA, 16 bp, P. troglodytes
aacagctcagagaaga

SEQ ID NO: 188449 - DNA, 16 bp, P. troglodytes
aacagctcagaggaga

SEQ ID NO: 188450 - DNA, 16 bp, P. troglodytes
aacagctcctggattt

SEQ ID NO: 188451 - DNA, 16 bp, P. troglodytes
aacagctcgtgtcctc

SEQ ID NO: 188452 - DNA, 16 bp, P. troglodytes
aacagctctcagcaga

SEQ ID NO: 188453 - DNA, 16 bp, P. troglodytes
aacagctgacatttat

SEQ ID NO: 188454 - DNA, 16 bp, P. troglodytes
aacagctgcaaaaaat

SEQ ID NO: 188455 - DNA, 16 bp, P. troglodytes
aacagctgctggagag

SEQ ID NO: 188456 - DNA, 16 bp, P. troglodytes
aacagctgtgtgacct

SEQ ID NO: 188457 - DNA, 16 bp, P. troglodytes
aacagcttgggggaaa

SEQ ID NO: 188458 - DNA, 16 bp, P. troglodytes
aacagctttatggaga

SEQ ID NO: 188459 - DNA, 16 bp, P. troglodytes
aacaggaaatattttt

SEQ ID NO: 188460 - DNA, 16 bp, P. troglodytes
aacaggaacaatttga

SEQ ID NO: 188461 - DNA, 16 bp, P. troglodytes
aacaggaatatgaaaa

SEQ ID NO: 188462 - DNA, 16 bp, P. troglodytes
aacaggaatgcctgtt

SEQ ID NO: 188463 - DNA, 16 bp, P. troglodytes
aacaggagaaaatatt

SEQ ID NO: 188464 - DNA, 16 bp, P. troglodytes
aacaggagacagggaa

SEQ ID NO: 188465 - DNA, 16 bp, P. troglodytes
aacaggatgatgctgg

SEQ ID NO: 188466 - DNA, 16 bp, P. troglodytes
aacaggatttgctgat

SEQ ID NO: 188467 - DNA, 32 bp, P. troglodytes
aacaggcaacctacaaaatgggagaaaatttt

SEQ ID NO: 188468 - DNA, 17 bp, P. troglodytes
aacaggcagaggctgga

SEQ ID NO: 188469 - DNA, 16 bp, P. troglodytes
aacaggcagagtttgg

SEQ ID NO: 188470 - DNA, 16 bp, P. troglodytes
aacaggccctggggtg

SEQ ID NO: 188471 - DNA, 16 bp, P. troglodytes
aacaggctcagagagg

SEQ ID NO: 188472 - DNA, 20 bp, P. troglodytes
aacaggctttgtgtgagcaa

SEQ ID NO: 188473 - DNA, 16 bp, P. troglodytes
aacaggggatttaaat

SEQ ID NO: 188474 - DNA, 16 bp, P. troglodytes
aacagggtctggagta

SEQ ID NO: 188475 - DNA, 16 bp, P. troglodytes
aacagggtgaaaccct

SEQ ID NO: 188476 - DNA, 16 bp, P. troglodytes
aacagggtgaaactct

SEQ ID NO: 188477 - DNA, 16 bp, P. troglodytes
aacaggtaatttttca

SEQ ID NO: 188478 - DNA, 16 bp, P. troglodytes
aacaggttttcaccat

SEQ ID NO: 188479 - DNA, 16 bp, P. troglodytes
aacagtacattaaaaa

SEQ ID NO: 188480 - DNA, 16 bp, P. troglodytes
aacagtattaagaagt

SEQ ID NO: 188481 - DNA, 16 bp, P. troglodytes
aacagtattttaaatt

SEQ ID NO: 188482 - DNA, 16 bp, P. troglodytes
aacagtcactggggca

SEQ ID NO: 188483 - DNA, 16 bp, P. troglodytes
aacagtccccagaatg

SEQ ID NO: 188484 - DNA, 17 bp, P. troglodytes
aacagtctctcagacca

SEQ ID NO: 188485 - DNA, 16 bp, P. troglodytes
aacagtctggcagttc

SEQ ID NO: 188486 - DNA, 16 bp, P. troglodytes
aacagtgaaaagttga

SEQ ID NO: 188487 - DNA, 16 bp, P. troglodytes
aacagtgaaacagcaa

SEQ ID NO: 188488 - DNA, 16 bp, P. troglodytes
aacagtgaaactctgt

SEQ ID NO: 188489 - DNA, 16 bp, P. troglodytes
aacagtgacaatttga

SEQ ID NO: 188490 - DNA, 16 bp, P. troglodytes
aacagtgagtccatta

SEQ ID NO: 188491 - DNA, 16 bp, P. troglodytes
aacagtgatgaaagtg

SEQ ID NO: 188492 - DNA, 16 bp, P. troglodytes
aacagtgatgatgagc

SEQ ID NO: 188493 - DNA, 16 bp, P. troglodytes
aacagtgcacaagggt

SEQ ID NO: 188494 - DNA, 16 bp, P. troglodytes
aacagtgcctggtaca

SEQ ID NO: 188495 - DNA, 17 bp, P. troglodytes
aacagtgctgcaataaa

SEQ ID NO: 188496 - DNA, 16 bp, P. troglodytes
aacagtgctgctgtga

SEQ ID NO: 188497 - DNA, 16 bp, P. troglodytes
aacagtggatttctca

SEQ ID NO: 188498 - DNA, 16 bp, P. troglodytes
aacagtggttcttaaa

SEQ ID NO: 188499 - DNA, 20 bp, P. troglodytes
aacagtgtaaaagcattcct

SEQ ID NO: 188500 - DNA, 16 bp, P. troglodytes
aacagtgttttaaaaa

SEQ ID NO: 188501 - DNA, 16 bp, P. troglodytes
aacagtgttttatagt

SEQ ID NO: 188502 - DNA, 16 bp, P. troglodytes
aacagttatttaaaaa

SEQ ID NO: 188503 - DNA, 16 bp, P. troglodytes
aacagttattttgaat

SEQ ID NO: 188504 - DNA, 16 bp, P. troglodytes
aacagttctttatata

SEQ ID NO: 188505 - DNA, 16 bp, P. troglodytes
aacagttgttattttt

SEQ ID NO: 188506 - DNA, 16 bp, P. troglodytes
aacagtttatttttct

SEQ ID NO: 188507 - DNA, 16 bp, P. troglodytes
aacagtttgatttcct

SEQ ID NO: 188508 - DNA, 16 bp, P. troglodytes
aacagtttttctttca

SEQ ID NO: 188509 - DNA, 16 bp, P. troglodytes
aacagtttttgttttt

SEQ ID NO: 188510 - DNA, 16 bp, P. troglodytes
aacagttttttctaat

SEQ ID NO: 188511 - DNA, 16 bp, P. troglodytes
aacataaaatatatgt

SEQ ID NO: 188512 - DNA, 16 bp, P. troglodytes
aacataaaatgtttat

SEQ ID NO: 188513 - DNA, 16 bp, P. troglodytes
aacataaacattttta

SEQ ID NO: 188514 - DNA, 16 bp, P. troglodytes
aacataaatattttct

SEQ ID NO: 188515 - DNA, 16 bp, P. troglodytes
aacataaatgaatttc

SEQ ID NO: 188516 - DNA, 16 bp, P. troglodytes
aacataaatgtattat

SEQ ID NO: 188517 - DNA, 23 bp, P. troglodytes
aacataaattgtgaagatttcat

SEQ ID NO: 188518 - DNA, 16 bp, P. troglodytes
aacataaatttgaaaa

SEQ ID NO: 188519 - DNA, 16 bp, P. troglodytes
aacataagacctgaaa

SEQ ID NO: 188520 - DNA, 16 bp, P. troglodytes
aacataagtttatttt

SEQ ID NO: 188521 - DNA, 16 bp, P. troglodytes
aacataatgatttcca

SEQ ID NO: 188522 - DNA, 16 bp, P. troglodytes
aacatacactggggaa

SEQ ID NO: 188523 - DNA, 16 bp, P. troglodytes
aacatacagtaaaatt

SEQ ID NO: 188524 - DNA, 16 bp, P. troglodytes
aacatacatgtaaaaa

SEQ ID NO: 188525 - DNA, 16 bp, P. troglodytes
aacataccaggaaagc

SEQ ID NO: 188526 - DNA, 16 bp, P. troglodytes
aacataccatgtttgg

SEQ ID NO: 188527 - DNA, 16 bp, P. troglodytes
aacatagaaaaggcac

SEQ ID NO: 188528 - DNA, 16 bp, P. troglodytes
aacatagaatatcttt

SEQ ID NO: 188529 - DNA, 16 bp, P. troglodytes
aacatagataaatctt

SEQ ID NO: 188530 - DNA, 16 bp, P. troglodytes
aacatagatgaaaaat

SEQ ID NO: 188531 - DNA, 16 bp, P. troglodytes
aacatagatgaacctt

SEQ ID NO: 188532 - DNA, 17 bp, P. troglodytes
aacatagcaagacccct

SEQ ID NO: 188533 - DNA, 16 bp, P. troglodytes
aacatagcaagactgc

SEQ ID NO: 188534 - DNA, 16 bp, P. troglodytes
aacatagcgagaccct

SEQ ID NO: 188535 - DNA, 17 bp, P. troglodytes
aacatagggagacccca

SEQ ID NO: 188536 - DNA, 16 bp, P. troglodytes
aacatagtaagacccc

SEQ ID NO: 188537 - DNA, 16 bp, P. troglodytes
aacatagtgagacctg

SEQ ID NO: 188538 - DNA, 16 bp, P. troglodytes
aacatagtgaggcctc

SEQ ID NO: 188539 - DNA, 16 bp, P. troglodytes
aacatagtttattttt

SEQ ID NO: 188540 - DNA, 16 bp, P. troglodytes
aacatatatatacaca

SEQ ID NO: 188541 - DNA, 16 bp, P. troglodytes
aacatatatgtgtgta

SEQ ID NO: 188542 - DNA, 16 bp, P. troglodytes
aacatatgaatttgga

SEQ ID NO: 188543 - DNA, 16 bp, P. troglodytes
aacatatgatatttgt

SEQ ID NO: 188544 - DNA, 16 bp, P. troglodytes
aacatatggaaaaata

SEQ ID NO: 188545 - DNA, 16 bp, P. troglodytes
aacatatggtatttga

SEQ ID NO: 188546 - DNA, 16 bp, P. troglodytes
aacatatggtatttgt

SEQ ID NO: 188547 - DNA, 16 bp, P. troglodytes
aacatatgtctacaca

SEQ ID NO: 188548 - DNA, 16 bp, P. troglodytes
aacatattcacaggtt

SEQ ID NO: 188549 - DNA, 16 bp, P. troglodytes
aacatattcctcattt

SEQ ID NO: 188550 - DNA, 16 bp, P. troglodytes
aacatattgtatattt

SEQ ID NO: 188551 - DNA, 16 bp, P. troglodytes
aacatatttaaagaaa

SEQ ID NO: 188552 - DNA, 16 bp, P. troglodytes
aacatatttgaaaaat

SEQ ID NO: 188553 - DNA, 16 bp, P. troglodytes
aacatatttgagaata

SEQ ID NO: 188554 - DNA, 16 bp, P. troglodytes
aacatattttgaaaac

SEQ ID NO: 188555 - DNA, 16 bp, P. troglodytes
aacatatttttttctc

SEQ ID NO: 188556 - DNA, 16 bp, P. troglodytes
aacatcaaagatcaca

SEQ ID NO: 188557 - DNA, 16 bp, P. troglodytes
aacatcaacaatgcat

SEQ ID NO: 188558 - DNA, 16 bp, P. troglodytes
aacatcacaattcaaa

SEQ ID NO: 188559 - DNA, 16 bp, P. troglodytes
aacatcacacacaagg

SEQ ID NO: 188560 - DNA, 16 bp, P. troglodytes
aacatcacacactgag

SEQ ID NO: 188561 - DNA, 16 bp, P. troglodytes
aacatcactaatgatc

SEQ ID NO: 188562 - DNA, 16 bp, P. troglodytes
aacatcactgataatt

SEQ ID NO: 188563 - DNA, 16 bp, P. troglodytes
aacatcagaaggaaaa

SEQ ID NO: 188564 - DNA, 21 bp, P. troglodytes
aacatcagaaggaacaaactc

SEQ ID NO: 188565 - DNA, 16 bp, P. troglodytes
aacatcagacagatca

SEQ ID NO: 188566 - DNA, 16 bp, P. troglodytes
aacatcagcatcacct

SEQ ID NO: 188567 - DNA, 16 bp, P. troglodytes
aacatcagctcagagc

SEQ ID NO: 188568 - DNA, 16 bp, P. troglodytes
aacatcagctcttcct

SEQ ID NO: 188569 - DNA, 16 bp, P. troglodytes
aacatcatagagtata

SEQ ID NO: 188570 - DNA, 16 bp, P. troglodytes
aacatcatagagtgtg

SEQ ID NO: 188571 - DNA, 16 bp, P. troglodytes
aacatcatagcttagc

SEQ ID NO: 188572 - DNA, 16 bp, P. troglodytes
aacatcatcattatta

SEQ ID NO: 188573 - DNA, 16 bp, P. troglodytes
aacatcatgaaaccct

SEQ ID NO: 188574 - DNA, 16 bp, P. troglodytes
aacatcatttttcata

SEQ ID NO: 188575 - DNA, 16 bp, P. troglodytes
aacatcccactgtcaa

SEQ ID NO: 188576 - DNA, 16 bp, P. troglodytes
aacatcctacctgtga

SEQ ID NO: 188577 - DNA, 16 bp, P. troglodytes
aacatccttgtacata

SEQ ID NO: 188578 - DNA, 16 bp, P. troglodytes
aacatcctttataata

SEQ ID NO: 188579 - DNA, 16 bp, P. troglodytes
aacatctagaagaaat

SEQ ID NO: 188580 - DNA, 16 bp, P. troglodytes
aacatctcaccaattt

SEQ ID NO: 188581 - DNA, 16 bp, P. troglodytes
aacatctgaaggaaca

SEQ ID NO: 188582 - DNA, 16 bp, P. troglodytes
aacatctttttatgtg

SEQ ID NO: 188583 - DNA, 16 bp, P. troglodytes
aacatgaaaaaaatct

SEQ ID NO: 188584 - DNA, 16 bp, P. troglodytes
aacatgaaaatatata

SEQ ID NO: 188585 - DNA, 16 bp, P. troglodytes
aacatgaaaatatgtt

SEQ ID NO: 188586 - DNA, 16 bp, P. troglodytes
aacatgaaaatgaaag

SEQ ID NO: 188587 - DNA, 16 bp, P. troglodytes
aacatgaaactataaa

SEQ ID NO: 188588 - DNA, 16 bp, P. troglodytes
aacatgaatggagctg

SEQ ID NO: 188589 - DNA, 16 bp, P. troglodytes
aacatgaattttgggg

SEQ ID NO: 188590 - DNA, 16 bp, P. troglodytes
aacatgaatttttttt

SEQ ID NO: 188591 - DNA, 16 bp, P. troglodytes
aacatgacaaaactct

SEQ ID NO: 188592 - DNA, 16 bp, P. troglodytes
aacatgagatgtgggt

SEQ ID NO: 188593 - DNA, 16 bp, P. troglodytes
aacatgaggaaaccct

SEQ ID NO: 188594 - DNA, 16 bp, P. troglodytes
aacatgatgaaaccgc

SEQ ID NO: 188595 - DNA, 16 bp, P. troglodytes
aacatgatgactggaa

SEQ ID NO: 188596 - DNA, 16 bp, P. troglodytes
aacatgatgctttgaa

SEQ ID NO: 188597 - DNA, 16 bp, P. troglodytes
aacatgatttcattct

SEQ ID NO: 188598 - DNA, 16 bp, P. troglodytes
aacatgcaaaggaaca

SEQ ID NO: 188599 - DNA, 16 bp, P. troglodytes
aacatgcaatatttat

SEQ ID NO: 188600 - DNA, 16 bp, P. troglodytes
aacatgctcctgaatg

SEQ ID NO: 188601 - DNA, 16 bp, P. troglodytes
aacatgctgaaacctc

SEQ ID NO: 188602 - DNA, 16 bp, P. troglodytes
aacatggaaagaaaat

SEQ ID NO: 188603 - DNA, 16 bp, P. troglodytes
aacatggaatattttt

SEQ ID NO: 188604 - DNA, 16 bp, P. troglodytes
aacatggagaaacccg

SEQ ID NO: 188605 - DNA, 16 bp, P. troglodytes
aacatggagaaacctc

SEQ ID NO: 188606 - DNA, 16 bp, P. troglodytes
aacatggatagagcta

SEQ ID NO: 188607 - DNA, 16 bp, P. troglodytes
aacatggatgggactg

SEQ ID NO: 188608 - DNA, 17 bp, P. troglodytes
aacatggcgaaatcccg

SEQ ID NO: 188609 - DNA, 16 bp, P. troglodytes
aacatggctgtgcttt

SEQ ID NO: 188610 - DNA, 16 bp, P. troglodytes
aacatgggaatacaga

SEQ ID NO: 188611 - DNA, 16 bp, P. troglodytes
aacatgggagtgcaga

SEQ ID NO: 188612 - DNA, 16 bp, P. troglodytes
aacatgggtttgaact

SEQ ID NO: 188613 - DNA, 16 bp, P. troglodytes
aacatggtgaaaacct

SEQ ID NO: 188614 - DNA, 16 bp, P. troglodytes
aacatggtgaaacatt

SEQ ID NO: 188615 - DNA, 16 bp, P. troglodytes
aacatggtgaagctcc

SEQ ID NO: 188616 - DNA, 16 bp, P. troglodytes
aacatggtgagacact

SEQ ID NO: 188617 - DNA, 16 bp, P. troglodytes
aacatggtggaaggca

SEQ ID NO: 188618 - DNA, 16 bp, P. troglodytes
aacatgtacagacttt

SEQ ID NO: 188619 - DNA, 16 bp, P. troglodytes
aacatgtatttattga

SEQ ID NO: 188620 - DNA, 16 bp, P. troglodytes
aacatgtattttaaaa

SEQ ID NO: 188621 - DNA, 16 bp, P. troglodytes
aacatgtattttttaa

SEQ ID NO: 188622 - DNA, 16 bp, P. troglodytes
aacatgtctcgcctcc

SEQ ID NO: 188623 - DNA, 16 bp, P. troglodytes
aacatgtgcaggggaa

SEQ ID NO: 188624 - DNA, 16 bp, P. troglodytes
aacatgtgcccaaggt

SEQ ID NO: 188625 - DNA, 16 bp, P. troglodytes
aacatgtgctatttgg

SEQ ID NO: 188626 - DNA, 16 bp, P. troglodytes
aacatgtggtgtttgg

SEQ ID NO: 188627 - DNA, 16 bp, P. troglodytes
aacatgttattttttg

SEQ ID NO: 188628 - DNA, 16 bp, P. troglodytes
aacattaaaaactttt

SEQ ID NO: 188629 - DNA, 16 bp, P. troglodytes
aacattaaagatcact

SEQ ID NO: 188630 - DNA, 16 bp, P. troglodytes
aacattactgattttt

SEQ ID NO: 188631 - DNA, 16 bp, P. troglodytes
aacattaggtatatct

SEQ ID NO: 188632 - DNA, 16 bp, P. troglodytes
aacattatactggaag

SEQ ID NO: 188633 - DNA, 16 bp, P. troglodytes
aacattatagagtgta

SEQ ID NO: 188634 - DNA, 16 bp, P. troglodytes
aacattatgctaagta

SEQ ID NO: 188635 - DNA, 16 bp, P. troglodytes
aacattattcacaaca

SEQ ID NO: 188636 - DNA, 16 bp, P. troglodytes
aacattatttccattt

SEQ ID NO: 188637 - DNA, 16 bp, P. troglodytes
aacattatttctggat

SEQ ID NO: 188638 - DNA, 16 bp, P. troglodytes
aacattatttgaaata

SEQ ID NO: 188639 - DNA, 16 bp, P. troglodytes
aacattcatgcaaaaa

SEQ ID NO: 188640 - DNA, 16 bp, P. troglodytes
aacattccacgctcat

SEQ ID NO: 188641 - DNA, 18 bp, P. troglodytes
aacattccatgctcatgg

SEQ ID NO: 188642 - DNA, 16 bp, P. troglodytes
aacattccatgcttat

SEQ ID NO: 188643 - DNA, 16 bp, P. troglodytes
aacattccattgtgta

SEQ ID NO: 188644 - DNA, 16 bp, P. troglodytes
aacattccctttgaaa

SEQ ID NO: 188645 - DNA, 16 bp, P. troglodytes
aacattctcacagaca

SEQ ID NO: 188646 - DNA, 16 bp, P. troglodytes
aacattctgaaagaaa

SEQ ID NO: 188647 - DNA, 16 bp, P. troglodytes
aacattctttctttct

SEQ ID NO: 188648 - DNA, 16 bp, P. troglodytes
aacattcttttaaaat

SEQ ID NO: 188649 - DNA, 16 bp, P. troglodytes
aacattgaatataaat

SEQ ID NO: 188650 - DNA, 16 bp, P. troglodytes
aacattgagaattaca

SEQ ID NO: 188651 - DNA, 16 bp, P. troglodytes
aacattgaggaaactc

SEQ ID NO: 188652 - DNA, 16 bp, P. troglodytes
aacattgatgagagaa

SEQ ID NO: 188653 - DNA, 16 bp, P. troglodytes
aacattgctgattctt

SEQ ID NO: 188654 - DNA, 16 bp, P. troglodytes
aacattgcttttaaaa

SEQ ID NO: 188655 - DNA, 16 bp, P. troglodytes
aacattggcaaaataa

SEQ ID NO: 188656 - DNA, 16 bp, P. troglodytes
aacattgggaaaactc

SEQ ID NO: 188657 - DNA, 16 bp, P. troglodytes
aacattgggaattata

SEQ ID NO: 188658 - DNA, 16 bp, P. troglodytes
aacattgttaaaatga

SEQ ID NO: 188659 - DNA, 16 bp, P. troglodytes
aacattgttaaagaaa

SEQ ID NO: 188660 - DNA, 16 bp, P. troglodytes
aacattgttgaaagaa

SEQ ID NO: 188661 - DNA, 16 bp, P. troglodytes
aacatttacactgact

SEQ ID NO: 188662 - DNA, 16 bp, P. troglodytes
aacatttacagaagaa

SEQ ID NO: 188663 - DNA, 16 bp, P. troglodytes
aacatttactgttttt

SEQ ID NO: 188664 - DNA, 16 bp, P. troglodytes
aacatttagaaaaaat

SEQ ID NO: 188665 - DNA, 16 bp, P. troglodytes
aacatttagaaataaa

SEQ ID NO: 188666 - DNA, 16 bp, P. troglodytes
aacatttatagaagaa

SEQ ID NO: 188667 - DNA, 16 bp, P. troglodytes
aacatttatcacttct

SEQ ID NO: 188668 - DNA, 16 bp, P. troglodytes
aacatttatgaagcac

SEQ ID NO: 188669 - DNA, 16 bp, P. troglodytes
aacatttattaagcac

SEQ ID NO: 188670 - DNA, 16 bp, P. troglodytes
aacatttattatgtgt

SEQ ID NO: 188671 - DNA, 16 bp, P. troglodytes
aacatttattgaatga

SEQ ID NO: 188672 - DNA, 16 bp, P. troglodytes
aacatttattgagcat

SEQ ID NO: 188673 - DNA, 16 bp, P. troglodytes
aacatttattgagtgc

SEQ ID NO: 188674 - DNA, 16 bp, P. troglodytes
aacatttattttttga

SEQ ID NO: 188675 - DNA, 16 bp, P. troglodytes
aacatttcaggccaat

SEQ ID NO: 188676 - DNA, 16 bp, P. troglodytes
aacatttcatccagtg

SEQ ID NO: 188677 - DNA, 16 bp, P. troglodytes
aacatttcattcattt

SEQ ID NO: 188678 - DNA, 16 bp, P. troglodytes
aacatttccatcaccc

SEQ ID NO: 188679 - DNA, 16 bp, P. troglodytes
aacatttctagaaaaa

SEQ ID NO: 188680 - DNA, 16 bp, P. troglodytes
aacatttctagacaca

SEQ ID NO: 188681 - DNA, 16 bp, P. troglodytes
aacatttgaaaaaaat

SEQ ID NO: 188682 - DNA, 16 bp, P. troglodytes
aacatttgaaaataaa

SEQ ID NO: 188683 - DNA, 16 bp, P. troglodytes
aacatttgaaaatatt

SEQ ID NO: 188684 - DNA, 16 bp, P. troglodytes
aacatttgaaaatcaa

SEQ ID NO: 188685 - DNA, 16 bp, P. troglodytes
aacatttgaaagaaaa

SEQ ID NO: 188686 - DNA, 16 bp, P. troglodytes
aacatttgaagaaaaa

SEQ ID NO: 188687 - DNA, 16 bp, P. troglodytes
aacatttggaaaatat

SEQ ID NO: 188688 - DNA, 16 bp, P. troglodytes
aacatttgtatacaag

SEQ ID NO: 188689 - DNA, 16 bp, P. troglodytes
aacatttgtatttatt

SEQ ID NO: 188690 - DNA, 16 bp, P. troglodytes
aacatttgtgtacaag

SEQ ID NO: 188691 - DNA, 16 bp, P. troglodytes
aacatttgtgttgttt

SEQ ID NO: 188692 - DNA, 16 bp, P. troglodytes
aacatttgttattttc

SEQ ID NO: 188693 - DNA, 16 bp, P. troglodytes
aacatttgttgaacac

SEQ ID NO: 188694 - DNA, 16 bp, P. troglodytes
aacattttaaaaaaga

SEQ ID NO: 188695 - DNA, 16 bp, P. troglodytes
aacattttaaaaagaa

SEQ ID NO: 188696 - DNA, 16 bp, P. troglodytes
aacattttaaaagcag

SEQ ID NO: 188697 - DNA, 16 bp, P. troglodytes
aacattttaaagaaaa

SEQ ID NO: 188698 - DNA, 16 bp, P. troglodytes
aacattttaaagtata

SEQ ID NO: 188699 - DNA, 16 bp, P. troglodytes
aacattttaaataact

SEQ ID NO: 188700 - DNA, 16 bp, P. troglodytes
aacattttaaatgaaa

SEQ ID NO: 188701 - DNA, 16 bp, P. troglodytes
aacattttaaatgttt

SEQ ID NO: 188702 - DNA, 16 bp, P. troglodytes
aacattttaagaaact

SEQ ID NO: 188703 - DNA, 16 bp, P. troglodytes
aacattttaataaact

SEQ ID NO: 188704 - DNA, 16 bp, P. troglodytes
aacattttaatgattt

SEQ ID NO: 188705 - DNA, 16 bp, P. troglodytes
aacattttaatgtata

SEQ ID NO: 188706 - DNA, 16 bp, P. troglodytes
aacattttaatgttta

SEQ ID NO: 188707 - DNA, 16 bp, P. troglodytes
aacattttacttaaaa

SEQ ID NO: 188708 - DNA, 16 bp, P. troglodytes
aacattttagttgttt

SEQ ID NO: 188709 - DNA, 16 bp, P. troglodytes
aacattttatccaaga

SEQ ID NO: 188710 - DNA, 16 bp, P. troglodytes
aacattttatttcaaa

SEQ ID NO: 188711 - DNA, 16 bp, P. troglodytes
aacattttcaaaaaga

SEQ ID NO: 188712 - DNA, 16 bp, P. troglodytes
aacattttcaaagtgc

SEQ ID NO: 188713 - DNA, 16 bp, P. troglodytes
aacattttcagaaata

SEQ ID NO: 188714 - DNA, 16 bp, P. troglodytes
aacattttcatcaacc

SEQ ID NO: 188715 - DNA, 16 bp, P. troglodytes
aacattttcatcaccc

SEQ ID NO: 188716 - DNA, 16 bp, P. troglodytes
aacattttcatgttta

SEQ ID NO: 188717 - DNA, 16 bp, P. troglodytes
aacattttctaatttc

SEQ ID NO: 188718 - DNA, 16 bp, P. troglodytes
aacattttctcccatt

SEQ ID NO: 188719 - DNA, 16 bp, P. troglodytes
aacattttctgaaaaa

SEQ ID NO: 188720 - DNA, 16 bp, P. troglodytes
aacattttcttccttt

SEQ ID NO: 188721 - DNA, 16 bp, P. troglodytes
aacattttgaaaaact

SEQ ID NO: 188722 - DNA, 16 bp, P. troglodytes
aacattttgaaatttt

SEQ ID NO: 188723 - DNA, 16 bp, P. troglodytes
aacattttgcaaaact

SEQ ID NO: 188724 - DNA, 16 bp, P. troglodytes
aacattttggtcaaag

SEQ ID NO: 188725 - DNA, 16 bp, P. troglodytes
aacattttggttattt

SEQ ID NO: 188726 - DNA, 16 bp, P. troglodytes
aacattttggttgttt

SEQ ID NO: 188727 - DNA, 16 bp, P. troglodytes
aacattttgtaatttt

SEQ ID NO: 188728 - DNA, 16 bp, P. troglodytes
aacattttgttaattt

SEQ ID NO: 188729 - DNA, 16 bp, P. troglodytes
aacattttgttatatt

SEQ ID NO: 188730 - DNA, 16 bp, P. troglodytes
aacatttttatcaacc

SEQ ID NO: 188731 - DNA, 16 bp, P. troglodytes
aacatttttcaaatgt

SEQ ID NO: 188732 - DNA, 16 bp, P. troglodytes
aacatttttgaaaaag

SEQ ID NO: 188733 - DNA, 16 bp, P. troglodytes
aacatttttgaaacaa

SEQ ID NO: 188734 - DNA, 16 bp, P. troglodytes
aacatttttgtaattt

SEQ ID NO: 188735 - DNA, 16 bp, P. troglodytes
aacattttttaaaaag

SEQ ID NO: 188736 - DNA, 16 bp, P. troglodytes
aacattttttcttatg

SEQ ID NO: 188737 - DNA, 16 bp, P. troglodytes
aacattttttcttcca

SEQ ID NO: 188738 - DNA, 16 bp, P. troglodytes
aacatttttttgtgtg

SEQ ID NO: 188739 - DNA, 16 bp, P. troglodytes
aacattttttttccta

SEQ ID NO: 188740 - DNA, 16 bp, P. troglodytes
aaccaaaaaacagcct

SEQ ID NO: 188741 - DNA, 16 bp, P. troglodytes
aaccaaaaaagtgccc

SEQ ID NO: 188742 - DNA, 16 bp, P. troglodytes
aaccaaaacatttgtg

SEQ ID NO: 188743 - DNA, 16 bp, P. troglodytes
aaccaaaagctgtttc

SEQ ID NO: 188744 - DNA, 16 bp, P. troglodytes
aaccaaaataagatac

SEQ ID NO: 188745 - DNA, 16 bp, P. troglodytes
aaccaaagaaagtcca

SEQ ID NO: 188746 - DNA, 16 bp, P. troglodytes
aaccaaagaagagcct

SEQ ID NO: 188747 - DNA, 16 bp, P. troglodytes
aaccaaagaagtgaaa

SEQ ID NO: 188748 - DNA, 16 bp, P. troglodytes
aaccaaagcaactcca

SEQ ID NO: 188749 - DNA, 16 bp, P. troglodytes
aaccaaagcagcatga

SEQ ID NO: 188750 - DNA, 16 bp, P. troglodytes
aaccaacatgatgaaa

SEQ ID NO: 188751 - DNA, 17 bp, P. troglodytes
aaccaacttggaaaaca

SEQ ID NO: 188752 - DNA, 16 bp, P. troglodytes
aaccaagaagatgaaa

SEQ ID NO: 188753 - DNA, 16 bp, P. troglodytes
aaccaagaattttata

SEQ ID NO: 188754 - DNA, 16 bp, P. troglodytes
aaccaagatttggaag

SEQ ID NO: 188755 - DNA, 16 bp, P. troglodytes
aaccaagctgtaccct

SEQ ID NO: 188756 - DNA, 16 bp, P. troglodytes
aaccaaggagatgaaa

SEQ ID NO: 188757 - DNA, 16 bp, P. troglodytes
aaccaaggcccagaaa

SEQ ID NO: 188758 - DNA, 16 bp, P. troglodytes
aaccaaggctcagaga

SEQ ID NO: 188759 - DNA, 16 bp, P. troglodytes
aaccaaggtggtgaaa

SEQ ID NO: 188760 - DNA, 16 bp, P. troglodytes
aaccaagtcaaaacca

SEQ ID NO: 188761 - DNA, 16 bp, P. troglodytes
aaccaatattaataca

SEQ ID NO: 188762 - DNA, 16 bp, P. troglodytes
aaccaatgcaaagaag

SEQ ID NO: 188763 - DNA, 16 bp, P. troglodytes
aaccaatggaacagaa

SEQ ID NO: 188764 - DNA, 16 bp, P. troglodytes
aaccaatgtatttctt

SEQ ID NO: 188765 - DNA, 16 bp, P. troglodytes
aaccaatgttcatctt

SEQ ID NO: 188766 - DNA, 16 bp, P. troglodytes
aaccaattataacttc

SEQ ID NO: 188767 - DNA, 16 bp, P. troglodytes
aaccaatttctccaat

SEQ ID NO: 188768 - DNA, 16 bp, P. troglodytes
aaccaatttggaaaac

SEQ ID NO: 188769 - DNA, 16 bp, P. troglodytes
aaccacaatgagataa

SEQ ID NO: 188770 - DNA, 23 bp, P. troglodytes
aaccacaatgagataccatctca

SEQ ID NO: 188771 - DNA, 16 bp, P. troglodytes
aaccacagatcaaaaa

SEQ ID NO: 188772 - DNA, 16 bp, P. troglodytes
aaccacagatgctgga

SEQ ID NO: 188773 - DNA, 16 bp, P. troglodytes
aaccacagattgaaaa

SEQ ID NO: 188774 - DNA, 16 bp, P. troglodytes
aaccacattttcttta

SEQ ID NO: 188775 - DNA, 16 bp, P. troglodytes
aaccaccacctcctgg

SEQ ID NO: 188776 - DNA, 16 bp, P. troglodytes
aaccaccatggcaaat

SEQ ID NO: 188777 - DNA, 16 bp, P. troglodytes
aaccaccatggcacgc

SEQ ID NO: 188778 - DNA, 16 bp, P. troglodytes
aaccacccagctaagc

SEQ ID NO: 188779 - DNA, 18 bp, P. troglodytes
aaccacgcccggctaatt

SEQ ID NO: 188780 - DNA, 16 bp, P. troglodytes
aaccactcatcttttt

SEQ ID NO: 188781 - DNA, 16 bp, P. troglodytes
aaccactttctccttt

SEQ ID NO: 188782 - DNA, 16 bp, P. troglodytes
aaccactttggaaaat

SEQ ID NO: 188783 - DNA, 16 bp, P. troglodytes
aaccagacaaagacag

SEQ ID NO: 188784 - DNA, 16 bp, P. troglodytes
aaccagacactgcatg

SEQ ID NO: 188785 - DNA, 17 bp, P. troglodytes
aaccagagcaactccat

SEQ ID NO: 188786 - DNA, 16 bp, P. troglodytes
aaccagatttcatgag

SEQ ID NO: 188787 - DNA, 16 bp, P. troglodytes
aaccagccaggcacag

SEQ ID NO: 188788 - DNA, 16 bp, P. troglodytes
aaccagccctagccag

SEQ ID NO: 188789 - DNA, 16 bp, P. troglodytes
aaccagccctgcccac

SEQ ID NO: 188790 - DNA, 17 bp, P. troglodytes
aaccagcctgaccaaca

SEQ ID NO: 188791 - DNA, 18 bp, P. troglodytes
aaccagcctgggcaacat

SEQ ID NO: 188792 - DNA, 17 bp, P. troglodytes
aaccagcctggtcaaca

SEQ ID NO: 188793 - DNA, 16 bp, P. troglodytes
aaccaggaaaggacac

SEQ ID NO: 188794 - DNA, 16 bp, P. troglodytes
aaccaggaagaaaatg

SEQ ID NO: 188795 - DNA, 16 bp, P. troglodytes
aaccaggaagaaattc

SEQ ID NO: 188796 - DNA, 16 bp, P. troglodytes
aaccaggagagctgat

SEQ ID NO: 188797 - DNA, 16 bp, P. troglodytes
aaccaggagattccct

SEQ ID NO: 188798 - DNA, 16 bp, P. troglodytes
aaccaggattcaaact

SEQ ID NO: 188799 - DNA, 16 bp, P. troglodytes
aaccaggcatggtggt

SEQ ID NO: 188800 - DNA, 16 bp, P. troglodytes
aaccagggagtcagaa

SEQ ID NO: 188801 - DNA, 16 bp, P. troglodytes
aaccagggctgcgcgc

SEQ ID NO: 188802 - DNA, 19 bp, P. troglodytes
aaccaggggcacaatgcac

SEQ ID NO: 188803 - DNA, 16 bp, P. troglodytes
aaccagtgatcttttt

SEQ ID NO: 188804 - DNA, 16 bp, P. troglodytes
aaccagttacagaaat

SEQ ID NO: 188805 - DNA, 16 bp, P. troglodytes
aaccagtttggaaaac

SEQ ID NO: 188806 - DNA, 16 bp, P. troglodytes
aaccagttttcccagc

SEQ ID NO: 188807 - DNA, 16 bp, P. troglodytes
aaccagttttttgttt

SEQ ID NO: 188808 - DNA, 17 bp, P. troglodytes
aaccataagccaattaa

SEQ ID NO: 188809 - DNA, 22 bp, P. troglodytes
aaccataaggtctgactgcctg

SEQ ID NO: 188810 - DNA, 16 bp, P. troglodytes
aaccatatgaaattgc

SEQ ID NO: 188811 - DNA, 16 bp, P. troglodytes
aaccatattcaaacca

SEQ ID NO: 188812 - DNA, 16 bp, P. troglodytes
aaccatatttttaaaa

SEQ ID NO: 188813 - DNA, 16 bp, P. troglodytes
aaccatcaccaccatc

SEQ ID NO: 188814 - DNA, 16 bp, P. troglodytes
aaccatcactgccatc

SEQ ID NO: 188815 - DNA, 16 bp, P. troglodytes
aaccatcaggaaaatg

SEQ ID NO: 188816 - DNA, 16 bp, P. troglodytes
aaccatcattctactc

SEQ ID NO: 188817 - DNA, 16 bp, P. troglodytes
aaccatccctgcattc

SEQ ID NO: 188818 - DNA, 17 bp, P. troglodytes
aaccatcctggctaaca

SEQ ID NO: 188819 - DNA, 16 bp, P. troglodytes
aaccatccttgcattc

SEQ ID NO: 188820 - DNA, 16 bp, P. troglodytes
aaccatgaagaaacag

SEQ ID NO: 188821 - DNA, 16 bp, P. troglodytes
aaccatgaagaaattc

SEQ ID NO: 188822 - DNA, 16 bp, P. troglodytes
aaccatgagaaataaa

SEQ ID NO: 188823 - DNA, 16 bp, P. troglodytes
aaccatggtccaaaaa

SEQ ID NO: 188824 - DNA, 16 bp, P. troglodytes
aaccattaaaaaatgt

SEQ ID NO: 188825 - DNA, 16 bp, P. troglodytes
aaccatttgatcttca

SEQ ID NO: 188826 - DNA, 16 bp, P. troglodytes
aaccatttgtctttta

SEQ ID NO: 188827 - DNA, 16 bp, P. troglodytes
aaccattttaaatgta

SEQ ID NO: 188828 - DNA, 16 bp, P. troglodytes
aaccattttctgggga

SEQ ID NO: 188829 - DNA, 16 bp, P. troglodytes
aaccatttttctttct

SEQ ID NO: 188830 - DNA, 16 bp, P. troglodytes
aacccaaaaggactgg

SEQ ID NO: 188831 - DNA, 16 bp, P. troglodytes
aacccaaactaagaca

SEQ ID NO: 188832 - DNA, 16 bp, P. troglodytes
aacccaaagcaagcag

SEQ ID NO: 188833 - DNA, 16 bp, P. troglodytes
aacccaaaggattata

SEQ ID NO: 188834 - DNA, 16 bp, P. troglodytes
aacccaaatgtccaat

SEQ ID NO: 188835 - DNA, 16 bp, P. troglodytes
aacccaaatgtccttc

SEQ ID NO: 188836 - DNA, 16 bp, P. troglodytes
aacccaagacacataa

SEQ ID NO: 188837 - DNA, 16 bp, P. troglodytes
aacccaagaggctgag

SEQ ID NO: 188838 - DNA, 16 bp, P. troglodytes
aacccaatacaaggaa

SEQ ID NO: 188839 - DNA, 16 bp, P. troglodytes
aacccaattaagaaat

SEQ ID NO: 188840 - DNA, 16 bp, P. troglodytes
aacccacagaatagga

SEQ ID NO: 188841 - DNA, 16 bp, P. troglodytes
aacccaccagaaggaa

SEQ ID NO: 188842 - DNA, 16 bp, P. troglodytes
aacccagaaaatctga

SEQ ID NO: 188843 - DNA, 16 bp, P. troglodytes
aacccagaaacaaatt

SEQ ID NO: 188844 - DNA, 16 bp, P. troglodytes
aacccagaagcagagg

SEQ ID NO: 188845 - DNA, 16 bp, P. troglodytes
aacccagaagcccagc

SEQ ID NO: 188846 - DNA, 16 bp, P. troglodytes
aacccagaaggtagag

SEQ ID NO: 188847 - DNA, 16 bp, P. troglodytes
aacccagagaggttaa

SEQ ID NO: 188848 - DNA, 16 bp, P. troglodytes
aacccagcacttcggg

SEQ ID NO: 188849 - DNA, 20 bp, P. troglodytes
aacccagctactcaggaggc

SEQ ID NO: 188850 - DNA, 16 bp, P. troglodytes
aacccaggaagcagag

SEQ ID NO: 188851 - DNA, 16 bp, P. troglodytes
aacccaggaggaagag

SEQ ID NO: 188852 - DNA, 16 bp, P. troglodytes
aacccaggaggcagaa

SEQ ID NO: 188853 - DNA, 16 bp, P. troglodytes
aacccaggaggcagag

SEQ ID NO: 188854 - DNA, 16 bp, P. troglodytes
aacccaggaggccgag

SEQ ID NO: 188855 - DNA, 16 bp, P. troglodytes
aacccaggaggtggaa

SEQ ID NO: 188856 - DNA, 16 bp, P. troglodytes
aacccaggaggttgaa

SEQ ID NO: 188857 - DNA, 16 bp, P. troglodytes
aacccagtcagacaaa

SEQ ID NO: 188858 - DNA, 16 bp, P. troglodytes
aacccatgaggcggag

SEQ ID NO: 188859 - DNA, 16 bp, P. troglodytes
aacccatggatacaga

SEQ ID NO: 188860 - DNA, 16 bp, P. troglodytes
aacccatggatatgga

SEQ ID NO: 188861 - DNA, 16 bp, P. troglodytes
aacccattcattcatt

SEQ ID NO: 188862 - DNA, 16 bp, P. troglodytes
aaccccacctctagta

SEQ ID NO: 188863 - DNA, 16 bp, P. troglodytes
aaccccagctacctgg

SEQ ID NO: 188864 - DNA, 16 bp, P. troglodytes
aaccccagctactctg

SEQ ID NO: 188865 - DNA, 16 bp, P. troglodytes
aaccccaggactttgg

SEQ ID NO: 188866 - DNA, 16 bp, P. troglodytes
aaccccattaaaaagt

SEQ ID NO: 188867 - DNA, 16 bp, P. troglodytes
aacccccatgacacac

SEQ ID NO: 188868 - DNA, 16 bp, P. troglodytes
aaccccggaagcagag

SEQ ID NO: 188869 - DNA, 16 bp, P. troglodytes
aaccccggagatggag

SEQ ID NO: 188870 - DNA, 16 bp, P. troglodytes
aaccccgtctctaccc

SEQ ID NO: 188871 - DNA, 16 bp, P. troglodytes
aacccctggcctcaag

SEQ ID NO: 188872 - DNA, 16 bp, P. troglodytes
aaccccttctacaaaa

SEQ ID NO: 188873 - DNA, 16 bp, P. troglodytes
aacccgagaagtggag

SEQ ID NO: 188874 - DNA, 16 bp, P. troglodytes
aacccgggagaaggag

SEQ ID NO: 188875 - DNA, 16 bp, P. troglodytes
aacccgggaggctgag

SEQ ID NO: 188876 - DNA, 16 bp, P. troglodytes
aacccgggaggtggag

SEQ ID NO: 188877 - DNA, 16 bp, P. troglodytes
aaccctattgtgaact

SEQ ID NO: 188878 - DNA, 16 bp, P. troglodytes
aaccctcagcaaaata

SEQ ID NO: 188879 - DNA, 16 bp, P. troglodytes
aaccctcagctgcagg

SEQ ID NO: 188880 - DNA, 16 bp, P. troglodytes
aaccctcattctcagc

SEQ ID NO: 188881 - DNA, 16 bp, P. troglodytes
aaccctctctctacca

SEQ ID NO: 188882 - DNA, 16 bp, P. troglodytes
aaccctgaaaacatta

SEQ ID NO: 188883 - DNA, 16 bp, P. troglodytes
aaccctgaactggaat

SEQ ID NO: 188884 - DNA, 16 bp, P. troglodytes
aaccctgactaatgca

SEQ ID NO: 188885 - DNA, 16 bp, P. troglodytes
aaccctgcccccacct

SEQ ID NO: 188886 - DNA, 16 bp, P. troglodytes
aaccctgctgacacct

SEQ ID NO: 188887 - DNA, 16 bp, P. troglodytes
aaccctggaggcagaa

SEQ ID NO: 188888 - DNA, 16 bp, P. troglodytes
aaccctggctctgcca

SEQ ID NO: 188889 - DNA, 16 bp, P. troglodytes
aaccctgtgctctctg

SEQ ID NO: 188890 - DNA, 16 bp, P. troglodytes
aacccttctgcctcag

SEQ ID NO: 188891 - DNA, 16 bp, P. troglodytes
aaccgatgcgatcaac

SEQ ID NO: 188892 - DNA, 16 bp, P. troglodytes
aaccgctgcctcccag

SEQ ID NO: 188893 - DNA, 16 bp, P. troglodytes
aaccggaaggcagagg

SEQ ID NO: 188894 - DNA, 16 bp, P. troglodytes
aacctaaaactgctct

SEQ ID NO: 188895 - DNA, 16 bp, P. troglodytes
aacctaaaataaaagt

SEQ ID NO: 188896 - DNA, 16 bp, P. troglodytes
aacctaaaataaagtt

SEQ ID NO: 188897 - DNA, 16 bp, P. troglodytes
aacctaaaatagaagt

SEQ ID NO: 188898 - DNA, 16 bp, P. troglodytes
aacctaaagaaagata

SEQ ID NO: 188899 - DNA, 16 bp, P. troglodytes
aacctaagaaatacca

SEQ ID NO: 188900 - DNA, 16 bp, P. troglodytes
aacctaagcaaaaaga

SEQ ID NO: 188901 - DNA, 16 bp, P. troglodytes
aacctacagaaagata

SEQ ID NO: 188902 - DNA, 16 bp, P. troglodytes
aacctactgaatcaaa

SEQ ID NO: 188903 - DNA, 17 bp, P. troglodytes
aacctagcaaggcaggc

SEQ ID NO: 188904 - DNA, 16 bp, P. troglodytes
aacctaggaaaaactt

SEQ ID NO: 188905 - DNA, 16 bp, P. troglodytes
aacctcaaaaacatga

SEQ ID NO: 188906 - DNA, 16 bp, P. troglodytes
aacctcaagtgatcca

SEQ ID NO: 188907 - DNA, 20 bp, P. troglodytes
aacctcaagtgatctgcccg

SEQ ID NO: 188908 - DNA, 16 bp, P. troglodytes
aacctcaccaaatgaa

SEQ ID NO: 188909 - DNA, 16 bp, P. troglodytes
aacctcacctcctggg

SEQ ID NO: 188910 - DNA, 16 bp, P. troglodytes
aacctcagcatcacat

SEQ ID NO: 188911 - DNA, 16 bp, P. troglodytes
aacctcagcatcatga

SEQ ID NO: 188912 - DNA, 16 bp, P. troglodytes
aacctcagcctcctga

SEQ ID NO: 188913 - DNA, 16 bp, P. troglodytes
aacctcattctttttt

SEQ ID NO: 188914 - DNA, 16 bp, P. troglodytes
aacctcatttaaaaat

SEQ ID NO: 188915 - DNA, 16 bp, P. troglodytes
aacctccacatcccag

SEQ ID NO: 188916 - DNA, 16 bp, P. troglodytes
aacctccacatgttca

SEQ ID NO: 188917 - DNA, 19 bp, P. troglodytes
aacctccacctcccaggct

SEQ ID NO: 188918 - DNA, 16 bp, P. troglodytes
aacctccagaggaacg

SEQ ID NO: 188919 - DNA, 16 bp, P. troglodytes
aacctccatctctcag

SEQ ID NO: 188920 - DNA, 16 bp, P. troglodytes
aacctccatctctggg

SEQ ID NO: 188921 - DNA, 18 bp, P. troglodytes
aacctcccaaagtgctga

SEQ ID NO: 188922 - DNA, 16 bp, P. troglodytes
aacctccccagactcc

SEQ ID NO: 188923 - DNA, 16 bp, P. troglodytes
aacctccccatcctgg

SEQ ID NO: 188924 - DNA, 16 bp, P. troglodytes
aacctccgcatcctgg

SEQ ID NO: 188925 - DNA, 16 bp, P. troglodytes
aacctcctcctcccag

SEQ ID NO: 188926 - DNA, 16 bp, P. troglodytes
aacctcctcctcctgg

SEQ ID NO: 188927 - DNA, 16 bp, P. troglodytes
aacctcctgaggctgt

SEQ ID NO: 188928 - DNA, 16 bp, P. troglodytes
aacctcctgggctcca

SEQ ID NO: 188929 - DNA, 16 bp, P. troglodytes
aacctctaggatacag

SEQ ID NO: 188930 - DNA, 16 bp, P. troglodytes
aacctctattttactt

SEQ ID NO: 188931 - DNA, 16 bp, P. troglodytes
aacctctcagagcctc

SEQ ID NO: 188932 - DNA, 16 bp, P. troglodytes
aacctctctgagcctc

SEQ ID NO: 188933 - DNA, 16 bp, P. troglodytes
aacctctctgtgtctt

SEQ ID NO: 188934 - DNA, 16 bp, P. troglodytes
aacctctcttcatccc

SEQ ID NO: 188935 - DNA, 16 bp, P. troglodytes
aacctctgataaaccc

SEQ ID NO: 188936 - DNA, 16 bp, P. troglodytes
aacctctgccctcctg

SEQ ID NO: 188937 - DNA, 16 bp, P. troglodytes
aacctctgcctccaaa

SEQ ID NO: 188938 - DNA, 16 bp, P. troglodytes
aacctctgccttccaa

SEQ ID NO: 188939 - DNA, 16 bp, P. troglodytes
aacctctgcttcctgg

SEQ ID NO: 188940 - DNA, 16 bp, P. troglodytes
aacctcttcctcctgg

SEQ ID NO: 188941 - DNA, 16 bp, P. troglodytes
aacctctttatttctg

SEQ ID NO: 188942 - DNA, 16 bp, P. troglodytes
aacctctttctttggt

SEQ ID NO: 188943 - DNA, 16 bp, P. troglodytes
aacctctttctttgta

SEQ ID NO: 188944 - DNA, 16 bp, P. troglodytes
aacctcttttcttgta

SEQ ID NO: 188945 - DNA, 16 bp, P. troglodytes
aacctcttttgtaaat

SEQ ID NO: 188946 - DNA, 16 bp, P. troglodytes
aacctgaaaatctagt

SEQ ID NO: 188947 - DNA, 16 bp, P. troglodytes
aacctgaaagactggt

SEQ ID NO: 188948 - DNA, 16 bp, P. troglodytes
aacctgaccaacatga

SEQ ID NO: 188949 - DNA, 16 bp, P. troglodytes
aacctgagactgggta

SEQ ID NO: 188950 - DNA, 18 bp, P. troglodytes
aacctgaggtcaggagtt

SEQ ID NO: 188951 - DNA, 16 bp, P. troglodytes
aacctgcacaccctgc

SEQ ID NO: 188952 - DNA, 16 bp, P. troglodytes
aacctgcacatatacc

SEQ ID NO: 188953 - DNA, 16 bp, P. troglodytes
aacctgcatttaagaa

SEQ ID NO: 188954 - DNA, 16 bp, P. troglodytes
aacctggaagacagag

SEQ ID NO: 188955 - DNA, 16 bp, P. troglodytes
aacctggaaggcagag

SEQ ID NO: 188956 - DNA, 16 bp, P. troglodytes
aacctggacctcctgg

SEQ ID NO: 188957 - DNA, 16 bp, P. troglodytes
aacctggcatggtggt

SEQ ID NO: 188958 - DNA, 16 bp, P. troglodytes
aacctggccaacagag

SEQ ID NO: 188959 - DNA, 16 bp, P. troglodytes
aacctggccaacatag

SEQ ID NO: 188960 - DNA, 16 bp, P. troglodytes
aacctggccaacgtgg

SEQ ID NO: 188961 - DNA, 16 bp, P. troglodytes
aacctgggaaatacca

SEQ ID NO: 188962 - DNA, 16 bp, P. troglodytes
aacctgggaagcagag

SEQ ID NO: 188963 - DNA, 16 bp, P. troglodytes
aacctgggaagcggag

SEQ ID NO: 188964 - DNA, 16 bp, P. troglodytes
aacctgggaagtggaa

SEQ ID NO: 188965 - DNA, 16 bp, P. troglodytes
aacctgggagacggaa

SEQ ID NO: 188966 - DNA, 16 bp, P. troglodytes
aacctgggagatagag

SEQ ID NO: 188967 - DNA, 16 bp, P. troglodytes
aacctgggaggaggag

SEQ ID NO: 188968 - DNA, 16 bp, P. troglodytes
aacctgggaggcgaag

SEQ ID NO: 188969 - DNA, 16 bp, P. troglodytes
aacctgggagtgggag

SEQ ID NO: 188970 - DNA, 16 bp, P. troglodytes
aacctgggcaaaaaga

SEQ ID NO: 188971 - DNA, 16 bp, P. troglodytes
aacctgggcaacagaa

SEQ ID NO: 188972 - DNA, 16 bp, P. troglodytes
aacctggggaggtgga

SEQ ID NO: 188973 - DNA, 16 bp, P. troglodytes
aacctggggagtggag

SEQ ID NO: 188974 - DNA, 16 bp, P. troglodytes
aacctgggtgacagaa

SEQ ID NO: 188975 - DNA, 17 bp, P. troglodytes
aacctggtccctccatt

SEQ ID NO: 188976 - DNA, 16 bp, P. troglodytes
aacctggtgaaacctc

SEQ ID NO: 188977 - DNA, 16 bp, P. troglodytes
aacctgtccctggtgc

SEQ ID NO: 188978 - DNA, 16 bp, P. troglodytes
aacctgtcttcaagct

SEQ ID NO: 188979 - DNA, 16 bp, P. troglodytes
aacctgtggggtctga

SEQ ID NO: 188980 - DNA, 16 bp, P. troglodytes
aacctgtttctacaaa

SEQ ID NO: 188981 - DNA, 16 bp, P. troglodytes
aacctgtttttcttcc

SEQ ID NO: 188982 - DNA, 16 bp, P. troglodytes
aaccttatttggaaat

SEQ ID NO: 188983 - DNA, 16 bp, P. troglodytes
aaccttcaaaaccatg

SEQ ID NO: 188984 - DNA, 16 bp, P. troglodytes
aaccttcaatggctcc

SEQ ID NO: 188985 - DNA, 16 bp, P. troglodytes
aaccttcacctcccga

SEQ ID NO: 188986 - DNA, 16 bp, P. troglodytes
aaccttcaccttccag

SEQ ID NO: 188987 - DNA, 16 bp, P. troglodytes
aaccttctggaaagaa

SEQ ID NO: 188988 - DNA, 16 bp, P. troglodytes
aaccttgagcaaatta

SEQ ID NO: 188989 - DNA, 16 bp, P. troglodytes
aaccttggaggcggag

SEQ ID NO: 188990 - DNA, 18 bp, P. troglodytes
aaccttggcctcccaaag

SEQ ID NO: 188991 - DNA, 16 bp, P. troglodytes
aaccttggcttccaca

SEQ ID NO: 188992 - DNA, 16 bp, P. troglodytes
aaccttgtctccacaa

SEQ ID NO: 188993 - DNA, 16 bp, P. troglodytes
aaccttgtgatccacc

SEQ ID NO: 188994 - DNA, 16 bp, P. troglodytes
aacctttgctagggca

SEQ ID NO: 188995 - DNA, 16 bp, P. troglodytes
aacctttgttttcatt

SEQ ID NO: 188996 - DNA, 16 bp, P. troglodytes
aacctttttaaaaaat

SEQ ID NO: 188997 - DNA, 16 bp, P. troglodytes
aacctttttggtacca

SEQ ID NO: 188998 - DNA, 17 bp, P. troglodytes
aacgcccagctaatttt

SEQ ID NO: 188999 - DNA, 17 bp, P. troglodytes
aacgcccggctaatttt

SEQ ID NO: 189000 - DNA, 16 bp, P. troglodytes
aacgctgatgaaagaa

SEQ ID NO: 189001 - DNA, 16 bp, P. troglodytes
aacggacacatgaaaa

SEQ ID NO: 189002 - DNA, 16 bp, P. troglodytes
aacggggtttcaccac

SEQ ID NO: 189003 - DNA, 16 bp, P. troglodytes
aacgtatttcttaaat

SEQ ID NO: 189004 - DNA, 16 bp, P. troglodytes
aacgtggatgcagctg

SEQ ID NO: 189005 - DNA, 16 bp, P. troglodytes
aacgtggcaaaacccc

SEQ ID NO: 189006 - DNA, 16 bp, P. troglodytes
aacgtggcgaaacccc

SEQ ID NO: 189007 - DNA, 17 bp, P. troglodytes
aacgtggtgaaaccctg

SEQ ID NO: 189008 - DNA, 16 bp, P. troglodytes
aacgtggtgaaactcc

SEQ ID NO: 189009 - DNA, 16 bp, P. troglodytes
aactaaaattagaaat

SEQ ID NO: 189010 - DNA, 16 bp, P. troglodytes
aactaaagaaatctga

SEQ ID NO: 189011 - DNA, 16 bp, P. troglodytes
aactaaagcaaatggt

SEQ ID NO: 189012 - DNA, 16 bp, P. troglodytes
aactaaatgaaataga

SEQ ID NO: 189013 - DNA, 16 bp, P. troglodytes
aactaaattcttccca

SEQ ID NO: 189014 - DNA, 16 bp, P. troglodytes
aactaaattgaaagga

SEQ ID NO: 189015 - DNA, 16 bp, P. troglodytes
aactaacaggaacaga

SEQ ID NO: 189016 - DNA, 16 bp, P. troglodytes
aactaagacacacaca

SEQ ID NO: 189017 - DNA, 16 bp, P. troglodytes
aactaaggcccagaga

SEQ ID NO: 189018 - DNA, 16 bp, P. troglodytes
aactaagtgaaattga

SEQ ID NO: 189019 - DNA, 16 bp, P. troglodytes
aactaagtttaacatt

SEQ ID NO: 189020 - DNA, 16 bp, P. troglodytes
aactaagtttcataag

SEQ ID NO: 189021 - DNA, 16 bp, P. troglodytes
aactaataaaaactct

SEQ ID NO: 189022 - DNA, 16 bp, P. troglodytes
aactaatacagaaaca

SEQ ID NO: 189023 - DNA, 16 bp, P. troglodytes
aactaatatgcaaaat

SEQ ID NO: 189024 - DNA, 16 bp, P. troglodytes
aactaatggaaaaata

SEQ ID NO: 189025 - DNA, 16 bp, P. troglodytes
aactaatttgcatttc

SEQ ID NO: 189026 - DNA, 16 bp, P. troglodytes
aactaatttttgaatt

SEQ ID NO: 189027 - DNA, 16 bp, P. troglodytes
aactacaaaagaccct

SEQ ID NO: 189028 - DNA, 21 bp, P. troglodytes
aactacaaaccactgctcaac

SEQ ID NO: 189029 - DNA, 16 bp, P. troglodytes
aactacaaagatgggg

SEQ ID NO: 189030 - DNA, 16 bp, P. troglodytes
aactacaatgagaaat

SEQ ID NO: 189031 - DNA, 28 bp, P. troglodytes
aactacacggaaactgaacaacctgctc

SEQ ID NO: 189032 - DNA, 16 bp, P. troglodytes
aactacagaaatttat

SEQ ID NO: 189033 - DNA, 16 bp, P. troglodytes
aactacagctttgatt

SEQ ID NO: 189034 - DNA, 16 bp, P. troglodytes
aactacaggcacatgc

SEQ ID NO: 189035 - DNA, 17 bp, P. troglodytes
aactacaggcacctgcc

SEQ ID NO: 189036 - DNA, 16 bp, P. troglodytes
aactacaggtgcacat

SEQ ID NO: 189037 - DNA, 16 bp, P. troglodytes
aactacatggaaaatg

SEQ ID NO: 189038 - DNA, 16 bp, P. troglodytes
aactacctgatctttg

SEQ ID NO: 189039 - DNA, 16 bp, P. troglodytes
aactactaaaaggaaa

SEQ ID NO: 189040 - DNA, 16 bp, P. troglodytes
aactactcaactctac

SEQ ID NO: 189041 - DNA, 16 bp, P. troglodytes
aactactcaactctgt

SEQ ID NO: 189042 - DNA, 16 bp, P. troglodytes
aactactcagctctgc

SEQ ID NO: 189043 - DNA, 16 bp, P. troglodytes
aactactgggctcaag

SEQ ID NO: 189044 - DNA, 16 bp, P. troglodytes
aactactttggaggct

SEQ ID NO: 189045 - DNA, 16 bp, P. troglodytes
aactagaaaatctgga

SEQ ID NO: 189046 - DNA, 16 bp, P. troglodytes
aactagaaacaccatt

SEQ ID NO: 189047 - DNA, 16 bp, P. troglodytes
aactagaaagtctaga

SEQ ID NO: 189048 - DNA, 16 bp, P. troglodytes
aactagaaataaaatg

SEQ ID NO: 189049 - DNA, 16 bp, P. troglodytes
aactagaatataaatt

SEQ ID NO: 189050 - DNA, 16 bp, P. troglodytes
aactagaattagaagt

SEQ ID NO: 189051 - DNA, 16 bp, P. troglodytes
aactagacaaactcac

SEQ ID NO: 189052 - DNA, 16 bp, P. troglodytes
aactagacacagagca

SEQ ID NO: 189053 - DNA, 16 bp, P. troglodytes
aactagacggtcccat

SEQ ID NO: 189054 - DNA, 16 bp, P. troglodytes
aactagactctgtctc

SEQ ID NO: 189055 - DNA, 16 bp, P. troglodytes
aactagagaaacaaga

SEQ ID NO: 189056 - DNA, 16 bp, P. troglodytes
aactagccacatttca

SEQ ID NO: 189057 - DNA, 16 bp, P. troglodytes
aactagcccaaatgcc

SEQ ID NO: 189058 - DNA, 16 bp, P. troglodytes
aactagctggaggaca

SEQ ID NO: 189059 - DNA, 16 bp, P. troglodytes
aactagggaggtggag

SEQ ID NO: 189060 - DNA, 16 bp, P. troglodytes
aactataaaagcaaga

SEQ ID NO: 189061 - DNA, 16 bp, P. troglodytes
aactataatttgtcaa

SEQ ID NO: 189062 - DNA, 16 bp, P. troglodytes
aactataggtgtgtgc

SEQ ID NO: 189063 - DNA, 16 bp, P. troglodytes
aactatagttaataat

SEQ ID NO: 189064 - DNA, 16 bp, P. troglodytes
aactatatatatatag

SEQ ID NO: 189065 - DNA, 16 bp, P. troglodytes
aactatatgaggtgat

SEQ ID NO: 189066 - DNA, 16 bp, P. troglodytes
aactatcacaagaata

SEQ ID NO: 189067 - DNA, 16 bp, P. troglodytes
aactatgaaaatgtta

SEQ ID NO: 189068 - DNA, 16 bp, P. troglodytes
aactatgagaaacaaa

SEQ ID NO: 189069 - DNA, 16 bp, P. troglodytes
aactatgtgtatatat

SEQ ID NO: 189070 - DNA, 16 bp, P. troglodytes
aactatgttactggtt

SEQ ID NO: 189071 - DNA, 16 bp, P. troglodytes
aactattgaaattttt

SEQ ID NO: 189072 - DNA, 16 bp, P. troglodytes
aactatttaaagaaat

SEQ ID NO: 189073 - DNA, 16 bp, P. troglodytes
aactatttatattcct

SEQ ID NO: 189074 - DNA, 16 bp, P. troglodytes
aactatttcaaaaatt

SEQ ID NO: 189075 - DNA, 16 bp, P. troglodytes
aactatttgatctttg

SEQ ID NO: 189076 - DNA, 16 bp, P. troglodytes
aactattttaaagtgt

SEQ ID NO: 189077 - DNA, 16 bp, P. troglodytes
aactattttcaaataa

SEQ ID NO: 189078 - DNA, 16 bp, P. troglodytes
aactatttttaagtat

SEQ ID NO: 189079 - DNA, 16 bp, P. troglodytes
aactatttttttccat

SEQ ID NO: 189080 - DNA, 16 bp, P. troglodytes
aactcaaaaagccaga

SEQ ID NO: 189081 - DNA, 16 bp, P. troglodytes
aactcaaaagtccaaa

SEQ ID NO: 189082 - DNA, 16 bp, P. troglodytes
aactcaaaagtctaaa

SEQ ID NO: 189083 - DNA, 16 bp, P. troglodytes
aactcaaaatgtattt

SEQ ID NO: 189084 - DNA, 16 bp, P. troglodytes
aactcaaaggataaat

SEQ ID NO: 189085 - DNA, 16 bp, P. troglodytes
aactcaaagtcatccc

SEQ ID NO: 189086 - DNA, 16 bp, P. troglodytes
aactcaagaacagaaa

SEQ ID NO: 189087 - DNA, 16 bp, P. troglodytes
aactcaagcagttatt

SEQ ID NO: 189088 - DNA, 16 bp, P. troglodytes
aactcaatagaaaaat

SEQ ID NO: 189089 - DNA, 16 bp, P. troglodytes
aactcacacaggaaca

SEQ ID NO: 189090 - DNA, 16 bp, P. troglodytes
aactcactcattacca

SEQ ID NO: 189091 - DNA, 16 bp, P. troglodytes
aactcactcattatca

SEQ ID NO: 189092 - DNA, 16 bp, P. troglodytes
aactcactttaaatat

SEQ ID NO: 189093 - DNA, 16 bp, P. troglodytes
aactcagaaaaataag

SEQ ID NO: 189094 - DNA, 16 bp, P. troglodytes
aactcagaaatggaaa

SEQ ID NO: 189095 - DNA, 16 bp, P. troglodytes
aactcagcattcacct

SEQ ID NO: 189096 - DNA, 16 bp, P. troglodytes
aactcaggaacagcca

SEQ ID NO: 189097 - DNA, 16 bp, P. troglodytes
aactcaggaggaggag

SEQ ID NO: 189098 - DNA, 16 bp, P. troglodytes
aactcaggaggcagaa

SEQ ID NO: 189099 - DNA, 16 bp, P. troglodytes
aactcaggagtttgag

SEQ ID NO: 189100 - DNA, 16 bp, P. troglodytes
aactcagggaaacact

SEQ ID NO: 189101 - DNA, 16 bp, P. troglodytes
aactcagggattctgt

SEQ ID NO: 189102 - DNA, 16 bp, P. troglodytes
aactcagtaagaaaaa

SEQ ID NO: 189103 - DNA, 16 bp, P. troglodytes
aactcagtcagacaaa

SEQ ID NO: 189104 - DNA, 16 bp, P. troglodytes
aactcagtctcaaaaa

SEQ ID NO: 189105 - DNA, 16 bp, P. troglodytes
aactcagtgctgcctt

SEQ ID NO: 189106 - DNA, 16 bp, P. troglodytes
aactcagtggcttaaa

SEQ ID NO: 189107 - DNA, 16 bp, P. troglodytes
aactcatagaagaaaa

SEQ ID NO: 189108 - DNA, 16 bp, P. troglodytes
aactcatcatttttat

SEQ ID NO: 189109 - DNA, 16 bp, P. troglodytes
aactcatcctctttta

SEQ ID NO: 189110 - DNA, 16 bp, P. troglodytes
aactcatgagctcaag

SEQ ID NO: 189111 - DNA, 16 bp, P. troglodytes
aactcatgcctgtaat

SEQ ID NO: 189112 - DNA, 16 bp, P. troglodytes
aactcatggaaataga

SEQ ID NO: 189113 - DNA, 16 bp, P. troglodytes
aactcattgcagcctc

SEQ ID NO: 189114 - DNA, 16 bp, P. troglodytes
aactcatttaatcatc

SEQ ID NO: 189115 - DNA, 16 bp, P. troglodytes
aactcattttattttc

SEQ ID NO: 189116 - DNA, 16 bp, P. troglodytes
aactcattttcaacaa

SEQ ID NO: 189117 - DNA, 16 bp, P. troglodytes
aactcattttctacaa

SEQ ID NO: 189118 - DNA, 16 bp, P. troglodytes
aactcatttttgacaa

SEQ ID NO: 189119 - DNA, 16 bp, P. troglodytes
aactccacattcagtg

SEQ ID NO: 189120 - DNA, 16 bp, P. troglodytes
aactccagaaattaga

SEQ ID NO: 189121 - DNA, 16 bp, P. troglodytes
aactccagacctcaag

SEQ ID NO: 189122 - DNA, 22 bp, P. troglodytes
aactccagacctcaggtgatcc

SEQ ID NO: 189123 - DNA, 16 bp, P. troglodytes
aactccagagctcaag

SEQ ID NO: 189124 - DNA, 16 bp, P. troglodytes
aactccagcctgggca

SEQ ID NO: 189125 - DNA, 16 bp, P. troglodytes
aactccagggctcaag

SEQ ID NO: 189126 - DNA, 16 bp, P. troglodytes
aactccaggggaagat

SEQ ID NO: 189127 - DNA, 16 bp, P. troglodytes
aactccatgagggcag

SEQ ID NO: 189128 - DNA, 16 bp, P. troglodytes
aactccattgtatgtt

SEQ ID NO: 189129 - DNA, 16 bp, P. troglodytes
aactcccaaagatcaa

SEQ ID NO: 189130 - DNA, 20 bp, P. troglodytes
aactcccaacctcaggtgat

SEQ ID NO: 189131 - DNA, 16 bp, P. troglodytes
aactcccacttacaag

SEQ ID NO: 189132 - DNA, 16 bp, P. troglodytes
aactcccaggctcaag

SEQ ID NO: 189133 - DNA, 16 bp, P. troglodytes
aactcccatctcccta

SEQ ID NO: 189134 - DNA, 16 bp, P. troglodytes
aactccccaggcctcc

SEQ ID NO: 189135 - DNA, 16 bp, P. troglodytes
aactcccgacctcaag

SEQ ID NO: 189136 - DNA, 18 bp, P. troglodytes
aactcccgacctcaggta

SEQ ID NO: 189137 - DNA, 18 bp, P. troglodytes
aactcccgacctcaggtg

SEQ ID NO: 189138 - DNA, 20 bp, P. troglodytes
aactcccgacctcaggtgat

SEQ ID NO: 189139 - DNA, 20 bp, P. troglodytes
aactcccgaccttaggtgat

SEQ ID NO: 189140 - DNA, 20 bp, P. troglodytes
aactcccgatctcaggtgat

SEQ ID NO: 189141 - DNA, 16 bp, P. troglodytes
aactcccggcctcaag

SEQ ID NO: 189142 - DNA, 16 bp, P. troglodytes
aactcccgggctcaag

SEQ ID NO: 189143 - DNA, 16 bp, P. troglodytes
aactccctttttaaaa

SEQ ID NO: 189144 - DNA, 20 bp, P. troglodytes
aactccgcctcccgggttca

SEQ ID NO: 189145 - DNA, 16 bp, P. troglodytes
aactcctaacctcaag

SEQ ID NO: 189146 - DNA, 20 bp, P. troglodytes
aactcctaacctcaggtgat

SEQ ID NO: 189147 - DNA, 16 bp, P. troglodytes
aactcctaacctccag

SEQ ID NO: 189148 - DNA, 16 bp, P. troglodytes
aactcctaacctgaag

SEQ ID NO: 189149 - DNA, 16 bp, P. troglodytes
aactcctaacttcaag

SEQ ID NO: 189150 - DNA, 16 bp, P. troglodytes
aactcctaagctcagg

SEQ ID NO: 189151 - DNA, 16 bp, P. troglodytes
aactcctacaactcaa

SEQ ID NO: 189152 - DNA, 16 bp, P. troglodytes
aactcctagactcaag

SEQ ID NO: 189153 - DNA, 16 bp, P. troglodytes
aactcctagcctcaag

SEQ ID NO: 189154 - DNA, 16 bp, P. troglodytes
aactcctaggctcaaa

SEQ ID NO: 189155 - DNA, 16 bp, P. troglodytes
aactcctaggctcaag

SEQ ID NO: 189156 - DNA, 16 bp, P. troglodytes
aactcctattcatcct

SEQ ID NO: 189157 - DNA, 21 bp, P. troglodytes
aactcctcacctcaggtgatc

SEQ ID NO: 189158 - DNA, 16 bp, P. troglodytes
aactcctgaactcaag

SEQ ID NO: 189159 - DNA, 16 bp, P. troglodytes
aactcctgaactcagg

SEQ ID NO: 189160 - DNA, 16 bp, P. troglodytes
aactcctgaactccag

SEQ ID NO: 189161 - DNA, 16 bp, P. troglodytes
aactcctgaactcctg

SEQ ID NO: 189162 - DNA, 20 bp, P. troglodytes
aactcctgacatcaggtgat

SEQ ID NO: 189163 - DNA, 16 bp, P. troglodytes
aactcctgaccccaga

SEQ ID NO: 189164 - DNA, 20 bp, P. troglodytes
aactcctgaccgcaggtgat

SEQ ID NO: 189165 - DNA, 16 bp, P. troglodytes
aactcctgacctaagg

SEQ ID NO: 189166 - DNA, 16 bp, P. troglodytes
aactcctgacctcaaa

SEQ ID NO: 189167 - DNA, 16 bp, P. troglodytes
aactcctgacctcaac

SEQ ID NO: 189168 - DNA, 16 bp, P. troglodytes
aactcctgacctcaag

SEQ ID NO: 189169 - DNA, 16 bp, P. troglodytes
aactcctgacctcacg

SEQ ID NO: 189170 - DNA, 18 bp, P. troglodytes
aactcctgacctcagata

SEQ ID NO: 189171 - DNA, 20 bp, P. troglodytes
aactcctgacctcagatgat

SEQ ID NO: 189172 - DNA, 17 bp, P. troglodytes
aactcctgacctcaggc

SEQ ID NO: 189173 - DNA, 17 bp, P. troglodytes
aactcctgacctcaggg

SEQ ID NO: 189174 - DNA, 20 bp, P. troglodytes
aactcctgacctcaggtaat

SEQ ID NO: 189175 - DNA, 19 bp, P. troglodytes
aactcctgacctcaggtag

SEQ ID NO: 189176 - DNA, 18 bp, P. troglodytes
aactcctgacctcaggtc

SEQ ID NO: 189177 - DNA, 20 bp, P. troglodytes
aactcctgacctcaggtgac

SEQ ID NO: 189178 - DNA, 20 bp, P. troglodytes
aactcctgacctcaggtgag

SEQ ID NO: 189179 - DNA, 20 bp, P. troglodytes
aactcctgacctcaggtgat

SEQ ID NO: 189180 - DNA, 19 bp, P. troglodytes
aactcctgacctcaggtgc

SEQ ID NO: 189181 - DNA, 19 bp, P. troglodytes
aactcctgacctcaggtgg

SEQ ID NO: 189182 - DNA, 19 bp, P. troglodytes
aactcctgacctcaggtgt

SEQ ID NO: 189183 - DNA, 16 bp, P. troglodytes
aactcctgacctcagt

SEQ ID NO: 189184 - DNA, 16 bp, P. troglodytes
aactcctgacctcatg

SEQ ID NO: 189185 - DNA, 16 bp, P. troglodytes
aactcctgacctccag

SEQ ID NO: 189186 - DNA, 16 bp, P. troglodytes
aactcctgacctcgag

SEQ ID NO: 189187 - DNA, 16 bp, P. troglodytes
aactcctgacctcggg

SEQ ID NO: 189188 - DNA, 16 bp, P. troglodytes
aactcctgacctgaag

SEQ ID NO: 189189 - DNA, 16 bp, P. troglodytes
aactcctgacctgagg

SEQ ID NO: 189190 - DNA, 20 bp, P. troglodytes
aactcctgaccttaggtgat

SEQ ID NO: 189191 - DNA, 21 bp, P. troglodytes
aactcctgaccttaggttatc

SEQ ID NO: 189192 - DNA, 16 bp, P. troglodytes
aactcctgaccttggg

SEQ ID NO: 189193 - DNA, 17 bp, P. troglodytes
aactcctgaccttgtga

SEQ ID NO: 189194 - DNA, 20 bp, P. troglodytes
aactcctgacgtcaggtgat

SEQ ID NO: 189195 - DNA, 16 bp, P. troglodytes
aactcctgactgacct

SEQ ID NO: 189196 - DNA, 16 bp, P. troglodytes
aactcctgacttcaaa

SEQ ID NO: 189197 - DNA, 16 bp, P. troglodytes
aactcctgacttcaag

SEQ ID NO: 189198 - DNA, 20 bp, P. troglodytes
aactcctgacttcaggtgat

SEQ ID NO: 189199 - DNA, 16 bp, P. troglodytes
aactcctgacttcgtg

SEQ ID NO: 189200 - DNA, 16 bp, P. troglodytes
aactcctgacttgaag

SEQ ID NO: 189201 - DNA, 18 bp, P. troglodytes
aactcctgactttgtgat

SEQ ID NO: 189202 - DNA, 16 bp, P. troglodytes
aactcctgagcccaag

SEQ ID NO: 189203 - DNA, 16 bp, P. troglodytes
aactcctgagctcaaa

SEQ ID NO: 189204 - DNA, 16 bp, P. troglodytes
aactcctgagctcaag

SEQ ID NO: 189205 - DNA, 16 bp, P. troglodytes
aactcctgagctcagc

SEQ ID NO: 189206 - DNA, 16 bp, P. troglodytes
aactcctgagctcagg

SEQ ID NO: 189207 - DNA, 16 bp, P. troglodytes
aactcctgagcttaag

SEQ ID NO: 189208 - DNA, 16 bp, P. troglodytes
aactcctgatctcaag

SEQ ID NO: 189209 - DNA, 16 bp, P. troglodytes
aactcctgatctcagg

SEQ ID NO: 189210 - DNA, 16 bp, P. troglodytes
aactcctgatctcatg

SEQ ID NO: 189211 - DNA, 16 bp, P. troglodytes
aactcctgatttcaag

SEQ ID NO: 189212 - DNA, 16 bp, P. troglodytes
aactcctgccctcaag

SEQ ID NO: 189213 - DNA, 16 bp, P. troglodytes
aactcctggaagaaaa

SEQ ID NO: 189214 - DNA, 16 bp, P. troglodytes
aactcctggacacaag

SEQ ID NO: 189215 - DNA, 16 bp, P. troglodytes
aactcctggactcaaa

SEQ ID NO: 189216 - DNA, 16 bp, P. troglodytes
aactcctggactcaag

SEQ ID NO: 189217 - DNA, 17 bp, P. troglodytes
aactcctggactcaagc

SEQ ID NO: 189218 - DNA, 16 bp, P. troglodytes
aactcctggattcaag

SEQ ID NO: 189219 - DNA, 16 bp, P. troglodytes
aactcctggattcatt

SEQ ID NO: 189220 - DNA, 16 bp, P. troglodytes
aactcctggcatcaag

SEQ ID NO: 189221 - DNA, 16 bp, P. troglodytes
aactcctggcctcaaa

SEQ ID NO: 189222 - DNA, 16 bp, P. troglodytes
aactcctggcctcaac

SEQ ID NO: 189223 - DNA, 16 bp, P. troglodytes
aactcctggcctcaag

SEQ ID NO: 189224 - DNA, 16 bp, P. troglodytes
aactcctggcctcagg

SEQ ID NO: 189225 - DNA, 16 bp, P. troglodytes
aactcctggccttaag

SEQ ID NO: 189226 - DNA, 16 bp, P. troglodytes
aactcctggccttgtg

SEQ ID NO: 189227 - DNA, 16 bp, P. troglodytes
aactcctggcttcaag

SEQ ID NO: 189228 - DNA, 16 bp, P. troglodytes
aactcctgggatcaag

SEQ ID NO: 189229 - DNA, 16 bp, P. troglodytes
aactcctgggccaaag

SEQ ID NO: 189230 - DNA, 16 bp, P. troglodytes
aactcctgggcccaag

SEQ ID NO: 189231 - DNA, 16 bp, P. troglodytes
aactcctgggctcaaa

SEQ ID NO: 189232 - DNA, 16 bp, P. troglodytes
aactcctgggctcaag

SEQ ID NO: 189233 - DNA, 16 bp, P. troglodytes
aactcctgggctcaga

SEQ ID NO: 189234 - DNA, 16 bp, P. troglodytes
aactcctgggctcagg

SEQ ID NO: 189235 - DNA, 16 bp, P. troglodytes
aactcctgggctcatg

SEQ ID NO: 189236 - DNA, 16 bp, P. troglodytes
aactcctgggctccag

SEQ ID NO: 189237 - DNA, 16 bp, P. troglodytes
aactcctgggctctag

SEQ ID NO: 189238 - DNA, 16 bp, P. troglodytes
aactcctgggcttaag

SEQ ID NO: 189239 - DNA, 16 bp, P. troglodytes
aactcctgggcttgag

SEQ ID NO: 189240 - DNA, 16 bp, P. troglodytes
aactcctggggctcaa

SEQ ID NO: 189241 - DNA, 16 bp, P. troglodytes
aactcctgggttcaag

SEQ ID NO: 189242 - DNA, 16 bp, P. troglodytes
aactcctgggttcagg

SEQ ID NO: 189243 - DNA, 16 bp, P. troglodytes
aactcctggtctcaag

SEQ ID NO: 189244 - DNA, 16 bp, P. troglodytes
aactcctggtctccag

SEQ ID NO: 189245 - DNA, 16 bp, P. troglodytes
aactcctggtctcgag

SEQ ID NO: 189246 - DNA, 16 bp, P. troglodytes
aactcctgtcctcaag

SEQ ID NO: 189247 - DNA, 16 bp, P. troglodytes
aactcctgtcctcagg

SEQ ID NO: 189248 - DNA, 16 bp, P. troglodytes
aactcctgtgctcaag

SEQ ID NO: 189249 - DNA, 16 bp, P. troglodytes
aactccttggctcaaa

SEQ ID NO: 189250 - DNA, 16 bp, P. troglodytes
aactccttggctcaag

SEQ ID NO: 189251 - DNA, 16 bp, P. troglodytes
aactctaaacagacca

SEQ ID NO: 189252 - DNA, 16 bp, P. troglodytes
aactctacagaaaaaa

SEQ ID NO: 189253 - DNA, 16 bp, P. troglodytes
aactctatttaaaatt

SEQ ID NO: 189254 - DNA, 16 bp, P. troglodytes
aactctcaaaaccaca

SEQ ID NO: 189255 - DNA, 16 bp, P. troglodytes
aactctcaaaagaaaa

SEQ ID NO: 189256 - DNA, 16 bp, P. troglodytes
aactctcaaaattcaa

SEQ ID NO: 189257 - DNA, 16 bp, P. troglodytes
aactctcagaagaaaa

SEQ ID NO: 189258 - DNA, 16 bp, P. troglodytes
aactctgcattcagtg

SEQ ID NO: 189259 - DNA, 16 bp, P. troglodytes
aactctgcctcaaaaa

SEQ ID NO: 189260 - DNA, 16 bp, P. troglodytes
aactctgccttctggg

SEQ ID NO: 189261 - DNA, 16 bp, P. troglodytes
aactctgctccccaaa

SEQ ID NO: 189262 - DNA, 16 bp, P. troglodytes
aactctgcttcctggg

SEQ ID NO: 189263 - DNA, 16 bp, P. troglodytes
aactctgggattaaag

SEQ ID NO: 189264 - DNA, 16 bp, P. troglodytes
aactctgtacccatca

SEQ ID NO: 189265 - DNA, 16 bp, P. troglodytes
aactctgtcccaaaaa

SEQ ID NO: 189266 - DNA, 18 bp, P. troglodytes
aactctgtctcaaaaaca

SEQ ID NO: 189267 - DNA, 16 bp, P. troglodytes
aactctgtgaagaaag

SEQ ID NO: 189268 - DNA, 16 bp, P. troglodytes
aactctgtgactttgg

SEQ ID NO: 189269 - DNA, 16 bp, P. troglodytes
aactcttcattttgtt

SEQ ID NO: 189270 - DNA, 16 bp, P. troglodytes
aactcttccaatccat

SEQ ID NO: 189271 - DNA, 16 bp, P. troglodytes
aactcttcttgttgca

SEQ ID NO: 189272 - DNA, 20 bp, P. troglodytes
aactcttgacctcaggtgat

SEQ ID NO: 189273 - DNA, 16 bp, P. troglodytes
aactcttgacctgaag

SEQ ID NO: 189274 - DNA, 16 bp, P. troglodytes
aactcttggactcaag

SEQ ID NO: 189275 - DNA, 16 bp, P. troglodytes
aactcttggcctcaaa

SEQ ID NO: 189276 - DNA, 16 bp, P. troglodytes
aactcttggcctcaag

SEQ ID NO: 189277 - DNA, 16 bp, P. troglodytes
aactcttggcttcaag

SEQ ID NO: 189278 - DNA, 16 bp, P. troglodytes
aactcttgggctcaag

SEQ ID NO: 189279 - DNA, 16 bp, P. troglodytes
aactcttgggctcagg

SEQ ID NO: 189280 - DNA, 16 bp, P. troglodytes
aactcttttagggcag

SEQ ID NO: 189281 - DNA, 16 bp, P. troglodytes
aactgaaaaatacaat

SEQ ID NO: 189282 - DNA, 16 bp, P. troglodytes
aactgaaaataaaatt

SEQ ID NO: 189283 - DNA, 16 bp, P. troglodytes
aactgaaaatagaaat

SEQ ID NO: 189284 - DNA, 16 bp, P. troglodytes
aactgaaaccttggaa

SEQ ID NO: 189285 - DNA, 16 bp, P. troglodytes
aactgaaacttcatac

SEQ ID NO: 189286 - DNA, 16 bp, P. troglodytes
aactgaaagaaagggt

SEQ ID NO: 189287 - DNA, 16 bp, P. troglodytes
aactgaaagagaaata

SEQ ID NO: 189288 - DNA, 16 bp, P. troglodytes
aactgaaagagacaga

SEQ ID NO: 189289 - DNA, 16 bp, P. troglodytes
aactgaaagagtataa

SEQ ID NO: 189290 - DNA, 16 bp, P. troglodytes
aactgaaagtcaccag

SEQ ID NO: 189291 - DNA, 16 bp, P. troglodytes
aactgaaatatatata

SEQ ID NO: 189292 - DNA, 16 bp, P. troglodytes
aactgaaatgaaaaat

SEQ ID NO: 189293 - DNA, 16 bp, P. troglodytes
aactgaaattttatac

SEQ ID NO: 189294 - DNA, 16 bp, P. troglodytes
aactgaacaagctgct

SEQ ID NO: 189295 - DNA, 16 bp, P. troglodytes
aactgaacagtgagaa

SEQ ID NO: 189296 - DNA, 16 bp, P. troglodytes
aactgaacattttaaa

SEQ ID NO: 189297 - DNA, 16 bp, P. troglodytes
aactgaagaaaatatt

SEQ ID NO: 189298 - DNA, 16 bp, P. troglodytes
aactgaagaacagaga

SEQ ID NO: 189299 - DNA, 16 bp, P. troglodytes
aactgaagaaggaaaa

SEQ ID NO: 189300 - DNA, 16 bp, P. troglodytes
aactgaagaatgatga

SEQ ID NO: 189301 - DNA, 16 bp, P. troglodytes
aactgaagagagaaat

SEQ ID NO: 189302 - DNA, 16 bp, P. troglodytes
aactgaagaggaagga

SEQ ID NO: 189303 - DNA, 16 bp, P. troglodytes
aactgaagaggaggaa

SEQ ID NO: 189304 - DNA, 16 bp, P. troglodytes
aactgaagctcagaga

SEQ ID NO: 189305 - DNA, 16 bp, P. troglodytes
aactgaaggaaactga

SEQ ID NO: 189306 - DNA, 16 bp, P. troglodytes
aactgaaggaaagaga

SEQ ID NO: 189307 - DNA, 16 bp, P. troglodytes
aactgaaggaaattaa

SEQ ID NO: 189308 - DNA, 16 bp, P. troglodytes
aactgaaggaaattga

SEQ ID NO: 189309 - DNA, 16 bp, P. troglodytes
aactgaaggagacaga

SEQ ID NO: 189310 - DNA, 16 bp, P. troglodytes
aactgaaggagctaga

SEQ ID NO: 189311 - DNA, 16 bp, P. troglodytes
aactgaaggagttaga

SEQ ID NO: 189312 - DNA, 16 bp, P. troglodytes
aactgaagggagaaat

SEQ ID NO: 189313 - DNA, 16 bp, P. troglodytes
aactgaagtttgattt

SEQ ID NO: 189314 - DNA, 16 bp, P. troglodytes
aactgaataccacaga

SEQ ID NO: 189315 - DNA, 16 bp, P. troglodytes
aactgaatattaaaat

SEQ ID NO: 189316 - DNA, 16 bp, P. troglodytes
aactgaatgaaattga

SEQ ID NO: 189317 - DNA, 16 bp, P. troglodytes
aactgaatgtttttaa

SEQ ID NO: 189318 - DNA, 16 bp, P. troglodytes
aactgaattctgccaa

SEQ ID NO: 189319 - DNA, 16 bp, P. troglodytes
aactgaattttgacaa

SEQ ID NO: 189320 - DNA, 16 bp, P. troglodytes
aactgaatttttcatt

SEQ ID NO: 189321 - DNA, 16 bp, P. troglodytes
aactgacaaactgttt

SEQ ID NO: 189322 - DNA, 16 bp, P. troglodytes
aactgacagaactgaa

SEQ ID NO: 189323 - DNA, 16 bp, P. troglodytes
aactgacatttattga

SEQ ID NO: 189324 - DNA, 16 bp, P. troglodytes
aactgaccaacattaa

SEQ ID NO: 189325 - DNA, 16 bp, P. troglodytes
aactgaccccaaagaa

SEQ ID NO: 189326 - DNA, 16 bp, P. troglodytes
aactgagaaaaaaatg

SEQ ID NO: 189327 - DNA, 16 bp, P. troglodytes
aactgagatcatgtca

SEQ ID NO: 189328 - DNA, 16 bp, P. troglodytes
aactgagatccagaga

SEQ ID NO: 189329 - DNA, 16 bp, P. troglodytes
aactgagcattttcaa

SEQ ID NO: 189330 - DNA, 16 bp, P. troglodytes
aactgaggaggaggga

SEQ ID NO: 189331 - DNA, 16 bp, P. troglodytes
aactgaggaggcggag

SEQ ID NO: 189332 - DNA, 16 bp, P. troglodytes
aactgaggcacagaga

SEQ ID NO: 189333 - DNA, 16 bp, P. troglodytes
aactgaggcacagagg

SEQ ID NO: 189334 - DNA, 16 bp, P. troglodytes
aactgaggcaggagac

SEQ ID NO: 189335 - DNA, 16 bp, P. troglodytes
aactgaggcccagcaa

SEQ ID NO: 189336 - DNA, 16 bp, P. troglodytes
aactgaggctcaggga

SEQ ID NO: 189337 - DNA, 16 bp, P. troglodytes
aactgaggcttagaaa

SEQ ID NO: 189338 - DNA, 16 bp, P. troglodytes
aactgaggcttggaaa

SEQ ID NO: 189339 - DNA, 16 bp, P. troglodytes
aactgagggacattct

SEQ ID NO: 189340 - DNA, 16 bp, P. troglodytes
aactgaggggaaaaaa

SEQ ID NO: 189341 - DNA, 16 bp, P. troglodytes
aactgaggtccagaga

SEQ ID NO: 189342 - DNA, 16 bp, P. troglodytes
aactgagtcttcaaaa

SEQ ID NO: 189343 - DNA, 16 bp, P. troglodytes
aactgagtgacttaaa

SEQ ID NO: 189344 - DNA, 16 bp, P. troglodytes
aactgagttcaagtcc

SEQ ID NO: 189345 - DNA, 16 bp, P. troglodytes
aactgatatttattga

SEQ ID NO: 189346 - DNA, 16 bp, P. troglodytes
aactgatcaaaaataa

SEQ ID NO: 189347 - DNA, 16 bp, P. troglodytes
aactgatctttgacag

SEQ ID NO: 189348 - DNA, 16 bp, P. troglodytes
aactgatggttttaaa

SEQ ID NO: 189349 - DNA, 16 bp, P. troglodytes
aactgattcttctgcc

SEQ ID NO: 189350 - DNA, 16 bp, P. troglodytes
aactgattttcaacaa

SEQ ID NO: 189351 - DNA, 16 bp, P. troglodytes
aactgattttcaataa

SEQ ID NO: 189352 - DNA, 16 bp, P. troglodytes
aactgatttttaaaat

SEQ ID NO: 189353 - DNA, 16 bp, P. troglodytes
aactgatttttttaaa

SEQ ID NO: 189354 - DNA, 16 bp, P. troglodytes
aactgcaaatcagaaa

SEQ ID NO: 189355 - DNA, 16 bp, P. troglodytes
aactgcagctgcagac

SEQ ID NO: 189356 - DNA, 16 bp, P. troglodytes
aactgcaggaaaaaaa

SEQ ID NO: 189357 - DNA, 16 bp, P. troglodytes
aactgcatcaactaac

SEQ ID NO: 189358 - DNA, 16 bp, P. troglodytes
aactgcatgttttcct

SEQ ID NO: 189359 - DNA, 16 bp, P. troglodytes
aactgcattttaacaa

SEQ ID NO: 189360 - DNA, 16 bp, P. troglodytes
aactgccaaactgttt

SEQ ID NO: 189361 - DNA, 16 bp, P. troglodytes
aactgccacctcctgg

SEQ ID NO: 189362 - DNA, 16 bp, P. troglodytes
aactgccagactgttt

SEQ ID NO: 189363 - DNA, 16 bp, P. troglodytes
aactgccctgagctgc

SEQ ID NO: 189364 - DNA, 16 bp, P. troglodytes
aactgcccttttataa

SEQ ID NO: 189365 - DNA, 16 bp, P. troglodytes
aactgcctacaatatt

SEQ ID NO: 189366 - DNA, 16 bp, P. troglodytes
aactgctccaacctct

SEQ ID NO: 189367 - DNA, 17 bp, P. troglodytes
aactgctcctaagatca

SEQ ID NO: 189368 - DNA, 16 bp, P. troglodytes
aactgctcttttaaaa

SEQ ID NO: 189369 - DNA, 16 bp, P. troglodytes
aactgctgacctcaag

SEQ ID NO: 189370 - DNA, 16 bp, P. troglodytes
aactgctggcctcaag

SEQ ID NO: 189371 - DNA, 16 bp, P. troglodytes
aactgctttaaaaatt

SEQ ID NO: 189372 - DNA, 16 bp, P. troglodytes
aactgctttttctgca

SEQ ID NO: 189373 - DNA, 16 bp, P. troglodytes
aactggaaaaaaaatg

SEQ ID NO: 189374 - DNA, 16 bp, P. troglodytes
aactggaaaaagacaa

SEQ ID NO: 189375 - DNA, 16 bp, P. troglodytes
aactggaaagaagcta

SEQ ID NO: 189376 - DNA, 16 bp, P. troglodytes
aactggaaataaccca

SEQ ID NO: 189377 - DNA, 16 bp, P. troglodytes
aactggaaataattca

SEQ ID NO: 189378 - DNA, 16 bp, P. troglodytes
aactggaacccttgtg

SEQ ID NO: 189379 - DNA, 16 bp, P. troglodytes
aactggaatgacaaga

SEQ ID NO: 189380 - DNA, 16 bp, P. troglodytes
aactggaattctcata

SEQ ID NO: 189381 - DNA, 16 bp, P. troglodytes
aactggaccccatcct

SEQ ID NO: 189382 - DNA, 16 bp, P. troglodytes
aactggaccccttcct

SEQ ID NO: 189383 - DNA, 16 bp, P. troglodytes
aactggacttacagtt

SEQ ID NO: 189384 - DNA, 16 bp, P. troglodytes
aactggagaaccaaga

SEQ ID NO: 189385 - DNA, 16 bp, P. troglodytes
aactggaggttattat

SEQ ID NO: 189386 - DNA, 16 bp, P. troglodytes
aactggctagccacat

SEQ ID NO: 189387 - DNA, 16 bp, P. troglodytes
aactggctagccatac

SEQ ID NO: 189388 - DNA, 17 bp, P. troglodytes
aactggctagccatatg

SEQ ID NO: 189389 - DNA, 16 bp, P. troglodytes
aactggctcatgtgat

SEQ ID NO: 189390 - DNA, 17 bp, P. troglodytes
aactggctggccatatg

SEQ ID NO: 189391 - DNA, 16 bp, P. troglodytes
aactgggactacagga

SEQ ID NO: 189392 - DNA, 16 bp, P. troglodytes
aactgggaggcagagg

SEQ ID NO: 189393 - DNA, 16 bp, P. troglodytes
aactgggatgagatga

SEQ ID NO: 189394 - DNA, 16 bp, P. troglodytes
aactgggcaactgttg

SEQ ID NO: 189395 - DNA, 16 bp, P. troglodytes
aactgggcatggtggt

SEQ ID NO: 189396 - DNA, 16 bp, P. troglodytes
aactggggctacaggt

SEQ ID NO: 189397 - DNA, 16 bp, P. troglodytes
aactgggtcatgcaaa

SEQ ID NO: 189398 - DNA, 17 bp, P. troglodytes
aactgggtggagcccac

SEQ ID NO: 189399 - DNA, 16 bp, P. troglodytes
aactggtcttcctgct

SEQ ID NO: 189400 - DNA, 16 bp, P. troglodytes
aactggtctttgacaa

SEQ ID NO: 189401 - DNA, 16 bp, P. troglodytes
aactgtaagaaatgaa

SEQ ID NO: 189402 - DNA, 16 bp, P. troglodytes
aactgtacactgaaaa

SEQ ID NO: 189403 - DNA, 16 bp, P. troglodytes
aactgtacatatttat

SEQ ID NO: 189404 - DNA, 16 bp, P. troglodytes
aactgtacatttaaaa

SEQ ID NO: 189405 - DNA, 16 bp, P. troglodytes
aactgtatctttcctt

SEQ ID NO: 189406 - DNA, 16 bp, P. troglodytes
aactgtatttattttt

SEQ ID NO: 189407 - DNA, 16 bp, P. troglodytes
aactgtatttttgtac

SEQ ID NO: 189408 - DNA, 16 bp, P. troglodytes
aactgtcaccacaatc

SEQ ID NO: 189409 - DNA, 16 bp, P. troglodytes
aactgtcatgagtatt

SEQ ID NO: 189410 - DNA, 16 bp, P. troglodytes
aactgtctcaaaaaat

SEQ ID NO: 189411 - DNA, 16 bp, P. troglodytes
aactgtctcctggaca

SEQ ID NO: 189412 - DNA, 16 bp, P. troglodytes
aactgtctttgtttct

SEQ ID NO: 189413 - DNA, 16 bp, P. troglodytes
aactgtgagaaaacaa

SEQ ID NO: 189414 - DNA, 16 bp, P. troglodytes
aactgtgagaaataag

SEQ ID NO: 189415 - DNA, 16 bp, P. troglodytes
aactgtgagaagaggg

SEQ ID NO: 189416 - DNA, 16 bp, P. troglodytes
aactgtgagatagtaa

SEQ ID NO: 189417 - DNA, 16 bp, P. troglodytes
aactgtgagccaaata

SEQ ID NO: 189418 - DNA, 16 bp, P. troglodytes
aactgtgagccaatta

SEQ ID NO: 189419 - DNA, 17 bp, P. troglodytes
aactgtgagtcaattaa

SEQ ID NO: 189420 - DNA, 16 bp, P. troglodytes
aactgtgataaaataa

SEQ ID NO: 189421 - DNA, 16 bp, P. troglodytes
aactgtggctcagaga

SEQ ID NO: 189422 - DNA, 16 bp, P. troglodytes
aactgtggtatatcca

SEQ ID NO: 189423 - DNA, 16 bp, P. troglodytes
aactgtggtatgtaaa

SEQ ID NO: 189424 - DNA, 16 bp, P. troglodytes
aactgtgtatttttat

SEQ ID NO: 189425 - DNA, 16 bp, P. troglodytes
aactgtgtgaccctgg

SEQ ID NO: 189426 - DNA, 16 bp, P. troglodytes
aactgtgtgactttgg

SEQ ID NO: 189427 - DNA, 16 bp, P. troglodytes
aactgttaagtccatt

SEQ ID NO: 189428 - DNA, 16 bp, P. troglodytes
aactgttaccaaaaaa

SEQ ID NO: 189429 - DNA, 16 bp, P. troglodytes
aactgttccaacctct

SEQ ID NO: 189430 - DNA, 16 bp, P. troglodytes
aactgttccagcctct

SEQ ID NO: 189431 - DNA, 16 bp, P. troglodytes
aactgttgaaagacaa

SEQ ID NO: 189432 - DNA, 16 bp, P. troglodytes
aactgttttcttcttt

SEQ ID NO: 189433 - DNA, 16 bp, P. troglodytes
aactgtttttaaaaat

SEQ ID NO: 189434 - DNA, 16 bp, P. troglodytes
aacttaaaaatagaat

SEQ ID NO: 189435 - DNA, 16 bp, P. troglodytes
aacttaaaagtccaca

SEQ ID NO: 189436 - DNA, 16 bp, P. troglodytes
aacttaaaagttggaa

SEQ ID NO: 189437 - DNA, 16 bp, P. troglodytes
aacttaaaatacaagt

SEQ ID NO: 189438 - DNA, 16 bp, P. troglodytes
aacttaaaatatttca

SEQ ID NO: 189439 - DNA, 16 bp, P. troglodytes
aacttaaacaattcaa

SEQ ID NO: 189440 - DNA, 16 bp, P. troglodytes
aacttaaagaataata

SEQ ID NO: 189441 - DNA, 16 bp, P. troglodytes
aacttaaagaatgtaa

SEQ ID NO: 189442 - DNA, 16 bp, P. troglodytes
aacttaaagcagaact

SEQ ID NO: 189443 - DNA, 16 bp, P. troglodytes
aacttaaaggataata

SEQ ID NO: 189444 - DNA, 16 bp, P. troglodytes
aacttaaagtaaaatt

SEQ ID NO: 189445 - DNA, 17 bp, P. troglodytes
aacttaaagtataataa

SEQ ID NO: 189446 - DNA, 16 bp, P. troglodytes
aacttaaataaatttg

SEQ ID NO: 189447 - DNA, 16 bp, P. troglodytes
aacttaactcttgttt

SEQ ID NO: 189448 - DNA, 16 bp, P. troglodytes
aacttaactgataaat

SEQ ID NO: 189449 - DNA, 16 bp, P. troglodytes
aacttaagatgaatta

SEQ ID NO: 189450 - DNA, 16 bp, P. troglodytes
aacttacaaggaatgt

SEQ ID NO: 189451 - DNA, 16 bp, P. troglodytes
aacttacatttaaaag

SEQ ID NO: 189452 - DNA, 16 bp, P. troglodytes
aacttacccaaagtca

SEQ ID NO: 189453 - DNA, 16 bp, P. troglodytes
aacttagaattctgta

SEQ ID NO: 189454 - DNA, 16 bp, P. troglodytes
aacttagataaaatgg

SEQ ID NO: 189455 - DNA, 16 bp, P. troglodytes
aacttatatttaaaag

SEQ ID NO: 189456 - DNA, 16 bp, P. troglodytes
aacttatccaaggtca

SEQ ID NO: 189457 - DNA, 16 bp, P. troglodytes
aacttcaaagaccaaa

SEQ ID NO: 189458 - DNA, 16 bp, P. troglodytes
aacttcaagaatgaag

SEQ ID NO: 189459 - DNA, 16 bp, P. troglodytes
aacttcaatcacatac

SEQ ID NO: 189460 - DNA, 16 bp, P. troglodytes
aacttcaccacagcct

SEQ ID NO: 189461 - DNA, 16 bp, P. troglodytes
aacttcacctcccggg

SEQ ID NO: 189462 - DNA, 16 bp, P. troglodytes
aacttcagaaaagtct

SEQ ID NO: 189463 - DNA, 31 bp, P. troglodytes
aacttcagcaaagtctcaggatacaaaatca

SEQ ID NO: 189464 - DNA, 16 bp, P. troglodytes
aacttcaggaaataca

SEQ ID NO: 189465 - DNA, 16 bp, P. troglodytes
aacttcatattgctga

SEQ ID NO: 189466 - DNA, 16 bp, P. troglodytes
aacttcatgatgcatg

SEQ ID NO: 189467 - DNA, 16 bp, P. troglodytes
aacttccagaaataaa

SEQ ID NO: 189468 - DNA, 16 bp, P. troglodytes
aacttccagaactgtg

SEQ ID NO: 189469 - DNA, 16 bp, P. troglodytes
aacttccagaggaaag

SEQ ID NO: 189470 - DNA, 16 bp, P. troglodytes
aacttccatttataaa

SEQ ID NO: 189471 - DNA, 16 bp, P. troglodytes
aacttcccaaatttga

SEQ ID NO: 189472 - DNA, 16 bp, P. troglodytes
aacttcccagcctcca

SEQ ID NO: 189473 - DNA, 16 bp, P. troglodytes
aacttcccagtggctt

SEQ ID NO: 189474 - DNA, 16 bp, P. troglodytes
aacttccctgagactg

SEQ ID NO: 189475 - DNA, 19 bp, P. troglodytes
aacttccgacctcaggtga

SEQ ID NO: 189476 - DNA, 17 bp, P. troglodytes
aacttcctcctttagct

SEQ ID NO: 189477 - DNA, 16 bp, P. troglodytes
aacttcctgaggcctc

SEQ ID NO: 189478 - DNA, 16 bp, P. troglodytes
aacttcctgattttga

SEQ ID NO: 189479 - DNA, 16 bp, P. troglodytes
aacttctacaagaaaa

SEQ ID NO: 189480 - DNA, 16 bp, P. troglodytes
aacttctaggctcaag

SEQ ID NO: 189481 - DNA, 16 bp, P. troglodytes
aacttctcttcatgct

SEQ ID NO: 189482 - DNA, 16 bp, P. troglodytes
aacttctgcctgccag

SEQ ID NO: 189483 - DNA, 16 bp, P. troglodytes
aacttctgctctttga

SEQ ID NO: 189484 - DNA, 16 bp, P. troglodytes
aacttctgcttcccag

SEQ ID NO: 189485 - DNA, 16 bp, P. troglodytes
aacttctggcctcaag

SEQ ID NO: 189486 - DNA, 16 bp, P. troglodytes
aacttctgggatcaag

SEQ ID NO: 189487 - DNA, 16 bp, P. troglodytes
aacttctggtctcaag

SEQ ID NO: 189488 - DNA, 16 bp, P. troglodytes
aacttctgttcctgtt

SEQ ID NO: 189489 - DNA, 16 bp, P. troglodytes
aacttcttaattttaa

SEQ ID NO: 189490 - DNA, 16 bp, P. troglodytes
aacttcttcaacctga

SEQ ID NO: 189491 - DNA, 16 bp, P. troglodytes
aacttcttggaggctt

SEQ ID NO: 189492 - DNA, 16 bp, P. troglodytes
aacttctttgtcaatt

SEQ ID NO: 189493 - DNA, 16 bp, P. troglodytes
aacttctttttcttca

SEQ ID NO: 189494 - DNA, 16 bp, P. troglodytes
aacttcttttttaaaa

SEQ ID NO: 189495 - DNA, 16 bp, P. troglodytes
aacttgaaaagtattt

SEQ ID NO: 189496 - DNA, 16 bp, P. troglodytes
aacttgaaaattattt

SEQ ID NO: 189497 - DNA, 16 bp, P. troglodytes
aacttgaaagaaaaat

SEQ ID NO: 189498 - DNA, 16 bp, P. troglodytes
aacttgaacagatgaa

SEQ ID NO: 189499 - DNA, 16 bp, P. troglodytes
aacttgaagataaatc

SEQ ID NO: 189500 - DNA, 16 bp, P. troglodytes
aacttgaatgtaaatg

SEQ ID NO: 189501 - DNA, 16 bp, P. troglodytes
aacttgaattttatct

SEQ ID NO: 189502 - DNA, 16 bp, P. troglodytes
aacttgatggcttaaa

SEQ ID NO: 189503 - DNA, 16 bp, P. troglodytes
aacttgattttaaaaa

SEQ ID NO: 189504 - DNA, 16 bp, P. troglodytes
aacttgattttaaaat

SEQ ID NO: 189505 - DNA, 16 bp, P. troglodytes
aacttgcccaacatca

SEQ ID NO: 189506 - DNA, 16 bp, P. troglodytes
aacttgcccaagatca

SEQ ID NO: 189507 - DNA, 16 bp, P. troglodytes
aacttgcccaaggcca

SEQ ID NO: 189508 - DNA, 16 bp, P. troglodytes
aacttgcccaaggtaa

SEQ ID NO: 189509 - DNA, 16 bp, P. troglodytes
aacttgctttggccaa

SEQ ID NO: 189510 - DNA, 16 bp, P. troglodytes
aacttggaaaaaaatt

SEQ ID NO: 189511 - DNA, 16 bp, P. troglodytes
aacttggaagcagcca

SEQ ID NO: 189512 - DNA, 16 bp, P. troglodytes
aacttggccttccaaa

SEQ ID NO: 189513 - DNA, 16 bp, P. troglodytes
aacttggggagggcag

SEQ ID NO: 189514 - DNA, 16 bp, P. troglodytes
aacttgggtaccagct

SEQ ID NO: 189515 - DNA, 16 bp, P. troglodytes
aacttggtgaatctga

SEQ ID NO: 189516 - DNA, 16 bp, P. troglodytes
aacttggtgctgttgg

SEQ ID NO: 189517 - DNA, 17 bp, P. troglodytes
aacttggttgcattctc

SEQ ID NO: 189518 - DNA, 16 bp, P. troglodytes
aacttgtgcaggaaaa

SEQ ID NO: 189519 - DNA, 16 bp, P. troglodytes
aacttgttatgcagca

SEQ ID NO: 189520 - DNA, 16 bp, P. troglodytes
aacttgttgggaactg

SEQ ID NO: 189521 - DNA, 16 bp, P. troglodytes
aacttgtttattcatt

SEQ ID NO: 189522 - DNA, 16 bp, P. troglodytes
aacttgtttccattct

SEQ ID NO: 189523 - DNA, 16 bp, P. troglodytes
aacttgtttttcattt

SEQ ID NO: 189524 - DNA, 16 bp, P. troglodytes
aacttgtttttctcat

SEQ ID NO: 189525 - DNA, 16 bp, P. troglodytes
aactttaaaaaagtta

SEQ ID NO: 189526 - DNA, 16 bp, P. troglodytes
aactttaaaaaatgta

SEQ ID NO: 189527 - DNA, 16 bp, P. troglodytes
aactttaaaaagtaat

SEQ ID NO: 189528 - DNA, 16 bp, P. troglodytes
aactttaaaaatgtgt

SEQ ID NO: 189529 - DNA, 16 bp, P. troglodytes
aactttaaaacaaaga

SEQ ID NO: 189530 - DNA, 16 bp, P. troglodytes
aactttaaaatagaaa

SEQ ID NO: 189531 - DNA, 16 bp, P. troglodytes
aactttaaagaagttt

SEQ ID NO: 189532 - DNA, 16 bp, P. troglodytes
aactttaaagttgttt

SEQ ID NO: 189533 - DNA, 17 bp, P. troglodytes
aactttaagttttaggg

SEQ ID NO: 189534 - DNA, 16 bp, P. troglodytes
aactttaggatttttt

SEQ ID NO: 189535 - DNA, 16 bp, P. troglodytes
aactttatcataagta

SEQ ID NO: 189536 - DNA, 16 bp, P. troglodytes
aactttattttgaaat

SEQ ID NO: 189537 - DNA, 16 bp, P. troglodytes
aactttcagaagaaaa

SEQ ID NO: 189538 - DNA, 16 bp, P. troglodytes
aactttcagtcctgca

SEQ ID NO: 189539 - DNA, 16 bp, P. troglodytes
aactttcatcttttca

SEQ ID NO: 189540 - DNA, 16 bp, P. troglodytes
aactttcattttaaaa

SEQ ID NO: 189541 - DNA, 16 bp, P. troglodytes
aactttccaaaatcaa

SEQ ID NO: 189542 - DNA, 16 bp, P. troglodytes
aactttccaaacctag

SEQ ID NO: 189543 - DNA, 16 bp, P. troglodytes
aactttccaaataaaa

SEQ ID NO: 189544 - DNA, 16 bp, P. troglodytes
aactttccattttatt

SEQ ID NO: 189545 - DNA, 16 bp, P. troglodytes
aactttctccaagaca

SEQ ID NO: 189546 - DNA, 16 bp, P. troglodytes
aactttgaaaaaaata

SEQ ID NO: 189547 - DNA, 16 bp, P. troglodytes
aactttgaaaaatatt

SEQ ID NO: 189548 - DNA, 16 bp, P. troglodytes
aactttgaaacaacca

SEQ ID NO: 189549 - DNA, 16 bp, P. troglodytes
aactttgaacttgaga

SEQ ID NO: 189550 - DNA, 16 bp, P. troglodytes
aactttgaagaggaaa

SEQ ID NO: 189551 - DNA, 16 bp, P. troglodytes
aactttgagggacaca

SEQ ID NO: 189552 - DNA, 16 bp, P. troglodytes
aactttgccatgaaat

SEQ ID NO: 189553 - DNA, 16 bp, P. troglodytes
aactttgcctcccagg

SEQ ID NO: 189554 - DNA, 16 bp, P. troglodytes
aactttgctctgaaat

SEQ ID NO: 189555 - DNA, 16 bp, P. troglodytes
aactttggaaacaaaa

SEQ ID NO: 189556 - DNA, 19 bp, P. troglodytes
aactttgggaggctgaggc

SEQ ID NO: 189557 - DNA, 16 bp, P. troglodytes
aactttgggcaagtta

SEQ ID NO: 189558 - DNA, 16 bp, P. troglodytes
aactttggtctccaca

SEQ ID NO: 189559 - DNA, 16 bp, P. troglodytes
aactttgtaataattt

SEQ ID NO: 189560 - DNA, 16 bp, P. troglodytes
aactttgtaatatttt

SEQ ID NO: 189561 - DNA, 16 bp, P. troglodytes
aactttgtaattttga

SEQ ID NO: 189562 - DNA, 16 bp, P. troglodytes
aactttgttctctggc

SEQ ID NO: 189563 - DNA, 16 bp, P. troglodytes
aactttgttcttattt

SEQ ID NO: 189564 - DNA, 16 bp, P. troglodytes
aactttgttctttttg

SEQ ID NO: 189565 - DNA, 16 bp, P. troglodytes
aactttgttttatgca

SEQ ID NO: 189566 - DNA, 16 bp, P. troglodytes
aacttttaaaacttaa

SEQ ID NO: 189567 - DNA, 16 bp, P. troglodytes
aacttttagaaaaaaa

SEQ ID NO: 189568 - DNA, 16 bp, P. troglodytes
aacttttagaaaaata

SEQ ID NO: 189569 - DNA, 16 bp, P. troglodytes
aacttttagaaaatat

SEQ ID NO: 189570 - DNA, 16 bp, P. troglodytes
aacttttagaaataaa

SEQ ID NO: 189571 - DNA, 16 bp, P. troglodytes
aacttttaggttcaag

SEQ ID NO: 189572 - DNA, 16 bp, P. troglodytes
aacttttatttgtcaa

SEQ ID NO: 189573 - DNA, 16 bp, P. troglodytes
aacttttattttagat

SEQ ID NO: 189574 - DNA, 16 bp, P. troglodytes
aacttttattttcagt

SEQ ID NO: 189575 - DNA, 16 bp, P. troglodytes
aacttttattttggaa

SEQ ID NO: 189576 - DNA, 16 bp, P. troglodytes
aacttttcagctccat

SEQ ID NO: 189577 - DNA, 16 bp, P. troglodytes
aacttttcagtggaaa

SEQ ID NO: 189578 - DNA, 16 bp, P. troglodytes
aacttttccaaagtca

SEQ ID NO: 189579 - DNA, 16 bp, P. troglodytes
aacttttccacatctt

SEQ ID NO: 189580 - DNA, 16 bp, P. troglodytes
aacttttctgtatttt

SEQ ID NO: 189581 - DNA, 16 bp, P. troglodytes
aacttttgactcccct

SEQ ID NO: 189582 - DNA, 16 bp, P. troglodytes
aacttttgcagtttga

SEQ ID NO: 189583 - DNA, 16 bp, P. troglodytes
aacttttgctcatttt

SEQ ID NO: 189584 - DNA, 16 bp, P. troglodytes
aactttttaaaaacca

SEQ ID NO: 189585 - DNA, 16 bp, P. troglodytes
aactttttaaaaactt

SEQ ID NO: 189586 - DNA, 16 bp, P. troglodytes
aactttttaaaacttt

SEQ ID NO: 189587 - DNA, 16 bp, P. troglodytes
aactttttaaaataga

SEQ ID NO: 189588 - DNA, 16 bp, P. troglodytes
aactttttaatgtatt

SEQ ID NO: 189589 - DNA, 16 bp, P. troglodytes
aactttttcaaaaatt

SEQ ID NO: 189590 - DNA, 16 bp, P. troglodytes
aacttttttaaaaaga

SEQ ID NO: 189591 - DNA, 16 bp, P. troglodytes
aacttttttcaaaatt

SEQ ID NO: 189592 - DNA, 16 bp, P. troglodytes
aactttttttaaaaag

SEQ ID NO: 189593 - DNA, 16 bp, P. troglodytes
aactttttttaagaaa

SEQ ID NO: 189594 - DNA, 16 bp, P. troglodytes
aactttttttgggggg

SEQ ID NO: 189595 - DNA, 16 bp, P. troglodytes
aacttttttttagaga

SEQ ID NO: 189596 - DNA, 16 bp, P. troglodytes
aactttttttttaagt

SEQ ID NO: 189597 - DNA, 16 bp, P. troglodytes
aagaaaaaaaactgtt

SEQ ID NO: 189598 - DNA, 16 bp, P. troglodytes
aagaaaaaaaagctgg

SEQ ID NO: 189599 - DNA, 16 bp, P. troglodytes
aagaaaaaaaaggctg

SEQ ID NO: 189600 - DNA, 16 bp, P. troglodytes
aagaaaaaaaatctct

SEQ ID NO: 189601 - DNA, 16 bp, P. troglodytes
aagaaaaaaaatcttt

SEQ ID NO: 189602 - DNA, 16 bp, P. troglodytes
aagaaaaaaaattcct

SEQ ID NO: 189603 - DNA, 16 bp, P. troglodytes
aagaaaaaaacttcag

SEQ ID NO: 189604 - DNA, 16 bp, P. troglodytes
aagaaaaaaagagtct

SEQ ID NO: 189605 - DNA, 16 bp, P. troglodytes
aagaaaaaaagctttt

SEQ ID NO: 189606 - DNA, 16 bp, P. troglodytes
aagaaaaaaagtctgt

SEQ ID NO: 189607 - DNA, 16 bp, P. troglodytes
aagaaaaaaatgccta

SEQ ID NO: 189608 - DNA, 16 bp, P. troglodytes
aagaaaaaaatgcttt

SEQ ID NO: 189609 - DNA, 16 bp, P. troglodytes
aagaaaaaaatgtcat

SEQ ID NO: 189610 - DNA, 16 bp, P. troglodytes
aagaaaaaaatgtttg

SEQ ID NO: 189611 - DNA, 16 bp, P. troglodytes
aagaaaaaacaatttg

SEQ ID NO: 189612 - DNA, 16 bp, P. troglodytes
aagaaaaaacactttt

SEQ ID NO: 189613 - DNA, 16 bp, P. troglodytes
aagaaaaaacattttt

SEQ ID NO: 189614 - DNA, 16 bp, P. troglodytes
aagaaaaaagaaggct

SEQ ID NO: 189615 - DNA, 16 bp, P. troglodytes
aagaaaaaagttttca

SEQ ID NO: 189616 - DNA, 16 bp, P. troglodytes
aagaaaaaatactgca

SEQ ID NO: 189617 - DNA, 16 bp, P. troglodytes
aagaaaaaatattgca

SEQ ID NO: 189618 - DNA, 16 bp, P. troglodytes
aagaaaaaatcatttt

SEQ ID NO: 189619 - DNA, 16 bp, P. troglodytes
aagaaaaaatctgaat

SEQ ID NO: 189620 - DNA, 16 bp, P. troglodytes
aagaaaaaatcttcaa

SEQ ID NO: 189621 - DNA, 16 bp, P. troglodytes
aagaaaaaatgctcat

SEQ ID NO: 189622 - DNA, 16 bp, P. troglodytes
aagaaaaaattcttga

SEQ ID NO: 189623 - DNA, 16 bp, P. troglodytes
aagaaaaaattttcaa

SEQ ID NO: 189624 - DNA, 16 bp, P. troglodytes
aagaaaaacaaattct

SEQ ID NO: 189625 - DNA, 16 bp, P. troglodytes
aagaaaaacagaattt

SEQ ID NO: 189626 - DNA, 16 bp, P. troglodytes
aagaaaaacagacttt

SEQ ID NO: 189627 - DNA, 16 bp, P. troglodytes
aagaaaaacataattt

SEQ ID NO: 189628 - DNA, 16 bp, P. troglodytes
aagaaaaacattgttt

SEQ ID NO: 189629 - DNA, 16 bp, P. troglodytes
aagaaaaacattttaa

SEQ ID NO: 189630 - DNA, 16 bp, P. troglodytes
aagaaaaacccatttt

SEQ ID NO: 189631 - DNA, 16 bp, P. troglodytes
aagaaaaacttccaaa

SEQ ID NO: 189632 - DNA, 16 bp, P. troglodytes
aagaaaaacttctaaa

SEQ ID NO: 189633 - DNA, 16 bp, P. troglodytes
aagaaaaactttattt

SEQ ID NO: 189634 - DNA, 16 bp, P. troglodytes
aagaaaaacttttttt

SEQ ID NO: 189635 - DNA, 16 bp, P. troglodytes
aagaaaaagaaactgg

SEQ ID NO: 189636 - DNA, 16 bp, P. troglodytes
aagaaaaagaaatctt

SEQ ID NO: 189637 - DNA, 16 bp, P. troglodytes
aagaaaaagaaattcc

SEQ ID NO: 189638 - DNA, 16 bp, P. troglodytes
aagaaaaagaaattct

SEQ ID NO: 189639 - DNA, 16 bp, P. troglodytes
aagaaaaagaagactt

SEQ ID NO: 189640 - DNA, 16 bp, P. troglodytes
aagaaaaagaagtcat

SEQ ID NO: 189641 - DNA, 16 bp, P. troglodytes
aagaaaaagaatttca

SEQ ID NO: 189642 - DNA, 16 bp, P. troglodytes
aagaaaaagaggttta

SEQ ID NO: 189643 - DNA, 16 bp, P. troglodytes
aagaaaaagcattttc

SEQ ID NO: 189644 - DNA, 16 bp, P. troglodytes
aagaaaaagctttttt

SEQ ID NO: 189645 - DNA, 16 bp, P. troglodytes
aagaaaaataatactt

SEQ ID NO: 189646 - DNA, 16 bp, P. troglodytes
aagaaaaataatcttt

SEQ ID NO: 189647 - DNA, 16 bp, P. troglodytes
aagaaaaataattctg

SEQ ID NO: 189648 - DNA, 16 bp, P. troglodytes
aagaaaaatacagttt

SEQ ID NO: 189649 - DNA, 16 bp, P. troglodytes
aagaaaaatactattt

SEQ ID NO: 189650 - DNA, 16 bp, P. troglodytes
aagaaaaatacttttt

SEQ ID NO: 189651 - DNA, 16 bp, P. troglodytes
aagaaaaatagctcag

SEQ ID NO: 189652 - DNA, 16 bp, P. troglodytes
aagaaaaatattctga

SEQ ID NO: 189653 - DNA, 16 bp, P. troglodytes
aagaaaaatcatttca

SEQ ID NO: 189654 - DNA, 16 bp, P. troglodytes
aagaaaaatcatttga

SEQ ID NO: 189655 - DNA, 16 bp, P. troglodytes
aagaaaaatctcaaat

SEQ ID NO: 189656 - DNA, 16 bp, P. troglodytes
aagaaaaatgcaaagt

SEQ ID NO: 189657 - DNA, 16 bp, P. troglodytes
aagaaaaatgtacatt

SEQ ID NO: 189658 - DNA, 16 bp, P. troglodytes
aagaaaaatgtgtgtt

SEQ ID NO: 189659 - DNA, 16 bp, P. troglodytes
aagaaaaatgtgttta

SEQ ID NO: 189660 - DNA, 16 bp, P. troglodytes
aagaaaaatgttattt

SEQ ID NO: 189661 - DNA, 16 bp, P. troglodytes
aagaaaaattactgaa

SEQ ID NO: 189662 - DNA, 16 bp, P. troglodytes
aagaaaaattagccag

SEQ ID NO: 189663 - DNA, 16 bp, P. troglodytes
aagaaaaattattcta

SEQ ID NO: 189664 - DNA, 16 bp, P. troglodytes
aagaaaaattatttgt

SEQ ID NO: 189665 - DNA, 16 bp, P. troglodytes
aagaaaaattggattt

SEQ ID NO: 189666 - DNA, 16 bp, P. troglodytes
aagaaaaattgttctg

SEQ ID NO: 189667 - DNA, 16 bp, P. troglodytes
aagaaaaatttgtttt

SEQ ID NO: 189668 - DNA, 16 bp, P. troglodytes
aagaaaaattttgcaa

SEQ ID NO: 189669 - DNA, 16 bp, P. troglodytes
aagaaaacaaaatttt

SEQ ID NO: 189670 - DNA, 16 bp, P. troglodytes
aagaaaacaagagttt

SEQ ID NO: 189671 - DNA, 16 bp, P. troglodytes
aagaaaacaagctcag

SEQ ID NO: 189672 - DNA, 16 bp, P. troglodytes
aagaaaacactatttt

SEQ ID NO: 189673 - DNA, 16 bp, P. troglodytes
aagaaaacactttttt

SEQ ID NO: 189674 - DNA, 16 bp, P. troglodytes
aagaaaacagaggctc

SEQ ID NO: 189675 - DNA, 16 bp, P. troglodytes
aagaaaacatggaaga

SEQ ID NO: 189676 - DNA, 16 bp, P. troglodytes
aagaaaacatgggcaa

SEQ ID NO: 189677 - DNA, 16 bp, P. troglodytes
aagaaaacatgttaaa

SEQ ID NO: 189678 - DNA, 16 bp, P. troglodytes
aagaaaacattcagaa

SEQ ID NO: 189679 - DNA, 16 bp, P. troglodytes
aagaaaacattgcaaa

SEQ ID NO: 189680 - DNA, 16 bp, P. troglodytes
aagaaaacatttacaa

SEQ ID NO: 189681 - DNA, 16 bp, P. troglodytes
aagaaaacatttcaag

SEQ ID NO: 189682 - DNA, 16 bp, P. troglodytes
aagaaaacatttgaaa

SEQ ID NO: 189683 - DNA, 16 bp, P. troglodytes
aagaaaacatttgaag

SEQ ID NO: 189684 - DNA, 16 bp, P. troglodytes
aagaaaacattttctg

SEQ ID NO: 189685 - DNA, 16 bp, P. troglodytes
aagaaaaccttggaaa

SEQ ID NO: 189686 - DNA, 16 bp, P. troglodytes
aagaaaactacagatc

SEQ ID NO: 189687 - DNA, 16 bp, P. troglodytes
aagaaaactggaggaa

SEQ ID NO: 189688 - DNA, 16 bp, P. troglodytes
aagaaaacttcaggct

SEQ ID NO: 189689 - DNA, 16 bp, P. troglodytes
aagaaaacttgttttt

SEQ ID NO: 189690 - DNA, 16 bp, P. troglodytes
aagaaaactttttaaa

SEQ ID NO: 189691 - DNA, 16 bp, P. troglodytes
aagaaaagaaaacctt

SEQ ID NO: 189692 - DNA, 16 bp, P. troglodytes
aagaaaagaaaagctg

SEQ ID NO: 189693 - DNA, 16 bp, P. troglodytes
aagaaaagaaaatggc

SEQ ID NO: 189694 - DNA, 16 bp, P. troglodytes
aagaaaagaaacactg

SEQ ID NO: 189695 - DNA, 16 bp, P. troglodytes
aagaaaagaaacagct

SEQ ID NO: 189696 - DNA, 16 bp, P. troglodytes
aagaaaagaaagcatt

SEQ ID NO: 189697 - DNA, 16 bp, P. troglodytes
aagaaaagaaagcttt

SEQ ID NO: 189698 - DNA, 16 bp, P. troglodytes
aagaaaagaaatcatt

SEQ ID NO: 189699 - DNA, 16 bp, P. troglodytes
aagaaaagaaatggca

SEQ ID NO: 189700 - DNA, 16 bp, P. troglodytes
aagaaaagaaatgtct

SEQ ID NO: 189701 - DNA, 16 bp, P. troglodytes
aagaaaagaatttcca

SEQ ID NO: 189702 - DNA, 16 bp, P. troglodytes
aagaaaagacagctgg

SEQ ID NO: 189703 - DNA, 16 bp, P. troglodytes
aagaaaagagatttat

SEQ ID NO: 189704 - DNA, 16 bp, P. troglodytes
aagaaaagaggttcag

SEQ ID NO: 189705 - DNA, 16 bp, P. troglodytes
aagaaaagatgcttaa

SEQ ID NO: 189706 - DNA, 16 bp, P. troglodytes
aagaaaagatttttca

SEQ ID NO: 189707 - DNA, 16 bp, P. troglodytes
aagaaaagcaattttt

SEQ ID NO: 189708 - DNA, 16 bp, P. troglodytes
aagaaaagcatttaaa

SEQ ID NO: 189709 - DNA, 16 bp, P. troglodytes
aagaaaagcatttaat

SEQ ID NO: 189710 - DNA, 16 bp, P. troglodytes
aagaaaagcattttca

SEQ ID NO: 189711 - DNA, 16 bp, P. troglodytes
aagaaaagcccatttt

SEQ ID NO: 189712 - DNA, 16 bp, P. troglodytes
aagaaaaggaaacttt

SEQ ID NO: 189713 - DNA, 16 bp, P. troglodytes
aagaaaaggaaattca

SEQ ID NO: 189714 - DNA, 16 bp, P. troglodytes
aagaaaaggctgaaaa

SEQ ID NO: 189715 - DNA, 16 bp, P. troglodytes
aagaaaaggggctttg

SEQ ID NO: 189716 - DNA, 16 bp, P. troglodytes
aagaaaagtaattttt

SEQ ID NO: 189717 - DNA, 16 bp, P. troglodytes
aagaaaagtctgaaaa

SEQ ID NO: 189718 - DNA, 16 bp, P. troglodytes
aagaaaagtggtttaa

SEQ ID NO: 189719 - DNA, 16 bp, P. troglodytes
aagaaaagtttagaga

SEQ ID NO: 189720 - DNA, 16 bp, P. troglodytes
aagaaaagtttatttc

SEQ ID NO: 189721 - DNA, 16 bp, P. troglodytes
aagaaaataaacagtt

SEQ ID NO: 189722 - DNA, 16 bp, P. troglodytes
aagaaaataaattctt

SEQ ID NO: 189723 - DNA, 16 bp, P. troglodytes
aagaaaataagtttca

SEQ ID NO: 189724 - DNA, 16 bp, P. troglodytes
aagaaaataattctaa

SEQ ID NO: 189725 - DNA, 16 bp, P. troglodytes
aagaaaataattttca

SEQ ID NO: 189726 - DNA, 16 bp, P. troglodytes
aagaaaatacaaattt

SEQ ID NO: 189727 - DNA, 16 bp, P. troglodytes
aagaaaatacacagat

SEQ ID NO: 189728 - DNA, 16 bp, P. troglodytes
aagaaaatacatttgt

SEQ ID NO: 189729 - DNA, 16 bp, P. troglodytes
aagaaaatacttgcaa

SEQ ID NO: 189730 - DNA, 16 bp, P. troglodytes
aagaaaatactttgaa

SEQ ID NO: 189731 - DNA, 16 bp, P. troglodytes
aagaaaatacttttct

SEQ ID NO: 189732 - DNA, 16 bp, P. troglodytes
aagaaaatatatttgg

SEQ ID NO: 189733 - DNA, 16 bp, P. troglodytes
aagaaaatatccagaa

SEQ ID NO: 189734 - DNA, 16 bp, P. troglodytes
aagaaaatatcttcat

SEQ ID NO: 189735 - DNA, 16 bp, P. troglodytes
aagaaaatatgcaaat

SEQ ID NO: 189736 - DNA, 20 bp, P. troglodytes
aagaaaatatggcacatata

SEQ ID NO: 189737 - DNA, 16 bp, P. troglodytes
aagaaaatattgtttt

SEQ ID NO: 189738 - DNA, 16 bp, P. troglodytes
aagaaaatatttcaga

SEQ ID NO: 189739 - DNA, 16 bp, P. troglodytes
aagaaaatatttctta

SEQ ID NO: 189740 - DNA, 16 bp, P. troglodytes
aagaaaatatttgcaa

SEQ ID NO: 189741 - DNA, 16 bp, P. troglodytes
aagaaaatatttggaa

SEQ ID NO: 189742 - DNA, 16 bp, P. troglodytes
aagaaaatattttcaa

SEQ ID NO: 189743 - DNA, 16 bp, P. troglodytes
aagaaaatatttttct

SEQ ID NO: 189744 - DNA, 16 bp, P. troglodytes
aagaaaatatttttgt

SEQ ID NO: 189745 - DNA, 16 bp, P. troglodytes
aagaaaatcacttgaa

SEQ ID NO: 189746 - DNA, 16 bp, P. troglodytes
aagaaaatcatttttt

SEQ ID NO: 189747 - DNA, 16 bp, P. troglodytes
aagaaaatccagcctc

SEQ ID NO: 189748 - DNA, 16 bp, P. troglodytes
aagaaaatcttaaaat

SEQ ID NO: 189749 - DNA, 16 bp, P. troglodytes
aagaaaatcttattta

SEQ ID NO: 189750 - DNA, 16 bp, P. troglodytes
aagaaaatctttattt

SEQ ID NO: 189751 - DNA, 16 bp, P. troglodytes
aagaaaatgaaatcag

SEQ ID NO: 189752 - DNA, 16 bp, P. troglodytes
aagaaaatgaaattgg

SEQ ID NO: 189753 - DNA, 16 bp, P. troglodytes
aagaaaatgaaatttg

SEQ ID NO: 189754 - DNA, 16 bp, P. troglodytes
aagaaaatgaaggcag

SEQ ID NO: 189755 - DNA, 16 bp, P. troglodytes
aagaaaatgaataggc

SEQ ID NO: 189756 - DNA, 16 bp, P. troglodytes
aagaaaatgaggcaca

SEQ ID NO: 189757 - DNA, 16 bp, P. troglodytes
aagaaaatgagttttt

SEQ ID NO: 189758 - DNA, 16 bp, P. troglodytes
aagaaaatgatatttt

SEQ ID NO: 189759 - DNA, 16 bp, P. troglodytes
aagaaaatgatgttaa

SEQ ID NO: 189760 - DNA, 16 bp, P. troglodytes
aagaaaatgatttctt

SEQ ID NO: 189761 - DNA, 16 bp, P. troglodytes
aagaaaatgctaaata

SEQ ID NO: 189762 - DNA, 16 bp, P. troglodytes
aagaaaatgctgaaaa

SEQ ID NO: 189763 - DNA, 16 bp, P. troglodytes
aagaaaatgtatgtaa

SEQ ID NO: 189764 - DNA, 16 bp, P. troglodytes
aagaaaatgtcatttt

SEQ ID NO: 189765 - DNA, 16 bp, P. troglodytes
aagaaaatgtctttaa

SEQ ID NO: 189766 - DNA, 16 bp, P. troglodytes
aagaaaatgtgataca

SEQ ID NO: 189767 - DNA, 16 bp, P. troglodytes
aagaaaatgtgattta

SEQ ID NO: 189768 - DNA, 24 bp, P. troglodytes
aagaaaatgtggcacatatacacc

SEQ ID NO: 189769 - DNA, 44 bp, P. troglodytes
aagaaaatgtggcacatatacaccatggaatactatgcagccat

SEQ ID NO: 189770 - DNA, 18 bp, P. troglodytes
aagaaaatgtggcacatg

SEQ ID NO: 189771 - DNA, 16 bp, P. troglodytes
aagaaaatgtggcatt

SEQ ID NO: 189772 - DNA, 17 bp, P. troglodytes
aagaaaatgtgtcacat

SEQ ID NO: 189773 - DNA, 18 bp, P. troglodytes
aagaaaatgtgtcacata

SEQ ID NO: 189774 - DNA, 16 bp, P. troglodytes
aagaaaatgttatcaa

SEQ ID NO: 189775 - DNA, 16 bp, P. troglodytes
aagaaaatgttgttaa

SEQ ID NO: 189776 - DNA, 16 bp, P. troglodytes
aagaaaatgtttattt

SEQ ID NO: 189777 - DNA, 16 bp, P. troglodytes
aagaaaatgtttcaag

SEQ ID NO: 189778 - DNA, 16 bp, P. troglodytes
aagaaaatgtttgcca

SEQ ID NO: 189779 - DNA, 16 bp, P. troglodytes
aagaaaattagcctgg

SEQ ID NO: 189780 - DNA, 16 bp, P. troglodytes
aagaaaattatgtttt

SEQ ID NO: 189781 - DNA, 16 bp, P. troglodytes
aagaaaattcataaat

SEQ ID NO: 189782 - DNA, 16 bp, P. troglodytes
aagaaaattgaattca

SEQ ID NO: 189783 - DNA, 16 bp, P. troglodytes
aagaaaattgacaaat

SEQ ID NO: 189784 - DNA, 16 bp, P. troglodytes
aagaaaatttacaaat

SEQ ID NO: 189785 - DNA, 16 bp, P. troglodytes
aagaaaatttagtttt

SEQ ID NO: 189786 - DNA, 16 bp, P. troglodytes
aagaaaattttaggaa

SEQ ID NO: 189787 - DNA, 16 bp, P. troglodytes
aagaaaattttctgaa

SEQ ID NO: 189788 - DNA, 16 bp, P. troglodytes
aagaaaattttcttaa

SEQ ID NO: 189789 - DNA, 16 bp, P. troglodytes
aagaaacaaaatctta

SEQ ID NO: 189790 - DNA, 16 bp, P. troglodytes
aagaaacaaattttaa

SEQ ID NO: 189791 - DNA, 16 bp, P. troglodytes
aagaaacaatagatgc

SEQ ID NO: 189792 - DNA, 16 bp, P. troglodytes
aagaaacaattttttt

SEQ ID NO: 189793 - DNA, 16 bp, P. troglodytes
aagaaacacattttac

SEQ ID NO: 189794 - DNA, 16 bp, P. troglodytes
aagaaacagaaatatt

SEQ ID NO: 189795 - DNA, 16 bp, P. troglodytes
aagaaacagagtcttg

SEQ ID NO: 189796 - DNA, 16 bp, P. troglodytes
aagaaacaggaaaatg

SEQ ID NO: 189797 - DNA, 16 bp, P. troglodytes
aagaaacaggcccaga

SEQ ID NO: 189798 - DNA, 16 bp, P. troglodytes
aagaaacagggtctca

SEQ ID NO: 189799 - DNA, 16 bp, P. troglodytes
aagaaacagtctttta

SEQ ID NO: 189800 - DNA, 16 bp, P. troglodytes
aagaaacatacctcaa

SEQ ID NO: 189801 - DNA, 16 bp, P. troglodytes
aagaaacatcaaattt

SEQ ID NO: 189802 - DNA, 16 bp, P. troglodytes
aagaaacatcagattt

SEQ ID NO: 189803 - DNA, 16 bp, P. troglodytes
aagaaacatgaaaatg

SEQ ID NO: 189804 - DNA, 16 bp, P. troglodytes
aagaaacattaatttt

SEQ ID NO: 189805 - DNA, 16 bp, P. troglodytes
aagaaacatttcaaaa

SEQ ID NO: 189806 - DNA, 16 bp, P. troglodytes
aagaaacatttgttgt

SEQ ID NO: 189807 - DNA, 16 bp, P. troglodytes
aagaaaccaaaatatt

SEQ ID NO: 189808 - DNA, 16 bp, P. troglodytes
aagaaactaaggctca

SEQ ID NO: 189809 - DNA, 16 bp, P. troglodytes
aagaaactattatttt

SEQ ID NO: 189810 - DNA, 16 bp, P. troglodytes
aagaaactcacccaaa

SEQ ID NO: 189811 - DNA, 17 bp, P. troglodytes
aagaaactcactcaaaa

SEQ ID NO: 189812 - DNA, 16 bp, P. troglodytes
aagaaactcacttcac

SEQ ID NO: 189813 - DNA, 16 bp, P. troglodytes
aagaaactcatctccc

SEQ ID NO: 189814 - DNA, 16 bp, P. troglodytes
aagaaactccattttg

SEQ ID NO: 189815 - DNA, 16 bp, P. troglodytes
aagaaactgaaaaact

SEQ ID NO: 189816 - DNA, 16 bp, P. troglodytes
aagaaactgaaagaag

SEQ ID NO: 189817 - DNA, 16 bp, P. troglodytes
aagaaactgaaataat

SEQ ID NO: 189818 - DNA, 16 bp, P. troglodytes
aagaaactgaagaaga

SEQ ID NO: 189819 - DNA, 16 bp, P. troglodytes
aagaaactgaagagaa

SEQ ID NO: 189820 - DNA, 16 bp, P. troglodytes
aagaaactgaagagga

SEQ ID NO: 189821 - DNA, 16 bp, P. troglodytes
aagaaactgaagcaaa

SEQ ID NO: 189822 - DNA, 16 bp, P. troglodytes
aagaaactgaattcct

SEQ ID NO: 189823 - DNA, 16 bp, P. troglodytes
aagaaactgacaaact

SEQ ID NO: 189824 - DNA, 16 bp, P. troglodytes
aagaaactgaggcttg

SEQ ID NO: 189825 - DNA, 16 bp, P. troglodytes
aagaaactgaggttca

SEQ ID NO: 189826 - DNA, 16 bp, P. troglodytes
aagaaactgagtccca

SEQ ID NO: 189827 - DNA, 16 bp, P. troglodytes
aagaaactgccaaatt

SEQ ID NO: 189828 - DNA, 16 bp, P. troglodytes
aagaaactgctgaact

SEQ ID NO: 189829 - DNA, 16 bp, P. troglodytes
aagaaactgttaaact

SEQ ID NO: 189830 - DNA, 16 bp, P. troglodytes
aagaaacttacttcaa

SEQ ID NO: 189831 - DNA, 16 bp, P. troglodytes
aagaaacttttaaaaa

SEQ ID NO: 189832 - DNA, 16 bp, P. troglodytes
aagaaagaaaaatggc

SEQ ID NO: 189833 - DNA, 16 bp, P. troglodytes
aagaaagaaaacagct

SEQ ID NO: 189834 - DNA, 16 bp, P. troglodytes
aagaaagaaaacctgt

SEQ ID NO: 189835 - DNA, 16 bp, P. troglodytes
aagaaagaaaactgtt

SEQ ID NO: 189836 - DNA, 16 bp, P. troglodytes
aagaaagaaaacttca

SEQ ID NO: 189837 - DNA, 16 bp, P. troglodytes
aagaaagaaaacttta

SEQ ID NO: 189838 - DNA, 16 bp, P. troglodytes
aagaaagaaaagatgc

SEQ ID NO: 189839 - DNA, 16 bp, P. troglodytes
aagaaagaaaatatcc

SEQ ID NO: 189840 - DNA, 16 bp, P. troglodytes
aagaaagaaaatatgc

SEQ ID NO: 189841 - DNA, 16 bp, P. troglodytes
aagaaagaaaatctat

SEQ ID NO: 189842 - DNA, 16 bp, P. troglodytes
aagaaagaaaatgcct

SEQ ID NO: 189843 - DNA, 16 bp, P. troglodytes
aagaaagaaaatgtgt

SEQ ID NO: 189844 - DNA, 16 bp, P. troglodytes
aagaaagaaaatgttt

SEQ ID NO: 189845 - DNA, 16 bp, P. troglodytes
aagaaagaaactggat

SEQ ID NO: 189846 - DNA, 16 bp, P. troglodytes
aagaaagaaagaactg

SEQ ID NO: 189847 - DNA, 16 bp, P. troglodytes
aagaaagaaagaattc

SEQ ID NO: 189848 - DNA, 16 bp, P. troglodytes
aagaaagaaagacatt

SEQ ID NO: 189849 - DNA, 16 bp, P. troglodytes
aagaaagaaaggctgg

SEQ ID NO: 189850 - DNA, 16 bp, P. troglodytes
aagaaagaaatacatg

SEQ ID NO: 189851 - DNA, 16 bp, P. troglodytes
aagaaagaaataccat

SEQ ID NO: 189852 - DNA, 16 bp, P. troglodytes
aagaaagaaatctttt

SEQ ID NO: 189853 - DNA, 16 bp, P. troglodytes
aagaaagaaatgcatg

SEQ ID NO: 189854 - DNA, 16 bp, P. troglodytes
aagaaagaaatgtatt

SEQ ID NO: 189855 - DNA, 16 bp, P. troglodytes
aagaaagaaattacag

SEQ ID NO: 189856 - DNA, 16 bp, P. troglodytes
aagaaagaaattatac

SEQ ID NO: 189857 - DNA, 16 bp, P. troglodytes
aagaaagaaattctaa

SEQ ID NO: 189858 - DNA, 16 bp, P. troglodytes
aagaaagaacctcaga

SEQ ID NO: 189859 - DNA, 16 bp, P. troglodytes
aagaaagaaggccagg

SEQ ID NO: 189860 - DNA, 16 bp, P. troglodytes
aagaaagaatctgtga

SEQ ID NO: 189861 - DNA, 16 bp, P. troglodytes
aagaaagaatttcaaa

SEQ ID NO: 189862 - DNA, 16 bp, P. troglodytes
aagaaagaatttgtga

SEQ ID NO: 189863 - DNA, 16 bp, P. troglodytes
aagaaagaatttttta

SEQ ID NO: 189864 - DNA, 16 bp, P. troglodytes
aagaaagacattacat

SEQ ID NO: 189865 - DNA, 16 bp, P. troglodytes
aagaaagacattttca

SEQ ID NO: 189866 - DNA, 16 bp, P. troglodytes
aagaaagacattttta

SEQ ID NO: 189867 - DNA, 16 bp, P. troglodytes
aagaaagagaagagct

SEQ ID NO: 189868 - DNA, 16 bp, P. troglodytes
aagaaagataatttga

SEQ ID NO: 189869 - DNA, 16 bp, P. troglodytes
aagaaagatttcaaat

SEQ ID NO: 189870 - DNA, 16 bp, P. troglodytes
aagaaagcaaagcagc

SEQ ID NO: 189871 - DNA, 16 bp, P. troglodytes
aagaaagcccaggacc

SEQ ID NO: 189872 - DNA, 16 bp, P. troglodytes
aagaaagcctatggga

SEQ ID NO: 189873 - DNA, 16 bp, P. troglodytes
aagaaagcttttaaaa

SEQ ID NO: 189874 - DNA, 16 bp, P. troglodytes
aagaaaggaaatctgt

SEQ ID NO: 189875 - DNA, 16 bp, P. troglodytes
aagaaaggatatcagt

SEQ ID NO: 189876 - DNA, 26 bp, P. troglodytes
aagaaaggtgatattgtagacatcaa

SEQ ID NO: 189877 - DNA, 16 bp, P. troglodytes
aagaaagtccaggacc

SEQ ID NO: 189878 - DNA, 16 bp, P. troglodytes
aagaaagtgaaacagt

SEQ ID NO: 189879 - DNA, 16 bp, P. troglodytes
aagaaagtgatttatt

SEQ ID NO: 189880 - DNA, 16 bp, P. troglodytes
aagaaataaaacattt

SEQ ID NO: 189881 - DNA, 16 bp, P. troglodytes
aagaaataaaagccat

SEQ ID NO: 189882 - DNA, 16 bp, P. troglodytes
aagaaataaaaggtgt

SEQ ID NO: 189883 - DNA, 16 bp, P. troglodytes
aagaaataaaatgtca

SEQ ID NO: 189884 - DNA, 16 bp, P. troglodytes
aagaaataaaatttca

SEQ ID NO: 189885 - DNA, 16 bp, P. troglodytes
aagaaataaacccaca

SEQ ID NO: 189886 - DNA, 16 bp, P. troglodytes
aagaaataaacctttt

SEQ ID NO: 189887 - DNA, 16 bp, P. troglodytes
aagaaataaatctttg

SEQ ID NO: 189888 - DNA, 16 bp, P. troglodytes
aagaaataaatgtttt

SEQ ID NO: 189889 - DNA, 16 bp, P. troglodytes
aagaaataacattttt

SEQ ID NO: 189890 - DNA, 16 bp, P. troglodytes
aagaaataagacattt

SEQ ID NO: 189891 - DNA, 16 bp, P. troglodytes
aagaaataatagcaat

SEQ ID NO: 189892 - DNA, 16 bp, P. troglodytes
aagaaataatggcaaa

SEQ ID NO: 189893 - DNA, 16 bp, P. troglodytes
aagaaatacaaggcat

SEQ ID NO: 189894 - DNA, 16 bp, P. troglodytes
aagaaatacacatatt

SEQ ID NO: 189895 - DNA, 16 bp, P. troglodytes
aagaaatacagaaatt

SEQ ID NO: 189896 - DNA, 16 bp, P. troglodytes
aagaaatacagaatat

SEQ ID NO: 189897 - DNA, 16 bp, P. troglodytes
aagaaatacagaattt

SEQ ID NO: 189898 - DNA, 16 bp, P. troglodytes
aagaaatacatttctt

SEQ ID NO: 189899 - DNA, 16 bp, P. troglodytes
aagaaatacctgagtc

SEQ ID NO: 189900 - DNA, 16 bp, P. troglodytes
aagaaatactaaaagg

SEQ ID NO: 189901 - DNA, 16 bp, P. troglodytes
aagaaatacttccaaa

SEQ ID NO: 189902 - DNA, 16 bp, P. troglodytes
aagaaatagaaaactt

SEQ ID NO: 189903 - DNA, 16 bp, P. troglodytes
aagaaatagaaaatct

SEQ ID NO: 189904 - DNA, 16 bp, P. troglodytes
aagaaatagaaacttt

SEQ ID NO: 189905 - DNA, 16 bp, P. troglodytes
aagaaatagaacattt

SEQ ID NO: 189906 - DNA, 16 bp, P. troglodytes
aagaaatagataaatc

SEQ ID NO: 189907 - DNA, 16 bp, P. troglodytes
aagaaatatacattat

SEQ ID NO: 189908 - DNA, 16 bp, P. troglodytes
aagaaatatctgtact

SEQ ID NO: 189909 - DNA, 16 bp, P. troglodytes
aagaaatatctttttt

SEQ ID NO: 189910 - DNA, 16 bp, P. troglodytes
aagaaatatgttttat

SEQ ID NO: 189911 - DNA, 16 bp, P. troglodytes
aagaaatattattcag

SEQ ID NO: 189912 - DNA, 16 bp, P. troglodytes
aagaaatatttactga

SEQ ID NO: 189913 - DNA, 16 bp, P. troglodytes
aagaaatatttcaaaa

SEQ ID NO: 189914 - DNA, 16 bp, P. troglodytes
aagaaatattttccta

SEQ ID NO: 189915 - DNA, 16 bp, P. troglodytes
aagaaatatttttcta

SEQ ID NO: 189916 - DNA, 16 bp, P. troglodytes
aagaaatcaaagaagg

SEQ ID NO: 189917 - DNA, 16 bp, P. troglodytes
aagaaatcaagaaagc

SEQ ID NO: 189918 - DNA, 16 bp, P. troglodytes
aagaaatcaagaccat

SEQ ID NO: 189919 - DNA, 16 bp, P. troglodytes
aagaaatcaatatatt

SEQ ID NO: 189920 - DNA, 16 bp, P. troglodytes
aagaaatcacaagaga

SEQ ID NO: 189921 - DNA, 16 bp, P. troglodytes
aagaaatcagagataa

SEQ ID NO: 189922 - DNA, 16 bp, P. troglodytes
aagaaatcagaggtga

SEQ ID NO: 189923 - DNA, 16 bp, P. troglodytes
aagaaatcaggagaga

SEQ ID NO: 189924 - DNA, 16 bp, P. troglodytes
aagaaatcatagacga

SEQ ID NO: 189925 - DNA, 16 bp, P. troglodytes
aagaaatcataggtga

SEQ ID NO: 189926 - DNA, 16 bp, P. troglodytes
aagaaatcatttttaa

SEQ ID NO: 189927 - DNA, 16 bp, P. troglodytes
aagaaatcattttttt

SEQ ID NO: 189928 - DNA, 16 bp, P. troglodytes
aagaaatccatgccaa

SEQ ID NO: 189929 - DNA, 16 bp, P. troglodytes
aagaaatccctgattt

SEQ ID NO: 189930 - DNA, 16 bp, P. troglodytes
aagaaatctttcccta

SEQ ID NO: 189931 - DNA, 16 bp, P. troglodytes
aagaaatgaaaacatg

SEQ ID NO: 189932 - DNA, 16 bp, P. troglodytes
aagaaatgaaaactac

SEQ ID NO: 189933 - DNA, 16 bp, P. troglodytes
aagaaatgaaaattac

SEQ ID NO: 189934 - DNA, 16 bp, P. troglodytes
aagaaatgaaaggcat

SEQ ID NO: 189935 - DNA, 16 bp, P. troglodytes
aagaaatgaagagcaa

SEQ ID NO: 189936 - DNA, 16 bp, P. troglodytes
aagaaatgactgtggt

SEQ ID NO: 189937 - DNA, 16 bp, P. troglodytes
aagaaatgatttttaa

SEQ ID NO: 189938 - DNA, 16 bp, P. troglodytes
aagaaatgcaaggaaa

SEQ ID NO: 189939 - DNA, 16 bp, P. troglodytes
aagaaatgcccaagac

SEQ ID NO: 189940 - DNA, 16 bp, P. troglodytes
aagaaatgctaaagaa

SEQ ID NO: 189941 - DNA, 16 bp, P. troglodytes
aagaaatgctaaagga

SEQ ID NO: 189942 - DNA, 16 bp, P. troglodytes
aagaaatggaaaatct

SEQ ID NO: 189943 - DNA, 16 bp, P. troglodytes
aagaaatgtggtacat

SEQ ID NO: 189944 - DNA, 16 bp, P. troglodytes
aagaaatgtgtgcaga

SEQ ID NO: 189945 - DNA, 16 bp, P. troglodytes
aagaaatgttattttt

SEQ ID NO: 189946 - DNA, 16 bp, P. troglodytes
aagaaatgtttctgga

SEQ ID NO: 189947 - DNA, 16 bp, P. troglodytes
aagaaatgtttgaaat

SEQ ID NO: 189948 - DNA, 16 bp, P. troglodytes
aagaaatgttttaaat

SEQ ID NO: 189949 - DNA, 16 bp, P. troglodytes
aagaaatgtttttaaa

SEQ ID NO: 189950 - DNA, 16 bp, P. troglodytes
aagaaattaaagaact

SEQ ID NO: 189951 - DNA, 16 bp, P. troglodytes
aagaaattagccaggc

SEQ ID NO: 189952 - DNA, 16 bp, P. troglodytes
aagaaattatcaacag

SEQ ID NO: 189953 - DNA, 16 bp, P. troglodytes
aagaaattattcagaa

SEQ ID NO: 189954 - DNA, 16 bp, P. troglodytes
aagaaattatttcaaa

SEQ ID NO: 189955 - DNA, 16 bp, P. troglodytes
aagaaattcaaatcaa

SEQ ID NO: 189956 - DNA, 16 bp, P. troglodytes
aagaaattcaacaaac

SEQ ID NO: 189957 - DNA, 16 bp, P. troglodytes
aagaaattcaagccag

SEQ ID NO: 189958 - DNA, 16 bp, P. troglodytes
aagaaattcaataaat

SEQ ID NO: 189959 - DNA, 16 bp, P. troglodytes
aagaaattcacttcaa

SEQ ID NO: 189960 - DNA, 16 bp, P. troglodytes
aagaaattcagaaaat

SEQ ID NO: 189961 - DNA, 16 bp, P. troglodytes
aagaaattcagagctt

SEQ ID NO: 189962 - DNA, 16 bp, P. troglodytes
aagaaattctaaaaat

SEQ ID NO: 189963 - DNA, 16 bp, P. troglodytes
aagaaattctaaagaa

SEQ ID NO: 189964 - DNA, 16 bp, P. troglodytes
aagaaattctgggttg

SEQ ID NO: 189965 - DNA, 16 bp, P. troglodytes
aagaaattgaagacat

SEQ ID NO: 189966 - DNA, 16 bp, P. troglodytes
aagaaattgaagaggg

SEQ ID NO: 189967 - DNA, 16 bp, P. troglodytes
aagaaattgaagatga

SEQ ID NO: 189968 - DNA, 16 bp, P. troglodytes
aagaaattgattccaa

SEQ ID NO: 189969 - DNA, 16 bp, P. troglodytes
aagaaattgctacagc

SEQ ID NO: 189970 - DNA, 16 bp, P. troglodytes
aagaaattggtaaatt

SEQ ID NO: 189971 - DNA, 16 bp, P. troglodytes
aagaaatttaagagga

SEQ ID NO: 189972 - DNA, 16 bp, P. troglodytes
aagaaatttctaagca

SEQ ID NO: 189973 - DNA, 16 bp, P. troglodytes
aagaaatttctaagct

SEQ ID NO: 189974 - DNA, 16 bp, P. troglodytes
aagaaatttctttttt

SEQ ID NO: 189975 - DNA, 16 bp, P. troglodytes
aagaaatttgcaaaaa

SEQ ID NO: 189976 - DNA, 16 bp, P. troglodytes
aagaaattttccattt

SEQ ID NO: 189977 - DNA, 16 bp, P. troglodytes
aagaaatttttcagtt

SEQ ID NO: 189978 - DNA, 16 bp, P. troglodytes
aagaaatttttgccca

SEQ ID NO: 189979 - DNA, 16 bp, P. troglodytes
aagaaattttttcaaa

SEQ ID NO: 189980 - DNA, 16 bp, P. troglodytes
aagaacaaaattctgt

SEQ ID NO: 189981 - DNA, 16 bp, P. troglodytes
aagaacaaactaaatc

SEQ ID NO: 189982 - DNA, 16 bp, P. troglodytes
aagaacaaagctaaag

SEQ ID NO: 189983 - DNA, 16 bp, P. troglodytes
aagaacaaatctgaag

SEQ ID NO: 189984 - DNA, 16 bp, P. troglodytes
aagaacaacaaaattg

SEQ ID NO: 189985 - DNA, 16 bp, P. troglodytes
aagaacacaattccat

SEQ ID NO: 189986 - DNA, 16 bp, P. troglodytes
aagaacacacactggg

SEQ ID NO: 189987 - DNA, 16 bp, P. troglodytes
aagaacacagactctg

SEQ ID NO: 189988 - DNA, 16 bp, P. troglodytes
aagaacacaggaaaat

SEQ ID NO: 189989 - DNA, 16 bp, P. troglodytes
aagaacacattttaaa

SEQ ID NO: 189990 - DNA, 16 bp, P. troglodytes
aagaacactgaaaact

SEQ ID NO: 189991 - DNA, 16 bp, P. troglodytes
aagaacactttttttt

SEQ ID NO: 189992 - DNA, 16 bp, P. troglodytes
aagaacagacatttat

SEQ ID NO: 189993 - DNA, 16 bp, P. troglodytes
aagaacagatatttat

SEQ ID NO: 189994 - DNA, 16 bp, P. troglodytes
aagaacagcagcatgg

SEQ ID NO: 189995 - DNA, 16 bp, P. troglodytes
aagaacagtatggagg

SEQ ID NO: 189996 - DNA, 16 bp, P. troglodytes
aagaacagtctcttca

SEQ ID NO: 189997 - DNA, 16 bp, P. troglodytes
aagaacatctgtattt

SEQ ID NO: 189998 - DNA, 16 bp, P. troglodytes
aagaacattccaggca

SEQ ID NO: 189999 - DNA, 16 bp, P. troglodytes
aagaacattccttgct

SEQ ID NO: 190000 - DNA, 18 bp, P. troglodytes
aagaacattgtgaaactc

SEQ ID NO: 190001 - DNA, 16 bp, P. troglodytes
aagaaccaaatggaaa

SEQ ID NO: 190002 - DNA, 16 bp, P. troglodytes
aagaaccaccacagga

SEQ ID NO: 190003 - DNA, 16 bp, P. troglodytes
aagaaccagctcctgg

SEQ ID NO: 190004 - DNA, 16 bp, P. troglodytes
aagaacctagaaaaag

SEQ ID NO: 190005 - DNA, 17 bp, P. troglodytes
aagaacctggagtctga

SEQ ID NO: 190006 - DNA, 16 bp, P. troglodytes
aagaactaaaggaaat

SEQ ID NO: 190007 - DNA, 16 bp, P. troglodytes
aagaactagaaaacca

SEQ ID NO: 190008 - DNA, 16 bp, P. troglodytes
aagaactagagaagaa

SEQ ID NO: 190009 - DNA, 16 bp, P. troglodytes
aagaactagagaatca

SEQ ID NO: 190010 - DNA, 16 bp, P. troglodytes
aagaactcagataaaa

SEQ ID NO: 190011 - DNA, 16 bp, P. troglodytes
aagaactgaaagaagg

SEQ ID NO: 190012 - DNA, 16 bp, P. troglodytes
aagaactgaaatcata

SEQ ID NO: 190013 - DNA, 16 bp, P. troglodytes
aagaactgaatgaaat

SEQ ID NO: 190014 - DNA, 16 bp, P. troglodytes
aagaactgcccaagat

SEQ ID NO: 190015 - DNA, 16 bp, P. troglodytes
aagaactggaaaaaga

SEQ ID NO: 190016 - DNA, 16 bp, P. troglodytes
aagaactgtaacattc

SEQ ID NO: 190017 - DNA, 16 bp, P. troglodytes
aagaacttaaaacagt

SEQ ID NO: 190018 - DNA, 16 bp, P. troglodytes
aagaacttaaagaaat

SEQ ID NO: 190019 - DNA, 16 bp, P. troglodytes
aagaacttacttattt

SEQ ID NO: 190020 - DNA, 16 bp, P. troglodytes
aagaacttcaacaaat

SEQ ID NO: 190021 - DNA, 16 bp, P. troglodytes
aagaactttatgatga

SEQ ID NO: 190022 - DNA, 16 bp, P. troglodytes
aagaactttttaaaaa

SEQ ID NO: 190023 - DNA, 16 bp, P. troglodytes
aagaagaaaaacagtt

SEQ ID NO: 190024 - DNA, 16 bp, P. troglodytes
aagaagaaaaacattt

SEQ ID NO: 190025 - DNA, 16 bp, P. troglodytes
aagaagaaaactggag

SEQ ID NO: 190026 - DNA, 16 bp, P. troglodytes
aagaagaaaacttcag

SEQ ID NO: 190027 - DNA, 16 bp, P. troglodytes
aagaagaaaactttaa

SEQ ID NO: 190028 - DNA, 16 bp, P. troglodytes
aagaagaaaatgaggc

SEQ ID NO: 190029 - DNA, 16 bp, P. troglodytes
aagaagaaaatgtggc

SEQ ID NO: 190030 - DNA, 16 bp, P. troglodytes
aagaagaaaatttcag

SEQ ID NO: 190031 - DNA, 16 bp, P. troglodytes
aagaagaaagactgaa

SEQ ID NO: 190032 - DNA, 16 bp, P. troglodytes
aagaagaaagcatttt

SEQ ID NO: 190033 - DNA, 16 bp, P. troglodytes
aagaagaaagctcaga

SEQ ID NO: 190034 - DNA, 16 bp, P. troglodytes
aagaagaaatcacagg

SEQ ID NO: 190035 - DNA, 16 bp, P. troglodytes
aagaagaaatctctga

SEQ ID NO: 190036 - DNA, 16 bp, P. troglodytes
aagaagaaatgttttt

SEQ ID NO: 190037 - DNA, 16 bp, P. troglodytes
aagaagaaattcctga

SEQ ID NO: 190038 - DNA, 16 bp, P. troglodytes
aagaagaacaaagctg

SEQ ID NO: 190039 - DNA, 16 bp, P. troglodytes
aagaagaacaagatca

SEQ ID NO: 190040 - DNA, 16 bp, P. troglodytes
aagaagaagaaatgca

SEQ ID NO: 190041 - DNA, 16 bp, P. troglodytes
aagaagaagaaatttg

SEQ ID NO: 190042 - DNA, 16 bp, P. troglodytes
aagaagaagaagaatc

SEQ ID NO: 190043 - DNA, 16 bp, P. troglodytes
aagaagaagcagcagc

SEQ ID NO: 190044 - DNA, 16 bp, P. troglodytes
aagaagaagttgaatc

SEQ ID NO: 190045 - DNA, 16 bp, P. troglodytes
aagaagaatctgaaca

SEQ ID NO: 190046 - DNA, 16 bp, P. troglodytes
aagaagaatctggaca

SEQ ID NO: 190047 - DNA, 16 bp, P. troglodytes
aagaagaatgaagttg

SEQ ID NO: 190048 - DNA, 16 bp, P. troglodytes
aagaagaatgtatatt

SEQ ID NO: 190049 - DNA, 16 bp, P. troglodytes
aagaagaattaatacc

SEQ ID NO: 190050 - DNA, 16 bp, P. troglodytes
aagaagaattagtacc

SEQ ID NO: 190051 - DNA, 16 bp, P. troglodytes
aagaagacaaaaatgt

SEQ ID NO: 190052 - DNA, 16 bp, P. troglodytes
aagaagacagtaaaat

SEQ ID NO: 190053 - DNA, 16 bp, P. troglodytes
aagaagacatactaat

SEQ ID NO: 190054 - DNA, 16 bp, P. troglodytes
aagaagacatggaaat

SEQ ID NO: 190055 - DNA, 16 bp, P. troglodytes
aagaagacattgttat

SEQ ID NO: 190056 - DNA, 16 bp, P. troglodytes
aagaagagaaaagcat

SEQ ID NO: 190057 - DNA, 16 bp, P. troglodytes
aagaagagaaatctga

SEQ ID NO: 190058 - DNA, 16 bp, P. troglodytes
aagaagagaagtttag

SEQ ID NO: 190059 - DNA, 16 bp, P. troglodytes
aagaagagagaaaact

SEQ ID NO: 190060 - DNA, 16 bp, P. troglodytes
aagaagagataactat

SEQ ID NO: 190061 - DNA, 16 bp, P. troglodytes
aagaagagcaaagtaa

SEQ ID NO: 190062 - DNA, 16 bp, P. troglodytes
aagaagagctggcacc

SEQ ID NO: 190063 - DNA, 16 bp, P. troglodytes
aagaagaggccagaga

SEQ ID NO: 190064 - DNA, 16 bp, P. troglodytes
aagaagaggctgggtg

SEQ ID NO: 190065 - DNA, 16 bp, P. troglodytes
aagaagagggaattct

SEQ ID NO: 190066 - DNA, 16 bp, P. troglodytes
aagaagagtctgagct

SEQ ID NO: 190067 - DNA, 16 bp, P. troglodytes
aagaagatatacagat

SEQ ID NO: 190068 - DNA, 16 bp, P. troglodytes
aagaagatctctcaaa

SEQ ID NO: 190069 - DNA, 16 bp, P. troglodytes
aagaagatgccatcta

SEQ ID NO: 190070 - DNA, 16 bp, P. troglodytes
aagaagattaaaatca

SEQ ID NO: 190071 - DNA, 16 bp, P. troglodytes
aagaagcaaatgcaaa

SEQ ID NO: 190072 - DNA, 16 bp, P. troglodytes
aagaagcagaaaatat

SEQ ID NO: 190073 - DNA, 16 bp, P. troglodytes
aagaagcagaaattct

SEQ ID NO: 190074 - DNA, 16 bp, P. troglodytes
aagaagcagataaact

SEQ ID NO: 190075 - DNA, 16 bp, P. troglodytes
aagaagcagcagcaga

SEQ ID NO: 190076 - DNA, 16 bp, P. troglodytes
aagaagcagcagcagc

SEQ ID NO: 190077 - DNA, 16 bp, P. troglodytes
aagaagcagtgccaga

SEQ ID NO: 190078 - DNA, 16 bp, P. troglodytes
aagaagccagacacag

SEQ ID NO: 190079 - DNA, 16 bp, P. troglodytes
aagaagctagaaaaag

SEQ ID NO: 190080 - DNA, 16 bp, P. troglodytes
aagaagctagagaaaa

SEQ ID NO: 190081 - DNA, 16 bp, P. troglodytes
aagaagctgggaccac

SEQ ID NO: 190082 - DNA, 16 bp, P. troglodytes
aagaagctgggcatgg

SEQ ID NO: 190083 - DNA, 16 bp, P. troglodytes
aagaagctggtggagc

SEQ ID NO: 190084 - DNA, 16 bp, P. troglodytes
aagaagcttctgcaca

SEQ ID NO: 190085 - DNA, 16 bp, P. troglodytes
aagaagctttaaaaaa

SEQ ID NO: 190086 - DNA, 16 bp, P. troglodytes
aagaaggaaactgagg

SEQ ID NO: 190087 - DNA, 16 bp, P. troglodytes
aagaaggaaattttaa

SEQ ID NO: 190088 - DNA, 16 bp, P. troglodytes
aagaaggaagctcctg

SEQ ID NO: 190089 - DNA, 16 bp, P. troglodytes
aagaaggaattcagaa

SEQ ID NO: 190090 - DNA, 16 bp, P. troglodytes
aagaaggacatatttg

SEQ ID NO: 190091 - DNA, 16 bp, P. troglodytes
aagaaggaggtttgtt

SEQ ID NO: 190092 - DNA, 16 bp, P. troglodytes
aagaaggatgtgtttg

SEQ ID NO: 190093 - DNA, 16 bp, P. troglodytes
aagaaggcagacacaa

SEQ ID NO: 190094 - DNA, 16 bp, P. troglodytes
aagaaggcatacaaat

SEQ ID NO: 190095 - DNA, 16 bp, P. troglodytes
aagaaggcattgtttt

SEQ ID NO: 190096 - DNA, 16 bp, P. troglodytes
aagaaggcggccatct

SEQ ID NO: 190097 - DNA, 16 bp, P. troglodytes
aagaaggctgtgatgt

SEQ ID NO: 190098 - DNA, 16 bp, P. troglodytes
aagaagggaatttatt

SEQ ID NO: 190099 - DNA, 16 bp, P. troglodytes
aagaagggccagatgg

SEQ ID NO: 190100 - DNA, 16 bp, P. troglodytes
aagaaggggaaatttg

SEQ ID NO: 190101 - DNA, 16 bp, P. troglodytes
aagaaggtgaaagacc

SEQ ID NO: 190102 - DNA, 16 bp, P. troglodytes
aagaagtaaaagattt

SEQ ID NO: 190103 - DNA, 16 bp, P. troglodytes
aagaagtaattttttt

SEQ ID NO: 190104 - DNA, 16 bp, P. troglodytes
aagaagtacattggtt

SEQ ID NO: 190105 - DNA, 16 bp, P. troglodytes
aagaagtatggcaaga

SEQ ID NO: 190106 - DNA, 16 bp, P. troglodytes
aagaagtcaaagagaa

SEQ ID NO: 190107 - DNA, 16 bp, P. troglodytes
aagaagtcaaattatc

SEQ ID NO: 190108 - DNA, 16 bp, P. troglodytes
aagaagtcagcagtct

SEQ ID NO: 190109 - DNA, 16 bp, P. troglodytes
aagaagtctttaaaaa

SEQ ID NO: 190110 - DNA, 16 bp, P. troglodytes
aagaagtgacatttaa

SEQ ID NO: 190111 - DNA, 16 bp, P. troglodytes
aagaagttaaacaaat

SEQ ID NO: 190112 - DNA, 16 bp, P. troglodytes
aagaagttctctgaaa

SEQ ID NO: 190113 - DNA, 16 bp, P. troglodytes
aagaagttctggagat

SEQ ID NO: 190114 - DNA, 16 bp, P. troglodytes
aagaagttgattccag

SEQ ID NO: 190115 - DNA, 16 bp, P. troglodytes
aagaagtttctgagaa

SEQ ID NO: 190116 - DNA, 16 bp, P. troglodytes
aagaagtttgggacta

SEQ ID NO: 190117 - DNA, 16 bp, P. troglodytes
aagaagttttaatttt

SEQ ID NO: 190118 - DNA, 16 bp, P. troglodytes
aagaagtttttcagaa

SEQ ID NO: 190119 - DNA, 16 bp, P. troglodytes
aagaagtttttgagaa

SEQ ID NO: 190120 - DNA, 16 bp, P. troglodytes
aagaagttttttaaaa

SEQ ID NO: 190121 - DNA, 16 bp, P. troglodytes
aagaataaaatgccta

SEQ ID NO: 190122 - DNA, 16 bp, P. troglodytes
aagaataaagttggat

SEQ ID NO: 190123 - DNA, 16 bp, P. troglodytes
aagaataaatttctct

SEQ ID NO: 190124 - DNA, 16 bp, P. troglodytes
aagaataagagagctg

SEQ ID NO: 190125 - DNA, 16 bp, P. troglodytes
aagaatacaaaagtta

SEQ ID NO: 190126 - DNA, 16 bp, P. troglodytes
aagaatacaaaattag

SEQ ID NO: 190127 - DNA, 16 bp, P. troglodytes
aagaatacacactggg

SEQ ID NO: 190128 - DNA, 16 bp, P. troglodytes
aagaatacagtataca

SEQ ID NO: 190129 - DNA, 16 bp, P. troglodytes
aagaatacatacaaat

SEQ ID NO: 190130 - DNA, 16 bp, P. troglodytes
aagaatacatatttat

SEQ ID NO: 190131 - DNA, 16 bp, P. troglodytes
aagaataccacagagg

SEQ ID NO: 190132 - DNA, 16 bp, P. troglodytes
aagaatactcacaact

SEQ ID NO: 190133 - DNA, 16 bp, P. troglodytes
aagaatactttttttt

SEQ ID NO: 190134 - DNA, 17 bp, P. troglodytes
aagaatagcatgggaaa

SEQ ID NO: 190135 - DNA, 16 bp, P. troglodytes
aagaatatatttttgt

SEQ ID NO: 190136 - DNA, 16 bp, P. troglodytes
aagaatatggagaaac

SEQ ID NO: 190137 - DNA, 16 bp, P. troglodytes
aagaatattcacaaat

SEQ ID NO: 190138 - DNA, 16 bp, P. troglodytes
aagaatattttcactg

SEQ ID NO: 190139 - DNA, 16 bp, P. troglodytes
aagaatattttctttt

SEQ ID NO: 190140 - DNA, 16 bp, P. troglodytes
aagaatattttgtgac

SEQ ID NO: 190141 - DNA, 16 bp, P. troglodytes
aagaatcaaatattta

SEQ ID NO: 190142 - DNA, 16 bp, P. troglodytes
aagaatcaatatgtca

SEQ ID NO: 190143 - DNA, 16 bp, P. troglodytes
aagaatcctaaaagca

SEQ ID NO: 190144 - DNA, 16 bp, P. troglodytes
aagaatctgaggctca

SEQ ID NO: 190145 - DNA, 16 bp, P. troglodytes
aagaatcttttttttt

SEQ ID NO: 190146 - DNA, 16 bp, P. troglodytes
aagaatgaaaacattt

SEQ ID NO: 190147 - DNA, 16 bp, P. troglodytes
aagaatgaaaaggaac

SEQ ID NO: 190148 - DNA, 16 bp, P. troglodytes
aagaatgaaatagaca

SEQ ID NO: 190149 - DNA, 16 bp, P. troglodytes
aagaatgaaattatgt

SEQ ID NO: 190150 - DNA, 16 bp, P. troglodytes
aagaatgaaggttttt

SEQ ID NO: 190151 - DNA, 16 bp, P. troglodytes
aagaatgactttgacg

SEQ ID NO: 190152 - DNA, 16 bp, P. troglodytes
aagaatgagaacatgt

SEQ ID NO: 190153 - DNA, 16 bp, P. troglodytes
aagaatgagaggaagc

SEQ ID NO: 190154 - DNA, 16 bp, P. troglodytes
aagaatgagatccagt

SEQ ID NO: 190155 - DNA, 16 bp, P. troglodytes
aagaatgagattgtgt

SEQ ID NO: 190156 - DNA, 16 bp, P. troglodytes
aagaatgaggatatgc

SEQ ID NO: 190157 - DNA, 16 bp, P. troglodytes
aagaatgatcaattaa

SEQ ID NO: 190158 - DNA, 16 bp, P. troglodytes
aagaatgatgatggta

SEQ ID NO: 190159 - DNA, 16 bp, P. troglodytes
aagaatgcaaaatggt

SEQ ID NO: 190160 - DNA, 16 bp, P. troglodytes
aagaatgccctctctc

SEQ ID NO: 190161 - DNA, 16 bp, P. troglodytes
aagaatgcctttaagc

SEQ ID NO: 190162 - DNA, 16 bp, P. troglodytes
aagaatgcctttaagt

SEQ ID NO: 190163 - DNA, 16 bp, P. troglodytes
aagaatgcttttgatt

SEQ ID NO: 190164 - DNA, 16 bp, P. troglodytes
aagaatggaaaaccaa

SEQ ID NO: 190165 - DNA, 16 bp, P. troglodytes
aagaatggaagtcagt

SEQ ID NO: 190166 - DNA, 16 bp, P. troglodytes
aagaatggaattgctg

SEQ ID NO: 190167 - DNA, 16 bp, P. troglodytes
aagaatggtttcatgg

SEQ ID NO: 190168 - DNA, 16 bp, P. troglodytes
aagaatgtaattctct

SEQ ID NO: 190169 - DNA, 16 bp, P. troglodytes
aagaatgtcactttct

SEQ ID NO: 190170 - DNA, 16 bp, P. troglodytes
aagaatgtcattgtta

SEQ ID NO: 190171 - DNA, 16 bp, P. troglodytes
aagaatgtggagaaac

SEQ ID NO: 190172 - DNA, 16 bp, P. troglodytes
aagaatgttcatagca

SEQ ID NO: 190173 - DNA, 16 bp, P. troglodytes
aagaatgttgaaaata

SEQ ID NO: 190174 - DNA, 16 bp, P. troglodytes
aagaatgtttatagca

SEQ ID NO: 190175 - DNA, 16 bp, P. troglodytes
aagaattagaaaagca

SEQ ID NO: 190176 - DNA, 16 bp, P. troglodytes
aagaattagagaaaca

SEQ ID NO: 190177 - DNA, 16 bp, P. troglodytes
aagaattatccagccc

SEQ ID NO: 190178 - DNA, 16 bp, P. troglodytes
aagaattattttcaaa

SEQ ID NO: 190179 - DNA, 16 bp, P. troglodytes
aagaattcaaagcata

SEQ ID NO: 190180 - DNA, 16 bp, P. troglodytes
aagaattcaagggtga

SEQ ID NO: 190181 - DNA, 16 bp, P. troglodytes
aagaattcaccaacca

SEQ ID NO: 190182 - DNA, 16 bp, P. troglodytes
aagaattcagaataat

SEQ ID NO: 190183 - DNA, 16 bp, P. troglodytes
aagaattcagggagag

SEQ ID NO: 190184 - DNA, 16 bp, P. troglodytes
aagaattgaaaacagg

SEQ ID NO: 190185 - DNA, 16 bp, P. troglodytes
aagaattgagttttgg

SEQ ID NO: 190186 - DNA, 16 bp, P. troglodytes
aagaattgctcagttg

SEQ ID NO: 190187 - DNA, 16 bp, P. troglodytes
aagaattggataaatt

SEQ ID NO: 190188 - DNA, 16 bp, P. troglodytes
aagaattggtccattt

SEQ ID NO: 190189 - DNA, 16 bp, P. troglodytes
aagaattgtcttgagc

SEQ ID NO: 190190 - DNA, 16 bp, P. troglodytes
aagaatttaaaaagtg

SEQ ID NO: 190191 - DNA, 16 bp, P. troglodytes
aagaatttaatccatt

SEQ ID NO: 190192 - DNA, 16 bp, P. troglodytes
aagaatttattcattt

SEQ ID NO: 190193 - DNA, 16 bp, P. troglodytes
aagaatttatttttct

SEQ ID NO: 190194 - DNA, 16 bp, P. troglodytes
aagaatttctaaaata

SEQ ID NO: 190195 - DNA, 16 bp, P. troglodytes
aagaatttctttttct

SEQ ID NO: 190196 - DNA, 16 bp, P. troglodytes
aagaatttgaatctct

SEQ ID NO: 190197 - DNA, 16 bp, P. troglodytes
aagaatttgagaagaa

SEQ ID NO: 190198 - DNA, 16 bp, P. troglodytes
aagaatttgctttatg

SEQ ID NO: 190199 - DNA, 16 bp, P. troglodytes
aagaattttcaaacca

SEQ ID NO: 190200 - DNA, 16 bp, P. troglodytes
aagaattttctttctt

SEQ ID NO: 190201 - DNA, 16 bp, P. troglodytes
aagaattttgtatcca

SEQ ID NO: 190202 - DNA, 16 bp, P. troglodytes
aagaattttttgtttg

SEQ ID NO: 190203 - DNA, 16 bp, P. troglodytes
aagacaaaaatatttt

SEQ ID NO: 190204 - DNA, 16 bp, P. troglodytes
aagacaaaattagaga

SEQ ID NO: 190205 - DNA, 16 bp, P. troglodytes
aagacaaacactgtat

SEQ ID NO: 190206 - DNA, 31 bp, P. troglodytes
aagacaaacagagagccaaatcatgagtgaa

SEQ ID NO: 190207 - DNA, 16 bp, P. troglodytes
aagacaaacatcatat

SEQ ID NO: 190208 - DNA, 16 bp, P. troglodytes
aagacaaacattgtat

SEQ ID NO: 190209 - DNA, 16 bp, P. troglodytes
aagacaaagaaaggct

SEQ ID NO: 190210 - DNA, 16 bp, P. troglodytes
aagacaaagagaagat

SEQ ID NO: 190211 - DNA, 16 bp, P. troglodytes
aagacaaagtccttgc

SEQ ID NO: 190212 - DNA, 16 bp, P. troglodytes
aagacaacctaggaaa

SEQ ID NO: 190213 - DNA, 16 bp, P. troglodytes
aagacaactttttaaa

SEQ ID NO: 190214 - DNA, 16 bp, P. troglodytes
aagacaagacacagac

SEQ ID NO: 190215 - DNA, 16 bp, P. troglodytes
aagacaaggagaaaat

SEQ ID NO: 190216 - DNA, 16 bp, P. troglodytes
aagacaaggatgacca

SEQ ID NO: 190217 - DNA, 16 bp, P. troglodytes
aagacaaggctttcaa

SEQ ID NO: 190218 - DNA, 16 bp, P. troglodytes
aagacaataacaagtg

SEQ ID NO: 190219 - DNA, 16 bp, P. troglodytes
aagacaatgaggatga

SEQ ID NO: 190220 - DNA, 16 bp, P. troglodytes
aagacaatgatattga

SEQ ID NO: 190221 - DNA, 16 bp, P. troglodytes
aagacaatggggaaaa

SEQ ID NO: 190222 - DNA, 16 bp, P. troglodytes
aagacaatggggtttt

SEQ ID NO: 190223 - DNA, 16 bp, P. troglodytes
aagacaatttttcttc

SEQ ID NO: 190224 - DNA, 16 bp, P. troglodytes
aagacacaaaatggca

SEQ ID NO: 190225 - DNA, 16 bp, P. troglodytes
aagacacaaacaaatg

SEQ ID NO: 190226 - DNA, 16 bp, P. troglodytes
aagacacacataaact

SEQ ID NO: 190227 - DNA, 16 bp, P. troglodytes
aagacacagacacaga

SEQ ID NO: 190228 - DNA, 16 bp, P. troglodytes
aagacacagggtctca

SEQ ID NO: 190229 - DNA, 16 bp, P. troglodytes
aagacacatgcacatg

SEQ ID NO: 190230 - DNA, 16 bp, P. troglodytes
aagacaccaaattcca

SEQ ID NO: 190231 - DNA, 16 bp, P. troglodytes
aagacaccatctctac

SEQ ID NO: 190232 - DNA, 16 bp, P. troglodytes
aagacaccattaagag

SEQ ID NO: 190233 - DNA, 16 bp, P. troglodytes
aagacacctcctggtg

SEQ ID NO: 190234 - DNA, 16 bp, P. troglodytes
aagacactttgggagg

SEQ ID NO: 190235 - DNA, 16 bp, P. troglodytes
aagacagaaaagttct

SEQ ID NO: 190236 - DNA, 16 bp, P. troglodytes
aagacagaaaatccaa

SEQ ID NO: 190237 - DNA, 16 bp, P. troglodytes
aagacagaactaccat

SEQ ID NO: 190238 - DNA, 16 bp, P. troglodytes
aagacagaagcagagg

SEQ ID NO: 190239 - DNA, 16 bp, P. troglodytes
aagacagaaggatcac

SEQ ID NO: 190240 - DNA, 16 bp, P. troglodytes
aagacagaatttaaaa

SEQ ID NO: 190241 - DNA, 16 bp, P. troglodytes
aagacagaatttttaa

SEQ ID NO: 190242 - DNA, 16 bp, P. troglodytes
aagacagaattttttt

SEQ ID NO: 190243 - DNA, 16 bp, P. troglodytes
aagacagactttaaac

SEQ ID NO: 190244 - DNA, 16 bp, P. troglodytes
aagacagaggttgcag

SEQ ID NO: 190245 - DNA, 16 bp, P. troglodytes
aagacagagtctcact

SEQ ID NO: 190246 - DNA, 16 bp, P. troglodytes
aagacagcagccccag

SEQ ID NO: 190247 - DNA, 16 bp, P. troglodytes
aagacagcatggtact

SEQ ID NO: 190248 - DNA, 16 bp, P. troglodytes
aagacagcccacagaa

SEQ ID NO: 190249 - DNA, 16 bp, P. troglodytes
aagacagctttgactc

SEQ ID NO: 190250 - DNA, 17 bp, P. troglodytes
aagacaggatttcacca

SEQ ID NO: 190251 - DNA, 16 bp, P. troglodytes
aagacaggcaataatg

SEQ ID NO: 190252 - DNA, 16 bp, P. troglodytes
aagacaggcagcccgg

SEQ ID NO: 190253 - DNA, 16 bp, P. troglodytes
aagacagggtctcact

SEQ ID NO: 190254 - DNA, 16 bp, P. troglodytes
aagacagggtctcgct

SEQ ID NO: 190255 - DNA, 16 bp, P. troglodytes
aagacagggtcttgct

SEQ ID NO: 190256 - DNA, 17 bp, P. troglodytes
aagacagggtttcacca

SEQ ID NO: 190257 - DNA, 16 bp, P. troglodytes
aagacaggtttatttt

SEQ ID NO: 190258 - DNA, 16 bp, P. troglodytes
aagacagtgacattga

SEQ ID NO: 190259 - DNA, 16 bp, P. troglodytes
aagacagtgggaaaaa

SEQ ID NO: 190260 - DNA, 16 bp, P. troglodytes
aagacagtgtggtggt

SEQ ID NO: 190261 - DNA, 16 bp, P. troglodytes
aagacagtttaaagcc

SEQ ID NO: 190262 - DNA, 16 bp, P. troglodytes
aagacagttttacttt

SEQ ID NO: 190263 - DNA, 16 bp, P. troglodytes
aagacagtttttattt

SEQ ID NO: 190264 - DNA, 16 bp, P. troglodytes
aagacataaccaagac

SEQ ID NO: 190265 - DNA, 16 bp, P. troglodytes
aagacatacaaatggg

SEQ ID NO: 190266 - DNA, 16 bp, P. troglodytes
aagacatacatacagc

SEQ ID NO: 190267 - DNA, 17 bp, P. troglodytes
aagacatacccaagact

SEQ ID NO: 190268 - DNA, 16 bp, P. troglodytes
aagacatatttaaaaa

SEQ ID NO: 190269 - DNA, 16 bp, P. troglodytes
aagacatgaacagaaa

SEQ ID NO: 190270 - DNA, 16 bp, P. troglodytes
aagacatgcccaccag

SEQ ID NO: 190271 - DNA, 16 bp, P. troglodytes
aagacatgcctgcttt

SEQ ID NO: 190272 - DNA, 16 bp, P. troglodytes
aagacattaaaacagt

SEQ ID NO: 190273 - DNA, 16 bp, P. troglodytes
aagacattaaaatatt

SEQ ID NO: 190274 - DNA, 16 bp, P. troglodytes
aagacattatcaagaa

SEQ ID NO: 190275 - DNA, 16 bp, P. troglodytes
aagacatttcagagac

SEQ ID NO: 190276 - DNA, 16 bp, P. troglodytes
aagacattttatttta

SEQ ID NO: 190277 - DNA, 16 bp, P. troglodytes
aagacattttgaaata

SEQ ID NO: 190278 - DNA, 16 bp, P. troglodytes
aagacatttttggttg

SEQ ID NO: 190279 - DNA, 16 bp, P. troglodytes
aagacattttttaaaa

SEQ ID NO: 190280 - DNA, 16 bp, P. troglodytes
aagaccaaacactgca

SEQ ID NO: 190281 - DNA, 16 bp, P. troglodytes
aagaccaaatatatat

SEQ ID NO: 190282 - DNA, 16 bp, P. troglodytes
aagaccaaatctaagt

SEQ ID NO: 190283 - DNA, 16 bp, P. troglodytes
aagaccaacccctcct

SEQ ID NO: 190284 - DNA, 16 bp, P. troglodytes
aagaccaacctggcca

SEQ ID NO: 190285 - DNA, 16 bp, P. troglodytes
aagaccaacctggcta

SEQ ID NO: 190286 - DNA, 16 bp, P. troglodytes
aagaccaagccatgat

SEQ ID NO: 190287 - DNA, 17 bp, P. troglodytes
aagaccaccctgggcaa

SEQ ID NO: 190288 - DNA, 16 bp, P. troglodytes
aagaccactctggcca

SEQ ID NO: 190289 - DNA, 16 bp, P. troglodytes
aagaccagccagacca

SEQ ID NO: 190290 - DNA, 16 bp, P. troglodytes
aagaccagcctgcaca

SEQ ID NO: 190291 - DNA, 17 bp, P. troglodytes
aagaccagcctggacaa

SEQ ID NO: 190292 - DNA, 16 bp, P. troglodytes
aagaccagcctgttca

SEQ ID NO: 190293 - DNA, 16 bp, P. troglodytes
aagaccagcttggcca

SEQ ID NO: 190294 - DNA, 16 bp, P. troglodytes
aagaccagtcagggca

SEQ ID NO: 190295 - DNA, 16 bp, P. troglodytes
aagaccatcaagacta

SEQ ID NO: 190296 - DNA, 16 bp, P. troglodytes
aagaccatcatggcca

SEQ ID NO: 190297 - DNA, 16 bp, P. troglodytes
aagaccattggaaaaa

SEQ ID NO: 190298 - DNA, 16 bp, P. troglodytes
aagacccaaaactata

SEQ ID NO: 190299 - DNA, 16 bp, P. troglodytes
aagacccactggcttg

SEQ ID NO: 190300 - DNA, 16 bp, P. troglodytes
aagaccccattctcca

SEQ ID NO: 190301 - DNA, 17 bp, P. troglodytes
aagaccccgtctctact

SEQ ID NO: 190302 - DNA, 16 bp, P. troglodytes
aagaccctatttccag

SEQ ID NO: 190303 - DNA, 16 bp, P. troglodytes
aagaccctgactctaa

SEQ ID NO: 190304 - DNA, 16 bp, P. troglodytes
aagacctcagaagcac

SEQ ID NO: 190305 - DNA, 16 bp, P. troglodytes
aagacctcatctccaa

SEQ ID NO: 190306 - DNA, 16 bp, P. troglodytes
aagacctgaaatcata

SEQ ID NO: 190307 - DNA, 16 bp, P. troglodytes
aagacctggaacaaga

SEQ ID NO: 190308 - DNA, 16 bp, P. troglodytes
aagaccttcctggcca

SEQ ID NO: 190309 - DNA, 16 bp, P. troglodytes
aagacggaggcagaga

SEQ ID NO: 190310 - DNA, 17 bp, P. troglodytes
aagacggggtttcacca

SEQ ID NO: 190311 - DNA, 17 bp, P. troglodytes
aagacggggtttcaccg

SEQ ID NO: 190312 - DNA, 18 bp, P. troglodytes
aagacgggtttcaccatg

SEQ ID NO: 190313 - DNA, 16 bp, P. troglodytes
aagacgtgactttgct

SEQ ID NO: 190314 - DNA, 16 bp, P. troglodytes
aagactaaataatatt

SEQ ID NO: 190315 - DNA, 16 bp, P. troglodytes
aagactaagagcttta

SEQ ID NO: 190316 - DNA, 16 bp, P. troglodytes
aagactaatgaagaaa

SEQ ID NO: 190317 - DNA, 16 bp, P. troglodytes
aagactacatactggg

SEQ ID NO: 190318 - DNA, 16 bp, P. troglodytes
aagactacattttcca

SEQ ID NO: 190319 - DNA, 16 bp, P. troglodytes
aagactagcctgggaa

SEQ ID NO: 190320 - DNA, 16 bp, P. troglodytes
aagactaggaagaaac

SEQ ID NO: 190321 - DNA, 16 bp, P. troglodytes
aagactatcctgggca

SEQ ID NO: 190322 - DNA, 16 bp, P. troglodytes
aagactcaaatgtaaa

SEQ ID NO: 190323 - DNA, 16 bp, P. troglodytes
aagactccagctcaaa

SEQ ID NO: 190324 - DNA, 16 bp, P. troglodytes
aagactccatctcaaa

SEQ ID NO: 190325 - DNA, 16 bp, P. troglodytes
aagactccatcttaaa

SEQ ID NO: 190326 - DNA, 16 bp, P. troglodytes
aagactctgctcctcc

SEQ ID NO: 190327 - DNA, 16 bp, P. troglodytes
aagactctgtctcaaa

SEQ ID NO: 190328 - DNA, 16 bp, P. troglodytes
aagactctgtcttaaa

SEQ ID NO: 190329 - DNA, 16 bp, P. troglodytes
aagactcttaaaaaaa

SEQ ID NO: 190330 - DNA, 16 bp, P. troglodytes
aagactcttccaaaag

SEQ ID NO: 190331 - DNA, 16 bp, P. troglodytes
aagactgaaccagaaa

SEQ ID NO: 190332 - DNA, 16 bp, P. troglodytes
aagactgaactaggaa

SEQ ID NO: 190333 - DNA, 16 bp, P. troglodytes
aagactgacaatatca

SEQ ID NO: 190334 - DNA, 16 bp, P. troglodytes
aagactgagaaagaaa

SEQ ID NO: 190335 - DNA, 17 bp, P. troglodytes
aagactgagcagcagca

SEQ ID NO: 190336 - DNA, 16 bp, P. troglodytes
aagactgagccaggaa

SEQ ID NO: 190337 - DNA, 16 bp, P. troglodytes
aagactgcagaggtta

SEQ ID NO: 190338 - DNA, 16 bp, P. troglodytes
aagactgcagtgagct

SEQ ID NO: 190339 - DNA, 16 bp, P. troglodytes
aagactggaaagaaat

SEQ ID NO: 190340 - DNA, 16 bp, P. troglodytes
aagactgggcaacata

SEQ ID NO: 190341 - DNA, 16 bp, P. troglodytes
aagactggggagaaaa

SEQ ID NO: 190342 - DNA, 16 bp, P. troglodytes
aagactggtctcaaac

SEQ ID NO: 190343 - DNA, 16 bp, P. troglodytes
aagactgtgtctcaaa

SEQ ID NO: 190344 - DNA, 16 bp, P. troglodytes
aagactgtttccaaat

SEQ ID NO: 190345 - DNA, 16 bp, P. troglodytes
aagacttaaaaacaga

SEQ ID NO: 190346 - DNA, 16 bp, P. troglodytes
aagacttaatattttt

SEQ ID NO: 190347 - DNA, 16 bp, P. troglodytes
aagacttagtacaaaa

SEQ ID NO: 190348 - DNA, 16 bp, P. troglodytes
aagacttcatctccaa

SEQ ID NO: 190349 - DNA, 16 bp, P. troglodytes
aagacttcctggagga

SEQ ID NO: 190350 - DNA, 16 bp, P. troglodytes
aagacttggagggaaa

SEQ ID NO: 190351 - DNA, 16 bp, P. troglodytes
aagacttgggggactg

SEQ ID NO: 190352 - DNA, 16 bp, P. troglodytes
aagactttggaggact

SEQ ID NO: 190353 - DNA, 16 bp, P. troglodytes
aagacttttctttata

SEQ ID NO: 190354 - DNA, 16 bp, P. troglodytes
aagactttttaaaagt

SEQ ID NO: 190355 - DNA, 16 bp, P. troglodytes
aagactttttgttttt

SEQ ID NO: 190356 - DNA, 16 bp, P. troglodytes
aagagaaaaaagactg

SEQ ID NO: 190357 - DNA, 16 bp, P. troglodytes
aagagaaaaacaatcc

SEQ ID NO: 190358 - DNA, 16 bp, P. troglodytes
aagagaaaaagactga

SEQ ID NO: 190359 - DNA, 16 bp, P. troglodytes
aagagaaaaataactt

SEQ ID NO: 190360 - DNA, 16 bp, P. troglodytes
aagagaaaaatatttg

SEQ ID NO: 190361 - DNA, 16 bp, P. troglodytes
aagagaaaaatctcaa

SEQ ID NO: 190362 - DNA, 16 bp, P. troglodytes
aagagaaaacccacag

SEQ ID NO: 190363 - DNA, 16 bp, P. troglodytes
aagagaaaactttaaa

SEQ ID NO: 190364 - DNA, 16 bp, P. troglodytes
aagagaaaagactcaa

SEQ ID NO: 190365 - DNA, 16 bp, P. troglodytes
aagagaaaagcatcta

SEQ ID NO: 190366 - DNA, 16 bp, P. troglodytes
aagagaaaatatttct

SEQ ID NO: 190367 - DNA, 16 bp, P. troglodytes
aagagaaaatatttgc

SEQ ID NO: 190368 - DNA, 16 bp, P. troglodytes
aagagaaaatattttc

SEQ ID NO: 190369 - DNA, 16 bp, P. troglodytes
aagagaaaattttgaa

SEQ ID NO: 190370 - DNA, 16 bp, P. troglodytes
aagagaaactatttta

SEQ ID NO: 190371 - DNA, 16 bp, P. troglodytes
aagagaaactgaggaa

SEQ ID NO: 190372 - DNA, 16 bp, P. troglodytes
aagagaaagaaatcat

SEQ ID NO: 190373 - DNA, 16 bp, P. troglodytes
aagagaaataagccag

SEQ ID NO: 190374 - DNA, 16 bp, P. troglodytes
aagagaaatgtaaatt

SEQ ID NO: 190375 - DNA, 16 bp, P. troglodytes
aagagaaattatattt

SEQ ID NO: 190376 - DNA, 16 bp, P. troglodytes
aagagaaattttaaag

SEQ ID NO: 190377 - DNA, 16 bp, P. troglodytes
aagagaaattttggaa

SEQ ID NO: 190378 - DNA, 16 bp, P. troglodytes
aagagaactagaattg

SEQ ID NO: 190379 - DNA, 16 bp, P. troglodytes
aagagaagaacaaagt

SEQ ID NO: 190380 - DNA, 16 bp, P. troglodytes
aagagaagaatttgaa

SEQ ID NO: 190381 - DNA, 16 bp, P. troglodytes
aagagaagagaacttg

SEQ ID NO: 190382 - DNA, 16 bp, P. troglodytes
aagagaagctttgttt

SEQ ID NO: 190383 - DNA, 16 bp, P. troglodytes
aagagaaggacccagt

SEQ ID NO: 190384 - DNA, 16 bp, P. troglodytes
aagagaaggagcatct

SEQ ID NO: 190385 - DNA, 17 bp, P. troglodytes
aagagaataaaataccc

SEQ ID NO: 190386 - DNA, 16 bp, P. troglodytes
aagagaataattcaaa

SEQ ID NO: 190387 - DNA, 16 bp, P. troglodytes
aagagaatactatgaa

SEQ ID NO: 190388 - DNA, 16 bp, P. troglodytes
aagagaatataacaat

SEQ ID NO: 190389 - DNA, 16 bp, P. troglodytes
aagagaatattatgaa

SEQ ID NO: 190390 - DNA, 16 bp, P. troglodytes
aagagaatctggctgc

SEQ ID NO: 190391 - DNA, 16 bp, P. troglodytes
aagagaattgaaaaca

SEQ ID NO: 190392 - DNA, 16 bp, P. troglodytes
aagagaattgcctgaa

SEQ ID NO: 190393 - DNA, 16 bp, P. troglodytes
aagagaatttcagacc

SEQ ID NO: 190394 - DNA, 16 bp, P. troglodytes
aagagaatttcaggcc

SEQ ID NO: 190395 - DNA, 16 bp, P. troglodytes
aagagacaaaggaggc

SEQ ID NO: 190396 - DNA, 16 bp, P. troglodytes
aagagacacagagaca

SEQ ID NO: 190397 - DNA, 16 bp, P. troglodytes
aagagacatttatttt

SEQ ID NO: 190398 - DNA, 16 bp, P. troglodytes
aagagactctgatgca

SEQ ID NO: 190399 - DNA, 16 bp, P. troglodytes
aagagactgagaaaga

SEQ ID NO: 190400 - DNA, 16 bp, P. troglodytes
aagagactggtgacat

SEQ ID NO: 190401 - DNA, 16 bp, P. troglodytes
aagagacttggactcc

SEQ ID NO: 190402 - DNA, 16 bp, P. troglodytes
aagagagaaacatttt

SEQ ID NO: 190403 - DNA, 16 bp, P. troglodytes
aagagagaaactgtct

SEQ ID NO: 190404 - DNA, 16 bp, P. troglodytes
aagagagaaatgattt

SEQ ID NO: 190405 - DNA, 16 bp, P. troglodytes
aagagagaagattcaa

SEQ ID NO: 190406 - DNA, 16 bp, P. troglodytes
aagagagaataatttt

SEQ ID NO: 190407 - DNA, 16 bp, P. troglodytes
aagagagagaaactga

SEQ ID NO: 190408 - DNA, 16 bp, P. troglodytes
aagagagagactccat

SEQ ID NO: 190409 - DNA, 16 bp, P. troglodytes
aagagagagagactga

SEQ ID NO: 190410 - DNA, 16 bp, P. troglodytes
aagagagagagcatgt

SEQ ID NO: 190411 - DNA, 16 bp, P. troglodytes
aagagagagtttgtgc

SEQ ID NO: 190412 - DNA, 16 bp, P. troglodytes
aagagagatagtttga

SEQ ID NO: 190413 - DNA, 16 bp, P. troglodytes
aagagagatattttga

SEQ ID NO: 190414 - DNA, 16 bp, P. troglodytes
aagagagctctggctg

SEQ ID NO: 190415 - DNA, 16 bp, P. troglodytes
aagagaggaagtcaaa

SEQ ID NO: 190416 - DNA, 16 bp, P. troglodytes
aagagaggaatcaaga

SEQ ID NO: 190417 - DNA, 16 bp, P. troglodytes
aagagagggcatccct

SEQ ID NO: 190418 - DNA, 16 bp, P. troglodytes
aagagagtcagtgaag

SEQ ID NO: 190419 - DNA, 16 bp, P. troglodytes
aagagagtcctcacca

SEQ ID NO: 190420 - DNA, 16 bp, P. troglodytes
aagagatatgtgcact

SEQ ID NO: 190421 - DNA, 16 bp, P. troglodytes
aagagatcctgaagga

SEQ ID NO: 190422 - DNA, 16 bp, P. troglodytes
aagagatgaaagatct

SEQ ID NO: 190423 - DNA, 16 bp, P. troglodytes
aagagatgaacaacaa

SEQ ID NO: 190424 - DNA, 16 bp, P. troglodytes
aagagatgaggacaca

SEQ ID NO: 190425 - DNA, 16 bp, P. troglodytes
aagagatgatggtggc

SEQ ID NO: 190426 - DNA, 16 bp, P. troglodytes
aagagatgctggagag

SEQ ID NO: 190427 - DNA, 16 bp, P. troglodytes
aagagatggagtctca

SEQ ID NO: 190428 - DNA, 16 bp, P. troglodytes
aagagatggataaatt

SEQ ID NO: 190429 - DNA, 16 bp, P. troglodytes
aagagattaataacaa

SEQ ID NO: 190430 - DNA, 16 bp, P. troglodytes
aagagattaggacaca

SEQ ID NO: 190431 - DNA, 16 bp, P. troglodytes
aagagattctcatgcc

SEQ ID NO: 190432 - DNA, 16 bp, P. troglodytes
aagagattgtagagaa

SEQ ID NO: 190433 - DNA, 16 bp, P. troglodytes
aagagatttattttaa

SEQ ID NO: 190434 - DNA, 16 bp, P. troglodytes
aagagattttagaaaa

SEQ ID NO: 190435 - DNA, 16 bp, P. troglodytes
aagagcaaaactcagt

SEQ ID NO: 190436 - DNA, 16 bp, P. troglodytes
aagagcaaagccagag

SEQ ID NO: 190437 - DNA, 16 bp, P. troglodytes
aagagcaaagtcatgt

SEQ ID NO: 190438 - DNA, 18 bp, P. troglodytes
aagagcaagactccatct

SEQ ID NO: 190439 - DNA, 16 bp, P. troglodytes
aagagcaagactctct

SEQ ID NO: 190440 - DNA, 17 bp, P. troglodytes
aagagcaagactctgtc

SEQ ID NO: 190441 - DNA, 16 bp, P. troglodytes
aagagcaagactgtct

SEQ ID NO: 190442 - DNA, 16 bp, P. troglodytes
aagagcacagactctg

SEQ ID NO: 190443 - DNA, 16 bp, P. troglodytes
aagagcacagattctg

SEQ ID NO: 190444 - DNA, 16 bp, P. troglodytes
aagagcagaactgaag

SEQ ID NO: 190445 - DNA, 16 bp, P. troglodytes
aagagcagcctgaaaa

SEQ ID NO: 190446 - DNA, 16 bp, P. troglodytes
aagagcagcctgggaa

SEQ ID NO: 190447 - DNA, 16 bp, P. troglodytes
aagagcagcttggcca

SEQ ID NO: 190448 - DNA, 16 bp, P. troglodytes
aagagcagtttcagtg

SEQ ID NO: 190449 - DNA, 16 bp, P. troglodytes
aagagcatctacagcc

SEQ ID NO: 190450 - DNA, 16 bp, P. troglodytes
aagagcatggtactgg

SEQ ID NO: 190451 - DNA, 16 bp, P. troglodytes
aagagcattccagaca

SEQ ID NO: 190452 - DNA, 16 bp, P. troglodytes
aagagccaaactccat

SEQ ID NO: 190453 - DNA, 16 bp, P. troglodytes
aagagccaattaaacc

SEQ ID NO: 190454 - DNA, 16 bp, P. troglodytes
aagagccagaccctgt

SEQ ID NO: 190455 - DNA, 16 bp, P. troglodytes
aagagccagcccctct

SEQ ID NO: 190456 - DNA, 19 bp, P. troglodytes
aagagcccacattgccaag

SEQ ID NO: 190457 - DNA, 18 bp, P. troglodytes
aagagcgagactccatct

SEQ ID NO: 190458 - DNA, 18 bp, P. troglodytes
aagagcgagactccgtct

SEQ ID NO: 190459 - DNA, 16 bp, P. troglodytes
aagagctaaaagcaga

SEQ ID NO: 190460 - DNA, 16 bp, P. troglodytes
aagagctaaaattgac

SEQ ID NO: 190461 - DNA, 16 bp, P. troglodytes
aagagctaaaggaaac

SEQ ID NO: 190462 - DNA, 16 bp, P. troglodytes
aagagctaaataaatg

SEQ ID NO: 190463 - DNA, 16 bp, P. troglodytes
aagagctagaaaagca

SEQ ID NO: 190464 - DNA, 17 bp, P. troglodytes
aagagctatttttgaca

SEQ ID NO: 190465 - DNA, 16 bp, P. troglodytes
aagagctcaggataca

SEQ ID NO: 190466 - DNA, 18 bp, P. troglodytes
aagagctcctgaaggaag

SEQ ID NO: 190467 - DNA, 16 bp, P. troglodytes
aagagctctgatggag

SEQ ID NO: 190468 - DNA, 16 bp, P. troglodytes
aagagctctgcacagc

SEQ ID NO: 190469 - DNA, 16 bp, P. troglodytes
aagagctgaaagaaat

SEQ ID NO: 190470 - DNA, 16 bp, P. troglodytes
aagagctgctgcacag

SEQ ID NO: 190471 - DNA, 16 bp, P. troglodytes
aagagctggagaccag

SEQ ID NO: 190472 - DNA, 16 bp, P. troglodytes
aagagcttctgaagga

SEQ ID NO: 190473 - DNA, 16 bp, P. troglodytes
aagagcttctgcatgg

SEQ ID NO: 190474 - DNA, 16 bp, P. troglodytes
aagagcttctgtatag

SEQ ID NO: 190475 - DNA, 16 bp, P. troglodytes
aagagcttgtaaacca

SEQ ID NO: 190476 - DNA, 16 bp, P. troglodytes
aagagctttttctttt

SEQ ID NO: 190477 - DNA, 16 bp, P. troglodytes
aagaggaaatgtggac

SEQ ID NO: 190478 - DNA, 16 bp, P. troglodytes
aagaggaaatttgaac

SEQ ID NO: 190479 - DNA, 16 bp, P. troglodytes
aagaggaagcagagca

SEQ ID NO: 190480 - DNA, 24 bp, P. troglodytes
aagaggaaggcatctgtctcctgc

SEQ ID NO: 190481 - DNA, 16 bp, P. troglodytes
aagaggaagtcaaaat

SEQ ID NO: 190482 - DNA, 16 bp, P. troglodytes
aagaggaagtcaagtt

SEQ ID NO: 190483 - DNA, 16 bp, P. troglodytes
aagaggacagctttga

SEQ ID NO: 190484 - DNA, 16 bp, P. troglodytes
aagaggactgagaaaa

SEQ ID NO: 190485 - DNA, 16 bp, P. troglodytes
aagaggagaggaaatt

SEQ ID NO: 190486 - DNA, 16 bp, P. troglodytes
aagaggagccaaatgt

SEQ ID NO: 190487 - DNA, 16 bp, P. troglodytes
aagaggagcctaagga

SEQ ID NO: 190488 - DNA, 16 bp, P. troglodytes
aagaggaggcagagca

SEQ ID NO: 190489 - DNA, 16 bp, P. troglodytes
aagaggagttcccctg

SEQ ID NO: 190490 - DNA, 16 bp, P. troglodytes
aagaggatacaaacaa

SEQ ID NO: 190491 - DNA, 16 bp, P. troglodytes
aagaggatgtggagaa

SEQ ID NO: 190492 - DNA, 16 bp, P. troglodytes
aagaggcaacccacag

SEQ ID NO: 190493 - DNA, 16 bp, P. troglodytes
aagaggcagagctgga

SEQ ID NO: 190494 - DNA, 16 bp, P. troglodytes
aagaggcagagctggg

SEQ ID NO: 190495 - DNA, 16 bp, P. troglodytes
aagaggcagagtttgc

SEQ ID NO: 190496 - DNA, 16 bp, P. troglodytes
aagaggcagctcattt

SEQ ID NO: 190497 - DNA, 16 bp, P. troglodytes
aagaggccaaatctat

SEQ ID NO: 190498 - DNA, 16 bp, P. troglodytes
aagaggccagagagct

SEQ ID NO: 190499 - DNA, 16 bp, P. troglodytes
aagaggcctcaggaga

SEQ ID NO: 190500 - DNA, 16 bp, P. troglodytes
aagaggcctgagagag

SEQ ID NO: 190501 - DNA, 16 bp, P. troglodytes
aagaggcttcagagag

SEQ ID NO: 190502 - DNA, 16 bp, P. troglodytes
aagagggaaactctgt

SEQ ID NO: 190503 - DNA, 16 bp, P. troglodytes
aagagggagcaggcac

SEQ ID NO: 190504 - DNA, 16 bp, P. troglodytes
aagagggagtcaaaga

SEQ ID NO: 190505 - DNA, 16 bp, P. troglodytes
aagagggccactgttc

SEQ ID NO: 190506 - DNA, 16 bp, P. troglodytes
aagagggccttcacca

SEQ ID NO: 190507 - DNA, 16 bp, P. troglodytes
aagagggctcagagga

SEQ ID NO: 190508 - DNA, 16 bp, P. troglodytes
aagaggtaacttgggt

SEQ ID NO: 190509 - DNA, 17 bp, P. troglodytes
aagaggtccaatataat

SEQ ID NO: 190510 - DNA, 16 bp, P. troglodytes
aagaggtgaaagatct

SEQ ID NO: 190511 - DNA, 16 bp, P. troglodytes
aagaggtgctggagag

SEQ ID NO: 190512 - DNA, 16 bp, P. troglodytes
aagaggttaagtaact

SEQ ID NO: 190513 - DNA, 16 bp, P. troglodytes
aagaggtttctcagaa

SEQ ID NO: 190514 - DNA, 16 bp, P. troglodytes
aagaggttttttaaaa

SEQ ID NO: 190515 - DNA, 16 bp, P. troglodytes
aagagtagtgatgctg

SEQ ID NO: 190516 - DNA, 16 bp, P. troglodytes
aagagtatatgccctt

SEQ ID NO: 190517 - DNA, 16 bp, P. troglodytes
aagagtatcagtgatt

SEQ ID NO: 190518 - DNA, 16 bp, P. troglodytes
aagagtatgtttagtt

SEQ ID NO: 190519 - DNA, 16 bp, P. troglodytes
aagagtattcaaatag

SEQ ID NO: 190520 - DNA, 16 bp, P. troglodytes
aagagtattttttaaa

SEQ ID NO: 190521 - DNA, 16 bp, P. troglodytes
aagagtcacctttact

SEQ ID NO: 190522 - DNA, 16 bp, P. troglodytes
aagagtcagtgaactt

SEQ ID NO: 190523 - DNA, 16 bp, P. troglodytes
aagagtccagtttcat

SEQ ID NO: 190524 - DNA, 16 bp, P. troglodytes
aagagtctcactctgt

SEQ ID NO: 190525 - DNA, 16 bp, P. troglodytes
aagagtctcgctctgt

SEQ ID NO: 190526 - DNA, 16 bp, P. troglodytes
aagagtctgggacctc

SEQ ID NO: 190527 - DNA, 16 bp, P. troglodytes
aagagtgaaaagacaa

SEQ ID NO: 190528 - DNA, 16 bp, P. troglodytes
aagagtgaaacgctgt

SEQ ID NO: 190529 - DNA, 16 bp, P. troglodytes
aagagtgaaagaacaa

SEQ ID NO: 190530 - DNA, 16 bp, P. troglodytes
aagagtgacctttgct

SEQ ID NO: 190531 - DNA, 18 bp, P. troglodytes
aagagtgagactccgtct

SEQ ID NO: 190532 - DNA, 16 bp, P. troglodytes
aagagtgagtcccagg

SEQ ID NO: 190533 - DNA, 16 bp, P. troglodytes
aagagtgctgggatta

SEQ ID NO: 190534 - DNA, 16 bp, P. troglodytes
aagagtggaaaggact

SEQ ID NO: 190535 - DNA, 16 bp, P. troglodytes
aagagtggaactctgt

SEQ ID NO: 190536 - DNA, 16 bp, P. troglodytes
aagagtggaagacaaa

SEQ ID NO: 190537 - DNA, 16 bp, P. troglodytes
aagagtggcctgaccc

SEQ ID NO: 190538 - DNA, 16 bp, P. troglodytes
aagagtgggaaggatt

SEQ ID NO: 190539 - DNA, 16 bp, P. troglodytes
aagagtgtggagggct

SEQ ID NO: 190540 - DNA, 16 bp, P. troglodytes
aagagttattggcctt

SEQ ID NO: 190541 - DNA, 16 bp, P. troglodytes
aagagttgaggcttgg

SEQ ID NO: 190542 - DNA, 16 bp, P. troglodytes
aagagtttgagaaaga

SEQ ID NO: 190543 - DNA, 16 bp, P. troglodytes
aagagtttgagacctg

SEQ ID NO: 190544 - DNA, 16 bp, P. troglodytes
aagagtttgtgcaggg

SEQ ID NO: 190545 - DNA, 16 bp, P. troglodytes
aagagttttatagttt

SEQ ID NO: 190546 - DNA, 16 bp, P. troglodytes
aagataaaaattacat

SEQ ID NO: 190547 - DNA, 16 bp, P. troglodytes
aagataaaataacatt

SEQ ID NO: 190548 - DNA, 16 bp, P. troglodytes
aagataaactcaaaga

SEQ ID NO: 190549 - DNA, 16 bp, P. troglodytes
aagataaaggcagaga

SEQ ID NO: 190550 - DNA, 16 bp, P. troglodytes
aagataaagtaagcat

SEQ ID NO: 190551 - DNA, 16 bp, P. troglodytes
aagataaatagatggg

SEQ ID NO: 190552 - DNA, 16 bp, P. troglodytes
aagataaatttgtgtt

SEQ ID NO: 190553 - DNA, 16 bp, P. troglodytes
aagataactttttaaa

SEQ ID NO: 190554 - DNA, 16 bp, P. troglodytes
aagataataaaatacc

SEQ ID NO: 190555 - DNA, 16 bp, P. troglodytes
aagataattatttacc

SEQ ID NO: 190556 - DNA, 16 bp, P. troglodytes
aagataattcttcttc

SEQ ID NO: 190557 - DNA, 16 bp, P. troglodytes
aagataatttcagata

SEQ ID NO: 190558 - DNA, 16 bp, P. troglodytes
aagataattttataca

SEQ ID NO: 190559 - DNA, 16 bp, P. troglodytes
aagataattttcaaaa

SEQ ID NO: 190560 - DNA, 16 bp, P. troglodytes
aagataattttgaaga

SEQ ID NO: 190561 - DNA, 16 bp, P. troglodytes
aagatacacaaatggc

SEQ ID NO: 190562 - DNA, 16 bp, P. troglodytes
aagatactacacaaga

SEQ ID NO: 190563 - DNA, 17 bp, P. troglodytes
aagatactccttgagaa

SEQ ID NO: 190564 - DNA, 16 bp, P. troglodytes
aagatagattaacaag

SEQ ID NO: 190565 - DNA, 16 bp, P. troglodytes
aagatagggccccaat

SEQ ID NO: 190566 - DNA, 16 bp, P. troglodytes
aagatatagaaactct

SEQ ID NO: 190567 - DNA, 16 bp, P. troglodytes
aagatatatgcttaaa

SEQ ID NO: 190568 - DNA, 16 bp, P. troglodytes
aagatatcatctcaca

SEQ ID NO: 190569 - DNA, 16 bp, P. troglodytes
aagatatgaaattaac

SEQ ID NO: 190570 - DNA, 16 bp, P. troglodytes
aagatatgctgaagtc

SEQ ID NO: 190571 - DNA, 16 bp, P. troglodytes
aagatattacaagaaa

SEQ ID NO: 190572 - DNA, 16 bp, P. troglodytes
aagatattcatatttt

SEQ ID NO: 190573 - DNA, 16 bp, P. troglodytes
aagatatttcattttt

SEQ ID NO: 190574 - DNA, 16 bp, P. troglodytes
aagatatttctaattt

SEQ ID NO: 190575 - DNA, 16 bp, P. troglodytes
aagatattttaaatca

SEQ ID NO: 190576 - DNA, 16 bp, P. troglodytes
aagatattttaagaga

SEQ ID NO: 190577 - DNA, 16 bp, P. troglodytes
aagatattttacaaaa

SEQ ID NO: 190578 - DNA, 16 bp, P. troglodytes
aagatattttcagata

SEQ ID NO: 190579 - DNA, 16 bp, P. troglodytes
aagatattttctttaa

SEQ ID NO: 190580 - DNA, 16 bp, P. troglodytes
aagatattttgtagat

SEQ ID NO: 190581 - DNA, 16 bp, P. troglodytes
aagatatttttctttt

SEQ ID NO: 190582 - DNA, 16 bp, P. troglodytes
aagatattttttaaag

SEQ ID NO: 190583 - DNA, 16 bp, P. troglodytes
aagatcaaagtgctgg

SEQ ID NO: 190584 - DNA, 16 bp, P. troglodytes
aagatcaacaaaatgg

SEQ ID NO: 190585 - DNA, 16 bp, P. troglodytes
aagatcaaccccaaga

SEQ ID NO: 190586 - DNA, 19 bp, P. troglodytes
aagatcaacttaatgaaat

SEQ ID NO: 190587 - DNA, 18 bp, P. troglodytes
aagatcaacttactgaaa

SEQ ID NO: 190588 - DNA, 16 bp, P. troglodytes
aagatcaagaataaga

SEQ ID NO: 190589 - DNA, 16 bp, P. troglodytes
aagatcaagatgttgg

SEQ ID NO: 190590 - DNA, 16 bp, P. troglodytes
aagatcaatgaaatga

SEQ ID NO: 190591 - DNA, 16 bp, P. troglodytes
aagatcacaaagattt

SEQ ID NO: 190592 - DNA, 16 bp, P. troglodytes
aagatcacaaggcaga

SEQ ID NO: 190593 - DNA, 16 bp, P. troglodytes
aagatcacacaactag

SEQ ID NO: 190594 - DNA, 16 bp, P. troglodytes
aagatcacaccactgt

SEQ ID NO: 190595 - DNA, 16 bp, P. troglodytes
aagatcacgccagtgc

SEQ ID NO: 190596 - DNA, 16 bp, P. troglodytes
aagatcagaccactgc

SEQ ID NO: 190597 - DNA, 16 bp, P. troglodytes
aagatcagagcacaac

SEQ ID NO: 190598 - DNA, 16 bp, P. troglodytes
aagatcagagcagagc

SEQ ID NO: 190599 - DNA, 17 bp, P. troglodytes
aagatcagatgattgta

SEQ ID NO: 190600 - DNA, 16 bp, P. troglodytes
aagatcagcctggcca

SEQ ID NO: 190601 - DNA, 16 bp, P. troglodytes
aagatcaggaaaaaca

SEQ ID NO: 190602 - DNA, 16 bp, P. troglodytes
aagatcaggaacaaag

SEQ ID NO: 190603 - DNA, 16 bp, P. troglodytes
aagatcaggaacaaga

SEQ ID NO: 190604 - DNA, 16 bp, P. troglodytes
aagatcaggaacaagg

SEQ ID NO: 190605 - DNA, 16 bp, P. troglodytes
aagatcatgcagtatt

SEQ ID NO: 190606 - DNA, 16 bp, P. troglodytes
aagatcatgccactgc

SEQ ID NO: 190607 - DNA, 19 bp, P. troglodytes
aagatcatgccactgcacc

SEQ ID NO: 190608 - DNA, 16 bp, P. troglodytes
aagatccaagaagaga

SEQ ID NO: 190609 - DNA, 16 bp, P. troglodytes
aagatccagagtctca

SEQ ID NO: 190610 - DNA, 16 bp, P. troglodytes
aagatccaggtgctgg

SEQ ID NO: 190611 - DNA, 19 bp, P. troglodytes
aagatccatcagtgtgctg

SEQ ID NO: 190612 - DNA, 16 bp, P. troglodytes
aagatccccagatgat

SEQ ID NO: 190613 - DNA, 16 bp, P. troglodytes
aagatcctatagcttt

SEQ ID NO: 190614 - DNA, 16 bp, P. troglodytes
aagatcctgtttctac

SEQ ID NO: 190615 - DNA, 16 bp, P. troglodytes
aagatcctttcttata

SEQ ID NO: 190616 - DNA, 16 bp, P. troglodytes
aagatcgagccactgc

SEQ ID NO: 190617 - DNA, 16 bp, P. troglodytes
aagatcgcaccactac

SEQ ID NO: 190618 - DNA, 16 bp, P. troglodytes
aagatctagaacaaga

SEQ ID NO: 190619 - DNA, 21 bp, P. troglodytes
aagatctatatctggtataac

SEQ ID NO: 190620 - DNA, 16 bp, P. troglodytes
aagatctcaaagagat

SEQ ID NO: 190621 - DNA, 16 bp, P. troglodytes
aagatctggaaaaaga

SEQ ID NO: 190622 - DNA, 16 bp, P. troglodytes
aagatctggaacaaga

SEQ ID NO: 190623 - DNA, 16 bp, P. troglodytes
aagatctggaacatga

SEQ ID NO: 190624 - DNA, 16 bp, P. troglodytes
aagatctggaagaatt

SEQ ID NO: 190625 - DNA, 16 bp, P. troglodytes
aagatcttttttaaaa

SEQ ID NO: 190626 - DNA, 16 bp, P. troglodytes
aagatgaaaaagttct

SEQ ID NO: 190627 - DNA, 16 bp, P. troglodytes
aagatgaaaatgtttt

SEQ ID NO: 190628 - DNA, 16 bp, P. troglodytes
aagatgaactcaaaga

SEQ ID NO: 190629 - DNA, 16 bp, P. troglodytes
aagatgaagaaaaacc

SEQ ID NO: 190630 - DNA, 16 bp, P. troglodytes
aagatgaagaaattga

SEQ ID NO: 190631 - DNA, 16 bp, P. troglodytes
aagatgaagacaaaga

SEQ ID NO: 190632 - DNA, 16 bp, P. troglodytes
aagatgaaggaagagc

SEQ ID NO: 190633 - DNA, 16 bp, P. troglodytes
aagatgaaggagaagc

SEQ ID NO: 190634 - DNA, 16 bp, P. troglodytes
aagatgaaggaggagc

SEQ ID NO: 190635 - DNA, 16 bp, P. troglodytes
aagatgaaggcaccag

SEQ ID NO: 190636 - DNA, 16 bp, P. troglodytes
aagatgaaggcagaaa

SEQ ID NO: 190637 - DNA, 16 bp, P. troglodytes
aagatgaaggcagaga

SEQ ID NO: 190638 - DNA, 16 bp, P. troglodytes
aagatgaatattttaa

SEQ ID NO: 190639 - DNA, 16 bp, P. troglodytes
aagatgaatgagttct

SEQ ID NO: 190640 - DNA, 16 bp, P. troglodytes
aagatgaattaaaaac

SEQ ID NO: 190641 - DNA, 16 bp, P. troglodytes
aagatgacaaagatga

SEQ ID NO: 190642 - DNA, 16 bp, P. troglodytes
aagatgacaaggatga

SEQ ID NO: 190643 - DNA, 16 bp, P. troglodytes
aagatgacaggaaaat

SEQ ID NO: 190644 - DNA, 16 bp, P. troglodytes
aagatgacataaaaat

SEQ ID NO: 190645 - DNA, 16 bp, P. troglodytes
aagatgacataaataa

SEQ ID NO: 190646 - DNA, 16 bp, P. troglodytes
aagatgacatttgggt

SEQ ID NO: 190647 - DNA, 16 bp, P. troglodytes
aagatgaggaaaagtt

SEQ ID NO: 190648 - DNA, 16 bp, P. troglodytes
aagatgaggtcatact

SEQ ID NO: 190649 - DNA, 16 bp, P. troglodytes
aagatgatcatgtgat

SEQ ID NO: 190650 - DNA, 16 bp, P. troglodytes
aagatgatgaaacccc

SEQ ID NO: 190651 - DNA, 16 bp, P. troglodytes
aagatgatgaggatga

SEQ ID NO: 190652 - DNA, 16 bp, P. troglodytes
aagatgatgagttcat

SEQ ID NO: 190653 - DNA, 16 bp, P. troglodytes
aagatgatgatgataa

SEQ ID NO: 190654 - DNA, 16 bp, P. troglodytes
aagatgattctaaaat

SEQ ID NO: 190655 - DNA, 16 bp, P. troglodytes
aagatgcagaagaaaa

SEQ ID NO: 190656 - DNA, 16 bp, P. troglodytes
aagatgcctttcaaaa

SEQ ID NO: 190657 - DNA, 16 bp, P. troglodytes
aagatgctcaagtccc

SEQ ID NO: 190658 - DNA, 16 bp, P. troglodytes
aagatgctcagcctca

SEQ ID NO: 190659 - DNA, 16 bp, P. troglodytes
aagatgctgaacatca

SEQ ID NO: 190660 - DNA, 16 bp, P. troglodytes
aagatgcttgatatga

SEQ ID NO: 190661 - DNA, 17 bp, P. troglodytes
aagatggaaaccatcat

SEQ ID NO: 190662 - DNA, 16 bp, P. troglodytes
aagatggaagcagaga

SEQ ID NO: 190663 - DNA, 16 bp, P. troglodytes
aagatggaatgttaaa

SEQ ID NO: 190664 - DNA, 16 bp, P. troglodytes
aagatggagacagaga

SEQ ID NO: 190665 - DNA, 16 bp, P. troglodytes
aagatggagctgccat

SEQ ID NO: 190666 - DNA, 16 bp, P. troglodytes
aagatggagtcagcta

SEQ ID NO: 190667 - DNA, 16 bp, P. troglodytes
aagatggagtttcgct

SEQ ID NO: 190668 - DNA, 16 bp, P. troglodytes
aagatggattaaaggc

SEQ ID NO: 190669 - DNA, 16 bp, P. troglodytes
aagatggcaatgaaag

SEQ ID NO: 190670 - DNA, 24 bp, P. troglodytes
aagatggccgaataggaacagctc

SEQ ID NO: 190671 - DNA, 16 bp, P. troglodytes
aagatggctccactgc

SEQ ID NO: 190672 - DNA, 16 bp, P. troglodytes
aagatggctgactaaa

SEQ ID NO: 190673 - DNA, 16 bp, P. troglodytes
aagatggcttgaaccc

SEQ ID NO: 190674 - DNA, 16 bp, P. troglodytes
aagatgggaaaaaaca

SEQ ID NO: 190675 - DNA, 17 bp, P. troglodytes
aagatggggaaaaaaca

SEQ ID NO: 190676 - DNA, 16 bp, P. troglodytes
aagatggggaaactga

SEQ ID NO: 190677 - DNA, 16 bp, P. troglodytes
aagatggggagaaacc

SEQ ID NO: 190678 - DNA, 16 bp, P. troglodytes
aagatgggtctcctga

SEQ ID NO: 190679 - DNA, 16 bp, P. troglodytes
aagatggtaaaacccc

SEQ ID NO: 190680 - DNA, 16 bp, P. troglodytes
aagatggtaacagccc

SEQ ID NO: 190681 - DNA, 16 bp, P. troglodytes
aagatggtgatgatga

SEQ ID NO: 190682 - DNA, 16 bp, P. troglodytes
aagatggtgccactgc

SEQ ID NO: 190683 - DNA, 16 bp, P. troglodytes
aagatggtggaatagg

SEQ ID NO: 190684 - DNA, 16 bp, P. troglodytes
aagatggtggtggtgg

SEQ ID NO: 190685 - DNA, 16 bp, P. troglodytes
aagatggtgtctcact

SEQ ID NO: 190686 - DNA, 16 bp, P. troglodytes
aagatgtacagaaatg

SEQ ID NO: 190687 - DNA, 16 bp, P. troglodytes
aagatgtagctatttt

SEQ ID NO: 190688 - DNA, 16 bp, P. troglodytes
aagatgtcagttctcc

SEQ ID NO: 190689 - DNA, 16 bp, P. troglodytes
aagatgtcagttcttc

SEQ ID NO: 190690 - DNA, 16 bp, P. troglodytes
aagatgtcctttgaaa

SEQ ID NO: 190691 - DNA, 16 bp, P. troglodytes
aagatgtctttttttt

SEQ ID NO: 190692 - DNA, 16 bp, P. troglodytes
aagatgtgcctgcttc

SEQ ID NO: 190693 - DNA, 16 bp, P. troglodytes
aagatgtggtatttgg

SEQ ID NO: 190694 - DNA, 16 bp, P. troglodytes
aagatgttaaaatgtg

SEQ ID NO: 190695 - DNA, 16 bp, P. troglodytes
aagatgttaataatag

SEQ ID NO: 190696 - DNA, 16 bp, P. troglodytes
aagatgttgtgaacat

SEQ ID NO: 190697 - DNA, 16 bp, P. troglodytes
aagatgtttgatatta

SEQ ID NO: 190698 - DNA, 16 bp, P. troglodytes
aagatgtttttctttt

SEQ ID NO: 190699 - DNA, 16 bp, P. troglodytes
aagattaaaggaacat

SEQ ID NO: 190700 - DNA, 16 bp, P. troglodytes
aagattaaatgatgaa

SEQ ID NO: 190701 - DNA, 16 bp, P. troglodytes
aagattaatgaaaaca

SEQ ID NO: 190702 - DNA, 16 bp, P. troglodytes
aagattacaaaaatta

SEQ ID NO: 190703 - DNA, 16 bp, P. troglodytes
aagattagagtcctgc

SEQ ID NO: 190704 - DNA, 16 bp, P. troglodytes
aagattatcagagact

SEQ ID NO: 190705 - DNA, 16 bp, P. troglodytes
aagattatgtctcaaa

SEQ ID NO: 190706 - DNA, 16 bp, P. troglodytes
aagattcaggagaaag

SEQ ID NO: 190707 - DNA, 16 bp, P. troglodytes
aagattcatccatgtt

SEQ ID NO: 190708 - DNA, 16 bp, P. troglodytes
aagattcatttgatga

SEQ ID NO: 190709 - DNA, 16 bp, P. troglodytes
aagattccaatttctc

SEQ ID NO: 190710 - DNA, 16 bp, P. troglodytes
aagattccatctcaaa

SEQ ID NO: 190711 - DNA, 16 bp, P. troglodytes
aagattccctatttaa

SEQ ID NO: 190712 - DNA, 16 bp, P. troglodytes
aagattctgtttcaaa

SEQ ID NO: 190713 - DNA, 20 bp, P. troglodytes
aagattcttgccaagagaat

SEQ ID NO: 190714 - DNA, 16 bp, P. troglodytes
aagattcttttaaaat

SEQ ID NO: 190715 - DNA, 16 bp, P. troglodytes
aagattctttttcttt

SEQ ID NO: 190716 - DNA, 16 bp, P. troglodytes
aagattgaatcagtaa

SEQ ID NO: 190717 - DNA, 16 bp, P. troglodytes
aagattgagaccatcc

SEQ ID NO: 190718 - DNA, 16 bp, P. troglodytes
aagattgagccactgt

SEQ ID NO: 190719 - DNA, 16 bp, P. troglodytes
aagattgatagaccac

SEQ ID NO: 190720 - DNA, 16 bp, P. troglodytes
aagattgcaccgttgc

SEQ ID NO: 190721 - DNA, 16 bp, P. troglodytes
aagattgcgccaccgc

SEQ ID NO: 190722 - DNA, 17 bp, P. troglodytes
aagattgcttgaggcca

SEQ ID NO: 190723 - DNA, 16 bp, P. troglodytes
aagattgttgtgagga

SEQ ID NO: 190724 - DNA, 16 bp, P. troglodytes
aagatttaatattgtt

SEQ ID NO: 190725 - DNA, 16 bp, P. troglodytes
aagatttaatgatgaa

SEQ ID NO: 190726 - DNA, 16 bp, P. troglodytes
aagatttacatctcaa

SEQ ID NO: 190727 - DNA, 16 bp, P. troglodytes
aagatttaccaagcaa

SEQ ID NO: 190728 - DNA, 16 bp, P. troglodytes
aagatttatgaacaga

SEQ ID NO: 190729 - DNA, 16 bp, P. troglodytes
aagatttatggacaga

SEQ ID NO: 190730 - DNA, 16 bp, P. troglodytes
aagatttatttttttc

SEQ ID NO: 190731 - DNA, 16 bp, P. troglodytes
aagatttctcaaataa

SEQ ID NO: 190732 - DNA, 16 bp, P. troglodytes
aagatttcttagatat

SEQ ID NO: 190733 - DNA, 16 bp, P. troglodytes
aagatttgaaatgttc

SEQ ID NO: 190734 - DNA, 16 bp, P. troglodytes
aagatttgaaatgttt

SEQ ID NO: 190735 - DNA, 16 bp, P. troglodytes
aagatttgaacccagg

SEQ ID NO: 190736 - DNA, 16 bp, P. troglodytes
aagatttgtctcttct

SEQ ID NO: 190737 - DNA, 16 bp, P. troglodytes
aagatttgttgatttt

SEQ ID NO: 190738 - DNA, 16 bp, P. troglodytes
aagattttaaaaatct

SEQ ID NO: 190739 - DNA, 16 bp, P. troglodytes
aagattttaaacattt

SEQ ID NO: 190740 - DNA, 16 bp, P. troglodytes
aagattttatgatgaa

SEQ ID NO: 190741 - DNA, 16 bp, P. troglodytes
aagattttattttcaa

SEQ ID NO: 190742 - DNA, 16 bp, P. troglodytes
aagattttattttcct

SEQ ID NO: 190743 - DNA, 16 bp, P. troglodytes
aagattttcctttttt

SEQ ID NO: 190744 - DNA, 16 bp, P. troglodytes
aagattttctttttgt

SEQ ID NO: 190745 - DNA, 16 bp, P. troglodytes
aagattttgaagcaac

SEQ ID NO: 190746 - DNA, 16 bp, P. troglodytes
aagatttttaaaaact

SEQ ID NO: 190747 - DNA, 16 bp, P. troglodytes
aagatttttaaagata

SEQ ID NO: 190748 - DNA, 16 bp, P. troglodytes
aagatttttcaacttt

SEQ ID NO: 190749 - DNA, 16 bp, P. troglodytes
aagatttttctttgtt

SEQ ID NO: 190750 - DNA, 16 bp, P. troglodytes
aagattttttaaaaga

SEQ ID NO: 190751 - DNA, 16 bp, P. troglodytes
aagatttttttaagat

SEQ ID NO: 190752 - DNA, 16 bp, P. troglodytes
aagatttttttctctt

SEQ ID NO: 190753 - DNA, 16 bp, P. troglodytes
aagattttttttaaag

SEQ ID NO: 190754 - DNA, 16 bp, P. troglodytes
aagatttttttttcat

SEQ ID NO: 190755 - DNA, 16 bp, P. troglodytes
aagcaaaaaagagccc

SEQ ID NO: 190756 - DNA, 16 bp, P. troglodytes
aagcaaaaactgaagg

SEQ ID NO: 190757 - DNA, 16 bp, P. troglodytes
aagcaaaaattgatga

SEQ ID NO: 190758 - DNA, 16 bp, P. troglodytes
aagcaaaacaaaactt

SEQ ID NO: 190759 - DNA, 16 bp, P. troglodytes
aagcaaaacaagaatt

SEQ ID NO: 190760 - DNA, 16 bp, P. troglodytes
aagcaaaaccacagat

SEQ ID NO: 190761 - DNA, 16 bp, P. troglodytes
aagcaaaacttgaatt

SEQ ID NO: 190762 - DNA, 16 bp, P. troglodytes
aagcaaaagctggaag

SEQ ID NO: 190763 - DNA, 16 bp, P. troglodytes
aagcaaaaggggtttc

SEQ ID NO: 190764 - DNA, 16 bp, P. troglodytes
aagcaaaatgaaattt

SEQ ID NO: 190765 - DNA, 16 bp, P. troglodytes
aagcaaaatggagtca

SEQ ID NO: 190766 - DNA, 16 bp, P. troglodytes
aagcaaaatgtgatat

SEQ ID NO: 190767 - DNA, 16 bp, P. troglodytes
aagcaaaattgacaaa

SEQ ID NO: 190768 - DNA, 16 bp, P. troglodytes
aagcaaaattttaaaa

SEQ ID NO: 190769 - DNA, 16 bp, P. troglodytes
aagcaaacaacttgga

SEQ ID NO: 190770 - DNA, 16 bp, P. troglodytes
aagcaaacaagatgtc

SEQ ID NO: 190771 - DNA, 16 bp, P. troglodytes
aagcaaacattttaaa

SEQ ID NO: 190772 - DNA, 16 bp, P. troglodytes
aagcaaagaaaaattt

SEQ ID NO: 190773 - DNA, 16 bp, P. troglodytes
aagcaaagaaagtggt

SEQ ID NO: 190774 - DNA, 16 bp, P. troglodytes
aagcaaagattgacaa

SEQ ID NO: 190775 - DNA, 16 bp, P. troglodytes
aagcaaaggctgagag

SEQ ID NO: 190776 - DNA, 16 bp, P. troglodytes
aagcaaataggagaaa

SEQ ID NO: 190777 - DNA, 16 bp, P. troglodytes
aagcaaatatcccagg

SEQ ID NO: 190778 - DNA, 16 bp, P. troglodytes
aagcaaatggaagaac

SEQ ID NO: 190779 - DNA, 16 bp, P. troglodytes
aagcaaatgtaataaa

SEQ ID NO: 190780 - DNA, 16 bp, P. troglodytes
aagcaaatgtttaaaa

SEQ ID NO: 190781 - DNA, 16 bp, P. troglodytes
aagcaaattaaatcca

SEQ ID NO: 190782 - DNA, 16 bp, P. troglodytes
aagcaaatttggaact

SEQ ID NO: 190783 - DNA, 16 bp, P. troglodytes
aagcaaatttttaaaa

SEQ ID NO: 190784 - DNA, 16 bp, P. troglodytes
aagcaacaacagcagc

SEQ ID NO: 190785 - DNA, 16 bp, P. troglodytes
aagcaacagaaatgta

SEQ ID NO: 190786 - DNA, 16 bp, P. troglodytes
aagcaacagatgttgg

SEQ ID NO: 190787 - DNA, 16 bp, P. troglodytes
aagcaacagcagttta

SEQ ID NO: 190788 - DNA, 16 bp, P. troglodytes
aagcaacccaagtgtc

SEQ ID NO: 190789 - DNA, 16 bp, P. troglodytes
aagcaactgcagcaaa

SEQ ID NO: 190790 - DNA, 16 bp, P. troglodytes
aagcaacttcaacaaa

SEQ ID NO: 190791 - DNA, 16 bp, P. troglodytes
aagcaagaaaagaatg

SEQ ID NO: 190792 - DNA, 16 bp, P. troglodytes
aagcaagaaatgggga

SEQ ID NO: 190793 - DNA, 16 bp, P. troglodytes
aagcaagacacatctt

SEQ ID NO: 190794 - DNA, 16 bp, P. troglodytes
aagcaagagcaaacac

SEQ ID NO: 190795 - DNA, 16 bp, P. troglodytes
aagcaagagcaagcac

SEQ ID NO: 190796 - DNA, 16 bp, P. troglodytes
aagcaagaggactgct

SEQ ID NO: 190797 - DNA, 16 bp, P. troglodytes
aagcaagaggattgct

SEQ ID NO: 190798 - DNA, 16 bp, P. troglodytes
aagcaagcaagcaaac

SEQ ID NO: 190799 - DNA, 16 bp, P. troglodytes
aagcaagcaagcaaat

SEQ ID NO: 190800 - DNA, 16 bp, P. troglodytes
aagcaagcaagcaagc

SEQ ID NO: 190801 - DNA, 16 bp, P. troglodytes
aagcaagcatcttctt

SEQ ID NO: 190802 - DNA, 17 bp, P. troglodytes
aagcaagctggaagctt

SEQ ID NO: 190803 - DNA, 16 bp, P. troglodytes
aagcaaggaaactgag

SEQ ID NO: 190804 - DNA, 16 bp, P. troglodytes
aagcaaggaaatatga

SEQ ID NO: 190805 - DNA, 16 bp, P. troglodytes
aagcaagtgaagaatc

SEQ ID NO: 190806 - DNA, 16 bp, P. troglodytes
aagcaagttcttacag

SEQ ID NO: 190807 - DNA, 17 bp, P. troglodytes
aagcaatagggaaagga

SEQ ID NO: 190808 - DNA, 17 bp, P. troglodytes
aagcaatatgctcctga

SEQ ID NO: 190809 - DNA, 16 bp, P. troglodytes
aagcaatatttattta

SEQ ID NO: 190810 - DNA, 16 bp, P. troglodytes
aagcaatcaaactcca

SEQ ID NO: 190811 - DNA, 16 bp, P. troglodytes
aagcaatcctccaatc

SEQ ID NO: 190812 - DNA, 16 bp, P. troglodytes
aagcaatcctccacct

SEQ ID NO: 190813 - DNA, 17 bp, P. troglodytes
aagcaatcctccagcct

SEQ ID NO: 190814 - DNA, 16 bp, P. troglodytes
aagcaatcttcctgct

SEQ ID NO: 190815 - DNA, 16 bp, P. troglodytes
aagcaatcttctcacc

SEQ ID NO: 190816 - DNA, 16 bp, P. troglodytes
aagcaatgaaagcaaa

SEQ ID NO: 190817 - DNA, 16 bp, P. troglodytes
aagcaatggagaaaaa

SEQ ID NO: 190818 - DNA, 16 bp, P. troglodytes
aagcaatggtgaaagg

SEQ ID NO: 190819 - DNA, 16 bp, P. troglodytes
aagcaattattattat

SEQ ID NO: 190820 - DNA, 16 bp, P. troglodytes
aagcaattccatttat

SEQ ID NO: 190821 - DNA, 16 bp, P. troglodytes
aagcaattcccatgcc

SEQ ID NO: 190822 - DNA, 16 bp, P. troglodytes
aagcaattgtgagtgg

SEQ ID NO: 190823 - DNA, 16 bp, P. troglodytes
aagcaattttaaaaag

SEQ ID NO: 190824 - DNA, 16 bp, P. troglodytes
aagcacaagaattgct

SEQ ID NO: 190825 - DNA, 16 bp, P. troglodytes
aagcacaagtgccact

SEQ ID NO: 190826 - DNA, 16 bp, P. troglodytes
aagcacaatcagaaat

SEQ ID NO: 190827 - DNA, 16 bp, P. troglodytes
aagcacacacagacac

SEQ ID NO: 190828 - DNA, 16 bp, P. troglodytes
aagcacaggagggagg

SEQ ID NO: 190829 - DNA, 16 bp, P. troglodytes
aagcacatgaaaaaga

SEQ ID NO: 190830 - DNA, 16 bp, P. troglodytes
aagcacatttttaaaa

SEQ ID NO: 190831 - DNA, 16 bp, P. troglodytes
aagcaccacctactgg

SEQ ID NO: 190832 - DNA, 16 bp, P. troglodytes
aagcaccaggaatctg

SEQ ID NO: 190833 - DNA, 17 bp, P. troglodytes
aagcacccagttcatga

SEQ ID NO: 190834 - DNA, 16 bp, P. troglodytes
aagcaccgcctcccgg

SEQ ID NO: 190835 - DNA, 16 bp, P. troglodytes
aagcacctactatgtg

SEQ ID NO: 190836 - DNA, 16 bp, P. troglodytes
aagcactgctcaaaga

SEQ ID NO: 190837 - DNA, 16 bp, P. troglodytes
aagcactttgggaggc

SEQ ID NO: 190838 - DNA, 16 bp, P. troglodytes
aagcagaaaagctgaa

SEQ ID NO: 190839 - DNA, 16 bp, P. troglodytes
aagcagaaataaaatt

SEQ ID NO: 190840 - DNA, 16 bp, P. troglodytes
aagcagaaatccctga

SEQ ID NO: 190841 - DNA, 16 bp, P. troglodytes
aagcagaacataaaag

SEQ ID NO: 190842 - DNA, 16 bp, P. troglodytes
aagcagaagaaaaagt

SEQ ID NO: 190843 - DNA, 16 bp, P. troglodytes
aagcagaagaaggaat

SEQ ID NO: 190844 - DNA, 16 bp, P. troglodytes
aagcagaaggaaaagt

SEQ ID NO: 190845 - DNA, 16 bp, P. troglodytes
aagcagaaggaaaata

SEQ ID NO: 190846 - DNA, 16 bp, P. troglodytes
aagcagaaggagtctt

SEQ ID NO: 190847 - DNA, 16 bp, P. troglodytes
aagcagaattttaaaa

SEQ ID NO: 190848 - DNA, 16 bp, P. troglodytes
aagcagacagaaaaat

SEQ ID NO: 190849 - DNA, 16 bp, P. troglodytes
aagcagacagccaaat

SEQ ID NO: 190850 - DNA, 16 bp, P. troglodytes
aagcagagaatagaat

SEQ ID NO: 190851 - DNA, 16 bp, P. troglodytes
aagcagagagaccagt

SEQ ID NO: 190852 - DNA, 16 bp, P. troglodytes
aagcagagagcaaaat

SEQ ID NO: 190853 - DNA, 16 bp, P. troglodytes
aagcagagagtgagcc

SEQ ID NO: 190854 - DNA, 18 bp, P. troglodytes
aagcagagcataaaagtt

SEQ ID NO: 190855 - DNA, 16 bp, P. troglodytes
aagcagaggcaacaaa

SEQ ID NO: 190856 - DNA, 16 bp, P. troglodytes
aagcagaggtcagaga

SEQ ID NO: 190857 - DNA, 16 bp, P. troglodytes
aagcagatcctccagc

SEQ ID NO: 190858 - DNA, 16 bp, P. troglodytes
aagcagatgccagtgc

SEQ ID NO: 190859 - DNA, 16 bp, P. troglodytes
aagcagatgctgatgc

SEQ ID NO: 190860 - DNA, 16 bp, P. troglodytes
aagcagatgttcaggg

SEQ ID NO: 190861 - DNA, 16 bp, P. troglodytes
aagcagattatcctcc

SEQ ID NO: 190862 - DNA, 16 bp, P. troglodytes
aagcagattttaaaat

SEQ ID NO: 190863 - DNA, 16 bp, P. troglodytes
aagcagcaaagtattc

SEQ ID NO: 190864 - DNA, 16 bp, P. troglodytes
aagcagcaagattaaa

SEQ ID NO: 190865 - DNA, 16 bp, P. troglodytes
aagcagcaaggccctg

SEQ ID NO: 190866 - DNA, 16 bp, P. troglodytes
aagcagcaagtgctga

SEQ ID NO: 190867 - DNA, 16 bp, P. troglodytes
aagcagcaagtgttga

SEQ ID NO: 190868 - DNA, 16 bp, P. troglodytes
aagcagcagaaaggcc

SEQ ID NO: 190869 - DNA, 16 bp, P. troglodytes
aagcagcagagctggg

SEQ ID NO: 190870 - DNA, 16 bp, P. troglodytes
aagcagcagcagcaga

SEQ ID NO: 190871 - DNA, 16 bp, P. troglodytes
aagcagcagcagcagc

SEQ ID NO: 190872 - DNA, 17 bp, P. troglodytes
aagcagcagcagcagct

SEQ ID NO: 190873 - DNA, 16 bp, P. troglodytes
aagcagcagcagcagg

SEQ ID NO: 190874 - DNA, 16 bp, P. troglodytes
aagcagcaggagagag

SEQ ID NO: 190875 - DNA, 16 bp, P. troglodytes
aagcagccaggaggga

SEQ ID NO: 190876 - DNA, 16 bp, P. troglodytes
aagcagccaggagtgg

SEQ ID NO: 190877 - DNA, 16 bp, P. troglodytes
aagcagccaggtgtgg

SEQ ID NO: 190878 - DNA, 16 bp, P. troglodytes
aagcagcccagaagct

SEQ ID NO: 190879 - DNA, 19 bp, P. troglodytes
aagcagccctgagaaacat

SEQ ID NO: 190880 - DNA, 16 bp, P. troglodytes
aagcagctgaccaatc

SEQ ID NO: 190881 - DNA, 16 bp, P. troglodytes
aagcagctgcaggggc

SEQ ID NO: 190882 - DNA, 16 bp, P. troglodytes
aagcagctgggactat

SEQ ID NO: 190883 - DNA, 16 bp, P. troglodytes
aagcagctgggagtgg

SEQ ID NO: 190884 - DNA, 16 bp, P. troglodytes
aagcagctgtggccag

SEQ ID NO: 190885 - DNA, 16 bp, P. troglodytes
aagcagcttcagcaaa

SEQ ID NO: 190886 - DNA, 16 bp, P. troglodytes
aagcaggaagactgct

SEQ ID NO: 190887 - DNA, 16 bp, P. troglodytes
aagcaggagaactgct

SEQ ID NO: 190888 - DNA, 16 bp, P. troglodytes
aagcaggagaatagct

SEQ ID NO: 190889 - DNA, 16 bp, P. troglodytes
aagcaggagaatttct

SEQ ID NO: 190890 - DNA, 16 bp, P. troglodytes
aagcaggagcaggcac

SEQ ID NO: 190891 - DNA, 16 bp, P. troglodytes
aagcaggatggagaat

SEQ ID NO: 190892 - DNA, 16 bp, P. troglodytes
aagcaggatgttggca

SEQ ID NO: 190893 - DNA, 16 bp, P. troglodytes
aagcaggatttttttt

SEQ ID NO: 190894 - DNA, 16 bp, P. troglodytes
aagcaggcaaaggaca

SEQ ID NO: 190895 - DNA, 16 bp, P. troglodytes
aagcaggcctcagaaa

SEQ ID NO: 190896 - DNA, 16 bp, P. troglodytes
aagcaggctgccccag

SEQ ID NO: 190897 - DNA, 16 bp, P. troglodytes
aagcagggacaatttg

SEQ ID NO: 190898 - DNA, 24 bp, P. troglodytes
aagcagggcgaggcattgcctcac

SEQ ID NO: 190899 - DNA, 16 bp, P. troglodytes
aagcagggtttttttt

SEQ ID NO: 190900 - DNA, 16 bp, P. troglodytes
aagcagtcaagagaag

SEQ ID NO: 190901 - DNA, 16 bp, P. troglodytes
aagcagtgggaagagc

SEQ ID NO: 190902 - DNA, 16 bp, P. troglodytes
aagcagtttctcagaa

SEQ ID NO: 190903 - DNA, 16 bp, P. troglodytes
aagcagttttaagagg

SEQ ID NO: 190904 - DNA, 16 bp, P. troglodytes
aagcataaaaatggat

SEQ ID NO: 190905 - DNA, 16 bp, P. troglodytes
aagcataaaactcaca

SEQ ID NO: 190906 - DNA, 16 bp, P. troglodytes
aagcataatataaaat

SEQ ID NO: 190907 - DNA, 16 bp, P. troglodytes
aagcatataaaaatgc

SEQ ID NO: 190908 - DNA, 16 bp, P. troglodytes
aagcatatatttttta

SEQ ID NO: 190909 - DNA, 16 bp, P. troglodytes
aagcatatgataaaat

SEQ ID NO: 190910 - DNA, 16 bp, P. troglodytes
aagcatattcaaatag

SEQ ID NO: 190911 - DNA, 16 bp, P. troglodytes
aagcatctttttaaaa

SEQ ID NO: 190912 - DNA, 16 bp, P. troglodytes
aagcatgattttaaaa

SEQ ID NO: 190913 - DNA, 16 bp, P. troglodytes
aagcatggatttttat

SEQ ID NO: 190914 - DNA, 16 bp, P. troglodytes
aagcatggtgctggta

SEQ ID NO: 190915 - DNA, 16 bp, P. troglodytes
aagcatgtacagctac

SEQ ID NO: 190916 - DNA, 16 bp, P. troglodytes
aagcattaaaaaaatt

SEQ ID NO: 190917 - DNA, 16 bp, P. troglodytes
aagcattaccacctga

SEQ ID NO: 190918 - DNA, 16 bp, P. troglodytes
aagcattaggattaca

SEQ ID NO: 190919 - DNA, 16 bp, P. troglodytes
aagcattcaagaagtg

SEQ ID NO: 190920 - DNA, 16 bp, P. troglodytes
aagcattcaagaccag

SEQ ID NO: 190921 - DNA, 16 bp, P. troglodytes
aagcattccctcttct

SEQ ID NO: 190922 - DNA, 16 bp, P. troglodytes
aagcattcctttctct

SEQ ID NO: 190923 - DNA, 16 bp, P. troglodytes
aagcattctcaaaaac

SEQ ID NO: 190924 - DNA, 16 bp, P. troglodytes
aagcattctcaggaac

SEQ ID NO: 190925 - DNA, 16 bp, P. troglodytes
aagcattctctttgaa

SEQ ID NO: 190926 - DNA, 16 bp, P. troglodytes
aagcattgacttctct

SEQ ID NO: 190927 - DNA, 16 bp, P. troglodytes
aagcatttaaaaatat

SEQ ID NO: 190928 - DNA, 16 bp, P. troglodytes
aagcatttaataaata

SEQ ID NO: 190929 - DNA, 16 bp, P. troglodytes
aagcatttatccttca

SEQ ID NO: 190930 - DNA, 16 bp, P. troglodytes
aagcatttattctttt

SEQ ID NO: 190931 - DNA, 16 bp, P. troglodytes
aagcatttatttcttt

SEQ ID NO: 190932 - DNA, 16 bp, P. troglodytes
aagcatttatttttca

SEQ ID NO: 190933 - DNA, 16 bp, P. troglodytes
aagcatttcccttgag

SEQ ID NO: 190934 - DNA, 16 bp, P. troglodytes
aagcatttgaaaaaaa

SEQ ID NO: 190935 - DNA, 16 bp, P. troglodytes
aagcattttaaaataa

SEQ ID NO: 190936 - DNA, 16 bp, P. troglodytes
aagcattttaaataat

SEQ ID NO: 190937 - DNA, 16 bp, P. troglodytes
aagcattttaaatatt

SEQ ID NO: 190938 - DNA, 16 bp, P. troglodytes
aagcattttataaata

SEQ ID NO: 190939 - DNA, 16 bp, P. troglodytes
aagcattttttaaaat

SEQ ID NO: 190940 - DNA, 16 bp, P. troglodytes
aagcattttttcatat

SEQ ID NO: 190941 - DNA, 16 bp, P. troglodytes
aagcattttttccttt

SEQ ID NO: 190942 - DNA, 17 bp, P. troglodytes
aagccaaaagattggat

SEQ ID NO: 190943 - DNA, 16 bp, P. troglodytes
aagccaacatcaccct

SEQ ID NO: 190944 - DNA, 16 bp, P. troglodytes
aagccaagaagaatct

SEQ ID NO: 190945 - DNA, 16 bp, P. troglodytes
aagccaagacaggagg

SEQ ID NO: 190946 - DNA, 17 bp, P. troglodytes
aagccaagatcacgcca

SEQ ID NO: 190947 - DNA, 17 bp, P. troglodytes
aagccaagatcatgcca

SEQ ID NO: 190948 - DNA, 16 bp, P. troglodytes
aagccaaggacagagg

SEQ ID NO: 190949 - DNA, 16 bp, P. troglodytes
aagccaaggcagatgg

SEQ ID NO: 190950 - DNA, 18 bp, P. troglodytes
aagccaaggctcaagaac

SEQ ID NO: 190951 - DNA, 16 bp, P. troglodytes
aagccaaggggagagg

SEQ ID NO: 190952 - DNA, 16 bp, P. troglodytes
aagccaatggtagctt

SEQ ID NO: 190953 - DNA, 16 bp, P. troglodytes
aagccaattaaatctc

SEQ ID NO: 190954 - DNA, 16 bp, P. troglodytes
aagccaattaacatat

SEQ ID NO: 190955 - DNA, 16 bp, P. troglodytes
aagccaattaagatct

SEQ ID NO: 190956 - DNA, 16 bp, P. troglodytes
aagccacaagaggcct

SEQ ID NO: 190957 - DNA, 16 bp, P. troglodytes
aagccaccacccctgg

SEQ ID NO: 190958 - DNA, 16 bp, P. troglodytes
aagccaccacgcccag

SEQ ID NO: 190959 - DNA, 16 bp, P. troglodytes
aagccaccatcatctc

SEQ ID NO: 190960 - DNA, 19 bp, P. troglodytes
aagccaccatgcctggcta

SEQ ID NO: 190961 - DNA, 16 bp, P. troglodytes
aagccaccatgctggg

SEQ ID NO: 190962 - DNA, 16 bp, P. troglodytes
aagccaccattcccag

SEQ ID NO: 190963 - DNA, 16 bp, P. troglodytes
aagccacccaatttat

SEQ ID NO: 190964 - DNA, 16 bp, P. troglodytes
aagccacccagtctct

SEQ ID NO: 190965 - DNA, 16 bp, P. troglodytes
aagccactgtgcccag

SEQ ID NO: 190966 - DNA, 16 bp, P. troglodytes
aagccactgtgcctgg

SEQ ID NO: 190967 - DNA, 16 bp, P. troglodytes
aagccactgtgcttgg

SEQ ID NO: 190968 - DNA, 16 bp, P. troglodytes
aagccagaagatattg

SEQ ID NO: 190969 - DNA, 16 bp, P. troglodytes
aagccagacagaaaag

SEQ ID NO: 190970 - DNA, 16 bp, P. troglodytes
aagccagactctgtct

SEQ ID NO: 190971 - DNA, 16 bp, P. troglodytes
aagccagactgcctgg

SEQ ID NO: 190972 - DNA, 16 bp, P. troglodytes
aagccagattttaaaa

SEQ ID NO: 190973 - DNA, 16 bp, P. troglodytes
aagccagcaagaccac

SEQ ID NO: 190974 - DNA, 16 bp, P. troglodytes
aagccagcacagtact

SEQ ID NO: 190975 - DNA, 16 bp, P. troglodytes
aagccagccaagccag

SEQ ID NO: 190976 - DNA, 16 bp, P. troglodytes
aagccagccagccagc

SEQ ID NO: 190977 - DNA, 16 bp, P. troglodytes
aagccagcctggacaa

SEQ ID NO: 190978 - DNA, 16 bp, P. troglodytes
aagccagctgcaaaaa

SEQ ID NO: 190979 - DNA, 16 bp, P. troglodytes
aagccagctgccatgt

SEQ ID NO: 190980 - DNA, 16 bp, P. troglodytes
aagccaggaagaaggc

SEQ ID NO: 190981 - DNA, 16 bp, P. troglodytes
aagccaggaagacagc

SEQ ID NO: 190982 - DNA, 16 bp, P. troglodytes
aagccaggatggtctc

SEQ ID NO: 190983 - DNA, 16 bp, P. troglodytes
aagccaggcacaaaat

SEQ ID NO: 190984 - DNA, 16 bp, P. troglodytes
aagccaggcacagaag

SEQ ID NO: 190985 - DNA, 16 bp, P. troglodytes
aagccaggcatggtgg

SEQ ID NO: 190986 - DNA, 16 bp, P. troglodytes
aagccaggcgtggtgg

SEQ ID NO: 190987 - DNA, 16 bp, P. troglodytes
aagccagggacagaaa

SEQ ID NO: 190988 - DNA, 16 bp, P. troglodytes
aagccaggtgtggtgg

SEQ ID NO: 190989 - DNA, 17 bp, P. troglodytes
aagccagtagtggctca

SEQ ID NO: 190990 - DNA, 16 bp, P. troglodytes
aagccagtcctgcctc

SEQ ID NO: 190991 - DNA, 16 bp, P. troglodytes
aagccagtggtgtaat

SEQ ID NO: 190992 - DNA, 16 bp, P. troglodytes
aagccagttggctgaa

SEQ ID NO: 190993 - DNA, 16 bp, P. troglodytes
aagccatcaggttctg

SEQ ID NO: 190994 - DNA, 16 bp, P. troglodytes
aagccatccagcctcc

SEQ ID NO: 190995 - DNA, 16 bp, P. troglodytes
aagccatcctcccact

SEQ ID NO: 190996 - DNA, 16 bp, P. troglodytes
aagccatcttcctgcc

SEQ ID NO: 190997 - DNA, 16 bp, P. troglodytes
aagccattcaacaagt

SEQ ID NO: 190998 - DNA, 16 bp, P. troglodytes
aagccatttatttatt

SEQ ID NO: 190999 - DNA, 16 bp, P. troglodytes
aagccattttcttttt

SEQ ID NO: 191000 - DNA, 16 bp, P. troglodytes
aagcccaaaccccagc

SEQ ID NO: 191001 - DNA, 16 bp, P. troglodytes
aagcccaaagccttgg

SEQ ID NO: 191002 - DNA, 16 bp, P. troglodytes
aagcccaaaggctgga

SEQ ID NO: 191003 - DNA, 16 bp, P. troglodytes
aagcccaacactttgg

SEQ ID NO: 191004 - DNA, 16 bp, P. troglodytes
aagcccaagaggtcaa

SEQ ID NO: 191005 - DNA, 16 bp, P. troglodytes
aagcccaaggtcaagg

SEQ ID NO: 191006 - DNA, 16 bp, P. troglodytes
aagcccaattaaacct

SEQ ID NO: 191007 - DNA, 16 bp, P. troglodytes
aagcccagaacctgat

SEQ ID NO: 191008 - DNA, 16 bp, P. troglodytes
aagcccagaaggttga

SEQ ID NO: 191009 - DNA, 16 bp, P. troglodytes
aagcccagcctggaca

SEQ ID NO: 191010 - DNA, 16 bp, P. troglodytes
aagcccagctctgcca

SEQ ID NO: 191011 - DNA, 16 bp, P. troglodytes
aagcccaggaagtcaa

SEQ ID NO: 191012 - DNA, 16 bp, P. troglodytes
aagcccaggaggctga

SEQ ID NO: 191013 - DNA, 19 bp, P. troglodytes
aagcccaggagtttgagac

SEQ ID NO: 191014 - DNA, 16 bp, P. troglodytes
aagcccagggaggtca

SEQ ID NO: 191015 - DNA, 16 bp, P. troglodytes
aagcccataaaaaccc

SEQ ID NO: 191016 - DNA, 16 bp, P. troglodytes
aagcccatcaaaaagt

SEQ ID NO: 191017 - DNA, 16 bp, P. troglodytes
aagccccaagccttga

SEQ ID NO: 191018 - DNA, 16 bp, P. troglodytes
aagccccaccctcaag

SEQ ID NO: 191019 - DNA, 16 bp, P. troglodytes
aagccccaccttcagg

SEQ ID NO: 191020 - DNA, 16 bp, P. troglodytes
aagcccctcactgcct

SEQ ID NO: 191021 - DNA, 16 bp, P. troglodytes
aagcccctgaagtata

SEQ ID NO: 191022 - DNA, 16 bp, P. troglodytes
aagccctcaccagaag

SEQ ID NO: 191023 - DNA, 16 bp, P. troglodytes
aagccctgggtctggg

SEQ ID NO: 191024 - DNA, 16 bp, P. troglodytes
aagccctttatttctt

SEQ ID NO: 191025 - DNA, 17 bp, P. troglodytes
aagccgagatcatgcca

SEQ ID NO: 191026 - DNA, 16 bp, P. troglodytes
aagccgagatcctgcc

SEQ ID NO: 191027 - DNA, 17 bp, P. troglodytes
aagccgagatcgcgcca

SEQ ID NO: 191028 - DNA, 16 bp, P. troglodytes
aagccggcagtcacag

SEQ ID NO: 191029 - DNA, 16 bp, P. troglodytes
aagcctagtacccaat

SEQ ID NO: 191030 - DNA, 16 bp, P. troglodytes
aagcctattgtgaact

SEQ ID NO: 191031 - DNA, 16 bp, P. troglodytes
aagcctcaggctgctt

SEQ ID NO: 191032 - DNA, 16 bp, P. troglodytes
aagcctcagtttcctc

SEQ ID NO: 191033 - DNA, 16 bp, P. troglodytes
aagcctcatgccagca

SEQ ID NO: 191034 - DNA, 16 bp, P. troglodytes
aagcctcattttcctc

SEQ ID NO: 191035 - DNA, 16 bp, P. troglodytes
aagcctccatctcaaa

SEQ ID NO: 191036 - DNA, 16 bp, P. troglodytes
aagcctccccagaagc

SEQ ID NO: 191037 - DNA, 16 bp, P. troglodytes
aagcctcctttgcgtc

SEQ ID NO: 191038 - DNA, 16 bp, P. troglodytes
aagcctgcagcagcag

SEQ ID NO: 191039 - DNA, 16 bp, P. troglodytes
aagcctgctgcagaaa

SEQ ID NO: 191040 - DNA, 16 bp, P. troglodytes
aagcctggctaatttt

SEQ ID NO: 191041 - DNA, 16 bp, P. troglodytes
aagcctgggcaacatg

SEQ ID NO: 191042 - DNA, 16 bp, P. troglodytes
aagcctgggggctggg

SEQ ID NO: 191043 - DNA, 16 bp, P. troglodytes
aagcctgggtgacaga

SEQ ID NO: 191044 - DNA, 16 bp, P. troglodytes
aagcctgggtggcaga

SEQ ID NO: 191045 - DNA, 16 bp, P. troglodytes
aagcctgtctataaaa

SEQ ID NO: 191046 - DNA, 16 bp, P. troglodytes
aagcctgtgggtgcac

SEQ ID NO: 191047 - DNA, 16 bp, P. troglodytes
aagccttaccaataat

SEQ ID NO: 191048 - DNA, 16 bp, P. troglodytes
aagccttctctcaact

SEQ ID NO: 191049 - DNA, 16 bp, P. troglodytes
aagccttctctgacca

SEQ ID NO: 191050 - DNA, 16 bp, P. troglodytes
aagccttggtggtttc

SEQ ID NO: 191051 - DNA, 16 bp, P. troglodytes
aagcgagactccatct

SEQ ID NO: 191052 - DNA, 16 bp, P. troglodytes
aagcgagactctgtct

SEQ ID NO: 191053 - DNA, 17 bp, P. troglodytes
aagcgatccttccacct

SEQ ID NO: 191054 - DNA, 17 bp, P. troglodytes
aagcgatctgcccacct

SEQ ID NO: 191055 - DNA, 16 bp, P. troglodytes
aagcgattctccttgc

SEQ ID NO: 191056 - DNA, 16 bp, P. troglodytes
aagcgattctcttgcc

SEQ ID NO: 191057 - DNA, 16 bp, P. troglodytes
aagcggaggctgcagt

SEQ ID NO: 191058 - DNA, 18 bp, P. troglodytes
aagcgttccctttgaaaa

SEQ ID NO: 191059 - DNA, 16 bp, P. troglodytes
aagctaaaaggaaaag

SEQ ID NO: 191060 - DNA, 16 bp, P. troglodytes
aagctaaagggaaaat

SEQ ID NO: 191061 - DNA, 16 bp, P. troglodytes
aagctaaatgtccatc

SEQ ID NO: 191062 - DNA, 16 bp, P. troglodytes
aagctaaattttaaaa

SEQ ID NO: 191063 - DNA, 16 bp, P. troglodytes
aagctaacaaattagc

SEQ ID NO: 191064 - DNA, 16 bp, P. troglodytes
aagctaacaaccacca

SEQ ID NO: 191065 - DNA, 16 bp, P. troglodytes
aagctaagaaacttga

SEQ ID NO: 191066 - DNA, 16 bp, P. troglodytes
aagctaagaaccttga

SEQ ID NO: 191067 - DNA, 16 bp, P. troglodytes
aagctaaggcaggcag

SEQ ID NO: 191068 - DNA, 16 bp, P. troglodytes
aagctaccaagtttgt

SEQ ID NO: 191069 - DNA, 16 bp, P. troglodytes
aagctagaagaagaaa

SEQ ID NO: 191070 - DNA, 16 bp, P. troglodytes
aagctagaagacaatg

SEQ ID NO: 191071 - DNA, 16 bp, P. troglodytes
aagctagagaaaatat

SEQ ID NO: 191072 - DNA, 16 bp, P. troglodytes
aagctagtctcccaaa

SEQ ID NO: 191073 - DNA, 16 bp, P. troglodytes
aagctatcagaagaaa

SEQ ID NO: 191074 - DNA, 16 bp, P. troglodytes
aagctattggtggatc

SEQ ID NO: 191075 - DNA, 16 bp, P. troglodytes
aagctatttttaaaag

SEQ ID NO: 191076 - DNA, 16 bp, P. troglodytes
aagctcactgcaacct

SEQ ID NO: 191077 - DNA, 16 bp, P. troglodytes
aagctcagggcccttg

SEQ ID NO: 191078 - DNA, 16 bp, P. troglodytes
aagctccacaaggaca

SEQ ID NO: 191079 - DNA, 16 bp, P. troglodytes
aagctccagctttaag

SEQ ID NO: 191080 - DNA, 16 bp, P. troglodytes
aagctccagtgtccca

SEQ ID NO: 191081 - DNA, 16 bp, P. troglodytes
aagctccatctctact

SEQ ID NO: 191082 - DNA, 16 bp, P. troglodytes
aagctcccaagagttt

SEQ ID NO: 191083 - DNA, 16 bp, P. troglodytes
aagctcccaggtgatt

SEQ ID NO: 191084 - DNA, 16 bp, P. troglodytes
aagctccccagatgat

SEQ ID NO: 191085 - DNA, 16 bp, P. troglodytes
aagctccctgggtggg

SEQ ID NO: 191086 - DNA, 16 bp, P. troglodytes
aagctccgcctcctga

SEQ ID NO: 191087 - DNA, 16 bp, P. troglodytes
aagctccttgagggca

SEQ ID NO: 191088 - DNA, 16 bp, P. troglodytes
aagctcggcctcccag

SEQ ID NO: 191089 - DNA, 18 bp, P. troglodytes
aagctcggcctcctgggt

SEQ ID NO: 191090 - DNA, 16 bp, P. troglodytes
aagctctgaagttctt

SEQ ID NO: 191091 - DNA, 16 bp, P. troglodytes
aagctctgcctcacgg

SEQ ID NO: 191092 - DNA, 17 bp, P. troglodytes
aagctctgcttcccggg

SEQ ID NO: 191093 - DNA, 16 bp, P. troglodytes
aagctctttgaggaca

SEQ ID NO: 191094 - DNA, 16 bp, P. troglodytes
aagctgaaaaaggcaa

SEQ ID NO: 191095 - DNA, 16 bp, P. troglodytes
aagctgaaaagcaact

SEQ ID NO: 191096 - DNA, 16 bp, P. troglodytes
aagctgaaaatgtcac

SEQ ID NO: 191097 - DNA, 16 bp, P. troglodytes
aagctgaaaattctga

SEQ ID NO: 191098 - DNA, 16 bp, P. troglodytes
aagctgaaacaggaga

SEQ ID NO: 191099 - DNA, 16 bp, P. troglodytes
aagctgaaactgtatc

SEQ ID NO: 191100 - DNA, 16 bp, P. troglodytes
aagctgaaagaacaaa

SEQ ID NO: 191101 - DNA, 16 bp, P. troglodytes
aagctgaaagctgagt

SEQ ID NO: 191102 - DNA, 16 bp, P. troglodytes
aagctgaacatcactg

SEQ ID NO: 191103 - DNA, 16 bp, P. troglodytes
aagctgaaccaattga

SEQ ID NO: 191104 - DNA, 16 bp, P. troglodytes
aagctgaaggaaaaat

SEQ ID NO: 191105 - DNA, 16 bp, P. troglodytes
aagctgagaataaaat

SEQ ID NO: 191106 - DNA, 16 bp, P. troglodytes
aagctgagaatcaaat

SEQ ID NO: 191107 - DNA, 16 bp, P. troglodytes
aagctgagacaggaaa

SEQ ID NO: 191108 - DNA, 16 bp, P. troglodytes
aagctgagaggccaaa

SEQ ID NO: 191109 - DNA, 16 bp, P. troglodytes
aagctgagattcagag

SEQ ID NO: 191110 - DNA, 16 bp, P. troglodytes
aagctgagattgtgcc

SEQ ID NO: 191111 - DNA, 16 bp, P. troglodytes
aagctgaggcagaagg

SEQ ID NO: 191112 - DNA, 16 bp, P. troglodytes
aagctgaggcaggagc

SEQ ID NO: 191113 - DNA, 16 bp, P. troglodytes
aagctgaggcaggcgg

SEQ ID NO: 191114 - DNA, 16 bp, P. troglodytes
aagctgaggcagggga

SEQ ID NO: 191115 - DNA, 16 bp, P. troglodytes
aagctgaggccagaga

SEQ ID NO: 191116 - DNA, 16 bp, P. troglodytes
aagctgaggctcagag

SEQ ID NO: 191117 - DNA, 16 bp, P. troglodytes
aagctgaggcttagag

SEQ ID NO: 191118 - DNA, 16 bp, P. troglodytes
aagctgagggagttca

SEQ ID NO: 191119 - DNA, 16 bp, P. troglodytes
aagctgaggtggcagg

SEQ ID NO: 191120 - DNA, 18 bp, P. troglodytes
aagctgaggtgggcggat

SEQ ID NO: 191121 - DNA, 16 bp, P. troglodytes
aagctgagtgttggga

SEQ ID NO: 191122 - DNA, 17 bp, P. troglodytes
aagctgatcctcttaca

SEQ ID NO: 191123 - DNA, 16 bp, P. troglodytes
aagctgcaaaaaccag

SEQ ID NO: 191124 - DNA, 16 bp, P. troglodytes
aagctgcaaaaccagc

SEQ ID NO: 191125 - DNA, 16 bp, P. troglodytes
aagctgcacacctaca

SEQ ID NO: 191126 - DNA, 16 bp, P. troglodytes
aagctgcagagaaaag

SEQ ID NO: 191127 - DNA, 16 bp, P. troglodytes
aagctgcagatcttcg

SEQ ID NO: 191128 - DNA, 16 bp, P. troglodytes
aagctgcagatctttg

SEQ ID NO: 191129 - DNA, 16 bp, P. troglodytes
aagctgccaaggcttg

SEQ ID NO: 191130 - DNA, 16 bp, P. troglodytes
aagctgctcaacatca

SEQ ID NO: 191131 - DNA, 16 bp, P. troglodytes
aagctggaaaagacaa

SEQ ID NO: 191132 - DNA, 16 bp, P. troglodytes
aagctggaaagaaaaa

SEQ ID NO: 191133 - DNA, 16 bp, P. troglodytes
aagctggaaagcagat

SEQ ID NO: 191134 - DNA, 16 bp, P. troglodytes
aagctggaagagacaa

SEQ ID NO: 191135 - DNA, 16 bp, P. troglodytes
aagctggaagaggaaa

SEQ ID NO: 191136 - DNA, 16 bp, P. troglodytes
aagctggaagcatttc

SEQ ID NO: 191137 - DNA, 16 bp, P. troglodytes
aagctggaagccacca

SEQ ID NO: 191138 - DNA, 16 bp, P. troglodytes
aagctggaggaaaaaa

SEQ ID NO: 191139 - DNA, 16 bp, P. troglodytes
aagctggaggcccagg

SEQ ID NO: 191140 - DNA, 16 bp, P. troglodytes
aagctggaggctgaga

SEQ ID NO: 191141 - DNA, 16 bp, P. troglodytes
aagctggagtgcaatg

SEQ ID NO: 191142 - DNA, 16 bp, P. troglodytes
aagctggccaacatgg

SEQ ID NO: 191143 - DNA, 16 bp, P. troglodytes
aagctggccctggctg

SEQ ID NO: 191144 - DNA, 16 bp, P. troglodytes
aagctgggaccacagg

SEQ ID NO: 191145 - DNA, 16 bp, P. troglodytes
aagctgggactacagg

SEQ ID NO: 191146 - DNA, 16 bp, P. troglodytes
aagctgggagcttgca

SEQ ID NO: 191147 - DNA, 16 bp, P. troglodytes
aagctgggcatccagg

SEQ ID NO: 191148 - DNA, 17 bp, P. troglodytes
aagctgggcatccgggg

SEQ ID NO: 191149 - DNA, 16 bp, P. troglodytes
aagctgggcctggtgg

SEQ ID NO: 191150 - DNA, 16 bp, P. troglodytes
aagctgggcgtggtgg

SEQ ID NO: 191151 - DNA, 16 bp, P. troglodytes
aagctgggtgcagtgg

SEQ ID NO: 191152 - DNA, 16 bp, P. troglodytes
aagctgggtgtggtgg

SEQ ID NO: 191153 - DNA, 16 bp, P. troglodytes
aagctggtcctgaact

SEQ ID NO: 191154 - DNA, 16 bp, P. troglodytes
aagctggttctaaaat

SEQ ID NO: 191155 - DNA, 16 bp, P. troglodytes
aagctgtagaagaaaa

SEQ ID NO: 191156 - DNA, 16 bp, P. troglodytes
aagctgtagttatggc

SEQ ID NO: 191157 - DNA, 16 bp, P. troglodytes
aagctgtcctcttgtg

SEQ ID NO: 191158 - DNA, 16 bp, P. troglodytes
aagctgtctttaaaaa

SEQ ID NO: 191159 - DNA, 16 bp, P. troglodytes
aagctgtgccccaacc

SEQ ID NO: 191160 - DNA, 16 bp, P. troglodytes
aagctgtggaccctcg

SEQ ID NO: 191161 - DNA, 16 bp, P. troglodytes
aagctgtggcaggaga

SEQ ID NO: 191162 - DNA, 16 bp, P. troglodytes
aagctgttaaaaagaa

SEQ ID NO: 191163 - DNA, 16 bp, P. troglodytes
aagctgttaaataaaa

SEQ ID NO: 191164 - DNA, 16 bp, P. troglodytes
aagctgtttctctttc

SEQ ID NO: 191165 - DNA, 16 bp, P. troglodytes
aagctgttttttaaaa

SEQ ID NO: 191166 - DNA, 16 bp, P. troglodytes
aagcttaaaagcaaga

SEQ ID NO: 191167 - DNA, 16 bp, P. troglodytes
aagcttactttggctg

SEQ ID NO: 191168 - DNA, 16 bp, P. troglodytes
aagcttattttaaaat

SEQ ID NO: 191169 - DNA, 16 bp, P. troglodytes
aagcttcaaaagacag

SEQ ID NO: 191170 - DNA, 16 bp, P. troglodytes
aagcttcatcagtgaa

SEQ ID NO: 191171 - DNA, 16 bp, P. troglodytes
aagcttcatgagggca

SEQ ID NO: 191172 - DNA, 16 bp, P. troglodytes
aagcttccatttcctc

SEQ ID NO: 191173 - DNA, 16 bp, P. troglodytes
aagcttcccaagtgat

SEQ ID NO: 191174 - DNA, 16 bp, P. troglodytes
aagcttcctaaggcct

SEQ ID NO: 191175 - DNA, 16 bp, P. troglodytes
aagcttcctgaggcct

SEQ ID NO: 191176 - DNA, 16 bp, P. troglodytes
aagcttcctgaggtcc

SEQ ID NO: 191177 - DNA, 16 bp, P. troglodytes
aagcttctgcatggca

SEQ ID NO: 191178 - DNA, 16 bp, P. troglodytes
aagctttaaaaagaaa

SEQ ID NO: 191179 - DNA, 16 bp, P. troglodytes
aagctttataaatgaa

SEQ ID NO: 191180 - DNA, 16 bp, P. troglodytes
aagctttcccactaag

SEQ ID NO: 191181 - DNA, 16 bp, P. troglodytes
aagctttcttgcctgc

SEQ ID NO: 191182 - DNA, 16 bp, P. troglodytes
aagctttctttacctg

SEQ ID NO: 191183 - DNA, 16 bp, P. troglodytes
aagctttcttttcatt

SEQ ID NO: 191184 - DNA, 16 bp, P. troglodytes
aagcttttaaagaatt

SEQ ID NO: 191185 - DNA, 16 bp, P. troglodytes
aagcttttatttaaaa

SEQ ID NO: 191186 - DNA, 16 bp, P. troglodytes
aagcttttcttttaaa

SEQ ID NO: 191187 - DNA, 16 bp, P. troglodytes
aagcttttctttttct

SEQ ID NO: 191188 - DNA, 16 bp, P. troglodytes
aagctttttaacttga

SEQ ID NO: 191189 - DNA, 16 bp, P. troglodytes
aagctttttgtttgtt

SEQ ID NO: 191190 - DNA, 16 bp, P. troglodytes
aaggaaaaaaaccttt

SEQ ID NO: 191191 - DNA, 16 bp, P. troglodytes
aaggaaaaaaatcttt

SEQ ID NO: 191192 - DNA, 16 bp, P. troglodytes
aaggaaaaaaatgttt

SEQ ID NO: 191193 - DNA, 16 bp, P. troglodytes
aaggaaaaaataatct

SEQ ID NO: 191194 - DNA, 16 bp, P. troglodytes
aaggaaaaacattttt

SEQ ID NO: 191195 - DNA, 16 bp, P. troglodytes
aaggaaaaagaaagct

SEQ ID NO: 191196 - DNA, 16 bp, P. troglodytes
aaggaaaaagctttat

SEQ ID NO: 191197 - DNA, 16 bp, P. troglodytes
aaggaaaaagtggttt

SEQ ID NO: 191198 - DNA, 16 bp, P. troglodytes
aaggaaaaatattttg

SEQ ID NO: 191199 - DNA, 16 bp, P. troglodytes
aaggaaaaatattttt

SEQ ID NO: 191200 - DNA, 16 bp, P. troglodytes
aaggaaaaatgtttta

SEQ ID NO: 191201 - DNA, 16 bp, P. troglodytes
aaggaaaaattcttga

SEQ ID NO: 191202 - DNA, 16 bp, P. troglodytes
aaggaaaacaaatttt

SEQ ID NO: 191203 - DNA, 16 bp, P. troglodytes
aaggaaaactaacaga

SEQ ID NO: 191204 - DNA, 16 bp, P. troglodytes
aaggaaaactatgaaa

SEQ ID NO: 191205 - DNA, 16 bp, P. troglodytes
aaggaaaactggaaaa

SEQ ID NO: 191206 - DNA, 16 bp, P. troglodytes
aaggaaaactggaaat

SEQ ID NO: 191207 - DNA, 16 bp, P. troglodytes
aaggaaaacttcaaaa

SEQ ID NO: 191208 - DNA, 16 bp, P. troglodytes
aaggaaaactttaaaa

SEQ ID NO: 191209 - DNA, 16 bp, P. troglodytes
aaggaaaagaaatctt

SEQ ID NO: 191210 - DNA, 16 bp, P. troglodytes
aaggaaaagaagccat

SEQ ID NO: 191211 - DNA, 16 bp, P. troglodytes
aaggaaaagcagacat

SEQ ID NO: 191212 - DNA, 16 bp, P. troglodytes
aaggaaaataacattt

SEQ ID NO: 191213 - DNA, 16 bp, P. troglodytes
aaggaaaataatgttt

SEQ ID NO: 191214 - DNA, 16 bp, P. troglodytes
aaggaaaatatttaga

SEQ ID NO: 191215 - DNA, 16 bp, P. troglodytes
aaggaaaatgtggcat

SEQ ID NO: 191216 - DNA, 16 bp, P. troglodytes
aaggaaaatgtggggt

SEQ ID NO: 191217 - DNA, 16 bp, P. troglodytes
aaggaaaatgtggtgt

SEQ ID NO: 191218 - DNA, 16 bp, P. troglodytes
aaggaaaatttatttt

SEQ ID NO: 191219 - DNA, 16 bp, P. troglodytes
aaggaaaatttcaggc

SEQ ID NO: 191220 - DNA, 16 bp, P. troglodytes
aaggaaacaaaattat

SEQ ID NO: 191221 - DNA, 16 bp, P. troglodytes
aaggaaacagattctt

SEQ ID NO: 191222 - DNA, 16 bp, P. troglodytes
aaggaaacagattttt

SEQ ID NO: 191223 - DNA, 16 bp, P. troglodytes
aaggaaacagcagaca

SEQ ID NO: 191224 - DNA, 16 bp, P. troglodytes
aaggaaacagtcaaca

SEQ ID NO: 191225 - DNA, 16 bp, P. troglodytes
aaggaaaccaaggctt

SEQ ID NO: 191226 - DNA, 16 bp, P. troglodytes
aaggaaagaaaatgca

SEQ ID NO: 191227 - DNA, 16 bp, P. troglodytes
aaggaaagaaatacag

SEQ ID NO: 191228 - DNA, 16 bp, P. troglodytes
aaggaaagaagtcatc

SEQ ID NO: 191229 - DNA, 16 bp, P. troglodytes
aaggaaagaatcttaa

SEQ ID NO: 191230 - DNA, 16 bp, P. troglodytes
aaggaaagactgaaaa

SEQ ID NO: 191231 - DNA, 16 bp, P. troglodytes
aaggaaagactgaaga

SEQ ID NO: 191232 - DNA, 16 bp, P. troglodytes
aaggaaagaggtttaa

SEQ ID NO: 191233 - DNA, 16 bp, P. troglodytes
aaggaaaggaaatcat

SEQ ID NO: 191234 - DNA, 16 bp, P. troglodytes
aaggaaagttttaaaa

SEQ ID NO: 191235 - DNA, 16 bp, P. troglodytes
aaggaaataaaatcag

SEQ ID NO: 191236 - DNA, 16 bp, P. troglodytes
aaggaaataaaatgtt

SEQ ID NO: 191237 - DNA, 16 bp, P. troglodytes
aaggaaataaatgttt

SEQ ID NO: 191238 - DNA, 16 bp, P. troglodytes
aaggaaataatcaaga

SEQ ID NO: 191239 - DNA, 16 bp, P. troglodytes
aaggaaatatacaaat

SEQ ID NO: 191240 - DNA, 16 bp, P. troglodytes
aaggaaatatatttta

SEQ ID NO: 191241 - DNA, 16 bp, P. troglodytes
aaggaaatatttaatt

SEQ ID NO: 191242 - DNA, 16 bp, P. troglodytes
aaggaaatattttata

SEQ ID NO: 191243 - DNA, 16 bp, P. troglodytes
aaggaaatatttttgt

SEQ ID NO: 191244 - DNA, 16 bp, P. troglodytes
aaggaaatcagagaaa

SEQ ID NO: 191245 - DNA, 16 bp, P. troglodytes
aaggaaatcagtatat

SEQ ID NO: 191246 - DNA, 16 bp, P. troglodytes
aaggaaatcattttgg

SEQ ID NO: 191247 - DNA, 16 bp, P. troglodytes
aaggaaatccaaaata

SEQ ID NO: 191248 - DNA, 16 bp, P. troglodytes
aaggaaatcccatcag

SEQ ID NO: 191249 - DNA, 16 bp, P. troglodytes
aaggaaatgaaaattt

SEQ ID NO: 191250 - DNA, 16 bp, P. troglodytes
aaggaaatgaaatcaa

SEQ ID NO: 191251 - DNA, 16 bp, P. troglodytes
aaggaaatgaaattat

SEQ ID NO: 191252 - DNA, 16 bp, P. troglodytes
aaggaaatgcagcagt

SEQ ID NO: 191253 - DNA, 16 bp, P. troglodytes
aaggaaatgctcaaaa

SEQ ID NO: 191254 - DNA, 16 bp, P. troglodytes
aaggaaatgttttaaa

SEQ ID NO: 191255 - DNA, 16 bp, P. troglodytes
aaggaaattaatgttt

SEQ ID NO: 191256 - DNA, 16 bp, P. troglodytes
aaggaaattcagaaaa

SEQ ID NO: 191257 - DNA, 16 bp, P. troglodytes
aaggaaattctgacat

SEQ ID NO: 191258 - DNA, 16 bp, P. troglodytes
aaggaaattgaacact

SEQ ID NO: 191259 - DNA, 16 bp, P. troglodytes
aaggaaatttaaattt

SEQ ID NO: 191260 - DNA, 16 bp, P. troglodytes
aaggaaattttaaatt

SEQ ID NO: 191261 - DNA, 16 bp, P. troglodytes
aaggaaattttctttt

SEQ ID NO: 191262 - DNA, 16 bp, P. troglodytes
aaggaaattttttaaa

SEQ ID NO: 191263 - DNA, 16 bp, P. troglodytes
aaggaacacagtcctg

SEQ ID NO: 191264 - DNA, 16 bp, P. troglodytes
aaggaacagaaattat

SEQ ID NO: 191265 - DNA, 16 bp, P. troglodytes
aaggaaccagtaagta

SEQ ID NO: 191266 - DNA, 16 bp, P. troglodytes
aaggaactcaaatcag

SEQ ID NO: 191267 - DNA, 16 bp, P. troglodytes
aaggaactcagataaa

SEQ ID NO: 191268 - DNA, 16 bp, P. troglodytes
aaggaactgaaacaaa

SEQ ID NO: 191269 - DNA, 16 bp, P. troglodytes
aaggaactgcagatgt

SEQ ID NO: 191270 - DNA, 16 bp, P. troglodytes
aaggaactggatcacc

SEQ ID NO: 191271 - DNA, 16 bp, P. troglodytes
aaggaacttaaaacaa

SEQ ID NO: 191272 - DNA, 16 bp, P. troglodytes
aaggaactttaaaaat

SEQ ID NO: 191273 - DNA, 16 bp, P. troglodytes
aaggaagaaaaatttt

SEQ ID NO: 191274 - DNA, 16 bp, P. troglodytes
aaggaagaaatgcaaa

SEQ ID NO: 191275 - DNA, 16 bp, P. troglodytes
aaggaagaagcaaaat

SEQ ID NO: 191276 - DNA, 16 bp, P. troglodytes
aaggaagaagtaaaac

SEQ ID NO: 191277 - DNA, 16 bp, P. troglodytes
aaggaagaattttaaa

SEQ ID NO: 191278 - DNA, 16 bp, P. troglodytes
aaggaagacagaaaat

SEQ ID NO: 191279 - DNA, 16 bp, P. troglodytes
aaggaagacatacaaa

SEQ ID NO: 191280 - DNA, 16 bp, P. troglodytes
aaggaagacattttct

SEQ ID NO: 191281 - DNA, 16 bp, P. troglodytes
aaggaagagtcagcag

SEQ ID NO: 191282 - DNA, 16 bp, P. troglodytes
aaggaagagttgcatg

SEQ ID NO: 191283 - DNA, 16 bp, P. troglodytes
aaggaagccaaaagat

SEQ ID NO: 191284 - DNA, 16 bp, P. troglodytes
aaggaagccagacaca

SEQ ID NO: 191285 - DNA, 16 bp, P. troglodytes
aaggaagcccatcaga

SEQ ID NO: 191286 - DNA, 16 bp, P. troglodytes
aaggaagctaagaaca

SEQ ID NO: 191287 - DNA, 16 bp, P. troglodytes
aaggaagctaagaact

SEQ ID NO: 191288 - DNA, 16 bp, P. troglodytes
aaggaagctgcagaag

SEQ ID NO: 191289 - DNA, 16 bp, P. troglodytes
aaggaaggaaactctg

SEQ ID NO: 191290 - DNA, 16 bp, P. troglodytes
aaggaaggaaagtaca

SEQ ID NO: 191291 - DNA, 16 bp, P. troglodytes
aaggaaggaaatattt

SEQ ID NO: 191292 - DNA, 16 bp, P. troglodytes
aaggaaggaagaaact

SEQ ID NO: 191293 - DNA, 16 bp, P. troglodytes
aaggaaggagatcatg

SEQ ID NO: 191294 - DNA, 16 bp, P. troglodytes
aaggaaggcaggcaag

SEQ ID NO: 191295 - DNA, 16 bp, P. troglodytes
aaggaaggcatccagt

SEQ ID NO: 191296 - DNA, 16 bp, P. troglodytes
aaggaagggatccaga

SEQ ID NO: 191297 - DNA, 16 bp, P. troglodytes
aaggaagtctgggaaa

SEQ ID NO: 191298 - DNA, 18 bp, P. troglodytes
aaggaagtgctaaacatg

SEQ ID NO: 191299 - DNA, 16 bp, P. troglodytes
aaggaagttttttttt

SEQ ID NO: 191300 - DNA, 16 bp, P. troglodytes
aaggaataaagctgga

SEQ ID NO: 191301 - DNA, 16 bp, P. troglodytes
aaggaataaattaatg

SEQ ID NO: 191302 - DNA, 16 bp, P. troglodytes
aaggaatataaatcat

SEQ ID NO: 191303 - DNA, 16 bp, P. troglodytes
aaggaatataaatcct

SEQ ID NO: 191304 - DNA, 16 bp, P. troglodytes
aaggaatatagatcat

SEQ ID NO: 191305 - DNA, 16 bp, P. troglodytes
aaggaatcagagagac

SEQ ID NO: 191306 - DNA, 16 bp, P. troglodytes
aaggaatgaaatcatg

SEQ ID NO: 191307 - DNA, 16 bp, P. troglodytes
aaggaatgaactattg

SEQ ID NO: 191308 - DNA, 16 bp, P. troglodytes
aaggaatggatccagt

SEQ ID NO: 191309 - DNA, 16 bp, P. troglodytes
aaggaatgtgaaggac

SEQ ID NO: 191310 - DNA, 16 bp, P. troglodytes
aaggaatgtgcttatt

SEQ ID NO: 191311 - DNA, 16 bp, P. troglodytes
aaggaatgtgggaaag

SEQ ID NO: 191312 - DNA, 16 bp, P. troglodytes
aaggaattaatatcca

SEQ ID NO: 191313 - DNA, 16 bp, P. troglodytes
aaggaattcaaggatg

SEQ ID NO: 191314 - DNA, 16 bp, P. troglodytes
aaggaattctgggaaa

SEQ ID NO: 191315 - DNA, 16 bp, P. troglodytes
aaggaatttgagaaat

SEQ ID NO: 191316 - DNA, 16 bp, P. troglodytes
aaggaattttgctctt

SEQ ID NO: 191317 - DNA, 16 bp, P. troglodytes
aaggacaatttttaaa

SEQ ID NO: 191318 - DNA, 16 bp, P. troglodytes
aaggacacaaacctgg

SEQ ID NO: 191319 - DNA, 16 bp, P. troglodytes
aaggacacaagcctgg

SEQ ID NO: 191320 - DNA, 16 bp, P. troglodytes
aaggacacacacacac

SEQ ID NO: 191321 - DNA, 16 bp, P. troglodytes
aaggacacttgtgatt

SEQ ID NO: 191322 - DNA, 16 bp, P. troglodytes
aaggacagaccatatg

SEQ ID NO: 191323 - DNA, 16 bp, P. troglodytes
aaggacagcaccaagc

SEQ ID NO: 191324 - DNA, 17 bp, P. troglodytes
aaggacagccagagaga

SEQ ID NO: 191325 - DNA, 16 bp, P. troglodytes
aaggacagtctttctc

SEQ ID NO: 191326 - DNA, 16 bp, P. troglodytes
aaggacagttttacat

SEQ ID NO: 191327 - DNA, 16 bp, P. troglodytes
aaggacataaccaaaa

SEQ ID NO: 191328 - DNA, 16 bp, P. troglodytes
aaggacataatttcat

SEQ ID NO: 191329 - DNA, 16 bp, P. troglodytes
aaggacatacctgaga

SEQ ID NO: 191330 - DNA, 16 bp, P. troglodytes
aaggacatcatcaaga

SEQ ID NO: 191331 - DNA, 16 bp, P. troglodytes
aaggacatctacacca

SEQ ID NO: 191332 - DNA, 17 bp, P. troglodytes
aaggacatgaacagaca

SEQ ID NO: 191333 - DNA, 17 bp, P. troglodytes
aaggacatgaacaggca

SEQ ID NO: 191334 - DNA, 16 bp, P. troglodytes
aaggacatgattttat

SEQ ID NO: 191335 - DNA, 16 bp, P. troglodytes
aaggacatggatgaag

SEQ ID NO: 191336 - DNA, 16 bp, P. troglodytes
aaggacattatcaaga

SEQ ID NO: 191337 - DNA, 16 bp, P. troglodytes
aaggacattttaaaat

SEQ ID NO: 191338 - DNA, 16 bp, P. troglodytes
aaggaccagccattta

SEQ ID NO: 191339 - DNA, 16 bp, P. troglodytes
aaggaccaggaaaggg

SEQ ID NO: 191340 - DNA, 21 bp, P. troglodytes
aaggacctcttcaaggagaaa

SEQ ID NO: 191341 - DNA, 16 bp, P. troglodytes
aaggacttagaaaagt

SEQ ID NO: 191342 - DNA, 16 bp, P. troglodytes
aaggacttcttcaaga

SEQ ID NO: 191343 - DNA, 16 bp, P. troglodytes
aaggacttttttttaa

SEQ ID NO: 191344 - DNA, 16 bp, P. troglodytes
aaggactttttttttt

SEQ ID NO: 191345 - DNA, 16 bp, P. troglodytes
aaggagaaaaatgttt

SEQ ID NO: 191346 - DNA, 16 bp, P. troglodytes
aaggagaaaatcttga

SEQ ID NO: 191347 - DNA, 16 bp, P. troglodytes
aaggagaaatactttc

SEQ ID NO: 191348 - DNA, 16 bp, P. troglodytes
aaggagaactacaaaa

SEQ ID NO: 191349 - DNA, 16 bp, P. troglodytes
aaggagaagtaaaatc

SEQ ID NO: 191350 - DNA, 16 bp, P. troglodytes
aaggagaagtgcagag

SEQ ID NO: 191351 - DNA, 16 bp, P. troglodytes
aaggagaattgcttga

SEQ ID NO: 191352 - DNA, 16 bp, P. troglodytes
aaggagaattttaaaa

SEQ ID NO: 191353 - DNA, 16 bp, P. troglodytes
aaggagacagagacag

SEQ ID NO: 191354 - DNA, 16 bp, P. troglodytes
aaggagactgagaaga

SEQ ID NO: 191355 - DNA, 16 bp, P. troglodytes
aaggagactttttttt

SEQ ID NO: 191356 - DNA, 16 bp, P. troglodytes
aaggagagagtctttg

SEQ ID NO: 191357 - DNA, 16 bp, P. troglodytes
aaggagaggccaggca

SEQ ID NO: 191358 - DNA, 17 bp, P. troglodytes
aaggagagtagttatct

SEQ ID NO: 191359 - DNA, 16 bp, P. troglodytes
aaggagataaaagatc

SEQ ID NO: 191360 - DNA, 16 bp, P. troglodytes
aaggagatacagacac

SEQ ID NO: 191361 - DNA, 16 bp, P. troglodytes
aaggagatatatatat

SEQ ID NO: 191362 - DNA, 16 bp, P. troglodytes
aaggagatcaacattt

SEQ ID NO: 191363 - DNA, 16 bp, P. troglodytes
aaggagatcattctgg

SEQ ID NO: 191364 - DNA, 16 bp, P. troglodytes
aaggagatgccatcta

SEQ ID NO: 191365 - DNA, 16 bp, P. troglodytes
aaggagatttttggct

SEQ ID NO: 191366 - DNA, 16 bp, P. troglodytes
aaggagcaggcaacct

SEQ ID NO: 191367 - DNA, 16 bp, P. troglodytes
aaggagccaaatgtta

SEQ ID NO: 191368 - DNA, 16 bp, P. troglodytes
aaggagccatgagcca

SEQ ID NO: 191369 - DNA, 16 bp, P. troglodytes
aaggagctgaaaaaca

SEQ ID NO: 191370 - DNA, 16 bp, P. troglodytes
aaggagctgcaatcct

SEQ ID NO: 191371 - DNA, 16 bp, P. troglodytes
aaggagctgggtgtgg

SEQ ID NO: 191372 - DNA, 16 bp, P. troglodytes
aaggaggaacaaaggc

SEQ ID NO: 191373 - DNA, 16 bp, P. troglodytes
aaggaggaaggggccc

SEQ ID NO: 191374 - DNA, 16 bp, P. troglodytes
aaggaggagcaaagac

SEQ ID NO: 191375 - DNA, 16 bp, P. troglodytes
aaggaggagcagaggc

SEQ ID NO: 191376 - DNA, 16 bp, P. troglodytes
aaggaggagcaggcat

SEQ ID NO: 191377 - DNA, 16 bp, P. troglodytes
aaggaggccagtgtgg

SEQ ID NO: 191378 - DNA, 16 bp, P. troglodytes
aaggaggctaaagaga

SEQ ID NO: 191379 - DNA, 16 bp, P. troglodytes
aaggaggctgagaaag

SEQ ID NO: 191380 - DNA, 16 bp, P. troglodytes
aaggagggcaccaagc

SEQ ID NO: 191381 - DNA, 16 bp, P. troglodytes
aaggagggcttcctgg

SEQ ID NO: 191382 - DNA, 16 bp, P. troglodytes
aaggaggggatccagt

SEQ ID NO: 191383 - DNA, 16 bp, P. troglodytes
aaggaggttaagtaac

SEQ ID NO: 191384 - DNA, 16 bp, P. troglodytes
aaggagtaattttgat

SEQ ID NO: 191385 - DNA, 16 bp, P. troglodytes
aaggagttcgagacca

SEQ ID NO: 191386 - DNA, 16 bp, P. troglodytes
aaggagttgaaagacc

SEQ ID NO: 191387 - DNA, 18 bp, P. troglodytes
aaggagtttgagaccagc

SEQ ID NO: 191388 - DNA, 16 bp, P. troglodytes
aaggagtttgggcttt

SEQ ID NO: 191389 - DNA, 16 bp, P. troglodytes
aaggagtttgttatta

SEQ ID NO: 191390 - DNA, 16 bp, P. troglodytes
aaggataattcaacat

SEQ ID NO: 191391 - DNA, 16 bp, P. troglodytes
aaggatacaaaattat

SEQ ID NO: 191392 - DNA, 16 bp, P. troglodytes
aaggatacaaacaaat

SEQ ID NO: 191393 - DNA, 17 bp, P. troglodytes
aaggatatgaacagaca

SEQ ID NO: 191394 - DNA, 16 bp, P. troglodytes
aaggatatggacagac

SEQ ID NO: 191395 - DNA, 16 bp, P. troglodytes
aaggatatttttgttg

SEQ ID NO: 191396 - DNA, 16 bp, P. troglodytes
aaggatcaaaagagac

SEQ ID NO: 191397 - DNA, 16 bp, P. troglodytes
aaggatcaaatgagat

SEQ ID NO: 191398 - DNA, 16 bp, P. troglodytes
aaggatcagcaatgtt

SEQ ID NO: 191399 - DNA, 16 bp, P. troglodytes
aaggatgacttcatgt

SEQ ID NO: 191400 - DNA, 16 bp, P. troglodytes
aaggatgaggcaggag

SEQ ID NO: 191401 - DNA, 16 bp, P. troglodytes
aaggatgaggtcatgt

SEQ ID NO: 191402 - DNA, 16 bp, P. troglodytes
aaggatgagtttggcc

SEQ ID NO: 191403 - DNA, 17 bp, P. troglodytes
aaggatgatgctggcct

SEQ ID NO: 191404 - DNA, 16 bp, P. troglodytes
aaggatgcaaggatgg

SEQ ID NO: 191405 - DNA, 16 bp, P. troglodytes
aaggatgccaagacca

SEQ ID NO: 191406 - DNA, 16 bp, P. troglodytes
aaggatggaaggatgg

SEQ ID NO: 191407 - DNA, 16 bp, P. troglodytes
aaggatgtggagaaat

SEQ ID NO: 191408 - DNA, 16 bp, P. troglodytes
aaggatgtggggaaac

SEQ ID NO: 191409 - DNA, 16 bp, P. troglodytes
aaggattaaatgagat

SEQ ID NO: 191410 - DNA, 16 bp, P. troglodytes
aaggattaattttctt

SEQ ID NO: 191411 - DNA, 16 bp, P. troglodytes
aaggattataaaggaa

SEQ ID NO: 191412 - DNA, 16 bp, P. troglodytes
aaggattataaatgat

SEQ ID NO: 191413 - DNA, 16 bp, P. troglodytes
aaggattctcctgtct

SEQ ID NO: 191414 - DNA, 16 bp, P. troglodytes
aaggattcttttaaaa

SEQ ID NO: 191415 - DNA, 16 bp, P. troglodytes
aaggattgaaaaatta

SEQ ID NO: 191416 - DNA, 30 bp, P. troglodytes
aaggattgtaaatacaccaatcggcactct

SEQ ID NO: 191417 - DNA, 16 bp, P. troglodytes
aaggattgttttaaat

SEQ ID NO: 191418 - DNA, 17 bp, P. troglodytes
aaggatttagaaccaga

SEQ ID NO: 191419 - DNA, 16 bp, P. troglodytes
aaggattttaaagcag

SEQ ID NO: 191420 - DNA, 16 bp, P. troglodytes
aaggattttcttcctt

SEQ ID NO: 191421 - DNA, 16 bp, P. troglodytes
aaggattttgagatgg

SEQ ID NO: 191422 - DNA, 16 bp, P. troglodytes
aaggattttttttttc

SEQ ID NO: 191423 - DNA, 16 bp, P. troglodytes
aaggcaaaggggaggc

SEQ ID NO: 191424 - DNA, 16 bp, P. troglodytes
aaggcaaatggagtga

SEQ ID NO: 191425 - DNA, 16 bp, P. troglodytes
aaggcaagaatgccca

SEQ ID NO: 191426 - DNA, 16 bp, P. troglodytes
aaggcaagagttgagg

SEQ ID NO: 191427 - DNA, 16 bp, P. troglodytes
aaggcaaggagaagca

SEQ ID NO: 191428 - DNA, 17 bp, P. troglodytes
aaggcaaggaggagcaa

SEQ ID NO: 191429 - DNA, 16 bp, P. troglodytes
aaggcaagggcaaaat

SEQ ID NO: 191430 - DNA, 16 bp, P. troglodytes
aaggcaccatctatga

SEQ ID NO: 191431 - DNA, 16 bp, P. troglodytes
aaggcagaaaccaaga

SEQ ID NO: 191432 - DNA, 16 bp, P. troglodytes
aaggcagaaatcaata

SEQ ID NO: 191433 - DNA, 16 bp, P. troglodytes
aaggcagaaattaaaa

SEQ ID NO: 191434 - DNA, 16 bp, P. troglodytes
aaggcagacactccca

SEQ ID NO: 191435 - DNA, 16 bp, P. troglodytes
aaggcagagagcagag

SEQ ID NO: 191436 - DNA, 16 bp, P. troglodytes
aaggcagagattgggg

SEQ ID NO: 191437 - DNA, 16 bp, P. troglodytes
aaggcagagccaggat

SEQ ID NO: 191438 - DNA, 34 bp, P. troglodytes; identical to SEQ ID NO: 17618

SEQ ID NO: 191439 - DNA, 16 bp, P. troglodytes
aaggcagaggaatatt

SEQ ID NO: 191440 - DNA, 16 bp, P. troglodytes
aaggcagaggcaggaa

SEQ ID NO: 191441 - DNA, 16 bp, P. troglodytes
aaggcagcagaaacct

SEQ ID NO: 191442 - DNA, 16 bp, P. troglodytes
aaggcagcagaaactt

SEQ ID NO: 191443 - DNA, 16 bp, P. troglodytes
aaggcagcagccaggc

SEQ ID NO: 191444 - DNA, 17 bp, P. troglodytes
aaggcagcagccccagt

SEQ ID NO: 191445 - DNA, 16 bp, P. troglodytes
aaggcagcagtgagcc

SEQ ID NO: 191446 - DNA, 16 bp, P. troglodytes
aaggcagccaggaggg

SEQ ID NO: 191447 - DNA, 21 bp, P. troglodytes
aaggcagcgtgtccggagttt

SEQ ID NO: 191448 - DNA, 16 bp, P. troglodytes
aaggcagctctctgca

SEQ ID NO: 191449 - DNA, 16 bp, P. troglodytes
aaggcaggaacaggcc

SEQ ID NO: 191450 - DNA, 16 bp, P. troglodytes
aaggcaggagaagatg

SEQ ID NO: 191451 - DNA, 24 bp, P. troglodytes
aaggcaggagaatcgcttgaacct

SEQ ID NO: 191452 - DNA, 16 bp, P. troglodytes
aaggcaggaggaccac

SEQ ID NO: 191453 - DNA, 16 bp, P. troglodytes
aaggcaggaggactgc

SEQ ID NO: 191454 - DNA, 17 bp, P. troglodytes
aaggcaggaggattact

SEQ ID NO: 191455 - DNA, 16 bp, P. troglodytes
aaggcaggaggcagag

SEQ ID NO: 191456 - DNA, 16 bp, P. troglodytes
aaggcaggaggcagga

SEQ ID NO: 191457 - DNA, 16 bp, P. troglodytes
aaggcaggcatggtgg

SEQ ID NO: 191458 - DNA, 16 bp, P. troglodytes
aaggcagtggttgcag

SEQ ID NO: 191459 - DNA, 16 bp, P. troglodytes
aaggcagtgtgtagag

SEQ ID NO: 191460 - DNA, 16 bp, P. troglodytes
aaggcataaaaatgta

SEQ ID NO: 191461 - DNA, 16 bp, P. troglodytes
aaggcatacatgcagc

SEQ ID NO: 191462 - DNA, 16 bp, P. troglodytes
aaggcatggaggtggg

SEQ ID NO: 191463 - DNA, 16 bp, P. troglodytes
aaggcatgtgggaagg

SEQ ID NO: 191464 - DNA, 16 bp, P. troglodytes
aaggcattggtcaagg

SEQ ID NO: 191465 - DNA, 16 bp, P. troglodytes
aaggcatttaacaaaa

SEQ ID NO: 191466 - DNA, 16 bp, P. troglodytes
aaggcatttttcaaaa

SEQ ID NO: 191467 - DNA, 16 bp, P. troglodytes
aaggccaaggagggag

SEQ ID NO: 191468 - DNA, 16 bp, P. troglodytes
aaggccaaggccaagg

SEQ ID NO: 191469 - DNA, 16 bp, P. troglodytes
aaggccaaggctgcag

SEQ ID NO: 191470 - DNA, 16 bp, P. troglodytes
aaggccaataactctt

SEQ ID NO: 191471 - DNA, 16 bp, P. troglodytes
aaggccacacagccag

SEQ ID NO: 191472 - DNA, 16 bp, P. troglodytes
aaggccagcaatatac

SEQ ID NO: 191473 - DNA, 16 bp, P. troglodytes
aaggccagcctgggaa

SEQ ID NO: 191474 - DNA, 16 bp, P. troglodytes
aaggccaggcatggtg

SEQ ID NO: 191475 - DNA, 16 bp, P. troglodytes
aaggccaggctgagga

SEQ ID NO: 191476 - DNA, 16 bp, P. troglodytes
aaggccatatttcaga

SEQ ID NO: 191477 - DNA, 16 bp, P. troglodytes
aaggccatctatgaca

SEQ ID NO: 191478 - DNA, 16 bp, P. troglodytes
aaggcccaagagcccc

SEQ ID NO: 191479 - DNA, 16 bp, P. troglodytes
aaggcccagctaattt

SEQ ID NO: 191480 - DNA, 16 bp, P. troglodytes
aaggccccaccttcta

SEQ ID NO: 191481 - DNA, 17 bp, P. troglodytes
aaggccctccggttctg

SEQ ID NO: 191482 - DNA, 16 bp, P. troglodytes
aaggccctcttcctgg

SEQ ID NO: 191483 - DNA, 16 bp, P. troglodytes
aaggccctgaggcaga

SEQ ID NO: 191484 - DNA, 16 bp, P. troglodytes
aaggcccttgccagat

SEQ ID NO: 191485 - DNA, 16 bp, P. troglodytes
aaggccgagaagcaat

SEQ ID NO: 191486 - DNA, 16 bp, P. troglodytes
aaggccgaggaggcac

SEQ ID NO: 191487 - DNA, 16 bp, P. troglodytes
aaggccgaggcaggtg

SEQ ID NO: 191488 - DNA, 21 bp, P. troglodytes
aaggccgggcacggtggctca

SEQ ID NO: 191489 - DNA, 16 bp, P. troglodytes
aaggcctcagaagaaa

SEQ ID NO: 191490 - DNA, 16 bp, P. troglodytes
aaggcctcagggtcct

SEQ ID NO: 191491 - DNA, 16 bp, P. troglodytes
aaggcctccctagcca

SEQ ID NO: 191492 - DNA, 16 bp, P. troglodytes
aaggcctcctggagga

SEQ ID NO: 191493 - DNA, 16 bp, P. troglodytes
aaggcctctctgaaga

SEQ ID NO: 191494 - DNA, 16 bp, P. troglodytes
aaggcctgaagcctgg

SEQ ID NO: 191495 - DNA, 16 bp, P. troglodytes
aaggcctgagagtccc

SEQ ID NO: 191496 - DNA, 16 bp, P. troglodytes
aaggcctggaatcagg

SEQ ID NO: 191497 - DNA, 16 bp, P. troglodytes
aaggcctgtgacaaaa

SEQ ID NO: 191498 - DNA, 16 bp, P. troglodytes
aaggccttcaacaaaa

SEQ ID NO: 191499 - DNA, 16 bp, P. troglodytes
aaggcctttttaaaaa

SEQ ID NO: 191500 - DNA, 19 bp, P. troglodytes
aaggcggaggttgcagtga

SEQ ID NO: 191501 - DNA, 23 bp, P. troglodytes
aaggcgggcagatcacttgaggc

SEQ ID NO: 191502 - DNA, 16 bp, P. troglodytes
aaggcggggcacagtg

SEQ ID NO: 191503 - DNA, 20 bp, P. troglodytes
aaggcgggtggatcacctga

SEQ ID NO: 191504 - DNA, 16 bp, P. troglodytes
aaggctaaggtaggag

SEQ ID NO: 191505 - DNA, 16 bp, P. troglodytes
aaggctattttttaaa

SEQ ID NO: 191506 - DNA, 16 bp, P. troglodytes
aaggctctatctcaaa

SEQ ID NO: 191507 - DNA, 16 bp, P. troglodytes
aaggctgaatattatt

SEQ ID NO: 191508 - DNA, 16 bp, P. troglodytes
aaggctgacctggcta

SEQ ID NO: 191509 - DNA, 16 bp, P. troglodytes
aaggctgaggcaggag

SEQ ID NO: 191510 - DNA, 19 bp, P. troglodytes
aaggctgaggcaggagaat

SEQ ID NO: 191511 - DNA, 19 bp, P. troglodytes
aaggctgaggcgggcggat

SEQ ID NO: 191512 - DNA, 18 bp, P. troglodytes
aaggctgaggtaggagaa

SEQ ID NO: 191513 - DNA, 16 bp, P. troglodytes
aaggctgaggtggaag

SEQ ID NO: 191514 - DNA, 16 bp, P. troglodytes
aaggctgaggtggcag

SEQ ID NO: 191515 - DNA, 16 bp, P. troglodytes
aaggctgcagtgagcc

SEQ ID NO: 191516 - DNA, 16 bp, P. troglodytes
aaggctgcagtgaggc

SEQ ID NO: 191517 - DNA, 16 bp, P. troglodytes
aaggctgcctggagga

SEQ ID NO: 191518 - DNA, 16 bp, P. troglodytes
aaggctgctgtgagga

SEQ ID NO: 191519 - DNA, 16 bp, P. troglodytes
aaggctgctgttcaga

SEQ ID NO: 191520 - DNA, 16 bp, P. troglodytes
aaggctggaaagtcca

SEQ ID NO: 191521 - DNA, 16 bp, P. troglodytes
aaggctggaatgcagt

SEQ ID NO: 191522 - DNA, 16 bp, P. troglodytes
aaggctggacacagtg

SEQ ID NO: 191523 - DNA, 17 bp, P. troglodytes
aaggctggagtgcagtg

SEQ ID NO: 191524 - DNA, 16 bp, P. troglodytes
aaggctggggtgggag

SEQ ID NO: 191525 - DNA, 17 bp, P. troglodytes
aaggctggtcttgaact

SEQ ID NO: 191526 - DNA, 23 bp, P. troglodytes
aaggctgtcacttcacacttgga

SEQ ID NO: 191527 - DNA, 16 bp, P. troglodytes
aaggcttccctgagga

SEQ ID NO: 191528 - DNA, 16 bp, P. troglodytes
aaggcttcctggaaga

SEQ ID NO: 191529 - DNA, 16 bp, P. troglodytes
aaggcttcctggagga

SEQ ID NO: 191530 - DNA, 16 bp, P. troglodytes
aaggcttcttggaaga

SEQ ID NO: 191531 - DNA, 16 bp, P. troglodytes
aaggcttgagaaccag

SEQ ID NO: 191532 - DNA, 16 bp, P. troglodytes
aaggctttcaattttt

SEQ ID NO: 191533 - DNA, 16 bp, P. troglodytes
aaggctttcagttttc

SEQ ID NO: 191534 - DNA, 16 bp, P. troglodytes
aaggctttccagatat

SEQ ID NO: 191535 - DNA, 16 bp, P. troglodytes
aaggctttctggaaga

SEQ ID NO: 191536 - DNA, 16 bp, P. troglodytes
aaggctttgccacatt

SEQ ID NO: 191537 - DNA, 16 bp, P. troglodytes
aagggaaaatatattt

SEQ ID NO: 191538 - DNA, 16 bp, P. troglodytes
aagggaaacccatcag

SEQ ID NO: 191539 - DNA, 16 bp, P. troglodytes
aagggaaactttcaca

SEQ ID NO: 191540 - DNA, 16 bp, P. troglodytes
aagggaaagcaaggca

SEQ ID NO: 191541 - DNA, 16 bp, P. troglodytes
aagggaaatgtggggt

SEQ ID NO: 191542 - DNA, 17 bp, P. troglodytes
aagggaacaaaactgga

SEQ ID NO: 191543 - DNA, 16 bp, P. troglodytes
aagggaacagaataaa

SEQ ID NO: 191544 - DNA, 16 bp, P. troglodytes
aagggaacagcatgtg

SEQ ID NO: 191545 - DNA, 16 bp, P. troglodytes
aagggaagcaaagcat

SEQ ID NO: 191546 - DNA, 16 bp, P. troglodytes
aagggaaggaaattct

SEQ ID NO: 191547 - DNA, 16 bp, P. troglodytes
aagggaaggagattct

SEQ ID NO: 191548 - DNA, 16 bp, P. troglodytes
aagggaataacagaca

SEQ ID NO: 191549 - DNA, 16 bp, P. troglodytes
aagggaattcttccag

SEQ ID NO: 191550 - DNA, 16 bp, P. troglodytes
aagggacagactgcct

SEQ ID NO: 191551 - DNA, 16 bp, P. troglodytes
aagggacataccttaa

SEQ ID NO: 191552 - DNA, 16 bp, P. troglodytes
aagggaccttagagat

SEQ ID NO: 191553 - DNA, 16 bp, P. troglodytes
aagggacttgaataga

SEQ ID NO: 191554 - DNA, 16 bp, P. troglodytes
aagggacttgcccaag

SEQ ID NO: 191555 - DNA, 16 bp, P. troglodytes
aagggactttgcaggt

SEQ ID NO: 191556 - DNA, 16 bp, P. troglodytes
aagggagaaattggaa

SEQ ID NO: 191557 - DNA, 16 bp, P. troglodytes
aagggagggacctagt

SEQ ID NO: 191558 - DNA, 16 bp, P. troglodytes
aagggagtcttgctct

SEQ ID NO: 191559 - DNA, 16 bp, P. troglodytes
aagggagttcttcaag

SEQ ID NO: 191560 - DNA, 16 bp, P. troglodytes
aagggatatttgagag

SEQ ID NO: 191561 - DNA, 16 bp, P. troglodytes
aagggatattttggag

SEQ ID NO: 191562 - DNA, 16 bp, P. troglodytes
aagggatcctccctcc

SEQ ID NO: 191563 - DNA, 16 bp, P. troglodytes
aagggatctgcccacc

SEQ ID NO: 191564 - DNA, 16 bp, P. troglodytes
aagggattttttaaaa

SEQ ID NO: 191565 - DNA, 16 bp, P. troglodytes
aagggcaaatctaaaa

SEQ ID NO: 191566 - DNA, 16 bp, P. troglodytes
aagggcactaatccca

SEQ ID NO: 191567 - DNA, 16 bp, P. troglodytes
aagggcagagggccag

SEQ ID NO: 191568 - DNA, 16 bp, P. troglodytes
aagggcagagtcctca

SEQ ID NO: 191569 - DNA, 16 bp, P. troglodytes
aagggcaggagaagac

SEQ ID NO: 191570 - DNA, 16 bp, P. troglodytes
aagggcagttcctctg

SEQ ID NO: 191571 - DNA, 16 bp, P. troglodytes
aagggctatgggagtt

SEQ ID NO: 191572 - DNA, 16 bp, P. troglodytes
aagggctccttaccca

SEQ ID NO: 191573 - DNA, 19 bp, P. troglodytes
aagggctgaggagtgcggg

SEQ ID NO: 191574 - DNA, 16 bp, P. troglodytes
aaggggaaaaaaaatc

SEQ ID NO: 191575 - DNA, 16 bp, P. troglodytes
aaggggaaaaaaatca

SEQ ID NO: 191576 - DNA, 16 bp, P. troglodytes
aaggggaaacaaggca

SEQ ID NO: 191577 - DNA, 16 bp, P. troglodytes
aaggggaaactgaggc

SEQ ID NO: 191578 - DNA, 16 bp, P. troglodytes
aaggggaatacttcca

SEQ ID NO: 191579 - DNA, 16 bp, P. troglodytes
aaggggaatttttttt

SEQ ID NO: 191580 - DNA, 16 bp, P. troglodytes
aaggggacccaagtgg

SEQ ID NO: 191581 - DNA, 16 bp, P. troglodytes
aaggggaccccagaga

SEQ ID NO: 191582 - DNA, 16 bp, P. troglodytes
aaggggacttcaaaaa

SEQ ID NO: 191583 - DNA, 16 bp, P. troglodytes
aaggggccaggagcca

SEQ ID NO: 191584 - DNA, 16 bp, P. troglodytes
aaggggctacatgccc

SEQ ID NO: 191585 - DNA, 16 bp, P. troglodytes
aaggggcttcctcctt

SEQ ID NO: 191586 - DNA, 16 bp, P. troglodytes
aaggggcttctccctt

SEQ ID NO: 191587 - DNA, 16 bp, P. troglodytes
aagggggagcaggtgt

SEQ ID NO: 191588 - DNA, 16 bp, P. troglodytes
aagggggcaaaggaca

SEQ ID NO: 191589 - DNA, 16 bp, P. troglodytes
aaggggtggaaaaata

SEQ ID NO: 191590 - DNA, 16 bp, P. troglodytes
aaggggtggctgtggg

SEQ ID NO: 191591 - DNA, 16 bp, P. troglodytes
aaggggttaatatcca

SEQ ID NO: 191592 - DNA, 16 bp, P. troglodytes
aagggtctccctctgt

SEQ ID NO: 191593 - DNA, 17 bp, P. troglodytes
aagggtctgtgctgagg

SEQ ID NO: 191594 - DNA, 16 bp, P. troglodytes
aagggtgcaagcccca

SEQ ID NO: 191595 - DNA, 16 bp, P. troglodytes
aagggtgggatcctct

SEQ ID NO: 191596 - DNA, 16 bp, P. troglodytes
aagggttttttttctt

SEQ ID NO: 191597 - DNA, 16 bp, P. troglodytes
aaggtaaaagctattg

SEQ ID NO: 191598 - DNA, 16 bp, P. troglodytes
aaggtaagctccatga

SEQ ID NO: 191599 - DNA, 16 bp, P. troglodytes
aaggtactcaacatca

SEQ ID NO: 191600 - DNA, 16 bp, P. troglodytes
aaggtagaaacaaccc

SEQ ID NO: 191601 - DNA, 16 bp, P. troglodytes
aaggtagagtaaaaat

SEQ ID NO: 191602 - DNA, 16 bp, P. troglodytes
aaggtaggtactgtta

SEQ ID NO: 191603 - DNA, 16 bp, P. troglodytes
aaggtattttgtagat

SEQ ID NO: 191604 - DNA, 16 bp, P. troglodytes
aaggtcaaggggccac

SEQ ID NO: 191605 - DNA, 16 bp, P. troglodytes
aaggtcaatgggaaac

SEQ ID NO: 191606 - DNA, 16 bp, P. troglodytes
aaggtcaatgtgaaag

SEQ ID NO: 191607 - DNA, 16 bp, P. troglodytes
aaggtcacacaactgg

SEQ ID NO: 191608 - DNA, 16 bp, P. troglodytes
aaggtcacacagttaa

SEQ ID NO: 191609 - DNA, 16 bp, P. troglodytes
aaggtcacacctcaag

SEQ ID NO: 191610 - DNA, 16 bp, P. troglodytes
aaggtcacatttacag

SEQ ID NO: 191611 - DNA, 16 bp, P. troglodytes
aaggtcacgtgggtca

SEQ ID NO: 191612 - DNA, 16 bp, P. troglodytes
aaggtcagaaagacct

SEQ ID NO: 191613 - DNA, 16 bp, P. troglodytes
aaggtcagcagatcaa

SEQ ID NO: 191614 - DNA, 20 bp, P. troglodytes
aaggtcaggagttcaagaca

SEQ ID NO: 191615 - DNA, 16 bp, P. troglodytes
aaggtcatacagctaa

SEQ ID NO: 191616 - DNA, 16 bp, P. troglodytes
aaggtcatacagctag

SEQ ID NO: 191617 - DNA, 16 bp, P. troglodytes
aaggtcatgcagctgg

SEQ ID NO: 191618 - DNA, 16 bp, P. troglodytes
aaggtccaggctgagg

SEQ ID NO: 191619 - DNA, 16 bp, P. troglodytes
aaggtcccatctccaa

SEQ ID NO: 191620 - DNA, 16 bp, P. troglodytes
aaggtccctgtcctca

SEQ ID NO: 191621 - DNA, 16 bp, P. troglodytes
aaggtcctggaagagg

SEQ ID NO: 191622 - DNA, 16 bp, P. troglodytes
aaggtcgggcatggtg

SEQ ID NO: 191623 - DNA, 16 bp, P. troglodytes
aaggtctctctctctc

SEQ ID NO: 191624 - DNA, 16 bp, P. troglodytes
aaggtctctctgtgtt

SEQ ID NO: 191625 - DNA, 16 bp, P. troglodytes
aaggtctgatttttca

SEQ ID NO: 191626 - DNA, 16 bp, P. troglodytes
aaggtcttgctctgtc

SEQ ID NO: 191627 - DNA, 16 bp, P. troglodytes
aaggtcttgctttgtt

SEQ ID NO: 191628 - DNA, 16 bp, P. troglodytes
aaggtgaaaccctgtc

SEQ ID NO: 191629 - DNA, 16 bp, P. troglodytes
aaggtgaagagggagc

SEQ ID NO: 191630 - DNA, 16 bp, P. troglodytes
aaggtgaagggaaagc

SEQ ID NO: 191631 - DNA, 16 bp, P. troglodytes
aaggtgatgctggcct

SEQ ID NO: 191632 - DNA, 16 bp, P. troglodytes
aaggtgattttaaaaa

SEQ ID NO: 191633 - DNA, 16 bp, P. troglodytes
aaggtgctggcagatc

SEQ ID NO: 191634 - DNA, 16 bp, P. troglodytes
aaggtggaaaaggcaa

SEQ ID NO: 191635 - DNA, 16 bp, P. troglodytes
aaggtggagggtgcag

SEQ ID NO: 191636 - DNA, 16 bp, P. troglodytes
aaggtggaggtggcag

SEQ ID NO: 191637 - DNA, 16 bp, P. troglodytes
aaggtggatggaagag

SEQ ID NO: 191638 - DNA, 16 bp, P. troglodytes
aaggtggcagagctgg

SEQ ID NO: 191639 - DNA, 16 bp, P. troglodytes
aaggtggcagcagggc

SEQ ID NO: 191640 - DNA, 16 bp, P. troglodytes
aaggtggcaggagtgg

SEQ ID NO: 191641 - DNA, 16 bp, P. troglodytes
aaggtggcatggaccc

SEQ ID NO: 191642 - DNA, 16 bp, P. troglodytes
aaggtgggaggaccac

SEQ ID NO: 191643 - DNA, 17 bp, P. troglodytes
aaggtgggcggatcact

SEQ ID NO: 191644 - DNA, 16 bp, P. troglodytes
aaggtgggtggaacac

SEQ ID NO: 191645 - DNA, 16 bp, P. troglodytes
aaggtggtttagtttt

SEQ ID NO: 191646 - DNA, 16 bp, P. troglodytes
aaggtggttttataat

SEQ ID NO: 191647 - DNA, 16 bp, P. troglodytes
aaggtgtaagaaaggg

SEQ ID NO: 191648 - DNA, 16 bp, P. troglodytes
aaggtgtatggaaggg

SEQ ID NO: 191649 - DNA, 16 bp, P. troglodytes
aaggtgtcaacagggt

SEQ ID NO: 191650 - DNA, 16 bp, P. troglodytes
aaggtgtcagactctc

SEQ ID NO: 191651 - DNA, 16 bp, P. troglodytes
aaggtgtccaagaaga

SEQ ID NO: 191652 - DNA, 16 bp, P. troglodytes
aaggtgttgggattat

SEQ ID NO: 191653 - DNA, 16 bp, P. troglodytes
aaggttaagtgaggtc

SEQ ID NO: 191654 - DNA, 16 bp, P. troglodytes
aaggttgaggaccact

SEQ ID NO: 191655 - DNA, 16 bp, P. troglodytes
aaggttgcagtgaacc

SEQ ID NO: 191656 - DNA, 16 bp, P. troglodytes
aaggttgcagtgagcc

SEQ ID NO: 191657 - DNA, 16 bp, P. troglodytes
aaggttgcagtgagtt

SEQ ID NO: 191658 - DNA, 16 bp, P. troglodytes
aaggttgcagtgggcc

SEQ ID NO: 191659 - DNA, 16 bp, P. troglodytes
aaggttgtagtgagct

SEQ ID NO: 191660 - DNA, 16 bp, P. troglodytes
aaggtttgctgagggc

SEQ ID NO: 191661 - DNA, 16 bp, P. troglodytes
aaggtttgtaaaggca

SEQ ID NO: 191662 - DNA, 16 bp, P. troglodytes
aaggtttgttcaacat

SEQ ID NO: 191663 - DNA, 16 bp, P. troglodytes
aaggtttttaacttga

SEQ ID NO: 191664 - DNA, 16 bp, P. troglodytes
aagtaaaacaattttt

SEQ ID NO: 191665 - DNA, 16 bp, P. troglodytes
aagtaaaacatttaaa

SEQ ID NO: 191666 - DNA, 16 bp, P. troglodytes
aagtaaaactgtcttt

SEQ ID NO: 191667 - DNA, 16 bp, P. troglodytes
aagtaaaagttgaaat

SEQ ID NO: 191668 - DNA, 16 bp, P. troglodytes
aagtaaaataattttc

SEQ ID NO: 191669 - DNA, 16 bp, P. troglodytes
aagtaaaattgtattt

SEQ ID NO: 191670 - DNA, 16 bp, P. troglodytes
aagtaaaggcctttcc

SEQ ID NO: 191671 - DNA, 16 bp, P. troglodytes
aagtaaatgacagaat

SEQ ID NO: 191672 - DNA, 16 bp, P. troglodytes
aagtaacctgatgtta

SEQ ID NO: 191673 - DNA, 16 bp, P. troglodytes
aagtaacttaacctct

SEQ ID NO: 191674 - DNA, 16 bp, P. troglodytes
aagtaacttgccaaag

SEQ ID NO: 191675 - DNA, 16 bp, P. troglodytes
aagtaacttgcctgaa

SEQ ID NO: 191676 - DNA, 16 bp, P. troglodytes
aagtaactttacagtg

SEQ ID NO: 191677 - DNA, 16 bp, P. troglodytes
aagtaagcctcttccc

SEQ ID NO: 191678 - DNA, 16 bp, P. troglodytes
aagtaagctagagaaa

SEQ ID NO: 191679 - DNA, 16 bp, P. troglodytes
aagtaagtaaggaagg

SEQ ID NO: 191680 - DNA, 16 bp, P. troglodytes
aagtaagttctttgaa

SEQ ID NO: 191681 - DNA, 16 bp, P. troglodytes
aagtaatctacctgcc

SEQ ID NO: 191682 - DNA, 16 bp, P. troglodytes
aagtaattgcaggttt

SEQ ID NO: 191683 - DNA, 16 bp, P. troglodytes
aagtaatttcttctta

SEQ ID NO: 191684 - DNA, 16 bp, P. troglodytes
aagtaatttgcccaag

SEQ ID NO: 191685 - DNA, 16 bp, P. troglodytes
aagtaattttcttttt

SEQ ID NO: 191686 - DNA, 16 bp, P. troglodytes
aagtaatttttttcta

SEQ ID NO: 191687 - DNA, 16 bp, P. troglodytes
aagtacaaatattagc

SEQ ID NO: 191688 - DNA, 16 bp, P. troglodytes
aagtacaagaagatta

SEQ ID NO: 191689 - DNA, 16 bp, P. troglodytes
aagtacaaggtgaagc

SEQ ID NO: 191690 - DNA, 16 bp, P. troglodytes
aagtacacactcaaga

SEQ ID NO: 191691 - DNA, 16 bp, P. troglodytes
aagtacactctatgat

SEQ ID NO: 191692 - DNA, 16 bp, P. troglodytes
aagtacagaaagacaa

SEQ ID NO: 191693 - DNA, 16 bp, P. troglodytes
aagtacagagagttcc

SEQ ID NO: 191694 - DNA, 16 bp, P. troglodytes
aagtacagtttctact

SEQ ID NO: 191695 - DNA, 16 bp, P. troglodytes
aagtacattctcaagg

SEQ ID NO: 191696 - DNA, 16 bp, P. troglodytes
aagtacattttttaaa

SEQ ID NO: 191697 - DNA, 16 bp, P. troglodytes
aagtaccacaaactgg

SEQ ID NO: 191698 - DNA, 16 bp, P. troglodytes
aagtacctactatgtg

SEQ ID NO: 191699 - DNA, 16 bp, P. troglodytes
aagtactgaaagaaaa

SEQ ID NO: 191700 - DNA, 16 bp, P. troglodytes
aagtactgcatgatct

SEQ ID NO: 191701 - DNA, 17 bp, P. troglodytes
aagtactgggattacaa

SEQ ID NO: 191702 - DNA, 16 bp, P. troglodytes
aagtacttaaaacaga

SEQ ID NO: 191703 - DNA, 16 bp, P. troglodytes
aagtactttttaaaaa

SEQ ID NO: 191704 - DNA, 16 bp, P. troglodytes
aagtagaaaaacattt

SEQ ID NO: 191705 - DNA, 16 bp, P. troglodytes
aagtagagactgggtt

SEQ ID NO: 191706 - DNA, 16 bp, P. troglodytes
aagtagattagtggtt

SEQ ID NO: 191707 - DNA, 16 bp, P. troglodytes
aagtagcagaacatgt

SEQ ID NO: 191708 - DNA, 16 bp, P. troglodytes
aagtagctgaaattac

SEQ ID NO: 191709 - DNA, 16 bp, P. troglodytes
aagtagctgagatgac

SEQ ID NO: 191710 - DNA, 20 bp, P. troglodytes
aagtagctgggacaacaggt

SEQ ID NO: 191711 - DNA, 17 bp, P. troglodytes
aagtagctgggaccaca

SEQ ID NO: 191712 - DNA, 16 bp, P. troglodytes
aagtagctgggactat

SEQ ID NO: 191713 - DNA, 17 bp, P. troglodytes
aagtagcttggactaca

SEQ ID NO: 191714 - DNA, 24 bp, P. troglodytes
aagtaggcttcagaaggtgggtaa

SEQ ID NO: 191715 - DNA, 16 bp, P. troglodytes
aagtagggaagctgac

SEQ ID NO: 191716 - DNA, 16 bp, P. troglodytes
aagtagtttttttttc

SEQ ID NO: 191717 - DNA, 16 bp, P. troglodytes
aagtataacatacata

SEQ ID NO: 191718 - DNA, 16 bp, P. troglodytes
aagtatacaattaaat

SEQ ID NO: 191719 - DNA, 16 bp, P. troglodytes
aagtatacaattcaat

SEQ ID NO: 191720 - DNA, 16 bp, P. troglodytes
aagtatacagttcaat

SEQ ID NO: 191721 - DNA, 16 bp, P. troglodytes
aagtatagtttctact

SEQ ID NO: 191722 - DNA, 16 bp, P. troglodytes
aagtatataaacattt

SEQ ID NO: 191723 - DNA, 16 bp, P. troglodytes
aagtatataagtatat

SEQ ID NO: 191724 - DNA, 16 bp, P. troglodytes
aagtatataatgcaaa

SEQ ID NO: 191725 - DNA, 16 bp, P. troglodytes
aagtatatatacatat

SEQ ID NO: 191726 - DNA, 16 bp, P. troglodytes
aagtatatgaaaaagt

SEQ ID NO: 191727 - DNA, 16 bp, P. troglodytes
aagtatatgaaaacat

SEQ ID NO: 191728 - DNA, 17 bp, P. troglodytes
aagtatatgaacagaca

SEQ ID NO: 191729 - DNA, 16 bp, P. troglodytes
aagtatattttaaaag

SEQ ID NO: 191730 - DNA, 16 bp, P. troglodytes
aagtatcaaaatatca

SEQ ID NO: 191731 - DNA, 17 bp, P. troglodytes
aagtatcaatagccgaa

SEQ ID NO: 191732 - DNA, 16 bp, P. troglodytes
aagtatcatgagatct

SEQ ID NO: 191733 - DNA, 16 bp, P. troglodytes
aagtatcatttaaaaa

SEQ ID NO: 191734 - DNA, 16 bp, P. troglodytes
aagtatctgggattat

SEQ ID NO: 191735 - DNA, 16 bp, P. troglodytes
aagtatgaaaatacat

SEQ ID NO: 191736 - DNA, 16 bp, P. troglodytes
aagtatgctcagcaaa

SEQ ID NO: 191737 - DNA, 16 bp, P. troglodytes
aagtatgtaaaatatt

SEQ ID NO: 191738 - DNA, 16 bp, P. troglodytes
aagtatgtcccaaata

SEQ ID NO: 191739 - DNA, 16 bp, P. troglodytes
aagtatgtctttatca

SEQ ID NO: 191740 - DNA, 16 bp, P. troglodytes
aagtatgtgaagaaaa

SEQ ID NO: 191741 - DNA, 16 bp, P. troglodytes
aagtatgtggaaatta

SEQ ID NO: 191742 - DNA, 16 bp, P. troglodytes
aagtattaacttacac

SEQ ID NO: 191743 - DNA, 16 bp, P. troglodytes
aagtattccctctgct

SEQ ID NO: 191744 - DNA, 16 bp, P. troglodytes
aagtattcccttttct

SEQ ID NO: 191745 - DNA, 16 bp, P. troglodytes
aagtattctgttataa

SEQ ID NO: 191746 - DNA, 16 bp, P. troglodytes
aagtattgccaaggaa

SEQ ID NO: 191747 - DNA, 16 bp, P. troglodytes
aagtatttaagtattt

SEQ ID NO: 191748 - DNA, 16 bp, P. troglodytes
aagtatttacaaaaca

SEQ ID NO: 191749 - DNA, 16 bp, P. troglodytes
aagtatttagcacagt

SEQ ID NO: 191750 - DNA, 16 bp, P. troglodytes
aagtatttagggataa

SEQ ID NO: 191751 - DNA, 16 bp, P. troglodytes
aagtatttattgagca

SEQ ID NO: 191752 - DNA, 16 bp, P. troglodytes
aagtatttattgggca

SEQ ID NO: 191753 - DNA, 16 bp, P. troglodytes
aagtatttcatttctc

SEQ ID NO: 191754 - DNA, 16 bp, P. troglodytes
aagtatttctatttct

SEQ ID NO: 191755 - DNA, 16 bp, P. troglodytes
aagtatttgaaaatat

SEQ ID NO: 191756 - DNA, 16 bp, P. troglodytes
aagtatttgaagaaaa

SEQ ID NO: 191757 - DNA, 16 bp, P. troglodytes
aagtatttgctgaatg

SEQ ID NO: 191758 - DNA, 16 bp, P. troglodytes
aagtatttgggtttct

SEQ ID NO: 191759 - DNA, 16 bp, P. troglodytes
aagtatttgtgtacct

SEQ ID NO: 191760 - DNA, 16 bp, P. troglodytes
aagtatttgtttaata

SEQ ID NO: 191761 - DNA, 16 bp, P. troglodytes
aagtatttgtttgaat

SEQ ID NO: 191762 - DNA, 16 bp, P. troglodytes
aagtattttatttcat

SEQ ID NO: 191763 - DNA, 16 bp, P. troglodytes
aagtattttctaattt

SEQ ID NO: 191764 - DNA, 16 bp, P. troglodytes
aagtattttctgattt

SEQ ID NO: 191765 - DNA, 16 bp, P. troglodytes
aagtattttcttaaaa

SEQ ID NO: 191766 - DNA, 16 bp, P. troglodytes
aagtattttggataag

SEQ ID NO: 191767 - DNA, 16 bp, P. troglodytes
aagtattttgttgagg

SEQ ID NO: 191768 - DNA, 16 bp, P. troglodytes
aagtcaaaatgaagaa

SEQ ID NO: 191769 - DNA, 16 bp, P. troglodytes
aagtcaaataccacat

SEQ ID NO: 191770 - DNA, 16 bp, P. troglodytes
aagtcaaatatcacat

SEQ ID NO: 191771 - DNA, 16 bp, P. troglodytes
aagtcaaattatctgt

SEQ ID NO: 191772 - DNA, 16 bp, P. troglodytes
aagtcaaattgtctgt

SEQ ID NO: 191773 - DNA, 16 bp, P. troglodytes
aagtcaacatgaagga

SEQ ID NO: 191774 - DNA, 16 bp, P. troglodytes
aagtcaactttttttt

SEQ ID NO: 191775 - DNA, 16 bp, P. troglodytes
aagtcacaaagattta

SEQ ID NO: 191776 - DNA, 16 bp, P. troglodytes
aagtcacacagctaat

SEQ ID NO: 191777 - DNA, 16 bp, P. troglodytes
aagtcacacagctagt

SEQ ID NO: 191778 - DNA, 16 bp, P. troglodytes
aagtcacatcttacat

SEQ ID NO: 191779 - DNA, 16 bp, P. troglodytes
aagtcacatgaccaag

SEQ ID NO: 191780 - DNA, 16 bp, P. troglodytes
aagtcacttaacctct

SEQ ID NO: 191781 - DNA, 16 bp, P. troglodytes
aagtcacttaaccttt

SEQ ID NO: 191782 - DNA, 16 bp, P. troglodytes
aagtcacttaacttct

SEQ ID NO: 191783 - DNA, 16 bp, P. troglodytes
aagtcacttaatctct

SEQ ID NO: 191784 - DNA, 16 bp, P. troglodytes
aagtcacttagcctct

SEQ ID NO: 191785 - DNA, 16 bp, P. troglodytes
aagtcacttgcccaag

SEQ ID NO: 191786 - DNA, 16 bp, P. troglodytes
aagtcagaaggagcca

SEQ ID NO: 191787 - DNA, 16 bp, P. troglodytes
aagtcagcagaaagaa

SEQ ID NO: 191788 - DNA, 16 bp, P. troglodytes
aagtcaggaatggaaa

SEQ ID NO: 191789 - DNA, 16 bp, P. troglodytes
aagtcaggcacaaaag

SEQ ID NO: 191790 - DNA, 16 bp, P. troglodytes
aagtcagtgtggccat

SEQ ID NO: 191791 - DNA, 16 bp, P. troglodytes
aagtcagttcctgggt

SEQ ID NO: 191792 - DNA, 16 bp, P. troglodytes
aagtcatcattctcag

SEQ ID NO: 191793 - DNA, 16 bp, P. troglodytes
aagtcatccatgagag

SEQ ID NO: 191794 - DNA, 16 bp, P. troglodytes
aagtcatgaaacaaca

SEQ ID NO: 191795 - DNA, 16 bp, P. troglodytes
aagtcatgaagatatt

SEQ ID NO: 191796 - DNA, 16 bp, P. troglodytes
aagtcattcatttaac

SEQ ID NO: 191797 - DNA, 16 bp, P. troglodytes
aagtcatttaacttct

SEQ ID NO: 191798 - DNA, 16 bp, P. troglodytes
aagtcatttaatctct

SEQ ID NO: 191799 - DNA, 16 bp, P. troglodytes
aagtcatttagcctct

SEQ ID NO: 191800 - DNA, 16 bp, P. troglodytes
aagtcatttatttgct

SEQ ID NO: 191801 - DNA, 16 bp, P. troglodytes
aagtcatttttcacag

SEQ ID NO: 191802 - DNA, 16 bp, P. troglodytes
aagtcatttttttaaa

SEQ ID NO: 191803 - DNA, 16 bp, P. troglodytes
aagtccaaagtctcat

SEQ ID NO: 191804 - DNA, 16 bp, P. troglodytes
aagtccaagatggagg

SEQ ID NO: 191805 - DNA, 16 bp, P. troglodytes
aagtccaagattaagg

SEQ ID NO: 191806 - DNA, 16 bp, P. troglodytes
aagtccacagtcaaaa

SEQ ID NO: 191807 - DNA, 16 bp, P. troglodytes
aagtccaggaccagac

SEQ ID NO: 191808 - DNA, 16 bp, P. troglodytes
aagtccaggctgaggt

SEQ ID NO: 191809 - DNA, 16 bp, P. troglodytes
aagtccagtgtttctt

SEQ ID NO: 191810 - DNA, 16 bp, P. troglodytes
aagtccatttgttgta

SEQ ID NO: 191811 - DNA, 16 bp, P. troglodytes
aagtcccagccagagc

SEQ ID NO: 191812 - DNA, 16 bp, P. troglodytes
aagtccccaccccacc

SEQ ID NO: 191813 - DNA, 16 bp, P. troglodytes
aagtccctaggctgca

SEQ ID NO: 191814 - DNA, 16 bp, P. troglodytes
aagtccctcccacaac

SEQ ID NO: 191815 - DNA, 16 bp, P. troglodytes
aagtccctgatataaa

SEQ ID NO: 191816 - DNA, 16 bp, P. troglodytes
aagtccctggaggaga

SEQ ID NO: 191817 - DNA, 16 bp, P. troglodytes
aagtcccttatataaa

SEQ ID NO: 191818 - DNA, 16 bp, P. troglodytes
aagtcccttattagat

SEQ ID NO: 191819 - DNA, 16 bp, P. troglodytes
aagtcctaacccccag

SEQ ID NO: 191820 - DNA, 16 bp, P. troglodytes
aagtcctaatccccaa

SEQ ID NO: 191821 - DNA, 16 bp, P. troglodytes
aagtcctagccacagc

SEQ ID NO: 191822 - DNA, 16 bp, P. troglodytes
aagtcctccaggtgat

SEQ ID NO: 191823 - DNA, 16 bp, P. troglodytes
aagtcctggctctgcc

SEQ ID NO: 191824 - DNA, 16 bp, P. troglodytes
aagtcctgggattgca

SEQ ID NO: 191825 - DNA, 16 bp, P. troglodytes
aagtcctttatcagat

SEQ ID NO: 191826 - DNA, 16 bp, P. troglodytes
aagtcctttcccatgc

SEQ ID NO: 191827 - DNA, 16 bp, P. troglodytes
aagtcgacaaaaacaa

SEQ ID NO: 191828 - DNA, 16 bp, P. troglodytes
aagtctaaacacaaaa

SEQ ID NO: 191829 - DNA, 16 bp, P. troglodytes
aagtctaatttttaaa

SEQ ID NO: 191830 - DNA, 16 bp, P. troglodytes
aagtctcaaaaaattt

SEQ ID NO: 191831 - DNA, 16 bp, P. troglodytes
aagtctcactctgtca

SEQ ID NO: 191832 - DNA, 16 bp, P. troglodytes
aagtctcactctgttg

SEQ ID NO: 191833 - DNA, 16 bp, P. troglodytes
aagtctccaagaagtt

SEQ ID NO: 191834 - DNA, 16 bp, P. troglodytes
aagtctcgctctgtca

SEQ ID NO: 191835 - DNA, 16 bp, P. troglodytes
aagtctcgctctgttg

SEQ ID NO: 191836 - DNA, 16 bp, P. troglodytes
aagtctcgctcttgtc

SEQ ID NO: 191837 - DNA, 16 bp, P. troglodytes
aagtctcgctgtgtca

SEQ ID NO: 191838 - DNA, 18 bp, P. troglodytes
aagtctctcgttccacct

SEQ ID NO: 191839 - DNA, 16 bp, P. troglodytes
aagtctcttttcttta

SEQ ID NO: 191840 - DNA, 16 bp, P. troglodytes
aagtctgaagtcaagg

SEQ ID NO: 191841 - DNA, 16 bp, P. troglodytes
aagtctgctgcaggag

SEQ ID NO: 191842 - DNA, 16 bp, P. troglodytes
aagtctggagttcaag

SEQ ID NO: 191843 - DNA, 16 bp, P. troglodytes
aagtctgtatatgttc

SEQ ID NO: 191844 - DNA, 16 bp, P. troglodytes
aagtcttatttatttt

SEQ ID NO: 191845 - DNA, 16 bp, P. troglodytes
aagtcttcaaaataat

SEQ ID NO: 191846 - DNA, 16 bp, P. troglodytes
aagtcttcaactatta

SEQ ID NO: 191847 - DNA, 16 bp, P. troglodytes
aagtcttcatttctct

SEQ ID NO: 191848 - DNA, 16 bp, P. troglodytes
aagtcttgaagtcaga

SEQ ID NO: 191849 - DNA, 16 bp, P. troglodytes
aagtcttgaagttggg

SEQ ID NO: 191850 - DNA, 16 bp, P. troglodytes
aagtcttgctctgtca

SEQ ID NO: 191851 - DNA, 16 bp, P. troglodytes
aagtcttgctttgtca

SEQ ID NO: 191852 - DNA, 16 bp, P. troglodytes
aagtctttctttcttt

SEQ ID NO: 191853 - DNA, 16 bp, P. troglodytes
aagtctttgaaatttg

SEQ ID NO: 191854 - DNA, 16 bp, P. troglodytes
aagtctttgatctttc

SEQ ID NO: 191855 - DNA, 16 bp, P. troglodytes
aagtctttgctcaaat

SEQ ID NO: 191856 - DNA, 16 bp, P. troglodytes
aagtctttttcatttt

SEQ ID NO: 191857 - DNA, 16 bp, P. troglodytes
aagtctttttcttcct

SEQ ID NO: 191858 - DNA, 16 bp, P. troglodytes
aagtgaaaaatacagt

SEQ ID NO: 191859 - DNA, 16 bp, P. troglodytes
aagtgaaaacaaatct

SEQ ID NO: 191860 - DNA, 16 bp, P. troglodytes
aagtgaaaacatgtgg

SEQ ID NO: 191861 - DNA, 16 bp, P. troglodytes
aagtgaaaagaaaact

SEQ ID NO: 191862 - DNA, 16 bp, P. troglodytes
aagtgaaaatagccag

SEQ ID NO: 191863 - DNA, 16 bp, P. troglodytes
aagtgaaagaaggcaa

SEQ ID NO: 191864 - DNA, 16 bp, P. troglodytes
aagtgaaagaagtcaa

SEQ ID NO: 191865 - DNA, 16 bp, P. troglodytes
aagtgaaagatttcta

SEQ ID NO: 191866 - DNA, 16 bp, P. troglodytes
aagtgaaattgctgga

SEQ ID NO: 191867 - DNA, 16 bp, P. troglodytes
aagtgaaatttagaag

SEQ ID NO: 191868 - DNA, 16 bp, P. troglodytes
aagtgaagaaactcag

SEQ ID NO: 191869 - DNA, 16 bp, P. troglodytes
aagtgaagagaggctg

SEQ ID NO: 191870 - DNA, 16 bp, P. troglodytes
aagtgaaggggaaata

SEQ ID NO: 191871 - DNA, 16 bp, P. troglodytes
aagtgaaggttgcagt

SEQ ID NO: 191872 - DNA, 16 bp, P. troglodytes
aagtgaagtgacttgc

SEQ ID NO: 191873 - DNA, 16 bp, P. troglodytes
aagtgaatgaagccag

SEQ ID NO: 191874 - DNA, 16 bp, P. troglodytes
aagtgactcttctgcc

SEQ ID NO: 191875 - DNA, 16 bp, P. troglodytes
aagtgactgttcatgt

SEQ ID NO: 191876 - DNA, 16 bp, P. troglodytes
aagtgacttgcccaag

SEQ ID NO: 191877 - DNA, 16 bp, P. troglodytes
aagtgacttgcctgag

SEQ ID NO: 191878 - DNA, 16 bp, P. troglodytes
aagtgacttgctcagg

SEQ ID NO: 191879 - DNA, 16 bp, P. troglodytes
aagtgacttgtccagg

SEQ ID NO: 191880 - DNA, 16 bp, P. troglodytes
aagtgagactccctct

SEQ ID NO: 191881 - DNA, 16 bp, P. troglodytes
aagtgagactccgtct

SEQ ID NO: 191882 - DNA, 16 bp, P. troglodytes
aagtgagagacatgtg

SEQ ID NO: 191883 - DNA, 17 bp, P. troglodytes
aagtgagccaagatcgc

SEQ ID NO: 191884 - DNA, 16 bp, P. troglodytes
aagtgagctcttgctc

SEQ ID NO: 191885 - DNA, 16 bp, P. troglodytes
aagtgaggagcgtctc

SEQ ID NO: 191886 - DNA, 16 bp, P. troglodytes
aagtgatacatgactg

SEQ ID NO: 191887 - DNA, 17 bp, P. troglodytes
aagtgatccacctgcca

SEQ ID NO: 191888 - DNA, 16 bp, P. troglodytes
aagtgatccttctccc

SEQ ID NO: 191889 - DNA, 16 bp, P. troglodytes
aagtgatgctggattt

SEQ ID NO: 191890 - DNA, 16 bp, P. troglodytes
aagtgatgctgggaaa

SEQ ID NO: 191891 - DNA, 16 bp, P. troglodytes
aagtgattatttaaaa

SEQ ID NO: 191892 - DNA, 16 bp, P. troglodytes
aagtgattgaaatcat

SEQ ID NO: 191893 - DNA, 16 bp, P. troglodytes
aagtgatttgctcaag

SEQ ID NO: 191894 - DNA, 16 bp, P. troglodytes
aagtgatttttctaaa

SEQ ID NO: 191895 - DNA, 16 bp, P. troglodytes
aagtgcaaaggccttg

SEQ ID NO: 191896 - DNA, 16 bp, P. troglodytes
aagtgcaaatcaaaac

SEQ ID NO: 191897 - DNA, 16 bp, P. troglodytes
aagtgcaatggcacca

SEQ ID NO: 191898 - DNA, 16 bp, P. troglodytes
aagtgcacaattcagt

SEQ ID NO: 191899 - DNA, 16 bp, P. troglodytes
aagtgcagagaagaaa

SEQ ID NO: 191900 - DNA, 16 bp, P. troglodytes
aagtgcagattctgat

SEQ ID NO: 191901 - DNA, 16 bp, P. troglodytes
aagtgcagttgtgtta

SEQ ID NO: 191902 - DNA, 16 bp, P. troglodytes
aagtgccacctcctgg

SEQ ID NO: 191903 - DNA, 16 bp, P. troglodytes
aagtgcctgctcctgc

SEQ ID NO: 191904 - DNA, 16 bp, P. troglodytes
aagtgcctggcacatg

SEQ ID NO: 191905 - DNA, 16 bp, P. troglodytes
aagtgcctgtaatccc

SEQ ID NO: 191906 - DNA, 16 bp, P. troglodytes
aagtgccttgcttccc

SEQ ID NO: 191907 - DNA, 16 bp, P. troglodytes
aagtgccttttttttt

SEQ ID NO: 191908 - DNA, 16 bp, P. troglodytes
aagtgctaaataaata

SEQ ID NO: 191909 - DNA, 16 bp, P. troglodytes
aagtgctagaagaaaa

SEQ ID NO: 191910 - DNA, 16 bp, P. troglodytes
aagtgctagggttaca

SEQ ID NO: 191911 - DNA, 16 bp, P. troglodytes
aagtgctcaataaatg

SEQ ID NO: 191912 - DNA, 16 bp, P. troglodytes
aagtgctcagtagtca

SEQ ID NO: 191913 - DNA, 16 bp, P. troglodytes
aagtgctcatcaacag

SEQ ID NO: 191914 - DNA, 16 bp, P. troglodytes
aagtgctctgaagaaa

SEQ ID NO: 191915 - DNA, 16 bp, P. troglodytes
aagtgctctgcctgcc

SEQ ID NO: 191916 - DNA, 16 bp, P. troglodytes
aagtgctgaaggaaaa

SEQ ID NO: 191917 - DNA, 16 bp, P. troglodytes
aagtgctgcacacttt

SEQ ID NO: 191918 - DNA, 16 bp, P. troglodytes
aagtgctggatttaca

SEQ ID NO: 191919 - DNA, 16 bp, P. troglodytes
aagtgctgggactgca

SEQ ID NO: 191920 - DNA, 16 bp, P. troglodytes
aagtgctgggagccac

SEQ ID NO: 191921 - DNA, 23 bp, P. troglodytes
aagtgctgggattataggcgtga

SEQ ID NO: 191922 - DNA, 16 bp, P. troglodytes
aagtgctgggattgag

SEQ ID NO: 191923 - DNA, 16 bp, P. troglodytes
aagtgctgtaattaca

SEQ ID NO: 191924 - DNA, 16 bp, P. troglodytes
aagtgctgtgattata

SEQ ID NO: 191925 - DNA, 16 bp, P. troglodytes
aagtgctgtgctttag

SEQ ID NO: 191926 - DNA, 16 bp, P. troglodytes
aagtgcttagattaca

SEQ ID NO: 191927 - DNA, 16 bp, P. troglodytes
aagtgcttagcatagt

SEQ ID NO: 191928 - DNA, 16 bp, P. troglodytes
aagtgctttttaaaaa

SEQ ID NO: 191929 - DNA, 16 bp, P. troglodytes
aagtggaaaaagcaaa

SEQ ID NO: 191930 - DNA, 16 bp, P. troglodytes
aagtggaactgctgga

SEQ ID NO: 191931 - DNA, 16 bp, P. troglodytes
aagtggaagacagtga

SEQ ID NO: 191932 - DNA, 16 bp, P. troglodytes
aagtggaagttgcagt

SEQ ID NO: 191933 - DNA, 16 bp, P. troglodytes
aagtggaatttctggg

SEQ ID NO: 191934 - DNA, 16 bp, P. troglodytes
aagtggaattttaaaa

SEQ ID NO: 191935 - DNA, 16 bp, P. troglodytes
aagtggacctgcacag

SEQ ID NO: 191936 - DNA, 16 bp, P. troglodytes
aagtggagaatttaat

SEQ ID NO: 191937 - DNA, 16 bp, P. troglodytes
aagtggaggagctggg

SEQ ID NO: 191938 - DNA, 16 bp, P. troglodytes
aagtggcagagccaga

SEQ ID NO: 191939 - DNA, 16 bp, P. troglodytes
aagtggcagagcccag

SEQ ID NO: 191940 - DNA, 16 bp, P. troglodytes
aagtggcagagtcagg

SEQ ID NO: 191941 - DNA, 16 bp, P. troglodytes
aagtggcagctaaaca

SEQ ID NO: 191942 - DNA, 16 bp, P. troglodytes
aagtggccaggcatgg

SEQ ID NO: 191943 - DNA, 16 bp, P. troglodytes
aagtggctgcatcatt

SEQ ID NO: 191944 - DNA, 17 bp, P. troglodytes
aagtggctgggattaca

SEQ ID NO: 191945 - DNA, 16 bp, P. troglodytes
aagtggctttggaact

SEQ ID NO: 191946 - DNA, 16 bp, P. troglodytes
aagtggctttggaatt

SEQ ID NO: 191947 - DNA, 16 bp, P. troglodytes
aagtgggagctgaaca

SEQ ID NO: 191948 - DNA, 16 bp, P. troglodytes
aagtgggaggatcgcc

SEQ ID NO: 191949 - DNA, 16 bp, P. troglodytes
aagtgggaggatcgct

SEQ ID NO: 191950 - DNA, 16 bp, P. troglodytes
aagtgggatttatttc

SEQ ID NO: 191951 - DNA, 16 bp, P. troglodytes
aagtgggatttgaaca

SEQ ID NO: 191952 - DNA, 16 bp, P. troglodytes
aagtgggcaaagaaca

SEQ ID NO: 191953 - DNA, 16 bp, P. troglodytes
aagtggggaaaagaca

SEQ ID NO: 191954 - DNA, 16 bp, P. troglodytes
aagtggggataataaa

SEQ ID NO: 191955 - DNA, 16 bp, P. troglodytes
aagtggtaaaagtggg

SEQ ID NO: 191956 - DNA, 16 bp, P. troglodytes
aagtggtagttgaaca

SEQ ID NO: 191957 - DNA, 16 bp, P. troglodytes
aagtggtatctcattg

SEQ ID NO: 191958 - DNA, 16 bp, P. troglodytes
aagtggtcaaaggaca

SEQ ID NO: 191959 - DNA, 17 bp, P. troglodytes
aagtggtgggattacag

SEQ ID NO: 191960 - DNA, 16 bp, P. troglodytes
aagtggtgggattcca

SEQ ID NO: 191961 - DNA, 16 bp, P. troglodytes
aagtggttctcccagc

SEQ ID NO: 191962 - DNA, 16 bp, P. troglodytes
aagtggttgtgccatt

SEQ ID NO: 191963 - DNA, 16 bp, P. troglodytes
aagtgtaattttgtta

SEQ ID NO: 191964 - DNA, 16 bp, P. troglodytes
aagtgtacaggaggat

SEQ ID NO: 191965 - DNA, 16 bp, P. troglodytes
aagtgtacatttcagt

SEQ ID NO: 191966 - DNA, 16 bp, P. troglodytes
aagtgtatagttcagt

SEQ ID NO: 191967 - DNA, 16 bp, P. troglodytes
aagtgtatgattcagt

SEQ ID NO: 191968 - DNA, 16 bp, P. troglodytes
aagtgtattttaaaat

SEQ ID NO: 191969 - DNA, 16 bp, P. troglodytes
aagtgtccaggaattt

SEQ ID NO: 191970 - DNA, 16 bp, P. troglodytes
aagtgtctattccagt

SEQ ID NO: 191971 - DNA, 16 bp, P. troglodytes
aagtgtctgtgcatgt

SEQ ID NO: 191972 - DNA, 16 bp, P. troglodytes
aagtgtgaagaatgtg

SEQ ID NO: 191973 - DNA, 16 bp, P. troglodytes
aagtgtgagccactga

SEQ ID NO: 191974 - DNA, 16 bp, P. troglodytes
aagtgtgcaatagcat

SEQ ID NO: 191975 - DNA, 16 bp, P. troglodytes
aagtgtgcattcatct

SEQ ID NO: 191976 - DNA, 16 bp, P. troglodytes
aagtgtggcacttcct

SEQ ID NO: 191977 - DNA, 16 bp, P. troglodytes
aagtgtgtataaaagt

SEQ ID NO: 191978 - DNA, 16 bp, P. troglodytes
aagtgtgtggcgcctc

SEQ ID NO: 191979 - DNA, 16 bp, P. troglodytes
aagtgtgtggtaattt

SEQ ID NO: 191980 - DNA, 16 bp, P. troglodytes
aagtgtgtgtgtgttt

SEQ ID NO: 191981 - DNA, 16 bp, P. troglodytes
aagtgtgttgtttaat

SEQ ID NO: 191982 - DNA, 16 bp, P. troglodytes
aagtgttacagttctt

SEQ ID NO: 191983 - DNA, 16 bp, P. troglodytes
aagtgttatctcattg

SEQ ID NO: 191984 - DNA, 16 bp, P. troglodytes
aagtgttatgaagaaa

SEQ ID NO: 191985 - DNA, 16 bp, P. troglodytes
aagtgttccctcttca

SEQ ID NO: 191986 - DNA, 16 bp, P. troglodytes
aagtgttccctttttc

SEQ ID NO: 191987 - DNA, 16 bp, P. troglodytes
aagtgttgacaaggat

SEQ ID NO: 191988 - DNA, 16 bp, P. troglodytes
aagtgttgggattata

SEQ ID NO: 191989 - DNA, 16 bp, P. troglodytes
aagtgtttacatcaga

SEQ ID NO: 191990 - DNA, 16 bp, P. troglodytes
aagtgtttattttaaa

SEQ ID NO: 191991 - DNA, 16 bp, P. troglodytes
aagtgtttcaaatttt

SEQ ID NO: 191992 - DNA, 16 bp, P. troglodytes
aagtgtttcagatttt

SEQ ID NO: 191993 - DNA, 16 bp, P. troglodytes
aagtgtttccttttct

SEQ ID NO: 191994 - DNA, 16 bp, P. troglodytes
aagtgtttggaagttc

SEQ ID NO: 191995 - DNA, 16 bp, P. troglodytes
aagtgtttttcctttt

SEQ ID NO: 191996 - DNA, 16 bp, P. troglodytes
aagttaaaaacatttt

SEQ ID NO: 191997 - DNA, 16 bp, P. troglodytes
aagttaaaaacttctg

SEQ ID NO: 191998 - DNA, 16 bp, P. troglodytes
aagttaaaaagcaagg

SEQ ID NO: 191999 - DNA, 16 bp, P. troglodytes
aagttaaaaagctttt

SEQ ID NO: 192000 - DNA, 16 bp, P. troglodytes
aagttaaaaatcttga

SEQ ID NO: 192001 - DNA, 16 bp, P. troglodytes
aagttaaaaccacaat

SEQ ID NO: 192002 - DNA, 16 bp, P. troglodytes
aagttaaacatacagt

SEQ ID NO: 192003 - DNA, 16 bp, P. troglodytes
aagttaaacattaaaa

SEQ ID NO: 192004 - DNA, 16 bp, P. troglodytes
aagttaaataagccag

SEQ ID NO: 192005 - DNA, 16 bp, P. troglodytes
aagttaactcaagatg

SEQ ID NO: 192006 - DNA, 16 bp, P. troglodytes
aagttaatattgttaa

SEQ ID NO: 192007 - DNA, 16 bp, P. troglodytes
aagttaattttccaaa

SEQ ID NO: 192008 - DNA, 16 bp, P. troglodytes
aagttacagtgagcca

SEQ ID NO: 192009 - DNA, 16 bp, P. troglodytes
aagttacttcacctct

SEQ ID NO: 192010 - DNA, 16 bp, P. troglodytes
aagttagccaggcatg

SEQ ID NO: 192011 - DNA, 18 bp, P. troglodytes
aagttagctgggcgtggt

SEQ ID NO: 192012 - DNA, 16 bp, P. troglodytes
aagttaggttgcagtt

SEQ ID NO: 192013 - DNA, 16 bp, P. troglodytes
aagttagtagaagaaa

SEQ ID NO: 192014 - DNA, 16 bp, P. troglodytes
aagttatagattcaat

SEQ ID NO: 192015 - DNA, 16 bp, P. troglodytes
aagttatgtttacact

SEQ ID NO: 192016 - DNA, 16 bp, P. troglodytes
aagttattgctatcag

SEQ ID NO: 192017 - DNA, 16 bp, P. troglodytes
aagttattgtttaatg

SEQ ID NO: 192018 - DNA, 16 bp, P. troglodytes
aagttatttaacctct

SEQ ID NO: 192019 - DNA, 16 bp, P. troglodytes
aagttatttttcaaaa

SEQ ID NO: 192020 - DNA, 16 bp, P. troglodytes
aagttcaaaaccagcc

SEQ ID NO: 192021 - DNA, 16 bp, P. troglodytes
aagttcaagaccaccc

SEQ ID NO: 192022 - DNA, 16 bp, P. troglodytes
aagttcaagaccagca

SEQ ID NO: 192023 - DNA, 16 bp, P. troglodytes
aagttcaagaccagct

SEQ ID NO: 192024 - DNA, 16 bp, P. troglodytes
aagttcaagatcaaga

SEQ ID NO: 192025 - DNA, 16 bp, P. troglodytes
aagttcaagatcaggg

SEQ ID NO: 192026 - DNA, 16 bp, P. troglodytes
aagttcagggtacatg

SEQ ID NO: 192027 - DNA, 16 bp, P. troglodytes
aagttcattaatcttt

SEQ ID NO: 192028 - DNA, 16 bp, P. troglodytes
aagttcattttatttt

SEQ ID NO: 192029 - DNA, 16 bp, P. troglodytes
aagttccaaaataatc

SEQ ID NO: 192030 - DNA, 16 bp, P. troglodytes
aagttccaatttcaaa

SEQ ID NO: 192031 - DNA, 18 bp, P. troglodytes
aagttccacaaatctcta

SEQ ID NO: 192032 - DNA, 16 bp, P. troglodytes
aagttccagaaataaa

SEQ ID NO: 192033 - DNA, 16 bp, P. troglodytes
aagttccccatctcca

SEQ ID NO: 192034 - DNA, 16 bp, P. troglodytes
aagttctactggacag

SEQ ID NO: 192035 - DNA, 16 bp, P. troglodytes
aagttctagagatcta

SEQ ID NO: 192036 - DNA, 16 bp, P. troglodytes
aagttctatttcttga

SEQ ID NO: 192037 - DNA, 16 bp, P. troglodytes
aagttctcacttataa

SEQ ID NO: 192038 - DNA, 16 bp, P. troglodytes
aagttctgagattctt

SEQ ID NO: 192039 - DNA, 16 bp, P. troglodytes
aagttctggagatgaa

SEQ ID NO: 192040 - DNA, 16 bp, P. troglodytes
aagttctggaggctgg

SEQ ID NO: 192041 - DNA, 16 bp, P. troglodytes
aagttctggccaggaa

SEQ ID NO: 192042 - DNA, 16 bp, P. troglodytes
aagttcttcagttttt

SEQ ID NO: 192043 - DNA, 16 bp, P. troglodytes
aagttctttacatatt

SEQ ID NO: 192044 - DNA, 16 bp, P. troglodytes
aagttctttcagaaat

SEQ ID NO: 192045 - DNA, 16 bp, P. troglodytes
aagttctttgcagatt

SEQ ID NO: 192046 - DNA, 16 bp, P. troglodytes
aagttcttttaaaaat

SEQ ID NO: 192047 - DNA, 16 bp, P. troglodytes
aagttgaaaataccat

SEQ ID NO: 192048 - DNA, 16 bp, P. troglodytes
aagttgaaaatattgt

SEQ ID NO: 192049 - DNA, 16 bp, P. troglodytes
aagttgaaaatgcatt

SEQ ID NO: 192050 - DNA, 16 bp, P. troglodytes
aagttgaagccaatgt

SEQ ID NO: 192051 - DNA, 16 bp, P. troglodytes
aagttgaattgcttga

SEQ ID NO: 192052 - DNA, 16 bp, P. troglodytes
aagttgaatttttaaa

SEQ ID NO: 192053 - DNA, 16 bp, P. troglodytes
aagttgatttttgtgt

SEQ ID NO: 192054 - DNA, 16 bp, P. troglodytes
aagttgcagaatataa

SEQ ID NO: 192055 - DNA, 16 bp, P. troglodytes
aagttgcagcgagcca

SEQ ID NO: 192056 - DNA, 16 bp, P. troglodytes
aagttgcaggatacaa

SEQ ID NO: 192057 - DNA, 16 bp, P. troglodytes
aagttgcaggatgcaa

SEQ ID NO: 192058 - DNA, 16 bp, P. troglodytes
aagttgccgaagaact

SEQ ID NO: 192059 - DNA, 16 bp, P. troglodytes
aagttgctctgggtga

SEQ ID NO: 192060 - DNA, 16 bp, P. troglodytes
aagttgcttaacttct

SEQ ID NO: 192061 - DNA, 16 bp, P. troglodytes
aagttgcttcacctct

SEQ ID NO: 192062 - DNA, 16 bp, P. troglodytes
aagttggaagccatca

SEQ ID NO: 192063 - DNA, 16 bp, P. troglodytes
aagttggagttgaaca

SEQ ID NO: 192064 - DNA, 16 bp, P. troglodytes
aagttggattcctggg

SEQ ID NO: 192065 - DNA, 18 bp, P. troglodytes
aagttggccaggcatggt

SEQ ID NO: 192066 - DNA, 16 bp, P. troglodytes
aagttggctgggtgcg

SEQ ID NO: 192067 - DNA, 16 bp, P. troglodytes
aagttgggaggctgag

SEQ ID NO: 192068 - DNA, 16 bp, P. troglodytes
aagttgtccttaaaaa

SEQ ID NO: 192069 - DNA, 16 bp, P. troglodytes
aagttgtcttttcact

SEQ ID NO: 192070 - DNA, 16 bp, P. troglodytes
aagttgtgagttgttt

SEQ ID NO: 192071 - DNA, 16 bp, P. troglodytes
aagttgtttccaattt

SEQ ID NO: 192072 - DNA, 16 bp, P. troglodytes
aagttgtttgagaaat

SEQ ID NO: 192073 - DNA, 16 bp, P. troglodytes
aagttgtttgctttct

SEQ ID NO: 192074 - DNA, 16 bp, P. troglodytes
aagttgtttttcttaa

SEQ ID NO: 192075 - DNA, 16 bp, P. troglodytes
aagtttaaaaacataa

SEQ ID NO: 192076 - DNA, 16 bp, P. troglodytes
aagtttaaataaaaca

SEQ ID NO: 192077 - DNA, 16 bp, P. troglodytes
aagtttaactttttaa

SEQ ID NO: 192078 - DNA, 16 bp, P. troglodytes
aagtttaattgtctca

SEQ ID NO: 192079 - DNA, 16 bp, P. troglodytes
aagtttaatttttctt

SEQ ID NO: 192080 - DNA, 16 bp, P. troglodytes
aagtttacattttatt

SEQ ID NO: 192081 - DNA, 17 bp, P. troglodytes
aagtttagcctaaagct

SEQ ID NO: 192082 - DNA, 16 bp, P. troglodytes
aagtttagggaaaaaa

SEQ ID NO: 192083 - DNA, 16 bp, P. troglodytes
aagtttatgtgagtct

SEQ ID NO: 192084 - DNA, 16 bp, P. troglodytes
aagtttattaagaaag

SEQ ID NO: 192085 - DNA, 16 bp, P. troglodytes
aagtttatttctctct

SEQ ID NO: 192086 - DNA, 16 bp, P. troglodytes
aagtttattttccttt

SEQ ID NO: 192087 - DNA, 16 bp, P. troglodytes
aagtttattttgccaa

SEQ ID NO: 192088 - DNA, 16 bp, P. troglodytes
aagtttatttttcctt

SEQ ID NO: 192089 - DNA, 16 bp, P. troglodytes
aagtttatttttctct

SEQ ID NO: 192090 - DNA, 16 bp, P. troglodytes
aagtttattttttcta

SEQ ID NO: 192091 - DNA, 16 bp, P. troglodytes
aagtttcaaaaaatat

SEQ ID NO: 192092 - DNA, 16 bp, P. troglodytes
aagtttcaagttttaa

SEQ ID NO: 192093 - DNA, 16 bp, P. troglodytes
aagtttcagaagaaaa

SEQ ID NO: 192094 - DNA, 16 bp, P. troglodytes
aagtttcagaataaaa

SEQ ID NO: 192095 - DNA, 16 bp, P. troglodytes
aagtttcaggaaaaaa

SEQ ID NO: 192096 - DNA, 16 bp, P. troglodytes
aagtttcagtgagctg

SEQ ID NO: 192097 - DNA, 16 bp, P. troglodytes
aagtttcatttctttt

SEQ ID NO: 192098 - DNA, 16 bp, P. troglodytes
aagtttcctgaagtct

SEQ ID NO: 192099 - DNA, 16 bp, P. troglodytes
aagtttcctgaggcct

SEQ ID NO: 192100 - DNA, 16 bp, P. troglodytes
aagtttccttaggcct

SEQ ID NO: 192101 - DNA, 16 bp, P. troglodytes
aagtttctggaggcct

SEQ ID NO: 192102 - DNA, 16 bp, P. troglodytes
aagtttcttttcattt

SEQ ID NO: 192103 - DNA, 16 bp, P. troglodytes
aagtttgaaaattatt

SEQ ID NO: 192104 - DNA, 16 bp, P. troglodytes
aagtttgaatttcaga

SEQ ID NO: 192105 - DNA, 18 bp, P. troglodytes
aagtttgagactagcctg

SEQ ID NO: 192106 - DNA, 16 bp, P. troglodytes
aagtttgcatttttga

SEQ ID NO: 192107 - DNA, 16 bp, P. troglodytes
aagtttgccaaccctt

SEQ ID NO: 192108 - DNA, 16 bp, P. troglodytes
aagtttgctgcaggga

SEQ ID NO: 192109 - DNA, 16 bp, P. troglodytes
aagtttgctgcagggg

SEQ ID NO: 192110 - DNA, 16 bp, P. troglodytes
aagtttgctttttaaa

SEQ ID NO: 192111 - DNA, 16 bp, P. troglodytes
aagtttggaaaatttt

SEQ ID NO: 192112 - DNA, 17 bp, P. troglodytes
aagtttgggattatgtt

SEQ ID NO: 192113 - DNA, 16 bp, P. troglodytes
aagtttgtgaatttgt

SEQ ID NO: 192114 - DNA, 16 bp, P. troglodytes
aagtttgttgaataaa

SEQ ID NO: 192115 - DNA, 16 bp, P. troglodytes
aagtttgttttaaaaa

SEQ ID NO: 192116 - DNA, 16 bp, P. troglodytes
aagttttaaaaacttt

SEQ ID NO: 192117 - DNA, 16 bp, P. troglodytes
aagttttaaaaagaga

SEQ ID NO: 192118 - DNA, 16 bp, P. troglodytes
aagttttaaaaattga

SEQ ID NO: 192119 - DNA, 16 bp, P. troglodytes
aagttttaaacttttt

SEQ ID NO: 192120 - DNA, 16 bp, P. troglodytes
aagttttaaattttga

SEQ ID NO: 192121 - DNA, 16 bp, P. troglodytes
aagttttaagaagaaa

SEQ ID NO: 192122 - DNA, 16 bp, P. troglodytes
aagttttaattttgaa

SEQ ID NO: 192123 - DNA, 16 bp, P. troglodytes
aagttttagaagaaaa

SEQ ID NO: 192124 - DNA, 16 bp, P. troglodytes
aagttttatggaaaaa

SEQ ID NO: 192125 - DNA, 16 bp, P. troglodytes
aagttttattgaaaaa

SEQ ID NO: 192126 - DNA, 16 bp, P. troglodytes
aagttttcaaataaaa

SEQ ID NO: 192127 - DNA, 16 bp, P. troglodytes
aagttttcaaatattt

SEQ ID NO: 192128 - DNA, 16 bp, P. troglodytes
aagttttcaaatgtat

SEQ ID NO: 192129 - DNA, 16 bp, P. troglodytes
aagttttcattttatt

SEQ ID NO: 192130 - DNA, 16 bp, P. troglodytes
aagttttctaattttt

SEQ ID NO: 192131 - DNA, 16 bp, P. troglodytes
aagttttctttgaaaa

SEQ ID NO: 192132 - DNA, 16 bp, P. troglodytes
aagttttgaaattgga

SEQ ID NO: 192133 - DNA, 16 bp, P. troglodytes
aagttttgcaaaggag

SEQ ID NO: 192134 - DNA, 16 bp, P. troglodytes
aagttttgctatgttg

SEQ ID NO: 192135 - DNA, 16 bp, P. troglodytes
aagttttgcttttgtt

SEQ ID NO: 192136 - DNA, 16 bp, P. troglodytes
aagttttggcaaggat

SEQ ID NO: 192137 - DNA, 16 bp, P. troglodytes
aagttttggcaattat

SEQ ID NO: 192138 - DNA, 16 bp, P. troglodytes
aagttttgttggaaca

SEQ ID NO: 192139 - DNA, 16 bp, P. troglodytes
aagttttgtttcattt

SEQ ID NO: 192140 - DNA, 16 bp, P. troglodytes
aagtttttctcctttt

SEQ ID NO: 192141 - DNA, 16 bp, P. troglodytes
aagtttttctctgacc

SEQ ID NO: 192142 - DNA, 16 bp, P. troglodytes
aagtttttgttaaaaa

SEQ ID NO: 192143 - DNA, 16 bp, P. troglodytes
aataaaaaaatgcttt

SEQ ID NO: 192144 - DNA, 16 bp, P. troglodytes
aataaaaaagacattt

SEQ ID NO: 192145 - DNA, 16 bp, P. troglodytes
aataaaaaagttagct

SEQ ID NO: 192146 - DNA, 16 bp, P. troglodytes
aataaaaaatctgaat

SEQ ID NO: 192147 - DNA, 16 bp, P. troglodytes
aataaaaaattcagta

SEQ ID NO: 192148 - DNA, 16 bp, P. troglodytes
aataaaaaattgccaa

SEQ ID NO: 192149 - DNA, 16 bp, P. troglodytes
aataaaaaatttagcc

SEQ ID NO: 192150 - DNA, 16 bp, P. troglodytes
aataaaaacaaatgct

SEQ ID NO: 192151 - DNA, 16 bp, P. troglodytes
aataaaaacaattttg

SEQ ID NO: 192152 - DNA, 16 bp, P. troglodytes
aataaaaacatcttca

SEQ ID NO: 192153 - DNA, 16 bp, P. troglodytes
aataaaaacatttctt

SEQ ID NO: 192154 - DNA, 16 bp, P. troglodytes
aataaaaactgtatat

SEQ ID NO: 192155 - DNA, 20 bp, P. troglodytes
aataaaaacttgctggtttt

SEQ ID NO: 192156 - DNA, 16 bp, P. troglodytes
aataaaaagatcagtg

SEQ ID NO: 192157 - DNA, 16 bp, P. troglodytes
aataaaaagcaagtta

SEQ ID NO: 192158 - DNA, 16 bp, P. troglodytes
aataaaaagcatttat

SEQ ID NO: 192159 - DNA, 16 bp, P. troglodytes
aataaaaagtatttgt

SEQ ID NO: 192160 - DNA, 16 bp, P. troglodytes
aataaaaagttcagag

SEQ ID NO: 192161 - DNA, 16 bp, P. troglodytes
aataaaaagttgtttt

SEQ ID NO: 192162 - DNA, 16 bp, P. troglodytes
aataaaaataaactgc

SEQ ID NO: 192163 - DNA, 16 bp, P. troglodytes
aataaaaataacagct

SEQ ID NO: 192164 - DNA, 16 bp, P. troglodytes
aataaaaataactgca

SEQ ID NO: 192165 - DNA, 16 bp, P. troglodytes
aataaaaataattagc

SEQ ID NO: 192166 - DNA, 16 bp, P. troglodytes
aataaaaatagcattt

SEQ ID NO: 192167 - DNA, 16 bp, P. troglodytes
aataaaaatatctcca

SEQ ID NO: 192168 - DNA, 16 bp, P. troglodytes
aataaaaatatgacat

SEQ ID NO: 192169 - DNA, 16 bp, P. troglodytes
aataaaaatctcattt

SEQ ID NO: 192170 - DNA, 16 bp, P. troglodytes
aataaaaatgaaatct

SEQ ID NO: 192171 - DNA, 16 bp, P. troglodytes
aataaaaatgcacata

SEQ ID NO: 192172 - DNA, 16 bp, P. troglodytes
aataaaaatgtctttt

SEQ ID NO: 192173 - DNA, 16 bp, P. troglodytes
aataaaaatgtgtttg

SEQ ID NO: 192174 - DNA, 16 bp, P. troglodytes
aataaaaatgtttcta

SEQ ID NO: 192175 - DNA, 16 bp, P. troglodytes
aataaaaatgttttga

SEQ ID NO: 192176 - DNA, 16 bp, P. troglodytes
aataaaaattatgcaa

SEQ ID NO: 192177 - DNA, 16 bp, P. troglodytes
aataaaaattccagaa

SEQ ID NO: 192178 - DNA, 16 bp, P. troglodytes
aataaaaattgttttg

SEQ ID NO: 192179 - DNA, 16 bp, P. troglodytes
aataaaaatttgttga

SEQ ID NO: 192180 - DNA, 16 bp, P. troglodytes
aataaaacaattttga

SEQ ID NO: 192181 - DNA, 16 bp, P. troglodytes
aataaaacagaatatt

SEQ ID NO: 192182 - DNA, 16 bp, P. troglodytes
aataaaacaggataca

SEQ ID NO: 192183 - DNA, 16 bp, P. troglodytes
aataaaacatttctct

SEQ ID NO: 192184 - DNA, 16 bp, P. troglodytes
aataaaacattttttc

SEQ ID NO: 192185 - DNA, 16 bp, P. troglodytes
aataaaaccatattca

SEQ ID NO: 192186 - DNA, 16 bp, P. troglodytes
aataaaaccttattta

SEQ ID NO: 192187 - DNA, 16 bp, P. troglodytes
aataaaaccttgcatt

SEQ ID NO: 192188 - DNA, 16 bp, P. troglodytes
aataaaacctttattt

SEQ ID NO: 192189 - DNA, 16 bp, P. troglodytes
aataaaactgcatttt

SEQ ID NO: 192190 - DNA, 16 bp, P. troglodytes
aataaaactgctaaaa

SEQ ID NO: 192191 - DNA, 16 bp, P. troglodytes
aataaaactgttattt

SEQ ID NO: 192192 - DNA, 16 bp, P. troglodytes
aataaaacttgtattt

SEQ ID NO: 192193 - DNA, 16 bp, P. troglodytes
aataaaacttgtttta

SEQ ID NO: 192194 - DNA, 16 bp, P. troglodytes
aataaaagacacattt

SEQ ID NO: 192195 - DNA, 16 bp, P. troglodytes
aataaaagcaatattt

SEQ ID NO: 192196 - DNA, 16 bp, P. troglodytes
aataaaagcatttttt

SEQ ID NO: 192197 - DNA, 16 bp, P. troglodytes
aataaaagccaattag

SEQ ID NO: 192198 - DNA, 16 bp, P. troglodytes
aataaaagctctttgg

SEQ ID NO: 192199 - DNA, 16 bp, P. troglodytes
aataaaaggaaccaga

SEQ ID NO: 192200 - DNA, 16 bp, P. troglodytes
aataaaaggcatgcaa

SEQ ID NO: 192201 - DNA, 16 bp, P. troglodytes
aataaaaggcattaaa

SEQ ID NO: 192202 - DNA, 16 bp, P. troglodytes
aataaaagtgatgaga

SEQ ID NO: 192203 - DNA, 16 bp, P. troglodytes
aataaaagtggcaaaa

SEQ ID NO: 192204 - DNA, 16 bp, P. troglodytes
aataaaagttatgtga

SEQ ID NO: 192205 - DNA, 16 bp, P. troglodytes
aataaaagtttgtttt

SEQ ID NO: 192206 - DNA, 16 bp, P. troglodytes
aataaaagtttttgaa

SEQ ID NO: 192207 - DNA, 16 bp, P. troglodytes
aataaaataaaactgg

SEQ ID NO: 192208 - DNA, 16 bp, P. troglodytes
aataaaataaaggcag

SEQ ID NO: 192209 - DNA, 16 bp, P. troglodytes
aataaaataaatgctt

SEQ ID NO: 192210 - DNA, 16 bp, P. troglodytes
aataaaataaatgttc

SEQ ID NO: 192211 - DNA, 16 bp, P. troglodytes
aataaaataagaattc

SEQ ID NO: 192212 - DNA, 16 bp, P. troglodytes
aataaaataagccagg

SEQ ID NO: 192213 - DNA, 16 bp, P. troglodytes
aataaaataatggcta

SEQ ID NO: 192214 - DNA, 16 bp, P. troglodytes
aataaaatacagtttt

SEQ ID NO: 192215 - DNA, 18 bp, P. troglodytes
aataaaatacctaggaat

SEQ ID NO: 192216 - DNA, 16 bp, P. troglodytes
aataaaatacttgaaa

SEQ ID NO: 192217 - DNA, 16 bp, P. troglodytes
aataaaataggccagg

SEQ ID NO: 192218 - DNA, 16 bp, P. troglodytes
aataaaatagttgttt

SEQ ID NO: 192219 - DNA, 16 bp, P. troglodytes
aataaaatatctttca

SEQ ID NO: 192220 - DNA, 16 bp, P. troglodytes
aataaaatatgacatt

SEQ ID NO: 192221 - DNA, 16 bp, P. troglodytes
aataaaatatggtatt

SEQ ID NO: 192222 - DNA, 16 bp, P. troglodytes
aataaaatattctcta

SEQ ID NO: 192223 - DNA, 16 bp, P. troglodytes
aataaaatatttcagt

SEQ ID NO: 192224 - DNA, 16 bp, P. troglodytes
aataaaatatttctct

SEQ ID NO: 192225 - DNA, 16 bp, P. troglodytes
aataaaatcatctttc

SEQ ID NO: 192226 - DNA, 16 bp, P. troglodytes
aataaaatcatttctt

SEQ ID NO: 192227 - DNA, 16 bp, P. troglodytes
aataaaatcattttgt

SEQ ID NO: 192228 - DNA, 16 bp, P. troglodytes
aataaaatcctgtcat

SEQ ID NO: 192229 - DNA, 16 bp, P. troglodytes
aataaaatctgtcttt

SEQ ID NO: 192230 - DNA, 16 bp, P. troglodytes
aataaaatcttaagaa

SEQ ID NO: 192231 - DNA, 16 bp, P. troglodytes
aataaaatctttttct

SEQ ID NO: 192232 - DNA, 16 bp, P. troglodytes
aataaaatgaaatttc

SEQ ID NO: 192233 - DNA, 16 bp, P. troglodytes
aataaaatgaagcatt

SEQ ID NO: 192234 - DNA, 16 bp, P. troglodytes
aataaaatgatacaga

SEQ ID NO: 192235 - DNA, 16 bp, P. troglodytes
aataaaatgattgttt

SEQ ID NO: 192236 - DNA, 16 bp, P. troglodytes
aataaaatgcacatat

SEQ ID NO: 192237 - DNA, 16 bp, P. troglodytes
aataaaatgctaattt

SEQ ID NO: 192238 - DNA, 16 bp, P. troglodytes
aataaaatggcatttt

SEQ ID NO: 192239 - DNA, 16 bp, P. troglodytes
aataaaatgggaggca

SEQ ID NO: 192240 - DNA, 16 bp, P. troglodytes
aataaaatggttttaa

SEQ ID NO: 192241 - DNA, 16 bp, P. troglodytes
aataaaatgtcaatat

SEQ ID NO: 192242 - DNA, 16 bp, P. troglodytes
aataaaatgtgaagac

SEQ ID NO: 192243 - DNA, 16 bp, P. troglodytes
aataaaatgtgttttt

SEQ ID NO: 192244 - DNA, 16 bp, P. troglodytes
aataaaatgtttcaaa

SEQ ID NO: 192245 - DNA, 16 bp, P. troglodytes
aataaaatgtttttct

SEQ ID NO: 192246 - DNA, 16 bp, P. troglodytes
aataaaattatttgca

SEQ ID NO: 192247 - DNA, 16 bp, P. troglodytes
aataaaattcagaatt

SEQ ID NO: 192248 - DNA, 16 bp, P. troglodytes
aataaaattcagcatt

SEQ ID NO: 192249 - DNA, 16 bp, P. troglodytes
aataaaattctgaaat

SEQ ID NO: 192250 - DNA, 16 bp, P. troglodytes
aataaaattgaacaag

SEQ ID NO: 192251 - DNA, 16 bp, P. troglodytes
aataaaattgctcaaa

SEQ ID NO: 192252 - DNA, 16 bp, P. troglodytes
aataaacaaaatgtgg

SEQ ID NO: 192253 - DNA, 16 bp, P. troglodytes
aataaacacatttctt

SEQ ID NO: 192254 - DNA, 16 bp, P. troglodytes
aataaacacattttta

SEQ ID NO: 192255 - DNA, 16 bp, P. troglodytes
aataaacagaatatac

SEQ ID NO: 192256 - DNA, 16 bp, P. troglodytes
aataaacagacaacct

SEQ ID NO: 192257 - DNA, 16 bp, P. troglodytes
aataaacaggaaaatg

SEQ ID NO: 192258 - DNA, 16 bp, P. troglodytes
aataaacagtttagag

SEQ ID NO: 192259 - DNA, 16 bp, P. troglodytes
aataaacataaatgtg

SEQ ID NO: 192260 - DNA, 16 bp, P. troglodytes
aataaacatatatgtg

SEQ ID NO: 192261 - DNA, 16 bp, P. troglodytes
aataaacatctttttt

SEQ ID NO: 192262 - DNA, 16 bp, P. troglodytes
aataaacatgcatgtg

SEQ ID NO: 192263 - DNA, 16 bp, P. troglodytes
aataaacatgttttca

SEQ ID NO: 192264 - DNA, 16 bp, P. troglodytes
aataaacatttaaaga

SEQ ID NO: 192265 - DNA, 16 bp, P. troglodytes
aataaacatttattga

SEQ ID NO: 192266 - DNA, 16 bp, P. troglodytes
aataaacatttcattt

SEQ ID NO: 192267 - DNA, 16 bp, P. troglodytes
aataaacatttctcaa

SEQ ID NO: 192268 - DNA, 16 bp, P. troglodytes
aataaacatttgctga

SEQ ID NO: 192269 - DNA, 16 bp, P. troglodytes
aataaacatttgttaa

SEQ ID NO: 192270 - DNA, 16 bp, P. troglodytes
aataaacatttgttat

SEQ ID NO: 192271 - DNA, 16 bp, P. troglodytes
aataaacatttttcca

SEQ ID NO: 192272 - DNA, 16 bp, P. troglodytes
aataaacccatcataa

SEQ ID NO: 192273 - DNA, 16 bp, P. troglodytes
aataaaccccttcctt

SEQ ID NO: 192274 - DNA, 16 bp, P. troglodytes
aataaacctctttata

SEQ ID NO: 192275 - DNA, 16 bp, P. troglodytes
aataaacctcttttcc

SEQ ID NO: 192276 - DNA, 16 bp, P. troglodytes
aataaacctgcttttc

SEQ ID NO: 192277 - DNA, 16 bp, P. troglodytes
aataaaccttgctact

SEQ ID NO: 192278 - DNA, 16 bp, P. troglodytes
aataaactagtaaatg

SEQ ID NO: 192279 - DNA, 16 bp, P. troglodytes
aataaactcattttca

SEQ ID NO: 192280 - DNA, 16 bp, P. troglodytes
aataaactgaatattt

SEQ ID NO: 192281 - DNA, 16 bp, P. troglodytes
aataaacttaaccaag

SEQ ID NO: 192282 - DNA, 16 bp, P. troglodytes
aataaacttgaaaata

SEQ ID NO: 192283 - DNA, 16 bp, P. troglodytes
aataaactttttaatg

SEQ ID NO: 192284 - DNA, 16 bp, P. troglodytes
aataaagaaaatgtgg

SEQ ID NO: 192285 - DNA, 16 bp, P. troglodytes
aataaagaaattcaga

SEQ ID NO: 192286 - DNA, 16 bp, P. troglodytes
aataaagaagttcttt

SEQ ID NO: 192287 - DNA, 16 bp, P. troglodytes
aataaagacatacttg

SEQ ID NO: 192288 - DNA, 16 bp, P. troglodytes
aataaagacattttaa

SEQ ID NO: 192289 - DNA, 16 bp, P. troglodytes
aataaagacattttca

SEQ ID NO: 192290 - DNA, 16 bp, P. troglodytes
aataaagacattttta

SEQ ID NO: 192291 - DNA, 16 bp, P. troglodytes
aataaagacttttttt

SEQ ID NO: 192292 - DNA, 16 bp, P. troglodytes
aataaagagtttaatt

SEQ ID NO: 192293 - DNA, 16 bp, P. troglodytes
aataaagatgctcttt

SEQ ID NO: 192294 - DNA, 16 bp, P. troglodytes
aataaagatgtatttt

SEQ ID NO: 192295 - DNA, 16 bp, P. troglodytes
aataaagattcatttt

SEQ ID NO: 192296 - DNA, 16 bp, P. troglodytes
aataaagatttgttga

SEQ ID NO: 192297 - DNA, 16 bp, P. troglodytes
aataaagcaaaatact

SEQ ID NO: 192298 - DNA, 16 bp, P. troglodytes
aataaagcagaaatat

SEQ ID NO: 192299 - DNA, 16 bp, P. troglodytes
aataaagcattttaaa

SEQ ID NO: 192300 - DNA, 16 bp, P. troglodytes
aataaagccacatact

SEQ ID NO: 192301 - DNA, 16 bp, P. troglodytes
aataaagccttttttt

SEQ ID NO: 192302 - DNA, 16 bp, P. troglodytes
aataaagctcaacatc

SEQ ID NO: 192303 - DNA, 16 bp, P. troglodytes
aataaagctgacattt

SEQ ID NO: 192304 - DNA, 16 bp, P. troglodytes
aataaagctgctatga

SEQ ID NO: 192305 - DNA, 16 bp, P. troglodytes
aataaagcttctgtga

SEQ ID NO: 192306 - DNA, 16 bp, P. troglodytes
aataaagctttattga

SEQ ID NO: 192307 - DNA, 16 bp, P. troglodytes
aataaagcttttcttt

SEQ ID NO: 192308 - DNA, 16 bp, P. troglodytes
aataaaggaaatgtgg

SEQ ID NO: 192309 - DNA, 16 bp, P. troglodytes
aataaaggctggtctg

SEQ ID NO: 192310 - DNA, 16 bp, P. troglodytes
aataaagtatgtttaa

SEQ ID NO: 192311 - DNA, 16 bp, P. troglodytes
aataaagtatttttca

SEQ ID NO: 192312 - DNA, 16 bp, P. troglodytes
aataaagtcattttta

SEQ ID NO: 192313 - DNA, 16 bp, P. troglodytes
aataaagtctttctca

SEQ ID NO: 192314 - DNA, 16 bp, P. troglodytes
aataaagtgagtcaca

SEQ ID NO: 192315 - DNA, 16 bp, P. troglodytes
aataaagtggtttaaa

SEQ ID NO: 192316 - DNA, 16 bp, P. troglodytes
aataaagttactataa

SEQ ID NO: 192317 - DNA, 16 bp, P. troglodytes
aataaagttatttttc

SEQ ID NO: 192318 - DNA, 16 bp, P. troglodytes
aataaagttctgtttt

SEQ ID NO: 192319 - DNA, 16 bp, P. troglodytes
aataaagttgattttt

SEQ ID NO: 192320 - DNA, 16 bp, P. troglodytes
aataaagttgtttaaa

SEQ ID NO: 192321 - DNA, 16 bp, P. troglodytes
aataaagtttgtattt

SEQ ID NO: 192322 - DNA, 16 bp, P. troglodytes
aataaagttttactga

SEQ ID NO: 192323 - DNA, 16 bp, P. troglodytes
aataaagttttattgg

SEQ ID NO: 192324 - DNA, 16 bp, P. troglodytes
aataaataaaacagtt

SEQ ID NO: 192325 - DNA, 16 bp, P. troglodytes
aataaataaaactgtt

SEQ ID NO: 192326 - DNA, 16 bp, P. troglodytes
aataaataaaagctat

SEQ ID NO: 192327 - DNA, 16 bp, P. troglodytes
aataaataaaatactg

SEQ ID NO: 192328 - DNA, 16 bp, P. troglodytes
aataaataaatctgaa

SEQ ID NO: 192329 - DNA, 16 bp, P. troglodytes
aataaataaatctgat

SEQ ID NO: 192330 - DNA, 16 bp, P. troglodytes
aataaataaatgtaca

SEQ ID NO: 192331 - DNA, 16 bp, P. troglodytes
aataaataacagtgca

SEQ ID NO: 192332 - DNA, 16 bp, P. troglodytes
aataaataactgaaac

SEQ ID NO: 192333 - DNA, 16 bp, P. troglodytes
aataaataagatcaga

SEQ ID NO: 192334 - DNA, 16 bp, P. troglodytes
aataaataagcaaatg

SEQ ID NO: 192335 - DNA, 16 bp, P. troglodytes
aataaataatgctggg

SEQ ID NO: 192336 - DNA, 16 bp, P. troglodytes
aataaataatttcctt

SEQ ID NO: 192337 - DNA, 16 bp, P. troglodytes
aataaatacaatgttt

SEQ ID NO: 192338 - DNA, 16 bp, P. troglodytes
aataaatacatgaata

SEQ ID NO: 192339 - DNA, 16 bp, P. troglodytes
aataaatacatgaatg

SEQ ID NO: 192340 - DNA, 16 bp, P. troglodytes
aataaatacattggaa

SEQ ID NO: 192341 - DNA, 16 bp, P. troglodytes
aataaatactgtttta

SEQ ID NO: 192342 - DNA, 16 bp, P. troglodytes
aataaatacttgctga

SEQ ID NO: 192343 - DNA, 16 bp, P. troglodytes
aataaatacttgttga

SEQ ID NO: 192344 - DNA, 16 bp, P. troglodytes
aataaatacttttgaa

SEQ ID NO: 192345 - DNA, 16 bp, P. troglodytes
aataaatagcaaaatg

SEQ ID NO: 192346 - DNA, 16 bp, P. troglodytes
aataaatatcttttct

SEQ ID NO: 192347 - DNA, 16 bp, P. troglodytes
aataaatatgtattca

SEQ ID NO: 192348 - DNA, 16 bp, P. troglodytes
aataaatatgtgtgaa

SEQ ID NO: 192349 - DNA, 16 bp, P. troglodytes
aataaatattgctgaa

SEQ ID NO: 192350 - DNA, 16 bp, P. troglodytes
aataaatatttagtga

SEQ ID NO: 192351 - DNA, 16 bp, P. troglodytes
aataaatatttgccaa

SEQ ID NO: 192352 - DNA, 16 bp, P. troglodytes
aataaatatttgctgt

SEQ ID NO: 192353 - DNA, 16 bp, P. troglodytes
aataaatatttgtaga

SEQ ID NO: 192354 - DNA, 16 bp, P. troglodytes
aataaatatttgtcaa

SEQ ID NO: 192355 - DNA, 16 bp, P. troglodytes
aataaatatttgtgga

SEQ ID NO: 192356 - DNA, 16 bp, P. troglodytes
aataaatatttgttgg

SEQ ID NO: 192357 - DNA, 16 bp, P. troglodytes
aataaatattttccca

SEQ ID NO: 192358 - DNA, 16 bp, P. troglodytes
aataaatatttttcct

SEQ ID NO: 192359 - DNA, 16 bp, P. troglodytes
aataaatccattttta

SEQ ID NO: 192360 - DNA, 16 bp, P. troglodytes
aataaatctcaagaga

SEQ ID NO: 192361 - DNA, 16 bp, P. troglodytes
aataaatctcatttta

SEQ ID NO: 192362 - DNA, 16 bp, P. troglodytes
aataaatctctttaaa

SEQ ID NO: 192363 - DNA, 16 bp, P. troglodytes
aataaatctgtaaaat

SEQ ID NO: 192364 - DNA, 16 bp, P. troglodytes
aataaatctgtgcttt

SEQ ID NO: 192365 - DNA, 16 bp, P. troglodytes
aataaatctgtgttgt

SEQ ID NO: 192366 - DNA, 16 bp, P. troglodytes
aataaatgaaacattt

SEQ ID NO: 192367 - DNA, 16 bp, P. troglodytes
aataaatgaaactttt

SEQ ID NO: 192368 - DNA, 16 bp, P. troglodytes
aataaatgaagacata

SEQ ID NO: 192369 - DNA, 16 bp, P. troglodytes
aataaatgaatgagtt

SEQ ID NO: 192370 - DNA, 16 bp, P. troglodytes
aataaatgaatgattt

SEQ ID NO: 192371 - DNA, 16 bp, P. troglodytes
aataaatgatgctgaa

SEQ ID NO: 192372 - DNA, 16 bp, P. troglodytes
aataaatgctagtttt

SEQ ID NO: 192373 - DNA, 16 bp, P. troglodytes
aataaatgcttatttt

SEQ ID NO: 192374 - DNA, 16 bp, P. troglodytes
aataaatgcttttaaa

SEQ ID NO: 192375 - DNA, 16 bp, P. troglodytes
aataaatggagaaatg

SEQ ID NO: 192376 - DNA, 16 bp, P. troglodytes
aataaatggtagttat

SEQ ID NO: 192377 - DNA, 16 bp, P. troglodytes
aataaatggtgctagg

SEQ ID NO: 192378 - DNA, 16 bp, P. troglodytes
aataaatggtgctgag

SEQ ID NO: 192379 - DNA, 17 bp, P. troglodytes
aataaatggtgctggga

SEQ ID NO: 192380 - DNA, 16 bp, P. troglodytes
aataaatgtaaagttt

SEQ ID NO: 192381 - DNA, 16 bp, P. troglodytes
aataaatgtacatatt

SEQ ID NO: 192382 - DNA, 16 bp, P. troglodytes
aataaatgtatacaat

SEQ ID NO: 192383 - DNA, 16 bp, P. troglodytes
aataaatgtatcattt

SEQ ID NO: 192384 - DNA, 16 bp, P. troglodytes
aataaatgtattttga

SEQ ID NO: 192385 - DNA, 16 bp, P. troglodytes
aataaatgtctattgt

SEQ ID NO: 192386 - DNA, 16 bp, P. troglodytes
aataaatgtctatttt

SEQ ID NO: 192387 - DNA, 16 bp, P. troglodytes
aataaatgtcttttct

SEQ ID NO: 192388 - DNA, 16 bp, P. troglodytes
aataaatgtgaaaatg

SEQ ID NO: 192389 - DNA, 16 bp, P. troglodytes
aataaatgtgactcac

SEQ ID NO: 192390 - DNA, 16 bp, P. troglodytes
aataaatgtgtatttt

SEQ ID NO: 192391 - DNA, 16 bp, P. troglodytes
aataaatgtgtgtttt

SEQ ID NO: 192392 - DNA, 16 bp, P. troglodytes
aataaatgttcattaa

SEQ ID NO: 192393 - DNA, 16 bp, P. troglodytes
aataaatgttggcatg

SEQ ID NO: 192394 - DNA, 16 bp, P. troglodytes
aataaatgttgtttta

SEQ ID NO: 192395 - DNA, 16 bp, P. troglodytes
aataaatgtttacaaa

SEQ ID NO: 192396 - DNA, 16 bp, P. troglodytes
aataaatgtttattga

SEQ ID NO: 192397 - DNA, 16 bp, P. troglodytes
aataaatgtttctgga

SEQ ID NO: 192398 - DNA, 16 bp, P. troglodytes
aataaatgtttcttaa

SEQ ID NO: 192399 - DNA, 16 bp, P. troglodytes
aataaatgtttgcaaa

SEQ ID NO: 192400 - DNA, 16 bp, P. troglodytes
aataaatgtttgtaaa

SEQ ID NO: 192401 - DNA, 16 bp, P. troglodytes
aataaatgttttaatg

SEQ ID NO: 192402 - DNA, 16 bp, P. troglodytes
aataaatgttttacaa

SEQ ID NO: 192403 - DNA, 16 bp, P. troglodytes
aataaatgttttcttt

SEQ ID NO: 192404 - DNA, 16 bp, P. troglodytes
aataaattactgttgt

SEQ ID NO: 192405 - DNA, 16 bp, P. troglodytes
aataaattagatattg

SEQ ID NO: 192406 - DNA, 16 bp, P. troglodytes
aataaattatagtaca

SEQ ID NO: 192407 - DNA, 16 bp, P. troglodytes
aataaattatggtgta

SEQ ID NO: 192408 - DNA, 16 bp, P. troglodytes
aataaattccagaaaa

SEQ ID NO: 192409 - DNA, 16 bp, P. troglodytes
aataaattcccttttt

SEQ ID NO: 192410 - DNA, 16 bp, P. troglodytes
aataaattcctgttgt

SEQ ID NO: 192411 - DNA, 16 bp, P. troglodytes
aataaattccttttgt

SEQ ID NO: 192412 - DNA, 16 bp, P. troglodytes
aataaatttatgttgt

SEQ ID NO: 192413 - DNA, 16 bp, P. troglodytes
aataaatttctattgt

SEQ ID NO: 192414 - DNA, 16 bp, P. troglodytes
aataaatttgaatttc

SEQ ID NO: 192415 - DNA, 16 bp, P. troglodytes
aataaatttgctttca

SEQ ID NO: 192416 - DNA, 16 bp, P. troglodytes
aataaatttttcagtt

SEQ ID NO: 192417 - DNA, 16 bp, P. troglodytes
aataaatttttttctg

SEQ ID NO: 192418 - DNA, 16 bp, P. troglodytes
aataacaaactcctct

SEQ ID NO: 192419 - DNA, 16 bp, P. troglodytes
aataacaaagacactc

SEQ ID NO: 192420 - DNA, 16 bp, P. troglodytes
aataacaacagcaaca

SEQ ID NO: 192421 - DNA, 16 bp, P. troglodytes
aataacaacagcagca

SEQ ID NO: 192422 - DNA, 16 bp, P. troglodytes
aataacactttattta

SEQ ID NO: 192423 - DNA, 16 bp, P. troglodytes
aataacagaaatgtat

SEQ ID NO: 192424 - DNA, 16 bp, P. troglodytes
aataacagactctgaa

SEQ ID NO: 192425 - DNA, 16 bp, P. troglodytes
aataacagcagaatac

SEQ ID NO: 192426 - DNA, 16 bp, P. troglodytes
aataacagctaccatt

SEQ ID NO: 192427 - DNA, 16 bp, P. troglodytes
aataacatgaaaaatt

SEQ ID NO: 192428 - DNA, 16 bp, P. troglodytes
aataacatggatgaat

SEQ ID NO: 192429 - DNA, 16 bp, P. troglodytes
aataacattgaatctg

SEQ ID NO: 192430 - DNA, 16 bp, P. troglodytes
aataacattgaatgta

SEQ ID NO: 192431 - DNA, 16 bp, P. troglodytes
aataacatttagaaaa

SEQ ID NO: 192432 - DNA, 16 bp, P. troglodytes
aataacatttgaaaat

SEQ ID NO: 192433 - DNA, 16 bp, P. troglodytes
aataacattttctgtt

SEQ ID NO: 192434 - DNA, 16 bp, P. troglodytes
aataacatttttaagt

SEQ ID NO: 192435 - DNA, 16 bp, P. troglodytes
aataacatttttcatt

SEQ ID NO: 192436 - DNA, 16 bp, P. troglodytes
aataacattttttcct

SEQ ID NO: 192437 - DNA, 16 bp, P. troglodytes
aataaccacatcatgg

SEQ ID NO: 192438 - DNA, 16 bp, P. troglodytes
aataaccagctagcat

SEQ ID NO: 192439 - DNA, 16 bp, P. troglodytes
aataacccagtttaaa

SEQ ID NO: 192440 - DNA, 16 bp, P. troglodytes
aataaccctgtgaggt

SEQ ID NO: 192441 - DNA, 16 bp, P. troglodytes
aataactataaaaagt

SEQ ID NO: 192442 - DNA, 16 bp, P. troglodytes
aataactattttctaa

SEQ ID NO: 192443 - DNA, 16 bp, P. troglodytes
aataactgaaatcaga

SEQ ID NO: 192444 - DNA, 16 bp, P. troglodytes
aataactgagactggg

SEQ ID NO: 192445 - DNA, 16 bp, P. troglodytes
aataactggagacttc

SEQ ID NO: 192446 - DNA, 16 bp, P. troglodytes
aataacttgcccaggg

SEQ ID NO: 192447 - DNA, 16 bp, P. troglodytes
aataactttcttttct

SEQ ID NO: 192448 - DNA, 16 bp, P. troglodytes
aataacttttagattt

SEQ ID NO: 192449 - DNA, 16 bp, P. troglodytes
aataacttttcctttg

SEQ ID NO: 192450 - DNA, 16 bp, P. troglodytes
aataagaacacatgga

SEQ ID NO: 192451 - DNA, 16 bp, P. troglodytes
aataagaaccatctat

SEQ ID NO: 192452 - DNA, 16 bp, P. troglodytes
aataagaatctatttt

SEQ ID NO: 192453 - DNA, 16 bp, P. troglodytes
aataagacatactatt

SEQ ID NO: 192454 - DNA, 16 bp, P. troglodytes
aataagactccgtctc

SEQ ID NO: 192455 - DNA, 16 bp, P. troglodytes
aataagagaaaaggca

SEQ ID NO: 192456 - DNA, 16 bp, P. troglodytes
aataagagatttgaaa

SEQ ID NO: 192457 - DNA, 16 bp, P. troglodytes
aataagatatttttca

SEQ ID NO: 192458 - DNA, 16 bp, P. troglodytes
aataagatttttcaaa

SEQ ID NO: 192459 - DNA, 16 bp, P. troglodytes
aataagcacatgaaaa

SEQ ID NO: 192460 - DNA, 16 bp, P. troglodytes
aataagcacttaaaaa

SEQ ID NO: 192461 - DNA, 16 bp, P. troglodytes
aataagcactttaaaa

SEQ ID NO: 192462 - DNA, 16 bp, P. troglodytes
aataagcatatgaaaa

SEQ ID NO: 192463 - DNA, 16 bp, P. troglodytes
aataagcatattaaaa

SEQ ID NO: 192464 - DNA, 16 bp, P. troglodytes
aataaggacatgaaaa

SEQ ID NO: 192465 - DNA, 16 bp, P. troglodytes
aataaggatcagagca

SEQ ID NO: 192466 - DNA, 16 bp, P. troglodytes
aataaggatgttcttt

SEQ ID NO: 192467 - DNA, 16 bp, P. troglodytes
aataaggcaaacactg

SEQ ID NO: 192468 - DNA, 16 bp, P. troglodytes
aataaggcaaatgcca

SEQ ID NO: 192469 - DNA, 16 bp, P. troglodytes
aataaggcaagagaaa

SEQ ID NO: 192470 - DNA, 16 bp, P. troglodytes
aataaggggatggagg

SEQ ID NO: 192471 - DNA, 16 bp, P. troglodytes
aataagtctcatgaga

SEQ ID NO: 192472 - DNA, 16 bp, P. troglodytes
aataagtgtgtgtgtg

SEQ ID NO: 192473 - DNA, 16 bp, P. troglodytes
aataagttcacattca

SEQ ID NO: 192474 - DNA, 16 bp, P. troglodytes
aataagttctactgtt

SEQ ID NO: 192475 - DNA, 16 bp, P. troglodytes
aataagttgcagacat

SEQ ID NO: 192476 - DNA, 16 bp, P. troglodytes
aataagtttcacaaga

SEQ ID NO: 192477 - DNA, 16 bp, P. troglodytes
aataataaaatactgt

SEQ ID NO: 192478 - DNA, 16 bp, P. troglodytes
aataataaaatagcag

SEQ ID NO: 192479 - DNA, 16 bp, P. troglodytes
aataataaaatggcaa

SEQ ID NO: 192480 - DNA, 16 bp, P. troglodytes
aataataacagtaata

SEQ ID NO: 192481 - DNA, 16 bp, P. troglodytes
aataataaccatttta

SEQ ID NO: 192482 - DNA, 16 bp, P. troglodytes
aataataataatgcta

SEQ ID NO: 192483 - DNA, 16 bp, P. troglodytes
aataataataggctgg

SEQ ID NO: 192484 - DNA, 16 bp, P. troglodytes
aataataatagtacct

SEQ ID NO: 192485 - DNA, 16 bp, P. troglodytes
aataataatattgatg

SEQ ID NO: 192486 - DNA, 16 bp, P. troglodytes
aataataatgacaata

SEQ ID NO: 192487 - DNA, 16 bp, P. troglodytes
aataataatgctaata

SEQ ID NO: 192488 - DNA, 16 bp, P. troglodytes
aataataatggctaac

SEQ ID NO: 192489 - DNA, 16 bp, P. troglodytes
aataatacatgtaaaa

SEQ ID NO: 192490 - DNA, 16 bp, P. troglodytes
aataatacttcattgt

SEQ ID NO: 192491 - DNA, 16 bp, P. troglodytes
aataatagctaataat

SEQ ID NO: 192492 - DNA, 16 bp, P. troglodytes
aataatattccactgt

SEQ ID NO: 192493 - DNA, 16 bp, P. troglodytes
aataatattccattat

SEQ ID NO: 192494 - DNA, 16 bp, P. troglodytes
aataatattccattgt

SEQ ID NO: 192495 - DNA, 16 bp, P. troglodytes
aataatattctgtttt

SEQ ID NO: 192496 - DNA, 16 bp, P. troglodytes
aataatatttcattgt

SEQ ID NO: 192497 - DNA, 16 bp, P. troglodytes
aataatatttgttgaa

SEQ ID NO: 192498 - DNA, 16 bp, P. troglodytes
aataatattttcaaag

SEQ ID NO: 192499 - DNA, 16 bp, P. troglodytes
aataatattttcttca

SEQ ID NO: 192500 - DNA, 16 bp, P. troglodytes
aataatcagaatattt

SEQ ID NO: 192501 - DNA, 16 bp, P. troglodytes
aataatcagtacaaca

SEQ ID NO: 192502 - DNA, 16 bp, P. troglodytes
aataatgaaaaagttg

SEQ ID NO: 192503 - DNA, 16 bp, P. troglodytes
aataatgatgataatg

SEQ ID NO: 192504 - DNA, 16 bp, P. troglodytes
aataatgcaaaaatta

SEQ ID NO: 192505 - DNA, 16 bp, P. troglodytes
aataatgcaattaaaa

SEQ ID NO: 192506 - DNA, 16 bp, P. troglodytes
aataatgctaccatga

SEQ ID NO: 192507 - DNA, 16 bp, P. troglodytes
aataatgctgctatga

SEQ ID NO: 192508 - DNA, 16 bp, P. troglodytes
aataatgctgtaatga

SEQ ID NO: 192509 - DNA, 16 bp, P. troglodytes
aataatgctttaaaaa

SEQ ID NO: 192510 - DNA, 16 bp, P. troglodytes
aataatgctttttttt

SEQ ID NO: 192511 - DNA, 16 bp, P. troglodytes
aataatggcccccaaa

SEQ ID NO: 192512 - DNA, 16 bp, P. troglodytes
aataatggcctccaat

SEQ ID NO: 192513 - DNA, 16 bp, P. troglodytes
aataatgggattgctg

SEQ ID NO: 192514 - DNA, 16 bp, P. troglodytes
aataatgtatacattt

SEQ ID NO: 192515 - DNA, 16 bp, P. troglodytes
aataatgtatattctt

SEQ ID NO: 192516 - DNA, 16 bp, P. troglodytes
aataatgtcctttata

SEQ ID NO: 192517 - DNA, 16 bp, P. troglodytes
aataatgtcttttaaa

SEQ ID NO: 192518 - DNA, 16 bp, P. troglodytes
aataatgttgggaaaa

SEQ ID NO: 192519 - DNA, 16 bp, P. troglodytes
aataatgtttgaccaa

SEQ ID NO: 192520 - DNA, 16 bp, P. troglodytes
aataatgtttgcttta

SEQ ID NO: 192521 - DNA, 16 bp, P. troglodytes
aataatgttttaaaac

SEQ ID NO: 192522 - DNA, 16 bp, P. troglodytes
aataatgttttagaaa

SEQ ID NO: 192523 - DNA, 16 bp, P. troglodytes
aataatgttttcaagg

SEQ ID NO: 192524 - DNA, 16 bp, P. troglodytes
aataattaccttgaat

SEQ ID NO: 192525 - DNA, 16 bp, P. troglodytes
aataattagtgatgtt

SEQ ID NO: 192526 - DNA, 16 bp, P. troglodytes
aataattatatgccaa

SEQ ID NO: 192527 - DNA, 16 bp, P. troglodytes
aataattatctggccc

SEQ ID NO: 192528 - DNA, 16 bp, P. troglodytes
aataattatttttcac

SEQ ID NO: 192529 - DNA, 16 bp, P. troglodytes
aataattcaggaaaat

SEQ ID NO: 192530 - DNA, 16 bp, P. troglodytes
aataattccattttta

SEQ ID NO: 192531 - DNA, 16 bp, P. troglodytes
aataattcttttttgt

SEQ ID NO: 192532 - DNA, 16 bp, P. troglodytes
aataattgcacatatt

SEQ ID NO: 192533 - DNA, 16 bp, P. troglodytes
aataattgcattaaat

SEQ ID NO: 192534 - DNA, 16 bp, P. troglodytes
aataattggtattcct

SEQ ID NO: 192535 - DNA, 16 bp, P. troglodytes
aataattggtcacagc

SEQ ID NO: 192536 - DNA, 16 bp, P. troglodytes
aataattgtagattca

SEQ ID NO: 192537 - DNA, 16 bp, P. troglodytes
aataatttaaaaactg

SEQ ID NO: 192538 - DNA, 16 bp, P. troglodytes
aataatttaagcaaaa

SEQ ID NO: 192539 - DNA, 16 bp, P. troglodytes
aataatttactgtata

SEQ ID NO: 192540 - DNA, 16 bp, P. troglodytes
aataatttgttttctt

SEQ ID NO: 192541 - DNA, 16 bp, P. troglodytes
aataattttgaaaatg

SEQ ID NO: 192542 - DNA, 16 bp, P. troglodytes
aataattttgacctca

SEQ ID NO: 192543 - DNA, 16 bp, P. troglodytes
aataattttgtctaat

SEQ ID NO: 192544 - DNA, 16 bp, P. troglodytes
aataattttgttcttt

SEQ ID NO: 192545 - DNA, 16 bp, P. troglodytes
aataatttttccagga

SEQ ID NO: 192546 - DNA, 16 bp, P. troglodytes
aataatttttgaaaca

SEQ ID NO: 192547 - DNA, 16 bp, P. troglodytes
aatacaaaaatcagct

SEQ ID NO: 192548 - DNA, 16 bp, P. troglodytes
aatacaaaaatgtttt

SEQ ID NO: 192549 - DNA, 16 bp, P. troglodytes
aatacaaaaggtaaat

SEQ ID NO: 192550 - DNA, 16 bp, P. troglodytes
aatacaaaatgtatta

SEQ ID NO: 192551 - DNA, 16 bp, P. troglodytes
aatacaaagagaggaa

SEQ ID NO: 192552 - DNA, 16 bp, P. troglodytes
aatacaaataaaatgt

SEQ ID NO: 192553 - DNA, 16 bp, P. troglodytes
aatacaaatataaatg

SEQ ID NO: 192554 - DNA, 16 bp, P. troglodytes
aatacaaatattccaa

SEQ ID NO: 192555 - DNA, 16 bp, P. troglodytes
aatacaaattaaaagc

SEQ ID NO: 192556 - DNA, 16 bp, P. troglodytes
aatacaatggcatgat

SEQ ID NO: 192557 - DNA, 16 bp, P. troglodytes
aatacacataacattt

SEQ ID NO: 192558 - DNA, 16 bp, P. troglodytes
aatacacatatacaca

SEQ ID NO: 192559 - DNA, 16 bp, P. troglodytes
aatacacatttattat

SEQ ID NO: 192560 - DNA, 16 bp, P. troglodytes
aatacacatttgaaaa

SEQ ID NO: 192561 - DNA, 16 bp, P. troglodytes
aatacacatttgttga

SEQ ID NO: 192562 - DNA, 16 bp, P. troglodytes
aatacagaaaactggt

SEQ ID NO: 192563 - DNA, 16 bp, P. troglodytes
aatacagaaaagtaca

SEQ ID NO: 192564 - DNA, 16 bp, P. troglodytes
aatacagaagcagaaa

SEQ ID NO: 192565 - DNA, 16 bp, P. troglodytes
aatacagacacacaca

SEQ ID NO: 192566 - DNA, 16 bp, P. troglodytes
aatacagagaacatca

SEQ ID NO: 192567 - DNA, 16 bp, P. troglodytes
aatacagagagatcct

SEQ ID NO: 192568 - DNA, 16 bp, P. troglodytes
aatacagattttgata

SEQ ID NO: 192569 - DNA, 16 bp, P. troglodytes
aatacagcaccttcaa

SEQ ID NO: 192570 - DNA, 16 bp, P. troglodytes
aatacagcagtgaaca

SEQ ID NO: 192571 - DNA, 16 bp, P. troglodytes
aatacaggaacagaaa

SEQ ID NO: 192572 - DNA, 19 bp, P. troglodytes
aatacaggagcaccaagat

SEQ ID NO: 192573 - DNA, 16 bp, P. troglodytes
aatacaggcttctgat

SEQ ID NO: 192574 - DNA, 17 bp, P. troglodytes
aatacagtaaagttgca

SEQ ID NO: 192575 - DNA, 17 bp, P. troglodytes
aatacagtaaattggta

SEQ ID NO: 192576 - DNA, 16 bp, P. troglodytes
aatacagtacaataca

SEQ ID NO: 192577 - DNA, 16 bp, P. troglodytes
aatacagtagccactg

SEQ ID NO: 192578 - DNA, 16 bp, P. troglodytes
aatacagtattttaaa

SEQ ID NO: 192579 - DNA, 16 bp, P. troglodytes
aatacagtgtttccaa

SEQ ID NO: 192580 - DNA, 16 bp, P. troglodytes
aatacagtttaatttt

SEQ ID NO: 192581 - DNA, 16 bp, P. troglodytes
aatacagtttttaaaa

SEQ ID NO: 192582 - DNA, 16 bp, P. troglodytes
aatacataaacaaatg

SEQ ID NO: 192583 - DNA, 16 bp, P. troglodytes
aatacataaagaaatg

SEQ ID NO: 192584 - DNA, 16 bp, P. troglodytes
aatacatacatacaca

SEQ ID NO: 192585 - DNA, 16 bp, P. troglodytes
aatacatacatacata

SEQ ID NO: 192586 - DNA, 16 bp, P. troglodytes
aatacatatataaatg

SEQ ID NO: 192587 - DNA, 16 bp, P. troglodytes
aatacatatttttctc

SEQ ID NO: 192588 - DNA, 16 bp, P. troglodytes
aatacatatttttgaa

SEQ ID NO: 192589 - DNA, 16 bp, P. troglodytes
aatacatgaagaaaat

SEQ ID NO: 192590 - DNA, 16 bp, P. troglodytes
aatacatgtaaaatgt

SEQ ID NO: 192591 - DNA, 16 bp, P. troglodytes
aatacatgtaaaattt

SEQ ID NO: 192592 - DNA, 16 bp, P. troglodytes
aatacatgtgtatgta

SEQ ID NO: 192593 - DNA, 16 bp, P. troglodytes
aatacattaaaaagat

SEQ ID NO: 192594 - DNA, 16 bp, P. troglodytes
aatacattattttgtt

SEQ ID NO: 192595 - DNA, 16 bp, P. troglodytes
aatacattcacatggt

SEQ ID NO: 192596 - DNA, 16 bp, P. troglodytes
aatacattcatataat

SEQ ID NO: 192597 - DNA, 16 bp, P. troglodytes
aatacatttctctttt

SEQ ID NO: 192598 - DNA, 16 bp, P. troglodytes
aatacatttgaaaact

SEQ ID NO: 192599 - DNA, 16 bp, P. troglodytes
aatacatttgtatttt

SEQ ID NO: 192600 - DNA, 16 bp, P. troglodytes
aatacattttatgaaa

SEQ ID NO: 192601 - DNA, 16 bp, P. troglodytes
aatacattttcaaaat

SEQ ID NO: 192602 - DNA, 16 bp, P. troglodytes
aatacattttcatttc

SEQ ID NO: 192603 - DNA, 16 bp, P. troglodytes
aatacattttcttcat

SEQ ID NO: 192604 - DNA, 16 bp, P. troglodytes
aatacattttttgttt

SEQ ID NO: 192605 - DNA, 16 bp, P. troglodytes
aatacatttttttcaa

SEQ ID NO: 192606 - DNA, 16 bp, P. troglodytes
aataccaaatatttta

SEQ ID NO: 192607 - DNA, 16 bp, P. troglodytes
aataccaacattaaca

SEQ ID NO: 192608 - DNA, 16 bp, P. troglodytes
aataccaatttttaaa

SEQ ID NO: 192609 - DNA, 16 bp, P. troglodytes
aataccacaccatttt

SEQ ID NO: 192610 - DNA, 16 bp, P. troglodytes
aataccacagaagtga

SEQ ID NO: 192611 - DNA, 16 bp, P. troglodytes
aataccacagactgag

SEQ ID NO: 192612 - DNA, 16 bp, P. troglodytes
aataccacagactggg

SEQ ID NO: 192613 - DNA, 16 bp, P. troglodytes
aataccacattttctc

SEQ ID NO: 192614 - DNA, 17 bp, P. troglodytes
aataccaccatcattct

SEQ ID NO: 192615 - DNA, 16 bp, P. troglodytes
aataccactactaaaa

SEQ ID NO: 192616 - DNA, 16 bp, P. troglodytes
aataccatcacattag

SEQ ID NO: 192617 - DNA, 16 bp, P. troglodytes
aataccatgctgtttt

SEQ ID NO: 192618 - DNA, 16 bp, P. troglodytes
aatacctaacacaatg

SEQ ID NO: 192619 - DNA, 16 bp, P. troglodytes
aatacctgtatcccca

SEQ ID NO: 192620 - DNA, 16 bp, P. troglodytes
aatacctttaaaatat

SEQ ID NO: 192621 - DNA, 16 bp, P. troglodytes
aataccttttatttcc

SEQ ID NO: 192622 - DNA, 16 bp, P. troglodytes
aatacggtgaaacccc

SEQ ID NO: 192623 - DNA, 16 bp, P. troglodytes
aatactactactaata

SEQ ID NO: 192624 - DNA, 16 bp, P. troglodytes
aatactatattgaata

SEQ ID NO: 192625 - DNA, 22 bp, P. troglodytes
aatactatgcagccataaaaag

SEQ ID NO: 192626 - DNA, 16 bp, P. troglodytes
aatactattccattgt

SEQ ID NO: 192627 - DNA, 16 bp, P. troglodytes
aatactattctattgt

SEQ ID NO: 192628 - DNA, 16 bp, P. troglodytes
aatactatttggcaat

SEQ ID NO: 192629 - DNA, 16 bp, P. troglodytes
aatactatttggccat

SEQ ID NO: 192630 - DNA, 16 bp, P. troglodytes
aatactcattttttaa

SEQ ID NO: 192631 - DNA, 16 bp, P. troglodytes
aatactgatataaaac

SEQ ID NO: 192632 - DNA, 16 bp, P. troglodytes
aatactggcaaagcaa

SEQ ID NO: 192633 - DNA, 16 bp, P. troglodytes
aatactgtaggcagtt

SEQ ID NO: 192634 - DNA, 16 bp, P. troglodytes
aatactgtcaacttga

SEQ ID NO: 192635 - DNA, 16 bp, P. troglodytes
aatactgtgaagaaag

SEQ ID NO: 192636 - DNA, 16 bp, P. troglodytes
aatacttcattgtatg

SEQ ID NO: 192637 - DNA, 16 bp, P. troglodytes
aatacttcttgaatga

SEQ ID NO: 192638 - DNA, 16 bp, P. troglodytes
aatacttgtgattttt

SEQ ID NO: 192639 - DNA, 16 bp, P. troglodytes
aatacttgtttttctt

SEQ ID NO: 192640 - DNA, 16 bp, P. troglodytes
aatactttgttttagt

SEQ ID NO: 192641 - DNA, 16 bp, P. troglodytes
aatactttttgaaatt

SEQ ID NO: 192642 - DNA, 16 bp, P. troglodytes
aatagaaaaagaagtc

SEQ ID NO: 192643 - DNA, 16 bp, P. troglodytes
aatagaaaaataagct

SEQ ID NO: 192644 - DNA, 16 bp, P. troglodytes
aatagaaaaattagca

SEQ ID NO: 192645 - DNA, 16 bp, P. troglodytes
aatagaaaacctgaaa

SEQ ID NO: 192646 - DNA, 16 bp, P. troglodytes
aatagaaaatgttttt

SEQ ID NO: 192647 - DNA, 16 bp, P. troglodytes
aatagaaacttccaaa

SEQ ID NO: 192648 - DNA, 16 bp, P. troglodytes
aatagaaagaacctat

SEQ ID NO: 192649 - DNA, 16 bp, P. troglodytes
aatagaaagtattttt

SEQ ID NO: 192650 - DNA, 16 bp, P. troglodytes
aatagaaatactttta

SEQ ID NO: 192651 - DNA, 16 bp, P. troglodytes
aatagaaatgattttt

SEQ ID NO: 192652 - DNA, 16 bp, P. troglodytes
aatagaaattctaaaa

SEQ ID NO: 192653 - DNA, 16 bp, P. troglodytes
aatagaagaaaaactt

SEQ ID NO: 192654 - DNA, 16 bp, P. troglodytes
aatagaagaacattcc

SEQ ID NO: 192655 - DNA, 16 bp, P. troglodytes
aatagaagtgacaaga

SEQ ID NO: 192656 - DNA, 16 bp, P. troglodytes
aatagaatacagcaga

SEQ ID NO: 192657 - DNA, 16 bp, P. troglodytes
aatagaatagtacctc

SEQ ID NO: 192658 - DNA, 16 bp, P. troglodytes
aatagaattcagctgt

SEQ ID NO: 192659 - DNA, 16 bp, P. troglodytes
aatagacaaatccaca

SEQ ID NO: 192660 - DNA, 16 bp, P. troglodytes
aatagacactggggac

SEQ ID NO: 192661 - DNA, 16 bp, P. troglodytes
aatagacacttcacaa

SEQ ID NO: 192662 - DNA, 24 bp, P. troglodytes
aatagacatctacagaactctcca

SEQ ID NO: 192663 - DNA, 16 bp, P. troglodytes
aatagacattctcaaa

SEQ ID NO: 192664 - DNA, 16 bp, P. troglodytes
aatagacctataacaa

SEQ ID NO: 192665 - DNA, 16 bp, P. troglodytes
aatagactatttttta

SEQ ID NO: 192666 - DNA, 26 bp, P. troglodytes
aatagactggattaagaaaatgtggc

SEQ ID NO: 192667 - DNA, 16 bp, P. troglodytes
aatagacttttatttt

SEQ ID NO: 192668 - DNA, 16 bp, P. troglodytes
aatagacttttttaaa

SEQ ID NO: 192669 - DNA, 16 bp, P. troglodytes
aatagagaatattttt

SEQ ID NO: 192670 - DNA, 16 bp, P. troglodytes
aatagagacagaaagt

SEQ ID NO: 192671 - DNA, 16 bp, P. troglodytes
aatagagagcccagaa

SEQ ID NO: 192672 - DNA, 16 bp, P. troglodytes
aatagagcgagactcc

SEQ ID NO: 192673 - DNA, 16 bp, P. troglodytes
aatagagtgaaaccct

SEQ ID NO: 192674 - DNA, 16 bp, P. troglodytes
aatagagtttttaaaa

SEQ ID NO: 192675 - DNA, 16 bp, P. troglodytes
aatagataaattcata

SEQ ID NO: 192676 - DNA, 16 bp, P. troglodytes
aatagataattctcaa

SEQ ID NO: 192677 - DNA, 16 bp, P. troglodytes
aatagatatttcacaa

SEQ ID NO: 192678 - DNA, 16 bp, P. troglodytes
aatagatgcaaaaaag

SEQ ID NO: 192679 - DNA, 16 bp, P. troglodytes
aatagatgcagaaaaa

SEQ ID NO: 192680 - DNA, 16 bp, P. troglodytes
aatagatgctgaaaag

SEQ ID NO: 192681 - DNA, 16 bp, P. troglodytes
aatagatgttcaataa

SEQ ID NO: 192682 - DNA, 16 bp, P. troglodytes
aatagattattgttaa

SEQ ID NO: 192683 - DNA, 16 bp, P. troglodytes
aatagcaaagaataat

SEQ ID NO: 192684 - DNA, 16 bp, P. troglodytes
aatagcaaataaatga

SEQ ID NO: 192685 - DNA, 16 bp, P. troglodytes
aatagcaacaggaggt

SEQ ID NO: 192686 - DNA, 16 bp, P. troglodytes
aatagcaatcattaaa

SEQ ID NO: 192687 - DNA, 16 bp, P. troglodytes
aatagcatgggaaaaa

SEQ ID NO: 192688 - DNA, 16 bp, P. troglodytes
aatagccaaaagagaa

SEQ ID NO: 192689 - DNA, 16 bp, P. troglodytes
aatagctaacaattat

SEQ ID NO: 192690 - DNA, 16 bp, P. troglodytes
aatagctattattaaa

SEQ ID NO: 192691 - DNA, 16 bp, P. troglodytes
aatagctcattatttt

SEQ ID NO: 192692 - DNA, 16 bp, P. troglodytes
aatagctccagctttg

SEQ ID NO: 192693 - DNA, 20 bp, P. troglodytes
aatagcttaccaaccaaaaa

SEQ ID NO: 192694 - DNA, 17 bp, P. troglodytes
aataggaacagctccag

SEQ ID NO: 192695 - DNA, 16 bp, P. troglodytes
aataggaacagctctg

SEQ ID NO: 192696 - DNA, 16 bp, P. troglodytes
aataggagctatttat

SEQ ID NO: 192697 - DNA, 16 bp, P. troglodytes
aataggcaaaatattt

SEQ ID NO: 192698 - DNA, 16 bp, P. troglodytes
aataggcaaatccata

SEQ ID NO: 192699 - DNA, 16 bp, P. troglodytes
aataggccgggcgtgg

SEQ ID NO: 192700 - DNA, 16 bp, P. troglodytes
aatagggaaaaaaatc

SEQ ID NO: 192701 - DNA, 19 bp, P. troglodytes
aatagggaatcctttccct

SEQ ID NO: 192702 - DNA, 16 bp, P. troglodytes
aatagggaatctttcc

SEQ ID NO: 192703 - DNA, 16 bp, P. troglodytes
aatagggaggcccaag

SEQ ID NO: 192704 - DNA, 16 bp, P. troglodytes
aataggtactcaataa

SEQ ID NO: 192705 - DNA, 16 bp, P. troglodytes
aataggtgttcaataa

SEQ ID NO: 192706 - DNA, 16 bp, P. troglodytes
aatagtaactacctca

SEQ ID NO: 192707 - DNA, 16 bp, P. troglodytes
aatagtattccattgt

SEQ ID NO: 192708 - DNA, 16 bp, P. troglodytes
aatagtattgaatctg

SEQ ID NO: 192709 - DNA, 16 bp, P. troglodytes
aatagtattttctttt

SEQ ID NO: 192710 - DNA, 16 bp, P. troglodytes
aatagtcaaattcata

SEQ ID NO: 192711 - DNA, 16 bp, P. troglodytes
aatagtccctgggcct

SEQ ID NO: 192712 - DNA, 16 bp, P. troglodytes
aatagtgaaagactga

SEQ ID NO: 192713 - DNA, 16 bp, P. troglodytes
aatagtgaacaatctg

SEQ ID NO: 192714 - DNA, 16 bp, P. troglodytes
aatagtggttacttct

SEQ ID NO: 192715 - DNA, 16 bp, P. troglodytes
aatagtgtcaataaga

SEQ ID NO: 192716 - DNA, 16 bp, P. troglodytes
aatagtgttaggaaaa

SEQ ID NO: 192717 - DNA, 16 bp, P. troglodytes
aatagttatttttttc

SEQ ID NO: 192718 - DNA, 16 bp, P. troglodytes
aatagttctttaaaaa

SEQ ID NO: 192719 - DNA, 16 bp, P. troglodytes
aatagttgttttttct

SEQ ID NO: 192720 - DNA, 16 bp, P. troglodytes
aatagttttctttctt

SEQ ID NO: 192721 - DNA, 16 bp, P. troglodytes
aatagttttgacctca

SEQ ID NO: 192722 - DNA, 16 bp, P. troglodytes
aatagtttttacattt

SEQ ID NO: 192723 - DNA, 16 bp, P. troglodytes
aatataaaacaatatg

SEQ ID NO: 192724 - DNA, 16 bp, P. troglodytes
aatataaaatgaacat

SEQ ID NO: 192725 - DNA, 16 bp, P. troglodytes
aatataaacaaatgta

SEQ ID NO: 192726 - DNA, 16 bp, P. troglodytes
aatataaaccatttta

SEQ ID NO: 192727 - DNA, 16 bp, P. troglodytes
aatataaatacatgta

SEQ ID NO: 192728 - DNA, 16 bp, P. troglodytes
aatataaatatttctg

SEQ ID NO: 192729 - DNA, 16 bp, P. troglodytes
aatataaatgattcta

SEQ ID NO: 192730 - DNA, 16 bp, P. troglodytes
aatataaatgcaaata

SEQ ID NO: 192731 - DNA, 16 bp, P. troglodytes
aatataaatttctgtt

SEQ ID NO: 192732 - DNA, 16 bp, P. troglodytes
aatataaattttggag

SEQ ID NO: 192733 - DNA, 16 bp, P. troglodytes
aatataactaccatat

SEQ ID NO: 192734 - DNA, 18 bp, P. troglodytes
aatataagaaggcaggaa

SEQ ID NO: 192735 - DNA, 16 bp, P. troglodytes
aatatacaaagaacac

SEQ ID NO: 192736 - DNA, 16 bp, P. troglodytes
aatatacaacacatta

SEQ ID NO: 192737 - DNA, 16 bp, P. troglodytes
aatatacatacacaca

SEQ ID NO: 192738 - DNA, 16 bp, P. troglodytes
aatatacatttatatg

SEQ ID NO: 192739 - DNA, 16 bp, P. troglodytes
aatatacatttgaaaa

SEQ ID NO: 192740 - DNA, 16 bp, P. troglodytes
aatatacattttgttt

SEQ ID NO: 192741 - DNA, 16 bp, P. troglodytes
aatatacctcaataaa

SEQ ID NO: 192742 - DNA, 16 bp, P. troglodytes
aatataccttcactgt

SEQ ID NO: 192743 - DNA, 16 bp, P. troglodytes
aatatacttaacatta

SEQ ID NO: 192744 - DNA, 16 bp, P. troglodytes
aatatacttaaccaag

SEQ ID NO: 192745 - DNA, 16 bp, P. troglodytes
aatatagaaagaactc

SEQ ID NO: 192746 - DNA, 16 bp, P. troglodytes
aatatagcagaagtga

SEQ ID NO: 192747 - DNA, 16 bp, P. troglodytes
aatatataaagagctc

SEQ ID NO: 192748 - DNA, 16 bp, P. troglodytes
aatatataaagtactt

SEQ ID NO: 192749 - DNA, 16 bp, P. troglodytes
aatatataagaaattc

SEQ ID NO: 192750 - DNA, 16 bp, P. troglodytes
aatatataaggaactc

SEQ ID NO: 192751 - DNA, 16 bp, P. troglodytes
aatatatacaattgtt

SEQ ID NO: 192752 - DNA, 16 bp, P. troglodytes
aatatatacagtatat

SEQ ID NO: 192753 - DNA, 16 bp, P. troglodytes
aatatatacatgaaaa

SEQ ID NO: 192754 - DNA, 16 bp, P. troglodytes
aatatatacattgtat

SEQ ID NO: 192755 - DNA, 16 bp, P. troglodytes
aatatatacttacata

SEQ ID NO: 192756 - DNA, 16 bp, P. troglodytes
aatatatagcatttat

SEQ ID NO: 192757 - DNA, 16 bp, P. troglodytes
aatatatatatatgtg

SEQ ID NO: 192758 - DNA, 16 bp, P. troglodytes
aatatatatgcaccaa

SEQ ID NO: 192759 - DNA, 16 bp, P. troglodytes
aatatatatgcatata

SEQ ID NO: 192760 - DNA, 16 bp, P. troglodytes
aatatatatgtacatg

SEQ ID NO: 192761 - DNA, 16 bp, P. troglodytes
aatatatattctattc

SEQ ID NO: 192762 - DNA, 16 bp, P. troglodytes
aatatatgatttcatt

SEQ ID NO: 192763 - DNA, 16 bp, P. troglodytes
aatatatgtacataaa

SEQ ID NO: 192764 - DNA, 16 bp, P. troglodytes
aatatatgtgtatata

SEQ ID NO: 192765 - DNA, 16 bp, P. troglodytes
aatatattacatttct

SEQ ID NO: 192766 - DNA, 16 bp, P. troglodytes
aatatattcagaaaaa

SEQ ID NO: 192767 - DNA, 16 bp, P. troglodytes
aatatattgtcattaa

SEQ ID NO: 192768 - DNA, 16 bp, P. troglodytes
aatatatttctaagaa

SEQ ID NO: 192769 - DNA, 16 bp, P. troglodytes
aatatatttgtttttc

SEQ ID NO: 192770 - DNA, 16 bp, P. troglodytes
aatatattttatactc

SEQ ID NO: 192771 - DNA, 16 bp, P. troglodytes
aatatattttctttgt

SEQ ID NO: 192772 - DNA, 16 bp, P. troglodytes
aatatattttgaaggt

SEQ ID NO: 192773 - DNA, 16 bp, P. troglodytes
aatatattttgaagtt

SEQ ID NO: 192774 - DNA, 16 bp, P. troglodytes
aatatatttttccatc

SEQ ID NO: 192775 - DNA, 16 bp, P. troglodytes
aatatatttttcccat

SEQ ID NO: 192776 - DNA, 16 bp, P. troglodytes
aatatatttttgaaag

SEQ ID NO: 192777 - DNA, 16 bp, P. troglodytes
aatatattttttcaga

SEQ ID NO: 192778 - DNA, 16 bp, P. troglodytes
aatatatttttttctg

SEQ ID NO: 192779 - DNA, 16 bp, P. troglodytes
aatatcaaaaaattag

SEQ ID NO: 192780 - DNA, 16 bp, P. troglodytes
aatatcacagactggg

SEQ ID NO: 192781 - DNA, 16 bp, P. troglodytes
aatatcacctttctta

SEQ ID NO: 192782 - DNA, 16 bp, P. troglodytes
aatatcagaaaataat

SEQ ID NO: 192783 - DNA, 16 bp, P. troglodytes
aatatcagaaatatat

SEQ ID NO: 192784 - DNA, 16 bp, P. troglodytes
aatatcagaaatgaga

SEQ ID NO: 192785 - DNA, 16 bp, P. troglodytes
aatatcatactcaatg

SEQ ID NO: 192786 - DNA, 16 bp, P. troglodytes
aatatcattgatattt

SEQ ID NO: 192787 - DNA, 16 bp, P. troglodytes
aatatccagaatctaa

SEQ ID NO: 192788 - DNA, 22 bp, P. troglodytes
aatatccagaatctacaaagaa

SEQ ID NO: 192789 - DNA, 19 bp, P. troglodytes
aatatccagaatctacaag

SEQ ID NO: 192790 - DNA, 16 bp, P. troglodytes
aatatccagaatcttt

SEQ ID NO: 192791 - DNA, 16 bp, P. troglodytes
aatatccatgtaacaa

SEQ ID NO: 192792 - DNA, 16 bp, P. troglodytes
aatatcccaggaaaaa

SEQ ID NO: 192793 - DNA, 16 bp, P. troglodytes
aatatcccattgcaga

SEQ ID NO: 192794 - DNA, 16 bp, P. troglodytes
aatatcctgcagaatg

SEQ ID NO: 192795 - DNA, 16 bp, P. troglodytes
aatatccttccttttt

SEQ ID NO: 192796 - DNA, 16 bp, P. troglodytes
aatatccttctttgtc

SEQ ID NO: 192797 - DNA, 16 bp, P. troglodytes
aatatccttttttaaa

SEQ ID NO: 192798 - DNA, 16 bp, P. troglodytes
aatatctactatgtgc

SEQ ID NO: 192799 - DNA, 16 bp, P. troglodytes
aatatctagaagaaaa

SEQ ID NO: 192800 - DNA, 16 bp, P. troglodytes
aatatctattcaaata

SEQ ID NO: 192801 - DNA, 16 bp, P. troglodytes
aatatctgaaaataaa

SEQ ID NO: 192802 - DNA, 16 bp, P. troglodytes
aatatctgaagacatt

SEQ ID NO: 192803 - DNA, 16 bp, P. troglodytes
aatatctgggtactgt

SEQ ID NO: 192804 - DNA, 16 bp, P. troglodytes
aatatcttcagagaaa

SEQ ID NO: 192805 - DNA, 16 bp, P. troglodytes
aatatcttctttttca

SEQ ID NO: 192806 - DNA, 16 bp, P. troglodytes
aatatctttttgaaat

SEQ ID NO: 192807 - DNA, 16 bp, P. troglodytes
aatatgaaaaattagc

SEQ ID NO: 192808 - DNA, 16 bp, P. troglodytes
aatatgaaaatatgtt

SEQ ID NO: 192809 - DNA, 16 bp, P. troglodytes
aatatgaacagacact

SEQ ID NO: 192810 - DNA, 16 bp, P. troglodytes
aatatgaaggagaaat

SEQ ID NO: 192811 - DNA, 16 bp, P. troglodytes
aatatgaatttcagat

SEQ ID NO: 192812 - DNA, 16 bp, P. troglodytes
aatatgacaccaaaag

SEQ ID NO: 192813 - DNA, 16 bp, P. troglodytes
aatatgacattatttt

SEQ ID NO: 192814 - DNA, 16 bp, P. troglodytes
aatatgacattctgga

SEQ ID NO: 192815 - DNA, 16 bp, P. troglodytes
aatatgacctcatctt

SEQ ID NO: 192816 - DNA, 16 bp, P. troglodytes
aatatgagactcaaag

SEQ ID NO: 192817 - DNA, 16 bp, P. troglodytes
aatatgatgaaaatgg

SEQ ID NO: 192818 - DNA, 16 bp, P. troglodytes
aatatgatgatgatga

SEQ ID NO: 192819 - DNA, 16 bp, P. troglodytes
aatatgatttacattt

SEQ ID NO: 192820 - DNA, 16 bp, P. troglodytes
aatatgattttgaaaa

SEQ ID NO: 192821 - DNA, 16 bp, P. troglodytes
aatatgcaaataatat

SEQ ID NO: 192822 - DNA, 16 bp, P. troglodytes
aatatgcaagaaaata

SEQ ID NO: 192823 - DNA, 16 bp, P. troglodytes
aatatgcacacacaca

SEQ ID NO: 192824 - DNA, 16 bp, P. troglodytes
aatatgcagaagaatg

SEQ ID NO: 192825 - DNA, 16 bp, P. troglodytes
aatatgccacaattta

SEQ ID NO: 192826 - DNA, 16 bp, P. troglodytes
aatatgccaggcatgg

SEQ ID NO: 192827 - DNA, 16 bp, P. troglodytes
aatatgctaaaataaa

SEQ ID NO: 192828 - DNA, 16 bp, P. troglodytes
aatatgctgaaaccct

SEQ ID NO: 192829 - DNA, 16 bp, P. troglodytes
aatatgctgctgaatt

SEQ ID NO: 192830 - DNA, 16 bp, P. troglodytes
aatatggaatcctttc

SEQ ID NO: 192831 - DNA, 16 bp, P. troglodytes
aatatggacattttaa

SEQ ID NO: 192832 - DNA, 16 bp, P. troglodytes
aatatggcaaaagtga

SEQ ID NO: 192833 - DNA, 16 bp, P. troglodytes
aatatggccatactgc

SEQ ID NO: 192834 - DNA, 16 bp, P. troglodytes
aatatggctactagaa

SEQ ID NO: 192835 - DNA, 16 bp, P. troglodytes
aatatggtaaaaatgt

SEQ ID NO: 192836 - DNA, 16 bp, P. troglodytes
aatatggtgaaaccca

SEQ ID NO: 192837 - DNA, 16 bp, P. troglodytes
aatatggtgaaatcct

SEQ ID NO: 192838 - DNA, 16 bp, P. troglodytes
aatatggtgacctcct

SEQ ID NO: 192839 - DNA, 16 bp, P. troglodytes
aatatgtaaacaaata

SEQ ID NO: 192840 - DNA, 16 bp, P. troglodytes
aatatgtaaatatgta

SEQ ID NO: 192841 - DNA, 16 bp, P. troglodytes
aatatgtaagaaactc

SEQ ID NO: 192842 - DNA, 16 bp, P. troglodytes
aatatgtaatatttgt

SEQ ID NO: 192843 - DNA, 16 bp, P. troglodytes
aatatgtacatttttt

SEQ ID NO: 192844 - DNA, 16 bp, P. troglodytes
aatatgtatataacat

SEQ ID NO: 192845 - DNA, 16 bp, P. troglodytes
aatatgtattacaaat

SEQ ID NO: 192846 - DNA, 16 bp, P. troglodytes
aatatgtatttgttga

SEQ ID NO: 192847 - DNA, 16 bp, P. troglodytes
aatatgtcaaagagat

SEQ ID NO: 192848 - DNA, 16 bp, P. troglodytes
aatatgtcaaataaat

SEQ ID NO: 192849 - DNA, 16 bp, P. troglodytes
aatatgtctttaaaat

SEQ ID NO: 192850 - DNA, 16 bp, P. troglodytes
aatatgtgatttttgt

SEQ ID NO: 192851 - DNA, 16 bp, P. troglodytes
aatatgtgcatttaaa

SEQ ID NO: 192852 - DNA, 16 bp, P. troglodytes
aatatgtggctttttg

SEQ ID NO: 192853 - DNA, 16 bp, P. troglodytes
aatatgtgtgtgtgtg

SEQ ID NO: 192854 - DNA, 16 bp, P. troglodytes
aatatgttaaatatgt

SEQ ID NO: 192855 - DNA, 16 bp, P. troglodytes
aatatgttccaagacc

SEQ ID NO: 192856 - DNA, 16 bp, P. troglodytes
aatatgttctgtgtgc

SEQ ID NO: 192857 - DNA, 16 bp, P. troglodytes
aatatgttctttaaaa

SEQ ID NO: 192858 - DNA, 16 bp, P. troglodytes
aatatgttcttttaaa

SEQ ID NO: 192859 - DNA, 16 bp, P. troglodytes
aatatgttttaaaagt

SEQ ID NO: 192860 - DNA, 16 bp, P. troglodytes
aatatgttttcatttt

SEQ ID NO: 192861 - DNA, 16 bp, P. troglodytes
aatatgttttgcaaat

SEQ ID NO: 192862 - DNA, 16 bp, P. troglodytes
aatattaaaactagaa

SEQ ID NO: 192863 - DNA, 16 bp, P. troglodytes
aatattaacagaactg

SEQ ID NO: 192864 - DNA, 16 bp, P. troglodytes
aatattaaccctttat

SEQ ID NO: 192865 - DNA, 16 bp, P. troglodytes
aatattaagaaaatca

SEQ ID NO: 192866 - DNA, 16 bp, P. troglodytes
aatattaatgcaaaaa

SEQ ID NO: 192867 - DNA, 16 bp, P. troglodytes
aatattaattctttca

SEQ ID NO: 192868 - DNA, 16 bp, P. troglodytes
aatattaattttccaa

SEQ ID NO: 192869 - DNA, 16 bp, P. troglodytes
aatattaatttttcca

SEQ ID NO: 192870 - DNA, 16 bp, P. troglodytes
aatattacagaataat

SEQ ID NO: 192871 - DNA, 16 bp, P. troglodytes
aatattactcagcttt

SEQ ID NO: 192872 - DNA, 16 bp, P. troglodytes
aatattagaaattatg

SEQ ID NO: 192873 - DNA, 16 bp, P. troglodytes
aatattagccgggcgt

SEQ ID NO: 192874 - DNA, 16 bp, P. troglodytes
aatattagctgctatt

SEQ ID NO: 192875 - DNA, 16 bp, P. troglodytes
aatattatccaggaga

SEQ ID NO: 192876 - DNA, 16 bp, P. troglodytes
aatattatgttgaata

SEQ ID NO: 192877 - DNA, 16 bp, P. troglodytes
aatattattcttttga

SEQ ID NO: 192878 - DNA, 16 bp, P. troglodytes
aatattattggtgtat

SEQ ID NO: 192879 - DNA, 16 bp, P. troglodytes
aatattatttgttgaa

SEQ ID NO: 192880 - DNA, 16 bp, P. troglodytes
aatattattttcaact

SEQ ID NO: 192881 - DNA, 16 bp, P. troglodytes
aatattatttttgtct

SEQ ID NO: 192882 - DNA, 16 bp, P. troglodytes
aatattcaagaaaata

SEQ ID NO: 192883 - DNA, 16 bp, P. troglodytes
aatattcaaggaaaaa

SEQ ID NO: 192884 - DNA, 16 bp, P. troglodytes
aatattcacaaattat

SEQ ID NO: 192885 - DNA, 16 bp, P. troglodytes
aatattcactgcagca

SEQ ID NO: 192886 - DNA, 16 bp, P. troglodytes
aatattcacttttaaa

SEQ ID NO: 192887 - DNA, 16 bp, P. troglodytes
aatattcatagcagca

SEQ ID NO: 192888 - DNA, 16 bp, P. troglodytes
aatattcatttgaaaa

SEQ ID NO: 192889 - DNA, 16 bp, P. troglodytes
aatattccaaacaata

SEQ ID NO: 192890 - DNA, 16 bp, P. troglodytes
aatattccactgtgta

SEQ ID NO: 192891 - DNA, 16 bp, P. troglodytes
aatattccattttaca

SEQ ID NO: 192892 - DNA, 16 bp, P. troglodytes
aatattctataaatgt

SEQ ID NO: 192893 - DNA, 16 bp, P. troglodytes
aatattctgaaaaata

SEQ ID NO: 192894 - DNA, 16 bp, P. troglodytes
aatattctggaaaaaa

SEQ ID NO: 192895 - DNA, 16 bp, P. troglodytes
aatattgaaatatttc

SEQ ID NO: 192896 - DNA, 16 bp, P. troglodytes
aatattgaaattaggc

SEQ ID NO: 192897 - DNA, 16 bp, P. troglodytes
aatattgaacattttt

SEQ ID NO: 192898 - DNA, 16 bp, P. troglodytes
aatattgaatattggc

SEQ ID NO: 192899 - DNA, 16 bp, P. troglodytes
aatattgaatcttcct

SEQ ID NO: 192900 - DNA, 16 bp, P. troglodytes
aatattgagatatttt

SEQ ID NO: 192901 - DNA, 16 bp, P. troglodytes
aatattgctaaaatga

SEQ ID NO: 192902 - DNA, 16 bp, P. troglodytes
aatattggctattatt

SEQ ID NO: 192903 - DNA, 16 bp, P. troglodytes
aatattgttaaaatgt

SEQ ID NO: 192904 - DNA, 16 bp, P. troglodytes
aatattgttaagatgg

SEQ ID NO: 192905 - DNA, 16 bp, P. troglodytes
aatattgttttcattt

SEQ ID NO: 192906 - DNA, 16 bp, P. troglodytes
aatattgttttgtctc

SEQ ID NO: 192907 - DNA, 16 bp, P. troglodytes
aatatttaaaagaaca

SEQ ID NO: 192908 - DNA, 16 bp, P. troglodytes
aatatttaaaatctac

SEQ ID NO: 192909 - DNA, 16 bp, P. troglodytes
aatatttaaatatgtg

SEQ ID NO: 192910 - DNA, 16 bp, P. troglodytes
aatatttaacaactgg

SEQ ID NO: 192911 - DNA, 16 bp, P. troglodytes
aatatttaacttaacc

SEQ ID NO: 192912 - DNA, 16 bp, P. troglodytes
aatatttaatgagtac

SEQ ID NO: 192913 - DNA, 16 bp, P. troglodytes
aatatttacaacattt

SEQ ID NO: 192914 - DNA, 16 bp, P. troglodytes
aatatttacatatttg

SEQ ID NO: 192915 - DNA, 16 bp, P. troglodytes
aatatttaccaaaatt

SEQ ID NO: 192916 - DNA, 16 bp, P. troglodytes
aatatttactattttg

SEQ ID NO: 192917 - DNA, 16 bp, P. troglodytes
aatatttactctctgg

SEQ ID NO: 192918 - DNA, 16 bp, P. troglodytes
aatatttataggaata

SEQ ID NO: 192919 - DNA, 16 bp, P. troglodytes
aatatttatcattttg

SEQ ID NO: 192920 - DNA, 16 bp, P. troglodytes
aatatttatgaaagga

SEQ ID NO: 192921 - DNA, 16 bp, P. troglodytes
aatatttatggataaa

SEQ ID NO: 192922 - DNA, 16 bp, P. troglodytes
aatatttattgaacac

SEQ ID NO: 192923 - DNA, 16 bp, P. troglodytes
aatatttattgactat

SEQ ID NO: 192924 - DNA, 16 bp, P. troglodytes
aatatttatttgcata

SEQ ID NO: 192925 - DNA, 16 bp, P. troglodytes
aatatttatttttgct

SEQ ID NO: 192926 - DNA, 16 bp, P. troglodytes
aatatttcaaaatgtg

SEQ ID NO: 192927 - DNA, 16 bp, P. troglodytes
aatatttcaaagaaat

SEQ ID NO: 192928 - DNA, 16 bp, P. troglodytes
aatatttcaagaataa

SEQ ID NO: 192929 - DNA, 16 bp, P. troglodytes
aatatttcaagataaa

SEQ ID NO: 192930 - DNA, 16 bp, P. troglodytes
aatatttcataattca

SEQ ID NO: 192931 - DNA, 16 bp, P. troglodytes
aatatttcatagtttt

SEQ ID NO: 192932 - DNA, 16 bp, P. troglodytes
aatatttcatcattaa

SEQ ID NO: 192933 - DNA, 16 bp, P. troglodytes
aatatttcccaaattt

SEQ ID NO: 192934 - DNA, 16 bp, P. troglodytes
aatatttctatatgta

SEQ ID NO: 192935 - DNA, 16 bp, P. troglodytes
aatatttcttaaaaag

SEQ ID NO: 192936 - DNA, 16 bp, P. troglodytes
aatatttcttaaaagt

SEQ ID NO: 192937 - DNA, 16 bp, P. troglodytes
aatatttcttcaaata

SEQ ID NO: 192938 - DNA, 16 bp, P. troglodytes
aatatttgaaaaacat

SEQ ID NO: 192939 - DNA, 16 bp, P. troglodytes
aatatttgaaacaata

SEQ ID NO: 192940 - DNA, 16 bp, P. troglodytes
aatatttgaaatcaaa

SEQ ID NO: 192941 - DNA, 16 bp, P. troglodytes
aatatttgaacaaata

SEQ ID NO: 192942 - DNA, 16 bp, P. troglodytes
aatatttgaacataat

SEQ ID NO: 192943 - DNA, 16 bp, P. troglodytes
aatatttgaagaggtt

SEQ ID NO: 192944 - DNA, 16 bp, P. troglodytes
aatatttgaaggaata

SEQ ID NO: 192945 - DNA, 16 bp, P. troglodytes
aatatttgcaaaatgt

SEQ ID NO: 192946 - DNA, 16 bp, P. troglodytes
aatatttgcaaactat

SEQ ID NO: 192947 - DNA, 16 bp, P. troglodytes
aatatttgcaaattat

SEQ ID NO: 192948 - DNA, 16 bp, P. troglodytes
aatatttgcaacattt

SEQ ID NO: 192949 - DNA, 16 bp, P. troglodytes
aatatttgcatatata

SEQ ID NO: 192950 - DNA, 16 bp, P. troglodytes
aatatttgcattaaaa

SEQ ID NO: 192951 - DNA, 16 bp, P. troglodytes
aatatttgcttaaaat

SEQ ID NO: 192952 - DNA, 16 bp, P. troglodytes
aatatttgctttatat

SEQ ID NO: 192953 - DNA, 16 bp, P. troglodytes
aatatttgcttttctg

SEQ ID NO: 192954 - DNA, 16 bp, P. troglodytes
aatatttggaaaagaa

SEQ ID NO: 192955 - DNA, 16 bp, P. troglodytes
aatatttggaaaatat

SEQ ID NO: 192956 - DNA, 16 bp, P. troglodytes
aatatttggaacatat

SEQ ID NO: 192957 - DNA, 16 bp, P. troglodytes
aatatttggaagaaaa

SEQ ID NO: 192958 - DNA, 16 bp, P. troglodytes
aatatttggaatattt

SEQ ID NO: 192959 - DNA, 16 bp, P. troglodytes
aatatttggagaaaat

SEQ ID NO: 192960 - DNA, 16 bp, P. troglodytes
aatatttggatatatt

SEQ ID NO: 192961 - DNA, 16 bp, P. troglodytes
aatatttgtaaaccat

SEQ ID NO: 192962 - DNA, 16 bp, P. troglodytes
aatatttgtaaactgt

SEQ ID NO: 192963 - DNA, 16 bp, P. troglodytes
aatatttgtaacatat

SEQ ID NO: 192964 - DNA, 16 bp, P. troglodytes
aatatttgtcatattt

SEQ ID NO: 192965 - DNA, 16 bp, P. troglodytes
aatatttgtctttctg

SEQ ID NO: 192966 - DNA, 16 bp, P. troglodytes
aatatttgtctttttg

SEQ ID NO: 192967 - DNA, 16 bp, P. troglodytes
aatatttgtggaaaga

SEQ ID NO: 192968 - DNA, 16 bp, P. troglodytes
aatatttgttgagtgc

SEQ ID NO: 192969 - DNA, 16 bp, P. troglodytes
aatatttgttggctga

SEQ ID NO: 192970 - DNA, 16 bp, P. troglodytes
aatatttgttttcaaa

SEQ ID NO: 192971 - DNA, 16 bp, P. troglodytes
aatatttgttttcctt

SEQ ID NO: 192972 - DNA, 16 bp, P. troglodytes
aatattttaaaatgtg

SEQ ID NO: 192973 - DNA, 16 bp, P. troglodytes
aatattttaaaggtat

SEQ ID NO: 192974 - DNA, 16 bp, P. troglodytes
aatattttaagcaaaa

SEQ ID NO: 192975 - DNA, 16 bp, P. troglodytes
aatattttacagtttg

SEQ ID NO: 192976 - DNA, 16 bp, P. troglodytes
aatattttagggaaaa

SEQ ID NO: 192977 - DNA, 16 bp, P. troglodytes
aatattttatgcaaaa

SEQ ID NO: 192978 - DNA, 16 bp, P. troglodytes
aatattttatttcaga

SEQ ID NO: 192979 - DNA, 16 bp, P. troglodytes
aatattttcaaaatgt

SEQ ID NO: 192980 - DNA, 16 bp, P. troglodytes
aatattttcaaagaaa

SEQ ID NO: 192981 - DNA, 16 bp, P. troglodytes
aatattttcaagattt

SEQ ID NO: 192982 - DNA, 16 bp, P. troglodytes
aatattttcaagccat

SEQ ID NO: 192983 - DNA, 16 bp, P. troglodytes
aatattttcaatctat

SEQ ID NO: 192984 - DNA, 16 bp, P. troglodytes
aatattttcacattta

SEQ ID NO: 192985 - DNA, 16 bp, P. troglodytes
aatattttcagaagga

SEQ ID NO: 192986 - DNA, 16 bp, P. troglodytes
aatattttcagtgaaa

SEQ ID NO: 192987 - DNA, 16 bp, P. troglodytes
aatattttcatagaaa

SEQ ID NO: 192988 - DNA, 16 bp, P. troglodytes
aatattttcatcaccc

SEQ ID NO: 192989 - DNA, 16 bp, P. troglodytes
aatattttcattgctt

SEQ ID NO: 192990 - DNA, 16 bp, P. troglodytes
aatattttccaaataa

SEQ ID NO: 192991 - DNA, 16 bp, P. troglodytes
aatattttccataaat

SEQ ID NO: 192992 - DNA, 16 bp, P. troglodytes
aatattttccatttgt

SEQ ID NO: 192993 - DNA, 16 bp, P. troglodytes
aatattttctccaaaa

SEQ ID NO: 192994 - DNA, 16 bp, P. troglodytes
aatattttctcttagt

SEQ ID NO: 192995 - DNA, 16 bp, P. troglodytes
aatattttctctttca

SEQ ID NO: 192996 - DNA, 16 bp, P. troglodytes
aatattttctgataat

SEQ ID NO: 192997 - DNA, 16 bp, P. troglodytes
aatattttctgtcatt

SEQ ID NO: 192998 - DNA, 16 bp, P. troglodytes
aatattttcttgcttt

SEQ ID NO: 192999 - DNA, 16 bp, P. troglodytes
aatattttctttaatg

SEQ ID NO: 193000 - DNA, 16 bp, P. troglodytes
aatattttctttgaaa

SEQ ID NO: 193001 - DNA, 16 bp, P. troglodytes
aatattttctttgcct

SEQ ID NO: 193002 - DNA, 16 bp, P. troglodytes
aatattttgaaaaaca

SEQ ID NO: 193003 - DNA, 16 bp, P. troglodytes
aatattttgaaaaact

SEQ ID NO: 193004 - DNA, 16 bp, P. troglodytes
aatattttgaaaacaa

SEQ ID NO: 193005 - DNA, 16 bp, P. troglodytes
aatattttgaaaactt

SEQ ID NO: 193006 - DNA, 16 bp, P. troglodytes
aatattttgaaaatgt

SEQ ID NO: 193007 - DNA, 16 bp, P. troglodytes
aatattttgaaatcaa

SEQ ID NO: 193008 - DNA, 16 bp, P. troglodytes
aatattttgcattttt

SEQ ID NO: 193009 - DNA, 16 bp, P. troglodytes
aatattttgccttttt

SEQ ID NO: 193010 - DNA, 16 bp, P. troglodytes
aatattttgctgagaa

SEQ ID NO: 193011 - DNA, 16 bp, P. troglodytes
aatattttgctttata

SEQ ID NO: 193012 - DNA, 16 bp, P. troglodytes
aatattttggaatatt

SEQ ID NO: 193013 - DNA, 16 bp, P. troglodytes
aatattttggatatat

SEQ ID NO: 193014 - DNA, 16 bp, P. troglodytes
aatattttggtttctt

SEQ ID NO: 193015 - DNA, 16 bp, P. troglodytes
aatattttgtcatttt

SEQ ID NO: 193016 - DNA, 16 bp, P. troglodytes
aatattttgtgctttt

SEQ ID NO: 193017 - DNA, 16 bp, P. troglodytes
aatattttgttgaaaa

SEQ ID NO: 193018 - DNA, 16 bp, P. troglodytes
aatatttttaaaactc

SEQ ID NO: 193019 - DNA, 16 bp, P. troglodytes
aatatttttaaaactg

SEQ ID NO: 193020 - DNA, 16 bp, P. troglodytes
aatatttttaaactac

SEQ ID NO: 193021 - DNA, 16 bp, P. troglodytes
aatatttttaaagtgc

SEQ ID NO: 193022 - DNA, 16 bp, P. troglodytes
aatatttttaaatgtc

SEQ ID NO: 193023 - DNA, 16 bp, P. troglodytes
aatatttttatcatca

SEQ ID NO: 193024 - DNA, 16 bp, P. troglodytes
aatatttttcaaagtt

SEQ ID NO: 193025 - DNA, 16 bp, P. troglodytes
aatatttttccaaatt

SEQ ID NO: 193026 - DNA, 16 bp, P. troglodytes
aatatttttcttagaa

SEQ ID NO: 193027 - DNA, 16 bp, P. troglodytes
aatatttttcttgatt

SEQ ID NO: 193028 - DNA, 16 bp, P. troglodytes
aatatttttgatctgc

SEQ ID NO: 193029 - DNA, 16 bp, P. troglodytes
aatatttttggaaaaa

SEQ ID NO: 193030 - DNA, 16 bp, P. troglodytes
aatattttttaaagca

SEQ ID NO: 193031 - DNA, 16 bp, P. troglodytes
aatattttttagttca

SEQ ID NO: 193032 - DNA, 16 bp, P. troglodytes
aatattttttctgaaa

SEQ ID NO: 193033 - DNA, 16 bp, P. troglodytes
aatattttttgaacaa

SEQ ID NO: 193034 - DNA, 16 bp, P. troglodytes
aatattttttgagatg

SEQ ID NO: 193035 - DNA, 16 bp, P. troglodytes
aatattttttgtctgt

SEQ ID NO: 193036 - DNA, 16 bp, P. troglodytes
aatatttttttcctcc

SEQ ID NO: 193037 - DNA, 16 bp, P. troglodytes
aatcaaaaacatgata

SEQ ID NO: 193038 - DNA, 16 bp, P. troglodytes
aatcaaaacaattgaa

SEQ ID NO: 193039 - DNA, 16 bp, P. troglodytes
aatcaaaaccataatg

SEQ ID NO: 193040 - DNA, 16 bp, P. troglodytes
aatcaaaagaatattt

SEQ ID NO: 193041 - DNA, 16 bp, P. troglodytes
aatcaaaataaatgta

SEQ ID NO: 193042 - DNA, 16 bp, P. troglodytes
aatcaaaatatttcat

SEQ ID NO: 193043 - DNA, 16 bp, P. troglodytes
aatcaaaatgaaaatt

SEQ ID NO: 193044 - DNA, 16 bp, P. troglodytes
aatcaaaatgaaatat

SEQ ID NO: 193045 - DNA, 16 bp, P. troglodytes
aatcaaaatggaaatt

SEQ ID NO: 193046 - DNA, 16 bp, P. troglodytes
aatcaaaatttcagca

SEQ ID NO: 193047 - DNA, 16 bp, P. troglodytes
aatcaaagaagtgaaa

SEQ ID NO: 193048 - DNA, 16 bp, P. troglodytes
aatcaaagacaaagag

SEQ ID NO: 193049 - DNA, 16 bp, P. troglodytes
aatcaaagttttacat

SEQ ID NO: 193050 - DNA, 16 bp, P. troglodytes
aatcaaataaaatttg

SEQ ID NO: 193051 - DNA, 16 bp, P. troglodytes
aatcaaatagatgaaa

SEQ ID NO: 193052 - DNA, 16 bp, P. troglodytes
aatcaaatgaaataat

SEQ ID NO: 193053 - DNA, 16 bp, P. troglodytes
aatcaaatggaaacac

SEQ ID NO: 193054 - DNA, 16 bp, P. troglodytes
aatcaaattagaagtc

SEQ ID NO: 193055 - DNA, 16 bp, P. troglodytes
aatcaaattcaaccca

SEQ ID NO: 193056 - DNA, 16 bp, P. troglodytes
aatcaaattgctaaaa

SEQ ID NO: 193057 - DNA, 16 bp, P. troglodytes
aatcaacaaagaaact

SEQ ID NO: 193058 - DNA, 16 bp, P. troglodytes
aatcaacaaatatttt

SEQ ID NO: 193059 - DNA, 16 bp, P. troglodytes
aatcaactgtttatat

SEQ ID NO: 193060 - DNA, 16 bp, P. troglodytes
aatcaagaggtcagga

SEQ ID NO: 193061 - DNA, 16 bp, P. troglodytes
aatcaagataaataat

SEQ ID NO: 193062 - DNA, 16 bp, P. troglodytes
aatcaagataataaac

SEQ ID NO: 193063 - DNA, 17 bp, P. troglodytes
aatcaaggtttaaggga

SEQ ID NO: 193064 - DNA, 16 bp, P. troglodytes
aatcaataaaattgaa

SEQ ID NO: 193065 - DNA, 16 bp, P. troglodytes
aatcaataacagaaga

SEQ ID NO: 193066 - DNA, 16 bp, P. troglodytes
aatcaatacatgtaat

SEQ ID NO: 193067 - DNA, 16 bp, P. troglodytes
aatcaatatcaagaaa

SEQ ID NO: 193068 - DNA, 16 bp, P. troglodytes
aatcaatatcactaaa

SEQ ID NO: 193069 - DNA, 16 bp, P. troglodytes
aatcaatcaattgaaa

SEQ ID NO: 193070 - DNA, 16 bp, P. troglodytes
aatcaatcagtcaata

SEQ ID NO: 193071 - DNA, 16 bp, P. troglodytes
aatcaatctaagtgcc

SEQ ID NO: 193072 - DNA, 16 bp, P. troglodytes
aatcaatgaaatataa

SEQ ID NO: 193073 - DNA, 16 bp, P. troglodytes
aatcaatgtagaaaaa

SEQ ID NO: 193074 - DNA, 16 bp, P. troglodytes
aatcaatgtgtaaaaa

SEQ ID NO: 193075 - DNA, 16 bp, P. troglodytes
aatcaattgcaacaaa

SEQ ID NO: 193076 - DNA, 16 bp, P. troglodytes
aatcaatttgtacaat

SEQ ID NO: 193077 - DNA, 16 bp, P. troglodytes
aatcaatttttgtata

SEQ ID NO: 193078 - DNA, 16 bp, P. troglodytes
aatcacaacttcagga

SEQ ID NO: 193079 - DNA, 17 bp, P. troglodytes
aatcacaaggtcaggag

SEQ ID NO: 193080 - DNA, 16 bp, P. troglodytes
aatcacagaaacagaa

SEQ ID NO: 193081 - DNA, 16 bp, P. troglodytes
aatcacagcagtttgg

SEQ ID NO: 193082 - DNA, 16 bp, P. troglodytes
aatcacagcttattgc

SEQ ID NO: 193083 - DNA, 16 bp, P. troglodytes
aatcacatctacaaaa

SEQ ID NO: 193084 - DNA, 16 bp, P. troglodytes
aatcacattaaaaagt

SEQ ID NO: 193085 - DNA, 16 bp, P. troglodytes
aatcacatttctacac

SEQ ID NO: 193086 - DNA, 16 bp, P. troglodytes
aatcaccacattgtct

SEQ ID NO: 193087 - DNA, 16 bp, P. troglodytes
aatcaccattttaaaa

SEQ ID NO: 193088 - DNA, 16 bp, P. troglodytes
aatcacccttacccca

SEQ ID NO: 193089 - DNA, 16 bp, P. troglodytes
aatcacctggagagct

SEQ ID NO: 193090 - DNA, 17 bp, P. troglodytes
aatcacgaggtcaggag

SEQ ID NO: 193091 - DNA, 16 bp, P. troglodytes
aatcacttatatcttt

SEQ ID NO: 193092 - DNA, 16 bp, P. troglodytes
aatcacttgaaaccgg

SEQ ID NO: 193093 - DNA, 20 bp, P. troglodytes
aatcacttgaacccgggaaa

SEQ ID NO: 193094 - DNA, 16 bp, P. troglodytes
aatcacttgaactagg

SEQ ID NO: 193095 - DNA, 16 bp, P. troglodytes
aatcactttttaaaat

SEQ ID NO: 193096 - DNA, 16 bp, P. troglodytes
aatcagaaaagtaatt

SEQ ID NO: 193097 - DNA, 16 bp, P. troglodytes
aatcagaaaccctggg

SEQ ID NO: 193098 - DNA, 16 bp, P. troglodytes
aatcagaaagacataa

SEQ ID NO: 193099 - DNA, 16 bp, P. troglodytes
aatcagaaatccaaaa

SEQ ID NO: 193100 - DNA, 16 bp, P. troglodytes
aatcagaaatgacaaa

SEQ ID NO: 193101 - DNA, 16 bp, P. troglodytes
aatcagaaattttaaa

SEQ ID NO: 193102 - DNA, 23 bp, P. troglodytes
aatcagaacatggagattggtgc

SEQ ID NO: 193103 - DNA, 16 bp, P. troglodytes
aatcagaagacagaaa

SEQ ID NO: 193104 - DNA, 16 bp, P. troglodytes
aatcagaagctctggg

SEQ ID NO: 193105 - DNA, 16 bp, P. troglodytes
aatcagacttttaaaa

SEQ ID NO: 193106 - DNA, 16 bp, P. troglodytes
aatcagagaagcagaa

SEQ ID NO: 193107 - DNA, 16 bp, P. troglodytes
aatcagagcagaaaag

SEQ ID NO: 193108 - DNA, 16 bp, P. troglodytes
aatcagagtgcctctt

SEQ ID NO: 193109 - DNA, 16 bp, P. troglodytes
aatcagatatgcattt

SEQ ID NO: 193110 - DNA, 16 bp, P. troglodytes
aatcagcaaagagaaa

SEQ ID NO: 193111 - DNA, 16 bp, P. troglodytes
aatcagcaagagaaaa

SEQ ID NO: 193112 - DNA, 16 bp, P. troglodytes
aatcagcactctgtag

SEQ ID NO: 193113 - DNA, 16 bp, P. troglodytes
aatcagcctaaatgtc

SEQ ID NO: 193114 - DNA, 16 bp, P. troglodytes
aatcagcctgggcaac

SEQ ID NO: 193115 - DNA, 16 bp, P. troglodytes
aatcagctcctggatt

SEQ ID NO: 193116 - DNA, 16 bp, P. troglodytes
aatcagctgactttaa

SEQ ID NO: 193117 - DNA, 16 bp, P. troglodytes
aatcagctgttaatct

SEQ ID NO: 193118 - DNA, 16 bp, P. troglodytes
aatcagcttgtcaatt

SEQ ID NO: 193119 - DNA, 16 bp, P. troglodytes
aatcaggaaaggaaag

SEQ ID NO: 193120 - DNA, 16 bp, P. troglodytes
aatcaggagtttgaga

SEQ ID NO: 193121 - DNA, 16 bp, P. troglodytes
aatcaggcaggaaaaa

SEQ ID NO: 193122 - DNA, 16 bp, P. troglodytes
aatcaggttaaaatga

SEQ ID NO: 193123 - DNA, 16 bp, P. troglodytes
aatcagtaattaaaaa

SEQ ID NO: 193124 - DNA, 16 bp, P. troglodytes
aatcagtatatgaaag

SEQ ID NO: 193125 - DNA, 16 bp, P. troglodytes
aatcagtatttcaaag

SEQ ID NO: 193126 - DNA, 16 bp, P. troglodytes
aatcatacaatatgta

SEQ ID NO: 193127 - DNA, 16 bp, P. troglodytes
aatcatacaatatttg

SEQ ID NO: 193128 - DNA, 16 bp, P. troglodytes
aatcatacattatgta

SEQ ID NO: 193129 - DNA, 16 bp, P. troglodytes
aatcatagctcactgt

SEQ ID NO: 193130 - DNA, 16 bp, P. troglodytes
aatcatagctgactgc

SEQ ID NO: 193131 - DNA, 16 bp, P. troglodytes
aatcatatatctgaaa

SEQ ID NO: 193132 - DNA, 16 bp, P. troglodytes
aatcatatgcagaaga

SEQ ID NO: 193133 - DNA, 16 bp, P. troglodytes
aatcatattccattgt

SEQ ID NO: 193134 - DNA, 16 bp, P. troglodytes
aatcatatttcattgt

SEQ ID NO: 193135 - DNA, 16 bp, P. troglodytes
aatcatcaaagaaata

SEQ ID NO: 193136 - DNA, 16 bp, P. troglodytes
aatcatcagaaaaatg

SEQ ID NO: 193137 - DNA, 16 bp, P. troglodytes
aatcatcagagtaaac

SEQ ID NO: 193138 - DNA, 16 bp, P. troglodytes
aatcatcagattcacc

SEQ ID NO: 193139 - DNA, 16 bp, P. troglodytes
aatcatcagggagatg

SEQ ID NO: 193140 - DNA, 16 bp, P. troglodytes
aatcatcattctgagc

SEQ ID NO: 193141 - DNA, 16 bp, P. troglodytes
aatcatctaacacaaa

SEQ ID NO: 193142 - DNA, 16 bp, P. troglodytes
aatcatctctagtctt

SEQ ID NO: 193143 - DNA, 17 bp, P. troglodytes
aatcatgaggtcaggag

SEQ ID NO: 193144 - DNA, 16 bp, P. troglodytes
aatcatgataaaacaa

SEQ ID NO: 193145 - DNA, 16 bp, P. troglodytes
aatcatgcaagagaaa

SEQ ID NO: 193146 - DNA, 16 bp, P. troglodytes
aatcatgccttcccaa

SEQ ID NO: 193147 - DNA, 16 bp, P. troglodytes
aatcatgcttcttcca

SEQ ID NO: 193148 - DNA, 16 bp, P. troglodytes
aatcatggtggaagaa

SEQ ID NO: 193149 - DNA, 16 bp, P. troglodytes
aatcatggtggcaggt

SEQ ID NO: 193150 - DNA, 16 bp, P. troglodytes
aatcatggtggtggtt

SEQ ID NO: 193151 - DNA, 16 bp, P. troglodytes
aatcatgtcttttgta

SEQ ID NO: 193152 - DNA, 16 bp, P. troglodytes
aatcatgtggttttgg

SEQ ID NO: 193153 - DNA, 16 bp, P. troglodytes
aatcatgtgtttttgt

SEQ ID NO: 193154 - DNA, 16 bp, P. troglodytes
aatcattagaaaaatg

SEQ ID NO: 193155 - DNA, 16 bp, P. troglodytes
aatcatttaaaaatgt

SEQ ID NO: 193156 - DNA, 16 bp, P. troglodytes
aatcatttaattctca

SEQ ID NO: 193157 - DNA, 16 bp, P. troglodytes
aatcatttccccattg

SEQ ID NO: 193158 - DNA, 16 bp, P. troglodytes
aatcatttctagattt

SEQ ID NO: 193159 - DNA, 16 bp, P. troglodytes
aatcatttgaaccagg

SEQ ID NO: 193160 - DNA, 16 bp, P. troglodytes
aatcatttgtatttct

SEQ ID NO: 193161 - DNA, 16 bp, P. troglodytes
aatcattttgaaattt

SEQ ID NO: 193162 - DNA, 16 bp, P. troglodytes
aatccaaaacattttg

SEQ ID NO: 193163 - DNA, 16 bp, P. troglodytes
aatccaaagcaaaaag

SEQ ID NO: 193164 - DNA, 16 bp, P. troglodytes
aatccaaatcaaaatc

SEQ ID NO: 193165 - DNA, 16 bp, P. troglodytes
aatccaacagcatatt

SEQ ID NO: 193166 - DNA, 16 bp, P. troglodytes
aatccaagcactttga

SEQ ID NO: 193167 - DNA, 16 bp, P. troglodytes
aatccaagtcaagtca

SEQ ID NO: 193168 - DNA, 16 bp, P. troglodytes
aatccaatttaaaaac

SEQ ID NO: 193169 - DNA, 16 bp, P. troglodytes
aatccaatttttaaaa

SEQ ID NO: 193170 - DNA, 16 bp, P. troglodytes
aatccacagatgcaga

SEQ ID NO: 193171 - DNA, 16 bp, P. troglodytes
aatccacatatttaca

SEQ ID NO: 193172 - DNA, 16 bp, P. troglodytes
aatccacccacctcag

SEQ ID NO: 193173 - DNA, 16 bp, P. troglodytes
aatccacccacctcgg

SEQ ID NO: 193174 - DNA, 19 bp, P. troglodytes
aatccacccacctcggcct

SEQ ID NO: 193175 - DNA, 16 bp, P. troglodytes
aatccacccaccttgg

SEQ ID NO: 193176 - DNA, 18 bp, P. troglodytes
aatccacccgcctcggcc

SEQ ID NO: 193177 - DNA, 17 bp, P. troglodytes
aatccacccgccttggc

SEQ ID NO: 193178 - DNA, 16 bp, P. troglodytes
aatccacctcttgttt

SEQ ID NO: 193179 - DNA, 16 bp, P. troglodytes
aatccacctgcctcag

SEQ ID NO: 193180 - DNA, 16 bp, P. troglodytes
aatccacctgccttag

SEQ ID NO: 193181 - DNA, 16 bp, P. troglodytes
aatccacctgccttgg

SEQ ID NO: 193182 - DNA, 16 bp, P. troglodytes
aatccagaatccagaa

SEQ ID NO: 193183 - DNA, 21 bp, P. troglodytes
aatccagcagcacatcaaaaa

SEQ ID NO: 193184 - DNA, 16 bp, P. troglodytes
aatccagcagcagatc

SEQ ID NO: 193185 - DNA, 16 bp, P. troglodytes
aatccaggagatggtt

SEQ ID NO: 193186 - DNA, 24 bp, P. troglodytes
aatccaggagctggttttttgaaa

SEQ ID NO: 193187 - DNA, 16 bp, P. troglodytes
aatccaggcacagaaa

SEQ ID NO: 193188 - DNA, 17 bp, P. troglodytes
aatccatctggtcctgg

SEQ ID NO: 193189 - DNA, 16 bp, P. troglodytes
aatccatgaaagaaat

SEQ ID NO: 193190 - DNA, 16 bp, P. troglodytes
aatccatgaataatga

SEQ ID NO: 193191 - DNA, 16 bp, P. troglodytes
aatccattcattcatt

SEQ ID NO: 193192 - DNA, 16 bp, P. troglodytes
aatccattttgatttg

SEQ ID NO: 193193 - DNA, 16 bp, P. troglodytes
aatccatttttaaaat

SEQ ID NO: 193194 - DNA, 16 bp, P. troglodytes
aatcccaaatgttgaa

SEQ ID NO: 193195 - DNA, 18 bp, P. troglodytes
aatcccaacactttggga

SEQ ID NO: 193196 - DNA, 16 bp, P. troglodytes
aatcccaactctgcca

SEQ ID NO: 193197 - DNA, 16 bp, P. troglodytes
aatcccaatgctttgg

SEQ ID NO: 193198 - DNA, 16 bp, P. troglodytes
aatcccacctctgcca

SEQ ID NO: 193199 - DNA, 16 bp, P. troglodytes
aatcccactactttgg

SEQ ID NO: 193200 - DNA, 16 bp, P. troglodytes
aatcccactgctgggt

SEQ ID NO: 193201 - DNA, 16 bp, P. troglodytes
aatcccagaacttcag

SEQ ID NO: 193202 - DNA, 18 bp, P. troglodytes
aatcccagcactgtggga

SEQ ID NO: 193203 - DNA, 16 bp, P. troglodytes
aatcccagcacttcag

SEQ ID NO: 193204 - DNA, 23 bp, P. troglodytes
aatcccagcacttcgggaggccg

SEQ ID NO: 193205 - DNA, 22 bp, P. troglodytes
aatcccagcacttcgggaggct

SEQ ID NO: 193206 - DNA, 17 bp, P. troglodytes
aatcccagcgatttggg

SEQ ID NO: 193207 - DNA, 16 bp, P. troglodytes
aatcccagctactaca

SEQ ID NO: 193208 - DNA, 16 bp, P. troglodytes
aatcccagctcagcca

SEQ ID NO: 193209 - DNA, 16 bp, P. troglodytes
aatcccagctctgcct

SEQ ID NO: 193210 - DNA, 16 bp, P. troglodytes
aatcccagctgcctgg

SEQ ID NO: 193211 - DNA, 16 bp, P. troglodytes
aatcccagctgcttga

SEQ ID NO: 193212 - DNA, 16 bp, P. troglodytes
aatcccagggatgaag

SEQ ID NO: 193213 - DNA, 16 bp, P. troglodytes
aatcccaggtacttag

SEQ ID NO: 193214 - DNA, 16 bp, P. troglodytes
aatcccagtactttga

SEQ ID NO: 193215 - DNA, 17 bp, P. troglodytes
aatcccagtactttgga

SEQ ID NO: 193216 - DNA, 16 bp, P. troglodytes
aatcccatccaggttg

SEQ ID NO: 193217 - DNA, 16 bp, P. troglodytes
aatcccattcctgagg

SEQ ID NO: 193218 - DNA, 16 bp, P. troglodytes
aatccccccacctcgg

SEQ ID NO: 193219 - DNA, 20 bp, P. troglodytes
aatcccggcactttgggagt

SEQ ID NO: 193220 - DNA, 16 bp, P. troglodytes
aatcccggctctgcca

SEQ ID NO: 193221 - DNA, 21 bp, P. troglodytes
aatccctgaatagaccaataa

SEQ ID NO: 193222 - DNA, 16 bp, P. troglodytes
aatccctgaggggtag

SEQ ID NO: 193223 - DNA, 16 bp, P. troglodytes
aatccctggtgccaaa

SEQ ID NO: 193224 - DNA, 16 bp, P. troglodytes
aatcccttgttagatg

SEQ ID NO: 193225 - DNA, 16 bp, P. troglodytes
aatccgcccacctcag

SEQ ID NO: 193226 - DNA, 16 bp, P. troglodytes
aatccgcctgcctcag

SEQ ID NO: 193227 - DNA, 18 bp, P. troglodytes
aatccgcctgcctcggcc

SEQ ID NO: 193228 - DNA, 19 bp, P. troglodytes
aatccgcctgccttggcct

SEQ ID NO: 193229 - DNA, 16 bp, P. troglodytes
aatccgggaggcagag

SEQ ID NO: 193230 - DNA, 16 bp, P. troglodytes
aatcctaagaaaaaag

SEQ ID NO: 193231 - DNA, 16 bp, P. troglodytes
aatcctcaatgtgatg

SEQ ID NO: 193232 - DNA, 16 bp, P. troglodytes
aatcctcagcaaatgt

SEQ ID NO: 193233 - DNA, 16 bp, P. troglodytes
aatcctccaatctcag

SEQ ID NO: 193234 - DNA, 16 bp, P. troglodytes
aatcctcccaccttgg

SEQ ID NO: 193235 - DNA, 16 bp, P. troglodytes
aatcctcccatctcaa

SEQ ID NO: 193236 - DNA, 16 bp, P. troglodytes
aatcctcccatcttgg

SEQ ID NO: 193237 - DNA, 16 bp, P. troglodytes
aatcctcctccttcag

SEQ ID NO: 193238 - DNA, 16 bp, P. troglodytes
aatcctcctgcatcag

SEQ ID NO: 193239 - DNA, 17 bp, P. troglodytes
aatcctcctgcctcagt

SEQ ID NO: 193240 - DNA, 16 bp, P. troglodytes
aatcctcctgcctcat

SEQ ID NO: 193241 - DNA, 16 bp, P. troglodytes
aatcctcctgcctcgg

SEQ ID NO: 193242 - DNA, 16 bp, P. troglodytes
aatcctcctgcctgag

SEQ ID NO: 193243 - DNA, 16 bp, P. troglodytes
aatcctcctgtctctg

SEQ ID NO: 193244 - DNA, 16 bp, P. troglodytes
aatcctggaacagaaa

SEQ ID NO: 193245 - DNA, 16 bp, P. troglodytes
aatcctggaggtggag

SEQ ID NO: 193246 - DNA, 16 bp, P. troglodytes
aatcctggcactttga

SEQ ID NO: 193247 - DNA, 18 bp, P. troglodytes
aatcctgtcagctgagga

SEQ ID NO: 193248 - DNA, 16 bp, P. troglodytes
aatcctgtcttttgca

SEQ ID NO: 193249 - DNA, 16 bp, P. troglodytes
aatccttccttgcttc

SEQ ID NO: 193250 - DNA, 16 bp, P. troglodytes
aatccttgtgattttt

SEQ ID NO: 193251 - DNA, 19 bp, P. troglodytes
aatcctttacattgtctat

SEQ ID NO: 193252 - DNA, 16 bp, P. troglodytes
aatcctttccagaagg

SEQ ID NO: 193253 - DNA, 16 bp, P. troglodytes
aatcctttcccattgc

SEQ ID NO: 193254 - DNA, 16 bp, P. troglodytes
aatcgcttgaatccga

SEQ ID NO: 193255 - DNA, 16 bp, P. troglodytes
aatcgcttgaatccgg

SEQ ID NO: 193256 - DNA, 16 bp, P. troglodytes
aatcgcttgaggccag

SEQ ID NO: 193257 - DNA, 16 bp, P. troglodytes
aatcgtgtgaacctgg

SEQ ID NO: 193258 - DNA, 16 bp, P. troglodytes
aatctaaaaaagttga

SEQ ID NO: 193259 - DNA, 16 bp, P. troglodytes
aatctaaaattgctct

SEQ ID NO: 193260 - DNA, 16 bp, P. troglodytes
aatctaagaatgagga

SEQ ID NO: 193261 - DNA, 16 bp, P. troglodytes
aatctacctgccttgg

SEQ ID NO: 193262 - DNA, 16 bp, P. troglodytes
aatctactgttgatgg

SEQ ID NO: 193263 - DNA, 16 bp, P. troglodytes
aatctactttctgtct

SEQ ID NO: 193264 - DNA, 16 bp, P. troglodytes
aatctagaaatgattt

SEQ ID NO: 193265 - DNA, 16 bp, P. troglodytes
aatctagaagaaatga

SEQ ID NO: 193266 - DNA, 16 bp, P. troglodytes
aatctatccatttctt

SEQ ID NO: 193267 - DNA, 16 bp, P. troglodytes
aatctatgaagaaaaa

SEQ ID NO: 193268 - DNA, 16 bp, P. troglodytes
aatctattttgtctaa

SEQ ID NO: 193269 - DNA, 16 bp, P. troglodytes
aatctcaataaattca

SEQ ID NO: 193270 - DNA, 16 bp, P. troglodytes
aatctcaccctgttgc

SEQ ID NO: 193271 - DNA, 17 bp, P. troglodytes
aatctcacctcactgca

SEQ ID NO: 193272 - DNA, 16 bp, P. troglodytes
aatctcactacttgtt

SEQ ID NO: 193273 - DNA, 16 bp, P. troglodytes
aatctcagacttccag

SEQ ID NO: 193274 - DNA, 16 bp, P. troglodytes
aatctcagcaccttgg

SEQ ID NO: 193275 - DNA, 16 bp, P. troglodytes
aatctcagcactttgt

SEQ ID NO: 193276 - DNA, 16 bp, P. troglodytes
aatctcagctactggg

SEQ ID NO: 193277 - DNA, 16 bp, P. troglodytes
aatctcagctccacca

SEQ ID NO: 193278 - DNA, 16 bp, P. troglodytes
aatctcatcagaaaag

SEQ ID NO: 193279 - DNA, 16 bp, P. troglodytes
aatctcatctggaatt

SEQ ID NO: 193280 - DNA, 16 bp, P. troglodytes
aatctcatgttgaaac

SEQ ID NO: 193281 - DNA, 16 bp, P. troglodytes
aatctcattcatgaga

SEQ ID NO: 193282 - DNA, 16 bp, P. troglodytes
aatctcattttgaaat

SEQ ID NO: 193283 - DNA, 16 bp, P. troglodytes
aatctccaaactgctc

SEQ ID NO: 193284 - DNA, 16 bp, P. troglodytes
aatctccatactgttt

SEQ ID NO: 193285 - DNA, 16 bp, P. troglodytes
aatctccctattttaa

SEQ ID NO: 193286 - DNA, 16 bp, P. troglodytes
aatctcggctcactgt

SEQ ID NO: 193287 - DNA, 16 bp, P. troglodytes
aatctctctgagtctc

SEQ ID NO: 193288 - DNA, 16 bp, P. troglodytes
aatctctgatatcttt

SEQ ID NO: 193289 - DNA, 16 bp, P. troglodytes
aatctctgcctcccag

SEQ ID NO: 193290 - DNA, 16 bp, P. troglodytes
aatctctggaacctgg

SEQ ID NO: 193291 - DNA, 16 bp, P. troglodytes
aatctcttctggaaat

SEQ ID NO: 193292 - DNA, 16 bp, P. troglodytes
aatctgaaaaggaaat

SEQ ID NO: 193293 - DNA, 16 bp, P. troglodytes
aatctgaaaatgaaat

SEQ ID NO: 193294 - DNA, 16 bp, P. troglodytes
aatctgaaacacttct

SEQ ID NO: 193295 - DNA, 16 bp, P. troglodytes
aatctgaaactttctg

SEQ ID NO: 193296 - DNA, 16 bp, P. troglodytes
aatctgaaatccagaa

SEQ ID NO: 193297 - DNA, 16 bp, P. troglodytes
aatctgaaattcaaaa

SEQ ID NO: 193298 - DNA, 16 bp, P. troglodytes
aatctgaagaagaaat

SEQ ID NO: 193299 - DNA, 16 bp, P. troglodytes
aatctgaataaagtct

SEQ ID NO: 193300 - DNA, 16 bp, P. troglodytes
aatctgaattttaaaa

SEQ ID NO: 193301 - DNA, 16 bp, P. troglodytes
aatctgaatttttttt

SEQ ID NO: 193302 - DNA, 16 bp, P. troglodytes
aatctgatccccagtg

SEQ ID NO: 193303 - DNA, 16 bp, P. troglodytes
aatctgatgaaagcta

SEQ ID NO: 193304 - DNA, 16 bp, P. troglodytes
aatctgatttaaaaat

SEQ ID NO: 193305 - DNA, 16 bp, P. troglodytes
aatctgattttaaaaa

SEQ ID NO: 193306 - DNA, 16 bp, P. troglodytes
aatctgattttctttt

SEQ ID NO: 193307 - DNA, 16 bp, P. troglodytes
aatctgatttttccaa

SEQ ID NO: 193308 - DNA, 16 bp, P. troglodytes
aatctgcagaatggga

SEQ ID NO: 193309 - DNA, 16 bp, P. troglodytes
aatctgcattttaaaa

SEQ ID NO: 193310 - DNA, 16 bp, P. troglodytes
aatctgcattttaatg

SEQ ID NO: 193311 - DNA, 16 bp, P. troglodytes
aatctgcattttcaca

SEQ ID NO: 193312 - DNA, 16 bp, P. troglodytes
aatctgcattttgaca

SEQ ID NO: 193313 - DNA, 16 bp, P. troglodytes
aatctgcccacctcag

SEQ ID NO: 193314 - DNA, 18 bp, P. troglodytes
aatctgcccacctcggcc

SEQ ID NO: 193315 - DNA, 16 bp, P. troglodytes
aatctgcccaccttgg

SEQ ID NO: 193316 - DNA, 16 bp, P. troglodytes
aatctgcctgcctagg

SEQ ID NO: 193317 - DNA, 16 bp, P. troglodytes
aatctgcctgcttcag

SEQ ID NO: 193318 - DNA, 16 bp, P. troglodytes
aatctgctggcacctt

SEQ ID NO: 193319 - DNA, 16 bp, P. troglodytes
aatctgctggcatctt

SEQ ID NO: 193320 - DNA, 16 bp, P. troglodytes
aatctgctgtgattct

SEQ ID NO: 193321 - DNA, 16 bp, P. troglodytes
aatctgctttttaaca

SEQ ID NO: 193322 - DNA, 16 bp, P. troglodytes
aatctggaaaatattt

SEQ ID NO: 193323 - DNA, 16 bp, P. troglodytes
aatctggaaggcagag

SEQ ID NO: 193324 - DNA, 16 bp, P. troglodytes
aatctggagaacatta

SEQ ID NO: 193325 - DNA, 16 bp, P. troglodytes
aatctggatgtctttt

SEQ ID NO: 193326 - DNA, 16 bp, P. troglodytes
aatctggctgccttca

SEQ ID NO: 193327 - DNA, 16 bp, P. troglodytes
aatctgggaggcagaa

SEQ ID NO: 193328 - DNA, 16 bp, P. troglodytes
aatctgggtgggcacc

SEQ ID NO: 193329 - DNA, 16 bp, P. troglodytes
aatctggttcaacttt

SEQ ID NO: 193330 - DNA, 16 bp, P. troglodytes
aatctgtaaaatattt

SEQ ID NO: 193331 - DNA, 16 bp, P. troglodytes
aatctgtacaaaaaac

SEQ ID NO: 193332 - DNA, 16 bp, P. troglodytes
aatctgtacatgaatg

SEQ ID NO: 193333 - DNA, 16 bp, P. troglodytes
aatctgtatattttaa

SEQ ID NO: 193334 - DNA, 16 bp, P. troglodytes
aatctgtatttctttt

SEQ ID NO: 193335 - DNA, 16 bp, P. troglodytes
aatctgtctgcagctc

SEQ ID NO: 193336 - DNA, 16 bp, P. troglodytes
aatctgtctttgtctt

SEQ ID NO: 193337 - DNA, 16 bp, P. troglodytes
aatctgtcttttgtta

SEQ ID NO: 193338 - DNA, 16 bp, P. troglodytes
aatctgtgaacttgaa

SEQ ID NO: 193339 - DNA, 16 bp, P. troglodytes
aatctgtgaaggaaca

SEQ ID NO: 193340 - DNA, 16 bp, P. troglodytes
aatctgtgtatttttt

SEQ ID NO: 193341 - DNA, 16 bp, P. troglodytes
aatctgtgttttaaca

SEQ ID NO: 193342 - DNA, 16 bp, P. troglodytes
aatctgtttttcaaaa

SEQ ID NO: 193343 - DNA, 16 bp, P. troglodytes
aatcttaaagctctaa

SEQ ID NO: 193344 - DNA, 16 bp, P. troglodytes
aatcttatgggaccat

SEQ ID NO: 193345 - DNA, 16 bp, P. troglodytes
aatcttatttatcctt

SEQ ID NO: 193346 - DNA, 16 bp, P. troglodytes
aatcttatttggaaat

SEQ ID NO: 193347 - DNA, 16 bp, P. troglodytes
aatcttcacaacaaca

SEQ ID NO: 193348 - DNA, 16 bp, P. troglodytes
aatcttcattttaaaa

SEQ ID NO: 193349 - DNA, 16 bp, P. troglodytes
aatcttctctctcaag

SEQ ID NO: 193350 - DNA, 16 bp, P. troglodytes
aatcttctgggctcaa

SEQ ID NO: 193351 - DNA, 16 bp, P. troglodytes
aatcttgaaaagaaaa

SEQ ID NO: 193352 - DNA, 16 bp, P. troglodytes
aatcttgctctgtcac

SEQ ID NO: 193353 - DNA, 16 bp, P. troglodytes
aatcttggacttccca

SEQ ID NO: 193354 - DNA, 20 bp, P. troglodytes
aatcttggctcactgcaaca

SEQ ID NO: 193355 - DNA, 21 bp, P. troglodytes
aatcttggctcactgcaaccc

SEQ ID NO: 193356 - DNA, 17 bp, P. troglodytes
aatcttggctcagtgca

SEQ ID NO: 193357 - DNA, 16 bp, P. troglodytes
aatcttggctgggtgc

SEQ ID NO: 193358 - DNA, 16 bp, P. troglodytes
aatcttggtctccaca

SEQ ID NO: 193359 - DNA, 16 bp, P. troglodytes
aatctttaggtttttc

SEQ ID NO: 193360 - DNA, 16 bp, P. troglodytes
aatctttatcaaaatt

SEQ ID NO: 193361 - DNA, 16 bp, P. troglodytes
aatctttattgagtgc

SEQ ID NO: 193362 - DNA, 16 bp, P. troglodytes
aatctttcctgcctgc

SEQ ID NO: 193363 - DNA, 16 bp, P. troglodytes
aatctttctaaaatgt

SEQ ID NO: 193364 - DNA, 16 bp, P. troglodytes
aatctttctcaaactc

SEQ ID NO: 193365 - DNA, 16 bp, P. troglodytes
aatctttcttttgatt

SEQ ID NO: 193366 - DNA, 16 bp, P. troglodytes
aatcttttcaaagaac

SEQ ID NO: 193367 - DNA, 16 bp, P. troglodytes
aatcttttgtatttta

SEQ ID NO: 193368 - DNA, 16 bp, P. troglodytes
aatctttttcccattg

SEQ ID NO: 193369 - DNA, 16 bp, P. troglodytes
aatgaaaaaaaatctt

SEQ ID NO: 193370 - DNA, 16 bp, P. troglodytes
aatgaaaaaaatcttt

SEQ ID NO: 193371 - DNA, 16 bp, P. troglodytes
aatgaaaaaagttttt

SEQ ID NO: 193372 - DNA, 16 bp, P. troglodytes
aatgaaaaaatcctca

SEQ ID NO: 193373 - DNA, 16 bp, P. troglodytes
aatgaaaaagaaagct

SEQ ID NO: 193374 - DNA, 16 bp, P. troglodytes
aatgaaaaagttattt

SEQ ID NO: 193375 - DNA, 16 bp, P. troglodytes
aatgaaaaattattca

SEQ ID NO: 193376 - DNA, 16 bp, P. troglodytes
aatgaaaacaaaatgt

SEQ ID NO: 193377 - DNA, 16 bp, P. troglodytes
aatgaaaacacatttt

SEQ ID NO: 193378 - DNA, 16 bp, P. troglodytes
aatgaaaacattttca

SEQ ID NO: 193379 - DNA, 16 bp, P. troglodytes
aatgaaaactgagaaa

SEQ ID NO: 193380 - DNA, 16 bp, P. troglodytes
aatgaaaagaaatgca

SEQ ID NO: 193381 - DNA, 16 bp, P. troglodytes
aatgaaaagatatttt

SEQ ID NO: 193382 - DNA, 16 bp, P. troglodytes
aatgaaaagcaaaatt

SEQ ID NO: 193383 - DNA, 17 bp, P. troglodytes
aatgaaaagtctcccat

SEQ ID NO: 193384 - DNA, 16 bp, P. troglodytes
aatgaaaagttatttt

SEQ ID NO: 193385 - DNA, 16 bp, P. troglodytes
aatgaaaagtttattt

SEQ ID NO: 193386 - DNA, 16 bp, P. troglodytes
aatgaaaataactgaa

SEQ ID NO: 193387 - DNA, 16 bp, P. troglodytes
aatgaaaataatacta

SEQ ID NO: 193388 - DNA, 16 bp, P. troglodytes
aatgaaaataatgttt

SEQ ID NO: 193389 - DNA, 16 bp, P. troglodytes
aatgaaaatatatcaa

SEQ ID NO: 193390 - DNA, 16 bp, P. troglodytes
aatgaaaatgaagaca

SEQ ID NO: 193391 - DNA, 16 bp, P. troglodytes
aatgaaaatgagaaca

SEQ ID NO: 193392 - DNA, 16 bp, P. troglodytes
aatgaaaatgtatgtt

SEQ ID NO: 193393 - DNA, 16 bp, P. troglodytes
aatgaaaatgttattt

SEQ ID NO: 193394 - DNA, 16 bp, P. troglodytes
aatgaaaatgttctga

SEQ ID NO: 193395 - DNA, 16 bp, P. troglodytes
aatgaaaatgttctgt

SEQ ID NO: 193396 - DNA, 16 bp, P. troglodytes
aatgaaaattccagaa

SEQ ID NO: 193397 - DNA, 16 bp, P. troglodytes
aatgaaaattctagaa

SEQ ID NO: 193398 - DNA, 16 bp, P. troglodytes
aatgaaaattctgaaa

SEQ ID NO: 193399 - DNA, 16 bp, P. troglodytes
aatgaaaattgtatat

SEQ ID NO: 193400 - DNA, 16 bp, P. troglodytes
aatgaaaatttattct

SEQ ID NO: 193401 - DNA, 16 bp, P. troglodytes
aatgaaacaaaatttt

SEQ ID NO: 193402 - DNA, 16 bp, P. troglodytes
aatgaaacagaacaga

SEQ ID NO: 193403 - DNA, 16 bp, P. troglodytes
aatgaaacatttaaat

SEQ ID NO: 193404 - DNA, 16 bp, P. troglodytes
aatgaaaccacatctg

SEQ ID NO: 193405 - DNA, 16 bp, P. troglodytes
aatgaaaccctgtttc

SEQ ID NO: 193406 - DNA, 17 bp, P. troglodytes
aatgaaactaaagagct

SEQ ID NO: 193407 - DNA, 16 bp, P. troglodytes
aatgaaactgaatcct

SEQ ID NO: 193408 - DNA, 16 bp, P. troglodytes
aatgaaactggaggac

SEQ ID NO: 193409 - DNA, 16 bp, P. troglodytes
aatgaaactggatctt

SEQ ID NO: 193410 - DNA, 16 bp, P. troglodytes
aatgaaactttattta

SEQ ID NO: 193411 - DNA, 16 bp, P. troglodytes
aatgaaagaagacaga

SEQ ID NO: 193412 - DNA, 16 bp, P. troglodytes
aatgaaagaatgaatg

SEQ ID NO: 193413 - DNA, 16 bp, P. troglodytes
aatgaaagatttttgt

SEQ ID NO: 193414 - DNA, 16 bp, P. troglodytes
aatgaaagtgacctct

SEQ ID NO: 193415 - DNA, 16 bp, P. troglodytes
aatgaaagtgagaact

SEQ ID NO: 193416 - DNA, 16 bp, P. troglodytes
aatgaaataaaccaga

SEQ ID NO: 193417 - DNA, 16 bp, P. troglodytes
aatgaaataaagcatg

SEQ ID NO: 193418 - DNA, 16 bp, P. troglodytes
aatgaaataaatacat

SEQ ID NO: 193419 - DNA, 16 bp, P. troglodytes
aatgaaataacaaatg

SEQ ID NO: 193420 - DNA, 16 bp, P. troglodytes
aatgaaataatacaga

SEQ ID NO: 193421 - DNA, 16 bp, P. troglodytes
aatgaaataatgcatg

SEQ ID NO: 193422 - DNA, 16 bp, P. troglodytes
aatgaaatactacata

SEQ ID NO: 193423 - DNA, 16 bp, P. troglodytes
aatgaaatattttaca

SEQ ID NO: 193424 - DNA, 16 bp, P. troglodytes
aatgaaatcattttaa

SEQ ID NO: 193425 - DNA, 16 bp, P. troglodytes
aatgaaatcatttttt

SEQ ID NO: 193426 - DNA, 16 bp, P. troglodytes
aatgaaatggaatgaa

SEQ ID NO: 193427 - DNA, 16 bp, P. troglodytes
aatgaaattgaaatga

SEQ ID NO: 193428 - DNA, 16 bp, P. troglodytes
aatgaacaaacaaacc

SEQ ID NO: 193429 - DNA, 16 bp, P. troglodytes
aatgaacaaatgaata

SEQ ID NO: 193430 - DNA, 16 bp, P. troglodytes
aatgaacaaattaatg

SEQ ID NO: 193431 - DNA, 16 bp, P. troglodytes
aatgaacatgggaatg

SEQ ID NO: 193432 - DNA, 16 bp, P. troglodytes
aatgaacattttttca

SEQ ID NO: 193433 - DNA, 16 bp, P. troglodytes
aatgaaccttgaagac

SEQ ID NO: 193434 - DNA, 16 bp, P. troglodytes
aatgaacgaatgaatg

SEQ ID NO: 193435 - DNA, 16 bp, P. troglodytes
aatgaactatttgaaa

SEQ ID NO: 193436 - DNA, 16 bp, P. troglodytes
aatgaactcaaattta

SEQ ID NO: 193437 - DNA, 16 bp, P. troglodytes
aatgaactcacagttt

SEQ ID NO: 193438 - DNA, 17 bp, P. troglodytes
aatgaactccaacaaat

SEQ ID NO: 193439 - DNA, 16 bp, P. troglodytes
aatgaacttgaagaca

SEQ ID NO: 193440 - DNA, 16 bp, P. troglodytes
aatgaacttttaattt

SEQ ID NO: 193441 - DNA, 16 bp, P. troglodytes
aatgaagaaaaatgtg

SEQ ID NO: 193442 - DNA, 16 bp, P. troglodytes
aatgaagaaagcctat

SEQ ID NO: 193443 - DNA, 16 bp, P. troglodytes
aatgaagaaattgaag

SEQ ID NO: 193444 - DNA, 16 bp, P. troglodytes
aatgaagacattaaaa

SEQ ID NO: 193445 - DNA, 16 bp, P. troglodytes
aatgaagatattaaga

SEQ ID NO: 193446 - DNA, 16 bp, P. troglodytes
aatgaagatcatcaag

SEQ ID NO: 193447 - DNA, 16 bp, P. troglodytes
aatgaagatgatgatg

SEQ ID NO: 193448 - DNA, 16 bp, P. troglodytes
aatgaagatggaaatt

SEQ ID NO: 193449 - DNA, 16 bp, P. troglodytes
aatgaagccaacttga

SEQ ID NO: 193450 - DNA, 16 bp, P. troglodytes
aatgaagctgaaaaat

SEQ ID NO: 193451 - DNA, 16 bp, P. troglodytes
aatgaagctggaagcc

SEQ ID NO: 193452 - DNA, 16 bp, P. troglodytes
aatgaaggaaattctg

SEQ ID NO: 193453 - DNA, 16 bp, P. troglodytes
aatgaaggacaaaacc

SEQ ID NO: 193454 - DNA, 16 bp, P. troglodytes
aatgaaggagaaatca

SEQ ID NO: 193455 - DNA, 16 bp, P. troglodytes
aatgaaggcaaaataa

SEQ ID NO: 193456 - DNA, 16 bp, P. troglodytes
aatgaagggatttatt

SEQ ID NO: 193457 - DNA, 16 bp, P. troglodytes
aatgaaggggaaatca

SEQ ID NO: 193458 - DNA, 16 bp, P. troglodytes
aatgaaggtgaaataa

SEQ ID NO: 193459 - DNA, 16 bp, P. troglodytes
aatgaagtattatttt

SEQ ID NO: 193460 - DNA, 16 bp, P. troglodytes
aatgaagttgaaaaat

SEQ ID NO: 193461 - DNA, 16 bp, P. troglodytes
aatgaagttggacctt

SEQ ID NO: 193462 - DNA, 16 bp, P. troglodytes
aatgaagttttaaatt

SEQ ID NO: 193463 - DNA, 16 bp, P. troglodytes
aatgaagttttgggca

SEQ ID NO: 193464 - DNA, 16 bp, P. troglodytes
aatgaataaaaacatt

SEQ ID NO: 193465 - DNA, 16 bp, P. troglodytes
aatgaataaagcaaat

SEQ ID NO: 193466 - DNA, 16 bp, P. troglodytes
aatgaataaatacata

SEQ ID NO: 193467 - DNA, 16 bp, P. troglodytes
aatgaatatatatgtg

SEQ ID NO: 193468 - DNA, 16 bp, P. troglodytes
aatgaatatatttatg

SEQ ID NO: 193469 - DNA, 16 bp, P. troglodytes
aatgaatattttgaaa

SEQ ID NO: 193470 - DNA, 16 bp, P. troglodytes
aatgaatcaagcagaa

SEQ ID NO: 193471 - DNA, 16 bp, P. troglodytes
aatgaatcaatgaata

SEQ ID NO: 193472 - DNA, 17 bp, P. troglodytes
aatgaatccaggagctt

SEQ ID NO: 193473 - DNA, 16 bp, P. troglodytes
aatgaatctcacaaac

SEQ ID NO: 193474 - DNA, 16 bp, P. troglodytes
aatgaatgaaacattt

SEQ ID NO: 193475 - DNA, 16 bp, P. troglodytes
aatgaatgaaagaaca

SEQ ID NO: 193476 - DNA, 16 bp, P. troglodytes
aatgaatgaacaaatt

SEQ ID NO: 193477 - DNA, 16 bp, P. troglodytes
aatgaatgaataaaca

SEQ ID NO: 193478 - DNA, 16 bp, P. troglodytes
aatgaatgaatacaga

SEQ ID NO: 193479 - DNA, 16 bp, P. troglodytes
aatgaatgaatcaaca

SEQ ID NO: 193480 - DNA, 16 bp, P. troglodytes
aatgaatgaatgaata

SEQ ID NO: 193481 - DNA, 16 bp, P. troglodytes
aatgaatgaatgaatg

SEQ ID NO: 193482 - DNA, 16 bp, P. troglodytes
aatgaatgaatgaatt

SEQ ID NO: 193483 - DNA, 16 bp, P. troglodytes
aatgaatgaattaatg

SEQ ID NO: 193484 - DNA, 16 bp, P. troglodytes
aatgaatgacttattt

SEQ ID NO: 193485 - DNA, 16 bp, P. troglodytes
aatgaatgagagttct

SEQ ID NO: 193486 - DNA, 16 bp, P. troglodytes
aatgaatggatgcatg

SEQ ID NO: 193487 - DNA, 16 bp, P. troglodytes
aatgaatggatggatg

SEQ ID NO: 193488 - DNA, 16 bp, P. troglodytes
aatgaatgtggaaaag

SEQ ID NO: 193489 - DNA, 16 bp, P. troglodytes
aatgaatgttaatttt

SEQ ID NO: 193490 - DNA, 16 bp, P. troglodytes
aatgaatgtttgttga

SEQ ID NO: 193491 - DNA, 16 bp, P. troglodytes
aatgaattagaaaatg

SEQ ID NO: 193492 - DNA, 16 bp, P. troglodytes
aatgaattagtgaatg

SEQ ID NO: 193493 - DNA, 16 bp, P. troglodytes
aatgaattatttttct

SEQ ID NO: 193494 - DNA, 16 bp, P. troglodytes
aatgaattcaaagaaa

SEQ ID NO: 193495 - DNA, 16 bp, P. troglodytes
aatgaattcttttttt

SEQ ID NO: 193496 - DNA, 16 bp, P. troglodytes
aatgaatttggaagtg

SEQ ID NO: 193497 - DNA, 16 bp, P. troglodytes
aatgaattttttcatt

SEQ ID NO: 193498 - DNA, 16 bp, P. troglodytes
aatgacaaaaaccata

SEQ ID NO: 193499 - DNA, 16 bp, P. troglodytes
aatgacaaaatcatct

SEQ ID NO: 193500 - DNA, 16 bp, P. troglodytes
aatgacaaatactgta

SEQ ID NO: 193501 - DNA, 16 bp, P. troglodytes
aatgacaaatatttca

SEQ ID NO: 193502 - DNA, 16 bp, P. troglodytes
aatgacaaatgtataa

SEQ ID NO: 193503 - DNA, 16 bp, P. troglodytes
aatgacaattttattt

SEQ ID NO: 193504 - DNA, 16 bp, P. troglodytes
aatgacacagcagcag

SEQ ID NO: 193505 - DNA, 16 bp, P. troglodytes
aatgacactttttttt

SEQ ID NO: 193506 - DNA, 16 bp, P. troglodytes
aatgacagaaaatatt

SEQ ID NO: 193507 - DNA, 16 bp, P. troglodytes
aatgacagagaaaaga

SEQ ID NO: 193508 - DNA, 16 bp, P. troglodytes
aatgacattcttcaca

SEQ ID NO: 193509 - DNA, 16 bp, P. troglodytes
aatgacattttagaaa

SEQ ID NO: 193510 - DNA, 17 bp, P. troglodytes
aatgaccaccattctaa

SEQ ID NO: 193511 - DNA, 16 bp, P. troglodytes
aatgaccatactgtcc

SEQ ID NO: 193512 - DNA, 16 bp, P. troglodytes
aatgacctccagttct

SEQ ID NO: 193513 - DNA, 16 bp, P. troglodytes
aatgacctctttaaag

SEQ ID NO: 193514 - DNA, 16 bp, P. troglodytes
aatgactaaaacacca

SEQ ID NO: 193515 - DNA, 16 bp, P. troglodytes
aatgactgccttgctg

SEQ ID NO: 193516 - DNA, 16 bp, P. troglodytes
aatgacttatattctt

SEQ ID NO: 193517 - DNA, 16 bp, P. troglodytes
aatgacttgcccaaag

SEQ ID NO: 193518 - DNA, 16 bp, P. troglodytes
aatgacttgttcaagg

SEQ ID NO: 193519 - DNA, 16 bp, P. troglodytes
aatgactttattttct

SEQ ID NO: 193520 - DNA, 16 bp, P. troglodytes
aatgactttattttta

SEQ ID NO: 193521 - DNA, 16 bp, P. troglodytes
aatgagaaaacaattt

SEQ ID NO: 193522 - DNA, 16 bp, P. troglodytes
aatgagaaaagaacag

SEQ ID NO: 193523 - DNA, 16 bp, P. troglodytes
aatgagaaaatttttt

SEQ ID NO: 193524 - DNA, 16 bp, P. troglodytes
aatgagaaatacattt

SEQ ID NO: 193525 - DNA, 16 bp, P. troglodytes
aatgagaacacaggga

SEQ ID NO: 193526 - DNA, 16 bp, P. troglodytes
aatgagaacatgcagt

SEQ ID NO: 193527 - DNA, 16 bp, P. troglodytes
aatgagaactataaaa

SEQ ID NO: 193528 - DNA, 16 bp, P. troglodytes
aatgagaagaaaacat

SEQ ID NO: 193529 - DNA, 16 bp, P. troglodytes
aatgagaataatgata

SEQ ID NO: 193530 - DNA, 16 bp, P. troglodytes
aatgagacactgtctc

SEQ ID NO: 193531 - DNA, 16 bp, P. troglodytes
aatgagaccctgtccc

SEQ ID NO: 193532 - DNA, 16 bp, P. troglodytes
aatgagaccctgtgtc

SEQ ID NO: 193533 - DNA, 16 bp, P. troglodytes
aatgagactctgtctc

SEQ ID NO: 193534 - DNA, 16 bp, P. troglodytes
aatgagagaaaatgtt

SEQ ID NO: 193535 - DNA, 16 bp, P. troglodytes
aatgagagaaatgcaa

SEQ ID NO: 193536 - DNA, 16 bp, P. troglodytes
aatgagagccaagcaa

SEQ ID NO: 193537 - DNA, 16 bp, P. troglodytes
aatgagataatgcatg

SEQ ID NO: 193538 - DNA, 16 bp, P. troglodytes
aatgagatacaatctc

SEQ ID NO: 193539 - DNA, 16 bp, P. troglodytes
aatgagatattatttt

SEQ ID NO: 193540 - DNA, 16 bp, P. troglodytes
aatgagatttttaaaa

SEQ ID NO: 193541 - DNA, 16 bp, P. troglodytes
aatgagcaacaagaaa

SEQ ID NO: 193542 - DNA, 16 bp, P. troglodytes
aatgagcagtgaggat

SEQ ID NO: 193543 - DNA, 16 bp, P. troglodytes
aatgagcatataatga

SEQ ID NO: 193544 - DNA, 16 bp, P. troglodytes
aatgagccaattaaac

SEQ ID NO: 193545 - DNA, 16 bp, P. troglodytes
aatgagctttttaaaa

SEQ ID NO: 193546 - DNA, 16 bp, P. troglodytes
aatgaggaaaatgagg

SEQ ID NO: 193547 - DNA, 17 bp, P. troglodytes
aatgaggaagaagcaaa

SEQ ID NO: 193548 - DNA, 16 bp, P. troglodytes
aatgaggaaggcatgt

SEQ ID NO: 193549 - DNA, 16 bp, P. troglodytes
aatgaggacaataata

SEQ ID NO: 193550 - DNA, 16 bp, P. troglodytes
aatgaggacttactgt

SEQ ID NO: 193551 - DNA, 18 bp, P. troglodytes
aatgaggagctgaatgtt

SEQ ID NO: 193552 - DNA, 16 bp, P. troglodytes
aatgaggaggaagcaa

SEQ ID NO: 193553 - DNA, 16 bp, P. troglodytes
aatgaggccctgtctc

SEQ ID NO: 193554 - DNA, 16 bp, P. troglodytes
aatgagtaatttttta

SEQ ID NO: 193555 - DNA, 16 bp, P. troglodytes
aatgagtagtaatatt

SEQ ID NO: 193556 - DNA, 16 bp, P. troglodytes
aatgagtattttttaa

SEQ ID NO: 193557 - DNA, 16 bp, P. troglodytes
aatgagtgagttttca

SEQ ID NO: 193558 - DNA, 16 bp, P. troglodytes
aatgagtggataaaga

SEQ ID NO: 193559 - DNA, 16 bp, P. troglodytes
aatgagtggatggatg

SEQ ID NO: 193560 - DNA, 16 bp, P. troglodytes
aatgagttaacacatg

SEQ ID NO: 193561 - DNA, 16 bp, P. troglodytes
aatgagttaaggagga

SEQ ID NO: 193562 - DNA, 16 bp, P. troglodytes
aatgagtttcttcaca

SEQ ID NO: 193563 - DNA, 16 bp, P. troglodytes
aatgagtttgacaagt

SEQ ID NO: 193564 - DNA, 16 bp, P. troglodytes
aatgagtttggaagaa

SEQ ID NO: 193565 - DNA, 16 bp, P. troglodytes
aatgataaaaagatca

SEQ ID NO: 193566 - DNA, 16 bp, P. troglodytes
aatgataaaatagact

SEQ ID NO: 193567 - DNA, 16 bp, P. troglodytes
aatgataaaattcaag

SEQ ID NO: 193568 - DNA, 16 bp, P. troglodytes
aatgataaagatgata

SEQ ID NO: 193569 - DNA, 16 bp, P. troglodytes
aatgataaaggagtca

SEQ ID NO: 193570 - DNA, 16 bp, P. troglodytes
aatgataacaaagaca

SEQ ID NO: 193571 - DNA, 16 bp, P. troglodytes
aatgataactattatt

SEQ ID NO: 193572 - DNA, 16 bp, P. troglodytes
aatgatacagaaaata

SEQ ID NO: 193573 - DNA, 16 bp, P. troglodytes
aatgatattcttcata

SEQ ID NO: 193574 - DNA, 16 bp, P. troglodytes
aatgatattctttaca

SEQ ID NO: 193575 - DNA, 16 bp, P. troglodytes
aatgatattggtattt

SEQ ID NO: 193576 - DNA, 16 bp, P. troglodytes
aatgatatttgcttta

SEQ ID NO: 193577 - DNA, 17 bp, P. troglodytes
aatgatcaataaatact

SEQ ID NO: 193578 - DNA, 16 bp, P. troglodytes
aatgatcatcagagaa

SEQ ID NO: 193579 - DNA, 16 bp, P. troglodytes
aatgatcattcagaag

SEQ ID NO: 193580 - DNA, 16 bp, P. troglodytes
aatgatcatttatttt

SEQ ID NO: 193581 - DNA, 16 bp, P. troglodytes
aatgatcccatcacca

SEQ ID NO: 193582 - DNA, 16 bp, P. troglodytes
aatgatcctttaaatt

SEQ ID NO: 193583 - DNA, 16 bp, P. troglodytes
aatgatcttttaaaaa

SEQ ID NO: 193584 - DNA, 16 bp, P. troglodytes
aatgatcttttcaatg

SEQ ID NO: 193585 - DNA, 16 bp, P. troglodytes
aatgatgaaattaaga

SEQ ID NO: 193586 - DNA, 16 bp, P. troglodytes
aatgatgaaggggata

SEQ ID NO: 193587 - DNA, 16 bp, P. troglodytes
aatgatgaattaatgg

SEQ ID NO: 193588 - DNA, 16 bp, P. troglodytes
aatgatgacttcatgt

SEQ ID NO: 193589 - DNA, 16 bp, P. troglodytes
aatgatgagaaagcaa

SEQ ID NO: 193590 - DNA, 16 bp, P. troglodytes
aatgatgagaacatgt

SEQ ID NO: 193591 - DNA, 16 bp, P. troglodytes
aatgatgagaatgcat

SEQ ID NO: 193592 - DNA, 16 bp, P. troglodytes
aatgatgagttcatgg

SEQ ID NO: 193593 - DNA, 16 bp, P. troglodytes
aatgatgatgaagatg

SEQ ID NO: 193594 - DNA, 16 bp, P. troglodytes
aatgatgatgataatg

SEQ ID NO: 193595 - DNA, 16 bp, P. troglodytes
aatgatgatgatgaca

SEQ ID NO: 193596 - DNA, 16 bp, P. troglodytes
aatgatgatgatgata

SEQ ID NO: 193597 - DNA, 16 bp, P. troglodytes
aatgatgatgatgatg

SEQ ID NO: 193598 - DNA, 16 bp, P. troglodytes
aatgatgcaatgaaca

SEQ ID NO: 193599 - DNA, 16 bp, P. troglodytes
aatgatgtgttaatgt

SEQ ID NO: 193600 - DNA, 16 bp, P. troglodytes
aatgatgtttcagtca

SEQ ID NO: 193601 - DNA, 16 bp, P. troglodytes
aatgattaatgatatt

SEQ ID NO: 193602 - DNA, 16 bp, P. troglodytes
aatgattaatgatgtt

SEQ ID NO: 193603 - DNA, 16 bp, P. troglodytes
aatgattagtgatgat

SEQ ID NO: 193604 - DNA, 16 bp, P. troglodytes
aatgattattttcatt

SEQ ID NO: 193605 - DNA, 17 bp, P. troglodytes
aatgattgaactagttt

SEQ ID NO: 193606 - DNA, 16 bp, P. troglodytes
aatgatttaatcaacc

SEQ ID NO: 193607 - DNA, 16 bp, P. troglodytes
aatgatttcaccattc

SEQ ID NO: 193608 - DNA, 16 bp, P. troglodytes
aatgatttcttttctt

SEQ ID NO: 193609 - DNA, 16 bp, P. troglodytes
aatgattttaaacatt

SEQ ID NO: 193610 - DNA, 16 bp, P. troglodytes
aatgattttgaaaaag

SEQ ID NO: 193611 - DNA, 16 bp, P. troglodytes
aatgatttttactttt

SEQ ID NO: 193612 - DNA, 16 bp, P. troglodytes
aatgatttttttcctc

SEQ ID NO: 193613 - DNA, 16 bp, P. troglodytes
aatgatttttttctct

SEQ ID NO: 193614 - DNA, 16 bp, P. troglodytes
aatgcaaaaaagtagc

SEQ ID NO: 193615 - DNA, 16 bp, P. troglodytes
aatgcaaaaattagca

SEQ ID NO: 193616 - DNA, 16 bp, P. troglodytes
aatgcaaaaattatct

SEQ ID NO: 193617 - DNA, 16 bp, P. troglodytes
aatgcaaaactgtaaa

SEQ ID NO: 193618 - DNA, 16 bp, P. troglodytes
aatgcaaaataaaact

SEQ ID NO: 193619 - DNA, 16 bp, P. troglodytes
aatgcaaaatgaaaca

SEQ ID NO: 193620 - DNA, 16 bp, P. troglodytes
aatgcaaagcaaaact

SEQ ID NO: 193621 - DNA, 16 bp, P. troglodytes
aatgcaaaggaaaaga

SEQ ID NO: 193622 - DNA, 16 bp, P. troglodytes
aatgcaaaggaaaagt

SEQ ID NO: 193623 - DNA, 16 bp, P. troglodytes
aatgcaaatataaaat

SEQ ID NO: 193624 - DNA, 16 bp, P. troglodytes
aatgcaaatattcaaa

SEQ ID NO: 193625 - DNA, 16 bp, P. troglodytes
aatgcaaatcaaaact

SEQ ID NO: 193626 - DNA, 16 bp, P. troglodytes
aatgcaaatcaaatcc

SEQ ID NO: 193627 - DNA, 16 bp, P. troglodytes
aatgcaaatcagaacc

SEQ ID NO: 193628 - DNA, 16 bp, P. troglodytes
aatgcaaatctgatca

SEQ ID NO: 193629 - DNA, 16 bp, P. troglodytes
aatgcaaattaaaaca

SEQ ID NO: 193630 - DNA, 16 bp, P. troglodytes
aatgcaaattcatttt

SEQ ID NO: 193631 - DNA, 16 bp, P. troglodytes
aatgcaaattctcaga

SEQ ID NO: 193632 - DNA, 16 bp, P. troglodytes
aatgcaacttattttt

SEQ ID NO: 193633 - DNA, 16 bp, P. troglodytes
aatgcaagaatgaact

SEQ ID NO: 193634 - DNA, 16 bp, P. troglodytes
aatgcaatagtgttga

SEQ ID NO: 193635 - DNA, 16 bp, P. troglodytes
aatgcaatcctaagca

SEQ ID NO: 193636 - DNA, 16 bp, P. troglodytes
aatgcaatgaagaaaa

SEQ ID NO: 193637 - DNA, 16 bp, P. troglodytes
aatgcaattttttaaa

SEQ ID NO: 193638 - DNA, 16 bp, P. troglodytes
aatgcacacatgcaca

SEQ ID NO: 193639 - DNA, 16 bp, P. troglodytes
aatgcagaaaaagcat

SEQ ID NO: 193640 - DNA, 16 bp, P. troglodytes
aatgcagaaaattggt

SEQ ID NO: 193641 - DNA, 16 bp, P. troglodytes
aatgcagaaactgagg

SEQ ID NO: 193642 - DNA, 16 bp, P. troglodytes
aatgcagaaatgaaaa

SEQ ID NO: 193643 - DNA, 16 bp, P. troglodytes
aatgcagaagcagaaa

SEQ ID NO: 193644 - DNA, 16 bp, P. troglodytes
aatgcagaaggcaggt

SEQ ID NO: 193645 - DNA, 16 bp, P. troglodytes
aatgcagagaactcct

SEQ ID NO: 193646 - DNA, 16 bp, P. troglodytes
aatgcagattcctggg

SEQ ID NO: 193647 - DNA, 16 bp, P. troglodytes
aatgcagattctggct

SEQ ID NO: 193648 - DNA, 16 bp, P. troglodytes
aatgcagattgctggg

SEQ ID NO: 193649 - DNA, 16 bp, P. troglodytes
aatgcagccaagctct

SEQ ID NO: 193650 - DNA, 16 bp, P. troglodytes
aatgcagctatgaaca

SEQ ID NO: 193651 - DNA, 16 bp, P. troglodytes
aatgcaggcagcttct

SEQ ID NO: 193652 - DNA, 16 bp, P. troglodytes
aatgcagtgaaaccct

SEQ ID NO: 193653 - DNA, 16 bp, P. troglodytes
aatgcagtgagccaag

SEQ ID NO: 193654 - DNA, 16 bp, P. troglodytes
aatgcagtggcacaaa

SEQ ID NO: 193655 - DNA, 16 bp, P. troglodytes
aatgcataaaatatat

SEQ ID NO: 193656 - DNA, 16 bp, P. troglodytes
aatgcatattaaatat

SEQ ID NO: 193657 - DNA, 16 bp, P. troglodytes
aatgcatattgctttt

SEQ ID NO: 193658 - DNA, 16 bp, P. troglodytes
aatgcatatttttaaa

SEQ ID NO: 193659 - DNA, 16 bp, P. troglodytes
aatgcatatttttctt

SEQ ID NO: 193660 - DNA, 16 bp, P. troglodytes
aatgcatgcccaaaac

SEQ ID NO: 193661 - DNA, 16 bp, P. troglodytes
aatgcattattttcta

SEQ ID NO: 193662 - DNA, 16 bp, P. troglodytes
aatgcattctttttta

SEQ ID NO: 193663 - DNA, 16 bp, P. troglodytes
aatgcatttttttaaa

SEQ ID NO: 193664 - DNA, 16 bp, P. troglodytes
aatgccaacatcaaaa

SEQ ID NO: 193665 - DNA, 16 bp, P. troglodytes
aatgccaactaataaa

SEQ ID NO: 193666 - DNA, 16 bp, P. troglodytes
aatgccaactaggtga

SEQ ID NO: 193667 - DNA, 16 bp, P. troglodytes
aatgccaagaagaaaa

SEQ ID NO: 193668 - DNA, 16 bp, P. troglodytes
aatgccaaggattgcc

SEQ ID NO: 193669 - DNA, 16 bp, P. troglodytes
aatgccaatttaaaaa

SEQ ID NO: 193670 - DNA, 16 bp, P. troglodytes
aatgccactaaattgt

SEQ ID NO: 193671 - DNA, 16 bp, P. troglodytes
aatgccactggaattt

SEQ ID NO: 193672 - DNA, 16 bp, P. troglodytes
aatgccagcacttggg

SEQ ID NO: 193673 - DNA, 16 bp, P. troglodytes
aatgccagcattttgg

SEQ ID NO: 193674 - DNA, 16 bp, P. troglodytes
aatgccatcacactgg

SEQ ID NO: 193675 - DNA, 16 bp, P. troglodytes
aatgccattaattttt

SEQ ID NO: 193676 - DNA, 16 bp, P. troglodytes
aatgccattctggaca

SEQ ID NO: 193677 - DNA, 16 bp, P. troglodytes
aatgcccttataaaaa

SEQ ID NO: 193678 - DNA, 16 bp, P. troglodytes
aatgcctactgtgtgc

SEQ ID NO: 193679 - DNA, 16 bp, P. troglodytes
aatgcctgcaccccca

SEQ ID NO: 193680 - DNA, 16 bp, P. troglodytes
aatgcctgcagcccag

SEQ ID NO: 193681 - DNA, 16 bp, P. troglodytes
aatgcctggcacaaag

SEQ ID NO: 193682 - DNA, 16 bp, P. troglodytes
aatgccttccccatca

SEQ ID NO: 193683 - DNA, 16 bp, P. troglodytes
aatgcctttcatttct

SEQ ID NO: 193684 - DNA, 16 bp, P. troglodytes
aatgcctttttaaaat

SEQ ID NO: 193685 - DNA, 16 bp, P. troglodytes
aatgccttttttaaaa

SEQ ID NO: 193686 - DNA, 16 bp, P. troglodytes
aatgcggtgtttggtt

SEQ ID NO: 193687 - DNA, 16 bp, P. troglodytes
aatgctagaagaaaac

SEQ ID NO: 193688 - DNA, 16 bp, P. troglodytes
aatgctagtgattttt

SEQ ID NO: 193689 - DNA, 16 bp, P. troglodytes
aatgctatccctccca

SEQ ID NO: 193690 - DNA, 16 bp, P. troglodytes
aatgctatccctcccc

SEQ ID NO: 193691 - DNA, 16 bp, P. troglodytes
aatgctatgcagtcat

SEQ ID NO: 193692 - DNA, 16 bp, P. troglodytes
aatgctattgattttt

SEQ ID NO: 193693 - DNA, 16 bp, P. troglodytes
aatgctctgtaaatag

SEQ ID NO: 193694 - DNA, 16 bp, P. troglodytes
aatgctctttccccag

SEQ ID NO: 193695 - DNA, 16 bp, P. troglodytes
aatgctgaaagtggga

SEQ ID NO: 193696 - DNA, 16 bp, P. troglodytes
aatgctgacgaggatg

SEQ ID NO: 193697 - DNA, 16 bp, P. troglodytes
aatgctgagaggtttt

SEQ ID NO: 193698 - DNA, 16 bp, P. troglodytes
aatgctgagcaaaagg

SEQ ID NO: 193699 - DNA, 16 bp, P. troglodytes
aatgctgatagtaata

SEQ ID NO: 193700 - DNA, 16 bp, P. troglodytes
aatgctgatagtgata

SEQ ID NO: 193701 - DNA, 16 bp, P. troglodytes
aatgctgattttaaaa

SEQ ID NO: 193702 - DNA, 16 bp, P. troglodytes
aatgctgctgggaaaa

SEQ ID NO: 193703 - DNA, 16 bp, P. troglodytes
aatgctgctgtaaaca

SEQ ID NO: 193704 - DNA, 16 bp, P. troglodytes
aatgctgctgtgaaca

SEQ ID NO: 193705 - DNA, 16 bp, P. troglodytes
aatgctggaattacag

SEQ ID NO: 193706 - DNA, 16 bp, P. troglodytes
aatgctggcagctgtg

SEQ ID NO: 193707 - DNA, 16 bp, P. troglodytes
aatgctggggaaaaaa

SEQ ID NO: 193708 - DNA, 16 bp, P. troglodytes
aatgctgggtgtggtg

SEQ ID NO: 193709 - DNA, 16 bp, P. troglodytes
aatgctgtaataaata

SEQ ID NO: 193710 - DNA, 16 bp, P. troglodytes
aatgctgtatttttac

SEQ ID NO: 193711 - DNA, 16 bp, P. troglodytes
aatgcttacagctttt

SEQ ID NO: 193712 - DNA, 16 bp, P. troglodytes
aatgcttattttaaaa

SEQ ID NO: 193713 - DNA, 16 bp, P. troglodytes
aatgcttcaagaaaac

SEQ ID NO: 193714 - DNA, 16 bp, P. troglodytes
aatgcttcctgttttt

SEQ ID NO: 193715 - DNA, 16 bp, P. troglodytes
aatgcttctgattttt

SEQ ID NO: 193716 - DNA, 16 bp, P. troglodytes
aatgctttaaaaatct

SEQ ID NO: 193717 - DNA, 16 bp, P. troglodytes
aatgctttacttccaa

SEQ ID NO: 193718 - DNA, 16 bp, P. troglodytes
aatgctttcctttttt

SEQ ID NO: 193719 - DNA, 16 bp, P. troglodytes
aatgcttttaaatttt

SEQ ID NO: 193720 - DNA, 16 bp, P. troglodytes
aatgcttttaattttt

SEQ ID NO: 193721 - DNA, 16 bp, P. troglodytes
aatgcttttatttctt

SEQ ID NO: 193722 - DNA, 16 bp, P. troglodytes
aatgctttttaaaaat

SEQ ID NO: 193723 - DNA, 16 bp, P. troglodytes
aatgctttttaaactt

SEQ ID NO: 193724 - DNA, 16 bp, P. troglodytes
aatgctttttcagcat

SEQ ID NO: 193725 - DNA, 16 bp, P. troglodytes
aatggaaaaatagaca

SEQ ID NO: 193726 - DNA, 16 bp, P. troglodytes
aatggaaaacaaattt

SEQ ID NO: 193727 - DNA, 16 bp, P. troglodytes
aatggaaaacatgaaa

SEQ ID NO: 193728 - DNA, 16 bp, P. troglodytes
aatggaaaaccattcc

SEQ ID NO: 193729 - DNA, 16 bp, P. troglodytes
aatggaaaatcaaaca

SEQ ID NO: 193730 - DNA, 16 bp, P. troglodytes
aatggaaaatctgaaa

SEQ ID NO: 193731 - DNA, 16 bp, P. troglodytes
aatggaaaattatatt

SEQ ID NO: 193732 - DNA, 16 bp, P. troglodytes
aatggaaacacatctc

SEQ ID NO: 193733 - DNA, 16 bp, P. troglodytes
aatggaaagaaaatca

SEQ ID NO: 193734 - DNA, 16 bp, P. troglodytes
aatggaaagaactaga

SEQ ID NO: 193735 - DNA, 16 bp, P. troglodytes
aatggaaagcaaagaa

SEQ ID NO: 193736 - DNA, 16 bp, P. troglodytes
aatggaaaggaatgga

SEQ ID NO: 193737 - DNA, 16 bp, P. troglodytes
aatggaaatcaatgaa

SEQ ID NO: 193738 - DNA, 16 bp, P. troglodytes
aatggaaatcataaca

SEQ ID NO: 193739 - DNA, 16 bp, P. troglodytes
aatggaaatggaaatg

SEQ ID NO: 193740 - DNA, 16 bp, P. troglodytes
aatggaaatggaaatt

SEQ ID NO: 193741 - DNA, 16 bp, P. troglodytes
aatggaaatgttttct

SEQ ID NO: 193742 - DNA, 16 bp, P. troglodytes
aatggaaattaaaact

SEQ ID NO: 193743 - DNA, 16 bp, P. troglodytes
aatggaacaaaataga

SEQ ID NO: 193744 - DNA, 16 bp, P. troglodytes
aatggaacagaaaaga

SEQ ID NO: 193745 - DNA, 16 bp, P. troglodytes
aatggaacagaagaca

SEQ ID NO: 193746 - DNA, 16 bp, P. troglodytes
aatggaacagaataga

SEQ ID NO: 193747 - DNA, 16 bp, P. troglodytes
aatggaacagaatgga

SEQ ID NO: 193748 - DNA, 16 bp, P. troglodytes
aatggaaccacaaaag

SEQ ID NO: 193749 - DNA, 16 bp, P. troglodytes
aatggaactgaaaaat

SEQ ID NO: 193750 - DNA, 16 bp, P. troglodytes
aatggaagaaatattt

SEQ ID NO: 193751 - DNA, 16 bp, P. troglodytes
aatggaagccaaaaaa

SEQ ID NO: 193752 - DNA, 16 bp, P. troglodytes
aatggaatagaacaga

SEQ ID NO: 193753 - DNA, 16 bp, P. troglodytes
aatggaatagaataca

SEQ ID NO: 193754 - DNA, 16 bp, P. troglodytes
aatggaatattattca

SEQ ID NO: 193755 - DNA, 16 bp, P. troglodytes
aatggaatattgttta

SEQ ID NO: 193756 - DNA, 16 bp, P. troglodytes
aatggaatcatcatca

SEQ ID NO: 193757 - DNA, 16 bp, P. troglodytes
aatggaatcatcgaat

SEQ ID NO: 193758 - DNA, 16 bp, P. troglodytes
aatggaatgaaatgga

SEQ ID NO: 193759 - DNA, 16 bp, P. troglodytes
aatggaatgacatttt

SEQ ID NO: 193760 - DNA, 16 bp, P. troglodytes
aatggaatggaatgga

SEQ ID NO: 193761 - DNA, 16 bp, P. troglodytes
aatggaatgttatttg

SEQ ID NO: 193762 - DNA, 16 bp, P. troglodytes
aatggaattgaatgga

SEQ ID NO: 193763 - DNA, 16 bp, P. troglodytes
aatggaatttaattaa

SEQ ID NO: 193764 - DNA, 16 bp, P. troglodytes
aatggaatttttaaaa

SEQ ID NO: 193765 - DNA, 16 bp, P. troglodytes
aatggacaaagaaaat

SEQ ID NO: 193766 - DNA, 16 bp, P. troglodytes
aatggacatttgaatt

SEQ ID NO: 193767 - DNA, 16 bp, P. troglodytes
aatggacatttgggct

SEQ ID NO: 193768 - DNA, 16 bp, P. troglodytes
aatggaccctctgcct

SEQ ID NO: 193769 - DNA, 16 bp, P. troglodytes
aatggactaagacaaa

SEQ ID NO: 193770 - DNA, 16 bp, P. troglodytes
aatggactttttaaaa

SEQ ID NO: 193771 - DNA, 16 bp, P. troglodytes
aatggagaaaaatcta

SEQ ID NO: 193772 - DNA, 16 bp, P. troglodytes
aatggagaaaatatct

SEQ ID NO: 193773 - DNA, 16 bp, P. troglodytes
aatggagaaaatattt

SEQ ID NO: 193774 - DNA, 16 bp, P. troglodytes
aatggagaaacagaaa

SEQ ID NO: 193775 - DNA, 16 bp, P. troglodytes
aatggagaaatatttt

SEQ ID NO: 193776 - DNA, 16 bp, P. troglodytes
aatggagaactcagaa

SEQ ID NO: 193777 - DNA, 16 bp, P. troglodytes
aatggagaagaaaatt

SEQ ID NO: 193778 - DNA, 16 bp, P. troglodytes
aatggagacaataaaa

SEQ ID NO: 193779 - DNA, 16 bp, P. troglodytes
aatggagacttggaag

SEQ ID NO: 193780 - DNA, 16 bp, P. troglodytes
aatggagataatcata

SEQ ID NO: 193781 - DNA, 16 bp, P. troglodytes
aatggagcagaacaga

SEQ ID NO: 193782 - DNA, 16 bp, P. troglodytes
aatggagcttacagga

SEQ ID NO: 193783 - DNA, 16 bp, P. troglodytes
aatggagcttgcagga

SEQ ID NO: 193784 - DNA, 16 bp, P. troglodytes
aatggaggctgagaag

SEQ ID NO: 193785 - DNA, 16 bp, P. troglodytes
aatggagtcttactct

SEQ ID NO: 193786 - DNA, 16 bp, P. troglodytes
aatggagttgtttttt

SEQ ID NO: 193787 - DNA, 16 bp, P. troglodytes
aatggagtttcgctct

SEQ ID NO: 193788 - DNA, 16 bp, P. troglodytes
aatggataaataattt

SEQ ID NO: 193789 - DNA, 16 bp, P. troglodytes
aatggataagtaaatt

SEQ ID NO: 193790 - DNA, 16 bp, P. troglodytes
aatggataagttcctg

SEQ ID NO: 193791 - DNA, 16 bp, P. troglodytes
aatggatacagaaaaa

SEQ ID NO: 193792 - DNA, 16 bp, P. troglodytes
aatggatatacaaaat

SEQ ID NO: 193793 - DNA, 16 bp, P. troglodytes
aatggatatagaaaat

SEQ ID NO: 193794 - DNA, 16 bp, P. troglodytes
aatggatccaaaccaa

SEQ ID NO: 193795 - DNA, 16 bp, P. troglodytes
aatggatgaataaaat

SEQ ID NO: 193796 - DNA, 16 bp, P. troglodytes
aatggatgagtgaatg

SEQ ID NO: 193797 - DNA, 16 bp, P. troglodytes
aatggattaatccatt

SEQ ID NO: 193798 - DNA, 16 bp, P. troglodytes
aatggattaatgaata

SEQ ID NO: 193799 - DNA, 16 bp, P. troglodytes
aatggattaatggatt

SEQ ID NO: 193800 - DNA, 16 bp, P. troglodytes
aatggattttaaaaag

SEQ ID NO: 193801 - DNA, 16 bp, P. troglodytes
aatggcaaaaaagcaa

SEQ ID NO: 193802 - DNA, 16 bp, P. troglodytes
aatggcaaaacctgca

SEQ ID NO: 193803 - DNA, 16 bp, P. troglodytes
aatggcaaagctggga

SEQ ID NO: 193804 - DNA, 16 bp, P. troglodytes
aatggcaaattaaatt

SEQ ID NO: 193805 - DNA, 17 bp, P. troglodytes
aatggcaataaaagcca

SEQ ID NO: 193806 - DNA, 16 bp, P. troglodytes
aatggcaatcataaaa

SEQ ID NO: 193807 - DNA, 16 bp, P. troglodytes
aatggcacagccactc

SEQ ID NO: 193808 - DNA, 16 bp, P. troglodytes
aatggcacgatcacag

SEQ ID NO: 193809 - DNA, 16 bp, P. troglodytes
aatggcactggtggca

SEQ ID NO: 193810 - DNA, 16 bp, P. troglodytes
aatggcagaatggata

SEQ ID NO: 193811 - DNA, 16 bp, P. troglodytes
aatggcagagctgaaa

SEQ ID NO: 193812 - DNA, 16 bp, P. troglodytes
aatggcagagctggaa

SEQ ID NO: 193813 - DNA, 16 bp, P. troglodytes
aatggcaggatttcct

SEQ ID NO: 193814 - DNA, 20 bp, P. troglodytes
aatggcataaacccgggagg

SEQ ID NO: 193815 - DNA, 16 bp, P. troglodytes
aatggcatcaacctgg

SEQ ID NO: 193816 - DNA, 16 bp, P. troglodytes
aatggccaaaaactgg

SEQ ID NO: 193817 - DNA, 16 bp, P. troglodytes
aatggccaaaactgca

SEQ ID NO: 193818 - DNA, 16 bp, P. troglodytes
aatggccaaaatccaa

SEQ ID NO: 193819 - DNA, 16 bp, P. troglodytes
aatggccaaagctgga

SEQ ID NO: 193820 - DNA, 17 bp, P. troglodytes
aatggccaggcatggtg

SEQ ID NO: 193821 - DNA, 16 bp, P. troglodytes
aatggccttgtctctt

SEQ ID NO: 193822 - DNA, 17 bp, P. troglodytes
aatggcgtgaaccccag

SEQ ID NO: 193823 - DNA, 16 bp, P. troglodytes
aatggcgtgaagccag

SEQ ID NO: 193824 - DNA, 16 bp, P. troglodytes
aatggctaaaattaaa

SEQ ID NO: 193825 - DNA, 16 bp, P. troglodytes
aatggctaaatcaagc

SEQ ID NO: 193826 - DNA, 16 bp, P. troglodytes
aatggctaattagaat

SEQ ID NO: 193827 - DNA, 16 bp, P. troglodytes
aatggctattcacagg

SEQ ID NO: 193828 - DNA, 16 bp, P. troglodytes
aatggcttcattttaa

SEQ ID NO: 193829 - DNA, 16 bp, P. troglodytes
aatggcttggtgccat

SEQ ID NO: 193830 - DNA, 16 bp, P. troglodytes
aatggcttttttaaaa

SEQ ID NO: 193831 - DNA, 16 bp, P. troglodytes
aatgggaaaaggacag

SEQ ID NO: 193832 - DNA, 16 bp, P. troglodytes
aatgggaataatatta

SEQ ID NO: 193833 - DNA, 16 bp, P. troglodytes
aatgggaataccagaa

SEQ ID NO: 193834 - DNA, 16 bp, P. troglodytes
aatgggaattcactca

SEQ ID NO: 193835 - DNA, 16 bp, P. troglodytes
aatgggagaaaaattt

SEQ ID NO: 193836 - DNA, 16 bp, P. troglodytes
aatgggagaaaacatt

SEQ ID NO: 193837 - DNA, 26 bp, P. troglodytes
aatgggagaaaatttttgcaatctac

SEQ ID NO: 193838 - DNA, 16 bp, P. troglodytes
aatgggagatattaca

SEQ ID NO: 193839 - DNA, 16 bp, P. troglodytes
aatgggaggcaggttt

SEQ ID NO: 193840 - DNA, 16 bp, P. troglodytes
aatgggagttttcctg

SEQ ID NO: 193841 - DNA, 16 bp, P. troglodytes
aatgggattgtttttt

SEQ ID NO: 193842 - DNA, 16 bp, P. troglodytes
aatgggcaaaaaattt

SEQ ID NO: 193843 - DNA, 16 bp, P. troglodytes
aatgggcaaaatatct

SEQ ID NO: 193844 - DNA, 16 bp, P. troglodytes
aatgggcacagggttt

SEQ ID NO: 193845 - DNA, 16 bp, P. troglodytes
aatggggaaaaactgg

SEQ ID NO: 193846 - DNA, 16 bp, P. troglodytes
aatggggaaaaatatt

SEQ ID NO: 193847 - DNA, 16 bp, P. troglodytes
aatggggaaagaattc

SEQ ID NO: 193848 - DNA, 16 bp, P. troglodytes
aatggggaaaggacac

SEQ ID NO: 193849 - DNA, 33 bp, P. troglodytes; identical to SEQ ID NO: 21463

SEQ ID NO: 193850 - DNA, 16 bp, P. troglodytes
aatggggaggctgagg

SEQ ID NO: 193851 - DNA, 16 bp, P. troglodytes
aatggggctgggaaaa

SEQ ID NO: 193852 - DNA, 16 bp, P. troglodytes
aatggggtcttgctat

SEQ ID NO: 193853 - DNA, 17 bp, P. troglodytes
aatggggtttcaccctg

SEQ ID NO: 193854 - DNA, 16 bp, P. troglodytes
aatgggtataaaattt

SEQ ID NO: 193855 - DNA, 16 bp, P. troglodytes
aatgggtatggagttt

SEQ ID NO: 193856 - DNA, 16 bp, P. troglodytes
aatgggtgtggctgtg

SEQ ID NO: 193857 - DNA, 16 bp, P. troglodytes
aatgggttcttcctgc

SEQ ID NO: 193858 - DNA, 16 bp, P. troglodytes
aatgggttttttttct

SEQ ID NO: 193859 - DNA, 16 bp, P. troglodytes
aatggtaaaggcatca

SEQ ID NO: 193860 - DNA, 16 bp, P. troglodytes
aatggtaatttttaaa

SEQ ID NO: 193861 - DNA, 16 bp, P. troglodytes
aatggtaccagctcct

SEQ ID NO: 193862 - DNA, 16 bp, P. troglodytes
aatggtactggaaaaa

SEQ ID NO: 193863 - DNA, 16 bp, P. troglodytes
aatggtagatccattg

SEQ ID NO: 193864 - DNA, 16 bp, P. troglodytes
aatggtagtttaatgg

SEQ ID NO: 193865 - DNA, 16 bp, P. troglodytes
aatggtatggaggttc

SEQ ID NO: 193866 - DNA, 16 bp, P. troglodytes
aatggtctcaatctct

SEQ ID NO: 193867 - DNA, 16 bp, P. troglodytes
aatggtcttccatgaa

SEQ ID NO: 193868 - DNA, 16 bp, P. troglodytes
aatggtctttaccatt

SEQ ID NO: 193869 - DNA, 16 bp, P. troglodytes
aatggtgcaatctcaa

SEQ ID NO: 193870 - DNA, 16 bp, P. troglodytes
aatggtgctggaaaaa

SEQ ID NO: 193871 - DNA, 16 bp, P. troglodytes
aatggtgctggggaaa

SEQ ID NO: 193872 - DNA, 16 bp, P. troglodytes
aatggtggaaggtgaa

SEQ ID NO: 193873 - DNA, 16 bp, P. troglodytes
aatggtggattggata

SEQ ID NO: 193874 - DNA, 16 bp, P. troglodytes
aatggtggtggtgatg

SEQ ID NO: 193875 - DNA, 16 bp, P. troglodytes
aatggtgtttcctagg

SEQ ID NO: 193876 - DNA, 16 bp, P. troglodytes
aatggttcaactctgt

SEQ ID NO: 193877 - DNA, 16 bp, P. troglodytes
aatggttctcaaattt

SEQ ID NO: 193878 - DNA, 16 bp, P. troglodytes
aatggtttagcactat

SEQ ID NO: 193879 - DNA, 16 bp, P. troglodytes
aatggttttatatata

SEQ ID NO: 193880 - DNA, 16 bp, P. troglodytes
aatggttttcagtata

SEQ ID NO: 193881 - DNA, 16 bp, P. troglodytes
aatgtaaaaacaattt

SEQ ID NO: 193882 - DNA, 16 bp, P. troglodytes
aatgtaaaacccaaaa

SEQ ID NO: 193883 - DNA, 16 bp, P. troglodytes
aatgtaaaatatctca

SEQ ID NO: 193884 - DNA, 16 bp, P. troglodytes
aatgtaaaatgttata

SEQ ID NO: 193885 - DNA, 16 bp, P. troglodytes
aatgtaaaattcaaaa

SEQ ID NO: 193886 - DNA, 16 bp, P. troglodytes
aatgtaaacattttaa

SEQ ID NO: 193887 - DNA, 16 bp, P. troglodytes
aatgtaaactccatga

SEQ ID NO: 193888 - DNA, 16 bp, P. troglodytes
aatgtaaagaatgtgg

SEQ ID NO: 193889 - DNA, 16 bp, P. troglodytes
aatgtaaagtagtttt

SEQ ID NO: 193890 - DNA, 16 bp, P. troglodytes
aatgtaaatactatgt

SEQ ID NO: 193891 - DNA, 16 bp, P. troglodytes
aatgtaaatataaaca

SEQ ID NO: 193892 - DNA, 16 bp, P. troglodytes
aatgtaaatatataca

SEQ ID NO: 193893 - DNA, 16 bp, P. troglodytes
aatgtaaatgtgtttt

SEQ ID NO: 193894 - DNA, 16 bp, P. troglodytes
aatgtaaatgttctaa

SEQ ID NO: 193895 - DNA, 16 bp, P. troglodytes
aatgtaaatgttctga

SEQ ID NO: 193896 - DNA, 16 bp, P. troglodytes
aatgtaaattagtaca

SEQ ID NO: 193897 - DNA, 16 bp, P. troglodytes
aatgtaaattagtgta

SEQ ID NO: 193898 - DNA, 16 bp, P. troglodytes
aatgtaaatttaaatg

SEQ ID NO: 193899 - DNA, 16 bp, P. troglodytes
aatgtaaatttgtaca

SEQ ID NO: 193900 - DNA, 16 bp, P. troglodytes
aatgtaacattttaaa

SEQ ID NO: 193901 - DNA, 16 bp, P. troglodytes
aatgtaagacctgaaa

SEQ ID NO: 193902 - DNA, 16 bp, P. troglodytes
aatgtaagacttaaaa

SEQ ID NO: 193903 - DNA, 16 bp, P. troglodytes
aatgtaagctccatga

SEQ ID NO: 193904 - DNA, 16 bp, P. troglodytes
aatgtaagcttcatga

SEQ ID NO: 193905 - DNA, 16 bp, P. troglodytes
aatgtaatcatttatc

SEQ ID NO: 193906 - DNA, 16 bp, P. troglodytes
aatgtaatctaccaca

SEQ ID NO: 193907 - DNA, 16 bp, P. troglodytes
aatgtaattactgata

SEQ ID NO: 193908 - DNA, 16 bp, P. troglodytes
aatgtaattctctgca

SEQ ID NO: 193909 - DNA, 16 bp, P. troglodytes
aatgtaatttttttca

SEQ ID NO: 193910 - DNA, 16 bp, P. troglodytes
aatgtacaaaaccaag

SEQ ID NO: 193911 - DNA, 16 bp, P. troglodytes
aatgtacaatgaactc

SEQ ID NO: 193912 - DNA, 16 bp, P. troglodytes
aatgtacagcttgggc

SEQ ID NO: 193913 - DNA, 16 bp, P. troglodytes
aatgtacataaaaata

SEQ ID NO: 193914 - DNA, 16 bp, P. troglodytes
aatgtaccacagtttg

SEQ ID NO: 193915 - DNA, 16 bp, P. troglodytes
aatgtaccataattta

SEQ ID NO: 193916 - DNA, 16 bp, P. troglodytes
aatgtactaaaaacca

SEQ ID NO: 193917 - DNA, 16 bp, P. troglodytes
aatgtactaaatgtca

SEQ ID NO: 193918 - DNA, 16 bp, P. troglodytes
aatgtagataatgggt

SEQ ID NO: 193919 - DNA, 16 bp, P. troglodytes
aatgtagatgacagat

SEQ ID NO: 193920 - DNA, 20 bp, P. troglodytes
aatgtagatgacgggttgat

SEQ ID NO: 193921 - DNA, 16 bp, P. troglodytes
aatgtagtgaaacctc

SEQ ID NO: 193922 - DNA, 16 bp, P. troglodytes
aatgtagttttaaaaa

SEQ ID NO: 193923 - DNA, 16 bp, P. troglodytes
aatgtataaaatgtat

SEQ ID NO: 193924 - DNA, 44 bp, P. troglodytes
aatgtataactagaataaccaatacagagaagtgcttaaaggag

SEQ ID NO: 193925 - DNA, 48 bp, P. troglodytes
aatgtataactagaataaccaatacagagaagtgcttaaaggagctga

SEQ ID NO: 193926 - DNA, 16 bp, P. troglodytes
aatgtataataatcaa

SEQ ID NO: 193927 - DNA, 16 bp, P. troglodytes
aatgtatacacatgga

SEQ ID NO: 193928 - DNA, 16 bp, P. troglodytes
aatgtatacatgtatt

SEQ ID NO: 193929 - DNA, 16 bp, P. troglodytes
aatgtatacttgaaaa

SEQ ID NO: 193930 - DNA, 16 bp, P. troglodytes
aatgtatatatgtaca

SEQ ID NO: 193931 - DNA, 16 bp, P. troglodytes
aatgtatatatttatg

SEQ ID NO: 193932 - DNA, 16 bp, P. troglodytes
aatgtatatatttcta

SEQ ID NO: 193933 - DNA, 16 bp, P. troglodytes
aatgtatctgatagaa

SEQ ID NO: 193934 - DNA, 16 bp, P. troglodytes
aatgtatgaaaccaag

SEQ ID NO: 193935 - DNA, 16 bp, P. troglodytes
aatgtatgtgaaagtg

SEQ ID NO: 193936 - DNA, 16 bp, P. troglodytes
aatgtattattttcaa

SEQ ID NO: 193937 - DNA, 16 bp, P. troglodytes
aatgtattcattcatt

SEQ ID NO: 193938 - DNA, 16 bp, P. troglodytes
aatgtatttatttctg

SEQ ID NO: 193939 - DNA, 16 bp, P. troglodytes
aatgtatttcttaaat

SEQ ID NO: 193940 - DNA, 16 bp, P. troglodytes
aatgtatttgaaaatt

SEQ ID NO: 193941 - DNA, 16 bp, P. troglodytes
aatgtatttgcaaata

SEQ ID NO: 193942 - DNA, 16 bp, P. troglodytes
aatgtatttggctcat

SEQ ID NO: 193943 - DNA, 16 bp, P. troglodytes
aatgtattttaagaaa

SEQ ID NO: 193944 - DNA, 16 bp, P. troglodytes
aatgtattttattttc

SEQ ID NO: 193945 - DNA, 16 bp, P. troglodytes
aatgtattttctttta

SEQ ID NO: 193946 - DNA, 16 bp, P. troglodytes
aatgtatttttcaaat

SEQ ID NO: 193947 - DNA, 16 bp, P. troglodytes
aatgtatttttcatat

SEQ ID NO: 193948 - DNA, 16 bp, P. troglodytes
aatgtatttttttcca

SEQ ID NO: 193949 - DNA, 16 bp, P. troglodytes
aatgtcaaaaatattt

SEQ ID NO: 193950 - DNA, 16 bp, P. troglodytes
aatgtcaatatatttt

SEQ ID NO: 193951 - DNA, 16 bp, P. troglodytes
aatgtcactgaactgt

SEQ ID NO: 193952 - DNA, 16 bp, P. troglodytes
aatgtcactgaattat

SEQ ID NO: 193953 - DNA, 16 bp, P. troglodytes
aatgtcactgaattgt

SEQ ID NO: 193954 - DNA, 16 bp, P. troglodytes
aatgtcagtagtgcca

SEQ ID NO: 193955 - DNA, 17 bp, P. troglodytes
aatgtcatcagttaagg

SEQ ID NO: 193956 - DNA, 16 bp, P. troglodytes
aatgtcatgtagttgg

SEQ ID NO: 193957 - DNA, 16 bp, P. troglodytes
aatgtcattaaaaaaa

SEQ ID NO: 193958 - DNA, 16 bp, P. troglodytes
aatgtcattaaaattt

SEQ ID NO: 193959 - DNA, 16 bp, P. troglodytes
aatgtcattggtattt

SEQ ID NO: 193960 - DNA, 16 bp, P. troglodytes
aatgtcatttttctgt

SEQ ID NO: 193961 - DNA, 16 bp, P. troglodytes
aatgtccagaaaaggc

SEQ ID NO: 193962 - DNA, 16 bp, P. troglodytes
aatgtccatcaacagg

SEQ ID NO: 193963 - DNA, 16 bp, P. troglodytes
aatgtccatcaacagt

SEQ ID NO: 193964 - DNA, 16 bp, P. troglodytes
aatgtctactttttca

SEQ ID NO: 193965 - DNA, 16 bp, P. troglodytes
aatgtctagatctcta

SEQ ID NO: 193966 - DNA, 16 bp, P. troglodytes
aatgtctctttttaaa

SEQ ID NO: 193967 - DNA, 16 bp, P. troglodytes
aatgtctgacacatag

SEQ ID NO: 193968 - DNA, 16 bp, P. troglodytes
aatgtctgtttttaaa

SEQ ID NO: 193969 - DNA, 16 bp, P. troglodytes
aatgtcttcaaagttc

SEQ ID NO: 193970 - DNA, 16 bp, P. troglodytes
aatgtcttccagttcc

SEQ ID NO: 193971 - DNA, 16 bp, P. troglodytes
aatgtctttaaaatat

SEQ ID NO: 193972 - DNA, 16 bp, P. troglodytes
aatgtctttctttttc

SEQ ID NO: 193973 - DNA, 16 bp, P. troglodytes
aatgtctttgtctggc

SEQ ID NO: 193974 - DNA, 16 bp, P. troglodytes
aatgtctttgtgtttt

SEQ ID NO: 193975 - DNA, 16 bp, P. troglodytes
aatgtctttgtttaaa

SEQ ID NO: 193976 - DNA, 16 bp, P. troglodytes
aatgtcttttaaaaaa

SEQ ID NO: 193977 - DNA, 16 bp, P. troglodytes
aatgtcttttcatttt

SEQ ID NO: 193978 - DNA, 16 bp, P. troglodytes
aatgtgaaaaaaatgt

SEQ ID NO: 193979 - DNA, 16 bp, P. troglodytes
aatgtgaaaaacagaa

SEQ ID NO: 193980 - DNA, 16 bp, P. troglodytes
aatgtgaaaacagaaa

SEQ ID NO: 193981 - DNA, 16 bp, P. troglodytes
aatgtgaaaacagaga

SEQ ID NO: 193982 - DNA, 16 bp, P. troglodytes
aatgtgaaaattttaa

SEQ ID NO: 193983 - DNA, 16 bp, P. troglodytes
aatgtgaaagacaaaa

SEQ ID NO: 193984 - DNA, 16 bp, P. troglodytes
aatgtgaaataatcac

SEQ ID NO: 193985 - DNA, 16 bp, P. troglodytes
aatgtgaaatttaaat

SEQ ID NO: 193986 - DNA, 16 bp, P. troglodytes
aatgtgaagaatgtgg

SEQ ID NO: 193987 - DNA, 16 bp, P. troglodytes
aatgtgaatgaattaa

SEQ ID NO: 193988 - DNA, 16 bp, P. troglodytes
aatgtgacagaaaaga

SEQ ID NO: 193989 - DNA, 16 bp, P. troglodytes
aatgtgataaatattt

SEQ ID NO: 193990 - DNA, 16 bp, P. troglodytes
aatgtgatacaccata

SEQ ID NO: 193991 - DNA, 16 bp, P. troglodytes
aatgtgatacattaca

SEQ ID NO: 193992 - DNA, 16 bp, P. troglodytes
aatgtgatgatttgat

SEQ ID NO: 193993 - DNA, 16 bp, P. troglodytes
aatgtgatgcttctgg

SEQ ID NO: 193994 - DNA, 16 bp, P. troglodytes
aatgtgatgttttggt

SEQ ID NO: 193995 - DNA, 16 bp, P. troglodytes
aatgtgattcaccata

SEQ ID NO: 193996 - DNA, 16 bp, P. troglodytes
aatgtgcaattaaatt

SEQ ID NO: 193997 - DNA, 16 bp, P. troglodytes
aatgtgcattttattt

SEQ ID NO: 193998 - DNA, 16 bp, P. troglodytes
aatgtgctggtttgtt

SEQ ID NO: 193999 - DNA, 16 bp, P. troglodytes
aatgtgctgtattcag

SEQ ID NO: 194000 - DNA, 16 bp, P. troglodytes
aatgtgcttttatttt

SEQ ID NO: 194001 - DNA, 16 bp, P. troglodytes
aatgtggaaaagcttt

SEQ ID NO: 194002 - DNA, 16 bp, P. troglodytes
aatgtggaaaatgtct

SEQ ID NO: 194003 - DNA, 16 bp, P. troglodytes
aatgtggaaatgactt

SEQ ID NO: 194004 - DNA, 16 bp, P. troglodytes
aatgtggaagacagtg

SEQ ID NO: 194005 - DNA, 16 bp, P. troglodytes
aatgtggaagagactt

SEQ ID NO: 194006 - DNA, 16 bp, P. troglodytes
aatgtggaagcaattt

SEQ ID NO: 194007 - DNA, 16 bp, P. troglodytes
aatgtggaaggaaaat

SEQ ID NO: 194008 - DNA, 16 bp, P. troglodytes
aatgtggcaaaacttt

SEQ ID NO: 194009 - DNA, 16 bp, P. troglodytes
aatgtggcagaagtga

SEQ ID NO: 194010 - DNA, 16 bp, P. troglodytes
aatgtggcatcctgga

SEQ ID NO: 194011 - DNA, 16 bp, P. troglodytes
aatgtggctgtgttcc

SEQ ID NO: 194012 - DNA, 16 bp, P. troglodytes
aatgtgggaaagcctt

SEQ ID NO: 194013 - DNA, 16 bp, P. troglodytes
aatgtggtaaaatata

SEQ ID NO: 194014 - DNA, 16 bp, P. troglodytes
aatgtggtatatgtat

SEQ ID NO: 194015 - DNA, 16 bp, P. troglodytes
aatgtgtaaataaatg

SEQ ID NO: 194016 - DNA, 16 bp, P. troglodytes
aatgtgtaatgatcca

SEQ ID NO: 194017 - DNA, 16 bp, P. troglodytes
aatgtgtatgtgtgtg

SEQ ID NO: 194018 - DNA, 16 bp, P. troglodytes
aatgtgtattctgtgg

SEQ ID NO: 194019 - DNA, 16 bp, P. troglodytes
aatgtgtattttgctg

SEQ ID NO: 194020 - DNA, 16 bp, P. troglodytes
aatgtgtatttttaaa

SEQ ID NO: 194021 - DNA, 16 bp, P. troglodytes
aatgtgtctggaattg

SEQ ID NO: 194022 - DNA, 16 bp, P. troglodytes
aatgtgtctttaaaaa

SEQ ID NO: 194023 - DNA, 16 bp, P. troglodytes
aatgtgtcttttctta

SEQ ID NO: 194024 - DNA, 16 bp, P. troglodytes
aatgtgtggcacctcc

SEQ ID NO: 194025 - DNA, 16 bp, P. troglodytes
aatgtgtgtatgtgtg

SEQ ID NO: 194026 - DNA, 16 bp, P. troglodytes
aatgtgtgtattttta

SEQ ID NO: 194027 - DNA, 16 bp, P. troglodytes
aatgtgtgtgtataca

SEQ ID NO: 194028 - DNA, 16 bp, P. troglodytes
aatgtgtgtgtgtatg

SEQ ID NO: 194029 - DNA, 16 bp, P. troglodytes
aatgtgtgtgtgtgtg

SEQ ID NO: 194030 - DNA, 16 bp, P. troglodytes
aatgtgtttaaaattt

SEQ ID NO: 194031 - DNA, 16 bp, P. troglodytes
aatgtgtttctgtttt

SEQ ID NO: 194032 - DNA, 16 bp, P. troglodytes
aatgtgttttaaaata

SEQ ID NO: 194033 - DNA, 16 bp, P. troglodytes
aatgtgttttataaat

SEQ ID NO: 194034 - DNA, 16 bp, P. troglodytes
aatgttaaaagaagtt

SEQ ID NO: 194035 - DNA, 16 bp, P. troglodytes
aatgttaaaatagaga

SEQ ID NO: 194036 - DNA, 16 bp, P. troglodytes
aatgttaaatttcttg

SEQ ID NO: 194037 - DNA, 16 bp, P. troglodytes
aatgttaacatttgtt

SEQ ID NO: 194038 - DNA, 16 bp, P. troglodytes
aatgttaagaaaatca

SEQ ID NO: 194039 - DNA, 16 bp, P. troglodytes
aatgttaagtggaaaa

SEQ ID NO: 194040 - DNA, 17 bp, P. troglodytes
aatgttaatagccaaga

SEQ ID NO: 194041 - DNA, 16 bp, P. troglodytes
aatgttaattagtaca

SEQ ID NO: 194042 - DNA, 16 bp, P. troglodytes
aatgttagctattatt

SEQ ID NO: 194043 - DNA, 16 bp, P. troglodytes
aatgttatgaagaaaa

SEQ ID NO: 194044 - DNA, 16 bp, P. troglodytes
aatgttattacaaaag

SEQ ID NO: 194045 - DNA, 16 bp, P. troglodytes
aatgttattttcttct

SEQ ID NO: 194046 - DNA, 16 bp, P. troglodytes
aatgttcataggagca

SEQ ID NO: 194047 - DNA, 16 bp, P. troglodytes
aatgttcatctctttt

SEQ ID NO: 194048 - DNA, 16 bp, P. troglodytes
aatgttcctctttgtc

SEQ ID NO: 194049 - DNA, 16 bp, P. troglodytes
aatgttctcattttta

SEQ ID NO: 194050 - DNA, 16 bp, P. troglodytes
aatgttctctctctct

SEQ ID NO: 194051 - DNA, 16 bp, P. troglodytes
aatgttctgtgtgctg

SEQ ID NO: 194052 - DNA, 16 bp, P. troglodytes
aatgttcttctttgtc

SEQ ID NO: 194053 - DNA, 16 bp, P. troglodytes
aatgttctttctcttt

SEQ ID NO: 194054 - DNA, 16 bp, P. troglodytes
aatgttgaactttttt

SEQ ID NO: 194055 - DNA, 16 bp, P. troglodytes
aatgttgcagtgaaca

SEQ ID NO: 194056 - DNA, 16 bp, P. troglodytes
aatgttggtgaggata

SEQ ID NO: 194057 - DNA, 16 bp, P. troglodytes
aatgttggtttccagc

SEQ ID NO: 194058 - DNA, 16 bp, P. troglodytes
aatgttgtcttctaga

SEQ ID NO: 194059 - DNA, 16 bp, P. troglodytes
aatgttgttaaaatga

SEQ ID NO: 194060 - DNA, 17 bp, P. troglodytes
aatgtttaaatttacct

SEQ ID NO: 194061 - DNA, 16 bp, P. troglodytes
aatgtttaaggtgatg

SEQ ID NO: 194062 - DNA, 16 bp, P. troglodytes
aatgtttaatattggc

SEQ ID NO: 194063 - DNA, 16 bp, P. troglodytes
aatgtttacattattt

SEQ ID NO: 194064 - DNA, 16 bp, P. troglodytes
aatgtttacatttatt

SEQ ID NO: 194065 - DNA, 16 bp, P. troglodytes
aatgtttacttttaat

SEQ ID NO: 194066 - DNA, 16 bp, P. troglodytes
aatgtttataaaatga

SEQ ID NO: 194067 - DNA, 16 bp, P. troglodytes
aatgtttatacatttt

SEQ ID NO: 194068 - DNA, 16 bp, P. troglodytes
aatgtttattaaatgc

SEQ ID NO: 194069 - DNA, 16 bp, P. troglodytes
aatgtttattgaacaa

SEQ ID NO: 194070 - DNA, 16 bp, P. troglodytes
aatgtttatttacaaa

SEQ ID NO: 194071 - DNA, 16 bp, P. troglodytes
aatgtttatttacttt

SEQ ID NO: 194072 - DNA, 16 bp, P. troglodytes
aatgtttcagtgaaca

SEQ ID NO: 194073 - DNA, 16 bp, P. troglodytes
aatgtttcattaaaat

SEQ ID NO: 194074 - DNA, 16 bp, P. troglodytes
aatgtttctatttatt

SEQ ID NO: 194075 - DNA, 16 bp, P. troglodytes
aatgtttctcttcatt

SEQ ID NO: 194076 - DNA, 16 bp, P. troglodytes
aatgtttcttatattt

SEQ ID NO: 194077 - DNA, 16 bp, P. troglodytes
aatgtttcttgtcaga

SEQ ID NO: 194078 - DNA, 16 bp, P. troglodytes
aatgtttctttttaaa

SEQ ID NO: 194079 - DNA, 16 bp, P. troglodytes
aatgtttgctgaatta

SEQ ID NO: 194080 - DNA, 16 bp, P. troglodytes
aatgtttggtagaact

SEQ ID NO: 194081 - DNA, 16 bp, P. troglodytes
aatgtttgtgaaatga

SEQ ID NO: 194082 - DNA, 16 bp, P. troglodytes
aatgtttgttaaatga

SEQ ID NO: 194083 - DNA, 16 bp, P. troglodytes
aatgtttgttgaataa

SEQ ID NO: 194084 - DNA, 16 bp, P. troglodytes
aatgttttaaaaacag

SEQ ID NO: 194085 - DNA, 16 bp, P. troglodytes
aatgttttaaaaattg

SEQ ID NO: 194086 - DNA, 16 bp, P. troglodytes
aatgttttaaaataga

SEQ ID NO: 194087 - DNA, 16 bp, P. troglodytes
aatgttttaagaaact

SEQ ID NO: 194088 - DNA, 16 bp, P. troglodytes
aatgttttacataatt

SEQ ID NO: 194089 - DNA, 16 bp, P. troglodytes
aatgttttatagaatt

SEQ ID NO: 194090 - DNA, 16 bp, P. troglodytes
aatgttttatattctt

SEQ ID NO: 194091 - DNA, 16 bp, P. troglodytes
aatgttttcaaaataa

SEQ ID NO: 194092 - DNA, 16 bp, P. troglodytes
aatgttttcaaaatat

SEQ ID NO: 194093 - DNA, 16 bp, P. troglodytes
aatgttttcaaatttc

SEQ ID NO: 194094 - DNA, 16 bp, P. troglodytes
aatgttttcagaaagt

SEQ ID NO: 194095 - DNA, 16 bp, P. troglodytes
aatgttttccaaatga

SEQ ID NO: 194096 - DNA, 16 bp, P. troglodytes
aatgttttccatttta

SEQ ID NO: 194097 - DNA, 16 bp, P. troglodytes
aatgttttcttcttaa

SEQ ID NO: 194098 - DNA, 16 bp, P. troglodytes
aatgttttcttgtagt

SEQ ID NO: 194099 - DNA, 16 bp, P. troglodytes
aatgttttcttttagt

SEQ ID NO: 194100 - DNA, 16 bp, P. troglodytes
aatgttttctttttca

SEQ ID NO: 194101 - DNA, 16 bp, P. troglodytes
aatgttttgaaaataa

SEQ ID NO: 194102 - DNA, 16 bp, P. troglodytes
aatgttttgatttctt

SEQ ID NO: 194103 - DNA, 16 bp, P. troglodytes
aatgttttgtaaatat

SEQ ID NO: 194104 - DNA, 16 bp, P. troglodytes
aatgttttgtatttct

SEQ ID NO: 194105 - DNA, 16 bp, P. troglodytes
aatgtttttaatcttt

SEQ ID NO: 194106 - DNA, 16 bp, P. troglodytes
aatgtttttccctttg

SEQ ID NO: 194107 - DNA, 16 bp, P. troglodytes
aatgtttttcctttaa

SEQ ID NO: 194108 - DNA, 16 bp, P. troglodytes
aatgtttttcttaaaa

SEQ ID NO: 194109 - DNA, 16 bp, P. troglodytes
aatgtttttcttaatt

SEQ ID NO: 194110 - DNA, 16 bp, P. troglodytes
aatgtttttgaggttt

SEQ ID NO: 194111 - DNA, 16 bp, P. troglodytes
aatgttttttaaaaag

SEQ ID NO: 194112 - DNA, 16 bp, P. troglodytes
aatgttttttaaagca

SEQ ID NO: 194113 - DNA, 16 bp, P. troglodytes
aattaaaaaccttctg

SEQ ID NO: 194114 - DNA, 16 bp, P. troglodytes
aattaaaaacttttgc

SEQ ID NO: 194115 - DNA, 16 bp, P. troglodytes
aattaaaaagctgaaa

SEQ ID NO: 194116 - DNA, 16 bp, P. troglodytes
aattaaaaatagaact

SEQ ID NO: 194117 - DNA, 16 bp, P. troglodytes
aattaaaaatggtcaa

SEQ ID NO: 194118 - DNA, 16 bp, P. troglodytes
aattaaaaattacaga

SEQ ID NO: 194119 - DNA, 16 bp, P. troglodytes
aattaaaaattcactt

SEQ ID NO: 194120 - DNA, 16 bp, P. troglodytes
aattaaaaattgcaaa

SEQ ID NO: 194121 - DNA, 16 bp, P. troglodytes
aattaaaacagaaatg

SEQ ID NO: 194122 - DNA, 16 bp, P. troglodytes
aattaaaacagtgtgg

SEQ ID NO: 194123 - DNA, 16 bp, P. troglodytes
aattaaaacattttca

SEQ ID NO: 194124 - DNA, 16 bp, P. troglodytes
aattaaaactacaatg

SEQ ID NO: 194125 - DNA, 16 bp, P. troglodytes
aattaaaactagaaat

SEQ ID NO: 194126 - DNA, 16 bp, P. troglodytes
aattaaaagaaacatt

SEQ ID NO: 194127 - DNA, 16 bp, P. troglodytes
aattaaaagaacattt

SEQ ID NO: 194128 - DNA, 16 bp, P. troglodytes
aattaaaaggcacaga

SEQ ID NO: 194129 - DNA, 16 bp, P. troglodytes
aattaaaatacttagg

SEQ ID NO: 194130 - DNA, 16 bp, P. troglodytes
aattaaaatgactttt

SEQ ID NO: 194131 - DNA, 16 bp, P. troglodytes
aattaaaatggcttat

SEQ ID NO: 194132 - DNA, 16 bp, P. troglodytes
aattaaaatttcagtg

SEQ ID NO: 194133 - DNA, 16 bp, P. troglodytes
aattaaacatttcttt

SEQ ID NO: 194134 - DNA, 16 bp, P. troglodytes
aattaaacctctttta

SEQ ID NO: 194135 - DNA, 16 bp, P. troglodytes
aattaaacttcctttc

SEQ ID NO: 194136 - DNA, 16 bp, P. troglodytes
aattaaacttttcatt

SEQ ID NO: 194137 - DNA, 16 bp, P. troglodytes
aattaaagggaaatta

SEQ ID NO: 194138 - DNA, 16 bp, P. troglodytes
aattaaagggagaaat

SEQ ID NO: 194139 - DNA, 16 bp, P. troglodytes
aattaaataacctgtt

SEQ ID NO: 194140 - DNA, 16 bp, P. troglodytes
aattaaatatagaact

SEQ ID NO: 194141 - DNA, 16 bp, P. troglodytes
aattaaatatgcattt

SEQ ID NO: 194142 - DNA, 16 bp, P. troglodytes
aattaaatcaagatgg

SEQ ID NO: 194143 - DNA, 16 bp, P. troglodytes
aattaaatcagtatgt

SEQ ID NO: 194144 - DNA, 16 bp, P. troglodytes
aattaaatccacaatg

SEQ ID NO: 194145 - DNA, 16 bp, P. troglodytes
aattaaatgaaacatt

SEQ ID NO: 194146 - DNA, 16 bp, P. troglodytes
aattaaatgaggtcat

SEQ ID NO: 194147 - DNA, 16 bp, P. troglodytes
aattaacaaagaaatt

SEQ ID NO: 194148 - DNA, 16 bp, P. troglodytes
aattaacatatgtaaa

SEQ ID NO: 194149 - DNA, 16 bp, P. troglodytes
aattaacattttcaaa

SEQ ID NO: 194150 - DNA, 16 bp, P. troglodytes
aattaacctctctgtg

SEQ ID NO: 194151 - DNA, 16 bp, P. troglodytes
aattaaccttagctta

SEQ ID NO: 194152 - DNA, 16 bp, P. troglodytes
aattaactcaaaatga

SEQ ID NO: 194153 - DNA, 16 bp, P. troglodytes
aattaagaaactggca

SEQ ID NO: 194154 - DNA, 16 bp, P. troglodytes
aattaagcaagagaaa

SEQ ID NO: 194155 - DNA, 16 bp, P. troglodytes
aattaagctaattaac

SEQ ID NO: 194156 - DNA, 16 bp, P. troglodytes
aattaaggcaacaaaa

SEQ ID NO: 194157 - DNA, 16 bp, P. troglodytes
aattaagtctttaaaa

SEQ ID NO: 194158 - DNA, 16 bp, P. troglodytes
aattaataaaatgaca

SEQ ID NO: 194159 - DNA, 16 bp, P. troglodytes
aattaataaccctaca

SEQ ID NO: 194160 - DNA, 16 bp, P. troglodytes
aattaatagaaacaga

SEQ ID NO: 194161 - DNA, 16 bp, P. troglodytes
aattaatatgtgtaaa

SEQ ID NO: 194162 - DNA, 16 bp, P. troglodytes
aattaatcagggaaga

SEQ ID NO: 194163 - DNA, 16 bp, P. troglodytes
aattaatgaacaaata

SEQ ID NO: 194164 - DNA, 16 bp, P. troglodytes
aattaatgaataaaca

SEQ ID NO: 194165 - DNA, 16 bp, P. troglodytes
aattaatgagataatt

SEQ ID NO: 194166 - DNA, 16 bp, P. troglodytes
aattaattcaggatgg

SEQ ID NO: 194167 - DNA, 16 bp, P. troglodytes
aattaatttcatctgt

SEQ ID NO: 194168 - DNA, 16 bp, P. troglodytes
aattaattttcaacaa

SEQ ID NO: 194169 - DNA, 16 bp, P. troglodytes
aattaattttcgtata

SEQ ID NO: 194170 - DNA, 16 bp, P. troglodytes
aattaattttgcattt

SEQ ID NO: 194171 - DNA, 16 bp, P. troglodytes
aattacacctcaataa

SEQ ID NO: 194172 - DNA, 16 bp, P. troglodytes
aattacaggcatgtgt

SEQ ID NO: 194173 - DNA, 16 bp, P. troglodytes
aattacatctttaaag

SEQ ID NO: 194174 - DNA, 16 bp, P. troglodytes
aattacatgcatgagc

SEQ ID NO: 194175 - DNA, 16 bp, P. troglodytes
aattacatgtatattt

SEQ ID NO: 194176 - DNA, 16 bp, P. troglodytes
aattacatgttacaat

SEQ ID NO: 194177 - DNA, 16 bp, P. troglodytes
aattacattgaatata

SEQ ID NO: 194178 - DNA, 16 bp, P. troglodytes
aattacatttcaattt

SEQ ID NO: 194179 - DNA, 16 bp, P. troglodytes
aattacatttgcaaaa

SEQ ID NO: 194180 - DNA, 16 bp, P. troglodytes
aattacattttatgtt

SEQ ID NO: 194181 - DNA, 16 bp, P. troglodytes
aattaccaaaatgtga

SEQ ID NO: 194182 - DNA, 16 bp, P. troglodytes
aattaccatttttaaa

SEQ ID NO: 194183 - DNA, 16 bp, P. troglodytes
aattacccagtcctgg

SEQ ID NO: 194184 - DNA, 16 bp, P. troglodytes
aattacctctttaaaa

SEQ ID NO: 194185 - DNA, 16 bp, P. troglodytes
aattacctctttaaag

SEQ ID NO: 194186 - DNA, 16 bp, P. troglodytes
aattaccttgtgcagt

SEQ ID NO: 194187 - DNA, 16 bp, P. troglodytes
aattacctttttaaaa

SEQ ID NO: 194188 - DNA, 16 bp, P. troglodytes
aattactctttctcca

SEQ ID NO: 194189 - DNA, 16 bp, P. troglodytes
aattactgaaataaat

SEQ ID NO: 194190 - DNA, 16 bp, P. troglodytes
aattactgtatgatcc

SEQ ID NO: 194191 - DNA, 16 bp, P. troglodytes
aattactgtattttaa

SEQ ID NO: 194192 - DNA, 16 bp, P. troglodytes
aattactgtttttatt

SEQ ID NO: 194193 - DNA, 16 bp, P. troglodytes
aattacttaatctctt

SEQ ID NO: 194194 - DNA, 16 bp, P. troglodytes
aattacttctttaaag

SEQ ID NO: 194195 - DNA, 16 bp, P. troglodytes
aattactttgaatgta

SEQ ID NO: 194196 - DNA, 16 bp, P. troglodytes
aattagaaaacaaatt

SEQ ID NO: 194197 - DNA, 16 bp, P. troglodytes
aattagaaactatttt

SEQ ID NO: 194198 - DNA, 16 bp, P. troglodytes
aattagaaatcaattt

SEQ ID NO: 194199 - DNA, 16 bp, P. troglodytes
aattagaaatcaggat

SEQ ID NO: 194200 - DNA, 16 bp, P. troglodytes
aattagaaatggagcc

SEQ ID NO: 194201 - DNA, 16 bp, P. troglodytes
aattagaagaactaga

SEQ ID NO: 194202 - DNA, 16 bp, P. troglodytes
aattagcatatccatc

SEQ ID NO: 194203 - DNA, 17 bp, P. troglodytes
aattagccagatgtggt

SEQ ID NO: 194204 - DNA, 21 bp, P. troglodytes
aattagccaggcatggtggcg

SEQ ID NO: 194205 - DNA, 16 bp, P. troglodytes
aattagccgaacatgg

SEQ ID NO: 194206 - DNA, 19 bp, P. troglodytes
aattagccgggcatggtgc

SEQ ID NO: 194207 - DNA, 18 bp, P. troglodytes
aattagccgggcttggtg

SEQ ID NO: 194208 - DNA, 20 bp, P. troglodytes
aattagccggtcgtggtggt

SEQ ID NO: 194209 - DNA, 18 bp, P. troglodytes
aattagcctggcgtggta

SEQ ID NO: 194210 - DNA, 17 bp, P. troglodytes
aattagctgggcgtggt

SEQ ID NO: 194211 - DNA, 16 bp, P. troglodytes
aattaggaagagagga

SEQ ID NO: 194212 - DNA, 16 bp, P. troglodytes
aattagggatgctcaa

SEQ ID NO: 194213 - DNA, 16 bp, P. troglodytes
aattagtaattagtaa

SEQ ID NO: 194214 - DNA, 17 bp, P. troglodytes
aattagtcgggcatggt

SEQ ID NO: 194215 - DNA, 24 bp, P. troglodytes
aattagtgaaagtactaaaagtct

SEQ ID NO: 194216 - DNA, 16 bp, P. troglodytes
aattataagcaaaatt

SEQ ID NO: 194217 - DNA, 16 bp, P. troglodytes
aattatacactttaaa

SEQ ID NO: 194218 - DNA, 16 bp, P. troglodytes
aattatacatatatgt

SEQ ID NO: 194219 - DNA, 16 bp, P. troglodytes
aattataccattttat

SEQ ID NO: 194220 - DNA, 16 bp, P. troglodytes
aattatacctcaataa

SEQ ID NO: 194221 - DNA, 16 bp, P. troglodytes
aattataccttaataa

SEQ ID NO: 194222 - DNA, 16 bp, P. troglodytes
aattatactgttttag

SEQ ID NO: 194223 - DNA, 16 bp, P. troglodytes
aattatactttaagtt

SEQ ID NO: 194224 - DNA, 16 bp, P. troglodytes
aattatagaaatggaa

SEQ ID NO: 194225 - DNA, 16 bp, P. troglodytes
aattataggcctgagc

SEQ ID NO: 194226 - DNA, 16 bp, P. troglodytes
aattataggtgtgaac

SEQ ID NO: 194227 - DNA, 16 bp, P. troglodytes
aattatagttttcttt

SEQ ID NO: 194228 - DNA, 16 bp, P. troglodytes
aattatatctcaataa

SEQ ID NO: 194229 - DNA, 16 bp, P. troglodytes
aattatatctcagtaa

SEQ ID NO: 194230 - DNA, 16 bp, P. troglodytes
aattatatgaatgtat

SEQ ID NO: 194231 - DNA, 16 bp, P. troglodytes
aattatatgacatttt

SEQ ID NO: 194232 - DNA, 16 bp, P. troglodytes
aattatatgcaaatta

SEQ ID NO: 194233 - DNA, 16 bp, P. troglodytes
aattatatgcattttt

SEQ ID NO: 194234 - DNA, 16 bp, P. troglodytes
aattatattaaaagca

SEQ ID NO: 194235 - DNA, 16 bp, P. troglodytes
aattatattttcagaa

SEQ ID NO: 194236 - DNA, 16 bp, P. troglodytes
aattatcaaaatgtga

SEQ ID NO: 194237 - DNA, 16 bp, P. troglodytes
aattatcactttggct

SEQ ID NO: 194238 - DNA, 18 bp, P. troglodytes
aattatcagccaagaatt

SEQ ID NO: 194239 - DNA, 16 bp, P. troglodytes
aattatcagtcaagaa

SEQ ID NO: 194240 - DNA, 16 bp, P. troglodytes
aattatccaaactgaa

SEQ ID NO: 194241 - DNA, 17 bp, P. troglodytes
aattatccgggcgtggt

SEQ ID NO: 194242 - DNA, 16 bp, P. troglodytes
aattatcctgcctcag

SEQ ID NO: 194243 - DNA, 16 bp, P. troglodytes
aattatccttcaaaaa

SEQ ID NO: 194244 - DNA, 16 bp, P. troglodytes
aattatctcaataaag

SEQ ID NO: 194245 - DNA, 16 bp, P. troglodytes
aattatctttttaatg

SEQ ID NO: 194246 - DNA, 16 bp, P. troglodytes
aattatgaaaacagaa

SEQ ID NO: 194247 - DNA, 16 bp, P. troglodytes
aattatgaaacatttt

SEQ ID NO: 194248 - DNA, 16 bp, P. troglodytes
aattatgctttaaaaa

SEQ ID NO: 194249 - DNA, 16 bp, P. troglodytes
aattatgggagataca

SEQ ID NO: 194250 - DNA, 16 bp, P. troglodytes
aattatgtatttcttt

SEQ ID NO: 194251 - DNA, 16 bp, P. troglodytes
aattatgttatctgca

SEQ ID NO: 194252 - DNA, 16 bp, P. troglodytes
aattatgtttcaagaa

SEQ ID NO: 194253 - DNA, 16 bp, P. troglodytes
aattattagtgatgtt

SEQ ID NO: 194254 - DNA, 16 bp, P. troglodytes
aattattcaaaagaaa

SEQ ID NO: 194255 - DNA, 17 bp, P. troglodytes
aattattcaatgatgtc

SEQ ID NO: 194256 - DNA, 16 bp, P. troglodytes
aattattctcttctag

SEQ ID NO: 194257 - DNA, 16 bp, P. troglodytes
aattattgagtctgag

SEQ ID NO: 194258 - DNA, 16 bp, P. troglodytes
aattattgcattttta

SEQ ID NO: 194259 - DNA, 16 bp, P. troglodytes
aattattgccttaatt

SEQ ID NO: 194260 - DNA, 16 bp, P. troglodytes
aattattgttttcatt

SEQ ID NO: 194261 - DNA, 16 bp, P. troglodytes
aattatttaacatgtt

SEQ ID NO: 194262 - DNA, 16 bp, P. troglodytes
aattatttatttgctt

SEQ ID NO: 194263 - DNA, 16 bp, P. troglodytes
aattatttcaaccatt

SEQ ID NO: 194264 - DNA, 16 bp, P. troglodytes
aattatttcacaattt

SEQ ID NO: 194265 - DNA, 16 bp, P. troglodytes
aattatttcagctttg

SEQ ID NO: 194266 - DNA, 16 bp, P. troglodytes
aattatttccaaaatg

SEQ ID NO: 194267 - DNA, 16 bp, P. troglodytes
aattatttcccaaggc

SEQ ID NO: 194268 - DNA, 16 bp, P. troglodytes
aattatttcctcattt

SEQ ID NO: 194269 - DNA, 16 bp, P. troglodytes
aattatttccttagga

SEQ ID NO: 194270 - DNA, 16 bp, P. troglodytes
aattatttctgaaata

SEQ ID NO: 194271 - DNA, 16 bp, P. troglodytes
aattatttcttcaaat

SEQ ID NO: 194272 - DNA, 16 bp, P. troglodytes
aattatttcttcagtt

SEQ ID NO: 194273 - DNA, 16 bp, P. troglodytes
aattatttgaacatat

SEQ ID NO: 194274 - DNA, 16 bp, P. troglodytes
aattatttggaataat

SEQ ID NO: 194275 - DNA, 16 bp, P. troglodytes
aattatttgtgaaaat

SEQ ID NO: 194276 - DNA, 16 bp, P. troglodytes
aattatttgtttcatt

SEQ ID NO: 194277 - DNA, 16 bp, P. troglodytes
aattatttgttttcct

SEQ ID NO: 194278 - DNA, 16 bp, P. troglodytes
aattattttaaacaca

SEQ ID NO: 194279 - DNA, 16 bp, P. troglodytes
aattattttacagatg

SEQ ID NO: 194280 - DNA, 16 bp, P. troglodytes
aattattttattgtct

SEQ ID NO: 194281 - DNA, 16 bp, P. troglodytes
aattattttcaaatgt

SEQ ID NO: 194282 - DNA, 16 bp, P. troglodytes
aattattttcacaaaa

SEQ ID NO: 194283 - DNA, 16 bp, P. troglodytes
aattattttctctcat

SEQ ID NO: 194284 - DNA, 16 bp, P. troglodytes
aattattttcttcctg

SEQ ID NO: 194285 - DNA, 16 bp, P. troglodytes
aattattttgaaatct

SEQ ID NO: 194286 - DNA, 16 bp, P. troglodytes
aattattttgcattaa

SEQ ID NO: 194287 - DNA, 16 bp, P. troglodytes
aattattttggaaaat

SEQ ID NO: 194288 - DNA, 16 bp, P. troglodytes
aattattttgtctatt

SEQ ID NO: 194289 - DNA, 16 bp, P. troglodytes
aattatttttaaaagg

SEQ ID NO: 194290 - DNA, 16 bp, P. troglodytes
aattatttttaacagt

SEQ ID NO: 194291 - DNA, 16 bp, P. troglodytes
aattatttttaagaag

SEQ ID NO: 194292 - DNA, 16 bp, P. troglodytes
aattatttttcagaaa

SEQ ID NO: 194293 - DNA, 16 bp, P. troglodytes
aattatttttcccatt

SEQ ID NO: 194294 - DNA, 16 bp, P. troglodytes
aattatttttgcctta

SEQ ID NO: 194295 - DNA, 16 bp, P. troglodytes
aattcaaaaataggaa

SEQ ID NO: 194296 - DNA, 16 bp, P. troglodytes
aattcaaaaatggaaa

SEQ ID NO: 194297 - DNA, 16 bp, P. troglodytes
aattcaaaaccagcct

SEQ ID NO: 194298 - DNA, 16 bp, P. troglodytes
aattcaaaagaatgca

SEQ ID NO: 194299 - DNA, 16 bp, P. troglodytes
aattcaaaatcatttt

SEQ ID NO: 194300 - DNA, 16 bp, P. troglodytes
aattcaaaatttgaaa

SEQ ID NO: 194301 - DNA, 16 bp, P. troglodytes
aattcaaatagaaaat

SEQ ID NO: 194302 - DNA, 16 bp, P. troglodytes
aattcaaatgaaaacc

SEQ ID NO: 194303 - DNA, 16 bp, P. troglodytes
aattcaacaaacattt

SEQ ID NO: 194304 - DNA, 16 bp, P. troglodytes
aattcaacaaagaaat

SEQ ID NO: 194305 - DNA, 16 bp, P. troglodytes
aattcaacaagaacag

SEQ ID NO: 194306 - DNA, 16 bp, P. troglodytes
aattcaacaagaagag

SEQ ID NO: 194307 - DNA, 16 bp, P. troglodytes
aattcaacaagtattt

SEQ ID NO: 194308 - DNA, 16 bp, P. troglodytes
aattcaacaatacatt

SEQ ID NO: 194309 - DNA, 16 bp, P. troglodytes
aattcaacaccagcct

SEQ ID NO: 194310 - DNA, 16 bp, P. troglodytes
aattcaacaggaagag

SEQ ID NO: 194311 - DNA, 16 bp, P. troglodytes
aattcaacccataaca

SEQ ID NO: 194312 - DNA, 16 bp, P. troglodytes
aattcaagaaaacttt

SEQ ID NO: 194313 - DNA, 16 bp, P. troglodytes
aattcaagaagagatt

SEQ ID NO: 194314 - DNA, 16 bp, P. troglodytes
aattcaagaccatcct

SEQ ID NO: 194315 - DNA, 17 bp, P. troglodytes
aattcaagatgagattt

SEQ ID NO: 194316 - DNA, 17 bp, P. troglodytes
aattcaaggtgagattt

SEQ ID NO: 194317 - DNA, 16 bp, P. troglodytes
aattcaaggtgatatt

SEQ ID NO: 194318 - DNA, 17 bp, P. troglodytes
aattcaagttgagattt

SEQ ID NO: 194319 - DNA, 16 bp, P. troglodytes
aattcaagttttgttt

SEQ ID NO: 194320 - DNA, 16 bp, P. troglodytes
aattcaataaaaaatg

SEQ ID NO: 194321 - DNA, 16 bp, P. troglodytes
aattcaatagaaaaat

SEQ ID NO: 194322 - DNA, 16 bp, P. troglodytes
aattcaatgaatttta

SEQ ID NO: 194323 - DNA, 16 bp, P. troglodytes
aattcaatgtttgata

SEQ ID NO: 194324 - DNA, 16 bp, P. troglodytes
aattcacaaatgcaaa

SEQ ID NO: 194325 - DNA, 16 bp, P. troglodytes
aattcacacacacaca

SEQ ID NO: 194326 - DNA, 16 bp, P. troglodytes
aattcacacaccataa

SEQ ID NO: 194327 - DNA, 16 bp, P. troglodytes
aattcacacataataa

SEQ ID NO: 194328 - DNA, 16 bp, P. troglodytes
aattcacacatttaaa

SEQ ID NO: 194329 - DNA, 16 bp, P. troglodytes
aattcacagaaagaaa

SEQ ID NO: 194330 - DNA, 16 bp, P. troglodytes
aattcacagaagcaga

SEQ ID NO: 194331 - DNA, 16 bp, P. troglodytes
aattcacagagacaga

SEQ ID NO: 194332 - DNA, 16 bp, P. troglodytes
aattcacatgtaacaa

SEQ ID NO: 194333 - DNA, 16 bp, P. troglodytes
aattcacattttttaa

SEQ ID NO: 194334 - DNA, 17 bp, P. troglodytes
aattcaccaaagttgaa

SEQ ID NO: 194335 - DNA, 16 bp, P. troglodytes
aattcaccaattttaa

SEQ ID NO: 194336 - DNA, 16 bp, P. troglodytes
aattcaccatgatcaa

SEQ ID NO: 194337 - DNA, 16 bp, P. troglodytes
aattcacttttaaaaa

SEQ ID NO: 194338 - DNA, 16 bp, P. troglodytes
aattcagaaaaaaagt

SEQ ID NO: 194339 - DNA, 16 bp, P. troglodytes
aattcagaaaataaag

SEQ ID NO: 194340 - DNA, 16 bp, P. troglodytes
aattcagaaactattt

SEQ ID NO: 194341 - DNA, 16 bp, P. troglodytes
aattcagaaagtattt

SEQ ID NO: 194342 - DNA, 16 bp, P. troglodytes
aattcagaaataaaat

SEQ ID NO: 194343 - DNA, 16 bp, P. troglodytes
aattcagaatatggat

SEQ ID NO: 194344 - DNA, 16 bp, P. troglodytes
aattcagaatctggat

SEQ ID NO: 194345 - DNA, 16 bp, P. troglodytes
aattcagagaaaaaga

SEQ ID NO: 194346 - DNA, 16 bp, P. troglodytes
aattcagagagacaga

SEQ ID NO: 194347 - DNA, 16 bp, P. troglodytes
aattcagaggaaaaaa

SEQ ID NO: 194348 - DNA, 16 bp, P. troglodytes
aattcagatgttgaaa

SEQ ID NO: 194349 - DNA, 16 bp, P. troglodytes
aattcagattttaaaa

SEQ ID NO: 194350 - DNA, 16 bp, P. troglodytes
aattcagcaaacattt

SEQ ID NO: 194351 - DNA, 16 bp, P. troglodytes
aattcagcagcatatt

SEQ ID NO: 194352 - DNA, 16 bp, P. troglodytes
aattcagtggttttta

SEQ ID NO: 194353 - DNA, 16 bp, P. troglodytes
aattcagtgtttgcag

SEQ ID NO: 194354 - DNA, 16 bp, P. troglodytes
aattcagttccttgtg

SEQ ID NO: 194355 - DNA, 17 bp, P. troglodytes
aattcatactggagaga

SEQ ID NO: 194356 - DNA, 16 bp, P. troglodytes
aattcatatgaaatct

SEQ ID NO: 194357 - DNA, 16 bp, P. troglodytes
aattcatatggaatct

SEQ ID NO: 194358 - DNA, 16 bp, P. troglodytes
aattcatatggaattg

SEQ ID NO: 194359 - DNA, 16 bp, P. troglodytes
aattcatatgttaaaa

SEQ ID NO: 194360 - DNA, 16 bp, P. troglodytes
aattcatatttcaaaa

SEQ ID NO: 194361 - DNA, 16 bp, P. troglodytes
aattcatcatgatcaa

SEQ ID NO: 194362 - DNA, 16 bp, P. troglodytes
aattcatccatttttt

SEQ ID NO: 194363 - DNA, 16 bp, P. troglodytes
aattcatctgtgaatc

SEQ ID NO: 194364 - DNA, 16 bp, P. troglodytes
aattcatcttgagtta

SEQ ID NO: 194365 - DNA, 16 bp, P. troglodytes
aattcatgaaaatata

SEQ ID NO: 194366 - DNA, 16 bp, P. troglodytes
aattcatgttttaaat

SEQ ID NO: 194367 - DNA, 16 bp, P. troglodytes
aattcatttaatcctc

SEQ ID NO: 194368 - DNA, 16 bp, P. troglodytes
aattcattttgagttt

SEQ ID NO: 194369 - DNA, 16 bp, P. troglodytes
aattcatttttcagtt

SEQ ID NO: 194370 - DNA, 16 bp, P. troglodytes
aattccaaagccactt

SEQ ID NO: 194371 - DNA, 16 bp, P. troglodytes
aattccaaccaagaat

SEQ ID NO: 194372 - DNA, 16 bp, P. troglodytes
aattccaaggggaaaa

SEQ ID NO: 194373 - DNA, 16 bp, P. troglodytes
aattccaattatatga

SEQ ID NO: 194374 - DNA, 16 bp, P. troglodytes
aattccacttctaggt

SEQ ID NO: 194375 - DNA, 16 bp, P. troglodytes
aattccacttgttcat

SEQ ID NO: 194376 - DNA, 16 bp, P. troglodytes
aattccagaaaaagaa

SEQ ID NO: 194377 - DNA, 16 bp, P. troglodytes
aattccagcaccttgg

SEQ ID NO: 194378 - DNA, 18 bp, P. troglodytes
aattccagcactttagga

SEQ ID NO: 194379 - DNA, 18 bp, P. troglodytes
aattccagcactttgggt

SEQ ID NO: 194380 - DNA, 16 bp, P. troglodytes
aattccagcatgttgg

SEQ ID NO: 194381 - DNA, 16 bp, P. troglodytes
aattccagcattctct

SEQ ID NO: 194382 - DNA, 16 bp, P. troglodytes
aattccagcctgggca

SEQ ID NO: 194383 - DNA, 16 bp, P. troglodytes
aattccagctctttgg

SEQ ID NO: 194384 - DNA, 16 bp, P. troglodytes
aattccaggctgggtg

SEQ ID NO: 194385 - DNA, 16 bp, P. troglodytes
aattccatttataata

SEQ ID NO: 194386 - DNA, 16 bp, P. troglodytes
aattccatttctttct

SEQ ID NO: 194387 - DNA, 16 bp, P. troglodytes
aattccattttaaaat

SEQ ID NO: 194388 - DNA, 16 bp, P. troglodytes
aattcccacatgtcat

SEQ ID NO: 194389 - DNA, 17 bp, P. troglodytes
aattcccacgtgtcatg

SEQ ID NO: 194390 - DNA, 16 bp, P. troglodytes
aattcccaggtgttgt

SEQ ID NO: 194391 - DNA, 16 bp, P. troglodytes
aattcccatgtatcat

SEQ ID NO: 194392 - DNA, 16 bp, P. troglodytes
aattcccatgtgctgt

SEQ ID NO: 194393 - DNA, 17 bp, P. troglodytes
aattcccattcacaatt

SEQ ID NO: 194394 - DNA, 16 bp, P. troglodytes
aattccctcagtattt

SEQ ID NO: 194395 - DNA, 16 bp, P. troglodytes
aattccctcatctgta

SEQ ID NO: 194396 - DNA, 16 bp, P. troglodytes
aattcctaaatatttt

SEQ ID NO: 194397 - DNA, 16 bp, P. troglodytes
aattcctaggctcaag

SEQ ID NO: 194398 - DNA, 16 bp, P. troglodytes
aattcctatgttgaaa

SEQ ID NO: 194399 - DNA, 16 bp, P. troglodytes
aattcctcaaggatgt

SEQ ID NO: 194400 - DNA, 16 bp, P. troglodytes
aattcctctgcctcag

SEQ ID NO: 194401 - DNA, 16 bp, P. troglodytes
aattcctctttaaatg

SEQ ID NO: 194402 - DNA, 16 bp, P. troglodytes
aattcctgaaggatct

SEQ ID NO: 194403 - DNA, 19 bp, P. troglodytes
aattcctgacctcaggtga

SEQ ID NO: 194404 - DNA, 20 bp, P. troglodytes
aattcctgacctcaggtgat

SEQ ID NO: 194405 - DNA, 16 bp, P. troglodytes
aattcctgacctcggg

SEQ ID NO: 194406 - DNA, 16 bp, P. troglodytes
aattcctgagctcaag

SEQ ID NO: 194407 - DNA, 16 bp, P. troglodytes
aattcctggacacaaa

SEQ ID NO: 194408 - DNA, 16 bp, P. troglodytes
aattcctggactcaag

SEQ ID NO: 194409 - DNA, 16 bp, P. troglodytes
aattcctggcctcaag

SEQ ID NO: 194410 - DNA, 16 bp, P. troglodytes
aattcctgggctcaac

SEQ ID NO: 194411 - DNA, 16 bp, P. troglodytes
aattcctgggctcaag

SEQ ID NO: 194412 - DNA, 16 bp, P. troglodytes
aattcctgggctctag

SEQ ID NO: 194413 - DNA, 16 bp, P. troglodytes
aattccttataataaa

SEQ ID NO: 194414 - DNA, 16 bp, P. troglodytes
aattccttcctcttca

SEQ ID NO: 194415 - DNA, 16 bp, P. troglodytes
aattcggttgtgaatc

SEQ ID NO: 194416 - DNA, 16 bp, P. troglodytes
aattctaaaatgtata

SEQ ID NO: 194417 - DNA, 16 bp, P. troglodytes
aattctaaagaaaaat

SEQ ID NO: 194418 - DNA, 16 bp, P. troglodytes
aattctaccacatgta

SEQ ID NO: 194419 - DNA, 19 bp, P. troglodytes
aattctaccagaggtacaa

SEQ ID NO: 194420 - DNA, 16 bp, P. troglodytes
aattctactaaatatt

SEQ ID NO: 194421 - DNA, 16 bp, P. troglodytes
aattctactactgggt

SEQ ID NO: 194422 - DNA, 16 bp, P. troglodytes
aattctagaaatattt

SEQ ID NO: 194423 - DNA, 16 bp, P. troglodytes
aattctagtctctgat

SEQ ID NO: 194424 - DNA, 16 bp, P. troglodytes
aattctagttttaaaa

SEQ ID NO: 194425 - DNA, 16 bp, P. troglodytes
aattctatgaaaaatg

SEQ ID NO: 194426 - DNA, 16 bp, P. troglodytes
aattctatgaagaaaa

SEQ ID NO: 194427 - DNA, 16 bp, P. troglodytes
aattctatgaaggcta

SEQ ID NO: 194428 - DNA, 16 bp, P. troglodytes
aattctatttcattga

SEQ ID NO: 194429 - DNA, 16 bp, P. troglodytes
aattctcaaaagaaaa

SEQ ID NO: 194430 - DNA, 16 bp, P. troglodytes
aattctcaacaaaatg

SEQ ID NO: 194431 - DNA, 16 bp, P. troglodytes
aattctcaaggacaag

SEQ ID NO: 194432 - DNA, 16 bp, P. troglodytes
aattctcacaagatct

SEQ ID NO: 194433 - DNA, 16 bp, P. troglodytes
aattctcccatctcag

SEQ ID NO: 194434 - DNA, 16 bp, P. troglodytes
aattctcctgcctcaa

SEQ ID NO: 194435 - DNA, 16 bp, P. troglodytes
aattctcctgctccag

SEQ ID NO: 194436 - DNA, 16 bp, P. troglodytes
aattctcctggatctt

SEQ ID NO: 194437 - DNA, 16 bp, P. troglodytes
aattctcctgtttcag

SEQ ID NO: 194438 - DNA, 16 bp, P. troglodytes
aattctcctttgccat

SEQ ID NO: 194439 - DNA, 16 bp, P. troglodytes
aattctctcaattttt

SEQ ID NO: 194440 - DNA, 16 bp, P. troglodytes
aattctctgcaagcct

SEQ ID NO: 194441 - DNA, 16 bp, P. troglodytes
aattctgaaagaaaat

SEQ ID NO: 194442 - DNA, 16 bp, P. troglodytes
aattctgaataatttt

SEQ ID NO: 194443 - DNA, 16 bp, P. troglodytes
aattctgacactacct

SEQ ID NO: 194444 - DNA, 16 bp, P. troglodytes
aattctgagaaataaa

SEQ ID NO: 194445 - DNA, 16 bp, P. troglodytes
aattctgagaagaaaa

SEQ ID NO: 194446 - DNA, 16 bp, P. troglodytes
aattctgatttctttt

SEQ ID NO: 194447 - DNA, 16 bp, P. troglodytes
aattctgcattgaaaa

SEQ ID NO: 194448 - DNA, 16 bp, P. troglodytes
aattctgccaaacatt

SEQ ID NO: 194449 - DNA, 16 bp, P. troglodytes
aattctgccattgtag

SEQ ID NO: 194450 - DNA, 16 bp, P. troglodytes
aattctggaactggaa

SEQ ID NO: 194451 - DNA, 16 bp, P. troglodytes
aattctggacacatta

SEQ ID NO: 194452 - DNA, 16 bp, P. troglodytes
aattctggacacattt

SEQ ID NO: 194453 - DNA, 16 bp, P. troglodytes
aattctggaggtgaaa

SEQ ID NO: 194454 - DNA, 16 bp, P. troglodytes
aattctggctctgcta

SEQ ID NO: 194455 - DNA, 16 bp, P. troglodytes
aattctgtatttcttt

SEQ ID NO: 194456 - DNA, 16 bp, P. troglodytes
aattctgtgaaaaata

SEQ ID NO: 194457 - DNA, 16 bp, P. troglodytes
aattctgtgaagaaaa

SEQ ID NO: 194458 - DNA, 16 bp, P. troglodytes
aattctgtgaagaatg

SEQ ID NO: 194459 - DNA, 16 bp, P. troglodytes
aattctgttcattttt

SEQ ID NO: 194460 - DNA, 16 bp, P. troglodytes
aattctgtttaatttt

SEQ ID NO: 194461 - DNA, 16 bp, P. troglodytes
aattctgtttgtgtga

SEQ ID NO: 194462 - DNA, 16 bp, P. troglodytes
aattctgttttaaaaa

SEQ ID NO: 194463 - DNA, 16 bp, P. troglodytes
aattctgtttttgtgg

SEQ ID NO: 194464 - DNA, 16 bp, P. troglodytes
aattcttaaaggaaat

SEQ ID NO: 194465 - DNA, 16 bp, P. troglodytes
aattcttatgttgaaa

SEQ ID NO: 194466 - DNA, 16 bp, P. troglodytes
aattcttcaaaagaaa

SEQ ID NO: 194467 - DNA, 16 bp, P. troglodytes
aattcttctctgcctt

SEQ ID NO: 194468 - DNA, 16 bp, P. troglodytes
aattcttgacttttgt

SEQ ID NO: 194469 - DNA, 16 bp, P. troglodytes
aattcttggctgggca

SEQ ID NO: 194470 - DNA, 16 bp, P. troglodytes
aattcttgggcctcca

SEQ ID NO: 194471 - DNA, 16 bp, P. troglodytes
aattcttgtaattttt

SEQ ID NO: 194472 - DNA, 16 bp, P. troglodytes
aattcttgtgttttta

SEQ ID NO: 194473 - DNA, 16 bp, P. troglodytes
aattctttctctgccc

SEQ ID NO: 194474 - DNA, 16 bp, P. troglodytes
aattctttcttttgct

SEQ ID NO: 194475 - DNA, 16 bp, P. troglodytes
aattctttgaaagaaa

SEQ ID NO: 194476 - DNA, 16 bp, P. troglodytes
aattctttgaagaatg

SEQ ID NO: 194477 - DNA, 16 bp, P. troglodytes
aattctttgagatttt

SEQ ID NO: 194478 - DNA, 16 bp, P. troglodytes
aattctttgcattttt

SEQ ID NO: 194479 - DNA, 16 bp, P. troglodytes
aattctttgccaagac

SEQ ID NO: 194480 - DNA, 16 bp, P. troglodytes
aattctttgccaaggc

SEQ ID NO: 194481 - DNA, 16 bp, P. troglodytes
aattctttggagaaaa

SEQ ID NO: 194482 - DNA, 16 bp, P. troglodytes
aattcttttaaatgta

SEQ ID NO: 194483 - DNA, 16 bp, P. troglodytes
aattctttttgaaata

SEQ ID NO: 194484 - DNA, 16 bp, P. troglodytes
aattgaaaacaatttt

SEQ ID NO: 194485 - DNA, 16 bp, P. troglodytes
aattgaaattatacaa

SEQ ID NO: 194486 - DNA, 16 bp, P. troglodytes
aattgaaattatatca

SEQ ID NO: 194487 - DNA, 16 bp, P. troglodytes
aattgaagaaaacaca

SEQ ID NO: 194488 - DNA, 16 bp, P. troglodytes
aattgaagaagacaca

SEQ ID NO: 194489 - DNA, 16 bp, P. troglodytes
aattgaagaggaggaa

SEQ ID NO: 194490 - DNA, 16 bp, P. troglodytes
aattgaatacccttga

SEQ ID NO: 194491 - DNA, 16 bp, P. troglodytes
aattgaatattattca

SEQ ID NO: 194492 - DNA, 16 bp, P. troglodytes
aattgaatttaaaaac

SEQ ID NO: 194493 - DNA, 16 bp, P. troglodytes
aattgaatttgtagtt

SEQ ID NO: 194494 - DNA, 16 bp, P. troglodytes
aattgacaaaataatt

SEQ ID NO: 194495 - DNA, 16 bp, P. troglodytes
aattgacaaataataa

SEQ ID NO: 194496 - DNA, 16 bp, P. troglodytes
aattgacaagaaaatt

SEQ ID NO: 194497 - DNA, 16 bp, P. troglodytes
aattgacagaagtaga

SEQ ID NO: 194498 - DNA, 16 bp, P. troglodytes
aattgaggaaaacttc

SEQ ID NO: 194499 - DNA, 16 bp, P. troglodytes
aattgaggtttaggaa

SEQ ID NO: 194500 - DNA, 16 bp, P. troglodytes
aattgaggtttgggga

SEQ ID NO: 194501 - DNA, 16 bp, P. troglodytes
aattgataaatgggat

SEQ ID NO: 194502 - DNA, 16 bp, P. troglodytes
aattgatagaccactg

SEQ ID NO: 194503 - DNA, 16 bp, P. troglodytes
aattgatcaaacagaa

SEQ ID NO: 194504 - DNA, 16 bp, P. troglodytes
aattgattttctaatg

SEQ ID NO: 194505 - DNA, 16 bp, P. troglodytes
aattgatttttgacaa

SEQ ID NO: 194506 - DNA, 16 bp, P. troglodytes
aattgcaaaaataata

SEQ ID NO: 194507 - DNA, 16 bp, P. troglodytes
aattgcaaaactatgg

SEQ ID NO: 194508 - DNA, 16 bp, P. troglodytes
aattgcaaaagagaaa

SEQ ID NO: 194509 - DNA, 16 bp, P. troglodytes
aattgcaaaggaagaa

SEQ ID NO: 194510 - DNA, 16 bp, P. troglodytes
aattgcaaatcaaaac

SEQ ID NO: 194511 - DNA, 16 bp, P. troglodytes
aattgcaataaaaaca

SEQ ID NO: 194512 - DNA, 16 bp, P. troglodytes
aattgcactgaattta

SEQ ID NO: 194513 - DNA, 16 bp, P. troglodytes
aattgcagctcactgc

SEQ ID NO: 194514 - DNA, 16 bp, P. troglodytes
aattgcaggaaaaaaa

SEQ ID NO: 194515 - DNA, 16 bp, P. troglodytes
aattgcatctgcaaag

SEQ ID NO: 194516 - DNA, 16 bp, P. troglodytes
aattgcatttatttat

SEQ ID NO: 194517 - DNA, 16 bp, P. troglodytes
aattgccacaaaagca

SEQ ID NO: 194518 - DNA, 16 bp, P. troglodytes
aattgcccaatctcag

SEQ ID NO: 194519 - DNA, 16 bp, P. troglodytes
aattgccttttctttt

SEQ ID NO: 194520 - DNA, 16 bp, P. troglodytes
aattgctaaaataaaa

SEQ ID NO: 194521 - DNA, 16 bp, P. troglodytes
aattgctaagagtaaa

SEQ ID NO: 194522 - DNA, 16 bp, P. troglodytes
aattgctattttaaat

SEQ ID NO: 194523 - DNA, 16 bp, P. troglodytes
aattgctcttctctgt

SEQ ID NO: 194524 - DNA, 17 bp, P. troglodytes
aattgcttcaaagacaa

SEQ ID NO: 194525 - DNA, 16 bp, P. troglodytes
aattgcttgaaccttg

SEQ ID NO: 194526 - DNA, 16 bp, P. troglodytes
aattgcttgagcacag

SEQ ID NO: 194527 - DNA, 16 bp, P. troglodytes
aattgcttgagcccag

SEQ ID NO: 194528 - DNA, 16 bp, P. troglodytes
aattgctttatatttt

SEQ ID NO: 194529 - DNA, 16 bp, P. troglodytes
aattgcttttaaatta

SEQ ID NO: 194530 - DNA, 16 bp, P. troglodytes
aattgctttttaaaat

SEQ ID NO: 194531 - DNA, 16 bp, P. troglodytes
aattgcttttttaaaa

SEQ ID NO: 194532 - DNA, 16 bp, P. troglodytes
aattggaaaaactggt

SEQ ID NO: 194533 - DNA, 16 bp, P. troglodytes
aattggaaaaagctac

SEQ ID NO: 194534 - DNA, 16 bp, P. troglodytes
aattggaaaatattta

SEQ ID NO: 194535 - DNA, 16 bp, P. troglodytes
aattggaaaatctgga

SEQ ID NO: 194536 - DNA, 16 bp, P. troglodytes
aattggaaactgaaat

SEQ ID NO: 194537 - DNA, 16 bp, P. troglodytes
aattggaagcttcctg

SEQ ID NO: 194538 - DNA, 16 bp, P. troglodytes
aattggaaggaaaaca

SEQ ID NO: 194539 - DNA, 16 bp, P. troglodytes
aattggaatgttccca

SEQ ID NO: 194540 - DNA, 16 bp, P. troglodytes
aattggaatgtttata

SEQ ID NO: 194541 - DNA, 16 bp, P. troglodytes
aattggaatgtttcta

SEQ ID NO: 194542 - DNA, 16 bp, P. troglodytes
aattggacttcacctt

SEQ ID NO: 194543 - DNA, 16 bp, P. troglodytes
aattggctcacagttc

SEQ ID NO: 194544 - DNA, 16 bp, P. troglodytes
aattggcttaaagaaa

SEQ ID NO: 194545 - DNA, 16 bp, P. troglodytes
aattggtaccaggaga

SEQ ID NO: 194546 - DNA, 16 bp, P. troglodytes
aattggttaaaagagt

SEQ ID NO: 194547 - DNA, 16 bp, P. troglodytes
aattgtaaagaacatc

SEQ ID NO: 194548 - DNA, 16 bp, P. troglodytes
aattgtaaaggaaatt

SEQ ID NO: 194549 - DNA, 16 bp, P. troglodytes
aattgtacactttaaa

SEQ ID NO: 194550 - DNA, 16 bp, P. troglodytes
aattgtacatatttat

SEQ ID NO: 194551 - DNA, 16 bp, P. troglodytes
aattgtacatattttg

SEQ ID NO: 194552 - DNA, 16 bp, P. troglodytes
aattgtagctcactgt

SEQ ID NO: 194553 - DNA, 16 bp, P. troglodytes
aattgtagttcccaca

SEQ ID NO: 194554 - DNA, 16 bp, P. troglodytes
aattgtatgtttaaaa

SEQ ID NO: 194555 - DNA, 16 bp, P. troglodytes
aattgtcaatcagaaa

SEQ ID NO: 194556 - DNA, 16 bp, P. troglodytes
aattgtcccaataatg

SEQ ID NO: 194557 - DNA, 16 bp, P. troglodytes
aattgtctcccattct

SEQ ID NO: 194558 - DNA, 16 bp, P. troglodytes
aattgtcttccttttt

SEQ ID NO: 194559 - DNA, 16 bp, P. troglodytes
aattgtctttgtttct

SEQ ID NO: 194560 - DNA, 16 bp, P. troglodytes
aattgtgaatgggagc

SEQ ID NO: 194561 - DNA, 16 bp, P. troglodytes
aattgtgcactttaaa

SEQ ID NO: 194562 - DNA, 17 bp, P. troglodytes
aattgtgccactgcact

SEQ ID NO: 194563 - DNA, 16 bp, P. troglodytes
aattgtgctgggaaaa

SEQ ID NO: 194564 - DNA, 16 bp, P. troglodytes
aattgtgcttctataa

SEQ ID NO: 194565 - DNA, 16 bp, P. troglodytes
aattgtgggagctaca

SEQ ID NO: 194566 - DNA, 16 bp, P. troglodytes
aattgtggtatatata

SEQ ID NO: 194567 - DNA, 16 bp, P. troglodytes
aattgtgtgaccttgg

SEQ ID NO: 194568 - DNA, 16 bp, P. troglodytes
aattgtgtgtatttat

SEQ ID NO: 194569 - DNA, 16 bp, P. troglodytes
aattgtgtttatcttt

SEQ ID NO: 194570 - DNA, 16 bp, P. troglodytes
aattgttaaattttca

SEQ ID NO: 194571 - DNA, 16 bp, P. troglodytes
aattgttaacattttg

SEQ ID NO: 194572 - DNA, 16 bp, P. troglodytes
aattgttgcttttgtt

SEQ ID NO: 194573 - DNA, 16 bp, P. troglodytes
aattgttgtattttca

SEQ ID NO: 194574 - DNA, 16 bp, P. troglodytes
aattgttgtcttgttt

SEQ ID NO: 194575 - DNA, 16 bp, P. troglodytes
aattgtttaaaacaaa

SEQ ID NO: 194576 - DNA, 16 bp, P. troglodytes
aattgtttatctgaaa

SEQ ID NO: 194577 - DNA, 16 bp, P. troglodytes
aattgtttcagctttg

SEQ ID NO: 194578 - DNA, 16 bp, P. troglodytes
aattgttttaagaaaa

SEQ ID NO: 194579 - DNA, 16 bp, P. troglodytes
aattgttttttctaat

SEQ ID NO: 194580 - DNA, 16 bp, P. troglodytes
aatttaaaaacatgat

SEQ ID NO: 194581 - DNA, 16 bp, P. troglodytes
aatttaaaaagccaaa

SEQ ID NO: 194582 - DNA, 16 bp, P. troglodytes
aatttaaaaatccttt

SEQ ID NO: 194583 - DNA, 16 bp, P. troglodytes
aatttaaaaattggtt

SEQ ID NO: 194584 - DNA, 16 bp, P. troglodytes
aatttaaaacaatcct

SEQ ID NO: 194585 - DNA, 16 bp, P. troglodytes
aatttaaaacattttg

SEQ ID NO: 194586 - DNA, 16 bp, P. troglodytes
aatttaaaagacataa

SEQ ID NO: 194587 - DNA, 16 bp, P. troglodytes
aatttaaaatactgtt

SEQ ID NO: 194588 - DNA, 16 bp, P. troglodytes
aatttaaaatatttcc

SEQ ID NO: 194589 - DNA, 16 bp, P. troglodytes
aatttaaaatgtgaat

SEQ ID NO: 194590 - DNA, 16 bp, P. troglodytes
aatttaaacaaaatgt

SEQ ID NO: 194591 - DNA, 16 bp, P. troglodytes
aatttaaactgaaaaa

SEQ ID NO: 194592 - DNA, 16 bp, P. troglodytes
aatttaaagtactttt

SEQ ID NO: 194593 - DNA, 16 bp, P. troglodytes
aatttaaatagccaca

SEQ ID NO: 194594 - DNA, 16 bp, P. troglodytes
aatttaacatccattc

SEQ ID NO: 194595 - DNA, 16 bp, P. troglodytes
aatttaacattttact

SEQ ID NO: 194596 - DNA, 16 bp, P. troglodytes
aatttaagaaaaacat

SEQ ID NO: 194597 - DNA, 16 bp, P. troglodytes
aatttaataagcattt

SEQ ID NO: 194598 - DNA, 16 bp, P. troglodytes
aatttaatgtaatttc

SEQ ID NO: 194599 - DNA, 16 bp, P. troglodytes
aatttaatgtattagt

SEQ ID NO: 194600 - DNA, 16 bp, P. troglodytes
aatttaattcagctga

SEQ ID NO: 194601 - DNA, 16 bp, P. troglodytes
aatttaatttcctttc

SEQ ID NO: 194602 - DNA, 16 bp, P. troglodytes
aatttaatttggctga

SEQ ID NO: 194603 - DNA, 16 bp, P. troglodytes
aatttacaaaagaaag

SEQ ID NO: 194604 - DNA, 16 bp, P. troglodytes
aatttacaagaaaata

SEQ ID NO: 194605 - DNA, 16 bp, P. troglodytes
aatttacaagaacaaa

SEQ ID NO: 194606 - DNA, 16 bp, P. troglodytes
aatttacaagtaaaaa

SEQ ID NO: 194607 - DNA, 16 bp, P. troglodytes
aatttacacatatttt

SEQ ID NO: 194608 - DNA, 16 bp, P. troglodytes
aatttacactaccacc

SEQ ID NO: 194609 - DNA, 16 bp, P. troglodytes
aatttacagaaaagtt

SEQ ID NO: 194610 - DNA, 16 bp, P. troglodytes
aatttacagaaaataa

SEQ ID NO: 194611 - DNA, 16 bp, P. troglodytes
aatttacagagaaaaa

SEQ ID NO: 194612 - DNA, 17 bp, P. troglodytes
aatttacagattcaatg

SEQ ID NO: 194613 - DNA, 16 bp, P. troglodytes
aatttacagttaaaaa

SEQ ID NO: 194614 - DNA, 16 bp, P. troglodytes
aatttacattttcact

SEQ ID NO: 194615 - DNA, 16 bp, P. troglodytes
aatttacatttttgaa

SEQ ID NO: 194616 - DNA, 16 bp, P. troglodytes
aatttaccaaagagat

SEQ ID NO: 194617 - DNA, 16 bp, P. troglodytes
aatttactgtattagt

SEQ ID NO: 194618 - DNA, 16 bp, P. troglodytes
aatttactgtattcat

SEQ ID NO: 194619 - DNA, 16 bp, P. troglodytes
aatttacttaaccaat

SEQ ID NO: 194620 - DNA, 16 bp, P. troglodytes
aatttactttttcaaa

SEQ ID NO: 194621 - DNA, 16 bp, P. troglodytes
aatttagaaaatacaa

SEQ ID NO: 194622 - DNA, 16 bp, P. troglodytes
aatttagaagtttatt

SEQ ID NO: 194623 - DNA, 16 bp, P. troglodytes
aatttagggggaaaaa

SEQ ID NO: 194624 - DNA, 16 bp, P. troglodytes
aatttaggtttttaaa

SEQ ID NO: 194625 - DNA, 16 bp, P. troglodytes
aatttagtatatgata

SEQ ID NO: 194626 - DNA, 16 bp, P. troglodytes
aatttataaagacaaa

SEQ ID NO: 194627 - DNA, 16 bp, P. troglodytes
aatttataaagaggtt

SEQ ID NO: 194628 - DNA, 16 bp, P. troglodytes
aatttataaagcaaaa

SEQ ID NO: 194629 - DNA, 16 bp, P. troglodytes
aatttataaaggagag

SEQ ID NO: 194630 - DNA, 16 bp, P. troglodytes
aatttatacatatttg

SEQ ID NO: 194631 - DNA, 16 bp, P. troglodytes
aatttatacattcaat

SEQ ID NO: 194632 - DNA, 16 bp, P. troglodytes
aatttatagacaaaaa

SEQ ID NO: 194633 - DNA, 17 bp, P. troglodytes
aatttatagattcaatg

SEQ ID NO: 194634 - DNA, 16 bp, P. troglodytes
aatttatagcacttaa

SEQ ID NO: 194635 - DNA, 16 bp, P. troglodytes
aatttatagctgtaaa

SEQ ID NO: 194636 - DNA, 16 bp, P. troglodytes
aatttatatagaaatg

SEQ ID NO: 194637 - DNA, 16 bp, P. troglodytes
aatttatatggaacca

SEQ ID NO: 194638 - DNA, 16 bp, P. troglodytes
aatttatatgttaaag

SEQ ID NO: 194639 - DNA, 16 bp, P. troglodytes
aatttatattcctttg

SEQ ID NO: 194640 - DNA, 16 bp, P. troglodytes
aatttatattcttttg

SEQ ID NO: 194641 - DNA, 16 bp, P. troglodytes
aatttatcaaacattt

SEQ ID NO: 194642 - DNA, 16 bp, P. troglodytes
aatttatcagtttttt

SEQ ID NO: 194643 - DNA, 16 bp, P. troglodytes
aatttatcatccaaac

SEQ ID NO: 194644 - DNA, 16 bp, P. troglodytes
aatttatcatccaaat

SEQ ID NO: 194645 - DNA, 16 bp, P. troglodytes
aatttatcctaaagaa

SEQ ID NO: 194646 - DNA, 16 bp, P. troglodytes
aatttatcctttgtgt

SEQ ID NO: 194647 - DNA, 16 bp, P. troglodytes
aatttatctgaaaatt

SEQ ID NO: 194648 - DNA, 16 bp, P. troglodytes
aatttatctgatagaa

SEQ ID NO: 194649 - DNA, 16 bp, P. troglodytes
aatttatctgtagatt

SEQ ID NO: 194650 - DNA, 16 bp, P. troglodytes
aatttatgaaagaaag

SEQ ID NO: 194651 - DNA, 16 bp, P. troglodytes
aatttatggagaaaag

SEQ ID NO: 194652 - DNA, 16 bp, P. troglodytes
aatttatgtgaaaatg

SEQ ID NO: 194653 - DNA, 16 bp, P. troglodytes
aatttatgttgaaact

SEQ ID NO: 194654 - DNA, 16 bp, P. troglodytes
aatttatgtttaactt

SEQ ID NO: 194655 - DNA, 16 bp, P. troglodytes
aatttatgttttgaaa

SEQ ID NO: 194656 - DNA, 16 bp, P. troglodytes
aatttattaaaacttg

SEQ ID NO: 194657 - DNA, 16 bp, P. troglodytes
aatttattaagcaaaa

SEQ ID NO: 194658 - DNA, 16 bp, P. troglodytes
aatttattcaacaaac

SEQ ID NO: 194659 - DNA, 16 bp, P. troglodytes
aatttattcaagaaaa

SEQ ID NO: 194660 - DNA, 16 bp, P. troglodytes
aatttattctgaaatt

SEQ ID NO: 194661 - DNA, 16 bp, P. troglodytes
aatttattgagcatct

SEQ ID NO: 194662 - DNA, 16 bp, P. troglodytes
aatttattgcaaaaag

SEQ ID NO: 194663 - DNA, 16 bp, P. troglodytes
aatttattgcttttta

SEQ ID NO: 194664 - DNA, 16 bp, P. troglodytes
aatttatttaaccatt

SEQ ID NO: 194665 - DNA, 16 bp, P. troglodytes
aatttatttagcaaat

SEQ ID NO: 194666 - DNA, 16 bp, P. troglodytes
aatttatttcagaaaa

SEQ ID NO: 194667 - DNA, 16 bp, P. troglodytes
aatttatttcagaaat

SEQ ID NO: 194668 - DNA, 16 bp, P. troglodytes
aatttatttctcacag

SEQ ID NO: 194669 - DNA, 16 bp, P. troglodytes
aatttatttctgaaat

SEQ ID NO: 194670 - DNA, 16 bp, P. troglodytes
aatttattttcatgtt

SEQ ID NO: 194671 - DNA, 16 bp, P. troglodytes
aatttattttctgtat

SEQ ID NO: 194672 - DNA, 16 bp, P. troglodytes
aatttatttttggaaa

SEQ ID NO: 194673 - DNA, 16 bp, P. troglodytes
aatttcaaagaaaaat

SEQ ID NO: 194674 - DNA, 16 bp, P. troglodytes
aatttcaaatacatat

SEQ ID NO: 194675 - DNA, 16 bp, P. troglodytes
aatttcaaatgacctg

SEQ ID NO: 194676 - DNA, 16 bp, P. troglodytes
aatttcaaatgtaaaa

SEQ ID NO: 194677 - DNA, 16 bp, P. troglodytes
aatttcaacatgtgaa

SEQ ID NO: 194678 - DNA, 16 bp, P. troglodytes
aatttcacatttaaaa

SEQ ID NO: 194679 - DNA, 16 bp, P. troglodytes
aatttcacattttaaa

SEQ ID NO: 194680 - DNA, 16 bp, P. troglodytes
aatttcaccctgacaa

SEQ ID NO: 194681 - DNA, 16 bp, P. troglodytes
aatttcaccctggtcc

SEQ ID NO: 194682 - DNA, 16 bp, P. troglodytes
aatttcactcttgtcg

SEQ ID NO: 194683 - DNA, 16 bp, P. troglodytes
aatttcactcttgttg

SEQ ID NO: 194684 - DNA, 16 bp, P. troglodytes
aatttcacttgatcat

SEQ ID NO: 194685 - DNA, 16 bp, P. troglodytes
aatttcagaaaagaaa

SEQ ID NO: 194686 - DNA, 16 bp, P. troglodytes
aatttcagaaattaaa

SEQ ID NO: 194687 - DNA, 16 bp, P. troglodytes
aatttcagaacatttc

SEQ ID NO: 194688 - DNA, 16 bp, P. troglodytes
aatttcagaacatttt

SEQ ID NO: 194689 - DNA, 16 bp, P. troglodytes
aatttcagaacttatt

SEQ ID NO: 194690 - DNA, 16 bp, P. troglodytes
aatttcagaaggaaaa

SEQ ID NO: 194691 - DNA, 16 bp, P. troglodytes
aatttcagaataattt

SEQ ID NO: 194692 - DNA, 16 bp, P. troglodytes
aatttcagaatttatt

SEQ ID NO: 194693 - DNA, 16 bp, P. troglodytes
aatttcagacaaagca

SEQ ID NO: 194694 - DNA, 16 bp, P. troglodytes
aatttcagattttcag

SEQ ID NO: 194695 - DNA, 16 bp, P. troglodytes
aatttcagcactctgg

SEQ ID NO: 194696 - DNA, 16 bp, P. troglodytes
aatttcaggaaggaaa

SEQ ID NO: 194697 - DNA, 16 bp, P. troglodytes
aatttcaggatacaaa

SEQ ID NO: 194698 - DNA, 16 bp, P. troglodytes
aatttcaggtaaacaa

SEQ ID NO: 194699 - DNA, 16 bp, P. troglodytes
aatttcaggtcttaca

SEQ ID NO: 194700 - DNA, 16 bp, P. troglodytes
aatttcagtattgttg

SEQ ID NO: 194701 - DNA, 16 bp, P. troglodytes
aatttcagttcctttc

SEQ ID NO: 194702 - DNA, 16 bp, P. troglodytes
aatttcagttctttga

SEQ ID NO: 194703 - DNA, 16 bp, P. troglodytes
aatttcagtttttaaa

SEQ ID NO: 194704 - DNA, 16 bp, P. troglodytes
aatttcataaaaatga

SEQ ID NO: 194705 - DNA, 24 bp, P. troglodytes
aatttcatatccagccaaactaaa

SEQ ID NO: 194706 - DNA, 16 bp, P. troglodytes
aatttcatatggttca

SEQ ID NO: 194707 - DNA, 16 bp, P. troglodytes
aatttcatcattttaa

SEQ ID NO: 194708 - DNA, 16 bp, P. troglodytes
aatttcatccatatcc

SEQ ID NO: 194709 - DNA, 16 bp, P. troglodytes
aatttcatctttaaaa

SEQ ID NO: 194710 - DNA, 16 bp, P. troglodytes
aatttcatcttttaaa

SEQ ID NO: 194711 - DNA, 16 bp, P. troglodytes
aatttcatgttatttt

SEQ ID NO: 194712 - DNA, 16 bp, P. troglodytes
aatttcattcatttct

SEQ ID NO: 194713 - DNA, 16 bp, P. troglodytes
aatttcattgttttct

SEQ ID NO: 194714 - DNA, 16 bp, P. troglodytes
aatttcatttatatga

SEQ ID NO: 194715 - DNA, 16 bp, P. troglodytes
aatttcatttatctct

SEQ ID NO: 194716 - DNA, 16 bp, P. troglodytes
aatttcatttgtaaaa

SEQ ID NO: 194717 - DNA, 16 bp, P. troglodytes
aatttcattttctaaa

SEQ ID NO: 194718 - DNA, 16 bp, P. troglodytes
aatttcatttttcaga

SEQ ID NO: 194719 - DNA, 16 bp, P. troglodytes
aatttcattttttcca

SEQ ID NO: 194720 - DNA, 16 bp, P. troglodytes
aatttccaaatgaaaa

SEQ ID NO: 194721 - DNA, 16 bp, P. troglodytes
aatttccacatgttgt

SEQ ID NO: 194722 - DNA, 16 bp, P. troglodytes
aatttccagtttttct

SEQ ID NO: 194723 - DNA, 16 bp, P. troglodytes
aatttccatatgtttg

SEQ ID NO: 194724 - DNA, 16 bp, P. troglodytes
aatttccatgtattta

SEQ ID NO: 194725 - DNA, 16 bp, P. troglodytes
aatttccatttctatt

SEQ ID NO: 194726 - DNA, 16 bp, P. troglodytes
aatttccattttataa

SEQ ID NO: 194727 - DNA, 16 bp, P. troglodytes
aatttcccaaatattt

SEQ ID NO: 194728 - DNA, 16 bp, P. troglodytes
aatttccccccaaaat

SEQ ID NO: 194729 - DNA, 19 bp, P. troglodytes
aatttccctctgcacactg

SEQ ID NO: 194730 - DNA, 16 bp, P. troglodytes
aatttccctttaaaaa

SEQ ID NO: 194731 - DNA, 16 bp, P. troglodytes
aatttcctcaactgta

SEQ ID NO: 194732 - DNA, 16 bp, P. troglodytes
aatttcctcatctcca

SEQ ID NO: 194733 - DNA, 16 bp, P. troglodytes
aatttcctgaaacaaa

SEQ ID NO: 194734 - DNA, 16 bp, P. troglodytes
aatttcctggttttga

SEQ ID NO: 194735 - DNA, 16 bp, P. troglodytes
aatttccttaaaaata

SEQ ID NO: 194736 - DNA, 16 bp, P. troglodytes
aatttccttaaaattt

SEQ ID NO: 194737 - DNA, 16 bp, P. troglodytes
aatttccttcatcagt

SEQ ID NO: 194738 - DNA, 16 bp, P. troglodytes
aatttcctttaaaatt

SEQ ID NO: 194739 - DNA, 16 bp, P. troglodytes
aatttcctttagttct

SEQ ID NO: 194740 - DNA, 16 bp, P. troglodytes
aatttccttttataaa

SEQ ID NO: 194741 - DNA, 16 bp, P. troglodytes
aatttccttttctgtt

SEQ ID NO: 194742 - DNA, 16 bp, P. troglodytes
aatttccttttggaaa

SEQ ID NO: 194743 - DNA, 16 bp, P. troglodytes
aatttctaaatatttg

SEQ ID NO: 194744 - DNA, 16 bp, P. troglodytes
aatttctaatatgata

SEQ ID NO: 194745 - DNA, 16 bp, P. troglodytes
aatttctacaaagaaa

SEQ ID NO: 194746 - DNA, 16 bp, P. troglodytes
aatttctagaaacaca

SEQ ID NO: 194747 - DNA, 16 bp, P. troglodytes
aatttctagtaaaaat

SEQ ID NO: 194748 - DNA, 16 bp, P. troglodytes
aatttctatgtgtttg

SEQ ID NO: 194749 - DNA, 16 bp, P. troglodytes
aatttctattgcttta

SEQ ID NO: 194750 - DNA, 16 bp, P. troglodytes
aatttctcaaaagaag

SEQ ID NO: 194751 - DNA, 16 bp, P. troglodytes
aatttctcaacaaaat

SEQ ID NO: 194752 - DNA, 16 bp, P. troglodytes
aatttctcattaatat

SEQ ID NO: 194753 - DNA, 16 bp, P. troglodytes
aatttctccacagaaa

SEQ ID NO: 194754 - DNA, 16 bp, P. troglodytes
aatttctccatattct

SEQ ID NO: 194755 - DNA, 16 bp, P. troglodytes
aatttctccttttaaa

SEQ ID NO: 194756 - DNA, 16 bp, P. troglodytes
aatttctctctccagt

SEQ ID NO: 194757 - DNA, 16 bp, P. troglodytes
aatttctctgagtttc

SEQ ID NO: 194758 - DNA, 16 bp, P. troglodytes
aatttctcttcagaaa

SEQ ID NO: 194759 - DNA, 16 bp, P. troglodytes
aatttctcttctttaa

SEQ ID NO: 194760 - DNA, 16 bp, P. troglodytes
aatttctgaaaataaa

SEQ ID NO: 194761 - DNA, 16 bp, P. troglodytes
aatttctgaaatattt

SEQ ID NO: 194762 - DNA, 16 bp, P. troglodytes
aatttctgaatatttt

SEQ ID NO: 194763 - DNA, 16 bp, P. troglodytes
aatttctgacctcaag

SEQ ID NO: 194764 - DNA, 16 bp, P. troglodytes
aatttctgcagcaagc

SEQ ID NO: 194765 - DNA, 16 bp, P. troglodytes
aatttctgcagctagc

SEQ ID NO: 194766 - DNA, 16 bp, P. troglodytes
aatttctggaaaactg

SEQ ID NO: 194767 - DNA, 16 bp, P. troglodytes
aatttctgtatatatt

SEQ ID NO: 194768 - DNA, 16 bp, P. troglodytes
aatttctgttcatttt

SEQ ID NO: 194769 - DNA, 16 bp, P. troglodytes
aatttcttaaaaatgt

SEQ ID NO: 194770 - DNA, 16 bp, P. troglodytes
aatttcttaacaaaat

SEQ ID NO: 194771 - DNA, 16 bp, P. troglodytes
aatttcttaagacaac

SEQ ID NO: 194772 - DNA, 16 bp, P. troglodytes
aatttcttaagttttt

SEQ ID NO: 194773 - DNA, 16 bp, P. troglodytes
aatttcttcaaaaaat

SEQ ID NO: 194774 - DNA, 16 bp, P. troglodytes
aatttcttcatctgaa

SEQ ID NO: 194775 - DNA, 16 bp, P. troglodytes
aatttcttcattgacc

SEQ ID NO: 194776 - DNA, 16 bp, P. troglodytes
aatttcttgcattttt

SEQ ID NO: 194777 - DNA, 16 bp, P. troglodytes
aatttcttgcttttaa

SEQ ID NO: 194778 - DNA, 16 bp, P. troglodytes
aatttctttaatgtct

SEQ ID NO: 194779 - DNA, 16 bp, P. troglodytes
aatttctttcattagt

SEQ ID NO: 194780 - DNA, 16 bp, P. troglodytes
aatttctttctagctc

SEQ ID NO: 194781 - DNA, 16 bp, P. troglodytes
aatttctttctgaaat

SEQ ID NO: 194782 - DNA, 16 bp, P. troglodytes
aatttctttgaaaatt

SEQ ID NO: 194783 - DNA, 16 bp, P. troglodytes
aatttctttgttaaat

SEQ ID NO: 194784 - DNA, 16 bp, P. troglodytes
aatttcttttgaaaaa

SEQ ID NO: 194785 - DNA, 16 bp, P. troglodytes
aatttctttttagaaa

SEQ ID NO: 194786 - DNA, 16 bp, P. troglodytes
aatttgaaaaaaatct

SEQ ID NO: 194787 - DNA, 16 bp, P. troglodytes
aatttgaaaaccttgt

SEQ ID NO: 194788 - DNA, 16 bp, P. troglodytes
aatttgaaaagaaatg

SEQ ID NO: 194789 - DNA, 16 bp, P. troglodytes
aatttgaaaagcaaaa

SEQ ID NO: 194790 - DNA, 16 bp, P. troglodytes
aatttgaaaaggaaat

SEQ ID NO: 194791 - DNA, 16 bp, P. troglodytes
aatttgaaatccaaaa

SEQ ID NO: 194792 - DNA, 16 bp, P. troglodytes
aatttgaaatctgaaa

SEQ ID NO: 194793 - DNA, 16 bp, P. troglodytes
aatttgaaatgtgaaa

SEQ ID NO: 194794 - DNA, 16 bp, P. troglodytes
aatttgaaattttcta

SEQ ID NO: 194795 - DNA, 16 bp, P. troglodytes
aatttgaagtaatttt

SEQ ID NO: 194796 - DNA, 16 bp, P. troglodytes
aatttgaatttcacat

SEQ ID NO: 194797 - DNA, 16 bp, P. troglodytes
aatttgaatttcccca

SEQ ID NO: 194798 - DNA, 17 bp, P. troglodytes
aatttgacatgagattt

SEQ ID NO: 194799 - DNA, 16 bp, P. troglodytes
aatttgacttttattt

SEQ ID NO: 194800 - DNA, 16 bp, P. troglodytes
aatttgagaaacactg

SEQ ID NO: 194801 - DNA, 16 bp, P. troglodytes
aatttgagaaacattg

SEQ ID NO: 194802 - DNA, 16 bp, P. troglodytes
aatttgagaaatattt

SEQ ID NO: 194803 - DNA, 16 bp, P. troglodytes
aatttgagaagaaatg

SEQ ID NO: 194804 - DNA, 16 bp, P. troglodytes
aatttgataacctaga

SEQ ID NO: 194805 - DNA, 16 bp, P. troglodytes
aatttgataggaataa

SEQ ID NO: 194806 - DNA, 16 bp, P. troglodytes
aatttgatgaaaacta

SEQ ID NO: 194807 - DNA, 16 bp, P. troglodytes
aatttgatgtttaaaa

SEQ ID NO: 194808 - DNA, 16 bp, P. troglodytes
aatttgatttctaaaa

SEQ ID NO: 194809 - DNA, 16 bp, P. troglodytes
aatttgattttgaaat

SEQ ID NO: 194810 - DNA, 16 bp, P. troglodytes
aatttgcaaaaatttt

SEQ ID NO: 194811 - DNA, 16 bp, P. troglodytes
aatttgcaaaagaaag

SEQ ID NO: 194812 - DNA, 16 bp, P. troglodytes
aatttgcaatttaaaa

SEQ ID NO: 194813 - DNA, 16 bp, P. troglodytes
aatttgcatgtaattg

SEQ ID NO: 194814 - DNA, 16 bp, P. troglodytes
aatttgcatttaaaat

SEQ ID NO: 194815 - DNA, 16 bp, P. troglodytes
aatttgcatttatata

SEQ ID NO: 194816 - DNA, 16 bp, P. troglodytes
aatttgcatttgaaaa

SEQ ID NO: 194817 - DNA, 16 bp, P. troglodytes
aatttgcattttattt

SEQ ID NO: 194818 - DNA, 16 bp, P. troglodytes
aatttgccaatatttt

SEQ ID NO: 194819 - DNA, 16 bp, P. troglodytes
aatttgccattctgtg

SEQ ID NO: 194820 - DNA, 16 bp, P. troglodytes
aatttgcccaaggcca

SEQ ID NO: 194821 - DNA, 16 bp, P. troglodytes
aatttgctcaaagaaa

SEQ ID NO: 194822 - DNA, 16 bp, P. troglodytes
aatttgcttgaacctg

SEQ ID NO: 194823 - DNA, 16 bp, P. troglodytes
aatttgctttaaaata

SEQ ID NO: 194824 - DNA, 16 bp, P. troglodytes
aatttgctttaatttt

SEQ ID NO: 194825 - DNA, 16 bp, P. troglodytes
aatttgcttttactgt

SEQ ID NO: 194826 - DNA, 16 bp, P. troglodytes
aatttgctttttaaat

SEQ ID NO: 194827 - DNA, 16 bp, P. troglodytes
aatttggaaaacattt

SEQ ID NO: 194828 - DNA, 16 bp, P. troglodytes
aatttggaaaactttt

SEQ ID NO: 194829 - DNA, 16 bp, P. troglodytes
aatttggaaaattttt

SEQ ID NO: 194830 - DNA, 16 bp, P. troglodytes
aatttggaaacatttt

SEQ ID NO: 194831 - DNA, 16 bp, P. troglodytes
aatttggaaaggagag

SEQ ID NO: 194832 - DNA, 16 bp, P. troglodytes
aatttggaaatatata

SEQ ID NO: 194833 - DNA, 16 bp, P. troglodytes
aatttggaactttcct

SEQ ID NO: 194834 - DNA, 16 bp, P. troglodytes
aatttggagagaactg

SEQ ID NO: 194835 - DNA, 16 bp, P. troglodytes
aatttggatacccttt

SEQ ID NO: 194836 - DNA, 16 bp, P. troglodytes
aatttggatgccattt

SEQ ID NO: 194837 - DNA, 16 bp, P. troglodytes
aatttggcaattattt

SEQ ID NO: 194838 - DNA, 16 bp, P. troglodytes
aatttgggagctccag

SEQ ID NO: 194839 - DNA, 19 bp, P. troglodytes
aatttgggaggccaaggca

SEQ ID NO: 194840 - DNA, 16 bp, P. troglodytes
aatttgggattatgtt

SEQ ID NO: 194841 - DNA, 16 bp, P. troglodytes
aatttggggaaaatat

SEQ ID NO: 194842 - DNA, 16 bp, P. troglodytes
aatttgggggattttt

SEQ ID NO: 194843 - DNA, 16 bp, P. troglodytes
aatttggtatcttatt

SEQ ID NO: 194844 - DNA, 16 bp, P. troglodytes
aatttgtaatttcttt

SEQ ID NO: 194845 - DNA, 16 bp, P. troglodytes
aatttgtatggaaaca

SEQ ID NO: 194846 - DNA, 16 bp, P. troglodytes
aatttgtatggaacta

SEQ ID NO: 194847 - DNA, 16 bp, P. troglodytes
aatttgtatgttgaaa

SEQ ID NO: 194848 - DNA, 16 bp, P. troglodytes
aatttgtcaatttcat

SEQ ID NO: 194849 - DNA, 16 bp, P. troglodytes
aatttgtcacagcagc

SEQ ID NO: 194850 - DNA, 16 bp, P. troglodytes
aatttgtcatttaatt

SEQ ID NO: 194851 - DNA, 16 bp, P. troglodytes
aatttgtccaaaccca

SEQ ID NO: 194852 - DNA, 16 bp, P. troglodytes
aatttgtctcaaagtg

SEQ ID NO: 194853 - DNA, 16 bp, P. troglodytes
aatttgtctgatattt

SEQ ID NO: 194854 - DNA, 16 bp, P. troglodytes
aatttgtcttaatttt

SEQ ID NO: 194855 - DNA, 21 bp, P. troglodytes
aatttgtgcagttaatgcaat

SEQ ID NO: 194856 - DNA, 16 bp, P. troglodytes
aatttgttacagcagc

SEQ ID NO: 194857 - DNA, 16 bp, P. troglodytes
aatttgttatagcagc

SEQ ID NO: 194858 - DNA, 16 bp, P. troglodytes
aatttgttcaactttt

SEQ ID NO: 194859 - DNA, 16 bp, P. troglodytes
aatttgtttaagaaaa

SEQ ID NO: 194860 - DNA, 16 bp, P. troglodytes
aatttgtttacattcc

SEQ ID NO: 194861 - DNA, 16 bp, P. troglodytes
aatttgtttaggatta

SEQ ID NO: 194862 - DNA, 16 bp, P. troglodytes
aatttgtttgtgttca

SEQ ID NO: 194863 - DNA, 16 bp, P. troglodytes
aatttgttttatgcat

SEQ ID NO: 194864 - DNA, 16 bp, P. troglodytes
aatttgttttgaaatg

SEQ ID NO: 194865 - DNA, 16 bp, P. troglodytes
aatttgtttttaactt

SEQ ID NO: 194866 - DNA, 16 bp, P. troglodytes
aatttgtttttcttaa

SEQ ID NO: 194867 - DNA, 16 bp, P. troglodytes
aattttaaaaactgat

SEQ ID NO: 194868 - DNA, 16 bp, P. troglodytes
aattttaaaaagctac

SEQ ID NO: 194869 - DNA, 16 bp, P. troglodytes
aattttaaaaagctat

SEQ ID NO: 194870 - DNA, 16 bp, P. troglodytes
aattttaaaaatcagt

SEQ ID NO: 194871 - DNA, 16 bp, P. troglodytes
aattttaaaaatgtag

SEQ ID NO: 194872 - DNA, 16 bp, P. troglodytes
aattttaaaacacagt

SEQ ID NO: 194873 - DNA, 16 bp, P. troglodytes
aattttaaaaggcaaa

SEQ ID NO: 194874 - DNA, 16 bp, P. troglodytes
aattttaaaagtagct

SEQ ID NO: 194875 - DNA, 16 bp, P. troglodytes
aattttaaaagtcaaa

SEQ ID NO: 194876 - DNA, 16 bp, P. troglodytes
aattttaaaagtcttt

SEQ ID NO: 194877 - DNA, 16 bp, P. troglodytes
aattttaaaatatcca

SEQ ID NO: 194878 - DNA, 16 bp, P. troglodytes
aattttaaaatgcaat

SEQ ID NO: 194879 - DNA, 16 bp, P. troglodytes
aattttaaaatgcaga

SEQ ID NO: 194880 - DNA, 16 bp, P. troglodytes
aattttaaaatgttga

SEQ ID NO: 194881 - DNA, 16 bp, P. troglodytes
aattttaaaattcctt

SEQ ID NO: 194882 - DNA, 16 bp, P. troglodytes
aattttaaagaggaaa

SEQ ID NO: 194883 - DNA, 16 bp, P. troglodytes
aattttaaaggaagaa

SEQ ID NO: 194884 - DNA, 16 bp, P. troglodytes
aattttaaaggaattt

SEQ ID NO: 194885 - DNA, 16 bp, P. troglodytes
aattttaaataagatg

SEQ ID NO: 194886 - DNA, 16 bp, P. troglodytes
aattttaaatgaaatg

SEQ ID NO: 194887 - DNA, 16 bp, P. troglodytes
aattttaacaaaagaa

SEQ ID NO: 194888 - DNA, 16 bp, P. troglodytes
aattttaacacaatgg

SEQ ID NO: 194889 - DNA, 16 bp, P. troglodytes
aattttaacatgagtt

SEQ ID NO: 194890 - DNA, 16 bp, P. troglodytes
aattttaagaggaaaa

SEQ ID NO: 194891 - DNA, 16 bp, P. troglodytes
aattttaagcaaaaag

SEQ ID NO: 194892 - DNA, 16 bp, P. troglodytes
aattttaaggaatttt

SEQ ID NO: 194893 - DNA, 16 bp, P. troglodytes
aattttaagtttcctg

SEQ ID NO: 194894 - DNA, 16 bp, P. troglodytes
aattttaataaatgct

SEQ ID NO: 194895 - DNA, 16 bp, P. troglodytes
aattttaatcagtttg

SEQ ID NO: 194896 - DNA, 16 bp, P. troglodytes
aattttaatctgtatt

SEQ ID NO: 194897 - DNA, 16 bp, P. troglodytes
aattttaatgacaaaa

SEQ ID NO: 194898 - DNA, 16 bp, P. troglodytes
aattttaatgtcattt

SEQ ID NO: 194899 - DNA, 16 bp, P. troglodytes
aattttaattgtttct

SEQ ID NO: 194900 - DNA, 16 bp, P. troglodytes
aattttacaaactttt

SEQ ID NO: 194901 - DNA, 16 bp, P. troglodytes
aattttacaaaggaaa

SEQ ID NO: 194902 - DNA, 16 bp, P. troglodytes
aattttacaagaaaaa

SEQ ID NO: 194903 - DNA, 16 bp, P. troglodytes
aattttaccattttaa

SEQ ID NO: 194904 - DNA, 16 bp, P. troglodytes
aattttacctgttttt

SEQ ID NO: 194905 - DNA, 16 bp, P. troglodytes
aattttactgaagtca

SEQ ID NO: 194906 - DNA, 16 bp, P. troglodytes
aattttactgtgtata

SEQ ID NO: 194907 - DNA, 16 bp, P. troglodytes
aattttactttgtatt

SEQ ID NO: 194908 - DNA, 16 bp, P. troglodytes
aattttacttttcaaa

SEQ ID NO: 194909 - DNA, 16 bp, P. troglodytes
aattttagaaaaatca

SEQ ID NO: 194910 - DNA, 16 bp, P. troglodytes
aattttagaaaatcaa

SEQ ID NO: 194911 - DNA, 16 bp, P. troglodytes
aattttagaacatttt

SEQ ID NO: 194912 - DNA, 16 bp, P. troglodytes
aattttagaacttgtt

SEQ ID NO: 194913 - DNA, 16 bp, P. troglodytes
aattttagaacttttt

SEQ ID NO: 194914 - DNA, 16 bp, P. troglodytes
aattttagaataagtg

SEQ ID NO: 194915 - DNA, 16 bp, P. troglodytes
aattttagagcatttt

SEQ ID NO: 194916 - DNA, 16 bp, P. troglodytes
aattttagccattctg

SEQ ID NO: 194917 - DNA, 16 bp, P. troglodytes
aattttagggagacac

SEQ ID NO: 194918 - DNA, 16 bp, P. troglodytes
aattttagtacatttt

SEQ ID NO: 194919 - DNA, 16 bp, P. troglodytes
aattttagtcagattt

SEQ ID NO: 194920 - DNA, 16 bp, P. troglodytes
aattttagtcttttaa

SEQ ID NO: 194921 - DNA, 16 bp, P. troglodytes
aattttagttttctga

SEQ ID NO: 194922 - DNA, 16 bp, P. troglodytes
aattttataaaaatgg

SEQ ID NO: 194923 - DNA, 16 bp, P. troglodytes
aattttatacacacac

SEQ ID NO: 194924 - DNA, 16 bp, P. troglodytes
aattttatactgtttt

SEQ ID NO: 194925 - DNA, 16 bp, P. troglodytes
aattttatagcatttt

SEQ ID NO: 194926 - DNA, 16 bp, P. troglodytes
aattttatagtttcag

SEQ ID NO: 194927 - DNA, 16 bp, P. troglodytes
aattttatattttcag

SEQ ID NO: 194928 - DNA, 16 bp, P. troglodytes
aattttatcacatgtg

SEQ ID NO: 194929 - DNA, 16 bp, P. troglodytes
aattttatcattgttt

SEQ ID NO: 194930 - DNA, 16 bp, P. troglodytes
aattttatgaaattca

SEQ ID NO: 194931 - DNA, 16 bp, P. troglodytes
aattttatgagaaatt

SEQ ID NO: 194932 - DNA, 16 bp, P. troglodytes
aattttatgtcatgta

SEQ ID NO: 194933 - DNA, 16 bp, P. troglodytes
aattttatgtgaaaaa

SEQ ID NO: 194934 - DNA, 16 bp, P. troglodytes
aattttatgttgaaat

SEQ ID NO: 194935 - DNA, 16 bp, P. troglodytes
aattttatttcctttg

SEQ ID NO: 194936 - DNA, 16 bp, P. troglodytes
aattttatttctcaca

SEQ ID NO: 194937 - DNA, 16 bp, P. troglodytes
aattttatttgacttt

SEQ ID NO: 194938 - DNA, 16 bp, P. troglodytes
aattttatttgttcat

SEQ ID NO: 194939 - DNA, 16 bp, P. troglodytes
aattttattttacaga

SEQ ID NO: 194940 - DNA, 16 bp, P. troglodytes
aattttattttgcatt

SEQ ID NO: 194941 - DNA, 16 bp, P. troglodytes
aattttatttttagca

SEQ ID NO: 194942 - DNA, 16 bp, P. troglodytes
aattttcaaaaattgt

SEQ ID NO: 194943 - DNA, 16 bp, P. troglodytes
aattttcaaaagaaaa

SEQ ID NO: 194944 - DNA, 16 bp, P. troglodytes
aattttcaaagagaaa

SEQ ID NO: 194945 - DNA, 16 bp, P. troglodytes
aattttcaaattcaaa

SEQ ID NO: 194946 - DNA, 16 bp, P. troglodytes
aattttcaactcagaa

SEQ ID NO: 194947 - DNA, 16 bp, P. troglodytes
aattttcaatgaaata

SEQ ID NO: 194948 - DNA, 16 bp, P. troglodytes
aattttcaatgtttaa

SEQ ID NO: 194949 - DNA, 16 bp, P. troglodytes
aattttcaatttttgt

SEQ ID NO: 194950 - DNA, 16 bp, P. troglodytes
aattttcactttaaaa

SEQ ID NO: 194951 - DNA, 16 bp, P. troglodytes
aattttcagaaaattt

SEQ ID NO: 194952 - DNA, 16 bp, P. troglodytes
aattttcagagaaaaa

SEQ ID NO: 194953 - DNA, 16 bp, P. troglodytes
aattttcagattttct

SEQ ID NO: 194954 - DNA, 16 bp, P. troglodytes
aattttcaggaaaaaa

SEQ ID NO: 194955 - DNA, 16 bp, P. troglodytes
aattttcagggaaaaa

SEQ ID NO: 194956 - DNA, 16 bp, P. troglodytes
aattttcagtatttta

SEQ ID NO: 194957 - DNA, 16 bp, P. troglodytes
aattttcatcagaaat

SEQ ID NO: 194958 - DNA, 16 bp, P. troglodytes
aattttcattttacaa

SEQ ID NO: 194959 - DNA, 16 bp, P. troglodytes
aattttccaaattttc

SEQ ID NO: 194960 - DNA, 16 bp, P. troglodytes
aattttccagcctcag

SEQ ID NO: 194961 - DNA, 16 bp, P. troglodytes
aattttcccaacacaa

SEQ ID NO: 194962 - DNA, 16 bp, P. troglodytes
aattttcccaactttt

SEQ ID NO: 194963 - DNA, 16 bp, P. troglodytes
aattttcccccacaaa

SEQ ID NO: 194964 - DNA, 16 bp, P. troglodytes
aattttctaaagaaat

SEQ ID NO: 194965 - DNA, 16 bp, P. troglodytes
aattttctaaatgcaa

SEQ ID NO: 194966 - DNA, 16 bp, P. troglodytes
aattttctaatttcaa

SEQ ID NO: 194967 - DNA, 16 bp, P. troglodytes
aattttctagtttttc

SEQ ID NO: 194968 - DNA, 16 bp, P. troglodytes
aattttctctgaaaat

SEQ ID NO: 194969 - DNA, 16 bp, P. troglodytes
aattttctgaactttt

SEQ ID NO: 194970 - DNA, 16 bp, P. troglodytes
aattttctgcaataaa

SEQ ID NO: 194971 - DNA, 16 bp, P. troglodytes
aattttctgcattttt

SEQ ID NO: 194972 - DNA, 16 bp, P. troglodytes
aattttctgttgttta

SEQ ID NO: 194973 - DNA, 16 bp, P. troglodytes
aattttctgttttaat

SEQ ID NO: 194974 - DNA, 16 bp, P. troglodytes
aattttcttaaaacat

SEQ ID NO: 194975 - DNA, 16 bp, P. troglodytes
aattttctttcaaaat

SEQ ID NO: 194976 - DNA, 16 bp, P. troglodytes
aattttctttctcata

SEQ ID NO: 194977 - DNA, 16 bp, P. troglodytes
aattttctttgctctg

SEQ ID NO: 194978 - DNA, 16 bp, P. troglodytes
aattttcttttaaaag

SEQ ID NO: 194979 - DNA, 16 bp, P. troglodytes
aattttcttttcagat

SEQ ID NO: 194980 - DNA, 16 bp, P. troglodytes
aattttgaaaaacaaa

SEQ ID NO: 194981 - DNA, 16 bp, P. troglodytes
aattttgaaaaatttc

SEQ ID NO: 194982 - DNA, 16 bp, P. troglodytes
aattttgaaaatacag

SEQ ID NO: 194983 - DNA, 16 bp, P. troglodytes
aattttgaaactgaaa

SEQ ID NO: 194984 - DNA, 16 bp, P. troglodytes
aattttgaaagaaatt

SEQ ID NO: 194985 - DNA, 16 bp, P. troglodytes
aattttgaaagaactt

SEQ ID NO: 194986 - DNA, 16 bp, P. troglodytes
aattttgaaagaagtt

SEQ ID NO: 194987 - DNA, 16 bp, P. troglodytes
aattttgaaagcagta

SEQ ID NO: 194988 - DNA, 16 bp, P. troglodytes
aattttgaactgtttt

SEQ ID NO: 194989 - DNA, 16 bp, P. troglodytes
aattttgaagaaaaga

SEQ ID NO: 194990 - DNA, 16 bp, P. troglodytes
aattttgaagaacaaa

SEQ ID NO: 194991 - DNA, 16 bp, P. troglodytes
aattttgaaggaaaaa

SEQ ID NO: 194992 - DNA, 16 bp, P. troglodytes
aattttgagaaatttt

SEQ ID NO: 194993 - DNA, 16 bp, P. troglodytes
aattttgagttttaaa

SEQ ID NO: 194994 - DNA, 16 bp, P. troglodytes
aattttgataaattgt

SEQ ID NO: 194995 - DNA, 16 bp, P. troglodytes
aattttgataagaatt

SEQ ID NO: 194996 - DNA, 16 bp, P. troglodytes
aattttgatgaagtct

SEQ ID NO: 194997 - DNA, 16 bp, P. troglodytes
aattttgcaaaaataa

SEQ ID NO: 194998 - DNA, 16 bp, P. troglodytes
aattttgcaaaatgtt

SEQ ID NO: 194999 - DNA, 16 bp, P. troglodytes
aattttgcaagagttt

SEQ ID NO: 195000 - DNA, 16 bp, P. troglodytes
aattttgcattttaca

SEQ ID NO: 195001 - DNA, 16 bp, P. troglodytes
aattttgccaaagagc

SEQ ID NO: 195002 - DNA, 16 bp, P. troglodytes
aattttgctgtgaact

SEQ ID NO: 195003 - DNA, 16 bp, P. troglodytes
aattttggaaaacttg

SEQ ID NO: 195004 - DNA, 16 bp, P. troglodytes
aattttggaagatttt

SEQ ID NO: 195005 - DNA, 16 bp, P. troglodytes
aattttggaataattt

SEQ ID NO: 195006 - DNA, 16 bp, P. troglodytes
aattttggaatatttg

SEQ ID NO: 195007 - DNA, 16 bp, P. troglodytes
aattttgtacattttt

SEQ ID NO: 195008 - DNA, 16 bp, P. troglodytes
aattttgtcatttcaa

SEQ ID NO: 195009 - DNA, 16 bp, P. troglodytes
aattttgtctttctgt

SEQ ID NO: 195010 - DNA, 16 bp, P. troglodytes
aattttgtgaaataaa

SEQ ID NO: 195011 - DNA, 16 bp, P. troglodytes
aattttgtgaaataat

SEQ ID NO: 195012 - DNA, 16 bp, P. troglodytes
aattttgtgatttaaa

SEQ ID NO: 195013 - DNA, 16 bp, P. troglodytes
aattttgtgcatgaaa

SEQ ID NO: 195014 - DNA, 16 bp, P. troglodytes
aattttgtgtactttt

SEQ ID NO: 195015 - DNA, 16 bp, P. troglodytes
aattttgttatttcaa

SEQ ID NO: 195016 - DNA, 16 bp, P. troglodytes
aattttgttctaaaat

SEQ ID NO: 195017 - DNA, 16 bp, P. troglodytes
aattttgtttaccttt

SEQ ID NO: 195018 - DNA, 16 bp, P. troglodytes
aattttgtttgaaaat

SEQ ID NO: 195019 - DNA, 16 bp, P. troglodytes
aattttgttttgaaaa

SEQ ID NO: 195020 - DNA, 16 bp, P. troglodytes
aatttttaaaaagtca

SEQ ID NO: 195021 - DNA, 16 bp, P. troglodytes
aatttttaaaaagtga

SEQ ID NO: 195022 - DNA, 16 bp, P. troglodytes
aatttttaaaacttct

SEQ ID NO: 195023 - DNA, 16 bp, P. troglodytes
aatttttaaaatagca

SEQ ID NO: 195024 - DNA, 16 bp, P. troglodytes
aatttttaaacatgta

SEQ ID NO: 195025 - DNA, 16 bp, P. troglodytes
aatttttaaatactga

SEQ ID NO: 195026 - DNA, 16 bp, P. troglodytes
aatttttaaatgcttt

SEQ ID NO: 195027 - DNA, 16 bp, P. troglodytes
aatttttaaatgttca

SEQ ID NO: 195028 - DNA, 16 bp, P. troglodytes
aatttttaacagaaaa

SEQ ID NO: 195029 - DNA, 16 bp, P. troglodytes
aatttttaactttttg

SEQ ID NO: 195030 - DNA, 16 bp, P. troglodytes
aatttttaagaaatga

SEQ ID NO: 195031 - DNA, 16 bp, P. troglodytes
aatttttaagaataca

SEQ ID NO: 195032 - DNA, 16 bp, P. troglodytes
aatttttaagtttctt

SEQ ID NO: 195033 - DNA, 16 bp, P. troglodytes
aatttttaatggaaaa

SEQ ID NO: 195034 - DNA, 16 bp, P. troglodytes
aatttttagattcaat

SEQ ID NO: 195035 - DNA, 16 bp, P. troglodytes
aatttttagtagagac

SEQ ID NO: 195036 - DNA, 16 bp, P. troglodytes
aatttttatacattga

SEQ ID NO: 195037 - DNA, 16 bp, P. troglodytes
aatttttatcaagtat

SEQ ID NO: 195038 - DNA, 16 bp, P. troglodytes
aatttttatcatgaaa

SEQ ID NO: 195039 - DNA, 16 bp, P. troglodytes
aatttttatggctttt

SEQ ID NO: 195040 - DNA, 16 bp, P. troglodytes
aatttttcagttccat

SEQ ID NO: 195041 - DNA, 16 bp, P. troglodytes
aatttttcatttagaa

SEQ ID NO: 195042 - DNA, 16 bp, P. troglodytes
aatttttccacattct

SEQ ID NO: 195043 - DNA, 16 bp, P. troglodytes
aatttttccatttaaa

SEQ ID NO: 195044 - DNA, 16 bp, P. troglodytes
aatttttccatttgtt

SEQ ID NO: 195045 - DNA, 16 bp, P. troglodytes
aatttttctaaatgtt

SEQ ID NO: 195046 - DNA, 16 bp, P. troglodytes
aatttttctacagaaa

SEQ ID NO: 195047 - DNA, 16 bp, P. troglodytes
aatttttctagaaaat

SEQ ID NO: 195048 - DNA, 16 bp, P. troglodytes
aatttttctgagtttt

SEQ ID NO: 195049 - DNA, 16 bp, P. troglodytes
aatttttctgtaaaca

SEQ ID NO: 195050 - DNA, 16 bp, P. troglodytes
aatttttctgtaaatt

SEQ ID NO: 195051 - DNA, 16 bp, P. troglodytes
aatttttctgtaataa

SEQ ID NO: 195052 - DNA, 16 bp, P. troglodytes
aatttttcttagtata

SEQ ID NO: 195053 - DNA, 16 bp, P. troglodytes
aatttttgaaatagtt

SEQ ID NO: 195054 - DNA, 16 bp, P. troglodytes
aatttttgaagaaaat

SEQ ID NO: 195055 - DNA, 16 bp, P. troglodytes
aatttttgaatttctt

SEQ ID NO: 195056 - DNA, 16 bp, P. troglodytes
aatttttgattcagta

SEQ ID NO: 195057 - DNA, 16 bp, P. troglodytes
aatttttgcaaactat

SEQ ID NO: 195058 - DNA, 16 bp, P. troglodytes
aatttttgcatgttta

SEQ ID NO: 195059 - DNA, 16 bp, P. troglodytes
aatttttgcattatta

SEQ ID NO: 195060 - DNA, 16 bp, P. troglodytes
aatttttgcatttgta

SEQ ID NO: 195061 - DNA, 16 bp, P. troglodytes
aatttttgcttcatgt

SEQ ID NO: 195062 - DNA, 16 bp, P. troglodytes
aatttttgcttcctat

SEQ ID NO: 195063 - DNA, 16 bp, P. troglodytes
aatttttgcttttgct

SEQ ID NO: 195064 - DNA, 16 bp, P. troglodytes
aatttttgctttttaa

SEQ ID NO: 195065 - DNA, 16 bp, P. troglodytes
aatttttggtgaatca

SEQ ID NO: 195066 - DNA, 16 bp, P. troglodytes
aatttttgtagaaatg

SEQ ID NO: 195067 - DNA, 16 bp, P. troglodytes
aatttttgtatacagt

SEQ ID NO: 195068 - DNA, 16 bp, P. troglodytes
aatttttgtcatttat

SEQ ID NO: 195069 - DNA, 16 bp, P. troglodytes
aatttttgtgaaaagt

SEQ ID NO: 195070 - DNA, 16 bp, P. troglodytes
aatttttgtttcagaa

SEQ ID NO: 195071 - DNA, 16 bp, P. troglodytes
aatttttgtttctaaa

SEQ ID NO: 195072 - DNA, 16 bp, P. troglodytes
aattttttaaaaagga

SEQ ID NO: 195073 - DNA, 16 bp, P. troglodytes
aattttttaaaatgca

SEQ ID NO: 195074 - DNA, 16 bp, P. troglodytes
aattttttaaagatgt

SEQ ID NO: 195075 - DNA, 16 bp, P. troglodytes
aattttttaaatgtca

SEQ ID NO: 195076 - DNA, 16 bp, P. troglodytes
aattttttacagcagc

SEQ ID NO: 195077 - DNA, 16 bp, P. troglodytes
aattttttatatggtg

SEQ ID NO: 195078 - DNA, 16 bp, P. troglodytes
aattttttattctgta

SEQ ID NO: 195079 - DNA, 16 bp, P. troglodytes
aattttttcaaatgtt

SEQ ID NO: 195080 - DNA, 16 bp, P. troglodytes
aattttttcacattct

SEQ ID NO: 195081 - DNA, 16 bp, P. troglodytes
aattttttcagcattt

SEQ ID NO: 195082 - DNA, 16 bp, P. troglodytes
aattttttcatctgta

SEQ ID NO: 195083 - DNA, 16 bp, P. troglodytes
aattttttccccattg

SEQ ID NO: 195084 - DNA, 16 bp, P. troglodytes
aattttttcttctgag

SEQ ID NO: 195085 - DNA, 16 bp, P. troglodytes
aattttttgaagaaaa

SEQ ID NO: 195086 - DNA, 16 bp, P. troglodytes
aattttttgagaaaca

SEQ ID NO: 195087 - DNA, 16 bp, P. troglodytes
aattttttgagaaatt

SEQ ID NO: 195088 - DNA, 16 bp, P. troglodytes
aattttttgcatattt

SEQ ID NO: 195089 - DNA, 16 bp, P. troglodytes
aattttttgtagagac

SEQ ID NO: 195090 - DNA, 16 bp, P. troglodytes
aattttttgtagagat

SEQ ID NO: 195091 - DNA, 16 bp, P. troglodytes
aatttttttaaaggag

SEQ ID NO: 195092 - DNA, 16 bp, P. troglodytes
aatttttttcaaaaac

SEQ ID NO: 195093 - DNA, 16 bp, P. troglodytes
aatttttttcatcagt

SEQ ID NO: 195094 - DNA, 16 bp, P. troglodytes
aattttttttaaacag

SEQ ID NO: 195095 - DNA, 16 bp, P. troglodytes
aattttttttaaccca

SEQ ID NO: 195096 - DNA, 16 bp, P. troglodytes
aattttttttcaagtt

SEQ ID NO: 195097 - DNA, 16 bp, P. troglodytes
aattttttttcatgaa

SEQ ID NO: 195098 - DNA, 16 bp, P. troglodytes
aattttttttcccaaa

SEQ ID NO: 195099 - DNA, 16 bp, P. troglodytes
aattttttttgagaca

SEQ ID NO: 195100 - DNA, 16 bp, P. troglodytes
aattttttttgtggag

SEQ ID NO: 195101 - DNA, 16 bp, P. troglodytes
aatttttttttgagac

SEQ ID NO: 195102 - DNA, 18 bp, P. troglodytes
acaaaaaaaattagccgg

SEQ ID NO: 195103 - DNA, 16 bp, P. troglodytes
acaaaaaaaggaattt

SEQ ID NO: 195104 - DNA, 16 bp, P. troglodytes
acaaaaaacacatgat

SEQ ID NO: 195105 - DNA, 16 bp, P. troglodytes
acaaaaaactcttcaa

SEQ ID NO: 195106 - DNA, 16 bp, P. troglodytes
acaaaaaaggagacat

SEQ ID NO: 195107 - DNA, 16 bp, P. troglodytes
acaaaaaagtttaaat

SEQ ID NO: 195108 - DNA, 16 bp, P. troglodytes
acaaaaaatgtgaaat

SEQ ID NO: 195109 - DNA, 16 bp, P. troglodytes
acaaaaaattaacctg

SEQ ID NO: 195110 - DNA, 16 bp, P. troglodytes
acaaaaaattagccca

SEQ ID NO: 195111 - DNA, 16 bp, P. troglodytes
acaaaaaattagtcag

SEQ ID NO: 195112 - DNA, 16 bp, P. troglodytes
acaaaaacaatttttt

SEQ ID NO: 195113 - DNA, 16 bp, P. troglodytes
acaaaaacacatgatt

SEQ ID NO: 195114 - DNA, 16 bp, P. troglodytes
acaaaaacagatacat

SEQ ID NO: 195115 - DNA, 16 bp, P. troglodytes
acaaaaacaggaaatg

SEQ ID NO: 195116 - DNA, 16 bp, P. troglodytes
acaaaaacatgaagtg

SEQ ID NO: 195117 - DNA, 16 bp, P. troglodytes
acaaaaacatggaaat

SEQ ID NO: 195118 - DNA, 16 bp, P. troglodytes
acaaaaacattttctt

SEQ ID NO: 195119 - DNA, 16 bp, P. troglodytes
acaaaaaccacatgat

SEQ ID NO: 195120 - DNA, 16 bp, P. troglodytes
acaaaaaccccattca

SEQ ID NO: 195121 - DNA, 16 bp, P. troglodytes
acaaaaactacatgat

SEQ ID NO: 195122 - DNA, 16 bp, P. troglodytes
acaaaaactatctggg

SEQ ID NO: 195123 - DNA, 16 bp, P. troglodytes
acaaaaagcagctggg

SEQ ID NO: 195124 - DNA, 16 bp, P. troglodytes
acaaaaagctcaaaga

SEQ ID NO: 195125 - DNA, 16 bp, P. troglodytes
acaaaaagctgtttct

SEQ ID NO: 195126 - DNA, 16 bp, P. troglodytes
acaaaaatcccttcaa

SEQ ID NO: 195127 - DNA, 16 bp, P. troglodytes
acaaaaatgaaaattt

SEQ ID NO: 195128 - DNA, 16 bp, P. troglodytes
acaaaaatggaaagat

SEQ ID NO: 195129 - DNA, 16 bp, P. troglodytes
acaaaaatggaaatat

SEQ ID NO: 195130 - DNA, 16 bp, P. troglodytes
acaaaaatgtatataa

SEQ ID NO: 195131 - DNA, 16 bp, P. troglodytes
acaaaaatgtatttct

SEQ ID NO: 195132 - DNA, 16 bp, P. troglodytes
acaaaaatgtgaatgt

SEQ ID NO: 195133 - DNA, 16 bp, P. troglodytes
acaaaaatgttcaaaa

SEQ ID NO: 195134 - DNA, 16 bp, P. troglodytes
acaaaaatgtttaaaa

SEQ ID NO: 195135 - DNA, 16 bp, P. troglodytes
acaaaaattaactgaa

SEQ ID NO: 195136 - DNA, 16 bp, P. troglodytes
acaaaaattagacagg

SEQ ID NO: 195137 - DNA, 16 bp, P. troglodytes
acaaaaattagctgta

SEQ ID NO: 195138 - DNA, 16 bp, P. troglodytes
acaaaaattagttgca

SEQ ID NO: 195139 - DNA, 16 bp, P. troglodytes
acaaaaattatccaga

SEQ ID NO: 195140 - DNA, 16 bp, P. troglodytes
acaaaaattgactcaa

SEQ ID NO: 195141 - DNA, 16 bp, P. troglodytes
acaaaacaaaactctt

SEQ ID NO: 195142 - DNA, 16 bp, P. troglodytes
acaaaacaattttgaa

SEQ ID NO: 195143 - DNA, 16 bp, P. troglodytes
acaaaacactttttaa

SEQ ID NO: 195144 - DNA, 16 bp, P. troglodytes
acaaaacagaaaatct

SEQ ID NO: 195145 - DNA, 16 bp, P. troglodytes
acaaaacagactaata

SEQ ID NO: 195146 - DNA, 16 bp, P. troglodytes
acaaaacagatttaaa

SEQ ID NO: 195147 - DNA, 16 bp, P. troglodytes
acaaaacagattttaa

SEQ ID NO: 195148 - DNA, 16 bp, P. troglodytes
acaaaacaggccgggc

SEQ ID NO: 195149 - DNA, 16 bp, P. troglodytes
acaaaactggaaaaat

SEQ ID NO: 195150 - DNA, 16 bp, P. troglodytes
acaaaactggaagaat

SEQ ID NO: 195151 - DNA, 16 bp, P. troglodytes
acaaaacttacctggg

SEQ ID NO: 195152 - DNA, 16 bp, P. troglodytes
acaaaagaaatttcaa

SEQ ID NO: 195153 - DNA, 16 bp, P. troglodytes
acaaaagaacaaagct

SEQ ID NO: 195154 - DNA, 16 bp, P. troglodytes
acaaaagaccacaaat

SEQ ID NO: 195155 - DNA, 16 bp, P. troglodytes
acaaaagaccatatat

SEQ ID NO: 195156 - DNA, 16 bp, P. troglodytes
acaaaagatcaatgaa

SEQ ID NO: 195157 - DNA, 16 bp, P. troglodytes
acaaaagcaaatggaa

SEQ ID NO: 195158 - DNA, 16 bp, P. troglodytes
acaaaagctcctgaag

SEQ ID NO: 195159 - DNA, 16 bp, P. troglodytes
acaaaagctggaggca

SEQ ID NO: 195160 - DNA, 16 bp, P. troglodytes
acaaaaggaaacattt

SEQ ID NO: 195161 - DNA, 16 bp, P. troglodytes
acaaaaggcagattaa

SEQ ID NO: 195162 - DNA, 16 bp, P. troglodytes
acaaaaggtaaatgaa

SEQ ID NO: 195163 - DNA, 16 bp, P. troglodytes
acaaaagtgccaagaa

SEQ ID NO: 195164 - DNA, 16 bp, P. troglodytes
acaaaagtttggaaaa

SEQ ID NO: 195165 - DNA, 16 bp, P. troglodytes
acaaaataaaaatgtg

SEQ ID NO: 195166 - DNA, 16 bp, P. troglodytes
acaaaataagaatttt

SEQ ID NO: 195167 - DNA, 16 bp, P. troglodytes
acaaaataatatgtac

SEQ ID NO: 195168 - DNA, 16 bp, P. troglodytes
acaaaataatgaagga

SEQ ID NO: 195169 - DNA, 16 bp, P. troglodytes
acaaaataatgtattt

SEQ ID NO: 195170 - DNA, 16 bp, P. troglodytes
acaaaataccacagac

SEQ ID NO: 195171 - DNA, 16 bp, P. troglodytes
acaaaatactacagac

SEQ ID NO: 195172 - DNA, 16 bp, P. troglodytes
acaaaatagattttaa

SEQ ID NO: 195173 - DNA, 16 bp, P. troglodytes
acaaaataggattaca

SEQ ID NO: 195174 - DNA, 16 bp, P. troglodytes
acaaaatataacaagt

SEQ ID NO: 195175 - DNA, 16 bp, P. troglodytes
acaaaatatagtaatt

SEQ ID NO: 195176 - DNA, 16 bp, P. troglodytes
acaaaatatgtgcaaa

SEQ ID NO: 195177 - DNA, 16 bp, P. troglodytes
acaaaatatgtgttaa

SEQ ID NO: 195178 - DNA, 16 bp, P. troglodytes
acaaaatattagtaaa

SEQ ID NO: 195179 - DNA, 16 bp, P. troglodytes
acaaaatattcttctt

SEQ ID NO: 195180 - DNA, 16 bp, P. troglodytes
acaaaatatttagaat

SEQ ID NO: 195181 - DNA, 16 bp, P. troglodytes
acaaaatatttgattt

SEQ ID NO: 195182 - DNA, 16 bp, P. troglodytes
acaaaatattttactt

SEQ ID NO: 195183 - DNA, 16 bp, P. troglodytes
acaaaatattttcatt

SEQ ID NO: 195184 - DNA, 16 bp, P. troglodytes
acaaaatattttcttt

SEQ ID NO: 195185 - DNA, 16 bp, P. troglodytes
acaaaatcaacatgca

SEQ ID NO: 195186 - DNA, 16 bp, P. troglodytes
acaaaatcagaaatta

SEQ ID NO: 195187 - DNA, 16 bp, P. troglodytes
acaaaatccaacacct

SEQ ID NO: 195188 - DNA, 16 bp, P. troglodytes
acaaaatccagcatcg

SEQ ID NO: 195189 - DNA, 16 bp, P. troglodytes
acaaaatctctcagta

SEQ ID NO: 195190 - DNA, 16 bp, P. troglodytes
acaaaatgaaaagctg

SEQ ID NO: 195191 - DNA, 16 bp, P. troglodytes
acaaaatgaatgaaat

SEQ ID NO: 195192 - DNA, 16 bp, P. troglodytes
acaaaatgagataata

SEQ ID NO: 195193 - DNA, 16 bp, P. troglodytes
acaaaatgatgttttg

SEQ ID NO: 195194 - DNA, 16 bp, P. troglodytes
acaaaatgatttaaaa

SEQ ID NO: 195195 - DNA, 16 bp, P. troglodytes
acaaaatgcatttttt

SEQ ID NO: 195196 - DNA, 16 bp, P. troglodytes
acaaaatggaaatatt

SEQ ID NO: 195197 - DNA, 20 bp, P. troglodytes
acaaaatgggagaaaatttt

SEQ ID NO: 195198 - DNA, 16 bp, P. troglodytes
acaaaatgggataaaa

SEQ ID NO: 195199 - DNA, 16 bp, P. troglodytes
acaaaatggggagaaa

SEQ ID NO: 195200 - DNA, 16 bp, P. troglodytes
acaaaatgtaatttaa

SEQ ID NO: 195201 - DNA, 16 bp, P. troglodytes
acaaaatgttgctgaa

SEQ ID NO: 195202 - DNA, 16 bp, P. troglodytes
acaaaatgttgtatat

SEQ ID NO: 195203 - DNA, 16 bp, P. troglodytes
acaaaattatgaaaat

SEQ ID NO: 195204 - DNA, 16 bp, P. troglodytes
acaaaattattctctt

SEQ ID NO: 195205 - DNA, 16 bp, P. troglodytes
acaaaattcaacaatg

SEQ ID NO: 195206 - DNA, 16 bp, P. troglodytes
acaaaattccatctca

SEQ ID NO: 195207 - DNA, 16 bp, P. troglodytes
acaaaattctgatgaa

SEQ ID NO: 195208 - DNA, 16 bp, P. troglodytes
acaaaattgacaaaca

SEQ ID NO: 195209 - DNA, 16 bp, P. troglodytes
acaaaattgagaccca

SEQ ID NO: 195210 - DNA, 16 bp, P. troglodytes
acaaaattgggatcat

SEQ ID NO: 195211 - DNA, 16 bp, P. troglodytes
acaaaatttggagcat

SEQ ID NO: 195212 - DNA, 16 bp, P. troglodytes
acaaaattttagaaat

SEQ ID NO: 195213 - DNA, 16 bp, P. troglodytes
acaaacaaaaactgtg

SEQ ID NO: 195214 - DNA, 16 bp, P. troglodytes
acaaacaaaaagcctg

SEQ ID NO: 195215 - DNA, 16 bp, P. troglodytes
acaaacaaaaattctg

SEQ ID NO: 195216 - DNA, 16 bp, P. troglodytes
acaaacaaaagctgag

SEQ ID NO: 195217 - DNA, 16 bp, P. troglodytes
acaaacaaatgtaaga

SEQ ID NO: 195218 - DNA, 16 bp, P. troglodytes
acaaacacatggaaat

SEQ ID NO: 195219 - DNA, 16 bp, P. troglodytes
acaaacacattataca

SEQ ID NO: 195220 - DNA, 16 bp, P. troglodytes
acaaacactgcatatt

SEQ ID NO: 195221 - DNA, 16 bp, P. troglodytes
acaaacactgtggaag

SEQ ID NO: 195222 - DNA, 16 bp, P. troglodytes
acaaacagaaatgaca

SEQ ID NO: 195223 - DNA, 16 bp, P. troglodytes
acaaacagccccatca

SEQ ID NO: 195224 - DNA, 16 bp, P. troglodytes
acaaacagtctcttag

SEQ ID NO: 195225 - DNA, 16 bp, P. troglodytes
acaaacatgtacatgt

SEQ ID NO: 195226 - DNA, 16 bp, P. troglodytes
acaaacatgttttaaa

SEQ ID NO: 195227 - DNA, 16 bp, P. troglodytes
acaaacattcagtcca

SEQ ID NO: 195228 - DNA, 16 bp, P. troglodytes
acaaacattttttaaa

SEQ ID NO: 195229 - DNA, 16 bp, P. troglodytes
acaaacccacagccat

SEQ ID NO: 195230 - DNA, 22 bp, P. troglodytes
acaaaccctgagctagacacag

SEQ ID NO: 195231 - DNA, 16 bp, P. troglodytes
acaaacctagatggca

SEQ ID NO: 195232 - DNA, 16 bp, P. troglodytes
acaaacctcttttctt

SEQ ID NO: 195233 - DNA, 18 bp, P. troglodytes
acaaactaccatcacaga

SEQ ID NO: 195234 - DNA, 16 bp, P. troglodytes
acaaactagaaaatat

SEQ ID NO: 195235 - DNA, 16 bp, P. troglodytes
acaaactagaaaatct

SEQ ID NO: 195236 - DNA, 16 bp, P. troglodytes
acaaactaggcataaa

SEQ ID NO: 195237 - DNA, 16 bp, P. troglodytes
acaaactgaagagaca

SEQ ID NO: 195238 - DNA, 16 bp, P. troglodytes
acaaagaaaaagaggt

SEQ ID NO: 195239 - DNA, 16 bp, P. troglodytes
acaaagaaaagagttt

SEQ ID NO: 195240 - DNA, 16 bp, P. troglodytes
acaaagaaactctgga

SEQ ID NO: 195241 - DNA, 16 bp, P. troglodytes
acaaagaaaggatcct

SEQ ID NO: 195242 - DNA, 16 bp, P. troglodytes
acaaagaaatggaaga

SEQ ID NO: 195243 - DNA, 16 bp, P. troglodytes
acaaagaaatggtaaa

SEQ ID NO: 195244 - DNA, 16 bp, P. troglodytes
acaaagaaattctgga

SEQ ID NO: 195245 - DNA, 16 bp, P. troglodytes
acaaagaaattgaaat

SEQ ID NO: 195246 - DNA, 16 bp, P. troglodytes
acaaagaaatttggtt

SEQ ID NO: 195247 - DNA, 16 bp, P. troglodytes
acaaagaactctcaaa

SEQ ID NO: 195248 - DNA, 16 bp, P. troglodytes
acaaagaactcttaaa

SEQ ID NO: 195249 - DNA, 16 bp, P. troglodytes
acaaagaagaccatta

SEQ ID NO: 195250 - DNA, 16 bp, P. troglodytes
acaaagaagttaaata

SEQ ID NO: 195251 - DNA, 16 bp, P. troglodytes
acaaagaatgatccag

SEQ ID NO: 195252 - DNA, 16 bp, P. troglodytes
acaaagaattatttgg

SEQ ID NO: 195253 - DNA, 16 bp, P. troglodytes
acaaagaattcaaaat

SEQ ID NO: 195254 - DNA, 16 bp, P. troglodytes
acaaagaattcttaaa

SEQ ID NO: 195255 - DNA, 16 bp, P. troglodytes
acaaagagaaaaatct

SEQ ID NO: 195256 - DNA, 16 bp, P. troglodytes
acaaagagagaattct

SEQ ID NO: 195257 - DNA, 16 bp, P. troglodytes
acaaagaggagctgga

SEQ ID NO: 195258 - DNA, 16 bp, P. troglodytes
acaaagataataacag

SEQ ID NO: 195259 - DNA, 16 bp, P. troglodytes
acaaagatactcagga

SEQ ID NO: 195260 - DNA, 16 bp, P. troglodytes
acaaagatggcaacaa

SEQ ID NO: 195261 - DNA, 16 bp, P. troglodytes
acaaagatgggaagaa

SEQ ID NO: 195262 - DNA, 16 bp, P. troglodytes
acaaagatggggaaga

SEQ ID NO: 195263 - DNA, 16 bp, P. troglodytes
acaaagattttctcct

SEQ ID NO: 195264 - DNA, 16 bp, P. troglodytes
acaaagatttttaaag

SEQ ID NO: 195265 - DNA, 16 bp, P. troglodytes
acaaagcattttcaaa

SEQ ID NO: 195266 - DNA, 16 bp, P. troglodytes
acaaagcccccaagaa

SEQ ID NO: 195267 - DNA, 16 bp, P. troglodytes
acaaagcctccaaaaa

SEQ ID NO: 195268 - DNA, 16 bp, P. troglodytes
acaaagctgacaaaaa

SEQ ID NO: 195269 - DNA, 16 bp, P. troglodytes
acaaagctgtttctca

SEQ ID NO: 195270 - DNA, 16 bp, P. troglodytes
acaaaggaaagaagtt

SEQ ID NO: 195271 - DNA, 16 bp, P. troglodytes
acaaaggaatgaagag

SEQ ID NO: 195272 - DNA, 16 bp, P. troglodytes
acaaaggacatgaatg

SEQ ID NO: 195273 - DNA, 16 bp, P. troglodytes
acaaaggactttatta

SEQ ID NO: 195274 - DNA, 16 bp, P. troglodytes
acaaaggatctctcag

SEQ ID NO: 195275 - DNA, 16 bp, P. troglodytes
acaaaggattcagaat

SEQ ID NO: 195276 - DNA, 16 bp, P. troglodytes
acaaaggattttaaaa

SEQ ID NO: 195277 - DNA, 16 bp, P. troglodytes
acaaaggcaccaagaa

SEQ ID NO: 195278 - DNA, 16 bp, P. troglodytes
acaaaggcatgaatga

SEQ ID NO: 195279 - DNA, 16 bp, P. troglodytes
acaaagggaagcctat

SEQ ID NO: 195280 - DNA, 16 bp, P. troglodytes
acaaagtaataataat

SEQ ID NO: 195281 - DNA, 16 bp, P. troglodytes
acaaagtaattttaaa

SEQ ID NO: 195282 - DNA, 16 bp, P. troglodytes
acaaagtatagagaaa

SEQ ID NO: 195283 - DNA, 16 bp, P. troglodytes
acaaagtatttatttt

SEQ ID NO: 195284 - DNA, 16 bp, P. troglodytes
acaaagtcaagagaca

SEQ ID NO: 195285 - DNA, 16 bp, P. troglodytes
acaaagtctcgccctg

SEQ ID NO: 195286 - DNA, 16 bp, P. troglodytes
acaaagtgaagagaca

SEQ ID NO: 195287 - DNA, 16 bp, P. troglodytes
acaaagtgaagataca

SEQ ID NO: 195288 - DNA, 16 bp, P. troglodytes
acaaagtgagacctgt

SEQ ID NO: 195289 - DNA, 17 bp, P. troglodytes
acaaagtgctgggatta

SEQ ID NO: 195290 - DNA, 16 bp, P. troglodytes
acaaagtggccaggaa

SEQ ID NO: 195291 - DNA, 16 bp, P. troglodytes
acaaagttatttaaaa

SEQ ID NO: 195292 - DNA, 16 bp, P. troglodytes
acaaagtttaatttat

SEQ ID NO: 195293 - DNA, 16 bp, P. troglodytes
acaaagtttcagttac

SEQ ID NO: 195294 - DNA, 16 bp, P. troglodytes
acaaataaatatttgt

SEQ ID NO: 195295 - DNA, 16 bp, P. troglodytes
acaaataatcccatca

SEQ ID NO: 195296 - DNA, 16 bp, P. troglodytes
acaaataattgaaaat

SEQ ID NO: 195297 - DNA, 16 bp, P. troglodytes
acaaatacatacagga

SEQ ID NO: 195298 - DNA, 16 bp, P. troglodytes
acaaatacattttaca

SEQ ID NO: 195299 - DNA, 16 bp, P. troglodytes
acaaataccacatgat

SEQ ID NO: 195300 - DNA, 16 bp, P. troglodytes
acaaataccactgtgt

SEQ ID NO: 195301 - DNA, 16 bp, P. troglodytes
acaaatactgcatgat

SEQ ID NO: 195302 - DNA, 16 bp, P. troglodytes
acaaatatacacatac

SEQ ID NO: 195303 - DNA, 16 bp, P. troglodytes
acaaatatatagatat

SEQ ID NO: 195304 - DNA, 16 bp, P. troglodytes
acaaatatctactgag

SEQ ID NO: 195305 - DNA, 16 bp, P. troglodytes
acaaatattaactgag

SEQ ID NO: 195306 - DNA, 16 bp, P. troglodytes
acaaatatttaatgag

SEQ ID NO: 195307 - DNA, 16 bp, P. troglodytes
acaaatatttacagaa

SEQ ID NO: 195308 - DNA, 16 bp, P. troglodytes
acaaatatttactttt

SEQ ID NO: 195309 - DNA, 16 bp, P. troglodytes
acaaatatttattggg

SEQ ID NO: 195310 - DNA, 16 bp, P. troglodytes
acaaatatttcctttt

SEQ ID NO: 195311 - DNA, 16 bp, P. troglodytes
acaaatatttcttaaa

SEQ ID NO: 195312 - DNA, 16 bp, P. troglodytes
acaaatatttcttcaa

SEQ ID NO: 195313 - DNA, 16 bp, P. troglodytes
acaaatattttctatt

SEQ ID NO: 195314 - DNA, 16 bp, P. troglodytes
acaaatcaacaagcaa

SEQ ID NO: 195315 - DNA, 16 bp, P. troglodytes
acaaatcattttattt

SEQ ID NO: 195316 - DNA, 16 bp, P. troglodytes
acaaatcccattcatg

SEQ ID NO: 195317 - DNA, 16 bp, P. troglodytes
acaaatctgcacatat

SEQ ID NO: 195318 - DNA, 16 bp, P. troglodytes
acaaatgaacaagcaa

SEQ ID NO: 195319 - DNA, 16 bp, P. troglodytes
acaaatgaagaaacta

SEQ ID NO: 195320 - DNA, 16 bp, P. troglodytes
acaaatgaagaaactg

SEQ ID NO: 195321 - DNA, 16 bp, P. troglodytes
acaaatgacaaaatgg

SEQ ID NO: 195322 - DNA, 16 bp, P. troglodytes
acaaatgacagtattt

SEQ ID NO: 195323 - DNA, 16 bp, P. troglodytes
acaaatgaccacaaac

SEQ ID NO: 195324 - DNA, 16 bp, P. troglodytes
acaaatgatattggga

SEQ ID NO: 195325 - DNA, 16 bp, P. troglodytes
acaaatgatgctgaaa

SEQ ID NO: 195326 - DNA, 16 bp, P. troglodytes
acaaatgcaagaacat

SEQ ID NO: 195327 - DNA, 16 bp, P. troglodytes
acaaatgcatgaaaat

SEQ ID NO: 195328 - DNA, 16 bp, P. troglodytes
acaaatggaaaaacgt

SEQ ID NO: 195329 - DNA, 16 bp, P. troglodytes
acaaatggaaaaatgt

SEQ ID NO: 195330 - DNA, 16 bp, P. troglodytes
acaaatggaaaccaaa

SEQ ID NO: 195331 - DNA, 16 bp, P. troglodytes
acaaatggaagaaaat

SEQ ID NO: 195332 - DNA, 16 bp, P. troglodytes
acaaatggatgtggct

SEQ ID NO: 195333 - DNA, 16 bp, P. troglodytes
acaaatggcaaataag

SEQ ID NO: 195334 - DNA, 16 bp, P. troglodytes
acaaatggcactggga

SEQ ID NO: 195335 - DNA, 16 bp, P. troglodytes
acaaatggccaacagg

SEQ ID NO: 195336 - DNA, 16 bp, P. troglodytes
acaaatgggatataat

SEQ ID NO: 195337 - DNA, 16 bp, P. troglodytes
acaaatgggccaggca

SEQ ID NO: 195338 - DNA, 19 bp, P. troglodytes
acaaatggtatctaattaa

SEQ ID NO: 195339 - DNA, 16 bp, P. troglodytes
acaaatggtgctggag

SEQ ID NO: 195340 - DNA, 16 bp, P. troglodytes
acaaatggtggtggga

SEQ ID NO: 195341 - DNA, 16 bp, P. troglodytes
acaaatggtttttggt

SEQ ID NO: 195342 - DNA, 16 bp, P. troglodytes
acaaatgtaattttat

SEQ ID NO: 195343 - DNA, 16 bp, P. troglodytes
acaaatgtatattttt

SEQ ID NO: 195344 - DNA, 16 bp, P. troglodytes
acaaatgttaatattt

SEQ ID NO: 195345 - DNA, 16 bp, P. troglodytes
acaaatgttggcaaag

SEQ ID NO: 195346 - DNA, 16 bp, P. troglodytes
acaaatgttggtgaga

SEQ ID NO: 195347 - DNA, 19 bp, P. troglodytes
acaaatgtttcttctaaca

SEQ ID NO: 195348 - DNA, 16 bp, P. troglodytes
acaaatgttttcattt

SEQ ID NO: 195349 - DNA, 16 bp, P. troglodytes
acaaatgtttttaaat

SEQ ID NO: 195350 - DNA, 16 bp, P. troglodytes
acaaattaaatgcaat

SEQ ID NO: 195351 - DNA, 16 bp, P. troglodytes
acaaattaacaagcaa

SEQ ID NO: 195352 - DNA, 16 bp, P. troglodytes
acaaattaccataaat

SEQ ID NO: 195353 - DNA, 16 bp, P. troglodytes
acaaattaccccaaat

SEQ ID NO: 195354 - DNA, 16 bp, P. troglodytes
acaaattacccccaaa

SEQ ID NO: 195355 - DNA, 16 bp, P. troglodytes
acaaattactgcaaat

SEQ ID NO: 195356 - DNA, 16 bp, P. troglodytes
acaaattattacagga

SEQ ID NO: 195357 - DNA, 16 bp, P. troglodytes
acaaattcaagaagct

SEQ ID NO: 195358 - DNA, 16 bp, P. troglodytes
acaaattcagaaaagt

SEQ ID NO: 195359 - DNA, 16 bp, P. troglodytes
acaaattcagtaaagc

SEQ ID NO: 195360 - DNA, 16 bp, P. troglodytes
acaaattgaagatttg

SEQ ID NO: 195361 - DNA, 16 bp, P. troglodytes
acaaattgaagttttg

SEQ ID NO: 195362 - DNA, 16 bp, P. troglodytes
acaaattgacaaccta

SEQ ID NO: 195363 - DNA, 16 bp, P. troglodytes
acaaattgatgtggat

SEQ ID NO: 195364 - DNA, 16 bp, P. troglodytes
acaaattggaaaatct

SEQ ID NO: 195365 - DNA, 16 bp, P. troglodytes
acaaatttatcatttt

SEQ ID NO: 195366 - DNA, 16 bp, P. troglodytes
acaaatttattatctt

SEQ ID NO: 195367 - DNA, 16 bp, P. troglodytes
acaaatttctgttgtt

SEQ ID NO: 195368 - DNA, 16 bp, P. troglodytes
acaaattttaagaaaa

SEQ ID NO: 195369 - DNA, 16 bp, P. troglodytes
acaaattttccaaatt

SEQ ID NO: 195370 - DNA, 16 bp, P. troglodytes
acaaattttcttttct

SEQ ID NO: 195371 - DNA, 16 bp, P. troglodytes
acaacaaaataaggca

SEQ ID NO: 195372 - DNA, 16 bp, P. troglodytes
acaacaacaaaatcag

SEQ ID NO: 195373 - DNA, 16 bp, P. troglodytes
acaacaacaaaatgcc

SEQ ID NO: 195374 - DNA, 16 bp, P. troglodytes
acaacaacaaaatgtt

SEQ ID NO: 195375 - DNA, 16 bp, P. troglodytes
acaacaatatgaatgt

SEQ ID NO: 195376 - DNA, 16 bp, P. troglodytes
acaacaatgaaatttg

SEQ ID NO: 195377 - DNA, 16 bp, P. troglodytes
acaacacaggtttgaa

SEQ ID NO: 195378 - DNA, 16 bp, P. troglodytes
acaacacccaagtcct

SEQ ID NO: 195379 - DNA, 16 bp, P. troglodytes
acaacagaaattcatt

SEQ ID NO: 195380 - DNA, 16 bp, P. troglodytes
acaacagaaatttatt

SEQ ID NO: 195381 - DNA, 16 bp, P. troglodytes
acaacagagcaagacc

SEQ ID NO: 195382 - DNA, 16 bp, P. troglodytes
acaacagatactggag

SEQ ID NO: 195383 - DNA, 16 bp, P. troglodytes
acaacagatataataa

SEQ ID NO: 195384 - DNA, 16 bp, P. troglodytes
acaacagatgaatgaa

SEQ ID NO: 195385 - DNA, 16 bp, P. troglodytes
acaacagatgctgaag

SEQ ID NO: 195386 - DNA, 16 bp, P. troglodytes
acaacagatgctgcag

SEQ ID NO: 195387 - DNA, 16 bp, P. troglodytes
acaacagatgctggga

SEQ ID NO: 195388 - DNA, 16 bp, P. troglodytes
acaacagcaaacattt

SEQ ID NO: 195389 - DNA, 16 bp, P. troglodytes
acaacagcaataacaa

SEQ ID NO: 195390 - DNA, 16 bp, P. troglodytes
acaacagcagagctga

SEQ ID NO: 195391 - DNA, 16 bp, P. troglodytes
acaacagcagagttga

SEQ ID NO: 195392 - DNA, 16 bp, P. troglodytes
acaacagcagcagcag

SEQ ID NO: 195393 - DNA, 16 bp, P. troglodytes
acaacaggcctcagtg

SEQ ID NO: 195394 - DNA, 16 bp, P. troglodytes
acaacagggtgctgga

SEQ ID NO: 195395 - DNA, 16 bp, P. troglodytes
acaacagtgaagtttg

SEQ ID NO: 195396 - DNA, 16 bp, P. troglodytes
acaacatacagaatgg

SEQ ID NO: 195397 - DNA, 16 bp, P. troglodytes
acaacatagcagaatc

SEQ ID NO: 195398 - DNA, 16 bp, P. troglodytes
acaacatgatgaacct

SEQ ID NO: 195399 - DNA, 16 bp, P. troglodytes
acaacatggacaaatc

SEQ ID NO: 195400 - DNA, 16 bp, P. troglodytes
acaacatggagaaacc

SEQ ID NO: 195401 - DNA, 16 bp, P. troglodytes
acaacatggcagagaa

SEQ ID NO: 195402 - DNA, 16 bp, P. troglodytes
acaacattaatccatt

SEQ ID NO: 195403 - DNA, 16 bp, P. troglodytes
acaacattttttaaat

SEQ ID NO: 195404 - DNA, 16 bp, P. troglodytes
acaacattttttttaa

SEQ ID NO: 195405 - DNA, 16 bp, P. troglodytes
acaaccaaaaatgtct

SEQ ID NO: 195406 - DNA, 16 bp, P. troglodytes
acaaccaaaaatgttt

SEQ ID NO: 195407 - DNA, 16 bp, P. troglodytes
acaaccacgcccagct

SEQ ID NO: 195408 - DNA, 16 bp, P. troglodytes
acaaccagatctcacg

SEQ ID NO: 195409 - DNA, 16 bp, P. troglodytes
acaaccagatcttgtg

SEQ ID NO: 195410 - DNA, 16 bp, P. troglodytes
acaaccagcctggcca

SEQ ID NO: 195411 - DNA, 16 bp, P. troglodytes
acaaccagtcatttta

SEQ ID NO: 195412 - DNA, 16 bp, P. troglodytes
acaaccatgtagaaat

SEQ ID NO: 195413 - DNA, 16 bp, P. troglodytes
acaaccatgtgatctt

SEQ ID NO: 195414 - DNA, 16 bp, P. troglodytes
acaaccattgtggaag

SEQ ID NO: 195415 - DNA, 16 bp, P. troglodytes
acaaccattttggaaa

SEQ ID NO: 195416 - DNA, 16 bp, P. troglodytes
acaacccaatagaaaa

SEQ ID NO: 195417 - DNA, 16 bp, P. troglodytes
acaacctaatgtcaca

SEQ ID NO: 195418 - DNA, 16 bp, P. troglodytes
acaacctagatccctt

SEQ ID NO: 195419 - DNA, 16 bp, P. troglodytes
acaacctcaccagcat

SEQ ID NO: 195420 - DNA, 16 bp, P. troglodytes
acaacctctgcttccc

SEQ ID NO: 195421 - DNA, 16 bp, P. troglodytes
acaacctcttcctcct

SEQ ID NO: 195422 - DNA, 16 bp, P. troglodytes
acaacctgctcctaaa

SEQ ID NO: 195423 - DNA, 16 bp, P. troglodytes
acaaccttgggcaagt

SEQ ID NO: 195424 - DNA, 16 bp, P. troglodytes
acaactactatggaga

SEQ ID NO: 195425 - DNA, 16 bp, P. troglodytes
acaactccagtgacct

SEQ ID NO: 195426 - DNA, 18 bp, P. troglodytes
acaactcctttccttcct

SEQ ID NO: 195427 - DNA, 16 bp, P. troglodytes
acaactctcctagctt

SEQ ID NO: 195428 - DNA, 16 bp, P. troglodytes
acaactctggaggctg

SEQ ID NO: 195429 - DNA, 16 bp, P. troglodytes
acaactgaggaaactg

SEQ ID NO: 195430 - DNA, 16 bp, P. troglodytes
acaactgctacaaaaa

SEQ ID NO: 195431 - DNA, 16 bp, P. troglodytes
acaactggcagtgcag

SEQ ID NO: 195432 - DNA, 16 bp, P. troglodytes
acaacttaggcaatac

SEQ ID NO: 195433 - DNA, 16 bp, P. troglodytes
acaacttcagtaaagt

SEQ ID NO: 195434 - DNA, 16 bp, P. troglodytes
acaactttgtgaatat

SEQ ID NO: 195435 - DNA, 16 bp, P. troglodytes
acaacttttatatgca

SEQ ID NO: 195436 - DNA, 16 bp, P. troglodytes
acaagaaaactacaga

SEQ ID NO: 195437 - DNA, 16 bp, P. troglodytes
acaagaacagcaaagg

SEQ ID NO: 195438 - DNA, 16 bp, P. troglodytes
acaagaacgaaactcc

SEQ ID NO: 195439 - DNA, 16 bp, P. troglodytes
acaagaactacatgac

SEQ ID NO: 195440 - DNA, 16 bp, P. troglodytes
acaagaagagaaaatt

SEQ ID NO: 195441 - DNA, 16 bp, P. troglodytes
acaagaagagcatggg

SEQ ID NO: 195442 - DNA, 16 bp, P. troglodytes
acaagaagaggaaatt

SEQ ID NO: 195443 - DNA, 19 bp, P. troglodytes
acaagaatcacttgaacct

SEQ ID NO: 195444 - DNA, 16 bp, P. troglodytes
acaagaattgcttgaa

SEQ ID NO: 195445 - DNA, 16 bp, P. troglodytes
acaagaatttaaaaat

SEQ ID NO: 195446 - DNA, 16 bp, P. troglodytes
acaagacaagaatgcc

SEQ ID NO: 195447 - DNA, 16 bp, P. troglodytes
acaagaccctgtcttt

SEQ ID NO: 195448 - DNA, 16 bp, P. troglodytes
acaagagaaagcagca

SEQ ID NO: 195449 - DNA, 16 bp, P. troglodytes
acaagagaaggaaata

SEQ ID NO: 195450 - DNA, 16 bp, P. troglodytes
acaagagcaagactcc

SEQ ID NO: 195451 - DNA, 16 bp, P. troglodytes
acaagagcagctaaaa

SEQ ID NO: 195452 - DNA, 16 bp, P. troglodytes
acaagagcgagactgt

SEQ ID NO: 195453 - DNA, 16 bp, P. troglodytes
acaagaggaattttga

SEQ ID NO: 195454 - DNA, 16 bp, P. troglodytes
acaagagtgaaagtct

SEQ ID NO: 195455 - DNA, 16 bp, P. troglodytes
acaagagtgaagctcc

SEQ ID NO: 195456 - DNA, 16 bp, P. troglodytes
acaagatgcagatgaa

SEQ ID NO: 195457 - DNA, 16 bp, P. troglodytes
acaagatgtggaggtg

SEQ ID NO: 195458 - DNA, 16 bp, P. troglodytes
acaagattagagaata

SEQ ID NO: 195459 - DNA, 16 bp, P. troglodytes
acaagatttattgcaa

SEQ ID NO: 195460 - DNA, 16 bp, P. troglodytes
acaagattttttaaaa

SEQ ID NO: 195461 - DNA, 16 bp, P. troglodytes
acaagcaaatgctaag

SEQ ID NO: 195462 - DNA, 16 bp, P. troglodytes
acaagcaacttcagca

SEQ ID NO: 195463 - DNA, 16 bp, P. troglodytes
acaagcaagctgggag

SEQ ID NO: 195464 - DNA, 16 bp, P. troglodytes
acaagcaatgggggaa

SEQ ID NO: 195465 - DNA, 16 bp, P. troglodytes
acaagcagaaagccaa

SEQ ID NO: 195466 - DNA, 16 bp, P. troglodytes
acaagcagaaaggaat

SEQ ID NO: 195467 - DNA, 16 bp, P. troglodytes
acaagcagcgagattg

SEQ ID NO: 195468 - DNA, 16 bp, P. troglodytes
acaagcaggaagtgaa

SEQ ID NO: 195469 - DNA, 16 bp, P. troglodytes
acaagcaggagacaga

SEQ ID NO: 195470 - DNA, 16 bp, P. troglodytes
acaagcatgagccatg

SEQ ID NO: 195471 - DNA, 16 bp, P. troglodytes
acaagcatttattgaa

SEQ ID NO: 195472 - DNA, 16 bp, P. troglodytes
acaagcatttattttt

SEQ ID NO: 195473 - DNA, 16 bp, P. troglodytes
acaagccacctataga

SEQ ID NO: 195474 - DNA, 17 bp, P. troglodytes
acaagcccggctaattt

SEQ ID NO: 195475 - DNA, 17 bp, P. troglodytes
acaagctctctttgcct

SEQ ID NO: 195476 - DNA, 16 bp, P. troglodytes
acaagctcttgctctg

SEQ ID NO: 195477 - DNA, 16 bp, P. troglodytes
acaagctgactgaaga

SEQ ID NO: 195478 - DNA, 16 bp, P. troglodytes
acaagctggagaccca

SEQ ID NO: 195479 - DNA, 16 bp, P. troglodytes
acaagctgtgcagcct

SEQ ID NO: 195480 - DNA, 17 bp, P. troglodytes
acaagctgttccagtat

SEQ ID NO: 195481 - DNA, 16 bp, P. troglodytes
acaaggaaacatcaga

SEQ ID NO: 195482 - DNA, 16 bp, P. troglodytes
acaaggaaagaaaact

SEQ ID NO: 195483 - DNA, 16 bp, P. troglodytes
acaaggaagaaattga

SEQ ID NO: 195484 - DNA, 16 bp, P. troglodytes
acaaggaagtgggcca

SEQ ID NO: 195485 - DNA, 16 bp, P. troglodytes
acaaggaagttaaaca

SEQ ID NO: 195486 - DNA, 16 bp, P. troglodytes
acaaggatacacagga

SEQ ID NO: 195487 - DNA, 16 bp, P. troglodytes
acaaggatgccatctc

SEQ ID NO: 195488 - DNA, 16 bp, P. troglodytes
acaaggatgtgaagaa

SEQ ID NO: 195489 - DNA, 16 bp, P. troglodytes
acaaggcaaagatgcc

SEQ ID NO: 195490 - DNA, 16 bp, P. troglodytes
acaaggcaccaagtcc

SEQ ID NO: 195491 - DNA, 16 bp, P. troglodytes
acaaggcctctgaagt

SEQ ID NO: 195492 - DNA, 16 bp, P. troglodytes
acaaggctggaggcat

SEQ ID NO: 195493 - DNA, 16 bp, P. troglodytes
acaagggaaagcagga

SEQ ID NO: 195494 - DNA, 16 bp, P. troglodytes
acaagggatgtgaaga

SEQ ID NO: 195495 - DNA, 17 bp, P. troglodytes
acaagggtattgactgg

SEQ ID NO: 195496 - DNA, 16 bp, P. troglodytes
acaaggtcaggcgttc

SEQ ID NO: 195497 - DNA, 16 bp, P. troglodytes
acaaggtctcactata

SEQ ID NO: 195498 - DNA, 16 bp, P. troglodytes
acaaggtctctgtcac

SEQ ID NO: 195499 - DNA, 16 bp, P. troglodytes
acaaggtgaagtccca

SEQ ID NO: 195500 - DNA, 16 bp, P. troglodytes
acaaggtttccccatg

SEQ ID NO: 195501 - DNA, 16 bp, P. troglodytes
acaagtaaaaagctga

SEQ ID NO: 195502 - DNA, 16 bp, P. troglodytes
acaagtaaataaatac

SEQ ID NO: 195503 - DNA, 16 bp, P. troglodytes
acaagtacaaaaatta

SEQ ID NO: 195504 - DNA, 16 bp, P. troglodytes
acaagtatgtggaaat

SEQ ID NO: 195505 - DNA, 16 bp, P. troglodytes
acaagtattttttttt

SEQ ID NO: 195506 - DNA, 16 bp, P. troglodytes
acaagtcaaggatgcc

SEQ ID NO: 195507 - DNA, 16 bp, P. troglodytes
acaagtgtttattgag

SEQ ID NO: 195508 - DNA, 17 bp, P. troglodytes
acaagttgagagaagaa

SEQ ID NO: 195509 - DNA, 16 bp, P. troglodytes
acaagttgtttaattt

SEQ ID NO: 195510 - DNA, 16 bp, P. troglodytes
acaataaaaatgaatg

SEQ ID NO: 195511 - DNA, 17 bp, P. troglodytes
acaataaaatccaggct

SEQ ID NO: 195512 - DNA, 16 bp, P. troglodytes
acaataaaatgttaat

SEQ ID NO: 195513 - DNA, 16 bp, P. troglodytes
acaataaagcaaatca

SEQ ID NO: 195514 - DNA, 16 bp, P. troglodytes
acaataaatgtttgtt

SEQ ID NO: 195515 - DNA, 16 bp, P. troglodytes
acaataaattattgtt

SEQ ID NO: 195516 - DNA, 16 bp, P. troglodytes
acaataagatccaggc

SEQ ID NO: 195517 - DNA, 16 bp, P. troglodytes
acaataatacctacct

SEQ ID NO: 195518 - DNA, 16 bp, P. troglodytes
acaataatatattgta

SEQ ID NO: 195519 - DNA, 16 bp, P. troglodytes
acaataatcatgggag

SEQ ID NO: 195520 - DNA, 16 bp, P. troglodytes
acaataatgtgaatat

SEQ ID NO: 195521 - DNA, 16 bp, P. troglodytes
acaatagaaatgtatt

SEQ ID NO: 195522 - DNA, 16 bp, P. troglodytes
acaatagacatttatt

SEQ ID NO: 195523 - DNA, 16 bp, P. troglodytes
acaatagcaaaaatgt

SEQ ID NO: 195524 - DNA, 16 bp, P. troglodytes
acaatagccaagattt

SEQ ID NO: 195525 - DNA, 16 bp, P. troglodytes
acaatatacatttttt

SEQ ID NO: 195526 - DNA, 16 bp, P. troglodytes
acaatatattcatgta

SEQ ID NO: 195527 - DNA, 16 bp, P. troglodytes
acaatatggtgaaacc

SEQ ID NO: 195528 - DNA, 16 bp, P. troglodytes
acaatatgtaaacaaa

SEQ ID NO: 195529 - DNA, 16 bp, P. troglodytes
acaatatgtaaatgaa

SEQ ID NO: 195530 - DNA, 16 bp, P. troglodytes
acaatattaaaatgta

SEQ ID NO: 195531 - DNA, 16 bp, P. troglodytes
acaatattgattcttc

SEQ ID NO: 195532 - DNA, 16 bp, P. troglodytes
acaatatttcatttaa

SEQ ID NO: 195533 - DNA, 16 bp, P. troglodytes
acaatcaaaaattcag

SEQ ID NO: 195534 - DNA, 16 bp, P. troglodytes
acaatcaacaaaatga

SEQ ID NO: 195535 - DNA, 16 bp, P. troglodytes
acaatcaatttgtaca

SEQ ID NO: 195536 - DNA, 16 bp, P. troglodytes
acaatcagaaattgaa

SEQ ID NO: 195537 - DNA, 16 bp, P. troglodytes
acaatcataactcact

SEQ ID NO: 195538 - DNA, 16 bp, P. troglodytes
acaatcatgacatctg

SEQ ID NO: 195539 - DNA, 17 bp, P. troglodytes
acaatcatgcccttcca

SEQ ID NO: 195540 - DNA, 16 bp, P. troglodytes
acaatcatggcggaag

SEQ ID NO: 195541 - DNA, 16 bp, P. troglodytes
acaatcatggctcacc

SEQ ID NO: 195542 - DNA, 16 bp, P. troglodytes
acaatcatggtggaag

SEQ ID NO: 195543 - DNA, 16 bp, P. troglodytes
acaatcctcagcaaat

SEQ ID NO: 195544 - DNA, 16 bp, P. troglodytes
acaatctcatttacaa

SEQ ID NO: 195545 - DNA, 19 bp, P. troglodytes
acaatctcggctcactgcg

SEQ ID NO: 195546 - DNA, 16 bp, P. troglodytes
acaatctctgtctttt

SEQ ID NO: 195547 - DNA, 16 bp, P. troglodytes
acaatctctttcatga

SEQ ID NO: 195548 - DNA, 16 bp, P. troglodytes
acaatcttaaatatat

SEQ ID NO: 195549 - DNA, 19 bp, P. troglodytes
acaatcttggctcactgca

SEQ ID NO: 195550 - DNA, 16 bp, P. troglodytes
acaatgaaaatattaa

SEQ ID NO: 195551 - DNA, 16 bp, P. troglodytes
acaatgaaattaaagc

SEQ ID NO: 195552 - DNA, 16 bp, P. troglodytes
acaatgaaccatttct

SEQ ID NO: 195553 - DNA, 16 bp, P. troglodytes
acaatgagaacatttg

SEQ ID NO: 195554 - DNA, 16 bp, P. troglodytes
acaatgagaaggcagc

SEQ ID NO: 195555 - DNA, 16 bp, P. troglodytes
acaatgaggaaactga

SEQ ID NO: 195556 - DNA, 16 bp, P. troglodytes
acaatgaggatgaaga

SEQ ID NO: 195557 - DNA, 16 bp, P. troglodytes
acaatgataaactgga

SEQ ID NO: 195558 - DNA, 16 bp, P. troglodytes
acaatgatcaaaatca

SEQ ID NO: 195559 - DNA, 16 bp, P. troglodytes
acaatgatgaataaaa

SEQ ID NO: 195560 - DNA, 16 bp, P. troglodytes
acaatgcacagaatgg

SEQ ID NO: 195561 - DNA, 16 bp, P. troglodytes
acaatgcacagcacag

SEQ ID NO: 195562 - DNA, 16 bp, P. troglodytes
acaatgcctgggaaag

SEQ ID NO: 195563 - DNA, 16 bp, P. troglodytes
acaatgctgcaatgaa

SEQ ID NO: 195564 - DNA, 16 bp, P. troglodytes
acaatgctttcttctg

SEQ ID NO: 195565 - DNA, 16 bp, P. troglodytes
acaatggaatattatt

SEQ ID NO: 195566 - DNA, 16 bp, P. troglodytes
acaatggcaacaaaaa

SEQ ID NO: 195567 - DNA, 16 bp, P. troglodytes
acaatggccaagattt

SEQ ID NO: 195568 - DNA, 16 bp, P. troglodytes
acaatggctttttttt

SEQ ID NO: 195569 - DNA, 16 bp, P. troglodytes
acaatggtgccaagaa

SEQ ID NO: 195570 - DNA, 16 bp, P. troglodytes
acaatggtggaactag

SEQ ID NO: 195571 - DNA, 16 bp, P. troglodytes
acaatggtgggacagg

SEQ ID NO: 195572 - DNA, 16 bp, P. troglodytes
acaatggtggtacagg

SEQ ID NO: 195573 - DNA, 16 bp, P. troglodytes
acaatggttaaactag

SEQ ID NO: 195574 - DNA, 16 bp, P. troglodytes
acaatgtaaatatata

SEQ ID NO: 195575 - DNA, 16 bp, P. troglodytes
acaatgtcttccacaa

SEQ ID NO: 195576 - DNA, 16 bp, P. troglodytes
acaatgtcttcttctg

SEQ ID NO: 195577 - DNA, 16 bp, P. troglodytes
acaatgtgatatttta

SEQ ID NO: 195578 - DNA, 16 bp, P. troglodytes
acaatgtgctgggatt

SEQ ID NO: 195579 - DNA, 16 bp, P. troglodytes
acaatgttaaatattt

SEQ ID NO: 195580 - DNA, 16 bp, P. troglodytes
acaatgttcactgttt

SEQ ID NO: 195581 - DNA, 16 bp, P. troglodytes
acaatgtttcctgtat

SEQ ID NO: 195582 - DNA, 16 bp, P. troglodytes
acaatgttttctttct

SEQ ID NO: 195583 - DNA, 16 bp, P. troglodytes
acaattaattttagaa

SEQ ID NO: 195584 - DNA, 16 bp, P. troglodytes
acaattactatgtgtc

SEQ ID NO: 195585 - DNA, 16 bp, P. troglodytes
acaattattttctttc

SEQ ID NO: 195586 - DNA, 16 bp, P. troglodytes
acaattcctatcaaaa

SEQ ID NO: 195587 - DNA, 16 bp, P. troglodytes
acaattctggagactg

SEQ ID NO: 195588 - DNA, 16 bp, P. troglodytes
acaattcttcttccaa

SEQ ID NO: 195589 - DNA, 16 bp, P. troglodytes
acaattctttgttgtg

SEQ ID NO: 195590 - DNA, 16 bp, P. troglodytes
acaattctttttcttc

SEQ ID NO: 195591 - DNA, 16 bp, P. troglodytes
acaattgctttgctga

SEQ ID NO: 195592 - DNA, 16 bp, P. troglodytes
acaattgcttttgagg

SEQ ID NO: 195593 - DNA, 16 bp, P. troglodytes
acaattggaaaatgaa

SEQ ID NO: 195594 - DNA, 16 bp, P. troglodytes
acaatttacaatagca

SEQ ID NO: 195595 - DNA, 16 bp, P. troglodytes
acaatttacctttttt

SEQ ID NO: 195596 - DNA, 16 bp, P. troglodytes
acaatttagcccataa

SEQ ID NO: 195597 - DNA, 18 bp, P. troglodytes
acaatttatgtttagaga

SEQ ID NO: 195598 - DNA, 16 bp, P. troglodytes
acaatttatttatcca

SEQ ID NO: 195599 - DNA, 16 bp, P. troglodytes
acaatttcagctcact

SEQ ID NO: 195600 - DNA, 16 bp, P. troglodytes
acaatttgaaaataat

SEQ ID NO: 195601 - DNA, 16 bp, P. troglodytes
acaatttgaaatgaga

SEQ ID NO: 195602 - DNA, 16 bp, P. troglodytes
acaatttgttatgttt

SEQ ID NO: 195603 - DNA, 16 bp, P. troglodytes
acaatttgtttatgca

SEQ ID NO: 195604 - DNA, 16 bp, P. troglodytes
acaattttaaaagatg

SEQ ID NO: 195605 - DNA, 16 bp, P. troglodytes
acaattttaaaatgtt

SEQ ID NO: 195606 - DNA, 16 bp, P. troglodytes
acaattttaagaaaat

SEQ ID NO: 195607 - DNA, 16 bp, P. troglodytes
acaattttgaaaagaa

SEQ ID NO: 195608 - DNA, 16 bp, P. troglodytes
acaatttttaaaagta

SEQ ID NO: 195609 - DNA, 16 bp, P. troglodytes
acaatttttagaaatt

SEQ ID NO: 195610 - DNA, 16 bp, P. troglodytes
acaatttttatttgta

SEQ ID NO: 195611 - DNA, 16 bp, P. troglodytes
acaatttttccatgga

SEQ ID NO: 195612 - DNA, 16 bp, P. troglodytes
acaatttttgaaaatt

SEQ ID NO: 195613 - DNA, 16 bp, P. troglodytes
acaattttttgtattt

SEQ ID NO: 195614 - DNA, 16 bp, P. troglodytes
acacaaaaagcatgaa

SEQ ID NO: 195615 - DNA, 16 bp, P. troglodytes
acacaaaaatcagttg

SEQ ID NO: 195616 - DNA, 16 bp, P. troglodytes
acacaaacaaatggaa

SEQ ID NO: 195617 - DNA, 16 bp, P. troglodytes
acacaaacaattggaa

SEQ ID NO: 195618 - DNA, 16 bp, P. troglodytes
acacaaacacatttat

SEQ ID NO: 195619 - DNA, 16 bp, P. troglodytes
acacaaacatgcatgc

SEQ ID NO: 195620 - DNA, 16 bp, P. troglodytes
acacaaacctagatga

SEQ ID NO: 195621 - DNA, 16 bp, P. troglodytes
acacaaagaaaatatt

SEQ ID NO: 195622 - DNA, 16 bp, P. troglodytes
acacaaagagtgaggt

SEQ ID NO: 195623 - DNA, 16 bp, P. troglodytes
acacaaagatgaacaa

SEQ ID NO: 195624 - DNA, 16 bp, P. troglodytes
acacaaagccagagag

SEQ ID NO: 195625 - DNA, 16 bp, P. troglodytes
acacaaagctggagag

SEQ ID NO: 195626 - DNA, 16 bp, P. troglodytes
acacaaataaatggaa

SEQ ID NO: 195627 - DNA, 16 bp, P. troglodytes
acacaaatgcatatct

SEQ ID NO: 195628 - DNA, 16 bp, P. troglodytes
acacaaatttaaaatg

SEQ ID NO: 195629 - DNA, 16 bp, P. troglodytes
acacaacagaatatta

SEQ ID NO: 195630 - DNA, 16 bp, P. troglodytes
acacaagaaagaattt

SEQ ID NO: 195631 - DNA, 16 bp, P. troglodytes
acacaagcaaaaattg

SEQ ID NO: 195632 - DNA, 16 bp, P. troglodytes
acacaagcacatgcac

SEQ ID NO: 195633 - DNA, 16 bp, P. troglodytes
acacaagcgcacacac

SEQ ID NO: 195634 - DNA, 17 bp, P. troglodytes
acacaaggcaaatggtt

SEQ ID NO: 195635 - DNA, 16 bp, P. troglodytes
acacaataaaaactga

SEQ ID NO: 195636 - DNA, 16 bp, P. troglodytes
acacaatagagtacta

SEQ ID NO: 195637 - DNA, 16 bp, P. troglodytes
acacaatctcagctca

SEQ ID NO: 195638 - DNA, 16 bp, P. troglodytes
acacaattattatttg

SEQ ID NO: 195639 - DNA, 16 bp, P. troglodytes
acacaattcaatccat

SEQ ID NO: 195640 - DNA, 16 bp, P. troglodytes
acacaattgcactcca

SEQ ID NO: 195641 - DNA, 16 bp, P. troglodytes
acacacaaaaaattag

SEQ ID NO: 195642 - DNA, 16 bp, P. troglodytes
acacacaaaaaatttt

SEQ ID NO: 195643 - DNA, 16 bp, P. troglodytes
acacacaaaagaatga

SEQ ID NO: 195644 - DNA, 16 bp, P. troglodytes
acacacaaacacatgc

SEQ ID NO: 195645 - DNA, 16 bp, P. troglodytes
acacacaatgcacaca

SEQ ID NO: 195646 - DNA, 16 bp, P. troglodytes
acacacacaaaaggta

SEQ ID NO: 195647 - DNA, 16 bp, P. troglodytes
acacacacaaaatgga

SEQ ID NO: 195648 - DNA, 16 bp, P. troglodytes
acacacacaaatgagt

SEQ ID NO: 195649 - DNA, 16 bp, P. troglodytes
acacacacaaattcag

SEQ ID NO: 195650 - DNA, 16 bp, P. troglodytes
acacacacaaattttt

SEQ ID NO: 195651 - DNA, 16 bp, P. troglodytes
acacacacaacagaat

SEQ ID NO: 195652 - DNA, 16 bp, P. troglodytes
acacacacacaaatga

SEQ ID NO: 195653 - DNA, 16 bp, P. troglodytes
acacacacacaaattt

SEQ ID NO: 195654 - DNA, 16 bp, P. troglodytes
acacacacacaatgga

SEQ ID NO: 195655 - DNA, 16 bp, P. troglodytes
acacacacacacagat

SEQ ID NO: 195656 - DNA, 16 bp, P. troglodytes
acacacacacacagtt

SEQ ID NO: 195657 - DNA, 16 bp, P. troglodytes
acacacacacacatct

SEQ ID NO: 195658 - DNA, 16 bp, P. troglodytes
acacacacacacatga

SEQ ID NO: 195659 - DNA, 16 bp, P. troglodytes
acacacacacacatgc

SEQ ID NO: 195660 - DNA, 16 bp, P. troglodytes
acacacacacacattg

SEQ ID NO: 195661 - DNA, 16 bp, P. troglodytes
acacacacacacctct

SEQ ID NO: 195662 - DNA, 16 bp, P. troglodytes
acacacacacacgcat

SEQ ID NO: 195663 - DNA, 16 bp, P. troglodytes
acacacacacactcct

SEQ ID NO: 195664 - DNA, 16 bp, P. troglodytes
acacacacacactctc

SEQ ID NO: 195665 - DNA, 16 bp, P. troglodytes
acacacacacacttat

SEQ ID NO: 195666 - DNA, 16 bp, P. troglodytes
acacacacacacttga

SEQ ID NO: 195667 - DNA, 16 bp, P. troglodytes
acacacacacagacat

SEQ ID NO: 195668 - DNA, 16 bp, P. troglodytes
acacacacacagagta

SEQ ID NO: 195669 - DNA, 16 bp, P. troglodytes
acacacacacagatac

SEQ ID NO: 195670 - DNA, 16 bp, P. troglodytes
acacacacacagccat

SEQ ID NO: 195671 - DNA, 16 bp, P. troglodytes
acacacacacagctaa

SEQ ID NO: 195672 - DNA, 16 bp, P. troglodytes
acacacacacagctgt

SEQ ID NO: 195673 - DNA, 16 bp, P. troglodytes
acacacacacaggtac

SEQ ID NO: 195674 - DNA, 16 bp, P. troglodytes
acacacacacagtagc

SEQ ID NO: 195675 - DNA, 16 bp, P. troglodytes
acacacacacatactc

SEQ ID NO: 195676 - DNA, 16 bp, P. troglodytes
acacacacacatatgc

SEQ ID NO: 195677 - DNA, 16 bp, P. troglodytes
acacacacacatattt

SEQ ID NO: 195678 - DNA, 16 bp, P. troglodytes
acacacacacatcaga

SEQ ID NO: 195679 - DNA, 16 bp, P. troglodytes
acacacacacatcttt

SEQ ID NO: 195680 - DNA, 16 bp, P. troglodytes
acacacacacatttgt

SEQ ID NO: 195681 - DNA, 16 bp, P. troglodytes
acacacacacccctga

SEQ ID NO: 195682 - DNA, 16 bp, P. troglodytes
acacacacacgcacat

SEQ ID NO: 195683 - DNA, 16 bp, P. troglodytes
acacacacacgcacgc

SEQ ID NO: 195684 - DNA, 16 bp, P. troglodytes
acacacacacgtatac

SEQ ID NO: 195685 - DNA, 16 bp, P. troglodytes
acacacacacgttttt

SEQ ID NO: 195686 - DNA, 16 bp, P. troglodytes
acacacacactccata

SEQ ID NO: 195687 - DNA, 16 bp, P. troglodytes
acacacacactcctaa

SEQ ID NO: 195688 - DNA, 16 bp, P. troglodytes
acacacacactcctac

SEQ ID NO: 195689 - DNA, 16 bp, P. troglodytes
acacacacactcctct

SEQ ID NO: 195690 - DNA, 16 bp, P. troglodytes
acacacacactctctc

SEQ ID NO: 195691 - DNA, 16 bp, P. troglodytes
acacacacactgcaga

SEQ ID NO: 195692 - DNA, 16 bp, P. troglodytes
acacacacactgcctg

SEQ ID NO: 195693 - DNA, 16 bp, P. troglodytes
acacacacactggaat

SEQ ID NO: 195694 - DNA, 16 bp, P. troglodytes
acacacacactttttt

SEQ ID NO: 195695 - DNA, 16 bp, P. troglodytes
acacacacagagagaa

SEQ ID NO: 195696 - DNA, 16 bp, P. troglodytes
acacacacagagagga

SEQ ID NO: 195697 - DNA, 16 bp, P. troglodytes
acacacacagagccac

SEQ ID NO: 195698 - DNA, 16 bp, P. troglodytes
acacacacagaggaga

SEQ ID NO: 195699 - DNA, 16 bp, P. troglodytes
acacacacagagtcaa

SEQ ID NO: 195700 - DNA, 16 bp, P. troglodytes
acacacacatacactc

SEQ ID NO: 195701 - DNA, 16 bp, P. troglodytes
acacacacatacagga

SEQ ID NO: 195702 - DNA, 16 bp, P. troglodytes
acacacacatagacca

SEQ ID NO: 195703 - DNA, 16 bp, P. troglodytes
acacacacatagatat

SEQ ID NO: 195704 - DNA, 16 bp, P. troglodytes
acacacacatatacac

SEQ ID NO: 195705 - DNA, 16 bp, P. troglodytes
acacacacatatatga

SEQ ID NO: 195706 - DNA, 16 bp, P. troglodytes
acacacacatatgtag

SEQ ID NO: 195707 - DNA, 16 bp, P. troglodytes
acacacacatcacata

SEQ ID NO: 195708 - DNA, 16 bp, P. troglodytes
acacacacatgcaatt

SEQ ID NO: 195709 - DNA, 16 bp, P. troglodytes
acacacacattcacat

SEQ ID NO: 195710 - DNA, 16 bp, P. troglodytes
acacacaccatatata

SEQ ID NO: 195711 - DNA, 16 bp, P. troglodytes
acacacacctgcacat

SEQ ID NO: 195712 - DNA, 16 bp, P. troglodytes
acacacacgcacacag

SEQ ID NO: 195713 - DNA, 16 bp, P. troglodytes
acacacacgtgcgcac

SEQ ID NO: 195714 - DNA, 16 bp, P. troglodytes
acacacactcacacag

SEQ ID NO: 195715 - DNA, 16 bp, P. troglodytes
acacacactcacacat

SEQ ID NO: 195716 - DNA, 16 bp, P. troglodytes
acacacactcacagac

SEQ ID NO: 195717 - DNA, 16 bp, P. troglodytes
acacacactctcacac

SEQ ID NO: 195718 - DNA, 18 bp, P. troglodytes
acacacactctctctctc

SEQ ID NO: 195719 - DNA, 16 bp, P. troglodytes
acacacactctctctt

SEQ ID NO: 195720 - DNA, 16 bp, P. troglodytes
acacacactctgtctc

SEQ ID NO: 195721 - DNA, 16 bp, P. troglodytes
acacacactggggaaa

SEQ ID NO: 195722 - DNA, 17 bp, P. troglodytes
acacacactggggcctg

SEQ ID NO: 195723 - DNA, 16 bp, P. troglodytes
acacacacttgcacat

SEQ ID NO: 195724 - DNA, 16 bp, P. troglodytes
acacacagaatttctt

SEQ ID NO: 195725 - DNA, 16 bp, P. troglodytes
acacacagagacagac

SEQ ID NO: 195726 - DNA, 16 bp, P. troglodytes
acacacagaggaaaga

SEQ ID NO: 195727 - DNA, 16 bp, P. troglodytes
acacacagaggagaag

SEQ ID NO: 195728 - DNA, 16 bp, P. troglodytes
acacacagggaagaag

SEQ ID NO: 195729 - DNA, 16 bp, P. troglodytes
acacacataatatata

SEQ ID NO: 195730 - DNA, 16 bp, P. troglodytes
acacacatacacacag

SEQ ID NO: 195731 - DNA, 16 bp, P. troglodytes
acacacatacacatac

SEQ ID NO: 195732 - DNA, 16 bp, P. troglodytes
acacacatacatacat

SEQ ID NO: 195733 - DNA, 16 bp, P. troglodytes
acacacatacatttta

SEQ ID NO: 195734 - DNA, 16 bp, P. troglodytes
acacacatactcacat

SEQ ID NO: 195735 - DNA, 16 bp, P. troglodytes
acacacatataaacat

SEQ ID NO: 195736 - DNA, 16 bp, P. troglodytes
acacacatatacttat

SEQ ID NO: 195737 - DNA, 16 bp, P. troglodytes
acacacatatatatac

SEQ ID NO: 195738 - DNA, 16 bp, P. troglodytes
acacacatatatatat

SEQ ID NO: 195739 - DNA, 16 bp, P. troglodytes
acacacatatatatca

SEQ ID NO: 195740 - DNA, 16 bp, P. troglodytes
acacacatatatgtat

SEQ ID NO: 195741 - DNA, 16 bp, P. troglodytes
acacacatatatgttt

SEQ ID NO: 195742 - DNA, 16 bp, P. troglodytes
acacacatatgtgtgt

SEQ ID NO: 195743 - DNA, 16 bp, P. troglodytes
acacacatgcaaacat

SEQ ID NO: 195744 - DNA, 22 bp, P. troglodytes
acacacatgcacacacacacac

SEQ ID NO: 195745 - DNA, 16 bp, P. troglodytes
acacacatgcatacat

SEQ ID NO: 195746 - DNA, 16 bp, P. troglodytes
acacacatgtacatgc

SEQ ID NO: 195747 - DNA, 16 bp, P. troglodytes
acacacatgtatatat

SEQ ID NO: 195748 - DNA, 16 bp, P. troglodytes
acacacattcacacac

SEQ ID NO: 195749 - DNA, 16 bp, P. troglodytes
acacacattttctttt

SEQ ID NO: 195750 - DNA, 17 bp, P. troglodytes
acacaccatctttaaga

SEQ ID NO: 195751 - DNA, 16 bp, P. troglodytes
acacacccacacatgc

SEQ ID NO: 195752 - DNA, 20 bp, P. troglodytes
acacacccagctaatttttg

SEQ ID NO: 195753 - DNA, 16 bp, P. troglodytes
acacacccagttaatt

SEQ ID NO: 195754 - DNA, 16 bp, P. troglodytes
acacacccggctaatt

SEQ ID NO: 195755 - DNA, 16 bp, P. troglodytes
acacaccctgggccag

SEQ ID NO: 195756 - DNA, 16 bp, P. troglodytes
acacacctacagtgaa

SEQ ID NO: 195757 - DNA, 16 bp, P. troglodytes
acacacctaggctatg

SEQ ID NO: 195758 - DNA, 16 bp, P. troglodytes
acacacctgtagtctc

SEQ ID NO: 195759 - DNA, 16 bp, P. troglodytes
acacacgcacacacat

SEQ ID NO: 195760 - DNA, 16 bp, P. troglodytes
acacacgcacacatat

SEQ ID NO: 195761 - DNA, 16 bp, P. troglodytes
acacacgcacgcacac

SEQ ID NO: 195762 - DNA, 16 bp, P. troglodytes
acacacgcacgcacgc

SEQ ID NO: 195763 - DNA, 16 bp, P. troglodytes
acacacgcagacacac

SEQ ID NO: 195764 - DNA, 16 bp, P. troglodytes
acacacgtacacacat

SEQ ID NO: 195765 - DNA, 16 bp, P. troglodytes
acacacgtacatacat

SEQ ID NO: 195766 - DNA, 16 bp, P. troglodytes
acacactcacacacat

SEQ ID NO: 195767 - DNA, 16 bp, P. troglodytes
acacactcacactctc

SEQ ID NO: 195768 - DNA, 16 bp, P. troglodytes
acacactgaaatattt

SEQ ID NO: 195769 - DNA, 16 bp, P. troglodytes
acacactgggtggctt

SEQ ID NO: 195770 - DNA, 16 bp, P. troglodytes
acacacttagaaaaat

SEQ ID NO: 195771 - DNA, 16 bp, P. troglodytes
acacactttaaaccaa

SEQ ID NO: 195772 - DNA, 16 bp, P. troglodytes
acacactttctttttt

SEQ ID NO: 195773 - DNA, 16 bp, P. troglodytes
acacagaaaactacaa

SEQ ID NO: 195774 - DNA, 16 bp, P. troglodytes
acacagaaaatcaaca

SEQ ID NO: 195775 - DNA, 16 bp, P. troglodytes
acacagaaatggaaaa

SEQ ID NO: 195776 - DNA, 16 bp, P. troglodytes
acacagaacaatggaa

SEQ ID NO: 195777 - DNA, 16 bp, P. troglodytes
acacagaacatattct

SEQ ID NO: 195778 - DNA, 28 bp, P. troglodytes
acacagaagatgggtgatttctgcattt

SEQ ID NO: 195779 - DNA, 16 bp, P. troglodytes
acacagaagtggaatt

SEQ ID NO: 195780 - DNA, 16 bp, P. troglodytes
acacagaatttcatat

SEQ ID NO: 195781 - DNA, 16 bp, P. troglodytes
acacagacaaatggaa

SEQ ID NO: 195782 - DNA, 16 bp, P. troglodytes
acacagacacacacat

SEQ ID NO: 195783 - DNA, 16 bp, P. troglodytes
acacagacacagcaac

SEQ ID NO: 195784 - DNA, 16 bp, P. troglodytes
acacagaccagtggaa

SEQ ID NO: 195785 - DNA, 16 bp, P. troglodytes
acacagagaaacccca

SEQ ID NO: 195786 - DNA, 16 bp, P. troglodytes
acacagagacagacac

SEQ ID NO: 195787 - DNA, 16 bp, P. troglodytes
acacagagagacccca

SEQ ID NO: 195788 - DNA, 16 bp, P. troglodytes
acacagaggaaaggcc

SEQ ID NO: 195789 - DNA, 16 bp, P. troglodytes
acacagagggaagaca

SEQ ID NO: 195790 - DNA, 16 bp, P. troglodytes
acacagataaatggaa

SEQ ID NO: 195791 - DNA, 16 bp, P. troglodytes
acacagataatttttt

SEQ ID NO: 195792 - DNA, 16 bp, P. troglodytes
acacagatgaatcttg

SEQ ID NO: 195793 - DNA, 16 bp, P. troglodytes
acacagatgtacacac

SEQ ID NO: 195794 - DNA, 16 bp, P. troglodytes
acacagattctcctct

SEQ ID NO: 195795 - DNA, 16 bp, P. troglodytes
acacagattgctgggc

SEQ ID NO: 195796 - DNA, 16 bp, P. troglodytes
acacagatttttaaaa

SEQ ID NO: 195797 - DNA, 16 bp, P. troglodytes
acacagcaagaaagcc

SEQ ID NO: 195798 - DNA, 16 bp, P. troglodytes
acacagcaagaaagtg

SEQ ID NO: 195799 - DNA, 16 bp, P. troglodytes
acacagcaagaaggtg

SEQ ID NO: 195800 - DNA, 16 bp, P. troglodytes
acacagcagccagaga

SEQ ID NO: 195801 - DNA, 16 bp, P. troglodytes
acacagcaggtgctca

SEQ ID NO: 195802 - DNA, 17 bp, P. troglodytes
acacagccaaaccatat

SEQ ID NO: 195803 - DNA, 16 bp, P. troglodytes
acacagccagaccctg

SEQ ID NO: 195804 - DNA, 16 bp, P. troglodytes
acacagccaggcacac

SEQ ID NO: 195805 - DNA, 16 bp, P. troglodytes
acacagccagtaaatg

SEQ ID NO: 195806 - DNA, 16 bp, P. troglodytes
acacagccatgcccat

SEQ ID NO: 195807 - DNA, 16 bp, P. troglodytes
acacagcgagaccctg

SEQ ID NO: 195808 - DNA, 16 bp, P. troglodytes
acacagctaataagta

SEQ ID NO: 195809 - DNA, 16 bp, P. troglodytes
acacagctagaaggtg

SEQ ID NO: 195810 - DNA, 16 bp, P. troglodytes
acacagctagtgagtg

SEQ ID NO: 195811 - DNA, 16 bp, P. troglodytes
acacagctgaaagaaa

SEQ ID NO: 195812 - DNA, 16 bp, P. troglodytes
acacaggaacagaata

SEQ ID NO: 195813 - DNA, 16 bp, P. troglodytes
acacaggaagaaggca

SEQ ID NO: 195814 - DNA, 16 bp, P. troglodytes
acacaggaggtgctca

SEQ ID NO: 195815 - DNA, 16 bp, P. troglodytes
acacaggcactcacac

SEQ ID NO: 195816 - DNA, 16 bp, P. troglodytes
acacagggagaccttg

SEQ ID NO: 195817 - DNA, 16 bp, P. troglodytes
acacagggccagaaat

SEQ ID NO: 195818 - DNA, 16 bp, P. troglodytes
acacagggcctggcac

SEQ ID NO: 195819 - DNA, 16 bp, P. troglodytes
acacagggtctcattc

SEQ ID NO: 195820 - DNA, 16 bp, P. troglodytes
acacagggtttcactc

SEQ ID NO: 195821 - DNA, 16 bp, P. troglodytes
acacagtaggcactca

SEQ ID NO: 195822 - DNA, 16 bp, P. troglodytes
acacagtcaaaccaca

SEQ ID NO: 195823 - DNA, 16 bp, P. troglodytes
acacagtcaaatcata

SEQ ID NO: 195824 - DNA, 16 bp, P. troglodytes
acacagtccctgccct

SEQ ID NO: 195825 - DNA, 16 bp, P. troglodytes
acacagtgagaacctg

SEQ ID NO: 195826 - DNA, 16 bp, P. troglodytes
acacagtgcaatcaaa

SEQ ID NO: 195827 - DNA, 16 bp, P. troglodytes
acacagtggtatttgt

SEQ ID NO: 195828 - DNA, 16 bp, P. troglodytes
acacagttgacccttg

SEQ ID NO: 195829 - DNA, 16 bp, P. troglodytes
acacagttttatttct

SEQ ID NO: 195830 - DNA, 16 bp, P. troglodytes
acacagttttgccatg

SEQ ID NO: 195831 - DNA, 16 bp, P. troglodytes
acacataaaacttacc

SEQ ID NO: 195832 - DNA, 16 bp, P. troglodytes
acacatacacaggcat

SEQ ID NO: 195833 - DNA, 16 bp, P. troglodytes
acacatacaggcacac

SEQ ID NO: 195834 - DNA, 16 bp, P. troglodytes
acacatacatatatac

SEQ ID NO: 195835 - DNA, 16 bp, P. troglodytes
acacatacatatatgt

SEQ ID NO: 195836 - DNA, 16 bp, P. troglodytes
acacatacatatgtat

SEQ ID NO: 195837 - DNA, 16 bp, P. troglodytes
acacatacatgcacaa

SEQ ID NO: 195838 - DNA, 16 bp, P. troglodytes
acacatacatgcacat

SEQ ID NO: 195839 - DNA, 16 bp, P. troglodytes
acacatacatgcatat

SEQ ID NO: 195840 - DNA, 16 bp, P. troglodytes
acacataccatggaat

SEQ ID NO: 195841 - DNA, 16 bp, P. troglodytes
acacatatacacatat

SEQ ID NO: 195842 - DNA, 16 bp, P. troglodytes
acacatatacacatgt

SEQ ID NO: 195843 - DNA, 16 bp, P. troglodytes
acacatatacgcacac

SEQ ID NO: 195844 - DNA, 16 bp, P. troglodytes
acacatatatacacat

SEQ ID NO: 195845 - DNA, 16 bp, P. troglodytes
acacatatatttatat

SEQ ID NO: 195846 - DNA, 16 bp, P. troglodytes
acacatatgcacacat

SEQ ID NO: 195847 - DNA, 16 bp, P. troglodytes
acacatatgtatacac

SEQ ID NO: 195848 - DNA, 16 bp, P. troglodytes
acacatatttaaattt

SEQ ID NO: 195849 - DNA, 16 bp, P. troglodytes
acacatatttatattt

SEQ ID NO: 195850 - DNA, 16 bp, P. troglodytes
acacatattttgtata

SEQ ID NO: 195851 - DNA, 16 bp, P. troglodytes
acacatcattatcatc

SEQ ID NO: 195852 - DNA, 16 bp, P. troglodytes
acacatcctcactggg

SEQ ID NO: 195853 - DNA, 16 bp, P. troglodytes
acacatcctcctgtat

SEQ ID NO: 195854 - DNA, 16 bp, P. troglodytes
acacatgaaaaaatac

SEQ ID NO: 195855 - DNA, 16 bp, P. troglodytes
acacatgaatgtgtat

SEQ ID NO: 195856 - DNA, 16 bp, P. troglodytes
acacatgaggaaacag

SEQ ID NO: 195857 - DNA, 16 bp, P. troglodytes
acacatgcacacgaat

SEQ ID NO: 195858 - DNA, 16 bp, P. troglodytes
acacatgcacagcctc

SEQ ID NO: 195859 - DNA, 16 bp, P. troglodytes
acacatgcagacacac

SEQ ID NO: 195860 - DNA, 16 bp, P. troglodytes
acacatgcaggatgtg

SEQ ID NO: 195861 - DNA, 16 bp, P. troglodytes
acacatgcatatatat

SEQ ID NO: 195862 - DNA, 16 bp, P. troglodytes
acacatgcatgcatat

SEQ ID NO: 195863 - DNA, 16 bp, P. troglodytes
acacatgcatgtgtct

SEQ ID NO: 195864 - DNA, 16 bp, P. troglodytes
acacatggaaatgaaa

SEQ ID NO: 195865 - DNA, 16 bp, P. troglodytes
acacatggacacaaag

SEQ ID NO: 195866 - DNA, 16 bp, P. troglodytes
acacatggacacacat

SEQ ID NO: 195867 - DNA, 16 bp, P. troglodytes
acacatggacacaggt

SEQ ID NO: 195868 - DNA, 16 bp, P. troglodytes
acacatgtaccccaga

SEQ ID NO: 195869 - DNA, 16 bp, P. troglodytes
acacatgtgcacacag

SEQ ID NO: 195870 - DNA, 16 bp, P. troglodytes
acacatgtgtacatgt

SEQ ID NO: 195871 - DNA, 16 bp, P. troglodytes
acacatgtgtgtatat

SEQ ID NO: 195872 - DNA, 16 bp, P. troglodytes
acacatgttttcattt

SEQ ID NO: 195873 - DNA, 16 bp, P. troglodytes
acacattagcctaggt

SEQ ID NO: 195874 - DNA, 16 bp, P. troglodytes
acacattattttcaaa

SEQ ID NO: 195875 - DNA, 16 bp, P. troglodytes
acacattatttttaaa

SEQ ID NO: 195876 - DNA, 16 bp, P. troglodytes
acacattcacatacac

SEQ ID NO: 195877 - DNA, 16 bp, P. troglodytes
acacattgcaaagcag

SEQ ID NO: 195878 - DNA, 16 bp, P. troglodytes
acacatttaaaacatt

SEQ ID NO: 195879 - DNA, 16 bp, P. troglodytes
acacatttattatctt

SEQ ID NO: 195880 - DNA, 16 bp, P. troglodytes
acacatttatttttct

SEQ ID NO: 195881 - DNA, 16 bp, P. troglodytes
acacattttaaaattt

SEQ ID NO: 195882 - DNA, 16 bp, P. troglodytes
acacattttaaagaaa

SEQ ID NO: 195883 - DNA, 16 bp, P. troglodytes
acacattttaattaaa

SEQ ID NO: 195884 - DNA, 16 bp, P. troglodytes
acacattttatttctt

SEQ ID NO: 195885 - DNA, 16 bp, P. troglodytes
acacatttttaaaata

SEQ ID NO: 195886 - DNA, 16 bp, P. troglodytes
acacatttttaaatga

SEQ ID NO: 195887 - DNA, 16 bp, P. troglodytes
acacatttttcaaaag

SEQ ID NO: 195888 - DNA, 16 bp, P. troglodytes
acacatttttcttaaa

SEQ ID NO: 195889 - DNA, 16 bp, P. troglodytes
acacatttttctttct

SEQ ID NO: 195890 - DNA, 16 bp, P. troglodytes
acacattttttaaaaa

SEQ ID NO: 195891 - DNA, 16 bp, P. troglodytes
acacattttttaaatg

SEQ ID NO: 195892 - DNA, 16 bp, P. troglodytes
acacatttttttaaaa

SEQ ID NO: 195893 - DNA, 16 bp, P. troglodytes
acacatttttttcatt

SEQ ID NO: 195894 - DNA, 16 bp, P. troglodytes
acaccaaaaatggaaa

SEQ ID NO: 195895 - DNA, 16 bp, P. troglodytes
acaccaaaagcagtgg

SEQ ID NO: 195896 - DNA, 16 bp, P. troglodytes
acaccaaaatcaatgg

SEQ ID NO: 195897 - DNA, 16 bp, P. troglodytes
acaccaaagttctgag

SEQ ID NO: 195898 - DNA, 16 bp, P. troglodytes
acaccaacctgggtga

SEQ ID NO: 195899 - DNA, 16 bp, P. troglodytes
acaccaagtcctgcta

SEQ ID NO: 195900 - DNA, 16 bp, P. troglodytes
acaccacatttccctt

SEQ ID NO: 195901 - DNA, 16 bp, P. troglodytes
acaccacattttcctt

SEQ ID NO: 195902 - DNA, 16 bp, P. troglodytes
acaccacattttcttt

SEQ ID NO: 195903 - DNA, 16 bp, P. troglodytes
acaccaccacccctgg

SEQ ID NO: 195904 - DNA, 16 bp, P. troglodytes
acaccacctattcccc

SEQ ID NO: 195905 - DNA, 16 bp, P. troglodytes
acaccactgcacttca

SEQ ID NO: 195906 - DNA, 16 bp, P. troglodytes
acaccactgccttcca

SEQ ID NO: 195907 - DNA, 16 bp, P. troglodytes
acaccagagagctctc

SEQ ID NO: 195908 - DNA, 16 bp, P. troglodytes
acaccagcctgaccaa

SEQ ID NO: 195909 - DNA, 16 bp, P. troglodytes
acaccagcctggccaa

SEQ ID NO: 195910 - DNA, 16 bp, P. troglodytes
acaccagcctgggcaa

SEQ ID NO: 195911 - DNA, 16 bp, P. troglodytes
acaccagcctgggcca

SEQ ID NO: 195912 - DNA, 16 bp, P. troglodytes
acaccagcctgtgcaa

SEQ ID NO: 195913 - DNA, 16 bp, P. troglodytes
acaccagggatgcagg

SEQ ID NO: 195914 - DNA, 16 bp, P. troglodytes
acaccataaactgggt

SEQ ID NO: 195915 - DNA, 16 bp, P. troglodytes
acaccatatatgaaaa

SEQ ID NO: 195916 - DNA, 16 bp, P. troglodytes
acaccatattaataga

SEQ ID NO: 195917 - DNA, 16 bp, P. troglodytes
acaccatctcagctca

SEQ ID NO: 195918 - DNA, 16 bp, P. troglodytes
acaccatgaaacccca

SEQ ID NO: 195919 - DNA, 16 bp, P. troglodytes
acaccatgaccaagtg

SEQ ID NO: 195920 - DNA, 16 bp, P. troglodytes
acaccatgtagaagct

SEQ ID NO: 195921 - DNA, 16 bp, P. troglodytes
acaccattcactccag

SEQ ID NO: 195922 - DNA, 16 bp, P. troglodytes
acacccaactaatttt

SEQ ID NO: 195923 - DNA, 16 bp, P. troglodytes
acacccacacatatat

SEQ ID NO: 195924 - DNA, 16 bp, P. troglodytes
acacccacgtcaagcc

SEQ ID NO: 195925 - DNA, 16 bp, P. troglodytes
acacccagaaggaagg

SEQ ID NO: 195926 - DNA, 16 bp, P. troglodytes
acacccagataatttt

SEQ ID NO: 195927 - DNA, 16 bp, P. troglodytes
acacccagctaagttt

SEQ ID NO: 195928 - DNA, 16 bp, P. troglodytes
acacccatgacacagc

SEQ ID NO: 195929 - DNA, 16 bp, P. troglodytes
acacccatgtaaccac

SEQ ID NO: 195930 - DNA, 16 bp, P. troglodytes
acaccccagggcctgt

SEQ ID NO: 195931 - DNA, 16 bp, P. troglodytes
acaccccatgggacaa

SEQ ID NO: 195932 - DNA, 16 bp, P. troglodytes
acaccccggctaattt

SEQ ID NO: 195933 - DNA, 17 bp, P. troglodytes
acacccgcctcggcctc

SEQ ID NO: 195934 - DNA, 16 bp, P. troglodytes
acaccctcacagaaac

SEQ ID NO: 195935 - DNA, 16 bp, P. troglodytes
acaccctcttcaataa

SEQ ID NO: 195936 - DNA, 16 bp, P. troglodytes
acacccttttcaacaa

SEQ ID NO: 195937 - DNA, 16 bp, P. troglodytes
acaccgtggaatacta

SEQ ID NO: 195938 - DNA, 16 bp, P. troglodytes
acacctaagaaaatta

SEQ ID NO: 195939 - DNA, 16 bp, P. troglodytes
acacctacaacaatct

SEQ ID NO: 195940 - DNA, 16 bp, P. troglodytes
acacctaggctatatg

SEQ ID NO: 195941 - DNA, 16 bp, P. troglodytes
acacctataataccag

SEQ ID NO: 195942 - DNA, 16 bp, P. troglodytes
acacctcagcctcctg

SEQ ID NO: 195943 - DNA, 16 bp, P. troglodytes
acacctcctccaggaa

SEQ ID NO: 195944 - DNA, 19 bp, P. troglodytes
acacctgaggtcaggagtt

SEQ ID NO: 195945 - DNA, 16 bp, P. troglodytes
acacctgctctgtgcc

SEQ ID NO: 195946 - DNA, 16 bp, P. troglodytes
acacctggaattccag

SEQ ID NO: 195947 - DNA, 16 bp, P. troglodytes
acacctggataatttt

SEQ ID NO: 195948 - DNA, 16 bp, P. troglodytes
acacctggctaagttt

SEQ ID NO: 195949 - DNA, 16 bp, P. troglodytes
acacctggctaattct

SEQ ID NO: 195950 - DNA, 16 bp, P. troglodytes
acacctggctaatttt

SEQ ID NO: 195951 - DNA, 17 bp, P. troglodytes
acacctggctgattttt

SEQ ID NO: 195952 - DNA, 16 bp, P. troglodytes
acacctgtagtcccaa

SEQ ID NO: 195953 - DNA, 16 bp, P. troglodytes
acacctgtggtctcag

SEQ ID NO: 195954 - DNA, 16 bp, P. troglodytes
acacctgtgtaaccac

SEQ ID NO: 195955 - DNA, 21 bp, P. troglodytes
acacgatctcggctcactgca

SEQ ID NO: 195956 - DNA, 16 bp, P. troglodytes
acacgcacacacacag

SEQ ID NO: 195957 - DNA, 16 bp, P. troglodytes
acacgcacacacacat

SEQ ID NO: 195958 - DNA, 16 bp, P. troglodytes
acacgcatgcacacat

SEQ ID NO: 195959 - DNA, 18 bp, P. troglodytes
acacgccaccttaagagc

SEQ ID NO: 195960 - DNA, 16 bp, P. troglodytes
acacggtgagaccctg

SEQ ID NO: 195961 - DNA, 16 bp, P. troglodytes
acacgtacatatatat

SEQ ID NO: 195962 - DNA, 16 bp, P. troglodytes
acacgtgcaggatgtg

SEQ ID NO: 195963 - DNA, 16 bp, P. troglodytes
acacgtgtgcatgtgt

SEQ ID NO: 195964 - DNA, 16 bp, P. troglodytes
acacgtttacttatgt

SEQ ID NO: 195965 - DNA, 16 bp, P. troglodytes
acactactacactcca

SEQ ID NO: 195966 - DNA, 16 bp, P. troglodytes
acactactcaaagcaa

SEQ ID NO: 195967 - DNA, 16 bp, P. troglodytes
acactactcaggtgac

SEQ ID NO: 195968 - DNA, 16 bp, P. troglodytes
acactatctacctgga

SEQ ID NO: 195969 - DNA, 16 bp, P. troglodytes
acactatttattaaat

SEQ ID NO: 195970 - DNA, 16 bp, P. troglodytes
acactattttgtcttt

SEQ ID NO: 195971 - DNA, 16 bp, P. troglodytes
acactatttttaaatt

SEQ ID NO: 195972 - DNA, 16 bp, P. troglodytes
acactcaagcaatcct

SEQ ID NO: 195973 - DNA, 16 bp, P. troglodytes
acactcaataaatgtt

SEQ ID NO: 195974 - DNA, 16 bp, P. troglodytes
acactcatttgtttat

SEQ ID NO: 195975 - DNA, 16 bp, P. troglodytes
acactccagcctgagt

SEQ ID NO: 195976 - DNA, 16 bp, P. troglodytes
acactcctcagccctt

SEQ ID NO: 195977 - DNA, 16 bp, P. troglodytes
acactcctcatcttca

SEQ ID NO: 195978 - DNA, 16 bp, P. troglodytes
acactcctgattcacc

SEQ ID NO: 195979 - DNA, 16 bp, P. troglodytes
acactctgtcttaaaa

SEQ ID NO: 195980 - DNA, 16 bp, P. troglodytes
acactgaaaaataatt

SEQ ID NO: 195981 - DNA, 16 bp, P. troglodytes
acactgaaatacacag

SEQ ID NO: 195982 - DNA, 16 bp, P. troglodytes
acactgaattagcaaa

SEQ ID NO: 195983 - DNA, 16 bp, P. troglodytes
acactgaattagtgaa

SEQ ID NO: 195984 - DNA, 16 bp, P. troglodytes
acactgaggcccagag

SEQ ID NO: 195985 - DNA, 16 bp, P. troglodytes
acactgatgagaaaaa

SEQ ID NO: 195986 - DNA, 16 bp, P. troglodytes
acactgatgatgagga

SEQ ID NO: 195987 - DNA, 16 bp, P. troglodytes
acactgattttctttc

SEQ ID NO: 195988 - DNA, 16 bp, P. troglodytes
acactgatttttaaaa

SEQ ID NO: 195989 - DNA, 16 bp, P. troglodytes
acactgattttttttt

SEQ ID NO: 195990 - DNA, 16 bp, P. troglodytes
acactgctccctgcat

SEQ ID NO: 195991 - DNA, 16 bp, P. troglodytes
acactgctgacaaaga

SEQ ID NO: 195992 - DNA, 17 bp, P. troglodytes
acactgctttaaatgtg

SEQ ID NO: 195993 - DNA, 16 bp, P. troglodytes
acactggaagaattgt

SEQ ID NO: 195994 - DNA, 16 bp, P. troglodytes
acactggaatgcagtg

SEQ ID NO: 195995 - DNA, 16 bp, P. troglodytes
acactggatctgctgg

SEQ ID NO: 195996 - DNA, 16 bp, P. troglodytes
acactggggagggcaa

SEQ ID NO: 195997 - DNA, 16 bp, P. troglodytes
acactggggcctgcca

SEQ ID NO: 195998 - DNA, 16 bp, P. troglodytes
acactgggggaaaaaa

SEQ ID NO: 195999 - DNA, 16 bp, P. troglodytes
acactggtcatattgg

SEQ ID NO: 196000 - DNA, 16 bp, P. troglodytes
acactgtctctttaaa

SEQ ID NO: 196001 - DNA, 16 bp, P. troglodytes
acactgtgagcataga

SEQ ID NO: 196002 - DNA, 16 bp, P. troglodytes
acactgtgaggggaaa

SEQ ID NO: 196003 - DNA, 16 bp, P. troglodytes
acactgtggaaggcca

SEQ ID NO: 196004 - DNA, 16 bp, P. troglodytes
acactgtgtgattcca

SEQ ID NO: 196005 - DNA, 16 bp, P. troglodytes
acactgttaactttta

SEQ ID NO: 196006 - DNA, 16 bp, P. troglodytes
acactgttcttccttc

SEQ ID NO: 196007 - DNA, 16 bp, P. troglodytes
acactgttgaaagaaa

SEQ ID NO: 196008 - DNA, 16 bp, P. troglodytes
acactgtttgtgggaa

SEQ ID NO: 196009 - DNA, 16 bp, P. troglodytes
acacttaaaaatagtt

SEQ ID NO: 196010 - DNA, 16 bp, P. troglodytes
acacttaacatttttt

SEQ ID NO: 196011 - DNA, 16 bp, P. troglodytes
acacttaccatatgat

SEQ ID NO: 196012 - DNA, 16 bp, P. troglodytes
acacttagaaatggtt

SEQ ID NO: 196013 - DNA, 16 bp, P. troglodytes
acacttagaataaaat

SEQ ID NO: 196014 - DNA, 16 bp, P. troglodytes
acacttaggttgcttc

SEQ ID NO: 196015 - DNA, 16 bp, P. troglodytes
acacttataaagccat

SEQ ID NO: 196016 - DNA, 16 bp, P. troglodytes
acacttatagaaatgc

SEQ ID NO: 196017 - DNA, 16 bp, P. troglodytes
acacttatatatatac

SEQ ID NO: 196018 - DNA, 16 bp, P. troglodytes
acacttcaggatatca

SEQ ID NO: 196019 - DNA, 16 bp, P. troglodytes
acacttccaccagcag

SEQ ID NO: 196020 - DNA, 16 bp, P. troglodytes
acacttcctgtttaca

SEQ ID NO: 196021 - DNA, 16 bp, P. troglodytes
acacttctccttcctg

SEQ ID NO: 196022 - DNA, 16 bp, P. troglodytes
acacttctctctcctg

SEQ ID NO: 196023 - DNA, 16 bp, P. troglodytes
acacttctggaggcca

SEQ ID NO: 196024 - DNA, 16 bp, P. troglodytes
acacttgaccaaatgg

SEQ ID NO: 196025 - DNA, 16 bp, P. troglodytes
acacttggaaattaaa

SEQ ID NO: 196026 - DNA, 16 bp, P. troglodytes
acacttggaagagggt

SEQ ID NO: 196027 - DNA, 16 bp, P. troglodytes
acacttggctaatttt

SEQ ID NO: 196028 - DNA, 16 bp, P. troglodytes
acacttgtaatcccaa

SEQ ID NO: 196029 - DNA, 16 bp, P. troglodytes
acactttaagttttag

SEQ ID NO: 196030 - DNA, 16 bp, P. troglodytes
acactttattataaaa

SEQ ID NO: 196031 - DNA, 16 bp, P. troglodytes
acactttctgatttta

SEQ ID NO: 196032 - DNA, 16 bp, P. troglodytes
acactttgagaaccag

SEQ ID NO: 196033 - DNA, 16 bp, P. troglodytes
acactttgagaggttg

SEQ ID NO: 196034 - DNA, 16 bp, P. troglodytes
acactttgggaggcca

SEQ ID NO: 196035 - DNA, 20 bp, P. troglodytes
acactttgggaggccaagac

SEQ ID NO: 196036 - DNA, 27 bp, P. troglodytes
acactttgggaggccaaggtgggcaga

SEQ ID NO: 196037 - DNA, 16 bp, P. troglodytes
acactttttaaaagaa

SEQ ID NO: 196038 - DNA, 16 bp, P. troglodytes
acagaaaaactgagca

SEQ ID NO: 196039 - DNA, 21 bp, P. troglodytes
acagaaaaactggaaactcta

SEQ ID NO: 196040 - DNA, 16 bp, P. troglodytes
acagaaaaagcttttg

SEQ ID NO: 196041 - DNA, 16 bp, P. troglodytes
acagaaaaataattta

SEQ ID NO: 196042 - DNA, 16 bp, P. troglodytes
acagaaaaattagcca

SEQ ID NO: 196043 - DNA, 16 bp, P. troglodytes
acagaaaaattggaaa

SEQ ID NO: 196044 - DNA, 16 bp, P. troglodytes
acagaaaacagcaaat

SEQ ID NO: 196045 - DNA, 16 bp, P. troglodytes
acagaaaagcaaatat

SEQ ID NO: 196046 - DNA, 16 bp, P. troglodytes
acagaaaagttacaaa

SEQ ID NO: 196047 - DNA, 16 bp, P. troglodytes
acagaaaagttgaaag

SEQ ID NO: 196048 - DNA, 16 bp, P. troglodytes
acagaaaagttggaaa

SEQ ID NO: 196049 - DNA, 16 bp, P. troglodytes
acagaaaataagcaag

SEQ ID NO: 196050 - DNA, 16 bp, P. troglodytes
acagaaaatctaaaca

SEQ ID NO: 196051 - DNA, 16 bp, P. troglodytes
acagaaaatgaaaagt

SEQ ID NO: 196052 - DNA, 16 bp, P. troglodytes
acagaaaatgaaagtg

SEQ ID NO: 196053 - DNA, 16 bp, P. troglodytes
acagaaaatggaaaga

SEQ ID NO: 196054 - DNA, 16 bp, P. troglodytes
acagaaaatggaaatg

SEQ ID NO: 196055 - DNA, 16 bp, P. troglodytes
acagaaaattaaatat

SEQ ID NO: 196056 - DNA, 16 bp, P. troglodytes
acagaaaatttggaaa

SEQ ID NO: 196057 - DNA, 16 bp, P. troglodytes
acagaaacagaattca

SEQ ID NO: 196058 - DNA, 16 bp, P. troglodytes
acagaaacagagacag

SEQ ID NO: 196059 - DNA, 16 bp, P. troglodytes
acagaaacatttttaa

SEQ ID NO: 196060 - DNA, 16 bp, P. troglodytes
acagaaaccacatgat

SEQ ID NO: 196061 - DNA, 16 bp, P. troglodytes
acagaaactagaaaat

SEQ ID NO: 196062 - DNA, 16 bp, P. troglodytes
acagaaactgtgagat

SEQ ID NO: 196063 - DNA, 16 bp, P. troglodytes
acagaaacttctgcag

SEQ ID NO: 196064 - DNA, 16 bp, P. troglodytes
acagaaacttttaaaa

SEQ ID NO: 196065 - DNA, 16 bp, P. troglodytes
acagaaagaaaaatgc

SEQ ID NO: 196066 - DNA, 16 bp, P. troglodytes
acagaaagaaatagca

SEQ ID NO: 196067 - DNA, 16 bp, P. troglodytes
acagaaagaagaatgg

SEQ ID NO: 196068 - DNA, 16 bp, P. troglodytes
acagaaagacaaactg

SEQ ID NO: 196069 - DNA, 16 bp, P. troglodytes
acagaaagacaaattt

SEQ ID NO: 196070 - DNA, 16 bp, P. troglodytes
acagaaagcagagtgg

SEQ ID NO: 196071 - DNA, 16 bp, P. troglodytes
acagaaaggggaatat

SEQ ID NO: 196072 - DNA, 16 bp, P. troglodytes
acagaaagtacattag

SEQ ID NO: 196073 - DNA, 16 bp, P. troglodytes
acagaaagtagaacag

SEQ ID NO: 196074 - DNA, 16 bp, P. troglodytes
acagaaataattttta

SEQ ID NO: 196075 - DNA, 16 bp, P. troglodytes
acagaaatataaatga

SEQ ID NO: 196076 - DNA, 16 bp, P. troglodytes
acagaaatattttttc

SEQ ID NO: 196077 - DNA, 16 bp, P. troglodytes
acagaaatctggagaa

SEQ ID NO: 196078 - DNA, 16 bp, P. troglodytes
acagaaatgcaaaaga

SEQ ID NO: 196079 - DNA, 16 bp, P. troglodytes
acagaaatgcaaagga

SEQ ID NO: 196080 - DNA, 16 bp, P. troglodytes
acagaaatgcaaataa

SEQ ID NO: 196081 - DNA, 16 bp, P. troglodytes
acagaaatgtaaaata

SEQ ID NO: 196082 - DNA, 16 bp, P. troglodytes
acagaaatgtattctg

SEQ ID NO: 196083 - DNA, 16 bp, P. troglodytes
acagaaattaattcaa

SEQ ID NO: 196084 - DNA, 16 bp, P. troglodytes
acagaaattcaaaaca

SEQ ID NO: 196085 - DNA, 16 bp, P. troglodytes
acagaaatttaaaatt

SEQ ID NO: 196086 - DNA, 16 bp, P. troglodytes
acagaacaaaatgaag

SEQ ID NO: 196087 - DNA, 16 bp, P. troglodytes
acagaacaagactcag

SEQ ID NO: 196088 - DNA, 16 bp, P. troglodytes
acagaacaagactctg

SEQ ID NO: 196089 - DNA, 17 bp, P. troglodytes
acagaacaagactgtct

SEQ ID NO: 196090 - DNA, 17 bp, P. troglodytes
acagaacaagattccgt

SEQ ID NO: 196091 - DNA, 16 bp, P. troglodytes
acagaacagagcctca

SEQ ID NO: 196092 - DNA, 16 bp, P. troglodytes
acagaacagaggcttc

SEQ ID NO: 196093 - DNA, 16 bp, P. troglodytes
acagaacagatgcctc

SEQ ID NO: 196094 - DNA, 16 bp, P. troglodytes
acagaacaggacaggg

SEQ ID NO: 196095 - DNA, 16 bp, P. troglodytes
acagaaccctccaccc

SEQ ID NO: 196096 - DNA, 16 bp, P. troglodytes
acagaacgagactctg

SEQ ID NO: 196097 - DNA, 16 bp, P. troglodytes
acagaactagtaggat

SEQ ID NO: 196098 - DNA, 16 bp, P. troglodytes
acagaactcagggaag

SEQ ID NO: 196099 - DNA, 16 bp, P. troglodytes
acagaactggagaaaa

SEQ ID NO: 196100 - DNA, 16 bp, P. troglodytes
acagaacttctggaaa

SEQ ID NO: 196101 - DNA, 16 bp, P. troglodytes
acagaactttattttc

SEQ ID NO: 196102 - DNA, 16 bp, P. troglodytes
acagaagaaaaattta

SEQ ID NO: 196103 - DNA, 16 bp, P. troglodytes
acagaagaaaataatt

SEQ ID NO: 196104 - DNA, 16 bp, P. troglodytes
acagaagaaactgaaa

SEQ ID NO: 196105 - DNA, 16 bp, P. troglodytes
acagaagaaagaatca

SEQ ID NO: 196106 - DNA, 16 bp, P. troglodytes
acagaagacttctgtg

SEQ ID NO: 196107 - DNA, 16 bp, P. troglodytes
acagaagcacacacac

SEQ ID NO: 196108 - DNA, 16 bp, P. troglodytes
acagaagcagagattg

SEQ ID NO: 196109 - DNA, 16 bp, P. troglodytes
acagaagcaggcttca

SEQ ID NO: 196110 - DNA, 16 bp, P. troglodytes
acagaagcccagagag

SEQ ID NO: 196111 - DNA, 16 bp, P. troglodytes
acagaaggataaactg

SEQ ID NO: 196112 - DNA, 16 bp, P. troglodytes
acagaagggcaagaga

SEQ ID NO: 196113 - DNA, 16 bp, P. troglodytes
acagaaggtgaaggag

SEQ ID NO: 196114 - DNA, 16 bp, P. troglodytes
acagaagtcaagaatg

SEQ ID NO: 196115 - DNA, 16 bp, P. troglodytes
acagaagtttctgctg

SEQ ID NO: 196116 - DNA, 16 bp, P. troglodytes
acagaagttttttttt

SEQ ID NO: 196117 - DNA, 16 bp, P. troglodytes
acagaataccacagat

SEQ ID NO: 196118 - DNA, 16 bp, P. troglodytes
acagaataccagagac

SEQ ID NO: 196119 - DNA, 16 bp, P. troglodytes
acagaatatacagtct

SEQ ID NO: 196120 - DNA, 16 bp, P. troglodytes
acagaatatacattct

SEQ ID NO: 196121 - DNA, 16 bp, P. troglodytes
acagaatatacattgt

SEQ ID NO: 196122 - DNA, 16 bp, P. troglodytes
acagaatatttttgtt

SEQ ID NO: 196123 - DNA, 16 bp, P. troglodytes
acagaatgaaagagaa

SEQ ID NO: 196124 - DNA, 16 bp, P. troglodytes
acagaatgaagaataa

SEQ ID NO: 196125 - DNA, 16 bp, P. troglodytes
acagaatgagaccctg

SEQ ID NO: 196126 - DNA, 16 bp, P. troglodytes
acagaatgaggaagaa

SEQ ID NO: 196127 - DNA, 16 bp, P. troglodytes
acagaatggaagaaat

SEQ ID NO: 196128 - DNA, 16 bp, P. troglodytes
acagaatggaataaaa

SEQ ID NO: 196129 - DNA, 16 bp, P. troglodytes
acagaatggataaaga

SEQ ID NO: 196130 - DNA, 16 bp, P. troglodytes
acagaatgggagaaaa

SEQ ID NO: 196131 - DNA, 16 bp, P. troglodytes
acagaatgggagaaat

SEQ ID NO: 196132 - DNA, 16 bp, P. troglodytes
acagaattagaaagaa

SEQ ID NO: 196133 - DNA, 16 bp, P. troglodytes
acagaattggaaaaat

SEQ ID NO: 196134 - DNA, 16 bp, P. troglodytes
acagaattggaaaata

SEQ ID NO: 196135 - DNA, 16 bp, P. troglodytes
acagaatttattttct

SEQ ID NO: 196136 - DNA, 16 bp, P. troglodytes
acagaatttccctctt

SEQ ID NO: 196137 - DNA, 16 bp, P. troglodytes
acagaattttaaaata

SEQ ID NO: 196138 - DNA, 16 bp, P. troglodytes
acagaattttatttct

SEQ ID NO: 196139 - DNA, 16 bp, P. troglodytes
acagaattttgctctg

SEQ ID NO: 196140 - DNA, 16 bp, P. troglodytes
acagaatttttttttt

SEQ ID NO: 196141 - DNA, 16 bp, P. troglodytes
acagacaaacacagag

SEQ ID NO: 196142 - DNA, 16 bp, P. troglodytes
acagacaaatgggatt

SEQ ID NO: 196143 - DNA, 16 bp, P. troglodytes
acagacaaccccatca

SEQ ID NO: 196144 - DNA, 16 bp, P. troglodytes
acagacaaggaaacag

SEQ ID NO: 196145 - DNA, 16 bp, P. troglodytes
acagacacacaactct

SEQ ID NO: 196146 - DNA, 16 bp, P. troglodytes
acagacacacacaatg

SEQ ID NO: 196147 - DNA, 16 bp, P. troglodytes
acagacacacagacac

SEQ ID NO: 196148 - DNA, 16 bp, P. troglodytes
acagacacacaggcac

SEQ ID NO: 196149 - DNA, 16 bp, P. troglodytes
acagacacagacacag

SEQ ID NO: 196150 - DNA, 16 bp, P. troglodytes
acagacacagacacat

SEQ ID NO: 196151 - DNA, 16 bp, P. troglodytes
acagacacagagacca

SEQ ID NO: 196152 - DNA, 16 bp, P. troglodytes
acagacacagccagaa

SEQ ID NO: 196153 - DNA, 16 bp, P. troglodytes
acagacacgcaccacc

SEQ ID NO: 196154 - DNA, 16 bp, P. troglodytes
acagacagacacagag

SEQ ID NO: 196155 - DNA, 16 bp, P. troglodytes
acagacagacagacac

SEQ ID NO: 196156 - DNA, 16 bp, P. troglodytes
acagacagagacagag

SEQ ID NO: 196157 - DNA, 16 bp, P. troglodytes
acagacagagcagccc

SEQ ID NO: 196158 - DNA, 16 bp, P. troglodytes
acagacagatggatag

SEQ ID NO: 196159 - DNA, 16 bp, P. troglodytes
acagacaggagacagg

SEQ ID NO: 196160 - DNA, 16 bp, P. troglodytes
acagacagggtcttgc

SEQ ID NO: 196161 - DNA, 16 bp, P. troglodytes
acagacagggtttccc

SEQ ID NO: 196162 - DNA, 16 bp, P. troglodytes
acagacatacatacat

SEQ ID NO: 196163 - DNA, 16 bp, P. troglodytes
acagacatatagaaca

SEQ ID NO: 196164 - DNA, 16 bp, P. troglodytes
acagacatatgccacc

SEQ ID NO: 196165 - DNA, 17 bp, P. troglodytes
acagacatcaagtactt

SEQ ID NO: 196166 - DNA, 16 bp, P. troglodytes
acagacatgaaaaaat

SEQ ID NO: 196167 - DNA, 16 bp, P. troglodytes
acagacatgtgccacc

SEQ ID NO: 196168 - DNA, 17 bp, P. troglodytes
acagacatgtgccacca

SEQ ID NO: 196169 - DNA, 16 bp, P. troglodytes
acagacattaaaagaa

SEQ ID NO: 196170 - DNA, 16 bp, P. troglodytes
acagaccctttgaagg

SEQ ID NO: 196171 - DNA, 16 bp, P. troglodytes
acagaccgagactctg

SEQ ID NO: 196172 - DNA, 16 bp, P. troglodytes
acagaccttacaccct

SEQ ID NO: 196173 - DNA, 16 bp, P. troglodytes
acagacgtgagccact

SEQ ID NO: 196174 - DNA, 16 bp, P. troglodytes
acagactctccctctg

SEQ ID NO: 196175 - DNA, 16 bp, P. troglodytes
acagactgaaggctgt

SEQ ID NO: 196176 - DNA, 16 bp, P. troglodytes
acagactgagactcca

SEQ ID NO: 196177 - DNA, 16 bp, P. troglodytes
acagactttaaaaata

SEQ ID NO: 196178 - DNA, 16 bp, P. troglodytes
acagactttaaaacaa

SEQ ID NO: 196179 - DNA, 16 bp, P. troglodytes
acagactttattcaga

SEQ ID NO: 196180 - DNA, 16 bp, P. troglodytes
acagagaaaaactctg

SEQ ID NO: 196181 - DNA, 16 bp, P. troglodytes
acagagaaactgaggc

SEQ ID NO: 196182 - DNA, 16 bp, P. troglodytes
acagagaaagaccctg

SEQ ID NO: 196183 - DNA, 16 bp, P. troglodytes
acagagaaaggaaata

SEQ ID NO: 196184 - DNA, 16 bp, P. troglodytes
acagagaagaaaatga

SEQ ID NO: 196185 - DNA, 16 bp, P. troglodytes
acagagaaggtgctca

SEQ ID NO: 196186 - DNA, 17 bp, P. troglodytes
acagagaatgagtttga

SEQ ID NO: 196187 - DNA, 16 bp, P. troglodytes
acagagaatttaaaat

SEQ ID NO: 196188 - DNA, 16 bp, P. troglodytes
acagagacacacagga

SEQ ID NO: 196189 - DNA, 16 bp, P. troglodytes
acagagacagagacag

SEQ ID NO: 196190 - DNA, 16 bp, P. troglodytes
acagagacagagagag

SEQ ID NO: 196191 - DNA, 16 bp, P. troglodytes
acagagacagagagta

SEQ ID NO: 196192 - DNA, 16 bp, P. troglodytes
acagagacagaggaga

SEQ ID NO: 196193 - DNA, 16 bp, P. troglodytes
acagagactccgtctc

SEQ ID NO: 196194 - DNA, 16 bp, P. troglodytes
acagagactgtatggc

SEQ ID NO: 196195 - DNA, 16 bp, P. troglodytes
acagagactttttttt

SEQ ID NO: 196196 - DNA, 16 bp, P. troglodytes
acagagagaaaataga

SEQ ID NO: 196197 - DNA, 16 bp, P. troglodytes
acagagagaaactcca

SEQ ID NO: 196198 - DNA, 16 bp, P. troglodytes
acagagagacacaaag

SEQ ID NO: 196199 - DNA, 16 bp, P. troglodytes
acagagagacacagag

SEQ ID NO: 196200 - DNA, 16 bp, P. troglodytes
acagagagacactgtc

SEQ ID NO: 196201 - DNA, 16 bp, P. troglodytes
acagagagacagagag

SEQ ID NO: 196202 - DNA, 16 bp, P. troglodytes
acagagagagacacag

SEQ ID NO: 196203 - DNA, 16 bp, P. troglodytes
acagagagagaccttg

SEQ ID NO: 196204 - DNA, 16 bp, P. troglodytes
acagagagagactcct

SEQ ID NO: 196205 - DNA, 16 bp, P. troglodytes
acagagagagagaaat

SEQ ID NO: 196206 - DNA, 16 bp, P. troglodytes
acagagagaggaagtg

SEQ ID NO: 196207 - DNA, 16 bp, P. troglodytes
acagagagagtgagag

SEQ ID NO: 196208 - DNA, 16 bp, P. troglodytes
acagagagccaaatct

SEQ ID NO: 196209 - DNA, 16 bp, P. troglodytes
acagagatagaaagta

SEQ ID NO: 196210 - DNA, 16 bp, P. troglodytes
acagagatgccaagaa

SEQ ID NO: 196211 - DNA, 16 bp, P. troglodytes
acagagatggggagaa

SEQ ID NO: 196212 - DNA, 17 bp, P. troglodytes
acagagcaaaaccatat

SEQ ID NO: 196213 - DNA, 16 bp, P. troglodytes
acagagcaaaactcca

SEQ ID NO: 196214 - DNA, 16 bp, P. troglodytes
acagagcaaaactctg

SEQ ID NO: 196215 - DNA, 16 bp, P. troglodytes
acagagcaagaacctg

SEQ ID NO: 196216 - DNA, 16 bp, P. troglodytes
acagagcaagacaatg

SEQ ID NO: 196217 - DNA, 16 bp, P. troglodytes
acagagcaagaccccg

SEQ ID NO: 196218 - DNA, 17 bp, P. troglodytes
acagagcaagaccctgg

SEQ ID NO: 196219 - DNA, 16 bp, P. troglodytes
acagagcaagactagg

SEQ ID NO: 196220 - DNA, 17 bp, P. troglodytes
acagagcaagactctct

SEQ ID NO: 196221 - DNA, 16 bp, P. troglodytes
acagagcaagactctg

SEQ ID NO: 196222 - DNA, 16 bp, P. troglodytes
acagagcaagactctt

SEQ ID NO: 196223 - DNA, 16 bp, P. troglodytes
acagagcaagactgtc

SEQ ID NO: 196224 - DNA, 16 bp, P. troglodytes
acagagcaagagagag

SEQ ID NO: 196225 - DNA, 17 bp, P. troglodytes
acagagcaagagtctgt

SEQ ID NO: 196226 - DNA, 16 bp, P. troglodytes
acagagcaagatctgt

SEQ ID NO: 196227 - DNA, 16 bp, P. troglodytes
acagagcaagatgctg

SEQ ID NO: 196228 - DNA, 17 bp, P. troglodytes
acagagcaagattctgt

SEQ ID NO: 196229 - DNA, 16 bp, P. troglodytes
acagagcaaggccttg

SEQ ID NO: 196230 - DNA, 16 bp, P. troglodytes
acagagcaagtctcca

SEQ ID NO: 196231 - DNA, 16 bp, P. troglodytes
acagagcacctgggga

SEQ ID NO: 196232 - DNA, 16 bp, P. troglodytes
acagagcagaaaaact

SEQ ID NO: 196233 - DNA, 16 bp, P. troglodytes
acagagcagaccctgt

SEQ ID NO: 196234 - DNA, 16 bp, P. troglodytes
acagagcagagccctc

SEQ ID NO: 196235 - DNA, 16 bp, P. troglodytes
acagagcaggagcacc

SEQ ID NO: 196236 - DNA, 16 bp, P. troglodytes
acagagcaggggggcc

SEQ ID NO: 196237 - DNA, 16 bp, P. troglodytes
acagagcatgaccctg

SEQ ID NO: 196238 - DNA, 17 bp, P. troglodytes
acagagccaaaccatat

SEQ ID NO: 196239 - DNA, 17 bp, P. troglodytes
acagagccaaaccgtat

SEQ ID NO: 196240 - DNA, 16 bp, P. troglodytes
acagagccaaagacaa

SEQ ID NO: 196241 - DNA, 16 bp, P. troglodytes
acagagccagaccttg

SEQ ID NO: 196242 - DNA, 16 bp, P. troglodytes
acagagccagactctg

SEQ ID NO: 196243 - DNA, 16 bp, P. troglodytes
acagagccagattcca

SEQ ID NO: 196244 - DNA, 16 bp, P. troglodytes
acagagccaggccctg

SEQ ID NO: 196245 - DNA, 16 bp, P. troglodytes
acagagcccccagaaa

SEQ ID NO: 196246 - DNA, 16 bp, P. troglodytes
acagagcctccctctg

SEQ ID NO: 196247 - DNA, 16 bp, P. troglodytes
acagagcctggctctg

SEQ ID NO: 196248 - DNA, 16 bp, P. troglodytes
acagagcgagaccccg

SEQ ID NO: 196249 - DNA, 16 bp, P. troglodytes
acagagcgagaccctg

SEQ ID NO: 196250 - DNA, 16 bp, P. troglodytes
acagagcgagactcta

SEQ ID NO: 196251 - DNA, 17 bp, P. troglodytes
acagagcgagactctgg

SEQ ID NO: 196252 - DNA, 19 bp, P. troglodytes
acagagcgagactctgtcc

SEQ ID NO: 196253 - DNA, 17 bp, P. troglodytes
acagagcgagactgtgt

SEQ ID NO: 196254 - DNA, 16 bp, P. troglodytes
acagagcgagagtctg

SEQ ID NO: 196255 - DNA, 16 bp, P. troglodytes
acagagcgagattctg

SEQ ID NO: 196256 - DNA, 16 bp, P. troglodytes
acagagctaagaaata

SEQ ID NO: 196257 - DNA, 16 bp, P. troglodytes
acagagctagactctg

SEQ ID NO: 196258 - DNA, 16 bp, P. troglodytes
acagagctgaaaacca

SEQ ID NO: 196259 - DNA, 16 bp, P. troglodytes
acagagctgcccaagg

SEQ ID NO: 196260 - DNA, 16 bp, P. troglodytes
acagagcttcaaaaca

SEQ ID NO: 196261 - DNA, 16 bp, P. troglodytes
acagaggaagaccttg

SEQ ID NO: 196262 - DNA, 16 bp, P. troglodytes
acagaggaagattctg

SEQ ID NO: 196263 - DNA, 16 bp, P. troglodytes
acagaggactttctgt

SEQ ID NO: 196264 - DNA, 16 bp, P. troglodytes
acagaggaggaaacag

SEQ ID NO: 196265 - DNA, 16 bp, P. troglodytes
acagaggcagaccctg

SEQ ID NO: 196266 - DNA, 16 bp, P. troglodytes
acagaggcagagacag

SEQ ID NO: 196267 - DNA, 16 bp, P. troglodytes
acagaggcatgccacc

SEQ ID NO: 196268 - DNA, 16 bp, P. troglodytes
acagaggcctcaaaaa

SEQ ID NO: 196269 - DNA, 16 bp, P. troglodytes
acagaggctgagaagt

SEQ ID NO: 196270 - DNA, 16 bp, P. troglodytes
acagaggctggaggag

SEQ ID NO: 196271 - DNA, 16 bp, P. troglodytes
acagagggaaactctg

SEQ ID NO: 196272 - DNA, 16 bp, P. troglodytes
acagagggagaatctg

SEQ ID NO: 196273 - DNA, 16 bp, P. troglodytes
acagagggagaccccc

SEQ ID NO: 196274 - DNA, 16 bp, P. troglodytes
acagagggagactctg

SEQ ID NO: 196275 - DNA, 16 bp, P. troglodytes
acagagggaggccctg

SEQ ID NO: 196276 - DNA, 16 bp, P. troglodytes
acagaggggaacatca

SEQ ID NO: 196277 - DNA, 16 bp, P. troglodytes
acagaggggagccagg

SEQ ID NO: 196278 - DNA, 16 bp, P. troglodytes
acagaggtggcagtga

SEQ ID NO: 196279 - DNA, 16 bp, P. troglodytes
acagaggtggctgggg

SEQ ID NO: 196280 - DNA, 16 bp, P. troglodytes
acagaggttgcagtga

SEQ ID NO: 196281 - DNA, 16 bp, P. troglodytes
acagaggttgtagtga

SEQ ID NO: 196282 - DNA, 16 bp, P. troglodytes
acagagtacaaaagag

SEQ ID NO: 196283 - DNA, 16 bp, P. troglodytes
acagagtactgattgg

SEQ ID NO: 196284 - DNA, 16 bp, P. troglodytes
acagagtagaagaaaa

SEQ ID NO: 196285 - DNA, 16 bp, P. troglodytes
acagagtaggtgttca

SEQ ID NO: 196286 - DNA, 16 bp, P. troglodytes
acagagtccccactag

SEQ ID NO: 196287 - DNA, 16 bp, P. troglodytes
acagagtccttactgg

SEQ ID NO: 196288 - DNA, 16 bp, P. troglodytes
acagagtctcactatt

SEQ ID NO: 196289 - DNA, 16 bp, P. troglodytes
acagagtctctctgtc

SEQ ID NO: 196290 - DNA, 16 bp, P. troglodytes
acagagtgagacactg

SEQ ID NO: 196291 - DNA, 16 bp, P. troglodytes
acagagtgagacccca

SEQ ID NO: 196292 - DNA, 16 bp, P. troglodytes
acagagtgagacccta

SEQ ID NO: 196293 - DNA, 16 bp, P. troglodytes
acagagtgagaccttg

SEQ ID NO: 196294 - DNA, 16 bp, P. troglodytes
acagagtgagactcag

SEQ ID NO: 196295 - DNA, 16 bp, P. troglodytes
acagagtgagactctt

SEQ ID NO: 196296 - DNA, 16 bp, P. troglodytes
acagagtgagatccca

SEQ ID NO: 196297 - DNA, 16 bp, P. troglodytes
acagagtggaagaaaa

SEQ ID NO: 196298 - DNA, 16 bp, P. troglodytes
acagagtgggagagaa

SEQ ID NO: 196299 - DNA, 16 bp, P. troglodytes
acagagtgtttccaaa

SEQ ID NO: 196300 - DNA, 16 bp, P. troglodytes
acagagtttaaaaaaa

SEQ ID NO: 196301 - DNA, 16 bp, P. troglodytes
acagataaaattttat

SEQ ID NO: 196302 - DNA, 16 bp, P. troglodytes
acagataaacaaactg

SEQ ID NO: 196303 - DNA, 16 bp, P. troglodytes
acagatataaaaatga

SEQ ID NO: 196304 - DNA, 16 bp, P. troglodytes
acagatatataaagca

SEQ ID NO: 196305 - DNA, 16 bp, P. troglodytes
acagatatataggcca

SEQ ID NO: 196306 - DNA, 16 bp, P. troglodytes
acagatatttacagaa

SEQ ID NO: 196307 - DNA, 16 bp, P. troglodytes
acagatatttactgag

SEQ ID NO: 196308 - DNA, 16 bp, P. troglodytes
acagatatttatagaa

SEQ ID NO: 196309 - DNA, 16 bp, P. troglodytes
acagatcccatggaca

SEQ ID NO: 196310 - DNA, 16 bp, P. troglodytes
acagatgaaaagactg

SEQ ID NO: 196311 - DNA, 16 bp, P. troglodytes
acagatgaaacaagat

SEQ ID NO: 196312 - DNA, 16 bp, P. troglodytes
acagatgaacagccag

SEQ ID NO: 196313 - DNA, 16 bp, P. troglodytes
acagatgaagaaactg

SEQ ID NO: 196314 - DNA, 16 bp, P. troglodytes
acagatgaagagactg

SEQ ID NO: 196315 - DNA, 16 bp, P. troglodytes
acagatgaagagataa

SEQ ID NO: 196316 - DNA, 16 bp, P. troglodytes
acagatgagaaaacag

SEQ ID NO: 196317 - DNA, 16 bp, P. troglodytes
acagatgagaaaatta

SEQ ID NO: 196318 - DNA, 16 bp, P. troglodytes
acagatgaggaaacta

SEQ ID NO: 196319 - DNA, 16 bp, P. troglodytes
acagatgaggaaactg

SEQ ID NO: 196320 - DNA, 16 bp, P. troglodytes
acagatgaggaagcag

SEQ ID NO: 196321 - DNA, 16 bp, P. troglodytes
acagatgaggagactg

SEQ ID NO: 196322 - DNA, 16 bp, P. troglodytes
acagatgaggtctcac

SEQ ID NO: 196323 - DNA, 16 bp, P. troglodytes
acagatgagtgccacc

SEQ ID NO: 196324 - DNA, 16 bp, P. troglodytes
acagatgatagataga

SEQ ID NO: 196325 - DNA, 16 bp, P. troglodytes
acagatgcaaaaactg

SEQ ID NO: 196326 - DNA, 16 bp, P. troglodytes
acagatgcagaaaaga

SEQ ID NO: 196327 - DNA, 16 bp, P. troglodytes
acagatgctaaaatcc

SEQ ID NO: 196328 - DNA, 16 bp, P. troglodytes
acagatgctggagagc

SEQ ID NO: 196329 - DNA, 16 bp, P. troglodytes
acagatggcttcactg

SEQ ID NO: 196330 - DNA, 16 bp, P. troglodytes
acagatggggaaactg

SEQ ID NO: 196331 - DNA, 16 bp, P. troglodytes
acagatggtggaagaa

SEQ ID NO: 196332 - DNA, 16 bp, P. troglodytes
acagatgtccaccacc

SEQ ID NO: 196333 - DNA, 16 bp, P. troglodytes
acagatgttggtgagg

SEQ ID NO: 196334 - DNA, 16 bp, P. troglodytes
acagattattttgtca

SEQ ID NO: 196335 - DNA, 16 bp, P. troglodytes
acagattcaatgcaat

SEQ ID NO: 196336 - DNA, 16 bp, P. troglodytes
acagattcaattcaat

SEQ ID NO: 196337 - DNA, 16 bp, P. troglodytes
acagattcagtgcaat

SEQ ID NO: 196338 - DNA, 16 bp, P. troglodytes
acagattcagtgtctg

SEQ ID NO: 196339 - DNA, 16 bp, P. troglodytes
acagattgagactcca

SEQ ID NO: 196340 - DNA, 16 bp, P. troglodytes
acagattgcagtaaag

SEQ ID NO: 196341 - DNA, 16 bp, P. troglodytes
acagattgggagaaaa

SEQ ID NO: 196342 - DNA, 16 bp, P. troglodytes
acagatttgtgaactc

SEQ ID NO: 196343 - DNA, 16 bp, P. troglodytes
acagattttatttatt

SEQ ID NO: 196344 - DNA, 16 bp, P. troglodytes
acagattttttaaatt

SEQ ID NO: 196345 - DNA, 16 bp, P. troglodytes
acagcaaaactgagtg

SEQ ID NO: 196346 - DNA, 16 bp, P. troglodytes
acagcaaaagcaatgg

SEQ ID NO: 196347 - DNA, 16 bp, P. troglodytes
acagcaaaattgagaa

SEQ ID NO: 196348 - DNA, 16 bp, P. troglodytes
acagcaaactcatttt

SEQ ID NO: 196349 - DNA, 16 bp, P. troglodytes
acagcaaagatgacag

SEQ ID NO: 196350 - DNA, 16 bp, P. troglodytes
acagcaaagatttctg

SEQ ID NO: 196351 - DNA, 16 bp, P. troglodytes
acagcaaagggaacaa

SEQ ID NO: 196352 - DNA, 16 bp, P. troglodytes
acagcaaaggggaagt

SEQ ID NO: 196353 - DNA, 16 bp, P. troglodytes
acagcaacattattca

SEQ ID NO: 196354 - DNA, 16 bp, P. troglodytes
acagcaacctcaaact

SEQ ID NO: 196355 - DNA, 16 bp, P. troglodytes
acagcaacctcagcct

SEQ ID NO: 196356 - DNA, 16 bp, P. troglodytes
acagcaacctctacct

SEQ ID NO: 196357 - DNA, 16 bp, P. troglodytes
acagcaacctggatga

SEQ ID NO: 196358 - DNA, 16 bp, P. troglodytes
acagcaagaaaacctc

SEQ ID NO: 196359 - DNA, 16 bp, P. troglodytes
acagcaagaaggctct

SEQ ID NO: 196360 - DNA, 16 bp, P. troglodytes
acagcaagaaggtgct

SEQ ID NO: 196361 - DNA, 16 bp, P. troglodytes
acagcaagaaggtggc

SEQ ID NO: 196362 - DNA, 16 bp, P. troglodytes
acagcaagaccagccc

SEQ ID NO: 196363 - DNA, 17 bp, P. troglodytes
acagcaagactccgtct

SEQ ID NO: 196364 - DNA, 16 bp, P. troglodytes
acagcaagactctgtc

SEQ ID NO: 196365 - DNA, 16 bp, P. troglodytes
acagcaagagagagag

SEQ ID NO: 196366 - DNA, 16 bp, P. troglodytes
acagcaagatcctgtc

SEQ ID NO: 196367 - DNA, 16 bp, P. troglodytes
acagcaagatttattg

SEQ ID NO: 196368 - DNA, 16 bp, P. troglodytes
acagcaatagataact

SEQ ID NO: 196369 - DNA, 16 bp, P. troglodytes
acagcaatattcacaa

SEQ ID NO: 196370 - DNA, 16 bp, P. troglodytes
acagcacaagactctg

SEQ ID NO: 196371 - DNA, 16 bp, P. troglodytes
acagcacagctgctct

SEQ ID NO: 196372 - DNA, 22 bp, P. troglodytes
acagcacatgtttcagagagca

SEQ ID NO: 196373 - DNA, 16 bp, P. troglodytes
acagcacccagcccaa

SEQ ID NO: 196374 - DNA, 16 bp, P. troglodytes
acagcacccagcctgg

SEQ ID NO: 196375 - DNA, 16 bp, P. troglodytes
acagcacccaggctca

SEQ ID NO: 196376 - DNA, 16 bp, P. troglodytes
acagcacctggaaaat

SEQ ID NO: 196377 - DNA, 16 bp, P. troglodytes
acagcacgagaaagac

SEQ ID NO: 196378 - DNA, 16 bp, P. troglodytes
acagcagaaaagctga

SEQ ID NO: 196379 - DNA, 16 bp, P. troglodytes
acagcagaacacacat

SEQ ID NO: 196380 - DNA, 16 bp, P. troglodytes
acagcagacctttcag

SEQ ID NO: 196381 - DNA, 16 bp, P. troglodytes
acagcagatatttatt

SEQ ID NO: 196382 - DNA, 16 bp, P. troglodytes
acagcagatgctggtg

SEQ ID NO: 196383 - DNA, 16 bp, P. troglodytes
acagcagcaacaggaa

SEQ ID NO: 196384 - DNA, 16 bp, P. troglodytes
acagcagcagcagagg

SEQ ID NO: 196385 - DNA, 16 bp, P. troglodytes
acagcagcagcagcaa

SEQ ID NO: 196386 - DNA, 16 bp, P. troglodytes
acagcagcagcagcac

SEQ ID NO: 196387 - DNA, 16 bp, P. troglodytes
acagcagcagcagtag

SEQ ID NO: 196388 - DNA, 16 bp, P. troglodytes
acagcagccatagaaa

SEQ ID NO: 196389 - DNA, 16 bp, P. troglodytes
acagcagccccaggaa

SEQ ID NO: 196390 - DNA, 16 bp, P. troglodytes
acagcagccctgggaa

SEQ ID NO: 196391 - DNA, 16 bp, P. troglodytes
acagcagcccttccca

SEQ ID NO: 196392 - DNA, 16 bp, P. troglodytes
acagcagctcaaggag

SEQ ID NO: 196393 - DNA, 16 bp, P. troglodytes
acagcagctctgagaa

SEQ ID NO: 196394 - DNA, 16 bp, P. troglodytes
acagcagctgtggcag

SEQ ID NO: 196395 - DNA, 16 bp, P. troglodytes
acagcagggagaagcc

SEQ ID NO: 196396 - DNA, 16 bp, P. troglodytes
acagcaggtccttgaa

SEQ ID NO: 196397 - DNA, 16 bp, P. troglodytes
acagcagtgaacaaac

SEQ ID NO: 196398 - DNA, 16 bp, P. troglodytes
acagcatatacaaaaa

SEQ ID NO: 196399 - DNA, 16 bp, P. troglodytes
acagcatcaacatcaa

SEQ ID NO: 196400 - DNA, 16 bp, P. troglodytes
acagcatgggtgaagg

SEQ ID NO: 196401 - DNA, 16 bp, P. troglodytes
acagcatggtactggc

SEQ ID NO: 196402 - DNA, 16 bp, P. troglodytes
acagcatggtcctggt

SEQ ID NO: 196403 - DNA, 16 bp, P. troglodytes
acagcatggtgaatat

SEQ ID NO: 196404 - DNA, 16 bp, P. troglodytes
acagcatggtgctggc

SEQ ID NO: 196405 - DNA, 16 bp, P. troglodytes
acagcatggtggctgg

SEQ ID NO: 196406 - DNA, 16 bp, P. troglodytes
acagcattaggagaaa

SEQ ID NO: 196407 - DNA, 16 bp, P. troglodytes
acagcattattcacaa

SEQ ID NO: 196408 - DNA, 16 bp, P. troglodytes
acagcattgcttctga

SEQ ID NO: 196409 - DNA, 16 bp, P. troglodytes
acagcatttttaaaaa

SEQ ID NO: 196410 - DNA, 16 bp, P. troglodytes
acagccaaattctgcc

SEQ ID NO: 196411 - DNA, 16 bp, P. troglodytes
acagccaacaaacata

SEQ ID NO: 196412 - DNA, 16 bp, P. troglodytes
acagccaaggaaacaa

SEQ ID NO: 196413 - DNA, 16 bp, P. troglodytes
acagccaataataatc

SEQ ID NO: 196414 - DNA, 16 bp, P. troglodytes
acagccaattgatttt

SEQ ID NO: 196415 - DNA, 16 bp, P. troglodytes
acagccacacccattc

SEQ ID NO: 196416 - DNA, 16 bp, P. troglodytes
acagccacctgccacc

SEQ ID NO: 196417 - DNA, 16 bp, P. troglodytes
acagccagaccctgtc

SEQ ID NO: 196418 - DNA, 16 bp, P. troglodytes
acagccagatcttgtg

SEQ ID NO: 196419 - DNA, 16 bp, P. troglodytes
acagccagcaccaggg

SEQ ID NO: 196420 - DNA, 16 bp, P. troglodytes
acagccctcaggagat

SEQ ID NO: 196421 - DNA, 16 bp, P. troglodytes
acagccctgtgaggta

SEQ ID NO: 196422 - DNA, 16 bp, P. troglodytes
acagccgggtgcccct

SEQ ID NO: 196423 - DNA, 16 bp, P. troglodytes
acagcctacagaactg

SEQ ID NO: 196424 - DNA, 16 bp, P. troglodytes
acagcctcaccagcat

SEQ ID NO: 196425 - DNA, 16 bp, P. troglodytes
acagcctccctcctgg

SEQ ID NO: 196426 - DNA, 16 bp, P. troglodytes
acagcctgcagaatca

SEQ ID NO: 196427 - DNA, 16 bp, P. troglodytes
acagcctggccaagat

SEQ ID NO: 196428 - DNA, 16 bp, P. troglodytes
acagcctggctaacat

SEQ ID NO: 196429 - DNA, 16 bp, P. troglodytes
acagcctgggcaacat

SEQ ID NO: 196430 - DNA, 19 bp, P. troglodytes
acagcctgggcaacatggt

SEQ ID NO: 196431 - DNA, 16 bp, P. troglodytes
acagcctgggcaccat

SEQ ID NO: 196432 - DNA, 16 bp, P. troglodytes
acagcctgggctacag

SEQ ID NO: 196433 - DNA, 16 bp, P. troglodytes
acagcctgggctccag

SEQ ID NO: 196434 - DNA, 16 bp, P. troglodytes
acagcctggtcaacat

SEQ ID NO: 196435 - DNA, 16 bp, P. troglodytes
acagcctgtggaactg

SEQ ID NO: 196436 - DNA, 16 bp, P. troglodytes
acagcctgttgctcct

SEQ ID NO: 196437 - DNA, 16 bp, P. troglodytes
acagccttaggcaggt

SEQ ID NO: 196438 - DNA, 17 bp, P. troglodytes
acagccttcagagctga

SEQ ID NO: 196439 - DNA, 16 bp, P. troglodytes
acagccttctgtatcc

SEQ ID NO: 196440 - DNA, 16 bp, P. troglodytes
acagccttgacctcct

SEQ ID NO: 196441 - DNA, 16 bp, P. troglodytes
acagccttggcctccc

SEQ ID NO: 196442 - DNA, 17 bp, P. troglodytes
acagcgagaccttgtct

SEQ ID NO: 196443 - DNA, 17 bp, P. troglodytes
acagcgagactccgtct

SEQ ID NO: 196444 - DNA, 16 bp, P. troglodytes
acagcgagactgtctc

SEQ ID NO: 196445 - DNA, 16 bp, P. troglodytes
acagcgtttcaccatg

SEQ ID NO: 196446 - DNA, 16 bp, P. troglodytes
acagctcactgcagac

SEQ ID NO: 196447 - DNA, 16 bp, P. troglodytes
acagctcactgcagtc

SEQ ID NO: 196448 - DNA, 16 bp, P. troglodytes
acagctcagcaaggcc

SEQ ID NO: 196449 - DNA, 16 bp, P. troglodytes
acagctctgaagagag

SEQ ID NO: 196450 - DNA, 16 bp, P. troglodytes
acagctgacatttatt

SEQ ID NO: 196451 - DNA, 16 bp, P. troglodytes
acagctgcagctgcct

SEQ ID NO: 196452 - DNA, 16 bp, P. troglodytes
acagctgctggcattt

SEQ ID NO: 196453 - DNA, 16 bp, P. troglodytes
acagctggattctcat

SEQ ID NO: 196454 - DNA, 16 bp, P. troglodytes
acagctgggaagtggt

SEQ ID NO: 196455 - DNA, 16 bp, P. troglodytes
acagctgggactacag

SEQ ID NO: 196456 - DNA, 16 bp, P. troglodytes
acagctgttccaaatg

SEQ ID NO: 196457 - DNA, 16 bp, P. troglodytes
acagcttccctttgct

SEQ ID NO: 196458 - DNA, 16 bp, P. troglodytes
acagcttctacatcag

SEQ ID NO: 196459 - DNA, 16 bp, P. troglodytes
acagcttgcaccatgt

SEQ ID NO: 196460 - DNA, 16 bp, P. troglodytes
acagcttggaagagag

SEQ ID NO: 196461 - DNA, 16 bp, P. troglodytes
acagctttatttttat

SEQ ID NO: 196462 - DNA, 16 bp, P. troglodytes
acagctttgaagagag

SEQ ID NO: 196463 - DNA, 16 bp, P. troglodytes
acagcttttaacaatt

SEQ ID NO: 196464 - DNA, 16 bp, P. troglodytes
acagcttttcccaaga

SEQ ID NO: 196465 - DNA, 16 bp, P. troglodytes
acaggaaaataaaact

SEQ ID NO: 196466 - DNA, 16 bp, P. troglodytes
acaggaaacatgaaaa

SEQ ID NO: 196467 - DNA, 16 bp, P. troglodytes
acaggaaatatcttca

SEQ ID NO: 196468 - DNA, 16 bp, P. troglodytes
acaggaaatggataaa

SEQ ID NO: 196469 - DNA, 16 bp, P. troglodytes
acaggaacagctccag

SEQ ID NO: 196470 - DNA, 16 bp, P. troglodytes
acaggaagaaatagaa

SEQ ID NO: 196471 - DNA, 16 bp, P. troglodytes
acaggaagacaaacat

SEQ ID NO: 196472 - DNA, 16 bp, P. troglodytes
acaggaagacaggaag

SEQ ID NO: 196473 - DNA, 16 bp, P. troglodytes
acaggaagatgtagga

SEQ ID NO: 196474 - DNA, 16 bp, P. troglodytes
acaggaagcacagcag

SEQ ID NO: 196475 - DNA, 16 bp, P. troglodytes
acaggaatgaaaggaa

SEQ ID NO: 196476 - DNA, 16 bp, P. troglodytes
acaggaatttttttaa

SEQ ID NO: 196477 - DNA, 16 bp, P. troglodytes
acaggacacaactgga

SEQ ID NO: 196478 - DNA, 16 bp, P. troglodytes
acaggacagcccccaa

SEQ ID NO: 196479 - DNA, 16 bp, P. troglodytes
acaggaccttcagctg

SEQ ID NO: 196480 - DNA, 16 bp, P. troglodytes
acaggagaatggataa

SEQ ID NO: 196481 - DNA, 16 bp, P. troglodytes
acaggagaatggtgtg

SEQ ID NO: 196482 - DNA, 19 bp, P. troglodytes
acaggagaattgcttgaac

SEQ ID NO: 196483 - DNA, 16 bp, P. troglodytes
acaggagactggggct

SEQ ID NO: 196484 - DNA, 16 bp, P. troglodytes
acaggagatattacaa

SEQ ID NO: 196485 - DNA, 16 bp, P. troglodytes
acaggagatgaaagat

SEQ ID NO: 196486 - DNA, 29 bp, P. troglodytes
acaggagcacccagattcataaagcaagt

SEQ ID NO: 196487 - DNA, 16 bp, P. troglodytes
acaggagctgaaggat

SEQ ID NO: 196488 - DNA, 16 bp, P. troglodytes
acaggaggaggagctc

SEQ ID NO: 196489 - DNA, 16 bp, P. troglodytes
acaggaggcagagctc

SEQ ID NO: 196490 - DNA, 16 bp, P. troglodytes
acaggaggcggagctc

SEQ ID NO: 196491 - DNA, 17 bp, P. troglodytes
acaggagtgagccacca

SEQ ID NO: 196492 - DNA, 17 bp, P. troglodytes
acaggagttcgagacca

SEQ ID NO: 196493 - DNA, 16 bp, P. troglodytes
acaggagtttgaaacc

SEQ ID NO: 196494 - DNA, 16 bp, P. troglodytes
acaggatcaaattcat

SEQ ID NO: 196495 - DNA, 16 bp, P. troglodytes
acaggatcagggaccc

SEQ ID NO: 196496 - DNA, 16 bp, P. troglodytes
acaggatctcaccctg

SEQ ID NO: 196497 - DNA, 16 bp, P. troglodytes
acaggatgactacagt

SEQ ID NO: 196498 - DNA, 16 bp, P. troglodytes
acaggatgggagaaaa

SEQ ID NO: 196499 - DNA, 16 bp, P. troglodytes
acaggattagaaaaaa

SEQ ID NO: 196500 - DNA, 16 bp, P. troglodytes
acaggcaaaaactgga

SEQ ID NO: 196501 - DNA, 16 bp, P. troglodytes
acaggcaacatggcac

SEQ ID NO: 196502 - DNA, 16 bp, P. troglodytes
acaggcacaaaccact

SEQ ID NO: 196503 - DNA, 17 bp, P. troglodytes
acaggcacaagccacca

SEQ ID NO: 196504 - DNA, 16 bp, P. troglodytes
acaggcacacacagag

SEQ ID NO: 196505 - DNA, 18 bp, P. troglodytes
acaggcacacaccaccat

SEQ ID NO: 196506 - DNA, 16 bp, P. troglodytes
acaggcacatgccatc

SEQ ID NO: 196507 - DNA, 17 bp, P. troglodytes
acaggcaccaaccacca

SEQ ID NO: 196508 - DNA, 19 bp, P. troglodytes
acaggcacgtgccaccaca

SEQ ID NO: 196509 - DNA, 16 bp, P. troglodytes
acaggcaggcaccacc

SEQ ID NO: 196510 - DNA, 16 bp, P. troglodytes
acaggcagtgtgccca

SEQ ID NO: 196511 - DNA, 17 bp, P. troglodytes
acaggcatatgccacca

SEQ ID NO: 196512 - DNA, 16 bp, P. troglodytes
acaggcatgaatcact

SEQ ID NO: 196513 - DNA, 16 bp, P. troglodytes
acaggcatgagctacc

SEQ ID NO: 196514 - DNA, 16 bp, P. troglodytes
acaggcatgagctgca

SEQ ID NO: 196515 - DNA, 16 bp, P. troglodytes
acaggcatgagtcaac

SEQ ID NO: 196516 - DNA, 16 bp, P. troglodytes
acaggcatgcaatgtg

SEQ ID NO: 196517 - DNA, 17 bp, P. troglodytes
acaggcatgcaccacca

SEQ ID NO: 196518 - DNA, 16 bp, P. troglodytes
acaggcatgcacccca

SEQ ID NO: 196519 - DNA, 17 bp, P. troglodytes
acaggcatgcatcacca

SEQ ID NO: 196520 - DNA, 16 bp, P. troglodytes
acaggcatgccaccat

SEQ ID NO: 196521 - DNA, 17 bp, P. troglodytes
acaggcatgcgctacca

SEQ ID NO: 196522 - DNA, 16 bp, P. troglodytes
acaggcatgggaatgg

SEQ ID NO: 196523 - DNA, 16 bp, P. troglodytes
acaggcatgtgccgct

SEQ ID NO: 196524 - DNA, 17 bp, P. troglodytes
acaggccaggcgtggtg

SEQ ID NO: 196525 - DNA, 16 bp, P. troglodytes
acaggccaggtgtggt

SEQ ID NO: 196526 - DNA, 16 bp, P. troglodytes
acaggcccagaggttt

SEQ ID NO: 196527 - DNA, 17 bp, P. troglodytes
acaggccccagtgtgtg

SEQ ID NO: 196528 - DNA, 16 bp, P. troglodytes
acaggcccctctgctg

SEQ ID NO: 196529 - DNA, 16 bp, P. troglodytes
acaggccctgctgtgt

SEQ ID NO: 196530 - DNA, 16 bp, P. troglodytes
acaggccctggggtgt

SEQ ID NO: 196531 - DNA, 16 bp, P. troglodytes
acaggcctgcgccacc

SEQ ID NO: 196532 - DNA, 16 bp, P. troglodytes
acaggcctgggtttga

SEQ ID NO: 196533 - DNA, 16 bp, P. troglodytes
acaggccttgctgggt

SEQ ID NO: 196534 - DNA, 16 bp, P. troglodytes
acaggcgcctgccccc

SEQ ID NO: 196535 - DNA, 17 bp, P. troglodytes
acaggcgcgagccacca

SEQ ID NO: 196536 - DNA, 17 bp, P. troglodytes
acaggcgtgagccacct

SEQ ID NO: 196537 - DNA, 16 bp, P. troglodytes
acaggcgtgagccatc

SEQ ID NO: 196538 - DNA, 16 bp, P. troglodytes
acaggcgtgagccccc

SEQ ID NO: 196539 - DNA, 16 bp, P. troglodytes
acaggcgtgagcccct

SEQ ID NO: 196540 - DNA, 19 bp, P. troglodytes
acaggcgtgagctaccacg

SEQ ID NO: 196541 - DNA, 16 bp, P. troglodytes
acaggctatttaaaaa

SEQ ID NO: 196542 - DNA, 16 bp, P. troglodytes
acaggctatttgaaaa

SEQ ID NO: 196543 - DNA, 16 bp, P. troglodytes
acaggctcctgccacc

SEQ ID NO: 196544 - DNA, 17 bp, P. troglodytes
acaggctctcattctgt

SEQ ID NO: 196545 - DNA, 16 bp, P. troglodytes
acaggctgaaggcagc

SEQ ID NO: 196546 - DNA, 16 bp, P. troglodytes
acaggctgacattgag

SEQ ID NO: 196547 - DNA, 16 bp, P. troglodytes
acaggctgactctctt

SEQ ID NO: 196548 - DNA, 16 bp, P. troglodytes
acaggctgactttctt

SEQ ID NO: 196549 - DNA, 16 bp, P. troglodytes
acaggctggagtgcaa

SEQ ID NO: 196550 - DNA, 16 bp, P. troglodytes
acaggctgggaagtgt

SEQ ID NO: 196551 - DNA, 16 bp, P. troglodytes
acaggctgggcactgt

SEQ ID NO: 196552 - DNA, 16 bp, P. troglodytes
acaggctggtcttgaa

SEQ ID NO: 196553 - DNA, 16 bp, P. troglodytes
acaggctttacaggaa

SEQ ID NO: 196554 - DNA, 16 bp, P. troglodytes
acaggctttggagtca

SEQ ID NO: 196555 - DNA, 16 bp, P. troglodytes
acagggaagaaggcca

SEQ ID NO: 196556 - DNA, 16 bp, P. troglodytes
acagggacagagacag

SEQ ID NO: 196557 - DNA, 16 bp, P. troglodytes
acagggacagggacag

SEQ ID NO: 196558 - DNA, 17 bp, P. troglodytes
acagggacatggatgaa

SEQ ID NO: 196559 - DNA, 16 bp, P. troglodytes
acagggaccctgggcc

SEQ ID NO: 196560 - DNA, 16 bp, P. troglodytes
acagggagaaggaaac

SEQ ID NO: 196561 - DNA, 16 bp, P. troglodytes
acagggatgcagaaaa

SEQ ID NO: 196562 - DNA, 16 bp, P. troglodytes
acagggattttcacag

SEQ ID NO: 196563 - DNA, 16 bp, P. troglodytes
acagggatttttacaa

SEQ ID NO: 196564 - DNA, 16 bp, P. troglodytes
acagggcaagactcca

SEQ ID NO: 196565 - DNA, 16 bp, P. troglodytes
acagggcaagactctg

SEQ ID NO: 196566 - DNA, 16 bp, P. troglodytes
acagggcctcactctg

SEQ ID NO: 196567 - DNA, 16 bp, P. troglodytes
acagggcctccctctg

SEQ ID NO: 196568 - DNA, 16 bp, P. troglodytes
acaggggtggagcttc

SEQ ID NO: 196569 - DNA, 16 bp, P. troglodytes
acagggtctcgccatg

SEQ ID NO: 196570 - DNA, 16 bp, P. troglodytes
acagggtctcgctcta

SEQ ID NO: 196571 - DNA, 16 bp, P. troglodytes
acagggtctctctttg

SEQ ID NO: 196572 - DNA, 17 bp, P. troglodytes
acagggtctggagtggg

SEQ ID NO: 196573 - DNA, 16 bp, P. troglodytes
acagggttcctgacct

SEQ ID NO: 196574 - DNA, 16 bp, P. troglodytes
acagggtttctccacg

SEQ ID NO: 196575 - DNA, 16 bp, P. troglodytes
acagggtttctccgtg

SEQ ID NO: 196576 - DNA, 16 bp, P. troglodytes
acagggttttgccaca

SEQ ID NO: 196577 - DNA, 16 bp, P. troglodytes
acaggtaaagaaactg

SEQ ID NO: 196578 - DNA, 16 bp, P. troglodytes
acaggtaaggaaacag

SEQ ID NO: 196579 - DNA, 16 bp, P. troglodytes
acaggtatgtaccacc

SEQ ID NO: 196580 - DNA, 16 bp, P. troglodytes
acaggtattaaaggac

SEQ ID NO: 196581 - DNA, 16 bp, P. troglodytes
acaggtcacagtcaaa

SEQ ID NO: 196582 - DNA, 16 bp, P. troglodytes
acaggtccccaccacc

SEQ ID NO: 196583 - DNA, 16 bp, P. troglodytes
acaggtctcactctgt

SEQ ID NO: 196584 - DNA, 16 bp, P. troglodytes
acaggtgatgtttggt

SEQ ID NO: 196585 - DNA, 16 bp, P. troglodytes
acaggtgcaagccaca

SEQ ID NO: 196586 - DNA, 16 bp, P. troglodytes
acaggtgcacgacacc

SEQ ID NO: 196587 - DNA, 16 bp, P. troglodytes
acaggtgcccagcacc

SEQ ID NO: 196588 - DNA, 16 bp, P. troglodytes
acaggtgcccgacacc

SEQ ID NO: 196589 - DNA, 16 bp, P. troglodytes
acaggtgccggccacc

SEQ ID NO: 196590 - DNA, 17 bp, P. troglodytes
acaggtgcctgcaacca

SEQ ID NO: 196591 - DNA, 16 bp, P. troglodytes
acaggtgcgagccact

SEQ ID NO: 196592 - DNA, 17 bp, P. troglodytes
acaggtgcttgccatca

SEQ ID NO: 196593 - DNA, 16 bp, P. troglodytes
acaggtgggggaagaa

SEQ ID NO: 196594 - DNA, 17 bp, P. troglodytes
acaggtgtgaaccacca

SEQ ID NO: 196595 - DNA, 16 bp, P. troglodytes
acaggtgtgcaccaca

SEQ ID NO: 196596 - DNA, 16 bp, P. troglodytes
acaggtgtgcaccgcc

SEQ ID NO: 196597 - DNA, 16 bp, P. troglodytes
acaggtgtgcatcact

SEQ ID NO: 196598 - DNA, 16 bp, P. troglodytes
acaggtgtggaggggc

SEQ ID NO: 196599 - DNA, 16 bp, P. troglodytes
acaggtgtgggctgct

SEQ ID NO: 196600 - DNA, 16 bp, P. troglodytes
acaggttgtggtaaag

SEQ ID NO: 196601 - DNA, 16 bp, P. troglodytes
acaggtttgtagcctg

SEQ ID NO: 196602 - DNA, 16 bp, P. troglodytes
acaggttttcaccata

SEQ ID NO: 196603 - DNA, 16 bp, P. troglodytes
acaggtttttgagaat

SEQ ID NO: 196604 - DNA, 16 bp, P. troglodytes
acaggttttttgtttt

SEQ ID NO: 196605 - DNA, 16 bp, P. troglodytes
acagtaaaaatgcagt

SEQ ID NO: 196606 - DNA, 16 bp, P. troglodytes
acagtaaaataaagca

SEQ ID NO: 196607 - DNA, 16 bp, P. troglodytes
acagtaaaatatattt

SEQ ID NO: 196608 - DNA, 16 bp, P. troglodytes
acagtaagagattaat

SEQ ID NO: 196609 - DNA, 16 bp, P. troglodytes
acagtaataatgggag

SEQ ID NO: 196610 - DNA, 16 bp, P. troglodytes
acagtaatttttaaat

SEQ ID NO: 196611 - DNA, 16 bp, P. troglodytes
acagtaatttttttaa

SEQ ID NO: 196612 - DNA, 16 bp, P. troglodytes
acagtaattttttttt

SEQ ID NO: 196613 - DNA, 16 bp, P. troglodytes
acagtacaaaatgaaa

SEQ ID NO: 196614 - DNA, 16 bp, P. troglodytes
acagtacctggcacag

SEQ ID NO: 196615 - DNA, 16 bp, P. troglodytes
acagtagatgctcagt

SEQ ID NO: 196616 - DNA, 16 bp, P. troglodytes
acagtagcatcaccag

SEQ ID NO: 196617 - DNA, 16 bp, P. troglodytes
acagtatgaaaatgga

SEQ ID NO: 196618 - DNA, 16 bp, P. troglodytes
acagtatgctcctgaa

SEQ ID NO: 196619 - DNA, 16 bp, P. troglodytes
acagtatggagtttcc

SEQ ID NO: 196620 - DNA, 16 bp, P. troglodytes
acagtatgtaacattt

SEQ ID NO: 196621 - DNA, 16 bp, P. troglodytes
acagtattacagtatt

SEQ ID NO: 196622 - DNA, 16 bp, P. troglodytes
acagtattattttaaa

SEQ ID NO: 196623 - DNA, 16 bp, P. troglodytes
acagtattgcactaaa

SEQ ID NO: 196624 - DNA, 16 bp, P. troglodytes
acagtattttcttttt

SEQ ID NO: 196625 - DNA, 16 bp, P. troglodytes
acagtattttttaaat

SEQ ID NO: 196626 - DNA, 19 bp, P. troglodytes
acagtccccagagtgtgat

SEQ ID NO: 196627 - DNA, 16 bp, P. troglodytes
acagtcctgatttggc

SEQ ID NO: 196628 - DNA, 16 bp, P. troglodytes
acagtcctggaggcta

SEQ ID NO: 196629 - DNA, 16 bp, P. troglodytes
acagtcgcatgccacc

SEQ ID NO: 196630 - DNA, 16 bp, P. troglodytes
acagtcgctcatgcct

SEQ ID NO: 196631 - DNA, 16 bp, P. troglodytes
acagtctcactctgtc

SEQ ID NO: 196632 - DNA, 16 bp, P. troglodytes
acagtctcgctctgtc

SEQ ID NO: 196633 - DNA, 16 bp, P. troglodytes
acagtctctcagacaa

SEQ ID NO: 196634 - DNA, 16 bp, P. troglodytes
acagtctctgaaattg

SEQ ID NO: 196635 - DNA, 16 bp, P. troglodytes
acagtctctgtctttt

SEQ ID NO: 196636 - DNA, 16 bp, P. troglodytes
acagtctcttcaaaaa

SEQ ID NO: 196637 - DNA, 16 bp, P. troglodytes
acagtctgtcatggct

SEQ ID NO: 196638 - DNA, 16 bp, P. troglodytes
acagtcttcctctgtt

SEQ ID NO: 196639 - DNA, 16 bp, P. troglodytes
acagtgaaaaaggaaa

SEQ ID NO: 196640 - DNA, 16 bp, P. troglodytes
acagtgaaataaaatt

SEQ ID NO: 196641 - DNA, 16 bp, P. troglodytes
acagtgaagaaacctg

SEQ ID NO: 196642 - DNA, 16 bp, P. troglodytes
acagtgaccaaaacag

SEQ ID NO: 196643 - DNA, 16 bp, P. troglodytes
acagtgacctggatga

SEQ ID NO: 196644 - DNA, 16 bp, P. troglodytes
acagtgactcatgtct

SEQ ID NO: 196645 - DNA, 16 bp, P. troglodytes
acagtgagacctccat

SEQ ID NO: 196646 - DNA, 17 bp, P. troglodytes
acagtgagactccatct

SEQ ID NO: 196647 - DNA, 17 bp, P. troglodytes
acagtgagactccgtct

SEQ ID NO: 196648 - DNA, 16 bp, P. troglodytes
acagtgagagactcca

SEQ ID NO: 196649 - DNA, 16 bp, P. troglodytes
acagtgagccaagatt

SEQ ID NO: 196650 - DNA, 23 bp, P. troglodytes
acagtgagctgagatcgtgccac

SEQ ID NO: 196651 - DNA, 16 bp, P. troglodytes
acagtgaggagggctg

SEQ ID NO: 196652 - DNA, 16 bp, P. troglodytes
acagtgaggccccatc

SEQ ID NO: 196653 - DNA, 16 bp, P. troglodytes
acagtgagtgagttct

SEQ ID NO: 196654 - DNA, 16 bp, P. troglodytes
acagtgcaagaccctg

SEQ ID NO: 196655 - DNA, 16 bp, P. troglodytes
acagtgcacacacaca

SEQ ID NO: 196656 - DNA, 16 bp, P. troglodytes
acagtgcagtggcagg

SEQ ID NO: 196657 - DNA, 16 bp, P. troglodytes
acagtgcatggcacat

SEQ ID NO: 196658 - DNA, 16 bp, P. troglodytes
acagtgcccagtccca

SEQ ID NO: 196659 - DNA, 16 bp, P. troglodytes
acagtgcctcatgcct

SEQ ID NO: 196660 - DNA, 16 bp, P. troglodytes
acagtgcctgacacat

SEQ ID NO: 196661 - DNA, 16 bp, P. troglodytes
acagtgcctgccacat

SEQ ID NO: 196662 - DNA, 16 bp, P. troglodytes
acagtgcctggcatat

SEQ ID NO: 196663 - DNA, 16 bp, P. troglodytes
acagtgctggcatctg

SEQ ID NO: 196664 - DNA, 16 bp, P. troglodytes
acagtgcttggaacat

SEQ ID NO: 196665 - DNA, 16 bp, P. troglodytes
acagtggacaccctgc

SEQ ID NO: 196666 - DNA, 16 bp, P. troglodytes
acagtggagaagcctg

SEQ ID NO: 196667 - DNA, 16 bp, P. troglodytes
acagtggagatggaga

SEQ ID NO: 196668 - DNA, 16 bp, P. troglodytes
acagtggagtgttaaa

SEQ ID NO: 196669 - DNA, 16 bp, P. troglodytes
acagtggatcatgcct

SEQ ID NO: 196670 - DNA, 16 bp, P. troglodytes
acagtggatctctctg

SEQ ID NO: 196671 - DNA, 16 bp, P. troglodytes
acagtggcacaatcat

SEQ ID NO: 196672 - DNA, 16 bp, P. troglodytes
acagtggcaggcaggc

SEQ ID NO: 196673 - DNA, 16 bp, P. troglodytes
acagtggcataatctc

SEQ ID NO: 196674 - DNA, 20 bp, P. troglodytes
acagtggcatgatctcagct

SEQ ID NO: 196675 - DNA, 29 bp, P. troglodytes
acagtggccttcctctatctcaactgcaa

SEQ ID NO: 196676 - DNA, 16 bp, P. troglodytes
acagtggctcatgctt

SEQ ID NO: 196677 - DNA, 16 bp, P. troglodytes
acagtggctgtcttct

SEQ ID NO: 196678 - DNA, 16 bp, P. troglodytes
acagtggctgtgccat

SEQ ID NO: 196679 - DNA, 16 bp, P. troglodytes
acagtggcttacacct

SEQ ID NO: 196680 - DNA, 16 bp, P. troglodytes
acagtggcttacatct

SEQ ID NO: 196681 - DNA, 16 bp, P. troglodytes
acagtgggccttgggc

SEQ ID NO: 196682 - DNA, 16 bp, P. troglodytes
acagtggtgtgatctc

SEQ ID NO: 196683 - DNA, 16 bp, P. troglodytes
acagtggttctcaaac

SEQ ID NO: 196684 - DNA, 16 bp, P. troglodytes
acagtggtttacacct

SEQ ID NO: 196685 - DNA, 16 bp, P. troglodytes
acagtgtaaaagtatt

SEQ ID NO: 196686 - DNA, 16 bp, P. troglodytes
acagtgtcacttctgc

SEQ ID NO: 196687 - DNA, 16 bp, P. troglodytes
acagtgtcttttgaag

SEQ ID NO: 196688 - DNA, 16 bp, P. troglodytes
acagtgtgaaactctg

SEQ ID NO: 196689 - DNA, 16 bp, P. troglodytes
acagtgtgagacttca

SEQ ID NO: 196690 - DNA, 16 bp, P. troglodytes
acagtgtggaaattcc

SEQ ID NO: 196691 - DNA, 16 bp, P. troglodytes
acagtgtggaagcttt

SEQ ID NO: 196692 - DNA, 16 bp, P. troglodytes
acagtgtggcactggc

SEQ ID NO: 196693 - DNA, 16 bp, P. troglodytes
acagtgtgggagcagg

SEQ ID NO: 196694 - DNA, 16 bp, P. troglodytes
acagtgttaaagtgtt

SEQ ID NO: 196695 - DNA, 16 bp, P. troglodytes
acagtgttatttgaaa

SEQ ID NO: 196696 - DNA, 16 bp, P. troglodytes
acagtgtttacaaagt

SEQ ID NO: 196697 - DNA, 16 bp, P. troglodytes
acagtgtttataaagt

SEQ ID NO: 196698 - DNA, 16 bp, P. troglodytes
acagtgtttcaccgtg

SEQ ID NO: 196699 - DNA, 16 bp, P. troglodytes
acagtgttttcttttt

SEQ ID NO: 196700 - DNA, 16 bp, P. troglodytes
acagttaaaagaacta

SEQ ID NO: 196701 - DNA, 16 bp, P. troglodytes
acagttagccaagttg

SEQ ID NO: 196702 - DNA, 16 bp, P. troglodytes
acagttcacaatagag

SEQ ID NO: 196703 - DNA, 16 bp, P. troglodytes
acagttcagtggcatt

SEQ ID NO: 196704 - DNA, 16 bp, P. troglodytes
acagttctagagtctg

SEQ ID NO: 196705 - DNA, 16 bp, P. troglodytes
acagttctaggggctg

SEQ ID NO: 196706 - DNA, 16 bp, P. troglodytes
acagttctggagggta

SEQ ID NO: 196707 - DNA, 16 bp, P. troglodytes
acagttctggaggtgg

SEQ ID NO: 196708 - DNA, 16 bp, P. troglodytes
acagttgacccttgaa

SEQ ID NO: 196709 - DNA, 16 bp, P. troglodytes
acagttggcagtttct

SEQ ID NO: 196710 - DNA, 17 bp, P. troglodytes
acagttggggtcctcct

SEQ ID NO: 196711 - DNA, 16 bp, P. troglodytes
acagttgtgcaggttg

SEQ ID NO: 196712 - DNA, 16 bp, P. troglodytes
acagtttacaaagcac

SEQ ID NO: 196713 - DNA, 17 bp, P. troglodytes
acagtttacaaatgcca

SEQ ID NO: 196714 - DNA, 16 bp, P. troglodytes
acagtttcatctcaaa

SEQ ID NO: 196715 - DNA, 16 bp, P. troglodytes
acagtttcattttttt

SEQ ID NO: 196716 - DNA, 16 bp, P. troglodytes
acagtttcctcatctg

SEQ ID NO: 196717 - DNA, 16 bp, P. troglodytes
acagtttccttttgct

SEQ ID NO: 196718 - DNA, 16 bp, P. troglodytes
acagtttcttttcttt

SEQ ID NO: 196719 - DNA, 16 bp, P. troglodytes
acagtttggaaaattt

SEQ ID NO: 196720 - DNA, 16 bp, P. troglodytes
acagtttggagggctt

SEQ ID NO: 196721 - DNA, 16 bp, P. troglodytes
acagtttggtggtttc

SEQ ID NO: 196722 - DNA, 16 bp, P. troglodytes
acagttttataatatt

SEQ ID NO: 196723 - DNA, 16 bp, P. troglodytes
acagttttcagtgtac

SEQ ID NO: 196724 - DNA, 16 bp, P. troglodytes
acagtttttaaaatta

SEQ ID NO: 196725 - DNA, 16 bp, P. troglodytes
acagtttttaaataaa

SEQ ID NO: 196726 - DNA, 16 bp, P. troglodytes
acagtttttatatttt

SEQ ID NO: 196727 - DNA, 16 bp, P. troglodytes
acagtttttccaaact

SEQ ID NO: 196728 - DNA, 16 bp, P. troglodytes
acataaaaaccagaca

SEQ ID NO: 196729 - DNA, 16 bp, P. troglodytes
acataaaaagatattc

SEQ ID NO: 196730 - DNA, 16 bp, P. troglodytes
acataaaacttacatt

SEQ ID NO: 196731 - DNA, 16 bp, P. troglodytes
acataaaatcaaccta

SEQ ID NO: 196732 - DNA, 16 bp, P. troglodytes
acataaaatttaccat

SEQ ID NO: 196733 - DNA, 16 bp, P. troglodytes
acataaacaaaaatgt

SEQ ID NO: 196734 - DNA, 16 bp, P. troglodytes
acataaacaaatggaa

SEQ ID NO: 196735 - DNA, 16 bp, P. troglodytes
acataaacagaatcaa

SEQ ID NO: 196736 - DNA, 16 bp, P. troglodytes
acataaagatgagaac

SEQ ID NO: 196737 - DNA, 16 bp, P. troglodytes
acataaatataaatgt

SEQ ID NO: 196738 - DNA, 16 bp, P. troglodytes
acataaatctggctta

SEQ ID NO: 196739 - DNA, 16 bp, P. troglodytes
acataaatgaaaatat

SEQ ID NO: 196740 - DNA, 18 bp, P. troglodytes
acataaatgtcttctttt

SEQ ID NO: 196741 - DNA, 16 bp, P. troglodytes
acataaatgttttaaa

SEQ ID NO: 196742 - DNA, 16 bp, P. troglodytes
acataactaactccat

SEQ ID NO: 196743 - DNA, 16 bp, P. troglodytes
acataagaagaatata

SEQ ID NO: 196744 - DNA, 16 bp, P. troglodytes
acataagctttcattt

SEQ ID NO: 196745 - DNA, 16 bp, P. troglodytes
acataagtgtgtgtgt

SEQ ID NO: 196746 - DNA, 16 bp, P. troglodytes
acataataaatatttg

SEQ ID NO: 196747 - DNA, 16 bp, P. troglodytes
acataataataatggg

SEQ ID NO: 196748 - DNA, 16 bp, P. troglodytes
acataatacaatgtaa

SEQ ID NO: 196749 - DNA, 16 bp, P. troglodytes
acataataggtgctca

SEQ ID NO: 196750 - DNA, 16 bp, P. troglodytes
acataatctcttggga

SEQ ID NO: 196751 - DNA, 16 bp, P. troglodytes
acataatgacttccag

SEQ ID NO: 196752 - DNA, 16 bp, P. troglodytes
acataatggctgaaaa

SEQ ID NO: 196753 - DNA, 16 bp, P. troglodytes
acataatttttctaaa

SEQ ID NO: 196754 - DNA, 16 bp, P. troglodytes
acatacaaatatcagt

SEQ ID NO: 196755 - DNA, 16 bp, P. troglodytes
acatacaatggaacat

SEQ ID NO: 196756 - DNA, 16 bp, P. troglodytes
acatacacacacacat

SEQ ID NO: 196757 - DNA, 16 bp, P. troglodytes
acatacacacatgcat

SEQ ID NO: 196758 - DNA, 17 bp, P. troglodytes
acatacacaccatggaa

SEQ ID NO: 196759 - DNA, 16 bp, P. troglodytes
acatacacatacacag

SEQ ID NO: 196760 - DNA, 16 bp, P. troglodytes
acatacagacacacat

SEQ ID NO: 196761 - DNA, 16 bp, P. troglodytes
acatacagagaagagc

SEQ ID NO: 196762 - DNA, 16 bp, P. troglodytes
acatacaggggagaga

SEQ ID NO: 196763 - DNA, 16 bp, P. troglodytes
acatacatacacacat

SEQ ID NO: 196764 - DNA, 16 bp, P. troglodytes
acatacatacacattt

SEQ ID NO: 196765 - DNA, 16 bp, P. troglodytes
acatacatacatacat

SEQ ID NO: 196766 - DNA, 16 bp, P. troglodytes
acatacatatatattt

SEQ ID NO: 196767 - DNA, 16 bp, P. troglodytes
acatacatgcacacac

SEQ ID NO: 196768 - DNA, 16 bp, P. troglodytes
acatacatgtgtatgt

SEQ ID NO: 196769 - DNA, 16 bp, P. troglodytes
acatacatttttaaaa

SEQ ID NO: 196770 - DNA, 16 bp, P. troglodytes
acataccaaattataa

SEQ ID NO: 196771 - DNA, 16 bp, P. troglodytes
acataccacattttct

SEQ ID NO: 196772 - DNA, 16 bp, P. troglodytes
acatacctcattttat

SEQ ID NO: 196773 - DNA, 16 bp, P. troglodytes
acatacctgaaaatgt

SEQ ID NO: 196774 - DNA, 16 bp, P. troglodytes
acataccttaatttaa

SEQ ID NO: 196775 - DNA, 16 bp, P. troglodytes
acatactacagagaaa

SEQ ID NO: 196776 - DNA, 16 bp, P. troglodytes
acatactatatatata

SEQ ID NO: 196777 - DNA, 16 bp, P. troglodytes
acatactttgtattat

SEQ ID NO: 196778 - DNA, 16 bp, P. troglodytes
acatagaaaatctgaa

SEQ ID NO: 196779 - DNA, 16 bp, P. troglodytes
acatagaaactgaaca

SEQ ID NO: 196780 - DNA, 16 bp, P. troglodytes
acatagaaatggccaa

SEQ ID NO: 196781 - DNA, 16 bp, P. troglodytes
acatagaagcaaaaat

SEQ ID NO: 196782 - DNA, 16 bp, P. troglodytes
acatagacatagatat

SEQ ID NO: 196783 - DNA, 17 bp, P. troglodytes
acatagagaaaccccat

SEQ ID NO: 196784 - DNA, 16 bp, P. troglodytes
acatagagaatagaag

SEQ ID NO: 196785 - DNA, 16 bp, P. troglodytes
acatagaggagaacaa

SEQ ID NO: 196786 - DNA, 16 bp, P. troglodytes
acatagataaatataa

SEQ ID NO: 196787 - DNA, 16 bp, P. troglodytes
acatagatcaatggaa

SEQ ID NO: 196788 - DNA, 16 bp, P. troglodytes
acatagatgaaattgg

SEQ ID NO: 196789 - DNA, 17 bp, P. troglodytes
acatagatgaagctgga

SEQ ID NO: 196790 - DNA, 16 bp, P. troglodytes
acatagatgtgaaaat

SEQ ID NO: 196791 - DNA, 16 bp, P. troglodytes
acatagcaagagccca

SEQ ID NO: 196792 - DNA, 16 bp, P. troglodytes
acatagcatttatatt

SEQ ID NO: 196793 - DNA, 16 bp, P. troglodytes
acatagcgagacctca

SEQ ID NO: 196794 - DNA, 16 bp, P. troglodytes
acatagcgagatcctg

SEQ ID NO: 196795 - DNA, 16 bp, P. troglodytes
acatagctagaaagtg

SEQ ID NO: 196796 - DNA, 16 bp, P. troglodytes
acataggctcaaagta

SEQ ID NO: 196797 - DNA, 16 bp, P. troglodytes
acatagtaagaccctg

SEQ ID NO: 196798 - DNA, 16 bp, P. troglodytes
acatagtagatattca

SEQ ID NO: 196799 - DNA, 16 bp, P. troglodytes
acatagtagatgctta

SEQ ID NO: 196800 - DNA, 16 bp, P. troglodytes
acatagtaggaactca

SEQ ID NO: 196801 - DNA, 16 bp, P. troglodytes
acatagtaggtgctca

SEQ ID NO: 196802 - DNA, 16 bp, P. troglodytes
acatagtatatacata

SEQ ID NO: 196803 - DNA, 16 bp, P. troglodytes
acatagtatttttatt

SEQ ID NO: 196804 - DNA, 16 bp, P. troglodytes
acatagtctctgccct

SEQ ID NO: 196805 - DNA, 16 bp, P. troglodytes
acatataaaaatgtgt

SEQ ID NO: 196806 - DNA, 16 bp, P. troglodytes
acatataaagaaaagt

SEQ ID NO: 196807 - DNA, 16 bp, P. troglodytes
acatataacatgcaaa

SEQ ID NO: 196808 - DNA, 16 bp, P. troglodytes
acatatacatatattt

SEQ ID NO: 196809 - DNA, 16 bp, P. troglodytes
acatatatacacatac

SEQ ID NO: 196810 - DNA, 16 bp, P. troglodytes
acatatatacatgtgt

SEQ ID NO: 196811 - DNA, 16 bp, P. troglodytes
acatatatatatatgg

SEQ ID NO: 196812 - DNA, 16 bp, P. troglodytes
acatatatatcctatt

SEQ ID NO: 196813 - DNA, 16 bp, P. troglodytes
acatatatatgcattt

SEQ ID NO: 196814 - DNA, 16 bp, P. troglodytes
acatatatatggaaca

SEQ ID NO: 196815 - DNA, 16 bp, P. troglodytes
acatatatatgtatgt

SEQ ID NO: 196816 - DNA, 16 bp, P. troglodytes
acatatatatttttga

SEQ ID NO: 196817 - DNA, 16 bp, P. troglodytes
acatatatgcacacac

SEQ ID NO: 196818 - DNA, 16 bp, P. troglodytes
acatatatgtatatat

SEQ ID NO: 196819 - DNA, 16 bp, P. troglodytes
acatatatgtatatta

SEQ ID NO: 196820 - DNA, 16 bp, P. troglodytes
acatatatgtatgtat

SEQ ID NO: 196821 - DNA, 16 bp, P. troglodytes
acatatatgtttatat

SEQ ID NO: 196822 - DNA, 16 bp, P. troglodytes
acatatattagtatta

SEQ ID NO: 196823 - DNA, 16 bp, P. troglodytes
acatatattcatatat

SEQ ID NO: 196824 - DNA, 16 bp, P. troglodytes
acatatatttattgag

SEQ ID NO: 196825 - DNA, 16 bp, P. troglodytes
acatatatttattgca

SEQ ID NO: 196826 - DNA, 16 bp, P. troglodytes
acatatatttgtgtgt

SEQ ID NO: 196827 - DNA, 16 bp, P. troglodytes
acatatctgaaaataa

SEQ ID NO: 196828 - DNA, 16 bp, P. troglodytes
acatatgaaaaatgct

SEQ ID NO: 196829 - DNA, 16 bp, P. troglodytes
acatatgaatttgcag

SEQ ID NO: 196830 - DNA, 16 bp, P. troglodytes
acatatgagaaaacta

SEQ ID NO: 196831 - DNA, 16 bp, P. troglodytes
acatatgagtacatgt

SEQ ID NO: 196832 - DNA, 16 bp, P. troglodytes
acatatgcacacaaaa

SEQ ID NO: 196833 - DNA, 16 bp, P. troglodytes
acatatgcatacatgt

SEQ ID NO: 196834 - DNA, 16 bp, P. troglodytes
acatatgcatgcatgt

SEQ ID NO: 196835 - DNA, 16 bp, P. troglodytes
acatatgcgtgcatgt

SEQ ID NO: 196836 - DNA, 16 bp, P. troglodytes
acatatgctttttttt

SEQ ID NO: 196837 - DNA, 16 bp, P. troglodytes
acatatgtacataaat

SEQ ID NO: 196838 - DNA, 16 bp, P. troglodytes
acatatgtactatata

SEQ ID NO: 196839 - DNA, 16 bp, P. troglodytes
acatatgtatacaaat

SEQ ID NO: 196840 - DNA, 16 bp, P. troglodytes
acatatgtgtatacat

SEQ ID NO: 196841 - DNA, 16 bp, P. troglodytes
acatatgtgtatatac

SEQ ID NO: 196842 - DNA, 16 bp, P. troglodytes
acatatgtgtgaatgt

SEQ ID NO: 196843 - DNA, 16 bp, P. troglodytes
acatatgtgtgtacac

SEQ ID NO: 196844 - DNA, 16 bp, P. troglodytes
acatatgtgtgtacat

SEQ ID NO: 196845 - DNA, 16 bp, P. troglodytes
acatatgtgtgtatat

SEQ ID NO: 196846 - DNA, 16 bp, P. troglodytes
acatatgtgtttgtgt

SEQ ID NO: 196847 - DNA, 16 bp, P. troglodytes
acatattactggaagt

SEQ ID NO: 196848 - DNA, 16 bp, P. troglodytes
acatattatctcattt

SEQ ID NO: 196849 - DNA, 16 bp, P. troglodytes
acatattgaccaatgg

SEQ ID NO: 196850 - DNA, 16 bp, P. troglodytes
acatattgtatgattc

SEQ ID NO: 196851 - DNA, 16 bp, P. troglodytes
acatatttacaagaaa

SEQ ID NO: 196852 - DNA, 16 bp, P. troglodytes
acatatttacatatat

SEQ ID NO: 196853 - DNA, 16 bp, P. troglodytes
acatatttatacattt

SEQ ID NO: 196854 - DNA, 16 bp, P. troglodytes
acatatttatatatct

SEQ ID NO: 196855 - DNA, 16 bp, P. troglodytes
acatatttattgacag

SEQ ID NO: 196856 - DNA, 16 bp, P. troglodytes
acatatttcaggatat

SEQ ID NO: 196857 - DNA, 16 bp, P. troglodytes
acatatttcttaaaaa

SEQ ID NO: 196858 - DNA, 16 bp, P. troglodytes
acatatttgaagaaat

SEQ ID NO: 196859 - DNA, 16 bp, P. troglodytes
acatatttgttaattt

SEQ ID NO: 196860 - DNA, 16 bp, P. troglodytes
acatattttaaattct

SEQ ID NO: 196861 - DNA, 16 bp, P. troglodytes
acatattttagaataa

SEQ ID NO: 196862 - DNA, 16 bp, P. troglodytes
acatattttagaattt

SEQ ID NO: 196863 - DNA, 16 bp, P. troglodytes
acatattttcaaaaat

SEQ ID NO: 196864 - DNA, 16 bp, P. troglodytes
acatattttgaaaatg

SEQ ID NO: 196865 - DNA, 16 bp, P. troglodytes
acatattttgaaatgg

SEQ ID NO: 196866 - DNA, 16 bp, P. troglodytes
acatattttggatgtt

SEQ ID NO: 196867 - DNA, 16 bp, P. troglodytes
acatattttgttagat

SEQ ID NO: 196868 - DNA, 16 bp, P. troglodytes
acatatttttaaacaa

SEQ ID NO: 196869 - DNA, 16 bp, P. troglodytes
acatatttttttctca

SEQ ID NO: 196870 - DNA, 16 bp, P. troglodytes
acatcaaaaaatggaa

SEQ ID NO: 196871 - DNA, 16 bp, P. troglodytes
acatcaaaaagctaat

SEQ ID NO: 196872 - DNA, 16 bp, P. troglodytes
acatcaaaatagaacc

SEQ ID NO: 196873 - DNA, 16 bp, P. troglodytes
acatcaaagatcacag

SEQ ID NO: 196874 - DNA, 16 bp, P. troglodytes
acatcaagggaacacc

SEQ ID NO: 196875 - DNA, 16 bp, P. troglodytes
acatcaagtgatctgc

SEQ ID NO: 196876 - DNA, 16 bp, P. troglodytes
acatcaagtttaaaag

SEQ ID NO: 196877 - DNA, 16 bp, P. troglodytes
acatcacaatcctaaa

SEQ ID NO: 196878 - DNA, 16 bp, P. troglodytes
acatcacacatggggg

SEQ ID NO: 196879 - DNA, 19 bp, P. troglodytes
acatcacactctggggact

SEQ ID NO: 196880 - DNA, 16 bp, P. troglodytes
acatcaccatcatcaa

SEQ ID NO: 196881 - DNA, 16 bp, P. troglodytes
acatcagagaatccat

SEQ ID NO: 196882 - DNA, 16 bp, P. troglodytes
acatcagctttggcaa

SEQ ID NO: 196883 - DNA, 16 bp, P. troglodytes
acatcaggagtttgag

SEQ ID NO: 196884 - DNA, 16 bp, P. troglodytes
acatcaggtgatccgc

SEQ ID NO: 196885 - DNA, 16 bp, P. troglodytes
acatcagtcatactgg

SEQ ID NO: 196886 - DNA, 16 bp, P. troglodytes
acatcagtgaataaaa

SEQ ID NO: 196887 - DNA, 16 bp, P. troglodytes
acatcataatcaaatt

SEQ ID NO: 196888 - DNA, 16 bp, P. troglodytes
acatcatatcaacaga

SEQ ID NO: 196889 - DNA, 16 bp, P. troglodytes
acatcatgtcaacaga

SEQ ID NO: 196890 - DNA, 16 bp, P. troglodytes
acatcatgttgtacat

SEQ ID NO: 196891 - DNA, 16 bp, P. troglodytes
acatcatttcatttaa

SEQ ID NO: 196892 - DNA, 16 bp, P. troglodytes
acatccaagtggagat

SEQ ID NO: 196893 - DNA, 16 bp, P. troglodytes
acatccagacaatgag

SEQ ID NO: 196894 - DNA, 16 bp, P. troglodytes
acatccagctaatttt

SEQ ID NO: 196895 - DNA, 16 bp, P. troglodytes
acatccagctgcttct

SEQ ID NO: 196896 - DNA, 16 bp, P. troglodytes
acatccaggtcatgct

SEQ ID NO: 196897 - DNA, 16 bp, P. troglodytes
acatcccatactcatg

SEQ ID NO: 196898 - DNA, 16 bp, P. troglodytes
acatccctaggaaaag

SEQ ID NO: 196899 - DNA, 16 bp, P. troglodytes
acatccctgtcttgtg

SEQ ID NO: 196900 - DNA, 16 bp, P. troglodytes
acatcctcaccaacat

SEQ ID NO: 196901 - DNA, 16 bp, P. troglodytes
acatcctcaccaccat

SEQ ID NO: 196902 - DNA, 16 bp, P. troglodytes
acatcctcaccacctg

SEQ ID NO: 196903 - DNA, 16 bp, P. troglodytes
acatcctcatcaacac

SEQ ID NO: 196904 - DNA, 16 bp, P. troglodytes
acatcctcctgtatac

SEQ ID NO: 196905 - DNA, 16 bp, P. troglodytes
acatcctcgtcagcat

SEQ ID NO: 196906 - DNA, 16 bp, P. troglodytes
acatcctgcacttgta

SEQ ID NO: 196907 - DNA, 16 bp, P. troglodytes
acatcctgcattcatg

SEQ ID NO: 196908 - DNA, 16 bp, P. troglodytes
acatccttgtcttttt

SEQ ID NO: 196909 - DNA, 17 bp, P. troglodytes
acatcctttccagcacc

SEQ ID NO: 196910 - DNA, 16 bp, P. troglodytes
acatctacatatatat

SEQ ID NO: 196911 - DNA, 16 bp, P. troglodytes
acatctatgcagccaa

SEQ ID NO: 196912 - DNA, 16 bp, P. troglodytes
acatctattgcttttt

SEQ ID NO: 196913 - DNA, 16 bp, P. troglodytes
acatctcagacaatgg

SEQ ID NO: 196914 - DNA, 16 bp, P. troglodytes
acatctccacttggat

SEQ ID NO: 196915 - DNA, 16 bp, P. troglodytes
acatctctccctttct

SEQ ID NO: 196916 - DNA, 16 bp, P. troglodytes
acatctgcctcccagg

SEQ ID NO: 196917 - DNA, 16 bp, P. troglodytes
acatctggctaatgtt

SEQ ID NO: 196918 - DNA, 16 bp, P. troglodytes
acatctggtaaaattc

SEQ ID NO: 196919 - DNA, 16 bp, P. troglodytes
acatctggtcacagaa

SEQ ID NO: 196920 - DNA, 16 bp, P. troglodytes
acatctgtaattccaa

SEQ ID NO: 196921 - DNA, 16 bp, P. troglodytes
acatctgtgaatagcc

SEQ ID NO: 196922 - DNA, 16 bp, P. troglodytes
acatcttattgaatga

SEQ ID NO: 196923 - DNA, 16 bp, P. troglodytes
acatcttcaccaacat

SEQ ID NO: 196924 - DNA, 16 bp, P. troglodytes
acatcttcctggttta

SEQ ID NO: 196925 - DNA, 16 bp, P. troglodytes
acatcttctccagcat

SEQ ID NO: 196926 - DNA, 16 bp, P. troglodytes
acatcttggccaacat

SEQ ID NO: 196927 - DNA, 16 bp, P. troglodytes
acatctttatttttgc

SEQ ID NO: 196928 - DNA, 16 bp, P. troglodytes
acatctttctcctgtg

SEQ ID NO: 196929 - DNA, 16 bp, P. troglodytes
acatctttgttttgtt

SEQ ID NO: 196930 - DNA, 17 bp, P. troglodytes
acatgaaaaaatgctca

SEQ ID NO: 196931 - DNA, 16 bp, P. troglodytes
acatgaaaataattta

SEQ ID NO: 196932 - DNA, 16 bp, P. troglodytes
acatgaaacattttcc

SEQ ID NO: 196933 - DNA, 16 bp, P. troglodytes
acatgaaagaaaaatg

SEQ ID NO: 196934 - DNA, 16 bp, P. troglodytes
acatgaaagggagttt

SEQ ID NO: 196935 - DNA, 16 bp, P. troglodytes
acatgaaattttaaat

SEQ ID NO: 196936 - DNA, 16 bp, P. troglodytes
acatgaacaaatattt

SEQ ID NO: 196937 - DNA, 16 bp, P. troglodytes
acatgaacagacactt

SEQ ID NO: 196938 - DNA, 26 bp, P. troglodytes
acatgaacagacacttctcaaaagaa

SEQ ID NO: 196939 - DNA, 16 bp, P. troglodytes
acatgaacagacattt

SEQ ID NO: 196940 - DNA, 16 bp, P. troglodytes
acatgaacctgggagg

SEQ ID NO: 196941 - DNA, 19 bp, P. troglodytes
acatgaactcattcttttt

SEQ ID NO: 196942 - DNA, 16 bp, P. troglodytes
acatgaacttgaaaaa

SEQ ID NO: 196943 - DNA, 16 bp, P. troglodytes
acatgaagaaactgag

SEQ ID NO: 196944 - DNA, 16 bp, P. troglodytes
acatgaaggaaaaaat

SEQ ID NO: 196945 - DNA, 16 bp, P. troglodytes
acatgaaggaaaaata

SEQ ID NO: 196946 - DNA, 16 bp, P. troglodytes
acatgaagggatgctg

SEQ ID NO: 196947 - DNA, 16 bp, P. troglodytes
acatgaatacacacac

SEQ ID NO: 196948 - DNA, 16 bp, P. troglodytes
acatgaatccacacat

SEQ ID NO: 196949 - DNA, 16 bp, P. troglodytes
acatgaatggcagcag

SEQ ID NO: 196950 - DNA, 16 bp, P. troglodytes
acatgaatttggaggg

SEQ ID NO: 196951 - DNA, 16 bp, P. troglodytes
acatgaattttggaag

SEQ ID NO: 196952 - DNA, 16 bp, P. troglodytes
acatgaatttttggag

SEQ ID NO: 196953 - DNA, 16 bp, P. troglodytes
acatgacaccaaaagc

SEQ ID NO: 196954 - DNA, 16 bp, P. troglodytes
acatgacatattttga

SEQ ID NO: 196955 - DNA, 16 bp, P. troglodytes
acatgacattctggaa

SEQ ID NO: 196956 - DNA, 16 bp, P. troglodytes
acatgagatttgaggg

SEQ ID NO: 196957 - DNA, 16 bp, P. troglodytes
acatgagatttggatg

SEQ ID NO: 196958 - DNA, 16 bp, P. troglodytes
acatgagatttgggca

SEQ ID NO: 196959 - DNA, 16 bp, P. troglodytes
acatgagatttgggtg

SEQ ID NO: 196960 - DNA, 16 bp, P. troglodytes
acatgagccatgctgg

SEQ ID NO: 196961 - DNA, 16 bp, P. troglodytes
acatgagtaatgtgtt

SEQ ID NO: 196962 - DNA, 16 bp, P. troglodytes
acatgataaatacata

SEQ ID NO: 196963 - DNA, 16 bp, P. troglodytes
acatgatacaggatat

SEQ ID NO: 196964 - DNA, 16 bp, P. troglodytes
acatgatctcattctt

SEQ ID NO: 196965 - DNA, 16 bp, P. troglodytes
acatgatctttttctt

SEQ ID NO: 196966 - DNA, 16 bp, P. troglodytes
acatgatggcacacac

SEQ ID NO: 196967 - DNA, 30 bp, P. troglodytes
acatgattgtatatctagaaaaccccattg

SEQ ID NO: 196968 - DNA, 16 bp, P. troglodytes
acatgatttgtaaata

SEQ ID NO: 196969 - DNA, 16 bp, P. troglodytes
acatgattttatattt

SEQ ID NO: 196970 - DNA, 16 bp, P. troglodytes
acatgatttttcttct

SEQ ID NO: 196971 - DNA, 16 bp, P. troglodytes
acatgcaaaataatga

SEQ ID NO: 196972 - DNA, 16 bp, P. troglodytes
acatgcaaatgtatgt

SEQ ID NO: 196973 - DNA, 16 bp, P. troglodytes
acatgcacacacaaag

SEQ ID NO: 196974 - DNA, 16 bp, P. troglodytes
acatgcacacacacag

SEQ ID NO: 196975 - DNA, 16 bp, P. troglodytes
acatgcacacacacat

SEQ ID NO: 196976 - DNA, 16 bp, P. troglodytes
acatgcacacacagac

SEQ ID NO: 196977 - DNA, 16 bp, P. troglodytes
acatgcacacggatgt

SEQ ID NO: 196978 - DNA, 16 bp, P. troglodytes
acatgcacatgaatgt

SEQ ID NO: 196979 - DNA, 17 bp, P. troglodytes
acatgcacatgtatgtt

SEQ ID NO: 196980 - DNA, 16 bp, P. troglodytes
acatgcacatgtgtgt

SEQ ID NO: 196981 - DNA, 16 bp, P. troglodytes
acatgcagtctttggt

SEQ ID NO: 196982 - DNA, 16 bp, P. troglodytes
acatgcatacacacat

SEQ ID NO: 196983 - DNA, 16 bp, P. troglodytes
acatgcatatgcaagt

SEQ ID NO: 196984 - DNA, 16 bp, P. troglodytes
acatgcatatgtatgt

SEQ ID NO: 196985 - DNA, 16 bp, P. troglodytes
acatgcatgaaccttg

SEQ ID NO: 196986 - DNA, 16 bp, P. troglodytes
acatgcatgtgtatgt

SEQ ID NO: 196987 - DNA, 16 bp, P. troglodytes
acatgcatgtttacag

SEQ ID NO: 196988 - DNA, 16 bp, P. troglodytes
acatgccaaaatgtaa

SEQ ID NO: 196989 - DNA, 16 bp, P. troglodytes
acatgccaaagaatga

SEQ ID NO: 196990 - DNA, 16 bp, P. troglodytes
acatgccaacaaattg

SEQ ID NO: 196991 - DNA, 17 bp, P. troglodytes
acatgccaccacaccca

SEQ ID NO: 196992 - DNA, 17 bp, P. troglodytes
acatgccaggctaattt

SEQ ID NO: 196993 - DNA, 16 bp, P. troglodytes
acatgcctggctaatt

SEQ ID NO: 196994 - DNA, 16 bp, P. troglodytes
acatgcctgtaatcca

SEQ ID NO: 196995 - DNA, 16 bp, P. troglodytes
acatgcctgtaatccg

SEQ ID NO: 196996 - DNA, 18 bp, P. troglodytes
acatgcctgtagtcccaa

SEQ ID NO: 196997 - DNA, 16 bp, P. troglodytes
acatgccttcctcact

SEQ ID NO: 196998 - DNA, 16 bp, P. troglodytes
acatgcctttctcact

SEQ ID NO: 196999 - DNA, 16 bp, P. troglodytes
acatgcgcacgcacac

SEQ ID NO: 197000 - DNA, 16 bp, P. troglodytes
acatgcgcgtgcacac

SEQ ID NO: 197001 - DNA, 16 bp, P. troglodytes
acatgctgaaacctca

SEQ ID NO: 197002 - DNA, 17 bp, P. troglodytes
acatgctggccaggctg

SEQ ID NO: 197003 - DNA, 16 bp, P. troglodytes
acatgctggggcctgt

SEQ ID NO: 197004 - DNA, 16 bp, P. troglodytes
acatgctgttctctct

SEQ ID NO: 197005 - DNA, 16 bp, P. troglodytes
acatgcttttaaaaaa

SEQ ID NO: 197006 - DNA, 16 bp, P. troglodytes
acatgcttttaaaata

SEQ ID NO: 197007 - DNA, 16 bp, P. troglodytes
acatggaaaaatgctc

SEQ ID NO: 197008 - DNA, 16 bp, P. troglodytes
acatggaaactgaaga

SEQ ID NO: 197009 - DNA, 16 bp, P. troglodytes
acatggaagaaccttg

SEQ ID NO: 197010 - DNA, 16 bp, P. troglodytes
acatggacacaggtag

SEQ ID NO: 197011 - DNA, 16 bp, P. troglodytes
acatggacacagtgag

SEQ ID NO: 197012 - DNA, 17 bp, P. troglodytes
acatggagaaaccccgt

SEQ ID NO: 197013 - DNA, 16 bp, P. troglodytes
acatggagaaacctgt

SEQ ID NO: 197014 - DNA, 17 bp, P. troglodytes
acatggagaaactctgt

SEQ ID NO: 197015 - DNA, 16 bp, P. troglodytes
acatggagaaattgga

SEQ ID NO: 197016 - DNA, 16 bp, P. troglodytes
acatggagaagccctg

SEQ ID NO: 197017 - DNA, 16 bp, P. troglodytes
acatggagaggaacaa

SEQ ID NO: 197018 - DNA, 16 bp, P. troglodytes
acatggagctgtcatc

SEQ ID NO: 197019 - DNA, 16 bp, P. troglodytes
acatggaggcaagacc

SEQ ID NO: 197020 - DNA, 16 bp, P. troglodytes
acatggagtcaaaaaa

SEQ ID NO: 197021 - DNA, 16 bp, P. troglodytes
acatggataaaactgg

SEQ ID NO: 197022 - DNA, 16 bp, P. troglodytes
acatggatgaacttga

SEQ ID NO: 197023 - DNA, 29 bp, P. troglodytes
acatggatgaagctggaaaccatcattct

SEQ ID NO: 197024 - DNA, 21 bp, P. troglodytes
acatggatgaagctggaaact

SEQ ID NO: 197025 - DNA, 16 bp, P. troglodytes
acatggatttttgact

SEQ ID NO: 197026 - DNA, 16 bp, P. troglodytes
acatggatttttttca

SEQ ID NO: 197027 - DNA, 16 bp, P. troglodytes
acatggcaaaacccag

SEQ ID NO: 197028 - DNA, 16 bp, P. troglodytes
acatggcaaaacgctg

SEQ ID NO: 197029 - DNA, 16 bp, P. troglodytes
acatggcaagacccta

SEQ ID NO: 197030 - DNA, 16 bp, P. troglodytes
acatggcagagcagga

SEQ ID NO: 197031 - DNA, 16 bp, P. troglodytes
acatggcagcaagcaa

SEQ ID NO: 197032 - DNA, 16 bp, P. troglodytes
acatggccttcttccc

SEQ ID NO: 197033 - DNA, 16 bp, P. troglodytes
acatggctaaaccctg

SEQ ID NO: 197034 - DNA, 16 bp, P. troglodytes
acatggctcacacctg

SEQ ID NO: 197035 - DNA, 16 bp, P. troglodytes
acatggctgtgctgga

SEQ ID NO: 197036 - DNA, 16 bp, P. troglodytes
acatgggactttcagt

SEQ ID NO: 197037 - DNA, 16 bp, P. troglodytes
acatggggaaactgag

SEQ ID NO: 197038 - DNA, 16 bp, P. troglodytes
acatggggattatgag

SEQ ID NO: 197039 - DNA, 16 bp, P. troglodytes
acatggggggctgagg

SEQ ID NO: 197040 - DNA, 16 bp, P. troglodytes
acatggtaactctatg

SEQ ID NO: 197041 - DNA, 16 bp, P. troglodytes
acatggtgaaacacct

SEQ ID NO: 197042 - DNA, 16 bp, P. troglodytes
acatggtgaaattcca

SEQ ID NO: 197043 - DNA, 16 bp, P. troglodytes
acatggtgctgggaaa

SEQ ID NO: 197044 - DNA, 16 bp, P. troglodytes
acatggtggaaggggt

SEQ ID NO: 197045 - DNA, 16 bp, P. troglodytes
acatggtggcacatgt

SEQ ID NO: 197046 - DNA, 27 bp, P. troglodytes
acatggtggctcacgcctgtaatccca

SEQ ID NO: 197047 - DNA, 18 bp, P. troglodytes
acatggtggctcatgcct

SEQ ID NO: 197048 - DNA, 16 bp, P. troglodytes
acatggtggtgcatgc

SEQ ID NO: 197049 - DNA, 16 bp, P. troglodytes
acatggtgttgaacct

SEQ ID NO: 197050 - DNA, 16 bp, P. troglodytes
acatgtaaaatatatg

SEQ ID NO: 197051 - DNA, 16 bp, P. troglodytes
acatgtaaatataaat

SEQ ID NO: 197052 - DNA, 16 bp, P. troglodytes
acatgtaacaaacctg

SEQ ID NO: 197053 - DNA, 16 bp, P. troglodytes
acatgtaattttaaat

SEQ ID NO: 197054 - DNA, 16 bp, P. troglodytes
acatgtacagacattt

SEQ ID NO: 197055 - DNA, 16 bp, P. troglodytes
acatgtacatacacac

SEQ ID NO: 197056 - DNA, 16 bp, P. troglodytes
acatgtacccccaaac

SEQ ID NO: 197057 - DNA, 16 bp, P. troglodytes
acatgtataatatata

SEQ ID NO: 197058 - DNA, 16 bp, P. troglodytes
acatgtatacctatat

SEQ ID NO: 197059 - DNA, 16 bp, P. troglodytes
acatgtatatgtatat

SEQ ID NO: 197060 - DNA, 16 bp, P. troglodytes
acatgtatgcatgtat

SEQ ID NO: 197061 - DNA, 16 bp, P. troglodytes
acatgtatgtatacat

SEQ ID NO: 197062 - DNA, 16 bp, P. troglodytes
acatgtatgtttatag

SEQ ID NO: 197063 - DNA, 16 bp, P. troglodytes
acatgtattaatatat

SEQ ID NO: 197064 - DNA, 16 bp, P. troglodytes
acatgtattcatcatt

SEQ ID NO: 197065 - DNA, 16 bp, P. troglodytes
acatgtatttatattt

SEQ ID NO: 197066 - DNA, 16 bp, P. troglodytes
acatgtccttcacatg

SEQ ID NO: 197067 - DNA, 16 bp, P. troglodytes
acatgtgaagaatgtg

SEQ ID NO: 197068 - DNA, 16 bp, P. troglodytes
acatgtgcacacacat

SEQ ID NO: 197069 - DNA, 16 bp, P. troglodytes
acatgtgcacacatgt

SEQ ID NO: 197070 - DNA, 16 bp, P. troglodytes
acatgtgcagattttt

SEQ ID NO: 197071 - DNA, 16 bp, P. troglodytes
acatgtgcaggtgtgt

SEQ ID NO: 197072 - DNA, 16 bp, P. troglodytes
acatgtgcatgtttgt

SEQ ID NO: 197073 - DNA, 29 bp, P. troglodytes
acatgtgccatgctggtgtgctgcaccca

SEQ ID NO: 197074 - DNA, 16 bp, P. troglodytes
acatgtggagattaca

SEQ ID NO: 197075 - DNA, 16 bp, P. troglodytes
acatgtgggaattaca

SEQ ID NO: 197076 - DNA, 16 bp, P. troglodytes
acatgtgtagaatgtg

SEQ ID NO: 197077 - DNA, 16 bp, P. troglodytes
acatgtgtatgcacac

SEQ ID NO: 197078 - DNA, 16 bp, P. troglodytes
acatgtgtgcatacac

SEQ ID NO: 197079 - DNA, 16 bp, P. troglodytes
acatgttaaaaatatt

SEQ ID NO: 197080 - DNA, 16 bp, P. troglodytes
acatgttcagtacaga

SEQ ID NO: 197081 - DNA, 16 bp, P. troglodytes
acatgttctcacctat

SEQ ID NO: 197082 - DNA, 16 bp, P. troglodytes
acatgttctcactcac

SEQ ID NO: 197083 - DNA, 16 bp, P. troglodytes
acatgttggccaggct

SEQ ID NO: 197084 - DNA, 16 bp, P. troglodytes
acatgttgggaacagg

SEQ ID NO: 197085 - DNA, 16 bp, P. troglodytes
acatgttttcatttct

SEQ ID NO: 197086 - DNA, 16 bp, P. troglodytes
acatgttttgtatgtt

SEQ ID NO: 197087 - DNA, 16 bp, P. troglodytes
acatgtttttaatttt

SEQ ID NO: 197088 - DNA, 16 bp, P. troglodytes
acatgtttttttaaaa

SEQ ID NO: 197089 - DNA, 16 bp, P. troglodytes
acattaaaaattagaa

SEQ ID NO: 197090 - DNA, 16 bp, P. troglodytes
acattaaaacagagat

SEQ ID NO: 197091 - DNA, 16 bp, P. troglodytes
acattaaaacagttgc

SEQ ID NO: 197092 - DNA, 16 bp, P. troglodytes
acattaaaaggaaaat

SEQ ID NO: 197093 - DNA, 16 bp, P. troglodytes
acattaaaatgtaaga

SEQ ID NO: 197094 - DNA, 16 bp, P. troglodytes
acattaaaattgtttt

SEQ ID NO: 197095 - DNA, 16 bp, P. troglodytes
acattaaagaagacct

SEQ ID NO: 197096 - DNA, 16 bp, P. troglodytes
acattaaagcaaaaat

SEQ ID NO: 197097 - DNA, 16 bp, P. troglodytes
acattaaaggaaaaat

SEQ ID NO: 197098 - DNA, 16 bp, P. troglodytes
acattaaataaatttg

SEQ ID NO: 197099 - DNA, 16 bp, P. troglodytes
acattaaatagcaaat

SEQ ID NO: 197100 - DNA, 16 bp, P. troglodytes
acattaaatataaatg

SEQ ID NO: 197101 - DNA, 16 bp, P. troglodytes
acattaaatgtaaatg

SEQ ID NO: 197102 - DNA, 16 bp, P. troglodytes
acattaaatttcatat

SEQ ID NO: 197103 - DNA, 16 bp, P. troglodytes
acattaacaggaattt

SEQ ID NO: 197104 - DNA, 16 bp, P. troglodytes
acattaagaaaataat

SEQ ID NO: 197105 - DNA, 16 bp, P. troglodytes
acattaattttatatc

SEQ ID NO: 197106 - DNA, 16 bp, P. troglodytes
acattacaactaaaag

SEQ ID NO: 197107 - DNA, 16 bp, P. troglodytes
acattagcaaagacat

SEQ ID NO: 197108 - DNA, 16 bp, P. troglodytes
acattaggctccttgc

SEQ ID NO: 197109 - DNA, 16 bp, P. troglodytes
acattagtgactccat

SEQ ID NO: 197110 - DNA, 16 bp, P. troglodytes
acattatatcatttaa

SEQ ID NO: 197111 - DNA, 16 bp, P. troglodytes
acattatattaaatga

SEQ ID NO: 197112 - DNA, 16 bp, P. troglodytes
acattatcaggctgca

SEQ ID NO: 197113 - DNA, 16 bp, P. troglodytes
acattattcacagaaa

SEQ ID NO: 197114 - DNA, 16 bp, P. troglodytes
acattattgttattat

SEQ ID NO: 197115 - DNA, 16 bp, P. troglodytes
acattatttttcaaaa

SEQ ID NO: 197116 - DNA, 16 bp, P. troglodytes
acattcaaagaagaat

SEQ ID NO: 197117 - DNA, 16 bp, P. troglodytes
acattcaaagcactgt

SEQ ID NO: 197118 - DNA, 16 bp, P. troglodytes
acattcaaattctgga

SEQ ID NO: 197119 - DNA, 16 bp, P. troglodytes
acattcaatgccagcc

SEQ ID NO: 197120 - DNA, 16 bp, P. troglodytes
acattcacaatgttgt

SEQ ID NO: 197121 - DNA, 16 bp, P. troglodytes
acattcacacactcac

SEQ ID NO: 197122 - DNA, 16 bp, P. troglodytes
acattcacaggtacca

SEQ ID NO: 197123 - DNA, 16 bp, P. troglodytes
acattcacagtgttgt

SEQ ID NO: 197124 - DNA, 16 bp, P. troglodytes
acattcacattgtttt

SEQ ID NO: 197125 - DNA, 16 bp, P. troglodytes
acattcagaccattgc

SEQ ID NO: 197126 - DNA, 16 bp, P. troglodytes
acattcatcctcagct

SEQ ID NO: 197127 - DNA, 16 bp, P. troglodytes
acattcattacatttg

SEQ ID NO: 197128 - DNA, 16 bp, P. troglodytes
acattcattcattcat

SEQ ID NO: 197129 - DNA, 16 bp, P. troglodytes
acattccagaaaaggc

SEQ ID NO: 197130 - DNA, 16 bp, P. troglodytes
acattcccaccagcca

SEQ ID NO: 197131 - DNA, 16 bp, P. troglodytes
acattcccaccatgga

SEQ ID NO: 197132 - DNA, 16 bp, P. troglodytes
acattcctttccattg

SEQ ID NO: 197133 - DNA, 16 bp, P. troglodytes
acattctatagagaat

SEQ ID NO: 197134 - DNA, 16 bp, P. troglodytes
acattctcacagacac

SEQ ID NO: 197135 - DNA, 16 bp, P. troglodytes
acattctcctcagcac

SEQ ID NO: 197136 - DNA, 16 bp, P. troglodytes
acattctgggaggcca

SEQ ID NO: 197137 - DNA, 16 bp, P. troglodytes
acattcttaaaagaaa

SEQ ID NO: 197138 - DNA, 16 bp, P. troglodytes
acattcttaaagagaa

SEQ ID NO: 197139 - DNA, 16 bp, P. troglodytes
acattcttaaaggaaa

SEQ ID NO: 197140 - DNA, 16 bp, P. troglodytes
acattcttaaatattt

SEQ ID NO: 197141 - DNA, 16 bp, P. troglodytes
acattcttaatgaaaa

SEQ ID NO: 197142 - DNA, 16 bp, P. troglodytes
acattcttcaagaaaa

SEQ ID NO: 197143 - DNA, 16 bp, P. troglodytes
acattcttcccagaaa

SEQ ID NO: 197144 - DNA, 16 bp, P. troglodytes
acattcttggctcact

SEQ ID NO: 197145 - DNA, 16 bp, P. troglodytes
acattcttgtacatat

SEQ ID NO: 197146 - DNA, 16 bp, P. troglodytes
acattcttttttaaaa

SEQ ID NO: 197147 - DNA, 16 bp, P. troglodytes
acattgaaaataaatt

SEQ ID NO: 197148 - DNA, 16 bp, P. troglodytes
acattgaaaataattt

SEQ ID NO: 197149 - DNA, 16 bp, P. troglodytes
acattgaaagaagaat

SEQ ID NO: 197150 - DNA, 16 bp, P. troglodytes
acattgaacatttttt

SEQ ID NO: 197151 - DNA, 16 bp, P. troglodytes
acattgatgaagctgg

SEQ ID NO: 197152 - DNA, 16 bp, P. troglodytes
acattgattttgtatt

SEQ ID NO: 197153 - DNA, 16 bp, P. troglodytes
acattgatttttaaaa

SEQ ID NO: 197154 - DNA, 16 bp, P. troglodytes
acattgatttttgtat

SEQ ID NO: 197155 - DNA, 17 bp, P. troglodytes
acattgcacttcagcct

SEQ ID NO: 197156 - DNA, 16 bp, P. troglodytes
acattgcatgcatgta

SEQ ID NO: 197157 - DNA, 16 bp, P. troglodytes
acattgcccagggcat

SEQ ID NO: 197158 - DNA, 16 bp, P. troglodytes
acattgctgctgggaa

SEQ ID NO: 197159 - DNA, 16 bp, P. troglodytes
acattgtacaccttga

SEQ ID NO: 197160 - DNA, 16 bp, P. troglodytes
acattgtataatgata

SEQ ID NO: 197161 - DNA, 16 bp, P. troglodytes
acattgtatctttgtt

SEQ ID NO: 197162 - DNA, 16 bp, P. troglodytes
acattgtattttattt

SEQ ID NO: 197163 - DNA, 16 bp, P. troglodytes
acattgtctctacaaa

SEQ ID NO: 197164 - DNA, 16 bp, P. troglodytes
acattgtctctttttt

SEQ ID NO: 197165 - DNA, 16 bp, P. troglodytes
acattgtgaatataat

SEQ ID NO: 197166 - DNA, 16 bp, P. troglodytes
acattgttaaaataaa

SEQ ID NO: 197167 - DNA, 16 bp, P. troglodytes
acattgttgcaaatga

SEQ ID NO: 197168 - DNA, 16 bp, P. troglodytes
acattgttttccaaag

SEQ ID NO: 197169 - DNA, 16 bp, P. troglodytes
acattgtttttgtaga

SEQ ID NO: 197170 - DNA, 16 bp, P. troglodytes
acatttaaaaaggaaa

SEQ ID NO: 197171 - DNA, 16 bp, P. troglodytes
acatttaaaagtaatt

SEQ ID NO: 197172 - DNA, 16 bp, P. troglodytes
acatttaaaatatgta

SEQ ID NO: 197173 - DNA, 16 bp, P. troglodytes
acatttaaagaaaaac

SEQ ID NO: 197174 - DNA, 16 bp, P. troglodytes
acatttaaagaaatat

SEQ ID NO: 197175 - DNA, 16 bp, P. troglodytes
acatttaaagaataaa

SEQ ID NO: 197176 - DNA, 16 bp, P. troglodytes
acatttaaagaattaa

SEQ ID NO: 197177 - DNA, 16 bp, P. troglodytes
acatttaaatctttaa

SEQ ID NO: 197178 - DNA, 16 bp, P. troglodytes
acatttaaattgtttt

SEQ ID NO: 197179 - DNA, 16 bp, P. troglodytes
acatttaagtatttaa

SEQ ID NO: 197180 - DNA, 16 bp, P. troglodytes
acatttaatatgatta

SEQ ID NO: 197181 - DNA, 16 bp, P. troglodytes
acatttacaaccatct

SEQ ID NO: 197182 - DNA, 17 bp, P. troglodytes
acatttacaagaaaaaa

SEQ ID NO: 197183 - DNA, 16 bp, P. troglodytes
acatttacataaaatt

SEQ ID NO: 197184 - DNA, 16 bp, P. troglodytes
acatttacatatttaa

SEQ ID NO: 197185 - DNA, 16 bp, P. troglodytes
acatttaccaaaatag

SEQ ID NO: 197186 - DNA, 16 bp, P. troglodytes
acatttaccctaaaac

SEQ ID NO: 197187 - DNA, 16 bp, P. troglodytes
acatttacttttaaaa

SEQ ID NO: 197188 - DNA, 16 bp, P. troglodytes
acatttagaaaatatt

SEQ ID NO: 197189 - DNA, 16 bp, P. troglodytes
acatttagaattgtta

SEQ ID NO: 197190 - DNA, 16 bp, P. troglodytes
acatttaggttgattc

SEQ ID NO: 197191 - DNA, 16 bp, P. troglodytes
acatttatagaatatt

SEQ ID NO: 197192 - DNA, 16 bp, P. troglodytes
acatttatataacttt

SEQ ID NO: 197193 - DNA, 16 bp, P. troglodytes
acatttatcatttgtg

SEQ ID NO: 197194 - DNA, 16 bp, P. troglodytes
acatttatgcaggcaa

SEQ ID NO: 197195 - DNA, 16 bp, P. troglodytes
acatttatgttttaaa

SEQ ID NO: 197196 - DNA, 16 bp, P. troglodytes
acatttattaaatgtt

SEQ ID NO: 197197 - DNA, 16 bp, P. troglodytes
acatttattaagcacc

SEQ ID NO: 197198 - DNA, 16 bp, P. troglodytes
acatttattaagtacc

SEQ ID NO: 197199 - DNA, 16 bp, P. troglodytes
acatttattgagctcc

SEQ ID NO: 197200 - DNA, 16 bp, P. troglodytes
acatttattttaaaga

SEQ ID NO: 197201 - DNA, 16 bp, P. troglodytes
acatttattttacaaa

SEQ ID NO: 197202 - DNA, 16 bp, P. troglodytes
acatttattttgcttt

SEQ ID NO: 197203 - DNA, 16 bp, P. troglodytes
acatttatttttgtat

SEQ ID NO: 197204 - DNA, 16 bp, P. troglodytes
acatttcaaaattaat

SEQ ID NO: 197205 - DNA, 16 bp, P. troglodytes
acatttcaaatgctca

SEQ ID NO: 197206 - DNA, 16 bp, P. troglodytes
acatttcaaatgttca

SEQ ID NO: 197207 - DNA, 16 bp, P. troglodytes
acatttcaagatgaga

SEQ ID NO: 197208 - DNA, 16 bp, P. troglodytes
acatttcaagtgctca

SEQ ID NO: 197209 - DNA, 16 bp, P. troglodytes
acatttcaagtgcttg

SEQ ID NO: 197210 - DNA, 16 bp, P. troglodytes
acatttcacaaatatt

SEQ ID NO: 197211 - DNA, 16 bp, P. troglodytes
acatttcacagatgag

SEQ ID NO: 197212 - DNA, 16 bp, P. troglodytes
acatttcaccaaaaaa

SEQ ID NO: 197213 - DNA, 16 bp, P. troglodytes
acatttcagaagaaaa

SEQ ID NO: 197214 - DNA, 16 bp, P. troglodytes
acatttcatataaatg

SEQ ID NO: 197215 - DNA, 16 bp, P. troglodytes
acatttcatattgctc

SEQ ID NO: 197216 - DNA, 16 bp, P. troglodytes
acatttcatcaatacc

SEQ ID NO: 197217 - DNA, 16 bp, P. troglodytes
acatttcattaaaaat

SEQ ID NO: 197218 - DNA, 16 bp, P. troglodytes
acatttcatttcattt

SEQ ID NO: 197219 - DNA, 16 bp, P. troglodytes
acatttcattttcatt

SEQ ID NO: 197220 - DNA, 16 bp, P. troglodytes
acatttccatataaat

SEQ ID NO: 197221 - DNA, 16 bp, P. troglodytes
acatttccatcagcaa

SEQ ID NO: 197222 - DNA, 16 bp, P. troglodytes
acatttccatcatccc

SEQ ID NO: 197223 - DNA, 16 bp, P. troglodytes
acatttcccagaatcc

SEQ ID NO: 197224 - DNA, 16 bp, P. troglodytes
acatttccccattcag

SEQ ID NO: 197225 - DNA, 16 bp, P. troglodytes
acatttcccctctgca

SEQ ID NO: 197226 - DNA, 16 bp, P. troglodytes
acatttctaaagaaaa

SEQ ID NO: 197227 - DNA, 16 bp, P. troglodytes
acatttctctctctct

SEQ ID NO: 197228 - DNA, 16 bp, P. troglodytes
acatttctctgaagaa

SEQ ID NO: 197229 - DNA, 16 bp, P. troglodytes
acatttctgattattt

SEQ ID NO: 197230 - DNA, 16 bp, P. troglodytes
acatttctgcagccaa

SEQ ID NO: 197231 - DNA, 16 bp, P. troglodytes
acatttctttgctttt

SEQ ID NO: 197232 - DNA, 16 bp, P. troglodytes
acatttgaaaataaat

SEQ ID NO: 197233 - DNA, 16 bp, P. troglodytes
acatttgaaaatattt

SEQ ID NO: 197234 - DNA, 16 bp, P. troglodytes
acatttgaaaatgaaa

SEQ ID NO: 197235 - DNA, 16 bp, P. troglodytes
acatttgaagaagaat

SEQ ID NO: 197236 - DNA, 16 bp, P. troglodytes
acatttgacaatgtct

SEQ ID NO: 197237 - DNA, 16 bp, P. troglodytes
acatttgcattgtttt

SEQ ID NO: 197238 - DNA, 16 bp, P. troglodytes
acatttgctaacttgc

SEQ ID NO: 197239 - DNA, 16 bp, P. troglodytes
acatttgcttttaaaa

SEQ ID NO: 197240 - DNA, 16 bp, P. troglodytes
acatttggaaaataaa

SEQ ID NO: 197241 - DNA, 16 bp, P. troglodytes
acatttgggaaaaaaa

SEQ ID NO: 197242 - DNA, 16 bp, P. troglodytes
acatttgggttatttc

SEQ ID NO: 197243 - DNA, 16 bp, P. troglodytes
acatttgtaaatattt

SEQ ID NO: 197244 - DNA, 16 bp, P. troglodytes
acatttgtatgtgtgt

SEQ ID NO: 197245 - DNA, 16 bp, P. troglodytes
acatttgtccaaactc

SEQ ID NO: 197246 - DNA, 16 bp, P. troglodytes
acatttgtccattttt

SEQ ID NO: 197247 - DNA, 16 bp, P. troglodytes
acatttgtggtaattt

SEQ ID NO: 197248 - DNA, 16 bp, P. troglodytes
acatttgtgttatttt

SEQ ID NO: 197249 - DNA, 16 bp, P. troglodytes
acatttgttaaatgaa

SEQ ID NO: 197250 - DNA, 16 bp, P. troglodytes
acatttgttaatatca

SEQ ID NO: 197251 - DNA, 16 bp, P. troglodytes
acatttgttatttctt

SEQ ID NO: 197252 - DNA, 16 bp, P. troglodytes
acatttgttgaataaa

SEQ ID NO: 197253 - DNA, 16 bp, P. troglodytes
acatttgttttaaaaa

SEQ ID NO: 197254 - DNA, 16 bp, P. troglodytes
acattttaaaaactga

SEQ ID NO: 197255 - DNA, 16 bp, P. troglodytes
acattttaaaaatcta

SEQ ID NO: 197256 - DNA, 16 bp, P. troglodytes
acattttaaaacttgc

SEQ ID NO: 197257 - DNA, 16 bp, P. troglodytes
acattttaaaagatgt

SEQ ID NO: 197258 - DNA, 16 bp, P. troglodytes
acattttaaaatagaa

SEQ ID NO: 197259 - DNA, 16 bp, P. troglodytes
acattttaaaatatca

SEQ ID NO: 197260 - DNA, 16 bp, P. troglodytes
acattttaaaattcat

SEQ ID NO: 197261 - DNA, 16 bp, P. troglodytes
acattttaaacaaatg

SEQ ID NO: 197262 - DNA, 16 bp, P. troglodytes
acattttaaagtattt

SEQ ID NO: 197263 - DNA, 16 bp, P. troglodytes
acattttaaattactt

SEQ ID NO: 197264 - DNA, 16 bp, P. troglodytes
acattttaacagtttt

SEQ ID NO: 197265 - DNA, 16 bp, P. troglodytes
acattttaactttaaa

SEQ ID NO: 197266 - DNA, 16 bp, P. troglodytes
acattttaagatattt

SEQ ID NO: 197267 - DNA, 16 bp, P. troglodytes
acattttaagcaaaaa

SEQ ID NO: 197268 - DNA, 16 bp, P. troglodytes
acattttaagcatttt

SEQ ID NO: 197269 - DNA, 16 bp, P. troglodytes
acattttaaggaaaaa

SEQ ID NO: 197270 - DNA, 16 bp, P. troglodytes
acattttaaggtattt

SEQ ID NO: 197271 - DNA, 16 bp, P. troglodytes
acattttaagtatatt

SEQ ID NO: 197272 - DNA, 16 bp, P. troglodytes
acattttaattatttg

SEQ ID NO: 197273 - DNA, 16 bp, P. troglodytes
acattttaattttgtt

SEQ ID NO: 197274 - DNA, 16 bp, P. troglodytes
acattttacactgttg

SEQ ID NO: 197275 - DNA, 16 bp, P. troglodytes
acattttacatttcta

SEQ ID NO: 197276 - DNA, 16 bp, P. troglodytes
acattttacattttca

SEQ ID NO: 197277 - DNA, 16 bp, P. troglodytes
acattttagaaacatt

SEQ ID NO: 197278 - DNA, 16 bp, P. troglodytes
acattttataatgttt

SEQ ID NO: 197279 - DNA, 16 bp, P. troglodytes
acattttatagtttta

SEQ ID NO: 197280 - DNA, 16 bp, P. troglodytes
acattttatatgtgta

SEQ ID NO: 197281 - DNA, 16 bp, P. troglodytes
acattttatttaagaa

SEQ ID NO: 197282 - DNA, 16 bp, P. troglodytes
acattttatttcactt

SEQ ID NO: 197283 - DNA, 16 bp, P. troglodytes
acattttatttcttca

SEQ ID NO: 197284 - DNA, 16 bp, P. troglodytes
acattttcaaagaaat

SEQ ID NO: 197285 - DNA, 16 bp, P. troglodytes
acattttcaaatgttt

SEQ ID NO: 197286 - DNA, 16 bp, P. troglodytes
acattttcacactgct

SEQ ID NO: 197287 - DNA, 16 bp, P. troglodytes
acattttcacatttct

SEQ ID NO: 197288 - DNA, 16 bp, P. troglodytes
acattttcagaaaaaa

SEQ ID NO: 197289 - DNA, 16 bp, P. troglodytes
acattttcagaaataa

SEQ ID NO: 197290 - DNA, 16 bp, P. troglodytes
acattttcatatgctt

SEQ ID NO: 197291 - DNA, 16 bp, P. troglodytes
acattttcatcacccc

SEQ ID NO: 197292 - DNA, 16 bp, P. troglodytes
acattttcatcaccct

SEQ ID NO: 197293 - DNA, 16 bp, P. troglodytes
acattttcatcagccc

SEQ ID NO: 197294 - DNA, 16 bp, P. troglodytes
acattttcattatcca

SEQ ID NO: 197295 - DNA, 16 bp, P. troglodytes
acattttcatttcatt

SEQ ID NO: 197296 - DNA, 16 bp, P. troglodytes
acattttcattttcat

SEQ ID NO: 197297 - DNA, 16 bp, P. troglodytes
acattttcattttcca

SEQ ID NO: 197298 - DNA, 16 bp, P. troglodytes
acattttccaaaatgt

SEQ ID NO: 197299 - DNA, 16 bp, P. troglodytes
acattttccaaatttt

SEQ ID NO: 197300 - DNA, 16 bp, P. troglodytes
acattttcccctttgt

SEQ ID NO: 197301 - DNA, 16 bp, P. troglodytes
acattttcctgttttt

SEQ ID NO: 197302 - DNA, 16 bp, P. troglodytes
acattttctcttaaaa

SEQ ID NO: 197303 - DNA, 16 bp, P. troglodytes
acattttcttaatcct

SEQ ID NO: 197304 - DNA, 16 bp, P. troglodytes
acattttcttctagta

SEQ ID NO: 197305 - DNA, 16 bp, P. troglodytes
acattttcttgaaaat

SEQ ID NO: 197306 - DNA, 16 bp, P. troglodytes
acattttctttctcta

SEQ ID NO: 197307 - DNA, 16 bp, P. troglodytes
acattttgaaaggaat

SEQ ID NO: 197308 - DNA, 16 bp, P. troglodytes
acattttgaatattaa

SEQ ID NO: 197309 - DNA, 16 bp, P. troglodytes
acattttgagccagat

SEQ ID NO: 197310 - DNA, 16 bp, P. troglodytes
acattttgattttatt

SEQ ID NO: 197311 - DNA, 16 bp, P. troglodytes
acattttgcttatcca

SEQ ID NO: 197312 - DNA, 16 bp, P. troglodytes
acattttgcttatctg

SEQ ID NO: 197313 - DNA, 16 bp, P. troglodytes
acattttggaaggctg

SEQ ID NO: 197314 - DNA, 16 bp, P. troglodytes
acattttggcaattat

SEQ ID NO: 197315 - DNA, 16 bp, P. troglodytes
acattttggcatgttt

SEQ ID NO: 197316 - DNA, 17 bp, P. troglodytes
acattttgggaggctga

SEQ ID NO: 197317 - DNA, 16 bp, P. troglodytes
acattttggtatgttg

SEQ ID NO: 197318 - DNA, 16 bp, P. troglodytes
acattttggtatgttt

SEQ ID NO: 197319 - DNA, 16 bp, P. troglodytes
acattttggtcaatga

SEQ ID NO: 197320 - DNA, 16 bp, P. troglodytes
acattttgttaaatga

SEQ ID NO: 197321 - DNA, 16 bp, P. troglodytes
acattttgtttaaaaa

SEQ ID NO: 197322 - DNA, 16 bp, P. troglodytes
acattttgttttcatt

SEQ ID NO: 197323 - DNA, 16 bp, P. troglodytes
acatttttaaaaatgg

SEQ ID NO: 197324 - DNA, 16 bp, P. troglodytes
acatttttaaaagaga

SEQ ID NO: 197325 - DNA, 16 bp, P. troglodytes
acatttttaaaaggaa

SEQ ID NO: 197326 - DNA, 16 bp, P. troglodytes
acatttttaaacattt

SEQ ID NO: 197327 - DNA, 16 bp, P. troglodytes
acatttttaaagcttt

SEQ ID NO: 197328 - DNA, 16 bp, P. troglodytes
acatttttaaagggtt

SEQ ID NO: 197329 - DNA, 16 bp, P. troglodytes
acatttttaaatagag

SEQ ID NO: 197330 - DNA, 16 bp, P. troglodytes
acatttttaaattgtt

SEQ ID NO: 197331 - DNA, 16 bp, P. troglodytes
acatttttacactgct

SEQ ID NO: 197332 - DNA, 16 bp, P. troglodytes
acatttttatatatgt

SEQ ID NO: 197333 - DNA, 16 bp, P. troglodytes
acatttttatccattc

SEQ ID NO: 197334 - DNA, 16 bp, P. troglodytes
acatttttatgaaaaa

SEQ ID NO: 197335 - DNA, 16 bp, P. troglodytes
acatttttatgattat

SEQ ID NO: 197336 - DNA, 16 bp, P. troglodytes
acatttttctcagtgc

SEQ ID NO: 197337 - DNA, 16 bp, P. troglodytes
acatttttctgttttc

SEQ ID NO: 197338 - DNA, 16 bp, P. troglodytes
acatttttgaagaaaa

SEQ ID NO: 197339 - DNA, 16 bp, P. troglodytes
acatttttgcaaatct

SEQ ID NO: 197340 - DNA, 16 bp, P. troglodytes
acatttttgccttcat

SEQ ID NO: 197341 - DNA, 16 bp, P. troglodytes
acatttttggttttca

SEQ ID NO: 197342 - DNA, 16 bp, P. troglodytes
acatttttgtggtttt

SEQ ID NO: 197343 - DNA, 16 bp, P. troglodytes
acatttttgtgtatat

SEQ ID NO: 197344 - DNA, 16 bp, P. troglodytes
acatttttgtttctct

SEQ ID NO: 197345 - DNA, 16 bp, P. troglodytes
acattttttaaagtgt

SEQ ID NO: 197346 - DNA, 16 bp, P. troglodytes
acattttttagcaata

SEQ ID NO: 197347 - DNA, 16 bp, P. troglodytes
acattttttatttgat

SEQ ID NO: 197348 - DNA, 16 bp, P. troglodytes
acattttttcaacttt

SEQ ID NO: 197349 - DNA, 16 bp, P. troglodytes
acattttttcacagaa

SEQ ID NO: 197350 - DNA, 16 bp, P. troglodytes
acattttttgaaagaa

SEQ ID NO: 197351 - DNA, 16 bp, P. troglodytes
acattttttgagacag

SEQ ID NO: 197352 - DNA, 16 bp, P. troglodytes
acatttttttaaaaac

SEQ ID NO: 197353 - DNA, 16 bp, P. troglodytes
acatttttttaaagaa

SEQ ID NO: 197354 - DNA, 16 bp, P. troglodytes
acatttttttaagaaa

SEQ ID NO: 197355 - DNA, 16 bp, P. troglodytes
acatttttttccaaat

SEQ ID NO: 197356 - DNA, 16 bp, P. troglodytes
acatttttttctcact

SEQ ID NO: 197357 - DNA, 16 bp, P. troglodytes
acattttttttcaagt

SEQ ID NO: 197358 - DNA, 16 bp, P. troglodytes
accaaaaaagaccctg

SEQ ID NO: 197359 - DNA, 16 bp, P. troglodytes
accaaaaaatagccca

SEQ ID NO: 197360 - DNA, 16 bp, P. troglodytes
accaaaaagggggaat

SEQ ID NO: 197361 - DNA, 16 bp, P. troglodytes
accaaaaatatatttt

SEQ ID NO: 197362 - DNA, 16 bp, P. troglodytes
accaaaaatttattag

SEQ ID NO: 197363 - DNA, 16 bp, P. troglodytes
accaaaacagatgtat

SEQ ID NO: 197364 - DNA, 16 bp, P. troglodytes
accaaaaccaagatgg

SEQ ID NO: 197365 - DNA, 16 bp, P. troglodytes
accaaaaccagaaaat

SEQ ID NO: 197366 - DNA, 16 bp, P. troglodytes
accaaaagcaatggga

SEQ ID NO: 197367 - DNA, 16 bp, P. troglodytes
accaaaagccacttgt

SEQ ID NO: 197368 - DNA, 16 bp, P. troglodytes
accaaaagtaatggca

SEQ ID NO: 197369 - DNA, 16 bp, P. troglodytes
accaaaatatcagaaa

SEQ ID NO: 197370 - DNA, 16 bp, P. troglodytes
accaaaatgtgaaccc

SEQ ID NO: 197371 - DNA, 16 bp, P. troglodytes
accaaaatgttcatca

SEQ ID NO: 197372 - DNA, 16 bp, P. troglodytes
accaaaattattttaa

SEQ ID NO: 197373 - DNA, 18 bp, P. troglodytes
accaaacaggctttgtgt

SEQ ID NO: 197374 - DNA, 16 bp, P. troglodytes
accaaacagttagcca

SEQ ID NO: 197375 - DNA, 16 bp, P. troglodytes
accaaactaaaatgga

SEQ ID NO: 197376 - DNA, 16 bp, P. troglodytes
accaaagataaagaga

SEQ ID NO: 197377 - DNA, 16 bp, P. troglodytes
accaaagccaagcacc

SEQ ID NO: 197378 - DNA, 16 bp, P. troglodytes
accaaaggaagataaa

SEQ ID NO: 197379 - DNA, 16 bp, P. troglodytes
accaaagtctggcaga

SEQ ID NO: 197380 - DNA, 21 bp, P. troglodytes
accaaagtgctgggattacag

SEQ ID NO: 197381 - DNA, 16 bp, P. troglodytes
accaaagtttccagaa

SEQ ID NO: 197382 - DNA, 16 bp, P. troglodytes
accaaataggatttat

SEQ ID NO: 197383 - DNA, 16 bp, P. troglodytes
accaaatattcaaatt

SEQ ID NO: 197384 - DNA, 18 bp, P. troglodytes
accaaatctacgtctgac

SEQ ID NO: 197385 - DNA, 16 bp, P. troglodytes
accaaatgctggtgag

SEQ ID NO: 197386 - DNA, 16 bp, P. troglodytes
accaaatgggagaaaa

SEQ ID NO: 197387 - DNA, 16 bp, P. troglodytes
accaaattggaaaaca

SEQ ID NO: 197388 - DNA, 16 bp, P. troglodytes
accaacacacccagct

SEQ ID NO: 197389 - DNA, 16 bp, P. troglodytes
accaacacagatacat

SEQ ID NO: 197390 - DNA, 17 bp, P. troglodytes
accaacagccaatatca

SEQ ID NO: 197391 - DNA, 16 bp, P. troglodytes
accaacagtgcacaag

SEQ ID NO: 197392 - DNA, 16 bp, P. troglodytes
accaacatagcacatg

SEQ ID NO: 197393 - DNA, 16 bp, P. troglodytes
accaacatccttgatg

SEQ ID NO: 197394 - DNA, 16 bp, P. troglodytes
accaacattcaaattc

SEQ ID NO: 197395 - DNA, 17 bp, P. troglodytes
accaacccagatgtcca

SEQ ID NO: 197396 - DNA, 16 bp, P. troglodytes
accaacccatcatcta

SEQ ID NO: 197397 - DNA, 16 bp, P. troglodytes
accaaccctgctgaca

SEQ ID NO: 197398 - DNA, 16 bp, P. troglodytes
accaacctctccccat

SEQ ID NO: 197399 - DNA, 16 bp, P. troglodytes
accaacctgacaaaaa

SEQ ID NO: 197400 - DNA, 16 bp, P. troglodytes
accaacctggataaca

SEQ ID NO: 197401 - DNA, 16 bp, P. troglodytes
accaacctggccatca

SEQ ID NO: 197402 - DNA, 16 bp, P. troglodytes
accaacctgggcaata

SEQ ID NO: 197403 - DNA, 16 bp, P. troglodytes
accaacctgggcgaca

SEQ ID NO: 197404 - DNA, 18 bp, P. troglodytes
accaacgtggtgaaaccc

SEQ ID NO: 197405 - DNA, 16 bp, P. troglodytes
accaactgatgaatgg

SEQ ID NO: 197406 - DNA, 16 bp, P. troglodytes
accaacttgccagcca

SEQ ID NO: 197407 - DNA, 16 bp, P. troglodytes
accaacttttggcttt

SEQ ID NO: 197408 - DNA, 16 bp, P. troglodytes
accaactttttgtttc

SEQ ID NO: 197409 - DNA, 16 bp, P. troglodytes
accaagaacatacaat

SEQ ID NO: 197410 - DNA, 16 bp, P. troglodytes
accaagaaccaggaaa

SEQ ID NO: 197411 - DNA, 16 bp, P. troglodytes
accaagaccccatctc

SEQ ID NO: 197412 - DNA, 16 bp, P. troglodytes
accaagagcaaaactc

SEQ ID NO: 197413 - DNA, 16 bp, P. troglodytes
accaagatatggaaac

SEQ ID NO: 197414 - DNA, 16 bp, P. troglodytes
accaagatgtccttta

SEQ ID NO: 197415 - DNA, 16 bp, P. troglodytes
accaagcaaattgaaa

SEQ ID NO: 197416 - DNA, 16 bp, P. troglodytes
accaagcagaagaaag

SEQ ID NO: 197417 - DNA, 16 bp, P. troglodytes
accaagcctggccaat

SEQ ID NO: 197418 - DNA, 16 bp, P. troglodytes
accaagctcagcctcc

SEQ ID NO: 197419 - DNA, 16 bp, P. troglodytes
accaagcttgagtgtc

SEQ ID NO: 197420 - DNA, 16 bp, P. troglodytes
accaaggaaatgaaag

SEQ ID NO: 197421 - DNA, 16 bp, P. troglodytes
accaaggaagtgaaag

SEQ ID NO: 197422 - DNA, 16 bp, P. troglodytes
accaaggacctgcacc

SEQ ID NO: 197423 - DNA, 16 bp, P. troglodytes
accaaggcaccagcag

SEQ ID NO: 197424 - DNA, 16 bp, P. troglodytes
accaaggcgggcagat

SEQ ID NO: 197425 - DNA, 16 bp, P. troglodytes
accaaggggatggcgc

SEQ ID NO: 197426 - DNA, 16 bp, P. troglodytes
accaagtagctgggac

SEQ ID NO: 197427 - DNA, 16 bp, P. troglodytes
accaagtctttttttt

SEQ ID NO: 197428 - DNA, 16 bp, P. troglodytes
accaagtggaatttat

SEQ ID NO: 197429 - DNA, 16 bp, P. troglodytes
accaagtttcagatgt

SEQ ID NO: 197430 - DNA, 16 bp, P. troglodytes
accaataatttttaaa

SEQ ID NO: 197431 - DNA, 17 bp, P. troglodytes
accaatcagcactctgt

SEQ ID NO: 197432 - DNA, 16 bp, P. troglodytes
accaatcagcatgcac

SEQ ID NO: 197433 - DNA, 17 bp, P. troglodytes
accaatcagcgctctgt

SEQ ID NO: 197434 - DNA, 16 bp, P. troglodytes
accaatcagtgtgctg

SEQ ID NO: 197435 - DNA, 16 bp, P. troglodytes
accaatcagtgttctg

SEQ ID NO: 197436 - DNA, 16 bp, P. troglodytes
accaatcatcagagaa

SEQ ID NO: 197437 - DNA, 16 bp, P. troglodytes
accaatctgggcaaca

SEQ ID NO: 197438 - DNA, 16 bp, P. troglodytes
accaatcttactgaaa

SEQ ID NO: 197439 - DNA, 16 bp, P. troglodytes
accaatgtatatctta

SEQ ID NO: 197440 - DNA, 16 bp, P. troglodytes
accaatgtggtgaaac

SEQ ID NO: 197441 - DNA, 16 bp, P. troglodytes
accaatgttcatagca

SEQ ID NO: 197442 - DNA, 16 bp, P. troglodytes
accaattctggacaca

SEQ ID NO: 197443 - DNA, 16 bp, P. troglodytes
accacaaaagacctag

SEQ ID NO: 197444 - DNA, 16 bp, P. troglodytes
accacaaagataggga

SEQ ID NO: 197445 - DNA, 16 bp, P. troglodytes
accacaataaaatgaa

SEQ ID NO: 197446 - DNA, 16 bp, P. troglodytes
accacaataaagcaaa

SEQ ID NO: 197447 - DNA, 17 bp, P. troglodytes
accacaatgagattcca

SEQ ID NO: 197448 - DNA, 16 bp, P. troglodytes
accacaattacttttt

SEQ ID NO: 197449 - DNA, 16 bp, P. troglodytes
accacaatttgtttat

SEQ ID NO: 197450 - DNA, 16 bp, P. troglodytes
accacacatctacacc

SEQ ID NO: 197451 - DNA, 16 bp, P. troglodytes
accacacatggctaat

SEQ ID NO: 197452 - DNA, 16 bp, P. troglodytes
accacacatttttaaa

SEQ ID NO: 197453 - DNA, 16 bp, P. troglodytes
accacacccagccaga

SEQ ID NO: 197454 - DNA, 18 bp, P. troglodytes
accacacccagctaattt

SEQ ID NO: 197455 - DNA, 16 bp, P. troglodytes
accacacccagcttat

SEQ ID NO: 197456 - DNA, 17 bp, P. troglodytes
accacacccggctaatg

SEQ ID NO: 197457 - DNA, 17 bp, P. troglodytes
accacacccggctaatt

SEQ ID NO: 197458 - DNA, 16 bp, P. troglodytes
accacacctactccaa

SEQ ID NO: 197459 - DNA, 16 bp, P. troglodytes
accacacctggccaat

SEQ ID NO: 197460 - DNA, 16 bp, P. troglodytes
accacacctggccagt

SEQ ID NO: 197461 - DNA, 16 bp, P. troglodytes
accacacctggctaat

SEQ ID NO: 197462 - DNA, 16 bp, P. troglodytes
accacacctgggtaat

SEQ ID NO: 197463 - DNA, 17 bp, P. troglodytes
accacactggctaattt

SEQ ID NO: 197464 - DNA, 16 bp, P. troglodytes
accacactgttttggt

SEQ ID NO: 197465 - DNA, 16 bp, P. troglodytes
accacactttgaggag

SEQ ID NO: 197466 - DNA, 16 bp, P. troglodytes
accacagaaatgtatt

SEQ ID NO: 197467 - DNA, 16 bp, P. troglodytes
accacagacttggtgg

SEQ ID NO: 197468 - DNA, 16 bp, P. troglodytes
accacagccagctaat

SEQ ID NO: 197469 - DNA, 16 bp, P. troglodytes
accacagctgcagacc

SEQ ID NO: 197470 - DNA, 16 bp, P. troglodytes
accacagctgcagctg

SEQ ID NO: 197471 - DNA, 16 bp, P. troglodytes
accacaggccccagtg

SEQ ID NO: 197472 - DNA, 16 bp, P. troglodytes
accacaggttctcact

SEQ ID NO: 197473 - DNA, 16 bp, P. troglodytes
accacagtgcccagct

SEQ ID NO: 197474 - DNA, 16 bp, P. troglodytes
accacagttgtgtgcc

SEQ ID NO: 197475 - DNA, 16 bp, P. troglodytes
accacagttttaaaaa

SEQ ID NO: 197476 - DNA, 16 bp, P. troglodytes
accacatattctcact

SEQ ID NO: 197477 - DNA, 16 bp, P. troglodytes
accacatccacgccaa

SEQ ID NO: 197478 - DNA, 16 bp, P. troglodytes
accacatccagctcat

SEQ ID NO: 197479 - DNA, 16 bp, P. troglodytes
accacatctgcaatta

SEQ ID NO: 197480 - DNA, 17 bp, P. troglodytes
accacatctggctaatt

SEQ ID NO: 197481 - DNA, 16 bp, P. troglodytes
accacatgactcagca

SEQ ID NO: 197482 - DNA, 16 bp, P. troglodytes
accacatggctgggct

SEQ ID NO: 197483 - DNA, 16 bp, P. troglodytes
accacatggtcaggct

SEQ ID NO: 197484 - DNA, 16 bp, P. troglodytes
accacatgtggctatt

SEQ ID NO: 197485 - DNA, 16 bp, P. troglodytes
accacattgtccaggc

SEQ ID NO: 197486 - DNA, 16 bp, P. troglodytes
accacattttacttat

SEQ ID NO: 197487 - DNA, 16 bp, P. troglodytes
accacattttctttat

SEQ ID NO: 197488 - DNA, 16 bp, P. troglodytes
accacatttttaaaaa

SEQ ID NO: 197489 - DNA, 16 bp, P. troglodytes
accaccaaactgtctt

SEQ ID NO: 197490 - DNA, 16 bp, P. troglodytes
accaccaagcccagct

SEQ ID NO: 197491 - DNA, 16 bp, P. troglodytes
accaccaagcctggct

SEQ ID NO: 197492 - DNA, 16 bp, P. troglodytes
accaccacaccaggct

SEQ ID NO: 197493 - DNA, 16 bp, P. troglodytes
accaccacacctggcc

SEQ ID NO: 197494 - DNA, 17 bp, P. troglodytes
accaccacacctggctt

SEQ ID NO: 197495 - DNA, 16 bp, P. troglodytes
accaccacactgggct

SEQ ID NO: 197496 - DNA, 16 bp, P. troglodytes
accaccacatccagct

SEQ ID NO: 197497 - DNA, 16 bp, P. troglodytes
accaccacatctggct

SEQ ID NO: 197498 - DNA, 16 bp, P. troglodytes
accaccacatgcagct

SEQ ID NO: 197499 - DNA, 16 bp, P. troglodytes
accaccaccaccactg

SEQ ID NO: 197500 - DNA, 16 bp, P. troglodytes
accaccaccaccagct

SEQ ID NO: 197501 - DNA, 16 bp, P. troglodytes
accaccaccatcacta

SEQ ID NO: 197502 - DNA, 16 bp, P. troglodytes
accaccacctcccagg

SEQ ID NO: 197503 - DNA, 19 bp, P. troglodytes
accaccacgcctggctaat

SEQ ID NO: 197504 - DNA, 16 bp, P. troglodytes
accaccactaccatca

SEQ ID NO: 197505 - DNA, 16 bp, P. troglodytes
accaccactcccagct

SEQ ID NO: 197506 - DNA, 16 bp, P. troglodytes
accaccactcccggct

SEQ ID NO: 197507 - DNA, 16 bp, P. troglodytes
accaccagacccagct

SEQ ID NO: 197508 - DNA, 16 bp, P. troglodytes
accaccagcagcagca

SEQ ID NO: 197509 - DNA, 16 bp, P. troglodytes
accaccaggcccggct

SEQ ID NO: 197510 - DNA, 16 bp, P. troglodytes
accaccatccccagct

SEQ ID NO: 197511 - DNA, 16 bp, P. troglodytes
accaccatcctccaga

SEQ ID NO: 197512 - DNA, 16 bp, P. troglodytes
accaccatgcccagcc

SEQ ID NO: 197513 - DNA, 16 bp, P. troglodytes
accaccatgcccggcc

SEQ ID NO: 197514 - DNA, 16 bp, P. troglodytes
accaccatgcctggcc

SEQ ID NO: 197515 - DNA, 16 bp, P. troglodytes
accaccatggaacatg

SEQ ID NO: 197516 - DNA, 16 bp, P. troglodytes
accaccatggccaaca

SEQ ID NO: 197517 - DNA, 16 bp, P. troglodytes
accaccatggccagct

SEQ ID NO: 197518 - DNA, 16 bp, P. troglodytes
accaccatgtccggct

SEQ ID NO: 197519 - DNA, 16 bp, P. troglodytes
accaccattgtatatg

SEQ ID NO: 197520 - DNA, 16 bp, P. troglodytes
accaccccaggctaat

SEQ ID NO: 197521 - DNA, 16 bp, P. troglodytes
accaccctgagcaaca

SEQ ID NO: 197522 - DNA, 16 bp, P. troglodytes
accaccgcgcctggcc

SEQ ID NO: 197523 - DNA, 16 bp, P. troglodytes
accacctcacccggct

SEQ ID NO: 197524 - DNA, 16 bp, P. troglodytes
accacctcagcctccc

SEQ ID NO: 197525 - DNA, 16 bp, P. troglodytes
accacctcagcctgga

SEQ ID NO: 197526 - DNA, 16 bp, P. troglodytes
accacctcagcctggg

SEQ ID NO: 197527 - DNA, 16 bp, P. troglodytes
accacctcatacccat

SEQ ID NO: 197528 - DNA, 16 bp, P. troglodytes
accacctccatgattc

SEQ ID NO: 197529 - DNA, 16 bp, P. troglodytes
accacctcctcaagct

SEQ ID NO: 197530 - DNA, 16 bp, P. troglodytes
accacctctgcctcct

SEQ ID NO: 197531 - DNA, 16 bp, P. troglodytes
accacctgttccccaa

SEQ ID NO: 197532 - DNA, 16 bp, P. troglodytes
accacgacgcccggct

SEQ ID NO: 197533 - DNA, 19 bp, P. troglodytes
accacgcatggctaatttt

SEQ ID NO: 197534 - DNA, 17 bp, P. troglodytes
accacgcccaactaatt

SEQ ID NO: 197535 - DNA, 18 bp, P. troglodytes
accacgcccagcctaaaa

SEQ ID NO: 197536 - DNA, 16 bp, P. troglodytes
accacgcccggctaaa

SEQ ID NO: 197537 - DNA, 16 bp, P. troglodytes
accacgcccggctaat

SEQ ID NO: 197538 - DNA, 19 bp, P. troglodytes
accacgcccggctaatttt

SEQ ID NO: 197539 - DNA, 16 bp, P. troglodytes
accacgcccggctgat

SEQ ID NO: 197540 - DNA, 16 bp, P. troglodytes
accacgcccgggtaat

SEQ ID NO: 197541 - DNA, 17 bp, P. troglodytes
accacgcctggccccac

SEQ ID NO: 197542 - DNA, 17 bp, P. troglodytes
accacgcctggctaatt

SEQ ID NO: 197543 - DNA, 16 bp, P. troglodytes
accacgctcagctaat

SEQ ID NO: 197544 - DNA, 16 bp, P. troglodytes
accacgctggccaaca

SEQ ID NO: 197545 - DNA, 16 bp, P. troglodytes
accacgttggaaaaca

SEQ ID NO: 197546 - DNA, 16 bp, P. troglodytes
accactaagatactcc

SEQ ID NO: 197547 - DNA, 16 bp, P. troglodytes
accactatactccagc

SEQ ID NO: 197548 - DNA, 16 bp, P. troglodytes
accactatgcaatata

SEQ ID NO: 197549 - DNA, 16 bp, P. troglodytes
accactatgcctggct

SEQ ID NO: 197550 - DNA, 16 bp, P. troglodytes
accactcctattcaat

SEQ ID NO: 197551 - DNA, 16 bp, P. troglodytes
accactcctggctttt

SEQ ID NO: 197552 - DNA, 16 bp, P. troglodytes
accactctcagctaat

SEQ ID NO: 197553 - DNA, 16 bp, P. troglodytes
accactctcctgcctc

SEQ ID NO: 197554 - DNA, 16 bp, P. troglodytes
accactgaaaattccc

SEQ ID NO: 197555 - DNA, 16 bp, P. troglodytes
accactgaactccagc

SEQ ID NO: 197556 - DNA, 16 bp, P. troglodytes
accactgaactgtaca

SEQ ID NO: 197557 - DNA, 16 bp, P. troglodytes
accactgactccacag

SEQ ID NO: 197558 - DNA, 16 bp, P. troglodytes
accactgatgccacag

SEQ ID NO: 197559 - DNA, 16 bp, P. troglodytes
accactgcaccccagc

SEQ ID NO: 197560 - DNA, 16 bp, P. troglodytes
accactgcactcaaac

SEQ ID NO: 197561 - DNA, 16 bp, P. troglodytes
accactgcactcaagc

SEQ ID NO: 197562 - DNA, 16 bp, P. troglodytes
accactgcactccagg

SEQ ID NO: 197563 - DNA, 16 bp, P. troglodytes
accactgcactgggtg

SEQ ID NO: 197564 - DNA, 16 bp, P. troglodytes
accactgccaccactg

SEQ ID NO: 197565 - DNA, 16 bp, P. troglodytes
accactgccctccagc

SEQ ID NO: 197566 - DNA, 16 bp, P. troglodytes
accactgcgcccagct

SEQ ID NO: 197567 - DNA, 16 bp, P. troglodytes
accactggctttcctg

SEQ ID NO: 197568 - DNA, 16 bp, P. troglodytes
accactgtactccaac

SEQ ID NO: 197569 - DNA, 17 bp, P. troglodytes
accactgtactccagct

SEQ ID NO: 197570 - DNA, 16 bp, P. troglodytes
accactgtgcttggct

SEQ ID NO: 197571 - DNA, 16 bp, P. troglodytes
accactgtggaagaca

SEQ ID NO: 197572 - DNA, 16 bp, P. troglodytes
accactgtgtccagct

SEQ ID NO: 197573 - DNA, 16 bp, P. troglodytes
accactgttctccagc

SEQ ID NO: 197574 - DNA, 16 bp, P. troglodytes
accagaaactataaaa

SEQ ID NO: 197575 - DNA, 16 bp, P. troglodytes
accagaaactggaaga

SEQ ID NO: 197576 - DNA, 16 bp, P. troglodytes
accagaaactgtaaaa

SEQ ID NO: 197577 - DNA, 16 bp, P. troglodytes
accagaagagtgcagt

SEQ ID NO: 197578 - DNA, 16 bp, P. troglodytes
accagaagctaggaga

SEQ ID NO: 197579 - DNA, 16 bp, P. troglodytes
accagaatctctggga

SEQ ID NO: 197580 - DNA, 16 bp, P. troglodytes
accagaatctgcattt

SEQ ID NO: 197581 - DNA, 16 bp, P. troglodytes
accagacacagtggct

SEQ ID NO: 197582 - DNA, 16 bp, P. troglodytes
accagaccctgtctct

SEQ ID NO: 197583 - DNA, 16 bp, P. troglodytes
accagactgggaaaca

SEQ ID NO: 197584 - DNA, 16 bp, P. troglodytes
accagactgggcaaca

SEQ ID NO: 197585 - DNA, 16 bp, P. troglodytes
accagactgtgcaaca

SEQ ID NO: 197586 - DNA, 16 bp, P. troglodytes
accagagaaaagtgaa

SEQ ID NO: 197587 - DNA, 16 bp, P. troglodytes
accagagaaatgaaaa

SEQ ID NO: 197588 - DNA, 16 bp, P. troglodytes
accagagaagcaagag

SEQ ID NO: 197589 - DNA, 16 bp, P. troglodytes
accagagatacaaaga

SEQ ID NO: 197590 - DNA, 16 bp, P. troglodytes
accagagcccagggag

SEQ ID NO: 197591 - DNA, 16 bp, P. troglodytes
accagagcctgtcagg

SEQ ID NO: 197592 - DNA, 16 bp, P. troglodytes
accagaggctgaagtg

SEQ ID NO: 197593 - DNA, 16 bp, P. troglodytes
accagaggctggagag

SEQ ID NO: 197594 - DNA, 16 bp, P. troglodytes
accagaggtcagcaaa

SEQ ID NO: 197595 - DNA, 16 bp, P. troglodytes
accagatgatccagca

SEQ ID NO: 197596 - DNA, 16 bp, P. troglodytes
accagatggagctgaa

SEQ ID NO: 197597 - DNA, 16 bp, P. troglodytes
accagatgtgcaaaga

SEQ ID NO: 197598 - DNA, 16 bp, P. troglodytes
accagattaagggtgg

SEQ ID NO: 197599 - DNA, 16 bp, P. troglodytes
accagattgagaacct

SEQ ID NO: 197600 - DNA, 16 bp, P. troglodytes
accagattggctacag

SEQ ID NO: 197601 - DNA, 16 bp, P. troglodytes
accagcaaaaagatta

SEQ ID NO: 197602 - DNA, 16 bp, P. troglodytes
accagcaagacagaac

SEQ ID NO: 197603 - DNA, 16 bp, P. troglodytes
accagcaagtttttta

SEQ ID NO: 197604 - DNA, 16 bp, P. troglodytes
accagcacagccacag

SEQ ID NO: 197605 - DNA, 16 bp, P. troglodytes
accagcactttgggaa

SEQ ID NO: 197606 - DNA, 16 bp, P. troglodytes
accagcactttgggag

SEQ ID NO: 197607 - DNA, 16 bp, P. troglodytes
accagcagaccaggag

SEQ ID NO: 197608 - DNA, 17 bp, P. troglodytes
accagcagaggctgcag

SEQ ID NO: 197609 - DNA, 16 bp, P. troglodytes
accagcagcaccagca

SEQ ID NO: 197610 - DNA, 16 bp, P. troglodytes
accagcagcagcaaca

SEQ ID NO: 197611 - DNA, 16 bp, P. troglodytes
accagcagcagtggct

SEQ ID NO: 197612 - DNA, 16 bp, P. troglodytes
accagcagcatcagca

SEQ ID NO: 197613 - DNA, 16 bp, P. troglodytes
accagcagcatcagta

SEQ ID NO: 197614 - DNA, 16 bp, P. troglodytes
accagcagcctggcca

SEQ ID NO: 197615 - DNA, 16 bp, P. troglodytes
accagcaggcctgcct

SEQ ID NO: 197616 - DNA, 16 bp, P. troglodytes
accagcagtgtacaag

SEQ ID NO: 197617 - DNA, 16 bp, P. troglodytes
accagcagtgtatgag

SEQ ID NO: 197618 - DNA, 16 bp, P. troglodytes
accagcatgagctaac

SEQ ID NO: 197619 - DNA, 16 bp, P. troglodytes
accagcatggccacag

SEQ ID NO: 197620 - DNA, 16 bp, P. troglodytes
accagccactgcaaaa

SEQ ID NO: 197621 - DNA, 16 bp, P. troglodytes
accagccaggcatggt

SEQ ID NO: 197622 - DNA, 16 bp, P. troglodytes
accagccaggccaata

SEQ ID NO: 197623 - DNA, 16 bp, P. troglodytes
accagccaggtgcagt

SEQ ID NO: 197624 - DNA, 16 bp, P. troglodytes
accagccatttctcca

SEQ ID NO: 197625 - DNA, 16 bp, P. troglodytes
accagcccaggaagcc

SEQ ID NO: 197626 - DNA, 16 bp, P. troglodytes
accagccccagcaaca

SEQ ID NO: 197627 - DNA, 16 bp, P. troglodytes
accagcccctgcaaaa

SEQ ID NO: 197628 - DNA, 16 bp, P. troglodytes
accagccctgccaaca

SEQ ID NO: 197629 - DNA, 16 bp, P. troglodytes
accagccctggcaaca

SEQ ID NO: 197630 - DNA, 16 bp, P. troglodytes
accagcctcaccaata

SEQ ID NO: 197631 - DNA, 16 bp, P. troglodytes
accagcctcagcaaca

SEQ ID NO: 197632 - DNA, 16 bp, P. troglodytes
accagcctccgcctcc

SEQ ID NO: 197633 - DNA, 16 bp, P. troglodytes
accagcctctgcctcc

SEQ ID NO: 197634 - DNA, 16 bp, P. troglodytes
accagcctgaccagta

SEQ ID NO: 197635 - DNA, 16 bp, P. troglodytes
accagcctgcccagca

SEQ ID NO: 197636 - DNA, 16 bp, P. troglodytes
accagcctggacagca

SEQ ID NO: 197637 - DNA, 16 bp, P. troglodytes
accagcctggataaca

SEQ ID NO: 197638 - DNA, 18 bp, P. troglodytes
accagcctggccaacatt

SEQ ID NO: 197639 - DNA, 16 bp, P. troglodytes
accagcctggccagct

SEQ ID NO: 197640 - DNA, 16 bp, P. troglodytes
accagcctggccgaga

SEQ ID NO: 197641 - DNA, 16 bp, P. troglodytes
accagcctgggcaaaa

SEQ ID NO: 197642 - DNA, 20 bp, P. troglodytes
accagcctgggcaatatagt

SEQ ID NO: 197643 - DNA, 16 bp, P. troglodytes
accagcctgggcacca

SEQ ID NO: 197644 - DNA, 16 bp, P. troglodytes
accagcctgggcagca

SEQ ID NO: 197645 - DNA, 16 bp, P. troglodytes
accagcctgggccaca

SEQ ID NO: 197646 - DNA, 16 bp, P. troglodytes
accagcctgggctata

SEQ ID NO: 197647 - DNA, 16 bp, P. troglodytes
accagcctggggagca

SEQ ID NO: 197648 - DNA, 16 bp, P. troglodytes
accagcctgggtgaca

SEQ ID NO: 197649 - DNA, 16 bp, P. troglodytes
accagccttgcaaccc

SEQ ID NO: 197650 - DNA, 16 bp, P. troglodytes
accagccttgtcaaca

SEQ ID NO: 197651 - DNA, 16 bp, P. troglodytes
accagcgctttgggag

SEQ ID NO: 197652 - DNA, 16 bp, P. troglodytes
accagcgtggccaaga

SEQ ID NO: 197653 - DNA, 16 bp, P. troglodytes
accagctaatttttaa

SEQ ID NO: 197654 - DNA, 19 bp, P. troglodytes
accagctacttgggaggct

SEQ ID NO: 197655 - DNA, 16 bp, P. troglodytes
accagctcagccacag

SEQ ID NO: 197656 - DNA, 16 bp, P. troglodytes
accagctcatctttgt

SEQ ID NO: 197657 - DNA, 16 bp, P. troglodytes
accagctcctggattg

SEQ ID NO: 197658 - DNA, 16 bp, P. troglodytes
accagctcttctttct

SEQ ID NO: 197659 - DNA, 16 bp, P. troglodytes
accagctgcagaaatt

SEQ ID NO: 197660 - DNA, 16 bp, P. troglodytes
accagctggccaacat

SEQ ID NO: 197661 - DNA, 16 bp, P. troglodytes
accagctgggctcctg

SEQ ID NO: 197662 - DNA, 16 bp, P. troglodytes
accagctgggtgtcct

SEQ ID NO: 197663 - DNA, 16 bp, P. troglodytes
accagctgtggagagg

SEQ ID NO: 197664 - DNA, 16 bp, P. troglodytes
accagcttgtccaaca

SEQ ID NO: 197665 - DNA, 16 bp, P. troglodytes
accagctttcctggtt

SEQ ID NO: 197666 - DNA, 16 bp, P. troglodytes
accagctttggcaaca

SEQ ID NO: 197667 - DNA, 16 bp, P. troglodytes
accagcttttgctgca

SEQ ID NO: 197668 - DNA, 16 bp, P. troglodytes
accaggaaacaggccc

SEQ ID NO: 197669 - DNA, 16 bp, P. troglodytes
accaggaagaaatcaa

SEQ ID NO: 197670 - DNA, 16 bp, P. troglodytes
accaggaagaagtcaa

SEQ ID NO: 197671 - DNA, 17 bp, P. troglodytes
accaggaagaagtccaa

SEQ ID NO: 197672 - DNA, 16 bp, P. troglodytes
accaggagctggaaga

SEQ ID NO: 197673 - DNA, 16 bp, P. troglodytes
accaggaggcagggat

SEQ ID NO: 197674 - DNA, 16 bp, P. troglodytes
accaggaggcggagct

SEQ ID NO: 197675 - DNA, 16 bp, P. troglodytes
accaggaggtggaggc

SEQ ID NO: 197676 - DNA, 16 bp, P. troglodytes
accaggagtttgaggc

SEQ ID NO: 197677 - DNA, 16 bp, P. troglodytes
accaggatggtctgga

SEQ ID NO: 197678 - DNA, 16 bp, P. troglodytes
accaggatggtcttga

SEQ ID NO: 197679 - DNA, 16 bp, P. troglodytes
accaggcaagggctgg

SEQ ID NO: 197680 - DNA, 19 bp, P. troglodytes
accaggcacagtggctcac

SEQ ID NO: 197681 - DNA, 18 bp, P. troglodytes
accaggcacggtggctca

SEQ ID NO: 197682 - DNA, 16 bp, P. troglodytes
accaggcactgaatct

SEQ ID NO: 197683 - DNA, 16 bp, P. troglodytes
accaggccaccacaca

SEQ ID NO: 197684 - DNA, 16 bp, P. troglodytes
accaggcccagctaat

SEQ ID NO: 197685 - DNA, 16 bp, P. troglodytes
accaggccccagctcc

SEQ ID NO: 197686 - DNA, 16 bp, P. troglodytes
accaggccgggcgcgg

SEQ ID NO: 197687 - DNA, 16 bp, P. troglodytes
accaggcctctcctcc

SEQ ID NO: 197688 - DNA, 16 bp, P. troglodytes
accaggcctttttttt

SEQ ID NO: 197689 - DNA, 16 bp, P. troglodytes
accaggcgtggtggcg

SEQ ID NO: 197690 - DNA, 16 bp, P. troglodytes
accaggctctgggctg

SEQ ID NO: 197691 - DNA, 16 bp, P. troglodytes
accaggctggagtgca

SEQ ID NO: 197692 - DNA, 22 bp, P. troglodytes
accaggctggagtgcagtggcg

SEQ ID NO: 197693 - DNA, 16 bp, P. troglodytes
accaggctggcctcga

SEQ ID NO: 197694 - DNA, 18 bp, P. troglodytes
accaggctggtctcaaat

SEQ ID NO: 197695 - DNA, 16 bp, P. troglodytes
accagggagctggagg

SEQ ID NO: 197696 - DNA, 16 bp, P. troglodytes
accagggcttcttgga

SEQ ID NO: 197697 - DNA, 16 bp, P. troglodytes
accaggggtgtccaat

SEQ ID NO: 197698 - DNA, 16 bp, P. troglodytes
accaggtcccacctcc

SEQ ID NO: 197699 - DNA, 16 bp, P. troglodytes
accaggtgctgtggct

SEQ ID NO: 197700 - DNA, 16 bp, P. troglodytes
accaggtgtggtggca

SEQ ID NO: 197701 - DNA, 16 bp, P. troglodytes
accaggttcaagagat

SEQ ID NO: 197702 - DNA, 17 bp, P. troglodytes
accaggttcaagcgatt

SEQ ID NO: 197703 - DNA, 16 bp, P. troglodytes
accagtacttctcaaa

SEQ ID NO: 197704 - DNA, 16 bp, P. troglodytes
accagtagcatcagca

SEQ ID NO: 197705 - DNA, 16 bp, P. troglodytes
accagtagttctcaaa

SEQ ID NO: 197706 - DNA, 16 bp, P. troglodytes
accagtcacaaaagga

SEQ ID NO: 197707 - DNA, 17 bp, P. troglodytes
accagtctctactaaaa

SEQ ID NO: 197708 - DNA, 16 bp, P. troglodytes
accagtctctggtgcc

SEQ ID NO: 197709 - DNA, 16 bp, P. troglodytes
accagtctggccgaca

SEQ ID NO: 197710 - DNA, 16 bp, P. troglodytes
accagtctgggaaaca

SEQ ID NO: 197711 - DNA, 17 bp, P. troglodytes
accagtgactttcttca

SEQ ID NO: 197712 - DNA, 16 bp, P. troglodytes
accagtgataatgagc

SEQ ID NO: 197713 - DNA, 16 bp, P. troglodytes
accagtgatgatgacc

SEQ ID NO: 197714 - DNA, 18 bp, P. troglodytes
accagtgcatgcagcccc

SEQ ID NO: 197715 - DNA, 16 bp, P. troglodytes
accagtttagagaaca

SEQ ID NO: 197716 - DNA, 16 bp, P. troglodytes
accagtttggccaaca

SEQ ID NO: 197717 - DNA, 16 bp, P. troglodytes
accataaaaaatgatg

SEQ ID NO: 197718 - DNA, 16 bp, P. troglodytes
accataaaattcactt

SEQ ID NO: 197719 - DNA, 16 bp, P. troglodytes
accataaagacacatg

SEQ ID NO: 197720 - DNA, 16 bp, P. troglodytes
accataagccaattaa

SEQ ID NO: 197721 - DNA, 16 bp, P. troglodytes
accataatttatttaa

SEQ ID NO: 197722 - DNA, 16 bp, P. troglodytes
accatacacacataca

SEQ ID NO: 197723 - DNA, 16 bp, P. troglodytes
accatagctcactgca

SEQ ID NO: 197724 - DNA, 16 bp, P. troglodytes
accataggcttcaatg

SEQ ID NO: 197725 - DNA, 16 bp, P. troglodytes
accatatgatagacca

SEQ ID NO: 197726 - DNA, 16 bp, P. troglodytes
accatcaaaaagtggg

SEQ ID NO: 197727 - DNA, 16 bp, P. troglodytes
accatcaacaaagtga

SEQ ID NO: 197728 - DNA, 16 bp, P. troglodytes
accatcaacatcaaca

SEQ ID NO: 197729 - DNA, 16 bp, P. troglodytes
accatcaaggacttga

SEQ ID NO: 197730 - DNA, 16 bp, P. troglodytes
accatcaccacaatca

SEQ ID NO: 197731 - DNA, 16 bp, P. troglodytes
accatcaccaccatca

SEQ ID NO: 197732 - DNA, 16 bp, P. troglodytes
accatcaccaccatct

SEQ ID NO: 197733 - DNA, 16 bp, P. troglodytes
accatcaccatcacca

SEQ ID NO: 197734 - DNA, 16 bp, P. troglodytes
accatcaccatcatca

SEQ ID NO: 197735 - DNA, 16 bp, P. troglodytes
accatcacccaggctg

SEQ ID NO: 197736 - DNA, 16 bp, P. troglodytes
accatcacctgatggt

SEQ ID NO: 197737 - DNA, 16 bp, P. troglodytes
accatcacgcccagct

SEQ ID NO: 197738 - DNA, 16 bp, P. troglodytes
accatcagaaaatact

SEQ ID NO: 197739 - DNA, 16 bp, P. troglodytes
accatcagagtgagca

SEQ ID NO: 197740 - DNA, 16 bp, P. troglodytes
accatcagcaccatcc

SEQ ID NO: 197741 - DNA, 16 bp, P. troglodytes
accatcaggaaaatgc

SEQ ID NO: 197742 - DNA, 16 bp, P. troglodytes
accatcatacccagct

SEQ ID NO: 197743 - DNA, 16 bp, P. troglodytes
accatcatcacagtca

SEQ ID NO: 197744 - DNA, 16 bp, P. troglodytes
accatcatcaccatct

SEQ ID NO: 197745 - DNA, 16 bp, P. troglodytes
accatcatctcagccc

SEQ ID NO: 197746 - DNA, 16 bp, P. troglodytes
accatcatgcctggtt

SEQ ID NO: 197747 - DNA, 16 bp, P. troglodytes
accatcattctcaaca

SEQ ID NO: 197748 - DNA, 16 bp, P. troglodytes
accatcattctcatca

SEQ ID NO: 197749 - DNA, 16 bp, P. troglodytes
accatccaagaaaaca

SEQ ID NO: 197750 - DNA, 16 bp, P. troglodytes
accatccatccatcca

SEQ ID NO: 197751 - DNA, 16 bp, P. troglodytes
accatccatctctaga

SEQ ID NO: 197752 - DNA, 16 bp, P. troglodytes
accatccccatcaagc

SEQ ID NO: 197753 - DNA, 16 bp, P. troglodytes
accatccccatgatcc

SEQ ID NO: 197754 - DNA, 16 bp, P. troglodytes
accatcctggataaca

SEQ ID NO: 197755 - DNA, 16 bp, P. troglodytes
accatcctggccaatg

SEQ ID NO: 197756 - DNA, 16 bp, P. troglodytes
accatcctggctacca

SEQ ID NO: 197757 - DNA, 16 bp, P. troglodytes
accatcctgggcaaca

SEQ ID NO: 197758 - DNA, 18 bp, P. troglodytes
accatcctggttaacacg

SEQ ID NO: 197759 - DNA, 16 bp, P. troglodytes
accatctaatcttcaa

SEQ ID NO: 197760 - DNA, 16 bp, P. troglodytes
accatctatctccaga

SEQ ID NO: 197761 - DNA, 16 bp, P. troglodytes
accatctcagcctgga

SEQ ID NO: 197762 - DNA, 16 bp, P. troglodytes
accatctgtgggtctc

SEQ ID NO: 197763 - DNA, 16 bp, P. troglodytes
accatgaaaaataaat

SEQ ID NO: 197764 - DNA, 16 bp, P. troglodytes
accatgaagaaatcca

SEQ ID NO: 197765 - DNA, 16 bp, P. troglodytes
accatgatcaagtgga

SEQ ID NO: 197766 - DNA, 16 bp, P. troglodytes
accatgatcatgccac

SEQ ID NO: 197767 - DNA, 16 bp, P. troglodytes
accatgatcgagtggg

SEQ ID NO: 197768 - DNA, 16 bp, P. troglodytes
accatgattctgaggc

SEQ ID NO: 197769 - DNA, 16 bp, P. troglodytes
accatgattgtgagga

SEQ ID NO: 197770 - DNA, 17 bp, P. troglodytes
accatgccaggctaatt

SEQ ID NO: 197771 - DNA, 16 bp, P. troglodytes
accatgcccagcagag

SEQ ID NO: 197772 - DNA, 16 bp, P. troglodytes
accatgcccagccaag

SEQ ID NO: 197773 - DNA, 16 bp, P. troglodytes
accatgcccagccaat

SEQ ID NO: 197774 - DNA, 19 bp, P. troglodytes
accatgcccagctaatttt

SEQ ID NO: 197775 - DNA, 16 bp, P. troglodytes
accatgcccagctgat

SEQ ID NO: 197776 - DNA, 16 bp, P. troglodytes
accatgcccagtttat

SEQ ID NO: 197777 - DNA, 16 bp, P. troglodytes
accatgcccggccttc

SEQ ID NO: 197778 - DNA, 16 bp, P. troglodytes
accatgcccggctgat

SEQ ID NO: 197779 - DNA, 16 bp, P. troglodytes
accatgcctggcacac

SEQ ID NO: 197780 - DNA, 16 bp, P. troglodytes
accatgcctggccctt

SEQ ID NO: 197781 - DNA, 17 bp, P. troglodytes
accatgcctggctaatc

SEQ ID NO: 197782 - DNA, 17 bp, P. troglodytes
accatgcctggctaatt

SEQ ID NO: 197783 - DNA, 16 bp, P. troglodytes
accatgcctggctctc

SEQ ID NO: 197784 - DNA, 16 bp, P. troglodytes
accatgcctggtctgt

SEQ ID NO: 197785 - DNA, 16 bp, P. troglodytes
accatgctcagctaat

SEQ ID NO: 197786 - DNA, 16 bp, P. troglodytes
accatgctggcaccct

SEQ ID NO: 197787 - DNA, 16 bp, P. troglodytes
accatgctgggttaat

SEQ ID NO: 197788 - DNA, 16 bp, P. troglodytes
accatgctgtcttcca

SEQ ID NO: 197789 - DNA, 16 bp, P. troglodytes
accatggaaactggca

SEQ ID NO: 197790 - DNA, 16 bp, P. troglodytes
accatggaggcagagg

SEQ ID NO: 197791 - DNA, 17 bp, P. troglodytes
accatggcacaagaact

SEQ ID NO: 197792 - DNA, 16 bp, P. troglodytes
accatggctggggagg

SEQ ID NO: 197793 - DNA, 16 bp, P. troglodytes
accatggtgaaacccc

SEQ ID NO: 197794 - DNA, 16 bp, P. troglodytes
accatgtcaaaaaaaa

SEQ ID NO: 197795 - DNA, 16 bp, P. troglodytes
accatgtcattccacc

SEQ ID NO: 197796 - DNA, 16 bp, P. troglodytes
accatgtccggctaat

SEQ ID NO: 197797 - DNA, 16 bp, P. troglodytes
accatgtctcagaaaa

SEQ ID NO: 197798 - DNA, 16 bp, P. troglodytes
accatgtctttaaaaa

SEQ ID NO: 197799 - DNA, 16 bp, P. troglodytes
accatgtgaagatgaa

SEQ ID NO: 197800 - DNA, 16 bp, P. troglodytes
accatgttctccatca

SEQ ID NO: 197801 - DNA, 17 bp, P. troglodytes
accatgttgctcaggct

SEQ ID NO: 197802 - DNA, 16 bp, P. troglodytes
accatgttggccagca

SEQ ID NO: 197803 - DNA, 16 bp, P. troglodytes
accatgttgtacaaca

SEQ ID NO: 197804 - DNA, 16 bp, P. troglodytes
accattaactttcttc

SEQ ID NO: 197805 - DNA, 16 bp, P. troglodytes
accattatcaagtggg

SEQ ID NO: 197806 - DNA, 16 bp, P. troglodytes
accattatggaaaaca

SEQ ID NO: 197807 - DNA, 16 bp, P. troglodytes
accattattttatgta

SEQ ID NO: 197808 - DNA, 16 bp, P. troglodytes
accattcaggacacag

SEQ ID NO: 197809 - DNA, 16 bp, P. troglodytes
accattcagtggtttt

SEQ ID NO: 197810 - DNA, 16 bp, P. troglodytes
accattccatctgaaa

SEQ ID NO: 197811 - DNA, 16 bp, P. troglodytes
accattcctactgaaa

SEQ ID NO: 197812 - DNA, 19 bp, P. troglodytes
accattctcctgcctcagc

SEQ ID NO: 197813 - DNA, 16 bp, P. troglodytes
accattctggacatca

SEQ ID NO: 197814 - DNA, 16 bp, P. troglodytes
accattctggacatgg

SEQ ID NO: 197815 - DNA, 16 bp, P. troglodytes
accattctggacattg

SEQ ID NO: 197816 - DNA, 16 bp, P. troglodytes
accattgtgggagaca

SEQ ID NO: 197817 - DNA, 16 bp, P. troglodytes
accattgttgaagaca

SEQ ID NO: 197818 - DNA, 16 bp, P. troglodytes
accatttaaaaatgtt

SEQ ID NO: 197819 - DNA, 16 bp, P. troglodytes
accatttattaaaaag

SEQ ID NO: 197820 - DNA, 16 bp, P. troglodytes
accatttctagctttt

SEQ ID NO: 197821 - DNA, 16 bp, P. troglodytes
accatttgaccaagca

SEQ ID NO: 197822 - DNA, 16 bp, P. troglodytes
accatttgataaaatt

SEQ ID NO: 197823 - DNA, 16 bp, P. troglodytes
accatttggccaggct

SEQ ID NO: 197824 - DNA, 16 bp, P. troglodytes
accatttgttgaaaat

SEQ ID NO: 197825 - DNA, 16 bp, P. troglodytes
accattttaaaaaatt

SEQ ID NO: 197826 - DNA, 16 bp, P. troglodytes
accattttacattctg

SEQ ID NO: 197827 - DNA, 16 bp, P. troglodytes
accattttgcatttcc

SEQ ID NO: 197828 - DNA, 16 bp, P. troglodytes
accattttttaaaaat

SEQ ID NO: 197829 - DNA, 16 bp, P. troglodytes
accattttttaaatag

SEQ ID NO: 197830 - DNA, 16 bp, P. troglodytes
acccaaaagaatggaa

SEQ ID NO: 197831 - DNA, 16 bp, P. troglodytes
acccaaaagaattaaa

SEQ ID NO: 197832 - DNA, 18 bp, P. troglodytes
acccaaaatctccttaag

SEQ ID NO: 197833 - DNA, 16 bp, P. troglodytes
acccaaagtcacacaa

SEQ ID NO: 197834 - DNA, 19 bp, P. troglodytes
acccaaagtgctgggatta

SEQ ID NO: 197835 - DNA, 16 bp, P. troglodytes
acccaaagtgctgggg

SEQ ID NO: 197836 - DNA, 16 bp, P. troglodytes
acccaaataagactac

SEQ ID NO: 197837 - DNA, 16 bp, P. troglodytes
acccaaatatcatctt

SEQ ID NO: 197838 - DNA, 16 bp, P. troglodytes
acccaaatctcacctg

SEQ ID NO: 197839 - DNA, 16 bp, P. troglodytes
acccaaatgaaaagaa

SEQ ID NO: 197840 - DNA, 16 bp, P. troglodytes
acccaaatgagaagaa

SEQ ID NO: 197841 - DNA, 16 bp, P. troglodytes
acccaaatgcccacca

SEQ ID NO: 197842 - DNA, 16 bp, P. troglodytes
acccaaatgtctatca

SEQ ID NO: 197843 - DNA, 16 bp, P. troglodytes
acccaaatgttcatca

SEQ ID NO: 197844 - DNA, 16 bp, P. troglodytes
acccaaatttcatgtt

SEQ ID NO: 197845 - DNA, 17 bp, P. troglodytes
acccaactaatttttgt

SEQ ID NO: 197846 - DNA, 16 bp, P. troglodytes
acccaactcctgagat

SEQ ID NO: 197847 - DNA, 16 bp, P. troglodytes
acccaacttaaaacta

SEQ ID NO: 197848 - DNA, 16 bp, P. troglodytes
acccaagatcacacag

SEQ ID NO: 197849 - DNA, 16 bp, P. troglodytes
acccaagatggtgcca

SEQ ID NO: 197850 - DNA, 16 bp, P. troglodytes
acccaaggaggcagag

SEQ ID NO: 197851 - DNA, 16 bp, P. troglodytes
acccaatatcaaactg

SEQ ID NO: 197852 - DNA, 16 bp, P. troglodytes
acccaatctctacaaa

SEQ ID NO: 197853 - DNA, 16 bp, P. troglodytes
acccaatgcctgtacc

SEQ ID NO: 197854 - DNA, 16 bp, P. troglodytes
acccaatgggagataa

SEQ ID NO: 197855 - DNA, 16 bp, P. troglodytes
acccacaaaatggaag

SEQ ID NO: 197856 - DNA, 16 bp, P. troglodytes
acccacacagacatgg

SEQ ID NO: 197857 - DNA, 16 bp, P. troglodytes
acccacagaatggcag

SEQ ID NO: 197858 - DNA, 16 bp, P. troglodytes
acccacaggcccaaca

SEQ ID NO: 197859 - DNA, 16 bp, P. troglodytes
acccacagtcccagct

SEQ ID NO: 197860 - DNA, 16 bp, P. troglodytes
acccaccaggaggaac

SEQ ID NO: 197861 - DNA, 16 bp, P. troglodytes
acccacccattcatcc

SEQ ID NO: 197862 - DNA, 16 bp, P. troglodytes
acccacccccatgatt

SEQ ID NO: 197863 - DNA, 16 bp, P. troglodytes
acccaccgagccaggc

SEQ ID NO: 197864 - DNA, 16 bp, P. troglodytes
acccaccgtgcccagc

SEQ ID NO: 197865 - DNA, 16 bp, P. troglodytes
acccacctcaacttcc

SEQ ID NO: 197866 - DNA, 16 bp, P. troglodytes
acccacctgcctcagc

SEQ ID NO: 197867 - DNA, 16 bp, P. troglodytes
acccacctggccaaca

SEQ ID NO: 197868 - DNA, 19 bp, P. troglodytes
acccaccttggcctcccag

SEQ ID NO: 197869 - DNA, 16 bp, P. troglodytes
acccactaactcctca

SEQ ID NO: 197870 - DNA, 16 bp, P. troglodytes
acccactagaatggct

SEQ ID NO: 197871 - DNA, 16 bp, P. troglodytes
acccactagatgccag

SEQ ID NO: 197872 - DNA, 16 bp, P. troglodytes
acccactaggtgccag

SEQ ID NO: 197873 - DNA, 16 bp, P. troglodytes
acccactccatgccag

SEQ ID NO: 197874 - DNA, 16 bp, P. troglodytes
acccactgagccaggc

SEQ ID NO: 197875 - DNA, 16 bp, P. troglodytes
acccactgcgcctggc

SEQ ID NO: 197876 - DNA, 16 bp, P. troglodytes
acccactgggctgcat

SEQ ID NO: 197877 - DNA, 16 bp, P. troglodytes
acccacttgagaaggc

SEQ ID NO: 197878 - DNA, 16 bp, P. troglodytes
acccagaaagaaatcc

SEQ ID NO: 197879 - DNA, 16 bp, P. troglodytes
acccagaaattccatt

SEQ ID NO: 197880 - DNA, 16 bp, P. troglodytes
acccagaagaaaataa

SEQ ID NO: 197881 - DNA, 16 bp, P. troglodytes
acccagaagaaatgga

SEQ ID NO: 197882 - DNA, 16 bp, P. troglodytes
acccagaagctctcca

SEQ ID NO: 197883 - DNA, 16 bp, P. troglodytes
acccagaaggcagagg

SEQ ID NO: 197884 - DNA, 17 bp, P. troglodytes
acccagaaggtggagct

SEQ ID NO: 197885 - DNA, 16 bp, P. troglodytes
acccagaaggtggagg

SEQ ID NO: 197886 - DNA, 16 bp, P. troglodytes
acccagactggagtgc

SEQ ID NO: 197887 - DNA, 16 bp, P. troglodytes
acccagagaggttaag

SEQ ID NO: 197888 - DNA, 16 bp, P. troglodytes
acccagcaatccctct

SEQ ID NO: 197889 - DNA, 16 bp, P. troglodytes
acccagcaatttcatt

SEQ ID NO: 197890 - DNA, 16 bp, P. troglodytes
acccagcactgtgctg

SEQ ID NO: 197891 - DNA, 16 bp, P. troglodytes
acccagcactttggga

SEQ ID NO: 197892 - DNA, 16 bp, P. troglodytes
acccagcagaagaaaa

SEQ ID NO: 197893 - DNA, 16 bp, P. troglodytes
acccagctaatgtttt

SEQ ID NO: 197894 - DNA, 16 bp, P. troglodytes
acccagctaattttcc

SEQ ID NO: 197895 - DNA, 16 bp, P. troglodytes
acccagctaatttttt

SEQ ID NO: 197896 - DNA, 16 bp, P. troglodytes
acccagctacttggga

SEQ ID NO: 197897 - DNA, 16 bp, P. troglodytes
acccagctcatctcac

SEQ ID NO: 197898 - DNA, 16 bp, P. troglodytes
acccaggaaatggagg

SEQ ID NO: 197899 - DNA, 16 bp, P. troglodytes
acccaggaagagctga

SEQ ID NO: 197900 - DNA, 16 bp, P. troglodytes
acccaggaagcccagc

SEQ ID NO: 197901 - DNA, 16 bp, P. troglodytes
acccaggaatgtcttt

SEQ ID NO: 197902 - DNA, 16 bp, P. troglodytes
acccaggaccagatgg

SEQ ID NO: 197903 - DNA, 16 bp, P. troglodytes
acccaggagatggaag

SEQ ID NO: 197904 - DNA, 16 bp, P. troglodytes
acccaggagctggagg

SEQ ID NO: 197905 - DNA, 16 bp, P. troglodytes
acccaggaggagaagg

SEQ ID NO: 197906 - DNA, 16 bp, P. troglodytes
acccaggaggaggtgg

SEQ ID NO: 197907 - DNA, 16 bp, P. troglodytes
acccaggaggcggaag

SEQ ID NO: 197908 - DNA, 16 bp, P. troglodytes
acccaggaggctggag

SEQ ID NO: 197909 - DNA, 16 bp, P. troglodytes
acccaggaggtagaag

SEQ ID NO: 197910 - DNA, 16 bp, P. troglodytes
acccaggaggtggaga

SEQ ID NO: 197911 - DNA, 16 bp, P. troglodytes
acccaggaggtggcag

SEQ ID NO: 197912 - DNA, 16 bp, P. troglodytes
acccaggagtttgaga

SEQ ID NO: 197913 - DNA, 16 bp, P. troglodytes
acccaggagtttgagg

SEQ ID NO: 197914 - DNA, 16 bp, P. troglodytes
acccaggcaagcaggg

SEQ ID NO: 197915 - DNA, 16 bp, P. troglodytes
acccaggcagaggagg

SEQ ID NO: 197916 - DNA, 16 bp, P. troglodytes
acccaggcagatctcc

SEQ ID NO: 197917 - DNA, 16 bp, P. troglodytes
acccaggcagcggagg

SEQ ID NO: 197918 - DNA, 16 bp, P. troglodytes
acccaggcaggtggat

SEQ ID NO: 197919 - DNA, 16 bp, P. troglodytes
acccaggcgtggtggt

SEQ ID NO: 197920 - DNA, 16 bp, P. troglodytes
acccaggctgcagtgt

SEQ ID NO: 197921 - DNA, 16 bp, P. troglodytes
acccaggctggacttg

SEQ ID NO: 197922 - DNA, 16 bp, P. troglodytes
acccaggctggagtga

SEQ ID NO: 197923 - DNA, 18 bp, P. troglodytes
acccaggctggagtgtgg

SEQ ID NO: 197924 - DNA, 16 bp, P. troglodytes
acccaggctttcccat

SEQ ID NO: 197925 - DNA, 16 bp, P. troglodytes
acccaggtacatgtcc

SEQ ID NO: 197926 - DNA, 16 bp, P. troglodytes
acccaggtgtgtctga

SEQ ID NO: 197927 - DNA, 16 bp, P. troglodytes
acccaggttcaagcaa

SEQ ID NO: 197928 - DNA, 19 bp, P. troglodytes
acccagtaactcgtcattt

SEQ ID NO: 197929 - DNA, 16 bp, P. troglodytes
acccagtctcagacat

SEQ ID NO: 197930 - DNA, 16 bp, P. troglodytes
acccagtctcaggcat

SEQ ID NO: 197931 - DNA, 16 bp, P. troglodytes
acccagtctcaggtgt

SEQ ID NO: 197932 - DNA, 16 bp, P. troglodytes
acccagtgaaaatatc

SEQ ID NO: 197933 - DNA, 16 bp, P. troglodytes
acccagtgggaaataa

SEQ ID NO: 197934 - DNA, 16 bp, P. troglodytes
acccagttaaatttga

SEQ ID NO: 197935 - DNA, 16 bp, P. troglodytes
acccagttccaaagcc

SEQ ID NO: 197936 - DNA, 18 bp, P. troglodytes
acccagttcctgatgaat

SEQ ID NO: 197937 - DNA, 16 bp, P. troglodytes
acccagttctaaagtt

SEQ ID NO: 197938 - DNA, 16 bp, P. troglodytes
acccagttttttgagg

SEQ ID NO: 197939 - DNA, 16 bp, P. troglodytes
acccatagtcccagct

SEQ ID NO: 197940 - DNA, 16 bp, P. troglodytes
acccatcctaaaattc

SEQ ID NO: 197941 - DNA, 16 bp, P. troglodytes
acccatctcacatgca

SEQ ID NO: 197942 - DNA, 16 bp, P. troglodytes
acccatctctataaaa

SEQ ID NO: 197943 - DNA, 16 bp, P. troglodytes
acccatcttatgtgca

SEQ ID NO: 197944 - DNA, 16 bp, P. troglodytes
acccatgaacttaaaa

SEQ ID NO: 197945 - DNA, 16 bp, P. troglodytes
acccattaactagtca

SEQ ID NO: 197946 - DNA, 16 bp, P. troglodytes
acccattatttatttt

SEQ ID NO: 197947 - DNA, 16 bp, P. troglodytes
acccattttgagttga

SEQ ID NO: 197948 - DNA, 16 bp, P. troglodytes
accccaaatggaggga

SEQ ID NO: 197949 - DNA, 16 bp, P. troglodytes
accccaagggaagaat

SEQ ID NO: 197950 - DNA, 16 bp, P. troglodytes
accccacacagagtcc

SEQ ID NO: 197951 - DNA, 16 bp, P. troglodytes
accccacatttccctt

SEQ ID NO: 197952 - DNA, 16 bp, P. troglodytes
accccaccccagacct

SEQ ID NO: 197953 - DNA, 16 bp, P. troglodytes
accccaccctgggtga

SEQ ID NO: 197954 - DNA, 16 bp, P. troglodytes
accccaccttcaagcc

SEQ ID NO: 197955 - DNA, 16 bp, P. troglodytes
accccagacttactga

SEQ ID NO: 197956 - DNA, 16 bp, P. troglodytes
accccagatcaacaga

SEQ ID NO: 197957 - DNA, 16 bp, P. troglodytes
accccagcctccagag

SEQ ID NO: 197958 - DNA, 16 bp, P. troglodytes
accccagcctcctgag

SEQ ID NO: 197959 - DNA, 16 bp, P. troglodytes
accccagcctcttgag

SEQ ID NO: 197960 - DNA, 16 bp, P. troglodytes
accccagcctggacaa

SEQ ID NO: 197961 - DNA, 16 bp, P. troglodytes
accccagcctgggtgg

SEQ ID NO: 197962 - DNA, 16 bp, P. troglodytes
accccagtctaatcat

SEQ ID NO: 197963 - DNA, 16 bp, P. troglodytes
accccagtgtgtgatg

SEQ ID NO: 197964 - DNA, 16 bp, P. troglodytes
accccatcactacaaa

SEQ ID NO: 197965 - DNA, 16 bp, P. troglodytes
accccatctctacaat

SEQ ID NO: 197966 - DNA, 17 bp, P. troglodytes
accccatctctactaag

SEQ ID NO: 197967 - DNA, 16 bp, P. troglodytes
accccattccccatga

SEQ ID NO: 197968 - DNA, 16 bp, P. troglodytes
accccattctcccagt

SEQ ID NO: 197969 - DNA, 16 bp, P. troglodytes
accccattgtcaacat

SEQ ID NO: 197970 - DNA, 16 bp, P. troglodytes
acccccagaggtggag

SEQ ID NO: 197971 - DNA, 16 bp, P. troglodytes
acccccaggacctcag

SEQ ID NO: 197972 - DNA, 16 bp, P. troglodytes
acccccatcatccaat

SEQ ID NO: 197973 - DNA, 16 bp, P. troglodytes
acccccatgcccagct

SEQ ID NO: 197974 - DNA, 16 bp, P. troglodytes
acccccatgcctggct

SEQ ID NO: 197975 - DNA, 16 bp, P. troglodytes
acccccgcctcccggg

SEQ ID NO: 197976 - DNA, 16 bp, P. troglodytes
accccctccaccaagg

SEQ ID NO: 197977 - DNA, 16 bp, P. troglodytes
accccctctctacaaa

SEQ ID NO: 197978 - DNA, 16 bp, P. troglodytes
accccctgataggccc

SEQ ID NO: 197979 - DNA, 16 bp, P. troglodytes
acccccttagagttgt

SEQ ID NO: 197980 - DNA, 16 bp, P. troglodytes
acccccttcctgcctg

SEQ ID NO: 197981 - DNA, 16 bp, P. troglodytes
acccccttccttatca

SEQ ID NO: 197982 - DNA, 16 bp, P. troglodytes
accccgtctctccaaa

SEQ ID NO: 197983 - DNA, 16 bp, P. troglodytes
acccctcgtggcttgg

SEQ ID NO: 197984 - DNA, 16 bp, P. troglodytes
acccctggactcaagc

SEQ ID NO: 197985 - DNA, 16 bp, P. troglodytes
acccctgtactccagc

SEQ ID NO: 197986 - DNA, 16 bp, P. troglodytes
acccctgtctcccagg

SEQ ID NO: 197987 - DNA, 16 bp, P. troglodytes
acccctgtctctcacc

SEQ ID NO: 197988 - DNA, 16 bp, P. troglodytes
acccctgtggctctgc

SEQ ID NO: 197989 - DNA, 16 bp, P. troglodytes
accccttccccagcct

SEQ ID NO: 197990 - DNA, 16 bp, P. troglodytes
accccttctcctccaa

SEQ ID NO: 197991 - DNA, 16 bp, P. troglodytes
accccttctctcctaa

SEQ ID NO: 197992 - DNA, 16 bp, P. troglodytes
accccttgcacttccc

SEQ ID NO: 197993 - DNA, 16 bp, P. troglodytes
acccctttcctgtaac

SEQ ID NO: 197994 - DNA, 16 bp, P. troglodytes
acccctttctttgtgg

SEQ ID NO: 197995 - DNA, 16 bp, P. troglodytes
acccgagactgggtag

SEQ ID NO: 197996 - DNA, 16 bp, P. troglodytes
acccgccaccatgtct

SEQ ID NO: 197997 - DNA, 16 bp, P. troglodytes
acccgcctggccaaca

SEQ ID NO: 197998 - DNA, 16 bp, P. troglodytes
acccgggagaaggagg

SEQ ID NO: 197999 - DNA, 16 bp, P. troglodytes
acccgggagctggagg

SEQ ID NO: 198000 - DNA, 16 bp, P. troglodytes
acccgggaggcagacc

SEQ ID NO: 198001 - DNA, 16 bp, P. troglodytes
acccgggaggcggcgc

SEQ ID NO: 198002 - DNA, 16 bp, P. troglodytes
acccgggaggcggtgg

SEQ ID NO: 198003 - DNA, 16 bp, P. troglodytes
accctacatttccctt

SEQ ID NO: 198004 - DNA, 16 bp, P. troglodytes
accctactaaaaatac

SEQ ID NO: 198005 - DNA, 17 bp, P. troglodytes
accctagaagaaaaccc

SEQ ID NO: 198006 - DNA, 16 bp, P. troglodytes
accctagctggagtgc

SEQ ID NO: 198007 - DNA, 16 bp, P. troglodytes
accctataagccagaa

SEQ ID NO: 198008 - DNA, 16 bp, P. troglodytes
accctcaacctcccag

SEQ ID NO: 198009 - DNA, 16 bp, P. troglodytes
accctcacagagtcca

SEQ ID NO: 198010 - DNA, 16 bp, P. troglodytes
accctcagaaactgtg

SEQ ID NO: 198011 - DNA, 16 bp, P. troglodytes
accctcagctctcctg

SEQ ID NO: 198012 - DNA, 16 bp, P. troglodytes
accctcaggtcaggag

SEQ ID NO: 198013 - DNA, 16 bp, P. troglodytes
accctcatggcctaat

SEQ ID NO: 198014 - DNA, 16 bp, P. troglodytes
accctccagcctgggc

SEQ ID NO: 198015 - DNA, 16 bp, P. troglodytes
accctcctccctttgg

SEQ ID NO: 198016 - DNA, 16 bp, P. troglodytes
accctcctgacaaagg

SEQ ID NO: 198017 - DNA, 16 bp, P. troglodytes
accctccttaccctgc

SEQ ID NO: 198018 - DNA, 16 bp, P. troglodytes
accctctctggaatgg

SEQ ID NO: 198019 - DNA, 16 bp, P. troglodytes
accctctgaagcagtg

SEQ ID NO: 198020 - DNA, 16 bp, P. troglodytes
accctctgcctcctgg

SEQ ID NO: 198021 - DNA, 16 bp, P. troglodytes
accctcttcaatgcct

SEQ ID NO: 198022 - DNA, 16 bp, P. troglodytes
accctcttcagtgcct

SEQ ID NO: 198023 - DNA, 16 bp, P. troglodytes
accctgaaaaagaaca

SEQ ID NO: 198024 - DNA, 16 bp, P. troglodytes
accctgaagactccac

SEQ ID NO: 198025 - DNA, 16 bp, P. troglodytes
accctgaaggcagagg

SEQ ID NO: 198026 - DNA, 16 bp, P. troglodytes
accctgaataaccaaa

SEQ ID NO: 198027 - DNA, 16 bp, P. troglodytes
accctgagaatgaccc

SEQ ID NO: 198028 - DNA, 16 bp, P. troglodytes
accctgagctgctggg

SEQ ID NO: 198029 - DNA, 16 bp, P. troglodytes
accctgatgaagctgg

SEQ ID NO: 198030 - DNA, 16 bp, P. troglodytes
accctgatgtgattac

SEQ ID NO: 198031 - DNA, 16 bp, P. troglodytes
accctgatgtggttat

SEQ ID NO: 198032 - DNA, 16 bp, P. troglodytes
accctgcaaagccaca

SEQ ID NO: 198033 - DNA, 16 bp, P. troglodytes
accctgccatgtgagg

SEQ ID NO: 198034 - DNA, 16 bp, P. troglodytes
accctgccgacacctt

SEQ ID NO: 198035 - DNA, 16 bp, P. troglodytes
accctgcctgtactaa

SEQ ID NO: 198036 - DNA, 16 bp, P. troglodytes
accctgctaatttttt

SEQ ID NO: 198037 - DNA, 16 bp, P. troglodytes
accctgctggccaggc

SEQ ID NO: 198038 - DNA, 16 bp, P. troglodytes
accctgcttagcttcc

SEQ ID NO: 198039 - DNA, 17 bp, P. troglodytes
accctgcttattcctgt

SEQ ID NO: 198040 - DNA, 16 bp, P. troglodytes
accctgctttggctca

SEQ ID NO: 198041 - DNA, 16 bp, P. troglodytes
accctggaccccagac

SEQ ID NO: 198042 - DNA, 16 bp, P. troglodytes
accctggagacagagg

SEQ ID NO: 198043 - DNA, 16 bp, P. troglodytes
accctggaggaggagg

SEQ ID NO: 198044 - DNA, 16 bp, P. troglodytes
accctggaggtggagc

SEQ ID NO: 198045 - DNA, 16 bp, P. troglodytes
accctgggccagaaag

SEQ ID NO: 198046 - DNA, 16 bp, P. troglodytes
accctgggctcaagtg

SEQ ID NO: 198047 - DNA, 16 bp, P. troglodytes
accctgtcaagaaaga

SEQ ID NO: 198048 - DNA, 16 bp, P. troglodytes
accctgtctaaaaaaa

SEQ ID NO: 198049 - DNA, 16 bp, P. troglodytes
accctgtctctaccag

SEQ ID NO: 198050 - DNA, 16 bp, P. troglodytes
accctgtctctatttt

SEQ ID NO: 198051 - DNA, 16 bp, P. troglodytes
accctgtctgtaaaaa

SEQ ID NO: 198052 - DNA, 16 bp, P. troglodytes
accctgtcttttaaaa

SEQ ID NO: 198053 - DNA, 16 bp, P. troglodytes
accctgtgacccagca

SEQ ID NO: 198054 - DNA, 16 bp, P. troglodytes
accctgtttcaaaaca

SEQ ID NO: 198055 - DNA, 16 bp, P. troglodytes
acccttaaatgtaaat

SEQ ID NO: 198056 - DNA, 16 bp, P. troglodytes
acccttatgacctcat

SEQ ID NO: 198057 - DNA, 16 bp, P. troglodytes
acccttcaaaaaatga

SEQ ID NO: 198058 - DNA, 17 bp, P. troglodytes
acccttcacctatttta

SEQ ID NO: 198059 - DNA, 17 bp, P. troglodytes
acccttctatagaagta

SEQ ID NO: 198060 - DNA, 16 bp, P. troglodytes
acccttgacctcaggt

SEQ ID NO: 198061 - DNA, 16 bp, P. troglodytes
acccttgtgcattgct

SEQ ID NO: 198062 - DNA, 16 bp, P. troglodytes
accctttacccagatt

SEQ ID NO: 198063 - DNA, 16 bp, P. troglodytes
accgaggcgggtggat

SEQ ID NO: 198064 - DNA, 18 bp, P. troglodytes
accgaggtgggcggatca

SEQ ID NO: 198065 - DNA, 16 bp, P. troglodytes
accgcagtcatttctt

SEQ ID NO: 198066 - DNA, 16 bp, P. troglodytes
accgcatccacaccaa

SEQ ID NO: 198067 - DNA, 16 bp, P. troglodytes
accgccacacccggct

SEQ ID NO: 198068 - DNA, 16 bp, P. troglodytes
accgcctgccttggcc

SEQ ID NO: 198069 - DNA, 16 bp, P. troglodytes
accgcgcccagccgca

SEQ ID NO: 198070 - DNA, 16 bp, P. troglodytes
accgcgcccggcctat

SEQ ID NO: 198071 - DNA, 16 bp, P. troglodytes
accggcttaaaaaatg

SEQ ID NO: 198072 - DNA, 16 bp, P. troglodytes
accgtcattctcagca

SEQ ID NO: 198073 - DNA, 16 bp, P. troglodytes
accgtgcccggcccac

SEQ ID NO: 198074 - DNA, 16 bp, P. troglodytes
accgtgcccggctgtg

SEQ ID NO: 198075 - DNA, 16 bp, P. troglodytes
accgtgcctggccaaa

SEQ ID NO: 198076 - DNA, 17 bp, P. troglodytes
accgtgcctggccttgt

SEQ ID NO: 198077 - DNA, 16 bp, P. troglodytes
accgtgcctggctact

SEQ ID NO: 198078 - DNA, 16 bp, P. troglodytes
accgtgcctggctgga

SEQ ID NO: 198079 - DNA, 16 bp, P. troglodytes
acctaaaaatgtggaa

SEQ ID NO: 198080 - DNA, 16 bp, P. troglodytes
acctaaaattattttt

SEQ ID NO: 198081 - DNA, 16 bp, P. troglodytes
acctaaaggaactaga

SEQ ID NO: 198082 - DNA, 16 bp, P. troglodytes
acctaaccaactccat

SEQ ID NO: 198083 - DNA, 16 bp, P. troglodytes
acctaagagattattt

SEQ ID NO: 198084 - DNA, 16 bp, P. troglodytes
acctaagagtgagaac

SEQ ID NO: 198085 - DNA, 16 bp, P. troglodytes
acctaagcctcccaag

SEQ ID NO: 198086 - DNA, 16 bp, P. troglodytes
acctaagtgtccagca

SEQ ID NO: 198087 - DNA, 16 bp, P. troglodytes
acctaataaatattta

SEQ ID NO: 198088 - DNA, 16 bp, P. troglodytes
acctaattaaactaaa

SEQ ID NO: 198089 - DNA, 16 bp, P. troglodytes
acctaattaaagagct

SEQ ID NO: 198090 - DNA, 16 bp, P. troglodytes
acctaattacctctca

SEQ ID NO: 198091 - DNA, 16 bp, P. troglodytes
acctacaactataaaa

SEQ ID NO: 198092 - DNA, 16 bp, P. troglodytes
acctacacagagactt

SEQ ID NO: 198093 - DNA, 16 bp, P. troglodytes
acctacaggatgggag

SEQ ID NO: 198094 - DNA, 16 bp, P. troglodytes
acctacatgtccatca

SEQ ID NO: 198095 - DNA, 16 bp, P. troglodytes
acctaccttggcctcc

SEQ ID NO: 198096 - DNA, 16 bp, P. troglodytes
acctactaaaaataca

SEQ ID NO: 198097 - DNA, 16 bp, P. troglodytes
acctactaaaggacat

SEQ ID NO: 198098 - DNA, 16 bp, P. troglodytes
acctactaaattagaa

SEQ ID NO: 198099 - DNA, 16 bp, P. troglodytes
acctactagatgccag

SEQ ID NO: 198100 - DNA, 16 bp, P. troglodytes
acctactaggtaccca

SEQ ID NO: 198101 - DNA, 16 bp, P. troglodytes
acctactgaatcagaa

SEQ ID NO: 198102 - DNA, 16 bp, P. troglodytes
acctactgagacacca

SEQ ID NO: 198103 - DNA, 16 bp, P. troglodytes
acctactgagtcagaa

SEQ ID NO: 198104 - DNA, 16 bp, P. troglodytes
acctactgggttcaag

SEQ ID NO: 198105 - DNA, 16 bp, P. troglodytes
acctactgtgtgccaa

SEQ ID NO: 198106 - DNA, 16 bp, P. troglodytes
acctacttcatagggt

SEQ ID NO: 198107 - DNA, 16 bp, P. troglodytes
acctagaaaaaatgga

SEQ ID NO: 198108 - DNA, 16 bp, P. troglodytes
acctagaaaaacctaa

SEQ ID NO: 198109 - DNA, 16 bp, P. troglodytes
acctagatgaaatgga

SEQ ID NO: 198110 - DNA, 16 bp, P. troglodytes
acctagcacagtgcct

SEQ ID NO: 198111 - DNA, 16 bp, P. troglodytes
acctagcacagtgctg

SEQ ID NO: 198112 - DNA, 16 bp, P. troglodytes
acctagcactttggga

SEQ ID NO: 198113 - DNA, 16 bp, P. troglodytes
acctagctaatttttt

SEQ ID NO: 198114 - DNA, 16 bp, P. troglodytes
acctaggtgaggacag

SEQ ID NO: 198115 - DNA, 16 bp, P. troglodytes
acctaggttttcttct

SEQ ID NO: 198116 - DNA, 16 bp, P. troglodytes
acctataaatatatac

SEQ ID NO: 198117 - DNA, 16 bp, P. troglodytes
acctatagcctggaag

SEQ ID NO: 198118 - DNA, 17 bp, P. troglodytes
acctatagtcccagctg

SEQ ID NO: 198119 - DNA, 16 bp, P. troglodytes
acctatcaactcatca

SEQ ID NO: 198120 - DNA, 16 bp, P. troglodytes
acctatgcctcctggg

SEQ ID NO: 198121 - DNA, 16 bp, P. troglodytes
acctattgaaggatat

SEQ ID NO: 198122 - DNA, 16 bp, P. troglodytes
acctattgaatcagaa

SEQ ID NO: 198123 - DNA, 16 bp, P. troglodytes
acctcaaactcagcat

SEQ ID NO: 198124 - DNA, 16 bp, P. troglodytes
acctcaacaaatttaa

SEQ ID NO: 198125 - DNA, 16 bp, P. troglodytes
acctcaacactttggg

SEQ ID NO: 198126 - DNA, 16 bp, P. troglodytes
acctcaagtgaactgc

SEQ ID NO: 198127 - DNA, 23 bp, P. troglodytes
acctcaagtgatccacccgcctt

SEQ ID NO: 198128 - DNA, 16 bp, P. troglodytes
acctcacaccagtcag

SEQ ID NO: 198129 - DNA, 16 bp, P. troglodytes
acctcacactgcaggg

SEQ ID NO: 198130 - DNA, 16 bp, P. troglodytes
acctcaccaaagaaaa

SEQ ID NO: 198131 - DNA, 16 bp, P. troglodytes
acctcacctggccaaa

SEQ ID NO: 198132 - DNA, 16 bp, P. troglodytes
acctcacgggttcaag

SEQ ID NO: 198133 - DNA, 16 bp, P. troglodytes
acctcactgcagcctc

SEQ ID NO: 198134 - DNA, 16 bp, P. troglodytes
acctcagaatgtgatt

SEQ ID NO: 198135 - DNA, 16 bp, P. troglodytes
acctcagaggcagagg

SEQ ID NO: 198136 - DNA, 16 bp, P. troglodytes
acctcagaggcggagg

SEQ ID NO: 198137 - DNA, 16 bp, P. troglodytes
acctcagcatatgatt

SEQ ID NO: 198138 - DNA, 16 bp, P. troglodytes
acctcagccccccaga

SEQ ID NO: 198139 - DNA, 16 bp, P. troglodytes
acctcagccgcctgag

SEQ ID NO: 198140 - DNA, 16 bp, P. troglodytes
acctcagcctcagcct

SEQ ID NO: 198141 - DNA, 22 bp, P. troglodytes
acctcagcctccagagtagctg

SEQ ID NO: 198142 - DNA, 19 bp, P. troglodytes
acctcagcctcccaaagta

SEQ ID NO: 198143 - DNA, 16 bp, P. troglodytes
acctcagcctcccaag

SEQ ID NO: 198144 - DNA, 16 bp, P. troglodytes
acctcagcctcccagg

SEQ ID NO: 198145 - DNA, 18 bp, P. troglodytes
acctcagcctcccgagta

SEQ ID NO: 198146 - DNA, 16 bp, P. troglodytes
acctcagcctccggag

SEQ ID NO: 198147 - DNA, 19 bp, P. troglodytes
acctcagcctcctaaagtg

SEQ ID NO: 198148 - DNA, 16 bp, P. troglodytes
acctcagcctcctgaa

SEQ ID NO: 198149 - DNA, 24 bp, P. troglodytes
acctcagcctcctgagtagctgga

SEQ ID NO: 198150 - DNA, 16 bp, P. troglodytes
acctcagcctctcaaa

SEQ ID NO: 198151 - DNA, 16 bp, P. troglodytes
acctcagcctgaattt

SEQ ID NO: 198152 - DNA, 16 bp, P. troglodytes
acctcagcctggattt

SEQ ID NO: 198153 - DNA, 16 bp, P. troglodytes
acctcagccttccaaa

SEQ ID NO: 198154 - DNA, 16 bp, P. troglodytes
acctcagctcactgca

SEQ ID NO: 198155 - DNA, 16 bp, P. troglodytes
acctcagctggaaatg

SEQ ID NO: 198156 - DNA, 16 bp, P. troglodytes
acctcagcttcccaaa

SEQ ID NO: 198157 - DNA, 16 bp, P. troglodytes
acctcaggaaacttac

SEQ ID NO: 198158 - DNA, 16 bp, P. troglodytes
acctcaggaccactat

SEQ ID NO: 198159 - DNA, 16 bp, P. troglodytes
acctcaggaccctgtg

SEQ ID NO: 198160 - DNA, 17 bp, P. troglodytes
acctcaggcgatccgcc

SEQ ID NO: 198161 - DNA, 16 bp, P. troglodytes
acctcaggtaatctgc

SEQ ID NO: 198162 - DNA, 16 bp, P. troglodytes
acctcaggtgacccac

SEQ ID NO: 198163 - DNA, 19 bp, P. troglodytes
acctcaggtgatccgccca

SEQ ID NO: 198164 - DNA, 16 bp, P. troglodytes
acctcaggtggtccgc

SEQ ID NO: 198165 - DNA, 16 bp, P. troglodytes
acctcagtctccagag

SEQ ID NO: 198166 - DNA, 16 bp, P. troglodytes
acctcagtgtcctgag

SEQ ID NO: 198167 - DNA, 16 bp, P. troglodytes
acctcagttttatcat

SEQ ID NO: 198168 - DNA, 16 bp, P. troglodytes
acctcataaacatata

SEQ ID NO: 198169 - DNA, 16 bp, P. troglodytes
acctcatataagtgga

SEQ ID NO: 198170 - DNA, 16 bp, P. troglodytes
acctcatcagcatctg

SEQ ID NO: 198171 - DNA, 16 bp, P. troglodytes
acctcatcatccgccc

SEQ ID NO: 198172 - DNA, 16 bp, P. troglodytes
acctcatctctgaaaa

SEQ ID NO: 198173 - DNA, 16 bp, P. troglodytes
acctcatctctgctaa

SEQ ID NO: 198174 - DNA, 16 bp, P. troglodytes
acctcatcttaattta

SEQ ID NO: 198175 - DNA, 16 bp, P. troglodytes
acctcatgatcagcct

SEQ ID NO: 198176 - DNA, 16 bp, P. troglodytes
acctcatgatctgctt

SEQ ID NO: 198177 - DNA, 16 bp, P. troglodytes
acctcatggagctgaa

SEQ ID NO: 198178 - DNA, 16 bp, P. troglodytes
acctcattaaaattaa

SEQ ID NO: 198179 - DNA, 16 bp, P. troglodytes
acctcatttctaaaaa

SEQ ID NO: 198180 - DNA, 16 bp, P. troglodytes
acctcatttctacaaa

SEQ ID NO: 198181 - DNA, 16 bp, P. troglodytes
acctccaaactcttct

SEQ ID NO: 198182 - DNA, 16 bp, P. troglodytes
acctccacctcccaag

SEQ ID NO: 198183 - DNA, 16 bp, P. troglodytes
acctccacctcccaga

SEQ ID NO: 198184 - DNA, 16 bp, P. troglodytes
acctccacctcctgca

SEQ ID NO: 198185 - DNA, 16 bp, P. troglodytes
acctccacctggtcac

SEQ ID NO: 198186 - DNA, 16 bp, P. troglodytes
acctccacctggtctc

SEQ ID NO: 198187 - DNA, 16 bp, P. troglodytes
acctccaccttcccag

SEQ ID NO: 198188 - DNA, 16 bp, P. troglodytes
acctccacttgttata

SEQ ID NO: 198189 - DNA, 16 bp, P. troglodytes
acctccatgcctggct

SEQ ID NO: 198190 - DNA, 16 bp, P. troglodytes
acctccattttacaga

SEQ ID NO: 198191 - DNA, 16 bp, P. troglodytes
acctcccaaaggcacc

SEQ ID NO: 198192 - DNA, 16 bp, P. troglodytes
acctcccaaaggtccc

SEQ ID NO: 198193 - DNA, 16 bp, P. troglodytes
acctcccaagctcaag

SEQ ID NO: 198194 - DNA, 16 bp, P. troglodytes
acctcccaggcccagg

SEQ ID NO: 198195 - DNA, 16 bp, P. troglodytes
acctcccaggctcaag

SEQ ID NO: 198196 - DNA, 16 bp, P. troglodytes
acctcccaggctcagg

SEQ ID NO: 198197 - DNA, 16 bp, P. troglodytes
acctcccaggcttaag

SEQ ID NO: 198198 - DNA, 16 bp, P. troglodytes
acctcccaggttcaaa

SEQ ID NO: 198199 - DNA, 16 bp, P. troglodytes
acctcccaggttcaag

SEQ ID NO: 198200 - DNA, 20 bp, P. troglodytes
acctcccaggttcaagtgat

SEQ ID NO: 198201 - DNA, 16 bp, P. troglodytes
acctccccaggctcag

SEQ ID NO: 198202 - DNA, 16 bp, P. troglodytes
acctccccctcccggg

SEQ ID NO: 198203 - DNA, 16 bp, P. troglodytes
acctccccgggctcag

SEQ ID NO: 198204 - DNA, 16 bp, P. troglodytes
acctccccggttcaag

SEQ ID NO: 198205 - DNA, 16 bp, P. troglodytes
acctcccgagctcaag

SEQ ID NO: 198206 - DNA, 16 bp, P. troglodytes
acctcccgggttcaag

SEQ ID NO: 198207 - DNA, 16 bp, P. troglodytes
acctcccgggttcact

SEQ ID NO: 198208 - DNA, 16 bp, P. troglodytes
acctcccgggttccag

SEQ ID NO: 198209 - DNA, 16 bp, P. troglodytes
acctccctccaggtcc

SEQ ID NO: 198210 - DNA, 16 bp, P. troglodytes
acctccctcccttgac

SEQ ID NO: 198211 - DNA, 16 bp, P. troglodytes
acctccctcctggctg

SEQ ID NO: 198212 - DNA, 16 bp, P. troglodytes
acctccctggctcaag

SEQ ID NO: 198213 - DNA, 16 bp, P. troglodytes
acctccctgggcctca

SEQ ID NO: 198214 - DNA, 16 bp, P. troglodytes
acctccgcctccaagg

SEQ ID NO: 198215 - DNA, 16 bp, P. troglodytes
acctccgcctcttggg

SEQ ID NO: 198216 - DNA, 16 bp, P. troglodytes
acctccgcctgccagg

SEQ ID NO: 198217 - DNA, 16 bp, P. troglodytes
acctccgcttcctggg

SEQ ID NO: 198218 - DNA, 16 bp, P. troglodytes
acctcctaaaggacct

SEQ ID NO: 198219 - DNA, 16 bp, P. troglodytes
acctcctactccctgg

SEQ ID NO: 198220 - DNA, 16 bp, P. troglodytes
acctcctagcctcaag

SEQ ID NO: 198221 - DNA, 16 bp, P. troglodytes
acctcctaggctcaag

SEQ ID NO: 198222 - DNA, 16 bp, P. troglodytes
acctcctaggctcagg

SEQ ID NO: 198223 - DNA, 17 bp, P. troglodytes
acctcctaggttcaaga

SEQ ID NO: 198224 - DNA, 18 bp, P. troglodytes
acctcctaggttcaagca

SEQ ID NO: 198225 - DNA, 16 bp, P. troglodytes
acctcctccaagaagc

SEQ ID NO: 198226 - DNA, 16 bp, P. troglodytes
acctcctcctcccaaa

SEQ ID NO: 198227 - DNA, 16 bp, P. troglodytes
acctcctcctctcagg

SEQ ID NO: 198228 - DNA, 16 bp, P. troglodytes
acctcctccttctggg

SEQ ID NO: 198229 - DNA, 16 bp, P. troglodytes
acctcctctgcctccc

SEQ ID NO: 198230 - DNA, 16 bp, P. troglodytes
acctcctctgtgaagc

SEQ ID NO: 198231 - DNA, 16 bp, P. troglodytes
acctcctcttcccggg

SEQ ID NO: 198232 - DNA, 16 bp, P. troglodytes
acctcctgaagctgtg

SEQ ID NO: 198233 - DNA, 16 bp, P. troglodytes
acctcctgagctcaag

SEQ ID NO: 198234 - DNA, 16 bp, P. troglodytes
acctcctgagtggctg

SEQ ID NO: 198235 - DNA, 18 bp, P. troglodytes
acctcctgagttcaagcg

SEQ ID NO: 198236 - DNA, 16 bp, P. troglodytes
acctcctgcctcagcc

SEQ ID NO: 198237 - DNA, 16 bp, P. troglodytes
acctcctggagtcaag

SEQ ID NO: 198238 - DNA, 16 bp, P. troglodytes
acctcctggattcaaa

SEQ ID NO: 198239 - DNA, 20 bp, P. troglodytes
acctcctggattcaagtgat

SEQ ID NO: 198240 - DNA, 16 bp, P. troglodytes
acctcctgggctcaaa

SEQ ID NO: 198241 - DNA, 16 bp, P. troglodytes
acctcctgggctcaag

SEQ ID NO: 198242 - DNA, 16 bp, P. troglodytes
acctcctgggctctag

SEQ ID NO: 198243 - DNA, 16 bp, P. troglodytes
acctcctgggttcaaa

SEQ ID NO: 198244 - DNA, 16 bp, P. troglodytes
acctcctgggttcaag

SEQ ID NO: 198245 - DNA, 16 bp, P. troglodytes
acctcctggtgcagtg

SEQ ID NO: 198246 - DNA, 16 bp, P. troglodytes
acctccttcttttgta

SEQ ID NO: 198247 - DNA, 16 bp, P. troglodytes
acctccttggctcaag

SEQ ID NO: 198248 - DNA, 19 bp, P. troglodytes
acctcggcctcccaaagta

SEQ ID NO: 198249 - DNA, 20 bp, P. troglodytes
acctcggcctcccaaagtgt

SEQ ID NO: 198250 - DNA, 16 bp, P. troglodytes
acctcggcctctcaaa

SEQ ID NO: 198251 - DNA, 16 bp, P. troglodytes
acctcgggctcccaaa

SEQ ID NO: 198252 - DNA, 16 bp, P. troglodytes
acctcgtctctacaaa

SEQ ID NO: 198253 - DNA, 21 bp, P. troglodytes
acctcgtgatccacccacctc

SEQ ID NO: 198254 - DNA, 24 bp, P. troglodytes
acctcgtgatccacccgcctcgac

SEQ ID NO: 198255 - DNA, 16 bp, P. troglodytes
acctcgtggtccaccc

SEQ ID NO: 198256 - DNA, 16 bp, P. troglodytes
acctcgtgttccacct

SEQ ID NO: 198257 - DNA, 16 bp, P. troglodytes
acctctacaaaaaatt

SEQ ID NO: 198258 - DNA, 16 bp, P. troglodytes
acctctacctcccagg

SEQ ID NO: 198259 - DNA, 16 bp, P. troglodytes
acctctcaggcccaag

SEQ ID NO: 198260 - DNA, 16 bp, P. troglodytes
acctctcagtgcctca

SEQ ID NO: 198261 - DNA, 16 bp, P. troglodytes
acctctctagtgagat

SEQ ID NO: 198262 - DNA, 16 bp, P. troglodytes
acctctctcagcctca

SEQ ID NO: 198263 - DNA, 16 bp, P. troglodytes
acctctctgtcacctg

SEQ ID NO: 198264 - DNA, 16 bp, P. troglodytes
acctctgacttcctgg

SEQ ID NO: 198265 - DNA, 16 bp, P. troglodytes
acctctgaggttcaag

SEQ ID NO: 198266 - DNA, 16 bp, P. troglodytes
acctctgcagacttca

SEQ ID NO: 198267 - DNA, 16 bp, P. troglodytes
acctctgccactcctg

SEQ ID NO: 198268 - DNA, 16 bp, P. troglodytes
acctctgccccccagg

SEQ ID NO: 198269 - DNA, 16 bp, P. troglodytes
acctctgcctaggaaa

SEQ ID NO: 198270 - DNA, 16 bp, P. troglodytes
acctctgcctccagat

SEQ ID NO: 198271 - DNA, 16 bp, P. troglodytes
acctctgcctcccaga

SEQ ID NO: 198272 - DNA, 16 bp, P. troglodytes
acctctgcctccccgg

SEQ ID NO: 198273 - DNA, 16 bp, P. troglodytes
acctctgcctccgagg

SEQ ID NO: 198274 - DNA, 16 bp, P. troglodytes
acctctgcctgctggg

SEQ ID NO: 198275 - DNA, 16 bp, P. troglodytes
acctctgccttcctgg

SEQ ID NO: 198276 - DNA, 16 bp, P. troglodytes
acctctgccttctgag

SEQ ID NO: 198277 - DNA, 16 bp, P. troglodytes
acctctgccttgcagg

SEQ ID NO: 198278 - DNA, 16 bp, P. troglodytes
acctctgctgcctggg

SEQ ID NO: 198279 - DNA, 16 bp, P. troglodytes
acctctgcttcccagt

SEQ ID NO: 198280 - DNA, 16 bp, P. troglodytes
acctctgcttcctggt

SEQ ID NO: 198281 - DNA, 16 bp, P. troglodytes
acctctggctgacctt

SEQ ID NO: 198282 - DNA, 16 bp, P. troglodytes
acctctggggagggga

SEQ ID NO: 198283 - DNA, 16 bp, P. troglodytes
acctctgtgtgcctca

SEQ ID NO: 198284 - DNA, 16 bp, P. troglodytes
acctcttaaaggctcc

SEQ ID NO: 198285 - DNA, 16 bp, P. troglodytes
acctcttcaaaaagaa

SEQ ID NO: 198286 - DNA, 16 bp, P. troglodytes
acctcttccaggaagc

SEQ ID NO: 198287 - DNA, 16 bp, P. troglodytes
acctcttccaggacct

SEQ ID NO: 198288 - DNA, 16 bp, P. troglodytes
acctcttccatcatgg

SEQ ID NO: 198289 - DNA, 16 bp, P. troglodytes
acctcttcccggccgc

SEQ ID NO: 198290 - DNA, 16 bp, P. troglodytes
acctcttcctcccaaa

SEQ ID NO: 198291 - DNA, 16 bp, P. troglodytes
acctcttgaacacttt

SEQ ID NO: 198292 - DNA, 16 bp, P. troglodytes
acctcttgatctgccc

SEQ ID NO: 198293 - DNA, 16 bp, P. troglodytes
acctcttgggctcaag

SEQ ID NO: 198294 - DNA, 16 bp, P. troglodytes
acctcttgggttcaag

SEQ ID NO: 198295 - DNA, 16 bp, P. troglodytes
acctcttggtctgggt

SEQ ID NO: 198296 - DNA, 16 bp, P. troglodytes
acctctttgaggcctt

SEQ ID NO: 198297 - DNA, 16 bp, P. troglodytes
acctcttttgtttgta

SEQ ID NO: 198298 - DNA, 16 bp, P. troglodytes
acctgaaaataataaa

SEQ ID NO: 198299 - DNA, 16 bp, P. troglodytes
acctgaaatctcagca

SEQ ID NO: 198300 - DNA, 16 bp, P. troglodytes
acctgaacccaggaag

SEQ ID NO: 198301 - DNA, 16 bp, P. troglodytes
acctgaagctggtgat

SEQ ID NO: 198302 - DNA, 16 bp, P. troglodytes
acctgaaggtccagat

SEQ ID NO: 198303 - DNA, 16 bp, P. troglodytes
acctgaagtcagaagt

SEQ ID NO: 198304 - DNA, 16 bp, P. troglodytes
acctgaagtcaggagc

SEQ ID NO: 198305 - DNA, 16 bp, P. troglodytes
acctgacagagctgaa

SEQ ID NO: 198306 - DNA, 17 bp, P. troglodytes
acctgacctcaagtgat

SEQ ID NO: 198307 - DNA, 17 bp, P. troglodytes
acctgacctcaggtgat

SEQ ID NO: 198308 - DNA, 16 bp, P. troglodytes
acctgagaaaaacaag

SEQ ID NO: 198309 - DNA, 16 bp, P. troglodytes
acctgagaagcagagg

SEQ ID NO: 198310 - DNA, 16 bp, P. troglodytes
acctgagccagggagg

SEQ ID NO: 198311 - DNA, 16 bp, P. troglodytes
acctgagcccagggag

SEQ ID NO: 198312 - DNA, 16 bp, P. troglodytes
acctgagcctcccaaa

SEQ ID NO: 198313 - DNA, 17 bp, P. troglodytes
acctgaggtagggagtt

SEQ ID NO: 198314 - DNA, 16 bp, P. troglodytes
acctgaggtcagagtt

SEQ ID NO: 198315 - DNA, 16 bp, P. troglodytes
acctgaggtcaggtgt

SEQ ID NO: 198316 - DNA, 16 bp, P. troglodytes
acctgaggtccagagt

SEQ ID NO: 198317 - DNA, 16 bp, P. troglodytes
acctgagtgagcttgg

SEQ ID NO: 198318 - DNA, 16 bp, P. troglodytes
acctgatactgggtaa

SEQ ID NO: 198319 - DNA, 16 bp, P. troglodytes
acctgatgcagctgaa

SEQ ID NO: 198320 - DNA, 16 bp, P. troglodytes
acctgatggagcagaa

SEQ ID NO: 198321 - DNA, 17 bp, P. troglodytes
acctgattcttcctgga

SEQ ID NO: 198322 - DNA, 16 bp, P. troglodytes
acctgatttttctttt

SEQ ID NO: 198323 - DNA, 16 bp, P. troglodytes
acctgcaaagtccctt

SEQ ID NO: 198324 - DNA, 16 bp, P. troglodytes
acctgcacatctaccc

SEQ ID NO: 198325 - DNA, 16 bp, P. troglodytes
acctgcagaatgggaa

SEQ ID NO: 198326 - DNA, 16 bp, P. troglodytes
acctgcagccccagct

SEQ ID NO: 198327 - DNA, 16 bp, P. troglodytes
acctgcagccccagtg

SEQ ID NO: 198328 - DNA, 16 bp, P. troglodytes
acctgcagcccctgtg

SEQ ID NO: 198329 - DNA, 16 bp, P. troglodytes
acctgcaggcatgcaa

SEQ ID NO: 198330 - DNA, 17 bp, P. troglodytes
acctgcagtcaggagtt

SEQ ID NO: 198331 - DNA, 16 bp, P. troglodytes
acctgcagtgccagct

SEQ ID NO: 198332 - DNA, 16 bp, P. troglodytes
acctgccaagactgaa

SEQ ID NO: 198333 - DNA, 16 bp, P. troglodytes
acctgccaagtagctg

SEQ ID NO: 198334 - DNA, 16 bp, P. troglodytes
acctgccaccacacct

SEQ ID NO: 198335 - DNA, 16 bp, P. troglodytes
acctgccaccacactt

SEQ ID NO: 198336 - DNA, 16 bp, P. troglodytes
acctgccaccatgcca

SEQ ID NO: 198337 - DNA, 16 bp, P. troglodytes
acctgccaccatggcc

SEQ ID NO: 198338 - DNA, 16 bp, P. troglodytes
acctgccaggttcaag

SEQ ID NO: 198339 - DNA, 16 bp, P. troglodytes
acctgccatcacaccc

SEQ ID NO: 198340 - DNA, 16 bp, P. troglodytes
acctgccattgctgag

SEQ ID NO: 198341 - DNA, 16 bp, P. troglodytes
acctgcccccgtgatt

SEQ ID NO: 198342 - DNA, 16 bp, P. troglodytes
acctgccctgggccag

SEQ ID NO: 198343 - DNA, 16 bp, P. troglodytes
acctgcctcaacctcc

SEQ ID NO: 198344 - DNA, 16 bp, P. troglodytes
acctgcctcagccccc

SEQ ID NO: 198345 - DNA, 32 bp, P. troglodytes
acctgcctcagcctcccaaagtgctgggattg

SEQ ID NO: 198346 - DNA, 19 bp, P. troglodytes
acctgcctcagcctcccag

SEQ ID NO: 198347 - DNA, 17 bp, P. troglodytes
acctgcctcagcctcct

SEQ ID NO: 198348 - DNA, 16 bp, P. troglodytes
acctgcctcagcctct

SEQ ID NO: 198349 - DNA, 16 bp, P. troglodytes
acctgcctcagtctcc

SEQ ID NO: 198350 - DNA, 16 bp, P. troglodytes
acctgcctcccagctg

SEQ ID NO: 198351 - DNA, 17 bp, P. troglodytes
acctgcctcgacctccc

SEQ ID NO: 198352 - DNA, 16 bp, P. troglodytes
acctgcctctcattct

SEQ ID NO: 198353 - DNA, 16 bp, P. troglodytes
acctgcctgggcttcc

SEQ ID NO: 198354 - DNA, 16 bp, P. troglodytes
acctgccttggctttc

SEQ ID NO: 198355 - DNA, 16 bp, P. troglodytes
acctgcggccccagtg

SEQ ID NO: 198356 - DNA, 16 bp, P. troglodytes
acctgcggccctggtg

SEQ ID NO: 198357 - DNA, 16 bp, P. troglodytes
acctgctccttttctc

SEQ ID NO: 198358 - DNA, 16 bp, P. troglodytes
acctgctgaatcagaa

SEQ ID NO: 198359 - DNA, 16 bp, P. troglodytes
acctgctgctcacctc

SEQ ID NO: 198360 - DNA, 16 bp, P. troglodytes
acctgctgggctcaag

SEQ ID NO: 198361 - DNA, 16 bp, P. troglodytes
acctgcttcagcctcc

SEQ ID NO: 198362 - DNA, 16 bp, P. troglodytes
acctgcttcagcttcc

SEQ ID NO: 198363 - DNA, 16 bp, P. troglodytes
acctgcttcaggggaa

SEQ ID NO: 198364 - DNA, 16 bp, P. troglodytes
acctgcttggcctccc

SEQ ID NO: 198365 - DNA, 16 bp, P. troglodytes
acctggaagaaatgga

SEQ ID NO: 198366 - DNA, 16 bp, P. troglodytes
acctggaagccctctc

SEQ ID NO: 198367 - DNA, 16 bp, P. troglodytes
acctggaagtcccctc

SEQ ID NO: 198368 - DNA, 16 bp, P. troglodytes
acctggaagttaccac

SEQ ID NO: 198369 - DNA, 16 bp, P. troglodytes
acctggagctgagaca

SEQ ID NO: 198370 - DNA, 16 bp, P. troglodytes
acctggatatccacat

SEQ ID NO: 198371 - DNA, 16 bp, P. troglodytes
acctggatccagccat

SEQ ID NO: 198372 - DNA, 16 bp, P. troglodytes
acctggatttgaatct

SEQ ID NO: 198373 - DNA, 16 bp, P. troglodytes
acctggcaatcccatt

SEQ ID NO: 198374 - DNA, 16 bp, P. troglodytes
acctggcacacagcag

SEQ ID NO: 198375 - DNA, 16 bp, P. troglodytes
acctggcacagtggct

SEQ ID NO: 198376 - DNA, 16 bp, P. troglodytes
acctggcacttagtag

SEQ ID NO: 198377 - DNA, 16 bp, P. troglodytes
acctggcagaggcaca

SEQ ID NO: 198378 - DNA, 16 bp, P. troglodytes
acctggcatatagtag

SEQ ID NO: 198379 - DNA, 16 bp, P. troglodytes
acctggccaacatagc

SEQ ID NO: 198380 - DNA, 24 bp, P. troglodytes
acctggccaacatggtgaaacccc

SEQ ID NO: 198381 - DNA, 16 bp, P. troglodytes
acctggccaacatgtt

SEQ ID NO: 198382 - DNA, 16 bp, P. troglodytes
acctggctaatttttt

SEQ ID NO: 198383 - DNA, 16 bp, P. troglodytes
acctggctcatctcac

SEQ ID NO: 198384 - DNA, 16 bp, P. troglodytes
acctggctggctttgc

SEQ ID NO: 198385 - DNA, 16 bp, P. troglodytes
acctggctgggcatgg

SEQ ID NO: 198386 - DNA, 16 bp, P. troglodytes
acctgggaagcaaagg

SEQ ID NO: 198387 - DNA, 16 bp, P. troglodytes
acctgggagacagaag

SEQ ID NO: 198388 - DNA, 16 bp, P. troglodytes
acctgggagacagagc

SEQ ID NO: 198389 - DNA, 16 bp, P. troglodytes
acctgggaggaagagg

SEQ ID NO: 198390 - DNA, 16 bp, P. troglodytes
acctgggaggagaagg

SEQ ID NO: 198391 - DNA, 17 bp, P. troglodytes
acctgggaggaggagct

SEQ ID NO: 198392 - DNA, 16 bp, P. troglodytes
acctgggaggcaaaga

SEQ ID NO: 198393 - DNA, 16 bp, P. troglodytes
acctgggaggcacagc

SEQ ID NO: 198394 - DNA, 16 bp, P. troglodytes
acctgggaggcagaaa

SEQ ID NO: 198395 - DNA, 16 bp, P. troglodytes
acctgggaggcagaga

SEQ ID NO: 198396 - DNA, 16 bp, P. troglodytes
acctgggaggtgaaga

SEQ ID NO: 198397 - DNA, 16 bp, P. troglodytes
acctgggaggtggaag

SEQ ID NO: 198398 - DNA, 16 bp, P. troglodytes
acctgggaggtggacg

SEQ ID NO: 198399 - DNA, 16 bp, P. troglodytes
acctgggagttggagg

SEQ ID NO: 198400 - DNA, 23 bp, P. troglodytes
acctgggcaacatggcaaaaccc

SEQ ID NO: 198401 - DNA, 16 bp, P. troglodytes
acctgggcaacatggt

SEQ ID NO: 198402 - DNA, 16 bp, P. troglodytes
acctgggcaagttact

SEQ ID NO: 198403 - DNA, 16 bp, P. troglodytes
acctgggcagtggagg

SEQ ID NO: 198404 - DNA, 17 bp, P. troglodytes
acctgggccagcagctg

SEQ ID NO: 198405 - DNA, 17 bp, P. troglodytes
acctgggcctcccaaag

SEQ ID NO: 198406 - DNA, 17 bp, P. troglodytes
acctgggctcaagtgat

SEQ ID NO: 198407 - DNA, 16 bp, P. troglodytes
acctgggctcactgca

SEQ ID NO: 198408 - DNA, 16 bp, P. troglodytes
acctggggtcccagct

SEQ ID NO: 198409 - DNA, 16 bp, P. troglodytes
acctggggtgggggtg

SEQ ID NO: 198410 - DNA, 16 bp, P. troglodytes
acctgggtattaagcc

SEQ ID NO: 198411 - DNA, 16 bp, P. troglodytes
acctgggtgacagagc

SEQ ID NO: 198412 - DNA, 16 bp, P. troglodytes
acctgggtgtggtggc

SEQ ID NO: 198413 - DNA, 16 bp, P. troglodytes
acctgggtttgaatcc

SEQ ID NO: 198414 - DNA, 16 bp, P. troglodytes
acctggtctctccttt

SEQ ID NO: 198415 - DNA, 16 bp, P. troglodytes
acctggtctttgagaa

SEQ ID NO: 198416 - DNA, 17 bp, P. troglodytes
acctggtgacagagtga

SEQ ID NO: 198417 - DNA, 16 bp, P. troglodytes
acctggtggtctttct

SEQ ID NO: 198418 - DNA, 17 bp, P. troglodytes
acctggttaatttttgt

SEQ ID NO: 198419 - DNA, 16 bp, P. troglodytes
acctggtttcaccatg

SEQ ID NO: 198420 - DNA, 16 bp, P. troglodytes
acctgtaaaatcaaaa

SEQ ID NO: 198421 - DNA, 16 bp, P. troglodytes
acctgtaagcccagca

SEQ ID NO: 198422 - DNA, 19 bp, P. troglodytes
acctgtaatcccagcactg

SEQ ID NO: 198423 - DNA, 16 bp, P. troglodytes
acctgtagtcccagca

SEQ ID NO: 198424 - DNA, 18 bp, P. troglodytes
acctgtagtcgcagctac

SEQ ID NO: 198425 - DNA, 16 bp, P. troglodytes
acctgtcaccatgccc

SEQ ID NO: 198426 - DNA, 16 bp, P. troglodytes
acctgtcatcccagct

SEQ ID NO: 198427 - DNA, 16 bp, P. troglodytes
acctgtcatctatatt

SEQ ID NO: 198428 - DNA, 16 bp, P. troglodytes
acctgtcattccagca

SEQ ID NO: 198429 - DNA, 16 bp, P. troglodytes
acctgtcccagctact

SEQ ID NO: 198430 - DNA, 16 bp, P. troglodytes
acctgtctgtgcctca

SEQ ID NO: 198431 - DNA, 16 bp, P. troglodytes
acctgtctgtggcctg

SEQ ID NO: 198432 - DNA, 20 bp, P. troglodytes
acctgtcttggcctcccaaa

SEQ ID NO: 198433 - DNA, 16 bp, P. troglodytes
acctgtgaatatgtga

SEQ ID NO: 198434 - DNA, 16 bp, P. troglodytes
acctgtgaatcctggc

SEQ ID NO: 198435 - DNA, 16 bp, P. troglodytes
acctgtgcttttgagg

SEQ ID NO: 198436 - DNA, 16 bp, P. troglodytes
acctgtggtcccagca

SEQ ID NO: 198437 - DNA, 16 bp, P. troglodytes
acctgtgtgtatgtgt

SEQ ID NO: 198438 - DNA, 16 bp, P. troglodytes
acctgttaactcatca

SEQ ID NO: 198439 - DNA, 16 bp, P. troglodytes
acctgttcctcaaaaa

SEQ ID NO: 198440 - DNA, 16 bp, P. troglodytes
acctgttgtttccaga

SEQ ID NO: 198441 - DNA, 16 bp, P. troglodytes
acctgttttatttatt

SEQ ID NO: 198442 - DNA, 16 bp, P. troglodytes
acctgtttttctcttt

SEQ ID NO: 198443 - DNA, 16 bp, P. troglodytes
accttaattttagccc

SEQ ID NO: 198444 - DNA, 16 bp, P. troglodytes
accttactacacataa

SEQ ID NO: 198445 - DNA, 16 bp, P. troglodytes
accttactccttcaag

SEQ ID NO: 198446 - DNA, 16 bp, P. troglodytes
accttcaaaatatatc

SEQ ID NO: 198447 - DNA, 16 bp, P. troglodytes
accttcaagccaagga

SEQ ID NO: 198448 - DNA, 16 bp, P. troglodytes
accttcacctcccgga

SEQ ID NO: 198449 - DNA, 16 bp, P. troglodytes
accttcacctcttggg

SEQ ID NO: 198450 - DNA, 16 bp, P. troglodytes
accttcagcttctcca

SEQ ID NO: 198451 - DNA, 16 bp, P. troglodytes
accttcatgacctaat

SEQ ID NO: 198452 - DNA, 16 bp, P. troglodytes
accttcatgagaacca

SEQ ID NO: 198453 - DNA, 16 bp, P. troglodytes
accttcattttacaga

SEQ ID NO: 198454 - DNA, 16 bp, P. troglodytes
accttccaaaggcccc

SEQ ID NO: 198455 - DNA, 16 bp, P. troglodytes
accttccaccagcaaa

SEQ ID NO: 198456 - DNA, 16 bp, P. troglodytes
accttccacctcccag

SEQ ID NO: 198457 - DNA, 16 bp, P. troglodytes
accttcccaccaacag

SEQ ID NO: 198458 - DNA, 16 bp, P. troglodytes
accttcccaccagcaa

SEQ ID NO: 198459 - DNA, 16 bp, P. troglodytes
accttcctgctgtgtc

SEQ ID NO: 198460 - DNA, 16 bp, P. troglodytes
accttcctgtgcctca

SEQ ID NO: 198461 - DNA, 16 bp, P. troglodytes
accttcgcctccctgg

SEQ ID NO: 198462 - DNA, 16 bp, P. troglodytes
accttcgcctcctgag

SEQ ID NO: 198463 - DNA, 16 bp, P. troglodytes
accttctccttattat

SEQ ID NO: 198464 - DNA, 16 bp, P. troglodytes
accttctgagtagctg

SEQ ID NO: 198465 - DNA, 16 bp, P. troglodytes
accttctgcacagcaa

SEQ ID NO: 198466 - DNA, 16 bp, P. troglodytes
accttctgcctcccag

SEQ ID NO: 198467 - DNA, 16 bp, P. troglodytes
accttctggactcaag

SEQ ID NO: 198468 - DNA, 16 bp, P. troglodytes
accttctgggctcaag

SEQ ID NO: 198469 - DNA, 16 bp, P. troglodytes
accttctgggctgaag

SEQ ID NO: 198470 - DNA, 16 bp, P. troglodytes
accttcttcacaagat

SEQ ID NO: 198471 - DNA, 16 bp, P. troglodytes
accttcttggttaaat

SEQ ID NO: 198472 - DNA, 16 bp, P. troglodytes
accttgaaaaaaatta

SEQ ID NO: 198473 - DNA, 16 bp, P. troglodytes
accttgaaaacatcat

SEQ ID NO: 198474 - DNA, 16 bp, P. troglodytes
accttgaaaacatttt

SEQ ID NO: 198475 - DNA, 16 bp, P. troglodytes
accttgaactcctagg

SEQ ID NO: 198476 - DNA, 16 bp, P. troglodytes
accttgactaatacag

SEQ ID NO: 198477 - DNA, 16 bp, P. troglodytes
accttgagcaagttac

SEQ ID NO: 198478 - DNA, 16 bp, P. troglodytes
accttgagctcctggg

SEQ ID NO: 198479 - DNA, 16 bp, P. troglodytes
accttgatattggact

SEQ ID NO: 198480 - DNA, 16 bp, P. troglodytes
accttgctgaagttgc

SEQ ID NO: 198481 - DNA, 17 bp, P. troglodytes
accttggcctcccaaaa

SEQ ID NO: 198482 - DNA, 20 bp, P. troglodytes
accttggcctcccaaaatgc

SEQ ID NO: 198483 - DNA, 16 bp, P. troglodytes
accttggccttccaaa

SEQ ID NO: 198484 - DNA, 16 bp, P. troglodytes
accttgggcaagctgc

SEQ ID NO: 198485 - DNA, 16 bp, P. troglodytes
accttggtcatttttt

SEQ ID NO: 198486 - DNA, 16 bp, P. troglodytes
accttggtttccacaa

SEQ ID NO: 198487 - DNA, 16 bp, P. troglodytes
accttgtctcaaaaat

SEQ ID NO: 198488 - DNA, 16 bp, P. troglodytes
accttgtctcaagaaa

SEQ ID NO: 198489 - DNA, 16 bp, P. troglodytes
accttgtctcaataaa

SEQ ID NO: 198490 - DNA, 16 bp, P. troglodytes
accttgtctctacaaa

SEQ ID NO: 198491 - DNA, 17 bp, P. troglodytes
accttgtctctactaaa

SEQ ID NO: 198492 - DNA, 16 bp, P. troglodytes
accttgtcttctcact

SEQ ID NO: 198493 - DNA, 16 bp, P. troglodytes
acctttaaaaaagaaa

SEQ ID NO: 198494 - DNA, 16 bp, P. troglodytes
acctttacacaaataa

SEQ ID NO: 198495 - DNA, 16 bp, P. troglodytes
acctttcaaaaaatca

SEQ ID NO: 198496 - DNA, 16 bp, P. troglodytes
acctttccaatttgct

SEQ ID NO: 198497 - DNA, 16 bp, P. troglodytes
acctttccagactgaa

SEQ ID NO: 198498 - DNA, 16 bp, P. troglodytes
acctttcttttgatta

SEQ ID NO: 198499 - DNA, 16 bp, P. troglodytes
acctttcttttgattt

SEQ ID NO: 198500 - DNA, 16 bp, P. troglodytes
acctttcttttgtaaa

SEQ ID NO: 198501 - DNA, 16 bp, P. troglodytes
acctttgaaaactggc

SEQ ID NO: 198502 - DNA, 16 bp, P. troglodytes
acctttgcacttgctg

SEQ ID NO: 198503 - DNA, 16 bp, P. troglodytes
acctttgcctcccagg

SEQ ID NO: 198504 - DNA, 16 bp, P. troglodytes
acctttgcctcctgag

SEQ ID NO: 198505 - DNA, 16 bp, P. troglodytes
acctttgcctctcggg

SEQ ID NO: 198506 - DNA, 16 bp, P. troglodytes
acctttgttaaaaatg

SEQ ID NO: 198507 - DNA, 16 bp, P. troglodytes
accttttaatactgtt

SEQ ID NO: 198508 - DNA, 16 bp, P. troglodytes
accttttcttaatcca

SEQ ID NO: 198509 - DNA, 16 bp, P. troglodytes
accttttggctatttt

SEQ ID NO: 198510 - DNA, 16 bp, P. troglodytes
acctttttaaaaaatt

SEQ ID NO: 198511 - DNA, 16 bp, P. troglodytes
acgaagatggggagaa

SEQ ID NO: 198512 - DNA, 18 bp, P. troglodytes
acgacacccagctaattt

SEQ ID NO: 198513 - DNA, 16 bp, P. troglodytes
acgacctgctgaggtg

SEQ ID NO: 198514 - DNA, 19 bp, P. troglodytes
acgacgcctggctaatttt

SEQ ID NO: 198515 - DNA, 16 bp, P. troglodytes
acgaggacaggagttc

SEQ ID NO: 198516 - DNA, 17 bp, P. troglodytes
acgaggtgggtggatca

SEQ ID NO: 198517 - DNA, 16 bp, P. troglodytes
acgaggtttcaccata

SEQ ID NO: 198518 - DNA, 16 bp, P. troglodytes
acgagttcaagatcag

SEQ ID NO: 198519 - DNA, 22 bp, P. troglodytes
acgatctcggctcactgcaact

SEQ ID NO: 198520 - DNA, 19 bp, P. troglodytes
acgatcttggctcaccaca

SEQ ID NO: 198521 - DNA, 16 bp, P. troglodytes
acgatttataatcctt

SEQ ID NO: 198522 - DNA, 16 bp, P. troglodytes
acgcacacacagacac

SEQ ID NO: 198523 - DNA, 16 bp, P. troglodytes
acgcacacatacacat

SEQ ID NO: 198524 - DNA, 16 bp, P. troglodytes
acgcactttttttttt

SEQ ID NO: 198525 - DNA, 16 bp, P. troglodytes
acgccaaggtgggcag

SEQ ID NO: 198526 - DNA, 19 bp, P. troglodytes
acgccaccacacctggcta

SEQ ID NO: 198527 - DNA, 16 bp, P. troglodytes
acgccaccaggcccag

SEQ ID NO: 198528 - DNA, 17 bp, P. troglodytes
acgccaccgcactccag

SEQ ID NO: 198529 - DNA, 16 bp, P. troglodytes
acgccattctcttgcc

SEQ ID NO: 198530 - DNA, 16 bp, P. troglodytes
acgccattgcagtcca

SEQ ID NO: 198531 - DNA, 16 bp, P. troglodytes
acgcccagataatttt

SEQ ID NO: 198532 - DNA, 16 bp, P. troglodytes
acgccgggctaatttt

SEQ ID NO: 198533 - DNA, 16 bp, P. troglodytes
acgcctagctaatttt

SEQ ID NO: 198534 - DNA, 16 bp, P. troglodytes
acgcctggccattttt

SEQ ID NO: 198535 - DNA, 16 bp, P. troglodytes
acgcctggctagtttt

SEQ ID NO: 198536 - DNA, 16 bp, P. troglodytes
acgcctggctattttt

SEQ ID NO: 198537 - DNA, 16 bp, P. troglodytes
acgcctgtactcccag

SEQ ID NO: 198538 - DNA, 16 bp, P. troglodytes
acgcgcacacacacac

SEQ ID NO: 198539 - DNA, 17 bp, P. troglodytes
acgcgcctatagtccca

SEQ ID NO: 198540 - DNA, 16 bp, P. troglodytes
acgcgcgcacacacac

SEQ ID NO: 198541 - DNA, 16 bp, P. troglodytes
acgcgcgcgcacacac

SEQ ID NO: 198542 - DNA, 18 bp, P. troglodytes
acgcggtggctcacacct

SEQ ID NO: 198543 - DNA, 18 bp, P. troglodytes
acgcggtggctcacgcct

SEQ ID NO: 198544 - DNA, 16 bp, P. troglodytes
acgctccagcctgggc

SEQ ID NO: 198545 - DNA, 16 bp, P. troglodytes
acgctggctcatgcct

SEQ ID NO: 198546 - DNA, 16 bp, P. troglodytes
acgctgtctcagaaaa

SEQ ID NO: 198547 - DNA, 16 bp, P. troglodytes
acggagtcccgctctg

SEQ ID NO: 198548 - DNA, 16 bp, P. troglodytes
acggagtctggctctt

SEQ ID NO: 198549 - DNA, 16 bp, P. troglodytes
acggagtttctccatg

SEQ ID NO: 198550 - DNA, 16 bp, P. troglodytes
acggatggcacctgga

SEQ ID NO: 198551 - DNA, 17 bp, P. troglodytes
acggcaaaactccatct

SEQ ID NO: 198552 - DNA, 16 bp, P. troglodytes
acggcaagctctgcct

SEQ ID NO: 198553 - DNA, 16 bp, P. troglodytes
acggcagaaggcaagg

SEQ ID NO: 198554 - DNA, 16 bp, P. troglodytes
acggccacacccaagg

SEQ ID NO: 198555 - DNA, 17 bp, P. troglodytes
acggggtggctgggcag

SEQ ID NO: 198556 - DNA, 16 bp, P. troglodytes
acggggtgtgtgtgtg

SEQ ID NO: 198557 - DNA, 16 bp, P. troglodytes
acggggtttctccata

SEQ ID NO: 198558 - DNA, 16 bp, P. troglodytes
acggggttttaccgtg

SEQ ID NO: 198559 - DNA, 16 bp, P. troglodytes
acgggttttcactatg

SEQ ID NO: 198560 - DNA, 26 bp, P. troglodytes
acggtgaaaccccgtctctactaaac

SEQ ID NO: 198561 - DNA, 23 bp, P. troglodytes
acggtgaaaccctgtctctactg

SEQ ID NO: 198562 - DNA, 16 bp, P. troglodytes
acggtgcaccaggaga

SEQ ID NO: 198563 - DNA, 16 bp, P. troglodytes
acggtggcatgatctc

SEQ ID NO: 198564 - DNA, 17 bp, P. troglodytes
acggtggctcacaccta

SEQ ID NO: 198565 - DNA, 16 bp, P. troglodytes
acggtttcaccatgtt

SEQ ID NO: 198566 - DNA, 16 bp, P. troglodytes
acgtacctgtggtccc

SEQ ID NO: 198567 - DNA, 16 bp, P. troglodytes
acgtagtactggaagt

SEQ ID NO: 198568 - DNA, 16 bp, P. troglodytes
acgtatatatgtgtgt

SEQ ID NO: 198569 - DNA, 16 bp, P. troglodytes
acgtccagctaatttt

SEQ ID NO: 198570 - DNA, 16 bp, P. troglodytes
acgtctgtaatctcag

SEQ ID NO: 198571 - DNA, 16 bp, P. troglodytes
acgtgaaataagccag

SEQ ID NO: 198572 - DNA, 16 bp, P. troglodytes
acgtgacaaatgcaca

SEQ ID NO: 198573 - DNA, 16 bp, P. troglodytes
acgtgatttgcaaata

SEQ ID NO: 198574 - DNA, 17 bp, P. troglodytes
acgtgcaggtttgttac

SEQ ID NO: 198575 - DNA, 16 bp, P. troglodytes
acgtgcagttcacaat

SEQ ID NO: 198576 - DNA, 16 bp, P. troglodytes
acgtgcctttcacctt

SEQ ID NO: 198577 - DNA, 16 bp, P. troglodytes
acgtgcgtgtgtgtgt

SEQ ID NO: 198578 - DNA, 16 bp, P. troglodytes
acgtggcaaaactcca

SEQ ID NO: 198579 - DNA, 16 bp, P. troglodytes
acgtggcccctgctgc

SEQ ID NO: 198580 - DNA, 16 bp, P. troglodytes
acgtggtggcgcatgc

SEQ ID NO: 198581 - DNA, 16 bp, P. troglodytes
acgtggtggtgggcac

SEQ ID NO: 198582 - DNA, 16 bp, P. troglodytes
acgtgtaatcccagca

SEQ ID NO: 198583 - DNA, 16 bp, P. troglodytes
acgtgtatacctgtgt

SEQ ID NO: 198584 - DNA, 16 bp, P. troglodytes
acgtgtatgttcattg

SEQ ID NO: 198585 - DNA, 16 bp, P. troglodytes
acgtgtgagccaccgc

SEQ ID NO: 198586 - DNA, 16 bp, P. troglodytes
acgtgtgcacacacac

SEQ ID NO: 198587 - DNA, 16 bp, P. troglodytes
acgtgtgtatatatgt

SEQ ID NO: 198588 - DNA, 20 bp, P. troglodytes
acgtttacctatgtaacaaa

SEQ ID NO: 198589 - DNA, 16 bp, P. troglodytes
acgtttgtatttttag

SEQ ID NO: 198590 - DNA, 16 bp, P. troglodytes
acgttttctttatcca

SEQ ID NO: 198591 - DNA, 16 bp, P. troglodytes
actaaaaataccattt

SEQ ID NO: 198592 - DNA, 16 bp, P. troglodytes
actaaaaattgagcta

SEQ ID NO: 198593 - DNA, 16 bp, P. troglodytes
actaaaatcagaaatg

SEQ ID NO: 198594 - DNA, 16 bp, P. troglodytes
actaaacacaatgaaa

SEQ ID NO: 198595 - DNA, 16 bp, P. troglodytes
actaaacatcagagaa

SEQ ID NO: 198596 - DNA, 16 bp, P. troglodytes
actaaacccaaaatta

SEQ ID NO: 198597 - DNA, 16 bp, P. troglodytes
actaaagcccagagag

SEQ ID NO: 198598 - DNA, 16 bp, P. troglodytes
actaaagctgaacata

SEQ ID NO: 198599 - DNA, 16 bp, P. troglodytes
actaaaggagatagag

SEQ ID NO: 198600 - DNA, 16 bp, P. troglodytes
actaaatttgtggtaa

SEQ ID NO: 198601 - DNA, 17 bp, P. troglodytes
actaacacaggagcaga

SEQ ID NO: 198602 - DNA, 19 bp, P. troglodytes
actaacacggtgaaacccc

SEQ ID NO: 198603 - DNA, 16 bp, P. troglodytes
actaacaggagaatgc

SEQ ID NO: 198604 - DNA, 20 bp, P. troglodytes
actaacatggtgaaacccca

SEQ ID NO: 198605 - DNA, 16 bp, P. troglodytes
actaactatcatgaga

SEQ ID NO: 198606 - DNA, 16 bp, P. troglodytes
actaagaaaccaacat

SEQ ID NO: 198607 - DNA, 16 bp, P. troglodytes
actaagatcaggaaca

SEQ ID NO: 198608 - DNA, 17 bp, P. troglodytes
actaagctctgattttt

SEQ ID NO: 198609 - DNA, 16 bp, P. troglodytes
actaaggaaatgcaaa

SEQ ID NO: 198610 - DNA, 16 bp, P. troglodytes
actaaggaagctgagg

SEQ ID NO: 198611 - DNA, 16 bp, P. troglodytes
actaaggagactgagg

SEQ ID NO: 198612 - DNA, 16 bp, P. troglodytes
actaaggctcagagag

SEQ ID NO: 198613 - DNA, 16 bp, P. troglodytes
actaagtctcactctg

SEQ ID NO: 198614 - DNA, 16 bp, P. troglodytes
actaataaaggagaaa

SEQ ID NO: 198615 - DNA, 17 bp, P. troglodytes
actaatacagtaaactg

SEQ ID NO: 198616 - DNA, 16 bp, P. troglodytes
actaatagtaataata

SEQ ID NO: 198617 - DNA, 16 bp, P. troglodytes
actaatcataagagaa

SEQ ID NO: 198618 - DNA, 16 bp, P. troglodytes
actaatcatcaagaaa

SEQ ID NO: 198619 - DNA, 16 bp, P. troglodytes
actaatcatcagaaaa

SEQ ID NO: 198620 - DNA, 16 bp, P. troglodytes
actaatcatcagagaa

SEQ ID NO: 198621 - DNA, 16 bp, P. troglodytes
actaatgaagaaaaga

SEQ ID NO: 198622 - DNA, 16 bp, P. troglodytes
actaatgaggaaactg

SEQ ID NO: 198623 - DNA, 16 bp, P. troglodytes
actaatgcaggaacag

SEQ ID NO: 198624 - DNA, 16 bp, P. troglodytes
actaatgggcaaaaca

SEQ ID NO: 198625 - DNA, 16 bp, P. troglodytes
actaattatcaggaaa

SEQ ID NO: 198626 - DNA, 16 bp, P. troglodytes
actaatttttgtattc

SEQ ID NO: 198627 - DNA, 16 bp, P. troglodytes
actacaaaaaattagc

SEQ ID NO: 198628 - DNA, 16 bp, P. troglodytes
actacaaaacattaat

SEQ ID NO: 198629 - DNA, 16 bp, P. troglodytes
actacaaagcctgcct

SEQ ID NO: 198630 - DNA, 19 bp, P. troglodytes
actacaacctccgcctcct

SEQ ID NO: 198631 - DNA, 16 bp, P. troglodytes
actacaagcagccaga

SEQ ID NO: 198632 - DNA, 16 bp, P. troglodytes
actacaagcgcacacc

SEQ ID NO: 198633 - DNA, 16 bp, P. troglodytes
actacaaggctatagt

SEQ ID NO: 198634 - DNA, 16 bp, P. troglodytes
actacacacttttaaa

SEQ ID NO: 198635 - DNA, 16 bp, P. troglodytes
actacacccggctaat

SEQ ID NO: 198636 - DNA, 16 bp, P. troglodytes
actacacctggccaaa

SEQ ID NO: 198637 - DNA, 16 bp, P. troglodytes
actacagatcaatatc

SEQ ID NO: 198638 - DNA, 16 bp, P. troglodytes
actacagcctcaacct

SEQ ID NO: 198639 - DNA, 16 bp, P. troglodytes
actacagcctcagcct

SEQ ID NO: 198640 - DNA, 16 bp, P. troglodytes
actacagcctgggcga

SEQ ID NO: 198641 - DNA, 16 bp, P. troglodytes
actacagccttaacct

SEQ ID NO: 198642 - DNA, 16 bp, P. troglodytes
actacagccttgacct

SEQ ID NO: 198643 - DNA, 16 bp, P. troglodytes
actacagctgtgagcc

SEQ ID NO: 198644 - DNA, 16 bp, P. troglodytes
actacaggcacgtgcc

SEQ ID NO: 198645 - DNA, 16 bp, P. troglodytes
actacaggcatgaacc

SEQ ID NO: 198646 - DNA, 21 bp, P. troglodytes
actacaggcatgcaccaccat

SEQ ID NO: 198647 - DNA, 17 bp, P. troglodytes
actacaggcgcgtgcca

SEQ ID NO: 198648 - DNA, 16 bp, P. troglodytes
actacaggtgcatact

SEQ ID NO: 198649 - DNA, 21 bp, P. troglodytes
actacaggtgtgcaccaccac

SEQ ID NO: 198650 - DNA, 16 bp, P. troglodytes
actacagtggtgtgat

SEQ ID NO: 198651 - DNA, 16 bp, P. troglodytes
actacagttaatttta

SEQ ID NO: 198652 - DNA, 16 bp, P. troglodytes
actacatcaactaatg

SEQ ID NO: 198653 - DNA, 16 bp, P. troglodytes
actacatgacattctg

SEQ ID NO: 198654 - DNA, 16 bp, P. troglodytes
actacatgtaaactga

SEQ ID NO: 198655 - DNA, 16 bp, P. troglodytes
actaccacacccagct

SEQ ID NO: 198656 - DNA, 18 bp, P. troglodytes
actaccacgcccggctaa

SEQ ID NO: 198657 - DNA, 16 bp, P. troglodytes
actaccatctgaccca

SEQ ID NO: 198658 - DNA, 16 bp, P. troglodytes
actaccatgcccagct

SEQ ID NO: 198659 - DNA, 16 bp, P. troglodytes
actaccatgcccagtt

SEQ ID NO: 198660 - DNA, 16 bp, P. troglodytes
actaccattgatattc

SEQ ID NO: 198661 - DNA, 16 bp, P. troglodytes
actaccccttccctag

SEQ ID NO: 198662 - DNA, 17 bp, P. troglodytes
actacctggaaactgaa

SEQ ID NO: 198663 - DNA, 16 bp, P. troglodytes
actacctgtgtgacct

SEQ ID NO: 198664 - DNA, 16 bp, P. troglodytes
actactacacacctat

SEQ ID NO: 198665 - DNA, 16 bp, P. troglodytes
actactactactactg

SEQ ID NO: 198666 - DNA, 16 bp, P. troglodytes
actactataagaaaac

SEQ ID NO: 198667 - DNA, 16 bp, P. troglodytes
actactatgaacacct

SEQ ID NO: 198668 - DNA, 16 bp, P. troglodytes
actactcagcaagaaa

SEQ ID NO: 198669 - DNA, 16 bp, P. troglodytes
actactgaaagaaaac

SEQ ID NO: 198670 - DNA, 16 bp, P. troglodytes
actactgaaataaaat

SEQ ID NO: 198671 - DNA, 16 bp, P. troglodytes
actactgcactcctgc

SEQ ID NO: 198672 - DNA, 16 bp, P. troglodytes
actactgcagctgatg

SEQ ID NO: 198673 - DNA, 16 bp, P. troglodytes
actactgctgctgctg

SEQ ID NO: 198674 - DNA, 16 bp, P. troglodytes
actactggtgtgtgcc

SEQ ID NO: 198675 - DNA, 16 bp, P. troglodytes
actactgttattcaac

SEQ ID NO: 198676 - DNA, 17 bp, P. troglodytes
actactttaaagttcac

SEQ ID NO: 198677 - DNA, 19 bp, P. troglodytes
actactttaaagttcatac

SEQ ID NO: 198678 - DNA, 16 bp, P. troglodytes
actactttgaaaaaca

SEQ ID NO: 198679 - DNA, 16 bp, P. troglodytes
actagaaaacctagaa

SEQ ID NO: 198680 - DNA, 16 bp, P. troglodytes
actagaaaatttaaaa

SEQ ID NO: 198681 - DNA, 16 bp, P. troglodytes
actagaaataaataac

SEQ ID NO: 198682 - DNA, 16 bp, P. troglodytes
actagaacttattcct

SEQ ID NO: 198683 - DNA, 16 bp, P. troglodytes
actagaatatttaaaa

SEQ ID NO: 198684 - DNA, 16 bp, P. troglodytes
actagaatctctggga

SEQ ID NO: 198685 - DNA, 16 bp, P. troglodytes
actagaatgactaaaa

SEQ ID NO: 198686 - DNA, 16 bp, P. troglodytes
actagaccaagcagaa

SEQ ID NO: 198687 - DNA, 16 bp, P. troglodytes
actagagacagggttt

SEQ ID NO: 198688 - DNA, 16 bp, P. troglodytes
actagattaactagat

SEQ ID NO: 198689 - DNA, 16 bp, P. troglodytes
actagattgcctttgt

SEQ ID NO: 198690 - DNA, 16 bp, P. troglodytes
actagcaaagacatgg

SEQ ID NO: 198691 - DNA, 18 bp, P. troglodytes
actagccaggtgtggtgg

SEQ ID NO: 198692 - DNA, 16 bp, P. troglodytes
actagctgggtgcggt

SEQ ID NO: 198693 - DNA, 16 bp, P. troglodytes
actaggtaatttttaa

SEQ ID NO: 198694 - DNA, 16 bp, P. troglodytes
actaggtcttattcat

SEQ ID NO: 198695 - DNA, 16 bp, P. troglodytes
actagtaaaaatacaa

SEQ ID NO: 198696 - DNA, 16 bp, P. troglodytes
actagtaaatggcaga

SEQ ID NO: 198697 - DNA, 16 bp, P. troglodytes
actataaaaagagaca

SEQ ID NO: 198698 - DNA, 16 bp, P. troglodytes
actataagtttcctga

SEQ ID NO: 198699 - DNA, 16 bp, P. troglodytes
actatacacacataca

SEQ ID NO: 198700 - DNA, 16 bp, P. troglodytes
actatacattgtatgt

SEQ ID NO: 198701 - DNA, 16 bp, P. troglodytes
actataccactgcact

SEQ ID NO: 198702 - DNA, 16 bp, P. troglodytes
actatagttagtaaca

SEQ ID NO: 198703 - DNA, 16 bp, P. troglodytes
actatagttagtaata

SEQ ID NO: 198704 - DNA, 16 bp, P. troglodytes
actatataatgataaa

SEQ ID NO: 198705 - DNA, 16 bp, P. troglodytes
actatatagcctaggt

SEQ ID NO: 198706 - DNA, 16 bp, P. troglodytes
actatatatatataca

SEQ ID NO: 198707 - DNA, 16 bp, P. troglodytes
actatatgccagacat

SEQ ID NO: 198708 - DNA, 16 bp, P. troglodytes
actatcacacctggct

SEQ ID NO: 198709 - DNA, 16 bp, P. troglodytes
actatcacgggaacag

SEQ ID NO: 198710 - DNA, 16 bp, P. troglodytes
actatcccaagaacag

SEQ ID NO: 198711 - DNA, 16 bp, P. troglodytes
actatccccattttac

SEQ ID NO: 198712 - DNA, 16 bp, P. troglodytes
actatcctttctccac

SEQ ID NO: 198713 - DNA, 16 bp, P. troglodytes
actatcttttaaaatt

SEQ ID NO: 198714 - DNA, 16 bp, P. troglodytes
actatgaagaaactac

SEQ ID NO: 198715 - DNA, 16 bp, P. troglodytes
actatgaagaaactgc

SEQ ID NO: 198716 - DNA, 17 bp, P. troglodytes
actatgcagccacagaa

SEQ ID NO: 198717 - DNA, 16 bp, P. troglodytes
actatgcctctgacaa

SEQ ID NO: 198718 - DNA, 16 bp, P. troglodytes
actatggaaaactgtg

SEQ ID NO: 198719 - DNA, 16 bp, P. troglodytes
actatggaggattcac

SEQ ID NO: 198720 - DNA, 16 bp, P. troglodytes
actatggaggctgaga

SEQ ID NO: 198721 - DNA, 16 bp, P. troglodytes
actatgggaacctacc

SEQ ID NO: 198722 - DNA, 16 bp, P. troglodytes
actatgtcaaaaaaaa

SEQ ID NO: 198723 - DNA, 18 bp, P. troglodytes
actatgtgaaaagaccac

SEQ ID NO: 198724 - DNA, 16 bp, P. troglodytes
actatgtgccagacac

SEQ ID NO: 198725 - DNA, 16 bp, P. troglodytes
actatgttgcccagtt

SEQ ID NO: 198726 - DNA, 19 bp, P. troglodytes
actatgttgctcaggctgg

SEQ ID NO: 198727 - DNA, 16 bp, P. troglodytes
actattaaaaagtcag

SEQ ID NO: 198728 - DNA, 16 bp, P. troglodytes
actattaataaaaatg

SEQ ID NO: 198729 - DNA, 16 bp, P. troglodytes
actattacaatggcaa

SEQ ID NO: 198730 - DNA, 16 bp, P. troglodytes
actattactattacta

SEQ ID NO: 198731 - DNA, 18 bp, P. troglodytes
actattaggttggtgcaa

SEQ ID NO: 198732 - DNA, 16 bp, P. troglodytes
actattctgtgtgata

SEQ ID NO: 198733 - DNA, 16 bp, P. troglodytes
actattctttctccat

SEQ ID NO: 198734 - DNA, 16 bp, P. troglodytes
actattgaagaaacag

SEQ ID NO: 198735 - DNA, 16 bp, P. troglodytes
actattgcaaggacag

SEQ ID NO: 198736 - DNA, 16 bp, P. troglodytes
actattgctttgtagt

SEQ ID NO: 198737 - DNA, 16 bp, P. troglodytes
actattgtgaatagtg

SEQ ID NO: 198738 - DNA, 16 bp, P. troglodytes
actatttggggtcttt

SEQ ID NO: 198739 - DNA, 16 bp, P. troglodytes
actattttaaaatgtt

SEQ ID NO: 198740 - DNA, 16 bp, P. troglodytes
actattttggagcttt

SEQ ID NO: 198741 - DNA, 16 bp, P. troglodytes
actcaaaaatgtggaa

SEQ ID NO: 198742 - DNA, 16 bp, P. troglodytes
actcaaaagaatgcaa

SEQ ID NO: 198743 - DNA, 16 bp, P. troglodytes
actcaaagaccccatc

SEQ ID NO: 198744 - DNA, 16 bp, P. troglodytes
actcaaaggaaaagaa

SEQ ID NO: 198745 - DNA, 16 bp, P. troglodytes
actcaaatatttattg

SEQ ID NO: 198746 - DNA, 16 bp, P. troglodytes
actcaacaaagaaaca

SEQ ID NO: 198747 - DNA, 16 bp, P. troglodytes
actcaagaaatatttg

SEQ ID NO: 198748 - DNA, 16 bp, P. troglodytes
actcaagaagaaataa

SEQ ID NO: 198749 - DNA, 16 bp, P. troglodytes
actcaagaggctgacg

SEQ ID NO: 198750 - DNA, 16 bp, P. troglodytes
actcaagccatccttc

SEQ ID NO: 198751 - DNA, 16 bp, P. troglodytes
actcaaggcctgctgt

SEQ ID NO: 198752 - DNA, 16 bp, P. troglodytes
actcaagtcctgcagt

SEQ ID NO: 198753 - DNA, 16 bp, P. troglodytes
actcaagtgatccacc

SEQ ID NO: 198754 - DNA, 16 bp, P. troglodytes
actcaagtgatctgcc

SEQ ID NO: 198755 - DNA, 16 bp, P. troglodytes
actcaataataaaaga

SEQ ID NO: 198756 - DNA, 16 bp, P. troglodytes
actcaatggtgaaaag

SEQ ID NO: 198757 - DNA, 16 bp, P. troglodytes
actcacaatagccaaa

SEQ ID NO: 198758 - DNA, 16 bp, P. troglodytes
actcacagaagcagag

SEQ ID NO: 198759 - DNA, 16 bp, P. troglodytes
actcacagagacagaa

SEQ ID NO: 198760 - DNA, 16 bp, P. troglodytes
actcacagcaacctct

SEQ ID NO: 198761 - DNA, 16 bp, P. troglodytes
actcacagctctgcag

SEQ ID NO: 198762 - DNA, 16 bp, P. troglodytes
actcacagttccacaa

SEQ ID NO: 198763 - DNA, 16 bp, P. troglodytes
actcacagttcctcat

SEQ ID NO: 198764 - DNA, 16 bp, P. troglodytes
actcaccgtgagggtc

SEQ ID NO: 198765 - DNA, 16 bp, P. troglodytes
actcacctcctactgt

SEQ ID NO: 198766 - DNA, 20 bp, P. troglodytes
actcacgcctgtaatcccaa

SEQ ID NO: 198767 - DNA, 21 bp, P. troglodytes
actcacgcctgtaatcccaga

SEQ ID NO: 198768 - DNA, 16 bp, P. troglodytes
actcacgcctgtcatc

SEQ ID NO: 198769 - DNA, 16 bp, P. troglodytes
actcacgtgtttgtgg

SEQ ID NO: 198770 - DNA, 16 bp, P. troglodytes
actcactacaacctcc

SEQ ID NO: 198771 - DNA, 16 bp, P. troglodytes
actcactcaaaactgc

SEQ ID NO: 198772 - DNA, 17 bp, P. troglodytes
actcactctgttgccca

SEQ ID NO: 198773 - DNA, 16 bp, P. troglodytes
actcactgcaacatcc

SEQ ID NO: 198774 - DNA, 16 bp, P. troglodytes
actcactgcaaccccc

SEQ ID NO: 198775 - DNA, 16 bp, P. troglodytes
actcactgcaacctcc

SEQ ID NO: 198776 - DNA, 16 bp, P. troglodytes
actcactgcaacctct

SEQ ID NO: 198777 - DNA, 16 bp, P. troglodytes
actcactgcagccctg

SEQ ID NO: 198778 - DNA, 16 bp, P. troglodytes
actcactgcagcctca

SEQ ID NO: 198779 - DNA, 16 bp, P. troglodytes
actcactgcagcctcg

SEQ ID NO: 198780 - DNA, 16 bp, P. troglodytes
actcactgtaacctcc

SEQ ID NO: 198781 - DNA, 16 bp, P. troglodytes
actcactgtgtcaccc

SEQ ID NO: 198782 - DNA, 16 bp, P. troglodytes
actcagaagctgaggc

SEQ ID NO: 198783 - DNA, 16 bp, P. troglodytes
actcagaaggtggagg

SEQ ID NO: 198784 - DNA, 16 bp, P. troglodytes
actcagaatggattaa

SEQ ID NO: 198785 - DNA, 16 bp, P. troglodytes
actcagagaagttaaa

SEQ ID NO: 198786 - DNA, 16 bp, P. troglodytes
actcagagaggctgag

SEQ ID NO: 198787 - DNA, 16 bp, P. troglodytes
actcagcctccagcaa

SEQ ID NO: 198788 - DNA, 16 bp, P. troglodytes
actcagcctctcaaag

SEQ ID NO: 198789 - DNA, 16 bp, P. troglodytes
actcagctcactgcaa

SEQ ID NO: 198790 - DNA, 16 bp, P. troglodytes
actcagctctgcaaca

SEQ ID NO: 198791 - DNA, 16 bp, P. troglodytes
actcagctgtggacca

SEQ ID NO: 198792 - DNA, 16 bp, P. troglodytes
actcaggaagcagagg

SEQ ID NO: 198793 - DNA, 16 bp, P. troglodytes
actcaggaagctgagc

SEQ ID NO: 198794 - DNA, 17 bp, P. troglodytes
actcaggaatggaaaat

SEQ ID NO: 198795 - DNA, 16 bp, P. troglodytes
actcaggagactaagg

SEQ ID NO: 198796 - DNA, 19 bp, P. troglodytes
actcaggagcccagctggc

SEQ ID NO: 198797 - DNA, 16 bp, P. troglodytes
actcaggaggaggctg

SEQ ID NO: 198798 - DNA, 16 bp, P. troglodytes
actcaggaggatgaag

SEQ ID NO: 198799 - DNA, 16 bp, P. troglodytes
actcaggaggcggaag

SEQ ID NO: 198800 - DNA, 16 bp, P. troglodytes
actcaggaggctgaga

SEQ ID NO: 198801 - DNA, 16 bp, P. troglodytes
actcaggaggctgagc

SEQ ID NO: 198802 - DNA, 17 bp, P. troglodytes
actcaggaggctgatgc

SEQ ID NO: 198803 - DNA, 16 bp, P. troglodytes
actcaggaggctggag

SEQ ID NO: 198804 - DNA, 16 bp, P. troglodytes
actcaggaggtgaggc

SEQ ID NO: 198805 - DNA, 16 bp, P. troglodytes
actcaggagtcagagg

SEQ ID NO: 198806 - DNA, 16 bp, P. troglodytes
actcaggctgaggcag

SEQ ID NO: 198807 - DNA, 16 bp, P. troglodytes
actcaggctggtctca

SEQ ID NO: 198808 - DNA, 24 bp, P. troglodytes
actcagggttaaatggattaaggg

SEQ ID NO: 198809 - DNA, 16 bp, P. troglodytes
actcagtaaacatttg

SEQ ID NO: 198810 - DNA, 16 bp, P. troglodytes
actcagtaaatggtag

SEQ ID NO: 198811 - DNA, 16 bp, P. troglodytes
actcagtattaaccat

SEQ ID NO: 198812 - DNA, 16 bp, P. troglodytes
actcagtctctcattt

SEQ ID NO: 198813 - DNA, 16 bp, P. troglodytes
actcagtggtggattc

SEQ ID NO: 198814 - DNA, 16 bp, P. troglodytes
actcagttacctccca

SEQ ID NO: 198815 - DNA, 16 bp, P. troglodytes
actcagttccaaagtc

SEQ ID NO: 198816 - DNA, 17 bp, P. troglodytes
actcatcagtgtgctgt

SEQ ID NO: 198817 - DNA, 16 bp, P. troglodytes
actcatctcagcctcc

SEQ ID NO: 198818 - DNA, 16 bp, P. troglodytes
actcatgactgtaatc

SEQ ID NO: 198819 - DNA, 16 bp, P. troglodytes
actcatgagggatctg

SEQ ID NO: 198820 - DNA, 16 bp, P. troglodytes
actcatgcacacacac

SEQ ID NO: 198821 - DNA, 16 bp, P. troglodytes
actcatgtaatcctca

SEQ ID NO: 198822 - DNA, 17 bp, P. troglodytes
actcatgtggtggattc

SEQ ID NO: 198823 - DNA, 16 bp, P. troglodytes
actcattaggatggct

SEQ ID NO: 198824 - DNA, 16 bp, P. troglodytes
actcattcattcattc

SEQ ID NO: 198825 - DNA, 16 bp, P. troglodytes
actcattcatttatgt

SEQ ID NO: 198826 - DNA, 16 bp, P. troglodytes
actcattccagcatca

SEQ ID NO: 198827 - DNA, 16 bp, P. troglodytes
actcattctcaaaaaa

SEQ ID NO: 198828 - DNA, 16 bp, P. troglodytes
actcatttaaagtata

SEQ ID NO: 198829 - DNA, 16 bp, P. troglodytes
actcatttttaaaata

SEQ ID NO: 198830 - DNA, 16 bp, P. troglodytes
actcatttttcacaaa

SEQ ID NO: 198831 - DNA, 16 bp, P. troglodytes
actccaaaagaaacct

SEQ ID NO: 198832 - DNA, 16 bp, P. troglodytes
actccaaagggaggag

SEQ ID NO: 198833 - DNA, 16 bp, P. troglodytes
actccaacatgggcaa

SEQ ID NO: 198834 - DNA, 16 bp, P. troglodytes
actccaacctaggtga

SEQ ID NO: 198835 - DNA, 17 bp, P. troglodytes
actccaacctgggcaat

SEQ ID NO: 198836 - DNA, 16 bp, P. troglodytes
actccaacgtgggcaa

SEQ ID NO: 198837 - DNA, 16 bp, P. troglodytes
actccaagtccttcag

SEQ ID NO: 198838 - DNA, 16 bp, P. troglodytes
actccaagttcttcag

SEQ ID NO: 198839 - DNA, 16 bp, P. troglodytes
actccacccagaactg

SEQ ID NO: 198840 - DNA, 16 bp, P. troglodytes
actccactgggagagg

SEQ ID NO: 198841 - DNA, 16 bp, P. troglodytes
actccagaactgtgag

SEQ ID NO: 198842 - DNA, 16 bp, P. troglodytes
actccagactgggaaa

SEQ ID NO: 198843 - DNA, 16 bp, P. troglodytes
actccagagcctgggc

SEQ ID NO: 198844 - DNA, 16 bp, P. troglodytes
actccagaggcagagg

SEQ ID NO: 198845 - DNA, 16 bp, P. troglodytes
actccagcagcccaga

SEQ ID NO: 198846 - DNA, 16 bp, P. troglodytes
actccagccagcctgg

SEQ ID NO: 198847 - DNA, 16 bp, P. troglodytes
actccagcccagcaac

SEQ ID NO: 198848 - DNA, 16 bp, P. troglodytes
actccagcctcggtga

SEQ ID NO: 198849 - DNA, 16 bp, P. troglodytes
actccagcctgagcca

SEQ ID NO: 198850 - DNA, 16 bp, P. troglodytes
actccagcctgcgcaa

SEQ ID NO: 198851 - DNA, 16 bp, P. troglodytes
actccagcctggagca

SEQ ID NO: 198852 - DNA, 16 bp, P. troglodytes
actccagcctggagga

SEQ ID NO: 198853 - DNA, 16 bp, P. troglodytes
actccagcctggatga

SEQ ID NO: 198854 - DNA, 16 bp, P. troglodytes
actccagcctggcaac

SEQ ID NO: 198855 - DNA, 18 bp, P. troglodytes
actccagcctggcgacaa

SEQ ID NO: 198856 - DNA, 16 bp, P. troglodytes
actccagcctgggctt

SEQ ID NO: 198857 - DNA, 16 bp, P. troglodytes
actccagcctgggtgg

SEQ ID NO: 198858 - DNA, 16 bp, P. troglodytes
actccagcctggtggc

SEQ ID NO: 198859 - DNA, 16 bp, P. troglodytes
actccagcctgtgcag

SEQ ID NO: 198860 - DNA, 16 bp, P. troglodytes
actccagctccagcct

SEQ ID NO: 198861 - DNA, 16 bp, P. troglodytes
actccagctctgggca

SEQ ID NO: 198862 - DNA, 16 bp, P. troglodytes
actccaggcctcaagc

SEQ ID NO: 198863 - DNA, 16 bp, P. troglodytes
actccaggggaaaacc

SEQ ID NO: 198864 - DNA, 16 bp, P. troglodytes
actccagtctgggtgt

SEQ ID NO: 198865 - DNA, 16 bp, P. troglodytes
actccataaatatttg

SEQ ID NO: 198866 - DNA, 16 bp, P. troglodytes
actccataaatgtttg

SEQ ID NO: 198867 - DNA, 16 bp, P. troglodytes
actccatcacccaggc

SEQ ID NO: 198868 - DNA, 16 bp, P. troglodytes
actccatccagcctga

SEQ ID NO: 198869 - DNA, 16 bp, P. troglodytes
actccatcccaaaaaa

SEQ ID NO: 198870 - DNA, 16 bp, P. troglodytes
actccatcctgggcca

SEQ ID NO: 198871 - DNA, 16 bp, P. troglodytes
actccatcctggggga

SEQ ID NO: 198872 - DNA, 16 bp, P. troglodytes
actccatctaaaaaaa

SEQ ID NO: 198873 - DNA, 16 bp, P. troglodytes
actccatctaaaataa

SEQ ID NO: 198874 - DNA, 16 bp, P. troglodytes
actccatctcaaaaaa

SEQ ID NO: 198875 - DNA, 16 bp, P. troglodytes
actccatctcaaaaag

SEQ ID NO: 198876 - DNA, 17 bp, P. troglodytes
actccatctcaaaagaa

SEQ ID NO: 198877 - DNA, 16 bp, P. troglodytes
actccatctcaaaata

SEQ ID NO: 198878 - DNA, 16 bp, P. troglodytes
actccatctcaggaaa

SEQ ID NO: 198879 - DNA, 16 bp, P. troglodytes
actccatctctccaaa

SEQ ID NO: 198880 - DNA, 16 bp, P. troglodytes
actccattctccatga

SEQ ID NO: 198881 - DNA, 16 bp, P. troglodytes
actccattgtctggat

SEQ ID NO: 198882 - DNA, 16 bp, P. troglodytes
actccatttaaaaaat

SEQ ID NO: 198883 - DNA, 16 bp, P. troglodytes
actccatttaaaaata

SEQ ID NO: 198884 - DNA, 16 bp, P. troglodytes
actccatttaccctga

SEQ ID NO: 198885 - DNA, 16 bp, P. troglodytes
actcccaagagtatat

SEQ ID NO: 198886 - DNA, 16 bp, P. troglodytes
actcccaaggtgatgg

SEQ ID NO: 198887 - DNA, 16 bp, P. troglodytes
actcccaagttcaagc

SEQ ID NO: 198888 - DNA, 17 bp, P. troglodytes
actcccaccaagagtgt

SEQ ID NO: 198889 - DNA, 16 bp, P. troglodytes
actcccactgacagtg

SEQ ID NO: 198890 - DNA, 16 bp, P. troglodytes
actcccaggctcaggc

SEQ ID NO: 198891 - DNA, 16 bp, P. troglodytes
actcccaggttcaagc

SEQ ID NO: 198892 - DNA, 16 bp, P. troglodytes
actcccatctctaaaa

SEQ ID NO: 198893 - DNA, 16 bp, P. troglodytes
actcccctcagcctcc

SEQ ID NO: 198894 - DNA, 16 bp, P. troglodytes
actcccctggaaagag

SEQ ID NO: 198895 - DNA, 16 bp, P. troglodytes
actccccttcccagcc

SEQ ID NO: 198896 - DNA, 16 bp, P. troglodytes
actccccttggcctcc

SEQ ID NO: 198897 - DNA, 16 bp, P. troglodytes
actcccctttcttgag

SEQ ID NO: 198898 - DNA, 19 bp, P. troglodytes
actcccgacctcaggtgac

SEQ ID NO: 198899 - DNA, 22 bp, P. troglodytes
actcccgacctcaggtgatccg

SEQ ID NO: 198900 - DNA, 16 bp, P. troglodytes
actcccggactcaagc

SEQ ID NO: 198901 - DNA, 16 bp, P. troglodytes
actccctcacccaggc

SEQ ID NO: 198902 - DNA, 16 bp, P. troglodytes
actccctctcaagaaa

SEQ ID NO: 198903 - DNA, 16 bp, P. troglodytes
actccctgacctcagg

SEQ ID NO: 198904 - DNA, 16 bp, P. troglodytes
actccctggttcaagc

SEQ ID NO: 198905 - DNA, 16 bp, P. troglodytes
actcccttggctgccc

SEQ ID NO: 198906 - DNA, 16 bp, P. troglodytes
actccggaggccgagg

SEQ ID NO: 198907 - DNA, 16 bp, P. troglodytes
actccggaggctgagt

SEQ ID NO: 198908 - DNA, 16 bp, P. troglodytes
actccgtcaaaaaaaa

SEQ ID NO: 198909 - DNA, 16 bp, P. troglodytes
actccgtctcaaaaaa

SEQ ID NO: 198910 - DNA, 16 bp, P. troglodytes
actccgtctcaaaaac

SEQ ID NO: 198911 - DNA, 16 bp, P. troglodytes
actccgtctcaaaaat

SEQ ID NO: 198912 - DNA, 16 bp, P. troglodytes
actccgtctcaaaata

SEQ ID NO: 198913 - DNA, 16 bp, P. troglodytes
actcctaagctcaggc

SEQ ID NO: 198914 - DNA, 16 bp, P. troglodytes
actcctacaagaatgg

SEQ ID NO: 198915 - DNA, 16 bp, P. troglodytes
actcctaggtatttac

SEQ ID NO: 198916 - DNA, 16 bp, P. troglodytes
actcctcagtaaatgc

SEQ ID NO: 198917 - DNA, 16 bp, P. troglodytes
actcctcctgggctca

SEQ ID NO: 198918 - DNA, 16 bp, P. troglodytes
actcctctccagcaag

SEQ ID NO: 198919 - DNA, 17 bp, P. troglodytes
actcctgaccgcaggtg

SEQ ID NO: 198920 - DNA, 16 bp, P. troglodytes
actcctgaccttaagc

SEQ ID NO: 198921 - DNA, 16 bp, P. troglodytes
actcctgacttcagat

SEQ ID NO: 198922 - DNA, 16 bp, P. troglodytes
actcctgagctcagac

SEQ ID NO: 198923 - DNA, 16 bp, P. troglodytes
actcctgagctcatgc

SEQ ID NO: 198924 - DNA, 16 bp, P. troglodytes
actcctgagctctggc

SEQ ID NO: 198925 - DNA, 18 bp, P. troglodytes
actcctgatctcaggtga

SEQ ID NO: 198926 - DNA, 16 bp, P. troglodytes
actcctgcagtcccag

SEQ ID NO: 198927 - DNA, 16 bp, P. troglodytes
actcctgcctggtgac

SEQ ID NO: 198928 - DNA, 16 bp, P. troglodytes
actcctgctctggcca

SEQ ID NO: 198929 - DNA, 16 bp, P. troglodytes
actcctgcttgttttt

SEQ ID NO: 198930 - DNA, 16 bp, P. troglodytes
actcctggactgaagt

SEQ ID NO: 198931 - DNA, 16 bp, P. troglodytes
actcctggccttgagc

SEQ ID NO: 198932 - DNA, 16 bp, P. troglodytes
actcctggctaatttt

SEQ ID NO: 198933 - DNA, 16 bp, P. troglodytes
actcctggcttcatgt

SEQ ID NO: 198934 - DNA, 16 bp, P. troglodytes
actcctgggctcaggg

SEQ ID NO: 198935 - DNA, 16 bp, P. troglodytes
actcctggtgaagata

SEQ ID NO: 198936 - DNA, 16 bp, P. troglodytes
actcctgtaaccccag

SEQ ID NO: 198937 - DNA, 16 bp, P. troglodytes
actcctgttctaaaac

SEQ ID NO: 198938 - DNA, 16 bp, P. troglodytes
actcctgtttttaaaa

SEQ ID NO: 198939 - DNA, 16 bp, P. troglodytes
actccttttaaattta

SEQ ID NO: 198940 - DNA, 16 bp, P. troglodytes
actcggactggctctc

SEQ ID NO: 198941 - DNA, 16 bp, P. troglodytes
actcgggaggctgagc

SEQ ID NO: 198942 - DNA, 17 bp, P. troglodytes
actcggtgtctgaggag

SEQ ID NO: 198943 - DNA, 16 bp, P. troglodytes
actctaagaaataaat

SEQ ID NO: 198944 - DNA, 16 bp, P. troglodytes
actctaccaaaaatac

SEQ ID NO: 198945 - DNA, 17 bp, P. troglodytes
actctactaaaaataca

SEQ ID NO: 198946 - DNA, 16 bp, P. troglodytes
actctactaaaaatat

SEQ ID NO: 198947 - DNA, 18 bp, P. troglodytes
actctactaaaactacaa

SEQ ID NO: 198948 - DNA, 16 bp, P. troglodytes
actctactgaaaatac

SEQ ID NO: 198949 - DNA, 16 bp, P. troglodytes
actctagcctggacag

SEQ ID NO: 198950 - DNA, 16 bp, P. troglodytes
actctatctcaggaaa

SEQ ID NO: 198951 - DNA, 16 bp, P. troglodytes
actctatctctaccaa

SEQ ID NO: 198952 - DNA, 16 bp, P. troglodytes
actctattaaaaatac

SEQ ID NO: 198953 - DNA, 16 bp, P. troglodytes
actctatttcccaggc

SEQ ID NO: 198954 - DNA, 16 bp, P. troglodytes
actctcaataaaccag

SEQ ID NO: 198955 - DNA, 16 bp, P. troglodytes
actctcagctacttgg

SEQ ID NO: 198956 - DNA, 16 bp, P. troglodytes
actctcatctcaaaaa

SEQ ID NO: 198957 - DNA, 16 bp, P. troglodytes
actctccaccccaagt

SEQ ID NO: 198958 - DNA, 16 bp, P. troglodytes
actctccaggacactg

SEQ ID NO: 198959 - DNA, 16 bp, P. troglodytes
actctcccaccctgaa

SEQ ID NO: 198960 - DNA, 16 bp, P. troglodytes
actctctcagactaca

SEQ ID NO: 198961 - DNA, 16 bp, P. troglodytes
actctctctctctgtc

SEQ ID NO: 198962 - DNA, 16 bp, P. troglodytes
actctctgaacctcag

SEQ ID NO: 198963 - DNA, 16 bp, P. troglodytes
actctctgcctcagcc

SEQ ID NO: 198964 - DNA, 16 bp, P. troglodytes
actctcttgcccttct

SEQ ID NO: 198965 - DNA, 16 bp, P. troglodytes
actctcttgctcctgc

SEQ ID NO: 198966 - DNA, 16 bp, P. troglodytes
actctgaaacaaaatt

SEQ ID NO: 198967 - DNA, 16 bp, P. troglodytes
actctgcaccaagcag

SEQ ID NO: 198968 - DNA, 16 bp, P. troglodytes
actctgcaccccaaat

SEQ ID NO: 198969 - DNA, 16 bp, P. troglodytes
actctgcaggctgagg

SEQ ID NO: 198970 - DNA, 16 bp, P. troglodytes
actctgcctcctgggt

SEQ ID NO: 198971 - DNA, 16 bp, P. troglodytes
actctgctcactgcaa

SEQ ID NO: 198972 - DNA, 16 bp, P. troglodytes
actctgctgtccaggc

SEQ ID NO: 198973 - DNA, 16 bp, P. troglodytes
actctggaaggccaag

SEQ ID NO: 198974 - DNA, 16 bp, P. troglodytes
actctggaggatgagg

SEQ ID NO: 198975 - DNA, 16 bp, P. troglodytes
actctggaggctgaag

SEQ ID NO: 198976 - DNA, 16 bp, P. troglodytes
actctggaggctgaga

SEQ ID NO: 198977 - DNA, 16 bp, P. troglodytes
actctggcctgagtga

SEQ ID NO: 198978 - DNA, 16 bp, P. troglodytes
actctggcggctgagg

SEQ ID NO: 198979 - DNA, 16 bp, P. troglodytes
actctgggaggcaaag

SEQ ID NO: 198980 - DNA, 16 bp, P. troglodytes
actctggtgatagttt

SEQ ID NO: 198981 - DNA, 19 bp, P. troglodytes
actctggtggggacttgga

SEQ ID NO: 198982 - DNA, 16 bp, P. troglodytes
actctggtgggggatg

SEQ ID NO: 198983 - DNA, 16 bp, P. troglodytes
actctgtcacccaggg

SEQ ID NO: 198984 - DNA, 16 bp, P. troglodytes
actctgtcacccaggt

SEQ ID NO: 198985 - DNA, 16 bp, P. troglodytes
actctgtcactcaagc

SEQ ID NO: 198986 - DNA, 16 bp, P. troglodytes
actctgtcctccaggc

SEQ ID NO: 198987 - DNA, 16 bp, P. troglodytes
actctgtccttttatt

SEQ ID NO: 198988 - DNA, 16 bp, P. troglodytes
actctgtcgcccaggt

SEQ ID NO: 198989 - DNA, 17 bp, P. troglodytes
actctgtctcaaaacaa

SEQ ID NO: 198990 - DNA, 16 bp, P. troglodytes
actctgtctcaacaaa

SEQ ID NO: 198991 - DNA, 16 bp, P. troglodytes
actctgtctcgaaaaa

SEQ ID NO: 198992 - DNA, 16 bp, P. troglodytes
actctgtctctactga

SEQ ID NO: 198993 - DNA, 16 bp, P. troglodytes
actctgtcttaaaaaa

SEQ ID NO: 198994 - DNA, 16 bp, P. troglodytes
actctgtgccaggcac

SEQ ID NO: 198995 - DNA, 16 bp, P. troglodytes
actctgtgtcttttga

SEQ ID NO: 198996 - DNA, 16 bp, P. troglodytes
actctgttcatagttt

SEQ ID NO: 198997 - DNA, 16 bp, P. troglodytes
actctgttctttttca

SEQ ID NO: 198998 - DNA, 17 bp, P. troglodytes
actctgttgcccaggct

SEQ ID NO: 198999 - DNA, 16 bp, P. troglodytes
actctgttgcccaggt

SEQ ID NO: 199000 - DNA, 17 bp, P. troglodytes
actctgttgcccatgct

SEQ ID NO: 199001 - DNA, 17 bp, P. troglodytes
actctgttgctcaggct

SEQ ID NO: 199002 - DNA, 16 bp, P. troglodytes
actctgtttcctcatc

SEQ ID NO: 199003 - DNA, 16 bp, P. troglodytes
actcttacaactcaat

SEQ ID NO: 199004 - DNA, 16 bp, P. troglodytes
actcttacaagaaaac

SEQ ID NO: 199005 - DNA, 16 bp, P. troglodytes
actcttactcaacata

SEQ ID NO: 199006 - DNA, 16 bp, P. troglodytes
actcttccaatccatg

SEQ ID NO: 199007 - DNA, 16 bp, P. troglodytes
actcttctttttaaaa

SEQ ID NO: 199008 - DNA, 16 bp, P. troglodytes
actcttgcccaggctg

SEQ ID NO: 199009 - DNA, 16 bp, P. troglodytes
actcttgcctgctgcc

SEQ ID NO: 199010 - DNA, 17 bp, P. troglodytes
actcttgtctcccaggc

SEQ ID NO: 199011 - DNA, 16 bp, P. troglodytes
actctttattcaattt

SEQ ID NO: 199012 - DNA, 16 bp, P. troglodytes
actctttcacccaggt

SEQ ID NO: 199013 - DNA, 16 bp, P. troglodytes
actctttcagttattt

SEQ ID NO: 199014 - DNA, 16 bp, P. troglodytes
actctttcctggcctg

SEQ ID NO: 199015 - DNA, 16 bp, P. troglodytes
actctttgggtccgca

SEQ ID NO: 199016 - DNA, 16 bp, P. troglodytes
actcttttgtaataat

SEQ ID NO: 199017 - DNA, 16 bp, P. troglodytes
actgaaaaaaaaattt

SEQ ID NO: 199018 - DNA, 16 bp, P. troglodytes
actgaaaaagagcctg

SEQ ID NO: 199019 - DNA, 16 bp, P. troglodytes
actgaaaaattattta

SEQ ID NO: 199020 - DNA, 16 bp, P. troglodytes
actgaaaactacaaaa

SEQ ID NO: 199021 - DNA, 16 bp, P. troglodytes
actgaaaataattttg

SEQ ID NO: 199022 - DNA, 16 bp, P. troglodytes
actgaaaatacaaata

SEQ ID NO: 199023 - DNA, 16 bp, P. troglodytes
actgaaaatatgaaaa

SEQ ID NO: 199024 - DNA, 16 bp, P. troglodytes
actgaaaatggattaa

SEQ ID NO: 199025 - DNA, 16 bp, P. troglodytes
actgaaaatgttttaa

SEQ ID NO: 199026 - DNA, 16 bp, P. troglodytes
actgaaaattatttaa

SEQ ID NO: 199027 - DNA, 16 bp, P. troglodytes
actgaaacaggaagaa

SEQ ID NO: 199028 - DNA, 16 bp, P. troglodytes
actgaaaccacagaaa

SEQ ID NO: 199029 - DNA, 16 bp, P. troglodytes
actgaaagaaaacatt

SEQ ID NO: 199030 - DNA, 16 bp, P. troglodytes
actgaaagtgaaaaat

SEQ ID NO: 199031 - DNA, 16 bp, P. troglodytes
actgaaatataaaata

SEQ ID NO: 199032 - DNA, 16 bp, P. troglodytes
actgaaatataattta

SEQ ID NO: 199033 - DNA, 16 bp, P. troglodytes
actgaaatcagagcag

SEQ ID NO: 199034 - DNA, 16 bp, P. troglodytes
actgaacaaggaagaa

SEQ ID NO: 199035 - DNA, 16 bp, P. troglodytes
actgaacatttaaaaa

SEQ ID NO: 199036 - DNA, 16 bp, P. troglodytes
actgaacccacagaaa

SEQ ID NO: 199037 - DNA, 16 bp, P. troglodytes
actgaactctacactt

SEQ ID NO: 199038 - DNA, 16 bp, P. troglodytes
actgaactgtacactt

SEQ ID NO: 199039 - DNA, 16 bp, P. troglodytes
actgaagaaagcagaa

SEQ ID NO: 199040 - DNA, 16 bp, P. troglodytes
actgaagaaatatttt

SEQ ID NO: 199041 - DNA, 16 bp, P. troglodytes
actgaagaagcaagcc

SEQ ID NO: 199042 - DNA, 16 bp, P. troglodytes
actgaagagcctttgg

SEQ ID NO: 199043 - DNA, 16 bp, P. troglodytes
actgaagagctcttgg

SEQ ID NO: 199044 - DNA, 16 bp, P. troglodytes
actgaagctcagaaaa

SEQ ID NO: 199045 - DNA, 16 bp, P. troglodytes
actgaagtcttgacct

SEQ ID NO: 199046 - DNA, 16 bp, P. troglodytes
actgaagttcagagaa

SEQ ID NO: 199047 - DNA, 16 bp, P. troglodytes
actgaataaagaagat

SEQ ID NO: 199048 - DNA, 16 bp, P. troglodytes
actgaataaataaatg

SEQ ID NO: 199049 - DNA, 16 bp, P. troglodytes
actgaataatttataa

SEQ ID NO: 199050 - DNA, 16 bp, P. troglodytes
actgaatatacaaaaa

SEQ ID NO: 199051 - DNA, 16 bp, P. troglodytes
actgaatatggaaagg

SEQ ID NO: 199052 - DNA, 16 bp, P. troglodytes
actgaatccaacaaca

SEQ ID NO: 199053 - DNA, 16 bp, P. troglodytes
actgaatctgctggtg

SEQ ID NO: 199054 - DNA, 16 bp, P. troglodytes
actgaatgctttctcc

SEQ ID NO: 199055 - DNA, 16 bp, P. troglodytes
actgaatggagaaaaa

SEQ ID NO: 199056 - DNA, 16 bp, P. troglodytes
actgaatgttttattt

SEQ ID NO: 199057 - DNA, 16 bp, P. troglodytes
actgaattacacactt

SEQ ID NO: 199058 - DNA, 16 bp, P. troglodytes
actgaattggcaaaag

SEQ ID NO: 199059 - DNA, 16 bp, P. troglodytes
actgaattgtacactt

SEQ ID NO: 199060 - DNA, 16 bp, P. troglodytes
actgaatttttaaaat

SEQ ID NO: 199061 - DNA, 16 bp, P. troglodytes
actgacacacacacac

SEQ ID NO: 199062 - DNA, 16 bp, P. troglodytes
actgacagagcaggag

SEQ ID NO: 199063 - DNA, 16 bp, P. troglodytes
actgacctcaggtgat

SEQ ID NO: 199064 - DNA, 16 bp, P. troglodytes
actgacctgatgccag

SEQ ID NO: 199065 - DNA, 16 bp, P. troglodytes
actgactaaagagccc

SEQ ID NO: 199066 - DNA, 16 bp, P. troglodytes
actgactcacagttct

SEQ ID NO: 199067 - DNA, 16 bp, P. troglodytes
actgactgactgactg

SEQ ID NO: 199068 - DNA, 16 bp, P. troglodytes
actgacttatttcact

SEQ ID NO: 199069 - DNA, 17 bp, P. troglodytes
actgacttctacaatgg

SEQ ID NO: 199070 - DNA, 16 bp, P. troglodytes
actgacttcttttcct

SEQ ID NO: 199071 - DNA, 16 bp, P. troglodytes
actgagaaataaagag

SEQ ID NO: 199072 - DNA, 16 bp, P. troglodytes
actgagacaccagctg

SEQ ID NO: 199073 - DNA, 16 bp, P. troglodytes
actgagacagcctgag

SEQ ID NO: 199074 - DNA, 16 bp, P. troglodytes
actgagaccccatctc

SEQ ID NO: 199075 - DNA, 16 bp, P. troglodytes
actgagagaaaaaaat

SEQ ID NO: 199076 - DNA, 16 bp, P. troglodytes
actgagagaggaagac

SEQ ID NO: 199077 - DNA, 16 bp, P. troglodytes
actgagagataagact

SEQ ID NO: 199078 - DNA, 16 bp, P. troglodytes
actgagatccagagag

SEQ ID NO: 199079 - DNA, 16 bp, P. troglodytes
actgagatcctgtctc

SEQ ID NO: 199080 - DNA, 16 bp, P. troglodytes
actgagatggagaaga

SEQ ID NO: 199081 - DNA, 16 bp, P. troglodytes
actgagatgggaggat

SEQ ID NO: 199082 - DNA, 16 bp, P. troglodytes
actgagcacttaaaat

SEQ ID NO: 199083 - DNA, 17 bp, P. troglodytes
actgagcaggagttaga

SEQ ID NO: 199084 - DNA, 16 bp, P. troglodytes
actgagccagactaag

SEQ ID NO: 199085 - DNA, 16 bp, P. troglodytes
actgagcctcactctg

SEQ ID NO: 199086 - DNA, 16 bp, P. troglodytes
actgaggaagctgagg

SEQ ID NO: 199087 - DNA, 16 bp, P. troglodytes
actgaggactccaaaa

SEQ ID NO: 199088 - DNA, 16 bp, P. troglodytes
actgaggaggctgaga

SEQ ID NO: 199089 - DNA, 16 bp, P. troglodytes
actgaggaggctgagg

SEQ ID NO: 199090 - DNA, 16 bp, P. troglodytes
actgaggcacaaagag

SEQ ID NO: 199091 - DNA, 16 bp, P. troglodytes
actgaggcacacagaa

SEQ ID NO: 199092 - DNA, 16 bp, P. troglodytes
actgaggcacacagag

SEQ ID NO: 199093 - DNA, 16 bp, P. troglodytes
actgaggcacagaagt

SEQ ID NO: 199094 - DNA, 16 bp, P. troglodytes
actgaggcacagagga

SEQ ID NO: 199095 - DNA, 16 bp, P. troglodytes
actgaggcacagagtg

SEQ ID NO: 199096 - DNA, 16 bp, P. troglodytes
actgaggcaggaaaat

SEQ ID NO: 199097 - DNA, 16 bp, P. troglodytes
actgaggcaggagaat

SEQ ID NO: 199098 - DNA, 16 bp, P. troglodytes
actgaggcaggaggat

SEQ ID NO: 199099 - DNA, 16 bp, P. troglodytes
actgaggcaggcagat

SEQ ID NO: 199100 - DNA, 16 bp, P. troglodytes
actgaggcatgagaat

SEQ ID NO: 199101 - DNA, 16 bp, P. troglodytes
actgaggccaggcatg

SEQ ID NO: 199102 - DNA, 16 bp, P. troglodytes
actgaggcccagaaga

SEQ ID NO: 199103 - DNA, 16 bp, P. troglodytes
actgaggcccagagag

SEQ ID NO: 199104 - DNA, 16 bp, P. troglodytes
actgaggcccaggaaa

SEQ ID NO: 199105 - DNA, 16 bp, P. troglodytes
actgaggcccaggagg

SEQ ID NO: 199106 - DNA, 16 bp, P. troglodytes
actgaggcctggagaa

SEQ ID NO: 199107 - DNA, 16 bp, P. troglodytes
actgaggctcagagaa

SEQ ID NO: 199108 - DNA, 16 bp, P. troglodytes
actgaggctgagaaag

SEQ ID NO: 199109 - DNA, 16 bp, P. troglodytes
actgaggctggaggat

SEQ ID NO: 199110 - DNA, 16 bp, P. troglodytes
actgaggcttagagag

SEQ ID NO: 199111 - DNA, 16 bp, P. troglodytes
actgagggacagagag

SEQ ID NO: 199112 - DNA, 16 bp, P. troglodytes
actgaggtcaggagtt

SEQ ID NO: 199113 - DNA, 16 bp, P. troglodytes
actgaggtgggaggat

SEQ ID NO: 199114 - DNA, 19 bp, P. troglodytes
actgaggtgggtggatcat

SEQ ID NO: 199115 - DNA, 16 bp, P. troglodytes
actgagtaatttataa

SEQ ID NO: 199116 - DNA, 16 bp, P. troglodytes
actgagtctcactcta

SEQ ID NO: 199117 - DNA, 16 bp, P. troglodytes
actgagttaaataaaa

SEQ ID NO: 199118 - DNA, 16 bp, P. troglodytes
actgagtttcagagaa

SEQ ID NO: 199119 - DNA, 16 bp, P. troglodytes
actgagtttgtggtaa

SEQ ID NO: 199120 - DNA, 16 bp, P. troglodytes
actgataatacaaaaa

SEQ ID NO: 199121 - DNA, 16 bp, P. troglodytes
actgatacatgtaaca

SEQ ID NO: 199122 - DNA, 16 bp, P. troglodytes
actgataccaaaacag

SEQ ID NO: 199123 - DNA, 16 bp, P. troglodytes
actgatcatcaaagaa

SEQ ID NO: 199124 - DNA, 16 bp, P. troglodytes
actgatcatcagagaa

SEQ ID NO: 199125 - DNA, 16 bp, P. troglodytes
actgatcttttcactg

SEQ ID NO: 199126 - DNA, 16 bp, P. troglodytes
actgatcttttcttct

SEQ ID NO: 199127 - DNA, 16 bp, P. troglodytes
actgatgaaggtggct

SEQ ID NO: 199128 - DNA, 16 bp, P. troglodytes
actgatgaatggataa

SEQ ID NO: 199129 - DNA, 16 bp, P. troglodytes
actgatgatatgattg

SEQ ID NO: 199130 - DNA, 16 bp, P. troglodytes
actgatgttcacttaa

SEQ ID NO: 199131 - DNA, 16 bp, P. troglodytes
actgatttatttttct

SEQ ID NO: 199132 - DNA, 16 bp, P. troglodytes
actgatttatttttta

SEQ ID NO: 199133 - DNA, 16 bp, P. troglodytes
actgattttattaaat

SEQ ID NO: 199134 - DNA, 16 bp, P. troglodytes
actgattttgtttcct

SEQ ID NO: 199135 - DNA, 16 bp, P. troglodytes
actgatttttgtataa

SEQ ID NO: 199136 - DNA, 16 bp, P. troglodytes
actgattttttttaaa

SEQ ID NO: 199137 - DNA, 19 bp, P. troglodytes
actgcaaaaacataccaaa

SEQ ID NO: 199138 - DNA, 16 bp, P. troglodytes
actgcaacaagacaag

SEQ ID NO: 199139 - DNA, 16 bp, P. troglodytes
actgcaacccccacct

SEQ ID NO: 199140 - DNA, 16 bp, P. troglodytes
actgcaacccctgcct

SEQ ID NO: 199141 - DNA, 16 bp, P. troglodytes
actgcaacctcaacct

SEQ ID NO: 199142 - DNA, 16 bp, P. troglodytes
actgcaacctccgccc

SEQ ID NO: 199143 - DNA, 16 bp, P. troglodytes
actgcaacctggacct

SEQ ID NO: 199144 - DNA, 16 bp, P. troglodytes
actgcaactccagcct

SEQ ID NO: 199145 - DNA, 16 bp, P. troglodytes
actgcaactttgacct

SEQ ID NO: 199146 - DNA, 16 bp, P. troglodytes
actgcaagctcttcct

SEQ ID NO: 199147 - DNA, 16 bp, P. troglodytes
actgcacatgtgagga

SEQ ID NO: 199148 - DNA, 16 bp, P. troglodytes
actgcacccagctcca

SEQ ID NO: 199149 - DNA, 16 bp, P. troglodytes
actgcacccagctgac

SEQ ID NO: 199150 - DNA, 16 bp, P. troglodytes
actgcacccagctggg

SEQ ID NO: 199151 - DNA, 16 bp, P. troglodytes
actgcaccccaggctg

SEQ ID NO: 199152 - DNA, 16 bp, P. troglodytes
actgcaccctctgcct

SEQ ID NO: 199153 - DNA, 16 bp, P. troglodytes
actgcactacatcctg

SEQ ID NO: 199154 - DNA, 17 bp, P. troglodytes
actgcactccagcctgc

SEQ ID NO: 199155 - DNA, 16 bp, P. troglodytes
actgcactcttgcctg

SEQ ID NO: 199156 - DNA, 16 bp, P. troglodytes
actgcactgcagcctc

SEQ ID NO: 199157 - DNA, 16 bp, P. troglodytes
actgcagaaaaccaaa

SEQ ID NO: 199158 - DNA, 16 bp, P. troglodytes
actgcagaaagcaaaa

SEQ ID NO: 199159 - DNA, 16 bp, P. troglodytes
actgcagaaatttgca

SEQ ID NO: 199160 - DNA, 16 bp, P. troglodytes
actgcagaagaaaagt

SEQ ID NO: 199161 - DNA, 16 bp, P. troglodytes
actgcagatcaaaaat

SEQ ID NO: 199162 - DNA, 16 bp, P. troglodytes
actgcagatgtgatgg

SEQ ID NO: 199163 - DNA, 16 bp, P. troglodytes
actgcagccccagctg

SEQ ID NO: 199164 - DNA, 16 bp, P. troglodytes
actgcagcccccacct

SEQ ID NO: 199165 - DNA, 16 bp, P. troglodytes
actgcagcctaggtga

SEQ ID NO: 199166 - DNA, 16 bp, P. troglodytes
actgcagcctcaaaca

SEQ ID NO: 199167 - DNA, 16 bp, P. troglodytes
actgcagcctcaaccc

SEQ ID NO: 199168 - DNA, 16 bp, P. troglodytes
actgcagcctcaacct

SEQ ID NO: 199169 - DNA, 16 bp, P. troglodytes
actgcagcctcagccc

SEQ ID NO: 199170 - DNA, 16 bp, P. troglodytes
actgcagcctcagctt

SEQ ID NO: 199171 - DNA, 20 bp, P. troglodytes
actgcagcctccacctccca

SEQ ID NO: 199172 - DNA, 16 bp, P. troglodytes
actgcagcctccatcc

SEQ ID NO: 199173 - DNA, 16 bp, P. troglodytes
actgcagcctctacct

SEQ ID NO: 199174 - DNA, 16 bp, P. troglodytes
actgcagcctggagct

SEQ ID NO: 199175 - DNA, 16 bp, P. troglodytes
actgcagcctgggcga

SEQ ID NO: 199176 - DNA, 16 bp, P. troglodytes
actgcagcctgggctc

SEQ ID NO: 199177 - DNA, 16 bp, P. troglodytes
actgcagccttcatct

SEQ ID NO: 199178 - DNA, 16 bp, P. troglodytes
actgcagccttgaaca

SEQ ID NO: 199179 - DNA, 16 bp, P. troglodytes
actgcagccttggcct

SEQ ID NO: 199180 - DNA, 16 bp, P. troglodytes
actgcagcctttgcct

SEQ ID NO: 199181 - DNA, 16 bp, P. troglodytes
actgcaggaagcagct

SEQ ID NO: 199182 - DNA, 16 bp, P. troglodytes
actgcaggacttgagt

SEQ ID NO: 199183 - DNA, 16 bp, P. troglodytes
actgcaggtgcccgcc

SEQ ID NO: 199184 - DNA, 16 bp, P. troglodytes
actgcagtctggctct

SEQ ID NO: 199185 - DNA, 16 bp, P. troglodytes
actgcagtgagccatg

SEQ ID NO: 199186 - DNA, 16 bp, P. troglodytes
actgcagtgagctatg

SEQ ID NO: 199187 - DNA, 16 bp, P. troglodytes
actgcagtgattgtta

SEQ ID NO: 199188 - DNA, 16 bp, P. troglodytes
actgcatcactgcact

SEQ ID NO: 199189 - DNA, 16 bp, P. troglodytes
actgcatccagccagg

SEQ ID NO: 199190 - DNA, 16 bp, P. troglodytes
actgcatcctctgctt

SEQ ID NO: 199191 - DNA, 16 bp, P. troglodytes
actgcatgttctcact

SEQ ID NO: 199192 - DNA, 16 bp, P. troglodytes
actgcatttgcttttg

SEQ ID NO: 199193 - DNA, 16 bp, P. troglodytes
actgccaaactctttt

SEQ ID NO: 199194 - DNA, 16 bp, P. troglodytes
actgccaaactttttc

SEQ ID NO: 199195 - DNA, 16 bp, P. troglodytes
actgccacacacacac

SEQ ID NO: 199196 - DNA, 16 bp, P. troglodytes
actgccatcatcatca

SEQ ID NO: 199197 - DNA, 16 bp, P. troglodytes
actgccatccagcctg

SEQ ID NO: 199198 - DNA, 16 bp, P. troglodytes
actgcccaaagaaatt

SEQ ID NO: 199199 - DNA, 18 bp, P. troglodytes
actgcccaaggcaattta

SEQ ID NO: 199200 - DNA, 16 bp, P. troglodytes
actgcctagtggagct

SEQ ID NO: 199201 - DNA, 16 bp, P. troglodytes
actgcctcaacttcag

SEQ ID NO: 199202 - DNA, 16 bp, P. troglodytes
actgcctcagcctccc

SEQ ID NO: 199203 - DNA, 16 bp, P. troglodytes
actgcctcctcaagta

SEQ ID NO: 199204 - DNA, 16 bp, P. troglodytes
actgcctctctagatt

SEQ ID NO: 199205 - DNA, 16 bp, P. troglodytes
actgcctcttcaagtg

SEQ ID NO: 199206 - DNA, 16 bp, P. troglodytes
actgcctggagttggg

SEQ ID NO: 199207 - DNA, 16 bp, P. troglodytes
actgcctggcacacag

SEQ ID NO: 199208 - DNA, 16 bp, P. troglodytes
actgcgcccagcccac

SEQ ID NO: 199209 - DNA, 16 bp, P. troglodytes
actgcgcctggccacc

SEQ ID NO: 199210 - DNA, 17 bp, P. troglodytes
actgcgcctggccagca

SEQ ID NO: 199211 - DNA, 16 bp, P. troglodytes
actgcgcctggcctac

SEQ ID NO: 199212 - DNA, 19 bp, P. troglodytes
actgcggaaggccgcaggg

SEQ ID NO: 199213 - DNA, 16 bp, P. troglodytes
actgcgtgttctcact

SEQ ID NO: 199214 - DNA, 16 bp, P. troglodytes
actgctacctctgtct

SEQ ID NO: 199215 - DNA, 16 bp, P. troglodytes
actgctataaagaact

SEQ ID NO: 199216 - DNA, 18 bp, P. troglodytes
actgctcaaggaaataag

SEQ ID NO: 199217 - DNA, 16 bp, P. troglodytes
actgctcaataaaata

SEQ ID NO: 199218 - DNA, 16 bp, P. troglodytes
actgctcaggccactg

SEQ ID NO: 199219 - DNA, 16 bp, P. troglodytes
actgctcagggaaata

SEQ ID NO: 199220 - DNA, 16 bp, P. troglodytes
actgctccaggaaata

SEQ ID NO: 199221 - DNA, 16 bp, P. troglodytes
actgctcgagcccagg

SEQ ID NO: 199222 - DNA, 16 bp, P. troglodytes
actgctctggctagga

SEQ ID NO: 199223 - DNA, 16 bp, P. troglodytes
actgctgataaagaca

SEQ ID NO: 199224 - DNA, 16 bp, P. troglodytes
actgctgatgggaatg

SEQ ID NO: 199225 - DNA, 16 bp, P. troglodytes
actgctgccactgctg

SEQ ID NO: 199226 - DNA, 16 bp, P. troglodytes
actgctgctgctgctg

SEQ ID NO: 199227 - DNA, 17 bp, P. troglodytes
actgctgctgctgctgt

SEQ ID NO: 199228 - DNA, 16 bp, P. troglodytes
actgctgctgctgctt

SEQ ID NO: 199229 - DNA, 16 bp, P. troglodytes
actgctgctgggaatg

SEQ ID NO: 199230 - DNA, 16 bp, P. troglodytes
actgctggaaaaaaaa

SEQ ID NO: 199231 - DNA, 16 bp, P. troglodytes
actgctggatttggtt

SEQ ID NO: 199232 - DNA, 16 bp, P. troglodytes
actgctggtctcaagt

SEQ ID NO: 199233 - DNA, 16 bp, P. troglodytes
actgcttcctgctgac

SEQ ID NO: 199234 - DNA, 16 bp, P. troglodytes
actgcttctcaaactt

SEQ ID NO: 199235 - DNA, 16 bp, P. troglodytes
actgcttctttgactt

SEQ ID NO: 199236 - DNA, 16 bp, P. troglodytes
actgcttgagaccaga

SEQ ID NO: 199237 - DNA, 16 bp, P. troglodytes
actgcttgaggccaag

SEQ ID NO: 199238 - DNA, 17 bp, P. troglodytes
actgcttgagtccagga

SEQ ID NO: 199239 - DNA, 16 bp, P. troglodytes
actgctttaaaaatat

SEQ ID NO: 199240 - DNA, 16 bp, P. troglodytes
actgctttccacagtg

SEQ ID NO: 199241 - DNA, 16 bp, P. troglodytes
actgctttccagcctg

SEQ ID NO: 199242 - DNA, 16 bp, P. troglodytes
actggaaaaaatgaaa

SEQ ID NO: 199243 - DNA, 16 bp, P. troglodytes
actggaaacagcaaca

SEQ ID NO: 199244 - DNA, 16 bp, P. troglodytes
actggaaagagaaaaa

SEQ ID NO: 199245 - DNA, 16 bp, P. troglodytes
actggaacaagacaat

SEQ ID NO: 199246 - DNA, 16 bp, P. troglodytes
actggaacaggtgctg

SEQ ID NO: 199247 - DNA, 16 bp, P. troglodytes
actggaagaaaaagaa

SEQ ID NO: 199248 - DNA, 16 bp, P. troglodytes
actggaagaagaattg

SEQ ID NO: 199249 - DNA, 16 bp, P. troglodytes
actggaagcaagccct

SEQ ID NO: 199250 - DNA, 16 bp, P. troglodytes
actggaagcattccat

SEQ ID NO: 199251 - DNA, 16 bp, P. troglodytes
actggaaggttttcag

SEQ ID NO: 199252 - DNA, 16 bp, P. troglodytes
actggaataaaaacag

SEQ ID NO: 199253 - DNA, 16 bp, P. troglodytes
actggaattttttaaa

SEQ ID NO: 199254 - DNA, 16 bp, P. troglodytes
actggacatcagagaa

SEQ ID NO: 199255 - DNA, 16 bp, P. troglodytes
actggacattttaaat

SEQ ID NO: 199256 - DNA, 16 bp, P. troglodytes
actggagaaacaagaa

SEQ ID NO: 199257 - DNA, 16 bp, P. troglodytes
actggagactgggaag

SEQ ID NO: 199258 - DNA, 16 bp, P. troglodytes
actggagagcagtggc

SEQ ID NO: 199259 - DNA, 16 bp, P. troglodytes
actggagaggctgaga

SEQ ID NO: 199260 - DNA, 16 bp, P. troglodytes
actggagcagctggga

SEQ ID NO: 199261 - DNA, 16 bp, P. troglodytes
actggagcccaggaga

SEQ ID NO: 199262 - DNA, 16 bp, P. troglodytes
actggagccccctgag

SEQ ID NO: 199263 - DNA, 16 bp, P. troglodytes
actggaggaaaaaaaa

SEQ ID NO: 199264 - DNA, 17 bp, P. troglodytes
actggagtgcaatggcg

SEQ ID NO: 199265 - DNA, 16 bp, P. troglodytes
actggagtgcagtggc

SEQ ID NO: 199266 - DNA, 19 bp, P. troglodytes
actggagtgcagtggcgca

SEQ ID NO: 199267 - DNA, 18 bp, P. troglodytes
actggagtgcagtggtgc

SEQ ID NO: 199268 - DNA, 16 bp, P. troglodytes
actggagttcagtggc

SEQ ID NO: 199269 - DNA, 16 bp, P. troglodytes
actggataaagaaaac

SEQ ID NO: 199270 - DNA, 16 bp, P. troglodytes
actggataaataaaat

SEQ ID NO: 199271 - DNA, 16 bp, P. troglodytes
actggatcactcatac

SEQ ID NO: 199272 - DNA, 17 bp, P. troglodytes
actggatcatggtggat

SEQ ID NO: 199273 - DNA, 16 bp, P. troglodytes
actggatgaagaaaat

SEQ ID NO: 199274 - DNA, 16 bp, P. troglodytes
actggatggagaatga

SEQ ID NO: 199275 - DNA, 16 bp, P. troglodytes
actggattaagaaaac

SEQ ID NO: 199276 - DNA, 16 bp, P. troglodytes
actggattagggtggg

SEQ ID NO: 199277 - DNA, 16 bp, P. troglodytes
actggattccagcctg

SEQ ID NO: 199278 - DNA, 16 bp, P. troglodytes
actggcaaagcagaat

SEQ ID NO: 199279 - DNA, 22 bp, P. troglodytes
actggcaaattggatcaagagt

SEQ ID NO: 199280 - DNA, 16 bp, P. troglodytes
actggcaaggatgcag

SEQ ID NO: 199281 - DNA, 16 bp, P. troglodytes
actggcagaagacaag

SEQ ID NO: 199282 - DNA, 16 bp, P. troglodytes
actggcagccctcccc

SEQ ID NO: 199283 - DNA, 16 bp, P. troglodytes
actggcagcctggccc

SEQ ID NO: 199284 - DNA, 16 bp, P. troglodytes
actggcataagaacag

SEQ ID NO: 199285 - DNA, 16 bp, P. troglodytes
actggccaacatggag

SEQ ID NO: 199286 - DNA, 16 bp, P. troglodytes
actggccactaatttc

SEQ ID NO: 199287 - DNA, 16 bp, P. troglodytes
actggcctctttcact

SEQ ID NO: 199288 - DNA, 19 bp, P. troglodytes
actggctcacgcctgtaat

SEQ ID NO: 199289 - DNA, 16 bp, P. troglodytes
actggctcaggagtga

SEQ ID NO: 199290 - DNA, 16 bp, P. troglodytes
actggctgcacctgct

SEQ ID NO: 199291 - DNA, 22 bp, P. troglodytes
actggctgggcacagtggctca

SEQ ID NO: 199292 - DNA, 16 bp, P. troglodytes
actggctgtgggtctg

SEQ ID NO: 199293 - DNA, 16 bp, P. troglodytes
actggctgtgtgatct

SEQ ID NO: 199294 - DNA, 16 bp, P. troglodytes
actggcttccccccac

SEQ ID NO: 199295 - DNA, 16 bp, P. troglodytes
actggcttcctttctc

SEQ ID NO: 199296 - DNA, 16 bp, P. troglodytes
actgggaaaactggat

SEQ ID NO: 199297 - DNA, 16 bp, P. troglodytes
actgggaaaccaaaaa

SEQ ID NO: 199298 - DNA, 16 bp, P. troglodytes
actgggaaaccaaaat

SEQ ID NO: 199299 - DNA, 16 bp, P. troglodytes
actgggaaagagaaaa

SEQ ID NO: 199300 - DNA, 16 bp, P. troglodytes
actgggaagtctaaga

SEQ ID NO: 199301 - DNA, 17 bp, P. troglodytes
actgggactacaggtgc

SEQ ID NO: 199302 - DNA, 16 bp, P. troglodytes
actgggagaaaacatt

SEQ ID NO: 199303 - DNA, 16 bp, P. troglodytes
actgggagaaaatatt

SEQ ID NO: 199304 - DNA, 16 bp, P. troglodytes
actgggattacaggca

SEQ ID NO: 199305 - DNA, 20 bp, P. troglodytes
actgggattacaggcatgaa

SEQ ID NO: 199306 - DNA, 20 bp, P. troglodytes
actgggattacaggcgccca

SEQ ID NO: 199307 - DNA, 16 bp, P. troglodytes
actgggattataggca

SEQ ID NO: 199308 - DNA, 17 bp, P. troglodytes
actgggcaacagagcaa

SEQ ID NO: 199309 - DNA, 16 bp, P. troglodytes
actgggcatcagagaa

SEQ ID NO: 199310 - DNA, 16 bp, P. troglodytes
actgggcatggtggca

SEQ ID NO: 199311 - DNA, 18 bp, P. troglodytes
actgggcatggtggctca

SEQ ID NO: 199312 - DNA, 17 bp, P. troglodytes
actgggcatggtggtgg

SEQ ID NO: 199313 - DNA, 16 bp, P. troglodytes
actgggccactgccta

SEQ ID NO: 199314 - DNA, 16 bp, P. troglodytes
actgggcccagtggct

SEQ ID NO: 199315 - DNA, 16 bp, P. troglodytes
actgggctcaagtgat

SEQ ID NO: 199316 - DNA, 16 bp, P. troglodytes
actggggaagaatctg

SEQ ID NO: 199317 - DNA, 16 bp, P. troglodytes
actggggcccagagag

SEQ ID NO: 199318 - DNA, 16 bp, P. troglodytes
actggggcctatttga

SEQ ID NO: 199319 - DNA, 16 bp, P. troglodytes
actggggctgctgcct

SEQ ID NO: 199320 - DNA, 16 bp, P. troglodytes
actgggggaaaaaatg

SEQ ID NO: 199321 - DNA, 16 bp, P. troglodytes
actgggtaatttctaa

SEQ ID NO: 199322 - DNA, 16 bp, P. troglodytes
actgggtaatttttaa

SEQ ID NO: 199323 - DNA, 16 bp, P. troglodytes
actgggtctggctctg

SEQ ID NO: 199324 - DNA, 16 bp, P. troglodytes
actgggtcttgctatg

SEQ ID NO: 199325 - DNA, 17 bp, P. troglodytes
actgggtgccgtggagc

SEQ ID NO: 199326 - DNA, 16 bp, P. troglodytes
actgggttattttaaa

SEQ ID NO: 199327 - DNA, 16 bp, P. troglodytes
actgggttcaagcgat

SEQ ID NO: 199328 - DNA, 16 bp, P. troglodytes
actggtaccagtttac

SEQ ID NO: 199329 - DNA, 16 bp, P. troglodytes
actggtctgtggcctg

SEQ ID NO: 199330 - DNA, 16 bp, P. troglodytes
actggtgaattttacc

SEQ ID NO: 199331 - DNA, 16 bp, P. troglodytes
actggtgagaaaccct

SEQ ID NO: 199332 - DNA, 16 bp, P. troglodytes
actggtgaggaaactg

SEQ ID NO: 199333 - DNA, 16 bp, P. troglodytes
actggtgcctgccacc

SEQ ID NO: 199334 - DNA, 16 bp, P. troglodytes
actggtggaagaaatt

SEQ ID NO: 199335 - DNA, 16 bp, P. troglodytes
actggtgtccctataa

SEQ ID NO: 199336 - DNA, 16 bp, P. troglodytes
actggttaaataaatg

SEQ ID NO: 199337 - DNA, 16 bp, P. troglodytes
actggttatataccca

SEQ ID NO: 199338 - DNA, 16 bp, P. troglodytes
actggtttcaggttac

SEQ ID NO: 199339 - DNA, 16 bp, P. troglodytes
actggtttcatagaat

SEQ ID NO: 199340 - DNA, 16 bp, P. troglodytes
actgtaaaacactgat

SEQ ID NO: 199341 - DNA, 16 bp, P. troglodytes
actgtaaactatttca

SEQ ID NO: 199342 - DNA, 16 bp, P. troglodytes
actgtaacctcaacct

SEQ ID NO: 199343 - DNA, 16 bp, P. troglodytes
actgtaagctctgtga

SEQ ID NO: 199344 - DNA, 16 bp, P. troglodytes
actgtaaggtaataaa

SEQ ID NO: 199345 - DNA, 16 bp, P. troglodytes
actgtaagttgaaaat

SEQ ID NO: 199346 - DNA, 16 bp, P. troglodytes
actgtaatggtgaata

SEQ ID NO: 199347 - DNA, 16 bp, P. troglodytes
actgtaatttttaaaa

SEQ ID NO: 199348 - DNA, 16 bp, P. troglodytes
actgtacacataaaaa

SEQ ID NO: 199349 - DNA, 16 bp, P. troglodytes
actgtacatttttaaa

SEQ ID NO: 199350 - DNA, 16 bp, P. troglodytes
actgtactatcaaata

SEQ ID NO: 199351 - DNA, 16 bp, P. troglodytes
actgtactgtacactt

SEQ ID NO: 199352 - DNA, 16 bp, P. troglodytes
actgtactgtagcctg

SEQ ID NO: 199353 - DNA, 16 bp, P. troglodytes
actgtactgtatttat

SEQ ID NO: 199354 - DNA, 16 bp, P. troglodytes
actgtagcctgggaga

SEQ ID NO: 199355 - DNA, 16 bp, P. troglodytes
actgtagcctgggcaa

SEQ ID NO: 199356 - DNA, 16 bp, P. troglodytes
actgtagccttcacct

SEQ ID NO: 199357 - DNA, 16 bp, P. troglodytes
actgtagttttgtaat

SEQ ID NO: 199358 - DNA, 16 bp, P. troglodytes
actgtataggaaaaaa

SEQ ID NO: 199359 - DNA, 16 bp, P. troglodytes
actgtatccaatgtgt

SEQ ID NO: 199360 - DNA, 16 bp, P. troglodytes
actgtatgattcaatt

SEQ ID NO: 199361 - DNA, 16 bp, P. troglodytes
actgtatggcctgcaa

SEQ ID NO: 199362 - DNA, 16 bp, P. troglodytes
actgtattaaaattaa

SEQ ID NO: 199363 - DNA, 16 bp, P. troglodytes
actgtattagtttgct

SEQ ID NO: 199364 - DNA, 16 bp, P. troglodytes
actgtattattattat

SEQ ID NO: 199365 - DNA, 16 bp, P. troglodytes
actgtattcccagcac

SEQ ID NO: 199366 - DNA, 16 bp, P. troglodytes
actgtattcctaggta

SEQ ID NO: 199367 - DNA, 16 bp, P. troglodytes
actgtattcttacagt

SEQ ID NO: 199368 - DNA, 16 bp, P. troglodytes
actgtatttaaaatat

SEQ ID NO: 199369 - DNA, 16 bp, P. troglodytes
actgtatttattgaaa

SEQ ID NO: 199370 - DNA, 16 bp, P. troglodytes
actgtatttggacata

SEQ ID NO: 199371 - DNA, 16 bp, P. troglodytes
actgtatttggagaaa

SEQ ID NO: 199372 - DNA, 16 bp, P. troglodytes
actgtatttttacaat

SEQ ID NO: 199373 - DNA, 16 bp, P. troglodytes
actgtatttttatttc

SEQ ID NO: 199374 - DNA, 16 bp, P. troglodytes
actgtatttttcagtt

SEQ ID NO: 199375 - DNA, 16 bp, P. troglodytes
actgtatttttgtatc

SEQ ID NO: 199376 - DNA, 16 bp, P. troglodytes
actgtcagagaatact

SEQ ID NO: 199377 - DNA, 16 bp, P. troglodytes
actgtccccatgatcc

SEQ ID NO: 199378 - DNA, 16 bp, P. troglodytes
actgtcctacctcagg

SEQ ID NO: 199379 - DNA, 16 bp, P. troglodytes
actgtctcaaaaaaaa

SEQ ID NO: 199380 - DNA, 16 bp, P. troglodytes
actgtctcaaaaaata

SEQ ID NO: 199381 - DNA, 16 bp, P. troglodytes
actgtcttccaaagtg

SEQ ID NO: 199382 - DNA, 16 bp, P. troglodytes
actgtcttccacaaaa

SEQ ID NO: 199383 - DNA, 16 bp, P. troglodytes
actgtcttccacctct

SEQ ID NO: 199384 - DNA, 16 bp, P. troglodytes
actgtcttcctcaatg

SEQ ID NO: 199385 - DNA, 16 bp, P. troglodytes
actgtcttctgcaatg

SEQ ID NO: 199386 - DNA, 16 bp, P. troglodytes
actgtctttctgaaat

SEQ ID NO: 199387 - DNA, 16 bp, P. troglodytes
actgtcttttaaaatt

SEQ ID NO: 199388 - DNA, 16 bp, P. troglodytes
actgtgaaataataaa

SEQ ID NO: 199389 - DNA, 16 bp, P. troglodytes
actgtgaacaattata

SEQ ID NO: 199390 - DNA, 16 bp, P. troglodytes
actgtgaagaaagtca

SEQ ID NO: 199391 - DNA, 16 bp, P. troglodytes
actgtgaatactgctg

SEQ ID NO: 199392 - DNA, 16 bp, P. troglodytes
actgtgaatattgctg

SEQ ID NO: 199393 - DNA, 16 bp, P. troglodytes
actgtgaatccattaa

SEQ ID NO: 199394 - DNA, 16 bp, P. troglodytes
actgtgactgagacaa

SEQ ID NO: 199395 - DNA, 16 bp, P. troglodytes
actgtgagaaataaac

SEQ ID NO: 199396 - DNA, 16 bp, P. troglodytes
actgtgagaaataaat

SEQ ID NO: 199397 - DNA, 16 bp, P. troglodytes
actgtgagcaataaat

SEQ ID NO: 199398 - DNA, 16 bp, P. troglodytes
actgtgagccaaaata

SEQ ID NO: 199399 - DNA, 16 bp, P. troglodytes
actgtgagctccttga

SEQ ID NO: 199400 - DNA, 16 bp, P. troglodytes
actgtgaggaatacat

SEQ ID NO: 199401 - DNA, 16 bp, P. troglodytes
actgtgataaaataaa

SEQ ID NO: 199402 - DNA, 16 bp, P. troglodytes
actgtgatgcctccag

SEQ ID NO: 199403 - DNA, 16 bp, P. troglodytes
actgtgattgtgaggc

SEQ ID NO: 199404 - DNA, 16 bp, P. troglodytes
actgtgcactttattt

SEQ ID NO: 199405 - DNA, 16 bp, P. troglodytes
actgtgcagaagctct

SEQ ID NO: 199406 - DNA, 16 bp, P. troglodytes
actgtgccaggcactg

SEQ ID NO: 199407 - DNA, 16 bp, P. troglodytes
actgtgccattgtact

SEQ ID NO: 199408 - DNA, 16 bp, P. troglodytes
actgtgccattttata

SEQ ID NO: 199409 - DNA, 16 bp, P. troglodytes
actgtgcccagcattt

SEQ ID NO: 199410 - DNA, 16 bp, P. troglodytes
actgtgcccagcccac

SEQ ID NO: 199411 - DNA, 16 bp, P. troglodytes
actgtgcccagcccag

SEQ ID NO: 199412 - DNA, 16 bp, P. troglodytes
actgtgcccagcccca

SEQ ID NO: 199413 - DNA, 17 bp, P. troglodytes
actgtgcccagcctaaa

SEQ ID NO: 199414 - DNA, 16 bp, P. troglodytes
actgtgcccagcctgc

SEQ ID NO: 199415 - DNA, 16 bp, P. troglodytes
actgtgcccagccttg

SEQ ID NO: 199416 - DNA, 16 bp, P. troglodytes
actgtgcccagctcaa

SEQ ID NO: 199417 - DNA, 16 bp, P. troglodytes
actgtgcccagctgca

SEQ ID NO: 199418 - DNA, 16 bp, P. troglodytes
actgtgcccggcccac

SEQ ID NO: 199419 - DNA, 16 bp, P. troglodytes
actgtgcccggcccca

SEQ ID NO: 199420 - DNA, 16 bp, P. troglodytes
actgtgcccggcctgg

SEQ ID NO: 199421 - DNA, 16 bp, P. troglodytes
actgtgcccggctgct

SEQ ID NO: 199422 - DNA, 16 bp, P. troglodytes
actgtgcctaattttt

SEQ ID NO: 199423 - DNA, 16 bp, P. troglodytes
actgtgcctagcctgt

SEQ ID NO: 199424 - DNA, 17 bp, P. troglodytes
actgtgcctggcccaaa

SEQ ID NO: 199425 - DNA, 16 bp, P. troglodytes
actgtgcctggcctgg

SEQ ID NO: 199426 - DNA, 16 bp, P. troglodytes
actgtgcctggctccc

SEQ ID NO: 199427 - DNA, 16 bp, P. troglodytes
actgtgcctggcttcc

SEQ ID NO: 199428 - DNA, 16 bp, P. troglodytes
actgtgctaggtgctg

SEQ ID NO: 199429 - DNA, 16 bp, P. troglodytes
actgtgctgagtcaga

SEQ ID NO: 199430 - DNA, 16 bp, P. troglodytes
actgtgctgctgcact

SEQ ID NO: 199431 - DNA, 16 bp, P. troglodytes
actgtgctggcttcag

SEQ ID NO: 199432 - DNA, 16 bp, P. troglodytes
actgtgcttttcccac

SEQ ID NO: 199433 - DNA, 16 bp, P. troglodytes
actgtggaggctgaga

SEQ ID NO: 199434 - DNA, 16 bp, P. troglodytes
actgtggcactgccta

SEQ ID NO: 199435 - DNA, 16 bp, P. troglodytes
actgtggccaggcaca

SEQ ID NO: 199436 - DNA, 16 bp, P. troglodytes
actgtggcctccaact

SEQ ID NO: 199437 - DNA, 16 bp, P. troglodytes
actgtggcctgggtga

SEQ ID NO: 199438 - DNA, 16 bp, P. troglodytes
actgtggctaagctgg

SEQ ID NO: 199439 - DNA, 16 bp, P. troglodytes
actgtggctcatgcct

SEQ ID NO: 199440 - DNA, 16 bp, P. troglodytes
actgtggctgaactgg

SEQ ID NO: 199441 - DNA, 16 bp, P. troglodytes
actgtgggaaaagcat

SEQ ID NO: 199442 - DNA, 16 bp, P. troglodytes
actgtgggtaaaatac

SEQ ID NO: 199443 - DNA, 16 bp, P. troglodytes
actgtggtgcccaggc

SEQ ID NO: 199444 - DNA, 16 bp, P. troglodytes
actgtggttcccactg

SEQ ID NO: 199445 - DNA, 16 bp, P. troglodytes
actgtggttttgactt

SEQ ID NO: 199446 - DNA, 16 bp, P. troglodytes
actgtggttttgtttt

SEQ ID NO: 199447 - DNA, 16 bp, P. troglodytes
actgtgtaacaggcag

SEQ ID NO: 199448 - DNA, 16 bp, P. troglodytes
actgtgtacccattaa

SEQ ID NO: 199449 - DNA, 18 bp, P. troglodytes
actgtgtctatgtagaaa

SEQ ID NO: 199450 - DNA, 16 bp, P. troglodytes
actgtgtcttcctgtc

SEQ ID NO: 199451 - DNA, 16 bp, P. troglodytes
actgtgtgccaagcac

SEQ ID NO: 199452 - DNA, 16 bp, P. troglodytes
actgtgtggccttggg

SEQ ID NO: 199453 - DNA, 16 bp, P. troglodytes
actgtgtttggagata

SEQ ID NO: 199454 - DNA, 16 bp, P. troglodytes
actgttataaagaaat

SEQ ID NO: 199455 - DNA, 16 bp, P. troglodytes
actgttcaaaaaggaa

SEQ ID NO: 199456 - DNA, 16 bp, P. troglodytes
actgttcagctcccac

SEQ ID NO: 199457 - DNA, 16 bp, P. troglodytes
actgttccaacctctt

SEQ ID NO: 199458 - DNA, 16 bp, P. troglodytes
actgttctgtatcttg

SEQ ID NO: 199459 - DNA, 16 bp, P. troglodytes
actgttgatgggaatg

SEQ ID NO: 199460 - DNA, 16 bp, P. troglodytes
actgttgcactgggga

SEQ ID NO: 199461 - DNA, 16 bp, P. troglodytes
actgttgggaaggcat

SEQ ID NO: 199462 - DNA, 16 bp, P. troglodytes
actgtttaaaattttt

SEQ ID NO: 199463 - DNA, 16 bp, P. troglodytes
actgtttctctaaaat

SEQ ID NO: 199464 - DNA, 16 bp, P. troglodytes
actgtttctgtgattc

SEQ ID NO: 199465 - DNA, 16 bp, P. troglodytes
actgtttgtttcaatt

SEQ ID NO: 199466 - DNA, 16 bp, P. troglodytes
actgttttaagaaagt

SEQ ID NO: 199467 - DNA, 16 bp, P. troglodytes
actgttttaattactg

SEQ ID NO: 199468 - DNA, 16 bp, P. troglodytes
actgttttacattccc

SEQ ID NO: 199469 - DNA, 16 bp, P. troglodytes
actgttttccaaagtg

SEQ ID NO: 199470 - DNA, 16 bp, P. troglodytes
actgttttccaacttg

SEQ ID NO: 199471 - DNA, 16 bp, P. troglodytes
actgttttcttctttg

SEQ ID NO: 199472 - DNA, 16 bp, P. troglodytes
actgttttgaatgtgt

SEQ ID NO: 199473 - DNA, 16 bp, P. troglodytes
actgttttgattttta

SEQ ID NO: 199474 - DNA, 16 bp, P. troglodytes
actgtttttcttttaa

SEQ ID NO: 199475 - DNA, 16 bp, P. troglodytes
actgtttttgcaaaat

SEQ ID NO: 199476 - DNA, 16 bp, P. troglodytes
actgttttttctatct

SEQ ID NO: 199477 - DNA, 16 bp, P. troglodytes
acttaaaaatatgtaa

SEQ ID NO: 199478 - DNA, 16 bp, P. troglodytes
acttaaaaatgattaa

SEQ ID NO: 199479 - DNA, 16 bp, P. troglodytes
acttaaaaatgggcaa

SEQ ID NO: 199480 - DNA, 16 bp, P. troglodytes
acttaaaaatggttaa

SEQ ID NO: 199481 - DNA, 16 bp, P. troglodytes
acttaaaaatgtattt

SEQ ID NO: 199482 - DNA, 16 bp, P. troglodytes
acttaaaacatttttt

SEQ ID NO: 199483 - DNA, 16 bp, P. troglodytes
acttaaaaggctgagg

SEQ ID NO: 199484 - DNA, 16 bp, P. troglodytes
acttaaaagtaaaacc

SEQ ID NO: 199485 - DNA, 16 bp, P. troglodytes
acttaaaatacatttt

SEQ ID NO: 199486 - DNA, 16 bp, P. troglodytes
acttaaaattttaaga

SEQ ID NO: 199487 - DNA, 16 bp, P. troglodytes
acttaaagaatgtaat

SEQ ID NO: 199488 - DNA, 16 bp, P. troglodytes
acttaaatagacattt

SEQ ID NO: 199489 - DNA, 16 bp, P. troglodytes
acttaaatgaaatgga

SEQ ID NO: 199490 - DNA, 16 bp, P. troglodytes
acttaaatgcccatca

SEQ ID NO: 199491 - DNA, 16 bp, P. troglodytes
acttaacctctctggg

SEQ ID NO: 199492 - DNA, 16 bp, P. troglodytes
acttaacctttctggg

SEQ ID NO: 199493 - DNA, 16 bp, P. troglodytes
acttaactcttgttta

SEQ ID NO: 199494 - DNA, 16 bp, P. troglodytes
acttaagcataaaaat

SEQ ID NO: 199495 - DNA, 16 bp, P. troglodytes
acttaatagatattta

SEQ ID NO: 199496 - DNA, 16 bp, P. troglodytes
acttaatccccagtgt

SEQ ID NO: 199497 - DNA, 16 bp, P. troglodytes
acttaatgccactaaa

SEQ ID NO: 199498 - DNA, 16 bp, P. troglodytes
acttaatggggaaaaa

SEQ ID NO: 199499 - DNA, 16 bp, P. troglodytes
acttaatgttttcaag

SEQ ID NO: 199500 - DNA, 16 bp, P. troglodytes
acttacaagtgggagt

SEQ ID NO: 199501 - DNA, 16 bp, P. troglodytes
acttacaatagcatca

SEQ ID NO: 199502 - DNA, 16 bp, P. troglodytes
acttacaattatggcg

SEQ ID NO: 199503 - DNA, 16 bp, P. troglodytes
acttacaattttttaa

SEQ ID NO: 199504 - DNA, 16 bp, P. troglodytes
acttacagatgaagaa

SEQ ID NO: 199505 - DNA, 16 bp, P. troglodytes
acttacagtcccagct

SEQ ID NO: 199506 - DNA, 16 bp, P. troglodytes
acttacccagagcaac

SEQ ID NO: 199507 - DNA, 16 bp, P. troglodytes
acttactatgtgccag

SEQ ID NO: 199508 - DNA, 16 bp, P. troglodytes
acttactcaaggtcac

SEQ ID NO: 199509 - DNA, 16 bp, P. troglodytes
acttactgaatcagaa

SEQ ID NO: 199510 - DNA, 16 bp, P. troglodytes
acttactgcagccttg

SEQ ID NO: 199511 - DNA, 16 bp, P. troglodytes
acttagaatagtgcct

SEQ ID NO: 199512 - DNA, 16 bp, P. troglodytes
acttagaggcttaaaa

SEQ ID NO: 199513 - DNA, 16 bp, P. troglodytes
acttagcagtgggatt

SEQ ID NO: 199514 - DNA, 16 bp, P. troglodytes
acttagggaaaacaga

SEQ ID NO: 199515 - DNA, 16 bp, P. troglodytes
acttaggttggttcca

SEQ ID NO: 199516 - DNA, 16 bp, P. troglodytes
acttagtgccttaaaa

SEQ ID NO: 199517 - DNA, 16 bp, P. troglodytes
acttatacattgctgg

SEQ ID NO: 199518 - DNA, 16 bp, P. troglodytes
acttatcaaaagaaga

SEQ ID NO: 199519 - DNA, 16 bp, P. troglodytes
acttatgatggggtta

SEQ ID NO: 199520 - DNA, 16 bp, P. troglodytes
acttatgatttgtgca

SEQ ID NO: 199521 - DNA, 16 bp, P. troglodytes
acttatgtaaatttct

SEQ ID NO: 199522 - DNA, 16 bp, P. troglodytes
acttatgtttaaaaga

SEQ ID NO: 199523 - DNA, 16 bp, P. troglodytes
acttattcactatcac

SEQ ID NO: 199524 - DNA, 16 bp, P. troglodytes
acttattcattcattt

SEQ ID NO: 199525 - DNA, 16 bp, P. troglodytes
acttattccagttcag

SEQ ID NO: 199526 - DNA, 16 bp, P. troglodytes
acttattctacaaggc

SEQ ID NO: 199527 - DNA, 16 bp, P. troglodytes
acttatttaatgaaat

SEQ ID NO: 199528 - DNA, 16 bp, P. troglodytes
acttatttctgctctg

SEQ ID NO: 199529 - DNA, 16 bp, P. troglodytes
acttatttcttacagt

SEQ ID NO: 199530 - DNA, 16 bp, P. troglodytes
acttatttgtgtcttt

SEQ ID NO: 199531 - DNA, 16 bp, P. troglodytes
acttatttttgtcatt

SEQ ID NO: 199532 - DNA, 16 bp, P. troglodytes
acttatttttttaaag

SEQ ID NO: 199533 - DNA, 16 bp, P. troglodytes
acttcaaaagaagaca

SEQ ID NO: 199534 - DNA, 16 bp, P. troglodytes
acttcaaaatatgtta

SEQ ID NO: 199535 - DNA, 16 bp, P. troglodytes
acttcaaagctgtcag

SEQ ID NO: 199536 - DNA, 16 bp, P. troglodytes
acttcaaatgggtgaa

SEQ ID NO: 199537 - DNA, 16 bp, P. troglodytes
acttcaaattatagta

SEQ ID NO: 199538 - DNA, 16 bp, P. troglodytes
acttcaacccaggaag

SEQ ID NO: 199539 - DNA, 16 bp, P. troglodytes
acttcaacctccatct

SEQ ID NO: 199540 - DNA, 16 bp, P. troglodytes
acttcaacctctgcct

SEQ ID NO: 199541 - DNA, 16 bp, P. troglodytes
acttcaacctctgctt

SEQ ID NO: 199542 - DNA, 16 bp, P. troglodytes
acttcaacctttgcct

SEQ ID NO: 199543 - DNA, 16 bp, P. troglodytes
acttcaagaaaataca

SEQ ID NO: 199544 - DNA, 16 bp, P. troglodytes
acttcaagacaaaaac

SEQ ID NO: 199545 - DNA, 16 bp, P. troglodytes
acttcaagacttactg

SEQ ID NO: 199546 - DNA, 16 bp, P. troglodytes
acttcaaggaactaga

SEQ ID NO: 199547 - DNA, 16 bp, P. troglodytes
acttcaaggacagtta

SEQ ID NO: 199548 - DNA, 16 bp, P. troglodytes
acttcaatttcctcat

SEQ ID NO: 199549 - DNA, 16 bp, P. troglodytes
acttcaccaaagagga

SEQ ID NO: 199550 - DNA, 16 bp, P. troglodytes
acttcactgacagcac

SEQ ID NO: 199551 - DNA, 16 bp, P. troglodytes
acttcagaaggccaag

SEQ ID NO: 199552 - DNA, 16 bp, P. troglodytes
acttcagcatcatgca

SEQ ID NO: 199553 - DNA, 16 bp, P. troglodytes
acttcagcatgggcaa

SEQ ID NO: 199554 - DNA, 16 bp, P. troglodytes
acttcagcctcctgag

SEQ ID NO: 199555 - DNA, 16 bp, P. troglodytes
acttcagcctggacaa

SEQ ID NO: 199556 - DNA, 16 bp, P. troglodytes
acttcagcttcctcat

SEQ ID NO: 199557 - DNA, 16 bp, P. troglodytes
acttcaggaaacattg

SEQ ID NO: 199558 - DNA, 16 bp, P. troglodytes
acttcaggaggccaag

SEQ ID NO: 199559 - DNA, 16 bp, P. troglodytes
acttcaggtcaatatc

SEQ ID NO: 199560 - DNA, 17 bp, P. troglodytes
acttcaggtgatccgcc

SEQ ID NO: 199561 - DNA, 18 bp, P. troglodytes
acttcaggtgatccgcct

SEQ ID NO: 199562 - DNA, 16 bp, P. troglodytes
acttcagtcaagccca

SEQ ID NO: 199563 - DNA, 16 bp, P. troglodytes
acttcagtgaccacac

SEQ ID NO: 199564 - DNA, 16 bp, P. troglodytes
acttcagtggaagaag

SEQ ID NO: 199565 - DNA, 16 bp, P. troglodytes
acttcagtggaggaaa

SEQ ID NO: 199566 - DNA, 16 bp, P. troglodytes
acttcagtttcttcat

SEQ ID NO: 199567 - DNA, 16 bp, P. troglodytes
acttcagttttgtttt

SEQ ID NO: 199568 - DNA, 16 bp, P. troglodytes
acttcataaatatgta

SEQ ID NO: 199569 - DNA, 16 bp, P. troglodytes
acttcatacaggagag

SEQ ID NO: 199570 - DNA, 16 bp, P. troglodytes
acttcataggattgtt

SEQ ID NO: 199571 - DNA, 16 bp, P. troglodytes
acttcatataagtaga

SEQ ID NO: 199572 - DNA, 16 bp, P. troglodytes
acttcatctcaaacaa

SEQ ID NO: 199573 - DNA, 16 bp, P. troglodytes
acttcatgccactgaa

SEQ ID NO: 199574 - DNA, 16 bp, P. troglodytes
acttcattaaaatgaa

SEQ ID NO: 199575 - DNA, 16 bp, P. troglodytes
acttcattccttttca

SEQ ID NO: 199576 - DNA, 16 bp, P. troglodytes
acttcattgctaaaaa

SEQ ID NO: 199577 - DNA, 16 bp, P. troglodytes
acttcattgttgtttt

SEQ ID NO: 199578 - DNA, 16 bp, P. troglodytes
acttcatttaaaataa

SEQ ID NO: 199579 - DNA, 16 bp, P. troglodytes
acttcattttacctta

SEQ ID NO: 199580 - DNA, 16 bp, P. troglodytes
acttcattttttaaaa

SEQ ID NO: 199581 - DNA, 16 bp, P. troglodytes
acttccaaatttatat

SEQ ID NO: 199582 - DNA, 16 bp, P. troglodytes
acttccaattttgtgg

SEQ ID NO: 199583 - DNA, 16 bp, P. troglodytes
acttccacagcacctc

SEQ ID NO: 199584 - DNA, 16 bp, P. troglodytes
acttccagactccaga

SEQ ID NO: 199585 - DNA, 16 bp, P. troglodytes
acttccaggaatttat

SEQ ID NO: 199586 - DNA, 16 bp, P. troglodytes
acttccagtttccaga

SEQ ID NO: 199587 - DNA, 16 bp, P. troglodytes
acttccagtttttgcc

SEQ ID NO: 199588 - DNA, 16 bp, P. troglodytes
acttcccaggctcaag

SEQ ID NO: 199589 - DNA, 17 bp, P. troglodytes
acttcccaggttcaagt

SEQ ID NO: 199590 - DNA, 16 bp, P. troglodytes
acttccccaacctggc

SEQ ID NO: 199591 - DNA, 16 bp, P. troglodytes
acttcccctttgacct

SEQ ID NO: 199592 - DNA, 16 bp, P. troglodytes
acttccctccagcccc

SEQ ID NO: 199593 - DNA, 16 bp, P. troglodytes
acttccctgggcctca

SEQ ID NO: 199594 - DNA, 16 bp, P. troglodytes
acttccctgtgcctca

SEQ ID NO: 199595 - DNA, 16 bp, P. troglodytes
acttcctagagacttg

SEQ ID NO: 199596 - DNA, 16 bp, P. troglodytes
acttcctcacttccta

SEQ ID NO: 199597 - DNA, 16 bp, P. troglodytes
acttcctcccctctga

SEQ ID NO: 199598 - DNA, 16 bp, P. troglodytes
acttcctcccttctga

SEQ ID NO: 199599 - DNA, 16 bp, P. troglodytes
acttcctcctcagcca

SEQ ID NO: 199600 - DNA, 16 bp, P. troglodytes
acttcctcctcctggg

SEQ ID NO: 199601 - DNA, 16 bp, P. troglodytes
acttcctctctcccta

SEQ ID NO: 199602 - DNA, 16 bp, P. troglodytes
acttcctctgggacat

SEQ ID NO: 199603 - DNA, 16 bp, P. troglodytes
acttcctcttttccag

SEQ ID NO: 199604 - DNA, 16 bp, P. troglodytes
acttcctgatttctgc

SEQ ID NO: 199605 - DNA, 16 bp, P. troglodytes
acttcctgggctcaag

SEQ ID NO: 199606 - DNA, 16 bp, P. troglodytes
acttcctgggtcaagt

SEQ ID NO: 199607 - DNA, 16 bp, P. troglodytes
acttcctgggttcaag

SEQ ID NO: 199608 - DNA, 16 bp, P. troglodytes
acttcctgggttcatg

SEQ ID NO: 199609 - DNA, 16 bp, P. troglodytes
acttcctggttcaagc

SEQ ID NO: 199610 - DNA, 16 bp, P. troglodytes
acttcctgtctctatg

SEQ ID NO: 199611 - DNA, 16 bp, P. troglodytes
acttcctttaaaaaaa

SEQ ID NO: 199612 - DNA, 16 bp, P. troglodytes
acttcgggagactgag

SEQ ID NO: 199613 - DNA, 18 bp, P. troglodytes
acttcgggaggccaaggc

SEQ ID NO: 199614 - DNA, 16 bp, P. troglodytes
acttcgggaggccgag

SEQ ID NO: 199615 - DNA, 16 bp, P. troglodytes
acttcgtctcaaaaaa

SEQ ID NO: 199616 - DNA, 16 bp, P. troglodytes
acttctaaataaagac

SEQ ID NO: 199617 - DNA, 16 bp, P. troglodytes
acttctagcctccaga

SEQ ID NO: 199618 - DNA, 16 bp, P. troglodytes
acttctatttaaaaat

SEQ ID NO: 199619 - DNA, 16 bp, P. troglodytes
acttctcagcctccca

SEQ ID NO: 199620 - DNA, 16 bp, P. troglodytes
acttctcagtctccag

SEQ ID NO: 199621 - DNA, 16 bp, P. troglodytes
acttctcatttttaaa

SEQ ID NO: 199622 - DNA, 16 bp, P. troglodytes
acttctccagcaaggg

SEQ ID NO: 199623 - DNA, 16 bp, P. troglodytes
acttctcccttgctgt

SEQ ID NO: 199624 - DNA, 16 bp, P. troglodytes
acttctccttcctgcc

SEQ ID NO: 199625 - DNA, 16 bp, P. troglodytes
acttctctaaagaaga

SEQ ID NO: 199626 - DNA, 16 bp, P. troglodytes
acttctctgacctcat

SEQ ID NO: 199627 - DNA, 16 bp, P. troglodytes
acttctctgagcttca

SEQ ID NO: 199628 - DNA, 16 bp, P. troglodytes
acttctctttgcctca

SEQ ID NO: 199629 - DNA, 16 bp, P. troglodytes
acttctgactgaccag

SEQ ID NO: 199630 - DNA, 16 bp, P. troglodytes
acttctgaggctagat

SEQ ID NO: 199631 - DNA, 16 bp, P. troglodytes
acttctgcaagaatgg

SEQ ID NO: 199632 - DNA, 16 bp, P. troglodytes
acttctgcacagcaaa

SEQ ID NO: 199633 - DNA, 16 bp, P. troglodytes
acttctgccacctggg

SEQ ID NO: 199634 - DNA, 16 bp, P. troglodytes
acttctgcctcctggt

SEQ ID NO: 199635 - DNA, 16 bp, P. troglodytes
acttctgcttctggga

SEQ ID NO: 199636 - DNA, 16 bp, P. troglodytes
acttctggaaatgaag

SEQ ID NO: 199637 - DNA, 16 bp, P. troglodytes
acttcttaaaaatatt

SEQ ID NO: 199638 - DNA, 16 bp, P. troglodytes
acttcttacatggtgg

SEQ ID NO: 199639 - DNA, 16 bp, P. troglodytes
acttcttcaagcatct

SEQ ID NO: 199640 - DNA, 16 bp, P. troglodytes
acttcttggaggcttt

SEQ ID NO: 199641 - DNA, 16 bp, P. troglodytes
acttcttggaggtttt

SEQ ID NO: 199642 - DNA, 16 bp, P. troglodytes
acttcttgtcagaaac

SEQ ID NO: 199643 - DNA, 16 bp, P. troglodytes
acttctttctttctga

SEQ ID NO: 199644 - DNA, 16 bp, P. troglodytes
acttctttgcaatggg

SEQ ID NO: 199645 - DNA, 18 bp, P. troglodytes
acttctttgccatgggtt

SEQ ID NO: 199646 - DNA, 16 bp, P. troglodytes
acttctttgggcctca

SEQ ID NO: 199647 - DNA, 16 bp, P. troglodytes
acttgaaaaatgttgt

SEQ ID NO: 199648 - DNA, 16 bp, P. troglodytes
acttgaaaataaattt

SEQ ID NO: 199649 - DNA, 16 bp, P. troglodytes
acttgaaagtaaaaat

SEQ ID NO: 199650 - DNA, 16 bp, P. troglodytes
acttgaaatggatcat

SEQ ID NO: 199651 - DNA, 16 bp, P. troglodytes
acttgaacacaaacac

SEQ ID NO: 199652 - DNA, 16 bp, P. troglodytes
acttgaacatgggagg

SEQ ID NO: 199653 - DNA, 16 bp, P. troglodytes
acttgaacatttagag

SEQ ID NO: 199654 - DNA, 18 bp, P. troglodytes
acttgaaccagggaggtg

SEQ ID NO: 199655 - DNA, 16 bp, P. troglodytes
acttgaacccagctct

SEQ ID NO: 199656 - DNA, 17 bp, P. troglodytes
acttgaacccaggaagt

SEQ ID NO: 199657 - DNA, 20 bp, P. troglodytes
acttgaacccaggaggcaga

SEQ ID NO: 199658 - DNA, 16 bp, P. troglodytes
acttgaacccaggcag

SEQ ID NO: 199659 - DNA, 17 bp, P. troglodytes
acttgaactcctggcct

SEQ ID NO: 199660 - DNA, 16 bp, P. troglodytes
acttgaagaactccct

SEQ ID NO: 199661 - DNA, 16 bp, P. troglodytes
acttgaaggaaaaaaa

SEQ ID NO: 199662 - DNA, 16 bp, P. troglodytes
acttgaaggtcaggag

SEQ ID NO: 199663 - DNA, 16 bp, P. troglodytes
acttgaatagacattt

SEQ ID NO: 199664 - DNA, 16 bp, P. troglodytes
acttgaatccaggagc

SEQ ID NO: 199665 - DNA, 16 bp, P. troglodytes
acttgaattttttaaa

SEQ ID NO: 199666 - DNA, 16 bp, P. troglodytes
acttgacaaatattta

SEQ ID NO: 199667 - DNA, 16 bp, P. troglodytes
acttgacagaagcatt

SEQ ID NO: 199668 - DNA, 16 bp, P. troglodytes
acttgacctctctggg

SEQ ID NO: 199669 - DNA, 16 bp, P. troglodytes
acttgagaacaggagt

SEQ ID NO: 199670 - DNA, 16 bp, P. troglodytes
acttgagccaagagtt

SEQ ID NO: 199671 - DNA, 16 bp, P. troglodytes
acttgagcccaggaac

SEQ ID NO: 199672 - DNA, 16 bp, P. troglodytes
acttgagccctgaagg

SEQ ID NO: 199673 - DNA, 16 bp, P. troglodytes
acttgagctgggaggt

SEQ ID NO: 199674 - DNA, 16 bp, P. troglodytes
acttgaggccaacagt

SEQ ID NO: 199675 - DNA, 16 bp, P. troglodytes
acttgaggccaggaac

SEQ ID NO: 199676 - DNA, 16 bp, P. troglodytes
acttgataaagaatat

SEQ ID NO: 199677 - DNA, 16 bp, P. troglodytes
acttgataaatatttg

SEQ ID NO: 199678 - DNA, 16 bp, P. troglodytes
acttgataaatatttt

SEQ ID NO: 199679 - DNA, 16 bp, P. troglodytes
acttgatattatttca

SEQ ID NO: 199680 - DNA, 17 bp, P. troglodytes
acttgatcttggtggat

SEQ ID NO: 199681 - DNA, 16 bp, P. troglodytes
acttgattctgtactc

SEQ ID NO: 199682 - DNA, 16 bp, P. troglodytes
acttgcacatatatgc

SEQ ID NO: 199683 - DNA, 16 bp, P. troglodytes
acttgcatggggcctg

SEQ ID NO: 199684 - DNA, 16 bp, P. troglodytes
acttgcccaagctcac

SEQ ID NO: 199685 - DNA, 16 bp, P. troglodytes
acttgcccaaggtcat

SEQ ID NO: 199686 - DNA, 16 bp, P. troglodytes
acttgcccagggtcac

SEQ ID NO: 199687 - DNA, 16 bp, P. troglodytes
acttgcccgaggtcac

SEQ ID NO: 199688 - DNA, 16 bp, P. troglodytes
acttgcctgaggctgt

SEQ ID NO: 199689 - DNA, 16 bp, P. troglodytes
acttgcggccaggagt

SEQ ID NO: 199690 - DNA, 16 bp, P. troglodytes
acttgctcaagggcac

SEQ ID NO: 199691 - DNA, 16 bp, P. troglodytes
acttgctcaagttcac

SEQ ID NO: 199692 - DNA, 16 bp, P. troglodytes
acttgctctgggggaa

SEQ ID NO: 199693 - DNA, 29 bp, P. troglodytes
acttgctttatgaatctgggtgctcctgt

SEQ ID NO: 199694 - DNA, 16 bp, P. troglodytes
acttggaaaggaacaa

SEQ ID NO: 199695 - DNA, 16 bp, P. troglodytes
acttggaaattaaaca

SEQ ID NO: 199696 - DNA, 16 bp, P. troglodytes
acttggaagaaggcca

SEQ ID NO: 199697 - DNA, 16 bp, P. troglodytes
acttggacccaggagt

SEQ ID NO: 199698 - DNA, 16 bp, P. troglodytes
acttggactggctctc

SEQ ID NO: 199699 - DNA, 21 bp, P. troglodytes
acttggagaacttttctgtct

SEQ ID NO: 199700 - DNA, 16 bp, P. troglodytes
acttggccaaagtcac

SEQ ID NO: 199701 - DNA, 16 bp, P. troglodytes
acttggcccctgccac

SEQ ID NO: 199702 - DNA, 16 bp, P. troglodytes
acttgggaagcacaag

SEQ ID NO: 199703 - DNA, 16 bp, P. troglodytes
acttgggaaggtgagg

SEQ ID NO: 199704 - DNA, 16 bp, P. troglodytes
acttgggaggctgagc

SEQ ID NO: 199705 - DNA, 16 bp, P. troglodytes
acttgggcaagttact

SEQ ID NO: 199706 - DNA, 16 bp, P. troglodytes
acttgggcccaggagt

SEQ ID NO: 199707 - DNA, 16 bp, P. troglodytes
acttggggaaaaaaaa

SEQ ID NO: 199708 - DNA, 16 bp, P. troglodytes
acttggtagcttaaaa

SEQ ID NO: 199709 - DNA, 16 bp, P. troglodytes
acttggtcatggtgga

SEQ ID NO: 199710 - DNA, 16 bp, P. troglodytes
acttggtggctcacac

SEQ ID NO: 199711 - DNA, 16 bp, P. troglodytes
acttgtaattccagca

SEQ ID NO: 199712 - DNA, 16 bp, P. troglodytes
acttgtacatatttat

SEQ ID NO: 199713 - DNA, 16 bp, P. troglodytes
acttgtacattgaaaa

SEQ ID NO: 199714 - DNA, 16 bp, P. troglodytes
acttgtaccccctaaa

SEQ ID NO: 199715 - DNA, 16 bp, P. troglodytes
acttgtagtcttttat

SEQ ID NO: 199716 - DNA, 16 bp, P. troglodytes
acttgtatgccttctt

SEQ ID NO: 199717 - DNA, 16 bp, P. troglodytes
acttgtccaaggccat

SEQ ID NO: 199718 - DNA, 16 bp, P. troglodytes
acttgtccaaggtcac

SEQ ID NO: 199719 - DNA, 16 bp, P. troglodytes
acttgtccaaggtctc

SEQ ID NO: 199720 - DNA, 16 bp, P. troglodytes
acttgtctaaagtcac

SEQ ID NO: 199721 - DNA, 16 bp, P. troglodytes
acttgtctaaggtcac

SEQ ID NO: 199722 - DNA, 16 bp, P. troglodytes
acttgtctcttaaaaa

SEQ ID NO: 199723 - DNA, 16 bp, P. troglodytes
acttgtctttttgtga

SEQ ID NO: 199724 - DNA, 16 bp, P. troglodytes
acttgtgaagttcaca

SEQ ID NO: 199725 - DNA, 16 bp, P. troglodytes
acttgtgcttttggtg

SEQ ID NO: 199726 - DNA, 16 bp, P. troglodytes
acttgtggaactttga

SEQ ID NO: 199727 - DNA, 16 bp, P. troglodytes
acttgtgtatgttaaa

SEQ ID NO: 199728 - DNA, 16 bp, P. troglodytes
acttgtgtccttataa

SEQ ID NO: 199729 - DNA, 16 bp, P. troglodytes
acttgttagaaatgca

SEQ ID NO: 199730 - DNA, 16 bp, P. troglodytes
acttgttatctcttgt

SEQ ID NO: 199731 - DNA, 16 bp, P. troglodytes
acttgttattatctga

SEQ ID NO: 199732 - DNA, 16 bp, P. troglodytes
acttgttttatgaatt

SEQ ID NO: 199733 - DNA, 16 bp, P. troglodytes
acttgtttttataaat

SEQ ID NO: 199734 - DNA, 16 bp, P. troglodytes
acttgttttttaaaaa

SEQ ID NO: 199735 - DNA, 16 bp, P. troglodytes
actttaaaaaaatgta

SEQ ID NO: 199736 - DNA, 16 bp, P. troglodytes
actttaaaaaatgtat

SEQ ID NO: 199737 - DNA, 16 bp, P. troglodytes
actttaaaaagattaa

SEQ ID NO: 199738 - DNA, 16 bp, P. troglodytes
actttaaaaagtgaaa

SEQ ID NO: 199739 - DNA, 16 bp, P. troglodytes
actttaaaaataaagt

SEQ ID NO: 199740 - DNA, 16 bp, P. troglodytes
actttaaaaatctttg

SEQ ID NO: 199741 - DNA, 16 bp, P. troglodytes
actttaaaaatctttt

SEQ ID NO: 199742 - DNA, 16 bp, P. troglodytes
actttaaaagaaaata

SEQ ID NO: 199743 - DNA, 16 bp, P. troglodytes
actttaaaatcatttt

SEQ ID NO: 199744 - DNA, 16 bp, P. troglodytes
actttaaaattttgtt

SEQ ID NO: 199745 - DNA, 16 bp, P. troglodytes
actttaaagttttagg

SEQ ID NO: 199746 - DNA, 16 bp, P. troglodytes
actttaaatacaaaga

SEQ ID NO: 199747 - DNA, 16 bp, P. troglodytes
actttaaatatgaaga

SEQ ID NO: 199748 - DNA, 16 bp, P. troglodytes
actttaaatatttatc

SEQ ID NO: 199749 - DNA, 16 bp, P. troglodytes
actttaaatgtaaaaa

SEQ ID NO: 199750 - DNA, 16 bp, P. troglodytes
actttaacactccact

SEQ ID NO: 199751 - DNA, 16 bp, P. troglodytes
actttaagaaaaagaa

SEQ ID NO: 199752 - DNA, 16 bp, P. troglodytes
actttaagcaaaatga

SEQ ID NO: 199753 - DNA, 16 bp, P. troglodytes
actttaagctctgggg

SEQ ID NO: 199754 - DNA, 16 bp, P. troglodytes
actttaagtcatctct

SEQ ID NO: 199755 - DNA, 16 bp, P. troglodytes
actttaagttctgtgg

SEQ ID NO: 199756 - DNA, 16 bp, P. troglodytes
actttacaaaaatatt

SEQ ID NO: 199757 - DNA, 16 bp, P. troglodytes
actttacaaaagaaga

SEQ ID NO: 199758 - DNA, 16 bp, P. troglodytes
actttacacaataaaa

SEQ ID NO: 199759 - DNA, 16 bp, P. troglodytes
actttacagatgagta

SEQ ID NO: 199760 - DNA, 16 bp, P. troglodytes
actttacagtggagaa

SEQ ID NO: 199761 - DNA, 16 bp, P. troglodytes
actttacatgtatttt

SEQ ID NO: 199762 - DNA, 16 bp, P. troglodytes
actttaccaaagaaaa

SEQ ID NO: 199763 - DNA, 16 bp, P. troglodytes
actttacttttaaaat

SEQ ID NO: 199764 - DNA, 16 bp, P. troglodytes
actttagaattgtttt

SEQ ID NO: 199765 - DNA, 16 bp, P. troglodytes
actttagcctgcagtg

SEQ ID NO: 199766 - DNA, 16 bp, P. troglodytes
actttaggattttttt

SEQ ID NO: 199767 - DNA, 16 bp, P. troglodytes
actttagtttttaaaa

SEQ ID NO: 199768 - DNA, 16 bp, P. troglodytes
actttataaatactgt

SEQ ID NO: 199769 - DNA, 16 bp, P. troglodytes
actttataatttacaa

SEQ ID NO: 199770 - DNA, 16 bp, P. troglodytes
actttatatacattat

SEQ ID NO: 199771 - DNA, 16 bp, P. troglodytes
actttatatgcattat

SEQ ID NO: 199772 - DNA, 16 bp, P. troglodytes
actttattaaggtata

SEQ ID NO: 199773 - DNA, 16 bp, P. troglodytes
actttattattagtta

SEQ ID NO: 199774 - DNA, 16 bp, P. troglodytes
actttattcatatttc

SEQ ID NO: 199775 - DNA, 16 bp, P. troglodytes
actttattgacaaaaa

SEQ ID NO: 199776 - DNA, 16 bp, P. troglodytes
actttatttagatttc

SEQ ID NO: 199777 - DNA, 16 bp, P. troglodytes
actttatttctgttat

SEQ ID NO: 199778 - DNA, 16 bp, P. troglodytes
actttattttatgaaa

SEQ ID NO: 199779 - DNA, 16 bp, P. troglodytes
actttatttttttaga

SEQ ID NO: 199780 - DNA, 16 bp, P. troglodytes
actttatttttttgag

SEQ ID NO: 199781 - DNA, 16 bp, P. troglodytes
actttcaaaatattct

SEQ ID NO: 199782 - DNA, 16 bp, P. troglodytes
actttcaaccaacaaa

SEQ ID NO: 199783 - DNA, 16 bp, P. troglodytes
actttcaagattttct

SEQ ID NO: 199784 - DNA, 16 bp, P. troglodytes
actttcagagcactga

SEQ ID NO: 199785 - DNA, 16 bp, P. troglodytes
actttcagtacagtat

SEQ ID NO: 199786 - DNA, 16 bp, P. troglodytes
actttcagtctccaga

SEQ ID NO: 199787 - DNA, 16 bp, P. troglodytes
actttcagtgctaaaa

SEQ ID NO: 199788 - DNA, 16 bp, P. troglodytes
actttcatattttaaa

SEQ ID NO: 199789 - DNA, 16 bp, P. troglodytes
actttcattttaaaag

SEQ ID NO: 199790 - DNA, 16 bp, P. troglodytes
actttcatttttaaaa

SEQ ID NO: 199791 - DNA, 16 bp, P. troglodytes
actttccaacactccc

SEQ ID NO: 199792 - DNA, 16 bp, P. troglodytes
actttccaacctccag

SEQ ID NO: 199793 - DNA, 16 bp, P. troglodytes
actttcctatatacca

SEQ ID NO: 199794 - DNA, 16 bp, P. troglodytes
actttcctgcctcagc

SEQ ID NO: 199795 - DNA, 17 bp, P. troglodytes
actttcctggtggtgtt

SEQ ID NO: 199796 - DNA, 16 bp, P. troglodytes
actttcctttccctca

SEQ ID NO: 199797 - DNA, 16 bp, P. troglodytes
actttctaaataaact

SEQ ID NO: 199798 - DNA, 16 bp, P. troglodytes
actttctacccctatc

SEQ ID NO: 199799 - DNA, 16 bp, P. troglodytes
actttctcaaggtcac

SEQ ID NO: 199800 - DNA, 16 bp, P. troglodytes
actttctcccactctg

SEQ ID NO: 199801 - DNA, 16 bp, P. troglodytes
actttctgagcctcag

SEQ ID NO: 199802 - DNA, 16 bp, P. troglodytes
actttctgatttcaaa

SEQ ID NO: 199803 - DNA, 16 bp, P. troglodytes
actttctgtctttata

SEQ ID NO: 199804 - DNA, 16 bp, P. troglodytes
actttctgtgtgccag

SEQ ID NO: 199805 - DNA, 16 bp, P. troglodytes
actttctgtttctaag

SEQ ID NO: 199806 - DNA, 16 bp, P. troglodytes
actttcttaaagaaaa

SEQ ID NO: 199807 - DNA, 16 bp, P. troglodytes
actttctttaaaaaat

SEQ ID NO: 199808 - DNA, 16 bp, P. troglodytes
actttgaaaaacaatt

SEQ ID NO: 199809 - DNA, 16 bp, P. troglodytes
actttgaaaatgaaaa

SEQ ID NO: 199810 - DNA, 16 bp, P. troglodytes
actttgaacttgaaag

SEQ ID NO: 199811 - DNA, 16 bp, P. troglodytes
actttgaccaaaatgc

SEQ ID NO: 199812 - DNA, 16 bp, P. troglodytes
actttgagaagccaaa

SEQ ID NO: 199813 - DNA, 16 bp, P. troglodytes
actttgagaatcacta

SEQ ID NO: 199814 - DNA, 16 bp, P. troglodytes
actttgagaggacaag

SEQ ID NO: 199815 - DNA, 16 bp, P. troglodytes
actttgagcctgtggg

SEQ ID NO: 199816 - DNA, 16 bp, P. troglodytes
actttgagtagcaaga

SEQ ID NO: 199817 - DNA, 16 bp, P. troglodytes
actttgataaaattca

SEQ ID NO: 199818 - DNA, 16 bp, P. troglodytes
actttgatatttaaaa

SEQ ID NO: 199819 - DNA, 16 bp, P. troglodytes
actttgatttttaaaa

SEQ ID NO: 199820 - DNA, 16 bp, P. troglodytes
actttgatttttctct

SEQ ID NO: 199821 - DNA, 16 bp, P. troglodytes
actttgatttttttaa

SEQ ID NO: 199822 - DNA, 16 bp, P. troglodytes
actttgcaaacattta

SEQ ID NO: 199823 - DNA, 16 bp, P. troglodytes
actttgcctgtaacct

SEQ ID NO: 199824 - DNA, 16 bp, P. troglodytes
actttgcttggaagga

SEQ ID NO: 199825 - DNA, 16 bp, P. troglodytes
actttgcttttaattt

SEQ ID NO: 199826 - DNA, 16 bp, P. troglodytes
actttggaaacaaaag

SEQ ID NO: 199827 - DNA, 16 bp, P. troglodytes
actttggaaagccaag

SEQ ID NO: 199828 - DNA, 16 bp, P. troglodytes
actttggaagacagag

SEQ ID NO: 199829 - DNA, 16 bp, P. troglodytes
actttggagattctaa

SEQ ID NO: 199830 - DNA, 16 bp, P. troglodytes
actttggaggcagaag

SEQ ID NO: 199831 - DNA, 16 bp, P. troglodytes
actttggcttttgttg

SEQ ID NO: 199832 - DNA, 16 bp, P. troglodytes
actttgggaaaaaaaa

SEQ ID NO: 199833 - DNA, 16 bp, P. troglodytes
actttgggaagctggg

SEQ ID NO: 199834 - DNA, 16 bp, P. troglodytes
actttgggagactgaa

SEQ ID NO: 199835 - DNA, 16 bp, P. troglodytes
actttgggaggccgaa

SEQ ID NO: 199836 - DNA, 16 bp, P. troglodytes
actttgggaggttgag

SEQ ID NO: 199837 - DNA, 16 bp, P. troglodytes
actttgggatgtcaag

SEQ ID NO: 199838 - DNA, 16 bp, P. troglodytes
actttggggaaaaaaa

SEQ ID NO: 199839 - DNA, 16 bp, P. troglodytes
actttggggactgtgg

SEQ ID NO: 199840 - DNA, 16 bp, P. troglodytes
actttggggacttgag

SEQ ID NO: 199841 - DNA, 16 bp, P. troglodytes
actttgggggaaaaaa

SEQ ID NO: 199842 - DNA, 16 bp, P. troglodytes
actttgggtaataatg

SEQ ID NO: 199843 - DNA, 16 bp, P. troglodytes
actttggtaggccaag

SEQ ID NO: 199844 - DNA, 16 bp, P. troglodytes
actttggtctttgatg

SEQ ID NO: 199845 - DNA, 16 bp, P. troglodytes
actttggttttgattt

SEQ ID NO: 199846 - DNA, 16 bp, P. troglodytes
actttgtatcaaaaaa

SEQ ID NO: 199847 - DNA, 16 bp, P. troglodytes
actttgtatctttcaa

SEQ ID NO: 199848 - DNA, 16 bp, P. troglodytes
actttgtcaaatatca

SEQ ID NO: 199849 - DNA, 16 bp, P. troglodytes
actttgtcaccaccag

SEQ ID NO: 199850 - DNA, 16 bp, P. troglodytes
actttgtgagaaccaa

SEQ ID NO: 199851 - DNA, 21 bp, P. troglodytes
actttgttgcccaggctggag

SEQ ID NO: 199852 - DNA, 16 bp, P. troglodytes
actttgtttctcccaa

SEQ ID NO: 199853 - DNA, 16 bp, P. troglodytes
actttgttttaaaata

SEQ ID NO: 199854 - DNA, 16 bp, P. troglodytes
actttgtttttaaaat

SEQ ID NO: 199855 - DNA, 16 bp, P. troglodytes
acttttaaaaaatact

SEQ ID NO: 199856 - DNA, 16 bp, P. troglodytes
acttttaaaaagattt

SEQ ID NO: 199857 - DNA, 16 bp, P. troglodytes
acttttaaaaatatgt

SEQ ID NO: 199858 - DNA, 16 bp, P. troglodytes
acttttaaaaatgtaa

SEQ ID NO: 199859 - DNA, 16 bp, P. troglodytes
acttttaaaaattgtt

SEQ ID NO: 199860 - DNA, 16 bp, P. troglodytes
acttttaaaacatgta

SEQ ID NO: 199861 - DNA, 16 bp, P. troglodytes
acttttaaaagatttt

SEQ ID NO: 199862 - DNA, 16 bp, P. troglodytes
acttttaaaagctttt

SEQ ID NO: 199863 - DNA, 16 bp, P. troglodytes
acttttaaaataaatg

SEQ ID NO: 199864 - DNA, 16 bp, P. troglodytes
acttttaaaatgtatt

SEQ ID NO: 199865 - DNA, 16 bp, P. troglodytes
acttttaaagtaattt

SEQ ID NO: 199866 - DNA, 16 bp, P. troglodytes
acttttaaattataca

SEQ ID NO: 199867 - DNA, 16 bp, P. troglodytes
acttttaactctagta

SEQ ID NO: 199868 - DNA, 16 bp, P. troglodytes
acttttaatagcaaaa

SEQ ID NO: 199869 - DNA, 16 bp, P. troglodytes
acttttaattttggaa

SEQ ID NO: 199870 - DNA, 16 bp, P. troglodytes
acttttacatgaatgt

SEQ ID NO: 199871 - DNA, 16 bp, P. troglodytes
acttttacattgttgg

SEQ ID NO: 199872 - DNA, 19 bp, P. troglodytes
acttttaccaagcatactg

SEQ ID NO: 199873 - DNA, 16 bp, P. troglodytes
acttttaccactttta

SEQ ID NO: 199874 - DNA, 16 bp, P. troglodytes
acttttaggatccttt

SEQ ID NO: 199875 - DNA, 16 bp, P. troglodytes
acttttagttttgttg

SEQ ID NO: 199876 - DNA, 16 bp, P. troglodytes
acttttataatgaaaa

SEQ ID NO: 199877 - DNA, 16 bp, P. troglodytes
acttttatgtaacaaa

SEQ ID NO: 199878 - DNA, 16 bp, P. troglodytes
acttttatgttataaa

SEQ ID NO: 199879 - DNA, 16 bp, P. troglodytes
acttttattatttcca

SEQ ID NO: 199880 - DNA, 16 bp, P. troglodytes
acttttattcaaaata

SEQ ID NO: 199881 - DNA, 16 bp, P. troglodytes
acttttatttctgaaa

SEQ ID NO: 199882 - DNA, 16 bp, P. troglodytes
acttttatttgaaata

SEQ ID NO: 199883 - DNA, 16 bp, P. troglodytes
acttttcaaaagaaga

SEQ ID NO: 199884 - DNA, 16 bp, P. troglodytes
acttttcaaaattaaa

SEQ ID NO: 199885 - DNA, 16 bp, P. troglodytes
acttttcaaagggaat

SEQ ID NO: 199886 - DNA, 16 bp, P. troglodytes
acttttcaaataaaat

SEQ ID NO: 199887 - DNA, 16 bp, P. troglodytes
acttttcaaatgaaaa

SEQ ID NO: 199888 - DNA, 16 bp, P. troglodytes
acttttcagatgagga

SEQ ID NO: 199889 - DNA, 16 bp, P. troglodytes
acttttcatgtttctt

SEQ ID NO: 199890 - DNA, 16 bp, P. troglodytes
acttttcccttaaaaa

SEQ ID NO: 199891 - DNA, 16 bp, P. troglodytes
acttttctaaattaaa

SEQ ID NO: 199892 - DNA, 16 bp, P. troglodytes
acttttctagattcca

SEQ ID NO: 199893 - DNA, 16 bp, P. troglodytes
acttttctatttttag

SEQ ID NO: 199894 - DNA, 16 bp, P. troglodytes
acttttctctctggct

SEQ ID NO: 199895 - DNA, 16 bp, P. troglodytes
acttttctctgcttct

SEQ ID NO: 199896 - DNA, 16 bp, P. troglodytes
acttttctcttttaaa

SEQ ID NO: 199897 - DNA, 16 bp, P. troglodytes
acttttctgacaaaat

SEQ ID NO: 199898 - DNA, 16 bp, P. troglodytes
acttttctgggcctca

SEQ ID NO: 199899 - DNA, 16 bp, P. troglodytes
acttttctgtaagttt

SEQ ID NO: 199900 - DNA, 16 bp, P. troglodytes
acttttgaaaacaaaa

SEQ ID NO: 199901 - DNA, 16 bp, P. troglodytes
acttttgaaataaaat

SEQ ID NO: 199902 - DNA, 16 bp, P. troglodytes
acttttgaagtttttt

SEQ ID NO: 199903 - DNA, 16 bp, P. troglodytes
acttttgaatggggtt

SEQ ID NO: 199904 - DNA, 16 bp, P. troglodytes
acttttgataaaattc

SEQ ID NO: 199905 - DNA, 16 bp, P. troglodytes
acttttgattcagcag

SEQ ID NO: 199906 - DNA, 16 bp, P. troglodytes
acttttgcaaatttta

SEQ ID NO: 199907 - DNA, 16 bp, P. troglodytes
acttttgctccaagaa

SEQ ID NO: 199908 - DNA, 16 bp, P. troglodytes
acttttggaggcccag

SEQ ID NO: 199909 - DNA, 16 bp, P. troglodytes
acttttggaggccgag

SEQ ID NO: 199910 - DNA, 16 bp, P. troglodytes
acttttggctgggcat

SEQ ID NO: 199911 - DNA, 16 bp, P. troglodytes
acttttgggtaaataa

SEQ ID NO: 199912 - DNA, 16 bp, P. troglodytes
acttttgtaattttag

SEQ ID NO: 199913 - DNA, 16 bp, P. troglodytes
acttttgtcagatgca

SEQ ID NO: 199914 - DNA, 16 bp, P. troglodytes
acttttgtgtatgttt

SEQ ID NO: 199915 - DNA, 16 bp, P. troglodytes
actttttaaaaaactt

SEQ ID NO: 199916 - DNA, 16 bp, P. troglodytes
actttttaaaaaatca

SEQ ID NO: 199917 - DNA, 16 bp, P. troglodytes
actttttaaaaacttt

SEQ ID NO: 199918 - DNA, 16 bp, P. troglodytes
actttttaaaaagata

SEQ ID NO: 199919 - DNA, 16 bp, P. troglodytes
actttttaaaaattca

SEQ ID NO: 199920 - DNA, 16 bp, P. troglodytes
actttttaaaaatttc

SEQ ID NO: 199921 - DNA, 16 bp, P. troglodytes
actttttaaaagaaat

SEQ ID NO: 199922 - DNA, 16 bp, P. troglodytes
actttttaaaagaaga

SEQ ID NO: 199923 - DNA, 16 bp, P. troglodytes
actttttaaaagtttt

SEQ ID NO: 199924 - DNA, 16 bp, P. troglodytes
actttttaaaatgcta

SEQ ID NO: 199925 - DNA, 16 bp, P. troglodytes
actttttaaaattgtt

SEQ ID NO: 199926 - DNA, 16 bp, P. troglodytes
actttttaagaaactg

SEQ ID NO: 199927 - DNA, 16 bp, P. troglodytes
actttttaagacatag

SEQ ID NO: 199928 - DNA, 16 bp, P. troglodytes
actttttaataaaaac

SEQ ID NO: 199929 - DNA, 16 bp, P. troglodytes
actttttaatgagatt

SEQ ID NO: 199930 - DNA, 16 bp, P. troglodytes
actttttagtaacagc

SEQ ID NO: 199931 - DNA, 16 bp, P. troglodytes
actttttatccaattt

SEQ ID NO: 199932 - DNA, 16 bp, P. troglodytes
actttttatttatcca

SEQ ID NO: 199933 - DNA, 16 bp, P. troglodytes
actttttattttgaga

SEQ ID NO: 199934 - DNA, 16 bp, P. troglodytes
actttttcatcattcc

SEQ ID NO: 199935 - DNA, 16 bp, P. troglodytes
actttttcatgtttct

SEQ ID NO: 199936 - DNA, 16 bp, P. troglodytes
actttttcctttctaa

SEQ ID NO: 199937 - DNA, 16 bp, P. troglodytes
actttttcttttgaga

SEQ ID NO: 199938 - DNA, 16 bp, P. troglodytes
actttttgaaaaatat

SEQ ID NO: 199939 - DNA, 16 bp, P. troglodytes
actttttgagcaccaa

SEQ ID NO: 199940 - DNA, 16 bp, P. troglodytes
actttttgatggaatt

SEQ ID NO: 199941 - DNA, 16 bp, P. troglodytes
actttttgatgtgatt

SEQ ID NO: 199942 - DNA, 16 bp, P. troglodytes
actttttggaaaaaaa

SEQ ID NO: 199943 - DNA, 16 bp, P. troglodytes
actttttggattttta

SEQ ID NO: 199944 - DNA, 16 bp, P. troglodytes
actttttgtacccatt

SEQ ID NO: 199945 - DNA, 16 bp, P. troglodytes
actttttgtactttta

SEQ ID NO: 199946 - DNA, 16 bp, P. troglodytes
actttttgtagaaaca

SEQ ID NO: 199947 - DNA, 16 bp, P. troglodytes
actttttgtagagaca

SEQ ID NO: 199948 - DNA, 16 bp, P. troglodytes
actttttgttttaata

SEQ ID NO: 199949 - DNA, 16 bp, P. troglodytes
acttttttaaaaagtt

SEQ ID NO: 199950 - DNA, 16 bp, P. troglodytes
acttttttaaaagaaa

SEQ ID NO: 199951 - DNA, 16 bp, P. troglodytes
acttttttagagacag

SEQ ID NO: 199952 - DNA, 16 bp, P. troglodytes
acttttttccaaagtg

SEQ ID NO: 199953 - DNA, 16 bp, P. troglodytes
acttttttccttaaaa

SEQ ID NO: 199954 - DNA, 16 bp, P. troglodytes
acttttttcttaaaaa

SEQ ID NO: 199955 - DNA, 16 bp, P. troglodytes
actttttttaaaaagt

SEQ ID NO: 199956 - DNA, 16 bp, P. troglodytes
actttttttaaaatgt

SEQ ID NO: 199957 - DNA, 16 bp, P. troglodytes
actttttttggttgat

SEQ ID NO: 199958 - DNA, 16 bp, P. troglodytes
actttttttgtagaat

SEQ ID NO: 199959 - DNA, 16 bp, P. troglodytes
actttttttgtgtgtg

SEQ ID NO: 199960 - DNA, 16 bp, P. troglodytes
acttttttttaaagga

SEQ ID NO: 199961 - DNA, 16 bp, P. troglodytes
actttttttttgagac

SEQ ID NO: 199962 - DNA, 16 bp, P. troglodytes
acttttttttttgagg

SEQ ID NO: 199963 - DNA, 16 bp, P. troglodytes
agaaaaaaaaactgct

SEQ ID NO: 199964 - DNA, 16 bp, P. troglodytes
agaaaaaaaaagtttc

SEQ ID NO: 199965 - DNA, 16 bp, P. troglodytes
agaaaaaaaacacttt

SEQ ID NO: 199966 - DNA, 16 bp, P. troglodytes
agaaaaaaaacccatc

SEQ ID NO: 199967 - DNA, 16 bp, P. troglodytes
agaaaaaaaaccttca

SEQ ID NO: 199968 - DNA, 16 bp, P. troglodytes
agaaaaaaaagattcc

SEQ ID NO: 199969 - DNA, 16 bp, P. troglodytes
agaaaaaaaatcaccc

SEQ ID NO: 199970 - DNA, 16 bp, P. troglodytes
agaaaaaaaatctcca

SEQ ID NO: 199971 - DNA, 16 bp, P. troglodytes
agaaaaaaaatctgtt

SEQ ID NO: 199972 - DNA, 16 bp, P. troglodytes
agaaaaaaaatgttct

SEQ ID NO: 199973 - DNA, 16 bp, P. troglodytes
agaaaaaaaattgctt

SEQ ID NO: 199974 - DNA, 16 bp, P. troglodytes
agaaaaaaacaagttt

SEQ ID NO: 199975 - DNA, 16 bp, P. troglodytes
agaaaaaaacaatttc

SEQ ID NO: 199976 - DNA, 16 bp, P. troglodytes
agaaaaaaacacattt

SEQ ID NO: 199977 - DNA, 16 bp, P. troglodytes
agaaaaaaacattttt

SEQ ID NO: 199978 - DNA, 16 bp, P. troglodytes
agaaaaaaacctggaa

SEQ ID NO: 199979 - DNA, 16 bp, P. troglodytes
agaaaaaaagaattct

SEQ ID NO: 199980 - DNA, 16 bp, P. troglodytes
agaaaaaaagcatttt

SEQ ID NO: 199981 - DNA, 16 bp, P. troglodytes
agaaaaaaataatcct

SEQ ID NO: 199982 - DNA, 16 bp, P. troglodytes
agaaaaaaatattcca

SEQ ID NO: 199983 - DNA, 16 bp, P. troglodytes
agaaaaaaatcagcat

SEQ ID NO: 199984 - DNA, 16 bp, P. troglodytes
agaaaaaaatcagttg

SEQ ID NO: 199985 - DNA, 16 bp, P. troglodytes
agaaaaaaatcctgaa

SEQ ID NO: 199986 - DNA, 16 bp, P. troglodytes
agaaaaaaatctgatt

SEQ ID NO: 199987 - DNA, 16 bp, P. troglodytes
agaaaaaaatgaagct

SEQ ID NO: 199988 - DNA, 16 bp, P. troglodytes
agaaaaaaatgcaatt

SEQ ID NO: 199989 - DNA, 16 bp, P. troglodytes
agaaaaaaatgcttta

SEQ ID NO: 199990 - DNA, 16 bp, P. troglodytes
agaaaaaaatggattt

SEQ ID NO: 199991 - DNA, 16 bp, P. troglodytes
agaaaaaaatgtgatt

SEQ ID NO: 199992 - DNA, 16 bp, P. troglodytes
agaaaaaaatgtgttt

SEQ ID NO: 199993 - DNA, 16 bp, P. troglodytes
agaaaaaaatgtttct

SEQ ID NO: 199994 - DNA, 16 bp, P. troglodytes
agaaaaaaattggcaa

SEQ ID NO: 199995 - DNA, 16 bp, P. troglodytes
agaaaaaaatttctct

SEQ ID NO: 199996 - DNA, 16 bp, P. troglodytes
agaaaaaacaattttt

SEQ ID NO: 199997 - DNA, 16 bp, P. troglodytes
agaaaaaacacttttt

SEQ ID NO: 199998 - DNA, 16 bp, P. troglodytes
agaaaaaactaattta

SEQ ID NO: 199999 - DNA, 16 bp, P. troglodytes
agaaaaaactattcta

SEQ ID NO: 200000 - DNA, 16 bp, P. troglodytes
agaaaaaactggaaac

SEQ ID NO: 200001 - DNA, 16 bp, P. troglodytes
agaaaaaacttttaaa

SEQ ID NO: 200002 - DNA, 16 bp, P. troglodytes
agaaaaaagaaacttg

SEQ ID NO: 200003 - DNA, 16 bp, P. troglodytes
agaaaaaagaaatcct

SEQ ID NO: 200004 - DNA, 16 bp, P. troglodytes
agaaaaaagaacttca

SEQ ID NO: 200005 - DNA, 16 bp, P. troglodytes
agaaaaaagatttctt

SEQ ID NO: 200006 - DNA, 16 bp, P. troglodytes
agaaaaaagctggagg

SEQ ID NO: 200007 - DNA, 16 bp, P. troglodytes
agaaaaaataaccatt

SEQ ID NO: 200008 - DNA, 16 bp, P. troglodytes
agaaaaaatacaattt

SEQ ID NO: 200009 - DNA, 16 bp, P. troglodytes
agaaaaaatactttca

SEQ ID NO: 200010 - DNA, 16 bp, P. troglodytes
agaaaaaatcttgaaa

SEQ ID NO: 200011 - DNA, 16 bp, P. troglodytes
agaaaaaatgatttca

SEQ ID NO: 200012 - DNA, 16 bp, P. troglodytes
agaaaaacaaacactg

SEQ ID NO: 200013 - DNA, 16 bp, P. troglodytes
agaaaaacaaccccat

SEQ ID NO: 200014 - DNA, 16 bp, P. troglodytes
agaaaaacaagctcag

SEQ ID NO: 200015 - DNA, 16 bp, P. troglodytes
agaaaaacaatatttt

SEQ ID NO: 200016 - DNA, 16 bp, P. troglodytes
agaaaaacaattattt

SEQ ID NO: 200017 - DNA, 16 bp, P. troglodytes
agaaaaacaatttcaa

SEQ ID NO: 200018 - DNA, 16 bp, P. troglodytes
agaaaaacatgaaatt

SEQ ID NO: 200019 - DNA, 16 bp, P. troglodytes
agaaaaacatttcaga

SEQ ID NO: 200020 - DNA, 16 bp, P. troglodytes
agaaaaacatttttaa

SEQ ID NO: 200021 - DNA, 16 bp, P. troglodytes
agaaaaaccagaaact

SEQ ID NO: 200022 - DNA, 16 bp, P. troglodytes
agaaaaactcagaaat

SEQ ID NO: 200023 - DNA, 16 bp, P. troglodytes
agaaaaactctgtctc

SEQ ID NO: 200024 - DNA, 16 bp, P. troglodytes
agaaaaactggaagct

SEQ ID NO: 200025 - DNA, 16 bp, P. troglodytes
agaaaaactgggaaaa

SEQ ID NO: 200026 - DNA, 16 bp, P. troglodytes
agaaaaacttcagaca

SEQ ID NO: 200027 - DNA, 16 bp, P. troglodytes
agaaaaactttcaaaa

SEQ ID NO: 200028 - DNA, 16 bp, P. troglodytes
agaaaaactttgaaaa

SEQ ID NO: 200029 - DNA, 16 bp, P. troglodytes
agaaaaactttttttt

SEQ ID NO: 200030 - DNA, 16 bp, P. troglodytes
agaaaaagaaaactct

SEQ ID NO: 200031 - DNA, 16 bp, P. troglodytes
agaaaaagaaaagctg

SEQ ID NO: 200032 - DNA, 16 bp, P. troglodytes
agaaaaagaaaattcc

SEQ ID NO: 200033 - DNA, 16 bp, P. troglodytes
agaaaaagaaactctt

SEQ ID NO: 200034 - DNA, 16 bp, P. troglodytes
agaaaaagaaatgctt

SEQ ID NO: 200035 - DNA, 16 bp, P. troglodytes
agaaaaagaaattgct

SEQ ID NO: 200036 - DNA, 16 bp, P. troglodytes
agaaaaagaaatttca

SEQ ID NO: 200037 - DNA, 16 bp, P. troglodytes
agaaaaagaacatttt

SEQ ID NO: 200038 - DNA, 16 bp, P. troglodytes
agaaaaagaaggaatc

SEQ ID NO: 200039 - DNA, 16 bp, P. troglodytes
agaaaaagacacatca

SEQ ID NO: 200040 - DNA, 16 bp, P. troglodytes
agaaaaagagaaagct

SEQ ID NO: 200041 - DNA, 16 bp, P. troglodytes
agaaaaagagaatttg

SEQ ID NO: 200042 - DNA, 16 bp, P. troglodytes
agaaaaagaggaaatc

SEQ ID NO: 200043 - DNA, 32 bp, P. troglodytes
agaaaaagagggaatcctccctaactcatttg

SEQ ID NO: 200044 - DNA, 16 bp, P. troglodytes
agaaaaagagggagtc

SEQ ID NO: 200045 - DNA, 16 bp, P. troglodytes
agaaaaagaggtttta

SEQ ID NO: 200046 - DNA, 16 bp, P. troglodytes
agaaaaagatatccca

SEQ ID NO: 200047 - DNA, 16 bp, P. troglodytes
agaaaaagatgatttt

SEQ ID NO: 200048 - DNA, 16 bp, P. troglodytes
agaaaaagattccttt

SEQ ID NO: 200049 - DNA, 16 bp, P. troglodytes
agaaaaagcaaagtca

SEQ ID NO: 200050 - DNA, 16 bp, P. troglodytes
agaaaaagcattcaac

SEQ ID NO: 200051 - DNA, 16 bp, P. troglodytes
agaaaaagctgaattg

SEQ ID NO: 200052 - DNA, 16 bp, P. troglodytes
agaaaaagcttgctga

SEQ ID NO: 200053 - DNA, 16 bp, P. troglodytes
agaaaaaggaaacatt

SEQ ID NO: 200054 - DNA, 16 bp, P. troglodytes
agaaaaaggaatgctt

SEQ ID NO: 200055 - DNA, 16 bp, P. troglodytes
agaaaaagtaaacttt

SEQ ID NO: 200056 - DNA, 16 bp, P. troglodytes
agaaaaagttaaattg

SEQ ID NO: 200057 - DNA, 16 bp, P. troglodytes
agaaaaagttatttat

SEQ ID NO: 200058 - DNA, 16 bp, P. troglodytes
agaaaaagtttaattg

SEQ ID NO: 200059 - DNA, 16 bp, P. troglodytes
agaaaaataaactgtt

SEQ ID NO: 200060 - DNA, 16 bp, P. troglodytes
agaaaaataaagcagt

SEQ ID NO: 200061 - DNA, 16 bp, P. troglodytes
agaaaaataaattcat

SEQ ID NO: 200062 - DNA, 16 bp, P. troglodytes
agaaaaataacttcaa

SEQ ID NO: 200063 - DNA, 16 bp, P. troglodytes
agaaaaatacatttga

SEQ ID NO: 200064 - DNA, 16 bp, P. troglodytes
agaaaaatactttttt

SEQ ID NO: 200065 - DNA, 16 bp, P. troglodytes
agaaaaataggcaaat

SEQ ID NO: 200066 - DNA, 16 bp, P. troglodytes
agaaaaatatcaacat

SEQ ID NO: 200067 - DNA, 16 bp, P. troglodytes
agaaaaatatcagaga

SEQ ID NO: 200068 - DNA, 16 bp, P. troglodytes
agaaaaatatctattt

SEQ ID NO: 200069 - DNA, 16 bp, P. troglodytes
agaaaaatatctgtaa

SEQ ID NO: 200070 - DNA, 16 bp, P. troglodytes
agaaaaatatttcatg

SEQ ID NO: 200071 - DNA, 16 bp, P. troglodytes
agaaaaatatttctaa

SEQ ID NO: 200072 - DNA, 16 bp, P. troglodytes
agaaaaatcacatttt

SEQ ID NO: 200073 - DNA, 16 bp, P. troglodytes
agaaaaatctattaaa

SEQ ID NO: 200074 - DNA, 16 bp, P. troglodytes
agaaaaatctatttta

SEQ ID NO: 200075 - DNA, 16 bp, P. troglodytes
agaaaaatctcttgaa

SEQ ID NO: 200076 - DNA, 16 bp, P. troglodytes
agaaaaatctgaacag

SEQ ID NO: 200077 - DNA, 16 bp, P. troglodytes
agaaaaatcttaaaag

SEQ ID NO: 200078 - DNA, 16 bp, P. troglodytes
agaaaaatctttaaaa

SEQ ID NO: 200079 - DNA, 16 bp, P. troglodytes
agaaaaatctttattt

SEQ ID NO: 200080 - DNA, 16 bp, P. troglodytes
agaaaaatctttccaa

SEQ ID NO: 200081 - DNA, 16 bp, P. troglodytes
agaaaaatctttgaat

SEQ ID NO: 200082 - DNA, 16 bp, P. troglodytes
agaaaaatgaaaactt

SEQ ID NO: 200083 - DNA, 16 bp, P. troglodytes
agaaaaatgaaatgtt

SEQ ID NO: 200084 - DNA, 16 bp, P. troglodytes
agaaaaatgaattcat

SEQ ID NO: 200085 - DNA, 16 bp, P. troglodytes
agaaaaatgttcaaaa

SEQ ID NO: 200086 - DNA, 16 bp, P. troglodytes
agaaaaatgttttcag

SEQ ID NO: 200087 - DNA, 16 bp, P. troglodytes
agaaaaattaatcaat

SEQ ID NO: 200088 - DNA, 16 bp, P. troglodytes
agaaaaattacaaatt

SEQ ID NO: 200089 - DNA, 16 bp, P. troglodytes
agaaaaattcaggaaa

SEQ ID NO: 200090 - DNA, 16 bp, P. troglodytes
agaaaaattcattttc

SEQ ID NO: 200091 - DNA, 16 bp, P. troglodytes
agaaaaattctaattt

SEQ ID NO: 200092 - DNA, 16 bp, P. troglodytes
agaaaaattggaaact

SEQ ID NO: 200093 - DNA, 16 bp, P. troglodytes
agaaaaattggcaaaa

SEQ ID NO: 200094 - DNA, 16 bp, P. troglodytes
agaaaaattggtacca

SEQ ID NO: 200095 - DNA, 16 bp, P. troglodytes
agaaaaatttcaaata

SEQ ID NO: 200096 - DNA, 16 bp, P. troglodytes
agaaaacaaaaacttt

SEQ ID NO: 200097 - DNA, 16 bp, P. troglodytes
agaaaacaaaactatt

SEQ ID NO: 200098 - DNA, 16 bp, P. troglodytes
agaaaacaaacatttt

SEQ ID NO: 200099 - DNA, 16 bp, P. troglodytes
agaaaacaaatttctg

SEQ ID NO: 200100 - DNA, 16 bp, P. troglodytes
agaaaacaagattaga

SEQ ID NO: 200101 - DNA, 16 bp, P. troglodytes
agaaaacaagttatct

SEQ ID NO: 200102 - DNA, 16 bp, P. troglodytes
agaaaacacagatgaa

SEQ ID NO: 200103 - DNA, 16 bp, P. troglodytes
agaaaacacattttct

SEQ ID NO: 200104 - DNA, 16 bp, P. troglodytes
agaaaacaccattctg

SEQ ID NO: 200105 - DNA, 16 bp, P. troglodytes
agaaaacactggaaaa

SEQ ID NO: 200106 - DNA, 16 bp, P. troglodytes
agaaaacactggagaa

SEQ ID NO: 200107 - DNA, 16 bp, P. troglodytes
agaaaacactgggaaa

SEQ ID NO: 200108 - DNA, 16 bp, P. troglodytes
agaaaacacttttaaa

SEQ ID NO: 200109 - DNA, 16 bp, P. troglodytes
agaaaacagaatattt

SEQ ID NO: 200110 - DNA, 16 bp, P. troglodytes
agaaaacagatgaaga

SEQ ID NO: 200111 - DNA, 16 bp, P. troglodytes
agaaaacagattcaga

SEQ ID NO: 200112 - DNA, 16 bp, P. troglodytes
agaaaacagattttaa

SEQ ID NO: 200113 - DNA, 16 bp, P. troglodytes
agaaaacagctgggcc

SEQ ID NO: 200114 - DNA, 16 bp, P. troglodytes
agaaaacaggaattag

SEQ ID NO: 200115 - DNA, 16 bp, P. troglodytes
agaaaacagtgtttcc

SEQ ID NO: 200116 - DNA, 16 bp, P. troglodytes
agaaaacagttaacaa

SEQ ID NO: 200117 - DNA, 16 bp, P. troglodytes
agaaaacataggcaaa

SEQ ID NO: 200118 - DNA, 16 bp, P. troglodytes
agaaaacataggcatt

SEQ ID NO: 200119 - DNA, 16 bp, P. troglodytes
agaaaacatcaggcca

SEQ ID NO: 200120 - DNA, 16 bp, P. troglodytes
agaaaacatgaaaatg

SEQ ID NO: 200121 - DNA, 16 bp, P. troglodytes
agaaaacatgaaaatt

SEQ ID NO: 200122 - DNA, 16 bp, P. troglodytes
agaaaacatgagagaa

SEQ ID NO: 200123 - DNA, 16 bp, P. troglodytes
agaaaacatggacaca

SEQ ID NO: 200124 - DNA, 16 bp, P. troglodytes
agaaaacattggggaa

SEQ ID NO: 200125 - DNA, 16 bp, P. troglodytes
agaaaacatttaaaat

SEQ ID NO: 200126 - DNA, 16 bp, P. troglodytes
agaaaacatttccaaa

SEQ ID NO: 200127 - DNA, 16 bp, P. troglodytes
agaaaacatttgccaa

SEQ ID NO: 200128 - DNA, 16 bp, P. troglodytes
agaaaacattttgaaa

SEQ ID NO: 200129 - DNA, 16 bp, P. troglodytes
agaaaacattttggaa

SEQ ID NO: 200130 - DNA, 16 bp, P. troglodytes
agaaaacatttttatt

SEQ ID NO: 200131 - DNA, 16 bp, P. troglodytes
agaaaacattttttaa

SEQ ID NO: 200132 - DNA, 16 bp, P. troglodytes
agaaaaccaaacaatg

SEQ ID NO: 200133 - DNA, 18 bp, P. troglodytes
agaaaaccaaacactgca

SEQ ID NO: 200134 - DNA, 16 bp, P. troglodytes
agaaaaccaaatgccg

SEQ ID NO: 200135 - DNA, 16 bp, P. troglodytes
agaaaaccattttaaa

SEQ ID NO: 200136 - DNA, 16 bp, P. troglodytes
agaaaaccatttttaa

SEQ ID NO: 200137 - DNA, 16 bp, P. troglodytes
agaaaacccaggcaat

SEQ ID NO: 200138 - DNA, 16 bp, P. troglodytes
agaaaaccctaaagaa

SEQ ID NO: 200139 - DNA, 16 bp, P. troglodytes
agaaaacccttcaaaa

SEQ ID NO: 200140 - DNA, 16 bp, P. troglodytes
agaaaacctaagaaat

SEQ ID NO: 200141 - DNA, 16 bp, P. troglodytes
agaaaacctcatcgtc

SEQ ID NO: 200142 - DNA, 16 bp, P. troglodytes
agaaaacctgaagaaa

SEQ ID NO: 200143 - DNA, 16 bp, P. troglodytes
agaaaactacagaaca

SEQ ID NO: 200144 - DNA, 16 bp, P. troglodytes
agaaaactatagacca

SEQ ID NO: 200145 - DNA, 16 bp, P. troglodytes
agaaaactattctaaa

SEQ ID NO: 200146 - DNA, 16 bp, P. troglodytes
agaaaactcaagcagt

SEQ ID NO: 200147 - DNA, 16 bp, P. troglodytes
agaaaactcaaggctg

SEQ ID NO: 200148 - DNA, 16 bp, P. troglodytes
agaaaactgaaacagg

SEQ ID NO: 200149 - DNA, 16 bp, P. troglodytes
agaaaactgaagagaa

SEQ ID NO: 200150 - DNA, 16 bp, P. troglodytes
agaaaactgaagagga

SEQ ID NO: 200151 - DNA, 16 bp, P. troglodytes
agaaaactgacaaaga

SEQ ID NO: 200152 - DNA, 16 bp, P. troglodytes
agaaaactgacaaata

SEQ ID NO: 200153 - DNA, 16 bp, P. troglodytes
agaaaactgagaaaat

SEQ ID NO: 200154 - DNA, 16 bp, P. troglodytes
agaaaactgaggatca

SEQ ID NO: 200155 - DNA, 16 bp, P. troglodytes
agaaaactgaggctca

SEQ ID NO: 200156 - DNA, 16 bp, P. troglodytes
agaaaactgaggcttc

SEQ ID NO: 200157 - DNA, 16 bp, P. troglodytes
agaaaactggaagaaa

SEQ ID NO: 200158 - DNA, 16 bp, P. troglodytes
agaaaactggaataaa

SEQ ID NO: 200159 - DNA, 16 bp, P. troglodytes
agaaaactggggctca

SEQ ID NO: 200160 - DNA, 16 bp, P. troglodytes
agaaaacttaaaatga

SEQ ID NO: 200161 - DNA, 16 bp, P. troglodytes
agaaaacttattcaaa

SEQ ID NO: 200162 - DNA, 16 bp, P. troglodytes
agaaaacttttaaata

SEQ ID NO: 200163 - DNA, 16 bp, P. troglodytes
agaaaacttttatttt

SEQ ID NO: 200164 - DNA, 16 bp, P. troglodytes
agaaaagaaaacactt

SEQ ID NO: 200165 - DNA, 16 bp, P. troglodytes
agaaaagaaaacatct

SEQ ID NO: 200166 - DNA, 16 bp, P. troglodytes
agaaaagaaaacattt

SEQ ID NO: 200167 - DNA, 16 bp, P. troglodytes
agaaaagaaaaccctt

SEQ ID NO: 200168 - DNA, 16 bp, P. troglodytes
agaaaagaaaacctca

SEQ ID NO: 200169 - DNA, 16 bp, P. troglodytes
agaaaagaaaactgat

SEQ ID NO: 200170 - DNA, 16 bp, P. troglodytes
agaaaagaaaactgga

SEQ ID NO: 200171 - DNA, 16 bp, P. troglodytes
agaaaagaaaagatgc

SEQ ID NO: 200172 - DNA, 16 bp, P. troglodytes
agaaaagaaaagctca

SEQ ID NO: 200173 - DNA, 16 bp, P. troglodytes
agaaaagaaaatattc

SEQ ID NO: 200174 - DNA, 16 bp, P. troglodytes
agaaaagaaaatgcag

SEQ ID NO: 200175 - DNA, 16 bp, P. troglodytes
agaaaagaaaatgctg

SEQ ID NO: 200176 - DNA, 16 bp, P. troglodytes
agaaaagaaaatggac

SEQ ID NO: 200177 - DNA, 16 bp, P. troglodytes
agaaaagaaaattcac

SEQ ID NO: 200178 - DNA, 16 bp, P. troglodytes
agaaaagaaaattcat

SEQ ID NO: 200179 - DNA, 16 bp, P. troglodytes
agaaaagaaacatttc

SEQ ID NO: 200180 - DNA, 16 bp, P. troglodytes
agaaaagaaacatttt

SEQ ID NO: 200181 - DNA, 16 bp, P. troglodytes
agaaaagaaagcattt

SEQ ID NO: 200182 - DNA, 16 bp, P. troglodytes
agaaaagaaagttatt

SEQ ID NO: 200183 - DNA, 16 bp, P. troglodytes
agaaaagaaagtttca

SEQ ID NO: 200184 - DNA, 16 bp, P. troglodytes
agaaaagaaatggttt

SEQ ID NO: 200185 - DNA, 16 bp, P. troglodytes
agaaaagaaatttcag

SEQ ID NO: 200186 - DNA, 16 bp, P. troglodytes
agaaaagaatctgaac

SEQ ID NO: 200187 - DNA, 16 bp, P. troglodytes
agaaaagaatgtttta

SEQ ID NO: 200188 - DNA, 16 bp, P. troglodytes
agaaaagacatgaaat

SEQ ID NO: 200189 - DNA, 16 bp, P. troglodytes
agaaaagagacatttt

SEQ ID NO: 200190 - DNA, 16 bp, P. troglodytes
agaaaagagacttaat

SEQ ID NO: 200191 - DNA, 16 bp, P. troglodytes
agaaaagagcaggagt

SEQ ID NO: 200192 - DNA, 16 bp, P. troglodytes
agaaaagaggtttgtt

SEQ ID NO: 200193 - DNA, 16 bp, P. troglodytes
agaaaagataactact

SEQ ID NO: 200194 - DNA, 16 bp, P. troglodytes
agaaaagatatttatt

SEQ ID NO: 200195 - DNA, 16 bp, P. troglodytes
agaaaagcaatttaaa

SEQ ID NO: 200196 - DNA, 16 bp, P. troglodytes
agaaaagcatgaaaag

SEQ ID NO: 200197 - DNA, 16 bp, P. troglodytes
agaaaagccttttgat

SEQ ID NO: 200198 - DNA, 16 bp, P. troglodytes
agaaaagctgaaaatt

SEQ ID NO: 200199 - DNA, 16 bp, P. troglodytes
agaaaagctgaaagaa

SEQ ID NO: 200200 - DNA, 16 bp, P. troglodytes
agaaaagctgaacaaa

SEQ ID NO: 200201 - DNA, 16 bp, P. troglodytes
agaaaaggaaaaattc

SEQ ID NO: 200202 - DNA, 16 bp, P. troglodytes
agaaaaggaaactgag

SEQ ID NO: 200203 - DNA, 16 bp, P. troglodytes
agaaaaggaaatgctt

SEQ ID NO: 200204 - DNA, 16 bp, P. troglodytes
agaaaaggaaatgtta

SEQ ID NO: 200205 - DNA, 16 bp, P. troglodytes
agaaaaggaaatgttt

SEQ ID NO: 200206 - DNA, 16 bp, P. troglodytes
agaaaaggaaatttat

SEQ ID NO: 200207 - DNA, 16 bp, P. troglodytes
agaaaaggaaatttgt

SEQ ID NO: 200208 - DNA, 16 bp, P. troglodytes
agaaaaggaatttgtt

SEQ ID NO: 200209 - DNA, 16 bp, P. troglodytes
agaaaaggcctctgac

SEQ ID NO: 200210 - DNA, 16 bp, P. troglodytes
agaaaagggaagcctt

SEQ ID NO: 200211 - DNA, 16 bp, P. troglodytes
agaaaagggaatgttt

SEQ ID NO: 200212 - DNA, 16 bp, P. troglodytes
agaaaagggaattttt

SEQ ID NO: 200213 - DNA, 16 bp, P. troglodytes
agaaaaggtacagcaa

SEQ ID NO: 200214 - DNA, 16 bp, P. troglodytes
agaaaaggtcttcaat

SEQ ID NO: 200215 - DNA, 16 bp, P. troglodytes
agaaaagtaaacagag

SEQ ID NO: 200216 - DNA, 16 bp, P. troglodytes
agaaaagtattttcaa

SEQ ID NO: 200217 - DNA, 16 bp, P. troglodytes
agaaaagttctccaag

SEQ ID NO: 200218 - DNA, 16 bp, P. troglodytes
agaaaagttgaaatta

SEQ ID NO: 200219 - DNA, 16 bp, P. troglodytes
agaaaagttgcaagaa

SEQ ID NO: 200220 - DNA, 16 bp, P. troglodytes
agaaaagtttcaaaaa

SEQ ID NO: 200221 - DNA, 16 bp, P. troglodytes
agaaaagtttgaaaat

SEQ ID NO: 200222 - DNA, 16 bp, P. troglodytes
agaaaataaaaatggc

SEQ ID NO: 200223 - DNA, 16 bp, P. troglodytes
agaaaataaaagttca

SEQ ID NO: 200224 - DNA, 16 bp, P. troglodytes
agaaaataaaatcact

SEQ ID NO: 200225 - DNA, 16 bp, P. troglodytes
agaaaataaaatctca

SEQ ID NO: 200226 - DNA, 16 bp, P. troglodytes
agaaaataaaatgtca

SEQ ID NO: 200227 - DNA, 16 bp, P. troglodytes
agaaaataaacattta

SEQ ID NO: 200228 - DNA, 16 bp, P. troglodytes
agaaaataaacatttt

SEQ ID NO: 200229 - DNA, 16 bp, P. troglodytes
agaaaataaacttctg

SEQ ID NO: 200230 - DNA, 16 bp, P. troglodytes
agaaaataaacttgtt

SEQ ID NO: 200231 - DNA, 16 bp, P. troglodytes
agaaaataaatatctg

SEQ ID NO: 200232 - DNA, 16 bp, P. troglodytes
agaaaataaatattca

SEQ ID NO: 200233 - DNA, 16 bp, P. troglodytes
agaaaataaatgcaat

SEQ ID NO: 200234 - DNA, 16 bp, P. troglodytes
agaaaataaattccaa

SEQ ID NO: 200235 - DNA, 16 bp, P. troglodytes
agaaaataactgtcaa

SEQ ID NO: 200236 - DNA, 16 bp, P. troglodytes
agaaaatacacattta

SEQ ID NO: 200237 - DNA, 16 bp, P. troglodytes
agaaaatacattattt

SEQ ID NO: 200238 - DNA, 16 bp, P. troglodytes
agaaaatacatttact

SEQ ID NO: 200239 - DNA, 16 bp, P. troglodytes
agaaaatacattttca

SEQ ID NO: 200240 - DNA, 16 bp, P. troglodytes
agaaaatactagcaaa

SEQ ID NO: 200241 - DNA, 16 bp, P. troglodytes
agaaaatacttccaaa

SEQ ID NO: 200242 - DNA, 16 bp, P. troglodytes
agaaaatacttgaaaa

SEQ ID NO: 200243 - DNA, 16 bp, P. troglodytes
agaaaatacttgcaaa

SEQ ID NO: 200244 - DNA, 16 bp, P. troglodytes
agaaaatactttcaaa

SEQ ID NO: 200245 - DNA, 16 bp, P. troglodytes
agaaaatagaagcaat

SEQ ID NO: 200246 - DNA, 16 bp, P. troglodytes
agaaaatagagacaca

SEQ ID NO: 200247 - DNA, 16 bp, P. troglodytes
agaaaatagatgtttt

SEQ ID NO: 200248 - DNA, 16 bp, P. troglodytes
agaaaatatattaaca

SEQ ID NO: 200249 - DNA, 16 bp, P. troglodytes
agaaaatatatttcta

SEQ ID NO: 200250 - DNA, 16 bp, P. troglodytes
agaaaatatgttattt

SEQ ID NO: 200251 - DNA, 16 bp, P. troglodytes
agaaaatattcacaat

SEQ ID NO: 200252 - DNA, 16 bp, P. troglodytes
agaaaatattctttgt

SEQ ID NO: 200253 - DNA, 16 bp, P. troglodytes
agaaaatatttacaga

SEQ ID NO: 200254 - DNA, 16 bp, P. troglodytes
agaaaatatttattga

SEQ ID NO: 200255 - DNA, 16 bp, P. troglodytes
agaaaatatttcaaga

SEQ ID NO: 200256 - DNA, 16 bp, P. troglodytes
agaaaatatttccaag

SEQ ID NO: 200257 - DNA, 16 bp, P. troglodytes
agaaaatatttgaaga

SEQ ID NO: 200258 - DNA, 16 bp, P. troglodytes
agaaaatatttgcaga

SEQ ID NO: 200259 - DNA, 16 bp, P. troglodytes
agaaaatatttgtcaa

SEQ ID NO: 200260 - DNA, 16 bp, P. troglodytes
agaaaatattttatct

SEQ ID NO: 200261 - DNA, 16 bp, P. troglodytes
agaaaatattttcaga

SEQ ID NO: 200262 - DNA, 16 bp, P. troglodytes
agaaaatattttccca

SEQ ID NO: 200263 - DNA, 16 bp, P. troglodytes
agaaaatatttttcaa

SEQ ID NO: 200264 - DNA, 16 bp, P. troglodytes
agaaaatcaaaattat

SEQ ID NO: 200265 - DNA, 16 bp, P. troglodytes
agaaaatcaacaagga

SEQ ID NO: 200266 - DNA, 16 bp, P. troglodytes
agaaaatcaataaatt

SEQ ID NO: 200267 - DNA, 16 bp, P. troglodytes
agaaaatcacattttc

SEQ ID NO: 200268 - DNA, 16 bp, P. troglodytes
agaaaatcagcaaaga

SEQ ID NO: 200269 - DNA, 16 bp, P. troglodytes
agaaaatcagcaagaa

SEQ ID NO: 200270 - DNA, 16 bp, P. troglodytes
agaaaatcagcttcct

SEQ ID NO: 200271 - DNA, 16 bp, P. troglodytes
agaaaatcaggccagg

SEQ ID NO: 200272 - DNA, 16 bp, P. troglodytes
agaaaatcatcaaaga

SEQ ID NO: 200273 - DNA, 16 bp, P. troglodytes
agaaaatccagaaata

SEQ ID NO: 200274 - DNA, 16 bp, P. troglodytes
agaaaatcctaaggaa

SEQ ID NO: 200275 - DNA, 16 bp, P. troglodytes
agaaaatctacaagcc

SEQ ID NO: 200276 - DNA, 16 bp, P. troglodytes
agaaaatctacatgac

SEQ ID NO: 200277 - DNA, 16 bp, P. troglodytes
agaaaatctattttaa

SEQ ID NO: 200278 - DNA, 16 bp, P. troglodytes
agaaaatctcaaagaa

SEQ ID NO: 200279 - DNA, 16 bp, P. troglodytes
agaaaatctcaaggaa

SEQ ID NO: 200280 - DNA, 16 bp, P. troglodytes
agaaaatctcaataaa

SEQ ID NO: 200281 - DNA, 16 bp, P. troglodytes
agaaaatctgaaagaa

SEQ ID NO: 200282 - DNA, 16 bp, P. troglodytes
agaaaatctgaacaaa

SEQ ID NO: 200283 - DNA, 16 bp, P. troglodytes
agaaaatcttaagaaa

SEQ ID NO: 200284 - DNA, 16 bp, P. troglodytes
agaaaatcttcaaaat

SEQ ID NO: 200285 - DNA, 16 bp, P. troglodytes
agaaaatctttgcaaa

SEQ ID NO: 200286 - DNA, 16 bp, P. troglodytes
agaaaatgaaactgaa

SEQ ID NO: 200287 - DNA, 16 bp, P. troglodytes
agaaaatgaaatatct

SEQ ID NO: 200288 - DNA, 16 bp, P. troglodytes
agaaaatgaaattctg

SEQ ID NO: 200289 - DNA, 16 bp, P. troglodytes
agaaaatgaacattaa

SEQ ID NO: 200290 - DNA, 16 bp, P. troglodytes
agaaaatgaagatgat

SEQ ID NO: 200291 - DNA, 16 bp, P. troglodytes
agaaaatgaagatttt

SEQ ID NO: 200292 - DNA, 16 bp, P. troglodytes
agaaaatgaagctcag

SEQ ID NO: 200293 - DNA, 16 bp, P. troglodytes
agaaaatgaatgtgaa

SEQ ID NO: 200294 - DNA, 16 bp, P. troglodytes
agaaaatgaatttatt

SEQ ID NO: 200295 - DNA, 16 bp, P. troglodytes
agaaaatgaatttctg

SEQ ID NO: 200296 - DNA, 16 bp, P. troglodytes
agaaaatgaattttga

SEQ ID NO: 200297 - DNA, 16 bp, P. troglodytes
agaaaatgacagaaat

SEQ ID NO: 200298 - DNA, 16 bp, P. troglodytes
agaaaatgacttttta

SEQ ID NO: 200299 - DNA, 16 bp, P. troglodytes
agaaaatgaggaacaa

SEQ ID NO: 200300 - DNA, 16 bp, P. troglodytes
agaaaatgatgatgat

SEQ ID NO: 200301 - DNA, 16 bp, P. troglodytes
agaaaatgatgtttat

SEQ ID NO: 200302 - DNA, 16 bp, P. troglodytes
agaaaatgcaaaatga

SEQ ID NO: 200303 - DNA, 16 bp, P. troglodytes
agaaaatgcagtgttt

SEQ ID NO: 200304 - DNA, 16 bp, P. troglodytes
agaaaatgctattttt

SEQ ID NO: 200305 - DNA, 16 bp, P. troglodytes
agaaaatgctgaaaaa

SEQ ID NO: 200306 - DNA, 16 bp, P. troglodytes
agaaaatgctttttat

SEQ ID NO: 200307 - DNA, 16 bp, P. troglodytes
agaaaatggaggctca

SEQ ID NO: 200308 - DNA, 16 bp, P. troglodytes
agaaaatgggctgggc

SEQ ID NO: 200309 - DNA, 16 bp, P. troglodytes
agaaaatggggttttc

SEQ ID NO: 200310 - DNA, 16 bp, P. troglodytes
agaaaatgtatggaaa

SEQ ID NO: 200311 - DNA, 16 bp, P. troglodytes
agaaaatgtatgtgaa

SEQ ID NO: 200312 - DNA, 16 bp, P. troglodytes
agaaaatgtattttct

SEQ ID NO: 200313 - DNA, 16 bp, P. troglodytes
agaaaatgtctttatt

SEQ ID NO: 200314 - DNA, 16 bp, P. troglodytes
agaaaatgtgaacaaa

SEQ ID NO: 200315 - DNA, 16 bp, P. troglodytes
agaaaatgtgatgttt

SEQ ID NO: 200316 - DNA, 16 bp, P. troglodytes
agaaaatgtgcagcct

SEQ ID NO: 200317 - DNA, 16 bp, P. troglodytes
agaaaatgtggaaaat

SEQ ID NO: 200318 - DNA, 16 bp, P. troglodytes
agaaaatgtgtacata

SEQ ID NO: 200319 - DNA, 16 bp, P. troglodytes
agaaaatgtgtcatat

SEQ ID NO: 200320 - DNA, 16 bp, P. troglodytes
agaaaatgttatttaa

SEQ ID NO: 200321 - DNA, 16 bp, P. troglodytes
agaaaatgttattttt

SEQ ID NO: 200322 - DNA, 16 bp, P. troglodytes
agaaaatgttcatttt

SEQ ID NO: 200323 - DNA, 16 bp, P. troglodytes
agaaaatgttgtatat

SEQ ID NO: 200324 - DNA, 16 bp, P. troglodytes
agaaaatgtttacatt

SEQ ID NO: 200325 - DNA, 16 bp, P. troglodytes
agaaaatgttttaatt

SEQ ID NO: 200326 - DNA, 16 bp, P. troglodytes
agaaaatgttttcctt

SEQ ID NO: 200327 - DNA, 16 bp, P. troglodytes
agaaaatgtttttaaa

SEQ ID NO: 200328 - DNA, 16 bp, P. troglodytes
agaaaattaaaactta

SEQ ID NO: 200329 - DNA, 16 bp, P. troglodytes
agaaaattaaatgttt

SEQ ID NO: 200330 - DNA, 16 bp, P. troglodytes
agaaaattaacaaggg

SEQ ID NO: 200331 - DNA, 16 bp, P. troglodytes
agaaaattaatccttt

SEQ ID NO: 200332 - DNA, 16 bp, P. troglodytes
agaaaattagctgggt

SEQ ID NO: 200333 - DNA, 16 bp, P. troglodytes
agaaaattaggccagg

SEQ ID NO: 200334 - DNA, 16 bp, P. troglodytes
agaaaattatttcaga

SEQ ID NO: 200335 - DNA, 16 bp, P. troglodytes
agaaaattcaaataag

SEQ ID NO: 200336 - DNA, 16 bp, P. troglodytes
agaaaattcaagagaa

SEQ ID NO: 200337 - DNA, 16 bp, P. troglodytes
agaaaattcagaaaga

SEQ ID NO: 200338 - DNA, 16 bp, P. troglodytes
agaaaattcagaaatt

SEQ ID NO: 200339 - DNA, 16 bp, P. troglodytes
agaaaattcattttaa

SEQ ID NO: 200340 - DNA, 16 bp, P. troglodytes
agaaaattgaaaacat

SEQ ID NO: 200341 - DNA, 16 bp, P. troglodytes
agaaaattgaaatcat

SEQ ID NO: 200342 - DNA, 16 bp, P. troglodytes
agaaaattgccatttt

SEQ ID NO: 200343 - DNA, 16 bp, P. troglodytes
agaaaatttcaactct

SEQ ID NO: 200344 - DNA, 16 bp, P. troglodytes
agaaaatttccagaaa

SEQ ID NO: 200345 - DNA, 16 bp, P. troglodytes
agaaaatttggaaaat

SEQ ID NO: 200346 - DNA, 16 bp, P. troglodytes
agaaaattttcctttt

SEQ ID NO: 200347 - DNA, 16 bp, P. troglodytes
agaaacaaaaattagc

SEQ ID NO: 200348 - DNA, 16 bp, P. troglodytes
agaaacaaaagctgag

SEQ ID NO: 200349 - DNA, 16 bp, P. troglodytes
agaaacaaacattttt

SEQ ID NO: 200350 - DNA, 16 bp, P. troglodytes
agaaacaaactttaaa

SEQ ID NO: 200351 - DNA, 16 bp, P. troglodytes
agaaacaaagtcaaat

SEQ ID NO: 200352 - DNA, 16 bp, P. troglodytes
agaaacaaatttctat

SEQ ID NO: 200353 - DNA, 16 bp, P. troglodytes
agaaacaagcaaagcc

SEQ ID NO: 200354 - DNA, 16 bp, P. troglodytes
agaaacaattttattt

SEQ ID NO: 200355 - DNA, 16 bp, P. troglodytes
agaaacacaaaaccta

SEQ ID NO: 200356 - DNA, 17 bp, P. troglodytes
agaaacacaaactacca

SEQ ID NO: 200357 - DNA, 23 bp, P. troglodytes
agaaacacccaagaatgatcaat

SEQ ID NO: 200358 - DNA, 19 bp, P. troglodytes
agaaacacccacaggtgtg

SEQ ID NO: 200359 - DNA, 16 bp, P. troglodytes
agaaacaccctcacag

SEQ ID NO: 200360 - DNA, 16 bp, P. troglodytes
agaaacactgaaaaat

SEQ ID NO: 200361 - DNA, 16 bp, P. troglodytes
agaaacagaaaatatg

SEQ ID NO: 200362 - DNA, 16 bp, P. troglodytes
agaaacagaaagtgga

SEQ ID NO: 200363 - DNA, 16 bp, P. troglodytes
agaaacagaaatatat

SEQ ID NO: 200364 - DNA, 16 bp, P. troglodytes
agaaacagaactaaag

SEQ ID NO: 200365 - DNA, 16 bp, P. troglodytes
agaaacagaagcacag

SEQ ID NO: 200366 - DNA, 16 bp, P. troglodytes
agaaacagaatcaata

SEQ ID NO: 200367 - DNA, 16 bp, P. troglodytes
agaaacagactggcaa

SEQ ID NO: 200368 - DNA, 16 bp, P. troglodytes
agaaacagcagatgct

SEQ ID NO: 200369 - DNA, 16 bp, P. troglodytes
agaaacatatgaagaa

SEQ ID NO: 200370 - DNA, 16 bp, P. troglodytes
agaaacatcagaagca

SEQ ID NO: 200371 - DNA, 16 bp, P. troglodytes
agaaacatccagaata

SEQ ID NO: 200372 - DNA, 16 bp, P. troglodytes
agaaacatgtttttaa

SEQ ID NO: 200373 - DNA, 16 bp, P. troglodytes
agaaacattcagacca

SEQ ID NO: 200374 - DNA, 16 bp, P. troglodytes
agaaacattctacaaa

SEQ ID NO: 200375 - DNA, 16 bp, P. troglodytes
agaaacatttaaaaag

SEQ ID NO: 200376 - DNA, 16 bp, P. troglodytes
agaaacatttaaatta

SEQ ID NO: 200377 - DNA, 16 bp, P. troglodytes
agaaacatttctcaaa

SEQ ID NO: 200378 - DNA, 16 bp, P. troglodytes
agaaacattttaaaaa

SEQ ID NO: 200379 - DNA, 16 bp, P. troglodytes
agaaacatttttaaaa

SEQ ID NO: 200380 - DNA, 16 bp, P. troglodytes
agaaacatttttggtt

SEQ ID NO: 200381 - DNA, 16 bp, P. troglodytes
agaaaccaaggctcag

SEQ ID NO: 200382 - DNA, 16 bp, P. troglodytes
agaaaccagccctttc

SEQ ID NO: 200383 - DNA, 16 bp, P. troglodytes
agaaaccagcctgggc

SEQ ID NO: 200384 - DNA, 16 bp, P. troglodytes
agaaaccagtgcaaaa

SEQ ID NO: 200385 - DNA, 16 bp, P. troglodytes
agaaaccattgcctaa

SEQ ID NO: 200386 - DNA, 16 bp, P. troglodytes
agaaacccacagctaa

SEQ ID NO: 200387 - DNA, 16 bp, P. troglodytes
agaaacccattttaaa

SEQ ID NO: 200388 - DNA, 16 bp, P. troglodytes
agaaaccccatctctc

SEQ ID NO: 200389 - DNA, 18 bp, P. troglodytes
agaaaccccatttctact

SEQ ID NO: 200390 - DNA, 17 bp, P. troglodytes
agaaaccccgtctctat

SEQ ID NO: 200391 - DNA, 16 bp, P. troglodytes
agaaacccctgataaa

SEQ ID NO: 200392 - DNA, 17 bp, P. troglodytes
agaaaccctacaaatgt

SEQ ID NO: 200393 - DNA, 16 bp, P. troglodytes
agaaaccttatgaatg

SEQ ID NO: 200394 - DNA, 16 bp, P. troglodytes
agaaacgggatttcac

SEQ ID NO: 200395 - DNA, 21 bp, P. troglodytes
agaaactaccatcagagtgaa

SEQ ID NO: 200396 - DNA, 16 bp, P. troglodytes
agaaactatcttcaga

SEQ ID NO: 200397 - DNA, 16 bp, P. troglodytes
agaaactatttgcaaa

SEQ ID NO: 200398 - DNA, 16 bp, P. troglodytes
agaaactcaaagcttt

SEQ ID NO: 200399 - DNA, 16 bp, P. troglodytes
agaaactcactttaga

SEQ ID NO: 200400 - DNA, 16 bp, P. troglodytes
agaaactcagagagct

SEQ ID NO: 200401 - DNA, 16 bp, P. troglodytes
agaaactccatctcca

SEQ ID NO: 200402 - DNA, 16 bp, P. troglodytes
agaaactctacaaacc

SEQ ID NO: 200403 - DNA, 16 bp, P. troglodytes
agaaactctctcaaaa

SEQ ID NO: 200404 - DNA, 16 bp, P. troglodytes
agaaactctggacaca

SEQ ID NO: 200405 - DNA, 16 bp, P. troglodytes
agaaactgaaaatcaa

SEQ ID NO: 200406 - DNA, 16 bp, P. troglodytes
agaaactgaaataaat

SEQ ID NO: 200407 - DNA, 16 bp, P. troglodytes
agaaactgaaatttaa

SEQ ID NO: 200408 - DNA, 16 bp, P. troglodytes
agaaactgaagaaaat

SEQ ID NO: 200409 - DNA, 16 bp, P. troglodytes
agaaactgaagcccag

SEQ ID NO: 200410 - DNA, 16 bp, P. troglodytes
agaaactgaaggaaaa

SEQ ID NO: 200411 - DNA, 16 bp, P. troglodytes
agaaactgaattttaa

SEQ ID NO: 200412 - DNA, 16 bp, P. troglodytes
agaaactgagacagag

SEQ ID NO: 200413 - DNA, 16 bp, P. troglodytes
agaaactgaggaaaag

SEQ ID NO: 200414 - DNA, 16 bp, P. troglodytes
agaaactgaggcacaa

SEQ ID NO: 200415 - DNA, 16 bp, P. troglodytes
agaaactgaggcccag

SEQ ID NO: 200416 - DNA, 16 bp, P. troglodytes
agaaactgaggctggg

SEQ ID NO: 200417 - DNA, 16 bp, P. troglodytes
agaaactgcagaagaa

SEQ ID NO: 200418 - DNA, 16 bp, P. troglodytes
agaaactgcagcaact

SEQ ID NO: 200419 - DNA, 16 bp, P. troglodytes
agaaactgcatcaaca

SEQ ID NO: 200420 - DNA, 16 bp, P. troglodytes
agaaactggaaccctt

SEQ ID NO: 200421 - DNA, 16 bp, P. troglodytes
agaaactggaagaaaa

SEQ ID NO: 200422 - DNA, 16 bp, P. troglodytes
agaaactggaattctc

SEQ ID NO: 200423 - DNA, 16 bp, P. troglodytes
agaaactggccaaaac

SEQ ID NO: 200424 - DNA, 16 bp, P. troglodytes
agaaactggttgtttt

SEQ ID NO: 200425 - DNA, 16 bp, P. troglodytes
agaaactgtcaacaga

SEQ ID NO: 200426 - DNA, 16 bp, P. troglodytes
agaaacttaaacaatt

SEQ ID NO: 200427 - DNA, 16 bp, P. troglodytes
agaaacttcaaataaa

SEQ ID NO: 200428 - DNA, 16 bp, P. troglodytes
agaaacttgaagaaaa

SEQ ID NO: 200429 - DNA, 16 bp, P. troglodytes
agaaactttacaaata

SEQ ID NO: 200430 - DNA, 16 bp, P. troglodytes
agaaactttgttttct

SEQ ID NO: 200431 - DNA, 16 bp, P. troglodytes
agaaacttttcttttt

SEQ ID NO: 200432 - DNA, 16 bp, P. troglodytes
agaaagaaaaacagct

SEQ ID NO: 200433 - DNA, 16 bp, P. troglodytes
agaaagaaaaacagtt

SEQ ID NO: 200434 - DNA, 16 bp, P. troglodytes
agaaagaaaaatcagt

SEQ ID NO: 200435 - DNA, 16 bp, P. troglodytes
agaaagaaaaatctct

SEQ ID NO: 200436 - DNA, 16 bp, P. troglodytes
agaaagaaaaatcttt

SEQ ID NO: 200437 - DNA, 16 bp, P. troglodytes
agaaagaaaaatggca

SEQ ID NO: 200438 - DNA, 16 bp, P. troglodytes
agaaagaaaaatgttt

SEQ ID NO: 200439 - DNA, 16 bp, P. troglodytes
agaaagaaaagaactt

SEQ ID NO: 200440 - DNA, 16 bp, P. troglodytes
agaaagaaaaggcatc

SEQ ID NO: 200441 - DNA, 16 bp, P. troglodytes
agaaagaaaatgtttc

SEQ ID NO: 200442 - DNA, 16 bp, P. troglodytes
agaaagaaaatttctt

SEQ ID NO: 200443 - DNA, 16 bp, P. troglodytes
agaaagaaagaaactg

SEQ ID NO: 200444 - DNA, 16 bp, P. troglodytes
agaaagaaagaaatct

SEQ ID NO: 200445 - DNA, 16 bp, P. troglodytes
agaaagaaagaaattc

SEQ ID NO: 200446 - DNA, 16 bp, P. troglodytes
agaaagaaagaacact

SEQ ID NO: 200447 - DNA, 16 bp, P. troglodytes
agaaagaaagaatgct

SEQ ID NO: 200448 - DNA, 16 bp, P. troglodytes
agaaagaaaggagtca

SEQ ID NO: 200449 - DNA, 16 bp, P. troglodytes
agaaagaaaggtcagg

SEQ ID NO: 200450 - DNA, 16 bp, P. troglodytes
agaaagaaatacctga

SEQ ID NO: 200451 - DNA, 16 bp, P. troglodytes
agaaagaaatgcagcc

SEQ ID NO: 200452 - DNA, 16 bp, P. troglodytes
agaaagaaattcagaa

SEQ ID NO: 200453 - DNA, 16 bp, P. troglodytes
agaaagaaatttcttc

SEQ ID NO: 200454 - DNA, 16 bp, P. troglodytes
agaaagaactggaaaa

SEQ ID NO: 200455 - DNA, 16 bp, P. troglodytes
agaaagaagaaattca

SEQ ID NO: 200456 - DNA, 16 bp, P. troglodytes
agaaagaaggaattct

SEQ ID NO: 200457 - DNA, 16 bp, P. troglodytes
agaaagaaggccctgg

SEQ ID NO: 200458 - DNA, 16 bp, P. troglodytes
agaaagaagttgaatc

SEQ ID NO: 200459 - DNA, 16 bp, P. troglodytes
agaaagaatctcagaa

SEQ ID NO: 200460 - DNA, 16 bp, P. troglodytes
agaaagaatcttaaga

SEQ ID NO: 200461 - DNA, 16 bp, P. troglodytes
agaaagaattcaaggc

SEQ ID NO: 200462 - DNA, 16 bp, P. troglodytes
agaaagaattcagaat

SEQ ID NO: 200463 - DNA, 16 bp, P. troglodytes
agaaagaattcagagc

SEQ ID NO: 200464 - DNA, 16 bp, P. troglodytes
agaaagacaaacactg

SEQ ID NO: 200465 - DNA, 16 bp, P. troglodytes
agaaagacaaacatcg

SEQ ID NO: 200466 - DNA, 16 bp, P. troglodytes
agaaagacaaacttca

SEQ ID NO: 200467 - DNA, 16 bp, P. troglodytes
agaaagacaaacttct

SEQ ID NO: 200468 - DNA, 16 bp, P. troglodytes
agaaagacaaatgctg

SEQ ID NO: 200469 - DNA, 16 bp, P. troglodytes
agaaagacactgacta

SEQ ID NO: 200470 - DNA, 16 bp, P. troglodytes
agaaagaccctatctc

SEQ ID NO: 200471 - DNA, 16 bp, P. troglodytes
agaaagagaaaagctc

SEQ ID NO: 200472 - DNA, 16 bp, P. troglodytes
agaaagagaactgaaa

SEQ ID NO: 200473 - DNA, 16 bp, P. troglodytes
agaaagagtacaaaga

SEQ ID NO: 200474 - DNA, 16 bp, P. troglodytes
agaaagatatctggaa

SEQ ID NO: 200475 - DNA, 16 bp, P. troglodytes
agaaagatcacaaatt

SEQ ID NO: 200476 - DNA, 16 bp, P. troglodytes
agaaagatttaaaatg

SEQ ID NO: 200477 - DNA, 16 bp, P. troglodytes
agaaagatttggaaaa

SEQ ID NO: 200478 - DNA, 16 bp, P. troglodytes
agaaagcaaaacattt

SEQ ID NO: 200479 - DNA, 16 bp, P. troglodytes
agaaagcaaaatattt

SEQ ID NO: 200480 - DNA, 16 bp, P. troglodytes
agaaagcaaacaactt

SEQ ID NO: 200481 - DNA, 16 bp, P. troglodytes
agaaagcagaaaaatg

SEQ ID NO: 200482 - DNA, 16 bp, P. troglodytes
agaaagcaggaaacat

SEQ ID NO: 200483 - DNA, 29 bp, P. troglodytes
agaaagcaggaaagatccaaaattgacac

SEQ ID NO: 200484 - DNA, 16 bp, P. troglodytes
agaaagcaggagagat

SEQ ID NO: 200485 - DNA, 16 bp, P. troglodytes
agaaagcatttgacaa

SEQ ID NO: 200486 - DNA, 16 bp, P. troglodytes
agaaagcattttaaat

SEQ ID NO: 200487 - DNA, 16 bp, P. troglodytes
agaaagcatttttaaa

SEQ ID NO: 200488 - DNA, 16 bp, P. troglodytes
agaaagccaaatacca

SEQ ID NO: 200489 - DNA, 16 bp, P. troglodytes
agaaagctcagaaaaa

SEQ ID NO: 200490 - DNA, 28 bp, P. troglodytes
agaaagctgaaactggatcccttcctta

SEQ ID NO: 200491 - DNA, 16 bp, P. troglodytes
agaaagctgaacctgg

SEQ ID NO: 200492 - DNA, 16 bp, P. troglodytes
agaaaggaaaatccaa

SEQ ID NO: 200493 - DNA, 16 bp, P. troglodytes
agaaaggaatggaatg

SEQ ID NO: 200494 - DNA, 16 bp, P. troglodytes
agaaaggaatgttcag

SEQ ID NO: 200495 - DNA, 16 bp, P. troglodytes
agaaaggactcattcc

SEQ ID NO: 200496 - DNA, 16 bp, P. troglodytes
agaaaggcagcagcct

SEQ ID NO: 200497 - DNA, 16 bp, P. troglodytes
agaaaggctgggaaat

SEQ ID NO: 200498 - DNA, 17 bp, P. troglodytes
agaaaggtcaggttacc

SEQ ID NO: 200499 - DNA, 16 bp, P. troglodytes
agaaaggttcaattct

SEQ ID NO: 200500 - DNA, 16 bp, P. troglodytes
agaaaggttttttaaa

SEQ ID NO: 200501 - DNA, 16 bp, P. troglodytes
agaaagtaaatttcaa

SEQ ID NO: 200502 - DNA, 16 bp, P. troglodytes
agaaagtagaatgctg

SEQ ID NO: 200503 - DNA, 16 bp, P. troglodytes
agaaagtattttttta

SEQ ID NO: 200504 - DNA, 16 bp, P. troglodytes
agaaagtcagagaaag

SEQ ID NO: 200505 - DNA, 16 bp, P. troglodytes
agaaagtgaaagaaca

SEQ ID NO: 200506 - DNA, 16 bp, P. troglodytes
agaaagtgacagagct

SEQ ID NO: 200507 - DNA, 16 bp, P. troglodytes
agaaagtgactttatt

SEQ ID NO: 200508 - DNA, 16 bp, P. troglodytes
agaaagtgatttcttg

SEQ ID NO: 200509 - DNA, 16 bp, P. troglodytes
agaaagtgctcaataa

SEQ ID NO: 200510 - DNA, 16 bp, P. troglodytes
agaaagtggcagagct

SEQ ID NO: 200511 - DNA, 16 bp, P. troglodytes
agaaagtgtattcaaa

SEQ ID NO: 200512 - DNA, 16 bp, P. troglodytes
agaaagtgtttttata

SEQ ID NO: 200513 - DNA, 16 bp, P. troglodytes
agaaagttctattgga

SEQ ID NO: 200514 - DNA, 16 bp, P. troglodytes
agaaagttgaatggtg

SEQ ID NO: 200515 - DNA, 16 bp, P. troglodytes
agaaagtttaaaaagt

SEQ ID NO: 200516 - DNA, 16 bp, P. troglodytes
agaaagtttatttaaa

SEQ ID NO: 200517 - DNA, 16 bp, P. troglodytes
agaaagtttccttcta

SEQ ID NO: 200518 - DNA, 16 bp, P. troglodytes
agaaagtttctttcta

SEQ ID NO: 200519 - DNA, 16 bp, P. troglodytes
agaaagtttggaaaat

SEQ ID NO: 200520 - DNA, 16 bp, P. troglodytes
agaaagttttaaaatt

SEQ ID NO: 200521 - DNA, 16 bp, P. troglodytes
agaaataaaaacttac

SEQ ID NO: 200522 - DNA, 16 bp, P. troglodytes
agaaataaaactaatt

SEQ ID NO: 200523 - DNA, 16 bp, P. troglodytes
agaaataaaagacatt

SEQ ID NO: 200524 - DNA, 16 bp, P. troglodytes
agaaataaaagatgtt

SEQ ID NO: 200525 - DNA, 16 bp, P. troglodytes
agaaataaaatacttc

SEQ ID NO: 200526 - DNA, 16 bp, P. troglodytes
agaaataaaccttcac

SEQ ID NO: 200527 - DNA, 16 bp, P. troglodytes
agaaataaacttccat

SEQ ID NO: 200528 - DNA, 16 bp, P. troglodytes
agaaataaagatattc

SEQ ID NO: 200529 - DNA, 16 bp, P. troglodytes
agaaataaagatcaga

SEQ ID NO: 200530 - DNA, 16 bp, P. troglodytes
agaaataaagatctca

SEQ ID NO: 200531 - DNA, 16 bp, P. troglodytes
agaaataaagatgtta

SEQ ID NO: 200532 - DNA, 16 bp, P. troglodytes
agaaataaagctaaat

SEQ ID NO: 200533 - DNA, 16 bp, P. troglodytes
agaaataaagtcattt

SEQ ID NO: 200534 - DNA, 16 bp, P. troglodytes
agaaataaatactttt

SEQ ID NO: 200535 - DNA, 16 bp, P. troglodytes
agaaataaatatttca

SEQ ID NO: 200536 - DNA, 16 bp, P. troglodytes
agaaataaatcagtaa

SEQ ID NO: 200537 - DNA, 16 bp, P. troglodytes
agaaataaatgtgtat

SEQ ID NO: 200538 - DNA, 16 bp, P. troglodytes
agaaataaattttgtt

SEQ ID NO: 200539 - DNA, 16 bp, P. troglodytes
agaaataacaaaatct

SEQ ID NO: 200540 - DNA, 16 bp, P. troglodytes
agaaataacatttaaa

SEQ ID NO: 200541 - DNA, 16 bp, P. troglodytes
agaaataactaatatc

SEQ ID NO: 200542 - DNA, 16 bp, P. troglodytes
agaaataacttttttt

SEQ ID NO: 200543 - DNA, 16 bp, P. troglodytes
agaaataagatctttt

SEQ ID NO: 200544 - DNA, 16 bp, P. troglodytes
agaaataaggctgcat

SEQ ID NO: 200545 - DNA, 16 bp, P. troglodytes
agaaataataaactat

SEQ ID NO: 200546 - DNA, 16 bp, P. troglodytes
agaaataataaagatc

SEQ ID NO: 200547 - DNA, 16 bp, P. troglodytes
agaaataatcagcaaa

SEQ ID NO: 200548 - DNA, 16 bp, P. troglodytes
agaaataatctttaaa

SEQ ID NO: 200549 - DNA, 16 bp, P. troglodytes
agaaataatgaaaatc

SEQ ID NO: 200550 - DNA, 16 bp, P. troglodytes
agaaataatgctacac

SEQ ID NO: 200551 - DNA, 16 bp, P. troglodytes
agaaataattatatca

SEQ ID NO: 200552 - DNA, 16 bp, P. troglodytes
agaaataattttatgt

SEQ ID NO: 200553 - DNA, 16 bp, P. troglodytes
agaaataattttctgt

SEQ ID NO: 200554 - DNA, 16 bp, P. troglodytes
agaaatacaaaaattg

SEQ ID NO: 200555 - DNA, 16 bp, P. troglodytes
agaaatacaaaatatt

SEQ ID NO: 200556 - DNA, 16 bp, P. troglodytes
agaaatacaaacatca

SEQ ID NO: 200557 - DNA, 16 bp, P. troglodytes
agaaatacaaaggatt

SEQ ID NO: 200558 - DNA, 16 bp, P. troglodytes
agaaatacaagttaaa

SEQ ID NO: 200559 - DNA, 16 bp, P. troglodytes
agaaatacacattttt

SEQ ID NO: 200560 - DNA, 16 bp, P. troglodytes
agaaatacaggaaaat

SEQ ID NO: 200561 - DNA, 16 bp, P. troglodytes
agaaatacagggtatt

SEQ ID NO: 200562 - DNA, 16 bp, P. troglodytes
agaaatacattggttt

SEQ ID NO: 200563 - DNA, 16 bp, P. troglodytes
agaaatacatttaata

SEQ ID NO: 200564 - DNA, 16 bp, P. troglodytes
agaaatacatttcata

SEQ ID NO: 200565 - DNA, 16 bp, P. troglodytes
agaaatacattttaat

SEQ ID NO: 200566 - DNA, 16 bp, P. troglodytes
agaaatacattttcat

SEQ ID NO: 200567 - DNA, 16 bp, P. troglodytes
agaaatacatttttgt

SEQ ID NO: 200568 - DNA, 16 bp, P. troglodytes
agaaatactttatttt

SEQ ID NO: 200569 - DNA, 16 bp, P. troglodytes
agaaatagaaaaattc

SEQ ID NO: 200570 - DNA, 16 bp, P. troglodytes
agaaatagaaaacctc

SEQ ID NO: 200571 - DNA, 16 bp, P. troglodytes
agaaatagaaacacat

SEQ ID NO: 200572 - DNA, 16 bp, P. troglodytes
agaaatagagaacaga

SEQ ID NO: 200573 - DNA, 16 bp, P. troglodytes
agaaatagatgaatcc

SEQ ID NO: 200574 - DNA, 16 bp, P. troglodytes
agaaatagattttttt

SEQ ID NO: 200575 - DNA, 16 bp, P. troglodytes
agaaataggaatgctt

SEQ ID NO: 200576 - DNA, 16 bp, P. troglodytes
agaaataggcaagaaa

SEQ ID NO: 200577 - DNA, 16 bp, P. troglodytes
agaaatatatattcaa

SEQ ID NO: 200578 - DNA, 16 bp, P. troglodytes
agaaatatatttaaca

SEQ ID NO: 200579 - DNA, 16 bp, P. troglodytes
agaaatatgattgatt

SEQ ID NO: 200580 - DNA, 16 bp, P. troglodytes
agaaatatgattttaa

SEQ ID NO: 200581 - DNA, 16 bp, P. troglodytes
agaaatatgcattttt

SEQ ID NO: 200582 - DNA, 17 bp, P. troglodytes
agaaatatgggactatt

SEQ ID NO: 200583 - DNA, 16 bp, P. troglodytes
agaaatatgtattttt

SEQ ID NO: 200584 - DNA, 16 bp, P. troglodytes
agaaatattcatggaa

SEQ ID NO: 200585 - DNA, 16 bp, P. troglodytes
agaaatatttcaaata

SEQ ID NO: 200586 - DNA, 16 bp, P. troglodytes
agaaatatttcatgaa

SEQ ID NO: 200587 - DNA, 16 bp, P. troglodytes
agaaatatttctaaat

SEQ ID NO: 200588 - DNA, 16 bp, P. troglodytes
agaaatattttatgca

SEQ ID NO: 200589 - DNA, 16 bp, P. troglodytes
agaaatatttttaaca

SEQ ID NO: 200590 - DNA, 16 bp, P. troglodytes
agaaatatttttcttt

SEQ ID NO: 200591 - DNA, 16 bp, P. troglodytes
agaaatatttttgaaa

SEQ ID NO: 200592 - DNA, 16 bp, P. troglodytes
agaaatatttttgtaa

SEQ ID NO: 200593 - DNA, 16 bp, P. troglodytes
agaaatcaaaatggaa

SEQ ID NO: 200594 - DNA, 16 bp, P. troglodytes
agaaatcaagaaagga

SEQ ID NO: 200595 - DNA, 16 bp, P. troglodytes
agaaatcaagcgcagc

SEQ ID NO: 200596 - DNA, 16 bp, P. troglodytes
agaaatcaaggaaaca

SEQ ID NO: 200597 - DNA, 16 bp, P. troglodytes
agaaatcaaggctcag

SEQ ID NO: 200598 - DNA, 16 bp, P. troglodytes
agaaatcaagttcttt

SEQ ID NO: 200599 - DNA, 16 bp, P. troglodytes
agaaatcaataaaatt

SEQ ID NO: 200600 - DNA, 16 bp, P. troglodytes
agaaatcaatgagaaa

SEQ ID NO: 200601 - DNA, 16 bp, P. troglodytes
agaaatcagaaagaag

SEQ ID NO: 200602 - DNA, 16 bp, P. troglodytes
agaaatccctgattta

SEQ ID NO: 200603 - DNA, 16 bp, P. troglodytes
agaaatcctaagcaaa

SEQ ID NO: 200604 - DNA, 16 bp, P. troglodytes
agaaatcctgaactat

SEQ ID NO: 200605 - DNA, 16 bp, P. troglodytes
agaaatcctggaactg

SEQ ID NO: 200606 - DNA, 16 bp, P. troglodytes
agaaatctccaaattg

SEQ ID NO: 200607 - DNA, 16 bp, P. troglodytes
agaaatctgaaggcca

SEQ ID NO: 200608 - DNA, 16 bp, P. troglodytes
agaaatctttcttctt

SEQ ID NO: 200609 - DNA, 16 bp, P. troglodytes
agaaatgaaaactgaa

SEQ ID NO: 200610 - DNA, 16 bp, P. troglodytes
agaaatgaaacaattt

SEQ ID NO: 200611 - DNA, 16 bp, P. troglodytes
agaaatgaaactggag

SEQ ID NO: 200612 - DNA, 16 bp, P. troglodytes
agaaatgaaagcagag

SEQ ID NO: 200613 - DNA, 16 bp, P. troglodytes
agaaatgaaatgggag

SEQ ID NO: 200614 - DNA, 16 bp, P. troglodytes
agaaatgaacaaagca

SEQ ID NO: 200615 - DNA, 16 bp, P. troglodytes
agaaatgaagaatgct

SEQ ID NO: 200616 - DNA, 16 bp, P. troglodytes
agaaatgaaggcagaa

SEQ ID NO: 200617 - DNA, 16 bp, P. troglodytes
agaaatgaagtcaaat

SEQ ID NO: 200618 - DNA, 16 bp, P. troglodytes
agaaatgaatgaaatt

SEQ ID NO: 200619 - DNA, 16 bp, P. troglodytes
agaaatgaatggaaat

SEQ ID NO: 200620 - DNA, 16 bp, P. troglodytes
agaaatgaatttcttt

SEQ ID NO: 200621 - DNA, 16 bp, P. troglodytes
agaaatgaatttgaaa

SEQ ID NO: 200622 - DNA, 16 bp, P. troglodytes
agaaatgacacaaata

SEQ ID NO: 200623 - DNA, 16 bp, P. troglodytes
agaaatgacaccaaaa

SEQ ID NO: 200624 - DNA, 16 bp, P. troglodytes
agaaatgacattttta

SEQ ID NO: 200625 - DNA, 16 bp, P. troglodytes
agaaatgactgtggtg

SEQ ID NO: 200626 - DNA, 16 bp, P. troglodytes
agaaatgagagaagac

SEQ ID NO: 200627 - DNA, 16 bp, P. troglodytes
agaaatgataaatgtt

SEQ ID NO: 200628 - DNA, 16 bp, P. troglodytes
agaaatgattatttta

SEQ ID NO: 200629 - DNA, 16 bp, P. troglodytes
agaaatgatttttaaa

SEQ ID NO: 200630 - DNA, 16 bp, P. troglodytes
agaaatgcaaaaatct

SEQ ID NO: 200631 - DNA, 16 bp, P. troglodytes
agaaatgcaaaatgtt

SEQ ID NO: 200632 - DNA, 16 bp, P. troglodytes
agaaatgcaaactaat

SEQ ID NO: 200633 - DNA, 16 bp, P. troglodytes
agaaatgcaaatgcaa

SEQ ID NO: 200634 - DNA, 16 bp, P. troglodytes
agaaatgcaactaatt

SEQ ID NO: 200635 - DNA, 16 bp, P. troglodytes
agaaatgcaagtaaaa

SEQ ID NO: 200636 - DNA, 16 bp, P. troglodytes
agaaatgcacagaaaa

SEQ ID NO: 200637 - DNA, 16 bp, P. troglodytes
agaaatgcacatcaaa

SEQ ID NO: 200638 - DNA, 16 bp, P. troglodytes
agaaatgcagaatttc

SEQ ID NO: 200639 - DNA, 16 bp, P. troglodytes
agaaatgcatatcaaa

SEQ ID NO: 200640 - DNA, 16 bp, P. troglodytes
agaaatgcatccttag

SEQ ID NO: 200641 - DNA, 16 bp, P. troglodytes
agaaatgctactggtt

SEQ ID NO: 200642 - DNA, 16 bp, P. troglodytes
agaaatgctgaaaatt

SEQ ID NO: 200643 - DNA, 16 bp, P. troglodytes
agaaatgcttaaggaa

SEQ ID NO: 200644 - DNA, 16 bp, P. troglodytes
agaaatgcttttaaaa

SEQ ID NO: 200645 - DNA, 16 bp, P. troglodytes
agaaatggaaaagctg

SEQ ID NO: 200646 - DNA, 16 bp, P. troglodytes
agaaatggaaaatatt

SEQ ID NO: 200647 - DNA, 16 bp, P. troglodytes
agaaatggaaacatat

SEQ ID NO: 200648 - DNA, 16 bp, P. troglodytes
agaaatggaaattcta

SEQ ID NO: 200649 - DNA, 16 bp, P. troglodytes
agaaatggaagaaaac

SEQ ID NO: 200650 - DNA, 16 bp, P. troglodytes
agaaatggaagtcaaa

SEQ ID NO: 200651 - DNA, 16 bp, P. troglodytes
agaaatggaatcacac

SEQ ID NO: 200652 - DNA, 16 bp, P. troglodytes
agaaatggagaaacaa

SEQ ID NO: 200653 - DNA, 16 bp, P. troglodytes
agaaatggagcaggtc

SEQ ID NO: 200654 - DNA, 16 bp, P. troglodytes
agaaatggaggctcag

SEQ ID NO: 200655 - DNA, 16 bp, P. troglodytes
agaaatggcattttaa

SEQ ID NO: 200656 - DNA, 16 bp, P. troglodytes
agaaatggctaattct

SEQ ID NO: 200657 - DNA, 16 bp, P. troglodytes
agaaatggcttccctg

SEQ ID NO: 200658 - DNA, 16 bp, P. troglodytes
agaaatggggcttcac

SEQ ID NO: 200659 - DNA, 16 bp, P. troglodytes
agaaatgtaattttat

SEQ ID NO: 200660 - DNA, 16 bp, P. troglodytes
agaaatgtatatattt

SEQ ID NO: 200661 - DNA, 16 bp, P. troglodytes
agaaatgtatattttt

SEQ ID NO: 200662 - DNA, 16 bp, P. troglodytes
agaaatgtatcaattt

SEQ ID NO: 200663 - DNA, 16 bp, P. troglodytes
agaaatgtattatttc

SEQ ID NO: 200664 - DNA, 16 bp, P. troglodytes
agaaatgtattcctca

SEQ ID NO: 200665 - DNA, 16 bp, P. troglodytes
agaaatgtatttggct

SEQ ID NO: 200666 - DNA, 16 bp, P. troglodytes
agaaatgtattttaaa

SEQ ID NO: 200667 - DNA, 16 bp, P. troglodytes
agaaatgtatttttat

SEQ ID NO: 200668 - DNA, 16 bp, P. troglodytes
agaaatgtccattcaa

SEQ ID NO: 200669 - DNA, 16 bp, P. troglodytes
agaaatgtctattaag

SEQ ID NO: 200670 - DNA, 16 bp, P. troglodytes
agaaatgtctatttat

SEQ ID NO: 200671 - DNA, 16 bp, P. troglodytes
agaaatgtctgttcag

SEQ ID NO: 200672 - DNA, 16 bp, P. troglodytes
agaaatgtcttatttt

SEQ ID NO: 200673 - DNA, 16 bp, P. troglodytes
agaaatgttaaaagtt

SEQ ID NO: 200674 - DNA, 16 bp, P. troglodytes
agaaatgtttaaatct

SEQ ID NO: 200675 - DNA, 16 bp, P. troglodytes
agaaatgtttcctttt

SEQ ID NO: 200676 - DNA, 16 bp, P. troglodytes
agaaattaacaaaatt

SEQ ID NO: 200677 - DNA, 16 bp, P. troglodytes
agaaattaagatattc

SEQ ID NO: 200678 - DNA, 16 bp, P. troglodytes
agaaattagccaaaag

SEQ ID NO: 200679 - DNA, 16 bp, P. troglodytes
agaaattaggaaaaca

SEQ ID NO: 200680 - DNA, 16 bp, P. troglodytes
agaaattataaatgtt

SEQ ID NO: 200681 - DNA, 16 bp, P. troglodytes
agaaattattattctt

SEQ ID NO: 200682 - DNA, 16 bp, P. troglodytes
agaaattattgccaaa

SEQ ID NO: 200683 - DNA, 16 bp, P. troglodytes
agaaattcaaagaatt

SEQ ID NO: 200684 - DNA, 16 bp, P. troglodytes
agaaattcaaaggatt

SEQ ID NO: 200685 - DNA, 16 bp, P. troglodytes
agaaattcaaataatt

SEQ ID NO: 200686 - DNA, 16 bp, P. troglodytes
agaaattcaaatgaaa

SEQ ID NO: 200687 - DNA, 16 bp, P. troglodytes
agaaattcaacagaga

SEQ ID NO: 200688 - DNA, 17 bp, P. troglodytes
agaaattcaagcctgct

SEQ ID NO: 200689 - DNA, 16 bp, P. troglodytes
agaaattcagagctca

SEQ ID NO: 200690 - DNA, 16 bp, P. troglodytes
agaaattcattcaaaa

SEQ ID NO: 200691 - DNA, 16 bp, P. troglodytes
agaaattcatttctta

SEQ ID NO: 200692 - DNA, 16 bp, P. troglodytes
agaaattctgttttct

SEQ ID NO: 200693 - DNA, 16 bp, P. troglodytes
agaaattcttaatttt

SEQ ID NO: 200694 - DNA, 16 bp, P. troglodytes
agaaattcttagaaaa

SEQ ID NO: 200695 - DNA, 16 bp, P. troglodytes
agaaattctttcaaaa

SEQ ID NO: 200696 - DNA, 16 bp, P. troglodytes
agaaattctttgaaac

SEQ ID NO: 200697 - DNA, 16 bp, P. troglodytes
agaaattgaaatcata

SEQ ID NO: 200698 - DNA, 16 bp, P. troglodytes
agaaattgacaagctg

SEQ ID NO: 200699 - DNA, 16 bp, P. troglodytes
agaaattgaccttttg

SEQ ID NO: 200700 - DNA, 16 bp, P. troglodytes
agaaattgccaaacta

SEQ ID NO: 200701 - DNA, 16 bp, P. troglodytes
agaaattggagaccag

SEQ ID NO: 200702 - DNA, 16 bp, P. troglodytes
agaaattggcaagctg

SEQ ID NO: 200703 - DNA, 16 bp, P. troglodytes
agaaattggccaaaaa

SEQ ID NO: 200704 - DNA, 16 bp, P. troglodytes
agaaattgtccaaaac

SEQ ID NO: 200705 - DNA, 16 bp, P. troglodytes
agaaattgtggcacat

SEQ ID NO: 200706 - DNA, 16 bp, P. troglodytes
agaaattgtggcatat

SEQ ID NO: 200707 - DNA, 16 bp, P. troglodytes
agaaattgtttctttt

SEQ ID NO: 200708 - DNA, 16 bp, P. troglodytes
agaaattgttttaaaa

SEQ ID NO: 200709 - DNA, 16 bp, P. troglodytes
agaaatttaaaatact

SEQ ID NO: 200710 - DNA, 16 bp, P. troglodytes
agaaatttactttttt

SEQ ID NO: 200711 - DNA, 16 bp, P. troglodytes
agaaatttatctgttt

SEQ ID NO: 200712 - DNA, 16 bp, P. troglodytes
agaaatttatgaattt

SEQ ID NO: 200713 - DNA, 16 bp, P. troglodytes
agaaatttattctgcc

SEQ ID NO: 200714 - DNA, 16 bp, P. troglodytes
agaaatttatttccta

SEQ ID NO: 200715 - DNA, 16 bp, P. troglodytes
agaaatttatttctta

SEQ ID NO: 200716 - DNA, 16 bp, P. troglodytes
agaaatttcttccagc

SEQ ID NO: 200717 - DNA, 16 bp, P. troglodytes
agaaatttgcaaaagt

SEQ ID NO: 200718 - DNA, 17 bp, P. troglodytes
agaaatttgcataagta

SEQ ID NO: 200719 - DNA, 16 bp, P. troglodytes
agaaatttgctgttaa

SEQ ID NO: 200720 - DNA, 16 bp, P. troglodytes
agaaatttggccaggc

SEQ ID NO: 200721 - DNA, 16 bp, P. troglodytes
agaaattttaaaaatc

SEQ ID NO: 200722 - DNA, 16 bp, P. troglodytes
agaaattttagaaatt

SEQ ID NO: 200723 - DNA, 16 bp, P. troglodytes
agaaattttatttcta

SEQ ID NO: 200724 - DNA, 16 bp, P. troglodytes
agaaattttcagattt

SEQ ID NO: 200725 - DNA, 16 bp, P. troglodytes
agaaattttgaaattt

SEQ ID NO: 200726 - DNA, 16 bp, P. troglodytes
agaaattttggagctg

SEQ ID NO: 200727 - DNA, 16 bp, P. troglodytes
agaaattttgttttct

SEQ ID NO: 200728 - DNA, 16 bp, P. troglodytes
agaacaaaaagtttta

SEQ ID NO: 200729 - DNA, 16 bp, P. troglodytes
agaacaaagagacaat

SEQ ID NO: 200730 - DNA, 16 bp, P. troglodytes
agaacaaagattatta

SEQ ID NO: 200731 - DNA, 16 bp, P. troglodytes
agaacaaagtcagaag

SEQ ID NO: 200732 - DNA, 16 bp, P. troglodytes
agaacaaagttcaaga

SEQ ID NO: 200733 - DNA, 16 bp, P. troglodytes
agaacaaatggacaca

SEQ ID NO: 200734 - DNA, 16 bp, P. troglodytes
agaacaactttttttt

SEQ ID NO: 200735 - DNA, 16 bp, P. troglodytes
agaacaagaaatattt

SEQ ID NO: 200736 - DNA, 17 bp, P. troglodytes
agaacaagactctgcct

SEQ ID NO: 200737 - DNA, 16 bp, P. troglodytes
agaacaataacaagta

SEQ ID NO: 200738 - DNA, 16 bp, P. troglodytes
agaacaattagacaag

SEQ ID NO: 200739 - DNA, 16 bp, P. troglodytes
agaacacattttaaaa

SEQ ID NO: 200740 - DNA, 16 bp, P. troglodytes
agaacaccaaagattg

SEQ ID NO: 200741 - DNA, 16 bp, P. troglodytes
agaacaccacagactg

SEQ ID NO: 200742 - DNA, 16 bp, P. troglodytes
agaacacttaaaatct

SEQ ID NO: 200743 - DNA, 16 bp, P. troglodytes
agaacacttatattag

SEQ ID NO: 200744 - DNA, 16 bp, P. troglodytes
agaacacttgaacaca

SEQ ID NO: 200745 - DNA, 16 bp, P. troglodytes
agaacactttttaaaa

SEQ ID NO: 200746 - DNA, 16 bp, P. troglodytes
agaacagaaaattcca

SEQ ID NO: 200747 - DNA, 16 bp, P. troglodytes
agaacagaaagaaatg

SEQ ID NO: 200748 - DNA, 16 bp, P. troglodytes
agaacagaaattttaa

SEQ ID NO: 200749 - DNA, 16 bp, P. troglodytes
agaacagactaataca

SEQ ID NO: 200750 - DNA, 16 bp, P. troglodytes
agaacagatgaataca

SEQ ID NO: 200751 - DNA, 16 bp, P. troglodytes
agaacagcaagaggga

SEQ ID NO: 200752 - DNA, 16 bp, P. troglodytes
agaacagcaccaaagg

SEQ ID NO: 200753 - DNA, 16 bp, P. troglodytes
agaacagcaccaagga

SEQ ID NO: 200754 - DNA, 16 bp, P. troglodytes
agaacagcactgtcca

SEQ ID NO: 200755 - DNA, 16 bp, P. troglodytes
agaacagcagtggctg

SEQ ID NO: 200756 - DNA, 16 bp, P. troglodytes
agaacagcatgggaaa

SEQ ID NO: 200757 - DNA, 16 bp, P. troglodytes
agaacagcctaataca

SEQ ID NO: 200758 - DNA, 16 bp, P. troglodytes
agaacagcctggccaa

SEQ ID NO: 200759 - DNA, 16 bp, P. troglodytes
agaacagcgtgaaccc

SEQ ID NO: 200760 - DNA, 16 bp, P. troglodytes
agaacagcttttaaaa

SEQ ID NO: 200761 - DNA, 16 bp, P. troglodytes
agaacaggagttaact

SEQ ID NO: 200762 - DNA, 16 bp, P. troglodytes
agaacaggcaaaacta

SEQ ID NO: 200763 - DNA, 16 bp, P. troglodytes
agaacagtgagaaaat

SEQ ID NO: 200764 - DNA, 16 bp, P. troglodytes
agaacagtgagaaata

SEQ ID NO: 200765 - DNA, 16 bp, P. troglodytes
agaacagtgcttgaca

SEQ ID NO: 200766 - DNA, 16 bp, P. troglodytes
agaacagtggttatca

SEQ ID NO: 200767 - DNA, 16 bp, P. troglodytes
agaacagtggttgcct

SEQ ID NO: 200768 - DNA, 16 bp, P. troglodytes
agaacagttcctggca

SEQ ID NO: 200769 - DNA, 16 bp, P. troglodytes
agaacagtttgaaggt

SEQ ID NO: 200770 - DNA, 16 bp, P. troglodytes
agaacataaaatattt

SEQ ID NO: 200771 - DNA, 16 bp, P. troglodytes
agaacataggatgttt

SEQ ID NO: 200772 - DNA, 16 bp, P. troglodytes
agaacatatggcattt

SEQ ID NO: 200773 - DNA, 16 bp, P. troglodytes
agaacatcagagaaag

SEQ ID NO: 200774 - DNA, 16 bp, P. troglodytes
agaacatcatgaaagt

SEQ ID NO: 200775 - DNA, 27 bp, P. troglodytes
agaacatctttatttctgccttcattt

SEQ ID NO: 200776 - DNA, 16 bp, P. troglodytes
agaacatctttttttc

SEQ ID NO: 200777 - DNA, 16 bp, P. troglodytes
agaacatgcaaaattt

SEQ ID NO: 200778 - DNA, 16 bp, P. troglodytes
agaacatgcagcattt

SEQ ID NO: 200779 - DNA, 16 bp, P. troglodytes
agaacatgtgatgttt

SEQ ID NO: 200780 - DNA, 16 bp, P. troglodytes
agaacattaatttttt

SEQ ID NO: 200781 - DNA, 16 bp, P. troglodytes
agaacattaggacaaa

SEQ ID NO: 200782 - DNA, 16 bp, P. troglodytes
agaacatttaaaattt

SEQ ID NO: 200783 - DNA, 16 bp, P. troglodytes
agaacatttcatccaa

SEQ ID NO: 200784 - DNA, 16 bp, P. troglodytes
agaacatttccatcaa

SEQ ID NO: 200785 - DNA, 16 bp, P. troglodytes
agaacattttaaaaaa

SEQ ID NO: 200786 - DNA, 16 bp, P. troglodytes
agaacattttcatctc

SEQ ID NO: 200787 - DNA, 16 bp, P. troglodytes
agaacatttttgcaat

SEQ ID NO: 200788 - DNA, 16 bp, P. troglodytes
agaaccaaatgaaaat

SEQ ID NO: 200789 - DNA, 17 bp, P. troglodytes
agaaccaagttggaaaa

SEQ ID NO: 200790 - DNA, 16 bp, P. troglodytes
agaaccacccagccaa

SEQ ID NO: 200791 - DNA, 16 bp, P. troglodytes
agaaccactgatttaa

SEQ ID NO: 200792 - DNA, 16 bp, P. troglodytes
agaaccagaaaaatct

SEQ ID NO: 200793 - DNA, 16 bp, P. troglodytes
agaaccagaaatacaa

SEQ ID NO: 200794 - DNA, 16 bp, P. troglodytes
agaaccagagagatgg

SEQ ID NO: 200795 - DNA, 16 bp, P. troglodytes
agaaccaggaaagctg

SEQ ID NO: 200796 - DNA, 16 bp, P. troglodytes
agaaccaggagcacca

SEQ ID NO: 200797 - DNA, 16 bp, P. troglodytes
agaaccaggatttgaa

SEQ ID NO: 200798 - DNA, 16 bp, P. troglodytes
agaacccagaaattaa

SEQ ID NO: 200799 - DNA, 18 bp, P. troglodytes
agaacccaggaggtggag

SEQ ID NO: 200800 - DNA, 16 bp, P. troglodytes
agaacccggaaataaa

SEQ ID NO: 200801 - DNA, 16 bp, P. troglodytes
agaaccctcctgggct

SEQ ID NO: 200802 - DNA, 16 bp, P. troglodytes
agaacctagaaataaa

SEQ ID NO: 200803 - DNA, 16 bp, P. troglodytes
agaacctctactaagg

SEQ ID NO: 200804 - DNA, 16 bp, P. troglodytes
agaacctgaccaaaaa

SEQ ID NO: 200805 - DNA, 16 bp, P. troglodytes
agaacctggagttctg

SEQ ID NO: 200806 - DNA, 16 bp, P. troglodytes
agaacctggcacctcc

SEQ ID NO: 200807 - DNA, 17 bp, P. troglodytes
agaacctgggaggcaga

SEQ ID NO: 200808 - DNA, 16 bp, P. troglodytes
agaacgagactctgtc

SEQ ID NO: 200809 - DNA, 16 bp, P. troglodytes
agaacggactaataca

SEQ ID NO: 200810 - DNA, 16 bp, P. troglodytes
agaactaaagaagcaa

SEQ ID NO: 200811 - DNA, 16 bp, P. troglodytes
agaactaaatcaaaag

SEQ ID NO: 200812 - DNA, 16 bp, P. troglodytes
agaactaaggacaaaa

SEQ ID NO: 200813 - DNA, 16 bp, P. troglodytes
agaactaatgacaaaa

SEQ ID NO: 200814 - DNA, 16 bp, P. troglodytes
agaactacaaaatgct

SEQ ID NO: 200815 - DNA, 16 bp, P. troglodytes
agaactacaaacaact

SEQ ID NO: 200816 - DNA, 22 bp, P. troglodytes
agaactacaaaccactgctcag

SEQ ID NO: 200817 - DNA, 24 bp, P. troglodytes
agaactacgtgaagaatgcagaag

SEQ ID NO: 200818 - DNA, 16 bp, P. troglodytes
agaactagaaaaacca

SEQ ID NO: 200819 - DNA, 16 bp, P. troglodytes
agaactagagaagcag

SEQ ID NO: 200820 - DNA, 16 bp, P. troglodytes
agaactagagaaggaa

SEQ ID NO: 200821 - DNA, 16 bp, P. troglodytes
agaactaggaatacca

SEQ ID NO: 200822 - DNA, 16 bp, P. troglodytes
agaactatgagaagta

SEQ ID NO: 200823 - DNA, 16 bp, P. troglodytes
agaactatgtgaagaa

SEQ ID NO: 200824 - DNA, 16 bp, P. troglodytes
agaactatgtgacgca

SEQ ID NO: 200825 - DNA, 16 bp, P. troglodytes
agaactcaaagaaatt

SEQ ID NO: 200826 - DNA, 16 bp, P. troglodytes
agaactcactcattat

SEQ ID NO: 200827 - DNA, 16 bp, P. troglodytes
agaactcagaaacaaa

SEQ ID NO: 200828 - DNA, 16 bp, P. troglodytes
agaactcattcactat

SEQ ID NO: 200829 - DNA, 16 bp, P. troglodytes
agaactcctgaaggaa

SEQ ID NO: 200830 - DNA, 16 bp, P. troglodytes
agaactctccacccca

SEQ ID NO: 200831 - DNA, 16 bp, P. troglodytes
agaactctccatactg

SEQ ID NO: 200832 - DNA, 16 bp, P. troglodytes
agaactcttggcctca

SEQ ID NO: 200833 - DNA, 16 bp, P. troglodytes
agaactgaaaaatata

SEQ ID NO: 200834 - DNA, 16 bp, P. troglodytes
agaactgaaggacata

SEQ ID NO: 200835 - DNA, 16 bp, P. troglodytes
agaactgaaggagtta

SEQ ID NO: 200836 - DNA, 16 bp, P. troglodytes
agaactgaattgaatt

SEQ ID NO: 200837 - DNA, 16 bp, P. troglodytes
agaactgacatcttta

SEQ ID NO: 200838 - DNA, 16 bp, P. troglodytes
agaactgacattttta

SEQ ID NO: 200839 - DNA, 16 bp, P. troglodytes
agaactgagagacaat

SEQ ID NO: 200840 - DNA, 16 bp, P. troglodytes
agaactgattgcttgc

SEQ ID NO: 200841 - DNA, 16 bp, P. troglodytes
agaactgcctctgagc

SEQ ID NO: 200842 - DNA, 16 bp, P. troglodytes
agaactggaaaagcaa

SEQ ID NO: 200843 - DNA, 16 bp, P. troglodytes
agaactggaacaaaac

SEQ ID NO: 200844 - DNA, 17 bp, P. troglodytes
agaactggaacaagaca

SEQ ID NO: 200845 - DNA, 16 bp, P. troglodytes
agaactgggatttgaa

SEQ ID NO: 200846 - DNA, 16 bp, P. troglodytes
agaactgtctattcaa

SEQ ID NO: 200847 - DNA, 16 bp, P. troglodytes
agaactgtgagaaaca

SEQ ID NO: 200848 - DNA, 16 bp, P. troglodytes
agaactgtgagataat

SEQ ID NO: 200849 - DNA, 16 bp, P. troglodytes
agaacttaaaaataca

SEQ ID NO: 200850 - DNA, 16 bp, P. troglodytes
agaacttaaagaaatt

SEQ ID NO: 200851 - DNA, 16 bp, P. troglodytes
agaacttaaagcaaaa

SEQ ID NO: 200852 - DNA, 16 bp, P. troglodytes
agaacttaaagtaaaa

SEQ ID NO: 200853 - DNA, 16 bp, P. troglodytes
agaacttattccttct

SEQ ID NO: 200854 - DNA, 16 bp, P. troglodytes
agaacttcacaatgca

SEQ ID NO: 200855 - DNA, 16 bp, P. troglodytes
agaacttcagagctca

SEQ ID NO: 200856 - DNA, 18 bp, P. troglodytes
agaacttccccaacctag

SEQ ID NO: 200857 - DNA, 16 bp, P. troglodytes
agaacttcgtgaagca

SEQ ID NO: 200858 - DNA, 18 bp, P. troglodytes
agaacttcgtgaagcata

SEQ ID NO: 200859 - DNA, 16 bp, P. troglodytes
agaacttctcaaacct

SEQ ID NO: 200860 - DNA, 16 bp, P. troglodytes
agaacttgatttctgc

SEQ ID NO: 200861 - DNA, 16 bp, P. troglodytes
agaactttctgtgatg

SEQ ID NO: 200862 - DNA, 16 bp, P. troglodytes
agaactttctttcttt

SEQ ID NO: 200863 - DNA, 16 bp, P. troglodytes
agaactttgagaaata

SEQ ID NO: 200864 - DNA, 16 bp, P. troglodytes
agaactttgtgaaaca

SEQ ID NO: 200865 - DNA, 16 bp, P. troglodytes
agaactttgtgacaca

SEQ ID NO: 200866 - DNA, 16 bp, P. troglodytes
agaacttttctttttt

SEQ ID NO: 200867 - DNA, 16 bp, P. troglodytes
agaacttttttatttt

SEQ ID NO: 200868 - DNA, 16 bp, P. troglodytes
agaagaaaaaactgag

SEQ ID NO: 200869 - DNA, 16 bp, P. troglodytes
agaagaaaaacaattt

SEQ ID NO: 200870 - DNA, 16 bp, P. troglodytes
agaagaaaaactattt

SEQ ID NO: 200871 - DNA, 16 bp, P. troglodytes
agaagaaaaacttcat

SEQ ID NO: 200872 - DNA, 16 bp, P. troglodytes
agaagaaaaataatct

SEQ ID NO: 200873 - DNA, 16 bp, P. troglodytes
agaagaaaaatctcaa

SEQ ID NO: 200874 - DNA, 16 bp, P. troglodytes
agaagaaaaatgttat

SEQ ID NO: 200875 - DNA, 16 bp, P. troglodytes
agaagaaaaattatct

SEQ ID NO: 200876 - DNA, 16 bp, P. troglodytes
agaagaaaaattcaga

SEQ ID NO: 200877 - DNA, 16 bp, P. troglodytes
agaagaaaaatttcaa

SEQ ID NO: 200878 - DNA, 16 bp, P. troglodytes
agaagaaaacattgga

SEQ ID NO: 200879 - DNA, 16 bp, P. troglodytes
agaagaaaacattttt

SEQ ID NO: 200880 - DNA, 16 bp, P. troglodytes
agaagaaaaccaaggc

SEQ ID NO: 200881 - DNA, 16 bp, P. troglodytes
agaagaaaacccagga

SEQ ID NO: 200882 - DNA, 16 bp, P. troglodytes
agaagaaaacctgagg

SEQ ID NO: 200883 - DNA, 16 bp, P. troglodytes
agaagaaaagataact

SEQ ID NO: 200884 - DNA, 16 bp, P. troglodytes
agaagaaaagatcagt

SEQ ID NO: 200885 - DNA, 16 bp, P. troglodytes
agaagaaaagtttgaa

SEQ ID NO: 200886 - DNA, 16 bp, P. troglodytes
agaagaaaataacttt

SEQ ID NO: 200887 - DNA, 16 bp, P. troglodytes
agaagaaaatacagag

SEQ ID NO: 200888 - DNA, 16 bp, P. troglodytes
agaagaaaatatttct

SEQ ID NO: 200889 - DNA, 16 bp, P. troglodytes
agaagaaaatctggaa

SEQ ID NO: 200890 - DNA, 16 bp, P. troglodytes
agaagaaaatgtcaaa

SEQ ID NO: 200891 - DNA, 16 bp, P. troglodytes
agaagaaaatgttatt

SEQ ID NO: 200892 - DNA, 16 bp, P. troglodytes
agaagaaaatgtttat

SEQ ID NO: 200893 - DNA, 16 bp, P. troglodytes
agaagaaaatgtttta

SEQ ID NO: 200894 - DNA, 16 bp, P. troglodytes
agaagaaaattcattt

SEQ ID NO: 200895 - DNA, 16 bp, P. troglodytes
agaagaaaatttcaaa

SEQ ID NO: 200896 - DNA, 16 bp, P. troglodytes
agaagaaacaaaattt

SEQ ID NO: 200897 - DNA, 16 bp, P. troglodytes
agaagaaacatcagaa

SEQ ID NO: 200898 - DNA, 16 bp, P. troglodytes
agaagaaactgaggct

SEQ ID NO: 200899 - DNA, 16 bp, P. troglodytes
agaagaaagaaacatg

SEQ ID NO: 200900 - DNA, 16 bp, P. troglodytes
agaagaaagaatctgt

SEQ ID NO: 200901 - DNA, 16 bp, P. troglodytes
agaagaaagaatttga

SEQ ID NO: 200902 - DNA, 16 bp, P. troglodytes
agaagaaagagcaaat

SEQ ID NO: 200903 - DNA, 16 bp, P. troglodytes
agaagaaagcttcaga

SEQ ID NO: 200904 - DNA, 16 bp, P. troglodytes
agaagaaagtgaaaca

SEQ ID NO: 200905 - DNA, 16 bp, P. troglodytes
agaagaaagtggaatg

SEQ ID NO: 200906 - DNA, 16 bp, P. troglodytes
agaagaaataaaatcc

SEQ ID NO: 200907 - DNA, 16 bp, P. troglodytes
agaagaaataattttt

SEQ ID NO: 200908 - DNA, 16 bp, P. troglodytes
agaagaaatacaaatg

SEQ ID NO: 200909 - DNA, 16 bp, P. troglodytes
agaagaaatgtttgaa

SEQ ID NO: 200910 - DNA, 16 bp, P. troglodytes
agaagaaattatttag

SEQ ID NO: 200911 - DNA, 16 bp, P. troglodytes
agaagaaatttcaaaa

SEQ ID NO: 200912 - DNA, 16 bp, P. troglodytes
agaagaaatttctaaa

SEQ ID NO: 200913 - DNA, 16 bp, P. troglodytes
agaagaaatttttttt

SEQ ID NO: 200914 - DNA, 16 bp, P. troglodytes
agaagaacagaatgct

SEQ ID NO: 200915 - DNA, 16 bp, P. troglodytes
agaagaacataaatga

SEQ ID NO: 200916 - DNA, 16 bp, P. troglodytes
agaagaacattccaga

SEQ ID NO: 200917 - DNA, 16 bp, P. troglodytes
agaagaaccaaatgaa

SEQ ID NO: 200918 - DNA, 16 bp, P. troglodytes
agaagaactacaaaac

SEQ ID NO: 200919 - DNA, 16 bp, P. troglodytes
agaagaactagaaaag

SEQ ID NO: 200920 - DNA, 16 bp, P. troglodytes
agaagaactagagaag

SEQ ID NO: 200921 - DNA, 16 bp, P. troglodytes
agaagaactggtacca

SEQ ID NO: 200922 - DNA, 16 bp, P. troglodytes
agaagaactttttttt

SEQ ID NO: 200923 - DNA, 16 bp, P. troglodytes
agaagaagaaattatt

SEQ ID NO: 200924 - DNA, 16 bp, P. troglodytes
agaagaagagactgag

SEQ ID NO: 200925 - DNA, 16 bp, P. troglodytes
agaagaagcagcagga

SEQ ID NO: 200926 - DNA, 16 bp, P. troglodytes
agaagaagcttctctg

SEQ ID NO: 200927 - DNA, 16 bp, P. troglodytes
agaagaaggaaattct

SEQ ID NO: 200928 - DNA, 16 bp, P. troglodytes
agaagaaggcttcaaa

SEQ ID NO: 200929 - DNA, 16 bp, P. troglodytes
agaagaagtaaaaact

SEQ ID NO: 200930 - DNA, 16 bp, P. troglodytes
agaagaatataaattg

SEQ ID NO: 200931 - DNA, 16 bp, P. troglodytes
agaagaatattttgtg

SEQ ID NO: 200932 - DNA, 16 bp, P. troglodytes
agaagaatcaattgaa

SEQ ID NO: 200933 - DNA, 16 bp, P. troglodytes
agaagaatcacttgag

SEQ ID NO: 200934 - DNA, 16 bp, P. troglodytes
agaagaatcacttgga

SEQ ID NO: 200935 - DNA, 16 bp, P. troglodytes
agaagaatcactttaa

SEQ ID NO: 200936 - DNA, 16 bp, P. troglodytes
agaagaatggtgtgaa

SEQ ID NO: 200937 - DNA, 16 bp, P. troglodytes
agaagaatgtggaaag

SEQ ID NO: 200938 - DNA, 16 bp, P. troglodytes
agaagaattatctgga

SEQ ID NO: 200939 - DNA, 16 bp, P. troglodytes
agaagaattttggaaa

SEQ ID NO: 200940 - DNA, 16 bp, P. troglodytes
agaagacaaaactgag

SEQ ID NO: 200941 - DNA, 16 bp, P. troglodytes
agaagacaaagatgaa

SEQ ID NO: 200942 - DNA, 16 bp, P. troglodytes
agaagacaatgaaata

SEQ ID NO: 200943 - DNA, 16 bp, P. troglodytes
agaagacacagagaca

SEQ ID NO: 200944 - DNA, 16 bp, P. troglodytes
agaagacacataaatg

SEQ ID NO: 200945 - DNA, 16 bp, P. troglodytes
agaagacagtggagca

SEQ ID NO: 200946 - DNA, 16 bp, P. troglodytes
agaagacatacagatg

SEQ ID NO: 200947 - DNA, 16 bp, P. troglodytes
agaagacatagaagaa

SEQ ID NO: 200948 - DNA, 16 bp, P. troglodytes
agaagacatctatgca

SEQ ID NO: 200949 - DNA, 16 bp, P. troglodytes
agaagacatttttaaa

SEQ ID NO: 200950 - DNA, 16 bp, P. troglodytes
agaagacccaaataaa

SEQ ID NO: 200951 - DNA, 16 bp, P. troglodytes
agaagaccctgtctca

SEQ ID NO: 200952 - DNA, 16 bp, P. troglodytes
agaagacctacaaatg

SEQ ID NO: 200953 - DNA, 16 bp, P. troglodytes
agaagacggccatctg

SEQ ID NO: 200954 - DNA, 16 bp, P. troglodytes
agaagagaaaaattgt

SEQ ID NO: 200955 - DNA, 16 bp, P. troglodytes
agaagagaaaactgaa

SEQ ID NO: 200956 - DNA, 16 bp, P. troglodytes
agaagagaaactccaa

SEQ ID NO: 200957 - DNA, 16 bp, P. troglodytes
agaagagaaatgattt

SEQ ID NO: 200958 - DNA, 16 bp, P. troglodytes
agaagagaacttgtgc

SEQ ID NO: 200959 - DNA, 16 bp, P. troglodytes
agaagagaatgagatg

SEQ ID NO: 200960 - DNA, 16 bp, P. troglodytes
agaagagagaagatct

SEQ ID NO: 200961 - DNA, 16 bp, P. troglodytes
agaagagagagcaaat

SEQ ID NO: 200962 - DNA, 16 bp, P. troglodytes
agaagagagagcccag

SEQ ID NO: 200963 - DNA, 16 bp, P. troglodytes
agaagagaggaagtca

SEQ ID NO: 200964 - DNA, 16 bp, P. troglodytes
agaagagaggacttga

SEQ ID NO: 200965 - DNA, 16 bp, P. troglodytes
agaagagcaaaactcc

SEQ ID NO: 200966 - DNA, 16 bp, P. troglodytes
agaagagcgaaactcc

SEQ ID NO: 200967 - DNA, 16 bp, P. troglodytes
agaagagctgcggccc

SEQ ID NO: 200968 - DNA, 16 bp, P. troglodytes
agaagaggaaactgaa

SEQ ID NO: 200969 - DNA, 16 bp, P. troglodytes
agaagaggaaattgag

SEQ ID NO: 200970 - DNA, 16 bp, P. troglodytes
agaagaggaagaggcc

SEQ ID NO: 200971 - DNA, 16 bp, P. troglodytes
agaagaggaccaccat

SEQ ID NO: 200972 - DNA, 16 bp, P. troglodytes
agaagaggtgctctga

SEQ ID NO: 200973 - DNA, 16 bp, P. troglodytes
agaagaggtttcacca

SEQ ID NO: 200974 - DNA, 16 bp, P. troglodytes
agaagagtacctggca

SEQ ID NO: 200975 - DNA, 16 bp, P. troglodytes
agaagagtgcctggca

SEQ ID NO: 200976 - DNA, 16 bp, P. troglodytes
agaagagtttttatta

SEQ ID NO: 200977 - DNA, 16 bp, P. troglodytes
agaagataacacagga

SEQ ID NO: 200978 - DNA, 16 bp, P. troglodytes
agaagataactttgga

SEQ ID NO: 200979 - DNA, 16 bp, P. troglodytes
agaagatacacagatg

SEQ ID NO: 200980 - DNA, 16 bp, P. troglodytes
agaagatatttgcaat

SEQ ID NO: 200981 - DNA, 16 bp, P. troglodytes
agaagatatttgtaat

SEQ ID NO: 200982 - DNA, 17 bp, P. troglodytes
agaagatcaagaccatc

SEQ ID NO: 200983 - DNA, 16 bp, P. troglodytes
agaagatcaatgaaac

SEQ ID NO: 200984 - DNA, 16 bp, P. troglodytes
agaagatcgagatcat

SEQ ID NO: 200985 - DNA, 16 bp, P. troglodytes
agaagatgaaactgag

SEQ ID NO: 200986 - DNA, 16 bp, P. troglodytes
agaagatgacagctcc

SEQ ID NO: 200987 - DNA, 16 bp, P. troglodytes
agaagatgcatggaaa

SEQ ID NO: 200988 - DNA, 16 bp, P. troglodytes
agaagatggaggctgc

SEQ ID NO: 200989 - DNA, 16 bp, P. troglodytes
agaagatgggaaaatg

SEQ ID NO: 200990 - DNA, 16 bp, P. troglodytes
agaagatgtatgaaaa

SEQ ID NO: 200991 - DNA, 16 bp, P. troglodytes
agaagatgtggagaaa

SEQ ID NO: 200992 - DNA, 16 bp, P. troglodytes
agaagatgtgggaaag

SEQ ID NO: 200993 - DNA, 16 bp, P. troglodytes
agaagattattttgga

SEQ ID NO: 200994 - DNA, 17 bp, P. troglodytes
agaagattgagaccatc

SEQ ID NO: 200995 - DNA, 16 bp, P. troglodytes
agaagattttttttaa

SEQ ID NO: 200996 - DNA, 16 bp, P. troglodytes
agaagcaaaaatattt

SEQ ID NO: 200997 - DNA, 16 bp, P. troglodytes
agaagcaaagagtaga

SEQ ID NO: 200998 - DNA, 16 bp, P. troglodytes
agaagcaaatgctgag

SEQ ID NO: 200999 - DNA, 16 bp, P. troglodytes
agaagcaacccaagtg

SEQ ID NO: 201000 - DNA, 16 bp, P. troglodytes
agaagcaactcaaatg

SEQ ID NO: 201001 - DNA, 16 bp, P. troglodytes
agaagcaagagcagac

SEQ ID NO: 201002 - DNA, 16 bp, P. troglodytes
agaagcaaggaaggat

SEQ ID NO: 201003 - DNA, 16 bp, P. troglodytes
agaagcagaaaaggcc

SEQ ID NO: 201004 - DNA, 16 bp, P. troglodytes
agaagcagaaaatata

SEQ ID NO: 201005 - DNA, 16 bp, P. troglodytes
agaagcagaacaactg

SEQ ID NO: 201006 - DNA, 16 bp, P. troglodytes
agaagcagaacctgag

SEQ ID NO: 201007 - DNA, 16 bp, P. troglodytes
agaagcagaagctgct

SEQ ID NO: 201008 - DNA, 16 bp, P. troglodytes
agaagcagaaggaata

SEQ ID NO: 201009 - DNA, 16 bp, P. troglodytes
agaagcagaagtggaa

SEQ ID NO: 201010 - DNA, 16 bp, P. troglodytes
agaagcagagaaaagt

SEQ ID NO: 201011 - DNA, 16 bp, P. troglodytes
agaagcagagcagatg

SEQ ID NO: 201012 - DNA, 16 bp, P. troglodytes
agaagcagagccagga

SEQ ID NO: 201013 - DNA, 16 bp, P. troglodytes
agaagcagagcctgag

SEQ ID NO: 201014 - DNA, 16 bp, P. troglodytes
agaagcagatgccaag

SEQ ID NO: 201015 - DNA, 16 bp, P. troglodytes
agaagcagcagaagca

SEQ ID NO: 201016 - DNA, 16 bp, P. troglodytes
agaagcagcagcaaca

SEQ ID NO: 201017 - DNA, 16 bp, P. troglodytes
agaagcagcagcagaa

SEQ ID NO: 201018 - DNA, 16 bp, P. troglodytes
agaagcagcagcagga

SEQ ID NO: 201019 - DNA, 16 bp, P. troglodytes
agaagcagcagctgga

SEQ ID NO: 201020 - DNA, 16 bp, P. troglodytes
agaagcagccaggcca

SEQ ID NO: 201021 - DNA, 16 bp, P. troglodytes
agaagcagccaggcta

SEQ ID NO: 201022 - DNA, 16 bp, P. troglodytes
agaagcagctcctcat

SEQ ID NO: 201023 - DNA, 16 bp, P. troglodytes
agaagcagctgcagtc

SEQ ID NO: 201024 - DNA, 16 bp, P. troglodytes
agaagcaggaggattg

SEQ ID NO: 201025 - DNA, 16 bp, P. troglodytes
agaagcagggagtaga

SEQ ID NO: 201026 - DNA, 16 bp, P. troglodytes
agaagcattctgaaaa

SEQ ID NO: 201027 - DNA, 16 bp, P. troglodytes
agaagcattgcatgca

SEQ ID NO: 201028 - DNA, 16 bp, P. troglodytes
agaagcatttgacaaa

SEQ ID NO: 201029 - DNA, 16 bp, P. troglodytes
agaagccaagaagaat

SEQ ID NO: 201030 - DNA, 16 bp, P. troglodytes
agaagccaagaagatg

SEQ ID NO: 201031 - DNA, 16 bp, P. troglodytes
agaagccaagggaaga

SEQ ID NO: 201032 - DNA, 16 bp, P. troglodytes
agaagccagagacaaa

SEQ ID NO: 201033 - DNA, 16 bp, P. troglodytes
agaagccagagagaga

SEQ ID NO: 201034 - DNA, 16 bp, P. troglodytes
agaagccaggcaaaaa

SEQ ID NO: 201035 - DNA, 16 bp, P. troglodytes
agaagccagttacaaa

SEQ ID NO: 201036 - DNA, 16 bp, P. troglodytes
agaagccataaaggaa

SEQ ID NO: 201037 - DNA, 16 bp, P. troglodytes
agaagcccaaacctca

SEQ ID NO: 201038 - DNA, 16 bp, P. troglodytes
agaagcccatcagact

SEQ ID NO: 201039 - DNA, 16 bp, P. troglodytes
agaagcccctctcagg

SEQ ID NO: 201040 - DNA, 16 bp, P. troglodytes
agaagcctcacaatca

SEQ ID NO: 201041 - DNA, 16 bp, P. troglodytes
agaagctaggagagaa

SEQ ID NO: 201042 - DNA, 16 bp, P. troglodytes
agaagctcaacatcac

SEQ ID NO: 201043 - DNA, 16 bp, P. troglodytes
agaagctcagtgagat

SEQ ID NO: 201044 - DNA, 16 bp, P. troglodytes
agaagctcttcctggc

SEQ ID NO: 201045 - DNA, 16 bp, P. troglodytes
agaagctgaaaaagac

SEQ ID NO: 201046 - DNA, 16 bp, P. troglodytes
agaagctgaaagaaca

SEQ ID NO: 201047 - DNA, 16 bp, P. troglodytes
agaagctgaagcagga

SEQ ID NO: 201048 - DNA, 16 bp, P. troglodytes
agaagctgagagaaga

SEQ ID NO: 201049 - DNA, 16 bp, P. troglodytes
agaagctgagcagatg

SEQ ID NO: 201050 - DNA, 16 bp, P. troglodytes
agaagctgagcaggtg

SEQ ID NO: 201051 - DNA, 16 bp, P. troglodytes
agaagctgaggcaaga

SEQ ID NO: 201052 - DNA, 16 bp, P. troglodytes
agaagctgcagcaaat

SEQ ID NO: 201053 - DNA, 16 bp, P. troglodytes
agaagctgcagcaagt

SEQ ID NO: 201054 - DNA, 16 bp, P. troglodytes
agaagctgcagtgagc

SEQ ID NO: 201055 - DNA, 16 bp, P. troglodytes
agaagctggaaaaaaa

SEQ ID NO: 201056 - DNA, 16 bp, P. troglodytes
agaagctggaaaaagc

SEQ ID NO: 201057 - DNA, 16 bp, P. troglodytes
agaagctggaaccaca

SEQ ID NO: 201058 - DNA, 16 bp, P. troglodytes
agaagctggacacaaa

SEQ ID NO: 201059 - DNA, 16 bp, P. troglodytes
agaagctggagctgct

SEQ ID NO: 201060 - DNA, 16 bp, P. troglodytes
agaagctggtggagca

SEQ ID NO: 201061 - DNA, 16 bp, P. troglodytes
agaagcttccagagga

SEQ ID NO: 201062 - DNA, 16 bp, P. troglodytes
agaagcttctctggat

SEQ ID NO: 201063 - DNA, 16 bp, P. troglodytes
agaagcttcttttttt

SEQ ID NO: 201064 - DNA, 16 bp, P. troglodytes
agaagctttatttttt

SEQ ID NO: 201065 - DNA, 16 bp, P. troglodytes
agaagctttctgaaaa

SEQ ID NO: 201066 - DNA, 16 bp, P. troglodytes
agaagcttttaatttt

SEQ ID NO: 201067 - DNA, 16 bp, P. troglodytes
agaaggaaaaaactcc

SEQ ID NO: 201068 - DNA, 16 bp, P. troglodytes
agaaggaaaacaaatt

SEQ ID NO: 201069 - DNA, 16 bp, P. troglodytes
agaaggaaaactaata

SEQ ID NO: 201070 - DNA, 16 bp, P. troglodytes
agaaggaaaatgacat

SEQ ID NO: 201071 - DNA, 16 bp, P. troglodytes
agaaggaaaatggcag

SEQ ID NO: 201072 - DNA, 16 bp, P. troglodytes
agaaggaaattctgtc

SEQ ID NO: 201073 - DNA, 16 bp, P. troglodytes
agaaggaacagcttcc

SEQ ID NO: 201074 - DNA, 16 bp, P. troglodytes
agaaggaaggaatgca

SEQ ID NO: 201075 - DNA, 16 bp, P. troglodytes
agaaggactttgtctt

SEQ ID NO: 201076 - DNA, 16 bp, P. troglodytes
agaaggaggagctggt

SEQ ID NO: 201077 - DNA, 16 bp, P. troglodytes
agaaggaggctgggca

SEQ ID NO: 201078 - DNA, 16 bp, P. troglodytes
agaaggatattttaaa

SEQ ID NO: 201079 - DNA, 16 bp, P. troglodytes
agaaggattaaagact

SEQ ID NO: 201080 - DNA, 16 bp, P. troglodytes
agaaggatttaacctt

SEQ ID NO: 201081 - DNA, 16 bp, P. troglodytes
agaaggattttttaaa

SEQ ID NO: 201082 - DNA, 16 bp, P. troglodytes
agaaggcaaagcagga

SEQ ID NO: 201083 - DNA, 16 bp, P. troglodytes
agaaggcagctgtcta

SEQ ID NO: 201084 - DNA, 16 bp, P. troglodytes
agaaggctgaggcagg

SEQ ID NO: 201085 - DNA, 16 bp, P. troglodytes
agaaggctgttttgtt

SEQ ID NO: 201086 - DNA, 16 bp, P. troglodytes
agaaggcttcagaaga

SEQ ID NO: 201087 - DNA, 16 bp, P. troglodytes
agaaggcttcagatga

SEQ ID NO: 201088 - DNA, 16 bp, P. troglodytes
agaaggcttcctggag

SEQ ID NO: 201089 - DNA, 16 bp, P. troglodytes
agaagggaaactgagg

SEQ ID NO: 201090 - DNA, 16 bp, P. troglodytes
agaagggaaatgtgga

SEQ ID NO: 201091 - DNA, 16 bp, P. troglodytes
agaagggaacagacac

SEQ ID NO: 201092 - DNA, 16 bp, P. troglodytes
agaagggagtttattt

SEQ ID NO: 201093 - DNA, 16 bp, P. troglodytes
agaaggggaaatttgg

SEQ ID NO: 201094 - DNA, 16 bp, P. troglodytes
agaagggggaggtgct

SEQ ID NO: 201095 - DNA, 16 bp, P. troglodytes
agaagggtgaggcagg

SEQ ID NO: 201096 - DNA, 16 bp, P. troglodytes
agaaggtcaaggctgc

SEQ ID NO: 201097 - DNA, 16 bp, P. troglodytes
agaaggtcagagagaa

SEQ ID NO: 201098 - DNA, 16 bp, P. troglodytes
agaaggtgacatttca

SEQ ID NO: 201099 - DNA, 16 bp, P. troglodytes
agaaggtgacatttga

SEQ ID NO: 201100 - DNA, 16 bp, P. troglodytes
agaaggtggagtttgc

SEQ ID NO: 201101 - DNA, 16 bp, P. troglodytes
agaaggtggctgtctg

SEQ ID NO: 201102 - DNA, 16 bp, P. troglodytes
agaaggtgtctgcttc

SEQ ID NO: 201103 - DNA, 16 bp, P. troglodytes
agaaggttgaagctgc

SEQ ID NO: 201104 - DNA, 16 bp, P. troglodytes
agaaggtttttaattt

SEQ ID NO: 201105 - DNA, 16 bp, P. troglodytes
agaagtaaaattttct

SEQ ID NO: 201106 - DNA, 16 bp, P. troglodytes
agaagtaattgcagtt

SEQ ID NO: 201107 - DNA, 16 bp, P. troglodytes
agaagtacaaagaaga

SEQ ID NO: 201108 - DNA, 16 bp, P. troglodytes
agaagtacaaagagga

SEQ ID NO: 201109 - DNA, 16 bp, P. troglodytes
agaagtagagtcctta

SEQ ID NO: 201110 - DNA, 16 bp, P. troglodytes
agaagtcaagaattaa

SEQ ID NO: 201111 - DNA, 16 bp, P. troglodytes
agaagtcaagcagatg

SEQ ID NO: 201112 - DNA, 16 bp, P. troglodytes
agaagtcagtctgaaa

SEQ ID NO: 201113 - DNA, 16 bp, P. troglodytes
agaagtccaagatgaa

SEQ ID NO: 201114 - DNA, 16 bp, P. troglodytes
agaagtctgaaaccaa

SEQ ID NO: 201115 - DNA, 16 bp, P. troglodytes
agaagtgaaattgtct

SEQ ID NO: 201116 - DNA, 16 bp, P. troglodytes
agaagtggaacaagac

SEQ ID NO: 201117 - DNA, 16 bp, P. troglodytes
agaagtggagcctgaa

SEQ ID NO: 201118 - DNA, 16 bp, P. troglodytes
agaagtggagttgctg

SEQ ID NO: 201119 - DNA, 16 bp, P. troglodytes
agaagtgggattgctg

SEQ ID NO: 201120 - DNA, 16 bp, P. troglodytes
agaagtgggcttcaga

SEQ ID NO: 201121 - DNA, 16 bp, P. troglodytes
agaagtgtcttttgcc

SEQ ID NO: 201122 - DNA, 16 bp, P. troglodytes
agaagttaaataactt

SEQ ID NO: 201123 - DNA, 16 bp, P. troglodytes
agaagttaaataattt

SEQ ID NO: 201124 - DNA, 16 bp, P. troglodytes
agaagttaaatgactt

SEQ ID NO: 201125 - DNA, 16 bp, P. troglodytes
agaagttaagaattga

SEQ ID NO: 201126 - DNA, 16 bp, P. troglodytes
agaagttcaagatcaa

SEQ ID NO: 201127 - DNA, 16 bp, P. troglodytes
agaagttgattctaac

SEQ ID NO: 201128 - DNA, 16 bp, P. troglodytes
agaagttgcaaaaata

SEQ ID NO: 201129 - DNA, 16 bp, P. troglodytes
agaagttgtagtgagc

SEQ ID NO: 201130 - DNA, 16 bp, P. troglodytes
agaagttgtggtgagc

SEQ ID NO: 201131 - DNA, 16 bp, P. troglodytes
agaagtttacagaaaa

SEQ ID NO: 201132 - DNA, 16 bp, P. troglodytes
agaagtttcagtgagc

SEQ ID NO: 201133 - DNA, 16 bp, P. troglodytes
agaagtttctgctgcc

SEQ ID NO: 201134 - DNA, 16 bp, P. troglodytes
agaagtttcttctgcc

SEQ ID NO: 201135 - DNA, 16 bp, P. troglodytes
agaagtttgaaatatt

SEQ ID NO: 201136 - DNA, 16 bp, P. troglodytes
agaagtttgaaatcag

SEQ ID NO: 201137 - DNA, 16 bp, P. troglodytes
agaagtttgcttcagg

SEQ ID NO: 201138 - DNA, 16 bp, P. troglodytes
agaagtttggagaaaa

SEQ ID NO: 201139 - DNA, 16 bp, P. troglodytes
agaagttttaaagttt

SEQ ID NO: 201140 - DNA, 16 bp, P. troglodytes
agaataaaaatcatat

SEQ ID NO: 201141 - DNA, 16 bp, P. troglodytes
agaataaaacatttaa

SEQ ID NO: 201142 - DNA, 16 bp, P. troglodytes
agaataaacttttttt

SEQ ID NO: 201143 - DNA, 16 bp, P. troglodytes
agaataaagaaattca

SEQ ID NO: 201144 - DNA, 16 bp, P. troglodytes
agaataaagctgaagg

SEQ ID NO: 201145 - DNA, 16 bp, P. troglodytes
agaataaatctcttaa

SEQ ID NO: 201146 - DNA, 16 bp, P. troglodytes
agaataaatgttttta

SEQ ID NO: 201147 - DNA, 16 bp, P. troglodytes
agaataaatttctgtt

SEQ ID NO: 201148 - DNA, 16 bp, P. troglodytes
agaataactttttttt

SEQ ID NO: 201149 - DNA, 16 bp, P. troglodytes
agaataagaatatttt

SEQ ID NO: 201150 - DNA, 16 bp, P. troglodytes
agaataagcaaatcca

SEQ ID NO: 201151 - DNA, 16 bp, P. troglodytes
agaataattatttgtt

SEQ ID NO: 201152 - DNA, 16 bp, P. troglodytes
agaataatttcagaaa

SEQ ID NO: 201153 - DNA, 16 bp, P. troglodytes
agaataattttctttt

SEQ ID NO: 201154 - DNA, 16 bp, P. troglodytes
agaatacacaaagaac

SEQ ID NO: 201155 - DNA, 16 bp, P. troglodytes
agaatacagcagtgaa

SEQ ID NO: 201156 - DNA, 16 bp, P. troglodytes
agaatacagccatatt

SEQ ID NO: 201157 - DNA, 16 bp, P. troglodytes
agaatacatatttttc

SEQ ID NO: 201158 - DNA, 16 bp, P. troglodytes
agaatacattttatat

SEQ ID NO: 201159 - DNA, 16 bp, P. troglodytes
agaataccatttgacc

SEQ ID NO: 201160 - DNA, 16 bp, P. troglodytes
agaatacctgaaactg

SEQ ID NO: 201161 - DNA, 17 bp, P. troglodytes
agaatacctgagactgg

SEQ ID NO: 201162 - DNA, 16 bp, P. troglodytes
agaatactctaatact

SEQ ID NO: 201163 - DNA, 16 bp, P. troglodytes
agaatacttaaaatct

SEQ ID NO: 201164 - DNA, 16 bp, P. troglodytes
agaatagaaatttatt

SEQ ID NO: 201165 - DNA, 16 bp, P. troglodytes
agaatagcacaagaaa

SEQ ID NO: 201166 - DNA, 16 bp, P. troglodytes
agaatagcacaggaaa

SEQ ID NO: 201167 - DNA, 16 bp, P. troglodytes
agaatagcacgggaaa

SEQ ID NO: 201168 - DNA, 16 bp, P. troglodytes
agaataggagaaaatt

SEQ ID NO: 201169 - DNA, 16 bp, P. troglodytes
agaatagtatctggca

SEQ ID NO: 201170 - DNA, 16 bp, P. troglodytes
agaatagtgcctggca

SEQ ID NO: 201171 - DNA, 16 bp, P. troglodytes
agaatatactttgtat

SEQ ID NO: 201172 - DNA, 16 bp, P. troglodytes
agaatatataaaaatc

SEQ ID NO: 201173 - DNA, 16 bp, P. troglodytes
agaatatataaagaac

SEQ ID NO: 201174 - DNA, 16 bp, P. troglodytes
agaatatatttacata

SEQ ID NO: 201175 - DNA, 16 bp, P. troglodytes
agaatatccaaataaa

SEQ ID NO: 201176 - DNA, 16 bp, P. troglodytes
agaatatctttttaaa

SEQ ID NO: 201177 - DNA, 16 bp, P. troglodytes
agaatatggcagaagt

SEQ ID NO: 201178 - DNA, 16 bp, P. troglodytes
agaatattatgcagcc

SEQ ID NO: 201179 - DNA, 16 bp, P. troglodytes
agaatattctacccaa

SEQ ID NO: 201180 - DNA, 16 bp, P. troglodytes
agaatatttcaaattt

SEQ ID NO: 201181 - DNA, 16 bp, P. troglodytes
agaatatttccatcac

SEQ ID NO: 201182 - DNA, 16 bp, P. troglodytes
agaatatttgaaatat

SEQ ID NO: 201183 - DNA, 16 bp, P. troglodytes
agaatattttcactga

SEQ ID NO: 201184 - DNA, 16 bp, P. troglodytes
agaatattttcatcac

SEQ ID NO: 201185 - DNA, 16 bp, P. troglodytes
agaatattttctaatt

SEQ ID NO: 201186 - DNA, 16 bp, P. troglodytes
agaatattttcttttt

SEQ ID NO: 201187 - DNA, 16 bp, P. troglodytes
agaatatttttcttca

SEQ ID NO: 201188 - DNA, 20 bp, P. troglodytes
agaatcaaatagacacaata

SEQ ID NO: 201189 - DNA, 16 bp, P. troglodytes
agaatcaaatgagaaa

SEQ ID NO: 201190 - DNA, 16 bp, P. troglodytes
agaatcacctggaaaa

SEQ ID NO: 201191 - DNA, 16 bp, P. troglodytes
agaatcacctgggaaa

SEQ ID NO: 201192 - DNA, 16 bp, P. troglodytes
agaatcactcgagccc

SEQ ID NO: 201193 - DNA, 16 bp, P. troglodytes
agaatcacttaaacca

SEQ ID NO: 201194 - DNA, 16 bp, P. troglodytes
agaatcacttcaaccc

SEQ ID NO: 201195 - DNA, 16 bp, P. troglodytes
agaatcacttgaaaac

SEQ ID NO: 201196 - DNA, 16 bp, P. troglodytes
agaatcatctggaagg

SEQ ID NO: 201197 - DNA, 16 bp, P. troglodytes
agaatcatgagccaat

SEQ ID NO: 201198 - DNA, 16 bp, P. troglodytes
agaatcatggcccctc

SEQ ID NO: 201199 - DNA, 16 bp, P. troglodytes
agaatcattctcagaa

SEQ ID NO: 201200 - DNA, 16 bp, P. troglodytes
agaatcatttgttgaa

SEQ ID NO: 201201 - DNA, 16 bp, P. troglodytes
agaatccagctgtctt

SEQ ID NO: 201202 - DNA, 16 bp, P. troglodytes
agaatccccatctcta

SEQ ID NO: 201203 - DNA, 16 bp, P. troglodytes
agaatcctatatccag

SEQ ID NO: 201204 - DNA, 16 bp, P. troglodytes
agaatcctgttaggtc

SEQ ID NO: 201205 - DNA, 16 bp, P. troglodytes
agaatcgcatgaaccc

SEQ ID NO: 201206 - DNA, 16 bp, P. troglodytes
agaatcgcttaaacca

SEQ ID NO: 201207 - DNA, 18 bp, P. troglodytes
agaatcgcttgaacccaa

SEQ ID NO: 201208 - DNA, 19 bp, P. troglodytes
agaatcgcttgaacccgga

SEQ ID NO: 201209 - DNA, 20 bp, P. troglodytes
agaatcgcttgaacctgggg

SEQ ID NO: 201210 - DNA, 16 bp, P. troglodytes
agaatctacaaagaaa

SEQ ID NO: 201211 - DNA, 16 bp, P. troglodytes
agaatctcttaaaccc

SEQ ID NO: 201212 - DNA, 16 bp, P. troglodytes
agaatctcttgaagcc

SEQ ID NO: 201213 - DNA, 16 bp, P. troglodytes
agaatctgcatttcca

SEQ ID NO: 201214 - DNA, 16 bp, P. troglodytes
agaatctgcatttgaa

SEQ ID NO: 201215 - DNA, 17 bp, P. troglodytes
agaatcttaagagctgt

SEQ ID NO: 201216 - DNA, 16 bp, P. troglodytes
agaatcttgctctgtc

SEQ ID NO: 201217 - DNA, 16 bp, P. troglodytes
agaatctttttttaaa

SEQ ID NO: 201218 - DNA, 16 bp, P. troglodytes
agaatgaaactgcatc

SEQ ID NO: 201219 - DNA, 16 bp, P. troglodytes
agaatgaaagtggatc

SEQ ID NO: 201220 - DNA, 16 bp, P. troglodytes
agaatgaaatcacatc

SEQ ID NO: 201221 - DNA, 16 bp, P. troglodytes
agaatgaaatggaaat

SEQ ID NO: 201222 - DNA, 16 bp, P. troglodytes
agaatgaagaaaagca

SEQ ID NO: 201223 - DNA, 16 bp, P. troglodytes
agaatgaagcaatgaa

SEQ ID NO: 201224 - DNA, 16 bp, P. troglodytes
agaatgaagctgcaga

SEQ ID NO: 201225 - DNA, 16 bp, P. troglodytes
agaatgaagttggatt

SEQ ID NO: 201226 - DNA, 16 bp, P. troglodytes
agaatgaatgaacaaa

SEQ ID NO: 201227 - DNA, 16 bp, P. troglodytes
agaatgaatgcaggag

SEQ ID NO: 201228 - DNA, 16 bp, P. troglodytes
agaatgacagtggatt

SEQ ID NO: 201229 - DNA, 16 bp, P. troglodytes
agaatgaccaaaatcc

SEQ ID NO: 201230 - DNA, 16 bp, P. troglodytes
agaatgagaccatgtc

SEQ ID NO: 201231 - DNA, 16 bp, P. troglodytes
agaatgagatcctgcc

SEQ ID NO: 201232 - DNA, 16 bp, P. troglodytes
agaatgagtttgacaa

SEQ ID NO: 201233 - DNA, 16 bp, P. troglodytes
agaatgatggtttcca

SEQ ID NO: 201234 - DNA, 16 bp, P. troglodytes
agaatgatgtgaaccc

SEQ ID NO: 201235 - DNA, 16 bp, P. troglodytes
agaatgattcatgaat

SEQ ID NO: 201236 - DNA, 16 bp, P. troglodytes
agaatgatttttaaaa

SEQ ID NO: 201237 - DNA, 16 bp, P. troglodytes
agaatgcagagaaaaa

SEQ ID NO: 201238 - DNA, 16 bp, P. troglodytes
agaatgcagcagaagt

SEQ ID NO: 201239 - DNA, 24 bp, P. troglodytes
agaatggaaccaagttagaaaaca

SEQ ID NO: 201240 - DNA, 24 bp, P. troglodytes
agaatggaaccaagttggaaaaca

SEQ ID NO: 201241 - DNA, 16 bp, P. troglodytes
agaatggaataataca

SEQ ID NO: 201242 - DNA, 16 bp, P. troglodytes
agaatggactaataca

SEQ ID NO: 201243 - DNA, 16 bp, P. troglodytes
agaatggagaaaagca

SEQ ID NO: 201244 - DNA, 16 bp, P. troglodytes
agaatggagaacccag

SEQ ID NO: 201245 - DNA, 16 bp, P. troglodytes
agaatggataaaaatt

SEQ ID NO: 201246 - DNA, 16 bp, P. troglodytes
agaatggatattatta

SEQ ID NO: 201247 - DNA, 16 bp, P. troglodytes
agaatggattaataca

SEQ ID NO: 201248 - DNA, 16 bp, P. troglodytes
agaatggcaccaagcc

SEQ ID NO: 201249 - DNA, 16 bp, P. troglodytes
agaatggccaaaataa

SEQ ID NO: 201250 - DNA, 16 bp, P. troglodytes
agaatggcctgaacct

SEQ ID NO: 201251 - DNA, 16 bp, P. troglodytes
agaatggcgtgaaccc

SEQ ID NO: 201252 - DNA, 16 bp, P. troglodytes
agaatggctaaaataa

SEQ ID NO: 201253 - DNA, 16 bp, P. troglodytes
agaatggctattaaca

SEQ ID NO: 201254 - DNA, 16 bp, P. troglodytes
agaatgggaaaaaatt

SEQ ID NO: 201255 - DNA, 16 bp, P. troglodytes
agaatgggagaaagtt

SEQ ID NO: 201256 - DNA, 16 bp, P. troglodytes
agaatgggagagaatt

SEQ ID NO: 201257 - DNA, 16 bp, P. troglodytes
agaatggtgactcctt

SEQ ID NO: 201258 - DNA, 16 bp, P. troglodytes
agaatggtgcctggca

SEQ ID NO: 201259 - DNA, 16 bp, P. troglodytes
agaatggtggttggca

SEQ ID NO: 201260 - DNA, 16 bp, P. troglodytes
agaatggtttcctggg

SEQ ID NO: 201261 - DNA, 16 bp, P. troglodytes
agaatggttttgtggg

SEQ ID NO: 201262 - DNA, 16 bp, P. troglodytes
agaatgtaaactccac

SEQ ID NO: 201263 - DNA, 16 bp, P. troglodytes
agaatgtataaagaat

SEQ ID NO: 201264 - DNA, 16 bp, P. troglodytes
agaatgtatttttaaa

SEQ ID NO: 201265 - DNA, 16 bp, P. troglodytes
agaatgtattttttaa

SEQ ID NO: 201266 - DNA, 16 bp, P. troglodytes
agaatgtgaggtcctg

SEQ ID NO: 201267 - DNA, 16 bp, P. troglodytes
agaatgtgtaagcaaa

SEQ ID NO: 201268 - DNA, 16 bp, P. troglodytes
agaatgttgaatatta

SEQ ID NO: 201269 - DNA, 16 bp, P. troglodytes
agaatgttttcatctt

SEQ ID NO: 201270 - DNA, 16 bp, P. troglodytes
agaattaaaaacacat

SEQ ID NO: 201271 - DNA, 16 bp, P. troglodytes
agaattaaaaatgttt

SEQ ID NO: 201272 - DNA, 16 bp, P. troglodytes
agaattaaaatgtttt

SEQ ID NO: 201273 - DNA, 16 bp, P. troglodytes
agaattaacattttta

SEQ ID NO: 201274 - DNA, 16 bp, P. troglodytes
agaattaaccatcaca

SEQ ID NO: 201275 - DNA, 16 bp, P. troglodytes
agaattacaaaaaact

SEQ ID NO: 201276 - DNA, 16 bp, P. troglodytes
agaattaccaaagtgt

SEQ ID NO: 201277 - DNA, 16 bp, P. troglodytes
agaattacctggggag

SEQ ID NO: 201278 - DNA, 16 bp, P. troglodytes
agaattagagaaaact

SEQ ID NO: 201279 - DNA, 16 bp, P. troglodytes
agaattagatagtggt

SEQ ID NO: 201280 - DNA, 16 bp, P. troglodytes
agaattaggaaaaaac

SEQ ID NO: 201281 - DNA, 16 bp, P. troglodytes
agaattagtcacatgg

SEQ ID NO: 201282 - DNA, 16 bp, P. troglodytes
agaattatatcagata

SEQ ID NO: 201283 - DNA, 16 bp, P. troglodytes
agaattattgtgagga

SEQ ID NO: 201284 - DNA, 16 bp, P. troglodytes
agaattatttattttc

SEQ ID NO: 201285 - DNA, 16 bp, P. troglodytes
agaattcaaaatagct

SEQ ID NO: 201286 - DNA, 16 bp, P. troglodytes
agaattcaccagtgaa

SEQ ID NO: 201287 - DNA, 16 bp, P. troglodytes
agaattcagaatatgg

SEQ ID NO: 201288 - DNA, 16 bp, P. troglodytes
agaattcagagtccag

SEQ ID NO: 201289 - DNA, 16 bp, P. troglodytes
agaattcagcaatgaa

SEQ ID NO: 201290 - DNA, 16 bp, P. troglodytes
agaattcagctataaa

SEQ ID NO: 201291 - DNA, 16 bp, P. troglodytes
agaattcagctctgaa

SEQ ID NO: 201292 - DNA, 16 bp, P. troglodytes
agaattcagctgcaaa

SEQ ID NO: 201293 - DNA, 16 bp, P. troglodytes
agaattcaggcccctc

SEQ ID NO: 201294 - DNA, 16 bp, P. troglodytes
agaattcattcactat

SEQ ID NO: 201295 - DNA, 16 bp, P. troglodytes
agaattctgtaccctg

SEQ ID NO: 201296 - DNA, 16 bp, P. troglodytes
agaattcttccagatt

SEQ ID NO: 201297 - DNA, 16 bp, P. troglodytes
agaattctttttaaaa

SEQ ID NO: 201298 - DNA, 16 bp, P. troglodytes
agaattctttttcttt

SEQ ID NO: 201299 - DNA, 16 bp, P. troglodytes
agaattgcaaattaaa

SEQ ID NO: 201300 - DNA, 16 bp, P. troglodytes
agaattgccagataaa

SEQ ID NO: 201301 - DNA, 16 bp, P. troglodytes
agaattgctagaacct

SEQ ID NO: 201302 - DNA, 16 bp, P. troglodytes
agaattgcttgaacaa

SEQ ID NO: 201303 - DNA, 16 bp, P. troglodytes
agaattgcttgaacac

SEQ ID NO: 201304 - DNA, 16 bp, P. troglodytes
agaattgcttgaatcc

SEQ ID NO: 201305 - DNA, 16 bp, P. troglodytes
agaattgcttgacccc

SEQ ID NO: 201306 - DNA, 16 bp, P. troglodytes
agaattggaaaagact

SEQ ID NO: 201307 - DNA, 16 bp, P. troglodytes
agaattggaagttctg

SEQ ID NO: 201308 - DNA, 16 bp, P. troglodytes
agaattgtaagataat

SEQ ID NO: 201309 - DNA, 16 bp, P. troglodytes
agaattgtgagagaat

SEQ ID NO: 201310 - DNA, 16 bp, P. troglodytes
agaattgttttctttt

SEQ ID NO: 201311 - DNA, 16 bp, P. troglodytes
agaattgttttttcca

SEQ ID NO: 201312 - DNA, 16 bp, P. troglodytes
agaatttaaagaattt

SEQ ID NO: 201313 - DNA, 16 bp, P. troglodytes
agaatttaaagtctgt

SEQ ID NO: 201314 - DNA, 16 bp, P. troglodytes
agaatttaagacaaaa

SEQ ID NO: 201315 - DNA, 16 bp, P. troglodytes
agaatttaagtgactt

SEQ ID NO: 201316 - DNA, 16 bp, P. troglodytes
agaatttagaatattt

SEQ ID NO: 201317 - DNA, 16 bp, P. troglodytes
agaatttatgatgaag

SEQ ID NO: 201318 - DNA, 16 bp, P. troglodytes
agaatttcagaagaaa

SEQ ID NO: 201319 - DNA, 16 bp, P. troglodytes
agaatttcataaaatt

SEQ ID NO: 201320 - DNA, 16 bp, P. troglodytes
agaatttcataataca

SEQ ID NO: 201321 - DNA, 34 bp, P. troglodytes
agaatttcatatccagccaaactaagcttcataa

SEQ ID NO: 201322 - DNA, 16 bp, P. troglodytes
agaatttcattcattt

SEQ ID NO: 201323 - DNA, 16 bp, P. troglodytes
agaatttcattctttt

SEQ ID NO: 201324 - DNA, 16 bp, P. troglodytes
agaatttccttctttt

SEQ ID NO: 201325 - DNA, 16 bp, P. troglodytes
agaatttcctttttta

SEQ ID NO: 201326 - DNA, 16 bp, P. troglodytes
agaatttcgctcttgt

SEQ ID NO: 201327 - DNA, 16 bp, P. troglodytes
agaatttctttaattt

SEQ ID NO: 201328 - DNA, 16 bp, P. troglodytes
agaatttgaaaactat

SEQ ID NO: 201329 - DNA, 16 bp, P. troglodytes
agaatttgcatttctg

SEQ ID NO: 201330 - DNA, 16 bp, P. troglodytes
agaatttgcattttaa

SEQ ID NO: 201331 - DNA, 16 bp, P. troglodytes
agaatttgctgaagtt

SEQ ID NO: 201332 - DNA, 16 bp, P. troglodytes
agaatttgtctgtgaa

SEQ ID NO: 201333 - DNA, 16 bp, P. troglodytes
agaattttaaaaagga

SEQ ID NO: 201334 - DNA, 16 bp, P. troglodytes
agaattttaaaacatt

SEQ ID NO: 201335 - DNA, 16 bp, P. troglodytes
agaattttaaaagtat

SEQ ID NO: 201336 - DNA, 16 bp, P. troglodytes
agaattttaaatgttc

SEQ ID NO: 201337 - DNA, 16 bp, P. troglodytes
agaattttacttttgg

SEQ ID NO: 201338 - DNA, 16 bp, P. troglodytes
agaattttatacaaat

SEQ ID NO: 201339 - DNA, 16 bp, P. troglodytes
agaattttatgaaaat

SEQ ID NO: 201340 - DNA, 16 bp, P. troglodytes
agaattttattcattt

SEQ ID NO: 201341 - DNA, 16 bp, P. troglodytes
agaattttcattttta

SEQ ID NO: 201342 - DNA, 16 bp, P. troglodytes
agaattttccagtgaa

SEQ ID NO: 201343 - DNA, 16 bp, P. troglodytes
agaattttctttcttt

SEQ ID NO: 201344 - DNA, 16 bp, P. troglodytes
agaattttgaaaaaga

SEQ ID NO: 201345 - DNA, 16 bp, P. troglodytes
agaattttgtcttttt

SEQ ID NO: 201346 - DNA, 16 bp, P. troglodytes
agaatttttatttctt

SEQ ID NO: 201347 - DNA, 16 bp, P. troglodytes
agaattttttctttct

SEQ ID NO: 201348 - DNA, 16 bp, P. troglodytes
agaatttttttgtaga

SEQ ID NO: 201349 - DNA, 16 bp, P. troglodytes
agacaaaaaatttttt

SEQ ID NO: 201350 - DNA, 16 bp, P. troglodytes
agacaaaaagcaaatt

SEQ ID NO: 201351 - DNA, 16 bp, P. troglodytes
agacaaaaatgaggaa

SEQ ID NO: 201352 - DNA, 16 bp, P. troglodytes
agacaaaaattatttt

SEQ ID NO: 201353 - DNA, 16 bp, P. troglodytes
agacaaaaattttaaa

SEQ ID NO: 201354 - DNA, 17 bp, P. troglodytes
agacaaaactcctcaga

SEQ ID NO: 201355 - DNA, 16 bp, P. troglodytes
agacaaaatagtcttt

SEQ ID NO: 201356 - DNA, 16 bp, P. troglodytes
agacaaaatatatttt

SEQ ID NO: 201357 - DNA, 16 bp, P. troglodytes
agacaaaatggagaaa

SEQ ID NO: 201358 - DNA, 16 bp, P. troglodytes
agacaaaattgataaa

SEQ ID NO: 201359 - DNA, 16 bp, P. troglodytes
agacaaacaaaaattg

SEQ ID NO: 201360 - DNA, 16 bp, P. troglodytes
agacaaacattttaaa

SEQ ID NO: 201361 - DNA, 16 bp, P. troglodytes
agacaaagaaaagctg

SEQ ID NO: 201362 - DNA, 16 bp, P. troglodytes
agacaaagagaaaatt

SEQ ID NO: 201363 - DNA, 16 bp, P. troglodytes
agacaaagagggatat

SEQ ID NO: 201364 - DNA, 16 bp, P. troglodytes
agacaaagatttttaa

SEQ ID NO: 201365 - DNA, 16 bp, P. troglodytes
agacaaaggactttat

SEQ ID NO: 201366 - DNA, 16 bp, P. troglodytes
agacaaagtcaaagag

SEQ ID NO: 201367 - DNA, 17 bp, P. troglodytes
agacaaagtctcactct

SEQ ID NO: 201368 - DNA, 16 bp, P. troglodytes
agacaaatgattgcat

SEQ ID NO: 201369 - DNA, 16 bp, P. troglodytes
agacaaatttataaaa

SEQ ID NO: 201370 - DNA, 16 bp, P. troglodytes
agacaacagaaattta

SEQ ID NO: 201371 - DNA, 18 bp, P. troglodytes
agacaagattagagaaaa

SEQ ID NO: 201372 - DNA, 16 bp, P. troglodytes
agacaagcaaaagctg

SEQ ID NO: 201373 - DNA, 17 bp, P. troglodytes
agacaagcaaatgctga

SEQ ID NO: 201374 - DNA, 16 bp, P. troglodytes
agacaagcctaggcaa

SEQ ID NO: 201375 - DNA, 16 bp, P. troglodytes
agacaagcctggccaa

SEQ ID NO: 201376 - DNA, 16 bp, P. troglodytes
agacaagcctgggcaa

SEQ ID NO: 201377 - DNA, 16 bp, P. troglodytes
agacaaggccactctg

SEQ ID NO: 201378 - DNA, 16 bp, P. troglodytes
agacaagggtgccctc

SEQ ID NO: 201379 - DNA, 16 bp, P. troglodytes
agacaaggtaatttat

SEQ ID NO: 201380 - DNA, 16 bp, P. troglodytes
agacaagtctgggcaa

SEQ ID NO: 201381 - DNA, 16 bp, P. troglodytes
agacaatcatgtggtt

SEQ ID NO: 201382 - DNA, 16 bp, P. troglodytes
agacaatcctggctaa

SEQ ID NO: 201383 - DNA, 22 bp, P. troglodytes
agacaatcctggctaacacggt

SEQ ID NO: 201384 - DNA, 16 bp, P. troglodytes
agacaatgaggaaaag

SEQ ID NO: 201385 - DNA, 16 bp, P. troglodytes
agacaatgaggaagaa

SEQ ID NO: 201386 - DNA, 16 bp, P. troglodytes
agacaatgaggatgaa

SEQ ID NO: 201387 - DNA, 16 bp, P. troglodytes
agacaatggaagaatg

SEQ ID NO: 201388 - DNA, 16 bp, P. troglodytes
agacaatggagactca

SEQ ID NO: 201389 - DNA, 16 bp, P. troglodytes
agacaatggagtatta

SEQ ID NO: 201390 - DNA, 16 bp, P. troglodytes
agacaatgggaaaaag

SEQ ID NO: 201391 - DNA, 16 bp, P. troglodytes
agacacacacacacag

SEQ ID NO: 201392 - DNA, 16 bp, P. troglodytes
agacacacagagggga

SEQ ID NO: 201393 - DNA, 23 bp, P. troglodytes
agacacacataggctcaaaataa

SEQ ID NO: 201394 - DNA, 24 bp, P. troglodytes
agacacacataggctcaaaataaa

SEQ ID NO: 201395 - DNA, 16 bp, P. troglodytes
agacacagaaaggtta

SEQ ID NO: 201396 - DNA, 16 bp, P. troglodytes
agacacagaaatagaa

SEQ ID NO: 201397 - DNA, 16 bp, P. troglodytes
agacacagagacaaag

SEQ ID NO: 201398 - DNA, 26 bp, P. troglodytes
agacacagagacaaagtatagagaaa

SEQ ID NO: 201399 - DNA, 16 bp, P. troglodytes
agacacagcaagaaag

SEQ ID NO: 201400 - DNA, 16 bp, P. troglodytes
agacacagggccagaa

SEQ ID NO: 201401 - DNA, 16 bp, P. troglodytes
agacacatggagcaga

SEQ ID NO: 201402 - DNA, 16 bp, P. troglodytes
agacacatttttaaaa

SEQ ID NO: 201403 - DNA, 16 bp, P. troglodytes
agacaccaaaccacag

SEQ ID NO: 201404 - DNA, 16 bp, P. troglodytes
agacaccagggtctac

SEQ ID NO: 201405 - DNA, 16 bp, P. troglodytes
agacacccagctggtg

SEQ ID NO: 201406 - DNA, 16 bp, P. troglodytes
agacacctcaccaaag

SEQ ID NO: 201407 - DNA, 16 bp, P. troglodytes
agacacctcatacagg

SEQ ID NO: 201408 - DNA, 16 bp, P. troglodytes
agacacgtgcacacac

SEQ ID NO: 201409 - DNA, 16 bp, P. troglodytes
agacactcaataaatg

SEQ ID NO: 201410 - DNA, 16 bp, P. troglodytes
agacactcaatgccag

SEQ ID NO: 201411 - DNA, 16 bp, P. troglodytes
agacactcagtaaata

SEQ ID NO: 201412 - DNA, 16 bp, P. troglodytes
agacactgaagaacat

SEQ ID NO: 201413 - DNA, 16 bp, P. troglodytes
agacactgaggctcag

SEQ ID NO: 201414 - DNA, 16 bp, P. troglodytes
agacactgctgaaaga

SEQ ID NO: 201415 - DNA, 16 bp, P. troglodytes
agacactggggaatac

SEQ ID NO: 201416 - DNA, 16 bp, P. troglodytes
agacactggtggcatt

SEQ ID NO: 201417 - DNA, 16 bp, P. troglodytes
agacactgtctccaaa

SEQ ID NO: 201418 - DNA, 16 bp, P. troglodytes
agacacttcttgaaag

SEQ ID NO: 201419 - DNA, 16 bp, P. troglodytes
agacacttttcaaaga

SEQ ID NO: 201420 - DNA, 16 bp, P. troglodytes
agacagaaaatgagaa

SEQ ID NO: 201421 - DNA, 17 bp, P. troglodytes
agacagaaaattaacaa

SEQ ID NO: 201422 - DNA, 16 bp, P. troglodytes
agacagaaagcaaatt

SEQ ID NO: 201423 - DNA, 16 bp, P. troglodytes
agacagaaagcagatt

SEQ ID NO: 201424 - DNA, 16 bp, P. troglodytes
agacagaaagtaggtt

SEQ ID NO: 201425 - DNA, 16 bp, P. troglodytes
agacagaaagtgaaca

SEQ ID NO: 201426 - DNA, 22 bp, P. troglodytes
agacagaaagttaacaaggata

SEQ ID NO: 201427 - DNA, 16 bp, P. troglodytes
agacagaaatcaagaa

SEQ ID NO: 201428 - DNA, 16 bp, P. troglodytes
agacagaagcagaaca

SEQ ID NO: 201429 - DNA, 16 bp, P. troglodytes
agacagaatctcactg

SEQ ID NO: 201430 - DNA, 16 bp, P. troglodytes
agacagacaaattcct

SEQ ID NO: 201431 - DNA, 16 bp, P. troglodytes
agacagacagacaaga

SEQ ID NO: 201432 - DNA, 16 bp, P. troglodytes
agacagacagacagac

SEQ ID NO: 201433 - DNA, 16 bp, P. troglodytes
agacagagaaactgag

SEQ ID NO: 201434 - DNA, 16 bp, P. troglodytes
agacagagaatgagtt

SEQ ID NO: 201435 - DNA, 16 bp, P. troglodytes
agacagagacaaagac

SEQ ID NO: 201436 - DNA, 16 bp, P. troglodytes
agacagagacagtgag

SEQ ID NO: 201437 - DNA, 16 bp, P. troglodytes
agacagagaccatcct

SEQ ID NO: 201438 - DNA, 16 bp, P. troglodytes
agacagagactcactc

SEQ ID NO: 201439 - DNA, 16 bp, P. troglodytes
agacagagcagccctg

SEQ ID NO: 201440 - DNA, 20 bp, P. troglodytes
agacagagcgagactctgtc

SEQ ID NO: 201441 - DNA, 16 bp, P. troglodytes
agacagagctagactc

SEQ ID NO: 201442 - DNA, 16 bp, P. troglodytes
agacagaggcaggagg

SEQ ID NO: 201443 - DNA, 16 bp, P. troglodytes
agacagaggctcagag

SEQ ID NO: 201444 - DNA, 16 bp, P. troglodytes
agacagaggtgggcag

SEQ ID NO: 201445 - DNA, 16 bp, P. troglodytes
agacagagtccctctc

SEQ ID NO: 201446 - DNA, 18 bp, P. troglodytes
agacagagtctcactgtg

SEQ ID NO: 201447 - DNA, 16 bp, P. troglodytes
agacagagtctccctg

SEQ ID NO: 201448 - DNA, 17 bp, P. troglodytes
agacagagtctcgctgt

SEQ ID NO: 201449 - DNA, 16 bp, P. troglodytes
agacagagtgagaccc

SEQ ID NO: 201450 - DNA, 16 bp, P. troglodytes
agacagagttccgctc

SEQ ID NO: 201451 - DNA, 16 bp, P. troglodytes
agacagagttcttgct

SEQ ID NO: 201452 - DNA, 16 bp, P. troglodytes
agacagagtttcacta

SEQ ID NO: 201453 - DNA, 16 bp, P. troglodytes
agacagagtttcatca

SEQ ID NO: 201454 - DNA, 16 bp, P. troglodytes
agacagagtttccctc

SEQ ID NO: 201455 - DNA, 17 bp, P. troglodytes
agacagataaactcaag

SEQ ID NO: 201456 - DNA, 16 bp, P. troglodytes
agacagcaagaccaac

SEQ ID NO: 201457 - DNA, 16 bp, P. troglodytes
agacagcaagagagag

SEQ ID NO: 201458 - DNA, 16 bp, P. troglodytes
agacagcagaagcagg

SEQ ID NO: 201459 - DNA, 17 bp, P. troglodytes
agacagcgttttgccat

SEQ ID NO: 201460 - DNA, 16 bp, P. troglodytes
agacagctgctgccca

SEQ ID NO: 201461 - DNA, 16 bp, P. troglodytes
agacaggaagatgtga

SEQ ID NO: 201462 - DNA, 19 bp, P. troglodytes
agacaggagaattgcttga

SEQ ID NO: 201463 - DNA, 16 bp, P. troglodytes
agacaggaggatcact

SEQ ID NO: 201464 - DNA, 16 bp, P. troglodytes
agacaggagttcaaga

SEQ ID NO: 201465 - DNA, 16 bp, P. troglodytes
agacaggatctcactt

SEQ ID NO: 201466 - DNA, 17 bp, P. troglodytes
agacaggatttcaccgt

SEQ ID NO: 201467 - DNA, 16 bp, P. troglodytes
agacaggatttcgcca

SEQ ID NO: 201468 - DNA, 16 bp, P. troglodytes
agacaggcctggccaa

SEQ ID NO: 201469 - DNA, 16 bp, P. troglodytes
agacaggctcctgggc

SEQ ID NO: 201470 - DNA, 16 bp, P. troglodytes
agacagggcctggctc

SEQ ID NO: 201471 - DNA, 16 bp, P. troglodytes
agacaggggtctcact

SEQ ID NO: 201472 - DNA, 18 bp, P. troglodytes
agacaggggtttcaccat

SEQ ID NO: 201473 - DNA, 16 bp, P. troglodytes
agacagggtcccactg

SEQ ID NO: 201474 - DNA, 16 bp, P. troglodytes
agacagggtctcccta

SEQ ID NO: 201475 - DNA, 16 bp, P. troglodytes
agacagggtctggctt

SEQ ID NO: 201476 - DNA, 17 bp, P. troglodytes
agacagggtgttgctct

SEQ ID NO: 201477 - DNA, 17 bp, P. troglodytes
agacagggttttaccac

SEQ ID NO: 201478 - DNA, 16 bp, P. troglodytes
agacagggtttttcca

SEQ ID NO: 201479 - DNA, 16 bp, P. troglodytes
agacagtaaatatttt

SEQ ID NO: 201480 - DNA, 16 bp, P. troglodytes
agacagtccagaaata

SEQ ID NO: 201481 - DNA, 16 bp, P. troglodytes
agacagtctctctctg

SEQ ID NO: 201482 - DNA, 16 bp, P. troglodytes
agacagtgagagagag

SEQ ID NO: 201483 - DNA, 16 bp, P. troglodytes
agacagtgagatcctt

SEQ ID NO: 201484 - DNA, 16 bp, P. troglodytes
agacagtggccttcct

SEQ ID NO: 201485 - DNA, 16 bp, P. troglodytes
agacagtgtctcactg

SEQ ID NO: 201486 - DNA, 16 bp, P. troglodytes
agacagtgtcttgctg

SEQ ID NO: 201487 - DNA, 16 bp, P. troglodytes
agacagttgtagatgt

SEQ ID NO: 201488 - DNA, 16 bp, P. troglodytes
agacagtttgctataa

SEQ ID NO: 201489 - DNA, 16 bp, P. troglodytes
agacagtttggtgatt

SEQ ID NO: 201490 - DNA, 16 bp, P. troglodytes
agacagttttcaaaag

SEQ ID NO: 201491 - DNA, 21 bp, P. troglodytes
agacataagagactccatttt

SEQ ID NO: 201492 - DNA, 16 bp, P. troglodytes
agacatagaacatttc

SEQ ID NO: 201493 - DNA, 16 bp, P. troglodytes
agacatatatatatat

SEQ ID NO: 201494 - DNA, 16 bp, P. troglodytes
agacatatatatgaga

SEQ ID NO: 201495 - DNA, 16 bp, P. troglodytes
agacatatttaaaaat

SEQ ID NO: 201496 - DNA, 16 bp, P. troglodytes
agacatcaaagctaga

SEQ ID NO: 201497 - DNA, 16 bp, P. troglodytes
agacatcaatcaaata

SEQ ID NO: 201498 - DNA, 16 bp, P. troglodytes
agacatcacaagaaaa

SEQ ID NO: 201499 - DNA, 16 bp, P. troglodytes
agacatcacatgttgg

SEQ ID NO: 201500 - DNA, 16 bp, P. troglodytes
agacatgagcagggca

SEQ ID NO: 201501 - DNA, 16 bp, P. troglodytes
agacatgagccaccac

SEQ ID NO: 201502 - DNA, 17 bp, P. troglodytes
agacatgagccaccgcg

SEQ ID NO: 201503 - DNA, 16 bp, P. troglodytes
agacatgagccactgc

SEQ ID NO: 201504 - DNA, 16 bp, P. troglodytes
agacatgcaatttacc

SEQ ID NO: 201505 - DNA, 16 bp, P. troglodytes
agacatggaacagatt

SEQ ID NO: 201506 - DNA, 16 bp, P. troglodytes
agacatggaatcatcc

SEQ ID NO: 201507 - DNA, 16 bp, P. troglodytes
agacatggaggaacct

SEQ ID NO: 201508 - DNA, 16 bp, P. troglodytes
agacatggatgaaatt

SEQ ID NO: 201509 - DNA, 16 bp, P. troglodytes
agacatggtctcactc

SEQ ID NO: 201510 - DNA, 16 bp, P. troglodytes
agacattaaataattt

SEQ ID NO: 201511 - DNA, 16 bp, P. troglodytes
agacattattattatt

SEQ ID NO: 201512 - DNA, 21 bp, P. troglodytes
agacattccattgcccaggga

SEQ ID NO: 201513 - DNA, 16 bp, P. troglodytes
agacattgcagaagaa

SEQ ID NO: 201514 - DNA, 16 bp, P. troglodytes
agacattgccaaatgt

SEQ ID NO: 201515 - DNA, 16 bp, P. troglodytes
agacattgtctctaca

SEQ ID NO: 201516 - DNA, 16 bp, P. troglodytes
agacatttaaaatttt

SEQ ID NO: 201517 - DNA, 17 bp, P. troglodytes
agacatttaggcagcca

SEQ ID NO: 201518 - DNA, 17 bp, P. troglodytes
agacatttatgtgacca

SEQ ID NO: 201519 - DNA, 16 bp, P. troglodytes
agacatttatttttca

SEQ ID NO: 201520 - DNA, 16 bp, P. troglodytes
agacatttctttaaag

SEQ ID NO: 201521 - DNA, 16 bp, P. troglodytes
agacatttggtctaaa

SEQ ID NO: 201522 - DNA, 16 bp, P. troglodytes
agacatttgttgaatg

SEQ ID NO: 201523 - DNA, 16 bp, P. troglodytes
agacattttaaaaata

SEQ ID NO: 201524 - DNA, 16 bp, P. troglodytes
agacattttaaaatta

SEQ ID NO: 201525 - DNA, 16 bp, P. troglodytes
agacattttattttac

SEQ ID NO: 201526 - DNA, 16 bp, P. troglodytes
agacattttcagacat

SEQ ID NO: 201527 - DNA, 16 bp, P. troglodytes
agacattttgaatttt

SEQ ID NO: 201528 - DNA, 16 bp, P. troglodytes
agacattttgttttta

SEQ ID NO: 201529 - DNA, 16 bp, P. troglodytes
agacatttttaaagaa

SEQ ID NO: 201530 - DNA, 16 bp, P. troglodytes
agacatttttctaaag

SEQ ID NO: 201531 - DNA, 16 bp, P. troglodytes
agacattttttaaaaa

SEQ ID NO: 201532 - DNA, 16 bp, P. troglodytes
agacattttttatttt

SEQ ID NO: 201533 - DNA, 16 bp, P. troglodytes
agacatttttttaaaa

SEQ ID NO: 201534 - DNA, 16 bp, P. troglodytes
agaccaaactggccaa

SEQ ID NO: 201535 - DNA, 16 bp, P. troglodytes
agaccaaagaatgact

SEQ ID NO: 201536 - DNA, 16 bp, P. troglodytes
agaccaacaaagagac

SEQ ID NO: 201537 - DNA, 17 bp, P. troglodytes
agaccaacatggtgaaa

SEQ ID NO: 201538 - DNA, 16 bp, P. troglodytes
agaccaacctagccaa

SEQ ID NO: 201539 - DNA, 16 bp, P. troglodytes
agaccaacctgaccaa

SEQ ID NO: 201540 - DNA, 16 bp, P. troglodytes
agaccaacctgagcaa

SEQ ID NO: 201541 - DNA, 16 bp, P. troglodytes
agaccaacctggacaa

SEQ ID NO: 201542 - DNA, 16 bp, P. troglodytes
agaccaacctggccaa

SEQ ID NO: 201543 - DNA, 16 bp, P. troglodytes
agaccaacctgggcaa

SEQ ID NO: 201544 - DNA, 16 bp, P. troglodytes
agaccaacctggtcaa

SEQ ID NO: 201545 - DNA, 16 bp, P. troglodytes
agaccaacgtggccaa

SEQ ID NO: 201546 - DNA, 16 bp, P. troglodytes
agaccaagactctgtc

SEQ ID NO: 201547 - DNA, 16 bp, P. troglodytes
agaccaaggcaggcag

SEQ ID NO: 201548 - DNA, 16 bp, P. troglodytes
agaccaaggcaggtga

SEQ ID NO: 201549 - DNA, 16 bp, P. troglodytes
agaccaagtggaggaa

SEQ ID NO: 201550 - DNA, 16 bp, P. troglodytes
agaccaatcagcactc

SEQ ID NO: 201551 - DNA, 16 bp, P. troglodytes
agaccaatctgagcaa

SEQ ID NO: 201552 - DNA, 16 bp, P. troglodytes
agaccaatctgggcaa

SEQ ID NO: 201553 - DNA, 16 bp, P. troglodytes
agaccaattacatcag

SEQ ID NO: 201554 - DNA, 16 bp, P. troglodytes
agaccacagagataaa

SEQ ID NO: 201555 - DNA, 16 bp, P. troglodytes
agaccacaggtgtgtg

SEQ ID NO: 201556 - DNA, 17 bp, P. troglodytes
agaccacagtgaaaccc

SEQ ID NO: 201557 - DNA, 16 bp, P. troglodytes
agaccaccctgaccaa

SEQ ID NO: 201558 - DNA, 16 bp, P. troglodytes
agaccaccctggccaa

SEQ ID NO: 201559 - DNA, 18 bp, P. troglodytes
agaccaccctggctaaca

SEQ ID NO: 201560 - DNA, 16 bp, P. troglodytes
agaccaccctgggcaa

SEQ ID NO: 201561 - DNA, 16 bp, P. troglodytes
agaccacctcagccag

SEQ ID NO: 201562 - DNA, 16 bp, P. troglodytes
agaccacgaacccacc

SEQ ID NO: 201563 - DNA, 16 bp, P. troglodytes
agaccacgctggccaa

SEQ ID NO: 201564 - DNA, 16 bp, P. troglodytes
agaccactagccagac

SEQ ID NO: 201565 - DNA, 16 bp, P. troglodytes
agaccactgcaataaa

SEQ ID NO: 201566 - DNA, 16 bp, P. troglodytes
agaccagaagaaccac

SEQ ID NO: 201567 - DNA, 16 bp, P. troglodytes
agaccagaccagacca

SEQ ID NO: 201568 - DNA, 16 bp, P. troglodytes
agaccagactgaccaa

SEQ ID NO: 201569 - DNA, 16 bp, P. troglodytes
agaccagactggacaa

SEQ ID NO: 201570 - DNA, 16 bp, P. troglodytes
agaccagactggccaa

SEQ ID NO: 201571 - DNA, 16 bp, P. troglodytes
agaccagcaagggcaa

SEQ ID NO: 201572 - DNA, 16 bp, P. troglodytes
agaccagcagaaagga

SEQ ID NO: 201573 - DNA, 16 bp, P. troglodytes
agaccagcatgaccaa

SEQ ID NO: 201574 - DNA, 16 bp, P. troglodytes
agaccagcatggccaa

SEQ ID NO: 201575 - DNA, 16 bp, P. troglodytes
agaccagccagagcaa

SEQ ID NO: 201576 - DNA, 16 bp, P. troglodytes
agaccagccaggacaa

SEQ ID NO: 201577 - DNA, 16 bp, P. troglodytes
agaccagccaggccaa

SEQ ID NO: 201578 - DNA, 16 bp, P. troglodytes
agaccagccagggcaa

SEQ ID NO: 201579 - DNA, 16 bp, P. troglodytes
agaccagcccaaccaa

SEQ ID NO: 201580 - DNA, 16 bp, P. troglodytes
agaccagcccggccaa

SEQ ID NO: 201581 - DNA, 16 bp, P. troglodytes
agaccagccctggcca

SEQ ID NO: 201582 - DNA, 16 bp, P. troglodytes
agaccagcctagacaa

SEQ ID NO: 201583 - DNA, 16 bp, P. troglodytes
agaccagcctagccaa

SEQ ID NO: 201584 - DNA, 16 bp, P. troglodytes
agaccagcctagccag

SEQ ID NO: 201585 - DNA, 16 bp, P. troglodytes
agaccagcctaggaaa

SEQ ID NO: 201586 - DNA, 16 bp, P. troglodytes
agaccagcctaggcaa

SEQ ID NO: 201587 - DNA, 16 bp, P. troglodytes
agaccagcctaggtaa

SEQ ID NO: 201588 - DNA, 16 bp, P. troglodytes
agaccagcctcaccaa

SEQ ID NO: 201589 - DNA, 16 bp, P. troglodytes
agaccagcctcggcaa

SEQ ID NO: 201590 - DNA, 16 bp, P. troglodytes
agaccagcctcgtcaa

SEQ ID NO: 201591 - DNA, 16 bp, P. troglodytes
agaccagcctgaacaa

SEQ ID NO: 201592 - DNA, 16 bp, P. troglodytes
agaccagcctgacaaa

SEQ ID NO: 201593 - DNA, 16 bp, P. troglodytes
agaccagcctgaccaa

SEQ ID NO: 201594 - DNA, 16 bp, P. troglodytes
agaccagcctgaccac

SEQ ID NO: 201595 - DNA, 16 bp, P. troglodytes
agaccagcctgaccag

SEQ ID NO: 201596 - DNA, 16 bp, P. troglodytes
agaccagcctgaccat

SEQ ID NO: 201597 - DNA, 16 bp, P. troglodytes
agaccagcctgactaa

SEQ ID NO: 201598 - DNA, 16 bp, P. troglodytes
agaccagcctgagaaa

SEQ ID NO: 201599 - DNA, 16 bp, P. troglodytes
agaccagcctgagcaa

SEQ ID NO: 201600 - DNA, 16 bp, P. troglodytes
agaccagcctgaggaa

SEQ ID NO: 201601 - DNA, 16 bp, P. troglodytes
agaccagcctgatcaa

SEQ ID NO: 201602 - DNA, 16 bp, P. troglodytes
agaccagcctgcccaa

SEQ ID NO: 201603 - DNA, 16 bp, P. troglodytes
agaccagcctggacaa

SEQ ID NO: 201604 - DNA, 16 bp, P. troglodytes
agaccagcctggacag

SEQ ID NO: 201605 - DNA, 16 bp, P. troglodytes
agaccagcctggatga

SEQ ID NO: 201606 - DNA, 16 bp, P. troglodytes
agaccagcctggcaaa

SEQ ID NO: 201607 - DNA, 16 bp, P. troglodytes
agaccagcctggcaac

SEQ ID NO: 201608 - DNA, 16 bp, P. troglodytes
agaccagcctggccaa

SEQ ID NO: 201609 - DNA, 16 bp, P. troglodytes
agaccagcctggccag

SEQ ID NO: 201610 - DNA, 16 bp, P. troglodytes
agaccagcctggccga

SEQ ID NO: 201611 - DNA, 16 bp, P. troglodytes
agaccagcctggctaa

SEQ ID NO: 201612 - DNA, 16 bp, P. troglodytes
agaccagcctggctga

SEQ ID NO: 201613 - DNA, 16 bp, P. troglodytes
agaccagcctgggaaa

SEQ ID NO: 201614 - DNA, 16 bp, P. troglodytes
agaccagcctgggaac

SEQ ID NO: 201615 - DNA, 16 bp, P. troglodytes
agaccagcctgggcaa

SEQ ID NO: 201616 - DNA, 16 bp, P. troglodytes
agaccagcctgggcac

SEQ ID NO: 201617 - DNA, 16 bp, P. troglodytes
agaccagcctgggcag

SEQ ID NO: 201618 - DNA, 16 bp, P. troglodytes
agaccagcctgggcca

SEQ ID NO: 201619 - DNA, 16 bp, P. troglodytes
agaccagcctggggca

SEQ ID NO: 201620 - DNA, 16 bp, P. troglodytes
agaccagcctgggggc

SEQ ID NO: 201621 - DNA, 16 bp, P. troglodytes
agaccagcctgggtaa

SEQ ID NO: 201622 - DNA, 16 bp, P. troglodytes
agaccagcctgggtat

SEQ ID NO: 201623 - DNA, 16 bp, P. troglodytes
agaccagcctggtcaa

SEQ ID NO: 201624 - DNA, 16 bp, P. troglodytes
agaccagcctgtccaa

SEQ ID NO: 201625 - DNA, 16 bp, P. troglodytes
agaccagcctgtgcaa

SEQ ID NO: 201626 - DNA, 16 bp, P. troglodytes
agaccagccttaccaa

SEQ ID NO: 201627 - DNA, 16 bp, P. troglodytes
agaccagccttggcaa

SEQ ID NO: 201628 - DNA, 16 bp, P. troglodytes
agaccagcgtgaccaa

SEQ ID NO: 201629 - DNA, 16 bp, P. troglodytes
agaccagcgtggccaa

SEQ ID NO: 201630 - DNA, 16 bp, P. troglodytes
agaccagctggccaac

SEQ ID NO: 201631 - DNA, 16 bp, P. troglodytes
agaccagctggggcaa

SEQ ID NO: 201632 - DNA, 16 bp, P. troglodytes
agaccagcttaggcaa

SEQ ID NO: 201633 - DNA, 16 bp, P. troglodytes
agaccagcttgaccaa

SEQ ID NO: 201634 - DNA, 16 bp, P. troglodytes
agaccagcttggccaa

SEQ ID NO: 201635 - DNA, 16 bp, P. troglodytes
agaccagcttgggcaa

SEQ ID NO: 201636 - DNA, 16 bp, P. troglodytes
agaccaggaattcaag

SEQ ID NO: 201637 - DNA, 16 bp, P. troglodytes
agaccaggagaaaata

SEQ ID NO: 201638 - DNA, 16 bp, P. troglodytes
agaccaggagttcaag

SEQ ID NO: 201639 - DNA, 16 bp, P. troglodytes
agaccaggctgaccaa

SEQ ID NO: 201640 - DNA, 16 bp, P. troglodytes
agaccaggctggccaa

SEQ ID NO: 201641 - DNA, 16 bp, P. troglodytes
agaccagtctgagcaa

SEQ ID NO: 201642 - DNA, 16 bp, P. troglodytes
agaccagtctggcaac

SEQ ID NO: 201643 - DNA, 16 bp, P. troglodytes
agaccagtctggccaa

SEQ ID NO: 201644 - DNA, 16 bp, P. troglodytes
agaccagtctgggaaa

SEQ ID NO: 201645 - DNA, 16 bp, P. troglodytes
agaccagtctgggcaa

SEQ ID NO: 201646 - DNA, 16 bp, P. troglodytes
agaccagtgtcctgaa

SEQ ID NO: 201647 - DNA, 16 bp, P. troglodytes
agaccagtgtgggcaa

SEQ ID NO: 201648 - DNA, 16 bp, P. troglodytes
agaccagtttgggcaa

SEQ ID NO: 201649 - DNA, 16 bp, P. troglodytes
agaccatactggctaa

SEQ ID NO: 201650 - DNA, 18 bp, P. troglodytes
agaccatcccggctaaca

SEQ ID NO: 201651 - DNA, 18 bp, P. troglodytes
agaccatcctagctaaca

SEQ ID NO: 201652 - DNA, 16 bp, P. troglodytes
agaccatcctgaacaa

SEQ ID NO: 201653 - DNA, 18 bp, P. troglodytes
agaccatcctgactaaca

SEQ ID NO: 201654 - DNA, 16 bp, P. troglodytes
agaccatcctgcccaa

SEQ ID NO: 201655 - DNA, 16 bp, P. troglodytes
agaccatcctggacaa

SEQ ID NO: 201656 - DNA, 16 bp, P. troglodytes
agaccatcctggcaaa

SEQ ID NO: 201657 - DNA, 16 bp, P. troglodytes
agaccatcctggccaa

SEQ ID NO: 201658 - DNA, 16 bp, P. troglodytes
agaccatcctggccat

SEQ ID NO: 201659 - DNA, 18 bp, P. troglodytes
agaccatcctggcgaaca

SEQ ID NO: 201660 - DNA, 17 bp, P. troglodytes
agaccatcctggctaaa

SEQ ID NO: 201661 - DNA, 18 bp, P. troglodytes
agaccatcctggctaaca

SEQ ID NO: 201662 - DNA, 18 bp, P. troglodytes
agaccatcctggctaacg

SEQ ID NO: 201663 - DNA, 17 bp, P. troglodytes
agaccatcctggctaat

SEQ ID NO: 201664 - DNA, 16 bp, P. troglodytes
agaccatcctggctac

SEQ ID NO: 201665 - DNA, 16 bp, P. troglodytes
agaccatcctggctag

SEQ ID NO: 201666 - DNA, 16 bp, P. troglodytes
agaccatcctggctat

SEQ ID NO: 201667 - DNA, 16 bp, P. troglodytes
agaccatcctgggcaa

SEQ ID NO: 201668 - DNA, 16 bp, P. troglodytes
agaccatcctgggcca

SEQ ID NO: 201669 - DNA, 16 bp, P. troglodytes
agaccatcctggtgaa

SEQ ID NO: 201670 - DNA, 18 bp, P. troglodytes
agaccatcctggttaaca

SEQ ID NO: 201671 - DNA, 18 bp, P. troglodytes
agaccatcctgtctaaca

SEQ ID NO: 201672 - DNA, 16 bp, P. troglodytes
agaccatcgtggctaa

SEQ ID NO: 201673 - DNA, 16 bp, P. troglodytes
agaccatcttggccaa

SEQ ID NO: 201674 - DNA, 18 bp, P. troglodytes
agaccatcttggctaaca

SEQ ID NO: 201675 - DNA, 18 bp, P. troglodytes
agaccatgctggctaaca

SEQ ID NO: 201676 - DNA, 16 bp, P. troglodytes
agaccattctggccaa

SEQ ID NO: 201677 - DNA, 18 bp, P. troglodytes
agaccattctggctaaca

SEQ ID NO: 201678 - DNA, 16 bp, P. troglodytes
agaccattgtggccaa

SEQ ID NO: 201679 - DNA, 16 bp, P. troglodytes
agacccagaagagaga

SEQ ID NO: 201680 - DNA, 16 bp, P. troglodytes
agacccagcctgacca

SEQ ID NO: 201681 - DNA, 16 bp, P. troglodytes
agacccaggaatccag

SEQ ID NO: 201682 - DNA, 16 bp, P. troglodytes
agacccaggagagcca

SEQ ID NO: 201683 - DNA, 16 bp, P. troglodytes
agacccaggagcccag

SEQ ID NO: 201684 - DNA, 16 bp, P. troglodytes
agaccccaactctaca

SEQ ID NO: 201685 - DNA, 16 bp, P. troglodytes
agaccccacctcttaa

SEQ ID NO: 201686 - DNA, 16 bp, P. troglodytes
agaccccatctcaaac

SEQ ID NO: 201687 - DNA, 16 bp, P. troglodytes
agaccccatctctaaa

SEQ ID NO: 201688 - DNA, 16 bp, P. troglodytes
agaccccatcttaaaa

SEQ ID NO: 201689 - DNA, 16 bp, P. troglodytes
agaccccatctttata

SEQ ID NO: 201690 - DNA, 16 bp, P. troglodytes
agaccccatttctaca

SEQ ID NO: 201691 - DNA, 16 bp, P. troglodytes
agacccccatctcaaa

SEQ ID NO: 201692 - DNA, 16 bp, P. troglodytes
agacccccatctctta

SEQ ID NO: 201693 - DNA, 16 bp, P. troglodytes
agaccccgtctcaaaa

SEQ ID NO: 201694 - DNA, 16 bp, P. troglodytes
agaccccgtctctgca

SEQ ID NO: 201695 - DNA, 16 bp, P. troglodytes
agaccccttccttcca

SEQ ID NO: 201696 - DNA, 16 bp, P. troglodytes
agaccctacctcttaa

SEQ ID NO: 201697 - DNA, 16 bp, P. troglodytes
agaccctatttcaaaa

SEQ ID NO: 201698 - DNA, 16 bp, P. troglodytes
agaccctatttccaaa

SEQ ID NO: 201699 - DNA, 16 bp, P. troglodytes
agaccctcctgcctca

SEQ ID NO: 201700 - DNA, 16 bp, P. troglodytes
agaccctgactcaaaa

SEQ ID NO: 201701 - DNA, 16 bp, P. troglodytes
agaccctgagacaagg

SEQ ID NO: 201702 - DNA, 16 bp, P. troglodytes
agaccctgcctctgaa

SEQ ID NO: 201703 - DNA, 16 bp, P. troglodytes
agaccctggtgtgtga

SEQ ID NO: 201704 - DNA, 16 bp, P. troglodytes
agaccctgtctaaaaa

SEQ ID NO: 201705 - DNA, 16 bp, P. troglodytes
agaccctgtctcaaaa

SEQ ID NO: 201706 - DNA, 16 bp, P. troglodytes
agaccctgtctcaaga

SEQ ID NO: 201707 - DNA, 17 bp, P. troglodytes
agaccctgtctccaaat

SEQ ID NO: 201708 - DNA, 16 bp, P. troglodytes
agaccctgtctctaaa

SEQ ID NO: 201709 - DNA, 16 bp, P. troglodytes
agaccctgtctctgaa

SEQ ID NO: 201710 - DNA, 16 bp, P. troglodytes
agaccctgtctgtaca

SEQ ID NO: 201711 - DNA, 16 bp, P. troglodytes
agaccctgtcttaaaa

SEQ ID NO: 201712 - DNA, 16 bp, P. troglodytes
agaccctgtctttaaa

SEQ ID NO: 201713 - DNA, 16 bp, P. troglodytes
agaccctgtttcaaaa

SEQ ID NO: 201714 - DNA, 16 bp, P. troglodytes
agacccttcaaaaaat

SEQ ID NO: 201715 - DNA, 17 bp, P. troglodytes
agaccggcctggccaat

SEQ ID NO: 201716 - DNA, 18 bp, P. troglodytes
agaccgtcctggctaaca

SEQ ID NO: 201717 - DNA, 16 bp, P. troglodytes
agaccgtggggagagg

SEQ ID NO: 201718 - DNA, 16 bp, P. troglodytes
agaccgtgtctcaaaa

SEQ ID NO: 201719 - DNA, 16 bp, P. troglodytes
agacctaaaacaataa

SEQ ID NO: 201720 - DNA, 16 bp, P. troglodytes
agacctatggtgaaaa

SEQ ID NO: 201721 - DNA, 16 bp, P. troglodytes
agacctcaccagaagc

SEQ ID NO: 201722 - DNA, 20 bp, P. troglodytes
agacctcaggtgatccaccc

SEQ ID NO: 201723 - DNA, 17 bp, P. troglodytes
agacctcatctctaaaa

SEQ ID NO: 201724 - DNA, 16 bp, P. troglodytes
agacctccacccctgg

SEQ ID NO: 201725 - DNA, 16 bp, P. troglodytes
agacctccccagccac

SEQ ID NO: 201726 - DNA, 16 bp, P. troglodytes
agacctgaaattataa

SEQ ID NO: 201727 - DNA, 16 bp, P. troglodytes
agacctgcctggccaa

SEQ ID NO: 201728 - DNA, 16 bp, P. troglodytes
agacctgcctgggcaa

SEQ ID NO: 201729 - DNA, 16 bp, P. troglodytes
agacctgctttacaag

SEQ ID NO: 201730 - DNA, 16 bp, P. troglodytes
agacctggagtttgag

SEQ ID NO: 201731 - DNA, 16 bp, P. troglodytes
agacctggatttgaat

SEQ ID NO: 201732 - DNA, 16 bp, P. troglodytes
agacctggccaacatg

SEQ ID NO: 201733 - DNA, 16 bp, P. troglodytes
agacctgggttccaat

SEQ ID NO: 201734 - DNA, 16 bp, P. troglodytes
agacctgggttccagt

SEQ ID NO: 201735 - DNA, 18 bp, P. troglodytes
agaccttcctggctaaca

SEQ ID NO: 201736 - DNA, 16 bp, P. troglodytes
agaccttgcctcaaaa

SEQ ID NO: 201737 - DNA, 17 bp, P. troglodytes
agaccttgctgataaaa

SEQ ID NO: 201738 - DNA, 16 bp, P. troglodytes
agaccttggtcagatg

SEQ ID NO: 201739 - DNA, 16 bp, P. troglodytes
agaccttgtctcagaa

SEQ ID NO: 201740 - DNA, 16 bp, P. troglodytes
agaccttgtctcgaaa

SEQ ID NO: 201741 - DNA, 16 bp, P. troglodytes
agaccttgtctctaaa

SEQ ID NO: 201742 - DNA, 16 bp, P. troglodytes
agacctttatcagata

SEQ ID NO: 201743 - DNA, 16 bp, P. troglodytes
agacctttgtggtgag

SEQ ID NO: 201744 - DNA, 17 bp, P. troglodytes
agacgaagtctcactct

SEQ ID NO: 201745 - DNA, 17 bp, P. troglodytes
agacggagtctcactgt

SEQ ID NO: 201746 - DNA, 17 bp, P. troglodytes
agacggagtctcgcact

SEQ ID NO: 201747 - DNA, 17 bp, P. troglodytes
agacggagtctcgctca

SEQ ID NO: 201748 - DNA, 27 bp, P. troglodytes
agacggagtctcgctctgtcgcccagg

SEQ ID NO: 201749 - DNA, 18 bp, P. troglodytes
agacggagtctcgctctt

SEQ ID NO: 201750 - DNA, 16 bp, P. troglodytes
agacggagtcttgcta

SEQ ID NO: 201751 - DNA, 17 bp, P. troglodytes
agacggagtcttgctct

SEQ ID NO: 201752 - DNA, 17 bp, P. troglodytes
agacggagtgttgctct

SEQ ID NO: 201753 - DNA, 16 bp, P. troglodytes
agacggagtttcacca

SEQ ID NO: 201754 - DNA, 17 bp, P. troglodytes
agacggggtttcaccac

SEQ ID NO: 201755 - DNA, 18 bp, P. troglodytes
agacggggtttcaccatt

SEQ ID NO: 201756 - DNA, 16 bp, P. troglodytes
agacggtttcgccatg

SEQ ID NO: 201757 - DNA, 16 bp, P. troglodytes
agacgtgagccaccac

SEQ ID NO: 201758 - DNA, 16 bp, P. troglodytes
agacgtgagccaccat

SEQ ID NO: 201759 - DNA, 16 bp, P. troglodytes
agacgtgagccaccgt

SEQ ID NO: 201760 - DNA, 16 bp, P. troglodytes
agactaaatgatgaac

SEQ ID NO: 201761 - DNA, 16 bp, P. troglodytes
agactaaggagacatg

SEQ ID NO: 201762 - DNA, 18 bp, P. troglodytes
agactaagggaggcattg

SEQ ID NO: 201763 - DNA, 16 bp, P. troglodytes
agactaatacagtaca

SEQ ID NO: 201764 - DNA, 16 bp, P. troglodytes
agactacaaatcaaag

SEQ ID NO: 201765 - DNA, 16 bp, P. troglodytes
agactagaaaatctag

SEQ ID NO: 201766 - DNA, 16 bp, P. troglodytes
agactagcctgaccaa

SEQ ID NO: 201767 - DNA, 16 bp, P. troglodytes
agactagcctggacaa

SEQ ID NO: 201768 - DNA, 16 bp, P. troglodytes
agactagcctggccaa

SEQ ID NO: 201769 - DNA, 16 bp, P. troglodytes
agactagcctgggaaa

SEQ ID NO: 201770 - DNA, 16 bp, P. troglodytes
agactagcctgggcaa

SEQ ID NO: 201771 - DNA, 16 bp, P. troglodytes
agactagcttgggcaa

SEQ ID NO: 201772 - DNA, 16 bp, P. troglodytes
agactaggagaaaata

SEQ ID NO: 201773 - DNA, 16 bp, P. troglodytes
agactaggcattgaag

SEQ ID NO: 201774 - DNA, 18 bp, P. troglodytes
agactatcctggctaaca

SEQ ID NO: 201775 - DNA, 16 bp, P. troglodytes
agactattaaagaaga

SEQ ID NO: 201776 - DNA, 16 bp, P. troglodytes
agactattctggctaa

SEQ ID NO: 201777 - DNA, 16 bp, P. troglodytes
agactcagaaagaaaa

SEQ ID NO: 201778 - DNA, 16 bp, P. troglodytes
agactcagccagactc

SEQ ID NO: 201779 - DNA, 16 bp, P. troglodytes
agactcagtctccaaa

SEQ ID NO: 201780 - DNA, 16 bp, P. troglodytes
agactcagttttctta

SEQ ID NO: 201781 - DNA, 16 bp, P. troglodytes
agactcatatcaaaac

SEQ ID NO: 201782 - DNA, 16 bp, P. troglodytes
agactcatccagaaag

SEQ ID NO: 201783 - DNA, 16 bp, P. troglodytes
agactcattcattcat

SEQ ID NO: 201784 - DNA, 16 bp, P. troglodytes
agactccaaatcaaaa

SEQ ID NO: 201785 - DNA, 17 bp, P. troglodytes
agactccaaatgtcctc

SEQ ID NO: 201786 - DNA, 16 bp, P. troglodytes
agactccacctcctgg

SEQ ID NO: 201787 - DNA, 16 bp, P. troglodytes
agactccatcaaaaaa

SEQ ID NO: 201788 - DNA, 16 bp, P. troglodytes
agactccatcccaaaa

SEQ ID NO: 201789 - DNA, 16 bp, P. troglodytes
agactccatctccccc

SEQ ID NO: 201790 - DNA, 16 bp, P. troglodytes
agactccatttctaaa

SEQ ID NO: 201791 - DNA, 17 bp, P. troglodytes
agactccctctcaaaaa

SEQ ID NO: 201792 - DNA, 18 bp, P. troglodytes
agactccgcctcaaaaaa

SEQ ID NO: 201793 - DNA, 16 bp, P. troglodytes
agactcctgacctcag

SEQ ID NO: 201794 - DNA, 16 bp, P. troglodytes
agactcctgttgggac

SEQ ID NO: 201795 - DNA, 16 bp, P. troglodytes
agactcggtctcaaaa

SEQ ID NO: 201796 - DNA, 16 bp, P. troglodytes
agactctatctccaaa

SEQ ID NO: 201797 - DNA, 16 bp, P. troglodytes
agactctctctcaaaa

SEQ ID NO: 201798 - DNA, 16 bp, P. troglodytes
agactctgcctcccag

SEQ ID NO: 201799 - DNA, 16 bp, P. troglodytes
agactctggctcaaaa

SEQ ID NO: 201800 - DNA, 16 bp, P. troglodytes
agactctgtatcaaaa

SEQ ID NO: 201801 - DNA, 17 bp, P. troglodytes
agactctgtcacacaca

SEQ ID NO: 201802 - DNA, 16 bp, P. troglodytes
agactctgtgtctaca

SEQ ID NO: 201803 - DNA, 16 bp, P. troglodytes
agactctgtttcaaaa

SEQ ID NO: 201804 - DNA, 16 bp, P. troglodytes
agactctttctcaaaa

SEQ ID NO: 201805 - DNA, 16 bp, P. troglodytes
agactgaaagaaaata

SEQ ID NO: 201806 - DNA, 16 bp, P. troglodytes
agactgaagactgcac

SEQ ID NO: 201807 - DNA, 16 bp, P. troglodytes
agactgaatgtttgtg

SEQ ID NO: 201808 - DNA, 16 bp, P. troglodytes
agactgagactcagag

SEQ ID NO: 201809 - DNA, 16 bp, P. troglodytes
agactgagatgggaga

SEQ ID NO: 201810 - DNA, 16 bp, P. troglodytes
agactgaggagggtgg

SEQ ID NO: 201811 - DNA, 16 bp, P. troglodytes
agactgaggcacagaa

SEQ ID NO: 201812 - DNA, 16 bp, P. troglodytes
agactgaggcaggcgg

SEQ ID NO: 201813 - DNA, 16 bp, P. troglodytes
agactgaggtgggtgg

SEQ ID NO: 201814 - DNA, 16 bp, P. troglodytes
agactgagtaatttaa

SEQ ID NO: 201815 - DNA, 16 bp, P. troglodytes
agactgagtaatttat

SEQ ID NO: 201816 - DNA, 17 bp, P. troglodytes
agactgagtctcactct

SEQ ID NO: 201817 - DNA, 16 bp, P. troglodytes
agactgagtttcactc

SEQ ID NO: 201818 - DNA, 16 bp, P. troglodytes
agactgatacctcaca

SEQ ID NO: 201819 - DNA, 16 bp, P. troglodytes
agactgcagtgagccc

SEQ ID NO: 201820 - DNA, 16 bp, P. troglodytes
agactgcagtgagccg

SEQ ID NO: 201821 - DNA, 16 bp, P. troglodytes
agactgctacattgtg

SEQ ID NO: 201822 - DNA, 16 bp, P. troglodytes
agactgctttgaggaa

SEQ ID NO: 201823 - DNA, 16 bp, P. troglodytes
agactggaaaactgga

SEQ ID NO: 201824 - DNA, 16 bp, P. troglodytes
agactggaagaaaaca

SEQ ID NO: 201825 - DNA, 16 bp, P. troglodytes
agactggaggcaggga

SEQ ID NO: 201826 - DNA, 16 bp, P. troglodytes
agactggagtacagtg

SEQ ID NO: 201827 - DNA, 16 bp, P. troglodytes
agactggagtgcggtg

SEQ ID NO: 201828 - DNA, 16 bp, P. troglodytes
agactggatagagaaa

SEQ ID NO: 201829 - DNA, 16 bp, P. troglodytes
agactggcagattgga

SEQ ID NO: 201830 - DNA, 16 bp, P. troglodytes
agactggcctgggaaa

SEQ ID NO: 201831 - DNA, 16 bp, P. troglodytes
agactggcctgggcaa

SEQ ID NO: 201832 - DNA, 16 bp, P. troglodytes
agactgggaaatccaa

SEQ ID NO: 201833 - DNA, 16 bp, P. troglodytes
agactgggaagaaaaa

SEQ ID NO: 201834 - DNA, 16 bp, P. troglodytes
agactgggaaggaaaa

SEQ ID NO: 201835 - DNA, 16 bp, P. troglodytes
agactgggcaacatag

SEQ ID NO: 201836 - DNA, 16 bp, P. troglodytes
agactgggcacagtgg

SEQ ID NO: 201837 - DNA, 16 bp, P. troglodytes
agactgggtgatttat

SEQ ID NO: 201838 - DNA, 16 bp, P. troglodytes
agactgggtggcttca

SEQ ID NO: 201839 - DNA, 16 bp, P. troglodytes
agactgggttatttat

SEQ ID NO: 201840 - DNA, 16 bp, P. troglodytes
agactggttaaagaaa

SEQ ID NO: 201841 - DNA, 16 bp, P. troglodytes
agactggttagacagt

SEQ ID NO: 201842 - DNA, 16 bp, P. troglodytes
agactgtaaaccaaca

SEQ ID NO: 201843 - DNA, 16 bp, P. troglodytes
agactgtctcaaaaat

SEQ ID NO: 201844 - DNA, 16 bp, P. troglodytes
agactgtcttccaaag

SEQ ID NO: 201845 - DNA, 16 bp, P. troglodytes
agactgtgaagatttt

SEQ ID NO: 201846 - DNA, 16 bp, P. troglodytes
agactgtggagaaata

SEQ ID NO: 201847 - DNA, 16 bp, P. troglodytes
agactgtgggaaaagc

SEQ ID NO: 201848 - DNA, 16 bp, P. troglodytes
agactgttttccaaag

SEQ ID NO: 201849 - DNA, 16 bp, P. troglodytes
agacttaaatataaaa

SEQ ID NO: 201850 - DNA, 16 bp, P. troglodytes
agacttaattgtaaaa

SEQ ID NO: 201851 - DNA, 16 bp, P. troglodytes
agacttaatttttaaa

SEQ ID NO: 201852 - DNA, 16 bp, P. troglodytes
agacttcaacattcca

SEQ ID NO: 201853 - DNA, 16 bp, P. troglodytes
agacttcagaacaagg

SEQ ID NO: 201854 - DNA, 16 bp, P. troglodytes
agacttcaggaaactt

SEQ ID NO: 201855 - DNA, 16 bp, P. troglodytes
agacttcaggggaaga

SEQ ID NO: 201856 - DNA, 16 bp, P. troglodytes
agacttcatctcaaaa

SEQ ID NO: 201857 - DNA, 16 bp, P. troglodytes
agacttccagcctcca

SEQ ID NO: 201858 - DNA, 17 bp, P. troglodytes
agacttccagcctccaa

SEQ ID NO: 201859 - DNA, 16 bp, P. troglodytes
agacttcctggaggag

SEQ ID NO: 201860 - DNA, 16 bp, P. troglodytes
agacttctaaggtttt

SEQ ID NO: 201861 - DNA, 16 bp, P. troglodytes
agacttctctcaaaaa

SEQ ID NO: 201862 - DNA, 16 bp, P. troglodytes
agacttctgcctgaac

SEQ ID NO: 201863 - DNA, 16 bp, P. troglodytes
agacttgaaagtaaaa

SEQ ID NO: 201864 - DNA, 16 bp, P. troglodytes
agacttgaaagtcaaa

SEQ ID NO: 201865 - DNA, 16 bp, P. troglodytes
agacttgatcaagcag

SEQ ID NO: 201866 - DNA, 16 bp, P. troglodytes
agacttggacccaacc

SEQ ID NO: 201867 - DNA, 16 bp, P. troglodytes
agacttggcagcttcc

SEQ ID NO: 201868 - DNA, 16 bp, P. troglodytes
agacttgtctcagata

SEQ ID NO: 201869 - DNA, 16 bp, P. troglodytes
agacttgtttgtgtgg

SEQ ID NO: 201870 - DNA, 16 bp, P. troglodytes
agactttaaaagaaaa

SEQ ID NO: 201871 - DNA, 16 bp, P. troglodytes
agactttactgaagtt

SEQ ID NO: 201872 - DNA, 16 bp, P. troglodytes
agactttattcagatt

SEQ ID NO: 201873 - DNA, 16 bp, P. troglodytes
agactttgctgataaa

SEQ ID NO: 201874 - DNA, 16 bp, P. troglodytes
agactttggagtcaga

SEQ ID NO: 201875 - DNA, 16 bp, P. troglodytes
agactttgggctgaga

SEQ ID NO: 201876 - DNA, 16 bp, P. troglodytes
agactttgtctcaaaa

SEQ ID NO: 201877 - DNA, 16 bp, P. troglodytes
agactttgtctccaaa

SEQ ID NO: 201878 - DNA, 16 bp, P. troglodytes
agactttgtctttaaa

SEQ ID NO: 201879 - DNA, 16 bp, P. troglodytes
agacttttaaaataaa

SEQ ID NO: 201880 - DNA, 16 bp, P. troglodytes
agacttttaaattttt

SEQ ID NO: 201881 - DNA, 24 bp, P. troglodytes
agacttttagtactttcactaatt

SEQ ID NO: 201882 - DNA, 16 bp, P. troglodytes
agacttttcagcagaa

SEQ ID NO: 201883 - DNA, 16 bp, P. troglodytes
agacttttcagtggaa

SEQ ID NO: 201884 - DNA, 16 bp, P. troglodytes
agacttttctcctcag

SEQ ID NO: 201885 - DNA, 16 bp, P. troglodytes
agacttttggggactg

SEQ ID NO: 201886 - DNA, 16 bp, P. troglodytes
agactttttaaaataa

SEQ ID NO: 201887 - DNA, 16 bp, P. troglodytes
agactttttatttatt

SEQ ID NO: 201888 - DNA, 16 bp, P. troglodytes
agacttttttttttaa

SEQ ID NO: 201889 - DNA, 16 bp, P. troglodytes
agagaaaaaatggcag

SEQ ID NO: 201890 - DNA, 16 bp, P. troglodytes
agagaaaaacatttaa

SEQ ID NO: 201891 - DNA, 16 bp, P. troglodytes
agagaaaaactggaaa

SEQ ID NO: 201892 - DNA, 16 bp, P. troglodytes
agagaaaaagcaaatg

SEQ ID NO: 201893 - DNA, 16 bp, P. troglodytes
agagaaaaaggacatt

SEQ ID NO: 201894 - DNA, 16 bp, P. troglodytes
agagaaaaaggccagg

SEQ ID NO: 201895 - DNA, 16 bp, P. troglodytes
agagaaaaataagtca

SEQ ID NO: 201896 - DNA, 16 bp, P. troglodytes
agagaaaaatctgaaa

SEQ ID NO: 201897 - DNA, 16 bp, P. troglodytes
agagaaaaatgaacat

SEQ ID NO: 201898 - DNA, 16 bp, P. troglodytes
agagaaaaatggtttc

SEQ ID NO: 201899 - DNA, 16 bp, P. troglodytes
agagaaaaatggtttt

SEQ ID NO: 201900 - DNA, 16 bp, P. troglodytes
agagaaaacactgaaa

SEQ ID NO: 201901 - DNA, 16 bp, P. troglodytes
agagaaaaccttaaaa

SEQ ID NO: 201902 - DNA, 16 bp, P. troglodytes
agagaaaagatttttt

SEQ ID NO: 201903 - DNA, 16 bp, P. troglodytes
agagaaaataattttg

SEQ ID NO: 201904 - DNA, 16 bp, P. troglodytes
agagaaaatacatgtg

SEQ ID NO: 201905 - DNA, 16 bp, P. troglodytes
agagaaaatattcaaa

SEQ ID NO: 201906 - DNA, 16 bp, P. troglodytes
agagaaaatattttta

SEQ ID NO: 201907 - DNA, 16 bp, P. troglodytes
agagaaaatctgcatt

SEQ ID NO: 201908 - DNA, 16 bp, P. troglodytes
agagaaaattttaaga

SEQ ID NO: 201909 - DNA, 16 bp, P. troglodytes
agagaaacaaaaatgt

SEQ ID NO: 201910 - DNA, 16 bp, P. troglodytes
agagaaacagaatgaa

SEQ ID NO: 201911 - DNA, 16 bp, P. troglodytes
agagaaaccctataaa

SEQ ID NO: 201912 - DNA, 16 bp, P. troglodytes
agagaaacctgaaaaa

SEQ ID NO: 201913 - DNA, 16 bp, P. troglodytes
agagaaactgaagaaa

SEQ ID NO: 201914 - DNA, 16 bp, P. troglodytes
agagaaactgaggcac

SEQ ID NO: 201915 - DNA, 17 bp, P. troglodytes
agagaaactggaggctt

SEQ ID NO: 201916 - DNA, 16 bp, P. troglodytes
agagaaacttccagtc

SEQ ID NO: 201917 - DNA, 16 bp, P. troglodytes
agagaaacttctttgt

SEQ ID NO: 201918 - DNA, 16 bp, P. troglodytes
agagaaagaaactgag

SEQ ID NO: 201919 - DNA, 16 bp, P. troglodytes
agagaaagagaagact

SEQ ID NO: 201920 - DNA, 16 bp, P. troglodytes
agagaaagagatcaaa

SEQ ID NO: 201921 - DNA, 16 bp, P. troglodytes
agagaaagcaggcaag

SEQ ID NO: 201922 - DNA, 16 bp, P. troglodytes
agagaaagccaaattt

SEQ ID NO: 201923 - DNA, 16 bp, P. troglodytes
agagaaagccacaaag

SEQ ID NO: 201924 - DNA, 16 bp, P. troglodytes
agagaaagcctggctg

SEQ ID NO: 201925 - DNA, 16 bp, P. troglodytes
agagaaaggactcaaa

SEQ ID NO: 201926 - DNA, 16 bp, P. troglodytes
agagaaaggggaaccc

SEQ ID NO: 201927 - DNA, 16 bp, P. troglodytes
agagaaagtggtttct

SEQ ID NO: 201928 - DNA, 16 bp, P. troglodytes
agagaaagttgaaaac

SEQ ID NO: 201929 - DNA, 16 bp, P. troglodytes
agagaaataaaacatt

SEQ ID NO: 201930 - DNA, 16 bp, P. troglodytes
agagaaataaaatcct

SEQ ID NO: 201931 - DNA, 16 bp, P. troglodytes
agagaaatagacaaat

SEQ ID NO: 201932 - DNA, 16 bp, P. troglodytes
agagaaatataatttt

SEQ ID NO: 201933 - DNA, 16 bp, P. troglodytes
agagaaatccaaatca

SEQ ID NO: 201934 - DNA, 16 bp, P. troglodytes
agagaaatctgaaaac

SEQ ID NO: 201935 - DNA, 16 bp, P. troglodytes
agagaaatctgacatg

SEQ ID NO: 201936 - DNA, 16 bp, P. troglodytes
agagaaatgaaaacct

SEQ ID NO: 201937 - DNA, 16 bp, P. troglodytes
agagaaatgaaaactt

SEQ ID NO: 201938 - DNA, 16 bp, P. troglodytes
agagaaatgaagactt

SEQ ID NO: 201939 - DNA, 16 bp, P. troglodytes
agagaaatgcaaagaa

SEQ ID NO: 201940 - DNA, 16 bp, P. troglodytes
agagaaatggaaatca

SEQ ID NO: 201941 - DNA, 16 bp, P. troglodytes
agagaaatggagagat

SEQ ID NO: 201942 - DNA, 16 bp, P. troglodytes
agagaaattctacaaa

SEQ ID NO: 201943 - DNA, 16 bp, P. troglodytes
agagaaattggaaaat

SEQ ID NO: 201944 - DNA, 16 bp, P. troglodytes
agagaaatttatttct

SEQ ID NO: 201945 - DNA, 16 bp, P. troglodytes
agagaaatttcagaaa

SEQ ID NO: 201946 - DNA, 16 bp, P. troglodytes
agagaacaatcaaata

SEQ ID NO: 201947 - DNA, 16 bp, P. troglodytes
agagaacacagaaata

SEQ ID NO: 201948 - DNA, 16 bp, P. troglodytes
agagaacacagataga

SEQ ID NO: 201949 - DNA, 16 bp, P. troglodytes
agagaacccagaaaga

SEQ ID NO: 201950 - DNA, 16 bp, P. troglodytes
agagaacccagaaata

SEQ ID NO: 201951 - DNA, 16 bp, P. troglodytes
agagaaccctaacaca

SEQ ID NO: 201952 - DNA, 16 bp, P. troglodytes
agagaactaaaattag

SEQ ID NO: 201953 - DNA, 24 bp, P. troglodytes
agagaactacaaaccactgctcaa

SEQ ID NO: 201954 - DNA, 16 bp, P. troglodytes
agagaactataaaaca

SEQ ID NO: 201955 - DNA, 16 bp, P. troglodytes
agagaacttaggaact

SEQ ID NO: 201956 - DNA, 16 bp, P. troglodytes
agagaagaaaatgaca

SEQ ID NO: 201957 - DNA, 16 bp, P. troglodytes
agagaagaaagcttca

SEQ ID NO: 201958 - DNA, 16 bp, P. troglodytes
agagaagaacagaaat

SEQ ID NO: 201959 - DNA, 16 bp, P. troglodytes
agagaagaaggcagac

SEQ ID NO: 201960 - DNA, 16 bp, P. troglodytes
agagaagaattttaca

SEQ ID NO: 201961 - DNA, 16 bp, P. troglodytes
agagaagaattttatt

SEQ ID NO: 201962 - DNA, 16 bp, P. troglodytes
agagaagaggcaggtc

SEQ ID NO: 201963 - DNA, 16 bp, P. troglodytes
agagaagaggcctgga

SEQ ID NO: 201964 - DNA, 16 bp, P. troglodytes
agagaagagtcaagga

SEQ ID NO: 201965 - DNA, 16 bp, P. troglodytes
agagaagatctaaata

SEQ ID NO: 201966 - DNA, 16 bp, P. troglodytes
agagaagatcttaaat

SEQ ID NO: 201967 - DNA, 16 bp, P. troglodytes
agagaagattctcaaa

SEQ ID NO: 201968 - DNA, 16 bp, P. troglodytes
agagaagcaaaggcac

SEQ ID NO: 201969 - DNA, 16 bp, P. troglodytes
agagaagcaagagcca

SEQ ID NO: 201970 - DNA, 16 bp, P. troglodytes
agagaagcagaaccag

SEQ ID NO: 201971 - DNA, 16 bp, P. troglodytes
agagaagcctgggcaa

SEQ ID NO: 201972 - DNA, 16 bp, P. troglodytes
agagaaggaaacactt

SEQ ID NO: 201973 - DNA, 16 bp, P. troglodytes
agagaaggagtttcac

SEQ ID NO: 201974 - DNA, 16 bp, P. troglodytes
agagaaggcttcctgg

SEQ ID NO: 201975 - DNA, 16 bp, P. troglodytes
agagaagggattttgc

SEQ ID NO: 201976 - DNA, 16 bp, P. troglodytes
agagaagtttacagaa

SEQ ID NO: 201977 - DNA, 16 bp, P. troglodytes
agagaataaaatacca

SEQ ID NO: 201978 - DNA, 16 bp, P. troglodytes
agagaatatttccaaa

SEQ ID NO: 201979 - DNA, 18 bp, P. troglodytes
agagaatcacttgaacct

SEQ ID NO: 201980 - DNA, 16 bp, P. troglodytes
agagaatcagcctgtc

SEQ ID NO: 201981 - DNA, 16 bp, P. troglodytes
agagaatcatttgaac

SEQ ID NO: 201982 - DNA, 16 bp, P. troglodytes
agagaatctagaaata

SEQ ID NO: 201983 - DNA, 16 bp, P. troglodytes
agagaatctccttccc

SEQ ID NO: 201984 - DNA, 16 bp, P. troglodytes
agagaatgagaagaca

SEQ ID NO: 201985 - DNA, 16 bp, P. troglodytes
agagaatgagacagag

SEQ ID NO: 201986 - DNA, 16 bp, P. troglodytes
agagaatgagagacaa

SEQ ID NO: 201987 - DNA, 16 bp, P. troglodytes
agagaatgagagtgaa

SEQ ID NO: 201988 - DNA, 16 bp, P. troglodytes
agagaatgaggaagac

SEQ ID NO: 201989 - DNA, 16 bp, P. troglodytes
agagaatgaggaagat

SEQ ID NO: 201990 - DNA, 16 bp, P. troglodytes
agagaatgccacagag

SEQ ID NO: 201991 - DNA, 16 bp, P. troglodytes
agagaatgtgtgtgtg

SEQ ID NO: 201992 - DNA, 16 bp, P. troglodytes
agagaattatttttaa

SEQ ID NO: 201993 - DNA, 16 bp, P. troglodytes
agagaattgaagagag

SEQ ID NO: 201994 - DNA, 16 bp, P. troglodytes
agagaattgcttgaac

SEQ ID NO: 201995 - DNA, 18 bp, P. troglodytes
agagaattgcttgaacct

SEQ ID NO: 201996 - DNA, 16 bp, P. troglodytes
agagaattttagatca

SEQ ID NO: 201997 - DNA, 16 bp, P. troglodytes
agagacaaagaagatc

SEQ ID NO: 201998 - DNA, 16 bp, P. troglodytes
agagacaaagcagcaa

SEQ ID NO: 201999 - DNA, 16 bp, P. troglodytes
agagacaaaggccatt

SEQ ID NO: 202000 - DNA, 16 bp, P. troglodytes
agagacaaagtctccc

SEQ ID NO: 202001 - DNA, 16 bp, P. troglodytes
agagacaaatcaagaa

SEQ ID NO: 202002 - DNA, 16 bp, P. troglodytes
agagacaaggtttctc

SEQ ID NO: 202003 - DNA, 16 bp, P. troglodytes
agagacacacacacag

SEQ ID NO: 202004 - DNA, 16 bp, P. troglodytes
agagacacacacacat

SEQ ID NO: 202005 - DNA, 16 bp, P. troglodytes
agagacacagagacag

SEQ ID NO: 202006 - DNA, 16 bp, P. troglodytes
agagacacaggagaga

SEQ ID NO: 202007 - DNA, 16 bp, P. troglodytes
agagacagaaaatgga

SEQ ID NO: 202008 - DNA, 16 bp, P. troglodytes
agagacagaaactaaa

SEQ ID NO: 202009 - DNA, 16 bp, P. troglodytes
agagacagaaagtaaa

SEQ ID NO: 202010 - DNA, 16 bp, P. troglodytes
agagacagaaagtaga

SEQ ID NO: 202011 - DNA, 16 bp, P. troglodytes
agagacagaaatggag

SEQ ID NO: 202012 - DNA, 16 bp, P. troglodytes
agagacagaatctcac

SEQ ID NO: 202013 - DNA, 16 bp, P. troglodytes
agagacagacacacag

SEQ ID NO: 202014 - DNA, 16 bp, P. troglodytes
agagacagacagacaa

SEQ ID NO: 202015 - DNA, 16 bp, P. troglodytes
agagacagagactgag

SEQ ID NO: 202016 - DNA, 16 bp, P. troglodytes
agagacagagagacag

SEQ ID NO: 202017 - DNA, 16 bp, P. troglodytes
agagacagagagagac

SEQ ID NO: 202018 - DNA, 16 bp, P. troglodytes
agagacagagagcaag

SEQ ID NO: 202019 - DNA, 16 bp, P. troglodytes
agagacagagagcgag

SEQ ID NO: 202020 - DNA, 16 bp, P. troglodytes
agagacagagaggcag

SEQ ID NO: 202021 - DNA, 16 bp, P. troglodytes
agagacagagagtgaa

SEQ ID NO: 202022 - DNA, 16 bp, P. troglodytes
agagacagagttttgc

SEQ ID NO: 202023 - DNA, 16 bp, P. troglodytes
agagacaggaagtgga

SEQ ID NO: 202024 - DNA, 16 bp, P. troglodytes
agagacaggaggcaga

SEQ ID NO: 202025 - DNA, 16 bp, P. troglodytes
agagacaggaggcagc

SEQ ID NO: 202026 - DNA, 16 bp, P. troglodytes
agagacaggatcttgc

SEQ ID NO: 202027 - DNA, 16 bp, P. troglodytes
agagacagggctttgc

SEQ ID NO: 202028 - DNA, 16 bp, P. troglodytes
agagacaggggtctcg

SEQ ID NO: 202029 - DNA, 17 bp, P. troglodytes
agagacagggtttcgct

SEQ ID NO: 202030 - DNA, 16 bp, P. troglodytes
agagacagggttttac

SEQ ID NO: 202031 - DNA, 16 bp, P. troglodytes
agagacaggttttcat

SEQ ID NO: 202032 - DNA, 16 bp, P. troglodytes
agagacagtgagaaag

SEQ ID NO: 202033 - DNA, 16 bp, P. troglodytes
agagacagtgtttctc

SEQ ID NO: 202034 - DNA, 16 bp, P. troglodytes
agagacatgcaactct

SEQ ID NO: 202035 - DNA, 16 bp, P. troglodytes
agagacatggagaagg

SEQ ID NO: 202036 - DNA, 16 bp, P. troglodytes
agagaccaccaaacag

SEQ ID NO: 202037 - DNA, 16 bp, P. troglodytes
agagaccaccctggcc

SEQ ID NO: 202038 - DNA, 16 bp, P. troglodytes
agagaccagcctggct

SEQ ID NO: 202039 - DNA, 16 bp, P. troglodytes
agagacccacccccag

SEQ ID NO: 202040 - DNA, 16 bp, P. troglodytes
agagacccatttcaca

SEQ ID NO: 202041 - DNA, 16 bp, P. troglodytes
agagaccctgtctcaa

SEQ ID NO: 202042 - DNA, 17 bp, P. troglodytes
agagaccctgtctcaaa

SEQ ID NO: 202043 - DNA, 16 bp, P. troglodytes
agagacctggagccag

SEQ ID NO: 202044 - DNA, 16 bp, P. troglodytes
agagaccttcctgctt

SEQ ID NO: 202045 - DNA, 16 bp, P. troglodytes
agagaccttgagccag

SEQ ID NO: 202046 - DNA, 16 bp, P. troglodytes
agagacctttgtggca

SEQ ID NO: 202047 - DNA, 16 bp, P. troglodytes
agagacgggatctcac

SEQ ID NO: 202048 - DNA, 16 bp, P. troglodytes
agagacggggtctcgc

SEQ ID NO: 202049 - DNA, 17 bp, P. troglodytes
agagactctgtctcaaa

SEQ ID NO: 202050 - DNA, 16 bp, P. troglodytes
agagactgaaggcaca

SEQ ID NO: 202051 - DNA, 17 bp, P. troglodytes
agagactgagaaaagaa

SEQ ID NO: 202052 - DNA, 16 bp, P. troglodytes
agagactgcagtaaag

SEQ ID NO: 202053 - DNA, 16 bp, P. troglodytes
agagactggaaagaaa

SEQ ID NO: 202054 - DNA, 16 bp, P. troglodytes
agagactgggaagaaa

SEQ ID NO: 202055 - DNA, 16 bp, P. troglodytes
agagacttgcccaagg

SEQ ID NO: 202056 - DNA, 16 bp, P. troglodytes
agagacttgcttgaac

SEQ ID NO: 202057 - DNA, 16 bp, P. troglodytes
agagactttaaaaata

SEQ ID NO: 202058 - DNA, 16 bp, P. troglodytes
agagacttttaaaaaa

SEQ ID NO: 202059 - DNA, 16 bp, P. troglodytes
agagagaaaaatcaag

SEQ ID NO: 202060 - DNA, 16 bp, P. troglodytes
agagagaaaaattatg

SEQ ID NO: 202061 - DNA, 16 bp, P. troglodytes
agagagaaaagatggc

SEQ ID NO: 202062 - DNA, 16 bp, P. troglodytes
agagagaaaatgaaca

SEQ ID NO: 202063 - DNA, 16 bp, P. troglodytes
agagagaaaattcaaa

SEQ ID NO: 202064 - DNA, 16 bp, P. troglodytes
agagagaaagagaact

SEQ ID NO: 202065 - DNA, 16 bp, P. troglodytes
agagagaaagattgag

SEQ ID NO: 202066 - DNA, 16 bp, P. troglodytes
agagagaaataaagca

SEQ ID NO: 202067 - DNA, 16 bp, P. troglodytes
agagagaagatctaaa

SEQ ID NO: 202068 - DNA, 16 bp, P. troglodytes
agagagaagatggcca

SEQ ID NO: 202069 - DNA, 16 bp, P. troglodytes
agagagaaggtggcca

SEQ ID NO: 202070 - DNA, 16 bp, P. troglodytes
agagagaagtatcaaa

SEQ ID NO: 202071 - DNA, 16 bp, P. troglodytes
agagagaagtgcagag

SEQ ID NO: 202072 - DNA, 16 bp, P. troglodytes
agagagacaaagtcaa

SEQ ID NO: 202073 - DNA, 16 bp, P. troglodytes
agagagacacacagag

SEQ ID NO: 202074 - DNA, 16 bp, P. troglodytes
agagagacagaaagta

SEQ ID NO: 202075 - DNA, 16 bp, P. troglodytes
agagagacagagacca

SEQ ID NO: 202076 - DNA, 16 bp, P. troglodytes
agagagacagagatga

SEQ ID NO: 202077 - DNA, 16 bp, P. troglodytes
agagagacagagtgtg

SEQ ID NO: 202078 - DNA, 16 bp, P. troglodytes
agagagaccatattca

SEQ ID NO: 202079 - DNA, 16 bp, P. troglodytes
agagagacccagtctc

SEQ ID NO: 202080 - DNA, 16 bp, P. troglodytes
agagagacccctgtct

SEQ ID NO: 202081 - DNA, 16 bp, P. troglodytes
agagagaccctgagtc

SEQ ID NO: 202082 - DNA, 17 bp, P. troglodytes
agagagaccctgtctct

SEQ ID NO: 202083 - DNA, 16 bp, P. troglodytes
agagagaccttgtctc

SEQ ID NO: 202084 - DNA, 16 bp, P. troglodytes
agagagagaaagatct

SEQ ID NO: 202085 - DNA, 16 bp, P. troglodytes
agagagagaactctgg

SEQ ID NO: 202086 - DNA, 16 bp, P. troglodytes
agagagagaagaccca

SEQ ID NO: 202087 - DNA, 16 bp, P. troglodytes
agagagagaagattca

SEQ ID NO: 202088 - DNA, 16 bp, P. troglodytes
agagagagacagagat

SEQ ID NO: 202089 - DNA, 16 bp, P. troglodytes
agagagagacagcaga

SEQ ID NO: 202090 - DNA, 16 bp, P. troglodytes
agagagagaccctttc

SEQ ID NO: 202091 - DNA, 16 bp, P. troglodytes
agagagagactccctc

SEQ ID NO: 202092 - DNA, 16 bp, P. troglodytes
agagagagactctgtc

SEQ ID NO: 202093 - DNA, 16 bp, P. troglodytes
agagagagagaaactc

SEQ ID NO: 202094 - DNA, 16 bp, P. troglodytes
agagagagagaaactg

SEQ ID NO: 202095 - DNA, 16 bp, P. troglodytes
agagagagagaaattc

SEQ ID NO: 202096 - DNA, 16 bp, P. troglodytes
agagagagagaacatt

SEQ ID NO: 202097 - DNA, 16 bp, P. troglodytes
agagagagagaaggcc

SEQ ID NO: 202098 - DNA, 16 bp, P. troglodytes
agagagagagaatcca

SEQ ID NO: 202099 - DNA, 16 bp, P. troglodytes
agagagagagaatttg

SEQ ID NO: 202100 - DNA, 16 bp, P. troglodytes
agagagagagacaaat

SEQ ID NO: 202101 - DNA, 16 bp, P. troglodytes
agagagagagacacag

SEQ ID NO: 202102 - DNA, 16 bp, P. troglodytes
agagagagagacccag

SEQ ID NO: 202103 - DNA, 16 bp, P. troglodytes
agagagagagagagct

SEQ ID NO: 202104 - DNA, 16 bp, P. troglodytes
agagagagagagagtc

SEQ ID NO: 202105 - DNA, 16 bp, P. troglodytes
agagagagagagatac

SEQ ID NO: 202106 - DNA, 16 bp, P. troglodytes
agagagagagagcgtg

SEQ ID NO: 202107 - DNA, 16 bp, P. troglodytes
agagagagagaggctt

SEQ ID NO: 202108 - DNA, 16 bp, P. troglodytes
agagagagagattaga

SEQ ID NO: 202109 - DNA, 16 bp, P. troglodytes
agagagagagatttca

SEQ ID NO: 202110 - DNA, 16 bp, P. troglodytes
agagagagagcgcgag

SEQ ID NO: 202111 - DNA, 16 bp, P. troglodytes
agagagagaggacaca

SEQ ID NO: 202112 - DNA, 16 bp, P. troglodytes
agagagagaggccagg

SEQ ID NO: 202113 - DNA, 16 bp, P. troglodytes
agagagagagtcttgc

SEQ ID NO: 202114 - DNA, 16 bp, P. troglodytes
agagagagagtttgac

SEQ ID NO: 202115 - DNA, 16 bp, P. troglodytes
agagagagccagagag

SEQ ID NO: 202116 - DNA, 16 bp, P. troglodytes
agagagagcccagaaa

SEQ ID NO: 202117 - DNA, 16 bp, P. troglodytes
agagagagcgagagca

SEQ ID NO: 202118 - DNA, 16 bp, P. troglodytes
agagagagcttatgca

SEQ ID NO: 202119 - DNA, 16 bp, P. troglodytes
agagagaggaggtgcc

SEQ ID NO: 202120 - DNA, 16 bp, P. troglodytes
agagagaggcagacag

SEQ ID NO: 202121 - DNA, 20 bp, P. troglodytes
agagagatcagattgttact

SEQ ID NO: 202122 - DNA, 16 bp, P. troglodytes
agagagatgcagagag

SEQ ID NO: 202123 - DNA, 16 bp, P. troglodytes
agagagatttttaaaa

SEQ ID NO: 202124 - DNA, 16 bp, P. troglodytes
agagagcaagacccca

SEQ ID NO: 202125 - DNA, 16 bp, P. troglodytes
agagagcagagcccag

SEQ ID NO: 202126 - DNA, 16 bp, P. troglodytes
agagagcagcctggcc

SEQ ID NO: 202127 - DNA, 16 bp, P. troglodytes
agagagcatcaggaaa

SEQ ID NO: 202128 - DNA, 16 bp, P. troglodytes
agagagcatccctgtc

SEQ ID NO: 202129 - DNA, 16 bp, P. troglodytes
agagagccaaatgatg

SEQ ID NO: 202130 - DNA, 16 bp, P. troglodytes
agagagccaagatcat

SEQ ID NO: 202131 - DNA, 16 bp, P. troglodytes
agagagccaccatcct

SEQ ID NO: 202132 - DNA, 16 bp, P. troglodytes
agagagccagagagag

SEQ ID NO: 202133 - DNA, 16 bp, P. troglodytes
agagagccctcaccag

SEQ ID NO: 202134 - DNA, 16 bp, P. troglodytes
agagagccctccccag

SEQ ID NO: 202135 - DNA, 16 bp, P. troglodytes
agagagcctcccacct

SEQ ID NO: 202136 - DNA, 16 bp, P. troglodytes
agagagctccagcaga

SEQ ID NO: 202137 - DNA, 16 bp, P. troglodytes
agagagctctggctgg

SEQ ID NO: 202138 - DNA, 16 bp, P. troglodytes
agagagcttgtgcagg

SEQ ID NO: 202139 - DNA, 16 bp, P. troglodytes
agagaggaaaactgag

SEQ ID NO: 202140 - DNA, 16 bp, P. troglodytes
agagaggacacaaata

SEQ ID NO: 202141 - DNA, 16 bp, P. troglodytes
agagaggacacaagca

SEQ ID NO: 202142 - DNA, 16 bp, P. troglodytes
agagaggacacagaga

SEQ ID NO: 202143 - DNA, 16 bp, P. troglodytes
agagaggacatccctg

SEQ ID NO: 202144 - DNA, 16 bp, P. troglodytes
agagaggagaagcagc

SEQ ID NO: 202145 - DNA, 16 bp, P. troglodytes
agagaggagaccctgg

SEQ ID NO: 202146 - DNA, 16 bp, P. troglodytes
agagaggaggcctgga

SEQ ID NO: 202147 - DNA, 16 bp, P. troglodytes
agagaggaggggctgg

SEQ ID NO: 202148 - DNA, 16 bp, P. troglodytes
agagaggcagaggcag

SEQ ID NO: 202149 - DNA, 16 bp, P. troglodytes
agagaggcatgaaaca

SEQ ID NO: 202150 - DNA, 16 bp, P. troglodytes
agagaggctctgtctc

SEQ ID NO: 202151 - DNA, 16 bp, P. troglodytes
agagaggctgagacag

SEQ ID NO: 202152 - DNA, 16 bp, P. troglodytes
agagaggctgaggtgg

SEQ ID NO: 202153 - DNA, 16 bp, P. troglodytes
agagaggctgggatga

SEQ ID NO: 202154 - DNA, 16 bp, P. troglodytes
agagagggaatccttg

SEQ ID NO: 202155 - DNA, 16 bp, P. troglodytes
agagaggggttttgcc

SEQ ID NO: 202156 - DNA, 16 bp, P. troglodytes
agagagggttcttgga

SEQ ID NO: 202157 - DNA, 16 bp, P. troglodytes
agagaggttaaatatc

SEQ ID NO: 202158 - DNA, 16 bp, P. troglodytes
agagagtagcagctca

SEQ ID NO: 202159 - DNA, 16 bp, P. troglodytes
agagagtcagcaaaga

SEQ ID NO: 202160 - DNA, 16 bp, P. troglodytes
agagagtgaaaagaca

SEQ ID NO: 202161 - DNA, 16 bp, P. troglodytes
agagagtgagagcgag

SEQ ID NO: 202162 - DNA, 16 bp, P. troglodytes
agagagtgtctcactc

SEQ ID NO: 202163 - DNA, 16 bp, P. troglodytes
agagagttttatttct

SEQ ID NO: 202164 - DNA, 16 bp, P. troglodytes
agagataagaaaactg

SEQ ID NO: 202165 - DNA, 17 bp, P. troglodytes
agagatacaaactacca

SEQ ID NO: 202166 - DNA, 16 bp, P. troglodytes
agagatacagagacag

SEQ ID NO: 202167 - DNA, 16 bp, P. troglodytes
agagatagggtcttgc

SEQ ID NO: 202168 - DNA, 16 bp, P. troglodytes
agagatagtttgattt

SEQ ID NO: 202169 - DNA, 16 bp, P. troglodytes
agagatcgagaacatc

SEQ ID NO: 202170 - DNA, 18 bp, P. troglodytes
agagatcgcgccactgca

SEQ ID NO: 202171 - DNA, 16 bp, P. troglodytes
agagatctctcacctc

SEQ ID NO: 202172 - DNA, 16 bp, P. troglodytes
agagatctgttgtaca

SEQ ID NO: 202173 - DNA, 16 bp, P. troglodytes
agagatcttgaaagga

SEQ ID NO: 202174 - DNA, 16 bp, P. troglodytes
agagatgaaaaataca

SEQ ID NO: 202175 - DNA, 16 bp, P. troglodytes
agagatgaagaaacag

SEQ ID NO: 202176 - DNA, 16 bp, P. troglodytes
agagatgacacaaaca

SEQ ID NO: 202177 - DNA, 16 bp, P. troglodytes
agagatgagatttctc

SEQ ID NO: 202178 - DNA, 16 bp, P. troglodytes
agagatgaggaaactg

SEQ ID NO: 202179 - DNA, 16 bp, P. troglodytes
agagatgaggtcccac

SEQ ID NO: 202180 - DNA, 16 bp, P. troglodytes
agagatgaggtcttgc

SEQ ID NO: 202181 - DNA, 16 bp, P. troglodytes
agagatgagttcttgc

SEQ ID NO: 202182 - DNA, 16 bp, P. troglodytes
agagatgcagggatgg

SEQ ID NO: 202183 - DNA, 16 bp, P. troglodytes
agagatggaaaacaga

SEQ ID NO: 202184 - DNA, 16 bp, P. troglodytes
agagatggaaataatt

SEQ ID NO: 202185 - DNA, 16 bp, P. troglodytes
agagatggagaccatc

SEQ ID NO: 202186 - DNA, 16 bp, P. troglodytes
agagatggagcaagag

SEQ ID NO: 202187 - DNA, 18 bp, P. troglodytes
agagatggagtctcactg

SEQ ID NO: 202188 - DNA, 16 bp, P. troglodytes
agagatgggatttcac

SEQ ID NO: 202189 - DNA, 16 bp, P. troglodytes
agagatgggatttcat

SEQ ID NO: 202190 - DNA, 16 bp, P. troglodytes
agagatgggctttctc

SEQ ID NO: 202191 - DNA, 16 bp, P. troglodytes
agagatggggtttcgc

SEQ ID NO: 202192 - DNA, 16 bp, P. troglodytes
agagatggggttttcc

SEQ ID NO: 202193 - DNA, 16 bp, P. troglodytes
agagatggtggtggct

SEQ ID NO: 202194 - DNA, 16 bp, P. troglodytes
agagatggtgttttgc

SEQ ID NO: 202195 - DNA, 16 bp, P. troglodytes
agagatggtttgactt

SEQ ID NO: 202196 - DNA, 16 bp, P. troglodytes
agagatgtggtctcgc

SEQ ID NO: 202197 - DNA, 16 bp, P. troglodytes
agagatgttaaataat

SEQ ID NO: 202198 - DNA, 22 bp, P. troglodytes
agagattaaagtaaagacaggc

SEQ ID NO: 202199 - DNA, 16 bp, P. troglodytes
agagattaagtgactt

SEQ ID NO: 202200 - DNA, 16 bp, P. troglodytes
agagattattttaaat

SEQ ID NO: 202201 - DNA, 18 bp, P. troglodytes
agagattcagcttcttcc

SEQ ID NO: 202202 - DNA, 16 bp, P. troglodytes
agagattcagtttctt

SEQ ID NO: 202203 - DNA, 16 bp, P. troglodytes
agagattctgttttga

SEQ ID NO: 202204 - DNA, 16 bp, P. troglodytes
agagattcttgtgtct

SEQ ID NO: 202205 - DNA, 16 bp, P. troglodytes
agagattgaagtgagc

SEQ ID NO: 202206 - DNA, 16 bp, P. troglodytes
agagattggaatgatg

SEQ ID NO: 202207 - DNA, 16 bp, P. troglodytes
agagattgggtcttgc

SEQ ID NO: 202208 - DNA, 16 bp, P. troglodytes
agagatttactgaaaa

SEQ ID NO: 202209 - DNA, 16 bp, P. troglodytes
agagatttattgcaaa

SEQ ID NO: 202210 - DNA, 16 bp, P. troglodytes
agagatttgtagaact

SEQ ID NO: 202211 - DNA, 16 bp, P. troglodytes
agagattttaaagaat

SEQ ID NO: 202212 - DNA, 16 bp, P. troglodytes
agagattttagaaaat

SEQ ID NO: 202213 - DNA, 16 bp, P. troglodytes
agagattttattaaaa

SEQ ID NO: 202214 - DNA, 16 bp, P. troglodytes
agagatttttaaaaat

SEQ ID NO: 202215 - DNA, 16 bp, P. troglodytes
agagatttttaaataa

SEQ ID NO: 202216 - DNA, 16 bp, P. troglodytes
agagatttttttaaag

SEQ ID NO: 202217 - DNA, 16 bp, P. troglodytes
agagcaaacagattca

SEQ ID NO: 202218 - DNA, 16 bp, P. troglodytes
agagcaaagccctgtc

SEQ ID NO: 202219 - DNA, 16 bp, P. troglodytes
agagcaaccactaaaa

SEQ ID NO: 202220 - DNA, 16 bp, P. troglodytes
agagcaagaacctgtc

SEQ ID NO: 202221 - DNA, 16 bp, P. troglodytes
agagcaagacactgtg

SEQ ID NO: 202222 - DNA, 18 bp, P. troglodytes
agagcaagaccctgtcta

SEQ ID NO: 202223 - DNA, 16 bp, P. troglodytes
agagcaagaccttctc

SEQ ID NO: 202224 - DNA, 16 bp, P. troglodytes
agagcaagactccgcc

SEQ ID NO: 202225 - DNA, 16 bp, P. troglodytes
agagcaagactttgtc

SEQ ID NO: 202226 - DNA, 16 bp, P. troglodytes
agagcaagatcctgtc

SEQ ID NO: 202227 - DNA, 16 bp, P. troglodytes
agagcaagattctgta

SEQ ID NO: 202228 - DNA, 16 bp, P. troglodytes
agagcaagattgtgtc

SEQ ID NO: 202229 - DNA, 16 bp, P. troglodytes
agagcaagcgagggct

SEQ ID NO: 202230 - DNA, 16 bp, P. troglodytes
agagcaaggattcaaa

SEQ ID NO: 202231 - DNA, 16 bp, P. troglodytes
agagcaaggctctgtc

SEQ ID NO: 202232 - DNA, 16 bp, P. troglodytes
agagcaatgaggcaag

SEQ ID NO: 202233 - DNA, 16 bp, P. troglodytes
agagcaatggcacaat

SEQ ID NO: 202234 - DNA, 16 bp, P. troglodytes
agagcacaggcagaat

SEQ ID NO: 202235 - DNA, 16 bp, P. troglodytes
agagcacagggaggcc

SEQ ID NO: 202236 - DNA, 16 bp, P. troglodytes
agagcacagggatgcc

SEQ ID NO: 202237 - DNA, 16 bp, P. troglodytes
agagcaccacagtggt

SEQ ID NO: 202238 - DNA, 16 bp, P. troglodytes
agagcaccagctgcag

SEQ ID NO: 202239 - DNA, 16 bp, P. troglodytes
agagcacctgtcaaag

SEQ ID NO: 202240 - DNA, 16 bp, P. troglodytes
agagcagaaaagatga

SEQ ID NO: 202241 - DNA, 16 bp, P. troglodytes
agagcagaagttttaa

SEQ ID NO: 202242 - DNA, 16 bp, P. troglodytes
agagcagcagcagcag

SEQ ID NO: 202243 - DNA, 16 bp, P. troglodytes
agagcagcagcatggg

SEQ ID NO: 202244 - DNA, 16 bp, P. troglodytes
agagcagccccaaggg

SEQ ID NO: 202245 - DNA, 16 bp, P. troglodytes
agagcagccctgaggg

SEQ ID NO: 202246 - DNA, 16 bp, P. troglodytes
agagcagcctgatcaa

SEQ ID NO: 202247 - DNA, 16 bp, P. troglodytes
agagcagcctggccaa

SEQ ID NO: 202248 - DNA, 16 bp, P. troglodytes
agagcagctcacagaa

SEQ ID NO: 202249 - DNA, 16 bp, P. troglodytes
agagcaggaatgaaaa

SEQ ID NO: 202250 - DNA, 16 bp, P. troglodytes
agagcaggaccttgtc

SEQ ID NO: 202251 - DNA, 16 bp, P. troglodytes
agagcaggactctgtc

SEQ ID NO: 202252 - DNA, 16 bp, P. troglodytes
agagcagggaccttgt

SEQ ID NO: 202253 - DNA, 16 bp, P. troglodytes
agagcaggggcacaat

SEQ ID NO: 202254 - DNA, 16 bp, P. troglodytes
agagcagtctgggcaa

SEQ ID NO: 202255 - DNA, 16 bp, P. troglodytes
agagcagtgctgtcca

SEQ ID NO: 202256 - DNA, 16 bp, P. troglodytes
agagcagtgcttctcc

SEQ ID NO: 202257 - DNA, 16 bp, P. troglodytes
agagcagtgtgtggag

SEQ ID NO: 202258 - DNA, 16 bp, P. troglodytes
agagcagttttatgtt

SEQ ID NO: 202259 - DNA, 16 bp, P. troglodytes
agagcatcctggccaa

SEQ ID NO: 202260 - DNA, 16 bp, P. troglodytes
agagcatgagctctgg

SEQ ID NO: 202261 - DNA, 16 bp, P. troglodytes
agagcatttttaaaaa

SEQ ID NO: 202262 - DNA, 16 bp, P. troglodytes
agagccaaaacatgag

SEQ ID NO: 202263 - DNA, 16 bp, P. troglodytes
agagccaaatcatatt

SEQ ID NO: 202264 - DNA, 16 bp, P. troglodytes
agagccaaatcatgac

SEQ ID NO: 202265 - DNA, 16 bp, P. troglodytes
agagccaactgaaaga

SEQ ID NO: 202266 - DNA, 18 bp, P. troglodytes
agagccaagatcgcacca

SEQ ID NO: 202267 - DNA, 16 bp, P. troglodytes
agagccaattccagaa

SEQ ID NO: 202268 - DNA, 16 bp, P. troglodytes
agagccacaggggcag

SEQ ID NO: 202269 - DNA, 16 bp, P. troglodytes
agagccactgcacctg

SEQ ID NO: 202270 - DNA, 16 bp, P. troglodytes
agagccagactccctc

SEQ ID NO: 202271 - DNA, 16 bp, P. troglodytes
agagccagagagagag

SEQ ID NO: 202272 - DNA, 16 bp, P. troglodytes
agagccagcaaaggag

SEQ ID NO: 202273 - DNA, 16 bp, P. troglodytes
agagccaggatttgaa

SEQ ID NO: 202274 - DNA, 16 bp, P. troglodytes
agagccaggcaccctt

SEQ ID NO: 202275 - DNA, 16 bp, P. troglodytes
agagccagtgccctta

SEQ ID NO: 202276 - DNA, 16 bp, P. troglodytes
agagcccacactgcca

SEQ ID NO: 202277 - DNA, 16 bp, P. troglodytes
agagcccaggaggcag

SEQ ID NO: 202278 - DNA, 17 bp, P. troglodytes
agagcccaggagttcaa

SEQ ID NO: 202279 - DNA, 16 bp, P. troglodytes
agagcccaggagtttg

SEQ ID NO: 202280 - DNA, 16 bp, P. troglodytes
agagcccaggctggag

SEQ ID NO: 202281 - DNA, 16 bp, P. troglodytes
agagccccagggcctt

SEQ ID NO: 202282 - DNA, 16 bp, P. troglodytes
agagccctcttcctgg

SEQ ID NO: 202283 - DNA, 16 bp, P. troglodytes
agagccctgtaattgc

SEQ ID NO: 202284 - DNA, 16 bp, P. troglodytes
agagcccttgagcctt

SEQ ID NO: 202285 - DNA, 18 bp, P. troglodytes
agagccgagatcatgcca

SEQ ID NO: 202286 - DNA, 16 bp, P. troglodytes
agagcctccaggagga

SEQ ID NO: 202287 - DNA, 16 bp, P. troglodytes
agagcctctctctgtc

SEQ ID NO: 202288 - DNA, 16 bp, P. troglodytes
agagcctctggaggga

SEQ ID NO: 202289 - DNA, 17 bp, P. troglodytes
agagcctgaaaaactgc

SEQ ID NO: 202290 - DNA, 16 bp, P. troglodytes
agagcctgcagaacca

SEQ ID NO: 202291 - DNA, 16 bp, P. troglodytes
agagcctgcatttcta

SEQ ID NO: 202292 - DNA, 16 bp, P. troglodytes
agagcctggagttctg

SEQ ID NO: 202293 - DNA, 16 bp, P. troglodytes
agagcctgtctaaaaa

SEQ ID NO: 202294 - DNA, 16 bp, P. troglodytes
agagccttcaccagaa

SEQ ID NO: 202295 - DNA, 16 bp, P. troglodytes
agagccttgaagatga

SEQ ID NO: 202296 - DNA, 16 bp, P. troglodytes
agagccttgctctgtc

SEQ ID NO: 202297 - DNA, 16 bp, P. troglodytes
agagccttggccctct

SEQ ID NO: 202298 - DNA, 17 bp, P. troglodytes
agagcgagactccatca

SEQ ID NO: 202299 - DNA, 16 bp, P. troglodytes
agagcgagactccatt

SEQ ID NO: 202300 - DNA, 16 bp, P. troglodytes
agagcgagactccgtt

SEQ ID NO: 202301 - DNA, 17 bp, P. troglodytes
agagcgagactgtctcc

SEQ ID NO: 202302 - DNA, 16 bp, P. troglodytes
agagcgagagactctg

SEQ ID NO: 202303 - DNA, 16 bp, P. troglodytes
agagctaaaatgttca

SEQ ID NO: 202304 - DNA, 16 bp, P. troglodytes
agagctaaatcatgaa

SEQ ID NO: 202305 - DNA, 17 bp, P. troglodytes
agagctaactatcctga

SEQ ID NO: 202306 - DNA, 16 bp, P. troglodytes
agagctagaatttgaa

SEQ ID NO: 202307 - DNA, 16 bp, P. troglodytes
agagctaggatttgaa

SEQ ID NO: 202308 - DNA, 16 bp, P. troglodytes
agagctagttgttaaa

SEQ ID NO: 202309 - DNA, 16 bp, P. troglodytes
agagctcatatagcca

SEQ ID NO: 202310 - DNA, 16 bp, P. troglodytes
agagctccctctcccc

SEQ ID NO: 202311 - DNA, 16 bp, P. troglodytes
agagctccctgtggga

SEQ ID NO: 202312 - DNA, 16 bp, P. troglodytes
agagctcctcctgcct

SEQ ID NO: 202313 - DNA, 16 bp, P. troglodytes
agagctctgccctcat

SEQ ID NO: 202314 - DNA, 17 bp, P. troglodytes
agagctctggctggcat

SEQ ID NO: 202315 - DNA, 16 bp, P. troglodytes
agagctctggtctgca

SEQ ID NO: 202316 - DNA, 16 bp, P. troglodytes
agagctgaagcagctg

SEQ ID NO: 202317 - DNA, 16 bp, P. troglodytes
agagctgagactggaa

SEQ ID NO: 202318 - DNA, 16 bp, P. troglodytes
agagctgagagccatg

SEQ ID NO: 202319 - DNA, 16 bp, P. troglodytes
agagctgagagcccca

SEQ ID NO: 202320 - DNA, 16 bp, P. troglodytes
agagctgagattgcac

SEQ ID NO: 202321 - DNA, 19 bp, P. troglodytes
agagctgagttcaagtcct

SEQ ID NO: 202322 - DNA, 16 bp, P. troglodytes
agagctgcaatctagt

SEQ ID NO: 202323 - DNA, 16 bp, P. troglodytes
agagctgctgcacagc

SEQ ID NO: 202324 - DNA, 16 bp, P. troglodytes
agagctgcttagagaa

SEQ ID NO: 202325 - DNA, 16 bp, P. troglodytes
agagctggagaggcag

SEQ ID NO: 202326 - DNA, 16 bp, P. troglodytes
agagctgggaccacag

SEQ ID NO: 202327 - DNA, 16 bp, P. troglodytes
agagctgggattcaaa

SEQ ID NO: 202328 - DNA, 16 bp, P. troglodytes
agagctgggcacagtg

SEQ ID NO: 202329 - DNA, 16 bp, P. troglodytes
agagctgggctttgaa

SEQ ID NO: 202330 - DNA, 16 bp, P. troglodytes
agagctggttgtttaa

SEQ ID NO: 202331 - DNA, 16 bp, P. troglodytes
agagctgtgagaaaaa

SEQ ID NO: 202332 - DNA, 16 bp, P. troglodytes
agagctgtgagaagaa

SEQ ID NO: 202333 - DNA, 16 bp, P. troglodytes
agagctgtgagaagag

SEQ ID NO: 202334 - DNA, 16 bp, P. troglodytes
agagctgtggtgggct

SEQ ID NO: 202335 - DNA, 16 bp, P. troglodytes
agagcttagaacagtg

SEQ ID NO: 202336 - DNA, 16 bp, P. troglodytes
agagcttcaaaatgca

SEQ ID NO: 202337 - DNA, 16 bp, P. troglodytes
agagcttctgcagagc

SEQ ID NO: 202338 - DNA, 16 bp, P. troglodytes
agagcttctgcctcca

SEQ ID NO: 202339 - DNA, 16 bp, P. troglodytes
agagctttgggaggct

SEQ ID NO: 202340 - DNA, 16 bp, P. troglodytes
agagcttttctttttt

SEQ ID NO: 202341 - DNA, 16 bp, P. troglodytes
agaggaaaaaactgaa

SEQ ID NO: 202342 - DNA, 16 bp, P. troglodytes
agaggaaaaacttcaa

SEQ ID NO: 202343 - DNA, 16 bp, P. troglodytes
agaggaaaagcaattt

SEQ ID NO: 202344 - DNA, 16 bp, P. troglodytes
agaggaaacaaatttg

SEQ ID NO: 202345 - DNA, 16 bp, P. troglodytes
agaggaaacacattca

SEQ ID NO: 202346 - DNA, 16 bp, P. troglodytes
agaggaaacagaaata

SEQ ID NO: 202347 - DNA, 16 bp, P. troglodytes
agaggaaagaaaacat

SEQ ID NO: 202348 - DNA, 16 bp, P. troglodytes
agaggaaagaccatgt

SEQ ID NO: 202349 - DNA, 16 bp, P. troglodytes
agaggaaagtcaaatt

SEQ ID NO: 202350 - DNA, 16 bp, P. troglodytes
agaggaaagtttataa

SEQ ID NO: 202351 - DNA, 16 bp, P. troglodytes
agaggaaagtttatat

SEQ ID NO: 202352 - DNA, 16 bp, P. troglodytes
agaggaactctcaaaa

SEQ ID NO: 202353 - DNA, 16 bp, P. troglodytes
agaggaactggtacca

SEQ ID NO: 202354 - DNA, 16 bp, P. troglodytes
agaggaagagagacct

SEQ ID NO: 202355 - DNA, 16 bp, P. troglodytes
agaggaagattttaat

SEQ ID NO: 202356 - DNA, 16 bp, P. troglodytes
agaggaagcaaagcat

SEQ ID NO: 202357 - DNA, 16 bp, P. troglodytes
agaggaagcagcagca

SEQ ID NO: 202358 - DNA, 16 bp, P. troglodytes
agaggaaggtacagag

SEQ ID NO: 202359 - DNA, 16 bp, P. troglodytes
agaggaagtcaaacta

SEQ ID NO: 202360 - DNA, 16 bp, P. troglodytes
agaggaagtcaagttg

SEQ ID NO: 202361 - DNA, 16 bp, P. troglodytes
agaggaagtgaaattg

SEQ ID NO: 202362 - DNA, 16 bp, P. troglodytes
agaggaatcaaggatg

SEQ ID NO: 202363 - DNA, 16 bp, P. troglodytes
agaggaatgagcagga

SEQ ID NO: 202364 - DNA, 16 bp, P. troglodytes
agaggaatgtggaagg

SEQ ID NO: 202365 - DNA, 16 bp, P. troglodytes
agaggaattctggttt

SEQ ID NO: 202366 - DNA, 16 bp, P. troglodytes
agaggaatttgaagcc

SEQ ID NO: 202367 - DNA, 16 bp, P. troglodytes
agaggaattttggaag

SEQ ID NO: 202368 - DNA, 16 bp, P. troglodytes
agaggacacagacaaa

SEQ ID NO: 202369 - DNA, 16 bp, P. troglodytes
agaggacatgatcttg

SEQ ID NO: 202370 - DNA, 16 bp, P. troglodytes
agaggacccagaaata

SEQ ID NO: 202371 - DNA, 16 bp, P. troglodytes
agaggaccctgaggcc

SEQ ID NO: 202372 - DNA, 16 bp, P. troglodytes
agaggagaaaattgag

SEQ ID NO: 202373 - DNA, 16 bp, P. troglodytes
agaggagagaacactt

SEQ ID NO: 202374 - DNA, 16 bp, P. troglodytes
agaggagagagacaca

SEQ ID NO: 202375 - DNA, 16 bp, P. troglodytes
agaggagatttggaca

SEQ ID NO: 202376 - DNA, 16 bp, P. troglodytes
agaggagatttttttt

SEQ ID NO: 202377 - DNA, 16 bp, P. troglodytes
agaggagcaagagcaa

SEQ ID NO: 202378 - DNA, 16 bp, P. troglodytes
agaggagcctgggcaa

SEQ ID NO: 202379 - DNA, 16 bp, P. troglodytes
agaggagctggttcca

SEQ ID NO: 202380 - DNA, 16 bp, P. troglodytes
agaggagcttcattga

SEQ ID NO: 202381 - DNA, 16 bp, P. troglodytes
agaggaggaaacactt

SEQ ID NO: 202382 - DNA, 16 bp, P. troglodytes
agaggaggaaactgag

SEQ ID NO: 202383 - DNA, 16 bp, P. troglodytes
agaggaggagactgag

SEQ ID NO: 202384 - DNA, 16 bp, P. troglodytes
agaggaggaggagcca

SEQ ID NO: 202385 - DNA, 16 bp, P. troglodytes
agaggaggaggctggg

SEQ ID NO: 202386 - DNA, 16 bp, P. troglodytes
agaggaggccctggag

SEQ ID NO: 202387 - DNA, 16 bp, P. troglodytes
agaggaggctgggaaa

SEQ ID NO: 202388 - DNA, 16 bp, P. troglodytes
agaggagtccctcctt

SEQ ID NO: 202389 - DNA, 16 bp, P. troglodytes
agaggagtgactttga

SEQ ID NO: 202390 - DNA, 16 bp, P. troglodytes
agaggatcactggagg

SEQ ID NO: 202391 - DNA, 16 bp, P. troglodytes
agaggatcacttgaac

SEQ ID NO: 202392 - DNA, 16 bp, P. troglodytes
agaggatcacttgagc

SEQ ID NO: 202393 - DNA, 16 bp, P. troglodytes
agaggatggcttgagc

SEQ ID NO: 202394 - DNA, 16 bp, P. troglodytes
agaggatgtgaagaaa

SEQ ID NO: 202395 - DNA, 16 bp, P. troglodytes
agaggattttaaatgt

SEQ ID NO: 202396 - DNA, 16 bp, P. troglodytes
agaggcacctgccacc

SEQ ID NO: 202397 - DNA, 16 bp, P. troglodytes
agaggcagaaaataga

SEQ ID NO: 202398 - DNA, 16 bp, P. troglodytes
agaggcagaatttgaa

SEQ ID NO: 202399 - DNA, 16 bp, P. troglodytes
agaggcagacagatca

SEQ ID NO: 202400 - DNA, 16 bp, P. troglodytes
agaggcagagaagcag

SEQ ID NO: 202401 - DNA, 16 bp, P. troglodytes
agaggcagagatggga

SEQ ID NO: 202402 - DNA, 16 bp, P. troglodytes
agaggcagagccagga

SEQ ID NO: 202403 - DNA, 16 bp, P. troglodytes
agaggcagagctgccc

SEQ ID NO: 202404 - DNA, 16 bp, P. troglodytes
agaggcagccataatc

SEQ ID NO: 202405 - DNA, 18 bp, P. troglodytes
agaggcaggagaatggcg

SEQ ID NO: 202406 - DNA, 16 bp, P. troglodytes
agaggcaggagctggg

SEQ ID NO: 202407 - DNA, 16 bp, P. troglodytes
agaggcaggaggatca

SEQ ID NO: 202408 - DNA, 16 bp, P. troglodytes
agaggcaggattcaaa

SEQ ID NO: 202409 - DNA, 16 bp, P. troglodytes
agaggcaggcaggggc

SEQ ID NO: 202410 - DNA, 16 bp, P. troglodytes
agaggcaggtggattg

SEQ ID NO: 202411 - DNA, 16 bp, P. troglodytes
agaggcatgagccact

SEQ ID NO: 202412 - DNA, 16 bp, P. troglodytes
agaggccaaagcagga

SEQ ID NO: 202413 - DNA, 16 bp, P. troglodytes
agaggccaacagtcaa

SEQ ID NO: 202414 - DNA, 16 bp, P. troglodytes
agaggccaaggcgggc

SEQ ID NO: 202415 - DNA, 16 bp, P. troglodytes
agaggccaaggcgggt

SEQ ID NO: 202416 - DNA, 16 bp, P. troglodytes
agaggccagaaggcag

SEQ ID NO: 202417 - DNA, 16 bp, P. troglodytes
agaggccagaggccag

SEQ ID NO: 202418 - DNA, 17 bp, P. troglodytes
agaggccaggagtttga

SEQ ID NO: 202419 - DNA, 16 bp, P. troglodytes
agaggccaggcagcag

SEQ ID NO: 202420 - DNA, 16 bp, P. troglodytes
agaggccaggtgctgt

SEQ ID NO: 202421 - DNA, 16 bp, P. troglodytes
agaggcccaggcaggt

SEQ ID NO: 202422 - DNA, 16 bp, P. troglodytes
agaggccgagatgggt

SEQ ID NO: 202423 - DNA, 16 bp, P. troglodytes
agaggccgaggcaggc

SEQ ID NO: 202424 - DNA, 16 bp, P. troglodytes
agaggccgaggcaggt

SEQ ID NO: 202425 - DNA, 16 bp, P. troglodytes
agaggcctaggaggga

SEQ ID NO: 202426 - DNA, 16 bp, P. troglodytes
agaggcctcaggagaa

SEQ ID NO: 202427 - DNA, 16 bp, P. troglodytes
agaggcctcaggagac

SEQ ID NO: 202428 - DNA, 16 bp, P. troglodytes
agaggcctcaggggaa

SEQ ID NO: 202429 - DNA, 16 bp, P. troglodytes
agaggcctgaaggtcc

SEQ ID NO: 202430 - DNA, 16 bp, P. troglodytes
agaggccttcctcttt

SEQ ID NO: 202431 - DNA, 16 bp, P. troglodytes
agaggcgggaggatag

SEQ ID NO: 202432 - DNA, 16 bp, P. troglodytes
agaggctaagaaactt

SEQ ID NO: 202433 - DNA, 16 bp, P. troglodytes
agaggctcaataaata

SEQ ID NO: 202434 - DNA, 19 bp, P. troglodytes
agaggctcacacctgtaat

SEQ ID NO: 202435 - DNA, 16 bp, P. troglodytes
agaggctctccatgag

SEQ ID NO: 202436 - DNA, 16 bp, P. troglodytes
agaggctgaagaagag

SEQ ID NO: 202437 - DNA, 16 bp, P. troglodytes
agaggctgaagcaaga

SEQ ID NO: 202438 - DNA, 16 bp, P. troglodytes
agaggctgaagcagga

SEQ ID NO: 202439 - DNA, 16 bp, P. troglodytes
agaggctgaagcaggt

SEQ ID NO: 202440 - DNA, 16 bp, P. troglodytes
agaggctgacgcagga

SEQ ID NO: 202441 - DNA, 16 bp, P. troglodytes
agaggctgagccagga

SEQ ID NO: 202442 - DNA, 16 bp, P. troglodytes
agaggctgaggagggc

SEQ ID NO: 202443 - DNA, 16 bp, P. troglodytes
agaggctgaggcagaa

SEQ ID NO: 202444 - DNA, 16 bp, P. troglodytes
agaggctgaggcaggc

SEQ ID NO: 202445 - DNA, 16 bp, P. troglodytes
agaggctgagggcagg

SEQ ID NO: 202446 - DNA, 16 bp, P. troglodytes
agaggctgaggtagaa

SEQ ID NO: 202447 - DNA, 16 bp, P. troglodytes
agaggctgaggtggaa

SEQ ID NO: 202448 - DNA, 16 bp, P. troglodytes
agaggctgcactgagc

SEQ ID NO: 202449 - DNA, 16 bp, P. troglodytes
agaggctgcagaacaa

SEQ ID NO: 202450 - DNA, 16 bp, P. troglodytes
agaggctgcagagagc

SEQ ID NO: 202451 - DNA, 16 bp, P. troglodytes
agaggctgcagtgagt

SEQ ID NO: 202452 - DNA, 16 bp, P. troglodytes
agaggctggaagaatt

SEQ ID NO: 202453 - DNA, 16 bp, P. troglodytes
agaggctggaggaggc

SEQ ID NO: 202454 - DNA, 16 bp, P. troglodytes
agaggctgggaaagat

SEQ ID NO: 202455 - DNA, 16 bp, P. troglodytes
agaggctgggaagggg

SEQ ID NO: 202456 - DNA, 16 bp, P. troglodytes
agaggctgggaagggt

SEQ ID NO: 202457 - DNA, 16 bp, P. troglodytes
agaggctgggagaggg

SEQ ID NO: 202458 - DNA, 16 bp, P. troglodytes
agaggctgggcatggt

SEQ ID NO: 202459 - DNA, 16 bp, P. troglodytes
agaggctggggaggag

SEQ ID NO: 202460 - DNA, 16 bp, P. troglodytes
agaggctggggagggt

SEQ ID NO: 202461 - DNA, 16 bp, P. troglodytes
agaggctggggcagaa

SEQ ID NO: 202462 - DNA, 16 bp, P. troglodytes
agaggctggggcagga

SEQ ID NO: 202463 - DNA, 16 bp, P. troglodytes
agaggcttgatcagat

SEQ ID NO: 202464 - DNA, 16 bp, P. troglodytes
agagggaaaaaaatca

SEQ ID NO: 202465 - DNA, 16 bp, P. troglodytes
agagggaaaaatggtt

SEQ ID NO: 202466 - DNA, 16 bp, P. troglodytes
agagggaaagtgactt

SEQ ID NO: 202467 - DNA, 31 bp, P. troglodytes
agagggaaatttatagcactaaatgcccaca

SEQ ID NO: 202468 - DNA, 16 bp, P. troglodytes
agagggaattctgcct

SEQ ID NO: 202469 - DNA, 16 bp, P. troglodytes
agagggacagaactaa

SEQ ID NO: 202470 - DNA, 16 bp, P. troglodytes
agagggagaaaatatt

SEQ ID NO: 202471 - DNA, 17 bp, P. troglodytes
agagggagactccatct

SEQ ID NO: 202472 - DNA, 16 bp, P. troglodytes
agagggaggacagagc

SEQ ID NO: 202473 - DNA, 16 bp, P. troglodytes
agagggaggaggtgcc

SEQ ID NO: 202474 - DNA, 16 bp, P. troglodytes
agagggcaagcagaag

SEQ ID NO: 202475 - DNA, 16 bp, P. troglodytes
agagggcaggggctgc

SEQ ID NO: 202476 - DNA, 16 bp, P. troglodytes
agagggcagtggtgtg

SEQ ID NO: 202477 - DNA, 16 bp, P. troglodytes
agagggccaaggctct

SEQ ID NO: 202478 - DNA, 16 bp, P. troglodytes
agagggccaggcatgg

SEQ ID NO: 202479 - DNA, 16 bp, P. troglodytes
agagggccaggtgcag

SEQ ID NO: 202480 - DNA, 16 bp, P. troglodytes
agagggccaggtgtgg

SEQ ID NO: 202481 - DNA, 16 bp, P. troglodytes
agagggctgaggtggg

SEQ ID NO: 202482 - DNA, 16 bp, P. troglodytes
agagggctggggagag

SEQ ID NO: 202483 - DNA, 16 bp, P. troglodytes
agaggggagaggtgct

SEQ ID NO: 202484 - DNA, 16 bp, P. troglodytes
agaggggctggggcag

SEQ ID NO: 202485 - DNA, 22 bp, P. troglodytes
agagggggatttggcagggtca

SEQ ID NO: 202486 - DNA, 16 bp, P. troglodytes
agagggtctgtgggtt

SEQ ID NO: 202487 - DNA, 16 bp, P. troglodytes
agagggtgcaagtccc

SEQ ID NO: 202488 - DNA, 16 bp, P. troglodytes
agaggtaaagtaattt

SEQ ID NO: 202489 - DNA, 16 bp, P. troglodytes
agaggtaatcaaatta

SEQ ID NO: 202490 - DNA, 16 bp, P. troglodytes
agaggtacaaagaaaa

SEQ ID NO: 202491 - DNA, 16 bp, P. troglodytes
agaggtacatctaact

SEQ ID NO: 202492 - DNA, 16 bp, P. troglodytes
agaggtagaatttgaa

SEQ ID NO: 202493 - DNA, 16 bp, P. troglodytes
agaggtcactctcatt

SEQ ID NO: 202494 - DNA, 17 bp, P. troglodytes
agaggtcaggagttcaa

SEQ ID NO: 202495 - DNA, 16 bp, P. troglodytes
agaggtcaggagttgg

SEQ ID NO: 202496 - DNA, 16 bp, P. troglodytes
agaggtcaggagtttg

SEQ ID NO: 202497 - DNA, 16 bp, P. troglodytes
agaggtcagggatgct

SEQ ID NO: 202498 - DNA, 18 bp, P. troglodytes
agaggtcatccctgtctt

SEQ ID NO: 202499 - DNA, 16 bp, P. troglodytes
agaggtccaagatcaa

SEQ ID NO: 202500 - DNA, 16 bp, P. troglodytes
agaggtcccagaagaa

SEQ ID NO: 202501 - DNA, 16 bp, P. troglodytes
agaggtcttcatggca

SEQ ID NO: 202502 - DNA, 16 bp, P. troglodytes
agaggtgacagagcag

SEQ ID NO: 202503 - DNA, 16 bp, P. troglodytes
agaggtgacatttgaa

SEQ ID NO: 202504 - DNA, 16 bp, P. troglodytes
agaggtggaagaaaat

SEQ ID NO: 202505 - DNA, 16 bp, P. troglodytes
agaggtggaggcagga

SEQ ID NO: 202506 - DNA, 18 bp, P. troglodytes
agaggtggaggttgcagt

SEQ ID NO: 202507 - DNA, 20 bp, P. troglodytes
agaggtggagtctacagagg

SEQ ID NO: 202508 - DNA, 16 bp, P. troglodytes
agaggtgggaggatta

SEQ ID NO: 202509 - DNA, 16 bp, P. troglodytes
agaggtgggattgctg

SEQ ID NO: 202510 - DNA, 16 bp, P. troglodytes
agaggtgggcagattg

SEQ ID NO: 202511 - DNA, 16 bp, P. troglodytes
agaggtgggggtttca

SEQ ID NO: 202512 - DNA, 16 bp, P. troglodytes
agaggttaagtaatgt

SEQ ID NO: 202513 - DNA, 16 bp, P. troglodytes
agaggttaggacttca

SEQ ID NO: 202514 - DNA, 16 bp, P. troglodytes
agaggttcagtgactt

SEQ ID NO: 202515 - DNA, 16 bp, P. troglodytes
agaggttctccatgaa

SEQ ID NO: 202516 - DNA, 16 bp, P. troglodytes
agaggttgagtaactt

SEQ ID NO: 202517 - DNA, 16 bp, P. troglodytes
agaggttgcagcgagc

SEQ ID NO: 202518 - DNA, 16 bp, P. troglodytes
agaggttgcagtcagc

SEQ ID NO: 202519 - DNA, 16 bp, P. troglodytes
agaggttgcagtgaag

SEQ ID NO: 202520 - DNA, 16 bp, P. troglodytes
agaggttgcagtgagt

SEQ ID NO: 202521 - DNA, 18 bp, P. troglodytes
agaggttgctgtgagctg

SEQ ID NO: 202522 - DNA, 16 bp, P. troglodytes
agaggttggaacagtt

SEQ ID NO: 202523 - DNA, 16 bp, P. troglodytes
agaggttggaagaatt

SEQ ID NO: 202524 - DNA, 16 bp, P. troglodytes
agaggttggagtgagc

SEQ ID NO: 202525 - DNA, 16 bp, P. troglodytes
agaggttggcagtgag

SEQ ID NO: 202526 - DNA, 16 bp, P. troglodytes
agaggttgtggtgagc

SEQ ID NO: 202527 - DNA, 16 bp, P. troglodytes
agaggtttaatagact

SEQ ID NO: 202528 - DNA, 16 bp, P. troglodytes
agaggtttaatggaat

SEQ ID NO: 202529 - DNA, 16 bp, P. troglodytes
agaggtttcagggagc

SEQ ID NO: 202530 - DNA, 16 bp, P. troglodytes
agaggtttttttcttt

SEQ ID NO: 202531 - DNA, 16 bp, P. troglodytes
agagtaaaatattttt

SEQ ID NO: 202532 - DNA, 16 bp, P. troglodytes
agagtaaagaggactt

SEQ ID NO: 202533 - DNA, 16 bp, P. troglodytes
agagtaacatgctgta

SEQ ID NO: 202534 - DNA, 16 bp, P. troglodytes
agagtaaccaaaacag

SEQ ID NO: 202535 - DNA, 16 bp, P. troglodytes
agagtaagaccttgtc

SEQ ID NO: 202536 - DNA, 16 bp, P. troglodytes
agagtaagactcagtc

SEQ ID NO: 202537 - DNA, 17 bp, P. troglodytes
agagtaagactccatct

SEQ ID NO: 202538 - DNA, 16 bp, P. troglodytes
agagtaagcagcagca

SEQ ID NO: 202539 - DNA, 28 bp, P. troglodytes
agagtacaaaagagagaaattttaaagc

SEQ ID NO: 202540 - DNA, 16 bp, P. troglodytes
agagtactttttaaaa

SEQ ID NO: 202541 - DNA, 16 bp, P. troglodytes
agagtagctgagatta

SEQ ID NO: 202542 - DNA, 16 bp, P. troglodytes
agagtagttgctactt

SEQ ID NO: 202543 - DNA, 16 bp, P. troglodytes
agagtatctacaaaaa

SEQ ID NO: 202544 - DNA, 16 bp, P. troglodytes
agagtatctttttttt

SEQ ID NO: 202545 - DNA, 16 bp, P. troglodytes
agagtatttttttctt

SEQ ID NO: 202546 - DNA, 16 bp, P. troglodytes
agagtcaaaggaatga

SEQ ID NO: 202547 - DNA, 16 bp, P. troglodytes
agagtcaaatcaagaa

SEQ ID NO: 202548 - DNA, 16 bp, P. troglodytes
agagtcaagattcaaa

SEQ ID NO: 202549 - DNA, 16 bp, P. troglodytes
agagtcaagatttgaa

SEQ ID NO: 202550 - DNA, 16 bp, P. troglodytes
agagtcagagagagat

SEQ ID NO: 202551 - DNA, 18 bp, P. troglodytes
agagtcagtgaagggaga

SEQ ID NO: 202552 - DNA, 16 bp, P. troglodytes
agagtccagaaacaaa

SEQ ID NO: 202553 - DNA, 16 bp, P. troglodytes
agagtcccagaaggag

SEQ ID NO: 202554 - DNA, 16 bp, P. troglodytes
agagtccctgtttccc

SEQ ID NO: 202555 - DNA, 16 bp, P. troglodytes
agagtctacaagaaac

SEQ ID NO: 202556 - DNA, 17 bp, P. troglodytes
agagtctcactctgtcc

SEQ ID NO: 202557 - DNA, 17 bp, P. troglodytes
agagtctcgctctgtca

SEQ ID NO: 202558 - DNA, 16 bp, P. troglodytes
agagtctcgctctgtt

SEQ ID NO: 202559 - DNA, 16 bp, P. troglodytes
agagtctctctctctc

SEQ ID NO: 202560 - DNA, 16 bp, P. troglodytes
agagtctctctctgtt

SEQ ID NO: 202561 - DNA, 16 bp, P. troglodytes
agagtctctctctttc

SEQ ID NO: 202562 - DNA, 16 bp, P. troglodytes
agagtctgtttcaaaa

SEQ ID NO: 202563 - DNA, 16 bp, P. troglodytes
agagtcttgccctgtc

SEQ ID NO: 202564 - DNA, 17 bp, P. troglodytes
agagtcttgctctgtcg

SEQ ID NO: 202565 - DNA, 17 bp, P. troglodytes
agagtcttgctctgtct

SEQ ID NO: 202566 - DNA, 16 bp, P. troglodytes
agagtcttgctttgtt

SEQ ID NO: 202567 - DNA, 16 bp, P. troglodytes
agagtctttaaagagg

SEQ ID NO: 202568 - DNA, 16 bp, P. troglodytes
agagtgaaaaggaatg

SEQ ID NO: 202569 - DNA, 16 bp, P. troglodytes
agagtgaaacctcatc

SEQ ID NO: 202570 - DNA, 16 bp, P. troglodytes
agagtgaacaggcaaa

SEQ ID NO: 202571 - DNA, 18 bp, P. troglodytes
agagtgaacaggcaacct

SEQ ID NO: 202572 - DNA, 16 bp, P. troglodytes
agagtgaacatgcaac

SEQ ID NO: 202573 - DNA, 16 bp, P. troglodytes
agagtgacctctggtc

SEQ ID NO: 202574 - DNA, 16 bp, P. troglodytes
agagtgagaacctgtc

SEQ ID NO: 202575 - DNA, 16 bp, P. troglodytes
agagtgagaccccatc

SEQ ID NO: 202576 - DNA, 17 bp, P. troglodytes
agagtgagactcggtct

SEQ ID NO: 202577 - DNA, 16 bp, P. troglodytes
agagtgagactctgtt

SEQ ID NO: 202578 - DNA, 16 bp, P. troglodytes
agagtgagattccatc

SEQ ID NO: 202579 - DNA, 16 bp, P. troglodytes
agagtgagattccttc

SEQ ID NO: 202580 - DNA, 18 bp, P. troglodytes
agagtgagattctgtcta

SEQ ID NO: 202581 - DNA, 16 bp, P. troglodytes
agagtgatatcctgtc

SEQ ID NO: 202582 - DNA, 19 bp, P. troglodytes
agagtgcaatggcacgatc

SEQ ID NO: 202583 - DNA, 16 bp, P. troglodytes
agagtgcaatggtgtg

SEQ ID NO: 202584 - DNA, 16 bp, P. troglodytes
agagtgcagagatgcc

SEQ ID NO: 202585 - DNA, 18 bp, P. troglodytes
agagtgcagtggcacaat

SEQ ID NO: 202586 - DNA, 16 bp, P. troglodytes
agagtgcagtggcacg

SEQ ID NO: 202587 - DNA, 16 bp, P. troglodytes
agagtgcagtggcgca

SEQ ID NO: 202588 - DNA, 16 bp, P. troglodytes
agagtgcagtggcgtg

SEQ ID NO: 202589 - DNA, 17 bp, P. troglodytes
agagtgcagtggtgtga

SEQ ID NO: 202590 - DNA, 16 bp, P. troglodytes
agagtgcagttgcaag

SEQ ID NO: 202591 - DNA, 16 bp, P. troglodytes
agagtgccgattggtg

SEQ ID NO: 202592 - DNA, 16 bp, P. troglodytes
agagtgcctagcacat

SEQ ID NO: 202593 - DNA, 16 bp, P. troglodytes
agagtgcttgtgattt

SEQ ID NO: 202594 - DNA, 16 bp, P. troglodytes
agagtggaagaaaatc

SEQ ID NO: 202595 - DNA, 16 bp, P. troglodytes
agagtggcaagctgaa

SEQ ID NO: 202596 - DNA, 16 bp, P. troglodytes
agagtgggagagatta

SEQ ID NO: 202597 - DNA, 16 bp, P. troglodytes
agagtgtaattgaatt

SEQ ID NO: 202598 - DNA, 16 bp, P. troglodytes
agagttaaaactttct

SEQ ID NO: 202599 - DNA, 16 bp, P. troglodytes
agagttaaagaaacca

SEQ ID NO: 202600 - DNA, 29 bp, P. troglodytes
agagttaaatggattaagggcggtgcaag

SEQ ID NO: 202601 - DNA, 16 bp, P. troglodytes
agagttattgtgaaga

SEQ ID NO: 202602 - DNA, 16 bp, P. troglodytes
agagttcaaaaccagc

SEQ ID NO: 202603 - DNA, 16 bp, P. troglodytes
agagttcaagcaattc

SEQ ID NO: 202604 - DNA, 16 bp, P. troglodytes
agagttcaagcccagc

SEQ ID NO: 202605 - DNA, 18 bp, P. troglodytes
agagttcaaggccagcct

SEQ ID NO: 202606 - DNA, 16 bp, P. troglodytes
agagttcagtggcatg

SEQ ID NO: 202607 - DNA, 16 bp, P. troglodytes
agagttcatgaccaag

SEQ ID NO: 202608 - DNA, 16 bp, P. troglodytes
agagttcattcatgat

SEQ ID NO: 202609 - DNA, 16 bp, P. troglodytes
agagttcctgaaggaa

SEQ ID NO: 202610 - DNA, 16 bp, P. troglodytes
agagttctgatggaga

SEQ ID NO: 202611 - DNA, 16 bp, P. troglodytes
agagttctggagatgg

SEQ ID NO: 202612 - DNA, 16 bp, P. troglodytes
agagttcttgcattgg

SEQ ID NO: 202613 - DNA, 16 bp, P. troglodytes
agagttgagattcaaa

SEQ ID NO: 202614 - DNA, 16 bp, P. troglodytes
agagttgctgggacta

SEQ ID NO: 202615 - DNA, 16 bp, P. troglodytes
agagttgggactttca

SEQ ID NO: 202616 - DNA, 16 bp, P. troglodytes
agagttgtgcaaccat

SEQ ID NO: 202617 - DNA, 16 bp, P. troglodytes
agagttgtttttttct

SEQ ID NO: 202618 - DNA, 16 bp, P. troglodytes
agagtttaaaaatatt

SEQ ID NO: 202619 - DNA, 16 bp, P. troglodytes
agagtttaaataattt

SEQ ID NO: 202620 - DNA, 16 bp, P. troglodytes
agagtttagaaataga

SEQ ID NO: 202621 - DNA, 16 bp, P. troglodytes
agagtttattaaaaag

SEQ ID NO: 202622 - DNA, 16 bp, P. troglodytes
agagtttatttttaaa

SEQ ID NO: 202623 - DNA, 16 bp, P. troglodytes
agagtttcagtttctc

SEQ ID NO: 202624 - DNA, 16 bp, P. troglodytes
agagtttcagttttgg

SEQ ID NO: 202625 - DNA, 16 bp, P. troglodytes
agagtttgaaaccagc

SEQ ID NO: 202626 - DNA, 16 bp, P. troglodytes
agagtttgacttcctc

SEQ ID NO: 202627 - DNA, 16 bp, P. troglodytes
agagtttgagactagc

SEQ ID NO: 202628 - DNA, 16 bp, P. troglodytes
agagtttgctgtgagc

SEQ ID NO: 202629 - DNA, 16 bp, P. troglodytes
agagtttggctcttgt

SEQ ID NO: 202630 - DNA, 16 bp, P. troglodytes
agagttttatcatgaa

SEQ ID NO: 202631 - DNA, 16 bp, P. troglodytes
agagttttattagttt

SEQ ID NO: 202632 - DNA, 16 bp, P. troglodytes
agagttttctacatat

SEQ ID NO: 202633 - DNA, 16 bp, P. troglodytes
agagttttctttcttt

SEQ ID NO: 202634 - DNA, 16 bp, P. troglodytes
agagttttgctctttg

SEQ ID NO: 202635 - DNA, 16 bp, P. troglodytes
agagttttgctctttt

SEQ ID NO: 202636 - DNA, 16 bp, P. troglodytes
agagttttgttttctt

SEQ ID NO: 202637 - DNA, 16 bp, P. troglodytes
agagtttttatagttt

SEQ ID NO: 202638 - DNA, 16 bp, P. troglodytes
agagtttttattatga

SEQ ID NO: 202639 - DNA, 16 bp, P. troglodytes
agataaaaatgcaaat

SEQ ID NO: 202640 - DNA, 16 bp, P. troglodytes
agataaaacatttttt

SEQ ID NO: 202641 - DNA, 16 bp, P. troglodytes
agataaaataaacttt

SEQ ID NO: 202642 - DNA, 16 bp, P. troglodytes
agataaaattgtatat

SEQ ID NO: 202643 - DNA, 16 bp, P. troglodytes
agataaagaaaacatg

SEQ ID NO: 202644 - DNA, 16 bp, P. troglodytes
agataaagaaactgag

SEQ ID NO: 202645 - DNA, 16 bp, P. troglodytes
agataaagagaaaatc

SEQ ID NO: 202646 - DNA, 16 bp, P. troglodytes
agataaagattttttt

SEQ ID NO: 202647 - DNA, 16 bp, P. troglodytes
agataaatgttggcaa

SEQ ID NO: 202648 - DNA, 16 bp, P. troglodytes
agataaatttgacaaa

SEQ ID NO: 202649 - DNA, 16 bp, P. troglodytes
agataacaaaggaatt

SEQ ID NO: 202650 - DNA, 16 bp, P. troglodytes
agataacaagtattgg

SEQ ID NO: 202651 - DNA, 16 bp, P. troglodytes
agataacattggaaaa

SEQ ID NO: 202652 - DNA, 16 bp, P. troglodytes
agataaccacctttaa

SEQ ID NO: 202653 - DNA, 16 bp, P. troglodytes
agataacttgttttct

SEQ ID NO: 202654 - DNA, 16 bp, P. troglodytes
agataagaaaacagag

SEQ ID NO: 202655 - DNA, 16 bp, P. troglodytes
agataagaaaactgag

SEQ ID NO: 202656 - DNA, 16 bp, P. troglodytes
agataagcagagagcc

SEQ ID NO: 202657 - DNA, 16 bp, P. troglodytes
agataagcctggagca

SEQ ID NO: 202658 - DNA, 16 bp, P. troglodytes
agataaggaaaccaag

SEQ ID NO: 202659 - DNA, 16 bp, P. troglodytes
agataagggaacttca

SEQ ID NO: 202660 - DNA, 16 bp, P. troglodytes
agataataaatgtatg

SEQ ID NO: 202661 - DNA, 16 bp, P. troglodytes
agataatacattttta

SEQ ID NO: 202662 - DNA, 16 bp, P. troglodytes
agataatatattcaaa

SEQ ID NO: 202663 - DNA, 16 bp, P. troglodytes
agataatattatctat

SEQ ID NO: 202664 - DNA, 16 bp, P. troglodytes
agataatcaactaaga

SEQ ID NO: 202665 - DNA, 16 bp, P. troglodytes
agataatctatgtaaa

SEQ ID NO: 202666 - DNA, 16 bp, P. troglodytes
agataatgattcctct

SEQ ID NO: 202667 - DNA, 16 bp, P. troglodytes
agataattctcaaaag

SEQ ID NO: 202668 - DNA, 16 bp, P. troglodytes
agataatttatgtaaa

SEQ ID NO: 202669 - DNA, 16 bp, P. troglodytes
agatacaaagatgaat

SEQ ID NO: 202670 - DNA, 16 bp, P. troglodytes
agatacaaagtattga

SEQ ID NO: 202671 - DNA, 16 bp, P. troglodytes
agatacaatgcaaaaa

SEQ ID NO: 202672 - DNA, 16 bp, P. troglodytes
agatacacaaatggcc

SEQ ID NO: 202673 - DNA, 16 bp, P. troglodytes
agatacacaatataaa

SEQ ID NO: 202674 - DNA, 16 bp, P. troglodytes
agatacagaaataaat

SEQ ID NO: 202675 - DNA, 16 bp, P. troglodytes
agatacagaaatgaat

SEQ ID NO: 202676 - DNA, 16 bp, P. troglodytes
agatacagatagatag

SEQ ID NO: 202677 - DNA, 16 bp, P. troglodytes
agatacatacatatat

SEQ ID NO: 202678 - DNA, 16 bp, P. troglodytes
agatacattttgaaaa

SEQ ID NO: 202679 - DNA, 16 bp, P. troglodytes
agataccaactcacac

SEQ ID NO: 202680 - DNA, 16 bp, P. troglodytes
agataccacttcacat

SEQ ID NO: 202681 - DNA, 16 bp, P. troglodytes
agataccagagaaagg

SEQ ID NO: 202682 - DNA, 16 bp, P. troglodytes
agatactcaaaaatgt

SEQ ID NO: 202683 - DNA, 22 bp, P. troglodytes
agatactccttgagaagagcaa

SEQ ID NO: 202684 - DNA, 16 bp, P. troglodytes
agatactctggaggct

SEQ ID NO: 202685 - DNA, 16 bp, P. troglodytes
agatactgccaaattg

SEQ ID NO: 202686 - DNA, 16 bp, P. troglodytes
agatactgtgtttttt

SEQ ID NO: 202687 - DNA, 16 bp, P. troglodytes
agatacttctccaaag

SEQ ID NO: 202688 - DNA, 16 bp, P. troglodytes
agatacttttcaaaag

SEQ ID NO: 202689 - DNA, 16 bp, P. troglodytes
agatagaggcagagat

SEQ ID NO: 202690 - DNA, 16 bp, P. troglodytes
agatagagttgctctg

SEQ ID NO: 202691 - DNA, 16 bp, P. troglodytes
agatagccaggcccct

SEQ ID NO: 202692 - DNA, 16 bp, P. troglodytes
agatagcggtgtagat

SEQ ID NO: 202693 - DNA, 16 bp, P. troglodytes
agatagcttcctgaaa

SEQ ID NO: 202694 - DNA, 16 bp, P. troglodytes
agataggagaaaacca

SEQ ID NO: 202695 - DNA, 16 bp, P. troglodytes
agatagggtcttgctc

SEQ ID NO: 202696 - DNA, 16 bp, P. troglodytes
agatagtaaatatttt

SEQ ID NO: 202697 - DNA, 16 bp, P. troglodytes
agatagtaaatgtttt

SEQ ID NO: 202698 - DNA, 16 bp, P. troglodytes
agatagtgaaaatagt

SEQ ID NO: 202699 - DNA, 16 bp, P. troglodytes
agatagtgatgatggt

SEQ ID NO: 202700 - DNA, 16 bp, P. troglodytes
agatataaaatataca

SEQ ID NO: 202701 - DNA, 16 bp, P. troglodytes
agatataaacagaaac

SEQ ID NO: 202702 - DNA, 16 bp, P. troglodytes
agatataaagcaaata

SEQ ID NO: 202703 - DNA, 16 bp, P. troglodytes
agatataatccacata

SEQ ID NO: 202704 - DNA, 16 bp, P. troglodytes
agatatagatatatat

SEQ ID NO: 202705 - DNA, 16 bp, P. troglodytes
agatatatatatatga

SEQ ID NO: 202706 - DNA, 16 bp, P. troglodytes
agatatatggatttat

SEQ ID NO: 202707 - DNA, 16 bp, P. troglodytes
agatatcaggagaaag

SEQ ID NO: 202708 - DNA, 16 bp, P. troglodytes
agatatctgcactctc

SEQ ID NO: 202709 - DNA, 16 bp, P. troglodytes
agatatgacactaaaa

SEQ ID NO: 202710 - DNA, 16 bp, P. troglodytes
agatatgcaaatactt

SEQ ID NO: 202711 - DNA, 16 bp, P. troglodytes
agatatgcaaattaaa

SEQ ID NO: 202712 - DNA, 16 bp, P. troglodytes
agatatgggaaagttt

SEQ ID NO: 202713 - DNA, 16 bp, P. troglodytes
agatatgtattatata

SEQ ID NO: 202714 - DNA, 16 bp, P. troglodytes
agatatgtcaatagaa

SEQ ID NO: 202715 - DNA, 16 bp, P. troglodytes
agatattaggcctttg

SEQ ID NO: 202716 - DNA, 26 bp, P. troglodytes
agatattatccaggagaacttcccca

SEQ ID NO: 202717 - DNA, 16 bp, P. troglodytes
agatattattattatc

SEQ ID NO: 202718 - DNA, 16 bp, P. troglodytes
agatattcaacacttc

SEQ ID NO: 202719 - DNA, 16 bp, P. troglodytes
agatattgtgtgtgtg

SEQ ID NO: 202720 - DNA, 16 bp, P. troglodytes
agatatttataaaaca

SEQ ID NO: 202721 - DNA, 16 bp, P. troglodytes
agatatttatgaaaat

SEQ ID NO: 202722 - DNA, 16 bp, P. troglodytes
agatatttattttaag

SEQ ID NO: 202723 - DNA, 16 bp, P. troglodytes
agatatttcacatttt

SEQ ID NO: 202724 - DNA, 16 bp, P. troglodytes
agatatttcattaaaa

SEQ ID NO: 202725 - DNA, 16 bp, P. troglodytes
agatatttcattttca

SEQ ID NO: 202726 - DNA, 16 bp, P. troglodytes
agatattttaaaatgt

SEQ ID NO: 202727 - DNA, 16 bp, P. troglodytes
agatattttaagtaaa

SEQ ID NO: 202728 - DNA, 16 bp, P. troglodytes
agatattttaatttct

SEQ ID NO: 202729 - DNA, 16 bp, P. troglodytes
agatattttcatattt

SEQ ID NO: 202730 - DNA, 16 bp, P. troglodytes
agatattttctaaatt

SEQ ID NO: 202731 - DNA, 16 bp, P. troglodytes
agatattttctccatt

SEQ ID NO: 202732 - DNA, 16 bp, P. troglodytes
agatattttcttagta

SEQ ID NO: 202733 - DNA, 16 bp, P. troglodytes
agatattttggtacag

SEQ ID NO: 202734 - DNA, 16 bp, P. troglodytes
agatatttttaaaaca

SEQ ID NO: 202735 - DNA, 16 bp, P. troglodytes
agatatttttaaagaa

SEQ ID NO: 202736 - DNA, 16 bp, P. troglodytes
agatatttttcatttt

SEQ ID NO: 202737 - DNA, 16 bp, P. troglodytes
agatatttttcctttt

SEQ ID NO: 202738 - DNA, 16 bp, P. troglodytes
agatattttttctctt

SEQ ID NO: 202739 - DNA, 16 bp, P. troglodytes
agatatttttttcctt

SEQ ID NO: 202740 - DNA, 16 bp, P. troglodytes
agatcaaaaacactgt

SEQ ID NO: 202741 - DNA, 16 bp, P. troglodytes
agatcaaaatttggga

SEQ ID NO: 202742 - DNA, 16 bp, P. troglodytes
agatcaaagaagaaat

SEQ ID NO: 202743 - DNA, 16 bp, P. troglodytes
agatcaaagcactggc

SEQ ID NO: 202744 - DNA, 16 bp, P. troglodytes
agatcaagcagaagaa

SEQ ID NO: 202745 - DNA, 16 bp, P. troglodytes
agatcaagggaacaga

SEQ ID NO: 202746 - DNA, 16 bp, P. troglodytes
agatcaaggtgtcagc

SEQ ID NO: 202747 - DNA, 16 bp, P. troglodytes
agatcaatggaataga

SEQ ID NO: 202748 - DNA, 16 bp, P. troglodytes
agatcacaagctcagg

SEQ ID NO: 202749 - DNA, 16 bp, P. troglodytes
agatcacaagggcagg

SEQ ID NO: 202750 - DNA, 16 bp, P. troglodytes
agatcacaccactcac

SEQ ID NO: 202751 - DNA, 16 bp, P. troglodytes
agatcaccaggtcaag

SEQ ID NO: 202752 - DNA, 16 bp, P. troglodytes
agatcacgccatagca

SEQ ID NO: 202753 - DNA, 16 bp, P. troglodytes
agatcactaaaactta

SEQ ID NO: 202754 - DNA, 16 bp, P. troglodytes
agatcactgcaacctc

SEQ ID NO: 202755 - DNA, 16 bp, P. troglodytes
agatcactgcagcctc

SEQ ID NO: 202756 - DNA, 16 bp, P. troglodytes
agatcactgcagcttc

SEQ ID NO: 202757 - DNA, 16 bp, P. troglodytes
agatcacttgagctca

SEQ ID NO: 202758 - DNA, 16 bp, P. troglodytes
agatcacttgaggtca

SEQ ID NO: 202759 - DNA, 21 bp, P. troglodytes
agatcacttgaggtcaggagc

SEQ ID NO: 202760 - DNA, 16 bp, P. troglodytes
agatcagagagttgta

SEQ ID NO: 202761 - DNA, 16 bp, P. troglodytes
agatcagagtgccagc

SEQ ID NO: 202762 - DNA, 16 bp, P. troglodytes
agatcagattgttgta

SEQ ID NO: 202763 - DNA, 16 bp, P. troglodytes
agatcagatttttttt

SEQ ID NO: 202764 - DNA, 21 bp, P. troglodytes
agatcagcctgaccaacatgg

SEQ ID NO: 202765 - DNA, 16 bp, P. troglodytes
agatcagcctggccaa

SEQ ID NO: 202766 - DNA, 16 bp, P. troglodytes
agatcagcctgggcaa

SEQ ID NO: 202767 - DNA, 16 bp, P. troglodytes
agatcagcttaggcaa

SEQ ID NO: 202768 - DNA, 16 bp, P. troglodytes
agatcaggaacaagac

SEQ ID NO: 202769 - DNA, 16 bp, P. troglodytes
agatcaggagactgag

SEQ ID NO: 202770 - DNA, 16 bp, P. troglodytes
agatcaggcatttcca

SEQ ID NO: 202771 - DNA, 16 bp, P. troglodytes
agatcagtctgggcaa

SEQ ID NO: 202772 - DNA, 16 bp, P. troglodytes
agatcatagcagaact

SEQ ID NO: 202773 - DNA, 16 bp, P. troglodytes
agatcatatggtagtt

SEQ ID NO: 202774 - DNA, 16 bp, P. troglodytes
agatcatcaagacaga

SEQ ID NO: 202775 - DNA, 16 bp, P. troglodytes
agatcatcaggcatta

SEQ ID NO: 202776 - DNA, 16 bp, P. troglodytes
agatcatccaggaaaa

SEQ ID NO: 202777 - DNA, 16 bp, P. troglodytes
agatcatcctggccaa

SEQ ID NO: 202778 - DNA, 18 bp, P. troglodytes
agatcatcctggctaaca

SEQ ID NO: 202779 - DNA, 19 bp, P. troglodytes
agatcatctgaggtcagga

SEQ ID NO: 202780 - DNA, 16 bp, P. troglodytes
agatcatgaaggtgga

SEQ ID NO: 202781 - DNA, 16 bp, P. troglodytes
agatcatgagtgaact

SEQ ID NO: 202782 - DNA, 16 bp, P. troglodytes
agatcatgccattgtg

SEQ ID NO: 202783 - DNA, 16 bp, P. troglodytes
agatcatgggacttct

SEQ ID NO: 202784 - DNA, 16 bp, P. troglodytes
agatcatgggagaagg

SEQ ID NO: 202785 - DNA, 18 bp, P. troglodytes
agatcatgtcactgcact

SEQ ID NO: 202786 - DNA, 16 bp, P. troglodytes
agatcatttgaaccca

SEQ ID NO: 202787 - DNA, 16 bp, P. troglodytes
agatcattttgaaact

SEQ ID NO: 202788 - DNA, 16 bp, P. troglodytes
agatcattttggaatt

SEQ ID NO: 202789 - DNA, 16 bp, P. troglodytes
agatccaatggtgctt

SEQ ID NO: 202790 - DNA, 17 bp, P. troglodytes
agatccaccaacagctt

SEQ ID NO: 202791 - DNA, 16 bp, P. troglodytes
agatccaccccctgcc

SEQ ID NO: 202792 - DNA, 17 bp, P. troglodytes
agatccactgacagctt

SEQ ID NO: 202793 - DNA, 16 bp, P. troglodytes
agatccatttgttcta

SEQ ID NO: 202794 - DNA, 16 bp, P. troglodytes
agatcccaccactgca

SEQ ID NO: 202795 - DNA, 16 bp, P. troglodytes
agatcccatctctaca

SEQ ID NO: 202796 - DNA, 16 bp, P. troglodytes
agatcctatctaaaaa

SEQ ID NO: 202797 - DNA, 16 bp, P. troglodytes
agatcctcccacatca

SEQ ID NO: 202798 - DNA, 16 bp, P. troglodytes
agatcctcctgcctcg

SEQ ID NO: 202799 - DNA, 16 bp, P. troglodytes
agatcctgggcttttc

SEQ ID NO: 202800 - DNA, 16 bp, P. troglodytes
agatcctgtctcagaa

SEQ ID NO: 202801 - DNA, 16 bp, P. troglodytes
agatcctgtttctaca

SEQ ID NO: 202802 - DNA, 16 bp, P. troglodytes
agatcgagaccacggt

SEQ ID NO: 202803 - DNA, 16 bp, P. troglodytes
agatcgagaccatctt

SEQ ID NO: 202804 - DNA, 16 bp, P. troglodytes
agatcgagccattgta

SEQ ID NO: 202805 - DNA, 16 bp, P. troglodytes
agatcgcaccactgcg

SEQ ID NO: 202806 - DNA, 16 bp, P. troglodytes
agatcgcatcactgca

SEQ ID NO: 202807 - DNA, 18 bp, P. troglodytes
agatcgcgccactgcacc

SEQ ID NO: 202808 - DNA, 18 bp, P. troglodytes
agatcgcgccattacact

SEQ ID NO: 202809 - DNA, 17 bp, P. troglodytes
agatcgcgcctttgcac

SEQ ID NO: 202810 - DNA, 17 bp, P. troglodytes
agatcgcttgagctcag

SEQ ID NO: 202811 - DNA, 16 bp, P. troglodytes
agatcgtgccattgcg

SEQ ID NO: 202812 - DNA, 16 bp, P. troglodytes
agatctaatggtttaa

SEQ ID NO: 202813 - DNA, 16 bp, P. troglodytes
agatctacctgtcttg

SEQ ID NO: 202814 - DNA, 16 bp, P. troglodytes
agatctcactctgttg

SEQ ID NO: 202815 - DNA, 16 bp, P. troglodytes
agatctcagaaataaa

SEQ ID NO: 202816 - DNA, 16 bp, P. troglodytes
agatctcagccctgct

SEQ ID NO: 202817 - DNA, 16 bp, P. troglodytes
agatctcaggagttgg

SEQ ID NO: 202818 - DNA, 16 bp, P. troglodytes
agatctcagttcaaat

SEQ ID NO: 202819 - DNA, 16 bp, P. troglodytes
agatctcatggtttta

SEQ ID NO: 202820 - DNA, 16 bp, P. troglodytes
agatctcatgttaagt

SEQ ID NO: 202821 - DNA, 16 bp, P. troglodytes
agatctcctgagaatt

SEQ ID NO: 202822 - DNA, 17 bp, P. troglodytes
agatctcggctcactgc

SEQ ID NO: 202823 - DNA, 18 bp, P. troglodytes
agatctcggctcactgca

SEQ ID NO: 202824 - DNA, 16 bp, P. troglodytes
agatctctgcaaggag

SEQ ID NO: 202825 - DNA, 16 bp, P. troglodytes
agatctgagtttgaat

SEQ ID NO: 202826 - DNA, 16 bp, P. troglodytes
agatctgatgatttta

SEQ ID NO: 202827 - DNA, 16 bp, P. troglodytes
agatctgatgggttta

SEQ ID NO: 202828 - DNA, 16 bp, P. troglodytes
agatctgatggtttaa

SEQ ID NO: 202829 - DNA, 16 bp, P. troglodytes
agatctgatggtttta

SEQ ID NO: 202830 - DNA, 16 bp, P. troglodytes
agatctgatggttttg

SEQ ID NO: 202831 - DNA, 16 bp, P. troglodytes
agatctgcccgccttg

SEQ ID NO: 202832 - DNA, 16 bp, P. troglodytes
agatctggggtggggc

SEQ ID NO: 202833 - DNA, 16 bp, P. troglodytes
agatctggtgagaact

SEQ ID NO: 202834 - DNA, 16 bp, P. troglodytes
agatctgtgcatttca

SEQ ID NO: 202835 - DNA, 16 bp, P. troglodytes
agatcttacatttaag

SEQ ID NO: 202836 - DNA, 16 bp, P. troglodytes
agatcttagcaacctc

SEQ ID NO: 202837 - DNA, 16 bp, P. troglodytes
agatcttcatttcttt

SEQ ID NO: 202838 - DNA, 16 bp, P. troglodytes
agatcttgtctctaaa

SEQ ID NO: 202839 - DNA, 16 bp, P. troglodytes
agatctttcacttctc

SEQ ID NO: 202840 - DNA, 16 bp, P. troglodytes
agatcttttccccatt

SEQ ID NO: 202841 - DNA, 16 bp, P. troglodytes
agatctttttaacttt

SEQ ID NO: 202842 - DNA, 16 bp, P. troglodytes
agatctttttcttcca

SEQ ID NO: 202843 - DNA, 16 bp, P. troglodytes
agatgaaaaagctgag

SEQ ID NO: 202844 - DNA, 16 bp, P. troglodytes
agatgaaaacttccca

SEQ ID NO: 202845 - DNA, 16 bp, P. troglodytes
agatgaaaagactgag

SEQ ID NO: 202846 - DNA, 16 bp, P. troglodytes
agatgaaaagagacaa

SEQ ID NO: 202847 - DNA, 16 bp, P. troglodytes
agatgaaaagagttct

SEQ ID NO: 202848 - DNA, 16 bp, P. troglodytes
agatgaaaataacatt

SEQ ID NO: 202849 - DNA, 16 bp, P. troglodytes
agatgaaaatatattt

SEQ ID NO: 202850 - DNA, 16 bp, P. troglodytes
agatgaaaattctaag

SEQ ID NO: 202851 - DNA, 16 bp, P. troglodytes
agatgaaataagattg

SEQ ID NO: 202852 - DNA, 16 bp, P. troglodytes
agatgaaatggaccaa

SEQ ID NO: 202853 - DNA, 16 bp, P. troglodytes
agatgaaatgttctgt

SEQ ID NO: 202854 - DNA, 16 bp, P. troglodytes
agatgaacaatgagaa

SEQ ID NO: 202855 - DNA, 16 bp, P. troglodytes
agatgaaccaggtacc

SEQ ID NO: 202856 - DNA, 16 bp, P. troglodytes
agatgaacctggaaga

SEQ ID NO: 202857 - DNA, 16 bp, P. troglodytes
agatgaagaaaaacca

SEQ ID NO: 202858 - DNA, 16 bp, P. troglodytes
agatgaagaaaaagca

SEQ ID NO: 202859 - DNA, 16 bp, P. troglodytes
agatgaagaaacagat

SEQ ID NO: 202860 - DNA, 16 bp, P. troglodytes
agatgaagaaaccaaa

SEQ ID NO: 202861 - DNA, 16 bp, P. troglodytes
agatgaagaaaccaag

SEQ ID NO: 202862 - DNA, 16 bp, P. troglodytes
agatgaagaaaccgag

SEQ ID NO: 202863 - DNA, 16 bp, P. troglodytes
agatgaagaaactaag

SEQ ID NO: 202864 - DNA, 16 bp, P. troglodytes
agatgaagaaactgaa

SEQ ID NO: 202865 - DNA, 16 bp, P. troglodytes
agatgaagaaactgag

SEQ ID NO: 202866 - DNA, 16 bp, P. troglodytes
agatgaagaaatcaaa

SEQ ID NO: 202867 - DNA, 16 bp, P. troglodytes
agatgaagaaatcaag

SEQ ID NO: 202868 - DNA, 16 bp, P. troglodytes
agatgaagaacttatt

SEQ ID NO: 202869 - DNA, 16 bp, P. troglodytes
agatgaagaagctgaa

SEQ ID NO: 202870 - DNA, 16 bp, P. troglodytes
agatgaagacactgaa

SEQ ID NO: 202871 - DNA, 16 bp, P. troglodytes
agatgaagaccatcct

SEQ ID NO: 202872 - DNA, 16 bp, P. troglodytes
agatgaagagactgag

SEQ ID NO: 202873 - DNA, 16 bp, P. troglodytes
agatgaagagatggat

SEQ ID NO: 202874 - DNA, 16 bp, P. troglodytes
agatgaagctggagaa

SEQ ID NO: 202875 - DNA, 16 bp, P. troglodytes
agatgaagctggagag

SEQ ID NO: 202876 - DNA, 16 bp, P. troglodytes
agatgaaggcagagat

SEQ ID NO: 202877 - DNA, 16 bp, P. troglodytes
agatgaagtcaaattg

SEQ ID NO: 202878 - DNA, 16 bp, P. troglodytes
agatgaagtcagagag

SEQ ID NO: 202879 - DNA, 17 bp, P. troglodytes
agatgaagtctcactct

SEQ ID NO: 202880 - DNA, 16 bp, P. troglodytes
agatgaataaatacaa

SEQ ID NO: 202881 - DNA, 16 bp, P. troglodytes
agatgaatcaaataga

SEQ ID NO: 202882 - DNA, 16 bp, P. troglodytes
agatgaatcttgaaga

SEQ ID NO: 202883 - DNA, 16 bp, P. troglodytes
agatgaatgaaaatga

SEQ ID NO: 202884 - DNA, 16 bp, P. troglodytes
agatgaatgcacaaat

SEQ ID NO: 202885 - DNA, 16 bp, P. troglodytes
agatgacaaaaatgaa

SEQ ID NO: 202886 - DNA, 16 bp, P. troglodytes
agatgacaaaattgag

SEQ ID NO: 202887 - DNA, 16 bp, P. troglodytes
agatgacagagatgtt

SEQ ID NO: 202888 - DNA, 16 bp, P. troglodytes
agatgacatgactgtc

SEQ ID NO: 202889 - DNA, 16 bp, P. troglodytes
agatgactttgagggg

SEQ ID NO: 202890 - DNA, 16 bp, P. troglodytes
agatgagaaaacaggc

SEQ ID NO: 202891 - DNA, 16 bp, P. troglodytes
agatgagaaaacggag

SEQ ID NO: 202892 - DNA, 16 bp, P. troglodytes
agatgagaaaactaag

SEQ ID NO: 202893 - DNA, 16 bp, P. troglodytes
agatgagaaaactgag

SEQ ID NO: 202894 - DNA, 16 bp, P. troglodytes
agatgagaaacttctt

SEQ ID NO: 202895 - DNA, 16 bp, P. troglodytes
agatgagaaagaacca

SEQ ID NO: 202896 - DNA, 16 bp, P. troglodytes
agatgagaaatgctat

SEQ ID NO: 202897 - DNA, 16 bp, P. troglodytes
agatgagaaattactt

SEQ ID NO: 202898 - DNA, 16 bp, P. troglodytes
agatgagaacattgag

SEQ ID NO: 202899 - DNA, 16 bp, P. troglodytes
agatgagaatccagtt

SEQ ID NO: 202900 - DNA, 16 bp, P. troglodytes
agatgagagagacaga

SEQ ID NO: 202901 - DNA, 16 bp, P. troglodytes
agatgagcaaagaaag

SEQ ID NO: 202902 - DNA, 16 bp, P. troglodytes
agatgaggaaacagat

SEQ ID NO: 202903 - DNA, 16 bp, P. troglodytes
agatgaggaaaccgag

SEQ ID NO: 202904 - DNA, 16 bp, P. troglodytes
agatgaggaaactaag

SEQ ID NO: 202905 - DNA, 16 bp, P. troglodytes
agatgaggaaactgaa

SEQ ID NO: 202906 - DNA, 16 bp, P. troglodytes
agatgaggaaactgag

SEQ ID NO: 202907 - DNA, 16 bp, P. troglodytes
agatgaggaaactgga

SEQ ID NO: 202908 - DNA, 16 bp, P. troglodytes
agatgaggaaatgaag

SEQ ID NO: 202909 - DNA, 16 bp, P. troglodytes
agatgaggaaattaaa

SEQ ID NO: 202910 - DNA, 16 bp, P. troglodytes
agatgaggaagaacca

SEQ ID NO: 202911 - DNA, 16 bp, P. troglodytes
agatgaggaagatgag

SEQ ID NO: 202912 - DNA, 16 bp, P. troglodytes
agatgaggaagccaag

SEQ ID NO: 202913 - DNA, 16 bp, P. troglodytes
agatgaggaagctgag

SEQ ID NO: 202914 - DNA, 16 bp, P. troglodytes
agatgaggaatctgag

SEQ ID NO: 202915 - DNA, 16 bp, P. troglodytes
agatgaggacactgag

SEQ ID NO: 202916 - DNA, 16 bp, P. troglodytes
agatgaggacagtgag

SEQ ID NO: 202917 - DNA, 16 bp, P. troglodytes
agatgaggagacagag

SEQ ID NO: 202918 - DNA, 16 bp, P. troglodytes
agatgaggagactgag

SEQ ID NO: 202919 - DNA, 16 bp, P. troglodytes
agatgaggagattgag

SEQ ID NO: 202920 - DNA, 16 bp, P. troglodytes
agatgaggatgaagac

SEQ ID NO: 202921 - DNA, 16 bp, P. troglodytes
agatgaggcaactgag

SEQ ID NO: 202922 - DNA, 16 bp, P. troglodytes
agatgaggtcacactg

SEQ ID NO: 202923 - DNA, 16 bp, P. troglodytes
agatgaggttttgcca

SEQ ID NO: 202924 - DNA, 16 bp, P. troglodytes
agatgagtctcctgaa

SEQ ID NO: 202925 - DNA, 16 bp, P. troglodytes
agatgagtttcaccat

SEQ ID NO: 202926 - DNA, 16 bp, P. troglodytes
agatgataaatatttt

SEQ ID NO: 202927 - DNA, 16 bp, P. troglodytes
agatgatagatttaaa

SEQ ID NO: 202928 - DNA, 16 bp, P. troglodytes
agatgatattttaaaa

SEQ ID NO: 202929 - DNA, 16 bp, P. troglodytes
agatgatcatttggtt

SEQ ID NO: 202930 - DNA, 16 bp, P. troglodytes
agatgatccacctgcc

SEQ ID NO: 202931 - DNA, 16 bp, P. troglodytes
agatgatccagcagca

SEQ ID NO: 202932 - DNA, 16 bp, P. troglodytes
agatgatctctctctc

SEQ ID NO: 202933 - DNA, 16 bp, P. troglodytes
agatgatgaatatgtt

SEQ ID NO: 202934 - DNA, 16 bp, P. troglodytes
agatgatgagttgata

SEQ ID NO: 202935 - DNA, 16 bp, P. troglodytes
agatgatggaaatgtt

SEQ ID NO: 202936 - DNA, 16 bp, P. troglodytes
agatgatggagttttc

SEQ ID NO: 202937 - DNA, 16 bp, P. troglodytes
agatgatgggcggcca

SEQ ID NO: 202938 - DNA, 16 bp, P. troglodytes
agatgatggtgatgat

SEQ ID NO: 202939 - DNA, 16 bp, P. troglodytes
agatgatggtgatggt

SEQ ID NO: 202940 - DNA, 16 bp, P. troglodytes
agatgatgtggagaaa

SEQ ID NO: 202941 - DNA, 16 bp, P. troglodytes
agatgattaaatcatg

SEQ ID NO: 202942 - DNA, 16 bp, P. troglodytes
agatgattatatggtt

SEQ ID NO: 202943 - DNA, 16 bp, P. troglodytes
agatgattcaagcaca

SEQ ID NO: 202944 - DNA, 16 bp, P. troglodytes
agatgattctgatgat

SEQ ID NO: 202945 - DNA, 16 bp, P. troglodytes
agatgattctttgttg

SEQ ID NO: 202946 - DNA, 16 bp, P. troglodytes
agatgatttaaaacat

SEQ ID NO: 202947 - DNA, 16 bp, P. troglodytes
agatgatttagagtat

SEQ ID NO: 202948 - DNA, 16 bp, P. troglodytes
agatgatttatttaaa

SEQ ID NO: 202949 - DNA, 16 bp, P. troglodytes
agatgcaaaaattctt

SEQ ID NO: 202950 - DNA, 16 bp, P. troglodytes
agatgcactgaaaact

SEQ ID NO: 202951 - DNA, 20 bp, P. troglodytes
agatgcagaaaaggccttca

SEQ ID NO: 202952 - DNA, 16 bp, P. troglodytes
agatgcagaaactgag

SEQ ID NO: 202953 - DNA, 16 bp, P. troglodytes
agatgcagaagaagca

SEQ ID NO: 202954 - DNA, 16 bp, P. troglodytes
agatgcagacactgag

SEQ ID NO: 202955 - DNA, 16 bp, P. troglodytes
agatgcagatgctggt

SEQ ID NO: 202956 - DNA, 16 bp, P. troglodytes
agatgcagccaggagg

SEQ ID NO: 202957 - DNA, 16 bp, P. troglodytes
agatgcagcccctcaa

SEQ ID NO: 202958 - DNA, 16 bp, P. troglodytes
agatgcaggaggcaga

SEQ ID NO: 202959 - DNA, 16 bp, P. troglodytes
agatgcaggctgggag

SEQ ID NO: 202960 - DNA, 16 bp, P. troglodytes
agatgcatgcatatgt

SEQ ID NO: 202961 - DNA, 16 bp, P. troglodytes
agatgccaacaccatg

SEQ ID NO: 202962 - DNA, 16 bp, P. troglodytes
agatgccagctggagc

SEQ ID NO: 202963 - DNA, 16 bp, P. troglodytes
agatgcccaatcttga

SEQ ID NO: 202964 - DNA, 16 bp, P. troglodytes
agatgcctgctcccac

SEQ ID NO: 202965 - DNA, 16 bp, P. troglodytes
agatgctcaataaaca

SEQ ID NO: 202966 - DNA, 16 bp, P. troglodytes
agatgctcagcatcat

SEQ ID NO: 202967 - DNA, 16 bp, P. troglodytes
agatgctctctgcacc

SEQ ID NO: 202968 - DNA, 16 bp, P. troglodytes
agatgctgaaaccctg

SEQ ID NO: 202969 - DNA, 17 bp, P. troglodytes
agatgctgcagaggatg

SEQ ID NO: 202970 - DNA, 16 bp, P. troglodytes
agatgctggagaggct

SEQ ID NO: 202971 - DNA, 16 bp, P. troglodytes
agatgctggcagaaga

SEQ ID NO: 202972 - DNA, 16 bp, P. troglodytes
agatgctggtgaagtt

SEQ ID NO: 202973 - DNA, 17 bp, P. troglodytes
agatgctggtgaggttg

SEQ ID NO: 202974 - DNA, 16 bp, P. troglodytes
agatgctgtctccaaa

SEQ ID NO: 202975 - DNA, 16 bp, P. troglodytes
agatgctgtgaatatt

SEQ ID NO: 202976 - DNA, 16 bp, P. troglodytes
agatggaaaaagatat

SEQ ID NO: 202977 - DNA, 16 bp, P. troglodytes
agatggaaaccatcct

SEQ ID NO: 202978 - DNA, 16 bp, P. troglodytes
agatggaatctcaccc

SEQ ID NO: 202979 - DNA, 16 bp, P. troglodytes
agatggaatctcactg

SEQ ID NO: 202980 - DNA, 16 bp, P. troglodytes
agatggacagagagag

SEQ ID NO: 202981 - DNA, 16 bp, P. troglodytes
agatggagaaacaaag

SEQ ID NO: 202982 - DNA, 16 bp, P. troglodytes
agatggagaaagtgag

SEQ ID NO: 202983 - DNA, 16 bp, P. troglodytes
agatggagaatgagtt

SEQ ID NO: 202984 - DNA, 16 bp, P. troglodytes
agatggagaccatctt

SEQ ID NO: 202985 - DNA, 16 bp, P. troglodytes
agatggagaccatgct

SEQ ID NO: 202986 - DNA, 16 bp, P. troglodytes
agatggagagagacag

SEQ ID NO: 202987 - DNA, 16 bp, P. troglodytes
agatggagccaccatt

SEQ ID NO: 202988 - DNA, 16 bp, P. troglodytes
agatggaggcagagat

SEQ ID NO: 202989 - DNA, 16 bp, P. troglodytes
agatggaggtctcact

SEQ ID NO: 202990 - DNA, 16 bp, P. troglodytes
agatggaggtgaggaa

SEQ ID NO: 202991 - DNA, 16 bp, P. troglodytes
agatggaggttgcagc

SEQ ID NO: 202992 - DNA, 17 bp, P. troglodytes
agatggagtctcactct

SEQ ID NO: 202993 - DNA, 18 bp, P. troglodytes
agatggagtctcactctt

SEQ ID NO: 202994 - DNA, 16 bp, P. troglodytes
agatggagtctcatct

SEQ ID NO: 202995 - DNA, 16 bp, P. troglodytes
agatggagtctcattc

SEQ ID NO: 202996 - DNA, 17 bp, P. troglodytes
agatggagtctcgctct

SEQ ID NO: 202997 - DNA, 18 bp, P. troglodytes
agatggagtctcgctctt

SEQ ID NO: 202998 - DNA, 16 bp, P. troglodytes
agatggagttgctttg

SEQ ID NO: 202999 - DNA, 16 bp, P. troglodytes
agatggagtttgcagt

SEQ ID NO: 203000 - DNA, 17 bp, P. troglodytes
agatggagttttgccgt

SEQ ID NO: 203001 - DNA, 16 bp, P. troglodytes
agatggataaactgag

SEQ ID NO: 203002 - DNA, 16 bp, P. troglodytes
agatggataaattgca

SEQ ID NO: 203003 - DNA, 16 bp, P. troglodytes
agatggattcacagat

SEQ ID NO: 203004 - DNA, 16 bp, P. troglodytes
agatggcaacaataaa

SEQ ID NO: 203005 - DNA, 16 bp, P. troglodytes
agatggcagaagaaaa

SEQ ID NO: 203006 - DNA, 16 bp, P. troglodytes
agatggcagaagaaag

SEQ ID NO: 203007 - DNA, 16 bp, P. troglodytes
agatggcatcttcttc

SEQ ID NO: 203008 - DNA, 16 bp, P. troglodytes
agatggccaccttctc

SEQ ID NO: 203009 - DNA, 16 bp, P. troglodytes
agatggccatcttctt

SEQ ID NO: 203010 - DNA, 16 bp, P. troglodytes
agatgggaaaaaaaca

SEQ ID NO: 203011 - DNA, 16 bp, P. troglodytes
agatgggaaaactgaa

SEQ ID NO: 203012 - DNA, 16 bp, P. troglodytes
agatgggaaaactgag

SEQ ID NO: 203013 - DNA, 16 bp, P. troglodytes
agatgggaagattgct

SEQ ID NO: 203014 - DNA, 16 bp, P. troglodytes
agatgggagaattgct

SEQ ID NO: 203015 - DNA, 16 bp, P. troglodytes
agatgggaggatcact

SEQ ID NO: 203016 - DNA, 16 bp, P. troglodytes
agatgggatctcactc

SEQ ID NO: 203017 - DNA, 16 bp, P. troglodytes
agatgggatcttgcca

SEQ ID NO: 203018 - DNA, 16 bp, P. troglodytes
agatgggcaaaagatt

SEQ ID NO: 203019 - DNA, 16 bp, P. troglodytes
agatgggcagatcatg

SEQ ID NO: 203020 - DNA, 16 bp, P. troglodytes
agatgggcaggtgcag

SEQ ID NO: 203021 - DNA, 16 bp, P. troglodytes
agatgggcggatcact

SEQ ID NO: 203022 - DNA, 16 bp, P. troglodytes
agatgggctttcacta

SEQ ID NO: 203023 - DNA, 16 bp, P. troglodytes
agatggggaaaaaaac

SEQ ID NO: 203024 - DNA, 16 bp, P. troglodytes
agatggggaaagtgag

SEQ ID NO: 203025 - DNA, 16 bp, P. troglodytes
agatggggagaaaaca

SEQ ID NO: 203026 - DNA, 16 bp, P. troglodytes
agatggggcctttggg

SEQ ID NO: 203027 - DNA, 17 bp, P. troglodytes
agatggggctttgccat

SEQ ID NO: 203028 - DNA, 16 bp, P. troglodytes
agatgggggtctcact

SEQ ID NO: 203029 - DNA, 16 bp, P. troglodytes
agatggggtctcacca

SEQ ID NO: 203030 - DNA, 18 bp, P. troglodytes
agatggggtttcaccgtg

SEQ ID NO: 203031 - DNA, 18 bp, P. troglodytes
agatggggtttcatcatt

SEQ ID NO: 203032 - DNA, 18 bp, P. troglodytes
agatggggtttctccata

SEQ ID NO: 203033 - DNA, 16 bp, P. troglodytes
agatggtatcccattg

SEQ ID NO: 203034 - DNA, 16 bp, P. troglodytes
agatggtccccaactt

SEQ ID NO: 203035 - DNA, 16 bp, P. troglodytes
agatggtgaaacccag

SEQ ID NO: 203036 - DNA, 16 bp, P. troglodytes
agatggtgacactgca

SEQ ID NO: 203037 - DNA, 16 bp, P. troglodytes
agatggtgtttctcca

SEQ ID NO: 203038 - DNA, 16 bp, P. troglodytes
agatggtttgagccca

SEQ ID NO: 203039 - DNA, 16 bp, P. troglodytes
agatgtacaaaaagga

SEQ ID NO: 203040 - DNA, 16 bp, P. troglodytes
agatgtacaaggagga

SEQ ID NO: 203041 - DNA, 16 bp, P. troglodytes
agatgtagaatatttc

SEQ ID NO: 203042 - DNA, 16 bp, P. troglodytes
agatgtagatgtagat

SEQ ID NO: 203043 - DNA, 16 bp, P. troglodytes
agatgtatgccaccat

SEQ ID NO: 203044 - DNA, 16 bp, P. troglodytes
agatgtatgtgtgtgt

SEQ ID NO: 203045 - DNA, 16 bp, P. troglodytes
agatgtattctggaga

SEQ ID NO: 203046 - DNA, 16 bp, P. troglodytes
agatgtcaaaacatca

SEQ ID NO: 203047 - DNA, 16 bp, P. troglodytes
agatgtcaccactgca

SEQ ID NO: 203048 - DNA, 16 bp, P. troglodytes
agatgtccagttgttc

SEQ ID NO: 203049 - DNA, 16 bp, P. troglodytes
agatgtctattaggtc

SEQ ID NO: 203050 - DNA, 16 bp, P. troglodytes
agatgtgacaaccaaa

SEQ ID NO: 203051 - DNA, 16 bp, P. troglodytes
agatgtgagacatgga

SEQ ID NO: 203052 - DNA, 17 bp, P. troglodytes
agatgtgagccaccgcg

SEQ ID NO: 203053 - DNA, 16 bp, P. troglodytes
agatgtgccttttgcc

SEQ ID NO: 203054 - DNA, 16 bp, P. troglodytes
agatgtggaaactgaa

SEQ ID NO: 203055 - DNA, 16 bp, P. troglodytes
agatgtggaaactgag

SEQ ID NO: 203056 - DNA, 16 bp, P. troglodytes
agatgtggaaattgag

SEQ ID NO: 203057 - DNA, 16 bp, P. troglodytes
agatgtggtcttgcta

SEQ ID NO: 203058 - DNA, 16 bp, P. troglodytes
agatgtggtgtttggt

SEQ ID NO: 203059 - DNA, 16 bp, P. troglodytes
agatgtgtgccactat

SEQ ID NO: 203060 - DNA, 16 bp, P. troglodytes
agatgtgtgggttttt

SEQ ID NO: 203061 - DNA, 16 bp, P. troglodytes
agatgtgtttcctgaa

SEQ ID NO: 203062 - DNA, 16 bp, P. troglodytes
agatgttccacatcat

SEQ ID NO: 203063 - DNA, 16 bp, P. troglodytes
agatgttctttggtgt

SEQ ID NO: 203064 - DNA, 16 bp, P. troglodytes
agatgttgatgtggat

SEQ ID NO: 203065 - DNA, 16 bp, P. troglodytes
agatgttggaattagc

SEQ ID NO: 203066 - DNA, 16 bp, P. troglodytes
agatgttggcaagaat

SEQ ID NO: 203067 - DNA, 16 bp, P. troglodytes
agatgttggcaaggtt

SEQ ID NO: 203068 - DNA, 16 bp, P. troglodytes
agatgttgtttgaaac

SEQ ID NO: 203069 - DNA, 16 bp, P. troglodytes
agatgtttaacatcat

SEQ ID NO: 203070 - DNA, 16 bp, P. troglodytes
agatgtttgatattat

SEQ ID NO: 203071 - DNA, 16 bp, P. troglodytes
agatgtttgtagatgt

SEQ ID NO: 203072 - DNA, 16 bp, P. troglodytes
agattaaaaccacaat

SEQ ID NO: 203073 - DNA, 16 bp, P. troglodytes
agattaaatcaggaag

SEQ ID NO: 203074 - DNA, 16 bp, P. troglodytes
agattaaatgaggtca

SEQ ID NO: 203075 - DNA, 16 bp, P. troglodytes
agattaacaacaacaa

SEQ ID NO: 203076 - DNA, 16 bp, P. troglodytes
agattaacagaagaaa

SEQ ID NO: 203077 - DNA, 16 bp, P. troglodytes
agattaacatttaagt

SEQ ID NO: 203078 - DNA, 16 bp, P. troglodytes
agattaactttttaaa

SEQ ID NO: 203079 - DNA, 16 bp, P. troglodytes
agattaagaaaatgtg

SEQ ID NO: 203080 - DNA, 16 bp, P. troglodytes
agattaattttgggag

SEQ ID NO: 203081 - DNA, 16 bp, P. troglodytes
agattaatttttacaa

SEQ ID NO: 203082 - DNA, 17 bp, P. troglodytes
agattacagcctctgcc

SEQ ID NO: 203083 - DNA, 16 bp, P. troglodytes
agattacaggcacatg

SEQ ID NO: 203084 - DNA, 16 bp, P. troglodytes
agattacaggcatgag

SEQ ID NO: 203085 - DNA, 16 bp, P. troglodytes
agattacatttttaaa

SEQ ID NO: 203086 - DNA, 16 bp, P. troglodytes
agattacttttaaaaa

SEQ ID NO: 203087 - DNA, 16 bp, P. troglodytes
agattagaaattatgg

SEQ ID NO: 203088 - DNA, 16 bp, P. troglodytes
agattagaacagaaat

SEQ ID NO: 203089 - DNA, 16 bp, P. troglodytes
agattaggaaattgag

SEQ ID NO: 203090 - DNA, 16 bp, P. troglodytes
agattagggatactca

SEQ ID NO: 203091 - DNA, 16 bp, P. troglodytes
agattaggttataaaa

SEQ ID NO: 203092 - DNA, 16 bp, P. troglodytes
agattatctgaaactg

SEQ ID NO: 203093 - DNA, 16 bp, P. troglodytes
agattattttaaagca

SEQ ID NO: 203094 - DNA, 16 bp, P. troglodytes
agattattttatcact

SEQ ID NO: 203095 - DNA, 16 bp, P. troglodytes
agattcaaacccaggc

SEQ ID NO: 203096 - DNA, 16 bp, P. troglodytes
agattcaaactcagat

SEQ ID NO: 203097 - DNA, 16 bp, P. troglodytes
agattcaaattcttcc

SEQ ID NO: 203098 - DNA, 16 bp, P. troglodytes
agattcaacaaatatt

SEQ ID NO: 203099 - DNA, 16 bp, P. troglodytes
agattcaatgcaatct

SEQ ID NO: 203100 - DNA, 16 bp, P. troglodytes
agattcaatgccatgc

SEQ ID NO: 203101 - DNA, 16 bp, P. troglodytes
agattcacagagactc

SEQ ID NO: 203102 - DNA, 16 bp, P. troglodytes
agattcactcatgttg

SEQ ID NO: 203103 - DNA, 16 bp, P. troglodytes
agattcactgacagct

SEQ ID NO: 203104 - DNA, 16 bp, P. troglodytes
agattcagatgaggaa

SEQ ID NO: 203105 - DNA, 20 bp, P. troglodytes
agattcagtgccatccccat

SEQ ID NO: 203106 - DNA, 16 bp, P. troglodytes
agattcagtgtctggt

SEQ ID NO: 203107 - DNA, 17 bp, P. troglodytes
agattcataaagcaagt

SEQ ID NO: 203108 - DNA, 16 bp, P. troglodytes
agattcatccacgttg

SEQ ID NO: 203109 - DNA, 16 bp, P. troglodytes
agattcatccatattg

SEQ ID NO: 203110 - DNA, 16 bp, P. troglodytes
agattccacatacaag

SEQ ID NO: 203111 - DNA, 16 bp, P. troglodytes
agattccgccactgca

SEQ ID NO: 203112 - DNA, 16 bp, P. troglodytes
agattcctagaagtga

SEQ ID NO: 203113 - DNA, 16 bp, P. troglodytes
agattcctgggccctg

SEQ ID NO: 203114 - DNA, 16 bp, P. troglodytes
agattcctttttcttt

SEQ ID NO: 203115 - DNA, 16 bp, P. troglodytes
agattctacatttcta

SEQ ID NO: 203116 - DNA, 16 bp, P. troglodytes
agattctcaaaggagc

SEQ ID NO: 203117 - DNA, 16 bp, P. troglodytes
agattctcataggagc

SEQ ID NO: 203118 - DNA, 16 bp, P. troglodytes
agattctcccctagag

SEQ ID NO: 203119 - DNA, 16 bp, P. troglodytes
agattctgactcagta

SEQ ID NO: 203120 - DNA, 16 bp, P. troglodytes
agattctggaatgttg

SEQ ID NO: 203121 - DNA, 16 bp, P. troglodytes
agattctggagtcaga

SEQ ID NO: 203122 - DNA, 16 bp, P. troglodytes
agattctggatattgg

SEQ ID NO: 203123 - DNA, 16 bp, P. troglodytes
agattctggtatattg

SEQ ID NO: 203124 - DNA, 17 bp, P. troglodytes
agattctgtctcaaaaa

SEQ ID NO: 203125 - DNA, 16 bp, P. troglodytes
agattcttttgctcac

SEQ ID NO: 203126 - DNA, 16 bp, P. troglodytes
agattgaaggatgcaa

SEQ ID NO: 203127 - DNA, 16 bp, P. troglodytes
agattgaatcccaggt

SEQ ID NO: 203128 - DNA, 16 bp, P. troglodytes
agattgacaaatggga

SEQ ID NO: 203129 - DNA, 16 bp, P. troglodytes
agattgagcatcattt

SEQ ID NO: 203130 - DNA, 16 bp, P. troglodytes
agattgaggaagttct

SEQ ID NO: 203131 - DNA, 19 bp, P. troglodytes
agattgcaccactgcactt

SEQ ID NO: 203132 - DNA, 16 bp, P. troglodytes
agattgcctctctaga

SEQ ID NO: 203133 - DNA, 16 bp, P. troglodytes
agattgcttcagctca

SEQ ID NO: 203134 - DNA, 16 bp, P. troglodytes
agattgcttgagtcca

SEQ ID NO: 203135 - DNA, 16 bp, P. troglodytes
agattggaaaaatttt

SEQ ID NO: 203136 - DNA, 16 bp, P. troglodytes
agattgggcaatttat

SEQ ID NO: 203137 - DNA, 16 bp, P. troglodytes
agattgtgacactgca

SEQ ID NO: 203138 - DNA, 16 bp, P. troglodytes
agattgtggagaaaaa

SEQ ID NO: 203139 - DNA, 16 bp, P. troglodytes
agatttaaccattcca

SEQ ID NO: 203140 - DNA, 16 bp, P. troglodytes
agatttaactcaaaga

SEQ ID NO: 203141 - DNA, 16 bp, P. troglodytes
agatttaatgctatcc

SEQ ID NO: 203142 - DNA, 16 bp, P. troglodytes
agatttacaagaaaaa

SEQ ID NO: 203143 - DNA, 16 bp, P. troglodytes
agatttacagaaaagt

SEQ ID NO: 203144 - DNA, 16 bp, P. troglodytes
agatttacatgcaagg

SEQ ID NO: 203145 - DNA, 16 bp, P. troglodytes
agatttagcataattt

SEQ ID NO: 203146 - DNA, 16 bp, P. troglodytes
agatttatctatgttg

SEQ ID NO: 203147 - DNA, 16 bp, P. troglodytes
agatttatgtttctct

SEQ ID NO: 203148 - DNA, 16 bp, P. troglodytes
agatttattacaaaga

SEQ ID NO: 203149 - DNA, 16 bp, P. troglodytes
agatttattcatgttg

SEQ ID NO: 203150 - DNA, 16 bp, P. troglodytes
agatttattctttttg

SEQ ID NO: 203151 - DNA, 16 bp, P. troglodytes
agatttattgaaaatg

SEQ ID NO: 203152 - DNA, 16 bp, P. troglodytes
agatttatttgagaaa

SEQ ID NO: 203153 - DNA, 16 bp, P. troglodytes
agatttcagacttgca

SEQ ID NO: 203154 - DNA, 16 bp, P. troglodytes
agatttcagagaatgt

SEQ ID NO: 203155 - DNA, 16 bp, P. troglodytes
agatttcagatttcag

SEQ ID NO: 203156 - DNA, 16 bp, P. troglodytes
agatttcatgacaaaa

SEQ ID NO: 203157 - DNA, 16 bp, P. troglodytes
agatttcattattttt

SEQ ID NO: 203158 - DNA, 16 bp, P. troglodytes
agatttctaaggtttt

SEQ ID NO: 203159 - DNA, 16 bp, P. troglodytes
agatttctagtttatt

SEQ ID NO: 203160 - DNA, 16 bp, P. troglodytes
agatttctataatttt

SEQ ID NO: 203161 - DNA, 16 bp, P. troglodytes
agatttctattttaaa

SEQ ID NO: 203162 - DNA, 16 bp, P. troglodytes
agatttctcattagaa

SEQ ID NO: 203163 - DNA, 16 bp, P. troglodytes
agatttctgtagatgt

SEQ ID NO: 203164 - DNA, 16 bp, P. troglodytes
agatttctgtgaccaa

SEQ ID NO: 203165 - DNA, 16 bp, P. troglodytes
agatttctttttaaaa

SEQ ID NO: 203166 - DNA, 16 bp, P. troglodytes
agatttgaaagcaacc

SEQ ID NO: 203167 - DNA, 16 bp, P. troglodytes
agatttgagaaatttt

SEQ ID NO: 203168 - DNA, 16 bp, P. troglodytes
agatttgcctattttg

SEQ ID NO: 203169 - DNA, 16 bp, P. troglodytes
agatttgccttttcta

SEQ ID NO: 203170 - DNA, 16 bp, P. troglodytes
agatttgctcttgttg

SEQ ID NO: 203171 - DNA, 16 bp, P. troglodytes
agatttggaaaattct

SEQ ID NO: 203172 - DNA, 16 bp, P. troglodytes
agatttggaaagttct

SEQ ID NO: 203173 - DNA, 16 bp, P. troglodytes
agatttggaaggcaga

SEQ ID NO: 203174 - DNA, 16 bp, P. troglodytes
agatttggaggaaaca

SEQ ID NO: 203175 - DNA, 16 bp, P. troglodytes
agatttggaggggaca

SEQ ID NO: 203176 - DNA, 16 bp, P. troglodytes
agatttggcctgcagg

SEQ ID NO: 203177 - DNA, 16 bp, P. troglodytes
agatttgggcaaggac

SEQ ID NO: 203178 - DNA, 16 bp, P. troglodytes
agatttggtttgccag

SEQ ID NO: 203179 - DNA, 16 bp, P. troglodytes
agatttgtccatgttg

SEQ ID NO: 203180 - DNA, 16 bp, P. troglodytes
agatttgttgattttg

SEQ ID NO: 203181 - DNA, 16 bp, P. troglodytes
agattttaaaaatgca

SEQ ID NO: 203182 - DNA, 16 bp, P. troglodytes
agattttaaaagtata

SEQ ID NO: 203183 - DNA, 16 bp, P. troglodytes
agattttaaagcaaca

SEQ ID NO: 203184 - DNA, 16 bp, P. troglodytes
agattttaagacaaaa

SEQ ID NO: 203185 - DNA, 16 bp, P. troglodytes
agattttagctgctct

SEQ ID NO: 203186 - DNA, 16 bp, P. troglodytes
agattttatatttctt

SEQ ID NO: 203187 - DNA, 16 bp, P. troglodytes
agattttattctaagt

SEQ ID NO: 203188 - DNA, 16 bp, P. troglodytes
agattttcaatttttt

SEQ ID NO: 203189 - DNA, 16 bp, P. troglodytes
agattttcatgctaaa

SEQ ID NO: 203190 - DNA, 16 bp, P. troglodytes
agattttcatttaatt

SEQ ID NO: 203191 - DNA, 16 bp, P. troglodytes
agattttcttctcttt

SEQ ID NO: 203192 - DNA, 16 bp, P. troglodytes
agattttcttgtttat

SEQ ID NO: 203193 - DNA, 16 bp, P. troglodytes
agattttctttaaaaa

SEQ ID NO: 203194 - DNA, 16 bp, P. troglodytes
agattttgcagatgtg

SEQ ID NO: 203195 - DNA, 16 bp, P. troglodytes
agattttgcatttcta

SEQ ID NO: 203196 - DNA, 16 bp, P. troglodytes
agattttgcatttttt

SEQ ID NO: 203197 - DNA, 16 bp, P. troglodytes
agattttggacttgct

SEQ ID NO: 203198 - DNA, 16 bp, P. troglodytes
agattttgttcatttt

SEQ ID NO: 203199 - DNA, 16 bp, P. troglodytes
agattttgtttaaaaa

SEQ ID NO: 203200 - DNA, 16 bp, P. troglodytes
agatttttaaaaaatg

SEQ ID NO: 203201 - DNA, 16 bp, P. troglodytes
agatttttaaaaatca

SEQ ID NO: 203202 - DNA, 16 bp, P. troglodytes
agatttttaaaatttg

SEQ ID NO: 203203 - DNA, 16 bp, P. troglodytes
agatttttagaaaaat

SEQ ID NO: 203204 - DNA, 16 bp, P. troglodytes
agatttttcaaagaat

SEQ ID NO: 203205 - DNA, 16 bp, P. troglodytes
agatttttcagttttt

SEQ ID NO: 203206 - DNA, 16 bp, P. troglodytes
agatttttctttcatt

SEQ ID NO: 203207 - DNA, 16 bp, P. troglodytes
agatttttgaggaatc

SEQ ID NO: 203208 - DNA, 16 bp, P. troglodytes
agatttttgttttcat

SEQ ID NO: 203209 - DNA, 16 bp, P. troglodytes
agattttttaaaaaga

SEQ ID NO: 203210 - DNA, 16 bp, P. troglodytes
agattttttaaaaatc

SEQ ID NO: 203211 - DNA, 16 bp, P. troglodytes
agattttttaaaagat

SEQ ID NO: 203212 - DNA, 16 bp, P. troglodytes
agattttttaatgtaa

SEQ ID NO: 203213 - DNA, 16 bp, P. troglodytes
agattttttccatttt

SEQ ID NO: 203214 - DNA, 16 bp, P. troglodytes
agatttttttaaagca

SEQ ID NO: 203215 - DNA, 16 bp, P. troglodytes
agatttttttcattat

SEQ ID NO: 203216 - DNA, 16 bp, P. troglodytes
agatttttttcccctc

SEQ ID NO: 203217 - DNA, 16 bp, P. troglodytes
agatttttttcccttc

SEQ ID NO: 203218 - DNA, 16 bp, P. troglodytes
agatttttttctatag

SEQ ID NO: 203219 - DNA, 16 bp, P. troglodytes
agatttttttgaaaaa

SEQ ID NO: 203220 - DNA, 16 bp, P. troglodytes
agatttttttttcaaa

SEQ ID NO: 203221 - DNA, 16 bp, P. troglodytes
agatttttttttctaa

SEQ ID NO: 203222 - DNA, 16 bp, P. troglodytes
agcaaaaaagtttgga

SEQ ID NO: 203223 - DNA, 16 bp, P. troglodytes
agcaaaaaattagcca

SEQ ID NO: 203224 - DNA, 16 bp, P. troglodytes
agcaaaaaattggaaa

SEQ ID NO: 203225 - DNA, 16 bp, P. troglodytes
agcaaaaagaaaatct

SEQ ID NO: 203226 - DNA, 16 bp, P. troglodytes
agcaaaaatgtatttt

SEQ ID NO: 203227 - DNA, 16 bp, P. troglodytes
agcaaaaattttgcta

SEQ ID NO: 203228 - DNA, 16 bp, P. troglodytes
agcaaaaatttttaaa

SEQ ID NO: 203229 - DNA, 16 bp, P. troglodytes
agcaaaacaaattcaa

SEQ ID NO: 203230 - DNA, 16 bp, P. troglodytes
agcaaaaccctgtctc

SEQ ID NO: 203231 - DNA, 16 bp, P. troglodytes
agcaaaactattcttc

SEQ ID NO: 203232 - DNA, 16 bp, P. troglodytes
agcaaaactccgcctc

SEQ ID NO: 203233 - DNA, 16 bp, P. troglodytes
agcaaaactcgggcaa

SEQ ID NO: 203234 - DNA, 16 bp, P. troglodytes
agcaaaagaaacaatc

SEQ ID NO: 203235 - DNA, 16 bp, P. troglodytes
agcaaaagaaactact

SEQ ID NO: 203236 - DNA, 16 bp, P. troglodytes
agcaaaagaaattatc

SEQ ID NO: 203237 - DNA, 16 bp, P. troglodytes
agcaaaagattagaaa

SEQ ID NO: 203238 - DNA, 16 bp, P. troglodytes
agcaaaagctgacaga

SEQ ID NO: 203239 - DNA, 16 bp, P. troglodytes
agcaaaagtaaatgaa

SEQ ID NO: 203240 - DNA, 16 bp, P. troglodytes
agcaaaatatatattt

SEQ ID NO: 203241 - DNA, 16 bp, P. troglodytes
agcaaaatcccatctc

SEQ ID NO: 203242 - DNA, 16 bp, P. troglodytes
agcaaaatgaaaatta

SEQ ID NO: 203243 - DNA, 16 bp, P. troglodytes
agcaaaatgaccagct

SEQ ID NO: 203244 - DNA, 16 bp, P. troglodytes
agcaaaatttatttta

SEQ ID NO: 203245 - DNA, 16 bp, P. troglodytes
agcaaaatttttaaaa

SEQ ID NO: 203246 - DNA, 16 bp, P. troglodytes
agcaaaattttttaaa

SEQ ID NO: 203247 - DNA, 16 bp, P. troglodytes
agcaaacaaatgcaaa

SEQ ID NO: 203248 - DNA, 16 bp, P. troglodytes
agcaaacaaattccaa

SEQ ID NO: 203249 - DNA, 16 bp, P. troglodytes
agcaaacaccagaagc

SEQ ID NO: 203250 - DNA, 16 bp, P. troglodytes
agcaaacatttactga

SEQ ID NO: 203251 - DNA, 16 bp, P. troglodytes
agcaaacatttcctga

SEQ ID NO: 203252 - DNA, 16 bp, P. troglodytes
agcaaaccaactccaa

SEQ ID NO: 203253 - DNA, 22 bp, P. troglodytes
agcaaaccaccatggcacgtgt

SEQ ID NO: 203254 - DNA, 17 bp, P. troglodytes
agcaaactaacacaaga

SEQ ID NO: 203255 - DNA, 16 bp, P. troglodytes
agcaaactatcacaag

SEQ ID NO: 203256 - DNA, 16 bp, P. troglodytes
agcaaactatcacgag

SEQ ID NO: 203257 - DNA, 16 bp, P. troglodytes
agcaaactccagcaga

SEQ ID NO: 203258 - DNA, 16 bp, P. troglodytes
agcaaactttttttta

SEQ ID NO: 203259 - DNA, 16 bp, P. troglodytes
agcaaagaaaatggaa

SEQ ID NO: 203260 - DNA, 16 bp, P. troglodytes
agcaaagaattcaaga

SEQ ID NO: 203261 - DNA, 17 bp, P. troglodytes
agcaaagactgctgcct

SEQ ID NO: 203262 - DNA, 16 bp, P. troglodytes
agcaaagatatggaaa

SEQ ID NO: 203263 - DNA, 16 bp, P. troglodytes
agcaaagatcacctgg

SEQ ID NO: 203264 - DNA, 16 bp, P. troglodytes
agcaaagcaaaaatgg

SEQ ID NO: 203265 - DNA, 16 bp, P. troglodytes
agcaaagctgaaagag

SEQ ID NO: 203266 - DNA, 16 bp, P. troglodytes
agcaaaggaaaaaagt

SEQ ID NO: 203267 - DNA, 16 bp, P. troglodytes
agcaaaggaaaagaat

SEQ ID NO: 203268 - DNA, 16 bp, P. troglodytes
agcaaaggaagaaaat

SEQ ID NO: 203269 - DNA, 16 bp, P. troglodytes
agcaaaggaggaagtg

SEQ ID NO: 203270 - DNA, 16 bp, P. troglodytes
agcaaaggctgagaga

SEQ ID NO: 203271 - DNA, 16 bp, P. troglodytes
agcaaagggaagccat

SEQ ID NO: 203272 - DNA, 16 bp, P. troglodytes
agcaaaggtgactctt

SEQ ID NO: 203273 - DNA, 16 bp, P. troglodytes
agcaaagtcattatat

SEQ ID NO: 203274 - DNA, 16 bp, P. troglodytes
agcaaagttgtggcca

SEQ ID NO: 203275 - DNA, 16 bp, P. troglodytes
agcaaagtttttgtat

SEQ ID NO: 203276 - DNA, 16 bp, P. troglodytes
agcaaataaatgactt

SEQ ID NO: 203277 - DNA, 16 bp, P. troglodytes
agcaaatatcatactg

SEQ ID NO: 203278 - DNA, 16 bp, P. troglodytes
agcaaatatggcaaaa

SEQ ID NO: 203279 - DNA, 16 bp, P. troglodytes
agcaaatccagcagca

SEQ ID NO: 203280 - DNA, 16 bp, P. troglodytes
agcaaatcctcttccc

SEQ ID NO: 203281 - DNA, 16 bp, P. troglodytes
agcaaatgaagaaaca

SEQ ID NO: 203282 - DNA, 16 bp, P. troglodytes
agcaaatgcaacaaca

SEQ ID NO: 203283 - DNA, 16 bp, P. troglodytes
agcaaatgcagtaaaa

SEQ ID NO: 203284 - DNA, 16 bp, P. troglodytes
agcaaatgctgaagga

SEQ ID NO: 203285 - DNA, 16 bp, P. troglodytes
agcaaatgctgaggaa

SEQ ID NO: 203286 - DNA, 16 bp, P. troglodytes
agcaaatggaaaacca

SEQ ID NO: 203287 - DNA, 16 bp, P. troglodytes
agcaaatggaaagaaa

SEQ ID NO: 203288 - DNA, 16 bp, P. troglodytes
agcaaatggaaagcca

SEQ ID NO: 203289 - DNA, 22 bp, P. troglodytes
agcaaatgtaaaagaacagaaa

SEQ ID NO: 203290 - DNA, 16 bp, P. troglodytes
agcaaatgtaaagcaa

SEQ ID NO: 203291 - DNA, 16 bp, P. troglodytes
agcaaatgtagaagaa

SEQ ID NO: 203292 - DNA, 16 bp, P. troglodytes
agcaaatgtggtaaaa

SEQ ID NO: 203293 - DNA, 16 bp, P. troglodytes
agcaaattgaattcaa

SEQ ID NO: 203294 - DNA, 16 bp, P. troglodytes
agcaacaacagcagca

SEQ ID NO: 203295 - DNA, 16 bp, P. troglodytes
agcaacaagaactctc

SEQ ID NO: 203296 - DNA, 16 bp, P. troglodytes
agcaacaccccacttc

SEQ ID NO: 203297 - DNA, 16 bp, P. troglodytes
agcaacagaaaatgaa

SEQ ID NO: 203298 - DNA, 17 bp, P. troglodytes
agcaacagagcgagacc

SEQ ID NO: 203299 - DNA, 17 bp, P. troglodytes
agcaacagcagcagcaa

SEQ ID NO: 203300 - DNA, 16 bp, P. troglodytes
agcaacaggaactccc

SEQ ID NO: 203301 - DNA, 16 bp, P. troglodytes
agcaacaggaactctc

SEQ ID NO: 203302 - DNA, 16 bp, P. troglodytes
agcaacataaatttat

SEQ ID NO: 203303 - DNA, 16 bp, P. troglodytes
agcaacatcagcaaag

SEQ ID NO: 203304 - DNA, 16 bp, P. troglodytes
agcaacatcagcatca

SEQ ID NO: 203305 - DNA, 16 bp, P. troglodytes
agcaacatggcaagac

SEQ ID NO: 203306 - DNA, 19 bp, P. troglodytes
agcaacatggtgaaacccc

SEQ ID NO: 203307 - DNA, 16 bp, P. troglodytes
agcaaccatgcctggc

SEQ ID NO: 203308 - DNA, 16 bp, P. troglodytes
agcaactcagaaggct

SEQ ID NO: 203309 - DNA, 16 bp, P. troglodytes
agcaactccaagacat

SEQ ID NO: 203310 - DNA, 16 bp, P. troglodytes
agcaactccagcaaag

SEQ ID NO: 203311 - DNA, 16 bp, P. troglodytes
agcaactgcactccag

SEQ ID NO: 203312 - DNA, 16 bp, P. troglodytes
agcaactggaactctc

SEQ ID NO: 203313 - DNA, 16 bp, P. troglodytes
agcaacttatccttca

SEQ ID NO: 203314 - DNA, 16 bp, P. troglodytes
agcaacttcagccaag

SEQ ID NO: 203315 - DNA, 16 bp, P. troglodytes
agcaacttccagtcct

SEQ ID NO: 203316 - DNA, 16 bp, P. troglodytes
agcaagaactctgtct

SEQ ID NO: 203317 - DNA, 16 bp, P. troglodytes
agcaagaaggaattct

SEQ ID NO: 203318 - DNA, 16 bp, P. troglodytes
agcaagaaggtcctca

SEQ ID NO: 203319 - DNA, 16 bp, P. troglodytes
agcaagaagtgccaag

SEQ ID NO: 203320 - DNA, 16 bp, P. troglodytes
agcaagacaccatctc

SEQ ID NO: 203321 - DNA, 16 bp, P. troglodytes
agcaagaccaaccctt

SEQ ID NO: 203322 - DNA, 16 bp, P. troglodytes
agcaagacccagtctc

SEQ ID NO: 203323 - DNA, 16 bp, P. troglodytes
agcaagacccatctct

SEQ ID NO: 203324 - DNA, 16 bp, P. troglodytes
agcaagaccccacctc

SEQ ID NO: 203325 - DNA, 16 bp, P. troglodytes
agcaagaccccatctc

SEQ ID NO: 203326 - DNA, 16 bp, P. troglodytes
agcaagaccccctctc

SEQ ID NO: 203327 - DNA, 16 bp, P. troglodytes
agcaagaccctatatc

SEQ ID NO: 203328 - DNA, 16 bp, P. troglodytes
agcaagaccctatctc

SEQ ID NO: 203329 - DNA, 16 bp, P. troglodytes
agcaagaccctgcctc

SEQ ID NO: 203330 - DNA, 16 bp, P. troglodytes
agcaagaccctgcttc

SEQ ID NO: 203331 - DNA, 16 bp, P. troglodytes
agcaagaccctgtctc

SEQ ID NO: 203332 - DNA, 16 bp, P. troglodytes
agcaagaccctttctc

SEQ ID NO: 203333 - DNA, 16 bp, P. troglodytes
agcaagaccgcatctc

SEQ ID NO: 203334 - DNA, 16 bp, P. troglodytes
agcaagacctcatctg

SEQ ID NO: 203335 - DNA, 16 bp, P. troglodytes
agcaagacctcatttc

SEQ ID NO: 203336 - DNA, 16 bp, P. troglodytes
agcaagacctcgtctc

SEQ ID NO: 203337 - DNA, 16 bp, P. troglodytes
agcaagactcagtctc

SEQ ID NO: 203338 - DNA, 17 bp, P. troglodytes
agcaagactccatctcc

SEQ ID NO: 203339 - DNA, 16 bp, P. troglodytes
agcaagactctgcttc

SEQ ID NO: 203340 - DNA, 16 bp, P. troglodytes
agcaagactctgtcca

SEQ ID NO: 203341 - DNA, 16 bp, P. troglodytes
agcaagacttcatctc

SEQ ID NO: 203342 - DNA, 16 bp, P. troglodytes
agcaagagaactggaa

SEQ ID NO: 203343 - DNA, 16 bp, P. troglodytes
agcaagagaagtagaa

SEQ ID NO: 203344 - DNA, 16 bp, P. troglodytes
agcaagagagagaggc

SEQ ID NO: 203345 - DNA, 16 bp, P. troglodytes
agcaagagagagtgag

SEQ ID NO: 203346 - DNA, 16 bp, P. troglodytes
agcaagagcaaacacg

SEQ ID NO: 203347 - DNA, 16 bp, P. troglodytes
agcaagatcccgtctc

SEQ ID NO: 203348 - DNA, 16 bp, P. troglodytes
agcaagatcctgtctc

SEQ ID NO: 203349 - DNA, 16 bp, P. troglodytes
agcaagatctcatctc

SEQ ID NO: 203350 - DNA, 16 bp, P. troglodytes
agcaagatcttgtctc

SEQ ID NO: 203351 - DNA, 16 bp, P. troglodytes
agcaagatgaagagga

SEQ ID NO: 203352 - DNA, 16 bp, P. troglodytes
agcaagatggagttgg

SEQ ID NO: 203353 - DNA, 16 bp, P. troglodytes
agcaagattccatctc

SEQ ID NO: 203354 - DNA, 16 bp, P. troglodytes
agcaagattctgtttc

SEQ ID NO: 203355 - DNA, 16 bp, P. troglodytes
agcaagattgtgccac

SEQ ID NO: 203356 - DNA, 18 bp, P. troglodytes
agcaagatttattgtgaa

SEQ ID NO: 203357 - DNA, 16 bp, P. troglodytes
agcaagatttcatctc

SEQ ID NO: 203358 - DNA, 16 bp, P. troglodytes
agcaagcacatcttca

SEQ ID NO: 203359 - DNA, 16 bp, P. troglodytes
agcaagccaagatcat

SEQ ID NO: 203360 - DNA, 16 bp, P. troglodytes
agcaagccgagatcac

SEQ ID NO: 203361 - DNA, 16 bp, P. troglodytes
agcaagctcccaggtg

SEQ ID NO: 203362 - DNA, 16 bp, P. troglodytes
agcaagctgcactttt

SEQ ID NO: 203363 - DNA, 16 bp, P. troglodytes
agcaaggaagccagtg

SEQ ID NO: 203364 - DNA, 17 bp, P. troglodytes
agcaaggaatattaata

SEQ ID NO: 203365 - DNA, 16 bp, P. troglodytes
agcaaggagaagaatg

SEQ ID NO: 203366 - DNA, 20 bp, P. troglodytes
agcaaggagccagcaagtct

SEQ ID NO: 203367 - DNA, 16 bp, P. troglodytes
agcaaggagcctaatg

SEQ ID NO: 203368 - DNA, 16 bp, P. troglodytes
agcaaggaggcaggag

SEQ ID NO: 203369 - DNA, 16 bp, P. troglodytes
agcaaggcagagaaga

SEQ ID NO: 203370 - DNA, 16 bp, P. troglodytes
agcaaggccctgtctc

SEQ ID NO: 203371 - DNA, 16 bp, P. troglodytes
agcaaggctggggaag

SEQ ID NO: 203372 - DNA, 16 bp, P. troglodytes
agcaagggctgccagc

SEQ ID NO: 203373 - DNA, 16 bp, P. troglodytes
agcaagtatttactga

SEQ ID NO: 203374 - DNA, 16 bp, P. troglodytes
agcaagtcacaaggcc

SEQ ID NO: 203375 - DNA, 16 bp, P. troglodytes
agcaagtctacctggc

SEQ ID NO: 203376 - DNA, 16 bp, P. troglodytes
agcaagtcttaacaaa

SEQ ID NO: 203377 - DNA, 16 bp, P. troglodytes
agcaagttgttcaatt

SEQ ID NO: 203378 - DNA, 16 bp, P. troglodytes
agcaataaaacatttt

SEQ ID NO: 203379 - DNA, 16 bp, P. troglodytes
agcaataaaatatttt

SEQ ID NO: 203380 - DNA, 16 bp, P. troglodytes
agcaataaagctgttt

SEQ ID NO: 203381 - DNA, 16 bp, P. troglodytes
agcaataacatcaaca

SEQ ID NO: 203382 - DNA, 16 bp, P. troglodytes
agcaataatttttttt

SEQ ID NO: 203383 - DNA, 16 bp, P. troglodytes
agcaatactccgtctc

SEQ ID NO: 203384 - DNA, 16 bp, P. troglodytes
agcaatagcaacaaaa

SEQ ID NO: 203385 - DNA, 16 bp, P. troglodytes
agcaatagggaaagga

SEQ ID NO: 203386 - DNA, 16 bp, P. troglodytes
agcaatattcactgtt

SEQ ID NO: 203387 - DNA, 16 bp, P. troglodytes
agcaatatttattttt

SEQ ID NO: 203388 - DNA, 16 bp, P. troglodytes
agcaatcagacaacag

SEQ ID NO: 203389 - DNA, 16 bp, P. troglodytes
agcaatcagagaaaaa

SEQ ID NO: 203390 - DNA, 16 bp, P. troglodytes
agcaatcctgccacct

SEQ ID NO: 203391 - DNA, 16 bp, P. troglodytes
agcaatccttctgctt

SEQ ID NO: 203392 - DNA, 16 bp, P. troglodytes
agcaatgaaagaaaag

SEQ ID NO: 203393 - DNA, 16 bp, P. troglodytes
agcaatgaagaaaata

SEQ ID NO: 203394 - DNA, 16 bp, P. troglodytes
agcaatgcagaagaca

SEQ ID NO: 203395 - DNA, 17 bp, P. troglodytes
agcaatgcagaagatgg

SEQ ID NO: 203396 - DNA, 16 bp, P. troglodytes
agcaatgccttcaaaa

SEQ ID NO: 203397 - DNA, 16 bp, P. troglodytes
agcaatggaaaagaaa

SEQ ID NO: 203398 - DNA, 16 bp, P. troglodytes
agcaatggcaacaaag

SEQ ID NO: 203399 - DNA, 16 bp, P. troglodytes
agcaatgtatgaaagt

SEQ ID NO: 203400 - DNA, 16 bp, P. troglodytes
agcaatgttgaatttt

SEQ ID NO: 203401 - DNA, 16 bp, P. troglodytes
agcaattagacaagaa

SEQ ID NO: 203402 - DNA, 16 bp, P. troglodytes
agcaattatttattga

SEQ ID NO: 203403 - DNA, 16 bp, P. troglodytes
agcaattcaagtcaag

SEQ ID NO: 203404 - DNA, 16 bp, P. troglodytes
agcaattcacctgcct

SEQ ID NO: 203405 - DNA, 16 bp, P. troglodytes
agcaattcccttgcct

SEQ ID NO: 203406 - DNA, 16 bp, P. troglodytes
agcaattctcccattt

SEQ ID NO: 203407 - DNA, 17 bp, P. troglodytes
agcaattctcctgccta

SEQ ID NO: 203408 - DNA, 16 bp, P. troglodytes
agcaattcttcctgcc

SEQ ID NO: 203409 - DNA, 36 bp, P. troglodytes
agcaattgtgaatgggagttcactcatgatttggct

SEQ ID NO: 203410 - DNA, 16 bp, P. troglodytes
agcaatttcagcaaag

SEQ ID NO: 203411 - DNA, 16 bp, P. troglodytes
agcaattttcatgcct

SEQ ID NO: 203412 - DNA, 16 bp, P. troglodytes
agcacaacaaaaagct

SEQ ID NO: 203413 - DNA, 16 bp, P. troglodytes
agcacaacaacatggc

SEQ ID NO: 203414 - DNA, 16 bp, P. troglodytes
agcacaagaaaagatg

SEQ ID NO: 203415 - DNA, 16 bp, P. troglodytes
agcacaagcaataaaa

SEQ ID NO: 203416 - DNA, 16 bp, P. troglodytes
agcacaagccaccatg

SEQ ID NO: 203417 - DNA, 16 bp, P. troglodytes
agcacaatgcccagca

SEQ ID NO: 203418 - DNA, 16 bp, P. troglodytes
agcacaatgtctggca

SEQ ID NO: 203419 - DNA, 16 bp, P. troglodytes
agcacaattcctggca

SEQ ID NO: 203420 - DNA, 16 bp, P. troglodytes
agcacactgcagcctc

SEQ ID NO: 203421 - DNA, 16 bp, P. troglodytes
agcacagaacctggca

SEQ ID NO: 203422 - DNA, 16 bp, P. troglodytes
agcacagagaggttaa

SEQ ID NO: 203423 - DNA, 16 bp, P. troglodytes
agcacagagcccagca

SEQ ID NO: 203424 - DNA, 16 bp, P. troglodytes
agcacagcacagcaca

SEQ ID NO: 203425 - DNA, 16 bp, P. troglodytes
agcacagcagctgctg

SEQ ID NO: 203426 - DNA, 16 bp, P. troglodytes
agcacagcctggagct

SEQ ID NO: 203427 - DNA, 16 bp, P. troglodytes
agcacagggcctgaca

SEQ ID NO: 203428 - DNA, 16 bp, P. troglodytes
agcacagggcctggct

SEQ ID NO: 203429 - DNA, 16 bp, P. troglodytes
agcacagtccctggca

SEQ ID NO: 203430 - DNA, 16 bp, P. troglodytes
agcacagtgccaggaa

SEQ ID NO: 203431 - DNA, 16 bp, P. troglodytes
agcacagtgcctggca

SEQ ID NO: 203432 - DNA, 16 bp, P. troglodytes
agcacagtgccttgca

SEQ ID NO: 203433 - DNA, 16 bp, P. troglodytes
agcacatctttttttt

SEQ ID NO: 203434 - DNA, 16 bp, P. troglodytes
agcacattatatttat

SEQ ID NO: 203435 - DNA, 17 bp, P. troglodytes
agcacattcctttccct

SEQ ID NO: 203436 - DNA, 16 bp, P. troglodytes
agcacattttatttta

SEQ ID NO: 203437 - DNA, 16 bp, P. troglodytes
agcacattttttaaaa

SEQ ID NO: 203438 - DNA, 16 bp, P. troglodytes
agcaccaacttgccag

SEQ ID NO: 203439 - DNA, 16 bp, P. troglodytes
agcaccaagcaggctc

SEQ ID NO: 203440 - DNA, 16 bp, P. troglodytes
agcaccacactgtctt

SEQ ID NO: 203441 - DNA, 17 bp, P. troglodytes
agcaccagtccctcaag

SEQ ID NO: 203442 - DNA, 16 bp, P. troglodytes
agcaccatgcctggct

SEQ ID NO: 203443 - DNA, 16 bp, P. troglodytes
agcaccatttgttgaa

SEQ ID NO: 203444 - DNA, 16 bp, P. troglodytes
agcacccagattcaca

SEQ ID NO: 203445 - DNA, 16 bp, P. troglodytes
agcacccagcacccag

SEQ ID NO: 203446 - DNA, 16 bp, P. troglodytes
agcaccccctccagag

SEQ ID NO: 203447 - DNA, 16 bp, P. troglodytes
agcacccctgtgacca

SEQ ID NO: 203448 - DNA, 16 bp, P. troglodytes
agcacccgccaccacg

SEQ ID NO: 203449 - DNA, 17 bp, P. troglodytes
agcaccctgggaggcca

SEQ ID NO: 203450 - DNA, 17 bp, P. troglodytes
agcaccctgtcaaaatg

SEQ ID NO: 203451 - DNA, 16 bp, P. troglodytes
agcacctaaaacagtg

SEQ ID NO: 203452 - DNA, 16 bp, P. troglodytes
agcacctaagtcacct

SEQ ID NO: 203453 - DNA, 16 bp, P. troglodytes
agcacctactatgtgt

SEQ ID NO: 203454 - DNA, 16 bp, P. troglodytes
agcacctactctgtgc

SEQ ID NO: 203455 - DNA, 16 bp, P. troglodytes
agcacctactgtgtgc

SEQ ID NO: 203456 - DNA, 16 bp, P. troglodytes
agcacctactgtgttc

SEQ ID NO: 203457 - DNA, 16 bp, P. troglodytes
agcacctcagcctccc

SEQ ID NO: 203458 - DNA, 16 bp, P. troglodytes
agcacctgctatgttc

SEQ ID NO: 203459 - DNA, 16 bp, P. troglodytes
agcacctgctgtgtgt

SEQ ID NO: 203460 - DNA, 16 bp, P. troglodytes
agcacctggcacacag

SEQ ID NO: 203461 - DNA, 20 bp, P. troglodytes
agcacctgggccagcggctg

SEQ ID NO: 203462 - DNA, 16 bp, P. troglodytes
agcacctgggcttggc

SEQ ID NO: 203463 - DNA, 16 bp, P. troglodytes
agcacctgttattttt

SEQ ID NO: 203464 - DNA, 19 bp, P. troglodytes
agcacgttgtcacctctca

SEQ ID NO: 203465 - DNA, 16 bp, P. troglodytes
agcactattaacattt

SEQ ID NO: 203466 - DNA, 16 bp, P. troglodytes
agcactcaaaaagttt

SEQ ID NO: 203467 - DNA, 16 bp, P. troglodytes
agcactccagcctggg

SEQ ID NO: 203468 - DNA, 25 bp, P. troglodytes
agcactccagcctgggcaacagagt

SEQ ID NO: 203469 - DNA, 16 bp, P. troglodytes
agcactcccagcagct

SEQ ID NO: 203470 - DNA, 16 bp, P. troglodytes
agcactggagagaaag

SEQ ID NO: 203471 - DNA, 16 bp, P. troglodytes
agcactgggtttacag

SEQ ID NO: 203472 - DNA, 16 bp, P. troglodytes
agcactgtgggaagcc

SEQ ID NO: 203473 - DNA, 16 bp, P. troglodytes
agcacttaacacagtg

SEQ ID NO: 203474 - DNA, 16 bp, P. troglodytes
agcacttaataaatgt

SEQ ID NO: 203475 - DNA, 16 bp, P. troglodytes
agcacttactgagcac

SEQ ID NO: 203476 - DNA, 18 bp, P. troglodytes
agcacttcaggaggctga

SEQ ID NO: 203477 - DNA, 16 bp, P. troglodytes
agcacttccagtacta

SEQ ID NO: 203478 - DNA, 16 bp, P. troglodytes
agcacttctctgtgtt

SEQ ID NO: 203479 - DNA, 16 bp, P. troglodytes
agcacttgaaatgtga

SEQ ID NO: 203480 - DNA, 16 bp, P. troglodytes
agcacttgaggaggcc

SEQ ID NO: 203481 - DNA, 17 bp, P. troglodytes
agcacttggggaggccc

SEQ ID NO: 203482 - DNA, 16 bp, P. troglodytes
agcactttaggaggtc

SEQ ID NO: 203483 - DNA, 16 bp, P. troglodytes
agcactttattttatt

SEQ ID NO: 203484 - DNA, 16 bp, P. troglodytes
agcactttcttttttt

SEQ ID NO: 203485 - DNA, 16 bp, P. troglodytes
agcactttgaaaatat

SEQ ID NO: 203486 - DNA, 16 bp, P. troglodytes
agcactttgaaagacc

SEQ ID NO: 203487 - DNA, 16 bp, P. troglodytes
agcactttgaatacat

SEQ ID NO: 203488 - DNA, 21 bp, P. troglodytes
agcactttggaaggctgaggc

SEQ ID NO: 203489 - DNA, 16 bp, P. troglodytes
agcactttgggaagac

SEQ ID NO: 203490 - DNA, 16 bp, P. troglodytes
agcactttgggacgcc

SEQ ID NO: 203491 - DNA, 16 bp, P. troglodytes
agcactttgggatgct

SEQ ID NO: 203492 - DNA, 16 bp, P. troglodytes
agcactttgggattct

SEQ ID NO: 203493 - DNA, 16 bp, P. troglodytes
agcactttgggggacc

SEQ ID NO: 203494 - DNA, 16 bp, P. troglodytes
agcactttggtaggcc

SEQ ID NO: 203495 - DNA, 16 bp, P. troglodytes
agcacttttagaggcc

SEQ ID NO: 203496 - DNA, 16 bp, P. troglodytes
agcacttttggaagcc

SEQ ID NO: 203497 - DNA, 16 bp, P. troglodytes
agcacttttgggaggc

SEQ ID NO: 203498 - DNA, 16 bp, P. troglodytes
agcagaaactttacaa

SEQ ID NO: 203499 - DNA, 16 bp, P. troglodytes
agcagaaagtacagag

SEQ ID NO: 203500 - DNA, 16 bp, P. troglodytes
agcagaaataagtgaa

SEQ ID NO: 203501 - DNA, 16 bp, P. troglodytes
agcagaaatcaataaa

SEQ ID NO: 203502 - DNA, 16 bp, P. troglodytes
agcagaaatgaaagag

SEQ ID NO: 203503 - DNA, 16 bp, P. troglodytes
agcagaaatgaatgaa

SEQ ID NO: 203504 - DNA, 16 bp, P. troglodytes
agcagaaatgtattct

SEQ ID NO: 203505 - DNA, 16 bp, P. troglodytes
agcagaacaaaatgaa

SEQ ID NO: 203506 - DNA, 16 bp, P. troglodytes
agcagaacatgttcca

SEQ ID NO: 203507 - DNA, 16 bp, P. troglodytes
agcagaactgaagaaa

SEQ ID NO: 203508 - DNA, 16 bp, P. troglodytes
agcagaactgaaggaa

SEQ ID NO: 203509 - DNA, 16 bp, P. troglodytes
agcagaactgaagggg

SEQ ID NO: 203510 - DNA, 16 bp, P. troglodytes
agcagaagaaagaacc

SEQ ID NO: 203511 - DNA, 16 bp, P. troglodytes
agcagaagaaagaatg

SEQ ID NO: 203512 - DNA, 16 bp, P. troglodytes
agcagaagaaatagaa

SEQ ID NO: 203513 - DNA, 16 bp, P. troglodytes
agcagaagagtgacat

SEQ ID NO: 203514 - DNA, 16 bp, P. troglodytes
agcagaagcagcagca

SEQ ID NO: 203515 - DNA, 16 bp, P. troglodytes
agcagaagcaggaaga

SEQ ID NO: 203516 - DNA, 16 bp, P. troglodytes
agcagaagccaagaaa

SEQ ID NO: 203517 - DNA, 16 bp, P. troglodytes
agcagaatagaccaag

SEQ ID NO: 203518 - DNA, 16 bp, P. troglodytes
agcagaatgaaaatgg

SEQ ID NO: 203519 - DNA, 16 bp, P. troglodytes
agcagaattaaataaa

SEQ ID NO: 203520 - DNA, 16 bp, P. troglodytes
agcagaattacttgaa

SEQ ID NO: 203521 - DNA, 16 bp, P. troglodytes
agcagaattgctggat

SEQ ID NO: 203522 - DNA, 16 bp, P. troglodytes
agcagacaacctacag

SEQ ID NO: 203523 - DNA, 16 bp, P. troglodytes
agcagacaccttcttc

SEQ ID NO: 203524 - DNA, 16 bp, P. troglodytes
agcagacagtaaaaca

SEQ ID NO: 203525 - DNA, 16 bp, P. troglodytes
agcagacatgtcacat

SEQ ID NO: 203526 - DNA, 16 bp, P. troglodytes
agcagaccctgaagga

SEQ ID NO: 203527 - DNA, 16 bp, P. troglodytes
agcagactctgtctca

SEQ ID NO: 203528 - DNA, 16 bp, P. troglodytes
agcagagaaaacagca

SEQ ID NO: 203529 - DNA, 16 bp, P. troglodytes
agcagagaagaaaaat

SEQ ID NO: 203530 - DNA, 16 bp, P. troglodytes
agcagagaagcagaga

SEQ ID NO: 203531 - DNA, 16 bp, P. troglodytes
agcagagagaagccag

SEQ ID NO: 203532 - DNA, 16 bp, P. troglodytes
agcagagagccaaatc

SEQ ID NO: 203533 - DNA, 16 bp, P. troglodytes
agcagagaggaggccc

SEQ ID NO: 203534 - DNA, 16 bp, P. troglodytes
agcagagatcaggcca

SEQ ID NO: 203535 - DNA, 16 bp, P. troglodytes
agcagagatcatgcca

SEQ ID NO: 203536 - DNA, 16 bp, P. troglodytes
agcagagatggcacca

SEQ ID NO: 203537 - DNA, 16 bp, P. troglodytes
agcagagattgtgcca

SEQ ID NO: 203538 - DNA, 16 bp, P. troglodytes
agcagagcaagactcc

SEQ ID NO: 203539 - DNA, 16 bp, P. troglodytes
agcagagcagctgctc

SEQ ID NO: 203540 - DNA, 16 bp, P. troglodytes
agcagagcataaaagc

SEQ ID NO: 203541 - DNA, 16 bp, P. troglodytes
agcagagccaggagag

SEQ ID NO: 203542 - DNA, 16 bp, P. troglodytes
agcagagctaaaagag

SEQ ID NO: 203543 - DNA, 16 bp, P. troglodytes
agcagagctgggattc

SEQ ID NO: 203544 - DNA, 16 bp, P. troglodytes
agcagagcttgtagct

SEQ ID NO: 203545 - DNA, 16 bp, P. troglodytes
agcagaggaatgacat

SEQ ID NO: 203546 - DNA, 16 bp, P. troglodytes
agcagaggagtgactt

SEQ ID NO: 203547 - DNA, 16 bp, P. troglodytes
agcagaggcagccata

SEQ ID NO: 203548 - DNA, 16 bp, P. troglodytes
agcagaggcaggaaga

SEQ ID NO: 203549 - DNA, 16 bp, P. troglodytes
agcagaggcaggagaa

SEQ ID NO: 203550 - DNA, 16 bp, P. troglodytes
agcagaggcaggagga

SEQ ID NO: 203551 - DNA, 16 bp, P. troglodytes
agcagaggctgaagaa

SEQ ID NO: 203552 - DNA, 16 bp, P. troglodytes
agcagaggctgcagtg

SEQ ID NO: 203553 - DNA, 16 bp, P. troglodytes
agcagaggctggagtg

SEQ ID NO: 203554 - DNA, 16 bp, P. troglodytes
agcagaggcttcagaa

SEQ ID NO: 203555 - DNA, 16 bp, P. troglodytes
agcagaggggcctgac

SEQ ID NO: 203556 - DNA, 22 bp, P. troglodytes
agcagaggttgcagtgagctga

SEQ ID NO: 203557 - DNA, 16 bp, P. troglodytes
agcagataccagcacc

SEQ ID NO: 203558 - DNA, 16 bp, P. troglodytes
agcagatgagtggttg

SEQ ID NO: 203559 - DNA, 16 bp, P. troglodytes
agcagatgccaagatg

SEQ ID NO: 203560 - DNA, 16 bp, P. troglodytes
agcagatgccggcacc

SEQ ID NO: 203561 - DNA, 16 bp, P. troglodytes
agcagatgctggcaag

SEQ ID NO: 203562 - DNA, 16 bp, P. troglodytes
agcagatgtgtggtgg

SEQ ID NO: 203563 - DNA, 16 bp, P. troglodytes
agcagcaagactgaaa

SEQ ID NO: 203564 - DNA, 16 bp, P. troglodytes
agcagcaaggccctgg

SEQ ID NO: 203565 - DNA, 16 bp, P. troglodytes
agcagcacaaaacaga

SEQ ID NO: 203566 - DNA, 16 bp, P. troglodytes
agcagcacaaacagac

SEQ ID NO: 203567 - DNA, 16 bp, P. troglodytes
agcagcacatcaagaa

SEQ ID NO: 203568 - DNA, 16 bp, P. troglodytes
agcagcaccagcagca

SEQ ID NO: 203569 - DNA, 16 bp, P. troglodytes
agcagcacccctggcc

SEQ ID NO: 203570 - DNA, 16 bp, P. troglodytes
agcagcagaaaaaaat

SEQ ID NO: 203571 - DNA, 16 bp, P. troglodytes
agcagcagaacaagat

SEQ ID NO: 203572 - DNA, 16 bp, P. troglodytes
agcagcagacaccagc

SEQ ID NO: 203573 - DNA, 16 bp, P. troglodytes
agcagcagacttttca

SEQ ID NO: 203574 - DNA, 16 bp, P. troglodytes
agcagcagagccagga

SEQ ID NO: 203575 - DNA, 16 bp, P. troglodytes
agcagcagaggcagga

SEQ ID NO: 203576 - DNA, 16 bp, P. troglodytes
agcagcagatctccca

SEQ ID NO: 203577 - DNA, 16 bp, P. troglodytes
agcagcagcaacaata

SEQ ID NO: 203578 - DNA, 17 bp, P. troglodytes
agcagcagcaagattta

SEQ ID NO: 203579 - DNA, 16 bp, P. troglodytes
agcagcagcagcaact

SEQ ID NO: 203580 - DNA, 16 bp, P. troglodytes
agcagcagcagcaatg

SEQ ID NO: 203581 - DNA, 16 bp, P. troglodytes
agcagcagcagcagaa

SEQ ID NO: 203582 - DNA, 16 bp, P. troglodytes
agcagcagcagcagca

SEQ ID NO: 203583 - DNA, 16 bp, P. troglodytes
agcagcagcagcagtg

SEQ ID NO: 203584 - DNA, 16 bp, P. troglodytes
agcagcagcagcatct

SEQ ID NO: 203585 - DNA, 16 bp, P. troglodytes
agcagcagcagcggca

SEQ ID NO: 203586 - DNA, 16 bp, P. troglodytes
agcagcagcagctggg

SEQ ID NO: 203587 - DNA, 16 bp, P. troglodytes
agcagcagcagctgtg

SEQ ID NO: 203588 - DNA, 16 bp, P. troglodytes
agcagcagcaggaaga

SEQ ID NO: 203589 - DNA, 16 bp, P. troglodytes
agcagcagcaggagca

SEQ ID NO: 203590 - DNA, 16 bp, P. troglodytes
agcagcagcaggagga

SEQ ID NO: 203591 - DNA, 16 bp, P. troglodytes
agcagcagcagtagca

SEQ ID NO: 203592 - DNA, 16 bp, P. troglodytes
agcagcagcagtagct

SEQ ID NO: 203593 - DNA, 16 bp, P. troglodytes
agcagcagccagagat

SEQ ID NO: 203594 - DNA, 16 bp, P. troglodytes
agcagcagcccaagct

SEQ ID NO: 203595 - DNA, 16 bp, P. troglodytes
agcagcagcttgggct

SEQ ID NO: 203596 - DNA, 16 bp, P. troglodytes
agcagcaggaggagga

SEQ ID NO: 203597 - DNA, 16 bp, P. troglodytes
agcagcaggaggcaga

SEQ ID NO: 203598 - DNA, 16 bp, P. troglodytes
agcagcagggaagctc

SEQ ID NO: 203599 - DNA, 16 bp, P. troglodytes
agcagcagggaggaag

SEQ ID NO: 203600 - DNA, 16 bp, P. troglodytes
agcagcagggccctgg

SEQ ID NO: 203601 - DNA, 16 bp, P. troglodytes
agcagcagtggcagtg

SEQ ID NO: 203602 - DNA, 16 bp, P. troglodytes
agcagcagtggctgca

SEQ ID NO: 203603 - DNA, 16 bp, P. troglodytes
agcagcatcaacaaca

SEQ ID NO: 203604 - DNA, 16 bp, P. troglodytes
agcagcatcaacatca

SEQ ID NO: 203605 - DNA, 16 bp, P. troglodytes
agcagcatccctagcc

SEQ ID NO: 203606 - DNA, 16 bp, P. troglodytes
agcagcatccttggcc

SEQ ID NO: 203607 - DNA, 16 bp, P. troglodytes
agcagcatttttcaca

SEQ ID NO: 203608 - DNA, 16 bp, P. troglodytes
agcagccacagaaaac

SEQ ID NO: 203609 - DNA, 16 bp, P. troglodytes
agcagccacaggggct

SEQ ID NO: 203610 - DNA, 16 bp, P. troglodytes
agcagccagagtgatc

SEQ ID NO: 203611 - DNA, 16 bp, P. troglodytes
agcagccagccagccc

SEQ ID NO: 203612 - DNA, 16 bp, P. troglodytes
agcagccaggaggggg

SEQ ID NO: 203613 - DNA, 16 bp, P. troglodytes
agcagccatcaacact

SEQ ID NO: 203614 - DNA, 16 bp, P. troglodytes
agcagccctcctgcct

SEQ ID NO: 203615 - DNA, 16 bp, P. troglodytes
agcagcctaggcaaca

SEQ ID NO: 203616 - DNA, 16 bp, P. troglodytes
agcagcctgaagccat

SEQ ID NO: 203617 - DNA, 16 bp, P. troglodytes
agcagcctggacaaca

SEQ ID NO: 203618 - DNA, 16 bp, P. troglodytes
agcagcctggccaata

SEQ ID NO: 203619 - DNA, 16 bp, P. troglodytes
agcagcctgggcaaca

SEQ ID NO: 203620 - DNA, 16 bp, P. troglodytes
agcagcctgggcacca

SEQ ID NO: 203621 - DNA, 16 bp, P. troglodytes
agcagcggttctcaaa

SEQ ID NO: 203622 - DNA, 16 bp, P. troglodytes
agcagctaggactaca

SEQ ID NO: 203623 - DNA, 16 bp, P. troglodytes
agcagctcagaggcag

SEQ ID NO: 203624 - DNA, 16 bp, P. troglodytes
agcagctcaggaggct

SEQ ID NO: 203625 - DNA, 16 bp, P. troglodytes
agcagctccagcttct

SEQ ID NO: 203626 - DNA, 16 bp, P. troglodytes
agcagctcccagcttg

SEQ ID NO: 203627 - DNA, 16 bp, P. troglodytes
agcagctctctctgcc

SEQ ID NO: 203628 - DNA, 16 bp, P. troglodytes
agcagctgatcctgac

SEQ ID NO: 203629 - DNA, 16 bp, P. troglodytes
agcagctgcaattgga

SEQ ID NO: 203630 - DNA, 16 bp, P. troglodytes
agcagctgcacagata

SEQ ID NO: 203631 - DNA, 16 bp, P. troglodytes
agcagctgctcaggca

SEQ ID NO: 203632 - DNA, 16 bp, P. troglodytes
agcagctgctgccatc

SEQ ID NO: 203633 - DNA, 16 bp, P. troglodytes
agcagctggaacacag

SEQ ID NO: 203634 - DNA, 16 bp, P. troglodytes
agcagctggaagaggc

SEQ ID NO: 203635 - DNA, 16 bp, P. troglodytes
agcagctggcagaggc

SEQ ID NO: 203636 - DNA, 16 bp, P. troglodytes
agcagctgggagaggg

SEQ ID NO: 203637 - DNA, 16 bp, P. troglodytes
agcagctgggatgaca

SEQ ID NO: 203638 - DNA, 17 bp, P. troglodytes
agcagctgggattacag

SEQ ID NO: 203639 - DNA, 16 bp, P. troglodytes
agcagctggggctaca

SEQ ID NO: 203640 - DNA, 16 bp, P. troglodytes
agcagctgtgctgtgt

SEQ ID NO: 203641 - DNA, 16 bp, P. troglodytes
agcagcttccacagct

SEQ ID NO: 203642 - DNA, 16 bp, P. troglodytes
agcagcttccacatgg

SEQ ID NO: 203643 - DNA, 16 bp, P. troglodytes
agcagcttgggctgct

SEQ ID NO: 203644 - DNA, 16 bp, P. troglodytes
agcagctttgtttgta

SEQ ID NO: 203645 - DNA, 16 bp, P. troglodytes
agcaggaaacatccaa

SEQ ID NO: 203646 - DNA, 16 bp, P. troglodytes
agcaggaacaagagag

SEQ ID NO: 203647 - DNA, 16 bp, P. troglodytes
agcaggaaggcagcca

SEQ ID NO: 203648 - DNA, 16 bp, P. troglodytes
agcaggacgtggtggt

SEQ ID NO: 203649 - DNA, 16 bp, P. troglodytes
agcaggactgggcaga

SEQ ID NO: 203650 - DNA, 16 bp, P. troglodytes
agcaggagaaggaaat

SEQ ID NO: 203651 - DNA, 16 bp, P. troglodytes
agcaggagaattgttt

SEQ ID NO: 203652 - DNA, 16 bp, P. troglodytes
agcaggagcaagagaa

SEQ ID NO: 203653 - DNA, 16 bp, P. troglodytes
agcaggagcaagagag

SEQ ID NO: 203654 - DNA, 16 bp, P. troglodytes
agcaggagcaagtgag

SEQ ID NO: 203655 - DNA, 16 bp, P. troglodytes
agcaggagcagcagca

SEQ ID NO: 203656 - DNA, 16 bp, P. troglodytes
agcaggagcgagagag

SEQ ID NO: 203657 - DNA, 16 bp, P. troglodytes
agcaggaggaagagac

SEQ ID NO: 203658 - DNA, 16 bp, P. troglodytes
agcaggaggcaagaaa

SEQ ID NO: 203659 - DNA, 16 bp, P. troglodytes
agcaggaggcctgggt

SEQ ID NO: 203660 - DNA, 16 bp, P. troglodytes
agcaggagggacaatg

SEQ ID NO: 203661 - DNA, 16 bp, P. troglodytes
agcaggaggtgagcga

SEQ ID NO: 203662 - DNA, 16 bp, P. troglodytes
agcaggagtgaaagtt

SEQ ID NO: 203663 - DNA, 16 bp, P. troglodytes
agcaggatgccatttt

SEQ ID NO: 203664 - DNA, 16 bp, P. troglodytes
agcaggcacatcttca

SEQ ID NO: 203665 - DNA, 16 bp, P. troglodytes
agcaggcactcaataa

SEQ ID NO: 203666 - DNA, 16 bp, P. troglodytes
agcaggcagcaggcag

SEQ ID NO: 203667 - DNA, 16 bp, P. troglodytes
agcaggcatggtggtg

SEQ ID NO: 203668 - DNA, 16 bp, P. troglodytes
agcaggccccagtgtg

SEQ ID NO: 203669 - DNA, 16 bp, P. troglodytes
agcaggccctcaccag

SEQ ID NO: 203670 - DNA, 16 bp, P. troglodytes
agcaggctctcaccag

SEQ ID NO: 203671 - DNA, 16 bp, P. troglodytes
agcaggctgtggagca

SEQ ID NO: 203672 - DNA, 16 bp, P. troglodytes
agcagggagaagccag

SEQ ID NO: 203673 - DNA, 16 bp, P. troglodytes
agcagggaggaggctg

SEQ ID NO: 203674 - DNA, 16 bp, P. troglodytes
agcagggagggagctt

SEQ ID NO: 203675 - DNA, 16 bp, P. troglodytes
agcagggcaggggcag

SEQ ID NO: 203676 - DNA, 16 bp, P. troglodytes
agcagggcatggtggc

SEQ ID NO: 203677 - DNA, 16 bp, P. troglodytes
agcagggcatgtatga

SEQ ID NO: 203678 - DNA, 16 bp, P. troglodytes
agcagggccctgggcc

SEQ ID NO: 203679 - DNA, 16 bp, P. troglodytes
agcagggcgtggtggc

SEQ ID NO: 203680 - DNA, 16 bp, P. troglodytes
agcagggctaccccat

SEQ ID NO: 203681 - DNA, 16 bp, P. troglodytes
agcagggctttcaggc

SEQ ID NO: 203682 - DNA, 16 bp, P. troglodytes
agcaggggcttccagg

SEQ ID NO: 203683 - DNA, 18 bp, P. troglodytes
agcaggggtccaaggaag

SEQ ID NO: 203684 - DNA, 16 bp, P. troglodytes
agcagggtgcggtggc

SEQ ID NO: 203685 - DNA, 16 bp, P. troglodytes
agcaggtccctgatcc

SEQ ID NO: 203686 - DNA, 16 bp, P. troglodytes
agcaggtctgggtggg

SEQ ID NO: 203687 - DNA, 16 bp, P. troglodytes
agcaggtgcaggagct

SEQ ID NO: 203688 - DNA, 16 bp, P. troglodytes
agcaggtggaggctgc

SEQ ID NO: 203689 - DNA, 16 bp, P. troglodytes
agcaggtggatcactt

SEQ ID NO: 203690 - DNA, 16 bp, P. troglodytes
agcaggttccatgatg

SEQ ID NO: 203691 - DNA, 16 bp, P. troglodytes
agcaggtttttaaagg

SEQ ID NO: 203692 - DNA, 16 bp, P. troglodytes
agcagtaaatgcctac

SEQ ID NO: 203693 - DNA, 16 bp, P. troglodytes
agcagtaagtctcaac

SEQ ID NO: 203694 - DNA, 16 bp, P. troglodytes
agcagtaatattttaa

SEQ ID NO: 203695 - DNA, 16 bp, P. troglodytes
agcagtagcagtagca

SEQ ID NO: 203696 - DNA, 16 bp, P. troglodytes
agcagtatctcattgt

SEQ ID NO: 203697 - DNA, 16 bp, P. troglodytes
agcagtatgaaaatgg

SEQ ID NO: 203698 - DNA, 16 bp, P. troglodytes
agcagtatggacattt

SEQ ID NO: 203699 - DNA, 16 bp, P. troglodytes
agcagtcagggagaga

SEQ ID NO: 203700 - DNA, 16 bp, P. troglodytes
agcagtcccactactg

SEQ ID NO: 203701 - DNA, 16 bp, P. troglodytes
agcagtcccatcagct

SEQ ID NO: 203702 - DNA, 16 bp, P. troglodytes
agcagtcctcaacctt

SEQ ID NO: 203703 - DNA, 17 bp, P. troglodytes
agcagtctgcttccttc

SEQ ID NO: 203704 - DNA, 16 bp, P. troglodytes
agcagtcttgaataat

SEQ ID NO: 203705 - DNA, 16 bp, P. troglodytes
agcagtgaacaaaaca

SEQ ID NO: 203706 - DNA, 16 bp, P. troglodytes
agcagtgaacaaaata

SEQ ID NO: 203707 - DNA, 16 bp, P. troglodytes
agcagtgatgatgagc

SEQ ID NO: 203708 - DNA, 16 bp, P. troglodytes
agcagtgatggttgca

SEQ ID NO: 203709 - DNA, 16 bp, P. troglodytes
agcagtgccagaaaac

SEQ ID NO: 203710 - DNA, 16 bp, P. troglodytes
agcagtgcttctcaaa

SEQ ID NO: 203711 - DNA, 16 bp, P. troglodytes
agcagtgcttttcaaa

SEQ ID NO: 203712 - DNA, 16 bp, P. troglodytes
agcagtggcagcagct

SEQ ID NO: 203713 - DNA, 17 bp, P. troglodytes
agcagtggctcacacct

SEQ ID NO: 203714 - DNA, 16 bp, P. troglodytes
agcagtgggaaaagga

SEQ ID NO: 203715 - DNA, 16 bp, P. troglodytes
agcagtggggaaaaga

SEQ ID NO: 203716 - DNA, 16 bp, P. troglodytes
agcagtgtgaaaacac

SEQ ID NO: 203717 - DNA, 16 bp, P. troglodytes
agcagtgtgaaaatgg

SEQ ID NO: 203718 - DNA, 16 bp, P. troglodytes
agcagtgtgagaaaag

SEQ ID NO: 203719 - DNA, 16 bp, P. troglodytes
agcagtgtgagaaggg

SEQ ID NO: 203720 - DNA, 16 bp, P. troglodytes
agcagtgtgtggaggg

SEQ ID NO: 203721 - DNA, 16 bp, P. troglodytes
agcagtgtttctcaaa

SEQ ID NO: 203722 - DNA, 16 bp, P. troglodytes
agcagttacaagtgga

SEQ ID NO: 203723 - DNA, 16 bp, P. troglodytes
agcagttcaagactag

SEQ ID NO: 203724 - DNA, 16 bp, P. troglodytes
agcagttcaaggctgc

SEQ ID NO: 203725 - DNA, 16 bp, P. troglodytes
agcagttctccctgcc

SEQ ID NO: 203726 - DNA, 16 bp, P. troglodytes
agcagttctcttgcct

SEQ ID NO: 203727 - DNA, 16 bp, P. troglodytes
agcagttgtcctgcct

SEQ ID NO: 203728 - DNA, 16 bp, P. troglodytes
agcagtttcaggatac

SEQ ID NO: 203729 - DNA, 16 bp, P. troglodytes
agcagtttgattatga

SEQ ID NO: 203730 - DNA, 16 bp, P. troglodytes
agcagttttataaacc

SEQ ID NO: 203731 - DNA, 16 bp, P. troglodytes
agcagttttatttgta

SEQ ID NO: 203732 - DNA, 16 bp, P. troglodytes
agcagttttggaggcc

SEQ ID NO: 203733 - DNA, 16 bp, P. troglodytes
agcagtttttaaaaat

SEQ ID NO: 203734 - DNA, 16 bp, P. troglodytes
agcataaaaatataca

SEQ ID NO: 203735 - DNA, 16 bp, P. troglodytes
agcataaggagatttt

SEQ ID NO: 203736 - DNA, 16 bp, P. troglodytes
agcataatgattttga

SEQ ID NO: 203737 - DNA, 16 bp, P. troglodytes
agcatacaaaaagaca

SEQ ID NO: 203738 - DNA, 16 bp, P. troglodytes
agcatacttttttttt

SEQ ID NO: 203739 - DNA, 16 bp, P. troglodytes
agcatagtacccaata

SEQ ID NO: 203740 - DNA, 16 bp, P. troglodytes
agcatatacagcatgg

SEQ ID NO: 203741 - DNA, 16 bp, P. troglodytes
agcatatatatatata

SEQ ID NO: 203742 - DNA, 16 bp, P. troglodytes
agcatatattttaaaa

SEQ ID NO: 203743 - DNA, 16 bp, P. troglodytes
agcatatcaaaaagat

SEQ ID NO: 203744 - DNA, 16 bp, P. troglodytes
agcatatggaaagatg

SEQ ID NO: 203745 - DNA, 16 bp, P. troglodytes
agcatattcttttttt

SEQ ID NO: 203746 - DNA, 16 bp, P. troglodytes
agcatatttttatgtt

SEQ ID NO: 203747 - DNA, 16 bp, P. troglodytes
agcatcacacactggg

SEQ ID NO: 203748 - DNA, 16 bp, P. troglodytes
agcatcatcaccatca

SEQ ID NO: 203749 - DNA, 16 bp, P. troglodytes
agcatcatgagaacag

SEQ ID NO: 203750 - DNA, 16 bp, P. troglodytes
agcatccaagatggag

SEQ ID NO: 203751 - DNA, 16 bp, P. troglodytes
agcatccattattttt

SEQ ID NO: 203752 - DNA, 16 bp, P. troglodytes
agcatccccagcctct

SEQ ID NO: 203753 - DNA, 16 bp, P. troglodytes
agcatccttaaagaaa

SEQ ID NO: 203754 - DNA, 16 bp, P. troglodytes
agcatctacagaaacc

SEQ ID NO: 203755 - DNA, 16 bp, P. troglodytes
agcatctccagatgag

SEQ ID NO: 203756 - DNA, 16 bp, P. troglodytes
agcatctgaggatttt

SEQ ID NO: 203757 - DNA, 16 bp, P. troglodytes
agcatctgcacagcaa

SEQ ID NO: 203758 - DNA, 16 bp, P. troglodytes
agcatctgctgtttct

SEQ ID NO: 203759 - DNA, 16 bp, P. troglodytes
agcatctgtagatttt

SEQ ID NO: 203760 - DNA, 16 bp, P. troglodytes
agcatctgttgcttct

SEQ ID NO: 203761 - DNA, 16 bp, P. troglodytes
agcatctgttgtttct

SEQ ID NO: 203762 - DNA, 16 bp, P. troglodytes
agcatcttctatgtgc

SEQ ID NO: 203763 - DNA, 16 bp, P. troglodytes
agcatcttttcatatg

SEQ ID NO: 203764 - DNA, 16 bp, P. troglodytes
agcatgaacagcctgg

SEQ ID NO: 203765 - DNA, 16 bp, P. troglodytes
agcatgaagtggtgtt

SEQ ID NO: 203766 - DNA, 16 bp, P. troglodytes
agcatgaatttctttt

SEQ ID NO: 203767 - DNA, 16 bp, P. troglodytes
agcatgacactggcat

SEQ ID NO: 203768 - DNA, 16 bp, P. troglodytes
agcatgagaaagaccc

SEQ ID NO: 203769 - DNA, 16 bp, P. troglodytes
agcatgagaacagact

SEQ ID NO: 203770 - DNA, 16 bp, P. troglodytes
agcatgagctaccatg

SEQ ID NO: 203771 - DNA, 16 bp, P. troglodytes
agcatgagcttcacca

SEQ ID NO: 203772 - DNA, 16 bp, P. troglodytes
agcatgatgcctccac

SEQ ID NO: 203773 - DNA, 16 bp, P. troglodytes
agcatgatgcctccat

SEQ ID NO: 203774 - DNA, 16 bp, P. troglodytes
agcatgatgccttcag

SEQ ID NO: 203775 - DNA, 16 bp, P. troglodytes
agcatgcaagaacaga

SEQ ID NO: 203776 - DNA, 16 bp, P. troglodytes
agcatgccctctctca

SEQ ID NO: 203777 - DNA, 16 bp, P. troglodytes
agcatgccctggatgt

SEQ ID NO: 203778 - DNA, 16 bp, P. troglodytes
agcatgctgctggcat

SEQ ID NO: 203779 - DNA, 16 bp, P. troglodytes
agcatggaaagttttt

SEQ ID NO: 203780 - DNA, 16 bp, P. troglodytes
agcatggaatgctctt

SEQ ID NO: 203781 - DNA, 16 bp, P. troglodytes
agcatggaatgttttc

SEQ ID NO: 203782 - DNA, 16 bp, P. troglodytes
agcatggactcatgga

SEQ ID NO: 203783 - DNA, 16 bp, P. troglodytes
agcatggagaaaccct

SEQ ID NO: 203784 - DNA, 16 bp, P. troglodytes
agcatggaggaaactg

SEQ ID NO: 203785 - DNA, 16 bp, P. troglodytes
agcatggcaccagcat

SEQ ID NO: 203786 - DNA, 16 bp, P. troglodytes
agcatgggaaagactt

SEQ ID NO: 203787 - DNA, 16 bp, P. troglodytes
agcatggtactggcat

SEQ ID NO: 203788 - DNA, 17 bp, P. troglodytes
agcatggtgaaaccccg

SEQ ID NO: 203789 - DNA, 16 bp, P. troglodytes
agcatggtgacatgtg

SEQ ID NO: 203790 - DNA, 16 bp, P. troglodytes
agcatggtggcacatg

SEQ ID NO: 203791 - DNA, 19 bp, P. troglodytes
agcatggtggctcatgcct

SEQ ID NO: 203792 - DNA, 16 bp, P. troglodytes
agcatgtattactttt

SEQ ID NO: 203793 - DNA, 16 bp, P. troglodytes
agcatgtattattttt

SEQ ID NO: 203794 - DNA, 16 bp, P. troglodytes
agcatgtgaaaaaatg

SEQ ID NO: 203795 - DNA, 16 bp, P. troglodytes
agcatgtgctcatttt

SEQ ID NO: 203796 - DNA, 16 bp, P. troglodytes
agcatgtggagaaata

SEQ ID NO: 203797 - DNA, 16 bp, P. troglodytes
agcatgtggtatttgg

SEQ ID NO: 203798 - DNA, 16 bp, P. troglodytes
agcatgtggtgtttgg

SEQ ID NO: 203799 - DNA, 16 bp, P. troglodytes
agcatgtgtcagtatt

SEQ ID NO: 203800 - DNA, 16 bp, P. troglodytes
agcatgtgttggaaac

SEQ ID NO: 203801 - DNA, 16 bp, P. troglodytes
agcattaaaataataa

SEQ ID NO: 203802 - DNA, 16 bp, P. troglodytes
agcattaaataaatat

SEQ ID NO: 203803 - DNA, 16 bp, P. troglodytes
agcattatttacagta

SEQ ID NO: 203804 - DNA, 16 bp, P. troglodytes
agcattatttctatag

SEQ ID NO: 203805 - DNA, 16 bp, P. troglodytes
agcattcaagaggaaa

SEQ ID NO: 203806 - DNA, 16 bp, P. troglodytes
agcattcatcatctgc

SEQ ID NO: 203807 - DNA, 16 bp, P. troglodytes
agcattccctttaaaa

SEQ ID NO: 203808 - DNA, 17 bp, P. troglodytes
agcattccctttgaaag

SEQ ID NO: 203809 - DNA, 16 bp, P. troglodytes
agcattctcagaaagt

SEQ ID NO: 203810 - DNA, 16 bp, P. troglodytes
agcattctctctgaga

SEQ ID NO: 203811 - DNA, 16 bp, P. troglodytes
agcattgctttatgat

SEQ ID NO: 203812 - DNA, 16 bp, P. troglodytes
agcatttaataaaatt

SEQ ID NO: 203813 - DNA, 16 bp, P. troglodytes
agcatttaataaatgt

SEQ ID NO: 203814 - DNA, 16 bp, P. troglodytes
agcatttactatgtat

SEQ ID NO: 203815 - DNA, 16 bp, P. troglodytes
agcatttagcaaacct

SEQ ID NO: 203816 - DNA, 16 bp, P. troglodytes
agcatttaggccattt

SEQ ID NO: 203817 - DNA, 16 bp, P. troglodytes
agcatttatcctttga

SEQ ID NO: 203818 - DNA, 16 bp, P. troglodytes
agcatttattttattt

SEQ ID NO: 203819 - DNA, 16 bp, P. troglodytes
agcatttatttttttc

SEQ ID NO: 203820 - DNA, 16 bp, P. troglodytes
agcatttcaaatttca

SEQ ID NO: 203821 - DNA, 16 bp, P. troglodytes
agcatttcagatttta

SEQ ID NO: 203822 - DNA, 16 bp, P. troglodytes
agcatttcattccttt

SEQ ID NO: 203823 - DNA, 16 bp, P. troglodytes
agcatttcctctgaga

SEQ ID NO: 203824 - DNA, 16 bp, P. troglodytes
agcatttcctttcttt

SEQ ID NO: 203825 - DNA, 16 bp, P. troglodytes
agcatttgacaaattt

SEQ ID NO: 203826 - DNA, 16 bp, P. troglodytes
agcatttgccagtttc

SEQ ID NO: 203827 - DNA, 16 bp, P. troglodytes
agcatttgctattttt

SEQ ID NO: 203828 - DNA, 16 bp, P. troglodytes
agcatttgttactttt

SEQ ID NO: 203829 - DNA, 16 bp, P. troglodytes
agcattttaaaagaaa

SEQ ID NO: 203830 - DNA, 16 bp, P. troglodytes
agcattttaaataata

SEQ ID NO: 203831 - DNA, 16 bp, P. troglodytes
agcattttacccagag

SEQ ID NO: 203832 - DNA, 16 bp, P. troglodytes
agcattttataatttt

SEQ ID NO: 203833 - DNA, 16 bp, P. troglodytes
agcattttcagaaact

SEQ ID NO: 203834 - DNA, 16 bp, P. troglodytes
agcattttctgcatct

SEQ ID NO: 203835 - DNA, 16 bp, P. troglodytes
agcattttgagaggcc

SEQ ID NO: 203836 - DNA, 16 bp, P. troglodytes
agcattttgccatgtt

SEQ ID NO: 203837 - DNA, 16 bp, P. troglodytes
agcattttggaaggcc

SEQ ID NO: 203838 - DNA, 16 bp, P. troglodytes
agcattttggagattt

SEQ ID NO: 203839 - DNA, 16 bp, P. troglodytes
agcattttggattttg

SEQ ID NO: 203840 - DNA, 16 bp, P. troglodytes
agcattttggccaggc

SEQ ID NO: 203841 - DNA, 16 bp, P. troglodytes
agcattttgttttatt

SEQ ID NO: 203842 - DNA, 16 bp, P. troglodytes
agcatttttggaggcc

SEQ ID NO: 203843 - DNA, 16 bp, P. troglodytes
agcattttttaaaata

SEQ ID NO: 203844 - DNA, 16 bp, P. troglodytes
agcattttttagcagt

SEQ ID NO: 203845 - DNA, 16 bp, P. troglodytes
agcattttttcatgca

SEQ ID NO: 203846 - DNA, 16 bp, P. troglodytes
agcatttttttcccct

SEQ ID NO: 203847 - DNA, 16 bp, P. troglodytes
agcattttttttaaaa

SEQ ID NO: 203848 - DNA, 16 bp, P. troglodytes
agcatttttttttcat

SEQ ID NO: 203849 - DNA, 16 bp, P. troglodytes
agccaaaaagtgggaa

SEQ ID NO: 203850 - DNA, 16 bp, P. troglodytes
agccaaaaatatttat

SEQ ID NO: 203851 - DNA, 16 bp, P. troglodytes
agccaaaataatcttt

SEQ ID NO: 203852 - DNA, 16 bp, P. troglodytes
agccaaaatttggaaa

SEQ ID NO: 203853 - DNA, 16 bp, P. troglodytes
agccaaaccatatcaa

SEQ ID NO: 203854 - DNA, 17 bp, P. troglodytes
agccaaaccatatcact

SEQ ID NO: 203855 - DNA, 16 bp, P. troglodytes
agccaaaccatgagtg

SEQ ID NO: 203856 - DNA, 16 bp, P. troglodytes
agccaaagacaaaggt

SEQ ID NO: 203857 - DNA, 16 bp, P. troglodytes
agccaaagagaaaggt

SEQ ID NO: 203858 - DNA, 16 bp, P. troglodytes
agccaaaggaaaataa

SEQ ID NO: 203859 - DNA, 19 bp, P. troglodytes
agccaaatcatgagtgaaa

SEQ ID NO: 203860 - DNA, 36 bp, P. troglodytes
agccaaatcatgagtgaactcccattcacaattgct

SEQ ID NO: 203861 - DNA, 16 bp, P. troglodytes
agccaaatgatgagaa

SEQ ID NO: 203862 - DNA, 16 bp, P. troglodytes
agccaaatgtgaggac

SEQ ID NO: 203863 - DNA, 16 bp, P. troglodytes
agccaacatggcaaaa

SEQ ID NO: 203864 - DNA, 21 bp, P. troglodytes
agccaacatggtgaaacccca

SEQ ID NO: 203865 - DNA, 16 bp, P. troglodytes
agccaacccaaatgcc

SEQ ID NO: 203866 - DNA, 16 bp, P. troglodytes
agccaacctgaaaagg

SEQ ID NO: 203867 - DNA, 16 bp, P. troglodytes
agccaacgtggtgaaa

SEQ ID NO: 203868 - DNA, 16 bp, P. troglodytes
agccaactccagaaac

SEQ ID NO: 203869 - DNA, 16 bp, P. troglodytes
agccaagaaaactttt

SEQ ID NO: 203870 - DNA, 16 bp, P. troglodytes
agccaagaagtggaag

SEQ ID NO: 203871 - DNA, 16 bp, P. troglodytes
agccaagacaatcctg

SEQ ID NO: 203872 - DNA, 16 bp, P. troglodytes
agccaagacatggaaa

SEQ ID NO: 203873 - DNA, 16 bp, P. troglodytes
agccaagaccacgcca

SEQ ID NO: 203874 - DNA, 16 bp, P. troglodytes
agccaagaggtgaaag

SEQ ID NO: 203875 - DNA, 16 bp, P. troglodytes
agccaagatcacagca

SEQ ID NO: 203876 - DNA, 16 bp, P. troglodytes
agccaagatcctacca

SEQ ID NO: 203877 - DNA, 16 bp, P. troglodytes
agccaagatcgcgccg

SEQ ID NO: 203878 - DNA, 17 bp, P. troglodytes
agccaagatcgtaccat

SEQ ID NO: 203879 - DNA, 16 bp, P. troglodytes
agccaagatcgtgcca

SEQ ID NO: 203880 - DNA, 16 bp, P. troglodytes
agccaagatcttgcca

SEQ ID NO: 203881 - DNA, 16 bp, P. troglodytes
agccaagatgacgcca

SEQ ID NO: 203882 - DNA, 16 bp, P. troglodytes
agccaagatggtgtca

SEQ ID NO: 203883 - DNA, 16 bp, P. troglodytes
agccaagattctgcca

SEQ ID NO: 203884 - DNA, 16 bp, P. troglodytes
agccaagcacagtggt

SEQ ID NO: 203885 - DNA, 16 bp, P. troglodytes
agccaagctggtctca

SEQ ID NO: 203886 - DNA, 16 bp, P. troglodytes
agccaaggaaagccaa

SEQ ID NO: 203887 - DNA, 16 bp, P. troglodytes
agccaaggagagaggc

SEQ ID NO: 203888 - DNA, 16 bp, P. troglodytes
agccaaggagggcaga

SEQ ID NO: 203889 - DNA, 16 bp, P. troglodytes
agccaaggaggtcaag

SEQ ID NO: 203890 - DNA, 17 bp, P. troglodytes
agccaaggcaggcagat

SEQ ID NO: 203891 - DNA, 19 bp, P. troglodytes
agccaaggcaggtggatca

SEQ ID NO: 203892 - DNA, 16 bp, P. troglodytes
agccaaggctcagaga

SEQ ID NO: 203893 - DNA, 16 bp, P. troglodytes
agccaaggctgagaac

SEQ ID NO: 203894 - DNA, 17 bp, P. troglodytes
agccaaggtgggcagat

SEQ ID NO: 203895 - DNA, 17 bp, P. troglodytes
agccaaggtgggtggat

SEQ ID NO: 203896 - DNA, 16 bp, P. troglodytes
agccaaggttgagaac

SEQ ID NO: 203897 - DNA, 16 bp, P. troglodytes
agccaagtacagaaag

SEQ ID NO: 203898 - DNA, 16 bp, P. troglodytes
agccaagtgcggtggc

SEQ ID NO: 203899 - DNA, 16 bp, P. troglodytes
agccaagtgtggcagc

SEQ ID NO: 203900 - DNA, 16 bp, P. troglodytes
agccaagtgtggtggt

SEQ ID NO: 203901 - DNA, 16 bp, P. troglodytes
agccaagttgacacaa

SEQ ID NO: 203902 - DNA, 16 bp, P. troglodytes
agccaataaaagcccc

SEQ ID NO: 203903 - DNA, 17 bp, P. troglodytes
agccaatcaaacctctt

SEQ ID NO: 203904 - DNA, 16 bp, P. troglodytes
agccaatggtgtaagt

SEQ ID NO: 203905 - DNA, 16 bp, P. troglodytes
agccaattcctagaga

SEQ ID NO: 203906 - DNA, 16 bp, P. troglodytes
agccaatttacattta

SEQ ID NO: 203907 - DNA, 16 bp, P. troglodytes
agccacaaaaccagca

SEQ ID NO: 203908 - DNA, 16 bp, P. troglodytes
agccacaacacccagc

SEQ ID NO: 203909 - DNA, 16 bp, P. troglodytes
agccacaatcatgcca

SEQ ID NO: 203910 - DNA, 16 bp, P. troglodytes
agccacacatggctat

SEQ ID NO: 203911 - DNA, 16 bp, P. troglodytes
agccacacccattcat

SEQ ID NO: 203912 - DNA, 16 bp, P. troglodytes
agccacactcattcat

SEQ ID NO: 203913 - DNA, 16 bp, P. troglodytes
agccacagacaatatg

SEQ ID NO: 203914 - DNA, 16 bp, P. troglodytes
agccacagaccctcac

SEQ ID NO: 203915 - DNA, 16 bp, P. troglodytes
agccacagagcccagc

SEQ ID NO: 203916 - DNA, 16 bp, P. troglodytes
agccacagagcccggc

SEQ ID NO: 203917 - DNA, 16 bp, P. troglodytes
agccacagccacagcc

SEQ ID NO: 203918 - DNA, 16 bp, P. troglodytes
agccacagcctcacag

SEQ ID NO: 203919 - DNA, 16 bp, P. troglodytes
agccacagcctgagct

SEQ ID NO: 203920 - DNA, 16 bp, P. troglodytes
agccacagcgcccagc

SEQ ID NO: 203921 - DNA, 16 bp, P. troglodytes
agccacagctgggatg

SEQ ID NO: 203922 - DNA, 16 bp, P. troglodytes
agccacagggcccagc

SEQ ID NO: 203923 - DNA, 16 bp, P. troglodytes
agccacagtacctggc

SEQ ID NO: 203924 - DNA, 16 bp, P. troglodytes
agccacagtgccctgc

SEQ ID NO: 203925 - DNA, 16 bp, P. troglodytes
agccacatattgtatg

SEQ ID NO: 203926 - DNA, 16 bp, P. troglodytes
agccacatgcagaaag

SEQ ID NO: 203927 - DNA, 16 bp, P. troglodytes
agccaccaagtccagc

SEQ ID NO: 203928 - DNA, 16 bp, P. troglodytes
agccaccacaccaggc

SEQ ID NO: 203929 - DNA, 18 bp, P. troglodytes
agccaccacacctggctt

SEQ ID NO: 203930 - DNA, 16 bp, P. troglodytes
agccaccacacctggt

SEQ ID NO: 203931 - DNA, 16 bp, P. troglodytes
agccaccacagccagc

SEQ ID NO: 203932 - DNA, 16 bp, P. troglodytes
agccaccacagctggt

SEQ ID NO: 203933 - DNA, 16 bp, P. troglodytes
agccaccacgccaggc

SEQ ID NO: 203934 - DNA, 16 bp, P. troglodytes
agccaccacgccctgc

SEQ ID NO: 203935 - DNA, 19 bp, P. troglodytes
agccaccacgcctggcctg

SEQ ID NO: 203936 - DNA, 16 bp, P. troglodytes
agccaccacgctggcc

SEQ ID NO: 203937 - DNA, 16 bp, P. troglodytes
agccaccacgtctggc

SEQ ID NO: 203938 - DNA, 16 bp, P. troglodytes
agccaccactctcagc

SEQ ID NO: 203939 - DNA, 16 bp, P. troglodytes
agccaccaggagctgg

SEQ ID NO: 203940 - DNA, 17 bp, P. troglodytes
agccaccatgcccagct

SEQ ID NO: 203941 - DNA, 16 bp, P. troglodytes
agccaccatgcccagg

SEQ ID NO: 203942 - DNA, 16 bp, P. troglodytes
agccaccatgcccatc

SEQ ID NO: 203943 - DNA, 16 bp, P. troglodytes
agccaccatgccggcc

SEQ ID NO: 203944 - DNA, 16 bp, P. troglodytes
agccaccatgcctgac

SEQ ID NO: 203945 - DNA, 16 bp, P. troglodytes
agccaccattcccagc

SEQ ID NO: 203946 - DNA, 16 bp, P. troglodytes
agccacccaaactgca

SEQ ID NO: 203947 - DNA, 16 bp, P. troglodytes
agccacccagcagagc

SEQ ID NO: 203948 - DNA, 16 bp, P. troglodytes
agccacccagcctatg

SEQ ID NO: 203949 - DNA, 16 bp, P. troglodytes
agccacccagtctttg

SEQ ID NO: 203950 - DNA, 16 bp, P. troglodytes
agccaccccgcctggc

SEQ ID NO: 203951 - DNA, 16 bp, P. troglodytes
agccaccctgcccagt

SEQ ID NO: 203952 - DNA, 16 bp, P. troglodytes
agccaccctgcccggc

SEQ ID NO: 203953 - DNA, 16 bp, P. troglodytes
agccaccctgcctggc

SEQ ID NO: 203954 - DNA, 16 bp, P. troglodytes
agccaccgcactggcc

SEQ ID NO: 203955 - DNA, 16 bp, P. troglodytes
agccaccgcagccggc

SEQ ID NO: 203956 - DNA, 16 bp, P. troglodytes
agccaccggacctggc

SEQ ID NO: 203957 - DNA, 16 bp, P. troglodytes
agccaccgtatctggc

SEQ ID NO: 203958 - DNA, 18 bp, P. troglodytes
agccaccgtgcccagcct

SEQ ID NO: 203959 - DNA, 19 bp, P. troglodytes
agccaccgtgcccagcctg

SEQ ID NO: 203960 - DNA, 17 bp, P. troglodytes
agccaccgtgcccagct

SEQ ID NO: 203961 - DNA, 20 bp, P. troglodytes
agccaccgtgcccggcctca

SEQ ID NO: 203962 - DNA, 20 bp, P. troglodytes
agccaccgtgcccggcctcc

SEQ ID NO: 203963 - DNA, 19 bp, P. troglodytes
agccaccgtgcctggcccc

SEQ ID NO: 203964 - DNA, 20 bp, P. troglodytes
agccaccgtgcctggcctca

SEQ ID NO: 203965 - DNA, 16 bp, P. troglodytes
agccaccgtgctgggc

SEQ ID NO: 203966 - DNA, 16 bp, P. troglodytes
agccaccgtggccggc

SEQ ID NO: 203967 - DNA, 16 bp, P. troglodytes
agccaccgtgtccagc

SEQ ID NO: 203968 - DNA, 16 bp, P. troglodytes
agccacctcctacagg

SEQ ID NO: 203969 - DNA, 16 bp, P. troglodytes
agccacctgcaagcca

SEQ ID NO: 203970 - DNA, 16 bp, P. troglodytes
agccacctgcccagcc

SEQ ID NO: 203971 - DNA, 16 bp, P. troglodytes
agccacctggaggccc

SEQ ID NO: 203972 - DNA, 16 bp, P. troglodytes
agccacctggtggcag

SEQ ID NO: 203973 - DNA, 16 bp, P. troglodytes
agccaccttcatcagt

SEQ ID NO: 203974 - DNA, 16 bp, P. troglodytes
agccacggcgcctggc

SEQ ID NO: 203975 - DNA, 16 bp, P. troglodytes
agccacggctcctggc

SEQ ID NO: 203976 - DNA, 16 bp, P. troglodytes
agccacggtgcccggc

SEQ ID NO: 203977 - DNA, 16 bp, P. troglodytes
agccactaaccacatg

SEQ ID NO: 203978 - DNA, 16 bp, P. troglodytes
agccactacgcccagc

SEQ ID NO: 203979 - DNA, 16 bp, P. troglodytes
agccactaggcctggc

SEQ ID NO: 203980 - DNA, 18 bp, P. troglodytes
agccactgagcccagccc

SEQ ID NO: 203981 - DNA, 16 bp, P. troglodytes
agccactgagcccagt

SEQ ID NO: 203982 - DNA, 16 bp, P. troglodytes
agccactgcaaaaaca

SEQ ID NO: 203983 - DNA, 16 bp, P. troglodytes
agccactgcacccagc

SEQ ID NO: 203984 - DNA, 18 bp, P. troglodytes
agccactgcacctggcca

SEQ ID NO: 203985 - DNA, 18 bp, P. troglodytes
agccactgcacctggcct

SEQ ID NO: 203986 - DNA, 16 bp, P. troglodytes
agccactgcagccagc

SEQ ID NO: 203987 - DNA, 16 bp, P. troglodytes
agccactgccccaggc

SEQ ID NO: 203988 - DNA, 16 bp, P. troglodytes
agccactgcccccagc

SEQ ID NO: 203989 - DNA, 16 bp, P. troglodytes
agccactgccctggcc

SEQ ID NO: 203990 - DNA, 16 bp, P. troglodytes
agccactgcctggcca

SEQ ID NO: 203991 - DNA, 19 bp, P. troglodytes
agccactgcgcccagcctc

SEQ ID NO: 203992 - DNA, 19 bp, P. troglodytes
agccactgcgcccggcctt

SEQ ID NO: 203993 - DNA, 16 bp, P. troglodytes
agccactgcgccctgg

SEQ ID NO: 203994 - DNA, 17 bp, P. troglodytes
agccactgcgcctggca

SEQ ID NO: 203995 - DNA, 16 bp, P. troglodytes
agccactgctcccagc

SEQ ID NO: 203996 - DNA, 16 bp, P. troglodytes
agccactgctcccagt

SEQ ID NO: 203997 - DNA, 16 bp, P. troglodytes
agccactgctcccggc

SEQ ID NO: 203998 - DNA, 16 bp, P. troglodytes
agccactggcctggcc

SEQ ID NO: 203999 - DNA, 16 bp, P. troglodytes
agccactgggccaggc

SEQ ID NO: 204000 - DNA, 16 bp, P. troglodytes
agccactgtacccgac

SEQ ID NO: 204001 - DNA, 16 bp, P. troglodytes
agccactgtcatctct

SEQ ID NO: 204002 - DNA, 16 bp, P. troglodytes
agccactgtgcacagc

SEQ ID NO: 204003 - DNA, 16 bp, P. troglodytes
agccactgtgccagcc

SEQ ID NO: 204004 - DNA, 18 bp, P. troglodytes
agccactgtgcccagcca

SEQ ID NO: 204005 - DNA, 16 bp, P. troglodytes
agccactgtgcccagt

SEQ ID NO: 204006 - DNA, 16 bp, P. troglodytes
agccactgtgccctgg

SEQ ID NO: 204007 - DNA, 16 bp, P. troglodytes
agccactgtgccctgt

SEQ ID NO: 204008 - DNA, 17 bp, P. troglodytes
agccactgtgcctggcc

SEQ ID NO: 204009 - DNA, 16 bp, P. troglodytes
agccacttcacccggc

SEQ ID NO: 204010 - DNA, 16 bp, P. troglodytes
agccacttgagaggct

SEQ ID NO: 204011 - DNA, 16 bp, P. troglodytes
agccactttggaaaag

SEQ ID NO: 204012 - DNA, 16 bp, P. troglodytes
agccactttgttttgg

SEQ ID NO: 204013 - DNA, 16 bp, P. troglodytes
agccacttttcccagc

SEQ ID NO: 204014 - DNA, 16 bp, P. troglodytes
agccactttttttttt

SEQ ID NO: 204015 - DNA, 16 bp, P. troglodytes
agccagaaacctggga

SEQ ID NO: 204016 - DNA, 16 bp, P. troglodytes
agccagaagaacaaag

SEQ ID NO: 204017 - DNA, 16 bp, P. troglodytes
agccagaagacagtgg

SEQ ID NO: 204018 - DNA, 16 bp, P. troglodytes
agccagaagttcgaga

SEQ ID NO: 204019 - DNA, 16 bp, P. troglodytes
agccagacaaaggcat

SEQ ID NO: 204020 - DNA, 16 bp, P. troglodytes
agccagacactgtctc

SEQ ID NO: 204021 - DNA, 16 bp, P. troglodytes
agccagacatggtgat

SEQ ID NO: 204022 - DNA, 16 bp, P. troglodytes
agccagaccctgactc

SEQ ID NO: 204023 - DNA, 16 bp, P. troglodytes
agccagaccttgtctc

SEQ ID NO: 204024 - DNA, 18 bp, P. troglodytes
agccagacgtggtggcac

SEQ ID NO: 204025 - DNA, 16 bp, P. troglodytes
agccagactccgcctc

SEQ ID NO: 204026 - DNA, 16 bp, P. troglodytes
agccagactgcctggg

SEQ ID NO: 204027 - DNA, 16 bp, P. troglodytes
agccagacttggtggt

SEQ ID NO: 204028 - DNA, 16 bp, P. troglodytes
agccagagaaaaaggt

SEQ ID NO: 204029 - DNA, 16 bp, P. troglodytes
agccagagaagtgaca

SEQ ID NO: 204030 - DNA, 16 bp, P. troglodytes
agccagagagaaagac

SEQ ID NO: 204031 - DNA, 16 bp, P. troglodytes
agccagagagaaagct

SEQ ID NO: 204032 - DNA, 16 bp, P. troglodytes
agccagagagaaagtt

SEQ ID NO: 204033 - DNA, 16 bp, P. troglodytes
agccagagagaaatgt

SEQ ID NO: 204034 - DNA, 16 bp, P. troglodytes
agccagagcaacatgg

SEQ ID NO: 204035 - DNA, 16 bp, P. troglodytes
agccagaggcaggagg

SEQ ID NO: 204036 - DNA, 16 bp, P. troglodytes
agccagagggaccagg

SEQ ID NO: 204037 - DNA, 16 bp, P. troglodytes
agccagagggatcttt

SEQ ID NO: 204038 - DNA, 16 bp, P. troglodytes
agccagatgcagtggc

SEQ ID NO: 204039 - DNA, 16 bp, P. troglodytes
agccagatgtggtagt

SEQ ID NO: 204040 - DNA, 16 bp, P. troglodytes
agccagatgtggtggc

SEQ ID NO: 204041 - DNA, 16 bp, P. troglodytes
agccagcaaaggagac

SEQ ID NO: 204042 - DNA, 16 bp, P. troglodytes
agccagcaaggaactg

SEQ ID NO: 204043 - DNA, 16 bp, P. troglodytes
agccagcaaggccagt

SEQ ID NO: 204044 - DNA, 16 bp, P. troglodytes
agccagcaatggcaac

SEQ ID NO: 204045 - DNA, 16 bp, P. troglodytes
agccagcagcagcaac

SEQ ID NO: 204046 - DNA, 16 bp, P. troglodytes
agccagcaggcaggga

SEQ ID NO: 204047 - DNA, 16 bp, P. troglodytes
agccagcatcaccctg

SEQ ID NO: 204048 - DNA, 16 bp, P. troglodytes
agccagcattggcaac

SEQ ID NO: 204049 - DNA, 16 bp, P. troglodytes
agccagccacaaaaga

SEQ ID NO: 204050 - DNA, 16 bp, P. troglodytes
agccagccagccagcc

SEQ ID NO: 204051 - DNA, 16 bp, P. troglodytes
agccagccagccctgc

SEQ ID NO: 204052 - DNA, 16 bp, P. troglodytes
agccagcccagagagg

SEQ ID NO: 204053 - DNA, 16 bp, P. troglodytes
agccagctccagcctc

SEQ ID NO: 204054 - DNA, 16 bp, P. troglodytes
agccagctgggcttct

SEQ ID NO: 204055 - DNA, 16 bp, P. troglodytes
agccaggaccacaggc

SEQ ID NO: 204056 - DNA, 16 bp, P. troglodytes
agccaggagcagtggc

SEQ ID NO: 204057 - DNA, 16 bp, P. troglodytes
agccaggagcccagcc

SEQ ID NO: 204058 - DNA, 16 bp, P. troglodytes
agccaggaggattgct

SEQ ID NO: 204059 - DNA, 16 bp, P. troglodytes
agccaggaggcagaag

SEQ ID NO: 204060 - DNA, 16 bp, P. troglodytes
agccaggatgggctca

SEQ ID NO: 204061 - DNA, 16 bp, P. troglodytes
agccaggattagaacc

SEQ ID NO: 204062 - DNA, 16 bp, P. troglodytes
agccaggattcaaatt

SEQ ID NO: 204063 - DNA, 16 bp, P. troglodytes
agccaggatttaaacc

SEQ ID NO: 204064 - DNA, 16 bp, P. troglodytes
agccaggcacagaagg

SEQ ID NO: 204065 - DNA, 16 bp, P. troglodytes
agccaggcacagtggc

SEQ ID NO: 204066 - DNA, 16 bp, P. troglodytes
agccaggcaccctttt

SEQ ID NO: 204067 - DNA, 16 bp, P. troglodytes
agccaggcacggtggt

SEQ ID NO: 204068 - DNA, 16 bp, P. troglodytes
agccaggcactgtgct

SEQ ID NO: 204069 - DNA, 16 bp, P. troglodytes
agccaggcagcctggg

SEQ ID NO: 204070 - DNA, 16 bp, P. troglodytes
agccaggcatagtagc

SEQ ID NO: 204071 - DNA, 16 bp, P. troglodytes
agccaggcatggagca

SEQ ID NO: 204072 - DNA, 16 bp, P. troglodytes
agccaggcatgggggc

SEQ ID NO: 204073 - DNA, 16 bp, P. troglodytes
agccaggcccagaaag

SEQ ID NO: 204074 - DNA, 16 bp, P. troglodytes
agccaggcctggtgac

SEQ ID NO: 204075 - DNA, 16 bp, P. troglodytes
agccaggcctggtggc

SEQ ID NO: 204076 - DNA, 17 bp, P. troglodytes
agccaggcctggtggta

SEQ ID NO: 204077 - DNA, 16 bp, P. troglodytes
agccaggcgtggtgca

SEQ ID NO: 204078 - DNA, 16 bp, P. troglodytes
agccaggcgtggtgcc

SEQ ID NO: 204079 - DNA, 19 bp, P. troglodytes
agccaggcgtggtggtgcg

SEQ ID NO: 204080 - DNA, 16 bp, P. troglodytes
agccaggctggtctgg

SEQ ID NO: 204081 - DNA, 16 bp, P. troglodytes
agccaggctgtggtgg

SEQ ID NO: 204082 - DNA, 16 bp, P. troglodytes
agccagggacagcctg

SEQ ID NO: 204083 - DNA, 16 bp, P. troglodytes
agccagggagattgag

SEQ ID NO: 204084 - DNA, 16 bp, P. troglodytes
agccagggagggcctg

SEQ ID NO: 204085 - DNA, 16 bp, P. troglodytes
agccagggatgctgct

SEQ ID NO: 204086 - DNA, 16 bp, P. troglodytes
agccagggcaacatag

SEQ ID NO: 204087 - DNA, 16 bp, P. troglodytes
agccagggccacagag

SEQ ID NO: 204088 - DNA, 16 bp, P. troglodytes
agccagggcgtggtgg

SEQ ID NO: 204089 - DNA, 16 bp, P. troglodytes
agccaggggctcaggg

SEQ ID NO: 204090 - DNA, 17 bp, P. troglodytes
agccaggtgcggtggct

SEQ ID NO: 204091 - DNA, 16 bp, P. troglodytes
agccaggtggatcact

SEQ ID NO: 204092 - DNA, 16 bp, P. troglodytes
agccaggtgtcatggt

SEQ ID NO: 204093 - DNA, 16 bp, P. troglodytes
agccaggtgtggcagt

SEQ ID NO: 204094 - DNA, 16 bp, P. troglodytes
agccaggtgtggctgg

SEQ ID NO: 204095 - DNA, 16 bp, P. troglodytes
agccaggtgtgttggt

SEQ ID NO: 204096 - DNA, 16 bp, P. troglodytes
agccaggtgttcaaga

SEQ ID NO: 204097 - DNA, 16 bp, P. troglodytes
agccaggttcagtggc

SEQ ID NO: 204098 - DNA, 16 bp, P. troglodytes
agccagtatcactcta

SEQ ID NO: 204099 - DNA, 16 bp, P. troglodytes
agccagtctcaaaaaa

SEQ ID NO: 204100 - DNA, 16 bp, P. troglodytes
agccagtcttcaagct

SEQ ID NO: 204101 - DNA, 16 bp, P. troglodytes
agccagtcttcccagc

SEQ ID NO: 204102 - DNA, 16 bp, P. troglodytes
agccagtgtgtgcaga

SEQ ID NO: 204103 - DNA, 16 bp, P. troglodytes
agccagttttttgaaa

SEQ ID NO: 204104 - DNA, 16 bp, P. troglodytes
agccataaaaaagaag

SEQ ID NO: 204105 - DNA, 17 bp, P. troglodytes
agccataaaaaagggtg

SEQ ID NO: 204106 - DNA, 16 bp, P. troglodytes
agccataaaaaggaaa

SEQ ID NO: 204107 - DNA, 16 bp, P. troglodytes
agccataaaaggaaat

SEQ ID NO: 204108 - DNA, 16 bp, P. troglodytes
agccataagaagaaat

SEQ ID NO: 204109 - DNA, 16 bp, P. troglodytes
agccataatcacgcca

SEQ ID NO: 204110 - DNA, 16 bp, P. troglodytes
agccataatcctcctg

SEQ ID NO: 204111 - DNA, 16 bp, P. troglodytes
agccatagaaaagaat

SEQ ID NO: 204112 - DNA, 16 bp, P. troglodytes
agccatagcgcccagc

SEQ ID NO: 204113 - DNA, 16 bp, P. troglodytes
agccatcacacctggc

SEQ ID NO: 204114 - DNA, 16 bp, P. troglodytes
agccatcatgcccagc

SEQ ID NO: 204115 - DNA, 23 bp, P. troglodytes
agccatcccattactgggtatat

SEQ ID NO: 204116 - DNA, 16 bp, P. troglodytes
agccatccccactgcc

SEQ ID NO: 204117 - DNA, 16 bp, P. troglodytes
agccatcctcctgccc

SEQ ID NO: 204118 - DNA, 16 bp, P. troglodytes
agccatcgcacccagc

SEQ ID NO: 204119 - DNA, 17 bp, P. troglodytes
agccatcgcactccagc

SEQ ID NO: 204120 - DNA, 16 bp, P. troglodytes
agccatctataacaaa

SEQ ID NO: 204121 - DNA, 16 bp, P. troglodytes
agccatcttggaagca

SEQ ID NO: 204122 - DNA, 16 bp, P. troglodytes
agccatgactggagct

SEQ ID NO: 204123 - DNA, 16 bp, P. troglodytes
agccatgagcatgcca

SEQ ID NO: 204124 - DNA, 16 bp, P. troglodytes
agccatgatcacacca

SEQ ID NO: 204125 - DNA, 16 bp, P. troglodytes
agccatgatcatacca

SEQ ID NO: 204126 - DNA, 16 bp, P. troglodytes
agccatgatggtgcca

SEQ ID NO: 204127 - DNA, 16 bp, P. troglodytes
agccatgctgaattgt

SEQ ID NO: 204128 - DNA, 16 bp, P. troglodytes
agccatggcagaagaa

SEQ ID NO: 204129 - DNA, 16 bp, P. troglodytes
agccatggctcactgc

SEQ ID NO: 204130 - DNA, 16 bp, P. troglodytes
agccatggctgggcag

SEQ ID NO: 204131 - DNA, 16 bp, P. troglodytes
agccatggtgcctggc

SEQ ID NO: 204132 - DNA, 16 bp, P. troglodytes
agccatgtgactttgg

SEQ ID NO: 204133 - DNA, 16 bp, P. troglodytes
agccatgtggaactgt

SEQ ID NO: 204134 - DNA, 16 bp, P. troglodytes
agccatgtggaattgt

SEQ ID NO: 204135 - DNA, 16 bp, P. troglodytes
agccattaaaaggaaa

SEQ ID NO: 204136 - DNA, 16 bp, P. troglodytes
agccattacataatgg

SEQ ID NO: 204137 - DNA, 16 bp, P. troglodytes
agccattatgcccagc

SEQ ID NO: 204138 - DNA, 16 bp, P. troglodytes
agccattgaagagttt

SEQ ID NO: 204139 - DNA, 17 bp, P. troglodytes
agccattgacttggcaa

SEQ ID NO: 204140 - DNA, 16 bp, P. troglodytes
agccattgcacccagt

SEQ ID NO: 204141 - DNA, 16 bp, P. troglodytes
agccatttgtagaaag

SEQ ID NO: 204142 - DNA, 16 bp, P. troglodytes
agccatttttaaatgt

SEQ ID NO: 204143 - DNA, 16 bp, P. troglodytes
agcccaaaatatttac

SEQ ID NO: 204144 - DNA, 16 bp, P. troglodytes
agcccaaagtgagaac

SEQ ID NO: 204145 - DNA, 16 bp, P. troglodytes
agcccaaatagccaag

SEQ ID NO: 204146 - DNA, 16 bp, P. troglodytes
agcccaacctggccaa

SEQ ID NO: 204147 - DNA, 16 bp, P. troglodytes
agcccaagaggtcaag

SEQ ID NO: 204148 - DNA, 16 bp, P. troglodytes
agcccaagagttcaag

SEQ ID NO: 204149 - DNA, 16 bp, P. troglodytes
agcccaagctctacat

SEQ ID NO: 204150 - DNA, 16 bp, P. troglodytes
agcccaagctgtacat

SEQ ID NO: 204151 - DNA, 16 bp, P. troglodytes
agcccaaggagggtga

SEQ ID NO: 204152 - DNA, 16 bp, P. troglodytes
agcccacagctctcaa

SEQ ID NO: 204153 - DNA, 16 bp, P. troglodytes
agcccaccctactcca

SEQ ID NO: 204154 - DNA, 16 bp, P. troglodytes
agcccacctcttgcat

SEQ ID NO: 204155 - DNA, 16 bp, P. troglodytes
agcccacgttgccaag

SEQ ID NO: 204156 - DNA, 16 bp, P. troglodytes
agcccactgattcaaa

SEQ ID NO: 204157 - DNA, 16 bp, P. troglodytes
agcccactgccacact

SEQ ID NO: 204158 - DNA, 16 bp, P. troglodytes
agcccactgccctgaa

SEQ ID NO: 204159 - DNA, 16 bp, P. troglodytes
agcccagaaatttgag

SEQ ID NO: 204160 - DNA, 16 bp, P. troglodytes
agcccagaagacagag

SEQ ID NO: 204161 - DNA, 16 bp, P. troglodytes
agcccagaaggcggag

SEQ ID NO: 204162 - DNA, 16 bp, P. troglodytes
agcccagaaggtcgag

SEQ ID NO: 204163 - DNA, 16 bp, P. troglodytes
agcccagaagttccag

SEQ ID NO: 204164 - DNA, 17 bp, P. troglodytes
agcccagaagtttgagg

SEQ ID NO: 204165 - DNA, 16 bp, P. troglodytes
agcccagagccggggc

SEQ ID NO: 204166 - DNA, 16 bp, P. troglodytes
agcccagagcctggca

SEQ ID NO: 204167 - DNA, 16 bp, P. troglodytes
agcccagcagttggag

SEQ ID NO: 204168 - DNA, 16 bp, P. troglodytes
agcccagcccaaattg

SEQ ID NO: 204169 - DNA, 16 bp, P. troglodytes
agcccagccctgaccc

SEQ ID NO: 204170 - DNA, 16 bp, P. troglodytes
agcccagcctcctcct

SEQ ID NO: 204171 - DNA, 16 bp, P. troglodytes
agcccagctctgtccc

SEQ ID NO: 204172 - DNA, 18 bp, P. troglodytes
agcccagctggcttcacc

SEQ ID NO: 204173 - DNA, 16 bp, P. troglodytes
agcccaggaaatggag

SEQ ID NO: 204174 - DNA, 16 bp, P. troglodytes
agcccaggaatccaag

SEQ ID NO: 204175 - DNA, 16 bp, P. troglodytes
agcccaggaattcaag

SEQ ID NO: 204176 - DNA, 17 bp, P. troglodytes
agcccaggaatttgagg

SEQ ID NO: 204177 - DNA, 16 bp, P. troglodytes
agcccaggagactgag

SEQ ID NO: 204178 - DNA, 16 bp, P. troglodytes
agcccaggagatagag

SEQ ID NO: 204179 - DNA, 16 bp, P. troglodytes
agcccaggagatggag

SEQ ID NO: 204180 - DNA, 16 bp, P. troglodytes
agcccaggagctccag

SEQ ID NO: 204181 - DNA, 16 bp, P. troglodytes
agcccaggagctggag

SEQ ID NO: 204182 - DNA, 16 bp, P. troglodytes
agcccaggaggaagag

SEQ ID NO: 204183 - DNA, 16 bp, P. troglodytes
agcccaggaggcagtg

SEQ ID NO: 204184 - DNA, 16 bp, P. troglodytes
agcccaggaggtagaa

SEQ ID NO: 204185 - DNA, 16 bp, P. troglodytes
agcccaggaggtcaat

SEQ ID NO: 204186 - DNA, 16 bp, P. troglodytes
agcccaggagtccagg

SEQ ID NO: 204187 - DNA, 16 bp, P. troglodytes
agcccaggagttaaag

SEQ ID NO: 204188 - DNA, 16 bp, P. troglodytes
agcccaggagttagaa

SEQ ID NO: 204189 - DNA, 16 bp, P. troglodytes
agcccaggagttcaag

SEQ ID NO: 204190 - DNA, 16 bp, P. troglodytes
agcccaggccacatgg

SEQ ID NO: 204191 - DNA, 16 bp, P. troglodytes
agcccagggaggtcga

SEQ ID NO: 204192 - DNA, 16 bp, P. troglodytes
agcccagggccaggca

SEQ ID NO: 204193 - DNA, 16 bp, P. troglodytes
agcccaggtggtcaag

SEQ ID NO: 204194 - DNA, 16 bp, P. troglodytes
agcccaggtgttcaag

SEQ ID NO: 204195 - DNA, 16 bp, P. troglodytes
agcccaggtgtttgaa

SEQ ID NO: 204196 - DNA, 16 bp, P. troglodytes
agcccaggttggagtg

SEQ ID NO: 204197 - DNA, 16 bp, P. troglodytes
agcccagtagttggag

SEQ ID NO: 204198 - DNA, 16 bp, P. troglodytes
agcccatgagttggag

SEQ ID NO: 204199 - DNA, 16 bp, P. troglodytes
agcccatggagcaggg

SEQ ID NO: 204200 - DNA, 16 bp, P. troglodytes
agcccattttctgggg

SEQ ID NO: 204201 - DNA, 16 bp, P. troglodytes
agccccaaaactgggg

SEQ ID NO: 204202 - DNA, 16 bp, P. troglodytes
agccccaaaccttggt

SEQ ID NO: 204203 - DNA, 16 bp, P. troglodytes
agccccaaactggaaa

SEQ ID NO: 204204 - DNA, 17 bp, P. troglodytes
agccccacagggtcggt

SEQ ID NO: 204205 - DNA, 16 bp, P. troglodytes
agccccacctctggag

SEQ ID NO: 204206 - DNA, 16 bp, P. troglodytes
agccccagccccagct

SEQ ID NO: 204207 - DNA, 16 bp, P. troglodytes
agccccagcctcagcc

SEQ ID NO: 204208 - DNA, 16 bp, P. troglodytes
agccccagcctcctgg

SEQ ID NO: 204209 - DNA, 16 bp, P. troglodytes
agccccagctgctcag

SEQ ID NO: 204210 - DNA, 16 bp, P. troglodytes
agccccagctgtgcct

SEQ ID NO: 204211 - DNA, 16 bp, P. troglodytes
agccccaggaggtgga

SEQ ID NO: 204212 - DNA, 16 bp, P. troglodytes
agccccaggccttggc

SEQ ID NO: 204213 - DNA, 16 bp, P. troglodytes
agccccaggctccagg

SEQ ID NO: 204214 - DNA, 16 bp, P. troglodytes
agccccaggctttgga

SEQ ID NO: 204215 - DNA, 18 bp, P. troglodytes
agccccagtcaggggctt

SEQ ID NO: 204216 - DNA, 16 bp, P. troglodytes
agccccagttcccacc

SEQ ID NO: 204217 - DNA, 16 bp, P. troglodytes
agccccagttgcccac

SEQ ID NO: 204218 - DNA, 16 bp, P. troglodytes
agccccatcccagacc

SEQ ID NO: 204219 - DNA, 16 bp, P. troglodytes
agccccatgagggcag

SEQ ID NO: 204220 - DNA, 16 bp, P. troglodytes
agcccccaaagtgctg

SEQ ID NO: 204221 - DNA, 16 bp, P. troglodytes
agcccccagccctgcc

SEQ ID NO: 204222 - DNA, 16 bp, P. troglodytes
agcccccatgcccagc

SEQ ID NO: 204223 - DNA, 16 bp, P. troglodytes
agccccctgaggactg

SEQ ID NO: 204224 - DNA, 16 bp, P. troglodytes
agccccctgcccggcc

SEQ ID NO: 204225 - DNA, 16 bp, P. troglodytes
agccccctgcctgcca

SEQ ID NO: 204226 - DNA, 16 bp, P. troglodytes
agccccctgcctggcc

SEQ ID NO: 204227 - DNA, 16 bp, P. troglodytes
agcccccttttcaggg

SEQ ID NO: 204228 - DNA, 16 bp, P. troglodytes
agccccggaggcagag

SEQ ID NO: 204229 - DNA, 16 bp, P. troglodytes
agcccctactgctgtg

SEQ ID NO: 204230 - DNA, 16 bp, P. troglodytes
agcccctcccaccaca

SEQ ID NO: 204231 - DNA, 16 bp, P. troglodytes
agcccctcccatcaca

SEQ ID NO: 204232 - DNA, 16 bp, P. troglodytes
agcccctcctatcaca

SEQ ID NO: 204233 - DNA, 16 bp, P. troglodytes
agcccctctgcccagc

SEQ ID NO: 204234 - DNA, 16 bp, P. troglodytes
agcccctgaaggaagc

SEQ ID NO: 204235 - DNA, 16 bp, P. troglodytes
agcccctgactgaggc

SEQ ID NO: 204236 - DNA, 16 bp, P. troglodytes
agcccctgagtagctg

SEQ ID NO: 204237 - DNA, 16 bp, P. troglodytes
agcccctgccccagcc

SEQ ID NO: 204238 - DNA, 16 bp, P. troglodytes
agcccctggaaaacca

SEQ ID NO: 204239 - DNA, 16 bp, P. troglodytes
agcccctggcaaccac

SEQ ID NO: 204240 - DNA, 16 bp, P. troglodytes
agcccctggcagccac

SEQ ID NO: 204241 - DNA, 16 bp, P. troglodytes
agccccttcctcctcc

SEQ ID NO: 204242 - DNA, 16 bp, P. troglodytes
agcccgaggcgggtgg

SEQ ID NO: 204243 - DNA, 17 bp, P. troglodytes
agcccggctaatttttt

SEQ ID NO: 204244 - DNA, 16 bp, P. troglodytes
agcccgggagatggag

SEQ ID NO: 204245 - DNA, 16 bp, P. troglodytes
agcccgggaggcagaa

SEQ ID NO: 204246 - DNA, 16 bp, P. troglodytes
agcccgggaggcggag

SEQ ID NO: 204247 - DNA, 16 bp, P. troglodytes
agcccgggaggtcgag

SEQ ID NO: 204248 - DNA, 16 bp, P. troglodytes
agcccgggagttccag

SEQ ID NO: 204249 - DNA, 16 bp, P. troglodytes
agcccgggcaacaaga

SEQ ID NO: 204250 - DNA, 17 bp, P. troglodytes
agcccgggcaacagagt

SEQ ID NO: 204251 - DNA, 17 bp, P. troglodytes
agcccggttcctaacag

SEQ ID NO: 204252 - DNA, 16 bp, P. troglodytes
agccctaatccaatat

SEQ ID NO: 204253 - DNA, 16 bp, P. troglodytes
agccctaggcagccac

SEQ ID NO: 204254 - DNA, 16 bp, P. troglodytes
agccctattttacaga

SEQ ID NO: 204255 - DNA, 16 bp, P. troglodytes
agccctcaaaccccac

SEQ ID NO: 204256 - DNA, 16 bp, P. troglodytes
agccctcaacctgtgg

SEQ ID NO: 204257 - DNA, 16 bp, P. troglodytes
agccctcagaaacaac

SEQ ID NO: 204258 - DNA, 16 bp, P. troglodytes
agccctcatcagaaac

SEQ ID NO: 204259 - DNA, 16 bp, P. troglodytes
agccctcatcctgaag

SEQ ID NO: 204260 - DNA, 16 bp, P. troglodytes
agccctcctcctcctc

SEQ ID NO: 204261 - DNA, 16 bp, P. troglodytes
agccctcgctcgctct

SEQ ID NO: 204262 - DNA, 16 bp, P. troglodytes
agccctcgcttgctct

SEQ ID NO: 204263 - DNA, 16 bp, P. troglodytes
agccctctgcctccct

SEQ ID NO: 204264 - DNA, 16 bp, P. troglodytes
agccctcttctcacag

SEQ ID NO: 204265 - DNA, 16 bp, P. troglodytes
agccctcttgcctgcc

SEQ ID NO: 204266 - DNA, 16 bp, P. troglodytes
agccctctttccaggg

SEQ ID NO: 204267 - DNA, 16 bp, P. troglodytes
agccctgagaaacatt

SEQ ID NO: 204268 - DNA, 16 bp, P. troglodytes
agccctgaggctacct

SEQ ID NO: 204269 - DNA, 16 bp, P. troglodytes
agccctgcactccagc

SEQ ID NO: 204270 - DNA, 16 bp, P. troglodytes
agccctgccaacacct

SEQ ID NO: 204271 - DNA, 16 bp, P. troglodytes
agccctgccctcaggg

SEQ ID NO: 204272 - DNA, 16 bp, P. troglodytes
agccctgccctcatgg

SEQ ID NO: 204273 - DNA, 16 bp, P. troglodytes
agccctggaagacaac

SEQ ID NO: 204274 - DNA, 16 bp, P. troglodytes
agccctggaccagatg

SEQ ID NO: 204275 - DNA, 16 bp, P. troglodytes
agccctggaggaggag

SEQ ID NO: 204276 - DNA, 16 bp, P. troglodytes
agccctggcaaactaa

SEQ ID NO: 204277 - DNA, 16 bp, P. troglodytes
agccctggccagaact

SEQ ID NO: 204278 - DNA, 16 bp, P. troglodytes
agccctggccctggcc

SEQ ID NO: 204279 - DNA, 16 bp, P. troglodytes
agccctggctctgcca

SEQ ID NO: 204280 - DNA, 16 bp, P. troglodytes
agccctgggctgggag

SEQ ID NO: 204281 - DNA, 16 bp, P. troglodytes
agccctggtttctttt

SEQ ID NO: 204282 - DNA, 16 bp, P. troglodytes
agccctgtggacacct

SEQ ID NO: 204283 - DNA, 18 bp, P. troglodytes
agcccttaaaagggacag

SEQ ID NO: 204284 - DNA, 16 bp, P. troglodytes
agcccttaacatatta

SEQ ID NO: 204285 - DNA, 16 bp, P. troglodytes
agccctttgggaggcc

SEQ ID NO: 204286 - DNA, 16 bp, P. troglodytes
agccgagaccgcgcca

SEQ ID NO: 204287 - DNA, 16 bp, P. troglodytes
agccgagatcatgcta

SEQ ID NO: 204288 - DNA, 16 bp, P. troglodytes
agccgagatcgcgcta

SEQ ID NO: 204289 - DNA, 18 bp, P. troglodytes
agccgagatcgggccact

SEQ ID NO: 204290 - DNA, 16 bp, P. troglodytes
agccgagatggagcca

SEQ ID NO: 204291 - DNA, 16 bp, P. troglodytes
agccgaggcgggtgga

SEQ ID NO: 204292 - DNA, 16 bp, P. troglodytes
agccgaggtgggagga

SEQ ID NO: 204293 - DNA, 17 bp, P. troglodytes
agccgaggtgggcagat

SEQ ID NO: 204294 - DNA, 16 bp, P. troglodytes
agccggatgcggtggc

SEQ ID NO: 204295 - DNA, 16 bp, P. troglodytes
agccggccgtggtggc

SEQ ID NO: 204296 - DNA, 16 bp, P. troglodytes
agccgggactgcaggc

SEQ ID NO: 204297 - DNA, 16 bp, P. troglodytes
agccgggaggcagagg

SEQ ID NO: 204298 - DNA, 16 bp, P. troglodytes
agccgggagttcaaga

SEQ ID NO: 204299 - DNA, 16 bp, P. troglodytes
agccgggcacagtggc

SEQ ID NO: 204300 - DNA, 16 bp, P. troglodytes
agccgggcacggcggc

SEQ ID NO: 204301 - DNA, 16 bp, P. troglodytes
agccgggcacggtggc

SEQ ID NO: 204302 - DNA, 16 bp, P. troglodytes
agccgggcatggcagc

SEQ ID NO: 204303 - DNA, 16 bp, P. troglodytes
agccgggcatggtgga

SEQ ID NO: 204304 - DNA, 16 bp, P. troglodytes
agccgggcccggtggc

SEQ ID NO: 204305 - DNA, 16 bp, P. troglodytes
agccgggcgtggaggc

SEQ ID NO: 204306 - DNA, 16 bp, P. troglodytes
agccgggcgtggtgac

SEQ ID NO: 204307 - DNA, 16 bp, P. troglodytes
agccgggcttggtgac

SEQ ID NO: 204308 - DNA, 16 bp, P. troglodytes
agccggggatggtggt

SEQ ID NO: 204309 - DNA, 16 bp, P. troglodytes
agccgggtgcaatggc

SEQ ID NO: 204310 - DNA, 16 bp, P. troglodytes
agccgggtgcagtggc

SEQ ID NO: 204311 - DNA, 16 bp, P. troglodytes
agccgggtgtggtggc

SEQ ID NO: 204312 - DNA, 16 bp, P. troglodytes
agccggtcatggtggc

SEQ ID NO: 204313 - DNA, 18 bp, P. troglodytes
agccggtcatggtggtgg

SEQ ID NO: 204314 - DNA, 16 bp, P. troglodytes
agccggttgtggtggc

SEQ ID NO: 204315 - DNA, 16 bp, P. troglodytes
agccgtgattgtgcca

SEQ ID NO: 204316 - DNA, 16 bp, P. troglodytes
agcctaaaatattgac

SEQ ID NO: 204317 - DNA, 17 bp, P. troglodytes
agcctaactgggaggca

SEQ ID NO: 204318 - DNA, 16 bp, P. troglodytes
agcctaataaagaaga

SEQ ID NO: 204319 - DNA, 16 bp, P. troglodytes
agcctaatgagtagct

SEQ ID NO: 204320 - DNA, 16 bp, P. troglodytes
agcctacagtgagctg

SEQ ID NO: 204321 - DNA, 17 bp, P. troglodytes
agcctaccaaccaaaaa

SEQ ID NO: 204322 - DNA, 16 bp, P. troglodytes
agcctaccaaccagaa

SEQ ID NO: 204323 - DNA, 16 bp, P. troglodytes
agcctaccaggtagct

SEQ ID NO: 204324 - DNA, 16 bp, P. troglodytes
agcctactacacacct

SEQ ID NO: 204325 - DNA, 16 bp, P. troglodytes
agcctagagaaaagag

SEQ ID NO: 204326 - DNA, 16 bp, P. troglodytes
agcctagatcacgcca

SEQ ID NO: 204327 - DNA, 17 bp, P. troglodytes
agcctaggcaacacagt

SEQ ID NO: 204328 - DNA, 16 bp, P. troglodytes
agcctataatcccagc

SEQ ID NO: 204329 - DNA, 16 bp, P. troglodytes
agcctcaaaagtagct

SEQ ID NO: 204330 - DNA, 16 bp, P. troglodytes
agcctcaacctctagg

SEQ ID NO: 204331 - DNA, 16 bp, P. troglodytes
agcctcaaccttctgg

SEQ ID NO: 204332 - DNA, 16 bp, P. troglodytes
agcctcaacttctcag

SEQ ID NO: 204333 - DNA, 16 bp, P. troglodytes
agcctcacagtcatgg

SEQ ID NO: 204334 - DNA, 16 bp, P. troglodytes
agcctcactgccacct

SEQ ID NO: 204335 - DNA, 16 bp, P. troglodytes
agcctcagaggcagag

SEQ ID NO: 204336 - DNA, 17 bp, P. troglodytes
agcctcagcaatggcgg

SEQ ID NO: 204337 - DNA, 16 bp, P. troglodytes
agcctcagcctccaaa

SEQ ID NO: 204338 - DNA, 16 bp, P. troglodytes
agcctcagcctcctga

SEQ ID NO: 204339 - DNA, 16 bp, P. troglodytes
agcctcagccttctgg

SEQ ID NO: 204340 - DNA, 16 bp, P. troglodytes
agcctcaggaagcttc

SEQ ID NO: 204341 - DNA, 16 bp, P. troglodytes
agcctcaggagccaat

SEQ ID NO: 204342 - DNA, 24 bp, P. troglodytes
agcctcaggagccgatgtgatcaa

SEQ ID NO: 204343 - DNA, 16 bp, P. troglodytes
agcctcaggaggtcct

SEQ ID NO: 204344 - DNA, 16 bp, P. troglodytes
agcctcagtcttccca

SEQ ID NO: 204345 - DNA, 16 bp, P. troglodytes
agcctcagtgtcctca

SEQ ID NO: 204346 - DNA, 16 bp, P. troglodytes
agcctcagtttcccca

SEQ ID NO: 204347 - DNA, 16 bp, P. troglodytes
agcctcagttttctca

SEQ ID NO: 204348 - DNA, 16 bp, P. troglodytes
agcctcagtttttcca

SEQ ID NO: 204349 - DNA, 16 bp, P. troglodytes
agcctcatcaacatgg

SEQ ID NO: 204350 - DNA, 16 bp, P. troglodytes
agcctcattttatttt

SEQ ID NO: 204351 - DNA, 16 bp, P. troglodytes
agcctcattttcctag

SEQ ID NO: 204352 - DNA, 16 bp, P. troglodytes
agcctccaactccagg

SEQ ID NO: 204353 - DNA, 16 bp, P. troglodytes
agcctccaattcctgg

SEQ ID NO: 204354 - DNA, 16 bp, P. troglodytes
agcctccacctcccaa

SEQ ID NO: 204355 - DNA, 16 bp, P. troglodytes
agcctccacctctggg

SEQ ID NO: 204356 - DNA, 16 bp, P. troglodytes
agcctccagaagaaac

SEQ ID NO: 204357 - DNA, 16 bp, P. troglodytes
agcctccagaatagct

SEQ ID NO: 204358 - DNA, 16 bp, P. troglodytes
agcctccagaatcaca

SEQ ID NO: 204359 - DNA, 16 bp, P. troglodytes
agcctccagagggaac

SEQ ID NO: 204360 - DNA, 16 bp, P. troglodytes
agcctccagctccacc

SEQ ID NO: 204361 - DNA, 16 bp, P. troglodytes
agcctccagctccatc

SEQ ID NO: 204362 - DNA, 16 bp, P. troglodytes
agcctccatttcccag

SEQ ID NO: 204363 - DNA, 19 bp, P. troglodytes
agcctcccaaactgctggg

SEQ ID NO: 204364 - DNA, 16 bp, P. troglodytes
agcctcccaaagcact

SEQ ID NO: 204365 - DNA, 17 bp, P. troglodytes
agcctcccaaagtgtta

SEQ ID NO: 204366 - DNA, 18 bp, P. troglodytes
agcctcccaaagtgttga

SEQ ID NO: 204367 - DNA, 16 bp, P. troglodytes
agcctcccaaataact

SEQ ID NO: 204368 - DNA, 16 bp, P. troglodytes
agcctcccaagcatct

SEQ ID NO: 204369 - DNA, 17 bp, P. troglodytes
agcctcccaagtagcta

SEQ ID NO: 204370 - DNA, 16 bp, P. troglodytes
agcctcccaagtattt

SEQ ID NO: 204371 - DNA, 16 bp, P. troglodytes
agcctcccacctcggc

SEQ ID NO: 204372 - DNA, 16 bp, P. troglodytes
agcctcccagcctgca

SEQ ID NO: 204373 - DNA, 16 bp, P. troglodytes
agcctcccaggtacct

SEQ ID NO: 204374 - DNA, 16 bp, P. troglodytes
agcctcccaggtggct

SEQ ID NO: 204375 - DNA, 16 bp, P. troglodytes
agcctccccagtggct

SEQ ID NO: 204376 - DNA, 16 bp, P. troglodytes
agcctccccgatgagc

SEQ ID NO: 204377 - DNA, 17 bp, P. troglodytes
agcctcccgagtaactg

SEQ ID NO: 204378 - DNA, 16 bp, P. troglodytes
agcctccctgacgagc

SEQ ID NO: 204379 - DNA, 16 bp, P. troglodytes
agcctccctgagtgct

SEQ ID NO: 204380 - DNA, 16 bp, P. troglodytes
agcctccctgcctccc

SEQ ID NO: 204381 - DNA, 16 bp, P. troglodytes
agcctcctaaactgct

SEQ ID NO: 204382 - DNA, 16 bp, P. troglodytes
agcctcctcctgcctc

SEQ ID NO: 204383 - DNA, 16 bp, P. troglodytes
agcctccttttcctca

SEQ ID NO: 204384 - DNA, 16 bp, P. troglodytes
agcctcgccaggtgtc

SEQ ID NO: 204385 - DNA, 16 bp, P. troglodytes
agcctcggcctcccga

SEQ ID NO: 204386 - DNA, 16 bp, P. troglodytes
agcctcggtgacagag

SEQ ID NO: 204387 - DNA, 16 bp, P. troglodytes
agcctcggtttcccca

SEQ ID NO: 204388 - DNA, 16 bp, P. troglodytes
agcctctaatcccagc

SEQ ID NO: 204389 - DNA, 16 bp, P. troglodytes
agcctctcaaggagct

SEQ ID NO: 204390 - DNA, 16 bp, P. troglodytes
agcctctggaaaactc

SEQ ID NO: 204391 - DNA, 16 bp, P. troglodytes
agcctctggaactgtg

SEQ ID NO: 204392 - DNA, 16 bp, P. troglodytes
agcctctggccagaag

SEQ ID NO: 204393 - DNA, 16 bp, P. troglodytes
agcctctttccccagc

SEQ ID NO: 204394 - DNA, 16 bp, P. troglodytes
agcctgaaaaccaagc

SEQ ID NO: 204395 - DNA, 16 bp, P. troglodytes
agcctgaaagtaattt

SEQ ID NO: 204396 - DNA, 16 bp, P. troglodytes
agcctgaacaacaaga

SEQ ID NO: 204397 - DNA, 16 bp, P. troglodytes
agcctgaacctggagg

SEQ ID NO: 204398 - DNA, 16 bp, P. troglodytes
agcctgaagatgtaac

SEQ ID NO: 204399 - DNA, 16 bp, P. troglodytes
agcctgaagcctgggg

SEQ ID NO: 204400 - DNA, 21 bp, P. troglodytes
agcctgaccaatatgatgaaa

SEQ ID NO: 204401 - DNA, 16 bp, P. troglodytes
agcctgaccgacatgg

SEQ ID NO: 204402 - DNA, 16 bp, P. troglodytes
agcctgagaaacagag

SEQ ID NO: 204403 - DNA, 16 bp, P. troglodytes
agcctgagaaacaggg

SEQ ID NO: 204404 - DNA, 16 bp, P. troglodytes
agcctgagaggtggag

SEQ ID NO: 204405 - DNA, 16 bp, P. troglodytes
agcctgagcaaaaaga

SEQ ID NO: 204406 - DNA, 16 bp, P. troglodytes
agcctgagcaacgtgg

SEQ ID NO: 204407 - DNA, 16 bp, P. troglodytes
agcctgagcaatgtag

SEQ ID NO: 204408 - DNA, 16 bp, P. troglodytes
agcctgagcaatgtgg

SEQ ID NO: 204409 - DNA, 16 bp, P. troglodytes
agcctgagcagcagag

SEQ ID NO: 204410 - DNA, 16 bp, P. troglodytes
agcctgagcccaggag

SEQ ID NO: 204411 - DNA, 16 bp, P. troglodytes
agcctgagctgctgga

SEQ ID NO: 204412 - DNA, 16 bp, P. troglodytes
agcctgaggcagaaga

SEQ ID NO: 204413 - DNA, 18 bp, P. troglodytes
agcctgaggcaggagaac

SEQ ID NO: 204414 - DNA, 16 bp, P. troglodytes
agcctgcacaacacag

SEQ ID NO: 204415 - DNA, 16 bp, P. troglodytes
agcctgcaggaccatg

SEQ ID NO: 204416 - DNA, 16 bp, P. troglodytes
agcctgcagtgagctg

SEQ ID NO: 204417 - DNA, 16 bp, P. troglodytes
agcctgcatgacagag

SEQ ID NO: 204418 - DNA, 16 bp, P. troglodytes
agcctgcctcccacag

SEQ ID NO: 204419 - DNA, 16 bp, P. troglodytes
agcctgctgcaggggc

SEQ ID NO: 204420 - DNA, 16 bp, P. troglodytes
agcctgctggcctgcc

SEQ ID NO: 204421 - DNA, 16 bp, P. troglodytes
agcctggaaagtccaa

SEQ ID NO: 204422 - DNA, 16 bp, P. troglodytes
agcctggacaacaaaa

SEQ ID NO: 204423 - DNA, 16 bp, P. troglodytes
agcctggacaagagag

SEQ ID NO: 204424 - DNA, 16 bp, P. troglodytes
agcctggacctccctg

SEQ ID NO: 204425 - DNA, 16 bp, P. troglodytes
agcctggacctcctgg

SEQ ID NO: 204426 - DNA, 16 bp, P. troglodytes
agcctggacttcactg

SEQ ID NO: 204427 - DNA, 16 bp, P. troglodytes
agcctggagacagagg

SEQ ID NO: 204428 - DNA, 16 bp, P. troglodytes
agcctggagacccagg

SEQ ID NO: 204429 - DNA, 16 bp, P. troglodytes
agcctggagtttgaga

SEQ ID NO: 204430 - DNA, 16 bp, P. troglodytes
agcctggatccctgag

SEQ ID NO: 204431 - DNA, 16 bp, P. troglodytes
agcctggatgacagca

SEQ ID NO: 204432 - DNA, 16 bp, P. troglodytes
agcctggatgacagga

SEQ ID NO: 204433 - DNA, 16 bp, P. troglodytes
agcctggatgacatgg

SEQ ID NO: 204434 - DNA, 16 bp, P. troglodytes
agcctggatttgaacc

SEQ ID NO: 204435 - DNA, 16 bp, P. troglodytes
agcctggcacacagca

SEQ ID NO: 204436 - DNA, 16 bp, P. troglodytes
agcctggcacacagta

SEQ ID NO: 204437 - DNA, 16 bp, P. troglodytes
agcctggcacatagta

SEQ ID NO: 204438 - DNA, 16 bp, P. troglodytes
agcctggcatcccagg

SEQ ID NO: 204439 - DNA, 16 bp, P. troglodytes
agcctggccaaactgg

SEQ ID NO: 204440 - DNA, 16 bp, P. troglodytes
agcctggccaacaatg

SEQ ID NO: 204441 - DNA, 16 bp, P. troglodytes
agcctggccaacatga

SEQ ID NO: 204442 - DNA, 17 bp, P. troglodytes
agcctggccaacatggc

SEQ ID NO: 204443 - DNA, 16 bp, P. troglodytes
agcctggccaagaagg

SEQ ID NO: 204444 - DNA, 16 bp, P. troglodytes
agcctggccaatgtag

SEQ ID NO: 204445 - DNA, 16 bp, P. troglodytes
agcctggccagtgtgg

SEQ ID NO: 204446 - DNA, 16 bp, P. troglodytes
agcctggcccccagcc

SEQ ID NO: 204447 - DNA, 16 bp, P. troglodytes
agcctggcccctgccc

SEQ ID NO: 204448 - DNA, 16 bp, P. troglodytes
agcctggcctctcctg

SEQ ID NO: 204449 - DNA, 26 bp, P. troglodytes
agcctggctaacatggtgaaacccca

SEQ ID NO: 204450 - DNA, 16 bp, P. troglodytes
agcctggctaattgtt

SEQ ID NO: 204451 - DNA, 16 bp, P. troglodytes
agcctggctgacacag

SEQ ID NO: 204452 - DNA, 16 bp, P. troglodytes
agcctggctggcagag

SEQ ID NO: 204453 - DNA, 16 bp, P. troglodytes
agcctggctggggagg

SEQ ID NO: 204454 - DNA, 16 bp, P. troglodytes
agcctgggaaacaaag

SEQ ID NO: 204455 - DNA, 16 bp, P. troglodytes
agcctgggaaacacag

SEQ ID NO: 204456 - DNA, 16 bp, P. troglodytes
agcctgggaaacataa

SEQ ID NO: 204457 - DNA, 16 bp, P. troglodytes
agcctgggaagcatag

SEQ ID NO: 204458 - DNA, 16 bp, P. troglodytes
agcctgggaaggaccc

SEQ ID NO: 204459 - DNA, 16 bp, P. troglodytes
agcctgggaagtcaag

SEQ ID NO: 204460 - DNA, 17 bp, P. troglodytes
agcctgggagacagagg

SEQ ID NO: 204461 - DNA, 16 bp, P. troglodytes
agcctgggagacagca

SEQ ID NO: 204462 - DNA, 16 bp, P. troglodytes
agcctgggagaccgag

SEQ ID NO: 204463 - DNA, 16 bp, P. troglodytes
agcctgggagcctggg

SEQ ID NO: 204464 - DNA, 16 bp, P. troglodytes
agcctgggaggtgggg

SEQ ID NO: 204465 - DNA, 16 bp, P. troglodytes
agcctgggaggttgag

SEQ ID NO: 204466 - DNA, 16 bp, P. troglodytes
agcctgggcaaaaaaa

SEQ ID NO: 204467 - DNA, 16 bp, P. troglodytes
agcctgggcaacaaga

SEQ ID NO: 204468 - DNA, 20 bp, P. troglodytes
agcctgggcaacaagagcaa

SEQ ID NO: 204469 - DNA, 16 bp, P. troglodytes
agcctgggcaacaatg

SEQ ID NO: 204470 - DNA, 16 bp, P. troglodytes
agcctgggcaacacaa

SEQ ID NO: 204471 - DNA, 16 bp, P. troglodytes
agcctgggcaacaggc

SEQ ID NO: 204472 - DNA, 17 bp, P. troglodytes
agcctgggcaacataag

SEQ ID NO: 204473 - DNA, 16 bp, P. troglodytes
agcctgggcactgtgg

SEQ ID NO: 204474 - DNA, 16 bp, P. troglodytes
agcctgggcagcatgg

SEQ ID NO: 204475 - DNA, 16 bp, P. troglodytes
agcctgggcatcaaag

SEQ ID NO: 204476 - DNA, 16 bp, P. troglodytes
agcctgggccacacag

SEQ ID NO: 204477 - DNA, 16 bp, P. troglodytes
agcctgggccatggag

SEQ ID NO: 204478 - DNA, 16 bp, P. troglodytes
agcctgggcgacgaag

SEQ ID NO: 204479 - DNA, 16 bp, P. troglodytes
agcctgggcgagaaga

SEQ ID NO: 204480 - DNA, 16 bp, P. troglodytes
agcctgggctacacag

SEQ ID NO: 204481 - DNA, 17 bp, P. troglodytes
agcctgggctacagagt

SEQ ID NO: 204482 - DNA, 16 bp, P. troglodytes
agcctggggaggtcga

SEQ ID NO: 204483 - DNA, 16 bp, P. troglodytes
agcctggggcaagttc

SEQ ID NO: 204484 - DNA, 16 bp, P. troglodytes
agcctggggcccagcc

SEQ ID NO: 204485 - DNA, 16 bp, P. troglodytes
agcctggggctgagga

SEQ ID NO: 204486 - DNA, 16 bp, P. troglodytes
agcctgggggacacag

SEQ ID NO: 204487 - DNA, 16 bp, P. troglodytes
agcctgggggccagag

SEQ ID NO: 204488 - DNA, 16 bp, P. troglodytes
agcctgggggtgctgc

SEQ ID NO: 204489 - DNA, 16 bp, P. troglodytes
agcctggggtgggagg

SEQ ID NO: 204490 - DNA, 16 bp, P. troglodytes
agcctgggtaacagaa

SEQ ID NO: 204491 - DNA, 16 bp, P. troglodytes
agcctgggtccctgag

SEQ ID NO: 204492 - DNA, 17 bp, P. troglodytes
agcctgggtgacagaat

SEQ ID NO: 204493 - DNA, 17 bp, P. troglodytes
agcctgggtgacagagg

SEQ ID NO: 204494 - DNA, 16 bp, P. troglodytes
agcctgggtgtcacag

SEQ ID NO: 204495 - DNA, 16 bp, P. troglodytes
agcctggtagccctgc

SEQ ID NO: 204496 - DNA, 16 bp, P. troglodytes
agcctggtgaaagagt

SEQ ID NO: 204497 - DNA, 20 bp, P. troglodytes
agcctggtgacagagcaaga

SEQ ID NO: 204498 - DNA, 17 bp, P. troglodytes
agcctggtgtggtggca

SEQ ID NO: 204499 - DNA, 17 bp, P. troglodytes
agcctgtaaaatcaaaa

SEQ ID NO: 204500 - DNA, 16 bp, P. troglodytes
agcctgtaaagtcaaa

SEQ ID NO: 204501 - DNA, 16 bp, P. troglodytes
agcctgtagtgcagtg

SEQ ID NO: 204502 - DNA, 16 bp, P. troglodytes
agcctgtattcccagc

SEQ ID NO: 204503 - DNA, 16 bp, P. troglodytes
agcctgtatttttttt

SEQ ID NO: 204504 - DNA, 16 bp, P. troglodytes
agcctgtctgcctcct

SEQ ID NO: 204505 - DNA, 16 bp, P. troglodytes
agcctgtgaaaacagc

SEQ ID NO: 204506 - DNA, 16 bp, P. troglodytes
agcctgtgaaactgtg

SEQ ID NO: 204507 - DNA, 16 bp, P. troglodytes
agcctgtgaaagcagc

SEQ ID NO: 204508 - DNA, 16 bp, P. troglodytes
agcctgtgcaacatag

SEQ ID NO: 204509 - DNA, 16 bp, P. troglodytes
agcctgtgcctctgga

SEQ ID NO: 204510 - DNA, 16 bp, P. troglodytes
agcctgtggaactgtg

SEQ ID NO: 204511 - DNA, 16 bp, P. troglodytes
agcctgtgggatctga

SEQ ID NO: 204512 - DNA, 16 bp, P. troglodytes
agcctgttgcccaggc

SEQ ID NO: 204513 - DNA, 16 bp, P. troglodytes
agcctgttggtggact

SEQ ID NO: 204514 - DNA, 16 bp, P. troglodytes
agcctgttttataata

SEQ ID NO: 204515 - DNA, 16 bp, P. troglodytes
agccttaaaaaagaag

SEQ ID NO: 204516 - DNA, 16 bp, P. troglodytes
agccttaaaaagaaga

SEQ ID NO: 204517 - DNA, 16 bp, P. troglodytes
agccttaacttcccag

SEQ ID NO: 204518 - DNA, 16 bp, P. troglodytes
agccttaatttttttt

SEQ ID NO: 204519 - DNA, 16 bp, P. troglodytes
agccttactgaggact

SEQ ID NO: 204520 - DNA, 16 bp, P. troglodytes
agccttagcctcctga

SEQ ID NO: 204521 - DNA, 16 bp, P. troglodytes
agccttaggtattcct

SEQ ID NO: 204522 - DNA, 16 bp, P. troglodytes
agccttattattatta

SEQ ID NO: 204523 - DNA, 16 bp, P. troglodytes
agccttcaaaaagaag

SEQ ID NO: 204524 - DNA, 16 bp, P. troglodytes
agccttcaaaaatgaa

SEQ ID NO: 204525 - DNA, 16 bp, P. troglodytes
agccttcaagctctga

SEQ ID NO: 204526 - DNA, 16 bp, P. troglodytes
agccttcagaaatgaa

SEQ ID NO: 204527 - DNA, 16 bp, P. troglodytes
agccttcagaaggaac

SEQ ID NO: 204528 - DNA, 16 bp, P. troglodytes
agccttcagagctgag

SEQ ID NO: 204529 - DNA, 16 bp, P. troglodytes
agccttcagtctgtgg

SEQ ID NO: 204530 - DNA, 16 bp, P. troglodytes
agccttcatctttctc

SEQ ID NO: 204531 - DNA, 16 bp, P. troglodytes
agccttccaagtagca

SEQ ID NO: 204532 - DNA, 16 bp, P. troglodytes
agccttccaggcagag

SEQ ID NO: 204533 - DNA, 16 bp, P. troglodytes
agccttcctggaggag

SEQ ID NO: 204534 - DNA, 16 bp, P. troglodytes
agccttctgaagtgct

SEQ ID NO: 204535 - DNA, 16 bp, P. troglodytes
agccttcttgctgcat

SEQ ID NO: 204536 - DNA, 16 bp, P. troglodytes
agccttgacctcccag

SEQ ID NO: 204537 - DNA, 18 bp, P. troglodytes
agccttgacctcccaggc

SEQ ID NO: 204538 - DNA, 16 bp, P. troglodytes
agccttgctcactgct

SEQ ID NO: 204539 - DNA, 16 bp, P. troglodytes
agccttgctctgtggc

SEQ ID NO: 204540 - DNA, 17 bp, P. troglodytes
agccttgctgctgcctt

SEQ ID NO: 204541 - DNA, 17 bp, P. troglodytes
agccttggctttcagct

SEQ ID NO: 204542 - DNA, 16 bp, P. troglodytes
agccttgggccagagt

SEQ ID NO: 204543 - DNA, 16 bp, P. troglodytes
agcctttaaaatcaaa

SEQ ID NO: 204544 - DNA, 16 bp, P. troglodytes
agcctttccaaaggag

SEQ ID NO: 204545 - DNA, 16 bp, P. troglodytes
agcctttggaaacccc

SEQ ID NO: 204546 - DNA, 16 bp, P. troglodytes
agccttttatccctca

SEQ ID NO: 204547 - DNA, 16 bp, P. troglodytes
agccttttattggaag

SEQ ID NO: 204548 - DNA, 16 bp, P. troglodytes
agccttttgttttgtt

SEQ ID NO: 204549 - DNA, 16 bp, P. troglodytes
agcctttttcttcttt

SEQ ID NO: 204550 - DNA, 16 bp, P. troglodytes
agcctttttttaaaaa

SEQ ID NO: 204551 - DNA, 16 bp, P. troglodytes
agcgaaaccccatctc

SEQ ID NO: 204552 - DNA, 16 bp, P. troglodytes
agcgaaataagccaga

SEQ ID NO: 204553 - DNA, 16 bp, P. troglodytes
agcgaaggagaaataa

SEQ ID NO: 204554 - DNA, 16 bp, P. troglodytes
agcgagaacttgtctc

SEQ ID NO: 204555 - DNA, 16 bp, P. troglodytes
agcgagacccccatct

SEQ ID NO: 204556 - DNA, 16 bp, P. troglodytes
agcgagaccccgtctc

SEQ ID NO: 204557 - DNA, 16 bp, P. troglodytes
agcgagaccctgtatc

SEQ ID NO: 204558 - DNA, 16 bp, P. troglodytes
agcgagaccctgtctc

SEQ ID NO: 204559 - DNA, 16 bp, P. troglodytes
agcgagactccgtcac

SEQ ID NO: 204560 - DNA, 16 bp, P. troglodytes
agcgagactctgcctc

SEQ ID NO: 204561 - DNA, 16 bp, P. troglodytes
agcgagactctgtctc

SEQ ID NO: 204562 - DNA, 16 bp, P. troglodytes
agcgagactgcatctc

SEQ ID NO: 204563 - DNA, 16 bp, P. troglodytes
agcgagacttcatttc

SEQ ID NO: 204564 - DNA, 16 bp, P. troglodytes
agcgagatcgcaccac

SEQ ID NO: 204565 - DNA, 16 bp, P. troglodytes
agcgagatgccatctc

SEQ ID NO: 204566 - DNA, 16 bp, P. troglodytes
agcgagattctatctc

SEQ ID NO: 204567 - DNA, 16 bp, P. troglodytes
agcgagcctcctgcct

SEQ ID NO: 204568 - DNA, 16 bp, P. troglodytes
agcgaggctctgtctc

SEQ ID NO: 204569 - DNA, 17 bp, P. troglodytes
agcgagggctgctagca

SEQ ID NO: 204570 - DNA, 16 bp, P. troglodytes
agcgatcctcccacat

SEQ ID NO: 204571 - DNA, 16 bp, P. troglodytes
agcgattcccccacct

SEQ ID NO: 204572 - DNA, 16 bp, P. troglodytes
agcgattcccctgctt

SEQ ID NO: 204573 - DNA, 16 bp, P. troglodytes
agcgattcttctgcct

SEQ ID NO: 204574 - DNA, 16 bp, P. troglodytes
agcgattcttgtgtct

SEQ ID NO: 204575 - DNA, 18 bp, P. troglodytes
agcgcaatggcgcgatct

SEQ ID NO: 204576 - DNA, 16 bp, P. troglodytes
agcgcctctgccctgc

SEQ ID NO: 204577 - DNA, 16 bp, P. troglodytes
agcgcctcttcctggc

SEQ ID NO: 204578 - DNA, 17 bp, P. troglodytes
agcgcggtggctcacgc

SEQ ID NO: 204579 - DNA, 16 bp, P. troglodytes
agcgcgtgccaccatg

SEQ ID NO: 204580 - DNA, 16 bp, P. troglodytes
agcgctggggttacag

SEQ ID NO: 204581 - DNA, 16 bp, P. troglodytes
agcggaggctgaggaa

SEQ ID NO: 204582 - DNA, 16 bp, P. troglodytes
agcggaggctggactg

SEQ ID NO: 204583 - DNA, 16 bp, P. troglodytes
agcggaggttgcaggg

SEQ ID NO: 204584 - DNA, 17 bp, P. troglodytes
agcggctgcagagggtg

SEQ ID NO: 204585 - DNA, 16 bp, P. troglodytes
agcggctggcagaggc

SEQ ID NO: 204586 - DNA, 16 bp, P. troglodytes
agcgggactccatctc

SEQ ID NO: 204587 - DNA, 22 bp, P. troglodytes
agcggtggctcacgcctgtaat

SEQ ID NO: 204588 - DNA, 18 bp, P. troglodytes
agcgtccctagtagctgg

SEQ ID NO: 204589 - DNA, 17 bp, P. troglodytes
agcgtgaacccaggagg

SEQ ID NO: 204590 - DNA, 16 bp, P. troglodytes
agcgtgagccaccacg

SEQ ID NO: 204591 - DNA, 19 bp, P. troglodytes
agcgtgagccaccatgcct

SEQ ID NO: 204592 - DNA, 16 bp, P. troglodytes
agcgtgcagtgagctg

SEQ ID NO: 204593 - DNA, 16 bp, P. troglodytes
agcgtggtggctcacg

SEQ ID NO: 204594 - DNA, 16 bp, P. troglodytes
agctaaaagagcactg

SEQ ID NO: 204595 - DNA, 16 bp, P. troglodytes
agctaaacattggata

SEQ ID NO: 204596 - DNA, 16 bp, P. troglodytes
agctaaagaaagagat

SEQ ID NO: 204597 - DNA, 16 bp, P. troglodytes
agctaaagcaatgttt

SEQ ID NO: 204598 - DNA, 16 bp, P. troglodytes
agctaaaggaaaaagt

SEQ ID NO: 204599 - DNA, 17 bp, P. troglodytes
agctaaaggagcatgtt

SEQ ID NO: 204600 - DNA, 16 bp, P. troglodytes
agctaaaggtttgcca

SEQ ID NO: 204601 - DNA, 16 bp, P. troglodytes
agctaacatttttaaa

SEQ ID NO: 204602 - DNA, 16 bp, P. troglodytes
agctaactttaaaaaa

SEQ ID NO: 204603 - DNA, 16 bp, P. troglodytes
agctaactttttattt

SEQ ID NO: 204604 - DNA, 16 bp, P. troglodytes
agctaagaatggtttt

SEQ ID NO: 204605 - DNA, 16 bp, P. troglodytes
agctaagctacaagga

SEQ ID NO: 204606 - DNA, 16 bp, P. troglodytes
agctaagctctgagga

SEQ ID NO: 204607 - DNA, 16 bp, P. troglodytes
agctaaggcaggcaga

SEQ ID NO: 204608 - DNA, 16 bp, P. troglodytes
agctaatatttattga

SEQ ID NO: 204609 - DNA, 16 bp, P. troglodytes
agctaatattttcttt

SEQ ID NO: 204610 - DNA, 16 bp, P. troglodytes
agctaatgcatgcagg

SEQ ID NO: 204611 - DNA, 16 bp, P. troglodytes
agctaatgcatgtggg

SEQ ID NO: 204612 - DNA, 16 bp, P. troglodytes
agctaatttatttttt

SEQ ID NO: 204613 - DNA, 16 bp, P. troglodytes
agctaattttaaaaat

SEQ ID NO: 204614 - DNA, 16 bp, P. troglodytes
agctaattttatattt

SEQ ID NO: 204615 - DNA, 16 bp, P. troglodytes
agctaatttttaaaaa

SEQ ID NO: 204616 - DNA, 16 bp, P. troglodytes
agctaatttttagatt

SEQ ID NO: 204617 - DNA, 16 bp, P. troglodytes
agctacaaaacaattc

SEQ ID NO: 204618 - DNA, 16 bp, P. troglodytes
agctacaatcatgcca

SEQ ID NO: 204619 - DNA, 16 bp, P. troglodytes
agctacagaccaatat

SEQ ID NO: 204620 - DNA, 25 bp, P. troglodytes
agctacaggaggaaattcaaaccaa

SEQ ID NO: 204621 - DNA, 16 bp, P. troglodytes
agctaccacacccagc

SEQ ID NO: 204622 - DNA, 16 bp, P. troglodytes
agctaccagaagctgg

SEQ ID NO: 204623 - DNA, 16 bp, P. troglodytes
agctaccaggcctggc

SEQ ID NO: 204624 - DNA, 16 bp, P. troglodytes
agctacccagaggctg

SEQ ID NO: 204625 - DNA, 16 bp, P. troglodytes
agctaccggggaggct

SEQ ID NO: 204626 - DNA, 17 bp, P. troglodytes
agctacctatgacaaac

SEQ ID NO: 204627 - DNA, 19 bp, P. troglodytes
agctacctgggaggctgaa

SEQ ID NO: 204628 - DNA, 16 bp, P. troglodytes
agctacgggggaggct

SEQ ID NO: 204629 - DNA, 16 bp, P. troglodytes
agctactcaggaaggt

SEQ ID NO: 204630 - DNA, 16 bp, P. troglodytes
agctactcaggagacc

SEQ ID NO: 204631 - DNA, 16 bp, P. troglodytes
agctactcaggagctt

SEQ ID NO: 204632 - DNA, 18 bp, P. troglodytes
agctactcaggaggccga

SEQ ID NO: 204633 - DNA, 16 bp, P. troglodytes
agctactcatgaagct

SEQ ID NO: 204634 - DNA, 21 bp, P. troglodytes
agctactcgggaggctgagcc

SEQ ID NO: 204635 - DNA, 19 bp, P. troglodytes
agctactcgggagtctgag

SEQ ID NO: 204636 - DNA, 18 bp, P. troglodytes
agctactcgggtggctga

SEQ ID NO: 204637 - DNA, 16 bp, P. troglodytes
agctactgggaagact

SEQ ID NO: 204638 - DNA, 16 bp, P. troglodytes
agctactgggggaggc

SEQ ID NO: 204639 - DNA, 16 bp, P. troglodytes
agctacttcagaggct

SEQ ID NO: 204640 - DNA, 16 bp, P. troglodytes
agctacttcgggggct

SEQ ID NO: 204641 - DNA, 16 bp, P. troglodytes
agctacttgcaaggct

SEQ ID NO: 204642 - DNA, 18 bp, P. troglodytes
agctacttggaaggctga

SEQ ID NO: 204643 - DNA, 17 bp, P. troglodytes
agctacttgggagggtg

SEQ ID NO: 204644 - DNA, 17 bp, P. troglodytes
agctacttgggaggtta

SEQ ID NO: 204645 - DNA, 16 bp, P. troglodytes
agctacttggtggcag

SEQ ID NO: 204646 - DNA, 16 bp, P. troglodytes
agctactttgggggct

SEQ ID NO: 204647 - DNA, 16 bp, P. troglodytes
agctagaactgcaggt

SEQ ID NO: 204648 - DNA, 16 bp, P. troglodytes
agctagaagagaagat

SEQ ID NO: 204649 - DNA, 20 bp, P. troglodytes
agctagacacagagtgctga

SEQ ID NO: 204650 - DNA, 16 bp, P. troglodytes
agctagaccctgtctc

SEQ ID NO: 204651 - DNA, 16 bp, P. troglodytes
agctagactccgtctc

SEQ ID NO: 204652 - DNA, 16 bp, P. troglodytes
agctagagaaagaaaa

SEQ ID NO: 204653 - DNA, 16 bp, P. troglodytes
agctagagaaatcaga

SEQ ID NO: 204654 - DNA, 16 bp, P. troglodytes
agctagaggaaagaaa

SEQ ID NO: 204655 - DNA, 16 bp, P. troglodytes
agctagatacagagtg

SEQ ID NO: 204656 - DNA, 16 bp, P. troglodytes
agctaggactacaggt

SEQ ID NO: 204657 - DNA, 16 bp, P. troglodytes
agctaggcacagtggt

SEQ ID NO: 204658 - DNA, 16 bp, P. troglodytes
agctaggcatggtggt

SEQ ID NO: 204659 - DNA, 16 bp, P. troglodytes
agctaggcctggtggc

SEQ ID NO: 204660 - DNA, 16 bp, P. troglodytes
agctagtaagtggcag

SEQ ID NO: 204661 - DNA, 16 bp, P. troglodytes
agctagtagaagaaaa

SEQ ID NO: 204662 - DNA, 16 bp, P. troglodytes
agctagtcagacatga

SEQ ID NO: 204663 - DNA, 16 bp, P. troglodytes
agctagttgagaggct

SEQ ID NO: 204664 - DNA, 16 bp, P. troglodytes
agctagtttttttgta

SEQ ID NO: 204665 - DNA, 16 bp, P. troglodytes
agctataaaaaatgat

SEQ ID NO: 204666 - DNA, 16 bp, P. troglodytes
agctatcaagtcatga

SEQ ID NO: 204667 - DNA, 16 bp, P. troglodytes
agctatcctgagcaaa

SEQ ID NO: 204668 - DNA, 16 bp, P. troglodytes
agctatgaccacacca

SEQ ID NO: 204669 - DNA, 16 bp, P. troglodytes
agctatgactgcatca

SEQ ID NO: 204670 - DNA, 16 bp, P. troglodytes
agctatgatcactcca

SEQ ID NO: 204671 - DNA, 16 bp, P. troglodytes
agctatgatcaggcca

SEQ ID NO: 204672 - DNA, 16 bp, P. troglodytes
agctatgattgctcca

SEQ ID NO: 204673 - DNA, 16 bp, P. troglodytes
agctattcaggaagct

SEQ ID NO: 204674 - DNA, 16 bp, P. troglodytes
agctattccagcacca

SEQ ID NO: 204675 - DNA, 16 bp, P. troglodytes
agctattctggaggct

SEQ ID NO: 204676 - DNA, 16 bp, P. troglodytes
agctattgcactccag

SEQ ID NO: 204677 - DNA, 16 bp, P. troglodytes
agctatttcagaggct

SEQ ID NO: 204678 - DNA, 16 bp, P. troglodytes
agctattttgaaatat

SEQ ID NO: 204679 - DNA, 16 bp, P. troglodytes
agctattttgaaattt

SEQ ID NO: 204680 - DNA, 16 bp, P. troglodytes
agctattttgaagtat

SEQ ID NO: 204681 - DNA, 16 bp, P. troglodytes
agctatttttaaaaat

SEQ ID NO: 204682 - DNA, 16 bp, P. troglodytes
agctatttttttatat

SEQ ID NO: 204683 - DNA, 16 bp, P. troglodytes
agctatttttttctgt

SEQ ID NO: 204684 - DNA, 16 bp, P. troglodytes
agctcaacatcactgg

SEQ ID NO: 204685 - DNA, 16 bp, P. troglodytes
agctcaagcagtaatg

SEQ ID NO: 204686 - DNA, 16 bp, P. troglodytes
agctcaagcagtcctc

SEQ ID NO: 204687 - DNA, 16 bp, P. troglodytes
agctcaagtgagcctc

SEQ ID NO: 204688 - DNA, 16 bp, P. troglodytes
agctcaagtgattctc

SEQ ID NO: 204689 - DNA, 16 bp, P. troglodytes
agctcacagaattcag

SEQ ID NO: 204690 - DNA, 16 bp, P. troglodytes
agctcacgcctgtaat

SEQ ID NO: 204691 - DNA, 16 bp, P. troglodytes
agctcacggcagcctc

SEQ ID NO: 204692 - DNA, 16 bp, P. troglodytes
agctcactacagcctc

SEQ ID NO: 204693 - DNA, 16 bp, P. troglodytes
agctcactgcaatctc

SEQ ID NO: 204694 - DNA, 16 bp, P. troglodytes
agctcactgcagactc

SEQ ID NO: 204695 - DNA, 16 bp, P. troglodytes
agctcactgcagcatc

SEQ ID NO: 204696 - DNA, 16 bp, P. troglodytes
agctcactgcagccgc

SEQ ID NO: 204697 - DNA, 16 bp, P. troglodytes
agctcactgcagtctc

SEQ ID NO: 204698 - DNA, 16 bp, P. troglodytes
agctcactgcatcctc

SEQ ID NO: 204699 - DNA, 16 bp, P. troglodytes
agctcactgccgcctc

SEQ ID NO: 204700 - DNA, 16 bp, P. troglodytes
agctcactgcgacctc

SEQ ID NO: 204701 - DNA, 16 bp, P. troglodytes
agctcactgtaacctc

SEQ ID NO: 204702 - DNA, 16 bp, P. troglodytes
agctcactgtagcctc

SEQ ID NO: 204703 - DNA, 16 bp, P. troglodytes
agctcactgtagtctc

SEQ ID NO: 204704 - DNA, 16 bp, P. troglodytes
agctcactgtgacctt

SEQ ID NO: 204705 - DNA, 16 bp, P. troglodytes
agctcactgtggtttt

SEQ ID NO: 204706 - DNA, 16 bp, P. troglodytes
agctcactgttgcctc

SEQ ID NO: 204707 - DNA, 16 bp, P. troglodytes
agctcacttcagcctc

SEQ ID NO: 204708 - DNA, 16 bp, P. troglodytes
agctcagaagacagga

SEQ ID NO: 204709 - DNA, 16 bp, P. troglodytes
agctcagagaggtttg

SEQ ID NO: 204710 - DNA, 16 bp, P. troglodytes
agctcagaggagaccc

SEQ ID NO: 204711 - DNA, 16 bp, P. troglodytes
agctcagctcagctca

SEQ ID NO: 204712 - DNA, 16 bp, P. troglodytes
agctcaggagtatgag

SEQ ID NO: 204713 - DNA, 16 bp, P. troglodytes
agctcaggcacagagg

SEQ ID NO: 204714 - DNA, 16 bp, P. troglodytes
agctcaggcagtaata

SEQ ID NO: 204715 - DNA, 16 bp, P. troglodytes
agctcaggccatggct

SEQ ID NO: 204716 - DNA, 16 bp, P. troglodytes
agctcaggctgctgct

SEQ ID NO: 204717 - DNA, 16 bp, P. troglodytes
agctcaggctgttgct

SEQ ID NO: 204718 - DNA, 16 bp, P. troglodytes
agctcagtctcaaatc

SEQ ID NO: 204719 - DNA, 16 bp, P. troglodytes
agctcagtgcagcctc

SEQ ID NO: 204720 - DNA, 16 bp, P. troglodytes
agctcagttgttggag

SEQ ID NO: 204721 - DNA, 16 bp, P. troglodytes
agctcatgcctgtaat

SEQ ID NO: 204722 - DNA, 16 bp, P. troglodytes
agctcatggttctgga

SEQ ID NO: 204723 - DNA, 16 bp, P. troglodytes
agctcatgtggttgtt

SEQ ID NO: 204724 - DNA, 16 bp, P. troglodytes
agctcatgttgaaatt

SEQ ID NO: 204725 - DNA, 16 bp, P. troglodytes
agctcattgcagcctc

SEQ ID NO: 204726 - DNA, 16 bp, P. troglodytes
agctcatttcagcatt

SEQ ID NO: 204727 - DNA, 16 bp, P. troglodytes
agctcatttcttttta

SEQ ID NO: 204728 - DNA, 16 bp, P. troglodytes
agctcatttttaaaaa

SEQ ID NO: 204729 - DNA, 16 bp, P. troglodytes
agctcatttttgtatt

SEQ ID NO: 204730 - DNA, 16 bp, P. troglodytes
agctccaaaagagacc

SEQ ID NO: 204731 - DNA, 16 bp, P. troglodytes
agctccaaactggaaa

SEQ ID NO: 204732 - DNA, 16 bp, P. troglodytes
agctccaaccatgtcc

SEQ ID NO: 204733 - DNA, 16 bp, P. troglodytes
agctccaactcctggg

SEQ ID NO: 204734 - DNA, 16 bp, P. troglodytes
agctccaatgtggtgg

SEQ ID NO: 204735 - DNA, 16 bp, P. troglodytes
agctccacatcctggg

SEQ ID NO: 204736 - DNA, 16 bp, P. troglodytes
agctccaccacttcct

SEQ ID NO: 204737 - DNA, 16 bp, P. troglodytes
agctccaccccctggg

SEQ ID NO: 204738 - DNA, 16 bp, P. troglodytes
agctccacctcctagg

SEQ ID NO: 204739 - DNA, 16 bp, P. troglodytes
agctccacctgcggcc

SEQ ID NO: 204740 - DNA, 16 bp, P. troglodytes
agctccacctgctggg

SEQ ID NO: 204741 - DNA, 17 bp, P. troglodytes
agctccaccttctgggt

SEQ ID NO: 204742 - DNA, 16 bp, P. troglodytes
agctccactcctgtgg

SEQ ID NO: 204743 - DNA, 16 bp, P. troglodytes
agctccagaagagaga

SEQ ID NO: 204744 - DNA, 16 bp, P. troglodytes
agctccagaataatct

SEQ ID NO: 204745 - DNA, 16 bp, P. troglodytes
agctccagccaccttt

SEQ ID NO: 204746 - DNA, 16 bp, P. troglodytes
agctccaggagggcag

SEQ ID NO: 204747 - DNA, 16 bp, P. troglodytes
agctccaggattcatt

SEQ ID NO: 204748 - DNA, 16 bp, P. troglodytes
agctccaggcagctca

SEQ ID NO: 204749 - DNA, 16 bp, P. troglodytes
agctccaggctggtac

SEQ ID NO: 204750 - DNA, 16 bp, P. troglodytes
agctccaggctgtgct

SEQ ID NO: 204751 - DNA, 16 bp, P. troglodytes
agctccagggcttggg

SEQ ID NO: 204752 - DNA, 16 bp, P. troglodytes
agctccaggtgctggc

SEQ ID NO: 204753 - DNA, 16 bp, P. troglodytes
agctccatctcctgtc

SEQ ID NO: 204754 - DNA, 16 bp, P. troglodytes
agctccatgaaggcag

SEQ ID NO: 204755 - DNA, 16 bp, P. troglodytes
agctccatgagggcag

SEQ ID NO: 204756 - DNA, 16 bp, P. troglodytes
agctccatgagggtag

SEQ ID NO: 204757 - DNA, 16 bp, P. troglodytes
agctcccacacagagt

SEQ ID NO: 204758 - DNA, 16 bp, P. troglodytes
agctcccacccccagc

SEQ ID NO: 204759 - DNA, 16 bp, P. troglodytes
agctcccagagggaga

SEQ ID NO: 204760 - DNA, 16 bp, P. troglodytes
agctcccagagggagg

SEQ ID NO: 204761 - DNA, 16 bp, P. troglodytes
agctcccagcctgagt

SEQ ID NO: 204762 - DNA, 16 bp, P. troglodytes
agctcccaggagatgc

SEQ ID NO: 204763 - DNA, 16 bp, P. troglodytes
agctcccagtctgatg

SEQ ID NO: 204764 - DNA, 16 bp, P. troglodytes
agctcccagtggccaa

SEQ ID NO: 204765 - DNA, 16 bp, P. troglodytes
agctccccaagggcag

SEQ ID NO: 204766 - DNA, 16 bp, P. troglodytes
agctccccaccccctg

SEQ ID NO: 204767 - DNA, 16 bp, P. troglodytes
agctccccaggtggtt

SEQ ID NO: 204768 - DNA, 16 bp, P. troglodytes
agctcccctcctggct

SEQ ID NO: 204769 - DNA, 16 bp, P. troglodytes
agctccctcaggcctc

SEQ ID NO: 204770 - DNA, 16 bp, P. troglodytes
agctccctctgcttgc

SEQ ID NO: 204771 - DNA, 16 bp, P. troglodytes
agctccctgagggcag

SEQ ID NO: 204772 - DNA, 16 bp, P. troglodytes
agctccctgcagcctc

SEQ ID NO: 204773 - DNA, 16 bp, P. troglodytes
agctccctgctcagcc

SEQ ID NO: 204774 - DNA, 16 bp, P. troglodytes
agctccctgctgcctc

SEQ ID NO: 204775 - DNA, 16 bp, P. troglodytes
agctccgaagagacag

SEQ ID NO: 204776 - DNA, 20 bp, P. troglodytes
agctccgcctcccaagttca

SEQ ID NO: 204777 - DNA, 16 bp, P. troglodytes
agctccgcctgctggg

SEQ ID NO: 204778 - DNA, 16 bp, P. troglodytes
agctcctaaaaccctt

SEQ ID NO: 204779 - DNA, 16 bp, P. troglodytes
agctcctagaacagtg

SEQ ID NO: 204780 - DNA, 16 bp, P. troglodytes
agctcctagcagagag

SEQ ID NO: 204781 - DNA, 16 bp, P. troglodytes
agctcctcccatcaca

SEQ ID NO: 204782 - DNA, 16 bp, P. troglodytes
agctcctgaaggaaac

SEQ ID NO: 204783 - DNA, 16 bp, P. troglodytes
agctcctgaaggaggc

SEQ ID NO: 204784 - DNA, 16 bp, P. troglodytes
agctcctgacaaccac

SEQ ID NO: 204785 - DNA, 16 bp, P. troglodytes
agctcctgacctcaag

SEQ ID NO: 204786 - DNA, 16 bp, P. troglodytes
agctcctgacctcagg

SEQ ID NO: 204787 - DNA, 16 bp, P. troglodytes
agctcctgagctcaag

SEQ ID NO: 204788 - DNA, 16 bp, P. troglodytes
agctcctgcctcccag

SEQ ID NO: 204789 - DNA, 16 bp, P. troglodytes
agctcctggaaggcag

SEQ ID NO: 204790 - DNA, 16 bp, P. troglodytes
agctcctggagctcag

SEQ ID NO: 204791 - DNA, 16 bp, P. troglodytes
agctcctggcctcaag

SEQ ID NO: 204792 - DNA, 16 bp, P. troglodytes
agctcctgggctcaag

SEQ ID NO: 204793 - DNA, 16 bp, P. troglodytes
agctcctggggaggct

SEQ ID NO: 204794 - DNA, 16 bp, P. troglodytes
agctccttgagagcag

SEQ ID NO: 204795 - DNA, 16 bp, P. troglodytes
agctccttgagggcag

SEQ ID NO: 204796 - DNA, 16 bp, P. troglodytes
agctccttgagggtag

SEQ ID NO: 204797 - DNA, 16 bp, P. troglodytes
agctcgctgcagcttc

SEQ ID NO: 204798 - DNA, 16 bp, P. troglodytes
agctcggactacaggc

SEQ ID NO: 204799 - DNA, 16 bp, P. troglodytes
agctcggtacccgggg

SEQ ID NO: 204800 - DNA, 16 bp, P. troglodytes
agctctcaggagacct

SEQ ID NO: 204801 - DNA, 16 bp, P. troglodytes
agctctcatactgtaa

SEQ ID NO: 204802 - DNA, 16 bp, P. troglodytes
agctctccaggtgatt

SEQ ID NO: 204803 - DNA, 16 bp, P. troglodytes
agctctctgaacctca

SEQ ID NO: 204804 - DNA, 16 bp, P. troglodytes
agctctctgcaacctc

SEQ ID NO: 204805 - DNA, 16 bp, P. troglodytes
agctctctgccctccc

SEQ ID NO: 204806 - DNA, 16 bp, P. troglodytes
agctctcttgtctgcc

SEQ ID NO: 204807 - DNA, 16 bp, P. troglodytes
agctctgagaacagac

SEQ ID NO: 204808 - DNA, 16 bp, P. troglodytes
agctctgcaccaagcc

SEQ ID NO: 204809 - DNA, 16 bp, P. troglodytes
agctctgcaccaggca

SEQ ID NO: 204810 - DNA, 16 bp, P. troglodytes
agctctgccactaact

SEQ ID NO: 204811 - DNA, 16 bp, P. troglodytes
agctctgccacttacc

SEQ ID NO: 204812 - DNA, 16 bp, P. troglodytes
agctctgccacttgct

SEQ ID NO: 204813 - DNA, 16 bp, P. troglodytes
agctctgcccctgtgg

SEQ ID NO: 204814 - DNA, 16 bp, P. troglodytes
agctctgccctcatga

SEQ ID NO: 204815 - DNA, 20 bp, P. troglodytes
agctctgcctcccgggctca

SEQ ID NO: 204816 - DNA, 16 bp, P. troglodytes
agctctgcctcctggg

SEQ ID NO: 204817 - DNA, 16 bp, P. troglodytes
agctctgcctcttggg

SEQ ID NO: 204818 - DNA, 16 bp, P. troglodytes
agctctgcctgccagg

SEQ ID NO: 204819 - DNA, 16 bp, P. troglodytes
agctctgccttccagg

SEQ ID NO: 204820 - DNA, 16 bp, P. troglodytes
agctctgctctgatct

SEQ ID NO: 204821 - DNA, 16 bp, P. troglodytes
agctctggagatggat

SEQ ID NO: 204822 - DNA, 16 bp, P. troglodytes
agctctggaggctggg

SEQ ID NO: 204823 - DNA, 16 bp, P. troglodytes
agctctggctcaggga

SEQ ID NO: 204824 - DNA, 16 bp, P. troglodytes
agctctgggcaacaga

SEQ ID NO: 204825 - DNA, 16 bp, P. troglodytes
agctctgtagtttaat

SEQ ID NO: 204826 - DNA, 16 bp, P. troglodytes
agctctgtcccagagg

SEQ ID NO: 204827 - DNA, 16 bp, P. troglodytes
agctctgtccctgtgg

SEQ ID NO: 204828 - DNA, 16 bp, P. troglodytes
agctctgtgactttgg

SEQ ID NO: 204829 - DNA, 16 bp, P. troglodytes
agctcttataaggcag

SEQ ID NO: 204830 - DNA, 18 bp, P. troglodytes
agctcttcatgagtcctg

SEQ ID NO: 204831 - DNA, 16 bp, P. troglodytes
agctcttcatttattt

SEQ ID NO: 204832 - DNA, 16 bp, P. troglodytes
agctctttacagaaaa

SEQ ID NO: 204833 - DNA, 16 bp, P. troglodytes
agctctttgagggcag

SEQ ID NO: 204834 - DNA, 16 bp, P. troglodytes
agctctttgggaagct

SEQ ID NO: 204835 - DNA, 16 bp, P. troglodytes
agctctttgggatgcc

SEQ ID NO: 204836 - DNA, 16 bp, P. troglodytes
agctgaaaaatacagt

SEQ ID NO: 204837 - DNA, 16 bp, P. troglodytes
agctgaaaaatgtaat

SEQ ID NO: 204838 - DNA, 16 bp, P. troglodytes
agctgaaaaccatggc

SEQ ID NO: 204839 - DNA, 16 bp, P. troglodytes
agctgaaaaccttgaa

SEQ ID NO: 204840 - DNA, 16 bp, P. troglodytes
agctgaaactacaggc

SEQ ID NO: 204841 - DNA, 16 bp, P. troglodytes
agctgaaactataaaa

SEQ ID NO: 204842 - DNA, 16 bp, P. troglodytes
agctgaaactggatct

SEQ ID NO: 204843 - DNA, 16 bp, P. troglodytes
agctgaaagcctttcc

SEQ ID NO: 204844 - DNA, 16 bp, P. troglodytes
agctgaaatgaaggaa

SEQ ID NO: 204845 - DNA, 16 bp, P. troglodytes
agctgaaattcaaacc

SEQ ID NO: 204846 - DNA, 16 bp, P. troglodytes
agctgaacaatgaaaa

SEQ ID NO: 204847 - DNA, 16 bp, P. troglodytes
agctgaagaaagaatc

SEQ ID NO: 204848 - DNA, 16 bp, P. troglodytes
agctgaagaacctgga

SEQ ID NO: 204849 - DNA, 16 bp, P. troglodytes
agctgaagaacttgaa

SEQ ID NO: 204850 - DNA, 16 bp, P. troglodytes
agctgaagaacttgga

SEQ ID NO: 204851 - DNA, 16 bp, P. troglodytes
agctgaagaatgagaa

SEQ ID NO: 204852 - DNA, 16 bp, P. troglodytes
agctgaagaatttaat

SEQ ID NO: 204853 - DNA, 16 bp, P. troglodytes
agctgaagcaggagga

SEQ ID NO: 204854 - DNA, 16 bp, P. troglodytes
agctgaagtcttttta

SEQ ID NO: 204855 - DNA, 16 bp, P. troglodytes
agctgaagtgggagaa

SEQ ID NO: 204856 - DNA, 16 bp, P. troglodytes
agctgacaaaaacaaa

SEQ ID NO: 204857 - DNA, 16 bp, P. troglodytes
agctgacacccaccca

SEQ ID NO: 204858 - DNA, 17 bp, P. troglodytes
agctgacagccaaaata

SEQ ID NO: 204859 - DNA, 16 bp, P. troglodytes
agctgacattgattcc

SEQ ID NO: 204860 - DNA, 16 bp, P. troglodytes
agctgactgaagagcc

SEQ ID NO: 204861 - DNA, 16 bp, P. troglodytes
agctgagaaaaaaaga

SEQ ID NO: 204862 - DNA, 16 bp, P. troglodytes
agctgagaaagcaagc

SEQ ID NO: 204863 - DNA, 16 bp, P. troglodytes
agctgagaagctgaga

SEQ ID NO: 204864 - DNA, 16 bp, P. troglodytes
agctgagaatgcgcca

SEQ ID NO: 204865 - DNA, 16 bp, P. troglodytes
agctgagaattttcca

SEQ ID NO: 204866 - DNA, 16 bp, P. troglodytes
agctgagacagcacca

SEQ ID NO: 204867 - DNA, 17 bp, P. troglodytes
agctgagacaggagaat

SEQ ID NO: 204868 - DNA, 16 bp, P. troglodytes
agctgagaccacaggt

SEQ ID NO: 204869 - DNA, 16 bp, P. troglodytes
agctgagactacaggc

SEQ ID NO: 204870 - DNA, 16 bp, P. troglodytes
agctgagactgtacca

SEQ ID NO: 204871 - DNA, 16 bp, P. troglodytes
agctgagagcacacca

SEQ ID NO: 204872 - DNA, 16 bp, P. troglodytes
agctgagagggaggct

SEQ ID NO: 204873 - DNA, 16 bp, P. troglodytes
agctgagagtggtggc

SEQ ID NO: 204874 - DNA, 16 bp, P. troglodytes
agctgagatcattcca

SEQ ID NO: 204875 - DNA, 16 bp, P. troglodytes
agctgagatccagcca

SEQ ID NO: 204876 - DNA, 16 bp, P. troglodytes
agctgagatggatgaa

SEQ ID NO: 204877 - DNA, 16 bp, P. troglodytes
agctgagatggcgcca

SEQ ID NO: 204878 - DNA, 16 bp, P. troglodytes
agctgagatgggtgga

SEQ ID NO: 204879 - DNA, 16 bp, P. troglodytes
agctgagattacagat

SEQ ID NO: 204880 - DNA, 16 bp, P. troglodytes
agctgagatttcacca

SEQ ID NO: 204881 - DNA, 16 bp, P. troglodytes
agctgagcaagactgt

SEQ ID NO: 204882 - DNA, 16 bp, P. troglodytes
agctgagcacagtggc

SEQ ID NO: 204883 - DNA, 16 bp, P. troglodytes
agctgagcatggtggt

SEQ ID NO: 204884 - DNA, 16 bp, P. troglodytes
agctgagccaggagaa

SEQ ID NO: 204885 - DNA, 16 bp, P. troglodytes
agctgagcctggtggc

SEQ ID NO: 204886 - DNA, 16 bp, P. troglodytes
agctgagctgggagga

SEQ ID NO: 204887 - DNA, 16 bp, P. troglodytes
agctgaggaggaggag

SEQ ID NO: 204888 - DNA, 16 bp, P. troglodytes
agctgaggaggatgta

SEQ ID NO: 204889 - DNA, 16 bp, P. troglodytes
agctgaggagtttgag

SEQ ID NO: 204890 - DNA, 18 bp, P. troglodytes
agctgaggcaagaggatc

SEQ ID NO: 204891 - DNA, 16 bp, P. troglodytes
agctgaggcacagaga

SEQ ID NO: 204892 - DNA, 16 bp, P. troglodytes
agctgaggcaggaaga

SEQ ID NO: 204893 - DNA, 17 bp, P. troglodytes
agctgaggcaggagaat

SEQ ID NO: 204894 - DNA, 16 bp, P. troglodytes
agctgaggcaggtggg

SEQ ID NO: 204895 - DNA, 16 bp, P. troglodytes
agctgaggcatgagaa

SEQ ID NO: 204896 - DNA, 16 bp, P. troglodytes
agctgaggccggagaa

SEQ ID NO: 204897 - DNA, 16 bp, P. troglodytes
agctgaggcgggcgga

SEQ ID NO: 204898 - DNA, 16 bp, P. troglodytes
agctgaggctcagaca

SEQ ID NO: 204899 - DNA, 16 bp, P. troglodytes
agctgaggctctgaga

SEQ ID NO: 204900 - DNA, 16 bp, P. troglodytes
agctgaggctggagaa

SEQ ID NO: 204901 - DNA, 16 bp, P. troglodytes
agctgaggggcaagga

SEQ ID NO: 204902 - DNA, 16 bp, P. troglodytes
agctgagggttctgac

SEQ ID NO: 204903 - DNA, 16 bp, P. troglodytes
agctgaggtaggagaa

SEQ ID NO: 204904 - DNA, 16 bp, P. troglodytes
agctgaggtcatgcca

SEQ ID NO: 204905 - DNA, 16 bp, P. troglodytes
agctgagtgtggtggt

SEQ ID NO: 204906 - DNA, 17 bp, P. troglodytes
agctgatatgcaacttc

SEQ ID NO: 204907 - DNA, 16 bp, P. troglodytes
agctgatgcctgccca

SEQ ID NO: 204908 - DNA, 16 bp, P. troglodytes
agctgattggatgagg

SEQ ID NO: 204909 - DNA, 16 bp, P. troglodytes
agctgattttgtattt

SEQ ID NO: 204910 - DNA, 16 bp, P. troglodytes
agctgcaacatcaact

SEQ ID NO: 204911 - DNA, 22 bp, P. troglodytes
agctgcacagctagagaaacag

SEQ ID NO: 204912 - DNA, 16 bp, P. troglodytes
agctgcactggcagct

SEQ ID NO: 204913 - DNA, 16 bp, P. troglodytes
agctgcagaaagatgt

SEQ ID NO: 204914 - DNA, 16 bp, P. troglodytes
agctgcagaagaaaaa

SEQ ID NO: 204915 - DNA, 16 bp, P. troglodytes
agctgcagacactcag

SEQ ID NO: 204916 - DNA, 16 bp, P. troglodytes
agctgcagaccttcat

SEQ ID NO: 204917 - DNA, 16 bp, P. troglodytes
agctgcagaccttctc

SEQ ID NO: 204918 - DNA, 16 bp, P. troglodytes
agctgcagaccttggc

SEQ ID NO: 204919 - DNA, 16 bp, P. troglodytes
agctgcagcagggagg

SEQ ID NO: 204920 - DNA, 16 bp, P. troglodytes
agctgcagccacccaa

SEQ ID NO: 204921 - DNA, 16 bp, P. troglodytes
agctgcagctgcccag

SEQ ID NO: 204922 - DNA, 16 bp, P. troglodytes
agctgcagctgtggtg

SEQ ID NO: 204923 - DNA, 16 bp, P. troglodytes
agctgcaggagacccc

SEQ ID NO: 204924 - DNA, 16 bp, P. troglodytes
agctgcaggccattat

SEQ ID NO: 204925 - DNA, 16 bp, P. troglodytes
agctgcagtagaatag

SEQ ID NO: 204926 - DNA, 17 bp, P. troglodytes
agctgcatagtattcca

SEQ ID NO: 204927 - DNA, 16 bp, P. troglodytes
agctgcatgctgggag

SEQ ID NO: 204928 - DNA, 16 bp, P. troglodytes
agctgccaccatgcct

SEQ ID NO: 204929 - DNA, 16 bp, P. troglodytes
agctgccatgttgtga

SEQ ID NO: 204930 - DNA, 16 bp, P. troglodytes
agctgccattgacttt

SEQ ID NO: 204931 - DNA, 16 bp, P. troglodytes
agctgcccaaggccat

SEQ ID NO: 204932 - DNA, 16 bp, P. troglodytes
agctgccccatctggg

SEQ ID NO: 204933 - DNA, 16 bp, P. troglodytes
agctgccctctgccag

SEQ ID NO: 204934 - DNA, 16 bp, P. troglodytes
agctgcctgccagtcc

SEQ ID NO: 204935 - DNA, 16 bp, P. troglodytes
agctgcctgccctgcc

SEQ ID NO: 204936 - DNA, 16 bp, P. troglodytes
agctgcctgggaggct

SEQ ID NO: 204937 - DNA, 16 bp, P. troglodytes
agctgcgcctcctggg

SEQ ID NO: 204938 - DNA, 16 bp, P. troglodytes
agctgcggagggtgca

SEQ ID NO: 204939 - DNA, 16 bp, P. troglodytes
agctgcgggagggagc

SEQ ID NO: 204940 - DNA, 16 bp, P. troglodytes
agctgctacagctgca

SEQ ID NO: 204941 - DNA, 16 bp, P. troglodytes
agctgctaccattcct

SEQ ID NO: 204942 - DNA, 16 bp, P. troglodytes
agctgctccagctgtg

SEQ ID NO: 204943 - DNA, 16 bp, P. troglodytes
agctgctgaaggaagc

SEQ ID NO: 204944 - DNA, 16 bp, P. troglodytes
agctgctgcacagcaa

SEQ ID NO: 204945 - DNA, 16 bp, P. troglodytes
agctgctgcacccagc

SEQ ID NO: 204946 - DNA, 16 bp, P. troglodytes
agctgctgcacccggc

SEQ ID NO: 204947 - DNA, 16 bp, P. troglodytes
agctgctgcacctggc

SEQ ID NO: 204948 - DNA, 16 bp, P. troglodytes
agctgctgctgctgct

SEQ ID NO: 204949 - DNA, 16 bp, P. troglodytes
agctgctgctgcttct

SEQ ID NO: 204950 - DNA, 16 bp, P. troglodytes
agctgctggggaagct

SEQ ID NO: 204951 - DNA, 16 bp, P. troglodytes
agctgctggggaggct

SEQ ID NO: 204952 - DNA, 16 bp, P. troglodytes
agctgcttcagaggct

SEQ ID NO: 204953 - DNA, 16 bp, P. troglodytes
agctgcttgggagtct

SEQ ID NO: 204954 - DNA, 16 bp, P. troglodytes
agctgctttttgtatt

SEQ ID NO: 204955 - DNA, 16 bp, P. troglodytes
agctggaaaaagaaaa

SEQ ID NO: 204956 - DNA, 16 bp, P. troglodytes
agctggaaaagacaag

SEQ ID NO: 204957 - DNA, 16 bp, P. troglodytes
agctggaaaattccta

SEQ ID NO: 204958 - DNA, 17 bp, P. troglodytes
agctggaaaccatcatc

SEQ ID NO: 204959 - DNA, 16 bp, P. troglodytes
agctggaaaccctcat

SEQ ID NO: 204960 - DNA, 16 bp, P. troglodytes
agctggaaactatcat

SEQ ID NO: 204961 - DNA, 16 bp, P. troglodytes
agctggaaccacaggc

SEQ ID NO: 204962 - DNA, 17 bp, P. troglodytes
agctggaactacaggca

SEQ ID NO: 204963 - DNA, 16 bp, P. troglodytes
agctggaactactggc

SEQ ID NO: 204964 - DNA, 16 bp, P. troglodytes
agctggaagagaagat

SEQ ID NO: 204965 - DNA, 16 bp, P. troglodytes
agctggaagaggaaag

SEQ ID NO: 204966 - DNA, 16 bp, P. troglodytes
agctggacatagtggc

SEQ ID NO: 204967 - DNA, 16 bp, P. troglodytes
agctggaccagatgta

SEQ ID NO: 204968 - DNA, 16 bp, P. troglodytes
agctggacgtggtggt

SEQ ID NO: 204969 - DNA, 18 bp, P. troglodytes
agctggacgtggtggtgg

SEQ ID NO: 204970 - DNA, 16 bp, P. troglodytes
agctggagaaccaggg

SEQ ID NO: 204971 - DNA, 16 bp, P. troglodytes
agctggagaaggcaag

SEQ ID NO: 204972 - DNA, 16 bp, P. troglodytes
agctggagaatttaat

SEQ ID NO: 204973 - DNA, 16 bp, P. troglodytes
agctggagacagagat

SEQ ID NO: 204974 - DNA, 16 bp, P. troglodytes
agctggagatcagcct

SEQ ID NO: 204975 - DNA, 16 bp, P. troglodytes
agctggagcaatcaga

SEQ ID NO: 204976 - DNA, 16 bp, P. troglodytes
agctggagcacagtgg

SEQ ID NO: 204977 - DNA, 16 bp, P. troglodytes
agctggagcagctggg

SEQ ID NO: 204978 - DNA, 16 bp, P. troglodytes
agctggagctgaagca

SEQ ID NO: 204979 - DNA, 16 bp, P. troglodytes
agctggaggaatcaca

SEQ ID NO: 204980 - DNA, 16 bp, P. troglodytes
agctggaggccatcat

SEQ ID NO: 204981 - DNA, 16 bp, P. troglodytes
agctggaggccattat

SEQ ID NO: 204982 - DNA, 16 bp, P. troglodytes
agctggaggccattct

SEQ ID NO: 204983 - DNA, 16 bp, P. troglodytes
agctggaggccatttt

SEQ ID NO: 204984 - DNA, 16 bp, P. troglodytes
agctggaggctgcaag

SEQ ID NO: 204985 - DNA, 17 bp, P. troglodytes
agctggagtacagtggc

SEQ ID NO: 204986 - DNA, 16 bp, P. troglodytes
agctggagtccagtgg

SEQ ID NO: 204987 - DNA, 16 bp, P. troglodytes
agctggagtgcaatgg

SEQ ID NO: 204988 - DNA, 16 bp, P. troglodytes
agctggagtgcagtgg

SEQ ID NO: 204989 - DNA, 16 bp, P. troglodytes
agctggagtgccatgg

SEQ ID NO: 204990 - DNA, 16 bp, P. troglodytes
agctggagtgcggtgg

SEQ ID NO: 204991 - DNA, 18 bp, P. troglodytes
agctggatgtggtggcag

SEQ ID NO: 204992 - DNA, 16 bp, P. troglodytes
agctggatgtggtggt

SEQ ID NO: 204993 - DNA, 16 bp, P. troglodytes
agctggcaagctctga

SEQ ID NO: 204994 - DNA, 16 bp, P. troglodytes
agctggctaaaaccca

SEQ ID NO: 204995 - DNA, 16 bp, P. troglodytes
agctggctccagcctc

SEQ ID NO: 204996 - DNA, 16 bp, P. troglodytes
agctggcttctcccag

SEQ ID NO: 204997 - DNA, 16 bp, P. troglodytes
agctgggaaaactgag

SEQ ID NO: 204998 - DNA, 16 bp, P. troglodytes
agctgggaaccctgca

SEQ ID NO: 204999 - DNA, 16 bp, P. troglodytes
agctgggaaggaggct

SEQ ID NO: 205000 - DNA, 16 bp, P. troglodytes
agctgggacaacaggc

SEQ ID NO: 205001 - DNA, 16 bp, P. troglodytes
agctgggaccacagcc

SEQ ID NO: 205002 - DNA, 16 bp, P. troglodytes
agctgggaccagaggc

SEQ ID NO: 205003 - DNA, 16 bp, P. troglodytes
agctgggactaaagga

SEQ ID NO: 205004 - DNA, 16 bp, P. troglodytes
agctgggactacaagg

SEQ ID NO: 205005 - DNA, 16 bp, P. troglodytes
agctgggactacaagt

SEQ ID NO: 205006 - DNA, 19 bp, P. troglodytes
agctgggactacaggggct

SEQ ID NO: 205007 - DNA, 22 bp, P. troglodytes
agctgggactgcaggcgcccgc

SEQ ID NO: 205008 - DNA, 16 bp, P. troglodytes
agctgggactgcaggt

SEQ ID NO: 205009 - DNA, 16 bp, P. troglodytes
agctgggactgctggt

SEQ ID NO: 205010 - DNA, 16 bp, P. troglodytes
agctgggactgtgggc

SEQ ID NO: 205011 - DNA, 16 bp, P. troglodytes
agctgggagcacaggt

SEQ ID NO: 205012 - DNA, 16 bp, P. troglodytes
agctgggagtggggct

SEQ ID NO: 205013 - DNA, 16 bp, P. troglodytes
agctgggagtggtggt

SEQ ID NO: 205014 - DNA, 16 bp, P. troglodytes
agctgggatcacaggc

SEQ ID NO: 205015 - DNA, 17 bp, P. troglodytes
agctgggatcacaggca

SEQ ID NO: 205016 - DNA, 17 bp, P. troglodytes
agctgggatgacaggca

SEQ ID NO: 205017 - DNA, 16 bp, P. troglodytes
agctgggattacagat

SEQ ID NO: 205018 - DNA, 20 bp, P. troglodytes
agctgggattacaggcaccc

SEQ ID NO: 205019 - DNA, 29 bp, P. troglodytes
agctgggattacaggcatgtgccaccaca

SEQ ID NO: 205020 - DNA, 18 bp, P. troglodytes
agctgggattacaggcgt

SEQ ID NO: 205021 - DNA, 16 bp, P. troglodytes
agctgggattgcaagt

SEQ ID NO: 205022 - DNA, 16 bp, P. troglodytes
agctgggattgcaggt

SEQ ID NO: 205023 - DNA, 20 bp, P. troglodytes
agctgggcacagtggctcac

SEQ ID NO: 205024 - DNA, 16 bp, P. troglodytes
agctgggcagtggtgg

SEQ ID NO: 205025 - DNA, 16 bp, P. troglodytes
agctgggcatctgggg

SEQ ID NO: 205026 - DNA, 17 bp, P. troglodytes
agctgggcatgatggca

SEQ ID NO: 205027 - DNA, 16 bp, P. troglodytes
agctgggcatgctggt

SEQ ID NO: 205028 - DNA, 16 bp, P. troglodytes
agctgggcatggaggt

SEQ ID NO: 205029 - DNA, 16 bp, P. troglodytes
agctgggcatggcggt

SEQ ID NO: 205030 - DNA, 17 bp, P. troglodytes
agctgggcatgttggca

SEQ ID NO: 205031 - DNA, 16 bp, P. troglodytes
agctgggcattgtggt

SEQ ID NO: 205032 - DNA, 16 bp, P. troglodytes
agctgggcctctgggg

SEQ ID NO: 205033 - DNA, 16 bp, P. troglodytes
agctgggcctgatggt

SEQ ID NO: 205034 - DNA, 16 bp, P. troglodytes
agctgggcctggggag

SEQ ID NO: 205035 - DNA, 16 bp, P. troglodytes
agctgggcctggggga

SEQ ID NO: 205036 - DNA, 16 bp, P. troglodytes
agctgggcctggtggc

SEQ ID NO: 205037 - DNA, 16 bp, P. troglodytes
agctgggcgccgtggc

SEQ ID NO: 205038 - DNA, 16 bp, P. troglodytes
agctgggcgcggtggc

SEQ ID NO: 205039 - DNA, 16 bp, P. troglodytes
agctgggcgtgctggt

SEQ ID NO: 205040 - DNA, 16 bp, P. troglodytes
agctgggcgtggaggc

SEQ ID NO: 205041 - DNA, 16 bp, P. troglodytes
agctgggcgtggtagc

SEQ ID NO: 205042 - DNA, 16 bp, P. troglodytes
agctgggcgtggtcat

SEQ ID NO: 205043 - DNA, 20 bp, P. troglodytes
agctgggcgtggtggctcat

SEQ ID NO: 205044 - DNA, 16 bp, P. troglodytes
agctgggctacaggtg

SEQ ID NO: 205045 - DNA, 16 bp, P. troglodytes
agctgggctgccaggg

SEQ ID NO: 205046 - DNA, 16 bp, P. troglodytes
agctgggctgggctgg

SEQ ID NO: 205047 - DNA, 16 bp, P. troglodytes
agctgggctgggttcc

SEQ ID NO: 205048 - DNA, 16 bp, P. troglodytes
agctgggcttcctggg

SEQ ID NO: 205049 - DNA, 16 bp, P. troglodytes
agctgggcttggtggc

SEQ ID NO: 205050 - DNA, 16 bp, P. troglodytes
agctgggcttggtggt

SEQ ID NO: 205051 - DNA, 16 bp, P. troglodytes
agctggggaagagaga

SEQ ID NO: 205052 - DNA, 16 bp, P. troglodytes
agctggggaggcctca

SEQ ID NO: 205053 - DNA, 16 bp, P. troglodytes
agctggggccacaggc

SEQ ID NO: 205054 - DNA, 16 bp, P. troglodytes
agctggggctacagga

SEQ ID NO: 205055 - DNA, 16 bp, P. troglodytes
agctggggctgcaggc

SEQ ID NO: 205056 - DNA, 16 bp, P. troglodytes
agctggggctggaacc

SEQ ID NO: 205057 - DNA, 16 bp, P. troglodytes
agctggggctggggct

SEQ ID NO: 205058 - DNA, 16 bp, P. troglodytes
agctgggggcagtggc

SEQ ID NO: 205059 - DNA, 16 bp, P. troglodytes
agctgggtgactttgg

SEQ ID NO: 205060 - DNA, 16 bp, P. troglodytes
agctgggtgcagtggg

SEQ ID NO: 205061 - DNA, 16 bp, P. troglodytes
agctgggtgcagtggt

SEQ ID NO: 205062 - DNA, 16 bp, P. troglodytes
agctgggtgctgtggc

SEQ ID NO: 205063 - DNA, 16 bp, P. troglodytes
agctgggtggtggtgg

SEQ ID NO: 205064 - DNA, 16 bp, P. troglodytes
agctggtaaatggcag

SEQ ID NO: 205065 - DNA, 16 bp, P. troglodytes
agctggtccatcagaa

SEQ ID NO: 205066 - DNA, 19 bp, P. troglodytes
agctggtctcaaactccta

SEQ ID NO: 205067 - DNA, 16 bp, P. troglodytes
agctggtctcgaactc

SEQ ID NO: 205068 - DNA, 20 bp, P. troglodytes
agctggtcttgaactcctgg

SEQ ID NO: 205069 - DNA, 16 bp, P. troglodytes
agctggtggccattat

SEQ ID NO: 205070 - DNA, 16 bp, P. troglodytes
agctggtggtgttaga

SEQ ID NO: 205071 - DNA, 16 bp, P. troglodytes
agctgtaaaactacaa

SEQ ID NO: 205072 - DNA, 16 bp, P. troglodytes
agctgtaaccaatcca

SEQ ID NO: 205073 - DNA, 16 bp, P. troglodytes
agctgtagttccagct

SEQ ID NO: 205074 - DNA, 23 bp, P. troglodytes
agctgtcagacagggacatttaa

SEQ ID NO: 205075 - DNA, 16 bp, P. troglodytes
agctgtcatcacacca

SEQ ID NO: 205076 - DNA, 16 bp, P. troglodytes
agctgtcatcatgcca

SEQ ID NO: 205077 - DNA, 16 bp, P. troglodytes
agctgtccttcagaaa

SEQ ID NO: 205078 - DNA, 16 bp, P. troglodytes
agctgtcttttctttt

SEQ ID NO: 205079 - DNA, 16 bp, P. troglodytes
agctgtgactacaggc

SEQ ID NO: 205080 - DNA, 16 bp, P. troglodytes
agctgtgactgcacca

SEQ ID NO: 205081 - DNA, 16 bp, P. troglodytes
agctgtgagacaaaag

SEQ ID NO: 205082 - DNA, 16 bp, P. troglodytes
agctgtgagacagaag

SEQ ID NO: 205083 - DNA, 16 bp, P. troglodytes
agctgtgagctgtgca

SEQ ID NO: 205084 - DNA, 16 bp, P. troglodytes
agctgtgatcacactg

SEQ ID NO: 205085 - DNA, 16 bp, P. troglodytes
agctgtgatcacagca

SEQ ID NO: 205086 - DNA, 16 bp, P. troglodytes
agctgtgatcatgcca

SEQ ID NO: 205087 - DNA, 16 bp, P. troglodytes
agctgtgatgatgcca

SEQ ID NO: 205088 - DNA, 17 bp, P. troglodytes
agctgtgattgcaccac

SEQ ID NO: 205089 - DNA, 16 bp, P. troglodytes
agctgtgattgcactg

SEQ ID NO: 205090 - DNA, 20 bp, P. troglodytes
agctgtgattgtgccactgc

SEQ ID NO: 205091 - DNA, 16 bp, P. troglodytes
agctgtgattgtgcta

SEQ ID NO: 205092 - DNA, 16 bp, P. troglodytes
agctgtgcagattctc

SEQ ID NO: 205093 - DNA, 16 bp, P. troglodytes
agctgtgcccaggagg

SEQ ID NO: 205094 - DNA, 16 bp, P. troglodytes
agctgtggagggtgca

SEQ ID NO: 205095 - DNA, 16 bp, P. troglodytes
agctgtggcaatttct

SEQ ID NO: 205096 - DNA, 16 bp, P. troglodytes
agctgtggcagccatc

SEQ ID NO: 205097 - DNA, 16 bp, P. troglodytes
agctgtggctgaaagg

SEQ ID NO: 205098 - DNA, 16 bp, P. troglodytes
agctgtgtgaacttag

SEQ ID NO: 205099 - DNA, 16 bp, P. troglodytes
agctgtgtgaacttgg

SEQ ID NO: 205100 - DNA, 16 bp, P. troglodytes
agctgtgtgacactga

SEQ ID NO: 205101 - DNA, 16 bp, P. troglodytes
agctgtgtgacattga

SEQ ID NO: 205102 - DNA, 16 bp, P. troglodytes
agctgtgtgaccctag

SEQ ID NO: 205103 - DNA, 16 bp, P. troglodytes
agctgtgtgacttcag

SEQ ID NO: 205104 - DNA, 16 bp, P. troglodytes
agctgtgtgactttag

SEQ ID NO: 205105 - DNA, 16 bp, P. troglodytes
agctgtgtgactttgg

SEQ ID NO: 205106 - DNA, 16 bp, P. troglodytes
agctgtgtgatcatgg

SEQ ID NO: 205107 - DNA, 16 bp, P. troglodytes
agctgtgtgatcttgg

SEQ ID NO: 205108 - DNA, 16 bp, P. troglodytes
agctgtgtgattttgg

SEQ ID NO: 205109 - DNA, 16 bp, P. troglodytes
agctgtgtggtcttgg

SEQ ID NO: 205110 - DNA, 16 bp, P. troglodytes
agctgtgttaccttgg

SEQ ID NO: 205111 - DNA, 17 bp, P. troglodytes
agctgtgttccaataaa

SEQ ID NO: 205112 - DNA, 16 bp, P. troglodytes
agctgttaacacttaa

SEQ ID NO: 205113 - DNA, 16 bp, P. troglodytes
agctgttattttaaaa

SEQ ID NO: 205114 - DNA, 16 bp, P. troglodytes
agctgttcctgttcag

SEQ ID NO: 205115 - DNA, 16 bp, P. troglodytes
agctgttggtggatct

SEQ ID NO: 205116 - DNA, 16 bp, P. troglodytes
agctgtttctaaaatt

SEQ ID NO: 205117 - DNA, 16 bp, P. troglodytes
agctgtttgagctcct

SEQ ID NO: 205118 - DNA, 16 bp, P. troglodytes
agctgtttgggaggct

SEQ ID NO: 205119 - DNA, 16 bp, P. troglodytes
agctgttttccaaagt

SEQ ID NO: 205120 - DNA, 16 bp, P. troglodytes
agctgttttcttttct

SEQ ID NO: 205121 - DNA, 16 bp, P. troglodytes
agctgttttgaaatat

SEQ ID NO: 205122 - DNA, 16 bp, P. troglodytes
agctgtttttatttct

SEQ ID NO: 205123 - DNA, 16 bp, P. troglodytes
agctgttttttttaaa

SEQ ID NO: 205124 - DNA, 16 bp, P. troglodytes
agcttaaacaacagaa

SEQ ID NO: 205125 - DNA, 16 bp, P. troglodytes
agcttaaggagctttt

SEQ ID NO: 205126 - DNA, 16 bp, P. troglodytes
agcttaagtgacagag

SEQ ID NO: 205127 - DNA, 16 bp, P. troglodytes
agcttaatttttattt

SEQ ID NO: 205128 - DNA, 16 bp, P. troglodytes
agcttacactctagtg

SEQ ID NO: 205129 - DNA, 16 bp, P. troglodytes
agcttacattctagca

SEQ ID NO: 205130 - DNA, 16 bp, P. troglodytes
agcttactgtaacctc

SEQ ID NO: 205131 - DNA, 16 bp, P. troglodytes
agcttagcctagccta

SEQ ID NO: 205132 - DNA, 16 bp, P. troglodytes
agcttatttggatttt

SEQ ID NO: 205133 - DNA, 16 bp, P. troglodytes
agcttatttttaaatt

SEQ ID NO: 205134 - DNA, 16 bp, P. troglodytes
agcttcagcttcctca

SEQ ID NO: 205135 - DNA, 16 bp, P. troglodytes
agcttcagtttccttt

SEQ ID NO: 205136 - DNA, 16 bp, P. troglodytes
agcttcatccacgtcc

SEQ ID NO: 205137 - DNA, 16 bp, P. troglodytes
agcttcatctgtgttt

SEQ ID NO: 205138 - DNA, 16 bp, P. troglodytes
agcttccacagcatgg

SEQ ID NO: 205139 - DNA, 16 bp, P. troglodytes
agcttccagaggctgc

SEQ ID NO: 205140 - DNA, 16 bp, P. troglodytes
agcttccaggggaagg

SEQ ID NO: 205141 - DNA, 16 bp, P. troglodytes
agcttccagtttttct

SEQ ID NO: 205142 - DNA, 16 bp, P. troglodytes
agcttcccaaatagct

SEQ ID NO: 205143 - DNA, 16 bp, P. troglodytes
agcttcctgaagccct

SEQ ID NO: 205144 - DNA, 16 bp, P. troglodytes
agcttcctgaagcctc

SEQ ID NO: 205145 - DNA, 16 bp, P. troglodytes
agcttcctgaggccct

SEQ ID NO: 205146 - DNA, 16 bp, P. troglodytes
agcttcctgaggcctc

SEQ ID NO: 205147 - DNA, 16 bp, P. troglodytes
agcttcctgagggcag

SEQ ID NO: 205148 - DNA, 16 bp, P. troglodytes
agcttcctgagtagcc

SEQ ID NO: 205149 - DNA, 16 bp, P. troglodytes
agcttcctgcagcctc

SEQ ID NO: 205150 - DNA, 16 bp, P. troglodytes
agcttcctggagctgg

SEQ ID NO: 205151 - DNA, 16 bp, P. troglodytes
agcttcctggggcctc

SEQ ID NO: 205152 - DNA, 17 bp, P. troglodytes
agcttcgcctcctgggt

SEQ ID NO: 205153 - DNA, 17 bp, P. troglodytes
agcttctctggataagg

SEQ ID NO: 205154 - DNA, 16 bp, P. troglodytes
agcttctgaatgtgtt

SEQ ID NO: 205155 - DNA, 17 bp, P. troglodytes
agcttctgcacagcaaa

SEQ ID NO: 205156 - DNA, 16 bp, P. troglodytes
agcttctgcacagcga

SEQ ID NO: 205157 - DNA, 16 bp, P. troglodytes
agcttctgcagagcaa

SEQ ID NO: 205158 - DNA, 16 bp, P. troglodytes
agcttctgcctcctgg

SEQ ID NO: 205159 - DNA, 16 bp, P. troglodytes
agcttcttttcatgtg

SEQ ID NO: 205160 - DNA, 16 bp, P. troglodytes
agcttgaaatcagcca

SEQ ID NO: 205161 - DNA, 16 bp, P. troglodytes
agcttgaaccctggag

SEQ ID NO: 205162 - DNA, 16 bp, P. troglodytes
agcttgaacctgagag

SEQ ID NO: 205163 - DNA, 16 bp, P. troglodytes
agcttgaactcaggag

SEQ ID NO: 205164 - DNA, 16 bp, P. troglodytes
agcttgaagactggct

SEQ ID NO: 205165 - DNA, 16 bp, P. troglodytes
agcttgaagatgtgac

SEQ ID NO: 205166 - DNA, 16 bp, P. troglodytes
agcttgaatttctccc

SEQ ID NO: 205167 - DNA, 16 bp, P. troglodytes
agcttgagaagaatgt

SEQ ID NO: 205168 - DNA, 16 bp, P. troglodytes
agcttgagaatggact

SEQ ID NO: 205169 - DNA, 16 bp, P. troglodytes
agcttgaggagcaagg

SEQ ID NO: 205170 - DNA, 16 bp, P. troglodytes
agcttgcagatgacct

SEQ ID NO: 205171 - DNA, 16 bp, P. troglodytes
agcttgcagggctgga

SEQ ID NO: 205172 - DNA, 16 bp, P. troglodytes
agcttgcagggtttct

SEQ ID NO: 205173 - DNA, 16 bp, P. troglodytes
agcttgcagtgagctg

SEQ ID NO: 205174 - DNA, 16 bp, P. troglodytes
agcttgccagctccca

SEQ ID NO: 205175 - DNA, 16 bp, P. troglodytes
agcttgctgcaacctc

SEQ ID NO: 205176 - DNA, 16 bp, P. troglodytes
agcttgctgggttcca

SEQ ID NO: 205177 - DNA, 16 bp, P. troglodytes
agcttggagatgccag

SEQ ID NO: 205178 - DNA, 17 bp, P. troglodytes
agcttggaggagtttgt

SEQ ID NO: 205179 - DNA, 16 bp, P. troglodytes
agcttggatttttttt

SEQ ID NO: 205180 - DNA, 16 bp, P. troglodytes
agcttggccaacatga

SEQ ID NO: 205181 - DNA, 16 bp, P. troglodytes
agcttgggagacagaa

SEQ ID NO: 205182 - DNA, 16 bp, P. troglodytes
agcttgggcaacagat

SEQ ID NO: 205183 - DNA, 16 bp, P. troglodytes
agcttgggtggaagaa

SEQ ID NO: 205184 - DNA, 16 bp, P. troglodytes
agcttggtcgctgttg

SEQ ID NO: 205185 - DNA, 16 bp, P. troglodytes
agcttggtttattttt

SEQ ID NO: 205186 - DNA, 16 bp, P. troglodytes
agcttgtatagccaag

SEQ ID NO: 205187 - DNA, 16 bp, P. troglodytes
agcttgtgtgtgtgtg

SEQ ID NO: 205188 - DNA, 16 bp, P. troglodytes
agcttgttggaaatgc

SEQ ID NO: 205189 - DNA, 16 bp, P. troglodytes
agcttgtttttgattt

SEQ ID NO: 205190 - DNA, 16 bp, P. troglodytes
agctttaaaaaataca

SEQ ID NO: 205191 - DNA, 16 bp, P. troglodytes
agctttaaaatttgat

SEQ ID NO: 205192 - DNA, 16 bp, P. troglodytes
agctttagtagatact

SEQ ID NO: 205193 - DNA, 16 bp, P. troglodytes
agctttataaatgaag

SEQ ID NO: 205194 - DNA, 16 bp, P. troglodytes
agctttataataaata

SEQ ID NO: 205195 - DNA, 16 bp, P. troglodytes
agctttatctgtattt

SEQ ID NO: 205196 - DNA, 16 bp, P. troglodytes
agctttattgagatat

SEQ ID NO: 205197 - DNA, 16 bp, P. troglodytes
agctttattgagatgt

SEQ ID NO: 205198 - DNA, 17 bp, P. troglodytes
agctttattgctcacac

SEQ ID NO: 205199 - DNA, 16 bp, P. troglodytes
agctttcaagcaaaaa

SEQ ID NO: 205200 - DNA, 16 bp, P. troglodytes
agctttcaagtgaaaa

SEQ ID NO: 205201 - DNA, 16 bp, P. troglodytes
agctttcagtctttca

SEQ ID NO: 205202 - DNA, 16 bp, P. troglodytes
agctttcccttttctc

SEQ ID NO: 205203 - DNA, 16 bp, P. troglodytes
agctttccttttgctt

SEQ ID NO: 205204 - DNA, 16 bp, P. troglodytes
agctttctacatatag

SEQ ID NO: 205205 - DNA, 16 bp, P. troglodytes
agctttctgaggccct

SEQ ID NO: 205206 - DNA, 16 bp, P. troglodytes
agctttgagaagaggg

SEQ ID NO: 205207 - DNA, 16 bp, P. troglodytes
agctttgcagggccat

SEQ ID NO: 205208 - DNA, 16 bp, P. troglodytes
agctttgggatgtggg

SEQ ID NO: 205209 - DNA, 16 bp, P. troglodytes
agctttgtcccagaag

SEQ ID NO: 205210 - DNA, 16 bp, P. troglodytes
agctttgtgaccttga

SEQ ID NO: 205211 - DNA, 16 bp, P. troglodytes
agctttgtgaccttgg

SEQ ID NO: 205212 - DNA, 16 bp, P. troglodytes
agctttgtgactttgg

SEQ ID NO: 205213 - DNA, 16 bp, P. troglodytes
agctttgtttttaaaa

SEQ ID NO: 205214 - DNA, 16 bp, P. troglodytes
agcttttaaaaaaatt

SEQ ID NO: 205215 - DNA, 16 bp, P. troglodytes
agcttttaaaaatatt

SEQ ID NO: 205216 - DNA, 16 bp, P. troglodytes
agcttttaatgtttaa

SEQ ID NO: 205217 - DNA, 16 bp, P. troglodytes
agcttttacttttctt

SEQ ID NO: 205218 - DNA, 16 bp, P. troglodytes
agcttttagtatattc

SEQ ID NO: 205219 - DNA, 16 bp, P. troglodytes
agcttttatcttccct

SEQ ID NO: 205220 - DNA, 16 bp, P. troglodytes
agcttttctttttcct

SEQ ID NO: 205221 - DNA, 16 bp, P. troglodytes
agcttttgaatatgtt

SEQ ID NO: 205222 - DNA, 16 bp, P. troglodytes
agcttttgaatttttt

SEQ ID NO: 205223 - DNA, 16 bp, P. troglodytes
agcttttgattgaaag

SEQ ID NO: 205224 - DNA, 16 bp, P. troglodytes
agcttttgtttcattt

SEQ ID NO: 205225 - DNA, 16 bp, P. troglodytes
agctttttaaaaacag

SEQ ID NO: 205226 - DNA, 16 bp, P. troglodytes
agctttttaaaaatac

SEQ ID NO: 205227 - DNA, 16 bp, P. troglodytes
agctttttaaattttt

SEQ ID NO: 205228 - DNA, 16 bp, P. troglodytes
agctttttattttgaa

SEQ ID NO: 205229 - DNA, 16 bp, P. troglodytes
agctttttcacctttc

SEQ ID NO: 205230 - DNA, 16 bp, P. troglodytes
agctttttgacatgct

SEQ ID NO: 205231 - DNA, 16 bp, P. troglodytes
agctttttggtttaat

SEQ ID NO: 205232 - DNA, 16 bp, P. troglodytes
agcttttttcataatt

SEQ ID NO: 205233 - DNA, 16 bp, P. troglodytes
agctttttttcctatg

SEQ ID NO: 205234 - DNA, 16 bp, P. troglodytes
aggaaaaaaaatcttt

SEQ ID NO: 205235 - DNA, 16 bp, P. troglodytes
aggaaaaaaagatttt

SEQ ID NO: 205236 - DNA, 16 bp, P. troglodytes
aggaaaaaaataatct

SEQ ID NO: 205237 - DNA, 16 bp, P. troglodytes
aggaaaaaaatccaga

SEQ ID NO: 205238 - DNA, 16 bp, P. troglodytes
aggaaaaaaatgcatt

SEQ ID NO: 205239 - DNA, 16 bp, P. troglodytes
aggaaaaaaatggttt

SEQ ID NO: 205240 - DNA, 16 bp, P. troglodytes
aggaaaaaatattttt

SEQ ID NO: 205241 - DNA, 16 bp, P. troglodytes
aggaaaaaatctcaga

SEQ ID NO: 205242 - DNA, 16 bp, P. troglodytes
aggaaaaaatgtattt

SEQ ID NO: 205243 - DNA, 16 bp, P. troglodytes
aggaaaaaatgttcag

SEQ ID NO: 205244 - DNA, 16 bp, P. troglodytes
aggaaaaacagtcttg

SEQ ID NO: 205245 - DNA, 16 bp, P. troglodytes
aggaaaaacagtttgt

SEQ ID NO: 205246 - DNA, 16 bp, P. troglodytes
aggaaaaagcatagta

SEQ ID NO: 205247 - DNA, 16 bp, P. troglodytes
aggaaaaataaaactg

SEQ ID NO: 205248 - DNA, 16 bp, P. troglodytes
aggaaaaataaattct

SEQ ID NO: 205249 - DNA, 16 bp, P. troglodytes
aggaaaaataagtttt

SEQ ID NO: 205250 - DNA, 16 bp, P. troglodytes
aggaaaaatacataat

SEQ ID NO: 205251 - DNA, 16 bp, P. troglodytes
aggaaaaatagctaat

SEQ ID NO: 205252 - DNA, 16 bp, P. troglodytes
aggaaaacaagctcag

SEQ ID NO: 205253 - DNA, 16 bp, P. troglodytes
aggaaaacagcctgtt

SEQ ID NO: 205254 - DNA, 16 bp, P. troglodytes
aggaaaacatttttat

SEQ ID NO: 205255 - DNA, 16 bp, P. troglodytes
aggaaaacatttttct

SEQ ID NO: 205256 - DNA, 16 bp, P. troglodytes
aggaaaaccaggagag

SEQ ID NO: 205257 - DNA, 16 bp, P. troglodytes
aggaaaaccttaccaa

SEQ ID NO: 205258 - DNA, 16 bp, P. troglodytes
aggaaaactgagaaaa

SEQ ID NO: 205259 - DNA, 16 bp, P. troglodytes
aggaaaactgaggccc

SEQ ID NO: 205260 - DNA, 16 bp, P. troglodytes
aggaaaacttagaact

SEQ ID NO: 205261 - DNA, 16 bp, P. troglodytes
aggaaaacttttaaaa

SEQ ID NO: 205262 - DNA, 16 bp, P. troglodytes
aggaaaagaaactatc

SEQ ID NO: 205263 - DNA, 16 bp, P. troglodytes
aggaaaagaagaaatc

SEQ ID NO: 205264 - DNA, 16 bp, P. troglodytes
aggaaaagaagaagtc

SEQ ID NO: 205265 - DNA, 16 bp, P. troglodytes
aggaaaagaagtaatt

SEQ ID NO: 205266 - DNA, 16 bp, P. troglodytes
aggaaaagaattcatt

SEQ ID NO: 205267 - DNA, 16 bp, P. troglodytes
aggaaaagaatttagt

SEQ ID NO: 205268 - DNA, 16 bp, P. troglodytes
aggaaaagagaaagtc

SEQ ID NO: 205269 - DNA, 16 bp, P. troglodytes
aggaaaagaggaagtt

SEQ ID NO: 205270 - DNA, 16 bp, P. troglodytes
aggaaaagatgttcaa

SEQ ID NO: 205271 - DNA, 16 bp, P. troglodytes
aggaaaaggaaaactg

SEQ ID NO: 205272 - DNA, 16 bp, P. troglodytes
aggaaaagggccctca

SEQ ID NO: 205273 - DNA, 16 bp, P. troglodytes
aggaaaaggggaagtc

SEQ ID NO: 205274 - DNA, 16 bp, P. troglodytes
aggaaaagtggaagct

SEQ ID NO: 205275 - DNA, 16 bp, P. troglodytes
aggaaaagtttggaac

SEQ ID NO: 205276 - DNA, 16 bp, P. troglodytes
aggaaaataaaaatct

SEQ ID NO: 205277 - DNA, 16 bp, P. troglodytes
aggaaaataaatctta

SEQ ID NO: 205278 - DNA, 16 bp, P. troglodytes
aggaaaataattattt

SEQ ID NO: 205279 - DNA, 16 bp, P. troglodytes
aggaaaataattttcc

SEQ ID NO: 205280 - DNA, 16 bp, P. troglodytes
aggaaaatacaaattt

SEQ ID NO: 205281 - DNA, 16 bp, P. troglodytes
aggaaaatagcttgaa

SEQ ID NO: 205282 - DNA, 16 bp, P. troglodytes
aggaaaatatacaaat

SEQ ID NO: 205283 - DNA, 16 bp, P. troglodytes
aggaaaatatcttggg

SEQ ID NO: 205284 - DNA, 16 bp, P. troglodytes
aggaaaatattatttc

SEQ ID NO: 205285 - DNA, 16 bp, P. troglodytes
aggaaaatattcaaaa

SEQ ID NO: 205286 - DNA, 16 bp, P. troglodytes
aggaaaatattttcta

SEQ ID NO: 205287 - DNA, 16 bp, P. troglodytes
aggaaaatgaggctga

SEQ ID NO: 205288 - DNA, 16 bp, P. troglodytes
aggaaaatggataaat

SEQ ID NO: 205289 - DNA, 16 bp, P. troglodytes
aggaaaatgtctccag

SEQ ID NO: 205290 - DNA, 16 bp, P. troglodytes
aggaaaatgtgaatta

SEQ ID NO: 205291 - DNA, 16 bp, P. troglodytes
aggaaaatgtgaccca

SEQ ID NO: 205292 - DNA, 16 bp, P. troglodytes
aggaaaatgtgtgaaa

SEQ ID NO: 205293 - DNA, 16 bp, P. troglodytes
aggaaaattccagaaa

SEQ ID NO: 205294 - DNA, 16 bp, P. troglodytes
aggaaaattgtttgaa

SEQ ID NO: 205295 - DNA, 16 bp, P. troglodytes
aggaaacaaaataatt

SEQ ID NO: 205296 - DNA, 16 bp, P. troglodytes
aggaaacaacaggggc

SEQ ID NO: 205297 - DNA, 16 bp, P. troglodytes
aggaaacactaaacat

SEQ ID NO: 205298 - DNA, 16 bp, P. troglodytes
aggaaacagaagccca

SEQ ID NO: 205299 - DNA, 16 bp, P. troglodytes
aggaaacagacacaga

SEQ ID NO: 205300 - DNA, 16 bp, P. troglodytes
aggaaacagagacaca

SEQ ID NO: 205301 - DNA, 16 bp, P. troglodytes
aggaaacagattcaga

SEQ ID NO: 205302 - DNA, 16 bp, P. troglodytes
aggaaacagattcttc

SEQ ID NO: 205303 - DNA, 16 bp, P. troglodytes
aggaaacagcaaatgc

SEQ ID NO: 205304 - DNA, 16 bp, P. troglodytes
aggaaacatcagataa

SEQ ID NO: 205305 - DNA, 16 bp, P. troglodytes
aggaaacattaaaatg

SEQ ID NO: 205306 - DNA, 16 bp, P. troglodytes
aggaaactaacacaga

SEQ ID NO: 205307 - DNA, 16 bp, P. troglodytes
aggaaactaacattta

SEQ ID NO: 205308 - DNA, 16 bp, P. troglodytes
aggaaactcaatgaaa

SEQ ID NO: 205309 - DNA, 16 bp, P. troglodytes
aggaaactgaagcata

SEQ ID NO: 205310 - DNA, 16 bp, P. troglodytes
aggaaactgaagcatg

SEQ ID NO: 205311 - DNA, 16 bp, P. troglodytes
aggaaactgaagctca

SEQ ID NO: 205312 - DNA, 16 bp, P. troglodytes
aggaaactgaattcaa

SEQ ID NO: 205313 - DNA, 16 bp, P. troglodytes
aggaaactgaccctca

SEQ ID NO: 205314 - DNA, 16 bp, P. troglodytes
aggaaactgagatcca

SEQ ID NO: 205315 - DNA, 16 bp, P. troglodytes
aggaaactgaggcaga

SEQ ID NO: 205316 - DNA, 16 bp, P. troglodytes
aggaaactgaggccag

SEQ ID NO: 205317 - DNA, 16 bp, P. troglodytes
aggaaactgaggccca

SEQ ID NO: 205318 - DNA, 16 bp, P. troglodytes
aggaaacttacagtta

SEQ ID NO: 205319 - DNA, 16 bp, P. troglodytes
aggaaacttcagtggt

SEQ ID NO: 205320 - DNA, 16 bp, P. troglodytes
aggaaagaaaaatctt

SEQ ID NO: 205321 - DNA, 16 bp, P. troglodytes
aggaaagaaaaatgca

SEQ ID NO: 205322 - DNA, 16 bp, P. troglodytes
aggaaagaaaagctaa

SEQ ID NO: 205323 - DNA, 16 bp, P. troglodytes
aggaaagaaagaaatc

SEQ ID NO: 205324 - DNA, 16 bp, P. troglodytes
aggaaagaaagaacat

SEQ ID NO: 205325 - DNA, 16 bp, P. troglodytes
aggaaagaaatcctgt

SEQ ID NO: 205326 - DNA, 16 bp, P. troglodytes
aggaaagaaattctga

SEQ ID NO: 205327 - DNA, 16 bp, P. troglodytes
aggaaagacaattttg

SEQ ID NO: 205328 - DNA, 16 bp, P. troglodytes
aggaaagacagaaaat

SEQ ID NO: 205329 - DNA, 16 bp, P. troglodytes
aggaaagacatttaat

SEQ ID NO: 205330 - DNA, 16 bp, P. troglodytes
aggaaagactgagaaa

SEQ ID NO: 205331 - DNA, 16 bp, P. troglodytes
aggaaagagcattttc

SEQ ID NO: 205332 - DNA, 16 bp, P. troglodytes
aggaaagagtggcatg

SEQ ID NO: 205333 - DNA, 16 bp, P. troglodytes
aggaaagagtttaatt

SEQ ID NO: 205334 - DNA, 16 bp, P. troglodytes
aggaaagatccaaaac

SEQ ID NO: 205335 - DNA, 16 bp, P. troglodytes
aggaaagattcaaaat

SEQ ID NO: 205336 - DNA, 16 bp, P. troglodytes
aggaaagctctggctg

SEQ ID NO: 205337 - DNA, 16 bp, P. troglodytes
aggaaagctgagaaaa

SEQ ID NO: 205338 - DNA, 16 bp, P. troglodytes
aggaaaggaaatcagt

SEQ ID NO: 205339 - DNA, 16 bp, P. troglodytes
aggaaagtgaggcaca

SEQ ID NO: 205340 - DNA, 16 bp, P. troglodytes
aggaaagtgaggccca

SEQ ID NO: 205341 - DNA, 16 bp, P. troglodytes
aggaaagtttgagaaa

SEQ ID NO: 205342 - DNA, 16 bp, P. troglodytes
aggaaataaaacattt

SEQ ID NO: 205343 - DNA, 16 bp, P. troglodytes
aggaaataaaatcaat

SEQ ID NO: 205344 - DNA, 16 bp, P. troglodytes
aggaaataaacatttt

SEQ ID NO: 205345 - DNA, 16 bp, P. troglodytes
aggaaataaaggtatt

SEQ ID NO: 205346 - DNA, 16 bp, P. troglodytes
aggaaataactaaaat

SEQ ID NO: 205347 - DNA, 16 bp, P. troglodytes
aggaaataatcttaag

SEQ ID NO: 205348 - DNA, 16 bp, P. troglodytes
aggaaataatgaagat

SEQ ID NO: 205349 - DNA, 16 bp, P. troglodytes
aggaaataccattcag

SEQ ID NO: 205350 - DNA, 16 bp, P. troglodytes
aggaaataccattcta

SEQ ID NO: 205351 - DNA, 16 bp, P. troglodytes
aggaaataccattttg

SEQ ID NO: 205352 - DNA, 16 bp, P. troglodytes
aggaaatacttccaaa

SEQ ID NO: 205353 - DNA, 16 bp, P. troglodytes
aggaaatactttcaaa

SEQ ID NO: 205354 - DNA, 16 bp, P. troglodytes
aggaaatagaaacaca

SEQ ID NO: 205355 - DNA, 16 bp, P. troglodytes
aggaaatagataaatt

SEQ ID NO: 205356 - DNA, 16 bp, P. troglodytes
aggaaatatattcaga

SEQ ID NO: 205357 - DNA, 16 bp, P. troglodytes
aggaaatatcattctg

SEQ ID NO: 205358 - DNA, 16 bp, P. troglodytes
aggaaatatttctaaa

SEQ ID NO: 205359 - DNA, 16 bp, P. troglodytes
aggaaatcaaactgtt

SEQ ID NO: 205360 - DNA, 16 bp, P. troglodytes
aggaaatcaagaaagc

SEQ ID NO: 205361 - DNA, 21 bp, P. troglodytes
aggaaatcacaagggtattga

SEQ ID NO: 205362 - DNA, 16 bp, P. troglodytes
aggaaatcagaaaaat

SEQ ID NO: 205363 - DNA, 16 bp, P. troglodytes
aggaaatccaaaacct

SEQ ID NO: 205364 - DNA, 16 bp, P. troglodytes
aggaaatctcaactgc

SEQ ID NO: 205365 - DNA, 16 bp, P. troglodytes
aggaaatgaaaatcaa

SEQ ID NO: 205366 - DNA, 16 bp, P. troglodytes
aggaaatgaaatattt

SEQ ID NO: 205367 - DNA, 16 bp, P. troglodytes
aggaaatgaagggtat

SEQ ID NO: 205368 - DNA, 16 bp, P. troglodytes
aggaaatgaataaatg

SEQ ID NO: 205369 - DNA, 16 bp, P. troglodytes
aggaaatgcaaataaa

SEQ ID NO: 205370 - DNA, 16 bp, P. troglodytes
aggaaatgcagagaaa

SEQ ID NO: 205371 - DNA, 16 bp, P. troglodytes
aggaaatgctcaaaga

SEQ ID NO: 205372 - DNA, 16 bp, P. troglodytes
aggaaatgctgagaga

SEQ ID NO: 205373 - DNA, 16 bp, P. troglodytes
aggaaatggaagaaca

SEQ ID NO: 205374 - DNA, 16 bp, P. troglodytes
aggaaatggagacaca

SEQ ID NO: 205375 - DNA, 16 bp, P. troglodytes
aggaaatggattttcc

SEQ ID NO: 205376 - DNA, 16 bp, P. troglodytes
aggaaatggggagatg

SEQ ID NO: 205377 - DNA, 16 bp, P. troglodytes
aggaaatgttttcttc

SEQ ID NO: 205378 - DNA, 16 bp, P. troglodytes
aggaaatgttttcttt

SEQ ID NO: 205379 - DNA, 16 bp, P. troglodytes
aggaaattaaaatgca

SEQ ID NO: 205380 - DNA, 16 bp, P. troglodytes
aggaaattaaatttta

SEQ ID NO: 205381 - DNA, 16 bp, P. troglodytes
aggaaattataaaagt

SEQ ID NO: 205382 - DNA, 16 bp, P. troglodytes
aggaaattctgtcatt

SEQ ID NO: 205383 - DNA, 16 bp, P. troglodytes
aggaaattgaagctca

SEQ ID NO: 205384 - DNA, 16 bp, P. troglodytes
aggaaattgaggccca

SEQ ID NO: 205385 - DNA, 16 bp, P. troglodytes
aggaaatttagaaaat

SEQ ID NO: 205386 - DNA, 16 bp, P. troglodytes
aggaaatttataatca

SEQ ID NO: 205387 - DNA, 16 bp, P. troglodytes
aggaaatttgaataaa

SEQ ID NO: 205388 - DNA, 16 bp, P. troglodytes
aggaaatttggaaaat

SEQ ID NO: 205389 - DNA, 16 bp, P. troglodytes
aggaaattttaaaagt

SEQ ID NO: 205390 - DNA, 16 bp, P. troglodytes
aggaaattttatagca

SEQ ID NO: 205391 - DNA, 16 bp, P. troglodytes
aggaacaaagtcacat

SEQ ID NO: 205392 - DNA, 16 bp, P. troglodytes
aggaacaagaattgct

SEQ ID NO: 205393 - DNA, 16 bp, P. troglodytes
aggaacacagccaaac

SEQ ID NO: 205394 - DNA, 17 bp, P. troglodytes
aggaacacagttcctca

SEQ ID NO: 205395 - DNA, 16 bp, P. troglodytes
aggaacagaaaaccag

SEQ ID NO: 205396 - DNA, 16 bp, P. troglodytes
aggaacagaaaactaa

SEQ ID NO: 205397 - DNA, 16 bp, P. troglodytes
aggaacagaaagttaa

SEQ ID NO: 205398 - DNA, 16 bp, P. troglodytes
aggaacagaagaaata

SEQ ID NO: 205399 - DNA, 16 bp, P. troglodytes
aggaacagcaaggagg

SEQ ID NO: 205400 - DNA, 16 bp, P. troglodytes
aggaacaggagaggcc

SEQ ID NO: 205401 - DNA, 16 bp, P. troglodytes
aggaacagtttgactt

SEQ ID NO: 205402 - DNA, 16 bp, P. troglodytes
aggaacatcttttgtt

SEQ ID NO: 205403 - DNA, 16 bp, P. troglodytes
aggaaccaaccctgcc

SEQ ID NO: 205404 - DNA, 16 bp, P. troglodytes
aggaaccagccctgga

SEQ ID NO: 205405 - DNA, 16 bp, P. troglodytes
aggaaccagctctgcc

SEQ ID NO: 205406 - DNA, 16 bp, P. troglodytes
aggaacctaaccctgt

SEQ ID NO: 205407 - DNA, 16 bp, P. troglodytes
aggaacctgaggcagg

SEQ ID NO: 205408 - DNA, 16 bp, P. troglodytes
aggaaccttttttttt

SEQ ID NO: 205409 - DNA, 16 bp, P. troglodytes
aggaactcttcaagga

SEQ ID NO: 205410 - DNA, 16 bp, P. troglodytes
aggaactgccagactt

SEQ ID NO: 205411 - DNA, 16 bp, P. troglodytes
aggaactgccatactg

SEQ ID NO: 205412 - DNA, 16 bp, P. troglodytes
aggaactggcaaagat

SEQ ID NO: 205413 - DNA, 16 bp, P. troglodytes
aggaactggccatttt

SEQ ID NO: 205414 - DNA, 16 bp, P. troglodytes
aggaactgtcaaacac

SEQ ID NO: 205415 - DNA, 16 bp, P. troglodytes
aggaactttttaaaaa

SEQ ID NO: 205416 - DNA, 16 bp, P. troglodytes
aggaagaaaaatactt

SEQ ID NO: 205417 - DNA, 16 bp, P. troglodytes
aggaagaaaaatgttt

SEQ ID NO: 205418 - DNA, 16 bp, P. troglodytes
aggaagaaactccaga

SEQ ID NO: 205419 - DNA, 16 bp, P. troglodytes
aggaagaaactgaaaa

SEQ ID NO: 205420 - DNA, 16 bp, P. troglodytes
aggaagaaactgaatc

SEQ ID NO: 205421 - DNA, 16 bp, P. troglodytes
aggaagaaagaacatg

SEQ ID NO: 205422 - DNA, 16 bp, P. troglodytes
aggaagaaataaaact

SEQ ID NO: 205423 - DNA, 16 bp, P. troglodytes
aggaagaaatacaaat

SEQ ID NO: 205424 - DNA, 16 bp, P. troglodytes
aggaagaaatcaaatc

SEQ ID NO: 205425 - DNA, 16 bp, P. troglodytes
aggaagaaatcaagaa

SEQ ID NO: 205426 - DNA, 16 bp, P. troglodytes
aggaagaaatggaatc

SEQ ID NO: 205427 - DNA, 16 bp, P. troglodytes
aggaagaaatgttttt

SEQ ID NO: 205428 - DNA, 16 bp, P. troglodytes
aggaagaaattcaaaa

SEQ ID NO: 205429 - DNA, 16 bp, P. troglodytes
aggaagaaattgaaat

SEQ ID NO: 205430 - DNA, 16 bp, P. troglodytes
aggaagaagaaaaatc

SEQ ID NO: 205431 - DNA, 16 bp, P. troglodytes
aggaagaagaaaattt

SEQ ID NO: 205432 - DNA, 16 bp, P. troglodytes
aggaagaagataaatc

SEQ ID NO: 205433 - DNA, 16 bp, P. troglodytes
aggaagaagatgaatc

SEQ ID NO: 205434 - DNA, 16 bp, P. troglodytes
aggaagaagatggcca

SEQ ID NO: 205435 - DNA, 16 bp, P. troglodytes
aggaagaagcagcagc

SEQ ID NO: 205436 - DNA, 16 bp, P. troglodytes
aggaagaagctgaggc

SEQ ID NO: 205437 - DNA, 16 bp, P. troglodytes
aggaagacccccatct

SEQ ID NO: 205438 - DNA, 16 bp, P. troglodytes
aggaagacctgcacca

SEQ ID NO: 205439 - DNA, 16 bp, P. troglodytes
aggaagacttcctgga

SEQ ID NO: 205440 - DNA, 16 bp, P. troglodytes
aggaagagaaaatcaa

SEQ ID NO: 205441 - DNA, 16 bp, P. troglodytes
aggaagagagaattct

SEQ ID NO: 205442 - DNA, 16 bp, P. troglodytes
aggaagagagccctcc

SEQ ID NO: 205443 - DNA, 16 bp, P. troglodytes
aggaagagcaaaggca

SEQ ID NO: 205444 - DNA, 16 bp, P. troglodytes
aggaagagctgatgtt

SEQ ID NO: 205445 - DNA, 16 bp, P. troglodytes
aggaagaggaaattcc

SEQ ID NO: 205446 - DNA, 16 bp, P. troglodytes
aggaagaggaacaggc

SEQ ID NO: 205447 - DNA, 16 bp, P. troglodytes
aggaagaggagaggcc

SEQ ID NO: 205448 - DNA, 16 bp, P. troglodytes
aggaagaggccaggtg

SEQ ID NO: 205449 - DNA, 16 bp, P. troglodytes
aggaagaggctgaggc

SEQ ID NO: 205450 - DNA, 16 bp, P. troglodytes
aggaagatatagaatc

SEQ ID NO: 205451 - DNA, 16 bp, P. troglodytes
aggaagatcacttaag

SEQ ID NO: 205452 - DNA, 16 bp, P. troglodytes
aggaagatctgccaag

SEQ ID NO: 205453 - DNA, 16 bp, P. troglodytes
aggaagatggcttgag

SEQ ID NO: 205454 - DNA, 16 bp, P. troglodytes
aggaagatgtggaaaa

SEQ ID NO: 205455 - DNA, 16 bp, P. troglodytes
aggaagatgtgggaaa

SEQ ID NO: 205456 - DNA, 16 bp, P. troglodytes
aggaagattacttgag

SEQ ID NO: 205457 - DNA, 16 bp, P. troglodytes
aggaagattcaatatt

SEQ ID NO: 205458 - DNA, 16 bp, P. troglodytes
aggaagattttctttt

SEQ ID NO: 205459 - DNA, 16 bp, P. troglodytes
aggaagcaaggcatgt

SEQ ID NO: 205460 - DNA, 16 bp, P. troglodytes
aggaagcacagtgctg

SEQ ID NO: 205461 - DNA, 16 bp, P. troglodytes
aggaagcaggaaagat

SEQ ID NO: 205462 - DNA, 16 bp, P. troglodytes
aggaagcaggctgaga

SEQ ID NO: 205463 - DNA, 16 bp, P. troglodytes
aggaagcagggctggg

SEQ ID NO: 205464 - DNA, 16 bp, P. troglodytes
aggaagccagagagag

SEQ ID NO: 205465 - DNA, 16 bp, P. troglodytes
aggaagccccatccct

SEQ ID NO: 205466 - DNA, 16 bp, P. troglodytes
aggaagctcaaagaaa

SEQ ID NO: 205467 - DNA, 16 bp, P. troglodytes
aggaagctcagtgaaa

SEQ ID NO: 205468 - DNA, 16 bp, P. troglodytes
aggaagctgaggttgg

SEQ ID NO: 205469 - DNA, 16 bp, P. troglodytes
aggaagctgatgcagg

SEQ ID NO: 205470 - DNA, 16 bp, P. troglodytes
aggaagctgcaaaaga

SEQ ID NO: 205471 - DNA, 16 bp, P. troglodytes
aggaagctgcagaaga

SEQ ID NO: 205472 - DNA, 16 bp, P. troglodytes
aggaagctgcagagga

SEQ ID NO: 205473 - DNA, 16 bp, P. troglodytes
aggaagcttcagaaga

SEQ ID NO: 205474 - DNA, 16 bp, P. troglodytes
aggaagcttttagtca

SEQ ID NO: 205475 - DNA, 16 bp, P. troglodytes
aggaaggaaattctaa

SEQ ID NO: 205476 - DNA, 16 bp, P. troglodytes
aggaaggaactgcaga

SEQ ID NO: 205477 - DNA, 16 bp, P. troglodytes
aggaaggactttgtct

SEQ ID NO: 205478 - DNA, 16 bp, P. troglodytes
aggaaggagcagacag

SEQ ID NO: 205479 - DNA, 16 bp, P. troglodytes
aggaaggaggatggct

SEQ ID NO: 205480 - DNA, 16 bp, P. troglodytes
aggaaggaggcagctg

SEQ ID NO: 205481 - DNA, 16 bp, P. troglodytes
aggaaggcaggtgagg

SEQ ID NO: 205482 - DNA, 16 bp, P. troglodytes
aggaaggcatccagtt

SEQ ID NO: 205483 - DNA, 16 bp, P. troglodytes
aggaaggcttcttgga

SEQ ID NO: 205484 - DNA, 16 bp, P. troglodytes
aggaagggcctggtgg

SEQ ID NO: 205485 - DNA, 16 bp, P. troglodytes
aggaagggctttattc

SEQ ID NO: 205486 - DNA, 18 bp, P. troglodytes
aggaaggggctcccacag

SEQ ID NO: 205487 - DNA, 16 bp, P. troglodytes
aggaagggtgaatttg

SEQ ID NO: 205488 - DNA, 16 bp, P. troglodytes
aggaaggtgtccagtt

SEQ ID NO: 205489 - DNA, 16 bp, P. troglodytes
aggaagtcatattgtc

SEQ ID NO: 205490 - DNA, 16 bp, P. troglodytes
aggaagtgaaatcaaa

SEQ ID NO: 205491 - DNA, 16 bp, P. troglodytes
aggaagtggcatttga

SEQ ID NO: 205492 - DNA, 16 bp, P. troglodytes
aggaagtggtggagct

SEQ ID NO: 205493 - DNA, 16 bp, P. troglodytes
aggaagttccaaattt

SEQ ID NO: 205494 - DNA, 16 bp, P. troglodytes
aggaagtttcaaattt

SEQ ID NO: 205495 - DNA, 16 bp, P. troglodytes
aggaataaaataatgg

SEQ ID NO: 205496 - DNA, 16 bp, P. troglodytes
aggaataacattgaat

SEQ ID NO: 205497 - DNA, 16 bp, P. troglodytes
aggaatacatttaaca

SEQ ID NO: 205498 - DNA, 17 bp, P. troglodytes
aggaatagctctaggag

SEQ ID NO: 205499 - DNA, 16 bp, P. troglodytes
aggaatataaaatggt

SEQ ID NO: 205500 - DNA, 16 bp, P. troglodytes
aggaatataaatagtt

SEQ ID NO: 205501 - DNA, 16 bp, P. troglodytes
aggaatatttttatta

SEQ ID NO: 205502 - DNA, 16 bp, P. troglodytes
aggaatattttttaaa

SEQ ID NO: 205503 - DNA, 16 bp, P. troglodytes
aggaatcagagagacc

SEQ ID NO: 205504 - DNA, 16 bp, P. troglodytes
aggaatcatttaaaaa

SEQ ID NO: 205505 - DNA, 16 bp, P. troglodytes
aggaatccaacttaaa

SEQ ID NO: 205506 - DNA, 21 bp, P. troglodytes
aggaatccaacttacaagaga

SEQ ID NO: 205507 - DNA, 16 bp, P. troglodytes
aggaatgaagtactaa

SEQ ID NO: 205508 - DNA, 16 bp, P. troglodytes
aggaatgatcagacag

SEQ ID NO: 205509 - DNA, 16 bp, P. troglodytes
aggaatgcaaagatga

SEQ ID NO: 205510 - DNA, 16 bp, P. troglodytes
aggaatggaatttctg

SEQ ID NO: 205511 - DNA, 22 bp, P. troglodytes
aggaatggcaagaccagcaaga

SEQ ID NO: 205512 - DNA, 16 bp, P. troglodytes
aggaatgggagaaaat

SEQ ID NO: 205513 - DNA, 16 bp, P. troglodytes
aggaatggggagtgac

SEQ ID NO: 205514 - DNA, 16 bp, P. troglodytes
aggaatggtatcagct

SEQ ID NO: 205515 - DNA, 16 bp, P. troglodytes
aggaatggtgccatat

SEQ ID NO: 205516 - DNA, 16 bp, P. troglodytes
aggaatgtaaaatgat

SEQ ID NO: 205517 - DNA, 16 bp, P. troglodytes
aggaatgtttttaaaa

SEQ ID NO: 205518 - DNA, 16 bp, P. troglodytes
aggaattagaaaagca

SEQ ID NO: 205519 - DNA, 16 bp, P. troglodytes
aggaattattttaaaa

SEQ ID NO: 205520 - DNA, 16 bp, P. troglodytes
aggaattcaaaaccag

SEQ ID NO: 205521 - DNA, 16 bp, P. troglodytes
aggaattcaaagctgc

SEQ ID NO: 205522 - DNA, 16 bp, P. troglodytes
aggaattcaggagcag

SEQ ID NO: 205523 - DNA, 16 bp, P. troglodytes
aggaattctgggagat

SEQ ID NO: 205524 - DNA, 16 bp, P. troglodytes
aggaatttaatttata

SEQ ID NO: 205525 - DNA, 16 bp, P. troglodytes
aggaatttcatcaaca

SEQ ID NO: 205526 - DNA, 16 bp, P. troglodytes
aggaatttccacactg

SEQ ID NO: 205527 - DNA, 16 bp, P. troglodytes
aggaatttgatcagat

SEQ ID NO: 205528 - DNA, 16 bp, P. troglodytes
aggaatttgtttattt

SEQ ID NO: 205529 - DNA, 16 bp, P. troglodytes
aggaattttataattt

SEQ ID NO: 205530 - DNA, 16 bp, P. troglodytes
aggaatttttttcttt

SEQ ID NO: 205531 - DNA, 16 bp, P. troglodytes
aggacaaagaagggca

SEQ ID NO: 205532 - DNA, 16 bp, P. troglodytes
aggacaactgcagcta

SEQ ID NO: 205533 - DNA, 16 bp, P. troglodytes
aggacaatggcttcca

SEQ ID NO: 205534 - DNA, 16 bp, P. troglodytes
aggacaatttgctgag

SEQ ID NO: 205535 - DNA, 16 bp, P. troglodytes
aggacacaagtcatat

SEQ ID NO: 205536 - DNA, 16 bp, P. troglodytes
aggacacagcaagaag

SEQ ID NO: 205537 - DNA, 16 bp, P. troglodytes
aggacacagcattcat

SEQ ID NO: 205538 - DNA, 16 bp, P. troglodytes
aggacaccaagtcctg

SEQ ID NO: 205539 - DNA, 16 bp, P. troglodytes
aggacaccatcaagaa

SEQ ID NO: 205540 - DNA, 16 bp, P. troglodytes
aggacacccagctggt

SEQ ID NO: 205541 - DNA, 16 bp, P. troglodytes
aggacactgaggctca

SEQ ID NO: 205542 - DNA, 16 bp, P. troglodytes
aggacagaaaatggag

SEQ ID NO: 205543 - DNA, 16 bp, P. troglodytes
aggacagacattccca

SEQ ID NO: 205544 - DNA, 16 bp, P. troglodytes
aggacaggacaggaca

SEQ ID NO: 205545 - DNA, 16 bp, P. troglodytes
aggacaggactgggga

SEQ ID NO: 205546 - DNA, 16 bp, P. troglodytes
aggacaggcacagtgg

SEQ ID NO: 205547 - DNA, 16 bp, P. troglodytes
aggacagggactgtgt

SEQ ID NO: 205548 - DNA, 16 bp, P. troglodytes
aggacagggatttttg

SEQ ID NO: 205549 - DNA, 16 bp, P. troglodytes
aggacagtatcttcaa

SEQ ID NO: 205550 - DNA, 16 bp, P. troglodytes
aggacatccctgaagg

SEQ ID NO: 205551 - DNA, 17 bp, P. troglodytes
aggacatcttcaaggag

SEQ ID NO: 205552 - DNA, 16 bp, P. troglodytes
aggacatgaacagaga

SEQ ID NO: 205553 - DNA, 16 bp, P. troglodytes
aggacattattttgtt

SEQ ID NO: 205554 - DNA, 16 bp, P. troglodytes
aggacattcaaaagca

SEQ ID NO: 205555 - DNA, 16 bp, P. troglodytes
aggaccaacctgggca

SEQ ID NO: 205556 - DNA, 16 bp, P. troglodytes
aggaccaccttcatga

SEQ ID NO: 205557 - DNA, 16 bp, P. troglodytes
aggaccagacagattt

SEQ ID NO: 205558 - DNA, 16 bp, P. troglodytes
aggaccagtctgggca

SEQ ID NO: 205559 - DNA, 16 bp, P. troglodytes
aggaccagttttgtgg

SEQ ID NO: 205560 - DNA, 16 bp, P. troglodytes
aggaccatgctgtttt

SEQ ID NO: 205561 - DNA, 16 bp, P. troglodytes
aggacccagtgggagg

SEQ ID NO: 205562 - DNA, 16 bp, P. troglodytes
aggaccccagtccctt

SEQ ID NO: 205563 - DNA, 16 bp, P. troglodytes
aggacccccagatgac

SEQ ID NO: 205564 - DNA, 16 bp, P. troglodytes
aggaccctctctggaa

SEQ ID NO: 205565 - DNA, 18 bp, P. troglodytes
aggaccctggggccttcc

SEQ ID NO: 205566 - DNA, 16 bp, P. troglodytes
aggacccttgtgatta

SEQ ID NO: 205567 - DNA, 16 bp, P. troglodytes
aggacctggtgggaga

SEQ ID NO: 205568 - DNA, 16 bp, P. troglodytes
aggaccttgatcttgg

SEQ ID NO: 205569 - DNA, 16 bp, P. troglodytes
aggacgtgtttgcttc

SEQ ID NO: 205570 - DNA, 17 bp, P. troglodytes
aggactaacattagcca

SEQ ID NO: 205571 - DNA, 16 bp, P. troglodytes
aggactacaggcaagt

SEQ ID NO: 205572 - DNA, 16 bp, P. troglodytes
aggactacaggcacat

SEQ ID NO: 205573 - DNA, 17 bp, P. troglodytes
aggactacaggcgtgca

SEQ ID NO: 205574 - DNA, 16 bp, P. troglodytes
aggactacatcaaact

SEQ ID NO: 205575 - DNA, 16 bp, P. troglodytes
aggactacatttccca

SEQ ID NO: 205576 - DNA, 16 bp, P. troglodytes
aggactcatgtgatta

SEQ ID NO: 205577 - DNA, 16 bp, P. troglodytes
aggactcttttgccct

SEQ ID NO: 205578 - DNA, 16 bp, P. troglodytes
aggactgcttgagctc

SEQ ID NO: 205579 - DNA, 16 bp, P. troglodytes
aggactgggtccttcc

SEQ ID NO: 205580 - DNA, 16 bp, P. troglodytes
aggactggtttcatgg

SEQ ID NO: 205581 - DNA, 16 bp, P. troglodytes
aggacttcaactcagc

SEQ ID NO: 205582 - DNA, 16 bp, P. troglodytes
aggacttcctggagga

SEQ ID NO: 205583 - DNA, 17 bp, P. troglodytes
aggacttctctgcattg

SEQ ID NO: 205584 - DNA, 16 bp, P. troglodytes
aggacttcttcaagga

SEQ ID NO: 205585 - DNA, 16 bp, P. troglodytes
aggacttgaacccagg

SEQ ID NO: 205586 - DNA, 16 bp, P. troglodytes
aggacttgtatccaga

SEQ ID NO: 205587 - DNA, 16 bp, P. troglodytes
aggagaaaaaccatat

SEQ ID NO: 205588 - DNA, 16 bp, P. troglodytes
aggagaaaaatcagaa

SEQ ID NO: 205589 - DNA, 16 bp, P. troglodytes
aggagaaaaatcatat

SEQ ID NO: 205590 - DNA, 16 bp, P. troglodytes
aggagaaaagtaaaca

SEQ ID NO: 205591 - DNA, 16 bp, P. troglodytes
aggagaaaataaaact

SEQ ID NO: 205592 - DNA, 16 bp, P. troglodytes
aggagaaaatctagat

SEQ ID NO: 205593 - DNA, 17 bp, P. troglodytes
aggagaaaatttttgca

SEQ ID NO: 205594 - DNA, 16 bp, P. troglodytes
aggagaaacaagcttg

SEQ ID NO: 205595 - DNA, 16 bp, P. troglodytes
aggagaaacccttgaa

SEQ ID NO: 205596 - DNA, 16 bp, P. troglodytes
aggagaaagaatttga

SEQ ID NO: 205597 - DNA, 16 bp, P. troglodytes
aggagaaaggtgtgaa

SEQ ID NO: 205598 - DNA, 16 bp, P. troglodytes
aggagaaatgcctaat

SEQ ID NO: 205599 - DNA, 16 bp, P. troglodytes
aggagaacagcttgaa

SEQ ID NO: 205600 - DNA, 16 bp, P. troglodytes
aggagaacctgggagg

SEQ ID NO: 205601 - DNA, 16 bp, P. troglodytes
aggagaactgcctgaa

SEQ ID NO: 205602 - DNA, 16 bp, P. troglodytes
aggagaactgctggaa

SEQ ID NO: 205603 - DNA, 16 bp, P. troglodytes
aggagaagatgggtgt

SEQ ID NO: 205604 - DNA, 16 bp, P. troglodytes
aggagaagcagcagca

SEQ ID NO: 205605 - DNA, 16 bp, P. troglodytes
aggagaagcagcagga

SEQ ID NO: 205606 - DNA, 17 bp, P. troglodytes
aggagaagcaggcacct

SEQ ID NO: 205607 - DNA, 16 bp, P. troglodytes
aggagaaggaatttca

SEQ ID NO: 205608 - DNA, 16 bp, P. troglodytes
aggagaaggctctgca

SEQ ID NO: 205609 - DNA, 16 bp, P. troglodytes
aggagaaggcttcaga

SEQ ID NO: 205610 - DNA, 17 bp, P. troglodytes
aggagaagggcgtgaac

SEQ ID NO: 205611 - DNA, 16 bp, P. troglodytes
aggagaaggtcagaga

SEQ ID NO: 205612 - DNA, 16 bp, P. troglodytes
aggagaatatcttcat

SEQ ID NO: 205613 - DNA, 16 bp, P. troglodytes
aggagaatcatttcaa

SEQ ID NO: 205614 - DNA, 16 bp, P. troglodytes
aggagaatctgagctc

SEQ ID NO: 205615 - DNA, 16 bp, P. troglodytes
aggagaatcttttgag

SEQ ID NO: 205616 - DNA, 17 bp, P. troglodytes
aggagaatgaaactgga

SEQ ID NO: 205617 - DNA, 16 bp, P. troglodytes
aggagaatgctgtgaa

SEQ ID NO: 205618 - DNA, 16 bp, P. troglodytes
aggagaatggcataaa

SEQ ID NO: 205619 - DNA, 16 bp, P. troglodytes
aggagaatggcatcaa

SEQ ID NO: 205620 - DNA, 16 bp, P. troglodytes
aggagaatgttgtgaa

SEQ ID NO: 205621 - DNA, 16 bp, P. troglodytes
aggagaattcatactg

SEQ ID NO: 205622 - DNA, 16 bp, P. troglodytes
aggagaattgacatct

SEQ ID NO: 205623 - DNA, 16 bp, P. troglodytes
aggagaattgctcgag

SEQ ID NO: 205624 - DNA, 18 bp, P. troglodytes
aggagaattgcttgaaca

SEQ ID NO: 205625 - DNA, 16 bp, P. troglodytes
aggagaattgcttgga

SEQ ID NO: 205626 - DNA, 16 bp, P. troglodytes
aggagaattgttggaa

SEQ ID NO: 205627 - DNA, 16 bp, P. troglodytes
aggagaatttaaaaat

SEQ ID NO: 205628 - DNA, 16 bp, P. troglodytes
aggagacacaaacatt

SEQ ID NO: 205629 - DNA, 16 bp, P. troglodytes
aggagacagacagaga

SEQ ID NO: 205630 - DNA, 16 bp, P. troglodytes
aggagacagggaaata

SEQ ID NO: 205631 - DNA, 16 bp, P. troglodytes
aggagacccagagtgg

SEQ ID NO: 205632 - DNA, 16 bp, P. troglodytes
aggagacctatctcat

SEQ ID NO: 205633 - DNA, 16 bp, P. troglodytes
aggagacctctggcct

SEQ ID NO: 205634 - DNA, 16 bp, P. troglodytes
aggagacctggattct

SEQ ID NO: 205635 - DNA, 16 bp, P. troglodytes
aggagactgagacaca

SEQ ID NO: 205636 - DNA, 16 bp, P. troglodytes
aggagactttgggctg

SEQ ID NO: 205637 - DNA, 16 bp, P. troglodytes
aggagacttttttttt

SEQ ID NO: 205638 - DNA, 16 bp, P. troglodytes
aggagagaaaatgagt

SEQ ID NO: 205639 - DNA, 16 bp, P. troglodytes
aggagagaaagcaagc

SEQ ID NO: 205640 - DNA, 16 bp, P. troglodytes
aggagagactcctccc

SEQ ID NO: 205641 - DNA, 16 bp, P. troglodytes
aggagagaggcctggg

SEQ ID NO: 205642 - DNA, 16 bp, P. troglodytes
aggagagatatcacta

SEQ ID NO: 205643 - DNA, 16 bp, P. troglodytes
aggagaggaattcacc

SEQ ID NO: 205644 - DNA, 16 bp, P. troglodytes
aggagaggagagccag

SEQ ID NO: 205645 - DNA, 16 bp, P. troglodytes
aggagaggggcctcag

SEQ ID NO: 205646 - DNA, 16 bp, P. troglodytes
aggagagtgggggcca

SEQ ID NO: 205647 - DNA, 16 bp, P. troglodytes
aggagatagagaccat

SEQ ID NO: 205648 - DNA, 16 bp, P. troglodytes
aggagatattcctaat

SEQ ID NO: 205649 - DNA, 16 bp, P. troglodytes
aggagatcaagaccct

SEQ ID NO: 205650 - DNA, 17 bp, P. troglodytes
aggagatcaagatcatc

SEQ ID NO: 205651 - DNA, 16 bp, P. troglodytes
aggagatgagatcaga

SEQ ID NO: 205652 - DNA, 16 bp, P. troglodytes
aggagatgaggctgga

SEQ ID NO: 205653 - DNA, 16 bp, P. troglodytes
aggagatggtgctaaa

SEQ ID NO: 205654 - DNA, 16 bp, P. troglodytes
aggagatgtgatgaca

SEQ ID NO: 205655 - DNA, 16 bp, P. troglodytes
aggagattgagaccag

SEQ ID NO: 205656 - DNA, 16 bp, P. troglodytes
aggagattgaggctgc

SEQ ID NO: 205657 - DNA, 16 bp, P. troglodytes
aggagcaaagaagcca

SEQ ID NO: 205658 - DNA, 16 bp, P. troglodytes
aggagcaagaaagcca

SEQ ID NO: 205659 - DNA, 16 bp, P. troglodytes
aggagcaagacagaga

SEQ ID NO: 205660 - DNA, 16 bp, P. troglodytes
aggagcaagactctgt

SEQ ID NO: 205661 - DNA, 16 bp, P. troglodytes
aggagcaataggctat

SEQ ID NO: 205662 - DNA, 16 bp, P. troglodytes
aggagcacaccaccat

SEQ ID NO: 205663 - DNA, 16 bp, P. troglodytes
aggagcacatcaaaaa

SEQ ID NO: 205664 - DNA, 16 bp, P. troglodytes
aggagcacccaggttc

SEQ ID NO: 205665 - DNA, 16 bp, P. troglodytes
aggagcaccctttctg

SEQ ID NO: 205666 - DNA, 16 bp, P. troglodytes
aggagcagagagttta

SEQ ID NO: 205667 - DNA, 16 bp, P. troglodytes
aggagcaggctagaaa

SEQ ID NO: 205668 - DNA, 16 bp, P. troglodytes
aggagcagggctgggg

SEQ ID NO: 205669 - DNA, 16 bp, P. troglodytes
aggagcaggttcttca

SEQ ID NO: 205670 - DNA, 16 bp, P. troglodytes
aggagcagtggctcaa

SEQ ID NO: 205671 - DNA, 16 bp, P. troglodytes
aggagccaacttgaag

SEQ ID NO: 205672 - DNA, 16 bp, P. troglodytes
aggagccaaggaatgt

SEQ ID NO: 205673 - DNA, 16 bp, P. troglodytes
aggagccagacacaaa

SEQ ID NO: 205674 - DNA, 16 bp, P. troglodytes
aggagccagccctgcc

SEQ ID NO: 205675 - DNA, 16 bp, P. troglodytes
aggagcccaggcagag

SEQ ID NO: 205676 - DNA, 16 bp, P. troglodytes
aggagcccctctgccc

SEQ ID NO: 205677 - DNA, 16 bp, P. troglodytes
aggagccctggttcct

SEQ ID NO: 205678 - DNA, 16 bp, P. troglodytes
aggagcctaatgttaa

SEQ ID NO: 205679 - DNA, 16 bp, P. troglodytes
aggagcctctccctcc

SEQ ID NO: 205680 - DNA, 16 bp, P. troglodytes
aggagcctgagacagg

SEQ ID NO: 205681 - DNA, 16 bp, P. troglodytes
aggagcgcctctaccc

SEQ ID NO: 205682 - DNA, 16 bp, P. troglodytes
aggagctaatgcagct

SEQ ID NO: 205683 - DNA, 16 bp, P. troglodytes
aggagctcaaggccag

SEQ ID NO: 205684 - DNA, 16 bp, P. troglodytes
aggagctccaggctgc

SEQ ID NO: 205685 - DNA, 16 bp, P. troglodytes
aggagctctggttcct

SEQ ID NO: 205686 - DNA, 16 bp, P. troglodytes
aggagctgaaagatga

SEQ ID NO: 205687 - DNA, 16 bp, P. troglodytes
aggagctgaggcagga

SEQ ID NO: 205688 - DNA, 16 bp, P. troglodytes
aggagctgcagaccag

SEQ ID NO: 205689 - DNA, 16 bp, P. troglodytes
aggagctggaaccatt

SEQ ID NO: 205690 - DNA, 16 bp, P. troglodytes
aggagctggaggccag

SEQ ID NO: 205691 - DNA, 16 bp, P. troglodytes
aggagctggaggccat

SEQ ID NO: 205692 - DNA, 16 bp, P. troglodytes
aggagctggaggctgc

SEQ ID NO: 205693 - DNA, 16 bp, P. troglodytes
aggagctgggactaca

SEQ ID NO: 205694 - DNA, 17 bp, P. troglodytes
aggagctgggattacag

SEQ ID NO: 205695 - DNA, 16 bp, P. troglodytes
aggagctgggcctgga

SEQ ID NO: 205696 - DNA, 16 bp, P. troglodytes
aggagctggggagcag

SEQ ID NO: 205697 - DNA, 16 bp, P. troglodytes
aggagctggggctaca

SEQ ID NO: 205698 - DNA, 16 bp, P. troglodytes
aggagctgggggagga

SEQ ID NO: 205699 - DNA, 16 bp, P. troglodytes
aggagctttctggaag

SEQ ID NO: 205700 - DNA, 16 bp, P. troglodytes
aggagctttttagttt

SEQ ID NO: 205701 - DNA, 16 bp, P. troglodytes
aggaggaaaaccagga

SEQ ID NO: 205702 - DNA, 16 bp, P. troglodytes
aggaggaaacagaggc

SEQ ID NO: 205703 - DNA, 16 bp, P. troglodytes
aggaggaaactgaggc

SEQ ID NO: 205704 - DNA, 16 bp, P. troglodytes
aggaggaagacagtga

SEQ ID NO: 205705 - DNA, 16 bp, P. troglodytes
aggaggaagaggatca

SEQ ID NO: 205706 - DNA, 16 bp, P. troglodytes
aggaggaatcctgggc

SEQ ID NO: 205707 - DNA, 16 bp, P. troglodytes
aggaggaatctagaga

SEQ ID NO: 205708 - DNA, 16 bp, P. troglodytes
aggaggaattccagaa

SEQ ID NO: 205709 - DNA, 16 bp, P. troglodytes
aggaggaatttcaggg

SEQ ID NO: 205710 - DNA, 16 bp, P. troglodytes
aggaggagaaagtcac

SEQ ID NO: 205711 - DNA, 16 bp, P. troglodytes
aggaggagaaccagga

SEQ ID NO: 205712 - DNA, 16 bp, P. troglodytes
aggaggagcagaggca

SEQ ID NO: 205713 - DNA, 16 bp, P. troglodytes
aggaggagcaggcaga

SEQ ID NO: 205714 - DNA, 16 bp, P. troglodytes
aggaggagcaggcatg

SEQ ID NO: 205715 - DNA, 16 bp, P. troglodytes
aggaggagcaggtgga

SEQ ID NO: 205716 - DNA, 16 bp, P. troglodytes
aggaggaggaagctgg

SEQ ID NO: 205717 - DNA, 16 bp, P. troglodytes
aggaggaggagattgc

SEQ ID NO: 205718 - DNA, 16 bp, P. troglodytes
aggaggaggagctcag

SEQ ID NO: 205719 - DNA, 16 bp, P. troglodytes
aggaggaggagctggg

SEQ ID NO: 205720 - DNA, 16 bp, P. troglodytes
aggaggaggagcttgc

SEQ ID NO: 205721 - DNA, 16 bp, P. troglodytes
aggaggaggaggctgc

SEQ ID NO: 205722 - DNA, 16 bp, P. troglodytes
aggaggaggaggtggc

SEQ ID NO: 205723 - DNA, 16 bp, P. troglodytes
aggaggaggagtttgc

SEQ ID NO: 205724 - DNA, 16 bp, P. troglodytes
aggaggaggcaggtgg

SEQ ID NO: 205725 - DNA, 16 bp, P. troglodytes
aggaggatcactggag

SEQ ID NO: 205726 - DNA, 16 bp, P. troglodytes
aggaggatcacttgaa

SEQ ID NO: 205727 - DNA, 20 bp, P. troglodytes
aggaggatcacttgaggccg

SEQ ID NO: 205728 - DNA, 16 bp, P. troglodytes
aggaggatcccttcag

SEQ ID NO: 205729 - DNA, 16 bp, P. troglodytes
aggaggatcccttgat

SEQ ID NO: 205730 - DNA, 16 bp, P. troglodytes
aggaggatcctttgag

SEQ ID NO: 205731 - DNA, 16 bp, P. troglodytes
aggaggatctcttcag

SEQ ID NO: 205732 - DNA, 16 bp, P. troglodytes
aggaggatggattgag

SEQ ID NO: 205733 - DNA, 16 bp, P. troglodytes
aggaggattccctctt

SEQ ID NO: 205734 - DNA, 17 bp, P. troglodytes
aggaggattgcttgaag

SEQ ID NO: 205735 - DNA, 16 bp, P. troglodytes
aggaggatttcttgag

SEQ ID NO: 205736 - DNA, 16 bp, P. troglodytes
aggaggcaccaagagc

SEQ ID NO: 205737 - DNA, 16 bp, P. troglodytes
aggaggcagagatcag

SEQ ID NO: 205738 - DNA, 16 bp, P. troglodytes
aggaggcagagcacag

SEQ ID NO: 205739 - DNA, 16 bp, P. troglodytes
aggaggcagagctcag

SEQ ID NO: 205740 - DNA, 16 bp, P. troglodytes
aggaggcagaggccac

SEQ ID NO: 205741 - DNA, 16 bp, P. troglodytes
aggaggcagaggctgt

SEQ ID NO: 205742 - DNA, 16 bp, P. troglodytes
aggaggcagagtgaga

SEQ ID NO: 205743 - DNA, 16 bp, P. troglodytes
aggaggcagtctgccc

SEQ ID NO: 205744 - DNA, 16 bp, P. troglodytes
aggaggcagtctgccg

SEQ ID NO: 205745 - DNA, 16 bp, P. troglodytes
aggaggcagtctgttc

SEQ ID NO: 205746 - DNA, 16 bp, P. troglodytes
aggaggcatggctggg

SEQ ID NO: 205747 - DNA, 16 bp, P. troglodytes
aggaggccaaagcagg

SEQ ID NO: 205748 - DNA, 16 bp, P. troglodytes
aggaggccaaggtgga

SEQ ID NO: 205749 - DNA, 17 bp, P. troglodytes
aggaggccgaggcagga

SEQ ID NO: 205750 - DNA, 16 bp, P. troglodytes
aggaggccgaggccgg

SEQ ID NO: 205751 - DNA, 16 bp, P. troglodytes
aggaggcctgaggcag

SEQ ID NO: 205752 - DNA, 16 bp, P. troglodytes
aggaggccttcctgcc

SEQ ID NO: 205753 - DNA, 16 bp, P. troglodytes
aggaggcgccaagagc

SEQ ID NO: 205754 - DNA, 16 bp, P. troglodytes
aggaggcggaggctgc

SEQ ID NO: 205755 - DNA, 16 bp, P. troglodytes
aggaggctaaggcaga

SEQ ID NO: 205756 - DNA, 16 bp, P. troglodytes
aggaggctgaaatggg

SEQ ID NO: 205757 - DNA, 16 bp, P. troglodytes
aggaggctgaagaagg

SEQ ID NO: 205758 - DNA, 16 bp, P. troglodytes
aggaggctgaaggagg

SEQ ID NO: 205759 - DNA, 16 bp, P. troglodytes
aggaggctgaaggcag

SEQ ID NO: 205760 - DNA, 16 bp, P. troglodytes
aggaggctgacatggg

SEQ ID NO: 205761 - DNA, 16 bp, P. troglodytes
aggaggctgagaaagg

SEQ ID NO: 205762 - DNA, 16 bp, P. troglodytes
aggaggctgagagagg

SEQ ID NO: 205763 - DNA, 16 bp, P. troglodytes
aggaggctgagccagg

SEQ ID NO: 205764 - DNA, 16 bp, P. troglodytes
aggaggctgaggaaga

SEQ ID NO: 205765 - DNA, 16 bp, P. troglodytes
aggaggctgaggaggc

SEQ ID NO: 205766 - DNA, 16 bp, P. troglodytes
aggaggctgaggatgg

SEQ ID NO: 205767 - DNA, 17 bp, P. troglodytes
aggaggctgaggcaggt

SEQ ID NO: 205768 - DNA, 16 bp, P. troglodytes
aggaggctgaggcagt

SEQ ID NO: 205769 - DNA, 16 bp, P. troglodytes
aggaggctgaggcctg

SEQ ID NO: 205770 - DNA, 16 bp, P. troglodytes
aggaggctgaggctgc

SEQ ID NO: 205771 - DNA, 16 bp, P. troglodytes
aggaggctgagggaga

SEQ ID NO: 205772 - DNA, 16 bp, P. troglodytes
aggaggctgaggtgag

SEQ ID NO: 205773 - DNA, 16 bp, P. troglodytes
aggaggctgaggtgga

SEQ ID NO: 205774 - DNA, 16 bp, P. troglodytes
aggaggctgcagaaca

SEQ ID NO: 205775 - DNA, 16 bp, P. troglodytes
aggaggctgcagggag

SEQ ID NO: 205776 - DNA, 16 bp, P. troglodytes
aggaggctgcagtggg

SEQ ID NO: 205777 - DNA, 16 bp, P. troglodytes
aggaggctgggcatgg

SEQ ID NO: 205778 - DNA, 16 bp, P. troglodytes
aggaggctggggacag

SEQ ID NO: 205779 - DNA, 16 bp, P. troglodytes
aggaggctggggcaga

SEQ ID NO: 205780 - DNA, 16 bp, P. troglodytes
aggaggctgtggcagg

SEQ ID NO: 205781 - DNA, 16 bp, P. troglodytes
aggagggaaaagtggt

SEQ ID NO: 205782 - DNA, 16 bp, P. troglodytes
aggagggacaggatca

SEQ ID NO: 205783 - DNA, 16 bp, P. troglodytes
aggagggacccggtgg

SEQ ID NO: 205784 - DNA, 16 bp, P. troglodytes
aggagggcggatcacc

SEQ ID NO: 205785 - DNA, 16 bp, P. troglodytes
aggaggggccaggtgg

SEQ ID NO: 205786 - DNA, 16 bp, P. troglodytes
aggaggggctgctgtg

SEQ ID NO: 205787 - DNA, 16 bp, P. troglodytes
aggagggggaggctgc

SEQ ID NO: 205788 - DNA, 16 bp, P. troglodytes
aggagggtgaggctgc

SEQ ID NO: 205789 - DNA, 16 bp, P. troglodytes
aggaggtcaaggcggc

SEQ ID NO: 205790 - DNA, 16 bp, P. troglodytes
aggaggtcaaggcttc

SEQ ID NO: 205791 - DNA, 16 bp, P. troglodytes
aggaggtcgaggcagc

SEQ ID NO: 205792 - DNA, 16 bp, P. troglodytes
aggaggtgacagctcc

SEQ ID NO: 205793 - DNA, 16 bp, P. troglodytes
aggaggtgagcagcag

SEQ ID NO: 205794 - DNA, 16 bp, P. troglodytes
aggaggtgatatttga

SEQ ID NO: 205795 - DNA, 16 bp, P. troglodytes
aggaggtgattgaatt

SEQ ID NO: 205796 - DNA, 16 bp, P. troglodytes
aggaggtgctcaataa

SEQ ID NO: 205797 - DNA, 16 bp, P. troglodytes
aggaggtgctcagtaa

SEQ ID NO: 205798 - DNA, 16 bp, P. troglodytes
aggaggtggagccttt

SEQ ID NO: 205799 - DNA, 16 bp, P. troglodytes
aggaggtggagctgag

SEQ ID NO: 205800 - DNA, 16 bp, P. troglodytes
aggaggtggaggaggc

SEQ ID NO: 205801 - DNA, 16 bp, P. troglodytes
aggaggtggaggcagc

SEQ ID NO: 205802 - DNA, 16 bp, P. troglodytes
aggaggtggcatctga

SEQ ID NO: 205803 - DNA, 16 bp, P. troglodytes
aggaggtggtggctgc

SEQ ID NO: 205804 - DNA, 16 bp, P. troglodytes
aggaggtgtctcccag

SEQ ID NO: 205805 - DNA, 16 bp, P. troglodytes
aggaggttctggagga

SEQ ID NO: 205806 - DNA, 16 bp, P. troglodytes
aggaggttgaagctac

SEQ ID NO: 205807 - DNA, 16 bp, P. troglodytes
aggaggttgagatcag

SEQ ID NO: 205808 - DNA, 24 bp, P. troglodytes
aggaggttgaggctgcagtgagct

SEQ ID NO: 205809 - DNA, 16 bp, P. troglodytes
aggaggttgaggcttc

SEQ ID NO: 205810 - DNA, 16 bp, P. troglodytes
aggagtaaggtggtat

SEQ ID NO: 205811 - DNA, 16 bp, P. troglodytes
aggagtacccggccat

SEQ ID NO: 205812 - DNA, 16 bp, P. troglodytes
aggagtagaaaaccaa

SEQ ID NO: 205813 - DNA, 16 bp, P. troglodytes
aggagtcatgcagcca

SEQ ID NO: 205814 - DNA, 16 bp, P. troglodytes
aggagtccaagatcag

SEQ ID NO: 205815 - DNA, 16 bp, P. troglodytes
aggagtcctcctgcct

SEQ ID NO: 205816 - DNA, 16 bp, P. troglodytes
aggagtctctcccaga

SEQ ID NO: 205817 - DNA, 16 bp, P. troglodytes
aggagtctgagagcag

SEQ ID NO: 205818 - DNA, 16 bp, P. troglodytes
aggagtgactttgaat

SEQ ID NO: 205819 - DNA, 17 bp, P. troglodytes
aggagtgagccaccaca

SEQ ID NO: 205820 - DNA, 16 bp, P. troglodytes
aggagtgatttttttt

SEQ ID NO: 205821 - DNA, 16 bp, P. troglodytes
aggagtgcagtggtgt

SEQ ID NO: 205822 - DNA, 16 bp, P. troglodytes
aggagtggagctgccc

SEQ ID NO: 205823 - DNA, 16 bp, P. troglodytes
aggagtggcagaggca

SEQ ID NO: 205824 - DNA, 16 bp, P. troglodytes
aggagtgttttccttc

SEQ ID NO: 205825 - DNA, 16 bp, P. troglodytes
aggagttagagaacag

SEQ ID NO: 205826 - DNA, 16 bp, P. troglodytes
aggagttagagactag

SEQ ID NO: 205827 - DNA, 16 bp, P. troglodytes
aggagttatagaccag

SEQ ID NO: 205828 - DNA, 16 bp, P. troglodytes
aggagttcaaagccag

SEQ ID NO: 205829 - DNA, 16 bp, P. troglodytes
aggagttcaaagctgc

SEQ ID NO: 205830 - DNA, 16 bp, P. troglodytes
aggagttcaaggcctg

SEQ ID NO: 205831 - DNA, 16 bp, P. troglodytes
aggagttcaggaccag

SEQ ID NO: 205832 - DNA, 16 bp, P. troglodytes
aggagttccagaaaga

SEQ ID NO: 205833 - DNA, 17 bp, P. troglodytes
aggagttccagaccagt

SEQ ID NO: 205834 - DNA, 16 bp, P. troglodytes
aggagttggaggctgt

SEQ ID NO: 205835 - DNA, 16 bp, P. troglodytes
aggagtttaagaccat

SEQ ID NO: 205836 - DNA, 16 bp, P. troglodytes
aggagtttaagactag

SEQ ID NO: 205837 - DNA, 16 bp, P. troglodytes
aggagtttgagaagag

SEQ ID NO: 205838 - DNA, 16 bp, P. troglodytes
aggagtttgagacatg

SEQ ID NO: 205839 - DNA, 16 bp, P. troglodytes
aggagtttgagaccat

SEQ ID NO: 205840 - DNA, 16 bp, P. troglodytes
aggagtttgagaccta

SEQ ID NO: 205841 - DNA, 16 bp, P. troglodytes
aggagtttgagactgt

SEQ ID NO: 205842 - DNA, 16 bp, P. troglodytes
aggagtttgagcccag

SEQ ID NO: 205843 - DNA, 16 bp, P. troglodytes
aggagtttgaggtcac

SEQ ID NO: 205844 - DNA, 16 bp, P. troglodytes
aggagtttgcagccag

SEQ ID NO: 205845 - DNA, 16 bp, P. troglodytes
aggagtttgcatttta

SEQ ID NO: 205846 - DNA, 16 bp, P. troglodytes
aggagtttgtgaccaa

SEQ ID NO: 205847 - DNA, 16 bp, P. troglodytes
aggataaagtccaaat

SEQ ID NO: 205848 - DNA, 16 bp, P. troglodytes
aggataatctctccat

SEQ ID NO: 205849 - DNA, 16 bp, P. troglodytes
aggataatggtctcca

SEQ ID NO: 205850 - DNA, 16 bp, P. troglodytes
aggatacaaaatcaac

SEQ ID NO: 205851 - DNA, 16 bp, P. troglodytes
aggatacagtgagaag

SEQ ID NO: 205852 - DNA, 16 bp, P. troglodytes
aggatagcttgagcca

SEQ ID NO: 205853 - DNA, 16 bp, P. troglodytes
aggatagtgagctctt

SEQ ID NO: 205854 - DNA, 16 bp, P. troglodytes
aggatataaataactc

SEQ ID NO: 205855 - DNA, 17 bp, P. troglodytes
aggatatcatttttgat

SEQ ID NO: 205856 - DNA, 16 bp, P. troglodytes
aggatatgaagaaatt

SEQ ID NO: 205857 - DNA, 16 bp, P. troglodytes
aggatatggaaaaatt

SEQ ID NO: 205858 - DNA, 16 bp, P. troglodytes
aggatatggacatctt

SEQ ID NO: 205859 - DNA, 16 bp, P. troglodytes
aggatatggagcaaca

SEQ ID NO: 205860 - DNA, 16 bp, P. troglodytes
aggatattgtccatga

SEQ ID NO: 205861 - DNA, 16 bp, P. troglodytes
aggatatttagcagca

SEQ ID NO: 205862 - DNA, 16 bp, P. troglodytes
aggatattttccagga

SEQ ID NO: 205863 - DNA, 16 bp, P. troglodytes
aggatatttttttctt

SEQ ID NO: 205864 - DNA, 16 bp, P. troglodytes
aggatcaaatgaaata

SEQ ID NO: 205865 - DNA, 16 bp, P. troglodytes
aggatcaaatgagaaa

SEQ ID NO: 205866 - DNA, 16 bp, P. troglodytes
aggatcaaatgagaca

SEQ ID NO: 205867 - DNA, 16 bp, P. troglodytes
aggatcaacaaaactg

SEQ ID NO: 205868 - DNA, 16 bp, P. troglodytes
aggatcagcctggcca

SEQ ID NO: 205869 - DNA, 16 bp, P. troglodytes
aggatcagctgagccc

SEQ ID NO: 205870 - DNA, 16 bp, P. troglodytes
aggatcctttgagccc

SEQ ID NO: 205871 - DNA, 16 bp, P. troglodytes
aggatctagaatcaga

SEQ ID NO: 205872 - DNA, 16 bp, P. troglodytes
aggatctagaattaga

SEQ ID NO: 205873 - DNA, 16 bp, P. troglodytes
aggatctaggttgcat

SEQ ID NO: 205874 - DNA, 21 bp, P. troglodytes
aggatctcactctgttgccca

SEQ ID NO: 205875 - DNA, 16 bp, P. troglodytes
aggatctctctctgtc

SEQ ID NO: 205876 - DNA, 16 bp, P. troglodytes
aggatctgtttccttg

SEQ ID NO: 205877 - DNA, 16 bp, P. troglodytes
aggatcttgagatgga

SEQ ID NO: 205878 - DNA, 16 bp, P. troglodytes
aggatctttaaagagg

SEQ ID NO: 205879 - DNA, 16 bp, P. troglodytes
aggatctttgcagatg

SEQ ID NO: 205880 - DNA, 16 bp, P. troglodytes
aggatcttttcttttt

SEQ ID NO: 205881 - DNA, 16 bp, P. troglodytes
aggatgaaatgagata

SEQ ID NO: 205882 - DNA, 16 bp, P. troglodytes
aggatgaaatgagatc

SEQ ID NO: 205883 - DNA, 16 bp, P. troglodytes
aggatgaagaaactca

SEQ ID NO: 205884 - DNA, 16 bp, P. troglodytes
aggatgaagaccttta

SEQ ID NO: 205885 - DNA, 16 bp, P. troglodytes
aggatgagccaggaga

SEQ ID NO: 205886 - DNA, 16 bp, P. troglodytes
aggatgagctgcagac

SEQ ID NO: 205887 - DNA, 16 bp, P. troglodytes
aggatgaggatgaaga

SEQ ID NO: 205888 - DNA, 16 bp, P. troglodytes
aggatgaggcagaaga

SEQ ID NO: 205889 - DNA, 16 bp, P. troglodytes
aggatgaggcaggagg

SEQ ID NO: 205890 - DNA, 16 bp, P. troglodytes
aggatgagtaggagtt

SEQ ID NO: 205891 - DNA, 17 bp, P. troglodytes
aggatgatctctatctc

SEQ ID NO: 205892 - DNA, 16 bp, P. troglodytes
aggatgatgctggcct

SEQ ID NO: 205893 - DNA, 16 bp, P. troglodytes
aggatgcagtgagcca

SEQ ID NO: 205894 - DNA, 16 bp, P. troglodytes
aggatgcccactgtca

SEQ ID NO: 205895 - DNA, 16 bp, P. troglodytes
aggatgcccactttca

SEQ ID NO: 205896 - DNA, 16 bp, P. troglodytes
aggatgccctccctca

SEQ ID NO: 205897 - DNA, 16 bp, P. troglodytes
aggatgcctccagctt

SEQ ID NO: 205898 - DNA, 16 bp, P. troglodytes
aggatgctgaatttta

SEQ ID NO: 205899 - DNA, 16 bp, P. troglodytes
aggatggaaaaattca

SEQ ID NO: 205900 - DNA, 16 bp, P. troglodytes
aggatggaacatgaaa

SEQ ID NO: 205901 - DNA, 16 bp, P. troglodytes
aggatggaaggatgga

SEQ ID NO: 205902 - DNA, 16 bp, P. troglodytes
aggatggaatattttt

SEQ ID NO: 205903 - DNA, 16 bp, P. troglodytes
aggatggagcaggtga

SEQ ID NO: 205904 - DNA, 16 bp, P. troglodytes
aggatggagtgcggtg

SEQ ID NO: 205905 - DNA, 16 bp, P. troglodytes
aggatggagtgtagtg

SEQ ID NO: 205906 - DNA, 16 bp, P. troglodytes
aggatggatgaatgga

SEQ ID NO: 205907 - DNA, 16 bp, P. troglodytes
aggatggcagagcaga

SEQ ID NO: 205908 - DNA, 16 bp, P. troglodytes
aggatggctactattt

SEQ ID NO: 205909 - DNA, 16 bp, P. troglodytes
aggatggctggagcct

SEQ ID NO: 205910 - DNA, 16 bp, P. troglodytes
aggatggggagaggtt

SEQ ID NO: 205911 - DNA, 25 bp, P. troglodytes
aggatggtctcgatctcctgatctc

SEQ ID NO: 205912 - DNA, 17 bp, P. troglodytes
aggatggtctctatctc

SEQ ID NO: 205913 - DNA, 16 bp, P. troglodytes
aggatggtctcttcaa

SEQ ID NO: 205914 - DNA, 16 bp, P. troglodytes
aggatggtcttgctct

SEQ ID NO: 205915 - DNA, 16 bp, P. troglodytes
aggatggtgctggcct

SEQ ID NO: 205916 - DNA, 16 bp, P. troglodytes
aggatggttaccagaa

SEQ ID NO: 205917 - DNA, 16 bp, P. troglodytes
aggatggttcaaaata

SEQ ID NO: 205918 - DNA, 16 bp, P. troglodytes
aggatgtaaagaaatt

SEQ ID NO: 205919 - DNA, 16 bp, P. troglodytes
aggatgtacagggatg

SEQ ID NO: 205920 - DNA, 16 bp, P. troglodytes
aggatgtagtgagcca

SEQ ID NO: 205921 - DNA, 16 bp, P. troglodytes
aggatgtcattctttt

SEQ ID NO: 205922 - DNA, 16 bp, P. troglodytes
aggatgtcttgagccc

SEQ ID NO: 205923 - DNA, 16 bp, P. troglodytes
aggatgtggacatttt

SEQ ID NO: 205924 - DNA, 16 bp, P. troglodytes
aggatgtggagaagct

SEQ ID NO: 205925 - DNA, 16 bp, P. troglodytes
aggatgtgtgtgtatg

SEQ ID NO: 205926 - DNA, 16 bp, P. troglodytes
aggatgtgtttacttc

SEQ ID NO: 205927 - DNA, 16 bp, P. troglodytes
aggatgtttccagaag

SEQ ID NO: 205928 - DNA, 16 bp, P. troglodytes
aggattaaaagagata

SEQ ID NO: 205929 - DNA, 16 bp, P. troglodytes
aggattacaagtgtga

SEQ ID NO: 205930 - DNA, 16 bp, P. troglodytes
aggattacagatgtga

SEQ ID NO: 205931 - DNA, 16 bp, P. troglodytes
aggattacaggcatcc

SEQ ID NO: 205932 - DNA, 18 bp, P. troglodytes
aggattacaggcatgagg

SEQ ID NO: 205933 - DNA, 16 bp, P. troglodytes
aggattagtgccctta

SEQ ID NO: 205934 - DNA, 16 bp, P. troglodytes
aggattcaaaatcaac

SEQ ID NO: 205935 - DNA, 16 bp, P. troglodytes
aggattcaaagccagg

SEQ ID NO: 205936 - DNA, 16 bp, P. troglodytes
aggattccctcctttt

SEQ ID NO: 205937 - DNA, 16 bp, P. troglodytes
aggattctaaaagtag

SEQ ID NO: 205938 - DNA, 16 bp, P. troglodytes
aggattcttacagttt

SEQ ID NO: 205939 - DNA, 18 bp, P. troglodytes
aggattgcaacccctgct

SEQ ID NO: 205940 - DNA, 16 bp, P. troglodytes
aggattgctggagccc

SEQ ID NO: 205941 - DNA, 16 bp, P. troglodytes
aggattgcttgagcct

SEQ ID NO: 205942 - DNA, 16 bp, P. troglodytes
aggattgcttgcacct

SEQ ID NO: 205943 - DNA, 16 bp, P. troglodytes
aggattggtaccagtt

SEQ ID NO: 205944 - DNA, 16 bp, P. troglodytes
aggattgtaaaacgca

SEQ ID NO: 205945 - DNA, 16 bp, P. troglodytes
aggattgtgatatttt

SEQ ID NO: 205946 - DNA, 16 bp, P. troglodytes
aggattgttatgaaga

SEQ ID NO: 205947 - DNA, 16 bp, P. troglodytes
aggattgttttaaatt

SEQ ID NO: 205948 - DNA, 16 bp, P. troglodytes
aggatttatttcaaga

SEQ ID NO: 205949 - DNA, 16 bp, P. troglodytes
aggatttcaccatgtt

SEQ ID NO: 205950 - DNA, 16 bp, P. troglodytes
aggatttcatatccag

SEQ ID NO: 205951 - DNA, 16 bp, P. troglodytes
aggatttcattctctt

SEQ ID NO: 205952 - DNA, 16 bp, P. troglodytes
aggatttcattctttt

SEQ ID NO: 205953 - DNA, 16 bp, P. troglodytes
aggatttctcaacctt

SEQ ID NO: 205954 - DNA, 16 bp, P. troglodytes
aggatttctttctttc

SEQ ID NO: 205955 - DNA, 16 bp, P. troglodytes
aggatttgaactcaga

SEQ ID NO: 205956 - DNA, 16 bp, P. troglodytes
aggatttgaagccagg

SEQ ID NO: 205957 - DNA, 16 bp, P. troglodytes
aggatttgaatccaga

SEQ ID NO: 205958 - DNA, 16 bp, P. troglodytes
aggatttgaattcagg

SEQ ID NO: 205959 - DNA, 16 bp, P. troglodytes
aggatttgctgatgga

SEQ ID NO: 205960 - DNA, 16 bp, P. troglodytes
aggatttggagaaaag

SEQ ID NO: 205961 - DNA, 16 bp, P. troglodytes
aggattttcaacccag

SEQ ID NO: 205962 - DNA, 16 bp, P. troglodytes
aggattttcacatcaa

SEQ ID NO: 205963 - DNA, 16 bp, P. troglodytes
aggattttctttttaa

SEQ ID NO: 205964 - DNA, 16 bp, P. troglodytes
aggattttgaatgttt

SEQ ID NO: 205965 - DNA, 16 bp, P. troglodytes
aggattttgaggctgc

SEQ ID NO: 205966 - DNA, 16 bp, P. troglodytes
aggattttgataggga

SEQ ID NO: 205967 - DNA, 16 bp, P. troglodytes
aggattttgtcaccac

SEQ ID NO: 205968 - DNA, 16 bp, P. troglodytes
aggatttttacagttt

SEQ ID NO: 205969 - DNA, 16 bp, P. troglodytes
aggatttttgcctcta

SEQ ID NO: 205970 - DNA, 16 bp, P. troglodytes
aggatttttttttcta

SEQ ID NO: 205971 - DNA, 16 bp, P. troglodytes
aggcaaaaattgacaa

SEQ ID NO: 205972 - DNA, 16 bp, P. troglodytes
aggcaaaactgtgaag

SEQ ID NO: 205973 - DNA, 16 bp, P. troglodytes
aggcaaaactttgtag

SEQ ID NO: 205974 - DNA, 16 bp, P. troglodytes
aggcaaaatatctgaa

SEQ ID NO: 205975 - DNA, 23 bp, P. troglodytes
aggcaaacagggtctggagtgga

SEQ ID NO: 205976 - DNA, 16 bp, P. troglodytes
aggcaaacgctgagct

SEQ ID NO: 205977 - DNA, 16 bp, P. troglodytes
aggcaaagaaggagca

SEQ ID NO: 205978 - DNA, 16 bp, P. troglodytes
aggcaaagagaaactg

SEQ ID NO: 205979 - DNA, 16 bp, P. troglodytes
aggcaaagagagaact

SEQ ID NO: 205980 - DNA, 16 bp, P. troglodytes
aggcaaagaggagcaa

SEQ ID NO: 205981 - DNA, 16 bp, P. troglodytes
aggcaaagagggagca

SEQ ID NO: 205982 - DNA, 16 bp, P. troglodytes
aggcaaaggcagagga

SEQ ID NO: 205983 - DNA, 16 bp, P. troglodytes
aggcaaataaaaagct

SEQ ID NO: 205984 - DNA, 16 bp, P. troglodytes
aggcaaatatttcatg

SEQ ID NO: 205985 - DNA, 16 bp, P. troglodytes
aggcaaatcaataaat

SEQ ID NO: 205986 - DNA, 16 bp, P. troglodytes
aggcaaatccacagaa

SEQ ID NO: 205987 - DNA, 16 bp, P. troglodytes
aggcaaattcacaaat

SEQ ID NO: 205988 - DNA, 16 bp, P. troglodytes
aggcaacaaagtgaga

SEQ ID NO: 205989 - DNA, 17 bp, P. troglodytes
aggcaacaagagcaaaa

SEQ ID NO: 205990 - DNA, 16 bp, P. troglodytes
aggcaacacagcaaga

SEQ ID NO: 205991 - DNA, 17 bp, P. troglodytes
aggcaacagaattgctt

SEQ ID NO: 205992 - DNA, 16 bp, P. troglodytes
aggcaacagagcagga

SEQ ID NO: 205993 - DNA, 16 bp, P. troglodytes
aggcaacataaaatta

SEQ ID NO: 205994 - DNA, 16 bp, P. troglodytes
aggcaacatggcaaga

SEQ ID NO: 205995 - DNA, 16 bp, P. troglodytes
aggcaacatggtgaaa

SEQ ID NO: 205996 - DNA, 16 bp, P. troglodytes
aggcaaccaaagcaaa

SEQ ID NO: 205997 - DNA, 16 bp, P. troglodytes
aggcaacctagagaat

SEQ ID NO: 205998 - DNA, 16 bp, P. troglodytes
aggcaacttggaagtg

SEQ ID NO: 205999 - DNA, 16 bp, P. troglodytes
aggcaagaaggaggtc

SEQ ID NO: 206000 - DNA, 16 bp, P. troglodytes
aggcaagactctgtct

SEQ ID NO: 206001 - DNA, 16 bp, P. troglodytes
aggcaagagaaagata

SEQ ID NO: 206002 - DNA, 16 bp, P. troglodytes
aggcaagagccactgc

SEQ ID NO: 206003 - DNA, 16 bp, P. troglodytes
aggcaagaggattgct

SEQ ID NO: 206004 - DNA, 16 bp, P. troglodytes
aggcaagatgggggtt

SEQ ID NO: 206005 - DNA, 16 bp, P. troglodytes
aggcaagcaccaccac

SEQ ID NO: 206006 - DNA, 16 bp, P. troglodytes
aggcaagctacagact

SEQ ID NO: 206007 - DNA, 16 bp, P. troglodytes
aggcaaggagcagcaa

SEQ ID NO: 206008 - DNA, 16 bp, P. troglodytes
aggcaataataaatag

SEQ ID NO: 206009 - DNA, 16 bp, P. troglodytes
aggcaatgccccaccc

SEQ ID NO: 206010 - DNA, 16 bp, P. troglodytes
aggcacagaaagacac

SEQ ID NO: 206011 - DNA, 16 bp, P. troglodytes
aggcacagaaagataa

SEQ ID NO: 206012 - DNA, 16 bp, P. troglodytes
aggcacagaaaggtta

SEQ ID NO: 206013 - DNA, 16 bp, P. troglodytes
aggcacagagaaaaca

SEQ ID NO: 206014 - DNA, 16 bp, P. troglodytes
aggcacagagagatta

SEQ ID NO: 206015 - DNA, 16 bp, P. troglodytes
aggcacagagaggcca

SEQ ID NO: 206016 - DNA, 16 bp, P. troglodytes
aggcacagagaggtta

SEQ ID NO: 206017 - DNA, 16 bp, P. troglodytes
aggcacagctggatcc

SEQ ID NO: 206018 - DNA, 16 bp, P. troglodytes
aggcacaggatggggg

SEQ ID NO: 206019 - DNA, 16 bp, P. troglodytes
aggcacaggtgggagg

SEQ ID NO: 206020 - DNA, 21 bp, P. troglodytes
aggcacagtggctcacaccta

SEQ ID NO: 206021 - DNA, 16 bp, P. troglodytes
aggcacattggtcttt

SEQ ID NO: 206022 - DNA, 16 bp, P. troglodytes
aggcaccaccaccaca

SEQ ID NO: 206023 - DNA, 16 bp, P. troglodytes
aggcacccaagggaat

SEQ ID NO: 206024 - DNA, 16 bp, P. troglodytes
aggcacccaccatgcc

SEQ ID NO: 206025 - DNA, 16 bp, P. troglodytes
aggcacccctccccca

SEQ ID NO: 206026 - DNA, 16 bp, P. troglodytes
aggcacctcttcacag

SEQ ID NO: 206027 - DNA, 17 bp, P. troglodytes
aggcacctgccacaacg

SEQ ID NO: 206028 - DNA, 16 bp, P. troglodytes
aggcacctgccaccca

SEQ ID NO: 206029 - DNA, 16 bp, P. troglodytes
aggcacctgccactac

SEQ ID NO: 206030 - DNA, 16 bp, P. troglodytes
aggcacctgcccccac

SEQ ID NO: 206031 - DNA, 16 bp, P. troglodytes
aggcacgcaccactgc

SEQ ID NO: 206032 - DNA, 16 bp, P. troglodytes
aggcacggcggctcat

SEQ ID NO: 206033 - DNA, 16 bp, P. troglodytes
aggcactattcacaat

SEQ ID NO: 206034 - DNA, 16 bp, P. troglodytes
aggcactattctagat

SEQ ID NO: 206035 - DNA, 16 bp, P. troglodytes
aggcactcaataaata

SEQ ID NO: 206036 - DNA, 16 bp, P. troglodytes
aggcactgaaagaaaa

SEQ ID NO: 206037 - DNA, 16 bp, P. troglodytes
aggcactgaggacaca

SEQ ID NO: 206038 - DNA, 16 bp, P. troglodytes
aggcactgggctgggc

SEQ ID NO: 206039 - DNA, 16 bp, P. troglodytes
aggcactggggacaca

SEQ ID NO: 206040 - DNA, 16 bp, P. troglodytes
aggcactgtgccaggt

SEQ ID NO: 206041 - DNA, 16 bp, P. troglodytes
aggcactgtgcccagc

SEQ ID NO: 206042 - DNA, 16 bp, P. troglodytes
aggcactgtgctaggt

SEQ ID NO: 206043 - DNA, 16 bp, P. troglodytes
aggcactgtgctcagt

SEQ ID NO: 206044 - DNA, 16 bp, P. troglodytes
aggcactgtgctgggc

SEQ ID NO: 206045 - DNA, 16 bp, P. troglodytes
aggcactgttctaaat

SEQ ID NO: 206046 - DNA, 16 bp, P. troglodytes
aggcacttctgagcct

SEQ ID NO: 206047 - DNA, 16 bp, P. troglodytes
aggcagaaaaaaattt

SEQ ID NO: 206048 - DNA, 16 bp, P. troglodytes
aggcagaaaagggtgg

SEQ ID NO: 206049 - DNA, 16 bp, P. troglodytes
aggcagaagaaaatct

SEQ ID NO: 206050 - DNA, 16 bp, P. troglodytes
aggcagaagaaatgct

SEQ ID NO: 206051 - DNA, 16 bp, P. troglodytes
aggcagaagaagatgg

SEQ ID NO: 206052 - DNA, 16 bp, P. troglodytes
aggcagaagaatcttt

SEQ ID NO: 206053 - DNA, 42 bp, P. troglodytes
aggcagaagaatttttcttagtacagaacaaaatggagtctc

SEQ ID NO: 206054 - DNA, 16 bp, P. troglodytes
aggcagaagaggtgga

SEQ ID NO: 206055 - DNA, 16 bp, P. troglodytes
aggcagaagcaggagg

SEQ ID NO: 206056 - DNA, 16 bp, P. troglodytes
aggcagaaggactgct

SEQ ID NO: 206057 - DNA, 16 bp, P. troglodytes
aggcagaattctaaga

SEQ ID NO: 206058 - DNA, 16 bp, P. troglodytes
aggcagacaaaaataa

SEQ ID NO: 206059 - DNA, 16 bp, P. troglodytes
aggcagacacacaggc

SEQ ID NO: 206060 - DNA, 16 bp, P. troglodytes
aggcagacactcccag

SEQ ID NO: 206061 - DNA, 16 bp, P. troglodytes
aggcagacagatcgct

SEQ ID NO: 206062 - DNA, 16 bp, P. troglodytes
aggcagacagcccagc

SEQ ID NO: 206063 - DNA, 16 bp, P. troglodytes
aggcagacagggatgg

SEQ ID NO: 206064 - DNA, 16 bp, P. troglodytes
aggcagacccaccctc

SEQ ID NO: 206065 - DNA, 16 bp, P. troglodytes
aggcagactggtcccc

SEQ ID NO: 206066 - DNA, 16 bp, P. troglodytes
aggcagagaatcgctt

SEQ ID NO: 206067 - DNA, 16 bp, P. troglodytes
aggcagagacagagaa

SEQ ID NO: 206068 - DNA, 16 bp, P. troglodytes
aggcagagacaggagg

SEQ ID NO: 206069 - DNA, 16 bp, P. troglodytes
aggcagagagagagct

SEQ ID NO: 206070 - DNA, 16 bp, P. troglodytes
aggcagagaggttgca

SEQ ID NO: 206071 - DNA, 16 bp, P. troglodytes
aggcagagatggcagt

SEQ ID NO: 206072 - DNA, 16 bp, P. troglodytes
aggcagagattggagt

SEQ ID NO: 206073 - DNA, 16 bp, P. troglodytes
aggcagagattgtcaa

SEQ ID NO: 206074 - DNA, 16 bp, P. troglodytes
aggcagagcacagagg

SEQ ID NO: 206075 - DNA, 16 bp, P. troglodytes
aggcagagctgggatt

SEQ ID NO: 206076 - DNA, 16 bp, P. troglodytes
aggcagagctgggcct

SEQ ID NO: 206077 - DNA, 16 bp, P. troglodytes
aggcagaggaaacagc

SEQ ID NO: 206078 - DNA, 16 bp, P. troglodytes
aggcagaggaaggtgg

SEQ ID NO: 206079 - DNA, 16 bp, P. troglodytes
aggcagaggacagagg

SEQ ID NO: 206080 - DNA, 16 bp, P. troglodytes
aggcagaggagaagca

SEQ ID NO: 206081 - DNA, 16 bp, P. troglodytes
aggcagaggaggtgcc

SEQ ID NO: 206082 - DNA, 16 bp, P. troglodytes
aggcagaggaggtgct

SEQ ID NO: 206083 - DNA, 16 bp, P. troglodytes
aggcagaggcaggagt

SEQ ID NO: 206084 - DNA, 16 bp, P. troglodytes
aggcagaggcaggtga

SEQ ID NO: 206085 - DNA, 16 bp, P. troglodytes
aggcagaggcagtgag

SEQ ID NO: 206086 - DNA, 16 bp, P. troglodytes
aggcagaggccaggga

SEQ ID NO: 206087 - DNA, 16 bp, P. troglodytes
aggcagaggcggaggc

SEQ ID NO: 206088 - DNA, 16 bp, P. troglodytes
aggcagaggctgaggc

SEQ ID NO: 206089 - DNA, 16 bp, P. troglodytes
aggcagagggaactgc

SEQ ID NO: 206090 - DNA, 16 bp, P. troglodytes
aggcagagggagattt

SEQ ID NO: 206091 - DNA, 16 bp, P. troglodytes
aggcagagggcacagc

SEQ ID NO: 206092 - DNA, 16 bp, P. troglodytes
aggcagaggtgggtga

SEQ ID NO: 206093 - DNA, 17 bp, P. troglodytes
aggcagagtcttgttct

SEQ ID NO: 206094 - DNA, 16 bp, P. troglodytes
aggcagagtttgtggt

SEQ ID NO: 206095 - DNA, 16 bp, P. troglodytes
aggcagatattattat

SEQ ID NO: 206096 - DNA, 16 bp, P. troglodytes
aggcagattgcctgag

SEQ ID NO: 206097 - DNA, 17 bp, P. troglodytes
aggcagcagaatggcat

SEQ ID NO: 206098 - DNA, 16 bp, P. troglodytes
aggcagcagaattact

SEQ ID NO: 206099 - DNA, 16 bp, P. troglodytes
aggcagcagccccagc

SEQ ID NO: 206100 - DNA, 16 bp, P. troglodytes
aggcagcagcctcagt

SEQ ID NO: 206101 - DNA, 16 bp, P. troglodytes
aggcagcagctccagt

SEQ ID NO: 206102 - DNA, 16 bp, P. troglodytes
aggcagcaggagcagg

SEQ ID NO: 206103 - DNA, 16 bp, P. troglodytes
aggcagcaggcaaggt

SEQ ID NO: 206104 - DNA, 16 bp, P. troglodytes
aggcagcagggggctg

SEQ ID NO: 206105 - DNA, 16 bp, P. troglodytes
aggcagcagttgcagt

SEQ ID NO: 206106 - DNA, 16 bp, P. troglodytes
aggcagcattcaccac

SEQ ID NO: 206107 - DNA, 16 bp, P. troglodytes
aggcagccagtgacca

SEQ ID NO: 206108 - DNA, 16 bp, P. troglodytes
aggcagccatctgcaa

SEQ ID NO: 206109 - DNA, 16 bp, P. troglodytes
aggcagctccaggcac

SEQ ID NO: 206110 - DNA, 16 bp, P. troglodytes
aggcagctctctgcag

SEQ ID NO: 206111 - DNA, 16 bp, P. troglodytes
aggcaggaaaattact

SEQ ID NO: 206112 - DNA, 16 bp, P. troglodytes
aggcaggaagaatcac

SEQ ID NO: 206113 - DNA, 16 bp, P. troglodytes
aggcaggaagaattct

SEQ ID NO: 206114 - DNA, 20 bp, P. troglodytes
aggcaggaagatcacttgag

SEQ ID NO: 206115 - DNA, 16 bp, P. troglodytes
aggcaggaagatggct

SEQ ID NO: 206116 - DNA, 16 bp, P. troglodytes
aggcaggaaggcaggc

SEQ ID NO: 206117 - DNA, 16 bp, P. troglodytes
aggcaggagaaccagg

SEQ ID NO: 206118 - DNA, 19 bp, P. troglodytes
aggcaggagaatcacttca

SEQ ID NO: 206119 - DNA, 16 bp, P. troglodytes
aggcaggagccaggga

SEQ ID NO: 206120 - DNA, 16 bp, P. troglodytes
aggcaggaggaacagc

SEQ ID NO: 206121 - DNA, 16 bp, P. troglodytes
aggcaggaggacctct

SEQ ID NO: 206122 - DNA, 16 bp, P. troglodytes
aggcaggaggatcact

SEQ ID NO: 206123 - DNA, 16 bp, P. troglodytes
aggcaggaggatcaga

SEQ ID NO: 206124 - DNA, 16 bp, P. troglodytes
aggcaggaggatcgct

SEQ ID NO: 206125 - DNA, 16 bp, P. troglodytes
aggcaggaggatgcct

SEQ ID NO: 206126 - DNA, 16 bp, P. troglodytes
aggcaggattgcttga

SEQ ID NO: 206127 - DNA, 16 bp, P. troglodytes
aggcaggcaagaagga

SEQ ID NO: 206128 - DNA, 16 bp, P. troglodytes
aggcaggcacagtggc

SEQ ID NO: 206129 - DNA, 16 bp, P. troglodytes
aggcaggcagactgct

SEQ ID NO: 206130 - DNA, 16 bp, P. troglodytes
aggcaggcagctcact

SEQ ID NO: 206131 - DNA, 16 bp, P. troglodytes
aggcaggcaggaagca

SEQ ID NO: 206132 - DNA, 16 bp, P. troglodytes
aggcaggcaggaagga

SEQ ID NO: 206133 - DNA, 16 bp, P. troglodytes
aggcaggcaggcaggc

SEQ ID NO: 206134 - DNA, 18 bp, P. troglodytes
aggcaggcaggcctcctt

SEQ ID NO: 206135 - DNA, 16 bp, P. troglodytes
aggcaggcagggccag

SEQ ID NO: 206136 - DNA, 20 bp, P. troglodytes
aggcaggcctccttgagctg

SEQ ID NO: 206137 - DNA, 16 bp, P. troglodytes
aggcaggcctggtggc

SEQ ID NO: 206138 - DNA, 16 bp, P. troglodytes
aggcaggccttgtggt

SEQ ID NO: 206139 - DNA, 16 bp, P. troglodytes
aggcaggcggaggttg

SEQ ID NO: 206140 - DNA, 16 bp, P. troglodytes
aggcaggcggatcagt

SEQ ID NO: 206141 - DNA, 19 bp, P. troglodytes
aggcaggcggatcatttga

SEQ ID NO: 206142 - DNA, 16 bp, P. troglodytes
aggcaggcgggtcaca

SEQ ID NO: 206143 - DNA, 16 bp, P. troglodytes
aggcagggaacataag

SEQ ID NO: 206144 - DNA, 16 bp, P. troglodytes
aggcagggaacatcac

SEQ ID NO: 206145 - DNA, 16 bp, P. troglodytes
aggcagggcagggcct

SEQ ID NO: 206146 - DNA, 16 bp, P. troglodytes
aggcagggctggggct

SEQ ID NO: 206147 - DNA, 16 bp, P. troglodytes
aggcagggcttgcagt

SEQ ID NO: 206148 - DNA, 16 bp, P. troglodytes
aggcaggtactattat

SEQ ID NO: 206149 - DNA, 16 bp, P. troglodytes
aggcaggtcatcctga

SEQ ID NO: 206150 - DNA, 16 bp, P. troglodytes
aggcaggtggagcacc

SEQ ID NO: 206151 - DNA, 19 bp, P. troglodytes
aggcaggtggatcacctga

SEQ ID NO: 206152 - DNA, 17 bp, P. troglodytes
aggcaggtggatcactc

SEQ ID NO: 206153 - DNA, 17 bp, P. troglodytes
aggcaggtggatcactg

SEQ ID NO: 206154 - DNA, 16 bp, P. troglodytes
aggcagtcagatcact

SEQ ID NO: 206155 - DNA, 16 bp, P. troglodytes
aggcagtgagctatga

SEQ ID NO: 206156 - DNA, 16 bp, P. troglodytes
aggcagtgtgcccaga

SEQ ID NO: 206157 - DNA, 16 bp, P. troglodytes
aggcagtgtggctcca

SEQ ID NO: 206158 - DNA, 16 bp, P. troglodytes
aggcagtttttttttt

SEQ ID NO: 206159 - DNA, 16 bp, P. troglodytes
aggcataaatgggtta

SEQ ID NO: 206160 - DNA, 16 bp, P. troglodytes
aggcataagccaccac

SEQ ID NO: 206161 - DNA, 16 bp, P. troglodytes
aggcataagccaccat

SEQ ID NO: 206162 - DNA, 16 bp, P. troglodytes
aggcatagaaagaaaa

SEQ ID NO: 206163 - DNA, 16 bp, P. troglodytes
aggcatatatatatat

SEQ ID NO: 206164 - DNA, 16 bp, P. troglodytes
aggcatcagccactgt

SEQ ID NO: 206165 - DNA, 16 bp, P. troglodytes
aggcatctgccactgc

SEQ ID NO: 206166 - DNA, 17 bp, P. troglodytes
aggcatgacccaccgcg

SEQ ID NO: 206167 - DNA, 16 bp, P. troglodytes
aggcatgagaatggca

SEQ ID NO: 206168 - DNA, 16 bp, P. troglodytes
aggcatgagcaaagat

SEQ ID NO: 206169 - DNA, 16 bp, P. troglodytes
aggcatgagccaccaa

SEQ ID NO: 206170 - DNA, 17 bp, P. troglodytes
aggcatgagccaccaca

SEQ ID NO: 206171 - DNA, 20 bp, P. troglodytes
aggcatgagccaccacgccc

SEQ ID NO: 206172 - DNA, 19 bp, P. troglodytes
aggcatgagccaccacgct

SEQ ID NO: 206173 - DNA, 16 bp, P. troglodytes
aggcatgagccaccag

SEQ ID NO: 206174 - DNA, 18 bp, P. troglodytes
aggcatgagccaccatgg

SEQ ID NO: 206175 - DNA, 16 bp, P. troglodytes
aggcatgagccaccgc

SEQ ID NO: 206176 - DNA, 17 bp, P. troglodytes
aggcatgagccaccgta

SEQ ID NO: 206177 - DNA, 16 bp, P. troglodytes
aggcatgagccactga

SEQ ID NO: 206178 - DNA, 16 bp, P. troglodytes
aggcatgagccactgc

SEQ ID NO: 206179 - DNA, 16 bp, P. troglodytes
aggcatgagccactgg

SEQ ID NO: 206180 - DNA, 16 bp, P. troglodytes
aggcatgagccactgt

SEQ ID NO: 206181 - DNA, 17 bp, P. troglodytes
aggcatgagccactgta

SEQ ID NO: 206182 - DNA, 16 bp, P. troglodytes
aggcatgagccatcgc

SEQ ID NO: 206183 - DNA, 16 bp, P. troglodytes
aggcatgagccattgc

SEQ ID NO: 206184 - DNA, 16 bp, P. troglodytes
aggcatgagccgctgc

SEQ ID NO: 206185 - DNA, 16 bp, P. troglodytes
aggcatgagctaccaa

SEQ ID NO: 206186 - DNA, 17 bp, P. troglodytes
aggcatgagctaccaca

SEQ ID NO: 206187 - DNA, 16 bp, P. troglodytes
aggcatgagctaccat

SEQ ID NO: 206188 - DNA, 16 bp, P. troglodytes
aggcatgagctatcac

SEQ ID NO: 206189 - DNA, 17 bp, P. troglodytes
aggcatgagtcaccacg

SEQ ID NO: 206190 - DNA, 16 bp, P. troglodytes
aggcatgagttactgt

SEQ ID NO: 206191 - DNA, 23 bp, P. troglodytes
aggcatgcaccaccacacctggc

SEQ ID NO: 206192 - DNA, 16 bp, P. troglodytes
aggcatgcaccgccat

SEQ ID NO: 206193 - DNA, 16 bp, P. troglodytes
aggcatgggcaaggtc

SEQ ID NO: 206194 - DNA, 18 bp, P. troglodytes
aggcatgggcagggactt

SEQ ID NO: 206195 - DNA, 16 bp, P. troglodytes
aggcatggtcaaggac

SEQ ID NO: 206196 - DNA, 17 bp, P. troglodytes
aggcatggtggcgcacg

SEQ ID NO: 206197 - DNA, 16 bp, P. troglodytes
aggcatggtggctcat

SEQ ID NO: 206198 - DNA, 17 bp, P. troglodytes
aggcatggtggtgtgcg

SEQ ID NO: 206199 - DNA, 17 bp, P. troglodytes
aggcatgtaccaccaca

SEQ ID NO: 206200 - DNA, 16 bp, P. troglodytes
aggcatgtaccactgc

SEQ ID NO: 206201 - DNA, 16 bp, P. troglodytes
aggcatgtcaaaagct

SEQ ID NO: 206202 - DNA, 16 bp, P. troglodytes
aggcatgtcctacatg

SEQ ID NO: 206203 - DNA, 16 bp, P. troglodytes
aggcatgtctgacctc

SEQ ID NO: 206204 - DNA, 16 bp, P. troglodytes
aggcatgtgccaccat

SEQ ID NO: 206205 - DNA, 16 bp, P. troglodytes
aggcattcaataaatg

SEQ ID NO: 206206 - DNA, 16 bp, P. troglodytes
aggcattcctatttct

SEQ ID NO: 206207 - DNA, 16 bp, P. troglodytes
aggcattctgactggt

SEQ ID NO: 206208 - DNA, 16 bp, P. troglodytes
aggcatttaataaaat

SEQ ID NO: 206209 - DNA, 16 bp, P. troglodytes
aggcatttccatacat

SEQ ID NO: 206210 - DNA, 16 bp, P. troglodytes
aggcatttgagtttgc

SEQ ID NO: 206211 - DNA, 16 bp, P. troglodytes
aggcatttgttgctat

SEQ ID NO: 206212 - DNA, 16 bp, P. troglodytes
aggccaaagcaggcaa

SEQ ID NO: 206213 - DNA, 16 bp, P. troglodytes
aggccaaagtggacag

SEQ ID NO: 206214 - DNA, 16 bp, P. troglodytes
aggccaaagtgggagg

SEQ ID NO: 206215 - DNA, 16 bp, P. troglodytes
aggccaaagtgggcag

SEQ ID NO: 206216 - DNA, 16 bp, P. troglodytes
aggccaacatccctga

SEQ ID NO: 206217 - DNA, 21 bp, P. troglodytes
aggccaacatggtgaaacccc

SEQ ID NO: 206218 - DNA, 18 bp, P. troglodytes
aggccaacattccaattc

SEQ ID NO: 206219 - DNA, 16 bp, P. troglodytes
aggccaaccaactcaa

SEQ ID NO: 206220 - DNA, 16 bp, P. troglodytes
aggccaacctggccaa

SEQ ID NO: 206221 - DNA, 16 bp, P. troglodytes
aggccaagaagaatct

SEQ ID NO: 206222 - DNA, 18 bp, P. troglodytes
aggccaagacaggtggat

SEQ ID NO: 206223 - DNA, 16 bp, P. troglodytes
aggccaagaggggcag

SEQ ID NO: 206224 - DNA, 16 bp, P. troglodytes
aggccaagagttcaag

SEQ ID NO: 206225 - DNA, 16 bp, P. troglodytes
aggccaagagtttgag

SEQ ID NO: 206226 - DNA, 16 bp, P. troglodytes
aggccaagatcaaggt

SEQ ID NO: 206227 - DNA, 16 bp, P. troglodytes
aggccaagatgggcag

SEQ ID NO: 206228 - DNA, 16 bp, P. troglodytes
aggccaagcaggagga

SEQ ID NO: 206229 - DNA, 16 bp, P. troglodytes
aggccaaggaggcgcc

SEQ ID NO: 206230 - DNA, 16 bp, P. troglodytes
aggccaaggcagaagg

SEQ ID NO: 206231 - DNA, 16 bp, P. troglodytes
aggccaaggcagacat

SEQ ID NO: 206232 - DNA, 16 bp, P. troglodytes
aggccaaggcaggaga

SEQ ID NO: 206233 - DNA, 16 bp, P. troglodytes
aggccaaggcaggcaa

SEQ ID NO: 206234 - DNA, 16 bp, P. troglodytes
aggccaaggccagcag

SEQ ID NO: 206235 - DNA, 18 bp, P. troglodytes
aggccaaggcggatggat

SEQ ID NO: 206236 - DNA, 16 bp, P. troglodytes
aggccaagggggcaga

SEQ ID NO: 206237 - DNA, 16 bp, P. troglodytes
aggccaagggtgggtg

SEQ ID NO: 206238 - DNA, 16 bp, P. troglodytes
aggccaaggtcagagg

SEQ ID NO: 206239 - DNA, 16 bp, P. troglodytes
aggccaaggtggaaga

SEQ ID NO: 206240 - DNA, 17 bp, P. troglodytes
aggccaaggtggaagga

SEQ ID NO: 206241 - DNA, 16 bp, P. troglodytes
aggccaaggtggatgg

SEQ ID NO: 206242 - DNA, 16 bp, P. troglodytes
aggccaaggtgggaga

SEQ ID NO: 206243 - DNA, 16 bp, P. troglodytes
aggccaaggtggggtg

SEQ ID NO: 206244 - DNA, 16 bp, P. troglodytes
aggccaagtacagtgg

SEQ ID NO: 206245 - DNA, 16 bp, P. troglodytes
aggccaatatcactga

SEQ ID NO: 206246 - DNA, 16 bp, P. troglodytes
aggccaatattaccct

SEQ ID NO: 206247 - DNA, 16 bp, P. troglodytes
aggccacaaaagaagt

SEQ ID NO: 206248 - DNA, 16 bp, P. troglodytes
aggccacaaagcaagt

SEQ ID NO: 206249 - DNA, 16 bp, P. troglodytes
aggccaccatcatcct

SEQ ID NO: 206250 - DNA, 16 bp, P. troglodytes
aggccaccatcctcca

SEQ ID NO: 206251 - DNA, 16 bp, P. troglodytes
aggccacgtgaagatg

SEQ ID NO: 206252 - DNA, 16 bp, P. troglodytes
aggccactgcttcaga

SEQ ID NO: 206253 - DNA, 16 bp, P. troglodytes
aggccactgtggccag

SEQ ID NO: 206254 - DNA, 16 bp, P. troglodytes
aggccagaagagagtg

SEQ ID NO: 206255 - DNA, 16 bp, P. troglodytes
aggccagaagttcaaa

SEQ ID NO: 206256 - DNA, 16 bp, P. troglodytes
aggccagacacggtgg

SEQ ID NO: 206257 - DNA, 17 bp, P. troglodytes
aggccagactgcagtgg

SEQ ID NO: 206258 - DNA, 16 bp, P. troglodytes
aggccagagatgctgc

SEQ ID NO: 206259 - DNA, 16 bp, P. troglodytes
aggccagagggcagtg

SEQ ID NO: 206260 - DNA, 16 bp, P. troglodytes
aggccagagttcaaga

SEQ ID NO: 206261 - DNA, 16 bp, P. troglodytes
aggccagcagctgcag

SEQ ID NO: 206262 - DNA, 27 bp, P. troglodytes
aggccagcaggcagttcccagtgtaga

SEQ ID NO: 206263 - DNA, 16 bp, P. troglodytes
aggccagcatcaccct

SEQ ID NO: 206264 - DNA, 16 bp, P. troglodytes
aggccagcatcgtcct

SEQ ID NO: 206265 - DNA, 16 bp, P. troglodytes
aggccagcctgaccaa

SEQ ID NO: 206266 - DNA, 16 bp, P. troglodytes
aggccagcctgcccaa

SEQ ID NO: 206267 - DNA, 16 bp, P. troglodytes
aggccagcctggccaa

SEQ ID NO: 206268 - DNA, 16 bp, P. troglodytes
aggccagcctggggaa

SEQ ID NO: 206269 - DNA, 16 bp, P. troglodytes
aggccaggaatctgag

SEQ ID NO: 206270 - DNA, 16 bp, P. troglodytes
aggccaggaattcgag

SEQ ID NO: 206271 - DNA, 16 bp, P. troglodytes
aggccaggaatttgaa

SEQ ID NO: 206272 - DNA, 16 bp, P. troglodytes
aggccaggaggtcaag

SEQ ID NO: 206273 - DNA, 16 bp, P. troglodytes
aggccaggaggtggag

SEQ ID NO: 206274 - DNA, 16 bp, P. troglodytes
aggccaggcacagcgg

SEQ ID NO: 206275 - DNA, 16 bp, P. troglodytes
aggccaggcactatgg

SEQ ID NO: 206276 - DNA, 16 bp, P. troglodytes
aggccaggccaggccc

SEQ ID NO: 206277 - DNA, 20 bp, P. troglodytes
aggccaggcgcagtggctca

SEQ ID NO: 206278 - DNA, 22 bp, P. troglodytes
aggccaggcgcggtggctcaca

SEQ ID NO: 206279 - DNA, 16 bp, P. troglodytes
aggccagggaggaggc

SEQ ID NO: 206280 - DNA, 16 bp, P. troglodytes
aggccagggcaggtgg

SEQ ID NO: 206281 - DNA, 16 bp, P. troglodytes
aggccagggccagggc

SEQ ID NO: 206282 - DNA, 16 bp, P. troglodytes
aggccagggtgggtgg

SEQ ID NO: 206283 - DNA, 18 bp, P. troglodytes
aggccaggtgcagtggct

SEQ ID NO: 206284 - DNA, 17 bp, P. troglodytes
aggccaggtgcagtggt

SEQ ID NO: 206285 - DNA, 16 bp, P. troglodytes
aggccaggtgtgctgg

SEQ ID NO: 206286 - DNA, 16 bp, P. troglodytes
aggccaggtgttcaag

SEQ ID NO: 206287 - DNA, 16 bp, P. troglodytes
aggccagtattaccct

SEQ ID NO: 206288 - DNA, 16 bp, P. troglodytes
aggccagtggggctgg

SEQ ID NO: 206289 - DNA, 16 bp, P. troglodytes
aggccagtgtccagaa

SEQ ID NO: 206290 - DNA, 21 bp, P. troglodytes
aggccatacatttcaatccct

SEQ ID NO: 206291 - DNA, 47 bp, P. troglodytes
aggccatatttcagactatcacatggggagaaaccttggacaatacc

SEQ ID NO: 206292 - DNA, 16 bp, P. troglodytes
aggccatcatcatcct

SEQ ID NO: 206293 - DNA, 16 bp, P. troglodytes
aggccatcctggccaa

SEQ ID NO: 206294 - DNA, 16 bp, P. troglodytes
aggccatctgcaagcc

SEQ ID NO: 206295 - DNA, 18 bp, P. troglodytes
aggccatctggatgtata

SEQ ID NO: 206296 - DNA, 16 bp, P. troglodytes
aggccatttcctgatg

SEQ ID NO: 206297 - DNA, 16 bp, P. troglodytes
aggcccaaggagaggg

SEQ ID NO: 206298 - DNA, 16 bp, P. troglodytes
aggcccaagtgatcct

SEQ ID NO: 206299 - DNA, 16 bp, P. troglodytes
aggcccacatggcaag

SEQ ID NO: 206300 - DNA, 16 bp, P. troglodytes
aggcccactgccccag

SEQ ID NO: 206301 - DNA, 16 bp, P. troglodytes
aggcccagagaaggga

SEQ ID NO: 206302 - DNA, 16 bp, P. troglodytes
aggcccagagaggaca

SEQ ID NO: 206303 - DNA, 16 bp, P. troglodytes
aggcccagaggcagga

SEQ ID NO: 206304 - DNA, 16 bp, P. troglodytes
aggcccagaggcccag

SEQ ID NO: 206305 - DNA, 16 bp, P. troglodytes
aggcccagcacagtgg

SEQ ID NO: 206306 - DNA, 16 bp, P. troglodytes
aggcccagctctgcca

SEQ ID NO: 206307 - DNA, 16 bp, P. troglodytes
aggcccaggaaggagg

SEQ ID NO: 206308 - DNA, 16 bp, P. troglodytes
aggcccaggagggagg

SEQ ID NO: 206309 - DNA, 16 bp, P. troglodytes
aggcccaggagtttga

SEQ ID NO: 206310 - DNA, 17 bp, P. troglodytes
aggcccaggcaggcgga

SEQ ID NO: 206311 - DNA, 16 bp, P. troglodytes
aggcccaggcgggcag

SEQ ID NO: 206312 - DNA, 16 bp, P. troglodytes
aggcccagggcccagc

SEQ ID NO: 206313 - DNA, 16 bp, P. troglodytes
aggcccagggccccct

SEQ ID NO: 206314 - DNA, 16 bp, P. troglodytes
aggcccagggtccctg

SEQ ID NO: 206315 - DNA, 16 bp, P. troglodytes
aggccccagagagcta

SEQ ID NO: 206316 - DNA, 16 bp, P. troglodytes
aggccccatctctacc

SEQ ID NO: 206317 - DNA, 16 bp, P. troglodytes
aggcccccataggtga

SEQ ID NO: 206318 - DNA, 16 bp, P. troglodytes
aggcccctgccaccac

SEQ ID NO: 206319 - DNA, 16 bp, P. troglodytes
aggcccggcgagaatt

SEQ ID NO: 206320 - DNA, 16 bp, P. troglodytes
aggccctaaagaaggc

SEQ ID NO: 206321 - DNA, 16 bp, P. troglodytes
aggccctaacccaagc

SEQ ID NO: 206322 - DNA, 16 bp, P. troglodytes
aggccctagctcccag

SEQ ID NO: 206323 - DNA, 16 bp, P. troglodytes
aggccctaggggagaa

SEQ ID NO: 206324 - DNA, 16 bp, P. troglodytes
aggccctcaataaatg

SEQ ID NO: 206325 - DNA, 16 bp, P. troglodytes
aggccctcaccagatg

SEQ ID NO: 206326 - DNA, 16 bp, P. troglodytes
aggccctcagtccaac

SEQ ID NO: 206327 - DNA, 16 bp, P. troglodytes
aggccctcccaatcct

SEQ ID NO: 206328 - DNA, 16 bp, P. troglodytes
aggccctgaggcagca

SEQ ID NO: 206329 - DNA, 16 bp, P. troglodytes
aggccctgccctgcct

SEQ ID NO: 206330 - DNA, 16 bp, P. troglodytes
aggccctggagagggt

SEQ ID NO: 206331 - DNA, 16 bp, P. troglodytes
aggccctggggcaggg

SEQ ID NO: 206332 - DNA, 16 bp, P. troglodytes
aggccctgggtgggtc

SEQ ID NO: 206333 - DNA, 16 bp, P. troglodytes
aggccctggtggtgtg

SEQ ID NO: 206334 - DNA, 16 bp, P. troglodytes
aggccctgtgctaagc

SEQ ID NO: 206335 - DNA, 16 bp, P. troglodytes
aggccctgtgtgatct

SEQ ID NO: 206336 - DNA, 16 bp, P. troglodytes
aggccgacgtgggcag

SEQ ID NO: 206337 - DNA, 17 bp, P. troglodytes
aggccgagatgggagga

SEQ ID NO: 206338 - DNA, 18 bp, P. troglodytes
aggccgagcacagtggct

SEQ ID NO: 206339 - DNA, 16 bp, P. troglodytes
aggccgaggaaggcag

SEQ ID NO: 206340 - DNA, 19 bp, P. troglodytes
aggccgaggcaggcagatt

SEQ ID NO: 206341 - DNA, 16 bp, P. troglodytes
aggccgaggtggatga

SEQ ID NO: 206342 - DNA, 19 bp, P. troglodytes
aggccgaggtgggcggatt

SEQ ID NO: 206343 - DNA, 16 bp, P. troglodytes
aggccgctgcactcca

SEQ ID NO: 206344 - DNA, 18 bp, P. troglodytes
aggccgggcgaggtggct

SEQ ID NO: 206345 - DNA, 16 bp, P. troglodytes
aggccggtcttgaact

SEQ ID NO: 206346 - DNA, 16 bp, P. troglodytes
aggccgtggcgggcgg

SEQ ID NO: 206347 - DNA, 16 bp, P. troglodytes
aggccgtggtgggagg

SEQ ID NO: 206348 - DNA, 16 bp, P. troglodytes
aggccgtggtgggcgg

SEQ ID NO: 206349 - DNA, 16 bp, P. troglodytes
aggcctacttctgtca

SEQ ID NO: 206350 - DNA, 16 bp, P. troglodytes
aggcctagctttcagc

SEQ ID NO: 206351 - DNA, 16 bp, P. troglodytes
aggcctcacctccagc

SEQ ID NO: 206352 - DNA, 16 bp, P. troglodytes
aggcctcactgagaag

SEQ ID NO: 206353 - DNA, 16 bp, P. troglodytes
aggcctcagcctcctg

SEQ ID NO: 206354 - DNA, 16 bp, P. troglodytes
aggcctcaggaagctc

SEQ ID NO: 206355 - DNA, 16 bp, P. troglodytes
aggcctcagtttcctt

SEQ ID NO: 206356 - DNA, 16 bp, P. troglodytes
aggcctccagaacttc

SEQ ID NO: 206357 - DNA, 16 bp, P. troglodytes
aggcctcccaaagtac

SEQ ID NO: 206358 - DNA, 16 bp, P. troglodytes
aggcctccccagacac

SEQ ID NO: 206359 - DNA, 16 bp, P. troglodytes
aggcctccccagaggc

SEQ ID NO: 206360 - DNA, 16 bp, P. troglodytes
aggcctccccagccca

SEQ ID NO: 206361 - DNA, 16 bp, P. troglodytes
aggcctccccagccct

SEQ ID NO: 206362 - DNA, 16 bp, P. troglodytes
aggcctccccaggcac

SEQ ID NO: 206363 - DNA, 16 bp, P. troglodytes
aggcctccccggaagc

SEQ ID NO: 206364 - DNA, 16 bp, P. troglodytes
aggcctccctgcctct

SEQ ID NO: 206365 - DNA, 16 bp, P. troglodytes
aggcctcctcagccac

SEQ ID NO: 206366 - DNA, 16 bp, P. troglodytes
aggcctcctgccaaca

SEQ ID NO: 206367 - DNA, 16 bp, P. troglodytes
aggcctctccagccct

SEQ ID NO: 206368 - DNA, 16 bp, P. troglodytes
aggcctctggacctgt

SEQ ID NO: 206369 - DNA, 16 bp, P. troglodytes
aggcctcttctgcatc

SEQ ID NO: 206370 - DNA, 16 bp, P. troglodytes
aggcctgagccaccgc

SEQ ID NO: 206371 - DNA, 16 bp, P. troglodytes
aggcctgagccactgc

SEQ ID NO: 206372 - DNA, 16 bp, P. troglodytes
aggcctgcctgccact

SEQ ID NO: 206373 - DNA, 16 bp, P. troglodytes
aggcctgcctgcctgc

SEQ ID NO: 206374 - DNA, 16 bp, P. troglodytes
aggcctggaacagatc

SEQ ID NO: 206375 - DNA, 16 bp, P. troglodytes
aggcctggactctgag

SEQ ID NO: 206376 - DNA, 16 bp, P. troglodytes
aggcctggagcctggg

SEQ ID NO: 206377 - DNA, 16 bp, P. troglodytes
aggcctggaggcctaa

SEQ ID NO: 206378 - DNA, 16 bp, P. troglodytes
aggcctggaggctgga

SEQ ID NO: 206379 - DNA, 16 bp, P. troglodytes
aggcctggaggtggga

SEQ ID NO: 206380 - DNA, 17 bp, P. troglodytes
aggcctgggcctgcctg

SEQ ID NO: 206381 - DNA, 16 bp, P. troglodytes
aggcctggggcagggg

SEQ ID NO: 206382 - DNA, 16 bp, P. troglodytes
aggcctgggtgggagg

SEQ ID NO: 206383 - DNA, 16 bp, P. troglodytes
aggcctggtagtgaca

SEQ ID NO: 206384 - DNA, 16 bp, P. troglodytes
aggcctggtggtgtgc

SEQ ID NO: 206385 - DNA, 16 bp, P. troglodytes
aggcctggtgtggtgg

SEQ ID NO: 206386 - DNA, 16 bp, P. troglodytes
aggccttcactcttct

SEQ ID NO: 206387 - DNA, 16 bp, P. troglodytes
aggccttcagccacag

SEQ ID NO: 206388 - DNA, 16 bp, P. troglodytes
aggccttcagcctcag

SEQ ID NO: 206389 - DNA, 16 bp, P. troglodytes
aggccttccctgaccc

SEQ ID NO: 206390 - DNA, 16 bp, P. troglodytes
aggccttggaagccca

SEQ ID NO: 206391 - DNA, 16 bp, P. troglodytes
aggccttggacagctc

SEQ ID NO: 206392 - DNA, 16 bp, P. troglodytes
aggccttgggagccca

SEQ ID NO: 206393 - DNA, 16 bp, P. troglodytes
aggccttgggagctca

SEQ ID NO: 206394 - DNA, 16 bp, P. troglodytes
aggcctttagtgtgag

SEQ ID NO: 206395 - DNA, 16 bp, P. troglodytes
aggcctttggccttgg

SEQ ID NO: 206396 - DNA, 16 bp, P. troglodytes
aggcctttggtgaaaa

SEQ ID NO: 206397 - DNA, 16 bp, P. troglodytes
aggccttttttgcatc

SEQ ID NO: 206398 - DNA, 16 bp, P. troglodytes
aggcgaatcacaaggt

SEQ ID NO: 206399 - DNA, 16 bp, P. troglodytes
aggcgacagagggaga

SEQ ID NO: 206400 - DNA, 16 bp, P. troglodytes
aggcgcccattgccgc

SEQ ID NO: 206401 - DNA, 16 bp, P. troglodytes
aggcgcctgccacctc

SEQ ID NO: 206402 - DNA, 16 bp, P. troglodytes
aggcgcctgccactgt

SEQ ID NO: 206403 - DNA, 16 bp, P. troglodytes
aggcgcctgccagcac

SEQ ID NO: 206404 - DNA, 16 bp, P. troglodytes
aggcgcctgcctccac

SEQ ID NO: 206405 - DNA, 16 bp, P. troglodytes
aggcgcggtggctctc

SEQ ID NO: 206406 - DNA, 19 bp, P. troglodytes
aggcggagcttgcagtgaa

SEQ ID NO: 206407 - DNA, 16 bp, P. troglodytes
aggcggaggttatggt

SEQ ID NO: 206408 - DNA, 16 bp, P. troglodytes
aggcggaggttgcagc

SEQ ID NO: 206409 - DNA, 16 bp, P. troglodytes
aggcggatcaactgag

SEQ ID NO: 206410 - DNA, 18 bp, P. troglodytes
aggcggatcacctgaagt

SEQ ID NO: 206411 - DNA, 18 bp, P. troglodytes
aggcggatcacctgaggc

SEQ ID NO: 206412 - DNA, 19 bp, P. troglodytes
aggcggatggatcacctga

SEQ ID NO: 206413 - DNA, 17 bp, P. troglodytes
aggcggcagccaggctg

SEQ ID NO: 206414 - DNA, 16 bp, P. troglodytes
aggcggccagatcact

SEQ ID NO: 206415 - DNA, 16 bp, P. troglodytes
aggcggccgccaccac

SEQ ID NO: 206416 - DNA, 16 bp, P. troglodytes
aggcgggaggatagct

SEQ ID NO: 206417 - DNA, 17 bp, P. troglodytes
aggcgggcagatcacgt

SEQ ID NO: 206418 - DNA, 18 bp, P. troglodytes
aggcgggcagatcactgg

SEQ ID NO: 206419 - DNA, 24 bp, P. troglodytes
aggcgggcggatcacttgaggtcg

SEQ ID NO: 206420 - DNA, 16 bp, P. troglodytes
aggcgggcggattgcc

SEQ ID NO: 206421 - DNA, 19 bp, P. troglodytes
aggcgggtggatcacgagt

SEQ ID NO: 206422 - DNA, 18 bp, P. troglodytes
aggcgggtggatcactag

SEQ ID NO: 206423 - DNA, 16 bp, P. troglodytes
aggcgtgagcaactgc

SEQ ID NO: 206424 - DNA, 17 bp, P. troglodytes
aggcgtgagccaccaca

SEQ ID NO: 206425 - DNA, 26 bp, P. troglodytes
aggcgtgagccactgcgcccggccca

SEQ ID NO: 206426 - DNA, 16 bp, P. troglodytes
aggcgtgagccacttc

SEQ ID NO: 206427 - DNA, 17 bp, P. troglodytes
aggcgtgagccatcgca

SEQ ID NO: 206428 - DNA, 18 bp, P. troglodytes
aggcgtgagcccccatgc

SEQ ID NO: 206429 - DNA, 16 bp, P. troglodytes
aggcgtgcagatcacc

SEQ ID NO: 206430 - DNA, 16 bp, P. troglodytes
aggcgtgcagcaccac

SEQ ID NO: 206431 - DNA, 16 bp, P. troglodytes
aggcgtggtggggcac

SEQ ID NO: 206432 - DNA, 16 bp, P. troglodytes
aggcgtgtgccaccaa

SEQ ID NO: 206433 - DNA, 16 bp, P. troglodytes
aggctaaaaataaagg

SEQ ID NO: 206434 - DNA, 16 bp, P. troglodytes
aggctaaagaagaaaa

SEQ ID NO: 206435 - DNA, 17 bp, P. troglodytes
aggctaaagtgcagtgg

SEQ ID NO: 206436 - DNA, 16 bp, P. troglodytes
aggctaagcaaaaaga

SEQ ID NO: 206437 - DNA, 16 bp, P. troglodytes
aggctaaggaaggaga

SEQ ID NO: 206438 - DNA, 18 bp, P. troglodytes
aggctaaggcaggcagat

SEQ ID NO: 206439 - DNA, 16 bp, P. troglodytes
aggctaattttttttt

SEQ ID NO: 206440 - DNA, 16 bp, P. troglodytes
aggctacactacattt

SEQ ID NO: 206441 - DNA, 16 bp, P. troglodytes
aggctacagtgagcca

SEQ ID NO: 206442 - DNA, 16 bp, P. troglodytes
aggctacagtgagctg

SEQ ID NO: 206443 - DNA, 16 bp, P. troglodytes
aggctacagtgcagtg

SEQ ID NO: 206444 - DNA, 16 bp, P. troglodytes
aggctagaatgcagtg

SEQ ID NO: 206445 - DNA, 16 bp, P. troglodytes
aggctagactgcagtg

SEQ ID NO: 206446 - DNA, 16 bp, P. troglodytes
aggctagagtacagtg

SEQ ID NO: 206447 - DNA, 19 bp, P. troglodytes
aggctagagtgcagtggcg

SEQ ID NO: 206448 - DNA, 16 bp, P. troglodytes
aggctagtcttgaact

SEQ ID NO: 206449 - DNA, 16 bp, P. troglodytes
aggctatggagaaaag

SEQ ID NO: 206450 - DNA, 16 bp, P. troglodytes
aggctattatcctaag

SEQ ID NO: 206451 - DNA, 16 bp, P. troglodytes
aggctcaagcaatcct

SEQ ID NO: 206452 - DNA, 16 bp, P. troglodytes
aggctcaagcaattct

SEQ ID NO: 206453 - DNA, 16 bp, P. troglodytes
aggctcaagcgattct

SEQ ID NO: 206454 - DNA, 16 bp, P. troglodytes
aggctcaagctattct

SEQ ID NO: 206455 - DNA, 16 bp, P. troglodytes
aggctcaagtgcagtg

SEQ ID NO: 206456 - DNA, 16 bp, P. troglodytes
aggctcagaaatgcct

SEQ ID NO: 206457 - DNA, 16 bp, P. troglodytes
aggctcagagaggctg

SEQ ID NO: 206458 - DNA, 16 bp, P. troglodytes
aggctcagagaggtga

SEQ ID NO: 206459 - DNA, 16 bp, P. troglodytes
aggctcagcagttttc

SEQ ID NO: 206460 - DNA, 16 bp, P. troglodytes
aggctcagtggttcat

SEQ ID NO: 206461 - DNA, 16 bp, P. troglodytes
aggctcagtgtggaca

SEQ ID NO: 206462 - DNA, 16 bp, P. troglodytes
aggctcagttttctca

SEQ ID NO: 206463 - DNA, 16 bp, P. troglodytes
aggctccagaggaagg

SEQ ID NO: 206464 - DNA, 16 bp, P. troglodytes
aggctcgtctcgaact

SEQ ID NO: 206465 - DNA, 16 bp, P. troglodytes
aggctctcaataaata

SEQ ID NO: 206466 - DNA, 16 bp, P. troglodytes
aggctctctgcctctc

SEQ ID NO: 206467 - DNA, 16 bp, P. troglodytes
aggctctgaaattgaa

SEQ ID NO: 206468 - DNA, 16 bp, P. troglodytes
aggctctgaccccaca

SEQ ID NO: 206469 - DNA, 16 bp, P. troglodytes
aggctctggaaaaggg

SEQ ID NO: 206470 - DNA, 16 bp, P. troglodytes
aggctctggagccagg

SEQ ID NO: 206471 - DNA, 16 bp, P. troglodytes
aggctctggagtcaga

SEQ ID NO: 206472 - DNA, 16 bp, P. troglodytes
aggctctgggcctggg

SEQ ID NO: 206473 - DNA, 16 bp, P. troglodytes
aggctctgggggagaa

SEQ ID NO: 206474 - DNA, 18 bp, P. troglodytes
aggctctgtgggcatagg

SEQ ID NO: 206475 - DNA, 16 bp, P. troglodytes
aggctcttggggtccc

SEQ ID NO: 206476 - DNA, 16 bp, P. troglodytes
aggctgaaagtgaaag

SEQ ID NO: 206477 - DNA, 16 bp, P. troglodytes
aggctgaactgcagtg

SEQ ID NO: 206478 - DNA, 16 bp, P. troglodytes
aggctgaagaacagca

SEQ ID NO: 206479 - DNA, 16 bp, P. troglodytes
aggctgaagaggagga

SEQ ID NO: 206480 - DNA, 16 bp, P. troglodytes
aggctgaagcagatgg

SEQ ID NO: 206481 - DNA, 16 bp, P. troglodytes
aggctgaagcaggaca

SEQ ID NO: 206482 - DNA, 18 bp, P. troglodytes
aggctgaagcaggagaat

SEQ ID NO: 206483 - DNA, 16 bp, P. troglodytes
aggctgaagcagggga

SEQ ID NO: 206484 - DNA, 16 bp, P. troglodytes
aggctgaagtgattct

SEQ ID NO: 206485 - DNA, 16 bp, P. troglodytes
aggctgaagtgcaatg

SEQ ID NO: 206486 - DNA, 16 bp, P. troglodytes
aggctgaagtggaaag

SEQ ID NO: 206487 - DNA, 16 bp, P. troglodytes
aggctgaatagtattt

SEQ ID NO: 206488 - DNA, 16 bp, P. troglodytes
aggctgaatttattga

SEQ ID NO: 206489 - DNA, 16 bp, P. troglodytes
aggctgacacagaaga

SEQ ID NO: 206490 - DNA, 16 bp, P. troglodytes
aggctgacatgcagtg

SEQ ID NO: 206491 - DNA, 16 bp, P. troglodytes
aggctgagaaaccctg

SEQ ID NO: 206492 - DNA, 16 bp, P. troglodytes
aggctgagaaatcctg

SEQ ID NO: 206493 - DNA, 16 bp, P. troglodytes
aggctgagaaggaagg

SEQ ID NO: 206494 - DNA, 16 bp, P. troglodytes
aggctgagaattgctt

SEQ ID NO: 206495 - DNA, 16 bp, P. troglodytes
aggctgagacaaaaga

SEQ ID NO: 206496 - DNA, 16 bp, P. troglodytes
aggctgagacagaatc

SEQ ID NO: 206497 - DNA, 17 bp, P. troglodytes
aggctgagacaggaaaa

SEQ ID NO: 206498 - DNA, 16 bp, P. troglodytes
aggctgagacaggagg

SEQ ID NO: 206499 - DNA, 16 bp, P. troglodytes
aggctgagacaggcga

SEQ ID NO: 206500 - DNA, 16 bp, P. troglodytes
aggctgagacgggtgg

SEQ ID NO: 206501 - DNA, 16 bp, P. troglodytes
aggctgagaggctgag

SEQ ID NO: 206502 - DNA, 16 bp, P. troglodytes
aggctgagatgagcag

SEQ ID NO: 206503 - DNA, 16 bp, P. troglodytes
aggctgagatggagga

SEQ ID NO: 206504 - DNA, 16 bp, P. troglodytes
aggctgagatgggaga

SEQ ID NO: 206505 - DNA, 16 bp, P. troglodytes
aggctgagcaagagaa

SEQ ID NO: 206506 - DNA, 16 bp, P. troglodytes
aggctgaggaacaaga

SEQ ID NO: 206507 - DNA, 16 bp, P. troglodytes
aggctgaggaagaaga

SEQ ID NO: 206508 - DNA, 16 bp, P. troglodytes
aggctgaggaagagga

SEQ ID NO: 206509 - DNA, 16 bp, P. troglodytes
aggctgaggaaggaaa

SEQ ID NO: 206510 - DNA, 16 bp, P. troglodytes
aggctgaggaaggtga

SEQ ID NO: 206511 - DNA, 16 bp, P. troglodytes
aggctgaggagaagga

SEQ ID NO: 206512 - DNA, 16 bp, P. troglodytes
aggctgaggaggacag

SEQ ID NO: 206513 - DNA, 16 bp, P. troglodytes
aggctgaggaggagga

SEQ ID NO: 206514 - DNA, 16 bp, P. troglodytes
aggctgaggaggcagg

SEQ ID NO: 206515 - DNA, 16 bp, P. troglodytes
aggctgaggaggtctc

SEQ ID NO: 206516 - DNA, 16 bp, P. troglodytes
aggctgaggcaagtga

SEQ ID NO: 206517 - DNA, 16 bp, P. troglodytes
aggctgaggcacagag

SEQ ID NO: 206518 - DNA, 17 bp, P. troglodytes
aggctgaggcacgagac

SEQ ID NO: 206519 - DNA, 19 bp, P. troglodytes
aggctgaggcagaagaatc

SEQ ID NO: 206520 - DNA, 16 bp, P. troglodytes
aggctgaggcagagaa

SEQ ID NO: 206521 - DNA, 16 bp, P. troglodytes
aggctgaggcagatga

SEQ ID NO: 206522 - DNA, 16 bp, P. troglodytes
aggctgaggcagcagc

SEQ ID NO: 206523 - DNA, 18 bp, P. troglodytes
aggctgaggcaggaaaat

SEQ ID NO: 206524 - DNA, 18 bp, P. troglodytes
aggctgaggcaggagaaa

SEQ ID NO: 206525 - DNA, 16 bp, P. troglodytes
aggctgaggcaggagc

SEQ ID NO: 206526 - DNA, 22 bp, P. troglodytes
aggctgaggcaggcagatcacc

SEQ ID NO: 206527 - DNA, 19 bp, P. troglodytes
aggctgaggcaggcggatt

SEQ ID NO: 206528 - DNA, 19 bp, P. troglodytes
aggctgaggcaggggaatg

SEQ ID NO: 206529 - DNA, 16 bp, P. troglodytes
aggctgaggcataaga

SEQ ID NO: 206530 - DNA, 16 bp, P. troglodytes
aggctgaggccagcag

SEQ ID NO: 206531 - DNA, 16 bp, P. troglodytes
aggctgaggcccagga

SEQ ID NO: 206532 - DNA, 16 bp, P. troglodytes
aggctgaggcgggaag

SEQ ID NO: 206533 - DNA, 18 bp, P. troglodytes
aggctgaggcgggagaat

SEQ ID NO: 206534 - DNA, 16 bp, P. troglodytes
aggctgaggctgagga

SEQ ID NO: 206535 - DNA, 16 bp, P. troglodytes
aggctgaggctgaggc

SEQ ID NO: 206536 - DNA, 16 bp, P. troglodytes
aggctgaggctggggg

SEQ ID NO: 206537 - DNA, 16 bp, P. troglodytes
aggctgagggaggaag

SEQ ID NO: 206538 - DNA, 16 bp, P. troglodytes
aggctgagggcaggtg

SEQ ID NO: 206539 - DNA, 16 bp, P. troglodytes
aggctgagggggatgg

SEQ ID NO: 206540 - DNA, 16 bp, P. troglodytes
aggctgaggtcaggag

SEQ ID NO: 206541 - DNA, 16 bp, P. troglodytes
aggctgaggtgagaag

SEQ ID NO: 206542 - DNA, 16 bp, P. troglodytes
aggctgaggtggcaga

SEQ ID NO: 206543 - DNA, 16 bp, P. troglodytes
aggctgaggtgggaga

SEQ ID NO: 206544 - DNA, 16 bp, P. troglodytes
aggctgaggtgggagc

SEQ ID NO: 206545 - DNA, 16 bp, P. troglodytes
aggctgaggtgggcat

SEQ ID NO: 206546 - DNA, 16 bp, P. troglodytes
aggctgaggtggggga

SEQ ID NO: 206547 - DNA, 16 bp, P. troglodytes
aggctgaggtggtctc

SEQ ID NO: 206548 - DNA, 16 bp, P. troglodytes
aggctgaggtggtgga

SEQ ID NO: 206549 - DNA, 16 bp, P. troglodytes
aggctgaggttggaga

SEQ ID NO: 206550 - DNA, 16 bp, P. troglodytes
aggctgagtacagtgg

SEQ ID NO: 206551 - DNA, 16 bp, P. troglodytes
aggctgagtcacgaga

SEQ ID NO: 206552 - DNA, 16 bp, P. troglodytes
aggctgagtgcagtgg

SEQ ID NO: 206553 - DNA, 16 bp, P. troglodytes
aggctgagtggaagga

SEQ ID NO: 206554 - DNA, 17 bp, P. troglodytes
aggctgagttgggtgga

SEQ ID NO: 206555 - DNA, 16 bp, P. troglodytes
aggctgatctcgaact

SEQ ID NO: 206556 - DNA, 16 bp, P. troglodytes
aggctgatcttgaact

SEQ ID NO: 206557 - DNA, 16 bp, P. troglodytes
aggctgcaaacctgta

SEQ ID NO: 206558 - DNA, 16 bp, P. troglodytes
aggctgcaataagctg

SEQ ID NO: 206559 - DNA, 16 bp, P. troglodytes
aggctgcaatgagcag

SEQ ID NO: 206560 - DNA, 16 bp, P. troglodytes
aggctgcaatgagcca

SEQ ID NO: 206561 - DNA, 16 bp, P. troglodytes
aggctgcaatgagcta

SEQ ID NO: 206562 - DNA, 16 bp, P. troglodytes
aggctgcacacagcag

SEQ ID NO: 206563 - DNA, 16 bp, P. troglodytes
aggctgcacagagcag

SEQ ID NO: 206564 - DNA, 16 bp, P. troglodytes
aggctgcacagcttgt

SEQ ID NO: 206565 - DNA, 16 bp, P. troglodytes
aggctgcactgagcca

SEQ ID NO: 206566 - DNA, 16 bp, P. troglodytes
aggctgcacttggctc

SEQ ID NO: 206567 - DNA, 16 bp, P. troglodytes
aggctgcagcaggagg

SEQ ID NO: 206568 - DNA, 16 bp, P. troglodytes
aggctgcagcaggcag

SEQ ID NO: 206569 - DNA, 16 bp, P. troglodytes
aggctgcagggaacca

SEQ ID NO: 206570 - DNA, 16 bp, P. troglodytes
aggctgcagggagcag

SEQ ID NO: 206571 - DNA, 16 bp, P. troglodytes
aggctgcagggcagga

SEQ ID NO: 206572 - DNA, 16 bp, P. troglodytes
aggctgcagtaagcca

SEQ ID NO: 206573 - DNA, 16 bp, P. troglodytes
aggctgcagtgaattg

SEQ ID NO: 206574 - DNA, 16 bp, P. troglodytes
aggctgcagtgagcta

SEQ ID NO: 206575 - DNA, 16 bp, P. troglodytes
aggctgcagtgagtta

SEQ ID NO: 206576 - DNA, 18 bp, P. troglodytes
aggctgcagtgcaatggt

SEQ ID NO: 206577 - DNA, 16 bp, P. troglodytes
aggctgcagtgcactg

SEQ ID NO: 206578 - DNA, 16 bp, P. troglodytes
aggctgcagtgcagtg

SEQ ID NO: 206579 - DNA, 16 bp, P. troglodytes
aggctgcagtgcgcca

SEQ ID NO: 206580 - DNA, 16 bp, P. troglodytes
aggctgcagtgggcca

SEQ ID NO: 206581 - DNA, 16 bp, P. troglodytes
aggctgcagtgggctg

SEQ ID NO: 206582 - DNA, 16 bp, P. troglodytes
aggctgcagtgtgctg

SEQ ID NO: 206583 - DNA, 16 bp, P. troglodytes
aggctgcattgagcca

SEQ ID NO: 206584 - DNA, 16 bp, P. troglodytes
aggctgccaagcctcc

SEQ ID NO: 206585 - DNA, 16 bp, P. troglodytes
aggctgccaggctgga

SEQ ID NO: 206586 - DNA, 16 bp, P. troglodytes
aggctgccatctttgc

SEQ ID NO: 206587 - DNA, 16 bp, P. troglodytes
aggctgctacaacaaa

SEQ ID NO: 206588 - DNA, 16 bp, P. troglodytes
aggctggaagagtttt

SEQ ID NO: 206589 - DNA, 16 bp, P. troglodytes
aggctggaatgcagta

SEQ ID NO: 206590 - DNA, 16 bp, P. troglodytes
aggctggaatgcagtg

SEQ ID NO: 206591 - DNA, 17 bp, P. troglodytes
aggctggaatgcagtga

SEQ ID NO: 206592 - DNA, 18 bp, P. troglodytes
aggctggacgcagtggct

SEQ ID NO: 206593 - DNA, 16 bp, P. troglodytes
aggctggactggagtg

SEQ ID NO: 206594 - DNA, 16 bp, P. troglodytes
aggctggactgtgctg

SEQ ID NO: 206595 - DNA, 16 bp, P. troglodytes
aggctggagaatggca

SEQ ID NO: 206596 - DNA, 16 bp, P. troglodytes
aggctggagagcaatg

SEQ ID NO: 206597 - DNA, 16 bp, P. troglodytes
aggctggagagcagca

SEQ ID NO: 206598 - DNA, 16 bp, P. troglodytes
aggctggagagcctgg

SEQ ID NO: 206599 - DNA, 16 bp, P. troglodytes
aggctggagaggcagg

SEQ ID NO: 206600 - DNA, 16 bp, P. troglodytes
aggctggagcacaatg

SEQ ID NO: 206601 - DNA, 16 bp, P. troglodytes
aggctggagcacaggg

SEQ ID NO: 206602 - DNA, 17 bp, P. troglodytes
aggctggagcgcaatgg

SEQ ID NO: 206603 - DNA, 19 bp, P. troglodytes
aggctggagcgcagtggcg

SEQ ID NO: 206604 - DNA, 17 bp, P. troglodytes
aggctggagcgctgtgg

SEQ ID NO: 206605 - DNA, 16 bp, P. troglodytes
aggctggagctcaatg

SEQ ID NO: 206606 - DNA, 16 bp, P. troglodytes
aggctggaggaggtgg

SEQ ID NO: 206607 - DNA, 16 bp, P. troglodytes
aggctggaggcaggga

SEQ ID NO: 206608 - DNA, 16 bp, P. troglodytes
aggctggaggctggag

SEQ ID NO: 206609 - DNA, 16 bp, P. troglodytes
aggctggagggcaggg

SEQ ID NO: 206610 - DNA, 18 bp, P. troglodytes
aggctggagtacagtagt

SEQ ID NO: 206611 - DNA, 16 bp, P. troglodytes
aggctggagtacgatg

SEQ ID NO: 206612 - DNA, 16 bp, P. troglodytes
aggctggagtagagtg

SEQ ID NO: 206613 - DNA, 16 bp, P. troglodytes
aggctggagtataatg

SEQ ID NO: 206614 - DNA, 16 bp, P. troglodytes
aggctggagtgcaagg

SEQ ID NO: 206615 - DNA, 16 bp, P. troglodytes
aggctggagtgcagga

SEQ ID NO: 206616 - DNA, 17 bp, P. troglodytes
aggctggagtgcagtga

SEQ ID NO: 206617 - DNA, 17 bp, P. troglodytes
aggctggagtgcagtgc

SEQ ID NO: 206618 - DNA, 26 bp, P. troglodytes
aggctggagtgcagtggcgcaatctt

SEQ ID NO: 206619 - DNA, 16 bp, P. troglodytes
aggctggagtgccatg

SEQ ID NO: 206620 - DNA, 18 bp, P. troglodytes
aggctggagtgccgtggt

SEQ ID NO: 206621 - DNA, 18 bp, P. troglodytes
aggctggagtgcgatggt

SEQ ID NO: 206622 - DNA, 16 bp, P. troglodytes
aggctggagtgcggag

SEQ ID NO: 206623 - DNA, 20 bp, P. troglodytes
aggctggagtgcggtggcgc

SEQ ID NO: 206624 - DNA, 16 bp, P. troglodytes
aggctggagtggaggg

SEQ ID NO: 206625 - DNA, 16 bp, P. troglodytes
aggctggagtgtcatg

SEQ ID NO: 206626 - DNA, 16 bp, P. troglodytes
aggctggagttcagta

SEQ ID NO: 206627 - DNA, 16 bp, P. troglodytes
aggctggagttcagtg

SEQ ID NO: 206628 - DNA, 16 bp, P. troglodytes
aggctggattgcagtg

SEQ ID NO: 206629 - DNA, 16 bp, P. troglodytes
aggctggcagagacac

SEQ ID NO: 206630 - DNA, 16 bp, P. troglodytes
aggctggcctcagact

SEQ ID NO: 206631 - DNA, 16 bp, P. troglodytes
aggctggccttgaact

SEQ ID NO: 206632 - DNA, 16 bp, P. troglodytes
aggctggcgtacagtg

SEQ ID NO: 206633 - DNA, 19 bp, P. troglodytes
aggctggcgtgcagtggcg

SEQ ID NO: 206634 - DNA, 16 bp, P. troglodytes
aggctgggaaatgtgg

SEQ ID NO: 206635 - DNA, 16 bp, P. troglodytes
aggctgggaagcagag

SEQ ID NO: 206636 - DNA, 16 bp, P. troglodytes
aggctgggaaggggag

SEQ ID NO: 206637 - DNA, 16 bp, P. troglodytes
aggctgggaagtccaa

SEQ ID NO: 206638 - DNA, 16 bp, P. troglodytes
aggctgggaagtccag

SEQ ID NO: 206639 - DNA, 16 bp, P. troglodytes
aggctgggagaggtgg

SEQ ID NO: 206640 - DNA, 16 bp, P. troglodytes
aggctgggaggctagg

SEQ ID NO: 206641 - DNA, 16 bp, P. troglodytes
aggctgggagtggtgg

SEQ ID NO: 206642 - DNA, 16 bp, P. troglodytes
aggctgggcaccgtgg

SEQ ID NO: 206643 - DNA, 16 bp, P. troglodytes
aggctgggcactgtgg

SEQ ID NO: 206644 - DNA, 16 bp, P. troglodytes
aggctgggcctggtgg

SEQ ID NO: 206645 - DNA, 16 bp, P. troglodytes
aggctggggaagttct

SEQ ID NO: 206646 - DNA, 16 bp, P. troglodytes
aggctggggaccactg

SEQ ID NO: 206647 - DNA, 16 bp, P. troglodytes
aggctggggcacaaga

SEQ ID NO: 206648 - DNA, 16 bp, P. troglodytes
aggctggggcaggcag

SEQ ID NO: 206649 - DNA, 16 bp, P. troglodytes
aggctggggctggggc

SEQ ID NO: 206650 - DNA, 16 bp, P. troglodytes
aggctgggggcagagg

SEQ ID NO: 206651 - DNA, 16 bp, P. troglodytes
aggctgggggctgggc

SEQ ID NO: 206652 - DNA, 16 bp, P. troglodytes
aggctggggtccagtg

SEQ ID NO: 206653 - DNA, 16 bp, P. troglodytes
aggctggggtgcggtg

SEQ ID NO: 206654 - DNA, 16 bp, P. troglodytes
aggctggggtgctgtg

SEQ ID NO: 206655 - DNA, 16 bp, P. troglodytes
aggctggggtgggaga

SEQ ID NO: 206656 - DNA, 16 bp, P. troglodytes
aggctgggtaatttat

SEQ ID NO: 206657 - DNA, 21 bp, P. troglodytes
aggctgggtgcagtggctcat

SEQ ID NO: 206658 - DNA, 16 bp, P. troglodytes
aggctgggtgccgtgg

SEQ ID NO: 206659 - DNA, 16 bp, P. troglodytes
aggctgggtgtggtga

SEQ ID NO: 206660 - DNA, 16 bp, P. troglodytes
aggctgggttcagtgg

SEQ ID NO: 206661 - DNA, 16 bp, P. troglodytes
aggctggtaatttata

SEQ ID NO: 206662 - DNA, 16 bp, P. troglodytes
aggctggtatgcagtg

SEQ ID NO: 206663 - DNA, 16 bp, P. troglodytes
aggctggtcacgaact

SEQ ID NO: 206664 - DNA, 17 bp, P. troglodytes
aggctggtctcaaactt

SEQ ID NO: 206665 - DNA, 16 bp, P. troglodytes
aggctggtctcctact

SEQ ID NO: 206666 - DNA, 16 bp, P. troglodytes
aggctggtctcgaatt

SEQ ID NO: 206667 - DNA, 16 bp, P. troglodytes
aggctggtctctgaac

SEQ ID NO: 206668 - DNA, 16 bp, P. troglodytes
aggctggtcttgaaca

SEQ ID NO: 206669 - DNA, 19 bp, P. troglodytes
aggctggtcttgaactccc

SEQ ID NO: 206670 - DNA, 17 bp, P. troglodytes
aggctggtcttgaactg

SEQ ID NO: 206671 - DNA, 18 bp, P. troglodytes
aggctggtcttgaactga

SEQ ID NO: 206672 - DNA, 16 bp, P. troglodytes
aggctggttgcaaact

SEQ ID NO: 206673 - DNA, 17 bp, P. troglodytes
aggctgtacaggaagca

SEQ ID NO: 206674 - DNA, 16 bp, P. troglodytes
aggctgtagtgcagca

SEQ ID NO: 206675 - DNA, 16 bp, P. troglodytes
aggctgtcacactgac

SEQ ID NO: 206676 - DNA, 16 bp, P. troglodytes
aggctgtgaagaaaag

SEQ ID NO: 206677 - DNA, 16 bp, P. troglodytes
aggctgtggaagcttt

SEQ ID NO: 206678 - DNA, 16 bp, P. troglodytes
aggctgtggcaggagg

SEQ ID NO: 206679 - DNA, 16 bp, P. troglodytes
aggctgtgggagccca

SEQ ID NO: 206680 - DNA, 16 bp, P. troglodytes
aggctgtgtaatttat

SEQ ID NO: 206681 - DNA, 16 bp, P. troglodytes
aggctgtgtctcaaaa

SEQ ID NO: 206682 - DNA, 16 bp, P. troglodytes
aggctgttaaaaaaaa

SEQ ID NO: 206683 - DNA, 16 bp, P. troglodytes
aggctgttctggaact

SEQ ID NO: 206684 - DNA, 16 bp, P. troglodytes
aggctgttttccaaag

SEQ ID NO: 206685 - DNA, 16 bp, P. troglodytes
aggctgtttttatttt

SEQ ID NO: 206686 - DNA, 16 bp, P. troglodytes
aggcttcagaaagtgg

SEQ ID NO: 206687 - DNA, 16 bp, P. troglodytes
aggcttcagaaggtgg

SEQ ID NO: 206688 - DNA, 16 bp, P. troglodytes
aggcttcagaatgtgg

SEQ ID NO: 206689 - DNA, 16 bp, P. troglodytes
aggcttcagccaccat

SEQ ID NO: 206690 - DNA, 16 bp, P. troglodytes
aggcttcataatcatg

SEQ ID NO: 206691 - DNA, 16 bp, P. troglodytes
aggcttccccagccat

SEQ ID NO: 206692 - DNA, 16 bp, P. troglodytes
aggcttctcagcagaa

SEQ ID NO: 206693 - DNA, 16 bp, P. troglodytes
aggcttctccagccac

SEQ ID NO: 206694 - DNA, 16 bp, P. troglodytes
aggcttgagcctggga

SEQ ID NO: 206695 - DNA, 16 bp, P. troglodytes
aggcttgaggtgggag

SEQ ID NO: 206696 - DNA, 16 bp, P. troglodytes
aggcttggggaggggc

SEQ ID NO: 206697 - DNA, 16 bp, P. troglodytes
aggcttggtggctcat

SEQ ID NO: 206698 - DNA, 16 bp, P. troglodytes
aggcttggtggtgaca

SEQ ID NO: 206699 - DNA, 16 bp, P. troglodytes
aggcttgtcttgaact

SEQ ID NO: 206700 - DNA, 16 bp, P. troglodytes
aggctttacaggaagc

SEQ ID NO: 206701 - DNA, 16 bp, P. troglodytes
aggctttcctcctcag

SEQ ID NO: 206702 - DNA, 16 bp, P. troglodytes
aggctttgcaggccac

SEQ ID NO: 206703 - DNA, 16 bp, P. troglodytes
aggctttggaatcaga

SEQ ID NO: 206704 - DNA, 16 bp, P. troglodytes
aggctttggggtcaga

SEQ ID NO: 206705 - DNA, 16 bp, P. troglodytes
aggctttgtttacact

SEQ ID NO: 206706 - DNA, 16 bp, P. troglodytes
aggcttttcagattgg

SEQ ID NO: 206707 - DNA, 16 bp, P. troglodytes
aggcttttcttgaact

SEQ ID NO: 206708 - DNA, 16 bp, P. troglodytes
aggcttttctttttaa

SEQ ID NO: 206709 - DNA, 16 bp, P. troglodytes
aggctttttctagcct

SEQ ID NO: 206710 - DNA, 16 bp, P. troglodytes
agggaaaaaaatccaa

SEQ ID NO: 206711 - DNA, 16 bp, P. troglodytes
agggaaaaaaatgttt

SEQ ID NO: 206712 - DNA, 16 bp, P. troglodytes
agggaaaaatgttaag

SEQ ID NO: 206713 - DNA, 16 bp, P. troglodytes
agggaaaactgaggct

SEQ ID NO: 206714 - DNA, 16 bp, P. troglodytes
agggaaaataaatcat

SEQ ID NO: 206715 - DNA, 16 bp, P. troglodytes
agggaaaccgccccca

SEQ ID NO: 206716 - DNA, 16 bp, P. troglodytes
agggaaacctttcccc

SEQ ID NO: 206717 - DNA, 16 bp, P. troglodytes
agggaaagaatagtct

SEQ ID NO: 206718 - DNA, 16 bp, P. troglodytes
agggaaaggcagtttc

SEQ ID NO: 206719 - DNA, 16 bp, P. troglodytes
agggaaatatggggtt

SEQ ID NO: 206720 - DNA, 16 bp, P. troglodytes
agggaaatgcaagtca

SEQ ID NO: 206721 - DNA, 16 bp, P. troglodytes
agggaaatgccagatg

SEQ ID NO: 206722 - DNA, 16 bp, P. troglodytes
agggaaattccaggca

SEQ ID NO: 206723 - DNA, 16 bp, P. troglodytes
agggaacagattctcc

SEQ ID NO: 206724 - DNA, 16 bp, P. troglodytes
agggaaccagtgggag

SEQ ID NO: 206725 - DNA, 16 bp, P. troglodytes
agggaagcccaccaga

SEQ ID NO: 206726 - DNA, 16 bp, P. troglodytes
agggaagcccagcaga

SEQ ID NO: 206727 - DNA, 16 bp, P. troglodytes
agggaagcctcaggaa

SEQ ID NO: 206728 - DNA, 16 bp, P. troglodytes
agggaagcttcatctg

SEQ ID NO: 206729 - DNA, 16 bp, P. troglodytes
agggaaggcttctcag

SEQ ID NO: 206730 - DNA, 16 bp, P. troglodytes
agggaagtataaatta

SEQ ID NO: 206731 - DNA, 16 bp, P. troglodytes
agggaagttggggaaa

SEQ ID NO: 206732 - DNA, 16 bp, P. troglodytes
agggaatagagaggcc

SEQ ID NO: 206733 - DNA, 16 bp, P. troglodytes
agggaatccattcccc

SEQ ID NO: 206734 - DNA, 16 bp, P. troglodytes
agggaatgatgacaag

SEQ ID NO: 206735 - DNA, 16 bp, P. troglodytes
agggaatgcttccagc

SEQ ID NO: 206736 - DNA, 16 bp, P. troglodytes
agggaatggggagtta

SEQ ID NO: 206737 - DNA, 16 bp, P. troglodytes
agggacacagatgaag

SEQ ID NO: 206738 - DNA, 16 bp, P. troglodytes
agggacagactgacac

SEQ ID NO: 206739 - DNA, 16 bp, P. troglodytes
agggacagactgcttc

SEQ ID NO: 206740 - DNA, 16 bp, P. troglodytes
agggacagagtgagac

SEQ ID NO: 206741 - DNA, 16 bp, P. troglodytes
agggacaggaggcaga

SEQ ID NO: 206742 - DNA, 16 bp, P. troglodytes
agggacagtgagagag

SEQ ID NO: 206743 - DNA, 16 bp, P. troglodytes
agggaccagtgggagg

SEQ ID NO: 206744 - DNA, 16 bp, P. troglodytes
agggacccagagggag

SEQ ID NO: 206745 - DNA, 16 bp, P. troglodytes
agggacccgatgggag

SEQ ID NO: 206746 - DNA, 16 bp, P. troglodytes
agggacctggcaggag

SEQ ID NO: 206747 - DNA, 16 bp, P. troglodytes
agggacctggggggag

SEQ ID NO: 206748 - DNA, 16 bp, P. troglodytes
agggacctggtgggag

SEQ ID NO: 206749 - DNA, 16 bp, P. troglodytes
agggactctggccttg

SEQ ID NO: 206750 - DNA, 16 bp, P. troglodytes
agggactgctgtgaag

SEQ ID NO: 206751 - DNA, 16 bp, P. troglodytes
agggactggcagtggg

SEQ ID NO: 206752 - DNA, 16 bp, P. troglodytes
agggactggtttctgt

SEQ ID NO: 206753 - DNA, 16 bp, P. troglodytes
agggactgtgtacaca

SEQ ID NO: 206754 - DNA, 16 bp, P. troglodytes
agggacttcccttgtc

SEQ ID NO: 206755 - DNA, 16 bp, P. troglodytes
agggacttgagcatca

SEQ ID NO: 206756 - DNA, 16 bp, P. troglodytes
agggacttgcccaggg

SEQ ID NO: 206757 - DNA, 16 bp, P. troglodytes
agggactttgcaggtg

SEQ ID NO: 206758 - DNA, 16 bp, P. troglodytes
agggagaaataaaatc

SEQ ID NO: 206759 - DNA, 16 bp, P. troglodytes
agggagaagagcccct

SEQ ID NO: 206760 - DNA, 16 bp, P. troglodytes
agggagaagatggcca

SEQ ID NO: 206761 - DNA, 16 bp, P. troglodytes
agggagaagccaggag

SEQ ID NO: 206762 - DNA, 16 bp, P. troglodytes
agggagaattgcttga

SEQ ID NO: 206763 - DNA, 16 bp, P. troglodytes
agggagacatgagaca

SEQ ID NO: 206764 - DNA, 16 bp, P. troglodytes
agggagacccagtctc

SEQ ID NO: 206765 - DNA, 16 bp, P. troglodytes
agggagacccccatct

SEQ ID NO: 206766 - DNA, 16 bp, P. troglodytes
agggagaccctgtctc

SEQ ID NO: 206767 - DNA, 16 bp, P. troglodytes
agggagactctgtctc

SEQ ID NO: 206768 - DNA, 16 bp, P. troglodytes
agggagactctgtctt

SEQ ID NO: 206769 - DNA, 16 bp, P. troglodytes
agggagactgcatctc

SEQ ID NO: 206770 - DNA, 16 bp, P. troglodytes
agggagagacagagac

SEQ ID NO: 206771 - DNA, 16 bp, P. troglodytes
agggagagaggctggg

SEQ ID NO: 206772 - DNA, 16 bp, P. troglodytes
agggagagcaccagga

SEQ ID NO: 206773 - DNA, 16 bp, P. troglodytes
agggagaggccagaga

SEQ ID NO: 206774 - DNA, 16 bp, P. troglodytes
agggagagtctgtctc

SEQ ID NO: 206775 - DNA, 16 bp, P. troglodytes
agggagatcccatctc

SEQ ID NO: 206776 - DNA, 16 bp, P. troglodytes
agggagatgttggtca

SEQ ID NO: 206777 - DNA, 16 bp, P. troglodytes
agggagcacagggttg

SEQ ID NO: 206778 - DNA, 16 bp, P. troglodytes
agggagcacggccctg

SEQ ID NO: 206779 - DNA, 16 bp, P. troglodytes
agggagcagggctggg

SEQ ID NO: 206780 - DNA, 16 bp, P. troglodytes
agggagccaagatcgt

SEQ ID NO: 206781 - DNA, 16 bp, P. troglodytes
agggagccaagattgt

SEQ ID NO: 206782 - DNA, 16 bp, P. troglodytes
agggagctcccaggtc

SEQ ID NO: 206783 - DNA, 16 bp, P. troglodytes
agggagctctggagca

SEQ ID NO: 206784 - DNA, 16 bp, P. troglodytes
agggagctggctccag

SEQ ID NO: 206785 - DNA, 16 bp, P. troglodytes
agggagctggctccgg

SEQ ID NO: 206786 - DNA, 16 bp, P. troglodytes
agggagctggtgggag

SEQ ID NO: 206787 - DNA, 16 bp, P. troglodytes
agggagctttttaaaa

SEQ ID NO: 206788 - DNA, 16 bp, P. troglodytes
agggaggaacactgcc

SEQ ID NO: 206789 - DNA, 16 bp, P. troglodytes
agggaggaggactgct

SEQ ID NO: 206790 - DNA, 16 bp, P. troglodytes
agggaggaggctgaga

SEQ ID NO: 206791 - DNA, 16 bp, P. troglodytes
agggaggatcacttga

SEQ ID NO: 206792 - DNA, 16 bp, P. troglodytes
agggaggatcaggtgg

SEQ ID NO: 206793 - DNA, 16 bp, P. troglodytes
agggaggccagggcag

SEQ ID NO: 206794 - DNA, 16 bp, P. troglodytes
agggaggcccagggag

SEQ ID NO: 206795 - DNA, 16 bp, P. troglodytes
agggaggctataccct

SEQ ID NO: 206796 - DNA, 16 bp, P. troglodytes
agggaggctcaggtgg

SEQ ID NO: 206797 - DNA, 16 bp, P. troglodytes
agggaggctgaggtgg

SEQ ID NO: 206798 - DNA, 16 bp, P. troglodytes
agggagggaactggtg

SEQ ID NO: 206799 - DNA, 16 bp, P. troglodytes
agggaggtattattat

SEQ ID NO: 206800 - DNA, 16 bp, P. troglodytes
agggaggtggaagttg

SEQ ID NO: 206801 - DNA, 16 bp, P. troglodytes
agggaggtggaggctg

SEQ ID NO: 206802 - DNA, 16 bp, P. troglodytes
agggagtcaaaggaga

SEQ ID NO: 206803 - DNA, 16 bp, P. troglodytes
agggagtcctttcccc

SEQ ID NO: 206804 - DNA, 16 bp, P. troglodytes
agggagtgcagccctg

SEQ ID NO: 206805 - DNA, 16 bp, P. troglodytes
agggagtgggagcagg

SEQ ID NO: 206806 - DNA, 16 bp, P. troglodytes
agggagtgtggccctg

SEQ ID NO: 206807 - DNA, 16 bp, P. troglodytes
agggagtttatcacca

SEQ ID NO: 206808 - DNA, 16 bp, P. troglodytes
agggataaaagaatac

SEQ ID NO: 206809 - DNA, 16 bp, P. troglodytes
agggatcagaagaaga

SEQ ID NO: 206810 - DNA, 16 bp, P. troglodytes
agggatccagtttcat

SEQ ID NO: 206811 - DNA, 16 bp, P. troglodytes
agggatccagttttag

SEQ ID NO: 206812 - DNA, 16 bp, P. troglodytes
agggatcctcctgccc

SEQ ID NO: 206813 - DNA, 16 bp, P. troglodytes
agggatgaacaagggc

SEQ ID NO: 206814 - DNA, 16 bp, P. troglodytes
agggatgaatcccact

SEQ ID NO: 206815 - DNA, 16 bp, P. troglodytes
agggatgagcaggaga

SEQ ID NO: 206816 - DNA, 16 bp, P. troglodytes
agggatgcctgggtcc

SEQ ID NO: 206817 - DNA, 16 bp, P. troglodytes
agggatgctgccaaac

SEQ ID NO: 206818 - DNA, 16 bp, P. troglodytes
agggatggcattagga

SEQ ID NO: 206819 - DNA, 16 bp, P. troglodytes
agggatggtttaacat

SEQ ID NO: 206820 - DNA, 17 bp, P. troglodytes
agggattcgatttcttc

SEQ ID NO: 206821 - DNA, 16 bp, P. troglodytes
agggattcttctgcct

SEQ ID NO: 206822 - DNA, 16 bp, P. troglodytes
agggattttcacagtg

SEQ ID NO: 206823 - DNA, 16 bp, P. troglodytes
agggattttgcagata

SEQ ID NO: 206824 - DNA, 16 bp, P. troglodytes
agggcaaaaactggaa

SEQ ID NO: 206825 - DNA, 21 bp, P. troglodytes
agggcaacatggtgaaacccc

SEQ ID NO: 206826 - DNA, 16 bp, P. troglodytes
agggcaatctggcaag

SEQ ID NO: 206827 - DNA, 16 bp, P. troglodytes
agggcaatgcagaggg

SEQ ID NO: 206828 - DNA, 16 bp, P. troglodytes
agggcacaggctctgg

SEQ ID NO: 206829 - DNA, 16 bp, P. troglodytes
agggcaccaagcaagg

SEQ ID NO: 206830 - DNA, 16 bp, P. troglodytes
agggcaccatgtccca

SEQ ID NO: 206831 - DNA, 16 bp, P. troglodytes
agggcagagaggtgtg

SEQ ID NO: 206832 - DNA, 16 bp, P. troglodytes
agggcagaggaaacaa

SEQ ID NO: 206833 - DNA, 16 bp, P. troglodytes
agggcagaggctgcag

SEQ ID NO: 206834 - DNA, 16 bp, P. troglodytes
agggcagcaggaaaga

SEQ ID NO: 206835 - DNA, 16 bp, P. troglodytes
agggcagccagagaaa

SEQ ID NO: 206836 - DNA, 16 bp, P. troglodytes
agggcagccagggaga

SEQ ID NO: 206837 - DNA, 16 bp, P. troglodytes
agggcagctcacaaca

SEQ ID NO: 206838 - DNA, 17 bp, P. troglodytes
agggcaggagatcgaga

SEQ ID NO: 206839 - DNA, 16 bp, P. troglodytes
agggcaggctggcagg

SEQ ID NO: 206840 - DNA, 16 bp, P. troglodytes
agggcagggaccatgt

SEQ ID NO: 206841 - DNA, 16 bp, P. troglodytes
agggcagggaccttgt

SEQ ID NO: 206842 - DNA, 16 bp, P. troglodytes
agggcagggatttttg

SEQ ID NO: 206843 - DNA, 16 bp, P. troglodytes
agggcagggctgggca

SEQ ID NO: 206844 - DNA, 16 bp, P. troglodytes
agggcagggctgggcc

SEQ ID NO: 206845 - DNA, 16 bp, P. troglodytes
agggcagggctgggga

SEQ ID NO: 206846 - DNA, 16 bp, P. troglodytes
agggcagggctgtgtc

SEQ ID NO: 206847 - DNA, 16 bp, P. troglodytes
agggcagggtggctca

SEQ ID NO: 206848 - DNA, 16 bp, P. troglodytes
agggcaggtgcaaaat

SEQ ID NO: 206849 - DNA, 16 bp, P. troglodytes
agggcagtgaagaagg

SEQ ID NO: 206850 - DNA, 16 bp, P. troglodytes
agggcagtggcaagat

SEQ ID NO: 206851 - DNA, 16 bp, P. troglodytes
agggcagtggcaccat

SEQ ID NO: 206852 - DNA, 16 bp, P. troglodytes
agggcagtggcatgat

SEQ ID NO: 206853 - DNA, 16 bp, P. troglodytes
agggcagtggggaagg

SEQ ID NO: 206854 - DNA, 16 bp, P. troglodytes
agggcagtggtgccat

SEQ ID NO: 206855 - DNA, 16 bp, P. troglodytes
agggcagtgtggaagg

SEQ ID NO: 206856 - DNA, 16 bp, P. troglodytes
agggcagttccccagc

SEQ ID NO: 206857 - DNA, 16 bp, P. troglodytes
agggcatctctgaaaa

SEQ ID NO: 206858 - DNA, 16 bp, P. troglodytes
agggcatctttgtctt

SEQ ID NO: 206859 - DNA, 16 bp, P. troglodytes
agggcatggtggccca

SEQ ID NO: 206860 - DNA, 16 bp, P. troglodytes
agggccaccagagggc

SEQ ID NO: 206861 - DNA, 21 bp, P. troglodytes
agggccaggcacagtggctca

SEQ ID NO: 206862 - DNA, 16 bp, P. troglodytes
agggccaggcacggtg

SEQ ID NO: 206863 - DNA, 16 bp, P. troglodytes
agggccaggcccaggg

SEQ ID NO: 206864 - DNA, 19 bp, P. troglodytes
agggccaggcgcggtggct

SEQ ID NO: 206865 - DNA, 16 bp, P. troglodytes
agggccagggccaggg

SEQ ID NO: 206866 - DNA, 16 bp, P. troglodytes
agggccaggtgcagtg

SEQ ID NO: 206867 - DNA, 16 bp, P. troglodytes
agggccaggtgcggtg

SEQ ID NO: 206868 - DNA, 16 bp, P. troglodytes
agggcccaagagctct

SEQ ID NO: 206869 - DNA, 16 bp, P. troglodytes
agggcccaggcaggag

SEQ ID NO: 206870 - DNA, 16 bp, P. troglodytes
agggccccaaagaggg

SEQ ID NO: 206871 - DNA, 16 bp, P. troglodytes
agggccccacccacca

SEQ ID NO: 206872 - DNA, 16 bp, P. troglodytes
agggccctctctggaa

SEQ ID NO: 206873 - DNA, 16 bp, P. troglodytes
agggccctctttctgg

SEQ ID NO: 206874 - DNA, 16 bp, P. troglodytes
agggcctcaaaggcca

SEQ ID NO: 206875 - DNA, 16 bp, P. troglodytes
agggcctcagaagcaa

SEQ ID NO: 206876 - DNA, 16 bp, P. troglodytes
agggcctcagggagct

SEQ ID NO: 206877 - DNA, 16 bp, P. troglodytes
agggcctgaggcagga

SEQ ID NO: 206878 - DNA, 16 bp, P. troglodytes
agggcctgctttctgg

SEQ ID NO: 206879 - DNA, 16 bp, P. troglodytes
agggcctggctgggag

SEQ ID NO: 206880 - DNA, 16 bp, P. troglodytes
agggcctgggggaagg

SEQ ID NO: 206881 - DNA, 16 bp, P. troglodytes
agggcctgtcgggggg

SEQ ID NO: 206882 - DNA, 16 bp, P. troglodytes
agggccttcttgctgc

SEQ ID NO: 206883 - DNA, 16 bp, P. troglodytes
agggcgagactctgtc

SEQ ID NO: 206884 - DNA, 16 bp, P. troglodytes
agggcgagatcacagg

SEQ ID NO: 206885 - DNA, 16 bp, P. troglodytes
agggcgcggtggctca

SEQ ID NO: 206886 - DNA, 16 bp, P. troglodytes
agggcgtggtggcgtg

SEQ ID NO: 206887 - DNA, 16 bp, P. troglodytes
agggctccactctcat

SEQ ID NO: 206888 - DNA, 16 bp, P. troglodytes
agggctccttggagaa

SEQ ID NO: 206889 - DNA, 16 bp, P. troglodytes
agggctctacccctgc

SEQ ID NO: 206890 - DNA, 16 bp, P. troglodytes
agggctctcaggcctt

SEQ ID NO: 206891 - DNA, 16 bp, P. troglodytes
agggctcttcctgctg

SEQ ID NO: 206892 - DNA, 16 bp, P. troglodytes
agggctgccagaggaa

SEQ ID NO: 206893 - DNA, 16 bp, P. troglodytes
agggctgcctggagga

SEQ ID NO: 206894 - DNA, 16 bp, P. troglodytes
agggctgctgggagga

SEQ ID NO: 206895 - DNA, 16 bp, P. troglodytes
agggctgctgtgagaa

SEQ ID NO: 206896 - DNA, 16 bp, P. troglodytes
agggctgctgtgagga

SEQ ID NO: 206897 - DNA, 16 bp, P. troglodytes
agggctggctccttct

SEQ ID NO: 206898 - DNA, 16 bp, P. troglodytes
agggctgggacccagg

SEQ ID NO: 206899 - DNA, 16 bp, P. troglodytes
agggctgggagctggg

SEQ ID NO: 206900 - DNA, 16 bp, P. troglodytes
agggctgggagggctg

SEQ ID NO: 206901 - DNA, 17 bp, P. troglodytes
agggctgggcacggtgg

SEQ ID NO: 206902 - DNA, 16 bp, P. troglodytes
agggctggggaaggga

SEQ ID NO: 206903 - DNA, 16 bp, P. troglodytes
agggctggggaggcct

SEQ ID NO: 206904 - DNA, 16 bp, P. troglodytes
agggctggggctggga

SEQ ID NO: 206905 - DNA, 16 bp, P. troglodytes
agggctgtgaggactg

SEQ ID NO: 206906 - DNA, 28 bp, P. troglodytes
agggctgtgcaggacgtgccttgttaac

SEQ ID NO: 206907 - DNA, 19 bp, P. troglodytes
agggctgtgcaggatgtgc

SEQ ID NO: 206908 - DNA, 16 bp, P. troglodytes
agggctgttgtgaaga

SEQ ID NO: 206909 - DNA, 16 bp, P. troglodytes
agggcttcacagagga

SEQ ID NO: 206910 - DNA, 16 bp, P. troglodytes
agggcttcccttggct

SEQ ID NO: 206911 - DNA, 16 bp, P. troglodytes
agggcttcctggagaa

SEQ ID NO: 206912 - DNA, 16 bp, P. troglodytes
agggcttgctctctgc

SEQ ID NO: 206913 - DNA, 16 bp, P. troglodytes
agggcttgtgaaaaca

SEQ ID NO: 206914 - DNA, 16 bp, P. troglodytes
agggcttgttaaaaca

SEQ ID NO: 206915 - DNA, 16 bp, P. troglodytes
agggctttaagaaagc

SEQ ID NO: 206916 - DNA, 16 bp, P. troglodytes
agggctttggagtcag

SEQ ID NO: 206917 - DNA, 16 bp, P. troglodytes
aggggaaattgtccat

SEQ ID NO: 206918 - DNA, 16 bp, P. troglodytes
aggggaagcaaagacc

SEQ ID NO: 206919 - DNA, 16 bp, P. troglodytes
aggggaagcaagcact

SEQ ID NO: 206920 - DNA, 16 bp, P. troglodytes
aggggacagaggaaca

SEQ ID NO: 206921 - DNA, 16 bp, P. troglodytes
aggggacagaggttgc

SEQ ID NO: 206922 - DNA, 16 bp, P. troglodytes
aggggagaaaactgag

SEQ ID NO: 206923 - DNA, 16 bp, P. troglodytes
aggggagcatcacaca

SEQ ID NO: 206924 - DNA, 16 bp, P. troglodytes
aggggagctgtgagaa

SEQ ID NO: 206925 - DNA, 16 bp, P. troglodytes
aggggaggcctggtgg

SEQ ID NO: 206926 - DNA, 16 bp, P. troglodytes
aggggaggctgaggtg

SEQ ID NO: 206927 - DNA, 18 bp, P. troglodytes
aggggaggttgcagtgag

SEQ ID NO: 206928 - DNA, 16 bp, P. troglodytes
aggggatacaggcccc

SEQ ID NO: 206929 - DNA, 16 bp, P. troglodytes
aggggatatttggcaa

SEQ ID NO: 206930 - DNA, 16 bp, P. troglodytes
aggggatggacacccc

SEQ ID NO: 206931 - DNA, 17 bp, P. troglodytes
aggggatggacacccca

SEQ ID NO: 206932 - DNA, 16 bp, P. troglodytes
aggggattctgatgca

SEQ ID NO: 206933 - DNA, 16 bp, P. troglodytes
aggggattgcttgagc

SEQ ID NO: 206934 - DNA, 17 bp, P. troglodytes
aggggcaacccacccct

SEQ ID NO: 206935 - DNA, 16 bp, P. troglodytes
aggggcaagggagctc

SEQ ID NO: 206936 - DNA, 16 bp, P. troglodytes
aggggcagagccagga

SEQ ID NO: 206937 - DNA, 16 bp, P. troglodytes
aggggcagagctggga

SEQ ID NO: 206938 - DNA, 17 bp, P. troglodytes
aggggcatggacgaggg

SEQ ID NO: 206939 - DNA, 16 bp, P. troglodytes
aggggcatggagcttc

SEQ ID NO: 206940 - DNA, 16 bp, P. troglodytes
aggggccaggcccagg

SEQ ID NO: 206941 - DNA, 16 bp, P. troglodytes
aggggccagggctggg

SEQ ID NO: 206942 - DNA, 16 bp, P. troglodytes
aggggccagggtggaa

SEQ ID NO: 206943 - DNA, 16 bp, P. troglodytes
aggggccaggtggaga

SEQ ID NO: 206944 - DNA, 16 bp, P. troglodytes
aggggcctgcatctgg

SEQ ID NO: 206945 - DNA, 16 bp, P. troglodytes
aggggcggccaggcag

SEQ ID NO: 206946 - DNA, 29 bp, P. troglodytes
aggggctcagaaagctgtgaaactcactc

SEQ ID NO: 206947 - DNA, 19 bp, P. troglodytes
aggggctcccacagtgcag

SEQ ID NO: 206948 - DNA, 16 bp, P. troglodytes
aggggctgagggaagg

SEQ ID NO: 206949 - DNA, 16 bp, P. troglodytes
aggggctggggcctgg

SEQ ID NO: 206950 - DNA, 16 bp, P. troglodytes
aggggctggggtggaa

SEQ ID NO: 206951 - DNA, 16 bp, P. troglodytes
aggggcttctgggaaa

SEQ ID NO: 206952 - DNA, 16 bp, P. troglodytes
agggggaaaaaatcac

SEQ ID NO: 206953 - DNA, 16 bp, P. troglodytes
agggggaatcctccct

SEQ ID NO: 206954 - DNA, 16 bp, P. troglodytes
agggggacaagggaac

SEQ ID NO: 206955 - DNA, 16 bp, P. troglodytes
agggggcagaggttgc

SEQ ID NO: 206956 - DNA, 16 bp, P. troglodytes
agggggcagggaagtg

SEQ ID NO: 206957 - DNA, 16 bp, P. troglodytes
agggggcatcatggaa

SEQ ID NO: 206958 - DNA, 16 bp, P. troglodytes
agggggccacaagcca

SEQ ID NO: 206959 - DNA, 16 bp, P. troglodytes
agggggcctgcccctc

SEQ ID NO: 206960 - DNA, 16 bp, P. troglodytes
agggggcggcgctcat

SEQ ID NO: 206961 - DNA, 16 bp, P. troglodytes
agggggctgtaccctg

SEQ ID NO: 206962 - DNA, 16 bp, P. troglodytes
agggggcttagaattt

SEQ ID NO: 206963 - DNA, 16 bp, P. troglodytes
agggggtacatatgca

SEQ ID NO: 206964 - DNA, 16 bp, P. troglodytes
agggggtctcactttg

SEQ ID NO: 206965 - DNA, 16 bp, P. troglodytes
agggggtggggagcaa

SEQ ID NO: 206966 - DNA, 16 bp, P. troglodytes
aggggtcagcaaacta

SEQ ID NO: 206967 - DNA, 16 bp, P. troglodytes
aggggtcagggaactc

SEQ ID NO: 206968 - DNA, 16 bp, P. troglodytes
aggggtcctaggacag

SEQ ID NO: 206969 - DNA, 16 bp, P. troglodytes
aggggtctgaggcagg

SEQ ID NO: 206970 - DNA, 16 bp, P. troglodytes
aggggtgattttgccc

SEQ ID NO: 206971 - DNA, 16 bp, P. troglodytes
aggggtgctgaatttt

SEQ ID NO: 206972 - DNA, 16 bp, P. troglodytes
aggggtggagctgcct

SEQ ID NO: 206973 - DNA, 16 bp, P. troglodytes
aggggtggctgtgggt

SEQ ID NO: 206974 - DNA, 17 bp, P. troglodytes
aggggtgggttgcccct

SEQ ID NO: 206975 - DNA, 18 bp, P. troglodytes
aggggttgcaatcctact

SEQ ID NO: 206976 - DNA, 16 bp, P. troglodytes
aggggttggggaccct

SEQ ID NO: 206977 - DNA, 16 bp, P. troglodytes
aggggttggtcttgct

SEQ ID NO: 206978 - DNA, 17 bp, P. troglodytes
aggggtttcaccgtgtt

SEQ ID NO: 206979 - DNA, 16 bp, P. troglodytes
agggtaggtatatgta

SEQ ID NO: 206980 - DNA, 16 bp, P. troglodytes
agggtattaattattg

SEQ ID NO: 206981 - DNA, 16 bp, P. troglodytes
agggtcaaaataaagg

SEQ ID NO: 206982 - DNA, 16 bp, P. troglodytes
agggtcaactgtacta

SEQ ID NO: 206983 - DNA, 16 bp, P. troglodytes
agggtcacctgagcct

SEQ ID NO: 206984 - DNA, 16 bp, P. troglodytes
agggtccctctctgtc

SEQ ID NO: 206985 - DNA, 16 bp, P. troglodytes
agggtcctccagagaa

SEQ ID NO: 206986 - DNA, 16 bp, P. troglodytes
agggtcctcttcctgg

SEQ ID NO: 206987 - DNA, 16 bp, P. troglodytes
agggtctccctttgtt

SEQ ID NO: 206988 - DNA, 16 bp, P. troglodytes
agggtctcgccatgtt

SEQ ID NO: 206989 - DNA, 16 bp, P. troglodytes
agggtctctctctgtc

SEQ ID NO: 206990 - DNA, 16 bp, P. troglodytes
agggtctctctctgtt

SEQ ID NO: 206991 - DNA, 16 bp, P. troglodytes
agggtctgtgctgagg

SEQ ID NO: 206992 - DNA, 16 bp, P. troglodytes
agggtcttgctttgtg

SEQ ID NO: 206993 - DNA, 16 bp, P. troglodytes
agggtctttgcacttg

SEQ ID NO: 206994 - DNA, 16 bp, P. troglodytes
agggtctttgcagatt

SEQ ID NO: 206995 - DNA, 16 bp, P. troglodytes
agggtgaaactagaat

SEQ ID NO: 206996 - DNA, 16 bp, P. troglodytes
agggtgaatttggagc

SEQ ID NO: 206997 - DNA, 16 bp, P. troglodytes
agggtgactacagtca

SEQ ID NO: 206998 - DNA, 16 bp, P. troglodytes
agggtgagacaggaga

SEQ ID NO: 206999 - DNA, 16 bp, P. troglodytes
agggtgcagcctccct

SEQ ID NO: 207000 - DNA, 16 bp, P. troglodytes
agggtgctgattgatg

SEQ ID NO: 207001 - DNA, 16 bp, P. troglodytes
agggtggatcacctga

SEQ ID NO: 207002 - DNA, 16 bp, P. troglodytes
agggtggattacctga

SEQ ID NO: 207003 - DNA, 16 bp, P. troglodytes
agggtggccagctttt

SEQ ID NO: 207004 - DNA, 16 bp, P. troglodytes
agggtggtggcacatg

SEQ ID NO: 207005 - DNA, 16 bp, P. troglodytes
agggtggtggctcaca

SEQ ID NO: 207006 - DNA, 16 bp, P. troglodytes
agggtggtgtgcccag

SEQ ID NO: 207007 - DNA, 16 bp, P. troglodytes
agggtgtcagcagggc

SEQ ID NO: 207008 - DNA, 16 bp, P. troglodytes
agggtgttgattggtg

SEQ ID NO: 207009 - DNA, 16 bp, P. troglodytes
agggtgttttccaact

SEQ ID NO: 207010 - DNA, 16 bp, P. troglodytes
agggttaagtcacaca

SEQ ID NO: 207011 - DNA, 16 bp, P. troglodytes
agggttagggttagga

SEQ ID NO: 207012 - DNA, 16 bp, P. troglodytes
agggttctcttataaa

SEQ ID NO: 207013 - DNA, 16 bp, P. troglodytes
agggttctgagcagag

SEQ ID NO: 207014 - DNA, 16 bp, P. troglodytes
agggttcttgtgagga

SEQ ID NO: 207015 - DNA, 16 bp, P. troglodytes
agggttggtcttgctg

SEQ ID NO: 207016 - DNA, 16 bp, P. troglodytes
agggtttatttctgaa

SEQ ID NO: 207017 - DNA, 16 bp, P. troglodytes
agggtttcaatttctc

SEQ ID NO: 207018 - DNA, 20 bp, P. troglodytes
agggtttcaccatgttggct

SEQ ID NO: 207019 - DNA, 24 bp, P. troglodytes
agggtttcaccatgttggtcagga

SEQ ID NO: 207020 - DNA, 16 bp, P. troglodytes
agggtttctccatgct

SEQ ID NO: 207021 - DNA, 16 bp, P. troglodytes
agggtttcttttggag

SEQ ID NO: 207022 - DNA, 16 bp, P. troglodytes
agggttttgccgtgtt

SEQ ID NO: 207023 - DNA, 16 bp, P. troglodytes
agggttttgctatatt

SEQ ID NO: 207024 - DNA, 16 bp, P. troglodytes
agggtttttgctgaga

SEQ ID NO: 207025 - DNA, 16 bp, P. troglodytes
aggtaaagaaactgag

SEQ ID NO: 207026 - DNA, 16 bp, P. troglodytes
aggtaaagaaagacaa

SEQ ID NO: 207027 - DNA, 16 bp, P. troglodytes
aggtaaatatattttt

SEQ ID NO: 207028 - DNA, 16 bp, P. troglodytes
aggtaaccactgttct

SEQ ID NO: 207029 - DNA, 16 bp, P. troglodytes
aggtaatctagagatg

SEQ ID NO: 207030 - DNA, 16 bp, P. troglodytes
aggtaatgtgattcct

SEQ ID NO: 207031 - DNA, 16 bp, P. troglodytes
aggtaatttttaaaga

SEQ ID NO: 207032 - DNA, 16 bp, P. troglodytes
aggtaatttttcatcc

SEQ ID NO: 207033 - DNA, 16 bp, P. troglodytes
aggtaattttttaaaa

SEQ ID NO: 207034 - DNA, 16 bp, P. troglodytes
aggtacagagatttct

SEQ ID NO: 207035 - DNA, 16 bp, P. troglodytes
aggtacagcttgggcc

SEQ ID NO: 207036 - DNA, 16 bp, P. troglodytes
aggtaccattattatt

SEQ ID NO: 207037 - DNA, 16 bp, P. troglodytes
aggtacctagagtagt

SEQ ID NO: 207038 - DNA, 22 bp, P. troglodytes
aggtactatgcctggatgtgca

SEQ ID NO: 207039 - DNA, 16 bp, P. troglodytes
aggtactcagtaaatg

SEQ ID NO: 207040 - DNA, 16 bp, P. troglodytes
aggtacttggaaggct

SEQ ID NO: 207041 - DNA, 16 bp, P. troglodytes
aggtagaaaagacaaa

SEQ ID NO: 207042 - DNA, 16 bp, P. troglodytes
aggtagatagacagat

SEQ ID NO: 207043 - DNA, 16 bp, P. troglodytes
aggtagatcacttgaa

SEQ ID NO: 207044 - DNA, 16 bp, P. troglodytes
aggtagcagtgagccg

SEQ ID NO: 207045 - DNA, 21 bp, P. troglodytes
aggtagctgggattacaggcg

SEQ ID NO: 207046 - DNA, 16 bp, P. troglodytes
aggtaggaaaatcttg

SEQ ID NO: 207047 - DNA, 17 bp, P. troglodytes
aggtaggagaatcattt

SEQ ID NO: 207048 - DNA, 16 bp, P. troglodytes
aggtaggcagatcact

SEQ ID NO: 207049 - DNA, 16 bp, P. troglodytes
aggtagggcctttagg

SEQ ID NO: 207050 - DNA, 16 bp, P. troglodytes
aggtagtgtttgccag

SEQ ID NO: 207051 - DNA, 16 bp, P. troglodytes
aggtagtttttcaatt

SEQ ID NO: 207052 - DNA, 16 bp, P. troglodytes
aggtataacttacata

SEQ ID NO: 207053 - DNA, 16 bp, P. troglodytes
aggtatacacgtgcca

SEQ ID NO: 207054 - DNA, 16 bp, P. troglodytes
aggtatcaaaatatca

SEQ ID NO: 207055 - DNA, 16 bp, P. troglodytes
aggtatcattctttca

SEQ ID NO: 207056 - DNA, 16 bp, P. troglodytes
aggtatgcaccaccat

SEQ ID NO: 207057 - DNA, 16 bp, P. troglodytes
aggtatggtgactcat

SEQ ID NO: 207058 - DNA, 16 bp, P. troglodytes
aggtatgtttagatac

SEQ ID NO: 207059 - DNA, 16 bp, P. troglodytes
aggtattatttccatt

SEQ ID NO: 207060 - DNA, 16 bp, P. troglodytes
aggtattgaagaaaca

SEQ ID NO: 207061 - DNA, 16 bp, P. troglodytes
aggtattgatgggata

SEQ ID NO: 207062 - DNA, 16 bp, P. troglodytes
aggtatttctcaaaag

SEQ ID NO: 207063 - DNA, 16 bp, P. troglodytes
aggtatttcttcacag

SEQ ID NO: 207064 - DNA, 16 bp, P. troglodytes
aggtattttgcaaaaa

SEQ ID NO: 207065 - DNA, 16 bp, P. troglodytes
aggtattttgtaaaat

SEQ ID NO: 207066 - DNA, 16 bp, P. troglodytes
aggtcaaagaaaaaat

SEQ ID NO: 207067 - DNA, 16 bp, P. troglodytes
aggtcaaagaagaaat

SEQ ID NO: 207068 - DNA, 16 bp, P. troglodytes
aggtcaaagacaaaga

SEQ ID NO: 207069 - DNA, 16 bp, P. troglodytes
aggtcaagaccaacct

SEQ ID NO: 207070 - DNA, 16 bp, P. troglodytes
aggtcaaggatgcagt

SEQ ID NO: 207071 - DNA, 16 bp, P. troglodytes
aggtcaaggtgggtgg

SEQ ID NO: 207072 - DNA, 16 bp, P. troglodytes
aggtcacacagcaagt

SEQ ID NO: 207073 - DNA, 16 bp, P. troglodytes
aggtcacacagcctgt

SEQ ID NO: 207074 - DNA, 16 bp, P. troglodytes
aggtcacaggcaggtt

SEQ ID NO: 207075 - DNA, 16 bp, P. troglodytes
aggtcaccatcatcaa

SEQ ID NO: 207076 - DNA, 16 bp, P. troglodytes
aggtcagaatttcaag

SEQ ID NO: 207077 - DNA, 16 bp, P. troglodytes
aggtcagagcagaaat

SEQ ID NO: 207078 - DNA, 23 bp, P. troglodytes
aggtcagagttcaagaccagcct

SEQ ID NO: 207079 - DNA, 16 bp, P. troglodytes
aggtcaggagaccatc

SEQ ID NO: 207080 - DNA, 17 bp, P. troglodytes
aggtcaggagttcgaga

SEQ ID NO: 207081 - DNA, 17 bp, P. troglodytes
aggtcaggagtttgaga

SEQ ID NO: 207082 - DNA, 16 bp, P. troglodytes
aggtcaggctgcagtg

SEQ ID NO: 207083 - DNA, 17 bp, P. troglodytes
aggtcaggggtttgaga

SEQ ID NO: 207084 - DNA, 16 bp, P. troglodytes
aggtcagtattaccct

SEQ ID NO: 207085 - DNA, 16 bp, P. troglodytes
aggtcataaagattta

SEQ ID NO: 207086 - DNA, 16 bp, P. troglodytes
aggtcatcaaaaacaa

SEQ ID NO: 207087 - DNA, 16 bp, P. troglodytes
aggtcatcaagagaga

SEQ ID NO: 207088 - DNA, 16 bp, P. troglodytes
aggtcatcaaggcaga

SEQ ID NO: 207089 - DNA, 16 bp, P. troglodytes
aggtcatctgcaagct

SEQ ID NO: 207090 - DNA, 16 bp, P. troglodytes
aggtcatgaaggtgga

SEQ ID NO: 207091 - DNA, 16 bp, P. troglodytes
aggtcatgagagtgga

SEQ ID NO: 207092 - DNA, 16 bp, P. troglodytes
aggtcatgtgaagaca

SEQ ID NO: 207093 - DNA, 16 bp, P. troglodytes
aggtcattgccatgga

SEQ ID NO: 207094 - DNA, 16 bp, P. troglodytes
aggtcattgtgcacag

SEQ ID NO: 207095 - DNA, 16 bp, P. troglodytes
aggtcatttctttgct

SEQ ID NO: 207096 - DNA, 16 bp, P. troglodytes
aggtccaagcgattct

SEQ ID NO: 207097 - DNA, 16 bp, P. troglodytes
aggtccaagctgcagt

SEQ ID NO: 207098 - DNA, 17 bp, P. troglodytes
aggtcccaacaggagtc

SEQ ID NO: 207099 - DNA, 16 bp, P. troglodytes
aggtcccacaataggc

SEQ ID NO: 207100 - DNA, 17 bp, P. troglodytes
aggtccggagttcgaga

SEQ ID NO: 207101 - DNA, 16 bp, P. troglodytes
aggtcctcagtaaata

SEQ ID NO: 207102 - DNA, 16 bp, P. troglodytes
aggtcctccaggcctg

SEQ ID NO: 207103 - DNA, 16 bp, P. troglodytes
aggtcctgctgcttgc

SEQ ID NO: 207104 - DNA, 16 bp, P. troglodytes
aggtcctgtctctaca

SEQ ID NO: 207105 - DNA, 16 bp, P. troglodytes
aggtctcacacttcct

SEQ ID NO: 207106 - DNA, 16 bp, P. troglodytes
aggtctcactatgttg

SEQ ID NO: 207107 - DNA, 16 bp, P. troglodytes
aggtctcactctgtca

SEQ ID NO: 207108 - DNA, 16 bp, P. troglodytes
aggtctcactctgttg

SEQ ID NO: 207109 - DNA, 16 bp, P. troglodytes
aggtctctaggaagtt

SEQ ID NO: 207110 - DNA, 16 bp, P. troglodytes
aggtctctggttttcc

SEQ ID NO: 207111 - DNA, 16 bp, P. troglodytes
aggtctgcagcttcag

SEQ ID NO: 207112 - DNA, 16 bp, P. troglodytes
aggtctgtgggcacag

SEQ ID NO: 207113 - DNA, 16 bp, P. troglodytes
aggtcttactctgtca

SEQ ID NO: 207114 - DNA, 16 bp, P. troglodytes
aggtcttagattcaag

SEQ ID NO: 207115 - DNA, 16 bp, P. troglodytes
aggtcttatttaattt

SEQ ID NO: 207116 - DNA, 16 bp, P. troglodytes
aggtcttcaaggcagc

SEQ ID NO: 207117 - DNA, 16 bp, P. troglodytes
aggtcttctgactcct

SEQ ID NO: 207118 - DNA, 16 bp, P. troglodytes
aggtcttgctatgttg

SEQ ID NO: 207119 - DNA, 16 bp, P. troglodytes
aggtcttgctctgctg

SEQ ID NO: 207120 - DNA, 16 bp, P. troglodytes
aggtcttgctctgtca

SEQ ID NO: 207121 - DNA, 16 bp, P. troglodytes
aggtctttatttcttc

SEQ ID NO: 207122 - DNA, 16 bp, P. troglodytes
aggtctttcctgcact

SEQ ID NO: 207123 - DNA, 16 bp, P. troglodytes
aggtctttttaaattt

SEQ ID NO: 207124 - DNA, 16 bp, P. troglodytes
aggtgaaacagcaagt

SEQ ID NO: 207125 - DNA, 16 bp, P. troglodytes
aggtgaaaggaaagca

SEQ ID NO: 207126 - DNA, 16 bp, P. troglodytes
aggtgaacaccaccac

SEQ ID NO: 207127 - DNA, 16 bp, P. troglodytes
aggtgaacccactggg

SEQ ID NO: 207128 - DNA, 16 bp, P. troglodytes
aggtgaagaggaagca

SEQ ID NO: 207129 - DNA, 16 bp, P. troglodytes
aggtgaagcctttggg

SEQ ID NO: 207130 - DNA, 16 bp, P. troglodytes
aggtgaaggagaagca

SEQ ID NO: 207131 - DNA, 16 bp, P. troglodytes
aggtgacacaaacaaa

SEQ ID NO: 207132 - DNA, 16 bp, P. troglodytes
aggtgaccatctgcaa

SEQ ID NO: 207133 - DNA, 16 bp, P. troglodytes
aggtgacctgtccttt

SEQ ID NO: 207134 - DNA, 16 bp, P. troglodytes
aggtgactgaggcagg

SEQ ID NO: 207135 - DNA, 16 bp, P. troglodytes
aggtgagaaaatagag

SEQ ID NO: 207136 - DNA, 16 bp, P. troglodytes
aggtgagaactgaaca

SEQ ID NO: 207137 - DNA, 16 bp, P. troglodytes
aggtgagaagttcaag

SEQ ID NO: 207138 - DNA, 16 bp, P. troglodytes
aggtgaggaaactgaa

SEQ ID NO: 207139 - DNA, 16 bp, P. troglodytes
aggtgaggaaactgag

SEQ ID NO: 207140 - DNA, 16 bp, P. troglodytes
aggtgaggaagctgaa

SEQ ID NO: 207141 - DNA, 16 bp, P. troglodytes
aggtgaggtgacttgc

SEQ ID NO: 207142 - DNA, 16 bp, P. troglodytes
aggtgatcaaggttaa

SEQ ID NO: 207143 - DNA, 16 bp, P. troglodytes
aggtgatccccccgcc

SEQ ID NO: 207144 - DNA, 16 bp, P. troglodytes
aggtgatccgcctgac

SEQ ID NO: 207145 - DNA, 16 bp, P. troglodytes
aggtgatgctgatgcc

SEQ ID NO: 207146 - DNA, 16 bp, P. troglodytes
aggtgatgtgcccacc

SEQ ID NO: 207147 - DNA, 17 bp, P. troglodytes
aggtgattaaaagcttt

SEQ ID NO: 207148 - DNA, 16 bp, P. troglodytes
aggtgattaaaggaaa

SEQ ID NO: 207149 - DNA, 16 bp, P. troglodytes
aggtgattctgatgct

SEQ ID NO: 207150 - DNA, 16 bp, P. troglodytes
aggtgattctgattca

SEQ ID NO: 207151 - DNA, 16 bp, P. troglodytes
aggtgcacagtgcaag

SEQ ID NO: 207152 - DNA, 17 bp, P. troglodytes
aggtgcacgccaccaca

SEQ ID NO: 207153 - DNA, 16 bp, P. troglodytes
aggtgcagaggctcac

SEQ ID NO: 207154 - DNA, 16 bp, P. troglodytes
aggtgcagcaaaccac

SEQ ID NO: 207155 - DNA, 16 bp, P. troglodytes
aggtgcagcaggatcc

SEQ ID NO: 207156 - DNA, 16 bp, P. troglodytes
aggtgcagccaaccac

SEQ ID NO: 207157 - DNA, 16 bp, P. troglodytes
aggtgcagcggctcac

SEQ ID NO: 207158 - DNA, 16 bp, P. troglodytes
aggtgcagttgctcat

SEQ ID NO: 207159 - DNA, 16 bp, P. troglodytes
aggtgcatgccaccat

SEQ ID NO: 207160 - DNA, 16 bp, P. troglodytes
aggtgcatgccatcac

SEQ ID NO: 207161 - DNA, 16 bp, P. troglodytes
aggtgccaggctcttt

SEQ ID NO: 207162 - DNA, 16 bp, P. troglodytes
aggtgccccctgaccc

SEQ ID NO: 207163 - DNA, 16 bp, P. troglodytes
aggtgcccgcccccac

SEQ ID NO: 207164 - DNA, 16 bp, P. troglodytes
aggtgccctctgtgcc

SEQ ID NO: 207165 - DNA, 16 bp, P. troglodytes
aggtgcctgccacctc

SEQ ID NO: 207166 - DNA, 16 bp, P. troglodytes
aggtgcctgcccccac

SEQ ID NO: 207167 - DNA, 16 bp, P. troglodytes
aggtgcgcaccaccac

SEQ ID NO: 207168 - DNA, 16 bp, P. troglodytes
aggtgctaaaggaaat

SEQ ID NO: 207169 - DNA, 16 bp, P. troglodytes
aggtgctcaataaaca

SEQ ID NO: 207170 - DNA, 16 bp, P. troglodytes
aggtgctcaataaata

SEQ ID NO: 207171 - DNA, 16 bp, P. troglodytes
aggtgctcaccatcac

SEQ ID NO: 207172 - DNA, 16 bp, P. troglodytes
aggtgctggagaggac

SEQ ID NO: 207173 - DNA, 16 bp, P. troglodytes
aggtgctggagagggt

SEQ ID NO: 207174 - DNA, 16 bp, P. troglodytes
aggtgctggccaccat

SEQ ID NO: 207175 - DNA, 16 bp, P. troglodytes
aggtgctgggaataca

SEQ ID NO: 207176 - DNA, 16 bp, P. troglodytes
aggtgctgggagagga

SEQ ID NO: 207177 - DNA, 16 bp, P. troglodytes
aggtgctggggataca

SEQ ID NO: 207178 - DNA, 16 bp, P. troglodytes
aggtgctgtgattaca

SEQ ID NO: 207179 - DNA, 16 bp, P. troglodytes
aggtgcttaataaata

SEQ ID NO: 207180 - DNA, 16 bp, P. troglodytes
aggtggaaacaaccca

SEQ ID NO: 207181 - DNA, 16 bp, P. troglodytes
aggtggaaatgaagga

SEQ ID NO: 207182 - DNA, 18 bp, P. troglodytes
aggtggaacgagagactt

SEQ ID NO: 207183 - DNA, 16 bp, P. troglodytes
aggtggaagatagtga

SEQ ID NO: 207184 - DNA, 16 bp, P. troglodytes
aggtggaagccattat

SEQ ID NO: 207185 - DNA, 16 bp, P. troglodytes
aggtggaaggatcacc

SEQ ID NO: 207186 - DNA, 18 bp, P. troglodytes
aggtggacagatcacctg

SEQ ID NO: 207187 - DNA, 16 bp, P. troglodytes
aggtggagattcccaa

SEQ ID NO: 207188 - DNA, 16 bp, P. troglodytes
aggtggaggccaggga

SEQ ID NO: 207189 - DNA, 16 bp, P. troglodytes
aggtggaggctgtggt

SEQ ID NO: 207190 - DNA, 16 bp, P. troglodytes
aggtggagtgcagtgg

SEQ ID NO: 207191 - DNA, 20 bp, P. troglodytes
aggtggatcacctgaggtct

SEQ ID NO: 207192 - DNA, 16 bp, P. troglodytes
aggtggatcacttcag

SEQ ID NO: 207193 - DNA, 16 bp, P. troglodytes
aggtggatcacttgaa

SEQ ID NO: 207194 - DNA, 16 bp, P. troglodytes
aggtggatcatctgag

SEQ ID NO: 207195 - DNA, 16 bp, P. troglodytes
aggtggatcctttgag

SEQ ID NO: 207196 - DNA, 16 bp, P. troglodytes
aggtggattgcttgag

SEQ ID NO: 207197 - DNA, 16 bp, P. troglodytes
aggtggcaaagccagc

SEQ ID NO: 207198 - DNA, 16 bp, P. troglodytes
aggtggcagaggcaga

SEQ ID NO: 207199 - DNA, 16 bp, P. troglodytes
aggtggcagtgagctg

SEQ ID NO: 207200 - DNA, 16 bp, P. troglodytes
aggtggcccatgcctg

SEQ ID NO: 207201 - DNA, 16 bp, P. troglodytes
aggtggccgggtgcag

SEQ ID NO: 207202 - DNA, 16 bp, P. troglodytes
aggtggctcacacctg

SEQ ID NO: 207203 - DNA, 16 bp, P. troglodytes
aggtggctcacgcctg

SEQ ID NO: 207204 - DNA, 16 bp, P. troglodytes
aggtggctcatgcctg

SEQ ID NO: 207205 - DNA, 16 bp, P. troglodytes
aggtggctgaggcaga

SEQ ID NO: 207206 - DNA, 16 bp, P. troglodytes
aggtggctgaggcctg

SEQ ID NO: 207207 - DNA, 16 bp, P. troglodytes
aggtgggaactggagt

SEQ ID NO: 207208 - DNA, 16 bp, P. troglodytes
aggtgggaagatgact

SEQ ID NO: 207209 - DNA, 16 bp, P. troglodytes
aggtgggaagattgtt

SEQ ID NO: 207210 - DNA, 16 bp, P. troglodytes
aggtgggagaattgtt

SEQ ID NO: 207211 - DNA, 16 bp, P. troglodytes
aggtgggagccaccac

SEQ ID NO: 207212 - DNA, 16 bp, P. troglodytes
aggtgggcagattcct

SEQ ID NO: 207213 - DNA, 16 bp, P. troglodytes
aggtgggcagattgct

SEQ ID NO: 207214 - DNA, 16 bp, P. troglodytes
aggtgggcatggtggc

SEQ ID NO: 207215 - DNA, 17 bp, P. troglodytes
aggtgggcggatcacca

SEQ ID NO: 207216 - DNA, 21 bp, P. troglodytes
aggtgggcggatcacctgaga

SEQ ID NO: 207217 - DNA, 23 bp, P. troglodytes
aggtgggcggatcacgaggtcaa

SEQ ID NO: 207218 - DNA, 17 bp, P. troglodytes
aggtgggcggatcacta

SEQ ID NO: 207219 - DNA, 16 bp, P. troglodytes
aggtgggcggatcatc

SEQ ID NO: 207220 - DNA, 16 bp, P. troglodytes
aggtggggcagggcat

SEQ ID NO: 207221 - DNA, 16 bp, P. troglodytes
aggtggggcccttggg

SEQ ID NO: 207222 - DNA, 16 bp, P. troglodytes
aggtggggcctctggg

SEQ ID NO: 207223 - DNA, 16 bp, P. troglodytes
aggtggggcctgttgg

SEQ ID NO: 207224 - DNA, 16 bp, P. troglodytes
aggtgggtaataaact

SEQ ID NO: 207225 - DNA, 16 bp, P. troglodytes
aggtgggtagtttgca

SEQ ID NO: 207226 - DNA, 16 bp, P. troglodytes
aggtgggtggatccca

SEQ ID NO: 207227 - DNA, 16 bp, P. troglodytes
aggtggtagagctggg

SEQ ID NO: 207228 - DNA, 16 bp, P. troglodytes
aggtggtcctcccacc

SEQ ID NO: 207229 - DNA, 16 bp, P. troglodytes
aggtggtggagcagag

SEQ ID NO: 207230 - DNA, 16 bp, P. troglodytes
aggtggtgggcgcctg

SEQ ID NO: 207231 - DNA, 16 bp, P. troglodytes
aggtggtgtttgttta

SEQ ID NO: 207232 - DNA, 16 bp, P. troglodytes
aggtgtgagccaacat

SEQ ID NO: 207233 - DNA, 17 bp, P. troglodytes
aggtgtgagccaccacg

SEQ ID NO: 207234 - DNA, 16 bp, P. troglodytes
aggtgtgagccaccat

SEQ ID NO: 207235 - DNA, 16 bp, P. troglodytes
aggtgtgagccatggc

SEQ ID NO: 207236 - DNA, 16 bp, P. troglodytes
aggtgtgagctactgt

SEQ ID NO: 207237 - DNA, 16 bp, P. troglodytes
aggtgtgcaacaccat

SEQ ID NO: 207238 - DNA, 16 bp, P. troglodytes
aggtgtggaggggcag

SEQ ID NO: 207239 - DNA, 16 bp, P. troglodytes
aggtgtggccaggctg

SEQ ID NO: 207240 - DNA, 16 bp, P. troglodytes
aggtgtgggatatagt

SEQ ID NO: 207241 - DNA, 16 bp, P. troglodytes
aggtgtggtgacatgt

SEQ ID NO: 207242 - DNA, 16 bp, P. troglodytes
aggtgtggtgctgcac

SEQ ID NO: 207243 - DNA, 18 bp, P. troglodytes
aggtgtggtggcacacac

SEQ ID NO: 207244 - DNA, 20 bp, P. troglodytes
aggtgtggtggcaggtgcct

SEQ ID NO: 207245 - DNA, 16 bp, P. troglodytes
aggtgtggtggctcat

SEQ ID NO: 207246 - DNA, 16 bp, P. troglodytes
aggtgtgtgtatgtgt

SEQ ID NO: 207247 - DNA, 16 bp, P. troglodytes
aggtgttcaaggctgc

SEQ ID NO: 207248 - DNA, 16 bp, P. troglodytes
aggtgttggcagggct

SEQ ID NO: 207249 - DNA, 16 bp, P. troglodytes
aggtgtttatattatt

SEQ ID NO: 207250 - DNA, 16 bp, P. troglodytes
aggtgtttgagaccaa

SEQ ID NO: 207251 - DNA, 16 bp, P. troglodytes
aggttaaatgagatca

SEQ ID NO: 207252 - DNA, 16 bp, P. troglodytes
aggttaagaaatttgc

SEQ ID NO: 207253 - DNA, 16 bp, P. troglodytes
aggttaaggagatttt

SEQ ID NO: 207254 - DNA, 16 bp, P. troglodytes
aggttaagtgaaataa

SEQ ID NO: 207255 - DNA, 16 bp, P. troglodytes
aggttaagtgaggtca

SEQ ID NO: 207256 - DNA, 16 bp, P. troglodytes
aggttaatacacaaaa

SEQ ID NO: 207257 - DNA, 16 bp, P. troglodytes
aggttacagagaaaag

SEQ ID NO: 207258 - DNA, 16 bp, P. troglodytes
aggttacttccaaatc

SEQ ID NO: 207259 - DNA, 16 bp, P. troglodytes
aggttagggtttcaac

SEQ ID NO: 207260 - DNA, 16 bp, P. troglodytes
aggttatagtgagcca

SEQ ID NO: 207261 - DNA, 18 bp, P. troglodytes
aggttatagtgagccgag

SEQ ID NO: 207262 - DNA, 16 bp, P. troglodytes
aggttatatgcaaata

SEQ ID NO: 207263 - DNA, 16 bp, P. troglodytes
aggttatcaaatttgt

SEQ ID NO: 207264 - DNA, 16 bp, P. troglodytes
aggttatgccactgca

SEQ ID NO: 207265 - DNA, 16 bp, P. troglodytes
aggttcaagcaattcc

SEQ ID NO: 207266 - DNA, 16 bp, P. troglodytes
aggttcaagcaattct

SEQ ID NO: 207267 - DNA, 16 bp, P. troglodytes
aggttcaagcagtcct

SEQ ID NO: 207268 - DNA, 16 bp, P. troglodytes
aggttcaagcagttct

SEQ ID NO: 207269 - DNA, 16 bp, P. troglodytes
aggttcaagcgattcc

SEQ ID NO: 207270 - DNA, 27 bp, P. troglodytes
aggttcaagcgattctcctgcctcagt

SEQ ID NO: 207271 - DNA, 18 bp, P. troglodytes
aggttcaagcgattcttg

SEQ ID NO: 207272 - DNA, 16 bp, P. troglodytes
aggttcaagcggttct

SEQ ID NO: 207273 - DNA, 16 bp, P. troglodytes
aggttcaatttttttt

SEQ ID NO: 207274 - DNA, 16 bp, P. troglodytes
aggttcacaccatttt

SEQ ID NO: 207275 - DNA, 16 bp, P. troglodytes
aggttcaggagattct

SEQ ID NO: 207276 - DNA, 16 bp, P. troglodytes
aggttcatccatgttg

SEQ ID NO: 207277 - DNA, 16 bp, P. troglodytes
aggttcatccgtgttg

SEQ ID NO: 207278 - DNA, 16 bp, P. troglodytes
aggttccatgatgccc

SEQ ID NO: 207279 - DNA, 16 bp, P. troglodytes
aggttcccaaacccca

SEQ ID NO: 207280 - DNA, 17 bp, P. troglodytes
aggttccgtgatgcccc

SEQ ID NO: 207281 - DNA, 16 bp, P. troglodytes
aggttctaagaggcag

SEQ ID NO: 207282 - DNA, 17 bp, P. troglodytes
aggttctctcatcagaa

SEQ ID NO: 207283 - DNA, 16 bp, P. troglodytes
aggttctgcacagcaa

SEQ ID NO: 207284 - DNA, 16 bp, P. troglodytes
aggttctggagtcaga

SEQ ID NO: 207285 - DNA, 16 bp, P. troglodytes
aggttcttagaaactg

SEQ ID NO: 207286 - DNA, 16 bp, P. troglodytes
aggttcttcagagaaa

SEQ ID NO: 207287 - DNA, 16 bp, P. troglodytes
aggttcttgctctgtc

SEQ ID NO: 207288 - DNA, 16 bp, P. troglodytes
aggttctttgcagatg

SEQ ID NO: 207289 - DNA, 16 bp, P. troglodytes
aggttgaaacagtttg

SEQ ID NO: 207290 - DNA, 16 bp, P. troglodytes
aggttgagaaaccctg

SEQ ID NO: 207291 - DNA, 19 bp, P. troglodytes
aggttgaggctgcagtgaa

SEQ ID NO: 207292 - DNA, 16 bp, P. troglodytes
aggttgatctcgaact

SEQ ID NO: 207293 - DNA, 16 bp, P. troglodytes
aggttgcaatgaggtg

SEQ ID NO: 207294 - DNA, 16 bp, P. troglodytes
aggttgcagagagccg

SEQ ID NO: 207295 - DNA, 16 bp, P. troglodytes
aggttgcagagagctg

SEQ ID NO: 207296 - DNA, 16 bp, P. troglodytes
aggttgcagcgagcca

SEQ ID NO: 207297 - DNA, 16 bp, P. troglodytes
aggttgcagtaagttg

SEQ ID NO: 207298 - DNA, 16 bp, P. troglodytes
aggttgcagtgagcta

SEQ ID NO: 207299 - DNA, 17 bp, P. troglodytes
aggttgcagtgagctgg

SEQ ID NO: 207300 - DNA, 16 bp, P. troglodytes
aggttgcatgagctga

SEQ ID NO: 207301 - DNA, 16 bp, P. troglodytes
aggttgcatgttcact

SEQ ID NO: 207302 - DNA, 21 bp, P. troglodytes
aggttgcggtaagccaagatt

SEQ ID NO: 207303 - DNA, 16 bp, P. troglodytes
aggttgctgcaaaagt

SEQ ID NO: 207304 - DNA, 16 bp, P. troglodytes
aggttgctgtgagtca

SEQ ID NO: 207305 - DNA, 16 bp, P. troglodytes
aggttgctgttatttt

SEQ ID NO: 207306 - DNA, 16 bp, P. troglodytes
aggttggagagcagtg

SEQ ID NO: 207307 - DNA, 16 bp, P. troglodytes
aggttggagtacagtg

SEQ ID NO: 207308 - DNA, 16 bp, P. troglodytes
aggttggagtgcggtg

SEQ ID NO: 207309 - DNA, 16 bp, P. troglodytes
aggttggggaccgctg

SEQ ID NO: 207310 - DNA, 16 bp, P. troglodytes
aggttggggtggctgt

SEQ ID NO: 207311 - DNA, 16 bp, P. troglodytes
aggttggtctcagact

SEQ ID NO: 207312 - DNA, 16 bp, P. troglodytes
aggttgtagtgggcca

SEQ ID NO: 207313 - DNA, 16 bp, P. troglodytes
aggttgtatgtgtcta

SEQ ID NO: 207314 - DNA, 16 bp, P. troglodytes
aggttgtttcttcact

SEQ ID NO: 207315 - DNA, 16 bp, P. troglodytes
aggtttaaaacatttg

SEQ ID NO: 207316 - DNA, 16 bp, P. troglodytes
aggtttaaagaaaaat

SEQ ID NO: 207317 - DNA, 16 bp, P. troglodytes
aggtttaactctgaga

SEQ ID NO: 207318 - DNA, 16 bp, P. troglodytes
aggtttaaggaaagaa

SEQ ID NO: 207319 - DNA, 16 bp, P. troglodytes
aggtttaatcaactca

SEQ ID NO: 207320 - DNA, 16 bp, P. troglodytes
aggtttaattgcctca

SEQ ID NO: 207321 - DNA, 16 bp, P. troglodytes
aggtttaggattggct

SEQ ID NO: 207322 - DNA, 16 bp, P. troglodytes
aggtttatcaatttta

SEQ ID NO: 207323 - DNA, 16 bp, P. troglodytes
aggtttcaccatcttg

SEQ ID NO: 207324 - DNA, 24 bp, P. troglodytes
aggtttcaccatgttggccaggat

SEQ ID NO: 207325 - DNA, 16 bp, P. troglodytes
aggtttcagtgagctg

SEQ ID NO: 207326 - DNA, 16 bp, P. troglodytes
aggtttccagctggaa

SEQ ID NO: 207327 - DNA, 16 bp, P. troglodytes
aggtttctaaagaaat

SEQ ID NO: 207328 - DNA, 16 bp, P. troglodytes
aggtttctcaggtgat

SEQ ID NO: 207329 - DNA, 16 bp, P. troglodytes
aggtttctccatgtct

SEQ ID NO: 207330 - DNA, 16 bp, P. troglodytes
aggtttctccatgttg

SEQ ID NO: 207331 - DNA, 16 bp, P. troglodytes
aggtttctccgtgttg

SEQ ID NO: 207332 - DNA, 16 bp, P. troglodytes
aggtttctggccagaa

SEQ ID NO: 207333 - DNA, 16 bp, P. troglodytes
aggtttgatgaagagt

SEQ ID NO: 207334 - DNA, 16 bp, P. troglodytes
aggtttggccatttta

SEQ ID NO: 207335 - DNA, 16 bp, P. troglodytes
aggtttgggtggggac

SEQ ID NO: 207336 - DNA, 26 bp, P. troglodytes
aggtttgtaaacacaccaatcagcac

SEQ ID NO: 207337 - DNA, 16 bp, P. troglodytes
aggtttgttacatgag

SEQ ID NO: 207338 - DNA, 16 bp, P. troglodytes
aggttttaagctctgc

SEQ ID NO: 207339 - DNA, 17 bp, P. troglodytes
aggttttaagtttttga

SEQ ID NO: 207340 - DNA, 16 bp, P. troglodytes
aggttttattcattct

SEQ ID NO: 207341 - DNA, 16 bp, P. troglodytes
aggttttatttccttt

SEQ ID NO: 207342 - DNA, 16 bp, P. troglodytes
aggttttcttcttggg

SEQ ID NO: 207343 - DNA, 16 bp, P. troglodytes
aggttttgatagattg

SEQ ID NO: 207344 - DNA, 16 bp, P. troglodytes
aggttttgctcttgtt

SEQ ID NO: 207345 - DNA, 16 bp, P. troglodytes
aggttttgggacttgg

SEQ ID NO: 207346 - DNA, 16 bp, P. troglodytes
aggttttgggataggc

SEQ ID NO: 207347 - DNA, 16 bp, P. troglodytes
aggttttggggaacag

SEQ ID NO: 207348 - DNA, 16 bp, P. troglodytes
aggttttgtttgttcc

SEQ ID NO: 207349 - DNA, 16 bp, P. troglodytes
aggtttttattttcat

SEQ ID NO: 207350 - DNA, 16 bp, P. troglodytes
aggtttttgattactg

SEQ ID NO: 207351 - DNA, 16 bp, P. troglodytes
aggtttttgctgagaa

SEQ ID NO: 207352 - DNA, 16 bp, P. troglodytes
agtaaaaacatgcaag

SEQ ID NO: 207353 - DNA, 16 bp, P. troglodytes
agtaaaaagatcagtg

SEQ ID NO: 207354 - DNA, 16 bp, P. troglodytes
agtaaaaataattcat

SEQ ID NO: 207355 - DNA, 16 bp, P. troglodytes
agtaaaaatacagtgt

SEQ ID NO: 207356 - DNA, 16 bp, P. troglodytes
agtaaaacattcctca

SEQ ID NO: 207357 - DNA, 16 bp, P. troglodytes
agtaaaacctcattaa

SEQ ID NO: 207358 - DNA, 16 bp, P. troglodytes
agtaaaactgaaaaat

SEQ ID NO: 207359 - DNA, 16 bp, P. troglodytes
agtaaaataagggtga

SEQ ID NO: 207360 - DNA, 16 bp, P. troglodytes
agtaaaatagtggtta

SEQ ID NO: 207361 - DNA, 16 bp, P. troglodytes
agtaaaatatttagga

SEQ ID NO: 207362 - DNA, 16 bp, P. troglodytes
agtaaaatattttgtt

SEQ ID NO: 207363 - DNA, 16 bp, P. troglodytes
agtaaaatggataaat

SEQ ID NO: 207364 - DNA, 16 bp, P. troglodytes
agtaaaatgttaaatt

SEQ ID NO: 207365 - DNA, 16 bp, P. troglodytes
agtaaaatgtttaaat

SEQ ID NO: 207366 - DNA, 16 bp, P. troglodytes
agtaaaattatctgtt

SEQ ID NO: 207367 - DNA, 16 bp, P. troglodytes
agtaaaattgttttta

SEQ ID NO: 207368 - DNA, 16 bp, P. troglodytes
agtaaaatttcaggat

SEQ ID NO: 207369 - DNA, 16 bp, P. troglodytes
agtaaacagacagcct

SEQ ID NO: 207370 - DNA, 16 bp, P. troglodytes
agtaaacatttgaaaa

SEQ ID NO: 207371 - DNA, 16 bp, P. troglodytes
agtaaacatttttaaa

SEQ ID NO: 207372 - DNA, 16 bp, P. troglodytes
agtaaacatttttttt

SEQ ID NO: 207373 - DNA, 16 bp, P. troglodytes
agtaaactatcgcaag

SEQ ID NO: 207374 - DNA, 16 bp, P. troglodytes
agtaaactgaggccca

SEQ ID NO: 207375 - DNA, 16 bp, P. troglodytes
agtaaagaaagtggtt

SEQ ID NO: 207376 - DNA, 16 bp, P. troglodytes
agtaaagacaggcata

SEQ ID NO: 207377 - DNA, 16 bp, P. troglodytes
agtaaagagatggaga

SEQ ID NO: 207378 - DNA, 16 bp, P. troglodytes
agtaaataaatataca

SEQ ID NO: 207379 - DNA, 16 bp, P. troglodytes
agtaaatatcttcata

SEQ ID NO: 207380 - DNA, 16 bp, P. troglodytes
agtaaatatgttttct

SEQ ID NO: 207381 - DNA, 16 bp, P. troglodytes
agtaaatatttcaggc

SEQ ID NO: 207382 - DNA, 16 bp, P. troglodytes
agtaaatattttagat

SEQ ID NO: 207383 - DNA, 16 bp, P. troglodytes
agtaaatattttatga

SEQ ID NO: 207384 - DNA, 16 bp, P. troglodytes
agtaaatatttttggt

SEQ ID NO: 207385 - DNA, 16 bp, P. troglodytes
agtaaatctttggggt

SEQ ID NO: 207386 - DNA, 16 bp, P. troglodytes
agtaaatgaaaacaca

SEQ ID NO: 207387 - DNA, 16 bp, P. troglodytes
agtaaatgaatgaata

SEQ ID NO: 207388 - DNA, 16 bp, P. troglodytes
agtaaatgcaataaaa

SEQ ID NO: 207389 - DNA, 16 bp, P. troglodytes
agtaaatgctcaacaa

SEQ ID NO: 207390 - DNA, 16 bp, P. troglodytes
agtaaatggaaaacaa

SEQ ID NO: 207391 - DNA, 16 bp, P. troglodytes
agtaaatgtttattaa

SEQ ID NO: 207392 - DNA, 16 bp, P. troglodytes
agtaaatttcaaatgt

SEQ ID NO: 207393 - DNA, 16 bp, P. troglodytes
agtaacaaatatggta

SEQ ID NO: 207394 - DNA, 16 bp, P. troglodytes
agtaacagcagcagca

SEQ ID NO: 207395 - DNA, 16 bp, P. troglodytes
agtaacatcaaaaatc

SEQ ID NO: 207396 - DNA, 16 bp, P. troglodytes
agtaacatgctgtttt

SEQ ID NO: 207397 - DNA, 16 bp, P. troglodytes
agtaacattctgtaca

SEQ ID NO: 207398 - DNA, 16 bp, P. troglodytes
agtaacattgaatgta

SEQ ID NO: 207399 - DNA, 18 bp, P. troglodytes
agtaaccaaaacagcatg

SEQ ID NO: 207400 - DNA, 16 bp, P. troglodytes
agtaaccacaacagca

SEQ ID NO: 207401 - DNA, 16 bp, P. troglodytes
agtaactaataataaa

SEQ ID NO: 207402 - DNA, 16 bp, P. troglodytes
agtaactgaaataaaa

SEQ ID NO: 207403 - DNA, 16 bp, P. troglodytes
agtaactgaaatgaaa

SEQ ID NO: 207404 - DNA, 16 bp, P. troglodytes
agtaactgggactaca

SEQ ID NO: 207405 - DNA, 16 bp, P. troglodytes
agtaactgggattaca

SEQ ID NO: 207406 - DNA, 16 bp, P. troglodytes
agtaactgggattaga

SEQ ID NO: 207407 - DNA, 16 bp, P. troglodytes
agtaacttgcccagga

SEQ ID NO: 207408 - DNA, 16 bp, P. troglodytes
agtaacttggaaaaca

SEQ ID NO: 207409 - DNA, 16 bp, P. troglodytes
agtaagaaaatatttt

SEQ ID NO: 207410 - DNA, 16 bp, P. troglodytes
agtaagaccccatctc

SEQ ID NO: 207411 - DNA, 16 bp, P. troglodytes
agtaagaccctgtctc

SEQ ID NO: 207412 - DNA, 16 bp, P. troglodytes
agtaagactctgtctc

SEQ ID NO: 207413 - DNA, 16 bp, P. troglodytes
agtaagagattaacaa

SEQ ID NO: 207414 - DNA, 16 bp, P. troglodytes
agtaagatgatatctc

SEQ ID NO: 207415 - DNA, 16 bp, P. troglodytes
agtaagtactattatt

SEQ ID NO: 207416 - DNA, 16 bp, P. troglodytes
agtaagtacttaataa

SEQ ID NO: 207417 - DNA, 16 bp, P. troglodytes
agtaagtatttattga

SEQ ID NO: 207418 - DNA, 16 bp, P. troglodytes
agtaagtgctcaatta

SEQ ID NO: 207419 - DNA, 16 bp, P. troglodytes
agtaagtgctcagtaa

SEQ ID NO: 207420 - DNA, 16 bp, P. troglodytes
agtaagttagagaaaa

SEQ ID NO: 207421 - DNA, 16 bp, P. troglodytes
agtaagttctcaataa

SEQ ID NO: 207422 - DNA, 16 bp, P. troglodytes
agtaagttgcagacat

SEQ ID NO: 207423 - DNA, 16 bp, P. troglodytes
agtaataaaatgtttt

SEQ ID NO: 207424 - DNA, 16 bp, P. troglodytes
agtaatacatactcat

SEQ ID NO: 207425 - DNA, 16 bp, P. troglodytes
agtaatatcaaagatc

SEQ ID NO: 207426 - DNA, 16 bp, P. troglodytes
agtaatcaagttaaaa

SEQ ID NO: 207427 - DNA, 16 bp, P. troglodytes
agtaatcccagctact

SEQ ID NO: 207428 - DNA, 16 bp, P. troglodytes
agtaatcctcctgccc

SEQ ID NO: 207429 - DNA, 16 bp, P. troglodytes
agtaatctttctaaaa

SEQ ID NO: 207430 - DNA, 16 bp, P. troglodytes
agtaatgaagacagtg

SEQ ID NO: 207431 - DNA, 16 bp, P. troglodytes
agtaatgatgataata

SEQ ID NO: 207432 - DNA, 16 bp, P. troglodytes
agtaatgcaaattaaa

SEQ ID NO: 207433 - DNA, 16 bp, P. troglodytes
agtaatgcttgcttgc

SEQ ID NO: 207434 - DNA, 16 bp, P. troglodytes
agtaattctcccacct

SEQ ID NO: 207435 - DNA, 17 bp, P. troglodytes
agtaattgctacaaact

SEQ ID NO: 207436 - DNA, 16 bp, P. troglodytes
agtaatttatagaatc

SEQ ID NO: 207437 - DNA, 16 bp, P. troglodytes
agtaatttgtagattc

SEQ ID NO: 207438 - DNA, 17 bp, P. troglodytes
agtacaatggtgtgatc

SEQ ID NO: 207439 - DNA, 16 bp, P. troglodytes
agtacagaatcaagtt

SEQ ID NO: 207440 - DNA, 16 bp, P. troglodytes
agtacagatggggttt

SEQ ID NO: 207441 - DNA, 16 bp, P. troglodytes
agtacagatttttttt

SEQ ID NO: 207442 - DNA, 16 bp, P. troglodytes
agtacagcagcatgat

SEQ ID NO: 207443 - DNA, 16 bp, P. troglodytes
agtacagtggcactgt

SEQ ID NO: 207444 - DNA, 18 bp, P. troglodytes
agtacagtggcgcgatct

SEQ ID NO: 207445 - DNA, 17 bp, P. troglodytes
agtacagtggtgccatc

SEQ ID NO: 207446 - DNA, 16 bp, P. troglodytes
agtacagtggtgtaat

SEQ ID NO: 207447 - DNA, 16 bp, P. troglodytes
agtacagtgttgcaat

SEQ ID NO: 207448 - DNA, 16 bp, P. troglodytes
agtacagtgttgtgat

SEQ ID NO: 207449 - DNA, 16 bp, P. troglodytes
agtacataaaatatat

SEQ ID NO: 207450 - DNA, 16 bp, P. troglodytes
agtacataaacagata

SEQ ID NO: 207451 - DNA, 16 bp, P. troglodytes
agtacatcaaaaagat

SEQ ID NO: 207452 - DNA, 16 bp, P. troglodytes
agtacattaaaaaaat

SEQ ID NO: 207453 - DNA, 16 bp, P. troglodytes
agtaccatattgtttt

SEQ ID NO: 207454 - DNA, 16 bp, P. troglodytes
agtaccatgctgtttt

SEQ ID NO: 207455 - DNA, 16 bp, P. troglodytes
agtacctacctcacag

SEQ ID NO: 207456 - DNA, 16 bp, P. troglodytes
agtacctaggactaca

SEQ ID NO: 207457 - DNA, 16 bp, P. troglodytes
agtacctcaggatgtg

SEQ ID NO: 207458 - DNA, 16 bp, P. troglodytes
agtacctggcacaaag

SEQ ID NO: 207459 - DNA, 16 bp, P. troglodytes
agtacctggcatgtag

SEQ ID NO: 207460 - DNA, 16 bp, P. troglodytes
agtacctgggactaca

SEQ ID NO: 207461 - DNA, 19 bp, P. troglodytes
agtaccttcccttgaactt

SEQ ID NO: 207462 - DNA, 16 bp, P. troglodytes
agtaccttttcatata

SEQ ID NO: 207463 - DNA, 16 bp, P. troglodytes
agtactaaatatggaa

SEQ ID NO: 207464 - DNA, 16 bp, P. troglodytes
agtactatgttgaata

SEQ ID NO: 207465 - DNA, 19 bp, P. troglodytes
agtactcttaaagcaatcc

SEQ ID NO: 207466 - DNA, 16 bp, P. troglodytes
agtactgaaagaaaat

SEQ ID NO: 207467 - DNA, 16 bp, P. troglodytes
agtactgcctggctac

SEQ ID NO: 207468 - DNA, 16 bp, P. troglodytes
agtacttactatgtgc

SEQ ID NO: 207469 - DNA, 16 bp, P. troglodytes
agtagaaaacaaatag

SEQ ID NO: 207470 - DNA, 16 bp, P. troglodytes
agtagaaaatatttgc

SEQ ID NO: 207471 - DNA, 16 bp, P. troglodytes
agtagaaacgggtttt

SEQ ID NO: 207472 - DNA, 16 bp, P. troglodytes
agtagaactacaaaac

SEQ ID NO: 207473 - DNA, 16 bp, P. troglodytes
agtagaaggatggtta

SEQ ID NO: 207474 - DNA, 16 bp, P. troglodytes
agtagaatgatttaaa

SEQ ID NO: 207475 - DNA, 16 bp, P. troglodytes
agtagaatgatttata

SEQ ID NO: 207476 - DNA, 16 bp, P. troglodytes
agtagaatggtttata

SEQ ID NO: 207477 - DNA, 16 bp, P. troglodytes
agtagacagaaaatca

SEQ ID NO: 207478 - DNA, 18 bp, P. troglodytes
agtagacataggagactc

SEQ ID NO: 207479 - DNA, 16 bp, P. troglodytes
agtagacatttttcca

SEQ ID NO: 207480 - DNA, 16 bp, P. troglodytes
agtagagaccggattt

SEQ ID NO: 207481 - DNA, 16 bp, P. troglodytes
agtagagatcatgcca

SEQ ID NO: 207482 - DNA, 16 bp, P. troglodytes
agtagagatcgcacca

SEQ ID NO: 207483 - DNA, 16 bp, P. troglodytes
agtagagatgcagttt

SEQ ID NO: 207484 - DNA, 16 bp, P. troglodytes
agtagagatggggtct

SEQ ID NO: 207485 - DNA, 16 bp, P. troglodytes
agtagagtgaaatatt

SEQ ID NO: 207486 - DNA, 16 bp, P. troglodytes
agtagagttgggtttt

SEQ ID NO: 207487 - DNA, 16 bp, P. troglodytes
agtagataacttgttt

SEQ ID NO: 207488 - DNA, 16 bp, P. troglodytes
agtagatacagggttt

SEQ ID NO: 207489 - DNA, 16 bp, P. troglodytes
agtagatgggactaca

SEQ ID NO: 207490 - DNA, 16 bp, P. troglodytes
agtagatgggatttca

SEQ ID NO: 207491 - DNA, 16 bp, P. troglodytes
agtagatgttcaataa

SEQ ID NO: 207492 - DNA, 16 bp, P. troglodytes
agtagatttgtttaca

SEQ ID NO: 207493 - DNA, 16 bp, P. troglodytes
agtagatttttctaat

SEQ ID NO: 207494 - DNA, 17 bp, P. troglodytes
agtagcaagatttattg

SEQ ID NO: 207495 - DNA, 16 bp, P. troglodytes
agtagcagggattaca

SEQ ID NO: 207496 - DNA, 16 bp, P. troglodytes
agtagcagtagcagca

SEQ ID NO: 207497 - DNA, 16 bp, P. troglodytes
agtagcattccatggt

SEQ ID NO: 207498 - DNA, 16 bp, P. troglodytes
agtagccagagaaaaa

SEQ ID NO: 207499 - DNA, 16 bp, P. troglodytes
agtagccaggactgca

SEQ ID NO: 207500 - DNA, 16 bp, P. troglodytes
agtagccaggattaca

SEQ ID NO: 207501 - DNA, 16 bp, P. troglodytes
agtagccagggagtgg

SEQ ID NO: 207502 - DNA, 16 bp, P. troglodytes
agtagccattatttta

SEQ ID NO: 207503 - DNA, 16 bp, P. troglodytes
agtagccgggaccaca

SEQ ID NO: 207504 - DNA, 16 bp, P. troglodytes
agtagccgggactaca

SEQ ID NO: 207505 - DNA, 17 bp, P. troglodytes
agtagccgggattacag

SEQ ID NO: 207506 - DNA, 16 bp, P. troglodytes
agtagctacgactaca

SEQ ID NO: 207507 - DNA, 16 bp, P. troglodytes
agtagctagaactaca

SEQ ID NO: 207508 - DNA, 16 bp, P. troglodytes
agtagctaggaccaca

SEQ ID NO: 207509 - DNA, 16 bp, P. troglodytes
agtagctaggactaca

SEQ ID NO: 207510 - DNA, 16 bp, P. troglodytes
agtagctaggactata

SEQ ID NO: 207511 - DNA, 16 bp, P. troglodytes
agtagctaggactgca

SEQ ID NO: 207512 - DNA, 17 bp, P. troglodytes
agtagctaggatcacag

SEQ ID NO: 207513 - DNA, 17 bp, P. troglodytes
agtagctaggattacag

SEQ ID NO: 207514 - DNA, 16 bp, P. troglodytes
agtagctcagattaca

SEQ ID NO: 207515 - DNA, 17 bp, P. troglodytes
agtagctgaaactacaa

SEQ ID NO: 207516 - DNA, 16 bp, P. troglodytes
agtagctgacattaca

SEQ ID NO: 207517 - DNA, 16 bp, P. troglodytes
agtagctgagactaca

SEQ ID NO: 207518 - DNA, 16 bp, P. troglodytes
agtagctgagactacc

SEQ ID NO: 207519 - DNA, 16 bp, P. troglodytes
agtagctgagactata

SEQ ID NO: 207520 - DNA, 17 bp, P. troglodytes
agtagctgagattacag

SEQ ID NO: 207521 - DNA, 16 bp, P. troglodytes
agtagctgagattata

SEQ ID NO: 207522 - DNA, 16 bp, P. troglodytes
agtagctgaggccaca

SEQ ID NO: 207523 - DNA, 16 bp, P. troglodytes
agtagctgatactaca

SEQ ID NO: 207524 - DNA, 17 bp, P. troglodytes
agtagctgcgactacag

SEQ ID NO: 207525 - DNA, 17 bp, P. troglodytes
agtagctgcgattacag

SEQ ID NO: 207526 - DNA, 16 bp, P. troglodytes
agtagctggaactaca

SEQ ID NO: 207527 - DNA, 16 bp, P. troglodytes
agtagctggaactacc

SEQ ID NO: 207528 - DNA, 16 bp, P. troglodytes
agtagctggaactata

SEQ ID NO: 207529 - DNA, 16 bp, P. troglodytes
agtagctggaatgaca

SEQ ID NO: 207530 - DNA, 16 bp, P. troglodytes
agtagctggaattaca

SEQ ID NO: 207531 - DNA, 17 bp, P. troglodytes
agtagctggaattgcag

SEQ ID NO: 207532 - DNA, 16 bp, P. troglodytes
agtagctggattacag

SEQ ID NO: 207533 - DNA, 16 bp, P. troglodytes
agtagctggcactaca

SEQ ID NO: 207534 - DNA, 16 bp, P. troglodytes
agtagctgggaataca

SEQ ID NO: 207535 - DNA, 16 bp, P. troglodytes
agtagctgggaatata

SEQ ID NO: 207536 - DNA, 16 bp, P. troglodytes
agtagctgggaccata

SEQ ID NO: 207537 - DNA, 16 bp, P. troglodytes
agtagctgggaccgca

SEQ ID NO: 207538 - DNA, 16 bp, P. troglodytes
agtagctgggactaaa

SEQ ID NO: 207539 - DNA, 17 bp, P. troglodytes
agtagctgggactacaa

SEQ ID NO: 207540 - DNA, 17 bp, P. troglodytes
agtagctgggactacac

SEQ ID NO: 207541 - DNA, 17 bp, P. troglodytes
agtagctgggactacag

SEQ ID NO: 207542 - DNA, 17 bp, P. troglodytes
agtagctgggactacat

SEQ ID NO: 207543 - DNA, 16 bp, P. troglodytes
agtagctgggactacg

SEQ ID NO: 207544 - DNA, 16 bp, P. troglodytes
agtagctgggactact

SEQ ID NO: 207545 - DNA, 16 bp, P. troglodytes
agtagctgggactaga

SEQ ID NO: 207546 - DNA, 16 bp, P. troglodytes
agtagctgggactata

SEQ ID NO: 207547 - DNA, 16 bp, P. troglodytes
agtagctgggactatg

SEQ ID NO: 207548 - DNA, 16 bp, P. troglodytes
agtagctgggactcca

SEQ ID NO: 207549 - DNA, 16 bp, P. troglodytes
agtagctgggactgca

SEQ ID NO: 207550 - DNA, 16 bp, P. troglodytes
agtagctgggacttca

SEQ ID NO: 207551 - DNA, 16 bp, P. troglodytes
agtagctgggacttta

SEQ ID NO: 207552 - DNA, 16 bp, P. troglodytes
agtagctgggagtaca

SEQ ID NO: 207553 - DNA, 16 bp, P. troglodytes
agtagctgggataaca

SEQ ID NO: 207554 - DNA, 16 bp, P. troglodytes
agtagctgggataata

SEQ ID NO: 207555 - DNA, 16 bp, P. troglodytes
agtagctgggatcaca

SEQ ID NO: 207556 - DNA, 16 bp, P. troglodytes
agtagctgggatgaca

SEQ ID NO: 207557 - DNA, 18 bp, P. troglodytes
agtagctgggatgacagg

SEQ ID NO: 207558 - DNA, 17 bp, P. troglodytes
agtagctgggattacaa

SEQ ID NO: 207559 - DNA, 17 bp, P. troglodytes
agtagctgggattacac

SEQ ID NO: 207560 - DNA, 17 bp, P. troglodytes
agtagctgggattacag

SEQ ID NO: 207561 - DNA, 16 bp, P. troglodytes
agtagctgggattacc

SEQ ID NO: 207562 - DNA, 16 bp, P. troglodytes
agtagctgggattacg

SEQ ID NO: 207563 - DNA, 16 bp, P. troglodytes
agtagctgggattact

SEQ ID NO: 207564 - DNA, 16 bp, P. troglodytes
agtagctgggattaga

SEQ ID NO: 207565 - DNA, 17 bp, P. troglodytes
agtagctgggattatag

SEQ ID NO: 207566 - DNA, 16 bp, P. troglodytes
agtagctgggattatg

SEQ ID NO: 207567 - DNA, 16 bp, P. troglodytes
agtagctgggattcca

SEQ ID NO: 207568 - DNA, 16 bp, P. troglodytes
agtagctgggattgca

SEQ ID NO: 207569 - DNA, 16 bp, P. troglodytes
agtagctgggatttta

SEQ ID NO: 207570 - DNA, 16 bp, P. troglodytes
agtagctgggcacagt

SEQ ID NO: 207571 - DNA, 16 bp, P. troglodytes
agtagctgggcctaca

SEQ ID NO: 207572 - DNA, 17 bp, P. troglodytes
agtagctgggcttacag

SEQ ID NO: 207573 - DNA, 16 bp, P. troglodytes
agtagctggggctaca

SEQ ID NO: 207574 - DNA, 17 bp, P. troglodytes
agtagctggggttacag

SEQ ID NO: 207575 - DNA, 16 bp, P. troglodytes
agtagctggtactaca

SEQ ID NO: 207576 - DNA, 16 bp, P. troglodytes
agtagctggtactaga

SEQ ID NO: 207577 - DNA, 17 bp, P. troglodytes
agtagctggtattacag

SEQ ID NO: 207578 - DNA, 16 bp, P. troglodytes
agtagctgtgactaca

SEQ ID NO: 207579 - DNA, 17 bp, P. troglodytes
agtagctgtgattacag

SEQ ID NO: 207580 - DNA, 16 bp, P. troglodytes
agtagcttggactata

SEQ ID NO: 207581 - DNA, 16 bp, P. troglodytes
agtagcttggattaca

SEQ ID NO: 207582 - DNA, 16 bp, P. troglodytes
agtagctttaaaaaaa

SEQ ID NO: 207583 - DNA, 16 bp, P. troglodytes
agtaggagcaagagag

SEQ ID NO: 207584 - DNA, 16 bp, P. troglodytes
agtaggcatttaataa

SEQ ID NO: 207585 - DNA, 16 bp, P. troglodytes
agtaggcttcagaaag

SEQ ID NO: 207586 - DNA, 16 bp, P. troglodytes
agtaggtattcaataa

SEQ ID NO: 207587 - DNA, 16 bp, P. troglodytes
agtaggtgcttactaa

SEQ ID NO: 207588 - DNA, 16 bp, P. troglodytes
agtaggtgggactaca

SEQ ID NO: 207589 - DNA, 17 bp, P. troglodytes
agtaggtgggattacag

SEQ ID NO: 207590 - DNA, 16 bp, P. troglodytes
agtaggtgttcaacaa

SEQ ID NO: 207591 - DNA, 16 bp, P. troglodytes
agtagtagcagcagca

SEQ ID NO: 207592 - DNA, 16 bp, P. troglodytes
agtagtagcagcagta

SEQ ID NO: 207593 - DNA, 16 bp, P. troglodytes
agtagtatgaacattt

SEQ ID NO: 207594 - DNA, 16 bp, P. troglodytes
agtagtattccactgt

SEQ ID NO: 207595 - DNA, 16 bp, P. troglodytes
agtagtcattcaggag

SEQ ID NO: 207596 - DNA, 16 bp, P. troglodytes
agtagtccccccttat

SEQ ID NO: 207597 - DNA, 16 bp, P. troglodytes
agtagtcttttcaaca

SEQ ID NO: 207598 - DNA, 16 bp, P. troglodytes
agtagtgtacagtaat

SEQ ID NO: 207599 - DNA, 16 bp, P. troglodytes
agtagttcccccttat

SEQ ID NO: 207600 - DNA, 16 bp, P. troglodytes
agtagttctcaacagt

SEQ ID NO: 207601 - DNA, 16 bp, P. troglodytes
agtagttctgcttttg

SEQ ID NO: 207602 - DNA, 16 bp, P. troglodytes
agtagttggaattata

SEQ ID NO: 207603 - DNA, 16 bp, P. troglodytes
agtagttgggactaca

SEQ ID NO: 207604 - DNA, 17 bp, P. troglodytes
agtagttgggattacag

SEQ ID NO: 207605 - DNA, 16 bp, P. troglodytes
agtagtttttttaaaa

SEQ ID NO: 207606 - DNA, 16 bp, P. troglodytes
agtataaacattttta

SEQ ID NO: 207607 - DNA, 16 bp, P. troglodytes
agtataactttttttt

SEQ ID NO: 207608 - DNA, 16 bp, P. troglodytes
agtataatgatttata

SEQ ID NO: 207609 - DNA, 16 bp, P. troglodytes
agtataatggcatgat

SEQ ID NO: 207610 - DNA, 16 bp, P. troglodytes
agtataatttatatac

SEQ ID NO: 207611 - DNA, 16 bp, P. troglodytes
agtatactctgtgatg

SEQ ID NO: 207612 - DNA, 16 bp, P. troglodytes
agtatatacattttta

SEQ ID NO: 207613 - DNA, 16 bp, P. troglodytes
agtatatagaaatgca

SEQ ID NO: 207614 - DNA, 16 bp, P. troglodytes
agtatatataaataca

SEQ ID NO: 207615 - DNA, 16 bp, P. troglodytes
agtatattgaagaaat

SEQ ID NO: 207616 - DNA, 16 bp, P. troglodytes
agtatattttcatatg

SEQ ID NO: 207617 - DNA, 16 bp, P. troglodytes
agtatattttgaagtt

SEQ ID NO: 207618 - DNA, 16 bp, P. troglodytes
agtatcaaaaagaata

SEQ ID NO: 207619 - DNA, 16 bp, P. troglodytes
agtatcattttaaaat

SEQ ID NO: 207620 - DNA, 16 bp, P. troglodytes
agtatccagaatctat

SEQ ID NO: 207621 - DNA, 16 bp, P. troglodytes
agtatctgagattaca

SEQ ID NO: 207622 - DNA, 16 bp, P. troglodytes
agtatctgcaaatgga

SEQ ID NO: 207623 - DNA, 16 bp, P. troglodytes
agtatctgggactaca

SEQ ID NO: 207624 - DNA, 16 bp, P. troglodytes
agtatctgttgttttt

SEQ ID NO: 207625 - DNA, 16 bp, P. troglodytes
agtatctttaataaag

SEQ ID NO: 207626 - DNA, 16 bp, P. troglodytes
agtatgaaaatacatt

SEQ ID NO: 207627 - DNA, 16 bp, P. troglodytes
agtatgagaatgaact

SEQ ID NO: 207628 - DNA, 16 bp, P. troglodytes
agtatggggattacag

SEQ ID NO: 207629 - DNA, 16 bp, P. troglodytes
agtatgtaaatgaatg

SEQ ID NO: 207630 - DNA, 16 bp, P. troglodytes
agtatgtaaattatat

SEQ ID NO: 207631 - DNA, 16 bp, P. troglodytes
agtatgtgcaaaggcc

SEQ ID NO: 207632 - DNA, 16 bp, P. troglodytes
agtatgtgccatgtgg

SEQ ID NO: 207633 - DNA, 16 bp, P. troglodytes
agtatgtggtaatttg

SEQ ID NO: 207634 - DNA, 16 bp, P. troglodytes
agtattaagagggaaa

SEQ ID NO: 207635 - DNA, 16 bp, P. troglodytes
agtattaggaggtggg

SEQ ID NO: 207636 - DNA, 16 bp, P. troglodytes
agtattagggtggaag

SEQ ID NO: 207637 - DNA, 16 bp, P. troglodytes
agtattatacagaata

SEQ ID NO: 207638 - DNA, 16 bp, P. troglodytes
agtattatgaagaaaa

SEQ ID NO: 207639 - DNA, 16 bp, P. troglodytes
agtattcaaaaatcaa

SEQ ID NO: 207640 - DNA, 16 bp, P. troglodytes
agtattcatttttaaa

SEQ ID NO: 207641 - DNA, 16 bp, P. troglodytes
agtattcccagctact

SEQ ID NO: 207642 - DNA, 16 bp, P. troglodytes
agtattccccttgaaa

SEQ ID NO: 207643 - DNA, 16 bp, P. troglodytes
agtattctctcatggt

SEQ ID NO: 207644 - DNA, 16 bp, P. troglodytes
agtattcttaacttat

SEQ ID NO: 207645 - DNA, 16 bp, P. troglodytes
agtattgatacattat

SEQ ID NO: 207646 - DNA, 16 bp, P. troglodytes
agtattgtttgaagtt

SEQ ID NO: 207647 - DNA, 16 bp, P. troglodytes
agtatttatcatttct

SEQ ID NO: 207648 - DNA, 16 bp, P. troglodytes
agtatttattgagcac

SEQ ID NO: 207649 - DNA, 17 bp, P. troglodytes
agtatttattgatcatt

SEQ ID NO: 207650 - DNA, 16 bp, P. troglodytes
agtatttattttgaaa

SEQ ID NO: 207651 - DNA, 16 bp, P. troglodytes
agtatttcagaatgtg

SEQ ID NO: 207652 - DNA, 16 bp, P. troglodytes
agtatttcataatttt

SEQ ID NO: 207653 - DNA, 16 bp, P. troglodytes
agtatttcattttttg

SEQ ID NO: 207654 - DNA, 16 bp, P. troglodytes
agtatttcctcctttt

SEQ ID NO: 207655 - DNA, 16 bp, P. troglodytes
agtatttgcaaattat

SEQ ID NO: 207656 - DNA, 16 bp, P. troglodytes
agtatttgggcagaag

SEQ ID NO: 207657 - DNA, 16 bp, P. troglodytes
agtatttgtcattctg

SEQ ID NO: 207658 - DNA, 16 bp, P. troglodytes
agtatttgtctaaaac

SEQ ID NO: 207659 - DNA, 16 bp, P. troglodytes
agtatttgtgtgtgtg

SEQ ID NO: 207660 - DNA, 16 bp, P. troglodytes
agtattttattatctt

SEQ ID NO: 207661 - DNA, 16 bp, P. troglodytes
agtattttattgaaaa

SEQ ID NO: 207662 - DNA, 16 bp, P. troglodytes
agtattttcattaaaa

SEQ ID NO: 207663 - DNA, 16 bp, P. troglodytes
agtattttgaaaagaa

SEQ ID NO: 207664 - DNA, 16 bp, P. troglodytes
agtattttgaactgaa

SEQ ID NO: 207665 - DNA, 16 bp, P. troglodytes
agtattttgttaagga

SEQ ID NO: 207666 - DNA, 16 bp, P. troglodytes
agtattttgttgaaaa

SEQ ID NO: 207667 - DNA, 16 bp, P. troglodytes
agtatttttaaagaaa

SEQ ID NO: 207668 - DNA, 17 bp, P. troglodytes
agtatttttagtagaga

SEQ ID NO: 207669 - DNA, 16 bp, P. troglodytes
agtatttttttgagga

SEQ ID NO: 207670 - DNA, 16 bp, P. troglodytes
agtcaaaaaatcataa

SEQ ID NO: 207671 - DNA, 16 bp, P. troglodytes
agtcaaaaactataaa

SEQ ID NO: 207672 - DNA, 16 bp, P. troglodytes
agtcaaaaagtttaaa

SEQ ID NO: 207673 - DNA, 16 bp, P. troglodytes
agtcaaaaatcaaggt

SEQ ID NO: 207674 - DNA, 16 bp, P. troglodytes
agtcaaaatgaaggaa

SEQ ID NO: 207675 - DNA, 16 bp, P. troglodytes
agtcaaactctataaa

SEQ ID NO: 207676 - DNA, 18 bp, P. troglodytes
agtcaaagaaaggggtga

SEQ ID NO: 207677 - DNA, 16 bp, P. troglodytes
agtcaaagaagaaata

SEQ ID NO: 207678 - DNA, 16 bp, P. troglodytes
agtcaaagacaaagaa

SEQ ID NO: 207679 - DNA, 16 bp, P. troglodytes
agtcaaagagaaagaa

SEQ ID NO: 207680 - DNA, 16 bp, P. troglodytes
agtcaaagcaatcctg

SEQ ID NO: 207681 - DNA, 16 bp, P. troglodytes
agtcaaatgagatcat

SEQ ID NO: 207682 - DNA, 16 bp, P. troglodytes
agtcaaattatttttg

SEQ ID NO: 207683 - DNA, 16 bp, P. troglodytes
agtcaaatttatcagt

SEQ ID NO: 207684 - DNA, 16 bp, P. troglodytes
agtcaacaacaacaac

SEQ ID NO: 207685 - DNA, 16 bp, P. troglodytes
agtcaacaaggatacc

SEQ ID NO: 207686 - DNA, 16 bp, P. troglodytes
agtcaacatggcagat

SEQ ID NO: 207687 - DNA, 32 bp, P. troglodytes
agtcaagacccatcagtgtgctgtattcagga

SEQ ID NO: 207688 - DNA, 16 bp, P. troglodytes
agtcaagatgcagaac

SEQ ID NO: 207689 - DNA, 16 bp, P. troglodytes
agtcaaggaaactttt

SEQ ID NO: 207690 - DNA, 16 bp, P. troglodytes
agtcaaggctgcagta

SEQ ID NO: 207691 - DNA, 16 bp, P. troglodytes
agtcaaggtgacacat

SEQ ID NO: 207692 - DNA, 16 bp, P. troglodytes
agtcaataaaaccaaa

SEQ ID NO: 207693 - DNA, 17 bp, P. troglodytes
agtcaattaaacttctt

SEQ ID NO: 207694 - DNA, 16 bp, P. troglodytes
agtcacaaaaggaaaa

SEQ ID NO: 207695 - DNA, 16 bp, P. troglodytes
agtcacatggccacac

SEQ ID NO: 207696 - DNA, 16 bp, P. troglodytes
agtcacatgtctctca

SEQ ID NO: 207697 - DNA, 16 bp, P. troglodytes
agtcaccacacctggt

SEQ ID NO: 207698 - DNA, 16 bp, P. troglodytes
agtcaccactaaagaa

SEQ ID NO: 207699 - DNA, 16 bp, P. troglodytes
agtcaccatgcctagc

SEQ ID NO: 207700 - DNA, 16 bp, P. troglodytes
agtcaccatgcttggc

SEQ ID NO: 207701 - DNA, 16 bp, P. troglodytes
agtcacctccacctgg

SEQ ID NO: 207702 - DNA, 16 bp, P. troglodytes
agtcactaagtttgtg

SEQ ID NO: 207703 - DNA, 22 bp, P. troglodytes
agtcactagatacttctcccag

SEQ ID NO: 207704 - DNA, 16 bp, P. troglodytes
agtcactccacctctc

SEQ ID NO: 207705 - DNA, 16 bp, P. troglodytes
agtcactgcgcccggc

SEQ ID NO: 207706 - DNA, 16 bp, P. troglodytes
agtcactgggttccat

SEQ ID NO: 207707 - DNA, 16 bp, P. troglodytes
agtcactgtgcccagc

SEQ ID NO: 207708 - DNA, 16 bp, P. troglodytes
agtcactgtgcccggc

SEQ ID NO: 207709 - DNA, 16 bp, P. troglodytes
agtcactttccctctc

SEQ ID NO: 207710 - DNA, 16 bp, P. troglodytes
agtcacttttttcttt

SEQ ID NO: 207711 - DNA, 16 bp, P. troglodytes
agtcagaaaaatattt

SEQ ID NO: 207712 - DNA, 16 bp, P. troglodytes
agtcagaagacctgag

SEQ ID NO: 207713 - DNA, 16 bp, P. troglodytes
agtcagaattcaaacc

SEQ ID NO: 207714 - DNA, 16 bp, P. troglodytes
agtcagaatttgaacc

SEQ ID NO: 207715 - DNA, 16 bp, P. troglodytes
agtcagacagacctgg

SEQ ID NO: 207716 - DNA, 16 bp, P. troglodytes
agtcagaccctgtctc

SEQ ID NO: 207717 - DNA, 16 bp, P. troglodytes
agtcagactccatctc

SEQ ID NO: 207718 - DNA, 16 bp, P. troglodytes
agtcagactttttttt

SEQ ID NO: 207719 - DNA, 16 bp, P. troglodytes
agtcagagaaaagaaa

SEQ ID NO: 207720 - DNA, 16 bp, P. troglodytes
agtcagagagagagag

SEQ ID NO: 207721 - DNA, 16 bp, P. troglodytes
agtcagaggagaaaaa

SEQ ID NO: 207722 - DNA, 16 bp, P. troglodytes
agtcagcaaccatcaa

SEQ ID NO: 207723 - DNA, 16 bp, P. troglodytes
agtcagcagatgatga

SEQ ID NO: 207724 - DNA, 16 bp, P. troglodytes
agtcagccctgtggaa

SEQ ID NO: 207725 - DNA, 16 bp, P. troglodytes
agtcagcgagaccacg

SEQ ID NO: 207726 - DNA, 16 bp, P. troglodytes
agtcaggaaacagcag

SEQ ID NO: 207727 - DNA, 16 bp, P. troglodytes
agtcaggaagaaacct

SEQ ID NO: 207728 - DNA, 16 bp, P. troglodytes
agtcaggaccctctgc

SEQ ID NO: 207729 - DNA, 16 bp, P. troglodytes
agtcaggagttcagga

SEQ ID NO: 207730 - DNA, 16 bp, P. troglodytes
agtcaggcatggtggg

SEQ ID NO: 207731 - DNA, 16 bp, P. troglodytes
agtcagggaagggaga

SEQ ID NO: 207732 - DNA, 16 bp, P. troglodytes
agtcagggttctccaa

SEQ ID NO: 207733 - DNA, 16 bp, P. troglodytes
agtcagtaataattta

SEQ ID NO: 207734 - DNA, 16 bp, P. troglodytes
agtcagtctctctctc

SEQ ID NO: 207735 - DNA, 16 bp, P. troglodytes
agtcagtgagtggtga

SEQ ID NO: 207736 - DNA, 16 bp, P. troglodytes
agtcagtgctgaaaca

SEQ ID NO: 207737 - DNA, 16 bp, P. troglodytes
agtcagtggatggaaa

SEQ ID NO: 207738 - DNA, 16 bp, P. troglodytes
agtcatagagacagaa

SEQ ID NO: 207739 - DNA, 16 bp, P. troglodytes
agtcatattggattag

SEQ ID NO: 207740 - DNA, 16 bp, P. troglodytes
agtcatccacccacct

SEQ ID NO: 207741 - DNA, 16 bp, P. troglodytes
agtcatccctcagtat

SEQ ID NO: 207742 - DNA, 16 bp, P. troglodytes
agtcatgaaaacaaca

SEQ ID NO: 207743 - DNA, 16 bp, P. troglodytes
agtcatgccctacaaa

SEQ ID NO: 207744 - DNA, 16 bp, P. troglodytes
agtcatggcagaagac

SEQ ID NO: 207745 - DNA, 16 bp, P. troglodytes
agtcatgtgtcactta

SEQ ID NO: 207746 - DNA, 16 bp, P. troglodytes
agtcattatataaaaa

SEQ ID NO: 207747 - DNA, 16 bp, P. troglodytes
agtcattatttgaaaa

SEQ ID NO: 207748 - DNA, 16 bp, P. troglodytes
agtcattcagcagcag

SEQ ID NO: 207749 - DNA, 31 bp, P. troglodytes
agtcattcaggagcaggttgttcagtttcca

SEQ ID NO: 207750 - DNA, 16 bp, P. troglodytes
agtcattccccatttc

SEQ ID NO: 207751 - DNA, 16 bp, P. troglodytes
agtcatttctccaaag

SEQ ID NO: 207752 - DNA, 16 bp, P. troglodytes
agtcatttgcccaagg

SEQ ID NO: 207753 - DNA, 16 bp, P. troglodytes
agtccaaaagcttctt

SEQ ID NO: 207754 - DNA, 16 bp, P. troglodytes
agtccaaattctcatc

SEQ ID NO: 207755 - DNA, 16 bp, P. troglodytes
agtccaacctgggcaa

SEQ ID NO: 207756 - DNA, 16 bp, P. troglodytes
agtccaagatcaagga

SEQ ID NO: 207757 - DNA, 16 bp, P. troglodytes
agtccagcagcccaag

SEQ ID NO: 207758 - DNA, 16 bp, P. troglodytes
agtccagcctgaccaa

SEQ ID NO: 207759 - DNA, 16 bp, P. troglodytes
agtccagcctggacaa

SEQ ID NO: 207760 - DNA, 16 bp, P. troglodytes
agtccagcctggccaa

SEQ ID NO: 207761 - DNA, 16 bp, P. troglodytes
agtccagcctgggcaa

SEQ ID NO: 207762 - DNA, 16 bp, P. troglodytes
agtccagcttcggctc

SEQ ID NO: 207763 - DNA, 16 bp, P. troglodytes
agtccaggaagtggag

SEQ ID NO: 207764 - DNA, 16 bp, P. troglodytes
agtccaggaccagaag

SEQ ID NO: 207765 - DNA, 16 bp, P. troglodytes
agtccaggagtccaag

SEQ ID NO: 207766 - DNA, 16 bp, P. troglodytes
agtccaggagttccag

SEQ ID NO: 207767 - DNA, 16 bp, P. troglodytes
agtccaggagttcgag

SEQ ID NO: 207768 - DNA, 16 bp, P. troglodytes
agtccaggagttggag

SEQ ID NO: 207769 - DNA, 16 bp, P. troglodytes
agtccaggcctccaga

SEQ ID NO: 207770 - DNA, 16 bp, P. troglodytes
agtccagggatgctgc

SEQ ID NO: 207771 - DNA, 16 bp, P. troglodytes
agtccaggtgtttgag

SEQ ID NO: 207772 - DNA, 16 bp, P. troglodytes
agtccagtggtgcaat

SEQ ID NO: 207773 - DNA, 16 bp, P. troglodytes
agtccagttttattct

SEQ ID NO: 207774 - DNA, 16 bp, P. troglodytes
agtccatagtttacat

SEQ ID NO: 207775 - DNA, 16 bp, P. troglodytes
agtccattaaaccttt

SEQ ID NO: 207776 - DNA, 16 bp, P. troglodytes
agtccatttatattca

SEQ ID NO: 207777 - DNA, 16 bp, P. troglodytes
agtcccaatgagagaa

SEQ ID NO: 207778 - DNA, 16 bp, P. troglodytes
agtcccacaataggcc

SEQ ID NO: 207779 - DNA, 16 bp, P. troglodytes
agtcccaccaactgtg

SEQ ID NO: 207780 - DNA, 16 bp, P. troglodytes
agtcccagacacttgg

SEQ ID NO: 207781 - DNA, 16 bp, P. troglodytes
agtcccagatgcttgg

SEQ ID NO: 207782 - DNA, 16 bp, P. troglodytes
agtcccagctactaca

SEQ ID NO: 207783 - DNA, 16 bp, P. troglodytes
agtcccagctactgag

SEQ ID NO: 207784 - DNA, 16 bp, P. troglodytes
agtcccagctcctcag

SEQ ID NO: 207785 - DNA, 16 bp, P. troglodytes
agtcccagctcctggg

SEQ ID NO: 207786 - DNA, 16 bp, P. troglodytes
agtcccagctctgcca

SEQ ID NO: 207787 - DNA, 16 bp, P. troglodytes
agtcccagctctgcct

SEQ ID NO: 207788 - DNA, 16 bp, P. troglodytes
agtcccagctctttgg

SEQ ID NO: 207789 - DNA, 16 bp, P. troglodytes
agtcccagcttctcaa

SEQ ID NO: 207790 - DNA, 16 bp, P. troglodytes
agtcccagtcccagct

SEQ ID NO: 207791 - DNA, 16 bp, P. troglodytes
agtcccagtgagatga

SEQ ID NO: 207792 - DNA, 16 bp, P. troglodytes
agtccccaaagtccat

SEQ ID NO: 207793 - DNA, 16 bp, P. troglodytes
agtccccaaagtctta

SEQ ID NO: 207794 - DNA, 16 bp, P. troglodytes
agtccccacacagagt

SEQ ID NO: 207795 - DNA, 16 bp, P. troglodytes
agtccccactggggca

SEQ ID NO: 207796 - DNA, 16 bp, P. troglodytes
agtccccagaactgtg

SEQ ID NO: 207797 - DNA, 16 bp, P. troglodytes
agtccccagagtatga

SEQ ID NO: 207798 - DNA, 16 bp, P. troglodytes
agtcccccaaattctt

SEQ ID NO: 207799 - DNA, 16 bp, P. troglodytes
agtccctcccccaaca

SEQ ID NO: 207800 - DNA, 16 bp, P. troglodytes
agtccctgagcaagga

SEQ ID NO: 207801 - DNA, 16 bp, P. troglodytes
agtcccttcttttcaa

SEQ ID NO: 207802 - DNA, 17 bp, P. troglodytes
agtcctcagtaaggttt

SEQ ID NO: 207803 - DNA, 16 bp, P. troglodytes
agtcctcccacctcaa

SEQ ID NO: 207804 - DNA, 16 bp, P. troglodytes
agtcctcccaccttga

SEQ ID NO: 207805 - DNA, 16 bp, P. troglodytes
agtcctctttattctt

SEQ ID NO: 207806 - DNA, 16 bp, P. troglodytes
agtcctgccattgcct

SEQ ID NO: 207807 - DNA, 16 bp, P. troglodytes
agtcctgcctcctgtc

SEQ ID NO: 207808 - DNA, 16 bp, P. troglodytes
agtcctggagatggat

SEQ ID NO: 207809 - DNA, 16 bp, P. troglodytes
agtcctgggtggggca

SEQ ID NO: 207810 - DNA, 16 bp, P. troglodytes
agtccttcctcctcaa

SEQ ID NO: 207811 - DNA, 16 bp, P. troglodytes
agtcctttccccactg

SEQ ID NO: 207812 - DNA, 16 bp, P. troglodytes
agtcctttccctgttg

SEQ ID NO: 207813 - DNA, 16 bp, P. troglodytes
agtcgagatcacgcca

SEQ ID NO: 207814 - DNA, 16 bp, P. troglodytes
agtcgaggagcatctg

SEQ ID NO: 207815 - DNA, 16 bp, P. troglodytes
agtcggccctctgtat

SEQ ID NO: 207816 - DNA, 16 bp, P. troglodytes
agtcgggtgtggtggc

SEQ ID NO: 207817 - DNA, 16 bp, P. troglodytes
agtctagagtgcagtg

SEQ ID NO: 207818 - DNA, 16 bp, P. troglodytes
agtctatggtattctg

SEQ ID NO: 207819 - DNA, 16 bp, P. troglodytes
agtctattggtgccat

SEQ ID NO: 207820 - DNA, 16 bp, P. troglodytes
agtctattttctgtct

SEQ ID NO: 207821 - DNA, 16 bp, P. troglodytes
agtctcaaaaaagaaa

SEQ ID NO: 207822 - DNA, 16 bp, P. troglodytes
agtctcaaactcctgg

SEQ ID NO: 207823 - DNA, 16 bp, P. troglodytes
agtctcaataaaccag

SEQ ID NO: 207824 - DNA, 22 bp, P. troglodytes
agtctcactctgtcacccagga

SEQ ID NO: 207825 - DNA, 16 bp, P. troglodytes
agtctcagaaaaaaaa

SEQ ID NO: 207826 - DNA, 16 bp, P. troglodytes
agtctcagctcactga

SEQ ID NO: 207827 - DNA, 17 bp, P. troglodytes
agtctcaggtatttctt

SEQ ID NO: 207828 - DNA, 16 bp, P. troglodytes
agtctcaggtgtgtct

SEQ ID NO: 207829 - DNA, 16 bp, P. troglodytes
agtctcatattttgtg

SEQ ID NO: 207830 - DNA, 16 bp, P. troglodytes
agtctcattctgtcac

SEQ ID NO: 207831 - DNA, 16 bp, P. troglodytes
agtctccaccccaaat

SEQ ID NO: 207832 - DNA, 16 bp, P. troglodytes
agtctccactggggca

SEQ ID NO: 207833 - DNA, 16 bp, P. troglodytes
agtctccagtgtctac

SEQ ID NO: 207834 - DNA, 16 bp, P. troglodytes
agtctcccagcaaaga

SEQ ID NO: 207835 - DNA, 16 bp, P. troglodytes
agtctcccatgtctac

SEQ ID NO: 207836 - DNA, 16 bp, P. troglodytes
agtctccctctgtcac

SEQ ID NO: 207837 - DNA, 16 bp, P. troglodytes
agtctccctctgttgc

SEQ ID NO: 207838 - DNA, 16 bp, P. troglodytes
agtctccctctttcac

SEQ ID NO: 207839 - DNA, 16 bp, P. troglodytes
agtctccctttcccca

SEQ ID NO: 207840 - DNA, 16 bp, P. troglodytes
agtctccctttccctg

SEQ ID NO: 207841 - DNA, 16 bp, P. troglodytes
agtctcctcatctgca

SEQ ID NO: 207842 - DNA, 16 bp, P. troglodytes
agtctcctgagtagtt

SEQ ID NO: 207843 - DNA, 19 bp, P. troglodytes
agtctcctgcctcagcctc

SEQ ID NO: 207844 - DNA, 16 bp, P. troglodytes
agtctcctttccttgg

SEQ ID NO: 207845 - DNA, 17 bp, P. troglodytes
agtctcgaccataagag

SEQ ID NO: 207846 - DNA, 16 bp, P. troglodytes
agtctctaaataaata

SEQ ID NO: 207847 - DNA, 16 bp, P. troglodytes
agtctctgagaatctt

SEQ ID NO: 207848 - DNA, 16 bp, P. troglodytes
agtctcttcagtaaat

SEQ ID NO: 207849 - DNA, 16 bp, P. troglodytes
agtctcttctaaaaat

SEQ ID NO: 207850 - DNA, 16 bp, P. troglodytes
agtctcttgtagacag

SEQ ID NO: 207851 - DNA, 16 bp, P. troglodytes
agtctctttgtaggtc

SEQ ID NO: 207852 - DNA, 16 bp, P. troglodytes
agtctgaaaaagaaat

SEQ ID NO: 207853 - DNA, 16 bp, P. troglodytes
agtctgaaaatattaa

SEQ ID NO: 207854 - DNA, 16 bp, P. troglodytes
agtctgaagatgtgac

SEQ ID NO: 207855 - DNA, 16 bp, P. troglodytes
agtctgaagtctcatc

SEQ ID NO: 207856 - DNA, 16 bp, P. troglodytes
agtctgaggcacgaga

SEQ ID NO: 207857 - DNA, 16 bp, P. troglodytes
agtctgaggcagaaga

SEQ ID NO: 207858 - DNA, 16 bp, P. troglodytes
agtctgagggaggagg

SEQ ID NO: 207859 - DNA, 16 bp, P. troglodytes
agtctgcagatgcaga

SEQ ID NO: 207860 - DNA, 16 bp, P. troglodytes
agtctgcttgctttct

SEQ ID NO: 207861 - DNA, 16 bp, P. troglodytes
agtctgcttttagctt

SEQ ID NO: 207862 - DNA, 17 bp, P. troglodytes
agtctggcagagacaca

SEQ ID NO: 207863 - DNA, 16 bp, P. troglodytes
agtctggccaacagag

SEQ ID NO: 207864 - DNA, 16 bp, P. troglodytes
agtctggccaacatgg

SEQ ID NO: 207865 - DNA, 16 bp, P. troglodytes
agtctggctccagggt

SEQ ID NO: 207866 - DNA, 16 bp, P. troglodytes
agtctgggagtttgag

SEQ ID NO: 207867 - DNA, 16 bp, P. troglodytes
agtctgggcaacggag

SEQ ID NO: 207868 - DNA, 16 bp, P. troglodytes
agtctggtctcaaact

SEQ ID NO: 207869 - DNA, 16 bp, P. troglodytes
agtctggttttgaact

SEQ ID NO: 207870 - DNA, 16 bp, P. troglodytes
agtctgtacatgttca

SEQ ID NO: 207871 - DNA, 16 bp, P. troglodytes
agtctgtatttttaaa

SEQ ID NO: 207872 - DNA, 16 bp, P. troglodytes
agtctgtcatccaggc

SEQ ID NO: 207873 - DNA, 16 bp, P. troglodytes
agtctgtctttctgtg

SEQ ID NO: 207874 - DNA, 16 bp, P. troglodytes
agtctgtttcttcatc

SEQ ID NO: 207875 - DNA, 30 bp, P. troglodytes
agtctgttttatcagagactaggattgcaa

SEQ ID NO: 207876 - DNA, 16 bp, P. troglodytes
agtctgttttctctga

SEQ ID NO: 207877 - DNA, 16 bp, P. troglodytes
agtctgttttgtcagt

SEQ ID NO: 207878 - DNA, 16 bp, P. troglodytes
agtcttaaaaaataaa

SEQ ID NO: 207879 - DNA, 16 bp, P. troglodytes
agtcttactctctcac

SEQ ID NO: 207880 - DNA, 16 bp, P. troglodytes
agtcttactctgttgc

SEQ ID NO: 207881 - DNA, 16 bp, P. troglodytes
agtcttagtctgtcac

SEQ ID NO: 207882 - DNA, 16 bp, P. troglodytes
agtcttcagtgtctat

SEQ ID NO: 207883 - DNA, 16 bp, P. troglodytes
agtcttcatagaattg

SEQ ID NO: 207884 - DNA, 16 bp, P. troglodytes
agtcttcatttctcct

SEQ ID NO: 207885 - DNA, 16 bp, P. troglodytes
agtcttctctttctct

SEQ ID NO: 207886 - DNA, 16 bp, P. troglodytes
agtcttctgcctcagc

SEQ ID NO: 207887 - DNA, 16 bp, P. troglodytes
agtcttctgtttcctt

SEQ ID NO: 207888 - DNA, 16 bp, P. troglodytes
agtcttgaattgccaa

SEQ ID NO: 207889 - DNA, 16 bp, P. troglodytes
agtcttgctctgcagc

SEQ ID NO: 207890 - DNA, 16 bp, P. troglodytes
agtcttgctctgttgt

SEQ ID NO: 207891 - DNA, 16 bp, P. troglodytes
agtcttgctgtgtcac

SEQ ID NO: 207892 - DNA, 16 bp, P. troglodytes
agtcttgcttgctctg

SEQ ID NO: 207893 - DNA, 17 bp, P. troglodytes
agtcttgggagtgtgta

SEQ ID NO: 207894 - DNA, 16 bp, P. troglodytes
agtcttgtggaactga

SEQ ID NO: 207895 - DNA, 16 bp, P. troglodytes
agtctttaacccattt

SEQ ID NO: 207896 - DNA, 16 bp, P. troglodytes
agtctttaatccagct

SEQ ID NO: 207897 - DNA, 16 bp, P. troglodytes
agtctttaattcactt

SEQ ID NO: 207898 - DNA, 16 bp, P. troglodytes
agtctttacaatttgg

SEQ ID NO: 207899 - DNA, 16 bp, P. troglodytes
agtctttcacctcctt

SEQ ID NO: 207900 - DNA, 16 bp, P. troglodytes
agtctttcaggagcag

SEQ ID NO: 207901 - DNA, 16 bp, P. troglodytes
agtctttcccatctca

SEQ ID NO: 207902 - DNA, 16 bp, P. troglodytes
agtctttgtgtgtgtg

SEQ ID NO: 207903 - DNA, 16 bp, P. troglodytes
agtcttttaaaaatgt

SEQ ID NO: 207904 - DNA, 16 bp, P. troglodytes
agtcttttaaaatatg

SEQ ID NO: 207905 - DNA, 16 bp, P. troglodytes
agtcttttcaacaaat

SEQ ID NO: 207906 - DNA, 16 bp, P. troglodytes
agtcttttcattttta

SEQ ID NO: 207907 - DNA, 16 bp, P. troglodytes
agtcttttctaattct

SEQ ID NO: 207908 - DNA, 16 bp, P. troglodytes
agtcttttgtgactgg

SEQ ID NO: 207909 - DNA, 16 bp, P. troglodytes
agtctttttcccattg

SEQ ID NO: 207910 - DNA, 16 bp, P. troglodytes
agtctttttgctaaag

SEQ ID NO: 207911 - DNA, 16 bp, P. troglodytes
agtgaaaaactgaatg

SEQ ID NO: 207912 - DNA, 16 bp, P. troglodytes
agtgaaaaattggaaa

SEQ ID NO: 207913 - DNA, 16 bp, P. troglodytes
agtgaaaagaacaaag

SEQ ID NO: 207914 - DNA, 16 bp, P. troglodytes
agtgaaaagacaactt

SEQ ID NO: 207915 - DNA, 16 bp, P. troglodytes
agtgaaaaggcaatct

SEQ ID NO: 207916 - DNA, 16 bp, P. troglodytes
agtgaaaatagtaatc

SEQ ID NO: 207917 - DNA, 16 bp, P. troglodytes
agtgaaacaccatctc

SEQ ID NO: 207918 - DNA, 16 bp, P. troglodytes
agtgaaacattttaaa

SEQ ID NO: 207919 - DNA, 26 bp, P. troglodytes
agtgaaaccccatctctactaaaaaa

SEQ ID NO: 207920 - DNA, 18 bp, P. troglodytes
agtgaaaccccatctctg

SEQ ID NO: 207921 - DNA, 17 bp, P. troglodytes
agtgaaaccccatgtct

SEQ ID NO: 207922 - DNA, 16 bp, P. troglodytes
agtgaaaccccatttc

SEQ ID NO: 207923 - DNA, 17 bp, P. troglodytes
agtgaaaccccgtctcc

SEQ ID NO: 207924 - DNA, 18 bp, P. troglodytes
agtgaaaccccgtctcta

SEQ ID NO: 207925 - DNA, 18 bp, P. troglodytes
agtgaaaccccgtctctg

SEQ ID NO: 207926 - DNA, 16 bp, P. troglodytes
agtgaaaccctatctc

SEQ ID NO: 207927 - DNA, 23 bp, P. troglodytes
agtgaaaccctgtctctaccaaa

SEQ ID NO: 207928 - DNA, 16 bp, P. troglodytes
agtgaaactccattta

SEQ ID NO: 207929 - DNA, 17 bp, P. troglodytes
agtgaaactccgtctct

SEQ ID NO: 207930 - DNA, 16 bp, P. troglodytes
agtgaaagaagaaagc

SEQ ID NO: 207931 - DNA, 16 bp, P. troglodytes
agtgaaagaagccaaa

SEQ ID NO: 207932 - DNA, 16 bp, P. troglodytes
agtgaaagaagccaca

SEQ ID NO: 207933 - DNA, 16 bp, P. troglodytes
agtgaaataacccaga

SEQ ID NO: 207934 - DNA, 16 bp, P. troglodytes
agtgaaataatccaga

SEQ ID NO: 207935 - DNA, 16 bp, P. troglodytes
agtgaaataattattt

SEQ ID NO: 207936 - DNA, 16 bp, P. troglodytes
agtgaaatcaaagaca

SEQ ID NO: 207937 - DNA, 16 bp, P. troglodytes
agtgaaatgagccagg

SEQ ID NO: 207938 - DNA, 16 bp, P. troglodytes
agtgaaatggcacgat

SEQ ID NO: 207939 - DNA, 16 bp, P. troglodytes
agtgaaatggcgcaat

SEQ ID NO: 207940 - DNA, 16 bp, P. troglodytes
agtgaaatttcatctc

SEQ ID NO: 207941 - DNA, 16 bp, P. troglodytes
agtgaacaaaacaaag

SEQ ID NO: 207942 - DNA, 16 bp, P. troglodytes
agtgaacacacaaatg

SEQ ID NO: 207943 - DNA, 16 bp, P. troglodytes
agtgaacagtcaacct

SEQ ID NO: 207944 - DNA, 16 bp, P. troglodytes
agtgaacatagtaccc

SEQ ID NO: 207945 - DNA, 16 bp, P. troglodytes
agtgaacatttattaa

SEQ ID NO: 207946 - DNA, 16 bp, P. troglodytes
agtgaaccctcatgta

SEQ ID NO: 207947 - DNA, 25 bp, P. troglodytes
agtgaactcccattcacaattgcta

SEQ ID NO: 207948 - DNA, 16 bp, P. troglodytes
agtgaactgtgattgt

SEQ ID NO: 207949 - DNA, 16 bp, P. troglodytes
agtgaacttgaagaca

SEQ ID NO: 207950 - DNA, 16 bp, P. troglodytes
agtgaagaaggcatgt

SEQ ID NO: 207951 - DNA, 16 bp, P. troglodytes
agtgaagatgagcatt

SEQ ID NO: 207952 - DNA, 16 bp, P. troglodytes
agtgaagcaggatatt

SEQ ID NO: 207953 - DNA, 16 bp, P. troglodytes
agtgaagccccatctc

SEQ ID NO: 207954 - DNA, 16 bp, P. troglodytes
agtgaagccctgtctc

SEQ ID NO: 207955 - DNA, 16 bp, P. troglodytes
agtgaagctgcagact

SEQ ID NO: 207956 - DNA, 18 bp, P. troglodytes
agtgaagctgcagatctt

SEQ ID NO: 207957 - DNA, 16 bp, P. troglodytes
agtgaaggaagtaact

SEQ ID NO: 207958 - DNA, 16 bp, P. troglodytes
agtgaaggagaaatac

SEQ ID NO: 207959 - DNA, 16 bp, P. troglodytes
agtgaaggagacagag

SEQ ID NO: 207960 - DNA, 16 bp, P. troglodytes
agtgaaggaggaactt

SEQ ID NO: 207961 - DNA, 16 bp, P. troglodytes
agtgaagtaactcaga

SEQ ID NO: 207962 - DNA, 16 bp, P. troglodytes
agtgaagtggactctg

SEQ ID NO: 207963 - DNA, 16 bp, P. troglodytes
agtgaagtggcataat

SEQ ID NO: 207964 - DNA, 16 bp, P. troglodytes
agtgaagtggtgtgat

SEQ ID NO: 207965 - DNA, 16 bp, P. troglodytes
agtgaatcagaaactc

SEQ ID NO: 207966 - DNA, 16 bp, P. troglodytes
agtgaatccagcagca

SEQ ID NO: 207967 - DNA, 16 bp, P. troglodytes
agtgaatctgcatttt

SEQ ID NO: 207968 - DNA, 16 bp, P. troglodytes
agtgaatgggaaggcc

SEQ ID NO: 207969 - DNA, 17 bp, P. troglodytes
agtgaatggttctgtct

SEQ ID NO: 207970 - DNA, 16 bp, P. troglodytes
agtgaatgtgaaggtc

SEQ ID NO: 207971 - DNA, 16 bp, P. troglodytes
agtgaatgtgtctttt

SEQ ID NO: 207972 - DNA, 16 bp, P. troglodytes
agtgacacaatcttgg

SEQ ID NO: 207973 - DNA, 16 bp, P. troglodytes
agtgacaccatcttgg

SEQ ID NO: 207974 - DNA, 16 bp, P. troglodytes
agtgacaccctgtttc

SEQ ID NO: 207975 - DNA, 16 bp, P. troglodytes
agtgacactctgtctc

SEQ ID NO: 207976 - DNA, 16 bp, P. troglodytes
agtgacactggtctgt

SEQ ID NO: 207977 - DNA, 16 bp, P. troglodytes
agtgacagaaagcaaa

SEQ ID NO: 207978 - DNA, 16 bp, P. troglodytes
agtgacagagaccctg

SEQ ID NO: 207979 - DNA, 16 bp, P. troglodytes
agtgacagagggagac

SEQ ID NO: 207980 - DNA, 16 bp, P. troglodytes
agtgacagatcatcag

SEQ ID NO: 207981 - DNA, 16 bp, P. troglodytes
agtgacagtgagaccc

SEQ ID NO: 207982 - DNA, 16 bp, P. troglodytes
agtgacatctcattgt

SEQ ID NO: 207983 - DNA, 16 bp, P. troglodytes
agtgaccaaaacagca

SEQ ID NO: 207984 - DNA, 16 bp, P. troglodytes
agtgaccaagcagaga

SEQ ID NO: 207985 - DNA, 16 bp, P. troglodytes
agtgacccacccacct

SEQ ID NO: 207986 - DNA, 18 bp, P. troglodytes
agtgacctgatggagctg

SEQ ID NO: 207987 - DNA, 16 bp, P. troglodytes
agtgaccttgggcaag

SEQ ID NO: 207988 - DNA, 16 bp, P. troglodytes
agtgaccttttttttt

SEQ ID NO: 207989 - DNA, 16 bp, P. troglodytes
agtgacggggaaaatg

SEQ ID NO: 207990 - DNA, 16 bp, P. troglodytes
agtgactccattttga

SEQ ID NO: 207991 - DNA, 16 bp, P. troglodytes
agtgactctgaagaag

SEQ ID NO: 207992 - DNA, 16 bp, P. troglodytes
agtgactgcttaatgg

SEQ ID NO: 207993 - DNA, 16 bp, P. troglodytes
agtgactggcacacag

SEQ ID NO: 207994 - DNA, 16 bp, P. troglodytes
agtgacttaacctctc

SEQ ID NO: 207995 - DNA, 16 bp, P. troglodytes
agtgacttacccaagg

SEQ ID NO: 207996 - DNA, 16 bp, P. troglodytes
agtgacttgaccaagg

SEQ ID NO: 207997 - DNA, 16 bp, P. troglodytes
agtgacttggccaagg

SEQ ID NO: 207998 - DNA, 16 bp, P. troglodytes
agtgacttgtccaagg

SEQ ID NO: 207999 - DNA, 16 bp, P. troglodytes
agtgacttttaaaaat

SEQ ID NO: 208000 - DNA, 16 bp, P. troglodytes
agtgagaaaactgaag

SEQ ID NO: 208001 - DNA, 16 bp, P. troglodytes
agtgagaaataaattt

SEQ ID NO: 208002 - DNA, 16 bp, P. troglodytes
agtgagaacatggggt

SEQ ID NO: 208003 - DNA, 16 bp, P. troglodytes
agtgagaacatgtaat

SEQ ID NO: 208004 - DNA, 16 bp, P. troglodytes
agtgagaacatgtcat

SEQ ID NO: 208005 - DNA, 16 bp, P. troglodytes
agtgagaacatgtggt

SEQ ID NO: 208006 - DNA, 16 bp, P. troglodytes
agtgagaactcactca

SEQ ID NO: 208007 - DNA, 16 bp, P. troglodytes
agtgagaagacaagat

SEQ ID NO: 208008 - DNA, 16 bp, P. troglodytes
agtgagaagatgcagt

SEQ ID NO: 208009 - DNA, 16 bp, P. troglodytes
agtgagaatgtaaaat

SEQ ID NO: 208010 - DNA, 16 bp, P. troglodytes
agtgagacaccatctc

SEQ ID NO: 208011 - DNA, 16 bp, P. troglodytes
agtgagacactgtctc

SEQ ID NO: 208012 - DNA, 16 bp, P. troglodytes
agtgagacatcgtctc

SEQ ID NO: 208013 - DNA, 16 bp, P. troglodytes
agtgagaccacatctc

SEQ ID NO: 208014 - DNA, 16 bp, P. troglodytes
agtgagaccagccttt

SEQ ID NO: 208015 - DNA, 16 bp, P. troglodytes
agtgagaccatgtctc

SEQ ID NO: 208016 - DNA, 16 bp, P. troglodytes
agtgagaccatgtttc

SEQ ID NO: 208017 - DNA, 16 bp, P. troglodytes
agtgagaccccatctt

SEQ ID NO: 208018 - DNA, 16 bp, P. troglodytes
agtgagaccccatttc

SEQ ID NO: 208019 - DNA, 16 bp, P. troglodytes
agtgagaccctgactc

SEQ ID NO: 208020 - DNA, 16 bp, P. troglodytes
agtgagaccctgcctc

SEQ ID NO: 208021 - DNA, 16 bp, P. troglodytes
agtgagaccctgtcac

SEQ ID NO: 208022 - DNA, 16 bp, P. troglodytes
agtgagaccctgtcta

SEQ ID NO: 208023 - DNA, 16 bp, P. troglodytes
agtgagaccctgtctc

SEQ ID NO: 208024 - DNA, 16 bp, P. troglodytes
agtgagaccctgtctg

SEQ ID NO: 208025 - DNA, 16 bp, P. troglodytes
agtgagaccctgtctt

SEQ ID NO: 208026 - DNA, 16 bp, P. troglodytes
agtgagaccctgtttc

SEQ ID NO: 208027 - DNA, 16 bp, P. troglodytes
agtgagaccgtgtctc

SEQ ID NO: 208028 - DNA, 16 bp, P. troglodytes
agtgagaccttatctc

SEQ ID NO: 208029 - DNA, 16 bp, P. troglodytes
agtgagaccttgtctc

SEQ ID NO: 208030 - DNA, 16 bp, P. troglodytes
agtgagaccttgtctt

SEQ ID NO: 208031 - DNA, 16 bp, P. troglodytes
agtgagacgctgtctc

SEQ ID NO: 208032 - DNA, 16 bp, P. troglodytes
agtgagactcagtctc

SEQ ID NO: 208033 - DNA, 16 bp, P. troglodytes
agtgagactctatctc

SEQ ID NO: 208034 - DNA, 16 bp, P. troglodytes
agtgagactctgcctc

SEQ ID NO: 208035 - DNA, 16 bp, P. troglodytes
agtgagactctgtctc

SEQ ID NO: 208036 - DNA, 16 bp, P. troglodytes
agtgagactctgtctg

SEQ ID NO: 208037 - DNA, 16 bp, P. troglodytes
agtgagactctgtctt

SEQ ID NO: 208038 - DNA, 17 bp, P. troglodytes
agtgagactgtctcaaa

SEQ ID NO: 208039 - DNA, 16 bp, P. troglodytes
agtgagacttcatctc

SEQ ID NO: 208040 - DNA, 16 bp, P. troglodytes
agtgagacttcatttc

SEQ ID NO: 208041 - DNA, 16 bp, P. troglodytes
agtgagactttgcctc

SEQ ID NO: 208042 - DNA, 16 bp, P. troglodytes
agtgagactttgtctc

SEQ ID NO: 208043 - DNA, 16 bp, P. troglodytes
agtgagagactgtctc

SEQ ID NO: 208044 - DNA, 16 bp, P. troglodytes
agtgagagaggaagca

SEQ ID NO: 208045 - DNA, 16 bp, P. troglodytes
agtgagagatgtgcaa

SEQ ID NO: 208046 - DNA, 16 bp, P. troglodytes
agtgagagcctgtctc

SEQ ID NO: 208047 - DNA, 16 bp, P. troglodytes
agtgagagctgaatga

SEQ ID NO: 208048 - DNA, 16 bp, P. troglodytes
agtgagagtgagagag

SEQ ID NO: 208049 - DNA, 16 bp, P. troglodytes
agtgagagtgtgtgtg

SEQ ID NO: 208050 - DNA, 16 bp, P. troglodytes
agtgagatcccatctc

SEQ ID NO: 208051 - DNA, 16 bp, P. troglodytes
agtgagatcccttctc

SEQ ID NO: 208052 - DNA, 16 bp, P. troglodytes
agtgagatcctatctc

SEQ ID NO: 208053 - DNA, 16 bp, P. troglodytes
agtgagatcctgtctc

SEQ ID NO: 208054 - DNA, 16 bp, P. troglodytes
agtgagatctcatctc

SEQ ID NO: 208055 - DNA, 22 bp, P. troglodytes
agtgagatgaacccggtacctc

SEQ ID NO: 208056 - DNA, 16 bp, P. troglodytes
agtgagattctgtctc

SEQ ID NO: 208057 - DNA, 16 bp, P. troglodytes
agtgagatttaaaaaa

SEQ ID NO: 208058 - DNA, 16 bp, P. troglodytes
agtgagcacgtgctgt

SEQ ID NO: 208059 - DNA, 16 bp, P. troglodytes
agtgagccaaaattgt

SEQ ID NO: 208060 - DNA, 17 bp, P. troglodytes
agtgagccaagactgca

SEQ ID NO: 208061 - DNA, 16 bp, P. troglodytes
agtgagccaagatttg

SEQ ID NO: 208062 - DNA, 16 bp, P. troglodytes
agtgagccatgactgt

SEQ ID NO: 208063 - DNA, 31 bp, P. troglodytes; identical to SEQ ID NO: 43544

SEQ ID NO: 208064 - DNA, 16 bp, P. troglodytes
agtgagccatgatctc

SEQ ID NO: 208065 - DNA, 16 bp, P. troglodytes
agtgagctatgatcgt

SEQ ID NO: 208066 - DNA, 16 bp, P. troglodytes
agtgagctatgattgt

SEQ ID NO: 208067 - DNA, 16 bp, P. troglodytes
agtgagctattatcat

SEQ ID NO: 208068 - DNA, 16 bp, P. troglodytes
agtgagctgtgattgc

SEQ ID NO: 208069 - DNA, 16 bp, P. troglodytes
agtgagctgtgggaca

SEQ ID NO: 208070 - DNA, 16 bp, P. troglodytes
agtgaggaaggtatgt

SEQ ID NO: 208071 - DNA, 16 bp, P. troglodytes
agtgaggacactgagg

SEQ ID NO: 208072 - DNA, 16 bp, P. troglodytes
agtgaggatgtggaga

SEQ ID NO: 208073 - DNA, 16 bp, P. troglodytes
agtgaggcaagattgc

SEQ ID NO: 208074 - DNA, 16 bp, P. troglodytes
agtgaggccttgtctc

SEQ ID NO: 208075 - DNA, 16 bp, P. troglodytes
agtgagggctctgagg

SEQ ID NO: 208076 - DNA, 16 bp, P. troglodytes
agtgaggtgagatcgc

SEQ ID NO: 208077 - DNA, 16 bp, P. troglodytes
agtgagtctccatctc

SEQ ID NO: 208078 - DNA, 16 bp, P. troglodytes
agtgagtgaattcttg

SEQ ID NO: 208079 - DNA, 16 bp, P. troglodytes
agtgagtgaattttca

SEQ ID NO: 208080 - DNA, 16 bp, P. troglodytes
agtgagtgagtgagtg

SEQ ID NO: 208081 - DNA, 16 bp, P. troglodytes
agtgagtgagttctaa

SEQ ID NO: 208082 - DNA, 16 bp, P. troglodytes
agtgagtgagttcttg

SEQ ID NO: 208083 - DNA, 16 bp, P. troglodytes
agtgagtggagattgc

SEQ ID NO: 208084 - DNA, 16 bp, P. troglodytes
agtgagttcttgctct

SEQ ID NO: 208085 - DNA, 16 bp, P. troglodytes
agtgagtttcttagtc

SEQ ID NO: 208086 - DNA, 16 bp, P. troglodytes
agtgagtttttaaaaa

SEQ ID NO: 208087 - DNA, 16 bp, P. troglodytes
agtgatcatttaaaaa

SEQ ID NO: 208088 - DNA, 16 bp, P. troglodytes
agtgatccacttgctt

SEQ ID NO: 208089 - DNA, 18 bp, P. troglodytes
agtgatccgcctgcctca

SEQ ID NO: 208090 - DNA, 18 bp, P. troglodytes
agtgatccgcctgcctcg

SEQ ID NO: 208091 - DNA, 16 bp, P. troglodytes
agtgatcctccaactt

SEQ ID NO: 208092 - DNA, 18 bp, P. troglodytes
agtgatcctcccgcctcg

SEQ ID NO: 208093 - DNA, 16 bp, P. troglodytes
agtgatcctcctgtct

SEQ ID NO: 208094 - DNA, 16 bp, P. troglodytes
agtgatcctccttcct

SEQ ID NO: 208095 - DNA, 16 bp, P. troglodytes
agtgatcctctcacct

SEQ ID NO: 208096 - DNA, 16 bp, P. troglodytes
agtgatcctctcatct

SEQ ID NO: 208097 - DNA, 16 bp, P. troglodytes
agtgatcgacctgcct

SEQ ID NO: 208098 - DNA, 16 bp, P. troglodytes
agtgatctacccacct

SEQ ID NO: 208099 - DNA, 19 bp, P. troglodytes
agtgatctgcccgccttgg

SEQ ID NO: 208100 - DNA, 16 bp, P. troglodytes
agtgatcttccagcct

SEQ ID NO: 208101 - DNA, 16 bp, P. troglodytes
agtgatctttttaaaa

SEQ ID NO: 208102 - DNA, 16 bp, P. troglodytes
agtgatgagattgctg

SEQ ID NO: 208103 - DNA, 16 bp, P. troglodytes
agtgatgatgaggttt

SEQ ID NO: 208104 - DNA, 16 bp, P. troglodytes
agtgatgatggtggtg

SEQ ID NO: 208105 - DNA, 16 bp, P. troglodytes
agtgatgcaataaaca

SEQ ID NO: 208106 - DNA, 16 bp, P. troglodytes
agtgatgcagtcttgg

SEQ ID NO: 208107 - DNA, 16 bp, P. troglodytes
agtgatgctcctgcct

SEQ ID NO: 208108 - DNA, 16 bp, P. troglodytes
agtgatgctgggaaaa

SEQ ID NO: 208109 - DNA, 16 bp, P. troglodytes
agtgatggaagacaaa

SEQ ID NO: 208110 - DNA, 16 bp, P. troglodytes
agtgatggagaaataa

SEQ ID NO: 208111 - DNA, 16 bp, P. troglodytes
agtgatgtctcctctt

SEQ ID NO: 208112 - DNA, 16 bp, P. troglodytes
agtgatgtggccacaa

SEQ ID NO: 208113 - DNA, 16 bp, P. troglodytes
agtgatgttttaaaaa

SEQ ID NO: 208114 - DNA, 16 bp, P. troglodytes
agtgatttctctgatg

SEQ ID NO: 208115 - DNA, 16 bp, P. troglodytes
agtgatttgtagattt

SEQ ID NO: 208116 - DNA, 16 bp, P. troglodytes
agtgatttgtagtttt

SEQ ID NO: 208117 - DNA, 16 bp, P. troglodytes
agtgatttttaaaaat

SEQ ID NO: 208118 - DNA, 16 bp, P. troglodytes
agtgatttttaaatat

SEQ ID NO: 208119 - DNA, 16 bp, P. troglodytes
agtgatttttgatgtt

SEQ ID NO: 208120 - DNA, 16 bp, P. troglodytes
agtgcaaaggcatgat

SEQ ID NO: 208121 - DNA, 16 bp, P. troglodytes
agtgcaagaccagcct

SEQ ID NO: 208122 - DNA, 16 bp, P. troglodytes
agtgcaatgatgcagt

SEQ ID NO: 208123 - DNA, 16 bp, P. troglodytes
agtgcaatggcacggt

SEQ ID NO: 208124 - DNA, 17 bp, P. troglodytes
agtgcaatggcatgatc

SEQ ID NO: 208125 - DNA, 18 bp, P. troglodytes
agtgcaatggtgcgatct

SEQ ID NO: 208126 - DNA, 18 bp, P. troglodytes
agtgcaatggtgtgatct

SEQ ID NO: 208127 - DNA, 16 bp, P. troglodytes
agtgcacaaatcttaa

SEQ ID NO: 208128 - DNA, 16 bp, P. troglodytes
agtgcacaacctagat

SEQ ID NO: 208129 - DNA, 16 bp, P. troglodytes
agtgcacctgtaatcc

SEQ ID NO: 208130 - DNA, 16 bp, P. troglodytes
agtgcagagaagaaaa

SEQ ID NO: 208131 - DNA, 16 bp, P. troglodytes
agtgcagatatctctt

SEQ ID NO: 208132 - DNA, 16 bp, P. troglodytes
agtgcagattgcccct

SEQ ID NO: 208133 - DNA, 16 bp, P. troglodytes
agtgcagccaccttca

SEQ ID NO: 208134 - DNA, 16 bp, P. troglodytes
agtgcagccactgtgg

SEQ ID NO: 208135 - DNA, 16 bp, P. troglodytes
agtgcagccttgaact

SEQ ID NO: 208136 - DNA, 18 bp, P. troglodytes
agtgcagtcgtgcgatct

SEQ ID NO: 208137 - DNA, 19 bp, P. troglodytes
agtgcagtgccgcgatctc

SEQ ID NO: 208138 - DNA, 19 bp, P. troglodytes
agtgcagtggcatgatcac

SEQ ID NO: 208139 - DNA, 16 bp, P. troglodytes
agtgcagtggcccaac

SEQ ID NO: 208140 - DNA, 16 bp, P. troglodytes
agtgcagtggcccaat

SEQ ID NO: 208141 - DNA, 19 bp, P. troglodytes
agtgcagtggcgtgatctc

SEQ ID NO: 208142 - DNA, 20 bp, P. troglodytes
agtgcagtggctcacaccta

SEQ ID NO: 208143 - DNA, 16 bp, P. troglodytes
agtgcagtggctggag

SEQ ID NO: 208144 - DNA, 19 bp, P. troglodytes
agtgcagtggtacgatctc

SEQ ID NO: 208145 - DNA, 16 bp, P. troglodytes
agtgcagtggtgagat

SEQ ID NO: 208146 - DNA, 16 bp, P. troglodytes
agtgcagtggtgcaat

SEQ ID NO: 208147 - DNA, 16 bp, P. troglodytes
agtgcagtggtgccat

SEQ ID NO: 208148 - DNA, 16 bp, P. troglodytes
agtgcagtggtgtcac

SEQ ID NO: 208149 - DNA, 18 bp, P. troglodytes
agtgcagtggtgtgatct

SEQ ID NO: 208150 - DNA, 16 bp, P. troglodytes
agtgcatgaaaagatg

SEQ ID NO: 208151 - DNA, 16 bp, P. troglodytes
agtgccaagcaaaagg

SEQ ID NO: 208152 - DNA, 16 bp, P. troglodytes
agtgccaaggctgaga

SEQ ID NO: 208153 - DNA, 16 bp, P. troglodytes
agtgccacaataaata

SEQ ID NO: 208154 - DNA, 17 bp, P. troglodytes
agtgccaccacgcctgg

SEQ ID NO: 208155 - DNA, 16 bp, P. troglodytes
agtgccagctcagcca

SEQ ID NO: 208156 - DNA, 16 bp, P. troglodytes
agtgccatcatggctc

SEQ ID NO: 208157 - DNA, 16 bp, P. troglodytes
agtgccatttgttgaa

SEQ ID NO: 208158 - DNA, 16 bp, P. troglodytes
agtgcccagatatttg

SEQ ID NO: 208159 - DNA, 17 bp, P. troglodytes
agtgccccactcctggt

SEQ ID NO: 208160 - DNA, 16 bp, P. troglodytes
agtgccctgcatccca

SEQ ID NO: 208161 - DNA, 17 bp, P. troglodytes
agtgcctacagggctct

SEQ ID NO: 208162 - DNA, 16 bp, P. troglodytes
agtgcctactctgtgc

SEQ ID NO: 208163 - DNA, 16 bp, P. troglodytes
agtgcctactgtatgc

SEQ ID NO: 208164 - DNA, 19 bp, P. troglodytes
agtgcctcacacctgtaat

SEQ ID NO: 208165 - DNA, 16 bp, P. troglodytes
agtgcctcagtgggga

SEQ ID NO: 208166 - DNA, 19 bp, P. troglodytes
agtgcctcatgcctgtaat

SEQ ID NO: 208167 - DNA, 16 bp, P. troglodytes
agtgcctgcaccattt

SEQ ID NO: 208168 - DNA, 16 bp, P. troglodytes
agtgcctggaacagtg

SEQ ID NO: 208169 - DNA, 16 bp, P. troglodytes
agtgcctggcacacaa

SEQ ID NO: 208170 - DNA, 16 bp, P. troglodytes
agtgcctggcacagag

SEQ ID NO: 208171 - DNA, 16 bp, P. troglodytes
agtgcctggcacagtg

SEQ ID NO: 208172 - DNA, 16 bp, P. troglodytes
agtgcctggcccagag

SEQ ID NO: 208173 - DNA, 16 bp, P. troglodytes
agtgcctggctaattt

SEQ ID NO: 208174 - DNA, 16 bp, P. troglodytes
agtgcctggctcatgg

SEQ ID NO: 208175 - DNA, 16 bp, P. troglodytes
agtgcctggtacatag

SEQ ID NO: 208176 - DNA, 16 bp, P. troglodytes
agtgcctggtacatgg

SEQ ID NO: 208177 - DNA, 16 bp, P. troglodytes
agtgccttttgcctcc

SEQ ID NO: 208178 - DNA, 16 bp, P. troglodytes
agtgcgactccatctc

SEQ ID NO: 208179 - DNA, 17 bp, P. troglodytes
agtgcgagactccatct

SEQ ID NO: 208180 - DNA, 19 bp, P. troglodytes
agtgcggtggcgcgatctc

SEQ ID NO: 208181 - DNA, 16 bp, P. troglodytes
agtgcggtggtgcgat

SEQ ID NO: 208182 - DNA, 18 bp, P. troglodytes
agtgcggtggtgtgatct

SEQ ID NO: 208183 - DNA, 16 bp, P. troglodytes
agtgctaagattacaa

SEQ ID NO: 208184 - DNA, 16 bp, P. troglodytes
agtgctaggcacatag

SEQ ID NO: 208185 - DNA, 16 bp, P. troglodytes
agtgctcaataaatat

SEQ ID NO: 208186 - DNA, 16 bp, P. troglodytes
agtgctccaaggaggt

SEQ ID NO: 208187 - DNA, 16 bp, P. troglodytes
agtgctccaatgaaca

SEQ ID NO: 208188 - DNA, 16 bp, P. troglodytes
agtgctctgtaaatgt

SEQ ID NO: 208189 - DNA, 17 bp, P. troglodytes
agtgctgagattacaga

SEQ ID NO: 208190 - DNA, 16 bp, P. troglodytes
agtgctgcaataaaca

SEQ ID NO: 208191 - DNA, 16 bp, P. troglodytes
agtgctgcaatgaaca

SEQ ID NO: 208192 - DNA, 16 bp, P. troglodytes
agtgctgcagtgaaca

SEQ ID NO: 208193 - DNA, 16 bp, P. troglodytes
agtgctgctatgaata

SEQ ID NO: 208194 - DNA, 16 bp, P. troglodytes
agtgctgctgctgctg

SEQ ID NO: 208195 - DNA, 16 bp, P. troglodytes
agtgctggaattccag

SEQ ID NO: 208196 - DNA, 16 bp, P. troglodytes
agtgctggaattgcag

SEQ ID NO: 208197 - DNA, 16 bp, P. troglodytes
agtgctggcattgcag

SEQ ID NO: 208198 - DNA, 16 bp, P. troglodytes
agtgctgggaagggaa

SEQ ID NO: 208199 - DNA, 16 bp, P. troglodytes
agtgctgggtagagga

SEQ ID NO: 208200 - DNA, 66 bp, P. troglodytes
agtgctgtgcttttagatatgcatacacataaacatctcaatgctttacaaagcagtattgctgcc

SEQ ID NO: 208201 - DNA, 16 bp, P. troglodytes
agtgcttattatgtgc

SEQ ID NO: 208202 - DNA, 16 bp, P. troglodytes
agtgcttggcacatag

SEQ ID NO: 208203 - DNA, 16 bp, P. troglodytes
agtgcttggcatacag

SEQ ID NO: 208204 - DNA, 16 bp, P. troglodytes
agtgctttaaaaaatt

SEQ ID NO: 208205 - DNA, 16 bp, P. troglodytes
agtgctttataaatat

SEQ ID NO: 208206 - DNA, 16 bp, P. troglodytes
agtgctttggaaggct

SEQ ID NO: 208207 - DNA, 16 bp, P. troglodytes
agtgctttgggaagct

SEQ ID NO: 208208 - DNA, 16 bp, P. troglodytes
agtggaaaaattgtct

SEQ ID NO: 208209 - DNA, 16 bp, P. troglodytes
agtggaaaatttcaca

SEQ ID NO: 208210 - DNA, 16 bp, P. troglodytes
agtggaaatccctgat

SEQ ID NO: 208211 - DNA, 16 bp, P. troglodytes
agtggaagaagccaga

SEQ ID NO: 208212 - DNA, 16 bp, P. troglodytes
agtggaagacagtgat

SEQ ID NO: 208213 - DNA, 16 bp, P. troglodytes
agtggaatcatataat

SEQ ID NO: 208214 - DNA, 16 bp, P. troglodytes
agtggaatcatgtagt

SEQ ID NO: 208215 - DNA, 16 bp, P. troglodytes
agtggaattactaggt

SEQ ID NO: 208216 - DNA, 16 bp, P. troglodytes
agtggagaaacctggc

SEQ ID NO: 208217 - DNA, 16 bp, P. troglodytes
agtggagaaagggcag

SEQ ID NO: 208218 - DNA, 16 bp, P. troglodytes
agtggagagagacaga

SEQ ID NO: 208219 - DNA, 16 bp, P. troglodytes
agtggagctctgagaa

SEQ ID NO: 208220 - DNA, 16 bp, P. troglodytes
agtggagctgtcagaa

SEQ ID NO: 208221 - DNA, 16 bp, P. troglodytes
agtggaggctgcaatg

SEQ ID NO: 208222 - DNA, 16 bp, P. troglodytes
agtggagtggagtgga

SEQ ID NO: 208223 - DNA, 16 bp, P. troglodytes
agtggagttttccaga

SEQ ID NO: 208224 - DNA, 16 bp, P. troglodytes
agtggatagaaaatta

SEQ ID NO: 208225 - DNA, 16 bp, P. troglodytes
agtggatcacgaagtc

SEQ ID NO: 208226 - DNA, 16 bp, P. troglodytes
agtggatcccacactg

SEQ ID NO: 208227 - DNA, 16 bp, P. troglodytes
agtggatctcatgaag

SEQ ID NO: 208228 - DNA, 16 bp, P. troglodytes
agtggatgcctgaaac

SEQ ID NO: 208229 - DNA, 16 bp, P. troglodytes
agtggatggcaaagtg

SEQ ID NO: 208230 - DNA, 16 bp, P. troglodytes
agtggatgtggagaaa

SEQ ID NO: 208231 - DNA, 16 bp, P. troglodytes
agtggattacctgagg

SEQ ID NO: 208232 - DNA, 16 bp, P. troglodytes
agtggattcaaagatt

SEQ ID NO: 208233 - DNA, 16 bp, P. troglodytes
agtggatttttgtata

SEQ ID NO: 208234 - DNA, 16 bp, P. troglodytes
agtggcacaaacttgg

SEQ ID NO: 208235 - DNA, 16 bp, P. troglodytes
agtggcacacgcctat

SEQ ID NO: 208236 - DNA, 16 bp, P. troglodytes
agtggcacagccagga

SEQ ID NO: 208237 - DNA, 16 bp, P. troglodytes
agtggcaccatcaggg

SEQ ID NO: 208238 - DNA, 16 bp, P. troglodytes
agtggcaccatctcca

SEQ ID NO: 208239 - DNA, 16 bp, P. troglodytes
agtggcacgcacctgt

SEQ ID NO: 208240 - DNA, 16 bp, P. troglodytes
agtggcagaactggga

SEQ ID NO: 208241 - DNA, 16 bp, P. troglodytes
agtggcagaatcagaa

SEQ ID NO: 208242 - DNA, 16 bp, P. troglodytes
agtggcagagcaagac

SEQ ID NO: 208243 - DNA, 16 bp, P. troglodytes
agtggcagagccagca

SEQ ID NO: 208244 - DNA, 16 bp, P. troglodytes
agtggcagagccagga

SEQ ID NO: 208245 - DNA, 16 bp, P. troglodytes
agtggcagagctagga

SEQ ID NO: 208246 - DNA, 16 bp, P. troglodytes
agtggcagatctggga

SEQ ID NO: 208247 - DNA, 16 bp, P. troglodytes
agtggcaggatctctg

SEQ ID NO: 208248 - DNA, 16 bp, P. troglodytes
agtggcaggctgaagg

SEQ ID NO: 208249 - DNA, 16 bp, P. troglodytes
agtggcagggctgggg

SEQ ID NO: 208250 - DNA, 16 bp, P. troglodytes
agtggcagtgagctga

SEQ ID NO: 208251 - DNA, 16 bp, P. troglodytes
agtggcagtggcagag

SEQ ID NO: 208252 - DNA, 16 bp, P. troglodytes
agtggcataaaacaat

SEQ ID NO: 208253 - DNA, 16 bp, P. troglodytes
agtggcatgaccacag

SEQ ID NO: 208254 - DNA, 16 bp, P. troglodytes
agtggcatgattacag

SEQ ID NO: 208255 - DNA, 16 bp, P. troglodytes
agtggcatgatttcag

SEQ ID NO: 208256 - DNA, 16 bp, P. troglodytes
agtggcctgatcatgg

SEQ ID NO: 208257 - DNA, 16 bp, P. troglodytes
agtggcgccatctggg

SEQ ID NO: 208258 - DNA, 16 bp, P. troglodytes
agtggctaaaattaaa

SEQ ID NO: 208259 - DNA, 16 bp, P. troglodytes
agtggctaccatattg

SEQ ID NO: 208260 - DNA, 19 bp, P. troglodytes
agtggctcacacctgtaat

SEQ ID NO: 208261 - DNA, 19 bp, P. troglodytes
agtggctcacacttgtaat

SEQ ID NO: 208262 - DNA, 16 bp, P. troglodytes
agtggctcacgcttgt

SEQ ID NO: 208263 - DNA, 19 bp, P. troglodytes
agtggctcatgcctgtaat

SEQ ID NO: 208264 - DNA, 16 bp, P. troglodytes
agtggctcccagcact

SEQ ID NO: 208265 - DNA, 16 bp, P. troglodytes
agtggctgcaccactt

SEQ ID NO: 208266 - DNA, 16 bp, P. troglodytes
agtggctgctctgctg

SEQ ID NO: 208267 - DNA, 16 bp, P. troglodytes
agtggctggatctcag

SEQ ID NO: 208268 - DNA, 16 bp, P. troglodytes
agtggctgggatgaca

SEQ ID NO: 208269 - DNA, 16 bp, P. troglodytes
agtggctggtgcctgt

SEQ ID NO: 208270 - DNA, 16 bp, P. troglodytes
agtggcttaaaatgac

SEQ ID NO: 208271 - DNA, 16 bp, P. troglodytes
agtggcttaaagcaac

SEQ ID NO: 208272 - DNA, 16 bp, P. troglodytes
agtggcttaaataata

SEQ ID NO: 208273 - DNA, 16 bp, P. troglodytes
agtggcttagctgggt

SEQ ID NO: 208274 - DNA, 16 bp, P. troglodytes
agtgggaagactgctt

SEQ ID NO: 208275 - DNA, 16 bp, P. troglodytes
agtgggaaggggagct

SEQ ID NO: 208276 - DNA, 16 bp, P. troglodytes
agtgggaccctgtctc

SEQ ID NO: 208277 - DNA, 16 bp, P. troglodytes
agtgggactctgtctc

SEQ ID NO: 208278 - DNA, 16 bp, P. troglodytes
agtgggactgctggat

SEQ ID NO: 208279 - DNA, 16 bp, P. troglodytes
agtgggagtgtaaatt

SEQ ID NO: 208280 - DNA, 16 bp, P. troglodytes
agtgggatcctctaga

SEQ ID NO: 208281 - DNA, 16 bp, P. troglodytes
agtgggattacaggtg

SEQ ID NO: 208282 - DNA, 16 bp, P. troglodytes
agtgggattgctggat

SEQ ID NO: 208283 - DNA, 16 bp, P. troglodytes
agtgggattgctggct

SEQ ID NO: 208284 - DNA, 16 bp, P. troglodytes
agtgggcaaaggagat

SEQ ID NO: 208285 - DNA, 16 bp, P. troglodytes
agtgggcacaggccag

SEQ ID NO: 208286 - DNA, 16 bp, P. troglodytes
agtgggctcctctctg

SEQ ID NO: 208287 - DNA, 16 bp, P. troglodytes
agtgggctgggcgcag

SEQ ID NO: 208288 - DNA, 16 bp, P. troglodytes
agtgggctgggtgcag

SEQ ID NO: 208289 - DNA, 16 bp, P. troglodytes
agtgggctgggtgtgg

SEQ ID NO: 208290 - DNA, 16 bp, P. troglodytes
agtggggacacagcca

SEQ ID NO: 208291 - DNA, 16 bp, P. troglodytes
agtggggagacagaca

SEQ ID NO: 208292 - DNA, 16 bp, P. troglodytes
agtggggaggctgagg

SEQ ID NO: 208293 - DNA, 16 bp, P. troglodytes
agtggggtactgctat

SEQ ID NO: 208294 - DNA, 16 bp, P. troglodytes
agtgggtatccttgtc

SEQ ID NO: 208295 - DNA, 16 bp, P. troglodytes
agtgggtgcctgtagt

SEQ ID NO: 208296 - DNA, 16 bp, P. troglodytes
agtggtatcttattgt

SEQ ID NO: 208297 - DNA, 16 bp, P. troglodytes
agtggtatgatcttag

SEQ ID NO: 208298 - DNA, 16 bp, P. troglodytes
agtggtctatgtattt

SEQ ID NO: 208299 - DNA, 16 bp, P. troglodytes
agtggtgaacaagaca

SEQ ID NO: 208300 - DNA, 16 bp, P. troglodytes
agtggtgatggctgca

SEQ ID NO: 208301 - DNA, 16 bp, P. troglodytes
agtggtgatggttgca

SEQ ID NO: 208302 - DNA, 16 bp, P. troglodytes
agtggtgcacacctgt

SEQ ID NO: 208303 - DNA, 16 bp, P. troglodytes
agtggtgctgggagaa

SEQ ID NO: 208304 - DNA, 16 bp, P. troglodytes
agtggtggcacatgcc

SEQ ID NO: 208305 - DNA, 16 bp, P. troglodytes
agtggtggcaggctgg

SEQ ID NO: 208306 - DNA, 16 bp, P. troglodytes
agtggtggcatgcacc

SEQ ID NO: 208307 - DNA, 16 bp, P. troglodytes
agtggtgggatctcag

SEQ ID NO: 208308 - DNA, 16 bp, P. troglodytes
agtggtgggattacag

SEQ ID NO: 208309 - DNA, 16 bp, P. troglodytes
agtggtgtgatcatga

SEQ ID NO: 208310 - DNA, 16 bp, P. troglodytes
agtggtgtgatgatag

SEQ ID NO: 208311 - DNA, 16 bp, P. troglodytes
agtggtgtgcatctgt

SEQ ID NO: 208312 - DNA, 16 bp, P. troglodytes
agtggtgtgctggtaa

SEQ ID NO: 208313 - DNA, 16 bp, P. troglodytes
agtggtgtgtgcttgt

SEQ ID NO: 208314 - DNA, 16 bp, P. troglodytes
agtggttctcaaagta

SEQ ID NO: 208315 - DNA, 16 bp, P. troglodytes
agtggttctcagcctt

SEQ ID NO: 208316 - DNA, 16 bp, P. troglodytes
agtggttctcccagca

SEQ ID NO: 208317 - DNA, 16 bp, P. troglodytes
agtggttctctcagca

SEQ ID NO: 208318 - DNA, 16 bp, P. troglodytes
agtggttggtaccagt

SEQ ID NO: 208319 - DNA, 16 bp, P. troglodytes
agtggtttctcattgt

SEQ ID NO: 208320 - DNA, 16 bp, P. troglodytes
agtggttttaaaacat

SEQ ID NO: 208321 - DNA, 16 bp, P. troglodytes
agtggttttctttttc

SEQ ID NO: 208322 - DNA, 16 bp, P. troglodytes
agtgtaaacaaagccc

SEQ ID NO: 208323 - DNA, 16 bp, P. troglodytes
agtgtaaacaaagcct

SEQ ID NO: 208324 - DNA, 16 bp, P. troglodytes
agtgtaaatgtaactt

SEQ ID NO: 208325 - DNA, 16 bp, P. troglodytes
agtgtacacacacaca

SEQ ID NO: 208326 - DNA, 16 bp, P. troglodytes
agtgtacttatacaaa

SEQ ID NO: 208327 - DNA, 16 bp, P. troglodytes
agtgtagaagcattcc

SEQ ID NO: 208328 - DNA, 16 bp, P. troglodytes
agtgtagtggcgcaat

SEQ ID NO: 208329 - DNA, 16 bp, P. troglodytes
agtgtagtggtgtgat

SEQ ID NO: 208330 - DNA, 16 bp, P. troglodytes
agtgtatattttcaaa

SEQ ID NO: 208331 - DNA, 16 bp, P. troglodytes
agtgtatgaaaagatg

SEQ ID NO: 208332 - DNA, 16 bp, P. troglodytes
agtgtatgagtgtgtg

SEQ ID NO: 208333 - DNA, 16 bp, P. troglodytes
agtgtatgtgtctttt

SEQ ID NO: 208334 - DNA, 16 bp, P. troglodytes
agtgtcactctgttgc

SEQ ID NO: 208335 - DNA, 16 bp, P. troglodytes
agtgtcagcatcacct

SEQ ID NO: 208336 - DNA, 16 bp, P. troglodytes
agtgtcccaggttgac

SEQ ID NO: 208337 - DNA, 16 bp, P. troglodytes
agtgtccttacaaaag

SEQ ID NO: 208338 - DNA, 16 bp, P. troglodytes
agtgtctactatatgc

SEQ ID NO: 208339 - DNA, 16 bp, P. troglodytes
agtgtctgacacatag

SEQ ID NO: 208340 - DNA, 16 bp, P. troglodytes
agtgtctgttcatgta

SEQ ID NO: 208341 - DNA, 16 bp, P. troglodytes
agtgtcttagtccatt

SEQ ID NO: 208342 - DNA, 16 bp, P. troglodytes
agtgtcttgaacttga

SEQ ID NO: 208343 - DNA, 16 bp, P. troglodytes
agtgtcttttgcagag

SEQ ID NO: 208344 - DNA, 16 bp, P. troglodytes
agtgtgaacccaggag

SEQ ID NO: 208345 - DNA, 17 bp, P. troglodytes
agtgtgaacccgggagg

SEQ ID NO: 208346 - DNA, 16 bp, P. troglodytes
agtgtgagaacagact

SEQ ID NO: 208347 - DNA, 16 bp, P. troglodytes
agtgtgagaagggact

SEQ ID NO: 208348 - DNA, 16 bp, P. troglodytes
agtgtgagccaccacg

SEQ ID NO: 208349 - DNA, 16 bp, P. troglodytes
agtgtgagtgagtgtg

SEQ ID NO: 208350 - DNA, 17 bp, P. troglodytes
agtgtgatctcagctca

SEQ ID NO: 208351 - DNA, 20 bp, P. troglodytes
agtgtgatcttggctcactg

SEQ ID NO: 208352 - DNA, 16 bp, P. troglodytes
agtgtgatgaggtgct

SEQ ID NO: 208353 - DNA, 16 bp, P. troglodytes
agtgtgcaaatatttt

SEQ ID NO: 208354 - DNA, 16 bp, P. troglodytes
agtgtgcagtggtgca

SEQ ID NO: 208355 - DNA, 16 bp, P. troglodytes
agtgtgcatgtgtctt

SEQ ID NO: 208356 - DNA, 16 bp, P. troglodytes
agtgtgcctgcctctc

SEQ ID NO: 208357 - DNA, 16 bp, P. troglodytes
agtgtgcgtgtgtgtg

SEQ ID NO: 208358 - DNA, 16 bp, P. troglodytes
agtgtggaggggaaat

SEQ ID NO: 208359 - DNA, 16 bp, P. troglodytes
agtgtggcaaagcctt

SEQ ID NO: 208360 - DNA, 16 bp, P. troglodytes
agtgtggcagtttctt

SEQ ID NO: 208361 - DNA, 16 bp, P. troglodytes
agtgtggctgtgttcc

SEQ ID NO: 208362 - DNA, 16 bp, P. troglodytes
agtgtggtgaaaccct

SEQ ID NO: 208363 - DNA, 16 bp, P. troglodytes
agtgtggtggcgcatg

SEQ ID NO: 208364 - DNA, 16 bp, P. troglodytes
agtgtggtggtgtgca

SEQ ID NO: 208365 - DNA, 16 bp, P. troglodytes
agtgtgtatatatgta

SEQ ID NO: 208366 - DNA, 16 bp, P. troglodytes
agtgtgtatgtatgtg

SEQ ID NO: 208367 - DNA, 16 bp, P. troglodytes
agtgtgtattgttccc

SEQ ID NO: 208368 - DNA, 19 bp, P. troglodytes
agtgtgtgatgttcccctc

SEQ ID NO: 208369 - DNA, 17 bp, P. troglodytes
agtgtgtgcatgtgtgt

SEQ ID NO: 208370 - DNA, 16 bp, P. troglodytes
agtgtgtgtatatata

SEQ ID NO: 208371 - DNA, 16 bp, P. troglodytes
agtgtgtgtatgtgag

SEQ ID NO: 208372 - DNA, 16 bp, P. troglodytes
agtgtgtgtatgtgtg

SEQ ID NO: 208373 - DNA, 16 bp, P. troglodytes
agtgtgtgtgaatgtg

SEQ ID NO: 208374 - DNA, 16 bp, P. troglodytes
agtgtgtgtgagtgtg

SEQ ID NO: 208375 - DNA, 16 bp, P. troglodytes
agtgtgtgtgcacatg

SEQ ID NO: 208376 - DNA, 16 bp, P. troglodytes
agtgtgtgtgcgtgtg

SEQ ID NO: 208377 - DNA, 16 bp, P. troglodytes
agtgtgtgtgtatata

SEQ ID NO: 208378 - DNA, 16 bp, P. troglodytes
agtgtgtgtgtgcatg

SEQ ID NO: 208379 - DNA, 16 bp, P. troglodytes
agtgtgtgtgtgcgcg

SEQ ID NO: 208380 - DNA, 16 bp, P. troglodytes
agtgtgttggctttct

SEQ ID NO: 208381 - DNA, 16 bp, P. troglodytes
agtgttcataaataaa

SEQ ID NO: 208382 - DNA, 16 bp, P. troglodytes
agtgttccattgtgtg

SEQ ID NO: 208383 - DNA, 16 bp, P. troglodytes
agtgttcctaagtgca

SEQ ID NO: 208384 - DNA, 16 bp, P. troglodytes
agtgttctcactgttc

SEQ ID NO: 208385 - DNA, 16 bp, P. troglodytes
agtgttggagagaatg

SEQ ID NO: 208386 - DNA, 16 bp, P. troglodytes
agtgttggtcaggctg

SEQ ID NO: 208387 - DNA, 16 bp, P. troglodytes
agtgttggtggaaatg

SEQ ID NO: 208388 - DNA, 16 bp, P. troglodytes
agtgtttaatccattt

SEQ ID NO: 208389 - DNA, 16 bp, P. troglodytes
agtgtttacatcagat

SEQ ID NO: 208390 - DNA, 16 bp, P. troglodytes
agtgtttactatatgc

SEQ ID NO: 208391 - DNA, 16 bp, P. troglodytes
agtgtttactatgtgc

SEQ ID NO: 208392 - DNA, 16 bp, P. troglodytes
agtgtttataaagtct

SEQ ID NO: 208393 - DNA, 16 bp, P. troglodytes
agtgtttattgagcac

SEQ ID NO: 208394 - DNA, 16 bp, P. troglodytes
agtgtttcctcctctt

SEQ ID NO: 208395 - DNA, 16 bp, P. troglodytes
agtgtttctcaaacat

SEQ ID NO: 208396 - DNA, 16 bp, P. troglodytes
agtgtttctcaaagta

SEQ ID NO: 208397 - DNA, 16 bp, P. troglodytes
agtgtttgagaccagc

SEQ ID NO: 208398 - DNA, 16 bp, P. troglodytes
agtgtttggagatttt

SEQ ID NO: 208399 - DNA, 31 bp, P. troglodytes
agtgtttgtgtccctgggtacttgagattaa

SEQ ID NO: 208400 - DNA, 38 bp, P. troglodytes
agtgtttgtgtccctgggtacttgagattagggagtgg

SEQ ID NO: 208401 - DNA, 16 bp, P. troglodytes
agtgttttaaaaaata

SEQ ID NO: 208402 - DNA, 16 bp, P. troglodytes
agtgttttaagaaagt

SEQ ID NO: 208403 - DNA, 16 bp, P. troglodytes
agtgttttacagtttt

SEQ ID NO: 208404 - DNA, 16 bp, P. troglodytes
agtgttttttaaaaaa

SEQ ID NO: 208405 - DNA, 16 bp, P. troglodytes
agttaaaaaaaatcag

SEQ ID NO: 208406 - DNA, 16 bp, P. troglodytes
agttaaaatgattttt

SEQ ID NO: 208407 - DNA, 16 bp, P. troglodytes
agttaaaatgccacaa

SEQ ID NO: 208408 - DNA, 16 bp, P. troglodytes
agttaaataaattatg

SEQ ID NO: 208409 - DNA, 16 bp, P. troglodytes
agttaaatgtgaattt

SEQ ID NO: 208410 - DNA, 16 bp, P. troglodytes
agttaaattttgaaaa

SEQ ID NO: 208411 - DNA, 16 bp, P. troglodytes
agttaacaataacata

SEQ ID NO: 208412 - DNA, 16 bp, P. troglodytes
agttaacatttgttga

SEQ ID NO: 208413 - DNA, 16 bp, P. troglodytes
agttaactgtgaaaca

SEQ ID NO: 208414 - DNA, 16 bp, P. troglodytes
agttaagacttcaaca

SEQ ID NO: 208415 - DNA, 16 bp, P. troglodytes
agttaataaatgtgat

SEQ ID NO: 208416 - DNA, 16 bp, P. troglodytes
agttaataataatgta

SEQ ID NO: 208417 - DNA, 16 bp, P. troglodytes
agttaatatatgtaaa

SEQ ID NO: 208418 - DNA, 16 bp, P. troglodytes
agttaatattttcttt

SEQ ID NO: 208419 - DNA, 16 bp, P. troglodytes
agttaatcctctcaaa

SEQ ID NO: 208420 - DNA, 22 bp, P. troglodytes
agttaatgggtgcagcacacca

SEQ ID NO: 208421 - DNA, 16 bp, P. troglodytes
agttaattcatgtaaa

SEQ ID NO: 208422 - DNA, 16 bp, P. troglodytes
agttaattttctttct

SEQ ID NO: 208423 - DNA, 16 bp, P. troglodytes
agttacaaaaatagta

SEQ ID NO: 208424 - DNA, 16 bp, P. troglodytes
agttacacaagatgaa

SEQ ID NO: 208425 - DNA, 16 bp, P. troglodytes
agttacatttttaaaa

SEQ ID NO: 208426 - DNA, 16 bp, P. troglodytes
agttaccacacctggc

SEQ ID NO: 208427 - DNA, 16 bp, P. troglodytes
agttacctaacttctc

SEQ ID NO: 208428 - DNA, 16 bp, P. troglodytes
agttactggagttctt

SEQ ID NO: 208429 - DNA, 16 bp, P. troglodytes
agttactgggattaca

SEQ ID NO: 208430 - DNA, 16 bp, P. troglodytes
agttactgtagccttg

SEQ ID NO: 208431 - DNA, 16 bp, P. troglodytes
agttacttaacctctt

SEQ ID NO: 208432 - DNA, 16 bp, P. troglodytes
agttacttcactcaga

SEQ ID NO: 208433 - DNA, 16 bp, P. troglodytes
agttactttaaaaaat

SEQ ID NO: 208434 - DNA, 16 bp, P. troglodytes
agttagaaaagacaaa

SEQ ID NO: 208435 - DNA, 16 bp, P. troglodytes
agttagaatttttaaa

SEQ ID NO: 208436 - DNA, 16 bp, P. troglodytes
agttagagacccctgg

SEQ ID NO: 208437 - DNA, 16 bp, P. troglodytes
agttagaggctgcagt

SEQ ID NO: 208438 - DNA, 16 bp, P. troglodytes
agttagagtccagcct

SEQ ID NO: 208439 - DNA, 16 bp, P. troglodytes
agttagccaagcatgg

SEQ ID NO: 208440 - DNA, 18 bp, P. troglodytes
agttagccgggcttggtg

SEQ ID NO: 208441 - DNA, 16 bp, P. troglodytes
agttagctgggtatgg

SEQ ID NO: 208442 - DNA, 16 bp, P. troglodytes
agttagggaggaattc

SEQ ID NO: 208443 - DNA, 16 bp, P. troglodytes
agttagtgaaaataaa

SEQ ID NO: 208444 - DNA, 18 bp, P. troglodytes
agttagttcttcttgttg

SEQ ID NO: 208445 - DNA, 16 bp, P. troglodytes
agttagtttctgatgc

SEQ ID NO: 208446 - DNA, 16 bp, P. troglodytes
agttataattttgcaa

SEQ ID NO: 208447 - DNA, 16 bp, P. troglodytes
agttatccagttttcc

SEQ ID NO: 208448 - DNA, 16 bp, P. troglodytes
agttatctattgctat

SEQ ID NO: 208449 - DNA, 16 bp, P. troglodytes
agttatgcatcactta

SEQ ID NO: 208450 - DNA, 16 bp, P. troglodytes
agttattcatttgtaa

SEQ ID NO: 208451 - DNA, 16 bp, P. troglodytes
agttatttaaaaatgt

SEQ ID NO: 208452 - DNA, 16 bp, P. troglodytes
agttatttattttgcc

SEQ ID NO: 208453 - DNA, 16 bp, P. troglodytes
agttatttcttgcttt

SEQ ID NO: 208454 - DNA, 16 bp, P. troglodytes
agttatttgcataagt

SEQ ID NO: 208455 - DNA, 17 bp, P. troglodytes
agttatttggcagagtg

SEQ ID NO: 208456 - DNA, 16 bp, P. troglodytes
agttattttaaaatct

SEQ ID NO: 208457 - DNA, 16 bp, P. troglodytes
agttattttgcagaat

SEQ ID NO: 208458 - DNA, 16 bp, P. troglodytes
agttcaaaaatatttt

SEQ ID NO: 208459 - DNA, 16 bp, P. troglodytes
agttcaaacccattgc

SEQ ID NO: 208460 - DNA, 16 bp, P. troglodytes
agttcaaccattttgg

SEQ ID NO: 208461 - DNA, 16 bp, P. troglodytes
agttcaagaccaacgt

SEQ ID NO: 208462 - DNA, 16 bp, P. troglodytes
agttcaagaccagccc

SEQ ID NO: 208463 - DNA, 17 bp, P. troglodytes
agttcaagaccagcccg

SEQ ID NO: 208464 - DNA, 18 bp, P. troglodytes
agttcaagaccagcctga

SEQ ID NO: 208465 - DNA, 17 bp, P. troglodytes
agttcaagaccagcctt

SEQ ID NO: 208466 - DNA, 17 bp, P. troglodytes
agttcaagactagccta

SEQ ID NO: 208467 - DNA, 16 bp, P. troglodytes
agttcaagagcagcct

SEQ ID NO: 208468 - DNA, 16 bp, P. troglodytes
agttcaagatcaaggc

SEQ ID NO: 208469 - DNA, 16 bp, P. troglodytes
agttcaagatcagcca

SEQ ID NO: 208470 - DNA, 16 bp, P. troglodytes
agttcaagatgaaatt

SEQ ID NO: 208471 - DNA, 16 bp, P. troglodytes
agttcaagcgattctc

SEQ ID NO: 208472 - DNA, 17 bp, P. troglodytes
agttcaagcgattctca

SEQ ID NO: 208473 - DNA, 16 bp, P. troglodytes
agttcaaggccaccct

SEQ ID NO: 208474 - DNA, 16 bp, P. troglodytes
agttcaaggccagcct

SEQ ID NO: 208475 - DNA, 16 bp, P. troglodytes
agttcaattattttaa

SEQ ID NO: 208476 - DNA, 16 bp, P. troglodytes
agttcaccaattcaaa

SEQ ID NO: 208477 - DNA, 16 bp, P. troglodytes
agttcacccatttaaa

SEQ ID NO: 208478 - DNA, 16 bp, P. troglodytes
agttcactaatctttt

SEQ ID NO: 208479 - DNA, 16 bp, P. troglodytes
agttcactgattcttc

SEQ ID NO: 208480 - DNA, 16 bp, P. troglodytes
agttcactgcagcctc

SEQ ID NO: 208481 - DNA, 16 bp, P. troglodytes
agttcagagaaaaaag

SEQ ID NO: 208482 - DNA, 16 bp, P. troglodytes
agttcagcaaacattt

SEQ ID NO: 208483 - DNA, 16 bp, P. troglodytes
agttcaggagtacaag

SEQ ID NO: 208484 - DNA, 16 bp, P. troglodytes
agttcagtggcatgat

SEQ ID NO: 208485 - DNA, 16 bp, P. troglodytes
agttcagtgtggctgg

SEQ ID NO: 208486 - DNA, 16 bp, P. troglodytes
agttcagtgttaatga

SEQ ID NO: 208487 - DNA, 16 bp, P. troglodytes
agttcagtttgggaca

SEQ ID NO: 208488 - DNA, 16 bp, P. troglodytes
agttcatgtgttggaa

SEQ ID NO: 208489 - DNA, 16 bp, P. troglodytes
agttcattattttaaa

SEQ ID NO: 208490 - DNA, 16 bp, P. troglodytes
agttcattcatgattt

SEQ ID NO: 208491 - DNA, 16 bp, P. troglodytes
agttcatttcctttgt

SEQ ID NO: 208492 - DNA, 16 bp, P. troglodytes
agttcatttgtgattt

SEQ ID NO: 208493 - DNA, 16 bp, P. troglodytes
agttccaagtctttgc

SEQ ID NO: 208494 - DNA, 16 bp, P. troglodytes
agttccacgtgtctgg

SEQ ID NO: 208495 - DNA, 16 bp, P. troglodytes
agttccagaacttttt

SEQ ID NO: 208496 - DNA, 16 bp, P. troglodytes
agttccagaccaacct

SEQ ID NO: 208497 - DNA, 16 bp, P. troglodytes
agttccagaccaccct

SEQ ID NO: 208498 - DNA, 16 bp, P. troglodytes
agttccagaccagcct

SEQ ID NO: 208499 - DNA, 16 bp, P. troglodytes
agttccagagggagga

SEQ ID NO: 208500 - DNA, 16 bp, P. troglodytes
agttccagatctttcc

SEQ ID NO: 208501 - DNA, 16 bp, P. troglodytes
agttccagttactcca

SEQ ID NO: 208502 - DNA, 16 bp, P. troglodytes
agttccagtttcttca

SEQ ID NO: 208503 - DNA, 16 bp, P. troglodytes
agttcccaataacttc

SEQ ID NO: 208504 - DNA, 16 bp, P. troglodytes
agttcccacttatgag

SEQ ID NO: 208505 - DNA, 16 bp, P. troglodytes
agttcccaggggatgc

SEQ ID NO: 208506 - DNA, 16 bp, P. troglodytes
agttcccaggtgatgc

SEQ ID NO: 208507 - DNA, 16 bp, P. troglodytes
agttccctcttctgta

SEQ ID NO: 208508 - DNA, 16 bp, P. troglodytes
agttccggaggctggg

SEQ ID NO: 208509 - DNA, 16 bp, P. troglodytes
agttcctcaaaaactt

SEQ ID NO: 208510 - DNA, 16 bp, P. troglodytes
agttcctcatctgtaa

SEQ ID NO: 208511 - DNA, 16 bp, P. troglodytes
agttcctcttcaaaga

SEQ ID NO: 208512 - DNA, 16 bp, P. troglodytes
agttcctgccttaact

SEQ ID NO: 208513 - DNA, 16 bp, P. troglodytes
agttcctggcacagag

SEQ ID NO: 208514 - DNA, 16 bp, P. troglodytes
agttcctgttgcttca

SEQ ID NO: 208515 - DNA, 16 bp, P. troglodytes
agttccttgagggcag

SEQ ID NO: 208516 - DNA, 16 bp, P. troglodytes
agttcgagaccagccc

SEQ ID NO: 208517 - DNA, 17 bp, P. troglodytes
agttcgagaccagcctg

SEQ ID NO: 208518 - DNA, 16 bp, P. troglodytes
agttcgagaccagtgt

SEQ ID NO: 208519 - DNA, 16 bp, P. troglodytes
agttctagaacagcct

SEQ ID NO: 208520 - DNA, 21 bp, P. troglodytes
agttctagatccctgaggaat

SEQ ID NO: 208521 - DNA, 16 bp, P. troglodytes
agttctattagttttt

SEQ ID NO: 208522 - DNA, 16 bp, P. troglodytes
agttctcaagaggaat

SEQ ID NO: 208523 - DNA, 16 bp, P. troglodytes
agttctcacaagatct

SEQ ID NO: 208524 - DNA, 16 bp, P. troglodytes
agttctcatgagaact

SEQ ID NO: 208525 - DNA, 16 bp, P. troglodytes
agttctcatgagatct

SEQ ID NO: 208526 - DNA, 16 bp, P. troglodytes
agttctcatgcctcag

SEQ ID NO: 208527 - DNA, 16 bp, P. troglodytes
agttctcattgttcaa

SEQ ID NO: 208528 - DNA, 16 bp, P. troglodytes
agttctccaactttgt

SEQ ID NO: 208529 - DNA, 16 bp, P. troglodytes
agttctcctagaagag

SEQ ID NO: 208530 - DNA, 16 bp, P. troglodytes
agttctccttcaagag

SEQ ID NO: 208531 - DNA, 16 bp, P. troglodytes
agttctctaaggactt

SEQ ID NO: 208532 - DNA, 16 bp, P. troglodytes
agttctgacactgtct

SEQ ID NO: 208533 - DNA, 16 bp, P. troglodytes
agttctgcccactggg

SEQ ID NO: 208534 - DNA, 16 bp, P. troglodytes
agttctgcctcctggg

SEQ ID NO: 208535 - DNA, 17 bp, P. troglodytes
agttctgctctgatctt

SEQ ID NO: 208536 - DNA, 16 bp, P. troglodytes
agttctgctcttgttg

SEQ ID NO: 208537 - DNA, 16 bp, P. troglodytes
agttctgcttttagtt

SEQ ID NO: 208538 - DNA, 16 bp, P. troglodytes
agttctggagactgga

SEQ ID NO: 208539 - DNA, 19 bp, P. troglodytes
agttctggaggctgggaag

SEQ ID NO: 208540 - DNA, 16 bp, P. troglodytes
agttctggcattacag

SEQ ID NO: 208541 - DNA, 16 bp, P. troglodytes
agttctggctgggcac

SEQ ID NO: 208542 - DNA, 16 bp, P. troglodytes
agttctgggattccag

SEQ ID NO: 208543 - DNA, 16 bp, P. troglodytes
agttctggggtacacg

SEQ ID NO: 208544 - DNA, 16 bp, P. troglodytes
agttctggttcctttt

SEQ ID NO: 208545 - DNA, 16 bp, P. troglodytes
agttctgtgaagaatt

SEQ ID NO: 208546 - DNA, 16 bp, P. troglodytes
agttctgtggaaaaag

SEQ ID NO: 208547 - DNA, 16 bp, P. troglodytes
agttctgttcatgtga

SEQ ID NO: 208548 - DNA, 16 bp, P. troglodytes
agttcttcaatctgaa

SEQ ID NO: 208549 - DNA, 16 bp, P. troglodytes
agttcttgacttaata

SEQ ID NO: 208550 - DNA, 16 bp, P. troglodytes
agttcttgaggctgga

SEQ ID NO: 208551 - DNA, 16 bp, P. troglodytes
agttcttgatttcatt

SEQ ID NO: 208552 - DNA, 16 bp, P. troglodytes
agttcttgtgccatgg

SEQ ID NO: 208553 - DNA, 16 bp, P. troglodytes
agttctttaagaaatc

SEQ ID NO: 208554 - DNA, 16 bp, P. troglodytes
agttctttaaggaatc

SEQ ID NO: 208555 - DNA, 16 bp, P. troglodytes
agttctttaattgtga

SEQ ID NO: 208556 - DNA, 16 bp, P. troglodytes
agttctttatttgatt

SEQ ID NO: 208557 - DNA, 16 bp, P. troglodytes
agttctttctaattct

SEQ ID NO: 208558 - DNA, 16 bp, P. troglodytes
agttctttgaaattaa

SEQ ID NO: 208559 - DNA, 16 bp, P. troglodytes
agttctttgaagaatg

SEQ ID NO: 208560 - DNA, 16 bp, P. troglodytes
agttctttgaattgtg

SEQ ID NO: 208561 - DNA, 16 bp, P. troglodytes
agttgaaaaatcttaa

SEQ ID NO: 208562 - DNA, 16 bp, P. troglodytes
agttgaaaagtacaat

SEQ ID NO: 208563 - DNA, 16 bp, P. troglodytes
agttgaaagcatttcc

SEQ ID NO: 208564 - DNA, 16 bp, P. troglodytes
agttgaactcatagaa

SEQ ID NO: 208565 - DNA, 16 bp, P. troglodytes
agttgaatttctgaat

SEQ ID NO: 208566 - DNA, 16 bp, P. troglodytes
agttgacagaggaaga

SEQ ID NO: 208567 - DNA, 16 bp, P. troglodytes
agttgacagtattaac

SEQ ID NO: 208568 - DNA, 16 bp, P. troglodytes
agttgagaaaactgaa

SEQ ID NO: 208569 - DNA, 16 bp, P. troglodytes
agttgagaatcactgc

SEQ ID NO: 208570 - DNA, 22 bp, P. troglodytes
agttgagagaagaaggcttcag

SEQ ID NO: 208571 - DNA, 16 bp, P. troglodytes
agttgaggcccagaga

SEQ ID NO: 208572 - DNA, 16 bp, P. troglodytes
agttgagttttgtata

SEQ ID NO: 208573 - DNA, 16 bp, P. troglodytes
agttgatcctcccacc

SEQ ID NO: 208574 - DNA, 16 bp, P. troglodytes
agttgatccttgaaca

SEQ ID NO: 208575 - DNA, 16 bp, P. troglodytes
agttgatgcaatttct

SEQ ID NO: 208576 - DNA, 16 bp, P. troglodytes
agttgatgcagcttct

SEQ ID NO: 208577 - DNA, 16 bp, P. troglodytes
agttgatttttaaaaa

SEQ ID NO: 208578 - DNA, 16 bp, P. troglodytes
agttgatttttgtatg

SEQ ID NO: 208579 - DNA, 16 bp, P. troglodytes
agttgattttttgaaa

SEQ ID NO: 208580 - DNA, 16 bp, P. troglodytes
agttgcaacagagatc

SEQ ID NO: 208581 - DNA, 16 bp, P. troglodytes
agttgcactgggcaca

SEQ ID NO: 208582 - DNA, 16 bp, P. troglodytes
agttgcagcaagttat

SEQ ID NO: 208583 - DNA, 16 bp, P. troglodytes
agttgcagctactcag

SEQ ID NO: 208584 - DNA, 19 bp, P. troglodytes
agttgcagtgagccgagac

SEQ ID NO: 208585 - DNA, 21 bp, P. troglodytes
agttgcagtgagccgagatca

SEQ ID NO: 208586 - DNA, 16 bp, P. troglodytes
agttgctcaagccaaa

SEQ ID NO: 208587 - DNA, 16 bp, P. troglodytes
agttgctggagaggat

SEQ ID NO: 208588 - DNA, 17 bp, P. troglodytes
agttgcttgggaggctg

SEQ ID NO: 208589 - DNA, 16 bp, P. troglodytes
agttgcttgtagattc

SEQ ID NO: 208590 - DNA, 16 bp, P. troglodytes
agttggaaaacactct

SEQ ID NO: 208591 - DNA, 16 bp, P. troglodytes
agttggaaagaatgaa

SEQ ID NO: 208592 - DNA, 16 bp, P. troglodytes
agttggaagtaaagca

SEQ ID NO: 208593 - DNA, 16 bp, P. troglodytes
agttggagaaactgag

SEQ ID NO: 208594 - DNA, 16 bp, P. troglodytes
agttggagatcagcct

SEQ ID NO: 208595 - DNA, 16 bp, P. troglodytes
agttggattgtttgta

SEQ ID NO: 208596 - DNA, 16 bp, P. troglodytes
agttggccctctgtat

SEQ ID NO: 208597 - DNA, 16 bp, P. troglodytes
agttggctcatgcctg

SEQ ID NO: 208598 - DNA, 16 bp, P. troglodytes
agttgggaagagatgc

SEQ ID NO: 208599 - DNA, 16 bp, P. troglodytes
agttgggactacaagc

SEQ ID NO: 208600 - DNA, 16 bp, P. troglodytes
agttgggactacaggt

SEQ ID NO: 208601 - DNA, 16 bp, P. troglodytes
agttgggcaaaatcat

SEQ ID NO: 208602 - DNA, 16 bp, P. troglodytes
agttggggaggagtcc

SEQ ID NO: 208603 - DNA, 16 bp, P. troglodytes
agttggggttttcctt

SEQ ID NO: 208604 - DNA, 17 bp, P. troglodytes
agttgggtgtggtggca

SEQ ID NO: 208605 - DNA, 16 bp, P. troglodytes
agttgtacaatgtgtt

SEQ ID NO: 208606 - DNA, 16 bp, P. troglodytes
agttgtacattttaaa

SEQ ID NO: 208607 - DNA, 16 bp, P. troglodytes
agttgtactaatttac

SEQ ID NO: 208608 - DNA, 16 bp, P. troglodytes
agttgtattagtctgt

SEQ ID NO: 208609 - DNA, 16 bp, P. troglodytes
agttgtcctgcctttc

SEQ ID NO: 208610 - DNA, 16 bp, P. troglodytes
agttgtctacagtatt

SEQ ID NO: 208611 - DNA, 16 bp, P. troglodytes
agttgtgaaaccatca

SEQ ID NO: 208612 - DNA, 16 bp, P. troglodytes
agttgtgagccaccgc

SEQ ID NO: 208613 - DNA, 16 bp, P. troglodytes
agttgtgaggattaaa

SEQ ID NO: 208614 - DNA, 16 bp, P. troglodytes
agttgtgcagtgcaca

SEQ ID NO: 208615 - DNA, 16 bp, P. troglodytes
agttgtggagaaaaag

SEQ ID NO: 208616 - DNA, 16 bp, P. troglodytes
agttgtgtgaccttgg

SEQ ID NO: 208617 - DNA, 16 bp, P. troglodytes
agttgtgtgactttgg

SEQ ID NO: 208618 - DNA, 16 bp, P. troglodytes
agttgtgtgcatgctc

SEQ ID NO: 208619 - DNA, 16 bp, P. troglodytes
agttgttaaattggtg

SEQ ID NO: 208620 - DNA, 16 bp, P. troglodytes
agttgttctgcttctg

SEQ ID NO: 208621 - DNA, 16 bp, P. troglodytes
agttgttggagttcct

SEQ ID NO: 208622 - DNA, 16 bp, P. troglodytes
agttgttgtgtctaaa

SEQ ID NO: 208623 - DNA, 16 bp, P. troglodytes
agttgtttcacttaaa

SEQ ID NO: 208624 - DNA, 16 bp, P. troglodytes
agttgttttctttcag

SEQ ID NO: 208625 - DNA, 16 bp, P. troglodytes
agttgttttttgaaaa

SEQ ID NO: 208626 - DNA, 16 bp, P. troglodytes
agtttaaaaagacaaa

SEQ ID NO: 208627 - DNA, 16 bp, P. troglodytes
agtttaaaaataagtt

SEQ ID NO: 208628 - DNA, 16 bp, P. troglodytes
agtttaaaacaaagat

SEQ ID NO: 208629 - DNA, 16 bp, P. troglodytes
agtttaaaatgtttaa

SEQ ID NO: 208630 - DNA, 16 bp, P. troglodytes
agtttaactttaaaac

SEQ ID NO: 208631 - DNA, 16 bp, P. troglodytes
agtttaagtcccattt

SEQ ID NO: 208632 - DNA, 16 bp, P. troglodytes
agtttaattagatttc

SEQ ID NO: 208633 - DNA, 16 bp, P. troglodytes
agtttaattctgttgt

SEQ ID NO: 208634 - DNA, 16 bp, P. troglodytes
agtttacaaagcattt

SEQ ID NO: 208635 - DNA, 16 bp, P. troglodytes
agtttacacacacaca

SEQ ID NO: 208636 - DNA, 16 bp, P. troglodytes
agtttacaccaaacca

SEQ ID NO: 208637 - DNA, 16 bp, P. troglodytes
agtttacagaaaaaag

SEQ ID NO: 208638 - DNA, 16 bp, P. troglodytes
agtttacagatatttt

SEQ ID NO: 208639 - DNA, 16 bp, P. troglodytes
agtttactcaaaaggt

SEQ ID NO: 208640 - DNA, 16 bp, P. troglodytes
agtttactttaaaaat

SEQ ID NO: 208641 - DNA, 16 bp, P. troglodytes
agtttagatgaggtca

SEQ ID NO: 208642 - DNA, 16 bp, P. troglodytes
agtttataaaaataca

SEQ ID NO: 208643 - DNA, 16 bp, P. troglodytes
agtttataaaacaatt

SEQ ID NO: 208644 - DNA, 17 bp, P. troglodytes
agtttatctaaagacct

SEQ ID NO: 208645 - DNA, 16 bp, P. troglodytes
agtttatgaatttgta

SEQ ID NO: 208646 - DNA, 16 bp, P. troglodytes
agtttatgaccagcct

SEQ ID NO: 208647 - DNA, 16 bp, P. troglodytes
agtttattcaaagaga

SEQ ID NO: 208648 - DNA, 16 bp, P. troglodytes
agtttattccttctga

SEQ ID NO: 208649 - DNA, 16 bp, P. troglodytes
agtttattgagaattt

SEQ ID NO: 208650 - DNA, 16 bp, P. troglodytes
agtttatttaaaagtt

SEQ ID NO: 208651 - DNA, 16 bp, P. troglodytes
agtttatttatccatt

SEQ ID NO: 208652 - DNA, 16 bp, P. troglodytes
agtttatttccagttt

SEQ ID NO: 208653 - DNA, 16 bp, P. troglodytes
agtttattttgaaaca

SEQ ID NO: 208654 - DNA, 16 bp, P. troglodytes
agtttattttggtgca

SEQ ID NO: 208655 - DNA, 16 bp, P. troglodytes
agtttcaaagctgctt

SEQ ID NO: 208656 - DNA, 16 bp, P. troglodytes
agtttcaagcgattct

SEQ ID NO: 208657 - DNA, 16 bp, P. troglodytes
agtttcaataaattta

SEQ ID NO: 208658 - DNA, 16 bp, P. troglodytes
agtttcaatcttctgc

SEQ ID NO: 208659 - DNA, 16 bp, P. troglodytes
agtttcacagatacct

SEQ ID NO: 208660 - DNA, 20 bp, P. troglodytes
agtttcaccatgttggtcag

SEQ ID NO: 208661 - DNA, 16 bp, P. troglodytes
agtttcactctcattg

SEQ ID NO: 208662 - DNA, 16 bp, P. troglodytes
agtttcactctgttgc

SEQ ID NO: 208663 - DNA, 16 bp, P. troglodytes
agtttcactcttattg

SEQ ID NO: 208664 - DNA, 16 bp, P. troglodytes
agtttcactcttgctg

SEQ ID NO: 208665 - DNA, 16 bp, P. troglodytes
agtttcactcttgttg

SEQ ID NO: 208666 - DNA, 16 bp, P. troglodytes
agtttcactgttgttg

SEQ ID NO: 208667 - DNA, 16 bp, P. troglodytes
agtttcacttttgtca

SEQ ID NO: 208668 - DNA, 16 bp, P. troglodytes
agtttcacttttgttg

SEQ ID NO: 208669 - DNA, 16 bp, P. troglodytes
agtttcagaaggaata

SEQ ID NO: 208670 - DNA, 16 bp, P. troglodytes
agtttcagagcaggaa

SEQ ID NO: 208671 - DNA, 16 bp, P. troglodytes
agtttcagattttgaa

SEQ ID NO: 208672 - DNA, 16 bp, P. troglodytes
agtttcagcaggaatg

SEQ ID NO: 208673 - DNA, 16 bp, P. troglodytes
agtttcagctttcttc

SEQ ID NO: 208674 - DNA, 16 bp, P. troglodytes
agtttcaggttttttc

SEQ ID NO: 208675 - DNA, 16 bp, P. troglodytes
agtttcagttctttga

SEQ ID NO: 208676 - DNA, 16 bp, P. troglodytes
agtttcagtttgggaa

SEQ ID NO: 208677 - DNA, 16 bp, P. troglodytes
agtttcagttttgcaa

SEQ ID NO: 208678 - DNA, 16 bp, P. troglodytes
agtttcatccatgttg

SEQ ID NO: 208679 - DNA, 16 bp, P. troglodytes
agtttcattctcctgc

SEQ ID NO: 208680 - DNA, 16 bp, P. troglodytes
agtttcattcttgttg

SEQ ID NO: 208681 - DNA, 16 bp, P. troglodytes
agtttcattctttttg

SEQ ID NO: 208682 - DNA, 16 bp, P. troglodytes
agtttcatttttaaaa

SEQ ID NO: 208683 - DNA, 16 bp, P. troglodytes
agtttccaagaaccta

SEQ ID NO: 208684 - DNA, 16 bp, P. troglodytes
agtttccatgtagtgg

SEQ ID NO: 208685 - DNA, 16 bp, P. troglodytes
agtttcccataatttt

SEQ ID NO: 208686 - DNA, 16 bp, P. troglodytes
agtttccccacttgta

SEQ ID NO: 208687 - DNA, 16 bp, P. troglodytes
agtttccccatctgtg

SEQ ID NO: 208688 - DNA, 16 bp, P. troglodytes
agtttccccttctgta

SEQ ID NO: 208689 - DNA, 16 bp, P. troglodytes
agtttccctctgtcac

SEQ ID NO: 208690 - DNA, 16 bp, P. troglodytes
agtttccctcttgctg

SEQ ID NO: 208691 - DNA, 16 bp, P. troglodytes
agtttccctcttgttg

SEQ ID NO: 208692 - DNA, 16 bp, P. troglodytes
agtttcctcaactgtg

SEQ ID NO: 208693 - DNA, 16 bp, P. troglodytes
agtttcctgatgcctc

SEQ ID NO: 208694 - DNA, 16 bp, P. troglodytes
agtttcctggacagaa

SEQ ID NO: 208695 - DNA, 16 bp, P. troglodytes
agtttcctgtggcctc

SEQ ID NO: 208696 - DNA, 16 bp, P. troglodytes
agtttcctgtttttct

SEQ ID NO: 208697 - DNA, 16 bp, P. troglodytes
agtttccttatcactt

SEQ ID NO: 208698 - DNA, 16 bp, P. troglodytes
agtttccttatcagta

SEQ ID NO: 208699 - DNA, 16 bp, P. troglodytes
agtttccttctgttcc

SEQ ID NO: 208700 - DNA, 16 bp, P. troglodytes
agtttccttttccttt

SEQ ID NO: 208701 - DNA, 16 bp, P. troglodytes
agtttccttttctcca

SEQ ID NO: 208702 - DNA, 16 bp, P. troglodytes
agtttcgctcttgttg

SEQ ID NO: 208703 - DNA, 16 bp, P. troglodytes
agtttctacacagcaa

SEQ ID NO: 208704 - DNA, 16 bp, P. troglodytes
agtttctatagggaac

SEQ ID NO: 208705 - DNA, 16 bp, P. troglodytes
agtttctatttttcta

SEQ ID NO: 208706 - DNA, 16 bp, P. troglodytes
agtttctcataatgct

SEQ ID NO: 208707 - DNA, 16 bp, P. troglodytes
agtttctcattcagta

SEQ ID NO: 208708 - DNA, 16 bp, P. troglodytes
agtttctccccagaaa

SEQ ID NO: 208709 - DNA, 16 bp, P. troglodytes
agtttctctcttgttg

SEQ ID NO: 208710 - DNA, 16 bp, P. troglodytes
agtttctcttttgttg

SEQ ID NO: 208711 - DNA, 16 bp, P. troglodytes
agtttctgatgccctg

SEQ ID NO: 208712 - DNA, 16 bp, P. troglodytes
agtttctgattcacta

SEQ ID NO: 208713 - DNA, 16 bp, P. troglodytes
agtttctgattcagaa

SEQ ID NO: 208714 - DNA, 16 bp, P. troglodytes
agtttctgattcagga

SEQ ID NO: 208715 - DNA, 16 bp, P. troglodytes
agtttctgcacaacaa

SEQ ID NO: 208716 - DNA, 16 bp, P. troglodytes
agtttctggtttttct

SEQ ID NO: 208717 - DNA, 16 bp, P. troglodytes
agtttcttaaaaatta

SEQ ID NO: 208718 - DNA, 16 bp, P. troglodytes
agtttcttcctagcct

SEQ ID NO: 208719 - DNA, 16 bp, P. troglodytes
agtttcttcctggcat

SEQ ID NO: 208720 - DNA, 16 bp, P. troglodytes
agtttctttaaaaaaa

SEQ ID NO: 208721 - DNA, 16 bp, P. troglodytes
agtttctttctttcat

SEQ ID NO: 208722 - DNA, 16 bp, P. troglodytes
agtttcttttctaaaa

SEQ ID NO: 208723 - DNA, 16 bp, P. troglodytes
agtttgaaaaacattg

SEQ ID NO: 208724 - DNA, 16 bp, P. troglodytes
agtttgaaaaccactg

SEQ ID NO: 208725 - DNA, 16 bp, P. troglodytes
agtttgaaaagagaaa

SEQ ID NO: 208726 - DNA, 16 bp, P. troglodytes
agtttgaaaatatttt

SEQ ID NO: 208727 - DNA, 16 bp, P. troglodytes
agtttgaaattatttc

SEQ ID NO: 208728 - DNA, 16 bp, P. troglodytes
agtttgaagatatttt

SEQ ID NO: 208729 - DNA, 16 bp, P. troglodytes
agtttgagaaagaaaa

SEQ ID NO: 208730 - DNA, 16 bp, P. troglodytes
agtttgagaaccactg

SEQ ID NO: 208731 - DNA, 16 bp, P. troglodytes
agtttgagaactgctg

SEQ ID NO: 208732 - DNA, 16 bp, P. troglodytes
agtttgagaagcactg

SEQ ID NO: 208733 - DNA, 17 bp, P. troglodytes
agtttgagaccagccat

SEQ ID NO: 208734 - DNA, 16 bp, P. troglodytes
agtttgagacccactg

SEQ ID NO: 208735 - DNA, 16 bp, P. troglodytes
agtttgagacgagcct

SEQ ID NO: 208736 - DNA, 16 bp, P. troglodytes
agtttgagagcagcct

SEQ ID NO: 208737 - DNA, 16 bp, P. troglodytes
agtttgaggccagcat

SEQ ID NO: 208738 - DNA, 16 bp, P. troglodytes
agtttgaggcttcagt

SEQ ID NO: 208739 - DNA, 16 bp, P. troglodytes
agtttgagttcattgt

SEQ ID NO: 208740 - DNA, 16 bp, P. troglodytes
agtttgatagaagaaa

SEQ ID NO: 208741 - DNA, 16 bp, P. troglodytes
agtttgattatgatgt

SEQ ID NO: 208742 - DNA, 16 bp, P. troglodytes
agtttgattgcttcta

SEQ ID NO: 208743 - DNA, 16 bp, P. troglodytes
agtttgcaaatatttt

SEQ ID NO: 208744 - DNA, 16 bp, P. troglodytes
agtttgcagtgagcta

SEQ ID NO: 208745 - DNA, 16 bp, P. troglodytes
agtttgccaacctctg

SEQ ID NO: 208746 - DNA, 16 bp, P. troglodytes
agtttgccattctgtg

SEQ ID NO: 208747 - DNA, 16 bp, P. troglodytes
agtttgctcaggataa

SEQ ID NO: 208748 - DNA, 16 bp, P. troglodytes
agtttgctccttttta

SEQ ID NO: 208749 - DNA, 16 bp, P. troglodytes
agtttgctgacccctg

SEQ ID NO: 208750 - DNA, 16 bp, P. troglodytes
agtttgctgagaacga

SEQ ID NO: 208751 - DNA, 16 bp, P. troglodytes
agtttgctgatccctg

SEQ ID NO: 208752 - DNA, 16 bp, P. troglodytes
agtttggaaaacactg

SEQ ID NO: 208753 - DNA, 16 bp, P. troglodytes
agtttggaaaatctgc

SEQ ID NO: 208754 - DNA, 16 bp, P. troglodytes
agtttggaaatattct

SEQ ID NO: 208755 - DNA, 16 bp, P. troglodytes
agtttggaagtatttt

SEQ ID NO: 208756 - DNA, 16 bp, P. troglodytes
agtttggacatatgca

SEQ ID NO: 208757 - DNA, 16 bp, P. troglodytes
agtttggcagtttctt

SEQ ID NO: 208758 - DNA, 16 bp, P. troglodytes
agtttggctgtgtccc

SEQ ID NO: 208759 - DNA, 16 bp, P. troglodytes
agtttgggaaatgctg

SEQ ID NO: 208760 - DNA, 16 bp, P. troglodytes
agtttgggaactgctg

SEQ ID NO: 208761 - DNA, 18 bp, P. troglodytes
agtttgggaggctgaggc

SEQ ID NO: 208762 - DNA, 16 bp, P. troglodytes
agtttgggggaaaaaa

SEQ ID NO: 208763 - DNA, 16 bp, P. troglodytes
agtttggttatttctt

SEQ ID NO: 208764 - DNA, 16 bp, P. troglodytes
agtttgtattttctag

SEQ ID NO: 208765 - DNA, 16 bp, P. troglodytes
agtttgtcaatttttt

SEQ ID NO: 208766 - DNA, 16 bp, P. troglodytes
agtttgtgaagaattg

SEQ ID NO: 208767 - DNA, 16 bp, P. troglodytes
agtttgtgattttaag

SEQ ID NO: 208768 - DNA, 16 bp, P. troglodytes
agtttgtgatttttag

SEQ ID NO: 208769 - DNA, 16 bp, P. troglodytes
agtttgtgcaggggaa

SEQ ID NO: 208770 - DNA, 16 bp, P. troglodytes
agtttgtggtaacttg

SEQ ID NO: 208771 - DNA, 16 bp, P. troglodytes
agtttgtgtgtgtaga

SEQ ID NO: 208772 - DNA, 16 bp, P. troglodytes
agtttgtgtttttcta

SEQ ID NO: 208773 - DNA, 17 bp, P. troglodytes
agtttgttataatttct

SEQ ID NO: 208774 - DNA, 16 bp, P. troglodytes
agtttgttcctgattt

SEQ ID NO: 208775 - DNA, 16 bp, P. troglodytes
agtttgtttatgcatt

SEQ ID NO: 208776 - DNA, 16 bp, P. troglodytes
agtttgttttcacgct

SEQ ID NO: 208777 - DNA, 16 bp, P. troglodytes
agtttgttttcctgca

SEQ ID NO: 208778 - DNA, 16 bp, P. troglodytes
agttttaaaaatagtt

SEQ ID NO: 208779 - DNA, 16 bp, P. troglodytes
agttttaaaaatcatt

SEQ ID NO: 208780 - DNA, 16 bp, P. troglodytes
agttttaaaacataat

SEQ ID NO: 208781 - DNA, 16 bp, P. troglodytes
agttttaaaactggga

SEQ ID NO: 208782 - DNA, 16 bp, P. troglodytes
agttttaaaataatga

SEQ ID NO: 208783 - DNA, 16 bp, P. troglodytes
agttttaaaatgttaa

SEQ ID NO: 208784 - DNA, 16 bp, P. troglodytes
agttttaaagaaattt

SEQ ID NO: 208785 - DNA, 16 bp, P. troglodytes
agttttaagatttaat

SEQ ID NO: 208786 - DNA, 16 bp, P. troglodytes
agttttaatttttcat

SEQ ID NO: 208787 - DNA, 16 bp, P. troglodytes
agttttacaaaatgaa

SEQ ID NO: 208788 - DNA, 16 bp, P. troglodytes
agttttacatttaaat

SEQ ID NO: 208789 - DNA, 16 bp, P. troglodytes
agttttactcttgttg

SEQ ID NO: 208790 - DNA, 16 bp, P. troglodytes
agttttagaaggaatg

SEQ ID NO: 208791 - DNA, 16 bp, P. troglodytes
agttttagaatagttt

SEQ ID NO: 208792 - DNA, 16 bp, P. troglodytes
agttttagcttttata

SEQ ID NO: 208793 - DNA, 16 bp, P. troglodytes
agttttataaaccagt

SEQ ID NO: 208794 - DNA, 16 bp, P. troglodytes
agttttattttactgt

SEQ ID NO: 208795 - DNA, 16 bp, P. troglodytes
agttttattttgaaaa

SEQ ID NO: 208796 - DNA, 16 bp, P. troglodytes
agttttattttgcatt

SEQ ID NO: 208797 - DNA, 16 bp, P. troglodytes
agttttatttttcaaa

SEQ ID NO: 208798 - DNA, 16 bp, P. troglodytes
agttttcaaaaatatt

SEQ ID NO: 208799 - DNA, 16 bp, P. troglodytes
agttttcaaacatttt

SEQ ID NO: 208800 - DNA, 16 bp, P. troglodytes
agttttcaacaaaaaa

SEQ ID NO: 208801 - DNA, 16 bp, P. troglodytes
agttttcaattttaat

SEQ ID NO: 208802 - DNA, 16 bp, P. troglodytes
agttttcagaaatttt

SEQ ID NO: 208803 - DNA, 16 bp, P. troglodytes
agttttccaaaattct

SEQ ID NO: 208804 - DNA, 16 bp, P. troglodytes
agttttccaattcatg

SEQ ID NO: 208805 - DNA, 16 bp, P. troglodytes
agttttccagaggcta

SEQ ID NO: 208806 - DNA, 16 bp, P. troglodytes
agttttccatggtgta

SEQ ID NO: 208807 - DNA, 16 bp, P. troglodytes
agttttcccagcaaca

SEQ ID NO: 208808 - DNA, 16 bp, P. troglodytes
agttttccttctgaca

SEQ ID NO: 208809 - DNA, 16 bp, P. troglodytes
agttttctaaaaattt

SEQ ID NO: 208810 - DNA, 16 bp, P. troglodytes
agttttctaattttct

SEQ ID NO: 208811 - DNA, 16 bp, P. troglodytes
agttttctcttaatat

SEQ ID NO: 208812 - DNA, 16 bp, P. troglodytes
agttttctctttgctt

SEQ ID NO: 208813 - DNA, 16 bp, P. troglodytes
agttttctgaggcctc

SEQ ID NO: 208814 - DNA, 16 bp, P. troglodytes
agttttctgccttgat

SEQ ID NO: 208815 - DNA, 16 bp, P. troglodytes
agttttcttataatgt

SEQ ID NO: 208816 - DNA, 16 bp, P. troglodytes
agttttcttttcatgt

SEQ ID NO: 208817 - DNA, 16 bp, P. troglodytes
agttttgaaacacttt

SEQ ID NO: 208818 - DNA, 16 bp, P. troglodytes
agttttgaaatatttg

SEQ ID NO: 208819 - DNA, 16 bp, P. troglodytes
agttttgaaatcaggt

SEQ ID NO: 208820 - DNA, 16 bp, P. troglodytes
agttttgaaattgaat

SEQ ID NO: 208821 - DNA, 16 bp, P. troglodytes
agttttgcattttata

SEQ ID NO: 208822 - DNA, 16 bp, P. troglodytes
agttttgcatttttat

SEQ ID NO: 208823 - DNA, 16 bp, P. troglodytes
agttttgccttctcca

SEQ ID NO: 208824 - DNA, 16 bp, P. troglodytes
agttttgccttttcca

SEQ ID NO: 208825 - DNA, 16 bp, P. troglodytes
agttttgctcttattg

SEQ ID NO: 208826 - DNA, 16 bp, P. troglodytes
agttttgctcttgttg

SEQ ID NO: 208827 - DNA, 16 bp, P. troglodytes
agttttgctgttgttt

SEQ ID NO: 208828 - DNA, 16 bp, P. troglodytes
agttttgctttaaaat

SEQ ID NO: 208829 - DNA, 16 bp, P. troglodytes
agttttgcttttaaaa

SEQ ID NO: 208830 - DNA, 16 bp, P. troglodytes
agttttgcttttgttg

SEQ ID NO: 208831 - DNA, 16 bp, P. troglodytes
agttttgctttttgga

SEQ ID NO: 208832 - DNA, 16 bp, P. troglodytes
agttttggaattacag

SEQ ID NO: 208833 - DNA, 16 bp, P. troglodytes
agttttggaggtcaga

SEQ ID NO: 208834 - DNA, 16 bp, P. troglodytes
agttttggatctttcc

SEQ ID NO: 208835 - DNA, 16 bp, P. troglodytes
agttttggccaatcaa

SEQ ID NO: 208836 - DNA, 16 bp, P. troglodytes
agttttggtgtggatg

SEQ ID NO: 208837 - DNA, 16 bp, P. troglodytes
agttttgtagtatatt

SEQ ID NO: 208838 - DNA, 16 bp, P. troglodytes
agttttgtcttttcta

SEQ ID NO: 208839 - DNA, 16 bp, P. troglodytes
agttttgtgcttgaaa

SEQ ID NO: 208840 - DNA, 16 bp, P. troglodytes
agttttgttcttgttg

SEQ ID NO: 208841 - DNA, 16 bp, P. troglodytes
agtttttaaaaaatga

SEQ ID NO: 208842 - DNA, 16 bp, P. troglodytes
agtttttaaaaatctt

SEQ ID NO: 208843 - DNA, 16 bp, P. troglodytes
agtttttaaatcctga

SEQ ID NO: 208844 - DNA, 16 bp, P. troglodytes
agtttttaaatgaaat

SEQ ID NO: 208845 - DNA, 16 bp, P. troglodytes
agtttttaaggaaaaa

SEQ ID NO: 208846 - DNA, 16 bp, P. troglodytes
agtttttaagtttgat

SEQ ID NO: 208847 - DNA, 16 bp, P. troglodytes
agtttttaataagaaa

SEQ ID NO: 208848 - DNA, 16 bp, P. troglodytes
agtttttaatgattgc

SEQ ID NO: 208849 - DNA, 16 bp, P. troglodytes
agtttttacattttat

SEQ ID NO: 208850 - DNA, 16 bp, P. troglodytes
agtttttatagagatg

SEQ ID NO: 208851 - DNA, 16 bp, P. troglodytes
agtttttatcacagga

SEQ ID NO: 208852 - DNA, 16 bp, P. troglodytes
agtttttatgtgagga

SEQ ID NO: 208853 - DNA, 16 bp, P. troglodytes
agtttttcccattcag

SEQ ID NO: 208854 - DNA, 16 bp, P. troglodytes
agtttttctaattctg

SEQ ID NO: 208855 - DNA, 16 bp, P. troglodytes
agtttttctgctcttt

SEQ ID NO: 208856 - DNA, 16 bp, P. troglodytes
agtttttcttctctgt

SEQ ID NO: 208857 - DNA, 16 bp, P. troglodytes
agtttttcttgtagag

SEQ ID NO: 208858 - DNA, 16 bp, P. troglodytes
agtttttctttttaaa

SEQ ID NO: 208859 - DNA, 16 bp, P. troglodytes
agtttttgaaaattat

SEQ ID NO: 208860 - DNA, 16 bp, P. troglodytes
agtttttgacttgaag

SEQ ID NO: 208861 - DNA, 16 bp, P. troglodytes
agtttttgcattttta

SEQ ID NO: 208862 - DNA, 16 bp, P. troglodytes
agtttttggtggagtc

SEQ ID NO: 208863 - DNA, 16 bp, P. troglodytes
agtttttgtaaataaa

SEQ ID NO: 208864 - DNA, 16 bp, P. troglodytes
agttttttaaaaaaac

SEQ ID NO: 208865 - DNA, 16 bp, P. troglodytes
agttttttaaaaagtt

SEQ ID NO: 208866 - DNA, 16 bp, P. troglodytes
agttttttaaaagtaa

SEQ ID NO: 208867 - DNA, 16 bp, P. troglodytes
agttttttgaggaaac

SEQ ID NO: 208868 - DNA, 16 bp, P. troglodytes
agttttttgaggaagc

SEQ ID NO: 208869 - DNA, 16 bp, P. troglodytes
agttttttgagggacc

SEQ ID NO: 208870 - DNA, 16 bp, P. troglodytes
agtttttttcataccc

SEQ ID NO: 208871 - DNA, 16 bp, P. troglodytes
agtttttttctaattc

SEQ ID NO: 208872 - DNA, 16 bp, P. troglodytes
agttttttttccccct

SEQ ID NO: 208873 - DNA, 16 bp, P. troglodytes
ataaaaaaatgctcaa

SEQ ID NO: 208874 - DNA, 16 bp, P. troglodytes
ataaaaaaattatctg

SEQ ID NO: 208875 - DNA, 16 bp, P. troglodytes
ataaaaaagatgagtt

SEQ ID NO: 208876 - DNA, 16 bp, P. troglodytes
ataaaaaaggagacat

SEQ ID NO: 208877 - DNA, 16 bp, P. troglodytes
ataaaaaatgcaaatg

SEQ ID NO: 208878 - DNA, 16 bp, P. troglodytes
ataaaaacaatacagt

SEQ ID NO: 208879 - DNA, 16 bp, P. troglodytes
ataaaaacacttgaaa

SEQ ID NO: 208880 - DNA, 16 bp, P. troglodytes
ataaaaacatgtttat

SEQ ID NO: 208881 - DNA, 16 bp, P. troglodytes
ataaaaacatttcatt

SEQ ID NO: 208882 - DNA, 16 bp, P. troglodytes
ataaaaacatttgtaa

SEQ ID NO: 208883 - DNA, 16 bp, P. troglodytes
ataaaaacattttgaa

SEQ ID NO: 208884 - DNA, 16 bp, P. troglodytes
ataaaaaccctgaaag

SEQ ID NO: 208885 - DNA, 16 bp, P. troglodytes
ataaaaactcagcaaa

SEQ ID NO: 208886 - DNA, 16 bp, P. troglodytes
ataaaaactctcagta

SEQ ID NO: 208887 - DNA, 16 bp, P. troglodytes
ataaaaacttgaaaat

SEQ ID NO: 208888 - DNA, 16 bp, P. troglodytes
ataaaaactttctttt

SEQ ID NO: 208889 - DNA, 16 bp, P. troglodytes
ataaaaactttgaaaa

SEQ ID NO: 208890 - DNA, 16 bp, P. troglodytes
ataaaaagaaaatctt

SEQ ID NO: 208891 - DNA, 16 bp, P. troglodytes
ataaaaagcaactcct

SEQ ID NO: 208892 - DNA, 16 bp, P. troglodytes
ataaaaagctttcttt

SEQ ID NO: 208893 - DNA, 16 bp, P. troglodytes
ataaaaagtttctttt

SEQ ID NO: 208894 - DNA, 16 bp, P. troglodytes
ataaaaagtttgtttt

SEQ ID NO: 208895 - DNA, 16 bp, P. troglodytes
ataaaaataaagctgt

SEQ ID NO: 208896 - DNA, 16 bp, P. troglodytes
ataaaaataaagtcat

SEQ ID NO: 208897 - DNA, 16 bp, P. troglodytes
ataaaaataaatgact

SEQ ID NO: 208898 - DNA, 16 bp, P. troglodytes
ataaaaatagttttga

SEQ ID NO: 208899 - DNA, 16 bp, P. troglodytes
ataaaaatatttgagg

SEQ ID NO: 208900 - DNA, 16 bp, P. troglodytes
ataaaaatcagaaatt

SEQ ID NO: 208901 - DNA, 16 bp, P. troglodytes
ataaaaatcatgtgat

SEQ ID NO: 208902 - DNA, 16 bp, P. troglodytes
ataaaaatccatgctt

SEQ ID NO: 208903 - DNA, 16 bp, P. troglodytes
ataaaaatcccagaag

SEQ ID NO: 208904 - DNA, 16 bp, P. troglodytes
ataaaaatcctgaaag

SEQ ID NO: 208905 - DNA, 16 bp, P. troglodytes
ataaaaatctgcattt

SEQ ID NO: 208906 - DNA, 16 bp, P. troglodytes
ataaaaatgaatttca

SEQ ID NO: 208907 - DNA, 16 bp, P. troglodytes
ataaaaatgcaaatta

SEQ ID NO: 208908 - DNA, 16 bp, P. troglodytes
ataaaaatgcagaatt

SEQ ID NO: 208909 - DNA, 16 bp, P. troglodytes
ataaaaatgctaaata

SEQ ID NO: 208910 - DNA, 16 bp, P. troglodytes
ataaaaatggaaatgt

SEQ ID NO: 208911 - DNA, 16 bp, P. troglodytes
ataaaaatggaatttt

SEQ ID NO: 208912 - DNA, 16 bp, P. troglodytes
ataaaaatggattttt

SEQ ID NO: 208913 - DNA, 16 bp, P. troglodytes
ataaaaatgtatcaat

SEQ ID NO: 208914 - DNA, 16 bp, P. troglodytes
ataaaaatgtgttcaa

SEQ ID NO: 208915 - DNA, 16 bp, P. troglodytes
ataaaaatgttaacaa

SEQ ID NO: 208916 - DNA, 16 bp, P. troglodytes
ataaaaatgttcatat

SEQ ID NO: 208917 - DNA, 16 bp, P. troglodytes
ataaaaatgttctaaa

SEQ ID NO: 208918 - DNA, 16 bp, P. troglodytes
ataaaaattagccaag

SEQ ID NO: 208919 - DNA, 16 bp, P. troglodytes
ataaaaattccagaaa

SEQ ID NO: 208920 - DNA, 16 bp, P. troglodytes
ataaaaattggctggg

SEQ ID NO: 208921 - DNA, 16 bp, P. troglodytes
ataaaacaaaaagttg

SEQ ID NO: 208922 - DNA, 16 bp, P. troglodytes
ataaaacaccaaaagc

SEQ ID NO: 208923 - DNA, 16 bp, P. troglodytes
ataaaacaggaataat

SEQ ID NO: 208924 - DNA, 16 bp, P. troglodytes
ataaaacaggctttaa

SEQ ID NO: 208925 - DNA, 16 bp, P. troglodytes
ataaaacagtattttt

SEQ ID NO: 208926 - DNA, 16 bp, P. troglodytes
ataaaacatctagaaa

SEQ ID NO: 208927 - DNA, 16 bp, P. troglodytes
ataaaacatgtttttc

SEQ ID NO: 208928 - DNA, 16 bp, P. troglodytes
ataaaacatttagaaa

SEQ ID NO: 208929 - DNA, 16 bp, P. troglodytes
ataaaacattttcttt

SEQ ID NO: 208930 - DNA, 16 bp, P. troglodytes
ataaaaccaagctgta

SEQ ID NO: 208931 - DNA, 16 bp, P. troglodytes
ataaaaccagaaatta

SEQ ID NO: 208932 - DNA, 16 bp, P. troglodytes
ataaaaccctggaaga

SEQ ID NO: 208933 - DNA, 16 bp, P. troglodytes
ataaaactctgatgaa

SEQ ID NO: 208934 - DNA, 16 bp, P. troglodytes
ataaaactggaaatca

SEQ ID NO: 208935 - DNA, 16 bp, P. troglodytes
ataaaactgttctaaa

SEQ ID NO: 208936 - DNA, 16 bp, P. troglodytes
ataaaacttacatttt

SEQ ID NO: 208937 - DNA, 16 bp, P. troglodytes
ataaaacttgaaaata

SEQ ID NO: 208938 - DNA, 16 bp, P. troglodytes
ataaaactttaatgga

SEQ ID NO: 208939 - DNA, 16 bp, P. troglodytes
ataaaagaaaacatgg

SEQ ID NO: 208940 - DNA, 16 bp, P. troglodytes
ataaaagaaaatcttt

SEQ ID NO: 208941 - DNA, 16 bp, P. troglodytes
ataaaagaaaatgtgg

SEQ ID NO: 208942 - DNA, 16 bp, P. troglodytes
ataaaagaaacatttt

SEQ ID NO: 208943 - DNA, 16 bp, P. troglodytes
ataaaagaaggaatct

SEQ ID NO: 208944 - DNA, 16 bp, P. troglodytes
ataaaagacaacatat

SEQ ID NO: 208945 - DNA, 16 bp, P. troglodytes
ataaaagaggcttcat

SEQ ID NO: 208946 - DNA, 16 bp, P. troglodytes
ataaaagatgaaatgc

SEQ ID NO: 208947 - DNA, 16 bp, P. troglodytes
ataaaagcaaaaattg

SEQ ID NO: 208948 - DNA, 16 bp, P. troglodytes
ataaaagccatatata

SEQ ID NO: 208949 - DNA, 16 bp, P. troglodytes
ataaaagctattttaa

SEQ ID NO: 208950 - DNA, 16 bp, P. troglodytes
ataaaaggaaattttt

SEQ ID NO: 208951 - DNA, 16 bp, P. troglodytes
ataaaaggatgaattt

SEQ ID NO: 208952 - DNA, 16 bp, P. troglodytes
ataaaagggcaacatg

SEQ ID NO: 208953 - DNA, 16 bp, P. troglodytes
ataaaaggtattttaa

SEQ ID NO: 208954 - DNA, 16 bp, P. troglodytes
ataaaagtaaccattt

SEQ ID NO: 208955 - DNA, 16 bp, P. troglodytes
ataaaagtagaaatca

SEQ ID NO: 208956 - DNA, 16 bp, P. troglodytes
ataaaagtagacacat

SEQ ID NO: 208957 - DNA, 16 bp, P. troglodytes
ataaaagtggtgaaaa

SEQ ID NO: 208958 - DNA, 16 bp, P. troglodytes
ataaaagtggtgaaag

SEQ ID NO: 208959 - DNA, 16 bp, P. troglodytes
ataaaagttacatttt

SEQ ID NO: 208960 - DNA, 16 bp, P. troglodytes
ataaaagttgctgtct

SEQ ID NO: 208961 - DNA, 16 bp, P. troglodytes
ataaaagtttggaaaa

SEQ ID NO: 208962 - DNA, 16 bp, P. troglodytes
ataaaataaaacttgt

SEQ ID NO: 208963 - DNA, 16 bp, P. troglodytes
ataaaataaaatgctg

SEQ ID NO: 208964 - DNA, 16 bp, P. troglodytes
ataaaataaaattagc

SEQ ID NO: 208965 - DNA, 16 bp, P. troglodytes
ataaaataaatgcaat

SEQ ID NO: 208966 - DNA, 16 bp, P. troglodytes
ataaaataagtcttaa

SEQ ID NO: 208967 - DNA, 16 bp, P. troglodytes
ataaaataatgcattt

SEQ ID NO: 208968 - DNA, 16 bp, P. troglodytes
ataaaataattcatgt

SEQ ID NO: 208969 - DNA, 16 bp, P. troglodytes
ataaaataatttgtac

SEQ ID NO: 208970 - DNA, 16 bp, P. troglodytes
ataaaatacacatttt

SEQ ID NO: 208971 - DNA, 16 bp, P. troglodytes
ataaaatacatcttta

SEQ ID NO: 208972 - DNA, 16 bp, P. troglodytes
ataaaatactagtaaa

SEQ ID NO: 208973 - DNA, 16 bp, P. troglodytes
ataaaatacttaagaa

SEQ ID NO: 208974 - DNA, 16 bp, P. troglodytes
ataaaatagatttcaa

SEQ ID NO: 208975 - DNA, 16 bp, P. troglodytes
ataaaatatatgttga

SEQ ID NO: 208976 - DNA, 16 bp, P. troglodytes
ataaaatattatacag

SEQ ID NO: 208977 - DNA, 16 bp, P. troglodytes
ataaaatattggcaaa

SEQ ID NO: 208978 - DNA, 16 bp, P. troglodytes
ataaaatatttaggta

SEQ ID NO: 208979 - DNA, 16 bp, P. troglodytes
ataaaatattttcttg

SEQ ID NO: 208980 - DNA, 16 bp, P. troglodytes
ataaaatatttttcca

SEQ ID NO: 208981 - DNA, 16 bp, P. troglodytes
ataaaatcattttgaa

SEQ ID NO: 208982 - DNA, 16 bp, P. troglodytes
ataaaatccaatttat

SEQ ID NO: 208983 - DNA, 16 bp, P. troglodytes
ataaaatcctaagccc

SEQ ID NO: 208984 - DNA, 16 bp, P. troglodytes
ataaaatctgaataaa

SEQ ID NO: 208985 - DNA, 16 bp, P. troglodytes
ataaaatcttcacaat

SEQ ID NO: 208986 - DNA, 16 bp, P. troglodytes
ataaaatctttgtcca

SEQ ID NO: 208987 - DNA, 16 bp, P. troglodytes
ataaaatgaaaacttt

SEQ ID NO: 208988 - DNA, 16 bp, P. troglodytes
ataaaatgacatagaa

SEQ ID NO: 208989 - DNA, 16 bp, P. troglodytes
ataaaatgacttattt

SEQ ID NO: 208990 - DNA, 16 bp, P. troglodytes
ataaaatgagatgata

SEQ ID NO: 208991 - DNA, 16 bp, P. troglodytes
ataaaatgagttagtg

SEQ ID NO: 208992 - DNA, 16 bp, P. troglodytes
ataaaatgcattaaaa

SEQ ID NO: 208993 - DNA, 16 bp, P. troglodytes
ataaaatgctttttct

SEQ ID NO: 208994 - DNA, 16 bp, P. troglodytes
ataaaatgtaaacaca

SEQ ID NO: 208995 - DNA, 16 bp, P. troglodytes
ataaaatgtaaactat

SEQ ID NO: 208996 - DNA, 16 bp, P. troglodytes
ataaaatgtgatatat

SEQ ID NO: 208997 - DNA, 16 bp, P. troglodytes
ataaaatgtgattttt

SEQ ID NO: 208998 - DNA, 16 bp, P. troglodytes
ataaaatgtgtaatga

SEQ ID NO: 208999 - DNA, 16 bp, P. troglodytes
ataaaatgttaacaat

SEQ ID NO: 209000 - DNA, 16 bp, P. troglodytes
ataaaatgttaacatt

SEQ ID NO: 209001 - DNA, 16 bp, P. troglodytes
ataaaatgttacattt

SEQ ID NO: 209002 - DNA, 16 bp, P. troglodytes
ataaaatgttattaag

SEQ ID NO: 209003 - DNA, 16 bp, P. troglodytes
ataaaatgttgatatt

SEQ ID NO: 209004 - DNA, 16 bp, P. troglodytes
ataaaatgtttcattt

SEQ ID NO: 209005 - DNA, 16 bp, P. troglodytes
ataaaatgtttctctt

SEQ ID NO: 209006 - DNA, 16 bp, P. troglodytes
ataaaattaaacacct

SEQ ID NO: 209007 - DNA, 16 bp, P. troglodytes
ataaaattaaatgcct

SEQ ID NO: 209008 - DNA, 16 bp, P. troglodytes
ataaaattaactatag

SEQ ID NO: 209009 - DNA, 16 bp, P. troglodytes
ataaaattaccttcaa

SEQ ID NO: 209010 - DNA, 16 bp, P. troglodytes
ataaaattagaaatca

SEQ ID NO: 209011 - DNA, 16 bp, P. troglodytes
ataaaattcaaacttt

SEQ ID NO: 209012 - DNA, 16 bp, P. troglodytes
ataaaattcaacatcc

SEQ ID NO: 209013 - DNA, 16 bp, P. troglodytes
ataaaattcactcatt

SEQ ID NO: 209014 - DNA, 16 bp, P. troglodytes
ataaaattctagaaat

SEQ ID NO: 209015 - DNA, 16 bp, P. troglodytes
ataaaatttaaaactg

SEQ ID NO: 209016 - DNA, 16 bp, P. troglodytes
ataaaatttactgtct

SEQ ID NO: 209017 - DNA, 16 bp, P. troglodytes
ataaaatttcccattt

SEQ ID NO: 209018 - DNA, 16 bp, P. troglodytes
ataaaatttgccattt

SEQ ID NO: 209019 - DNA, 16 bp, P. troglodytes
ataaaatttggaaaga

SEQ ID NO: 209020 - DNA, 16 bp, P. troglodytes
ataaacaaagtggcca

SEQ ID NO: 209021 - DNA, 16 bp, P. troglodytes
ataaacaaataaatgg

SEQ ID NO: 209022 - DNA, 16 bp, P. troglodytes
ataaacaaatgtttat

SEQ ID NO: 209023 - DNA, 16 bp, P. troglodytes
ataaacaacagaaatg

SEQ ID NO: 209024 - DNA, 16 bp, P. troglodytes
ataaacacagaaattg

SEQ ID NO: 209025 - DNA, 16 bp, P. troglodytes
ataaacacattttatt

SEQ ID NO: 209026 - DNA, 16 bp, P. troglodytes
ataaacactgcacact

SEQ ID NO: 209027 - DNA, 16 bp, P. troglodytes
ataaacacttattttt

SEQ ID NO: 209028 - DNA, 16 bp, P. troglodytes
ataaacagaacaaatg

SEQ ID NO: 209029 - DNA, 16 bp, P. troglodytes
ataaacagtgttggga

SEQ ID NO: 209030 - DNA, 16 bp, P. troglodytes
ataaacatacacatgc

SEQ ID NO: 209031 - DNA, 16 bp, P. troglodytes
ataaacatgagaacaa

SEQ ID NO: 209032 - DNA, 16 bp, P. troglodytes
ataaacatgcatgtgt

SEQ ID NO: 209033 - DNA, 16 bp, P. troglodytes
ataaacatgggaatgc

SEQ ID NO: 209034 - DNA, 16 bp, P. troglodytes
ataaacatgtaaaaat

SEQ ID NO: 209035 - DNA, 16 bp, P. troglodytes
ataaacatgtattaat

SEQ ID NO: 209036 - DNA, 16 bp, P. troglodytes
ataaacatgtgtgcat

SEQ ID NO: 209037 - DNA, 16 bp, P. troglodytes
ataaacattcatgtac

SEQ ID NO: 209038 - DNA, 16 bp, P. troglodytes
ataaacattccttttt

SEQ ID NO: 209039 - DNA, 16 bp, P. troglodytes
ataaacattcttatac

SEQ ID NO: 209040 - DNA, 16 bp, P. troglodytes
ataaacattcttttaa

SEQ ID NO: 209041 - DNA, 16 bp, P. troglodytes
ataaacattttaatga

SEQ ID NO: 209042 - DNA, 16 bp, P. troglodytes
ataaacattttgttaa

SEQ ID NO: 209043 - DNA, 16 bp, P. troglodytes
ataaacatttttatgt

SEQ ID NO: 209044 - DNA, 16 bp, P. troglodytes
ataaaccaggcatggt

SEQ ID NO: 209045 - DNA, 16 bp, P. troglodytes
ataaaccatggaatac

SEQ ID NO: 209046 - DNA, 16 bp, P. troglodytes
ataaacctctttaaaa

SEQ ID NO: 209047 - DNA, 16 bp, P. troglodytes
ataaaccttgaaaaca

SEQ ID NO: 209048 - DNA, 16 bp, P. troglodytes
ataaacctttaatttt

SEQ ID NO: 209049 - DNA, 16 bp, P. troglodytes
ataaactcccttcttt

SEQ ID NO: 209050 - DNA, 16 bp, P. troglodytes
ataaactcttaaattt

SEQ ID NO: 209051 - DNA, 16 bp, P. troglodytes
ataaactgaaatattt

SEQ ID NO: 209052 - DNA, 16 bp, P. troglodytes
ataaactgaatgtttg

SEQ ID NO: 209053 - DNA, 16 bp, P. troglodytes
ataaactgggtggctt

SEQ ID NO: 209054 - DNA, 16 bp, P. troglodytes
ataaactgtaaagtgc

SEQ ID NO: 209055 - DNA, 16 bp, P. troglodytes
ataaactgtttaaaaa

SEQ ID NO: 209056 - DNA, 16 bp, P. troglodytes
ataaacttaacaaaga

SEQ ID NO: 209057 - DNA, 16 bp, P. troglodytes
ataaacttcctttttt

SEQ ID NO: 209058 - DNA, 16 bp, P. troglodytes
ataaacttgaaaataa

SEQ ID NO: 209059 - DNA, 16 bp, P. troglodytes
ataaacttgtttgtgg

SEQ ID NO: 209060 - DNA, 16 bp, P. troglodytes
ataaactttagaatca

SEQ ID NO: 209061 - DNA, 16 bp, P. troglodytes
ataaactttcctcttg

SEQ ID NO: 209062 - DNA, 16 bp, P. troglodytes
ataaactttggggact

SEQ ID NO: 209063 - DNA, 16 bp, P. troglodytes
ataaacttttgttttt

SEQ ID NO: 209064 - DNA, 16 bp, P. troglodytes
ataaagaaaaaggttt

SEQ ID NO: 209065 - DNA, 16 bp, P. troglodytes
ataaagaaaacacagt

SEQ ID NO: 209066 - DNA, 16 bp, P. troglodytes
ataaagaaaacacatt

SEQ ID NO: 209067 - DNA, 16 bp, P. troglodytes
ataaagaaaacattta

SEQ ID NO: 209068 - DNA, 16 bp, P. troglodytes
ataaagaaaacttttt

SEQ ID NO: 209069 - DNA, 17 bp, P. troglodytes
ataaagaaaagaggttt

SEQ ID NO: 209070 - DNA, 16 bp, P. troglodytes
ataaagaaaatgtgcc

SEQ ID NO: 209071 - DNA, 17 bp, P. troglodytes
ataaagaaaatgtggca

SEQ ID NO: 209072 - DNA, 16 bp, P. troglodytes
ataaagaaatgcccaa

SEQ ID NO: 209073 - DNA, 16 bp, P. troglodytes
ataaagaaatggaggc

SEQ ID NO: 209074 - DNA, 16 bp, P. troglodytes
ataaagaaatgttgaa

SEQ ID NO: 209075 - DNA, 16 bp, P. troglodytes
ataaagaaattatctg

SEQ ID NO: 209076 - DNA, 16 bp, P. troglodytes
ataaagaaattctctg

SEQ ID NO: 209077 - DNA, 16 bp, P. troglodytes
ataaagaacatttcca

SEQ ID NO: 209078 - DNA, 16 bp, P. troglodytes
ataaagaactctcaaa

SEQ ID NO: 209079 - DNA, 16 bp, P. troglodytes
ataaagaatatttaca

SEQ ID NO: 209080 - DNA, 16 bp, P. troglodytes
ataaagaattcaaaag

SEQ ID NO: 209081 - DNA, 16 bp, P. troglodytes
ataaagacatattttt

SEQ ID NO: 209082 - DNA, 16 bp, P. troglodytes
ataaagacatgcacac

SEQ ID NO: 209083 - DNA, 16 bp, P. troglodytes
ataaagacatttaaaa

SEQ ID NO: 209084 - DNA, 16 bp, P. troglodytes
ataaagacattttcat

SEQ ID NO: 209085 - DNA, 16 bp, P. troglodytes
ataaagacattttctt

SEQ ID NO: 209086 - DNA, 16 bp, P. troglodytes
ataaagatattcaaat

SEQ ID NO: 209087 - DNA, 16 bp, P. troglodytes
ataaagatattttctt

SEQ ID NO: 209088 - DNA, 16 bp, P. troglodytes
ataaagatcagagaag

SEQ ID NO: 209089 - DNA, 16 bp, P. troglodytes
ataaagatgagaacaa

SEQ ID NO: 209090 - DNA, 16 bp, P. troglodytes
ataaagatgcagtatt

SEQ ID NO: 209091 - DNA, 16 bp, P. troglodytes
ataaagatgggaacaa

SEQ ID NO: 209092 - DNA, 16 bp, P. troglodytes
ataaagatgttctctg

SEQ ID NO: 209093 - DNA, 16 bp, P. troglodytes
ataaagatttattgga

SEQ ID NO: 209094 - DNA, 16 bp, P. troglodytes
ataaagattttcttct

SEQ ID NO: 209095 - DNA, 16 bp, P. troglodytes
ataaagcaaacattga

SEQ ID NO: 209096 - DNA, 16 bp, P. troglodytes
ataaagcaaatgaata

SEQ ID NO: 209097 - DNA, 16 bp, P. troglodytes
ataaagcagaaaagag

SEQ ID NO: 209098 - DNA, 16 bp, P. troglodytes
ataaagcagcagcaga

SEQ ID NO: 209099 - DNA, 16 bp, P. troglodytes
ataaagcatattaaaa

SEQ ID NO: 209100 - DNA, 16 bp, P. troglodytes
ataaagccaaatgctt

SEQ ID NO: 209101 - DNA, 16 bp, P. troglodytes
ataaagctacaataat

SEQ ID NO: 209102 - DNA, 16 bp, P. troglodytes
ataaagctacagaaat

SEQ ID NO: 209103 - DNA, 16 bp, P. troglodytes
ataaagctacagttat

SEQ ID NO: 209104 - DNA, 16 bp, P. troglodytes
ataaagctgttaagaa

SEQ ID NO: 209105 - DNA, 16 bp, P. troglodytes
ataaagctgttattta

SEQ ID NO: 209106 - DNA, 16 bp, P. troglodytes
ataaagctgttttgct

SEQ ID NO: 209107 - DNA, 16 bp, P. troglodytes
ataaaggaaaatattg

SEQ ID NO: 209108 - DNA, 16 bp, P. troglodytes
ataaaggaaagagctt

SEQ ID NO: 209109 - DNA, 17 bp, P. troglodytes
ataaaggacagttcccc

SEQ ID NO: 209110 - DNA, 16 bp, P. troglodytes
ataaaggggaatttcc

SEQ ID NO: 209111 - DNA, 16 bp, P. troglodytes
ataaaggtgttctttg

SEQ ID NO: 209112 - DNA, 16 bp, P. troglodytes
ataaagtacctaggaa

SEQ ID NO: 209113 - DNA, 16 bp, P. troglodytes
ataaagtatttgtctt

SEQ ID NO: 209114 - DNA, 16 bp, P. troglodytes
ataaagtatttttaag

SEQ ID NO: 209115 - DNA, 16 bp, P. troglodytes
ataaagtcttattttt

SEQ ID NO: 209116 - DNA, 16 bp, P. troglodytes
ataaagtgcttagaat

SEQ ID NO: 209117 - DNA, 16 bp, P. troglodytes
ataaagtgtttataaa

SEQ ID NO: 209118 - DNA, 16 bp, P. troglodytes
ataaagttatagtaat

SEQ ID NO: 209119 - DNA, 16 bp, P. troglodytes
ataaagtttattttct

SEQ ID NO: 209120 - DNA, 16 bp, P. troglodytes
ataaagtttcattttt

SEQ ID NO: 209121 - DNA, 16 bp, P. troglodytes
ataaagtttttaaaag

SEQ ID NO: 209122 - DNA, 16 bp, P. troglodytes
ataaataaaacatagt

SEQ ID NO: 209123 - DNA, 16 bp, P. troglodytes
ataaataaaactgaat

SEQ ID NO: 209124 - DNA, 16 bp, P. troglodytes
ataaataaaaggcata

SEQ ID NO: 209125 - DNA, 16 bp, P. troglodytes
ataaataaaattgaca

SEQ ID NO: 209126 - DNA, 16 bp, P. troglodytes
ataaataaataaagct

SEQ ID NO: 209127 - DNA, 16 bp, P. troglodytes
ataaataaatgaatgg

SEQ ID NO: 209128 - DNA, 16 bp, P. troglodytes
ataaataaatggtggt

SEQ ID NO: 209129 - DNA, 16 bp, P. troglodytes
ataaataaatgtgaca

SEQ ID NO: 209130 - DNA, 16 bp, P. troglodytes
ataaataaatgtgttt

SEQ ID NO: 209131 - DNA, 16 bp, P. troglodytes
ataaataaattctttg

SEQ ID NO: 209132 - DNA, 16 bp, P. troglodytes
ataaataatgaggagc

SEQ ID NO: 209133 - DNA, 16 bp, P. troglodytes
ataaataatgctggaa

SEQ ID NO: 209134 - DNA, 16 bp, P. troglodytes
ataaatacataaatgt

SEQ ID NO: 209135 - DNA, 16 bp, P. troglodytes
ataaatacatagaaat

SEQ ID NO: 209136 - DNA, 16 bp, P. troglodytes
ataaatacatgcatac

SEQ ID NO: 209137 - DNA, 16 bp, P. troglodytes
ataaatacatgtataa

SEQ ID NO: 209138 - DNA, 16 bp, P. troglodytes
ataaatacatgtatat

SEQ ID NO: 209139 - DNA, 16 bp, P. troglodytes
ataaatacatttttgt

SEQ ID NO: 209140 - DNA, 16 bp, P. troglodytes
ataaatagctcatatt

SEQ ID NO: 209141 - DNA, 16 bp, P. troglodytes
ataaatagctcctatt

SEQ ID NO: 209142 - DNA, 17 bp, P. troglodytes
ataaatagttcttatta

SEQ ID NO: 209143 - DNA, 16 bp, P. troglodytes
ataaatatatgcaatt

SEQ ID NO: 209144 - DNA, 16 bp, P. troglodytes
ataaatatatttgcac

SEQ ID NO: 209145 - DNA, 16 bp, P. troglodytes
ataaatatctagaaat

SEQ ID NO: 209146 - DNA, 16 bp, P. troglodytes
ataaatatgatacacc

SEQ ID NO: 209147 - DNA, 16 bp, P. troglodytes
ataaatatgcatatat

SEQ ID NO: 209148 - DNA, 16 bp, P. troglodytes
ataaatatgtaaacat

SEQ ID NO: 209149 - DNA, 16 bp, P. troglodytes
ataaatatgtacaaat

SEQ ID NO: 209150 - DNA, 16 bp, P. troglodytes
ataaatatgtacaatt

SEQ ID NO: 209151 - DNA, 16 bp, P. troglodytes
ataaatatgtatgcat

SEQ ID NO: 209152 - DNA, 16 bp, P. troglodytes
ataaatatgtatgtat

SEQ ID NO: 209153 - DNA, 16 bp, P. troglodytes
ataaatatgtggaaat

SEQ ID NO: 209154 - DNA, 16 bp, P. troglodytes
ataaatatgtgtgttt

SEQ ID NO: 209155 - DNA, 16 bp, P. troglodytes
ataaatatgtttatgt

SEQ ID NO: 209156 - DNA, 16 bp, P. troglodytes
ataaatattgcatgtt

SEQ ID NO: 209157 - DNA, 16 bp, P. troglodytes
ataaatatttacatgt

SEQ ID NO: 209158 - DNA, 16 bp, P. troglodytes
ataaatatttatcaag

SEQ ID NO: 209159 - DNA, 16 bp, P. troglodytes
ataaatatttatgaag

SEQ ID NO: 209160 - DNA, 16 bp, P. troglodytes
ataaatatttctaaca

SEQ ID NO: 209161 - DNA, 16 bp, P. troglodytes
ataaatatttgacaaa

SEQ ID NO: 209162 - DNA, 16 bp, P. troglodytes
ataaatatttgttgac

SEQ ID NO: 209163 - DNA, 16 bp, P. troglodytes
ataaatattttaggaa

SEQ ID NO: 209164 - DNA, 16 bp, P. troglodytes
ataaatattttaggct

SEQ ID NO: 209165 - DNA, 16 bp, P. troglodytes
ataaatattttcatgt

SEQ ID NO: 209166 - DNA, 16 bp, P. troglodytes
ataaatatttttgaag

SEQ ID NO: 209167 - DNA, 16 bp, P. troglodytes
ataaatatttttgaca

SEQ ID NO: 209168 - DNA, 16 bp, P. troglodytes
ataaatcaagaaagca

SEQ ID NO: 209169 - DNA, 16 bp, P. troglodytes
ataaatcacacttttt

SEQ ID NO: 209170 - DNA, 16 bp, P. troglodytes
ataaatcacattttta

SEQ ID NO: 209171 - DNA, 16 bp, P. troglodytes
ataaatcacccagtct

SEQ ID NO: 209172 - DNA, 16 bp, P. troglodytes
ataaatcacttgcaca

SEQ ID NO: 209173 - DNA, 16 bp, P. troglodytes
ataaatcactttttaa

SEQ ID NO: 209174 - DNA, 16 bp, P. troglodytes
ataaatcattcttcta

SEQ ID NO: 209175 - DNA, 16 bp, P. troglodytes
ataaatcattgtatta

SEQ ID NO: 209176 - DNA, 16 bp, P. troglodytes
ataaatcattttgaaa

SEQ ID NO: 209177 - DNA, 16 bp, P. troglodytes
ataaatccaaatactt

SEQ ID NO: 209178 - DNA, 16 bp, P. troglodytes
ataaatccatgaaaat

SEQ ID NO: 209179 - DNA, 16 bp, P. troglodytes
ataaatcctgtgaagt

SEQ ID NO: 209180 - DNA, 16 bp, P. troglodytes
ataaatctctttaaat

SEQ ID NO: 209181 - DNA, 16 bp, P. troglodytes
ataaatcttgaaaaca

SEQ ID NO: 209182 - DNA, 16 bp, P. troglodytes
ataaatcttgctgcta

SEQ ID NO: 209183 - DNA, 16 bp, P. troglodytes
ataaatgaaaaacatt

SEQ ID NO: 209184 - DNA, 16 bp, P. troglodytes
ataaatgaaatcatat

SEQ ID NO: 209185 - DNA, 16 bp, P. troglodytes
ataaatgaataaattc

SEQ ID NO: 209186 - DNA, 16 bp, P. troglodytes
ataaatgaatgaatgg

SEQ ID NO: 209187 - DNA, 16 bp, P. troglodytes
ataaatgaatgattta

SEQ ID NO: 209188 - DNA, 16 bp, P. troglodytes
ataaatgaattttgtg

SEQ ID NO: 209189 - DNA, 16 bp, P. troglodytes
ataaatgatgctgtga

SEQ ID NO: 209190 - DNA, 16 bp, P. troglodytes
ataaatgcaattaaaa

SEQ ID NO: 209191 - DNA, 16 bp, P. troglodytes
ataaatgcatattatt

SEQ ID NO: 209192 - DNA, 16 bp, P. troglodytes
ataaatgcattatttt

SEQ ID NO: 209193 - DNA, 16 bp, P. troglodytes
ataaatgcctggagtg

SEQ ID NO: 209194 - DNA, 16 bp, P. troglodytes
ataaatgctgtgaaga

SEQ ID NO: 209195 - DNA, 16 bp, P. troglodytes
ataaatgcttaataaa

SEQ ID NO: 209196 - DNA, 16 bp, P. troglodytes
ataaatggaaaaacat

SEQ ID NO: 209197 - DNA, 16 bp, P. troglodytes
ataaatggaaagatac

SEQ ID NO: 209198 - DNA, 16 bp, P. troglodytes
ataaatggaataaaca

SEQ ID NO: 209199 - DNA, 22 bp, P. troglodytes
ataaatggaatcatataatatg

SEQ ID NO: 209200 - DNA, 16 bp, P. troglodytes
ataaatggaatcatgt

SEQ ID NO: 209201 - DNA, 16 bp, P. troglodytes
ataaatggagaaacaa

SEQ ID NO: 209202 - DNA, 16 bp, P. troglodytes
ataaatggattttaaa

SEQ ID NO: 209203 - DNA, 16 bp, P. troglodytes
ataaatggcagagcca

SEQ ID NO: 209204 - DNA, 16 bp, P. troglodytes
ataaatggctgttatt

SEQ ID NO: 209205 - DNA, 16 bp, P. troglodytes
ataaatgggacttaat

SEQ ID NO: 209206 - DNA, 16 bp, P. troglodytes
ataaatgggtaaacat

SEQ ID NO: 209207 - DNA, 16 bp, P. troglodytes
ataaatggtagctgtt

SEQ ID NO: 209208 - DNA, 16 bp, P. troglodytes
ataaatggtgccggga

SEQ ID NO: 209209 - DNA, 16 bp, P. troglodytes
ataaatggtgctgcga

SEQ ID NO: 209210 - DNA, 16 bp, P. troglodytes
ataaatggttattgtt

SEQ ID NO: 209211 - DNA, 16 bp, P. troglodytes
ataaatgtacattaaa

SEQ ID NO: 209212 - DNA, 16 bp, P. troglodytes
ataaatgtataaatgt

SEQ ID NO: 209213 - DNA, 16 bp, P. troglodytes
ataaatgtatacaatt

SEQ ID NO: 209214 - DNA, 16 bp, P. troglodytes
ataaatgtattttgaa

SEQ ID NO: 209215 - DNA, 16 bp, P. troglodytes
ataaatgtcaaataaa

SEQ ID NO: 209216 - DNA, 16 bp, P. troglodytes
ataaatgtcaattaaa

SEQ ID NO: 209217 - DNA, 16 bp, P. troglodytes
ataaatgtccatgaaa

SEQ ID NO: 209218 - DNA, 16 bp, P. troglodytes
ataaatgtctattatt

SEQ ID NO: 209219 - DNA, 16 bp, P. troglodytes
ataaatgtggaaaata

SEQ ID NO: 209220 - DNA, 16 bp, P. troglodytes
ataaatgtgtacaatt

SEQ ID NO: 209221 - DNA, 16 bp, P. troglodytes
ataaatgtgtatatat

SEQ ID NO: 209222 - DNA, 16 bp, P. troglodytes
ataaatgtgtgaattt

SEQ ID NO: 209223 - DNA, 16 bp, P. troglodytes
ataaatgtgtgtatat

SEQ ID NO: 209224 - DNA, 16 bp, P. troglodytes
ataaatgtgttattaa

SEQ ID NO: 209225 - DNA, 16 bp, P. troglodytes
ataaatgtgtttgtgt

SEQ ID NO: 209226 - DNA, 16 bp, P. troglodytes
ataaatgttaaaaaca

SEQ ID NO: 209227 - DNA, 16 bp, P. troglodytes
ataaatgttaattacc

SEQ ID NO: 209228 - DNA, 16 bp, P. troglodytes
ataaatgttagctgct

SEQ ID NO: 209229 - DNA, 16 bp, P. troglodytes
ataaatgttagtttcc

SEQ ID NO: 209230 - DNA, 16 bp, P. troglodytes
ataaatgttcatttta

SEQ ID NO: 209231 - DNA, 16 bp, P. troglodytes
ataaatgtttatcaaa

SEQ ID NO: 209232 - DNA, 16 bp, P. troglodytes
ataaatgtttattttc

SEQ ID NO: 209233 - DNA, 16 bp, P. troglodytes
ataaatgtttgttgaa

SEQ ID NO: 209234 - DNA, 16 bp, P. troglodytes
ataaatgttttcattt

SEQ ID NO: 209235 - DNA, 16 bp, P. troglodytes
ataaatgtttttaatg

SEQ ID NO: 209236 - DNA, 16 bp, P. troglodytes
ataaattaagctttat

SEQ ID NO: 209237 - DNA, 16 bp, P. troglodytes
ataaattaccaatatc

SEQ ID NO: 209238 - DNA, 16 bp, P. troglodytes
ataaattactcagttt

SEQ ID NO: 209239 - DNA, 16 bp, P. troglodytes
ataaattactgttgtt

SEQ ID NO: 209240 - DNA, 16 bp, P. troglodytes
ataaattacttagtct

SEQ ID NO: 209241 - DNA, 16 bp, P. troglodytes
ataaattacttttggc

SEQ ID NO: 209242 - DNA, 16 bp, P. troglodytes
ataaattaggtatgga

SEQ ID NO: 209243 - DNA, 16 bp, P. troglodytes
ataaattatggtaaat

SEQ ID NO: 209244 - DNA, 16 bp, P. troglodytes
ataaattatgtttcaa

SEQ ID NO: 209245 - DNA, 16 bp, P. troglodytes
ataaattattaactgt

SEQ ID NO: 209246 - DNA, 16 bp, P. troglodytes
ataaattcaatgaaat

SEQ ID NO: 209247 - DNA, 16 bp, P. troglodytes
ataaattcagaaaagt

SEQ ID NO: 209248 - DNA, 16 bp, P. troglodytes
ataaattcccagaagt

SEQ ID NO: 209249 - DNA, 16 bp, P. troglodytes
ataaattcctggaaat

SEQ ID NO: 209250 - DNA, 16 bp, P. troglodytes
ataaattcttaaaatg

SEQ ID NO: 209251 - DNA, 16 bp, P. troglodytes
ataaattgcaagaaaa

SEQ ID NO: 209252 - DNA, 16 bp, P. troglodytes
ataaattgctttttaa

SEQ ID NO: 209253 - DNA, 16 bp, P. troglodytes
ataaattggaagaatt

SEQ ID NO: 209254 - DNA, 16 bp, P. troglodytes
ataaattgtgttatat

SEQ ID NO: 209255 - DNA, 16 bp, P. troglodytes
ataaattgttctatta

SEQ ID NO: 209256 - DNA, 16 bp, P. troglodytes
ataaattgtttccttt

SEQ ID NO: 209257 - DNA, 16 bp, P. troglodytes
ataaatttaacaaaga

SEQ ID NO: 209258 - DNA, 16 bp, P. troglodytes
ataaatttcagttgtt

SEQ ID NO: 209259 - DNA, 16 bp, P. troglodytes
ataaatttcctttctt

SEQ ID NO: 209260 - DNA, 16 bp, P. troglodytes
ataaatttgacaaatt

SEQ ID NO: 209261 - DNA, 16 bp, P. troglodytes
ataaatttgacttcat

SEQ ID NO: 209262 - DNA, 16 bp, P. troglodytes
ataaatttgtgctgtt

SEQ ID NO: 209263 - DNA, 16 bp, P. troglodytes
ataaattttagaacaa

SEQ ID NO: 209264 - DNA, 16 bp, P. troglodytes
ataaattttagcaagt

SEQ ID NO: 209265 - DNA, 16 bp, P. troglodytes
ataaattttatatgca

SEQ ID NO: 209266 - DNA, 16 bp, P. troglodytes
ataaattttgacaaat

SEQ ID NO: 209267 - DNA, 16 bp, P. troglodytes
ataacaaaataccaga

SEQ ID NO: 209268 - DNA, 16 bp, P. troglodytes
ataacaaaatgcctta

SEQ ID NO: 209269 - DNA, 16 bp, P. troglodytes
ataacaaaatgtcaca

SEQ ID NO: 209270 - DNA, 17 bp, P. troglodytes
ataacaaactgtccctc

SEQ ID NO: 209271 - DNA, 16 bp, P. troglodytes
ataacaaatgtttgtt

SEQ ID NO: 209272 - DNA, 16 bp, P. troglodytes
ataacaacttctgaaa

SEQ ID NO: 209273 - DNA, 16 bp, P. troglodytes
ataacaagctccaaaa

SEQ ID NO: 209274 - DNA, 16 bp, P. troglodytes
ataacaatattaatct

SEQ ID NO: 209275 - DNA, 16 bp, P. troglodytes
ataacaatttcttttc

SEQ ID NO: 209276 - DNA, 16 bp, P. troglodytes
ataacacaggaacaga

SEQ ID NO: 209277 - DNA, 16 bp, P. troglodytes
ataacagaaaataatt

SEQ ID NO: 209278 - DNA, 16 bp, P. troglodytes
ataacagaaaattatt

SEQ ID NO: 209279 - DNA, 16 bp, P. troglodytes
ataacagcaattgttc

SEQ ID NO: 209280 - DNA, 16 bp, P. troglodytes
ataacatagagaagga

SEQ ID NO: 209281 - DNA, 16 bp, P. troglodytes
ataacatcatgttgta

SEQ ID NO: 209282 - DNA, 16 bp, P. troglodytes
ataacatctccaacca

SEQ ID NO: 209283 - DNA, 16 bp, P. troglodytes
ataacattaaaaatgt

SEQ ID NO: 209284 - DNA, 16 bp, P. troglodytes
ataacatttcattgta

SEQ ID NO: 209285 - DNA, 16 bp, P. troglodytes
ataacatttcttcttt

SEQ ID NO: 209286 - DNA, 16 bp, P. troglodytes
ataacatttgaatttt

SEQ ID NO: 209287 - DNA, 16 bp, P. troglodytes
ataacattttgaaaat

SEQ ID NO: 209288 - DNA, 16 bp, P. troglodytes
ataaccaaaacagcat

SEQ ID NO: 209289 - DNA, 16 bp, P. troglodytes
ataaccaaggaactca

SEQ ID NO: 209290 - DNA, 16 bp, P. troglodytes
ataaccaatttagaga

SEQ ID NO: 209291 - DNA, 16 bp, P. troglodytes
ataaccagaatatata

SEQ ID NO: 209292 - DNA, 16 bp, P. troglodytes
ataacccagttaaaaa

SEQ ID NO: 209293 - DNA, 16 bp, P. troglodytes
ataaccctggggaagg

SEQ ID NO: 209294 - DNA, 16 bp, P. troglodytes
ataacctaggaaaaac

SEQ ID NO: 209295 - DNA, 16 bp, P. troglodytes
ataacctatgcacatc

SEQ ID NO: 209296 - DNA, 16 bp, P. troglodytes
ataacctcagcacttt

SEQ ID NO: 209297 - DNA, 16 bp, P. troglodytes
ataaccttgggcaagt

SEQ ID NO: 209298 - DNA, 16 bp, P. troglodytes
ataactactttgatat

SEQ ID NO: 209299 - DNA, 16 bp, P. troglodytes
ataactcattattttg

SEQ ID NO: 209300 - DNA, 16 bp, P. troglodytes
ataactctagtatgaa

SEQ ID NO: 209301 - DNA, 16 bp, P. troglodytes
ataactgaaaatgaaa

SEQ ID NO: 209302 - DNA, 16 bp, P. troglodytes
ataactgaaattttat

SEQ ID NO: 209303 - DNA, 16 bp, P. troglodytes
ataactgtgattaata

SEQ ID NO: 209304 - DNA, 16 bp, P. troglodytes
ataactgttctcattt

SEQ ID NO: 209305 - DNA, 16 bp, P. troglodytes
ataacttaaaactttt

SEQ ID NO: 209306 - DNA, 16 bp, P. troglodytes
ataacttatgggaaaa

SEQ ID NO: 209307 - DNA, 16 bp, P. troglodytes
ataacttattttaaga

SEQ ID NO: 209308 - DNA, 16 bp, P. troglodytes
ataacttgatttaaaa

SEQ ID NO: 209309 - DNA, 16 bp, P. troglodytes
ataacttgctgcaact

SEQ ID NO: 209310 - DNA, 16 bp, P. troglodytes
ataactttaaaaagaa

SEQ ID NO: 209311 - DNA, 16 bp, P. troglodytes
ataagaaaatatttgc

SEQ ID NO: 209312 - DNA, 16 bp, P. troglodytes
ataagaaaatgaacat

SEQ ID NO: 209313 - DNA, 16 bp, P. troglodytes
ataagaaaatggaggc

SEQ ID NO: 209314 - DNA, 16 bp, P. troglodytes
ataagaaaattgaggt

SEQ ID NO: 209315 - DNA, 16 bp, P. troglodytes
ataagaacagcatggg

SEQ ID NO: 209316 - DNA, 16 bp, P. troglodytes
ataagaagcaacttct

SEQ ID NO: 209317 - DNA, 16 bp, P. troglodytes
ataagaatcacctgga

SEQ ID NO: 209318 - DNA, 16 bp, P. troglodytes
ataagaatgtggattt

SEQ ID NO: 209319 - DNA, 16 bp, P. troglodytes
ataagaattattttga

SEQ ID NO: 209320 - DNA, 16 bp, P. troglodytes
ataagaattgcttgaa

SEQ ID NO: 209321 - DNA, 16 bp, P. troglodytes
ataagaatttttcagc

SEQ ID NO: 209322 - DNA, 16 bp, P. troglodytes
ataagactttggactt

SEQ ID NO: 209323 - DNA, 16 bp, P. troglodytes
ataagactttttaaag

SEQ ID NO: 209324 - DNA, 16 bp, P. troglodytes
ataagagaatattatg

SEQ ID NO: 209325 - DNA, 16 bp, P. troglodytes
ataagagctaaaacca

SEQ ID NO: 209326 - DNA, 16 bp, P. troglodytes
ataagagtagtttaca

SEQ ID NO: 209327 - DNA, 16 bp, P. troglodytes
ataagataatatatgt

SEQ ID NO: 209328 - DNA, 16 bp, P. troglodytes
ataagatcatgccatc

SEQ ID NO: 209329 - DNA, 16 bp, P. troglodytes
ataagatgttttatgt

SEQ ID NO: 209330 - DNA, 16 bp, P. troglodytes
ataagcaaactgtggt

SEQ ID NO: 209331 - DNA, 16 bp, P. troglodytes
ataagcaaagaaagtg

SEQ ID NO: 209332 - DNA, 17 bp, P. troglodytes
ataagcaacttcaccaa

SEQ ID NO: 209333 - DNA, 16 bp, P. troglodytes
ataagcaacttcagaa

SEQ ID NO: 209334 - DNA, 16 bp, P. troglodytes
ataagcactttttaaa

SEQ ID NO: 209335 - DNA, 16 bp, P. troglodytes
ataagcaggagttgaa

SEQ ID NO: 209336 - DNA, 16 bp, P. troglodytes
ataagcattcccttct

SEQ ID NO: 209337 - DNA, 16 bp, P. troglodytes
ataagcatttctaatg

SEQ ID NO: 209338 - DNA, 16 bp, P. troglodytes
ataagcatttttttaa

SEQ ID NO: 209339 - DNA, 16 bp, P. troglodytes
ataagccacagcaccc

SEQ ID NO: 209340 - DNA, 16 bp, P. troglodytes
ataagccagacataga

SEQ ID NO: 209341 - DNA, 16 bp, P. troglodytes
ataagccaggctcaga

SEQ ID NO: 209342 - DNA, 16 bp, P. troglodytes
ataagccattgtgccc

SEQ ID NO: 209343 - DNA, 16 bp, P. troglodytes
ataagccctgggtctg

SEQ ID NO: 209344 - DNA, 16 bp, P. troglodytes
ataaggaaaccaagac

SEQ ID NO: 209345 - DNA, 16 bp, P. troglodytes
ataaggaaattgaggc

SEQ ID NO: 209346 - DNA, 16 bp, P. troglodytes
ataaggcaccagagac

SEQ ID NO: 209347 - DNA, 16 bp, P. troglodytes
ataagggaataaaagc

SEQ ID NO: 209348 - DNA, 16 bp, P. troglodytes
ataagggagaacatgc

SEQ ID NO: 209349 - DNA, 16 bp, P. troglodytes
ataagggaggactact

SEQ ID NO: 209350 - DNA, 16 bp, P. troglodytes
ataaggtataaagaag

SEQ ID NO: 209351 - DNA, 16 bp, P. troglodytes
ataagtctcaggagat

SEQ ID NO: 209352 - DNA, 16 bp, P. troglodytes
ataagtgaaaacatgt

SEQ ID NO: 209353 - DNA, 16 bp, P. troglodytes
ataagtgaatcatggg

SEQ ID NO: 209354 - DNA, 16 bp, P. troglodytes
ataagtggatggatgg

SEQ ID NO: 209355 - DNA, 16 bp, P. troglodytes
ataagttgaaaatgca

SEQ ID NO: 209356 - DNA, 16 bp, P. troglodytes
ataagtttttatttct

SEQ ID NO: 209357 - DNA, 16 bp, P. troglodytes
ataataaaaactgtaa

SEQ ID NO: 209358 - DNA, 16 bp, P. troglodytes
ataataaaaagcattt

SEQ ID NO: 209359 - DNA, 16 bp, P. troglodytes
ataataaaactgtaat

SEQ ID NO: 209360 - DNA, 16 bp, P. troglodytes
ataataaaacttgaaa

SEQ ID NO: 209361 - DNA, 16 bp, P. troglodytes
ataataaaatacttag

SEQ ID NO: 209362 - DNA, 16 bp, P. troglodytes
ataataaaatgctttt

SEQ ID NO: 209363 - DNA, 16 bp, P. troglodytes
ataataaacacttttt

SEQ ID NO: 209364 - DNA, 16 bp, P. troglodytes
ataataaactgtctct

SEQ ID NO: 209365 - DNA, 16 bp, P. troglodytes
ataataaatctctttt

SEQ ID NO: 209366 - DNA, 16 bp, P. troglodytes
ataataaatgtaaaac

SEQ ID NO: 209367 - DNA, 16 bp, P. troglodytes
ataataaatgtgtttt

SEQ ID NO: 209368 - DNA, 16 bp, P. troglodytes
ataataacaaatgttg

SEQ ID NO: 209369 - DNA, 16 bp, P. troglodytes
ataataactatttaca

SEQ ID NO: 209370 - DNA, 16 bp, P. troglodytes
ataataagcatttttt

SEQ ID NO: 209371 - DNA, 16 bp, P. troglodytes
ataataataaaatcag

SEQ ID NO: 209372 - DNA, 16 bp, P. troglodytes
ataataataacagtat

SEQ ID NO: 209373 - DNA, 16 bp, P. troglodytes
ataataataataatgc

SEQ ID NO: 209374 - DNA, 16 bp, P. troglodytes
ataataataattgctt

SEQ ID NO: 209375 - DNA, 16 bp, P. troglodytes
ataataatacctatct

SEQ ID NO: 209376 - DNA, 16 bp, P. troglodytes
ataataatacctccct

SEQ ID NO: 209377 - DNA, 16 bp, P. troglodytes
ataataatagaaatca

SEQ ID NO: 209378 - DNA, 16 bp, P. troglodytes
ataataatagttaaca

SEQ ID NO: 209379 - DNA, 16 bp, P. troglodytes
ataataatatactgta

SEQ ID NO: 209380 - DNA, 16 bp, P. troglodytes
ataataatcattctga

SEQ ID NO: 209381 - DNA, 16 bp, P. troglodytes
ataataatgcctacct

SEQ ID NO: 209382 - DNA, 16 bp, P. troglodytes
ataataattacatcat

SEQ ID NO: 209383 - DNA, 16 bp, P. troglodytes
ataataattgtaccta

SEQ ID NO: 209384 - DNA, 16 bp, P. troglodytes
ataataatttaactgt

SEQ ID NO: 209385 - DNA, 16 bp, P. troglodytes
ataatacagagaaatc

SEQ ID NO: 209386 - DNA, 16 bp, P. troglodytes
ataatacatttatgtt

SEQ ID NO: 209387 - DNA, 16 bp, P. troglodytes
ataataccaagtgttg

SEQ ID NO: 209388 - DNA, 16 bp, P. troglodytes
ataatacctacctcat

SEQ ID NO: 209389 - DNA, 16 bp, P. troglodytes
ataatactgatatttt

SEQ ID NO: 209390 - DNA, 16 bp, P. troglodytes
ataatactgctataaa

SEQ ID NO: 209391 - DNA, 16 bp, P. troglodytes
ataatagacttttttt

SEQ ID NO: 209392 - DNA, 16 bp, P. troglodytes
ataatagcaaacattt

SEQ ID NO: 209393 - DNA, 16 bp, P. troglodytes
ataataggccacaaaa

SEQ ID NO: 209394 - DNA, 16 bp, P. troglodytes
ataatatatagtatac

SEQ ID NO: 209395 - DNA, 16 bp, P. troglodytes
ataatatatgtaaagt

SEQ ID NO: 209396 - DNA, 16 bp, P. troglodytes
ataatatcaagtgttt

SEQ ID NO: 209397 - DNA, 16 bp, P. troglodytes
ataatatggtttggat

SEQ ID NO: 209398 - DNA, 16 bp, P. troglodytes
ataatatggtttggct

SEQ ID NO: 209399 - DNA, 16 bp, P. troglodytes
ataatattaatagcaa

SEQ ID NO: 209400 - DNA, 16 bp, P. troglodytes
ataatattacattgta

SEQ ID NO: 209401 - DNA, 16 bp, P. troglodytes
ataatattctttgttt

SEQ ID NO: 209402 - DNA, 16 bp, P. troglodytes
ataatattgagtcttc

SEQ ID NO: 209403 - DNA, 16 bp, P. troglodytes
ataatattgttaagat

SEQ ID NO: 209404 - DNA, 16 bp, P. troglodytes
ataatatttctgaaaa

SEQ ID NO: 209405 - DNA, 16 bp, P. troglodytes
ataatattttaaagga

SEQ ID NO: 209406 - DNA, 16 bp, P. troglodytes
ataatattttcatttg

SEQ ID NO: 209407 - DNA, 16 bp, P. troglodytes
ataatcaatattgtga

SEQ ID NO: 209408 - DNA, 16 bp, P. troglodytes
ataatcacacacacac

SEQ ID NO: 209409 - DNA, 16 bp, P. troglodytes
ataatcacataatttt

SEQ ID NO: 209410 - DNA, 16 bp, P. troglodytes
ataatcatcatcataa

SEQ ID NO: 209411 - DNA, 16 bp, P. troglodytes
ataatcatgtattttt

SEQ ID NO: 209412 - DNA, 16 bp, P. troglodytes
ataatcatgtgctttt

SEQ ID NO: 209413 - DNA, 16 bp, P. troglodytes
ataatcatttggtttt

SEQ ID NO: 209414 - DNA, 16 bp, P. troglodytes
ataatccatgaaagaa

SEQ ID NO: 209415 - DNA, 16 bp, P. troglodytes
ataatcccagcactct

SEQ ID NO: 209416 - DNA, 18 bp, P. troglodytes
ataatcccagctacttga

SEQ ID NO: 209417 - DNA, 16 bp, P. troglodytes
ataatccccacgtgtc

SEQ ID NO: 209418 - DNA, 16 bp, P. troglodytes
ataatccccatgtgtg

SEQ ID NO: 209419 - DNA, 16 bp, P. troglodytes
ataatcctcctgggaa

SEQ ID NO: 209420 - DNA, 16 bp, P. troglodytes
ataatccttatgccaa

SEQ ID NO: 209421 - DNA, 16 bp, P. troglodytes
ataatctcagtgcttt

SEQ ID NO: 209422 - DNA, 16 bp, P. troglodytes
ataatctccttatttt

SEQ ID NO: 209423 - DNA, 16 bp, P. troglodytes
ataatctcctttgact

SEQ ID NO: 209424 - DNA, 16 bp, P. troglodytes
ataatctcctttgatt

SEQ ID NO: 209425 - DNA, 16 bp, P. troglodytes
ataatctgatttaaaa

SEQ ID NO: 209426 - DNA, 16 bp, P. troglodytes
ataatctgtacaacga

SEQ ID NO: 209427 - DNA, 16 bp, P. troglodytes
ataatcttttaagaaa

SEQ ID NO: 209428 - DNA, 16 bp, P. troglodytes
ataatgaaaaactgaa

SEQ ID NO: 209429 - DNA, 16 bp, P. troglodytes
ataatgaaaatgttct

SEQ ID NO: 209430 - DNA, 16 bp, P. troglodytes
ataatgaaataattct

SEQ ID NO: 209431 - DNA, 16 bp, P. troglodytes
ataatgaaatagttat

SEQ ID NO: 209432 - DNA, 16 bp, P. troglodytes
ataatgaaatcaattt

SEQ ID NO: 209433 - DNA, 16 bp, P. troglodytes
ataatgactttctttt

SEQ ID NO: 209434 - DNA, 16 bp, P. troglodytes
ataatgagatatcttg

SEQ ID NO: 209435 - DNA, 16 bp, P. troglodytes
ataatgaggtatcttg

SEQ ID NO: 209436 - DNA, 16 bp, P. troglodytes
ataatgagtttttaaa

SEQ ID NO: 209437 - DNA, 16 bp, P. troglodytes
ataatgataaagaagt

SEQ ID NO: 209438 - DNA, 16 bp, P. troglodytes
ataatgataaagtgtt

SEQ ID NO: 209439 - DNA, 16 bp, P. troglodytes
ataatgataacaataa

SEQ ID NO: 209440 - DNA, 16 bp, P. troglodytes
ataatgatgaaaatga

SEQ ID NO: 209441 - DNA, 16 bp, P. troglodytes
ataatgatgatgaaaa

SEQ ID NO: 209442 - DNA, 16 bp, P. troglodytes
ataatgatgatgataa

SEQ ID NO: 209443 - DNA, 16 bp, P. troglodytes
ataatgatgatgatga

SEQ ID NO: 209444 - DNA, 16 bp, P. troglodytes
ataatgcaaaaataat

SEQ ID NO: 209445 - DNA, 16 bp, P. troglodytes
ataatgcaacaataaa

SEQ ID NO: 209446 - DNA, 16 bp, P. troglodytes
ataatgcattatatat

SEQ ID NO: 209447 - DNA, 16 bp, P. troglodytes
ataatgccactgtact

SEQ ID NO: 209448 - DNA, 16 bp, P. troglodytes
ataatgctataatgaa

SEQ ID NO: 209449 - DNA, 16 bp, P. troglodytes
ataatgctgcaattaa

SEQ ID NO: 209450 - DNA, 16 bp, P. troglodytes
ataatgctgcatatct

SEQ ID NO: 209451 - DNA, 16 bp, P. troglodytes
ataatgctgccatgaa

SEQ ID NO: 209452 - DNA, 16 bp, P. troglodytes
ataatgctgctaggaa

SEQ ID NO: 209453 - DNA, 16 bp, P. troglodytes
ataatgctgctgtgga

SEQ ID NO: 209454 - DNA, 16 bp, P. troglodytes
ataatggaaataattt

SEQ ID NO: 209455 - DNA, 16 bp, P. troglodytes
ataatggaatgattta

SEQ ID NO: 209456 - DNA, 16 bp, P. troglodytes
ataatggagtactatt

SEQ ID NO: 209457 - DNA, 16 bp, P. troglodytes
ataatggcctccagct

SEQ ID NO: 209458 - DNA, 16 bp, P. troglodytes
ataatggctgaaaaca

SEQ ID NO: 209459 - DNA, 16 bp, P. troglodytes
ataatggcttccagct

SEQ ID NO: 209460 - DNA, 16 bp, P. troglodytes
ataatgggagaattta

SEQ ID NO: 209461 - DNA, 16 bp, P. troglodytes
ataatggtgatggttg

SEQ ID NO: 209462 - DNA, 16 bp, P. troglodytes
ataatgtacataaaat

SEQ ID NO: 209463 - DNA, 16 bp, P. troglodytes
ataatgtatgtataat

SEQ ID NO: 209464 - DNA, 16 bp, P. troglodytes
ataatgtatttaacca

SEQ ID NO: 209465 - DNA, 16 bp, P. troglodytes
ataatgtgtctttttt

SEQ ID NO: 209466 - DNA, 16 bp, P. troglodytes
ataatgttgaatgaaa

SEQ ID NO: 209467 - DNA, 16 bp, P. troglodytes
ataatgtttctaaaat

SEQ ID NO: 209468 - DNA, 16 bp, P. troglodytes
ataattaaaagggaag

SEQ ID NO: 209469 - DNA, 16 bp, P. troglodytes
ataattacacatattt

SEQ ID NO: 209470 - DNA, 16 bp, P. troglodytes
ataattattatttcca

SEQ ID NO: 209471 - DNA, 16 bp, P. troglodytes
ataattatttttcaca

SEQ ID NO: 209472 - DNA, 16 bp, P. troglodytes
ataattcccacatgct

SEQ ID NO: 209473 - DNA, 16 bp, P. troglodytes
ataattctgaaaaaaa

SEQ ID NO: 209474 - DNA, 16 bp, P. troglodytes
ataattctttgttatg

SEQ ID NO: 209475 - DNA, 16 bp, P. troglodytes
ataattgatatgattt

SEQ ID NO: 209476 - DNA, 16 bp, P. troglodytes
ataattgccaaaaagt

SEQ ID NO: 209477 - DNA, 16 bp, P. troglodytes
ataattgccattctga

SEQ ID NO: 209478 - DNA, 16 bp, P. troglodytes
ataattgtacatattt

SEQ ID NO: 209479 - DNA, 16 bp, P. troglodytes
ataattgtcattattt

SEQ ID NO: 209480 - DNA, 16 bp, P. troglodytes
ataatttacatgcaat

SEQ ID NO: 209481 - DNA, 16 bp, P. troglodytes
ataatttagaaacaaa

SEQ ID NO: 209482 - DNA, 16 bp, P. troglodytes
ataatttcacatattt

SEQ ID NO: 209483 - DNA, 16 bp, P. troglodytes
ataatttcagttttct

SEQ ID NO: 209484 - DNA, 16 bp, P. troglodytes
ataatttctgaaattt

SEQ ID NO: 209485 - DNA, 16 bp, P. troglodytes
ataatttctgagattt

SEQ ID NO: 209486 - DNA, 16 bp, P. troglodytes
ataatttctgttgttt

SEQ ID NO: 209487 - DNA, 16 bp, P. troglodytes
ataatttgagtcttct

SEQ ID NO: 209488 - DNA, 16 bp, P. troglodytes
ataatttggccaaacc

SEQ ID NO: 209489 - DNA, 16 bp, P. troglodytes
ataattttaaaaagac

SEQ ID NO: 209490 - DNA, 16 bp, P. troglodytes
ataattttaaaagtca

SEQ ID NO: 209491 - DNA, 16 bp, P. troglodytes
ataattttaaaatgca

SEQ ID NO: 209492 - DNA, 16 bp, P. troglodytes
ataattttaaccattt

SEQ ID NO: 209493 - DNA, 16 bp, P. troglodytes
ataattttagaccaat

SEQ ID NO: 209494 - DNA, 16 bp, P. troglodytes
ataattttagatttac

SEQ ID NO: 209495 - DNA, 16 bp, P. troglodytes
ataattttcattttgt

SEQ ID NO: 209496 - DNA, 16 bp, P. troglodytes
ataattttcttctaaa

SEQ ID NO: 209497 - DNA, 16 bp, P. troglodytes
ataattttgctatttt

SEQ ID NO: 209498 - DNA, 16 bp, P. troglodytes
ataattttggaataca

SEQ ID NO: 209499 - DNA, 16 bp, P. troglodytes
ataatttttaaagctg

SEQ ID NO: 209500 - DNA, 16 bp, P. troglodytes
ataatttttcaaatgt

SEQ ID NO: 209501 - DNA, 16 bp, P. troglodytes
ataatttttcattttg

SEQ ID NO: 209502 - DNA, 16 bp, P. troglodytes
ataatttttgaaaaga

SEQ ID NO: 209503 - DNA, 16 bp, P. troglodytes
ataatttttggttgaa

SEQ ID NO: 209504 - DNA, 16 bp, P. troglodytes
ataatttttgtatctt

SEQ ID NO: 209505 - DNA, 16 bp, P. troglodytes
ataatttttgttaaag

SEQ ID NO: 209506 - DNA, 16 bp, P. troglodytes
ataattttttgtactt

SEQ ID NO: 209507 - DNA, 16 bp, P. troglodytes
ataatttttttaaagg

SEQ ID NO: 209508 - DNA, 16 bp, P. troglodytes
ataatttttttctgca

SEQ ID NO: 209509 - DNA, 16 bp, P. troglodytes
atacaaaaaaaagttt

SEQ ID NO: 209510 - DNA, 16 bp, P. troglodytes
atacaaaaatcaattg

SEQ ID NO: 209511 - DNA, 16 bp, P. troglodytes
atacaaaaatcagcta

SEQ ID NO: 209512 - DNA, 16 bp, P. troglodytes
atacaaaaattggtca

SEQ ID NO: 209513 - DNA, 16 bp, P. troglodytes
atacaaaagcaatgtg

SEQ ID NO: 209514 - DNA, 16 bp, P. troglodytes
atacaaaagttagctg

SEQ ID NO: 209515 - DNA, 16 bp, P. troglodytes
atacaaaatatattct

SEQ ID NO: 209516 - DNA, 16 bp, P. troglodytes
atacaaaatcaacatt

SEQ ID NO: 209517 - DNA, 16 bp, P. troglodytes
atacaaaatcaatctg

SEQ ID NO: 209518 - DNA, 16 bp, P. troglodytes
atacaaaatggactaa

SEQ ID NO: 209519 - DNA, 16 bp, P. troglodytes
atacaaaattaaccag

SEQ ID NO: 209520 - DNA, 16 bp, P. troglodytes
atacaaacaattagcc

SEQ ID NO: 209521 - DNA, 16 bp, P. troglodytes
atacaaagaaacagga

SEQ ID NO: 209522 - DNA, 16 bp, P. troglodytes
atacaaagattttttt

SEQ ID NO: 209523 - DNA, 16 bp, P. troglodytes
atacaaagttaatata

SEQ ID NO: 209524 - DNA, 16 bp, P. troglodytes
atacaaataaatgttt

SEQ ID NO: 209525 - DNA, 16 bp, P. troglodytes
atacaaatatacacat

SEQ ID NO: 209526 - DNA, 16 bp, P. troglodytes
atacaaatatatgcat

SEQ ID NO: 209527 - DNA, 16 bp, P. troglodytes
atacaaatggcaaaca

SEQ ID NO: 209528 - DNA, 16 bp, P. troglodytes
atacaaatgtaaataa

SEQ ID NO: 209529 - DNA, 16 bp, P. troglodytes
atacaaatgtaacaaa

SEQ ID NO: 209530 - DNA, 21 bp, P. troglodytes
atacaacacatgtttttgtga

SEQ ID NO: 209531 - DNA, 16 bp, P. troglodytes
atacaacatgatcaag

SEQ ID NO: 209532 - DNA, 16 bp, P. troglodytes
atacaactcaccatca

SEQ ID NO: 209533 - DNA, 16 bp, P. troglodytes
atacaagaatgttcat

SEQ ID NO: 209534 - DNA, 16 bp, P. troglodytes
atacaagatgagcctg

SEQ ID NO: 209535 - DNA, 16 bp, P. troglodytes
atacaagcaaactgaa

SEQ ID NO: 209536 - DNA, 16 bp, P. troglodytes
atacaaggaactcaaa

SEQ ID NO: 209537 - DNA, 16 bp, P. troglodytes
atacaagtgaaatcat

SEQ ID NO: 209538 - DNA, 16 bp, P. troglodytes
atacaagtggccaaca

SEQ ID NO: 209539 - DNA, 16 bp, P. troglodytes
atacaagtggtcaaca

SEQ ID NO: 209540 - DNA, 16 bp, P. troglodytes
atacaatatatttgta

SEQ ID NO: 209541 - DNA, 16 bp, P. troglodytes
atacaatatttgtttt

SEQ ID NO: 209542 - DNA, 16 bp, P. troglodytes
atacaatggaatacca

SEQ ID NO: 209543 - DNA, 16 bp, P. troglodytes
atacaatggactttag

SEQ ID NO: 209544 - DNA, 16 bp, P. troglodytes
atacaatggagtatta

SEQ ID NO: 209545 - DNA, 16 bp, P. troglodytes
atacaatgtaagtgct

SEQ ID NO: 209546 - DNA, 16 bp, P. troglodytes
atacaattcaagttga

SEQ ID NO: 209547 - DNA, 16 bp, P. troglodytes
atacaattgaaagctt

SEQ ID NO: 209548 - DNA, 16 bp, P. troglodytes
atacacaaaatgtggt

SEQ ID NO: 209549 - DNA, 16 bp, P. troglodytes
atacacaaatgtttat

SEQ ID NO: 209550 - DNA, 16 bp, P. troglodytes
atacacaagagaaatg

SEQ ID NO: 209551 - DNA, 16 bp, P. troglodytes
atacacaatggagtac

SEQ ID NO: 209552 - DNA, 16 bp, P. troglodytes
atacacacacatatgt

SEQ ID NO: 209553 - DNA, 16 bp, P. troglodytes
atacacacacgtgtgt

SEQ ID NO: 209554 - DNA, 16 bp, P. troglodytes
atacacacagacatac

SEQ ID NO: 209555 - DNA, 16 bp, P. troglodytes
atacacacatattcat

SEQ ID NO: 209556 - DNA, 16 bp, P. troglodytes
atacacacatatttta

SEQ ID NO: 209557 - DNA, 16 bp, P. troglodytes
atacacacgtatacac

SEQ ID NO: 209558 - DNA, 16 bp, P. troglodytes
atacacagacacacac

SEQ ID NO: 209559 - DNA, 16 bp, P. troglodytes
atacacataatatatg

SEQ ID NO: 209560 - DNA, 16 bp, P. troglodytes
atacacatagcctgaa

SEQ ID NO: 209561 - DNA, 16 bp, P. troglodytes
atacacatatgtatat

SEQ ID NO: 209562 - DNA, 16 bp, P. troglodytes
atacacatatttattt

SEQ ID NO: 209563 - DNA, 16 bp, P. troglodytes
atacacatgtatttat

SEQ ID NO: 209564 - DNA, 16 bp, P. troglodytes
atacacatgtgcacat

SEQ ID NO: 209565 - DNA, 16 bp, P. troglodytes
atacaccaacaatagc

SEQ ID NO: 209566 - DNA, 16 bp, P. troglodytes
atacaccagcaatgaa

SEQ ID NO: 209567 - DNA, 16 bp, P. troglodytes
atacacccaaaggatt

SEQ ID NO: 209568 - DNA, 17 bp, P. troglodytes
atacacctgccttggcc

SEQ ID NO: 209569 - DNA, 16 bp, P. troglodytes
atacacgcacacacac

SEQ ID NO: 209570 - DNA, 16 bp, P. troglodytes
atacactatggaacac

SEQ ID NO: 209571 - DNA, 16 bp, P. troglodytes
atacacttgcaatgaa

SEQ ID NO: 209572 - DNA, 16 bp, P. troglodytes
atacacttgccatggt

SEQ ID NO: 209573 - DNA, 16 bp, P. troglodytes
atacactttttaaaaa

SEQ ID NO: 209574 - DNA, 16 bp, P. troglodytes
atacagaaaaatatta

SEQ ID NO: 209575 - DNA, 16 bp, P. troglodytes
atacagaaatcaaatc

SEQ ID NO: 209576 - DNA, 16 bp, P. troglodytes
atacagaagaatataa

SEQ ID NO: 209577 - DNA, 16 bp, P. troglodytes
atacagaatagtttca

SEQ ID NO: 209578 - DNA, 16 bp, P. troglodytes
atacagaattttaaat

SEQ ID NO: 209579 - DNA, 16 bp, P. troglodytes
atacagacaaatggaa

SEQ ID NO: 209580 - DNA, 16 bp, P. troglodytes
atacagacagaaaaat

SEQ ID NO: 209581 - DNA, 16 bp, P. troglodytes
atacagagaagattag

SEQ ID NO: 209582 - DNA, 16 bp, P. troglodytes
atacagagggccaact

SEQ ID NO: 209583 - DNA, 16 bp, P. troglodytes
atacagagggccgact

SEQ ID NO: 209584 - DNA, 16 bp, P. troglodytes
atacagatatctcttt

SEQ ID NO: 209585 - DNA, 16 bp, P. troglodytes
atacagatgaagcttc

SEQ ID NO: 209586 - DNA, 16 bp, P. troglodytes
atacagcatggtgact

SEQ ID NO: 209587 - DNA, 16 bp, P. troglodytes
atacagccttttcaga

SEQ ID NO: 209588 - DNA, 16 bp, P. troglodytes
atacaggagaatcact

SEQ ID NO: 209589 - DNA, 16 bp, P. troglodytes
atacagggagaagaca

SEQ ID NO: 209590 - DNA, 16 bp, P. troglodytes
atacaggttgagtatc

SEQ ID NO: 209591 - DNA, 16 bp, P. troglodytes
atacagtcacattgag

SEQ ID NO: 209592 - DNA, 16 bp, P. troglodytes
atacagtgagaaggtg

SEQ ID NO: 209593 - DNA, 16 bp, P. troglodytes
atacagtggcacaatc

SEQ ID NO: 209594 - DNA, 16 bp, P. troglodytes
atacagttagatagaa

SEQ ID NO: 209595 - DNA, 16 bp, P. troglodytes
atacagttcagtggca

SEQ ID NO: 209596 - DNA, 16 bp, P. troglodytes
atacagtttttaaaat

SEQ ID NO: 209597 - DNA, 16 bp, P. troglodytes
atacagtttttatttt

SEQ ID NO: 209598 - DNA, 16 bp, P. troglodytes
atacataaaattagct

SEQ ID NO: 209599 - DNA, 16 bp, P. troglodytes
atacataaatatgtat

SEQ ID NO: 209600 - DNA, 16 bp, P. troglodytes
atacataaatgaataa

SEQ ID NO: 209601 - DNA, 16 bp, P. troglodytes
atacataatatatact

SEQ ID NO: 209602 - DNA, 16 bp, P. troglodytes
atacatacaaaagaat

SEQ ID NO: 209603 - DNA, 16 bp, P. troglodytes
atacatacacatatat

SEQ ID NO: 209604 - DNA, 16 bp, P. troglodytes
atacatacacatatgt

SEQ ID NO: 209605 - DNA, 16 bp, P. troglodytes
atacatacacatgtat

SEQ ID NO: 209606 - DNA, 16 bp, P. troglodytes
atacatacatatatac

SEQ ID NO: 209607 - DNA, 16 bp, P. troglodytes
atacatacatatgtat

SEQ ID NO: 209608 - DNA, 16 bp, P. troglodytes
atacatacatattcat

SEQ ID NO: 209609 - DNA, 16 bp, P. troglodytes
atacatacatgtacac

SEQ ID NO: 209610 - DNA, 16 bp, P. troglodytes
atacatacatgtatat

SEQ ID NO: 209611 - DNA, 16 bp, P. troglodytes
atacatacatttatat

SEQ ID NO: 209612 - DNA, 16 bp, P. troglodytes
atacatacctatgata

SEQ ID NO: 209613 - DNA, 16 bp, P. troglodytes
atacatactatatata

SEQ ID NO: 209614 - DNA, 16 bp, P. troglodytes
atacatagaatgtata

SEQ ID NO: 209615 - DNA, 16 bp, P. troglodytes
atacataggtgtatat

SEQ ID NO: 209616 - DNA, 16 bp, P. troglodytes
atacatagtaaatgct

SEQ ID NO: 209617 - DNA, 16 bp, P. troglodytes
atacatataatggaat

SEQ ID NO: 209618 - DNA, 16 bp, P. troglodytes
atacatatacacataa

SEQ ID NO: 209619 - DNA, 16 bp, P. troglodytes
atacatatacacatat

SEQ ID NO: 209620 - DNA, 16 bp, P. troglodytes
atacatatacatgcat

SEQ ID NO: 209621 - DNA, 18 bp, P. troglodytes
atacatatatacacatat

SEQ ID NO: 209622 - DNA, 16 bp, P. troglodytes
atacatatatactatg

SEQ ID NO: 209623 - DNA, 17 bp, P. troglodytes
atacatatatatataca

SEQ ID NO: 209624 - DNA, 16 bp, P. troglodytes
atacatatatatgtta

SEQ ID NO: 209625 - DNA, 16 bp, P. troglodytes
atacatatatctgtat

SEQ ID NO: 209626 - DNA, 16 bp, P. troglodytes
atacatatatgataca

SEQ ID NO: 209627 - DNA, 17 bp, P. troglodytes
atacatatatgtgtgta

SEQ ID NO: 209628 - DNA, 16 bp, P. troglodytes
atacatatattaatac

SEQ ID NO: 209629 - DNA, 16 bp, P. troglodytes
atacatatatttaaga

SEQ ID NO: 209630 - DNA, 16 bp, P. troglodytes
atacatatctatgtat

SEQ ID NO: 209631 - DNA, 16 bp, P. troglodytes
atacatatgaaagaaa

SEQ ID NO: 209632 - DNA, 16 bp, P. troglodytes
atacatatgcacatac

SEQ ID NO: 209633 - DNA, 16 bp, P. troglodytes
atacatatgtacataa

SEQ ID NO: 209634 - DNA, 16 bp, P. troglodytes
atacatatgtatattt

SEQ ID NO: 209635 - DNA, 16 bp, P. troglodytes
atacatatgtatgtgt

SEQ ID NO: 209636 - DNA, 16 bp, P. troglodytes
atacatatgtgaatat

SEQ ID NO: 209637 - DNA, 16 bp, P. troglodytes
atacatatgttaatta

SEQ ID NO: 209638 - DNA, 16 bp, P. troglodytes
atacatattcaacagg

SEQ ID NO: 209639 - DNA, 16 bp, P. troglodytes
atacatatttgtatat

SEQ ID NO: 209640 - DNA, 16 bp, P. troglodytes
atacatatttgttttt

SEQ ID NO: 209641 - DNA, 16 bp, P. troglodytes
atacatattttgtaaa

SEQ ID NO: 209642 - DNA, 16 bp, P. troglodytes
atacatcatatcaata

SEQ ID NO: 209643 - DNA, 16 bp, P. troglodytes
atacatcattttcttt

SEQ ID NO: 209644 - DNA, 16 bp, P. troglodytes
atacatccattccaaa

SEQ ID NO: 209645 - DNA, 17 bp, P. troglodytes
atacatcctcctcagct

SEQ ID NO: 209646 - DNA, 16 bp, P. troglodytes
atacatctacaaccat

SEQ ID NO: 209647 - DNA, 16 bp, P. troglodytes
atacatgaaataaata

SEQ ID NO: 209648 - DNA, 16 bp, P. troglodytes
atacatgaatatatat

SEQ ID NO: 209649 - DNA, 16 bp, P. troglodytes
atacatgattttaaaa

SEQ ID NO: 209650 - DNA, 16 bp, P. troglodytes
atacatgcacatgcac

SEQ ID NO: 209651 - DNA, 16 bp, P. troglodytes
atacatgcatgcacac

SEQ ID NO: 209652 - DNA, 16 bp, P. troglodytes
atacatgtaacaaaat

SEQ ID NO: 209653 - DNA, 16 bp, P. troglodytes
atacatgtatatatgt

SEQ ID NO: 209654 - DNA, 16 bp, P. troglodytes
atacatgtatatttta

SEQ ID NO: 209655 - DNA, 16 bp, P. troglodytes
atacatgtatattttt

SEQ ID NO: 209656 - DNA, 16 bp, P. troglodytes
atacatgtgatatata

SEQ ID NO: 209657 - DNA, 16 bp, P. troglodytes
atacatgtgcatattt

SEQ ID NO: 209658 - DNA, 16 bp, P. troglodytes
atacatgtgtttatat

SEQ ID NO: 209659 - DNA, 16 bp, P. troglodytes
atacattatctcactt

SEQ ID NO: 209660 - DNA, 16 bp, P. troglodytes
atacattattttattg

SEQ ID NO: 209661 - DNA, 16 bp, P. troglodytes
atacattccaagaccc

SEQ ID NO: 209662 - DNA, 16 bp, P. troglodytes
atacattctaaaatat

SEQ ID NO: 209663 - DNA, 16 bp, P. troglodytes
atacattcttttcagc

SEQ ID NO: 209664 - DNA, 16 bp, P. troglodytes
atacattgtacccatt

SEQ ID NO: 209665 - DNA, 16 bp, P. troglodytes
atacattgtgaaatat

SEQ ID NO: 209666 - DNA, 16 bp, P. troglodytes
atacatttaaaattgt

SEQ ID NO: 209667 - DNA, 16 bp, P. troglodytes
atacatttataatgtt

SEQ ID NO: 209668 - DNA, 16 bp, P. troglodytes
atacatttatgtattt

SEQ ID NO: 209669 - DNA, 16 bp, P. troglodytes
atacatttcaatccct

SEQ ID NO: 209670 - DNA, 16 bp, P. troglodytes
atacatttccctctta

SEQ ID NO: 209671 - DNA, 16 bp, P. troglodytes
atacatttctcttgtt

SEQ ID NO: 209672 - DNA, 16 bp, P. troglodytes
atacatttctgttcat

SEQ ID NO: 209673 - DNA, 16 bp, P. troglodytes
atacatttctttaaaa

SEQ ID NO: 209674 - DNA, 16 bp, P. troglodytes
atacatttgaaaatat

SEQ ID NO: 209675 - DNA, 16 bp, P. troglodytes
atacatttgatttttt

SEQ ID NO: 209676 - DNA, 16 bp, P. troglodytes
atacattttagaaaca

SEQ ID NO: 209677 - DNA, 16 bp, P. troglodytes
atacattttcttaaaa

SEQ ID NO: 209678 - DNA, 16 bp, P. troglodytes
atacattttgatattt

SEQ ID NO: 209679 - DNA, 16 bp, P. troglodytes
atacattttgcttttt

SEQ ID NO: 209680 - DNA, 16 bp, P. troglodytes
atacattttgttatat

SEQ ID NO: 209681 - DNA, 16 bp, P. troglodytes
atacattttgtttgtt

SEQ ID NO: 209682 - DNA, 16 bp, P. troglodytes
atacatttttattgta

SEQ ID NO: 209683 - DNA, 16 bp, P. troglodytes
atacatttttatttgt

SEQ ID NO: 209684 - DNA, 16 bp, P. troglodytes
atacattttttaaatg

SEQ ID NO: 209685 - DNA, 16 bp, P. troglodytes
atacatttttttcagc

SEQ ID NO: 209686 - DNA, 16 bp, P. troglodytes
atacatttttttctgt

SEQ ID NO: 209687 - DNA, 16 bp, P. troglodytes
atacattttttttcag

SEQ ID NO: 209688 - DNA, 16 bp, P. troglodytes
ataccaaaaccaggaa

SEQ ID NO: 209689 - DNA, 16 bp, P. troglodytes
ataccaaaacctgaca

SEQ ID NO: 209690 - DNA, 16 bp, P. troglodytes
ataccaaaatcagaaa

SEQ ID NO: 209691 - DNA, 16 bp, P. troglodytes
ataccaaaggatgact

SEQ ID NO: 209692 - DNA, 16 bp, P. troglodytes
ataccaagggacaact

SEQ ID NO: 209693 - DNA, 16 bp, P. troglodytes
ataccacagtcaaacc

SEQ ID NO: 209694 - DNA, 16 bp, P. troglodytes
ataccacattttcttc

SEQ ID NO: 209695 - DNA, 16 bp, P. troglodytes
ataccactgcactctg

SEQ ID NO: 209696 - DNA, 16 bp, P. troglodytes
ataccactgccctcca

SEQ ID NO: 209697 - DNA, 16 bp, P. troglodytes
ataccagcacctgctt

SEQ ID NO: 209698 - DNA, 16 bp, P. troglodytes
ataccagcagtttggg

SEQ ID NO: 209699 - DNA, 16 bp, P. troglodytes
ataccagcctggccaa

SEQ ID NO: 209700 - DNA, 16 bp, P. troglodytes
ataccatcactttggg

SEQ ID NO: 209701 - DNA, 16 bp, P. troglodytes
ataccatcctggccaa

SEQ ID NO: 209702 - DNA, 16 bp, P. troglodytes
ataccatgttttgttt

SEQ ID NO: 209703 - DNA, 16 bp, P. troglodytes
ataccatttacaattg

SEQ ID NO: 209704 - DNA, 16 bp, P. troglodytes
atacccaaaagaaatg

SEQ ID NO: 209705 - DNA, 16 bp, P. troglodytes
atacccaaataatgaa

SEQ ID NO: 209706 - DNA, 16 bp, P. troglodytes
atacccattaaacaac

SEQ ID NO: 209707 - DNA, 16 bp, P. troglodytes
atacccattttacaga

SEQ ID NO: 209708 - DNA, 16 bp, P. troglodytes
ataccctgtatttctt

SEQ ID NO: 209709 - DNA, 16 bp, P. troglodytes
atacctaaccaaggac

SEQ ID NO: 209710 - DNA, 16 bp, P. troglodytes
atacctactgtgtgcc

SEQ ID NO: 209711 - DNA, 16 bp, P. troglodytes
atacctaggaatgcag

SEQ ID NO: 209712 - DNA, 16 bp, P. troglodytes
atacctaggctatatg

SEQ ID NO: 209713 - DNA, 16 bp, P. troglodytes
atacctcaaaataata

SEQ ID NO: 209714 - DNA, 16 bp, P. troglodytes
atacctcattttattt

SEQ ID NO: 209715 - DNA, 16 bp, P. troglodytes
atacctcctgaaagac

SEQ ID NO: 209716 - DNA, 16 bp, P. troglodytes
atacctgactaatttt

SEQ ID NO: 209717 - DNA, 16 bp, P. troglodytes
atacctgatgatctgt

SEQ ID NO: 209718 - DNA, 16 bp, P. troglodytes
atacctgtaatcccaa

SEQ ID NO: 209719 - DNA, 16 bp, P. troglodytes
atacctgtaatcccac

SEQ ID NO: 209720 - DNA, 16 bp, P. troglodytes
atacctgtggtcccag

SEQ ID NO: 209721 - DNA, 17 bp, P. troglodytes
atacgcaaatcaataaa

SEQ ID NO: 209722 - DNA, 16 bp, P. troglodytes
atacgtgtatatatgt

SEQ ID NO: 209723 - DNA, 16 bp, P. troglodytes
atacgtgtgtatatat

SEQ ID NO: 209724 - DNA, 16 bp, P. troglodytes
atactaaatctactct

SEQ ID NO: 209725 - DNA, 16 bp, P. troglodytes
atactaattttctttc

SEQ ID NO: 209726 - DNA, 16 bp, P. troglodytes
atactacaaaaacagt

SEQ ID NO: 209727 - DNA, 16 bp, P. troglodytes
atactacaacatgaat

SEQ ID NO: 209728 - DNA, 16 bp, P. troglodytes
atactacattttaaaa

SEQ ID NO: 209729 - DNA, 16 bp, P. troglodytes
atactactcagtcata

SEQ ID NO: 209730 - DNA, 16 bp, P. troglodytes
atactactttttaaaa

SEQ ID NO: 209731 - DNA, 16 bp, P. troglodytes
atactagaagaaaatc

SEQ ID NO: 209732 - DNA, 16 bp, P. troglodytes
atactaggaagaaact

SEQ ID NO: 209733 - DNA, 16 bp, P. troglodytes
atactaggtgctcaat

SEQ ID NO: 209734 - DNA, 16 bp, P. troglodytes
atactatgaacaattt

SEQ ID NO: 209735 - DNA, 16 bp, P. troglodytes
atactattcagtctta

SEQ ID NO: 209736 - DNA, 16 bp, P. troglodytes
atactattttccaaaa

SEQ ID NO: 209737 - DNA, 16 bp, P. troglodytes
atactcaacattatta

SEQ ID NO: 209738 - DNA, 16 bp, P. troglodytes
atactcaagtcccaca

SEQ ID NO: 209739 - DNA, 16 bp, P. troglodytes
atactcaggaggctga

SEQ ID NO: 209740 - DNA, 23 bp, P. troglodytes
atactcagtacctgttttaagaa

SEQ ID NO: 209741 - DNA, 16 bp, P. troglodytes
atactccagcctggga

SEQ ID NO: 209742 - DNA, 19 bp, P. troglodytes
atactccagcctggtgaca

SEQ ID NO: 209743 - DNA, 16 bp, P. troglodytes
atactcttttgtcttt

SEQ ID NO: 209744 - DNA, 16 bp, P. troglodytes
atactgaaagtgaaaa

SEQ ID NO: 209745 - DNA, 17 bp, P. troglodytes
atactgaataggcaaaa

SEQ ID NO: 209746 - DNA, 16 bp, P. troglodytes
atactgaatgggaaaa

SEQ ID NO: 209747 - DNA, 16 bp, P. troglodytes
atactgaatggggaaa

SEQ ID NO: 209748 - DNA, 16 bp, P. troglodytes
atactgaatttttttt

SEQ ID NO: 209749 - DNA, 16 bp, P. troglodytes
atactgacttcataga

SEQ ID NO: 209750 - DNA, 16 bp, P. troglodytes
atactgagattttttt

SEQ ID NO: 209751 - DNA, 16 bp, P. troglodytes
atactgataaaaataa

SEQ ID NO: 209752 - DNA, 16 bp, P. troglodytes
atactgatgggtcttg

SEQ ID NO: 209753 - DNA, 16 bp, P. troglodytes
atactgcatattctca

SEQ ID NO: 209754 - DNA, 16 bp, P. troglodytes
atactgcccaaagcaa

SEQ ID NO: 209755 - DNA, 16 bp, P. troglodytes
atactgctctgttact

SEQ ID NO: 209756 - DNA, 16 bp, P. troglodytes
atactggaaaactgaa

SEQ ID NO: 209757 - DNA, 16 bp, P. troglodytes
atactggaggaaaaca

SEQ ID NO: 209758 - DNA, 16 bp, P. troglodytes
atactggcaccatgct

SEQ ID NO: 209759 - DNA, 16 bp, P. troglodytes
atactgtataattcca

SEQ ID NO: 209760 - DNA, 16 bp, P. troglodytes
atactgtatgattcca

SEQ ID NO: 209761 - DNA, 16 bp, P. troglodytes
atactgtatgtatgta

SEQ ID NO: 209762 - DNA, 16 bp, P. troglodytes
atactgtatgttctta

SEQ ID NO: 209763 - DNA, 16 bp, P. troglodytes
atactgtattttgttt

SEQ ID NO: 209764 - DNA, 16 bp, P. troglodytes
atactgtatttttaaa

SEQ ID NO: 209765 - DNA, 16 bp, P. troglodytes
atactgtatttttact

SEQ ID NO: 209766 - DNA, 16 bp, P. troglodytes
atactgtattttttat

SEQ ID NO: 209767 - DNA, 16 bp, P. troglodytes
atactgtgtgtgtgtg

SEQ ID NO: 209768 - DNA, 16 bp, P. troglodytes
atactgttttctatag

SEQ ID NO: 209769 - DNA, 16 bp, P. troglodytes
atactgttttttaaaa

SEQ ID NO: 209770 - DNA, 16 bp, P. troglodytes
atacttaacagtgaaa

SEQ ID NO: 209771 - DNA, 16 bp, P. troglodytes
atacttaacatttatt

SEQ ID NO: 209772 - DNA, 16 bp, P. troglodytes
atacttaccaagcaaa

SEQ ID NO: 209773 - DNA, 16 bp, P. troglodytes
atacttaggagtggaa

SEQ ID NO: 209774 - DNA, 16 bp, P. troglodytes
atacttatatatacac

SEQ ID NO: 209775 - DNA, 16 bp, P. troglodytes
atacttcaaaatattt

SEQ ID NO: 209776 - DNA, 16 bp, P. troglodytes
atacttctaaataact

SEQ ID NO: 209777 - DNA, 16 bp, P. troglodytes
atacttgtgtatgctt

SEQ ID NO: 209778 - DNA, 16 bp, P. troglodytes
atactttaaaaaatga

SEQ ID NO: 209779 - DNA, 16 bp, P. troglodytes
atactttatatgattt

SEQ ID NO: 209780 - DNA, 16 bp, P. troglodytes
atactttattgctgaa

SEQ ID NO: 209781 - DNA, 16 bp, P. troglodytes
atactttcaatataaa

SEQ ID NO: 209782 - DNA, 16 bp, P. troglodytes
atactttgcatctttc

SEQ ID NO: 209783 - DNA, 16 bp, P. troglodytes
atactttgtaaatatt

SEQ ID NO: 209784 - DNA, 16 bp, P. troglodytes
atactttgtataattt

SEQ ID NO: 209785 - DNA, 16 bp, P. troglodytes
atactttgttagattt

SEQ ID NO: 209786 - DNA, 16 bp, P. troglodytes
atacttttaaaagcat

SEQ ID NO: 209787 - DNA, 16 bp, P. troglodytes
atacttttgtaacaaa

SEQ ID NO: 209788 - DNA, 16 bp, P. troglodytes
atactttttctatgtt

SEQ ID NO: 209789 - DNA, 16 bp, P. troglodytes
atagaaaaacatttca

SEQ ID NO: 209790 - DNA, 16 bp, P. troglodytes
atagaaaaattagcag

SEQ ID NO: 209791 - DNA, 16 bp, P. troglodytes
atagaaaaattagcct

SEQ ID NO: 209792 - DNA, 16 bp, P. troglodytes
atagaaaaatttcaaa

SEQ ID NO: 209793 - DNA, 16 bp, P. troglodytes
atagaaaactaatata

SEQ ID NO: 209794 - DNA, 16 bp, P. troglodytes
atagaaaactattttt

SEQ ID NO: 209795 - DNA, 16 bp, P. troglodytes
atagaaaagatacagt

SEQ ID NO: 209796 - DNA, 16 bp, P. troglodytes
atagaaaagcaagagc

SEQ ID NO: 209797 - DNA, 16 bp, P. troglodytes
atagaaaataaacttt

SEQ ID NO: 209798 - DNA, 16 bp, P. troglodytes
atagaaaatctaaaca

SEQ ID NO: 209799 - DNA, 16 bp, P. troglodytes
atagaaaatgaaaact

SEQ ID NO: 209800 - DNA, 16 bp, P. troglodytes
atagaaaatgggcaaa

SEQ ID NO: 209801 - DNA, 16 bp, P. troglodytes
atagaaaatgtacagt

SEQ ID NO: 209802 - DNA, 16 bp, P. troglodytes
atagaaaattaataca

SEQ ID NO: 209803 - DNA, 16 bp, P. troglodytes
atagaaaatttcaaac

SEQ ID NO: 209804 - DNA, 16 bp, P. troglodytes
atagaaaatttggaaa

SEQ ID NO: 209805 - DNA, 16 bp, P. troglodytes
atagaaacacctggat

SEQ ID NO: 209806 - DNA, 16 bp, P. troglodytes
atagaaacagagaata

SEQ ID NO: 209807 - DNA, 16 bp, P. troglodytes
atagaaaccaaaagag

SEQ ID NO: 209808 - DNA, 16 bp, P. troglodytes
atagaaacttttaaaa

SEQ ID NO: 209809 - DNA, 16 bp, P. troglodytes
atagaaagacaaatat

SEQ ID NO: 209810 - DNA, 16 bp, P. troglodytes
atagaaagaccctatc

SEQ ID NO: 209811 - DNA, 16 bp, P. troglodytes
atagaaataaacattt

SEQ ID NO: 209812 - DNA, 16 bp, P. troglodytes
atagaaatacatattt

SEQ ID NO: 209813 - DNA, 16 bp, P. troglodytes
atagaaatatgtatat

SEQ ID NO: 209814 - DNA, 16 bp, P. troglodytes
atagaaatatttctat

SEQ ID NO: 209815 - DNA, 16 bp, P. troglodytes
atagaaatggaatcat

SEQ ID NO: 209816 - DNA, 16 bp, P. troglodytes
atagaaatgttttata

SEQ ID NO: 209817 - DNA, 16 bp, P. troglodytes
atagaaattatacaaa

SEQ ID NO: 209818 - DNA, 16 bp, P. troglodytes
atagaacaagaccctg

SEQ ID NO: 209819 - DNA, 16 bp, P. troglodytes
atagaaccaacccaaa

SEQ ID NO: 209820 - DNA, 16 bp, P. troglodytes
atagaagaactcaaca

SEQ ID NO: 209821 - DNA, 16 bp, P. troglodytes
atagaagatttgaaca

SEQ ID NO: 209822 - DNA, 16 bp, P. troglodytes
atagaagtgagatcat

SEQ ID NO: 209823 - DNA, 16 bp, P. troglodytes
atagaataatttttct

SEQ ID NO: 209824 - DNA, 16 bp, P. troglodytes
atagaatacattttat

SEQ ID NO: 209825 - DNA, 16 bp, P. troglodytes
atagaatattatttgg

SEQ ID NO: 209826 - DNA, 16 bp, P. troglodytes
atagaatcatatcatc

SEQ ID NO: 209827 - DNA, 16 bp, P. troglodytes
atagaatgagttggaa

SEQ ID NO: 209828 - DNA, 16 bp, P. troglodytes
atagacaatacataaa

SEQ ID NO: 209829 - DNA, 16 bp, P. troglodytes
atagacagatggatag

SEQ ID NO: 209830 - DNA, 16 bp, P. troglodytes
atagacatatatgtgt

SEQ ID NO: 209831 - DNA, 16 bp, P. troglodytes
atagacatgattatat

SEQ ID NO: 209832 - DNA, 16 bp, P. troglodytes
atagacatgtacagaa

SEQ ID NO: 209833 - DNA, 16 bp, P. troglodytes
atagacatttatcaaa

SEQ ID NO: 209834 - DNA, 16 bp, P. troglodytes
atagaccactggaaca

SEQ ID NO: 209835 - DNA, 16 bp, P. troglodytes
atagactaaaagtaaa

SEQ ID NO: 209836 - DNA, 16 bp, P. troglodytes
atagactatatatagt

SEQ ID NO: 209837 - DNA, 16 bp, P. troglodytes
atagactggataaaga

SEQ ID NO: 209838 - DNA, 16 bp, P. troglodytes
atagactttggggact

SEQ ID NO: 209839 - DNA, 16 bp, P. troglodytes
atagactttgtttttt

SEQ ID NO: 209840 - DNA, 16 bp, P. troglodytes
atagagaacatttcca

SEQ ID NO: 209841 - DNA, 16 bp, P. troglodytes
atagagaatagaatga

SEQ ID NO: 209842 - DNA, 16 bp, P. troglodytes
atagagaatgcagaaa

SEQ ID NO: 209843 - DNA, 16 bp, P. troglodytes
atagagacacaaaaat

SEQ ID NO: 209844 - DNA, 16 bp, P. troglodytes
atagagacagaaaaca

SEQ ID NO: 209845 - DNA, 26 bp, P. troglodytes
atagagacggggtttcaccatgttga

SEQ ID NO: 209846 - DNA, 21 bp, P. troglodytes
atagagacggggtttcaccgt

SEQ ID NO: 209847 - DNA, 17 bp, P. troglodytes
atagagacggggtttcg

SEQ ID NO: 209848 - DNA, 22 bp, P. troglodytes
atagagacggggtttcgccatg

SEQ ID NO: 209849 - DNA, 16 bp, P. troglodytes
atagagactccgtctc

SEQ ID NO: 209850 - DNA, 16 bp, P. troglodytes
atagagagatgataga

SEQ ID NO: 209851 - DNA, 16 bp, P. troglodytes
atagagagggggtttc

SEQ ID NO: 209852 - DNA, 16 bp, P. troglodytes
atagagatagaaagca

SEQ ID NO: 209853 - DNA, 16 bp, P. troglodytes
atagagatagatgata

SEQ ID NO: 209854 - DNA, 16 bp, P. troglodytes
atagagatgggatctc

SEQ ID NO: 209855 - DNA, 16 bp, P. troglodytes
atagagatggggtttc

SEQ ID NO: 209856 - DNA, 16 bp, P. troglodytes
atagagcaagacccca

SEQ ID NO: 209857 - DNA, 16 bp, P. troglodytes
atagagcaagactctg

SEQ ID NO: 209858 - DNA, 16 bp, P. troglodytes
atagagcattaaacca

SEQ ID NO: 209859 - DNA, 16 bp, P. troglodytes
atagagcgagactcca

SEQ ID NO: 209860 - DNA, 16 bp, P. troglodytes
atagaggcagaaagta

SEQ ID NO: 209861 - DNA, 16 bp, P. troglodytes
atagaggtggggtctc

SEQ ID NO: 209862 - DNA, 16 bp, P. troglodytes
atagaggtgtttatag

SEQ ID NO: 209863 - DNA, 16 bp, P. troglodytes
atagagtccagaaaca

SEQ ID NO: 209864 - DNA, 16 bp, P. troglodytes
atagatacacacatat

SEQ ID NO: 209865 - DNA, 17 bp, P. troglodytes
atagatagatagataga

SEQ ID NO: 209866 - DNA, 16 bp, P. troglodytes
atagatatacagatat

SEQ ID NO: 209867 - DNA, 16 bp, P. troglodytes
atagatatagattata

SEQ ID NO: 209868 - DNA, 16 bp, P. troglodytes
atagatatatatgtgt

SEQ ID NO: 209869 - DNA, 16 bp, P. troglodytes
atagatcaaagaatga

SEQ ID NO: 209870 - DNA, 16 bp, P. troglodytes
atagatgaagaaaatg

SEQ ID NO: 209871 - DNA, 16 bp, P. troglodytes
atagatgaggaaattg

SEQ ID NO: 209872 - DNA, 16 bp, P. troglodytes
atagatgcaacaaaaa

SEQ ID NO: 209873 - DNA, 16 bp, P. troglodytes
atagatgctgaaaagg

SEQ ID NO: 209874 - DNA, 16 bp, P. troglodytes
atagatggtgccttct

SEQ ID NO: 209875 - DNA, 16 bp, P. troglodytes
atagatgttgaatttt

SEQ ID NO: 209876 - DNA, 16 bp, P. troglodytes
atagatgtttatagca

SEQ ID NO: 209877 - DNA, 18 bp, P. troglodytes
atagattaacagaatctc

SEQ ID NO: 209878 - DNA, 16 bp, P. troglodytes
atagattgcaaaattt

SEQ ID NO: 209879 - DNA, 16 bp, P. troglodytes
atagattgcaaatatt

SEQ ID NO: 209880 - DNA, 16 bp, P. troglodytes
atagattgctttgagt

SEQ ID NO: 209881 - DNA, 16 bp, P. troglodytes
atagattggataaaga

SEQ ID NO: 209882 - DNA, 16 bp, P. troglodytes
atagattgggagaaaa

SEQ ID NO: 209883 - DNA, 16 bp, P. troglodytes
atagatttaatgcaat

SEQ ID NO: 209884 - DNA, 16 bp, P. troglodytes
atagatttgtcttttc

SEQ ID NO: 209885 - DNA, 16 bp, P. troglodytes
atagattttaaacatt

SEQ ID NO: 209886 - DNA, 16 bp, P. troglodytes
atagattttaagacaa

SEQ ID NO: 209887 - DNA, 16 bp, P. troglodytes
atagatttttaaaact

SEQ ID NO: 209888 - DNA, 16 bp, P. troglodytes
atagcaaaatgacaga

SEQ ID NO: 209889 - DNA, 16 bp, P. troglodytes
atagcaaagaataatt

SEQ ID NO: 209890 - DNA, 16 bp, P. troglodytes
atagcaaagacatggg

SEQ ID NO: 209891 - DNA, 16 bp, P. troglodytes
atagcaaaggcttgga

SEQ ID NO: 209892 - DNA, 16 bp, P. troglodytes
atagcaagaccccatt

SEQ ID NO: 209893 - DNA, 16 bp, P. troglodytes
atagcaattttttaaa

SEQ ID NO: 209894 - DNA, 16 bp, P. troglodytes
atagcacctacttcat

SEQ ID NO: 209895 - DNA, 16 bp, P. troglodytes
atagcagcaataaaaa

SEQ ID NO: 209896 - DNA, 16 bp, P. troglodytes
atagcagcaatattca

SEQ ID NO: 209897 - DNA, 16 bp, P. troglodytes
atagcagcagcagcag

SEQ ID NO: 209898 - DNA, 16 bp, P. troglodytes
atagcagcattattca

SEQ ID NO: 209899 - DNA, 16 bp, P. troglodytes
atagcagctgtaccat

SEQ ID NO: 209900 - DNA, 16 bp, P. troglodytes
atagcagctttattca

SEQ ID NO: 209901 - DNA, 16 bp, P. troglodytes
atagcagtggttctca

SEQ ID NO: 209902 - DNA, 16 bp, P. troglodytes
atagcatcttcttcca

SEQ ID NO: 209903 - DNA, 16 bp, P. troglodytes
atagcatgaaagcagc

SEQ ID NO: 209904 - DNA, 17 bp, P. troglodytes
atagcatgatgcctcca

SEQ ID NO: 209905 - DNA, 16 bp, P. troglodytes
atagcatgggaaaaac

SEQ ID NO: 209906 - DNA, 16 bp, P. troglodytes
atagcatggtactggt

SEQ ID NO: 209907 - DNA, 16 bp, P. troglodytes
atagcatggtttactg

SEQ ID NO: 209908 - DNA, 16 bp, P. troglodytes
atagcattaaaaaata

SEQ ID NO: 209909 - DNA, 16 bp, P. troglodytes
atagcattttaaattt

SEQ ID NO: 209910 - DNA, 16 bp, P. troglodytes
atagccaccttggttt

SEQ ID NO: 209911 - DNA, 16 bp, P. troglodytes
atagccaggcatggtg

SEQ ID NO: 209912 - DNA, 16 bp, P. troglodytes
atagccaggtgtggtg

SEQ ID NO: 209913 - DNA, 16 bp, P. troglodytes
atagccatacaatgga

SEQ ID NO: 209914 - DNA, 16 bp, P. troglodytes
atagccatactgccca

SEQ ID NO: 209915 - DNA, 16 bp, P. troglodytes
atagccctgatgaaca

SEQ ID NO: 209916 - DNA, 16 bp, P. troglodytes
atagcctaagtgtgta

SEQ ID NO: 209917 - DNA, 16 bp, P. troglodytes
atagcctgagcccagg

SEQ ID NO: 209918 - DNA, 16 bp, P. troglodytes
atagcctgctgttgac

SEQ ID NO: 209919 - DNA, 16 bp, P. troglodytes
atagcctgggcaacat

SEQ ID NO: 209920 - DNA, 16 bp, P. troglodytes
atagctaacatttatt

SEQ ID NO: 209921 - DNA, 16 bp, P. troglodytes
atagctacaaataaaa

SEQ ID NO: 209922 - DNA, 16 bp, P. troglodytes
atagctaggactacag

SEQ ID NO: 209923 - DNA, 16 bp, P. troglodytes
atagctaggattacag

SEQ ID NO: 209924 - DNA, 16 bp, P. troglodytes
atagctcattcctttt

SEQ ID NO: 209925 - DNA, 16 bp, P. troglodytes
atagctctgaagagag

SEQ ID NO: 209926 - DNA, 16 bp, P. troglodytes
atagctgaagaaactg

SEQ ID NO: 209927 - DNA, 16 bp, P. troglodytes
atagctgagactacag

SEQ ID NO: 209928 - DNA, 16 bp, P. troglodytes
atagctgcaaaaaaaa

SEQ ID NO: 209929 - DNA, 16 bp, P. troglodytes
atagctgcaaaaaaat

SEQ ID NO: 209930 - DNA, 16 bp, P. troglodytes
atagctggcattacag

SEQ ID NO: 209931 - DNA, 16 bp, P. troglodytes
atagctgggaccacag

SEQ ID NO: 209932 - DNA, 18 bp, P. troglodytes
atagctgggactacaagt

SEQ ID NO: 209933 - DNA, 16 bp, P. troglodytes
atagctgggactacag

SEQ ID NO: 209934 - DNA, 16 bp, P. troglodytes
atagctgggattacac

SEQ ID NO: 209935 - DNA, 16 bp, P. troglodytes
atagctgggattacag

SEQ ID NO: 209936 - DNA, 16 bp, P. troglodytes
atagctgggcatggtg

SEQ ID NO: 209937 - DNA, 22 bp, P. troglodytes
atagctgggcgtggtggcaggc

SEQ ID NO: 209938 - DNA, 18 bp, P. troglodytes
atagctgggtgtggtggc

SEQ ID NO: 209939 - DNA, 16 bp, P. troglodytes
atagctgtgtgtgtgt

SEQ ID NO: 209940 - DNA, 16 bp, P. troglodytes
atagcttaaaagaaaa

SEQ ID NO: 209941 - DNA, 16 bp, P. troglodytes
atagcttatctttaca

SEQ ID NO: 209942 - DNA, 16 bp, P. troglodytes
atagcttgatgaattt

SEQ ID NO: 209943 - DNA, 16 bp, P. troglodytes
atagctttcttgggga

SEQ ID NO: 209944 - DNA, 16 bp, P. troglodytes
atagcttttaaaaaat

SEQ ID NO: 209945 - DNA, 16 bp, P. troglodytes
atagctttttgtttgt

SEQ ID NO: 209946 - DNA, 16 bp, P. troglodytes
ataggaacagcttcag

SEQ ID NO: 209947 - DNA, 16 bp, P. troglodytes
ataggaatagaggaag

SEQ ID NO: 209948 - DNA, 16 bp, P. troglodytes
ataggagaaaaatttt

SEQ ID NO: 209949 - DNA, 17 bp, P. troglodytes
ataggagcagctccagt

SEQ ID NO: 209950 - DNA, 16 bp, P. troglodytes
ataggatattttaaat

SEQ ID NO: 209951 - DNA, 16 bp, P. troglodytes
ataggcaattcacaga

SEQ ID NO: 209952 - DNA, 16 bp, P. troglodytes
ataggcacacgccacc

SEQ ID NO: 209953 - DNA, 16 bp, P. troglodytes
ataggcaggcaccacc

SEQ ID NO: 209954 - DNA, 16 bp, P. troglodytes
ataggcagtttttcag

SEQ ID NO: 209955 - DNA, 16 bp, P. troglodytes
ataggcatgagccatt

SEQ ID NO: 209956 - DNA, 17 bp, P. troglodytes
ataggcatgtgccacca

SEQ ID NO: 209957 - DNA, 16 bp, P. troglodytes
ataggctcaaaataaa

SEQ ID NO: 209958 - DNA, 18 bp, P. troglodytes
ataggctgggtgtggtgg

SEQ ID NO: 209959 - DNA, 16 bp, P. troglodytes
atagggacagggtctc

SEQ ID NO: 209960 - DNA, 16 bp, P. troglodytes
atagggattatattga

SEQ ID NO: 209961 - DNA, 16 bp, P. troglodytes
atagggcagaggaagc

SEQ ID NO: 209962 - DNA, 16 bp, P. troglodytes
atagggtgtcactctg

SEQ ID NO: 209963 - DNA, 16 bp, P. troglodytes
atagggttattgtgaa

SEQ ID NO: 209964 - DNA, 16 bp, P. troglodytes
atagggtttcaccacg

SEQ ID NO: 209965 - DNA, 16 bp, P. troglodytes
ataggtgacagagcaa

SEQ ID NO: 209966 - DNA, 16 bp, P. troglodytes
ataggtgctcagtaaa

SEQ ID NO: 209967 - DNA, 16 bp, P. troglodytes
ataggttggaattgaa

SEQ ID NO: 209968 - DNA, 16 bp, P. troglodytes
ataggtttttggggga

SEQ ID NO: 209969 - DNA, 16 bp, P. troglodytes
atagtaaataatttag

SEQ ID NO: 209970 - DNA, 16 bp, P. troglodytes
atagtaactcatttaa

SEQ ID NO: 209971 - DNA, 16 bp, P. troglodytes
atagtaagacctcgtc

SEQ ID NO: 209972 - DNA, 16 bp, P. troglodytes
atagtagatatatata

SEQ ID NO: 209973 - DNA, 16 bp, P. troglodytes
atagtagatgctcagt

SEQ ID NO: 209974 - DNA, 16 bp, P. troglodytes
atagtagctgtactaa

SEQ ID NO: 209975 - DNA, 16 bp, P. troglodytes
atagtaggcactcaac

SEQ ID NO: 209976 - DNA, 16 bp, P. troglodytes
atagtatgtagtcttt

SEQ ID NO: 209977 - DNA, 17 bp, P. troglodytes
atagtattccatggtat

SEQ ID NO: 209978 - DNA, 16 bp, P. troglodytes
atagtattcccttatt

SEQ ID NO: 209979 - DNA, 16 bp, P. troglodytes
atagtattcctttata

SEQ ID NO: 209980 - DNA, 16 bp, P. troglodytes
atagtcccaactactt

SEQ ID NO: 209981 - DNA, 16 bp, P. troglodytes
atagtcccagctaccc

SEQ ID NO: 209982 - DNA, 16 bp, P. troglodytes
atagtcccagttactc

SEQ ID NO: 209983 - DNA, 19 bp, P. troglodytes
atagtcccatatttcttgg

SEQ ID NO: 209984 - DNA, 16 bp, P. troglodytes
atagtccttggcatga

SEQ ID NO: 209985 - DNA, 16 bp, P. troglodytes
atagtctacccaaatg

SEQ ID NO: 209986 - DNA, 17 bp, P. troglodytes
atagtctcacctaaata

SEQ ID NO: 209987 - DNA, 16 bp, P. troglodytes
atagtgaaatgattac

SEQ ID NO: 209988 - DNA, 16 bp, P. troglodytes
atagtgagacccccat

SEQ ID NO: 209989 - DNA, 16 bp, P. troglodytes
atagtgagccatgatt

SEQ ID NO: 209990 - DNA, 16 bp, P. troglodytes
atagtgcctgacacat

SEQ ID NO: 209991 - DNA, 16 bp, P. troglodytes
atagtgctgctatgaa

SEQ ID NO: 209992 - DNA, 16 bp, P. troglodytes
atagtggaaggggaag

SEQ ID NO: 209993 - DNA, 16 bp, P. troglodytes
atagtggcaggaggca

SEQ ID NO: 209994 - DNA, 16 bp, P. troglodytes
atagtggcttccagct

SEQ ID NO: 209995 - DNA, 16 bp, P. troglodytes
atagtgtgtgtatata

SEQ ID NO: 209996 - DNA, 16 bp, P. troglodytes
atagttatcttttttg

SEQ ID NO: 209997 - DNA, 16 bp, P. troglodytes
atagttcccataatcc

SEQ ID NO: 209998 - DNA, 16 bp, P. troglodytes
atagttctggaggtta

SEQ ID NO: 209999 - DNA, 16 bp, P. troglodytes
atagttgtacatatgt

SEQ ID NO: 210000 - DNA, 16 bp, P. troglodytes
atagtttaaatctatt

SEQ ID NO: 210001 - DNA, 16 bp, P. troglodytes
atagtttattgagaat

SEQ ID NO: 210002 - DNA, 16 bp, P. troglodytes
atagtttattgttagt

SEQ ID NO: 210003 - DNA, 16 bp, P. troglodytes
atagtttcaaaatatt

SEQ ID NO: 210004 - DNA, 16 bp, P. troglodytes
atagtttgaaatcaga

SEQ ID NO: 210005 - DNA, 16 bp, P. troglodytes
atagtttgaataattt

SEQ ID NO: 210006 - DNA, 16 bp, P. troglodytes
atagtttgccaactcc

SEQ ID NO: 210007 - DNA, 16 bp, P. troglodytes
atagtttggttctgtg

SEQ ID NO: 210008 - DNA, 16 bp, P. troglodytes
atagtttgtatatttg

SEQ ID NO: 210009 - DNA, 16 bp, P. troglodytes
atagtttgttttaaaa

SEQ ID NO: 210010 - DNA, 16 bp, P. troglodytes
atagttttatatatag

SEQ ID NO: 210011 - DNA, 16 bp, P. troglodytes
atagttttcattttct

SEQ ID NO: 210012 - DNA, 16 bp, P. troglodytes
atagtttttccttttc

SEQ ID NO: 210013 - DNA, 16 bp, P. troglodytes
atataaaaatgtgctc

SEQ ID NO: 210014 - DNA, 16 bp, P. troglodytes
atataaaaattagcta

SEQ ID NO: 210015 - DNA, 16 bp, P. troglodytes
atataaaagcaaatat

SEQ ID NO: 210016 - DNA, 16 bp, P. troglodytes
atataaaatagtacag

SEQ ID NO: 210017 - DNA, 16 bp, P. troglodytes
atataaaatcagaaat

SEQ ID NO: 210018 - DNA, 16 bp, P. troglodytes
atataaaatgggaaat

SEQ ID NO: 210019 - DNA, 16 bp, P. troglodytes
atataaaatggtattt

SEQ ID NO: 210020 - DNA, 16 bp, P. troglodytes
atataaacaaatggaa

SEQ ID NO: 210021 - DNA, 16 bp, P. troglodytes
atataaagaactatta

SEQ ID NO: 210022 - DNA, 16 bp, P. troglodytes
atataaagaactctca

SEQ ID NO: 210023 - DNA, 16 bp, P. troglodytes
atataaagcacttaaa

SEQ ID NO: 210024 - DNA, 16 bp, P. troglodytes
atataaataaatgtgt

SEQ ID NO: 210025 - DNA, 16 bp, P. troglodytes
atataaatacacacat

SEQ ID NO: 210026 - DNA, 16 bp, P. troglodytes
atataaatacatacac

SEQ ID NO: 210027 - DNA, 16 bp, P. troglodytes
atataaatatatgcat

SEQ ID NO: 210028 - DNA, 16 bp, P. troglodytes
atataaatatatgtgt

SEQ ID NO: 210029 - DNA, 16 bp, P. troglodytes
atataaatgaaatcat

SEQ ID NO: 210030 - DNA, 16 bp, P. troglodytes
atataaatgaatttca

SEQ ID NO: 210031 - DNA, 16 bp, P. troglodytes
atataaatgcatatgt

SEQ ID NO: 210032 - DNA, 16 bp, P. troglodytes
atataaatggaatcat

SEQ ID NO: 210033 - DNA, 16 bp, P. troglodytes
atataaatggatttat

SEQ ID NO: 210034 - DNA, 16 bp, P. troglodytes
atataaatgtaaacaa

SEQ ID NO: 210035 - DNA, 16 bp, P. troglodytes
atataaatgtaaacat

SEQ ID NO: 210036 - DNA, 16 bp, P. troglodytes
atataaatgtatgtgt

SEQ ID NO: 210037 - DNA, 16 bp, P. troglodytes
atataaatgtgaattt

SEQ ID NO: 210038 - DNA, 16 bp, P. troglodytes
atataaatgtgtgtgt

SEQ ID NO: 210039 - DNA, 16 bp, P. troglodytes
atataaattagccagg

SEQ ID NO: 210040 - DNA, 16 bp, P. troglodytes
atataaattgtgtata

SEQ ID NO: 210041 - DNA, 16 bp, P. troglodytes
atataacatactatat

SEQ ID NO: 210042 - DNA, 16 bp, P. troglodytes
atataacctatacaca

SEQ ID NO: 210043 - DNA, 16 bp, P. troglodytes
atataagtaaaatcat

SEQ ID NO: 210044 - DNA, 16 bp, P. troglodytes
atataagtgaaatcat

SEQ ID NO: 210045 - DNA, 16 bp, P. troglodytes
atataataaatgtaca

SEQ ID NO: 210046 - DNA, 16 bp, P. troglodytes
atataatatatatgca

SEQ ID NO: 210047 - DNA, 16 bp, P. troglodytes
atataatatatgctat

SEQ ID NO: 210048 - DNA, 16 bp, P. troglodytes
atataatccacataaa

SEQ ID NO: 210049 - DNA, 16 bp, P. troglodytes
atataatctgcaaata

SEQ ID NO: 210050 - DNA, 16 bp, P. troglodytes
atataatcttacattt

SEQ ID NO: 210051 - DNA, 16 bp, P. troglodytes
atataatgtataacat

SEQ ID NO: 210052 - DNA, 16 bp, P. troglodytes
atataattactgatat

SEQ ID NO: 210053 - DNA, 16 bp, P. troglodytes
atataattcaagaaaa

SEQ ID NO: 210054 - DNA, 16 bp, P. troglodytes
atataatttgtaaaga

SEQ ID NO: 210055 - DNA, 16 bp, P. troglodytes
atataattttcacatg

SEQ ID NO: 210056 - DNA, 16 bp, P. troglodytes
atatacaaagaattct

SEQ ID NO: 210057 - DNA, 16 bp, P. troglodytes
atatacaaatagcaaa

SEQ ID NO: 210058 - DNA, 16 bp, P. troglodytes
atatacacacacacag

SEQ ID NO: 210059 - DNA, 16 bp, P. troglodytes
atatacacacacacat

SEQ ID NO: 210060 - DNA, 16 bp, P. troglodytes
atatacacacacttac

SEQ ID NO: 210061 - DNA, 16 bp, P. troglodytes
atatacacacactttt

SEQ ID NO: 210062 - DNA, 17 bp, P. troglodytes
atatacacacatatgtg

SEQ ID NO: 210063 - DNA, 16 bp, P. troglodytes
atatacacacatttta

SEQ ID NO: 210064 - DNA, 16 bp, P. troglodytes
atatacacacattttt

SEQ ID NO: 210065 - DNA, 16 bp, P. troglodytes
atatacacagacatat

SEQ ID NO: 210066 - DNA, 16 bp, P. troglodytes
atatacacattatatt

SEQ ID NO: 210067 - DNA, 19 bp, P. troglodytes
atatacaccatggaatact

SEQ ID NO: 210068 - DNA, 16 bp, P. troglodytes
atatacacgtatatat

SEQ ID NO: 210069 - DNA, 16 bp, P. troglodytes
atatacacgtgtgtat

SEQ ID NO: 210070 - DNA, 16 bp, P. troglodytes
atatacagaacatttc

SEQ ID NO: 210071 - DNA, 16 bp, P. troglodytes
atatacagaatataat

SEQ ID NO: 210072 - DNA, 16 bp, P. troglodytes
atatacagatggtaaa

SEQ ID NO: 210073 - DNA, 16 bp, P. troglodytes
atatacagattatata

SEQ ID NO: 210074 - DNA, 16 bp, P. troglodytes
atatacagtcatgtgc

SEQ ID NO: 210075 - DNA, 16 bp, P. troglodytes
atatacataacataca

SEQ ID NO: 210076 - DNA, 16 bp, P. troglodytes
atatacatacatatat

SEQ ID NO: 210077 - DNA, 16 bp, P. troglodytes
atatacatacatgtgt

SEQ ID NO: 210078 - DNA, 16 bp, P. troglodytes
atatacatatacatat

SEQ ID NO: 210079 - DNA, 16 bp, P. troglodytes
atatacatatatagat

SEQ ID NO: 210080 - DNA, 16 bp, P. troglodytes
atatacatatatatac

SEQ ID NO: 210081 - DNA, 16 bp, P. troglodytes
atatacatatatatag

SEQ ID NO: 210082 - DNA, 16 bp, P. troglodytes
atatacatatattgtg

SEQ ID NO: 210083 - DNA, 16 bp, P. troglodytes
atatacatcacagaat

SEQ ID NO: 210084 - DNA, 16 bp, P. troglodytes
atatacatgaaaaaat

SEQ ID NO: 210085 - DNA, 16 bp, P. troglodytes
atatacatgcacatat

SEQ ID NO: 210086 - DNA, 16 bp, P. troglodytes
atatacatgcatgcac

SEQ ID NO: 210087 - DNA, 16 bp, P. troglodytes
atatacatggatatat

SEQ ID NO: 210088 - DNA, 16 bp, P. troglodytes
atatacatgtaatata

SEQ ID NO: 210089 - DNA, 16 bp, P. troglodytes
atatacatgtatatat

SEQ ID NO: 210090 - DNA, 16 bp, P. troglodytes
atatacattaaaatgt

SEQ ID NO: 210091 - DNA, 16 bp, P. troglodytes
atatacatttatttac

SEQ ID NO: 210092 - DNA, 16 bp, P. troglodytes
atatacatttccttta

SEQ ID NO: 210093 - DNA, 16 bp, P. troglodytes
atatacatttgtattt

SEQ ID NO: 210094 - DNA, 16 bp, P. troglodytes
atatacattttttgag

SEQ ID NO: 210095 - DNA, 16 bp, P. troglodytes
atatacccaaaagaat

SEQ ID NO: 210096 - DNA, 16 bp, P. troglodytes
atatacccaaagcaat

SEQ ID NO: 210097 - DNA, 16 bp, P. troglodytes
atataccctttaccca

SEQ ID NO: 210098 - DNA, 16 bp, P. troglodytes
atatacctatataata

SEQ ID NO: 210099 - DNA, 16 bp, P. troglodytes
atatacctatatatgt

SEQ ID NO: 210100 - DNA, 16 bp, P. troglodytes
atatacgtatatacac

SEQ ID NO: 210101 - DNA, 16 bp, P. troglodytes
atatactaaatgccac

SEQ ID NO: 210102 - DNA, 16 bp, P. troglodytes
atatactaataatgaa

SEQ ID NO: 210103 - DNA, 16 bp, P. troglodytes
atatactatatgatat

SEQ ID NO: 210104 - DNA, 16 bp, P. troglodytes
atatactatgtatttt

SEQ ID NO: 210105 - DNA, 16 bp, P. troglodytes
atatactgaaatatgt

SEQ ID NO: 210106 - DNA, 16 bp, P. troglodytes
atatactgaaatattt

SEQ ID NO: 210107 - DNA, 16 bp, P. troglodytes
atatactgctggtggg

SEQ ID NO: 210108 - DNA, 16 bp, P. troglodytes
atatactgtatacagt

SEQ ID NO: 210109 - DNA, 16 bp, P. troglodytes
atatactgtatatata

SEQ ID NO: 210110 - DNA, 16 bp, P. troglodytes
atatactgtattctta

SEQ ID NO: 210111 - DNA, 16 bp, P. troglodytes
atatacttgtttgcca

SEQ ID NO: 210112 - DNA, 16 bp, P. troglodytes
atatagaaaaatacat

SEQ ID NO: 210113 - DNA, 16 bp, P. troglodytes
atatagaaaatcctaa

SEQ ID NO: 210114 - DNA, 16 bp, P. troglodytes
atatagaaaatgtggt

SEQ ID NO: 210115 - DNA, 16 bp, P. troglodytes
atatagaaagtataca

SEQ ID NO: 210116 - DNA, 16 bp, P. troglodytes
atatagaaatacaatt

SEQ ID NO: 210117 - DNA, 16 bp, P. troglodytes
atatagaacaatggaa

SEQ ID NO: 210118 - DNA, 16 bp, P. troglodytes
atatagagaaaaatgt

SEQ ID NO: 210119 - DNA, 16 bp, P. troglodytes
atatagagaaagtttt

SEQ ID NO: 210120 - DNA, 16 bp, P. troglodytes
atatagagatatatat

SEQ ID NO: 210121 - DNA, 16 bp, P. troglodytes
atatagatatagatat

SEQ ID NO: 210122 - DNA, 16 bp, P. troglodytes
atatagcagtgaacaa

SEQ ID NO: 210123 - DNA, 16 bp, P. troglodytes
atatagcatataaata

SEQ ID NO: 210124 - DNA, 16 bp, P. troglodytes
atatagcctgggtgtg

SEQ ID NO: 210125 - DNA, 16 bp, P. troglodytes
atatagctatatataa

SEQ ID NO: 210126 - DNA, 16 bp, P. troglodytes
atataggtaccacatt

SEQ ID NO: 210127 - DNA, 16 bp, P. troglodytes
atatagtagatgctca

SEQ ID NO: 210128 - DNA, 16 bp, P. troglodytes
atatagttttcaaaat

SEQ ID NO: 210129 - DNA, 16 bp, P. troglodytes
atatataaaaatgtgt

SEQ ID NO: 210130 - DNA, 16 bp, P. troglodytes
atatataaaagtgtat

SEQ ID NO: 210131 - DNA, 16 bp, P. troglodytes
atatataaacatagaa

SEQ ID NO: 210132 - DNA, 16 bp, P. troglodytes
atatataaagacatat

SEQ ID NO: 210133 - DNA, 16 bp, P. troglodytes
atatataaagtacata

SEQ ID NO: 210134 - DNA, 16 bp, P. troglodytes
atatataaatggtata

SEQ ID NO: 210135 - DNA, 16 bp, P. troglodytes
atatataagatgtata

SEQ ID NO: 210136 - DNA, 16 bp, P. troglodytes
atatataatcatatct

SEQ ID NO: 210137 - DNA, 16 bp, P. troglodytes
atatataatgtacata

SEQ ID NO: 210138 - DNA, 16 bp, P. troglodytes
atatataattatgtgt

SEQ ID NO: 210139 - DNA, 16 bp, P. troglodytes
atatatacaaatatct

SEQ ID NO: 210140 - DNA, 16 bp, P. troglodytes
atatatacaatgtaat

SEQ ID NO: 210141 - DNA, 16 bp, P. troglodytes
atatatacaatgttta

SEQ ID NO: 210142 - DNA, 16 bp, P. troglodytes
atatatacacatttgt

SEQ ID NO: 210143 - DNA, 16 bp, P. troglodytes
atatatacacttgtac

SEQ ID NO: 210144 - DNA, 16 bp, P. troglodytes
atatatacagatacat

SEQ ID NO: 210145 - DNA, 16 bp, P. troglodytes
atatatacatacattt

SEQ ID NO: 210146 - DNA, 16 bp, P. troglodytes
atatatacatagtttt

SEQ ID NO: 210147 - DNA, 16 bp, P. troglodytes
atatatacatatatgt

SEQ ID NO: 210148 - DNA, 16 bp, P. troglodytes
atatatacatatattc

SEQ ID NO: 210149 - DNA, 16 bp, P. troglodytes
atatatacatatgtaa

SEQ ID NO: 210150 - DNA, 16 bp, P. troglodytes
atatatacatggaaaa

SEQ ID NO: 210151 - DNA, 16 bp, P. troglodytes
atatatacatgtatac

SEQ ID NO: 210152 - DNA, 16 bp, P. troglodytes
atatatacatgtatgt

SEQ ID NO: 210153 - DNA, 16 bp, P. troglodytes
atatatacatgtgtat

SEQ ID NO: 210154 - DNA, 16 bp, P. troglodytes
atatatacatgtgttt

SEQ ID NO: 210155 - DNA, 16 bp, P. troglodytes
atatatacatttctct

SEQ ID NO: 210156 - DNA, 16 bp, P. troglodytes
atatataccattttta

SEQ ID NO: 210157 - DNA, 16 bp, P. troglodytes
atatataccttataca

SEQ ID NO: 210158 - DNA, 16 bp, P. troglodytes
atatatacgtatatat

SEQ ID NO: 210159 - DNA, 16 bp, P. troglodytes
atatatactcatatat

SEQ ID NO: 210160 - DNA, 16 bp, P. troglodytes
atatatactgaaaata

SEQ ID NO: 210161 - DNA, 16 bp, P. troglodytes
atatatactgtatgta

SEQ ID NO: 210162 - DNA, 16 bp, P. troglodytes
atatatagatatatag

SEQ ID NO: 210163 - DNA, 16 bp, P. troglodytes
atatatagcatattat

SEQ ID NO: 210164 - DNA, 16 bp, P. troglodytes
atatatagtatataga

SEQ ID NO: 210165 - DNA, 16 bp, P. troglodytes
atatatagttgtatat

SEQ ID NO: 210166 - DNA, 16 bp, P. troglodytes
atatatataacagaat

SEQ ID NO: 210167 - DNA, 16 bp, P. troglodytes
atatatataatgtaca

SEQ ID NO: 210168 - DNA, 16 bp, P. troglodytes
atatatatacatatgt

SEQ ID NO: 210169 - DNA, 16 bp, P. troglodytes
atatatatacccacat

SEQ ID NO: 210170 - DNA, 16 bp, P. troglodytes
atatatatagagagag

SEQ ID NO: 210171 - DNA, 16 bp, P. troglodytes
atatatatataaagcc

SEQ ID NO: 210172 - DNA, 16 bp, P. troglodytes
atatatatataattcc

SEQ ID NO: 210173 - DNA, 25 bp, P. troglodytes
atatatatatacacacacacacata

SEQ ID NO: 210174 - DNA, 16 bp, P. troglodytes
atatatatatagacac

SEQ ID NO: 210175 - DNA, 16 bp, P. troglodytes
atatatatatatagac

SEQ ID NO: 210176 - DNA, 16 bp, P. troglodytes
atatatatatataggc

SEQ ID NO: 210177 - DNA, 16 bp, P. troglodytes
atatatatatatagtc

SEQ ID NO: 210178 - DNA, 16 bp, P. troglodytes
atatatatatatatcc

SEQ ID NO: 210179 - DNA, 16 bp, P. troglodytes
atatatatatatatgg

SEQ ID NO: 210180 - DNA, 16 bp, P. troglodytes
atatatatatatctgg

SEQ ID NO: 210181 - DNA, 18 bp, P. troglodytes
atatatatatatctgtat

SEQ ID NO: 210182 - DNA, 16 bp, P. troglodytes
atatatatatatgatg

SEQ ID NO: 210183 - DNA, 16 bp, P. troglodytes
atatatatatatgcac

SEQ ID NO: 210184 - DNA, 16 bp, P. troglodytes
atatatatatatgtag

SEQ ID NO: 210185 - DNA, 16 bp, P. troglodytes
atatatatatatgttc

SEQ ID NO: 210186 - DNA, 16 bp, P. troglodytes
atatatatatattcac

SEQ ID NO: 210187 - DNA, 16 bp, P. troglodytes
atatatatatattcca

SEQ ID NO: 210188 - DNA, 16 bp, P. troglodytes
atatatatatcctctt

SEQ ID NO: 210189 - DNA, 16 bp, P. troglodytes
atatatatatctacat

SEQ ID NO: 210190 - DNA, 16 bp, P. troglodytes
atatatatatctccag

SEQ ID NO: 210191 - DNA, 16 bp, P. troglodytes
atatatatatctctct

SEQ ID NO: 210192 - DNA, 16 bp, P. troglodytes
atatatatatgaagag

SEQ ID NO: 210193 - DNA, 16 bp, P. troglodytes
atatatatatggagat

SEQ ID NO: 210194 - DNA, 16 bp, P. troglodytes
atatatatatggattt

SEQ ID NO: 210195 - DNA, 16 bp, P. troglodytes
atatatatatgtgggt

SEQ ID NO: 210196 - DNA, 16 bp, P. troglodytes
atatatatatgtgtgt

SEQ ID NO: 210197 - DNA, 16 bp, P. troglodytes
atatatatattcttgt

SEQ ID NO: 210198 - DNA, 16 bp, P. troglodytes
atatatatcacatata

SEQ ID NO: 210199 - DNA, 16 bp, P. troglodytes
atatatatccatatat

SEQ ID NO: 210200 - DNA, 16 bp, P. troglodytes
atatatatctatatgt

SEQ ID NO: 210201 - DNA, 16 bp, P. troglodytes
atatatatctatctat

SEQ ID NO: 210202 - DNA, 16 bp, P. troglodytes
atatatatctgtatat

SEQ ID NO: 210203 - DNA, 16 bp, P. troglodytes
atatatatctgtgtat

SEQ ID NO: 210204 - DNA, 16 bp, P. troglodytes
atatatatgacatttt

SEQ ID NO: 210205 - DNA, 16 bp, P. troglodytes
atatatatgatataca

SEQ ID NO: 210206 - DNA, 16 bp, P. troglodytes
atatatatgatatcat

SEQ ID NO: 210207 - DNA, 16 bp, P. troglodytes
atatatatgcatgcat

SEQ ID NO: 210208 - DNA, 16 bp, P. troglodytes
atatatatgcatgtgt

SEQ ID NO: 210209 - DNA, 16 bp, P. troglodytes
atatatatgctatata

SEQ ID NO: 210210 - DNA, 16 bp, P. troglodytes
atatatatgctatttt

SEQ ID NO: 210211 - DNA, 16 bp, P. troglodytes
atatatatgctcccaa

SEQ ID NO: 210212 - DNA, 16 bp, P. troglodytes
atatatatggttatat

SEQ ID NO: 210213 - DNA, 16 bp, P. troglodytes
atatatatgtatagac

SEQ ID NO: 210214 - DNA, 16 bp, P. troglodytes
atatatatgtatgtgt

SEQ ID NO: 210215 - DNA, 16 bp, P. troglodytes
atatatatgtctgtat

SEQ ID NO: 210216 - DNA, 16 bp, P. troglodytes
atatatatgtggaata

SEQ ID NO: 210217 - DNA, 16 bp, P. troglodytes
atatatatgtgtatac

SEQ ID NO: 210218 - DNA, 16 bp, P. troglodytes
atatatatgtgtatgt

SEQ ID NO: 210219 - DNA, 16 bp, P. troglodytes
atatatatgtgtgtat

SEQ ID NO: 210220 - DNA, 16 bp, P. troglodytes
atatatatgttacata

SEQ ID NO: 210221 - DNA, 16 bp, P. troglodytes
atatatatgttgatat

SEQ ID NO: 210222 - DNA, 16 bp, P. troglodytes
atatatattcagaata

SEQ ID NO: 210223 - DNA, 16 bp, P. troglodytes
atatatattgtttcaa

SEQ ID NO: 210224 - DNA, 16 bp, P. troglodytes
atatatatttactgaa

SEQ ID NO: 210225 - DNA, 16 bp, P. troglodytes
atatatatttatcatg

SEQ ID NO: 210226 - DNA, 16 bp, P. troglodytes
atatatatttccaaat

SEQ ID NO: 210227 - DNA, 16 bp, P. troglodytes
atatatatttgtactt

SEQ ID NO: 210228 - DNA, 16 bp, P. troglodytes
atatatattttacaca

SEQ ID NO: 210229 - DNA, 16 bp, P. troglodytes
atatatattttgcata

SEQ ID NO: 210230 - DNA, 16 bp, P. troglodytes
atatatcaaaatacca

SEQ ID NO: 210231 - DNA, 16 bp, P. troglodytes
atatatcaaatcatca

SEQ ID NO: 210232 - DNA, 16 bp, P. troglodytes
atatatccaaaaggaa

SEQ ID NO: 210233 - DNA, 16 bp, P. troglodytes
atatatccagaagaaa

SEQ ID NO: 210234 - DNA, 16 bp, P. troglodytes
atatatccagaggaaa

SEQ ID NO: 210235 - DNA, 16 bp, P. troglodytes
atatatcctatatata

SEQ ID NO: 210236 - DNA, 16 bp, P. troglodytes
atatatcctatatatt

SEQ ID NO: 210237 - DNA, 16 bp, P. troglodytes
atatatctagaaaacc

SEQ ID NO: 210238 - DNA, 16 bp, P. troglodytes
atatatctatctgtat

SEQ ID NO: 210239 - DNA, 16 bp, P. troglodytes
atatatctatctgtct

SEQ ID NO: 210240 - DNA, 16 bp, P. troglodytes
atatatcttacatata

SEQ ID NO: 210241 - DNA, 16 bp, P. troglodytes
atatatgaaatgtata

SEQ ID NO: 210242 - DNA, 16 bp, P. troglodytes
atatatgaatgaatat

SEQ ID NO: 210243 - DNA, 16 bp, P. troglodytes
atatatgaatgaatga

SEQ ID NO: 210244 - DNA, 16 bp, P. troglodytes
atatatgacattttct

SEQ ID NO: 210245 - DNA, 16 bp, P. troglodytes
atatatgattttcaaa

SEQ ID NO: 210246 - DNA, 16 bp, P. troglodytes
atatatgattttcttt

SEQ ID NO: 210247 - DNA, 16 bp, P. troglodytes
atatatgcaaataaat

SEQ ID NO: 210248 - DNA, 16 bp, P. troglodytes
atatatgcaaatatat

SEQ ID NO: 210249 - DNA, 16 bp, P. troglodytes
atatatgcaatatata

SEQ ID NO: 210250 - DNA, 16 bp, P. troglodytes
atatatgcaattttat

SEQ ID NO: 210251 - DNA, 16 bp, P. troglodytes
atatatgcacaaaata

SEQ ID NO: 210252 - DNA, 16 bp, P. troglodytes
atatatgcacatacat

SEQ ID NO: 210253 - DNA, 16 bp, P. troglodytes
atatatgcacatgcat

SEQ ID NO: 210254 - DNA, 16 bp, P. troglodytes
atatatgcagccaaca

SEQ ID NO: 210255 - DNA, 16 bp, P. troglodytes
atatatgcatacatgt

SEQ ID NO: 210256 - DNA, 16 bp, P. troglodytes
atatatgcatgtgtgt

SEQ ID NO: 210257 - DNA, 16 bp, P. troglodytes
atatatgctttctttt

SEQ ID NO: 210258 - DNA, 16 bp, P. troglodytes
atatatggaaatatat

SEQ ID NO: 210259 - DNA, 16 bp, P. troglodytes
atatatggactttatt

SEQ ID NO: 210260 - DNA, 16 bp, P. troglodytes
atatatggtatttata

SEQ ID NO: 210261 - DNA, 16 bp, P. troglodytes
atatatgtaaaacata

SEQ ID NO: 210262 - DNA, 16 bp, P. troglodytes
atatatgtaaaatgtt

SEQ ID NO: 210263 - DNA, 16 bp, P. troglodytes
atatatgtaacttttt

SEQ ID NO: 210264 - DNA, 16 bp, P. troglodytes
atatatgtaatataca

SEQ ID NO: 210265 - DNA, 16 bp, P. troglodytes
atatatgtacataaat

SEQ ID NO: 210266 - DNA, 16 bp, P. troglodytes
atatatgtagatatat

SEQ ID NO: 210267 - DNA, 16 bp, P. troglodytes
atatatgtataaatgt

SEQ ID NO: 210268 - DNA, 16 bp, P. troglodytes
atatatgtatacatgt

SEQ ID NO: 210269 - DNA, 16 bp, P. troglodytes
atatatgtatataaag

SEQ ID NO: 210270 - DNA, 16 bp, P. troglodytes
atatatgtatatagat

SEQ ID NO: 210271 - DNA, 16 bp, P. troglodytes
atatatgtatatgtgt

SEQ ID NO: 210272 - DNA, 16 bp, P. troglodytes
atatatgtatctgtat

SEQ ID NO: 210273 - DNA, 16 bp, P. troglodytes
atatatgtatgtatat

SEQ ID NO: 210274 - DNA, 16 bp, P. troglodytes
atatatgtatgtatgc

SEQ ID NO: 210275 - DNA, 16 bp, P. troglodytes
atatatgtatttttca

SEQ ID NO: 210276 - DNA, 16 bp, P. troglodytes
atatatgtgcatgtat

SEQ ID NO: 210277 - DNA, 16 bp, P. troglodytes
atatatgtgtatatat

SEQ ID NO: 210278 - DNA, 16 bp, P. troglodytes
atatatgtgtatatgt

SEQ ID NO: 210279 - DNA, 16 bp, P. troglodytes
atatatgtgtatgcat

SEQ ID NO: 210280 - DNA, 16 bp, P. troglodytes
atatatgtgtatgtac

SEQ ID NO: 210281 - DNA, 16 bp, P. troglodytes
atatatgtgtcccata

SEQ ID NO: 210282 - DNA, 16 bp, P. troglodytes
atatatgtgtgcatgt

SEQ ID NO: 210283 - DNA, 16 bp, P. troglodytes
atatatgtgtgtatac

SEQ ID NO: 210284 - DNA, 16 bp, P. troglodytes
atatatgtgtgtctat

SEQ ID NO: 210285 - DNA, 16 bp, P. troglodytes
atatatgtgtgtgcgt

SEQ ID NO: 210286 - DNA, 17 bp, P. troglodytes
atatatgtgtgtgtatg

SEQ ID NO: 210287 - DNA, 16 bp, P. troglodytes
atatatgtgtgtgtga

SEQ ID NO: 210288 - DNA, 16 bp, P. troglodytes
atatatgtgtgtttat

SEQ ID NO: 210289 - DNA, 16 bp, P. troglodytes
atatatgtgttttaaa

SEQ ID NO: 210290 - DNA, 16 bp, P. troglodytes
atatatgttatacata

SEQ ID NO: 210291 - DNA, 16 bp, P. troglodytes
atatatgttcattgta

SEQ ID NO: 210292 - DNA, 16 bp, P. troglodytes
atatatgttctctagg

SEQ ID NO: 210293 - DNA, 16 bp, P. troglodytes
atatatgtttcatttt

SEQ ID NO: 210294 - DNA, 16 bp, P. troglodytes
atatatgtttgtgtat

SEQ ID NO: 210295 - DNA, 16 bp, P. troglodytes
atatatgttttgaaaa

SEQ ID NO: 210296 - DNA, 16 bp, P. troglodytes
atatattaatatatgc

SEQ ID NO: 210297 - DNA, 16 bp, P. troglodytes
atatattacaaagtta

SEQ ID NO: 210298 - DNA, 16 bp, P. troglodytes
atatattatatgccat

SEQ ID NO: 210299 - DNA, 16 bp, P. troglodytes
atatattatgtacata

SEQ ID NO: 210300 - DNA, 16 bp, P. troglodytes
atatattcaaagtgta

SEQ ID NO: 210301 - DNA, 16 bp, P. troglodytes
atatattcaagaaaaa

SEQ ID NO: 210302 - DNA, 16 bp, P. troglodytes
atatattcaagaaata

SEQ ID NO: 210303 - DNA, 16 bp, P. troglodytes
atatattcaaggtgta

SEQ ID NO: 210304 - DNA, 16 bp, P. troglodytes
atatattcagttattt

SEQ ID NO: 210305 - DNA, 16 bp, P. troglodytes
atatattcatgtaata

SEQ ID NO: 210306 - DNA, 16 bp, P. troglodytes
atatattctggttgtt

SEQ ID NO: 210307 - DNA, 16 bp, P. troglodytes
atatattgagatatat

SEQ ID NO: 210308 - DNA, 16 bp, P. troglodytes
atatattgttttcatt

SEQ ID NO: 210309 - DNA, 16 bp, P. troglodytes
atatatttaaagtgta

SEQ ID NO: 210310 - DNA, 16 bp, P. troglodytes
atatatttaaatttgc

SEQ ID NO: 210311 - DNA, 16 bp, P. troglodytes
atatatttacatgtaa

SEQ ID NO: 210312 - DNA, 18 bp, P. troglodytes
atatatttaggatagtta

SEQ ID NO: 210313 - DNA, 16 bp, P. troglodytes
atatatttcatgttca

SEQ ID NO: 210314 - DNA, 16 bp, P. troglodytes
atatatttctaaaaca

SEQ ID NO: 210315 - DNA, 16 bp, P. troglodytes
atatatttctctaggt

SEQ ID NO: 210316 - DNA, 16 bp, P. troglodytes
atatatttgaatgtat

SEQ ID NO: 210317 - DNA, 16 bp, P. troglodytes
atatatttgacatttt

SEQ ID NO: 210318 - DNA, 16 bp, P. troglodytes
atatatttgcattttt

SEQ ID NO: 210319 - DNA, 16 bp, P. troglodytes
atatatttgccatttt

SEQ ID NO: 210320 - DNA, 16 bp, P. troglodytes
atatatttgtgtacat

SEQ ID NO: 210321 - DNA, 16 bp, P. troglodytes
atatattttaaaggta

SEQ ID NO: 210322 - DNA, 16 bp, P. troglodytes
atatattttaaagttg

SEQ ID NO: 210323 - DNA, 16 bp, P. troglodytes
atatattttaacacaa

SEQ ID NO: 210324 - DNA, 16 bp, P. troglodytes
atatattttaagtgat

SEQ ID NO: 210325 - DNA, 16 bp, P. troglodytes
atatattttctaaaac

SEQ ID NO: 210326 - DNA, 16 bp, P. troglodytes
atatattttgcaaaat

SEQ ID NO: 210327 - DNA, 16 bp, P. troglodytes
atatattttggaggta

SEQ ID NO: 210328 - DNA, 16 bp, P. troglodytes
atatattttggatagt

SEQ ID NO: 210329 - DNA, 16 bp, P. troglodytes
atatattttgggtatt

SEQ ID NO: 210330 - DNA, 16 bp, P. troglodytes
atatattttgtcattt

SEQ ID NO: 210331 - DNA, 16 bp, P. troglodytes
atatattttgtttcct

SEQ ID NO: 210332 - DNA, 16 bp, P. troglodytes
atatatttttacatgt

SEQ ID NO: 210333 - DNA, 16 bp, P. troglodytes
atatatttttgagaaa

SEQ ID NO: 210334 - DNA, 16 bp, P. troglodytes
atatatttttgtacat

SEQ ID NO: 210335 - DNA, 16 bp, P. troglodytes
atatattttttggtag

SEQ ID NO: 210336 - DNA, 16 bp, P. troglodytes
atatatttttttcagt

SEQ ID NO: 210337 - DNA, 16 bp, P. troglodytes
atatatttttttctga

SEQ ID NO: 210338 - DNA, 16 bp, P. troglodytes
atatcaaggacttgag

SEQ ID NO: 210339 - DNA, 16 bp, P. troglodytes
atatcaagtattttct

SEQ ID NO: 210340 - DNA, 16 bp, P. troglodytes
atatcaatgaaatcat

SEQ ID NO: 210341 - DNA, 16 bp, P. troglodytes
atatcaccaaagaaaa

SEQ ID NO: 210342 - DNA, 16 bp, P. troglodytes
atatcacctgaggtca

SEQ ID NO: 210343 - DNA, 16 bp, P. troglodytes
atatcagggtaatgct

SEQ ID NO: 210344 - DNA, 16 bp, P. troglodytes
atatcagtgagaatat

SEQ ID NO: 210345 - DNA, 16 bp, P. troglodytes
atatcataagcatttt

SEQ ID NO: 210346 - DNA, 16 bp, P. troglodytes
atatcataatttgttt

SEQ ID NO: 210347 - DNA, 16 bp, P. troglodytes
atatcatagttgtaca

SEQ ID NO: 210348 - DNA, 16 bp, P. troglodytes
atatcatcaacaaaca

SEQ ID NO: 210349 - DNA, 16 bp, P. troglodytes
atatcatcaagaaata

SEQ ID NO: 210350 - DNA, 16 bp, P. troglodytes
atatcatgctgttttg

SEQ ID NO: 210351 - DNA, 16 bp, P. troglodytes
atatcattctgccccg

SEQ ID NO: 210352 - DNA, 16 bp, P. troglodytes
atatcattgatatttt

SEQ ID NO: 210353 - DNA, 16 bp, P. troglodytes
atatcattgtcttcca

SEQ ID NO: 210354 - DNA, 16 bp, P. troglodytes
atatccaatgaaaata

SEQ ID NO: 210355 - DNA, 16 bp, P. troglodytes
atatccacaccaacat

SEQ ID NO: 210356 - DNA, 16 bp, P. troglodytes
atatccagaaggggag

SEQ ID NO: 210357 - DNA, 16 bp, P. troglodytes
atatccatacaacaga

SEQ ID NO: 210358 - DNA, 16 bp, P. troglodytes
atatccatatataata

SEQ ID NO: 210359 - DNA, 16 bp, P. troglodytes
atatccatatgcaaaa

SEQ ID NO: 210360 - DNA, 16 bp, P. troglodytes
atatcctctttggaga

SEQ ID NO: 210361 - DNA, 16 bp, P. troglodytes
atatcctctttgtcat

SEQ ID NO: 210362 - DNA, 16 bp, P. troglodytes
atatccttaacaaaat

SEQ ID NO: 210363 - DNA, 16 bp, P. troglodytes
atatcctttcttttgg

SEQ ID NO: 210364 - DNA, 16 bp, P. troglodytes
atatctagttttccca

SEQ ID NO: 210365 - DNA, 16 bp, P. troglodytes
atatctagtttttcca

SEQ ID NO: 210366 - DNA, 16 bp, P. troglodytes
atatctatatatctgt

SEQ ID NO: 210367 - DNA, 16 bp, P. troglodytes
atatctatctatctat

SEQ ID NO: 210368 - DNA, 16 bp, P. troglodytes
atatctatctctatat

SEQ ID NO: 210369 - DNA, 16 bp, P. troglodytes
atatctatgtatacat

SEQ ID NO: 210370 - DNA, 16 bp, P. troglodytes
atatctatttttatgt

SEQ ID NO: 210371 - DNA, 16 bp, P. troglodytes
atatctcaaaatagta

SEQ ID NO: 210372 - DNA, 16 bp, P. troglodytes
atatctcattatgatt

SEQ ID NO: 210373 - DNA, 16 bp, P. troglodytes
atatctcatttttaaa

SEQ ID NO: 210374 - DNA, 16 bp, P. troglodytes
atatctgcaaagacct

SEQ ID NO: 210375 - DNA, 16 bp, P. troglodytes
atatctgcactcccac

SEQ ID NO: 210376 - DNA, 16 bp, P. troglodytes
atatctgtaatatata

SEQ ID NO: 210377 - DNA, 16 bp, P. troglodytes
atatctgtatatatct

SEQ ID NO: 210378 - DNA, 16 bp, P. troglodytes
atatctgtatatctgt

SEQ ID NO: 210379 - DNA, 16 bp, P. troglodytes
atatctgtctttctgt

SEQ ID NO: 210380 - DNA, 16 bp, P. troglodytes
atatctgtggattcaa

SEQ ID NO: 210381 - DNA, 16 bp, P. troglodytes
atatctgtgggttctg

SEQ ID NO: 210382 - DNA, 16 bp, P. troglodytes
atatctgtgtgctcca

SEQ ID NO: 210383 - DNA, 16 bp, P. troglodytes
atatctgttaattttc

SEQ ID NO: 210384 - DNA, 16 bp, P. troglodytes
atatctgttttggtac

SEQ ID NO: 210385 - DNA, 16 bp, P. troglodytes
atatcttcagaaaaaa

SEQ ID NO: 210386 - DNA, 16 bp, P. troglodytes
atatcttccagaattt

SEQ ID NO: 210387 - DNA, 16 bp, P. troglodytes
atatcttccatttctt

SEQ ID NO: 210388 - DNA, 16 bp, P. troglodytes
atatcttgaaaagttg

SEQ ID NO: 210389 - DNA, 16 bp, P. troglodytes
atatcttggatattgt

SEQ ID NO: 210390 - DNA, 17 bp, P. troglodytes
atatcttggttaaagta

SEQ ID NO: 210391 - DNA, 16 bp, P. troglodytes
atatctttgctattat

SEQ ID NO: 210392 - DNA, 16 bp, P. troglodytes
atatcttttcaggttt

SEQ ID NO: 210393 - DNA, 16 bp, P. troglodytes
atatgaaaaaatactt

SEQ ID NO: 210394 - DNA, 16 bp, P. troglodytes
atatgaaaactttttt

SEQ ID NO: 210395 - DNA, 16 bp, P. troglodytes
atatgaaaagaagctc

SEQ ID NO: 210396 - DNA, 16 bp, P. troglodytes
atatgaaaagatactc

SEQ ID NO: 210397 - DNA, 16 bp, P. troglodytes
atatgaaaaggtgttc

SEQ ID NO: 210398 - DNA, 16 bp, P. troglodytes
atatgaaaatattcat

SEQ ID NO: 210399 - DNA, 16 bp, P. troglodytes
atatgaaaatcaataa

SEQ ID NO: 210400 - DNA, 16 bp, P. troglodytes
atatgaaacatttttt

SEQ ID NO: 210401 - DNA, 16 bp, P. troglodytes
atatgaaatggtgttt

SEQ ID NO: 210402 - DNA, 16 bp, P. troglodytes
atatgaaattcaaata

SEQ ID NO: 210403 - DNA, 16 bp, P. troglodytes
atatgaaatttggggg

SEQ ID NO: 210404 - DNA, 16 bp, P. troglodytes
atatgaacatttcaat

SEQ ID NO: 210405 - DNA, 16 bp, P. troglodytes
atatgaagaaactgaa

SEQ ID NO: 210406 - DNA, 16 bp, P. troglodytes
atatgaagagagagag

SEQ ID NO: 210407 - DNA, 16 bp, P. troglodytes
atatgaagtcaataaa

SEQ ID NO: 210408 - DNA, 16 bp, P. troglodytes
atatgaatatatgttt

SEQ ID NO: 210409 - DNA, 16 bp, P. troglodytes
atatgaatatgtatat

SEQ ID NO: 210410 - DNA, 16 bp, P. troglodytes
atatgaatggaatcat

SEQ ID NO: 210411 - DNA, 16 bp, P. troglodytes
atatgaatggaattat

SEQ ID NO: 210412 - DNA, 16 bp, P. troglodytes
atatgaatgtaaatat

SEQ ID NO: 210413 - DNA, 16 bp, P. troglodytes
atatgaatttgaggga

SEQ ID NO: 210414 - DNA, 16 bp, P. troglodytes
atatgaattttatgat

SEQ ID NO: 210415 - DNA, 16 bp, P. troglodytes
atatgaattttggaga

SEQ ID NO: 210416 - DNA, 16 bp, P. troglodytes
atatgacaaaatgctc

SEQ ID NO: 210417 - DNA, 16 bp, P. troglodytes
atatgacaaatgtttc

SEQ ID NO: 210418 - DNA, 16 bp, P. troglodytes
atatgacaagcccaca

SEQ ID NO: 210419 - DNA, 16 bp, P. troglodytes
atatgacaattttaaa

SEQ ID NO: 210420 - DNA, 16 bp, P. troglodytes
atatgacccagaaatt

SEQ ID NO: 210421 - DNA, 16 bp, P. troglodytes
atatgacccagccatt

SEQ ID NO: 210422 - DNA, 16 bp, P. troglodytes
atatgactagccagtt

SEQ ID NO: 210423 - DNA, 16 bp, P. troglodytes
atatgactgtatttgg

SEQ ID NO: 210424 - DNA, 16 bp, P. troglodytes
atatgagtaagttctt

SEQ ID NO: 210425 - DNA, 16 bp, P. troglodytes
atatgagtttttaaaa

SEQ ID NO: 210426 - DNA, 16 bp, P. troglodytes
atatgatagatatata

SEQ ID NO: 210427 - DNA, 16 bp, P. troglodytes
atatgatatatagtta

SEQ ID NO: 210428 - DNA, 16 bp, P. troglodytes
atatgatcatgtgatt

SEQ ID NO: 210429 - DNA, 16 bp, P. troglodytes
atatgatcatttaaaa

SEQ ID NO: 210430 - DNA, 16 bp, P. troglodytes
atatgatcattttaat

SEQ ID NO: 210431 - DNA, 20 bp, P. troglodytes
atatgatggcttagcttggg

SEQ ID NO: 210432 - DNA, 16 bp, P. troglodytes
atatgattattttctt

SEQ ID NO: 210433 - DNA, 16 bp, P. troglodytes
atatgattctatttat

SEQ ID NO: 210434 - DNA, 16 bp, P. troglodytes
atatgatttccaaata

SEQ ID NO: 210435 - DNA, 17 bp, P. troglodytes
atatgatttggctgtgt

SEQ ID NO: 210436 - DNA, 16 bp, P. troglodytes
atatgatttggctttg

SEQ ID NO: 210437 - DNA, 16 bp, P. troglodytes
atatgatttgtaaata

SEQ ID NO: 210438 - DNA, 16 bp, P. troglodytes
atatgcaaaaattaaa

SEQ ID NO: 210439 - DNA, 16 bp, P. troglodytes
atatgcaaaagaataa

SEQ ID NO: 210440 - DNA, 16 bp, P. troglodytes
atatgcaaataaataa

SEQ ID NO: 210441 - DNA, 16 bp, P. troglodytes
atatgcaaatatttat

SEQ ID NO: 210442 - DNA, 17 bp, P. troglodytes
atatgcaaatcaataaa

SEQ ID NO: 210443 - DNA, 16 bp, P. troglodytes
atatgcaaatttttaa

SEQ ID NO: 210444 - DNA, 16 bp, P. troglodytes
atatgcaagatgaaca

SEQ ID NO: 210445 - DNA, 16 bp, P. troglodytes
atatgcaattatatat

SEQ ID NO: 210446 - DNA, 16 bp, P. troglodytes
atatgcacatacatgt

SEQ ID NO: 210447 - DNA, 16 bp, P. troglodytes
atatgcacatgtatgt

SEQ ID NO: 210448 - DNA, 16 bp, P. troglodytes
atatgcacgtgtgtat

SEQ ID NO: 210449 - DNA, 16 bp, P. troglodytes
atatgcagaaagctga

SEQ ID NO: 210450 - DNA, 16 bp, P. troglodytes
atatgcagaaataatg

SEQ ID NO: 210451 - DNA, 16 bp, P. troglodytes
atatgcagattttctt

SEQ ID NO: 210452 - DNA, 16 bp, P. troglodytes
atatgcaggtttttgt

SEQ ID NO: 210453 - DNA, 16 bp, P. troglodytes
atatgcataaaataaa

SEQ ID NO: 210454 - DNA, 16 bp, P. troglodytes
atatgcatatatatct

SEQ ID NO: 210455 - DNA, 16 bp, P. troglodytes
atatgcatatctatat

SEQ ID NO: 210456 - DNA, 16 bp, P. troglodytes
atatgcatatgtatgt

SEQ ID NO: 210457 - DNA, 16 bp, P. troglodytes
atatgcatgcatgtgt

SEQ ID NO: 210458 - DNA, 16 bp, P. troglodytes
atatgcatgtatatat

SEQ ID NO: 210459 - DNA, 16 bp, P. troglodytes
atatgcatttatctca

SEQ ID NO: 210460 - DNA, 16 bp, P. troglodytes
atatgcatttatttct

SEQ ID NO: 210461 - DNA, 16 bp, P. troglodytes
atatgcatttttaaat

SEQ ID NO: 210462 - DNA, 16 bp, P. troglodytes
atatgccatatatatg

SEQ ID NO: 210463 - DNA, 16 bp, P. troglodytes
atatgctaagtgaaag

SEQ ID NO: 210464 - DNA, 16 bp, P. troglodytes
atatgctaagtgaaat

SEQ ID NO: 210465 - DNA, 16 bp, P. troglodytes
atatgctatattttaa

SEQ ID NO: 210466 - DNA, 16 bp, P. troglodytes
atatgctgccttcaag

SEQ ID NO: 210467 - DNA, 16 bp, P. troglodytes
atatgctgctggattt

SEQ ID NO: 210468 - DNA, 16 bp, P. troglodytes
atatgctgtattttca

SEQ ID NO: 210469 - DNA, 16 bp, P. troglodytes
atatgctgtgtttggt

SEQ ID NO: 210470 - DNA, 16 bp, P. troglodytes
atatgctttaaaaaaa

SEQ ID NO: 210471 - DNA, 16 bp, P. troglodytes
atatggaaaatctctg

SEQ ID NO: 210472 - DNA, 16 bp, P. troglodytes
atatggaaattaaaca

SEQ ID NO: 210473 - DNA, 16 bp, P. troglodytes
atatggactctttttt

SEQ ID NO: 210474 - DNA, 16 bp, P. troglodytes
atatggagaaaaggga

SEQ ID NO: 210475 - DNA, 16 bp, P. troglodytes
atatggagggctgact

SEQ ID NO: 210476 - DNA, 16 bp, P. troglodytes
atatggatatccagtt

SEQ ID NO: 210477 - DNA, 16 bp, P. troglodytes
atatggcaaaactcca

SEQ ID NO: 210478 - DNA, 16 bp, P. troglodytes
atatggcaaagaaaca

SEQ ID NO: 210479 - DNA, 16 bp, P. troglodytes
atatggcataaaagat

SEQ ID NO: 210480 - DNA, 16 bp, P. troglodytes
atatggccagagcagg

SEQ ID NO: 210481 - DNA, 16 bp, P. troglodytes
atatggctagccagct

SEQ ID NO: 210482 - DNA, 16 bp, P. troglodytes
atatgggttctttttt

SEQ ID NO: 210483 - DNA, 16 bp, P. troglodytes
atatggtagccactag

SEQ ID NO: 210484 - DNA, 16 bp, P. troglodytes
atatggtctaaaaaga

SEQ ID NO: 210485 - DNA, 16 bp, P. troglodytes
atatggtgccactgca

SEQ ID NO: 210486 - DNA, 16 bp, P. troglodytes
atatggtggtgtgcac

SEQ ID NO: 210487 - DNA, 16 bp, P. troglodytes
atatggttcaacctaa

SEQ ID NO: 210488 - DNA, 16 bp, P. troglodytes
atatggttggaatcat

SEQ ID NO: 210489 - DNA, 16 bp, P. troglodytes
atatggtttagctgtg

SEQ ID NO: 210490 - DNA, 16 bp, P. troglodytes
atatggtttatcttgg

SEQ ID NO: 210491 - DNA, 16 bp, P. troglodytes
atatggtttcaccatg

SEQ ID NO: 210492 - DNA, 16 bp, P. troglodytes
atatggtttctactga

SEQ ID NO: 210493 - DNA, 16 bp, P. troglodytes
atatggtttggctctg

SEQ ID NO: 210494 - DNA, 16 bp, P. troglodytes
atatggttttatttct

SEQ ID NO: 210495 - DNA, 16 bp, P. troglodytes
atatggttttcctttt

SEQ ID NO: 210496 - DNA, 16 bp, P. troglodytes
atatgtaaaaatgtat

SEQ ID NO: 210497 - DNA, 16 bp, P. troglodytes
atatgtaaaacatttt

SEQ ID NO: 210498 - DNA, 16 bp, P. troglodytes
atatgtaaagcactta

SEQ ID NO: 210499 - DNA, 16 bp, P. troglodytes
atatgtaaataatgta

SEQ ID NO: 210500 - DNA, 16 bp, P. troglodytes
atatgtaagaagtaca

SEQ ID NO: 210501 - DNA, 16 bp, P. troglodytes
atatgtaatatatgca

SEQ ID NO: 210502 - DNA, 16 bp, P. troglodytes
atatgtaattcatata

SEQ ID NO: 210503 - DNA, 16 bp, P. troglodytes
atatgtacacaaatat

SEQ ID NO: 210504 - DNA, 16 bp, P. troglodytes
atatgtacacatatgt

SEQ ID NO: 210505 - DNA, 16 bp, P. troglodytes
atatgtacacatttct

SEQ ID NO: 210506 - DNA, 16 bp, P. troglodytes
atatgtacagtttatt

SEQ ID NO: 210507 - DNA, 16 bp, P. troglodytes
atatgtacatatataa

SEQ ID NO: 210508 - DNA, 16 bp, P. troglodytes
atatgtacatatatta

SEQ ID NO: 210509 - DNA, 16 bp, P. troglodytes
atatgtacatgtgtat

SEQ ID NO: 210510 - DNA, 16 bp, P. troglodytes
atatgtacattgtttt

SEQ ID NO: 210511 - DNA, 16 bp, P. troglodytes
atatgtacatttatat

SEQ ID NO: 210512 - DNA, 16 bp, P. troglodytes
atatgtacattttaaa

SEQ ID NO: 210513 - DNA, 16 bp, P. troglodytes
atatgtacatttttaa

SEQ ID NO: 210514 - DNA, 16 bp, P. troglodytes
atatgtagatatattt

SEQ ID NO: 210515 - DNA, 16 bp, P. troglodytes
atatgtagttggaaaa

SEQ ID NO: 210516 - DNA, 16 bp, P. troglodytes
atatgtataaatatgt

SEQ ID NO: 210517 - DNA, 16 bp, P. troglodytes
atatgtatacatatta

SEQ ID NO: 210518 - DNA, 16 bp, P. troglodytes
atatgtatacatgtat

SEQ ID NO: 210519 - DNA, 16 bp, P. troglodytes
atatgtatacattgtg

SEQ ID NO: 210520 - DNA, 16 bp, P. troglodytes
atatgtatacgtatat

SEQ ID NO: 210521 - DNA, 16 bp, P. troglodytes
atatgtatatagatat

SEQ ID NO: 210522 - DNA, 16 bp, P. troglodytes
atatgtatatatgtaa

SEQ ID NO: 210523 - DNA, 16 bp, P. troglodytes
atatgtatatatgtgt

SEQ ID NO: 210524 - DNA, 16 bp, P. troglodytes
atatgtatatattatg

SEQ ID NO: 210525 - DNA, 16 bp, P. troglodytes
atatgtatatgtacat

SEQ ID NO: 210526 - DNA, 16 bp, P. troglodytes
atatgtatatgtgtat

SEQ ID NO: 210527 - DNA, 16 bp, P. troglodytes
atatgtatattctttt

SEQ ID NO: 210528 - DNA, 16 bp, P. troglodytes
atatgtatctatacat

SEQ ID NO: 210529 - DNA, 16 bp, P. troglodytes
atatgtatcttatata

SEQ ID NO: 210530 - DNA, 16 bp, P. troglodytes
atatgtatggatatat

SEQ ID NO: 210531 - DNA, 16 bp, P. troglodytes
atatgtatgtaataca

SEQ ID NO: 210532 - DNA, 16 bp, P. troglodytes
atatgtatgtacatat

SEQ ID NO: 210533 - DNA, 16 bp, P. troglodytes
atatgtatgtatatgt

SEQ ID NO: 210534 - DNA, 16 bp, P. troglodytes
atatgtatgtatgtgt

SEQ ID NO: 210535 - DNA, 16 bp, P. troglodytes
atatgtatgtgtatgt

SEQ ID NO: 210536 - DNA, 16 bp, P. troglodytes
atatgtatgtgtctat

SEQ ID NO: 210537 - DNA, 17 bp, P. troglodytes
atatgtatgtgtgtata

SEQ ID NO: 210538 - DNA, 16 bp, P. troglodytes
atatgtatgttatata

SEQ ID NO: 210539 - DNA, 16 bp, P. troglodytes
atatgtatgtttgtgt

SEQ ID NO: 210540 - DNA, 16 bp, P. troglodytes
atatgtattatacatt

SEQ ID NO: 210541 - DNA, 16 bp, P. troglodytes
atatgtattatatatg

SEQ ID NO: 210542 - DNA, 16 bp, P. troglodytes
atatgtattcatatat

SEQ ID NO: 210543 - DNA, 16 bp, P. troglodytes
atatgtatttacatat

SEQ ID NO: 210544 - DNA, 16 bp, P. troglodytes
atatgtatttaggata

SEQ ID NO: 210545 - DNA, 16 bp, P. troglodytes
atatgtatttgcttat

SEQ ID NO: 210546 - DNA, 16 bp, P. troglodytes
atatgtatttgtaaat

SEQ ID NO: 210547 - DNA, 16 bp, P. troglodytes
atatgtattttcaaaa

SEQ ID NO: 210548 - DNA, 16 bp, P. troglodytes
atatgtattttttcta

SEQ ID NO: 210549 - DNA, 16 bp, P. troglodytes
atatgtcaattatacc

SEQ ID NO: 210550 - DNA, 16 bp, P. troglodytes
atatgtcaatttaaaa

SEQ ID NO: 210551 - DNA, 16 bp, P. troglodytes
atatgtcatttttaaa

SEQ ID NO: 210552 - DNA, 16 bp, P. troglodytes
atatgtcctgagaaat

SEQ ID NO: 210553 - DNA, 16 bp, P. troglodytes
atatgtctatatattt

SEQ ID NO: 210554 - DNA, 16 bp, P. troglodytes
atatgtctatccttat

SEQ ID NO: 210555 - DNA, 16 bp, P. troglodytes
atatgtctttataata

SEQ ID NO: 210556 - DNA, 16 bp, P. troglodytes
atatgtgaaaaaaatg

SEQ ID NO: 210557 - DNA, 16 bp, P. troglodytes
atatgtgaaattttaa

SEQ ID NO: 210558 - DNA, 16 bp, P. troglodytes
atatgtgacatttcag

SEQ ID NO: 210559 - DNA, 16 bp, P. troglodytes
atatgtgagatcatgc

SEQ ID NO: 210560 - DNA, 16 bp, P. troglodytes
atatgtgaggcaaaaa

SEQ ID NO: 210561 - DNA, 16 bp, P. troglodytes
atatgtgataaagcaa

SEQ ID NO: 210562 - DNA, 16 bp, P. troglodytes
atatgtgatttttaaa

SEQ ID NO: 210563 - DNA, 16 bp, P. troglodytes
atatgtgcacatatat

SEQ ID NO: 210564 - DNA, 16 bp, P. troglodytes
atatgtgcacgtgtgt

SEQ ID NO: 210565 - DNA, 16 bp, P. troglodytes
atatgtgcatgtacat

SEQ ID NO: 210566 - DNA, 16 bp, P. troglodytes
atatgtgcatgtgtct

SEQ ID NO: 210567 - DNA, 16 bp, P. troglodytes
atatgtgcatttttct

SEQ ID NO: 210568 - DNA, 16 bp, P. troglodytes
atatgtgccacttttt

SEQ ID NO: 210569 - DNA, 16 bp, P. troglodytes
atatgtgggaaagttt

SEQ ID NO: 210570 - DNA, 16 bp, P. troglodytes
atatgtgggagctaag

SEQ ID NO: 210571 - DNA, 16 bp, P. troglodytes
atatgtggtgtgtgtg

SEQ ID NO: 210572 - DNA, 16 bp, P. troglodytes
atatgtgtaaatatat

SEQ ID NO: 210573 - DNA, 16 bp, P. troglodytes
atatgtgtacattgtg

SEQ ID NO: 210574 - DNA, 16 bp, P. troglodytes
atatgtgtatatacag

SEQ ID NO: 210575 - DNA, 16 bp, P. troglodytes
atatgtgtatatatat

SEQ ID NO: 210576 - DNA, 16 bp, P. troglodytes
atatgtgtatctatat

SEQ ID NO: 210577 - DNA, 16 bp, P. troglodytes
atatgtgtatgcatgt

SEQ ID NO: 210578 - DNA, 16 bp, P. troglodytes
atatgtgtgatatata

SEQ ID NO: 210579 - DNA, 16 bp, P. troglodytes
atatgtgtgcatatat

SEQ ID NO: 210580 - DNA, 16 bp, P. troglodytes
atatgtgtgtatatgt

SEQ ID NO: 210581 - DNA, 16 bp, P. troglodytes
atatgtgtgtatattt

SEQ ID NO: 210582 - DNA, 16 bp, P. troglodytes
atatgtgtgtatctat

SEQ ID NO: 210583 - DNA, 16 bp, P. troglodytes
atatgtgtgtatgtct

SEQ ID NO: 210584 - DNA, 16 bp, P. troglodytes
atatgtgtgtattata

SEQ ID NO: 210585 - DNA, 16 bp, P. troglodytes
atatgtgtgtgtgtgt

SEQ ID NO: 210586 - DNA, 16 bp, P. troglodytes
atatgtgttaaataaa

SEQ ID NO: 210587 - DNA, 16 bp, P. troglodytes
atatgtgttcatgtat

SEQ ID NO: 210588 - DNA, 16 bp, P. troglodytes
atatgttaattacttt

SEQ ID NO: 210589 - DNA, 16 bp, P. troglodytes
atatgttcatatatat

SEQ ID NO: 210590 - DNA, 16 bp, P. troglodytes
atatgttctaagaccc

SEQ ID NO: 210591 - DNA, 16 bp, P. troglodytes
atatgttgaatcatcc

SEQ ID NO: 210592 - DNA, 16 bp, P. troglodytes
atatgttgcattctga

SEQ ID NO: 210593 - DNA, 16 bp, P. troglodytes
atatgttgcctccaaa

SEQ ID NO: 210594 - DNA, 16 bp, P. troglodytes
atatgtttaataaatg

SEQ ID NO: 210595 - DNA, 16 bp, P. troglodytes
atatgtttatgtgtgt

SEQ ID NO: 210596 - DNA, 16 bp, P. troglodytes
atatgtttctaaaaat

SEQ ID NO: 210597 - DNA, 16 bp, P. troglodytes
atatgtttgaaatatt

SEQ ID NO: 210598 - DNA, 16 bp, P. troglodytes
atatgtttggatttat

SEQ ID NO: 210599 - DNA, 16 bp, P. troglodytes
atatgtttgtatatgt

SEQ ID NO: 210600 - DNA, 16 bp, P. troglodytes
atatgtttgtgtatgt

SEQ ID NO: 210601 - DNA, 16 bp, P. troglodytes
atatgttttaatatct

SEQ ID NO: 210602 - DNA, 16 bp, P. troglodytes
atatgttttatttact

SEQ ID NO: 210603 - DNA, 16 bp, P. troglodytes
atatgttttcacttct

SEQ ID NO: 210604 - DNA, 17 bp, P. troglodytes
atatgttttccaaactt

SEQ ID NO: 210605 - DNA, 16 bp, P. troglodytes
atatgtttttgtaaaa

SEQ ID NO: 210606 - DNA, 16 bp, P. troglodytes
atattaaaagctgaaa

SEQ ID NO: 210607 - DNA, 16 bp, P. troglodytes
atattaaagcaaaaat

SEQ ID NO: 210608 - DNA, 16 bp, P. troglodytes
atattaaaggctctga

SEQ ID NO: 210609 - DNA, 16 bp, P. troglodytes
atattaaagtttgaga

SEQ ID NO: 210610 - DNA, 16 bp, P. troglodytes
atattaacaaatgtga

SEQ ID NO: 210611 - DNA, 16 bp, P. troglodytes
atattaaccaggagaa

SEQ ID NO: 210612 - DNA, 16 bp, P. troglodytes
atattaagtgttctca

SEQ ID NO: 210613 - DNA, 16 bp, P. troglodytes
atattaatgaatgtga

SEQ ID NO: 210614 - DNA, 16 bp, P. troglodytes
atattacagaaatatt

SEQ ID NO: 210615 - DNA, 16 bp, P. troglodytes
atattacatatacaca

SEQ ID NO: 210616 - DNA, 16 bp, P. troglodytes
atattacatatgtatt

SEQ ID NO: 210617 - DNA, 16 bp, P. troglodytes
atattacatgtatttt

SEQ ID NO: 210618 - DNA, 16 bp, P. troglodytes
atattaccttcatttt

SEQ ID NO: 210619 - DNA, 16 bp, P. troglodytes
atattaccttttccac

SEQ ID NO: 210620 - DNA, 16 bp, P. troglodytes
atattagacaaaatag

SEQ ID NO: 210621 - DNA, 16 bp, P. troglodytes
atattataatactgta

SEQ ID NO: 210622 - DNA, 16 bp, P. troglodytes
atattatacatgtatt

SEQ ID NO: 210623 - DNA, 16 bp, P. troglodytes
atattatactacagtt

SEQ ID NO: 210624 - DNA, 16 bp, P. troglodytes
atattatatatacaca

SEQ ID NO: 210625 - DNA, 16 bp, P. troglodytes
atattatatatttctg

SEQ ID NO: 210626 - DNA, 16 bp, P. troglodytes
atattatatgattcca

SEQ ID NO: 210627 - DNA, 16 bp, P. troglodytes
atattatatgcattat

SEQ ID NO: 210628 - DNA, 16 bp, P. troglodytes
atattatccaagagaa

SEQ ID NO: 210629 - DNA, 16 bp, P. troglodytes
atattatctgcaaata

SEQ ID NO: 210630 - DNA, 16 bp, P. troglodytes
atattatggttattaa

SEQ ID NO: 210631 - DNA, 16 bp, P. troglodytes
atattatgtatatctt

SEQ ID NO: 210632 - DNA, 16 bp, P. troglodytes
atattatttgagaaaa

SEQ ID NO: 210633 - DNA, 16 bp, P. troglodytes
atattatttgcaaata

SEQ ID NO: 210634 - DNA, 16 bp, P. troglodytes
atattattttgtgaaa

SEQ ID NO: 210635 - DNA, 16 bp, P. troglodytes
atattcaaaagaaata

SEQ ID NO: 210636 - DNA, 16 bp, P. troglodytes
atattcaaagaaaatg

SEQ ID NO: 210637 - DNA, 16 bp, P. troglodytes
atattcaaagtgttga

SEQ ID NO: 210638 - DNA, 16 bp, P. troglodytes
atattcaacattttta

SEQ ID NO: 210639 - DNA, 16 bp, P. troglodytes
atattcaacctgtatt

SEQ ID NO: 210640 - DNA, 16 bp, P. troglodytes
atattcaagaagctca

SEQ ID NO: 210641 - DNA, 16 bp, P. troglodytes
atattcaagagaaatg

SEQ ID NO: 210642 - DNA, 16 bp, P. troglodytes
atattcacaaaatttt

SEQ ID NO: 210643 - DNA, 16 bp, P. troglodytes
atattcacacaaaaat

SEQ ID NO: 210644 - DNA, 16 bp, P. troglodytes
atattcacattgttgt

SEQ ID NO: 210645 - DNA, 16 bp, P. troglodytes
atattcaccatggaat

SEQ ID NO: 210646 - DNA, 16 bp, P. troglodytes
atattcactttttaaa

SEQ ID NO: 210647 - DNA, 16 bp, P. troglodytes
atattcagaaaaatga

SEQ ID NO: 210648 - DNA, 16 bp, P. troglodytes
atattcaggacttgaa

SEQ ID NO: 210649 - DNA, 16 bp, P. troglodytes
atattcataaaatgga

SEQ ID NO: 210650 - DNA, 16 bp, P. troglodytes
atattcatatattcat

SEQ ID NO: 210651 - DNA, 16 bp, P. troglodytes
atattcatattcatat

SEQ ID NO: 210652 - DNA, 16 bp, P. troglodytes
atattcatcagaaata

SEQ ID NO: 210653 - DNA, 16 bp, P. troglodytes
atattcatgtacaaat

SEQ ID NO: 210654 - DNA, 16 bp, P. troglodytes
atattccaaaatatat

SEQ ID NO: 210655 - DNA, 16 bp, P. troglodytes
atattccactgtatgt

SEQ ID NO: 210656 - DNA, 16 bp, P. troglodytes
atattccagaaaaaaa

SEQ ID NO: 210657 - DNA, 16 bp, P. troglodytes
atattccaggaaaaaa

SEQ ID NO: 210658 - DNA, 16 bp, P. troglodytes
atattccatgctcatg

SEQ ID NO: 210659 - DNA, 16 bp, P. troglodytes
atattcctccatctct

SEQ ID NO: 210660 - DNA, 16 bp, P. troglodytes
atattccttcatccct

SEQ ID NO: 210661 - DNA, 16 bp, P. troglodytes
atattcctttgagtat

SEQ ID NO: 210662 - DNA, 16 bp, P. troglodytes
atattcctttgcatat

SEQ ID NO: 210663 - DNA, 16 bp, P. troglodytes
atattctacagttgtt

SEQ ID NO: 210664 - DNA, 16 bp, P. troglodytes
atattctgaatataag

SEQ ID NO: 210665 - DNA, 16 bp, P. troglodytes
atattctgaatttttt

SEQ ID NO: 210666 - DNA, 16 bp, P. troglodytes
atattctgattttatt

SEQ ID NO: 210667 - DNA, 16 bp, P. troglodytes
atattctggaaattaa

SEQ ID NO: 210668 - DNA, 16 bp, P. troglodytes
atattctgtaaatatt

SEQ ID NO: 210669 - DNA, 16 bp, P. troglodytes
atattctgtgggtttt

SEQ ID NO: 210670 - DNA, 16 bp, P. troglodytes
atattctgtttattaa

SEQ ID NO: 210671 - DNA, 16 bp, P. troglodytes
atattcttacaataaa

SEQ ID NO: 210672 - DNA, 16 bp, P. troglodytes
atattcttccatccct

SEQ ID NO: 210673 - DNA, 16 bp, P. troglodytes
atattcttcctaatat

SEQ ID NO: 210674 - DNA, 16 bp, P. troglodytes
atattcttctttgata

SEQ ID NO: 210675 - DNA, 16 bp, P. troglodytes
atattcttgccaaaaa

SEQ ID NO: 210676 - DNA, 16 bp, P. troglodytes
atattctttatcaagt

SEQ ID NO: 210677 - DNA, 16 bp, P. troglodytes
atattcttttgaaaat

SEQ ID NO: 210678 - DNA, 16 bp, P. troglodytes
atattgaacatttttt

SEQ ID NO: 210679 - DNA, 16 bp, P. troglodytes
atattgaagccctcaa

SEQ ID NO: 210680 - DNA, 16 bp, P. troglodytes
atattgaaggagaaaa

SEQ ID NO: 210681 - DNA, 16 bp, P. troglodytes
atattgaatcttccaa

SEQ ID NO: 210682 - DNA, 16 bp, P. troglodytes
atattgacaaataaaa

SEQ ID NO: 210683 - DNA, 16 bp, P. troglodytes
atattgagcttttttt

SEQ ID NO: 210684 - DNA, 16 bp, P. troglodytes
atattgatacaaaaat

SEQ ID NO: 210685 - DNA, 16 bp, P. troglodytes
atattgatgatgatga

SEQ ID NO: 210686 - DNA, 16 bp, P. troglodytes
atattgattcttccta

SEQ ID NO: 210687 - DNA, 16 bp, P. troglodytes
atattgcaaaatattt

SEQ ID NO: 210688 - DNA, 16 bp, P. troglodytes
atattgcaataaaatg

SEQ ID NO: 210689 - DNA, 16 bp, P. troglodytes
atattgcattaaaaat

SEQ ID NO: 210690 - DNA, 16 bp, P. troglodytes
atattgcattatatat

SEQ ID NO: 210691 - DNA, 16 bp, P. troglodytes
atattgccaaattatt

SEQ ID NO: 210692 - DNA, 16 bp, P. troglodytes
atattgctgaacagca

SEQ ID NO: 210693 - DNA, 16 bp, P. troglodytes
atattggaaaattttt

SEQ ID NO: 210694 - DNA, 18 bp, P. troglodytes
atattggcctgaaatttt

SEQ ID NO: 210695 - DNA, 16 bp, P. troglodytes
atattgggggaaaaaa

SEQ ID NO: 210696 - DNA, 16 bp, P. troglodytes
atattggtcaggctgc

SEQ ID NO: 210697 - DNA, 16 bp, P. troglodytes
atattgtcagtgaaga

SEQ ID NO: 210698 - DNA, 16 bp, P. troglodytes
atattgtcctgtagtt

SEQ ID NO: 210699 - DNA, 16 bp, P. troglodytes
atattgtcttttatat

SEQ ID NO: 210700 - DNA, 16 bp, P. troglodytes
atattgtgaaattatt

SEQ ID NO: 210701 - DNA, 16 bp, P. troglodytes
atattgttgaataaat

SEQ ID NO: 210702 - DNA, 16 bp, P. troglodytes
atattgttgattcatt

SEQ ID NO: 210703 - DNA, 16 bp, P. troglodytes
atattgttgcatgtat

SEQ ID NO: 210704 - DNA, 16 bp, P. troglodytes
atattgtttaaacaat

SEQ ID NO: 210705 - DNA, 16 bp, P. troglodytes
atattgtttacatttt

SEQ ID NO: 210706 - DNA, 16 bp, P. troglodytes
atatttaaaaaagcaa

SEQ ID NO: 210707 - DNA, 16 bp, P. troglodytes
atatttaaaaattctg

SEQ ID NO: 210708 - DNA, 16 bp, P. troglodytes
atatttaaaacaaagt

SEQ ID NO: 210709 - DNA, 16 bp, P. troglodytes
atatttaaaagacaaa

SEQ ID NO: 210710 - DNA, 16 bp, P. troglodytes
atatttaaaatgcttt

SEQ ID NO: 210711 - DNA, 16 bp, P. troglodytes
atatttaaagcaaata

SEQ ID NO: 210712 - DNA, 16 bp, P. troglodytes
atatttaagactttaa

SEQ ID NO: 210713 - DNA, 16 bp, P. troglodytes
atatttaagttgtttc

SEQ ID NO: 210714 - DNA, 16 bp, P. troglodytes
atatttacaaactacc

SEQ ID NO: 210715 - DNA, 16 bp, P. troglodytes
atatttacaaagaaaa

SEQ ID NO: 210716 - DNA, 16 bp, P. troglodytes
atatttacacatattt

SEQ ID NO: 210717 - DNA, 16 bp, P. troglodytes
atatttacagaaaaat

SEQ ID NO: 210718 - DNA, 16 bp, P. troglodytes
atatttacagaaaatt

SEQ ID NO: 210719 - DNA, 16 bp, P. troglodytes
atatttacatagatat

SEQ ID NO: 210720 - DNA, 16 bp, P. troglodytes
atatttaccaaaatat

SEQ ID NO: 210721 - DNA, 16 bp, P. troglodytes
atatttactatgtatt

SEQ ID NO: 210722 - DNA, 16 bp, P. troglodytes
atatttactgtttatt

SEQ ID NO: 210723 - DNA, 16 bp, P. troglodytes
atatttactttgaaaa

SEQ ID NO: 210724 - DNA, 20 bp, P. troglodytes
atatttaggatagttagctc

SEQ ID NO: 210725 - DNA, 16 bp, P. troglodytes
atatttagtagaaatg

SEQ ID NO: 210726 - DNA, 16 bp, P. troglodytes
atatttatatgtatac

SEQ ID NO: 210727 - DNA, 16 bp, P. troglodytes
atatttatctgtgtgt

SEQ ID NO: 210728 - DNA, 16 bp, P. troglodytes
atatttatgaaaaaca

SEQ ID NO: 210729 - DNA, 16 bp, P. troglodytes
atatttatgaaacatt

SEQ ID NO: 210730 - DNA, 16 bp, P. troglodytes
atatttatgaaatgaa

SEQ ID NO: 210731 - DNA, 16 bp, P. troglodytes
atatttatggaatata

SEQ ID NO: 210732 - DNA, 16 bp, P. troglodytes
atatttatggagtaca

SEQ ID NO: 210733 - DNA, 16 bp, P. troglodytes
atatttatgtacacat

SEQ ID NO: 210734 - DNA, 16 bp, P. troglodytes
atatttatgtacatat

SEQ ID NO: 210735 - DNA, 16 bp, P. troglodytes
atatttattaaacacc

SEQ ID NO: 210736 - DNA, 16 bp, P. troglodytes
atatttattgaaaacc

SEQ ID NO: 210737 - DNA, 16 bp, P. troglodytes
atatttattgagaaaa

SEQ ID NO: 210738 - DNA, 16 bp, P. troglodytes
atatttattgatttcc

SEQ ID NO: 210739 - DNA, 16 bp, P. troglodytes
atatttattgtgcatt

SEQ ID NO: 210740 - DNA, 16 bp, P. troglodytes
atatttattttctcac

SEQ ID NO: 210741 - DNA, 16 bp, P. troglodytes
atatttcaaaacaaca

SEQ ID NO: 210742 - DNA, 16 bp, P. troglodytes
atatttcaaaacatca

SEQ ID NO: 210743 - DNA, 16 bp, P. troglodytes
atatttcaaaatatgt

SEQ ID NO: 210744 - DNA, 16 bp, P. troglodytes
atatttcagaaaatgt

SEQ ID NO: 210745 - DNA, 16 bp, P. troglodytes
atatttcagtatatat

SEQ ID NO: 210746 - DNA, 16 bp, P. troglodytes
atatttcatataaatg

SEQ ID NO: 210747 - DNA, 16 bp, P. troglodytes
atatttcatatatatg

SEQ ID NO: 210748 - DNA, 16 bp, P. troglodytes
atatttcatcaaatct

SEQ ID NO: 210749 - DNA, 16 bp, P. troglodytes
atatttcatcccttat

SEQ ID NO: 210750 - DNA, 16 bp, P. troglodytes
atatttcattttctgt

SEQ ID NO: 210751 - DNA, 16 bp, P. troglodytes
atatttccattaaaaa

SEQ ID NO: 210752 - DNA, 16 bp, P. troglodytes
atatttcctaggtttt

SEQ ID NO: 210753 - DNA, 16 bp, P. troglodytes
atatttctaaagcaaa

SEQ ID NO: 210754 - DNA, 16 bp, P. troglodytes
atatttctattttgaa

SEQ ID NO: 210755 - DNA, 16 bp, P. troglodytes
atatttctcaaaataa

SEQ ID NO: 210756 - DNA, 16 bp, P. troglodytes
atatttctccaaagaa

SEQ ID NO: 210757 - DNA, 19 bp, P. troglodytes
atatttctcccatttgctt

SEQ ID NO: 210758 - DNA, 16 bp, P. troglodytes
atatttctctgatgat

SEQ ID NO: 210759 - DNA, 16 bp, P. troglodytes
atatttctgaataaat

SEQ ID NO: 210760 - DNA, 16 bp, P. troglodytes
atatttctgtatattt

SEQ ID NO: 210761 - DNA, 16 bp, P. troglodytes
atatttctgtatttat

SEQ ID NO: 210762 - DNA, 16 bp, P. troglodytes
atatttctgtgtgtgt

SEQ ID NO: 210763 - DNA, 16 bp, P. troglodytes
atatttcttaaatgaa

SEQ ID NO: 210764 - DNA, 16 bp, P. troglodytes
atatttcttacagaaa

SEQ ID NO: 210765 - DNA, 16 bp, P. troglodytes
atatttcttcttaaaa

SEQ ID NO: 210766 - DNA, 16 bp, P. troglodytes
atatttcttgaagact

SEQ ID NO: 210767 - DNA, 16 bp, P. troglodytes
atatttcttgatattt

SEQ ID NO: 210768 - DNA, 16 bp, P. troglodytes
atatttctttaaaatg

SEQ ID NO: 210769 - DNA, 16 bp, P. troglodytes
atatttctttcaaaaa

SEQ ID NO: 210770 - DNA, 16 bp, P. troglodytes
atatttctttgttgat

SEQ ID NO: 210771 - DNA, 16 bp, P. troglodytes
atatttgaaaaaggaa

SEQ ID NO: 210772 - DNA, 16 bp, P. troglodytes
atatttgaaaagaaga

SEQ ID NO: 210773 - DNA, 16 bp, P. troglodytes
atatttgaaaagtttt

SEQ ID NO: 210774 - DNA, 16 bp, P. troglodytes
atatttgaaaatcaat

SEQ ID NO: 210775 - DNA, 16 bp, P. troglodytes
atatttgaacaaaaat

SEQ ID NO: 210776 - DNA, 16 bp, P. troglodytes
atatttgaagaataat

SEQ ID NO: 210777 - DNA, 16 bp, P. troglodytes
atatttgaagacagtt

SEQ ID NO: 210778 - DNA, 16 bp, P. troglodytes
atatttgaagagaaaa

SEQ ID NO: 210779 - DNA, 16 bp, P. troglodytes
atatttgaagattaaa

SEQ ID NO: 210780 - DNA, 16 bp, P. troglodytes
atatttgaatatgtaa

SEQ ID NO: 210781 - DNA, 16 bp, P. troglodytes
atatttgaatatgtat

SEQ ID NO: 210782 - DNA, 16 bp, P. troglodytes
atatttgaatttcata

SEQ ID NO: 210783 - DNA, 16 bp, P. troglodytes
atatttgaatttttca

SEQ ID NO: 210784 - DNA, 16 bp, P. troglodytes
atatttgacatatttt

SEQ ID NO: 210785 - DNA, 16 bp, P. troglodytes
atatttgatttttcac

SEQ ID NO: 210786 - DNA, 16 bp, P. troglodytes
atatttgcaaatcatc

SEQ ID NO: 210787 - DNA, 16 bp, P. troglodytes
atatttgcaatacata

SEQ ID NO: 210788 - DNA, 16 bp, P. troglodytes
atatttgcaatttttt

SEQ ID NO: 210789 - DNA, 16 bp, P. troglodytes
atatttgcataaataa

SEQ ID NO: 210790 - DNA, 16 bp, P. troglodytes
atatttgcataactaa

SEQ ID NO: 210791 - DNA, 16 bp, P. troglodytes
atatttgcatatgtgt

SEQ ID NO: 210792 - DNA, 16 bp, P. troglodytes
atatttgcatatttat

SEQ ID NO: 210793 - DNA, 16 bp, P. troglodytes
atatttgcatgtaacc

SEQ ID NO: 210794 - DNA, 16 bp, P. troglodytes
atatttgcctttctgt

SEQ ID NO: 210795 - DNA, 16 bp, P. troglodytes
atatttgctattttaa

SEQ ID NO: 210796 - DNA, 16 bp, P. troglodytes
atatttgctcaataaa

SEQ ID NO: 210797 - DNA, 16 bp, P. troglodytes
atatttgcttttatat

SEQ ID NO: 210798 - DNA, 16 bp, P. troglodytes
atatttgctttttctc

SEQ ID NO: 210799 - DNA, 16 bp, P. troglodytes
atatttggaaaacaaa

SEQ ID NO: 210800 - DNA, 16 bp, P. troglodytes
atatttggaaaagaaa

SEQ ID NO: 210801 - DNA, 16 bp, P. troglodytes
atatttggaaaatgta

SEQ ID NO: 210802 - DNA, 16 bp, P. troglodytes
atatttggctaatttt

SEQ ID NO: 210803 - DNA, 16 bp, P. troglodytes
atatttgggggaaaaa

SEQ ID NO: 210804 - DNA, 16 bp, P. troglodytes
atatttgggttgtttc

SEQ ID NO: 210805 - DNA, 16 bp, P. troglodytes
atatttgtaattttct

SEQ ID NO: 210806 - DNA, 16 bp, P. troglodytes
atatttgtacaccaat

SEQ ID NO: 210807 - DNA, 16 bp, P. troglodytes
atatttgtacatatgt

SEQ ID NO: 210808 - DNA, 16 bp, P. troglodytes
atatttgtatatacac

SEQ ID NO: 210809 - DNA, 16 bp, P. troglodytes
atatttgtattttcag

SEQ ID NO: 210810 - DNA, 16 bp, P. troglodytes
atatttgtcaaataaa

SEQ ID NO: 210811 - DNA, 16 bp, P. troglodytes
atatttgtcatctatt

SEQ ID NO: 210812 - DNA, 16 bp, P. troglodytes
atatttgtgaatttcc

SEQ ID NO: 210813 - DNA, 16 bp, P. troglodytes
atatttgtggaattaa

SEQ ID NO: 210814 - DNA, 16 bp, P. troglodytes
atatttgtgtatatgt

SEQ ID NO: 210815 - DNA, 16 bp, P. troglodytes
atatttgttacataaa

SEQ ID NO: 210816 - DNA, 16 bp, P. troglodytes
atatttgttcatttat

SEQ ID NO: 210817 - DNA, 16 bp, P. troglodytes
atatttgttgactaaa

SEQ ID NO: 210818 - DNA, 16 bp, P. troglodytes
atatttgttgtataaa

SEQ ID NO: 210819 - DNA, 16 bp, P. troglodytes
atatttgtttgcattt

SEQ ID NO: 210820 - DNA, 16 bp, P. troglodytes
atatttgttttggtac

SEQ ID NO: 210821 - DNA, 16 bp, P. troglodytes
atattttaaaaacatg

SEQ ID NO: 210822 - DNA, 16 bp, P. troglodytes
atattttaaaaacttg

SEQ ID NO: 210823 - DNA, 16 bp, P. troglodytes
atattttaaaacaaag

SEQ ID NO: 210824 - DNA, 16 bp, P. troglodytes
atattttaaaactcta

SEQ ID NO: 210825 - DNA, 16 bp, P. troglodytes
atattttaaaagctga

SEQ ID NO: 210826 - DNA, 16 bp, P. troglodytes
atattttaaaatgaga

SEQ ID NO: 210827 - DNA, 16 bp, P. troglodytes
atattttaaactgttt

SEQ ID NO: 210828 - DNA, 16 bp, P. troglodytes
atattttaaacttttg

SEQ ID NO: 210829 - DNA, 16 bp, P. troglodytes
atattttaaagcaata

SEQ ID NO: 210830 - DNA, 16 bp, P. troglodytes
atattttaaagtcaga

SEQ ID NO: 210831 - DNA, 16 bp, P. troglodytes
atattttaaatatcca

SEQ ID NO: 210832 - DNA, 16 bp, P. troglodytes
atattttaaatcacat

SEQ ID NO: 210833 - DNA, 16 bp, P. troglodytes
atattttaaatcagaa

SEQ ID NO: 210834 - DNA, 16 bp, P. troglodytes
atattttaaatggcaa

SEQ ID NO: 210835 - DNA, 16 bp, P. troglodytes
atattttaaattctca

SEQ ID NO: 210836 - DNA, 16 bp, P. troglodytes
atattttaacagtttt

SEQ ID NO: 210837 - DNA, 16 bp, P. troglodytes
atattttaagcatttt

SEQ ID NO: 210838 - DNA, 16 bp, P. troglodytes
atattttaaggtaaaa

SEQ ID NO: 210839 - DNA, 16 bp, P. troglodytes
atattttaatatgctt

SEQ ID NO: 210840 - DNA, 16 bp, P. troglodytes
atattttaatattcac

SEQ ID NO: 210841 - DNA, 16 bp, P. troglodytes
atattttaatgcattt

SEQ ID NO: 210842 - DNA, 16 bp, P. troglodytes
atattttacagaaata

SEQ ID NO: 210843 - DNA, 16 bp, P. troglodytes
atattttacatttctg

SEQ ID NO: 210844 - DNA, 16 bp, P. troglodytes
atattttacatttgaa

SEQ ID NO: 210845 - DNA, 16 bp, P. troglodytes
atattttaccaaaaat

SEQ ID NO: 210846 - DNA, 16 bp, P. troglodytes
atattttaccacaaaa

SEQ ID NO: 210847 - DNA, 16 bp, P. troglodytes
atattttaccccaaaa

SEQ ID NO: 210848 - DNA, 16 bp, P. troglodytes
atattttactgtaatt

SEQ ID NO: 210849 - DNA, 16 bp, P. troglodytes
atattttactttcaaa

SEQ ID NO: 210850 - DNA, 16 bp, P. troglodytes
atattttagaaagttt

SEQ ID NO: 210851 - DNA, 16 bp, P. troglodytes
atattttaggaagaaa

SEQ ID NO: 210852 - DNA, 16 bp, P. troglodytes
atattttaggcttttt

SEQ ID NO: 210853 - DNA, 16 bp, P. troglodytes
atattttagtaccttt

SEQ ID NO: 210854 - DNA, 16 bp, P. troglodytes
atattttattcatgaa

SEQ ID NO: 210855 - DNA, 16 bp, P. troglodytes
atattttatttctgta

SEQ ID NO: 210856 - DNA, 16 bp, P. troglodytes
atattttcaaaagata

SEQ ID NO: 210857 - DNA, 16 bp, P. troglodytes
atattttcaaatgtat

SEQ ID NO: 210858 - DNA, 16 bp, P. troglodytes
atattttcaaatgttt

SEQ ID NO: 210859 - DNA, 16 bp, P. troglodytes
atattttcaccagata

SEQ ID NO: 210860 - DNA, 16 bp, P. troglodytes
atattttcagaagaaa

SEQ ID NO: 210861 - DNA, 16 bp, P. troglodytes
atattttcaggatttt

SEQ ID NO: 210862 - DNA, 19 bp, P. troglodytes
atattttcagtagagacgg

SEQ ID NO: 210863 - DNA, 16 bp, P. troglodytes
atattttcagtgtttt

SEQ ID NO: 210864 - DNA, 16 bp, P. troglodytes
atattttcagtttaaa

SEQ ID NO: 210865 - DNA, 16 bp, P. troglodytes
atattttcatatgttt

SEQ ID NO: 210866 - DNA, 16 bp, P. troglodytes
atattttcatttatgt

SEQ ID NO: 210867 - DNA, 16 bp, P. troglodytes
atattttcatttgtat

SEQ ID NO: 210868 - DNA, 16 bp, P. troglodytes
atattttccaaattat

SEQ ID NO: 210869 - DNA, 16 bp, P. troglodytes
atattttccatgaaaa

SEQ ID NO: 210870 - DNA, 16 bp, P. troglodytes
atattttccctcattt

SEQ ID NO: 210871 - DNA, 16 bp, P. troglodytes
atattttcctgaattt

SEQ ID NO: 210872 - DNA, 16 bp, P. troglodytes
atattttcctttatgt

SEQ ID NO: 210873 - DNA, 16 bp, P. troglodytes
atattttcctttcaca

SEQ ID NO: 210874 - DNA, 16 bp, P. troglodytes
atattttctaaaacaa

SEQ ID NO: 210875 - DNA, 16 bp, P. troglodytes
atattttctagaaaat

SEQ ID NO: 210876 - DNA, 16 bp, P. troglodytes
atattttctagttatt

SEQ ID NO: 210877 - DNA, 16 bp, P. troglodytes
atattttctattatgt

SEQ ID NO: 210878 - DNA, 16 bp, P. troglodytes
atattttctcattaaa

SEQ ID NO: 210879 - DNA, 16 bp, P. troglodytes
atattttctcccactt

SEQ ID NO: 210880 - DNA, 16 bp, P. troglodytes
atattttctcctaatt

SEQ ID NO: 210881 - DNA, 16 bp, P. troglodytes
atattttctctcattc

SEQ ID NO: 210882 - DNA, 16 bp, P. troglodytes
atattttctgaaaata

SEQ ID NO: 210883 - DNA, 16 bp, P. troglodytes
atattttctgagaaat

SEQ ID NO: 210884 - DNA, 16 bp, P. troglodytes
atattttctgattatt

SEQ ID NO: 210885 - DNA, 16 bp, P. troglodytes
atattttctgatttcc

SEQ ID NO: 210886 - DNA, 16 bp, P. troglodytes
atattttctgcctttt

SEQ ID NO: 210887 - DNA, 16 bp, P. troglodytes
atattttctgtaaata

SEQ ID NO: 210888 - DNA, 16 bp, P. troglodytes
atattttcttccattc

SEQ ID NO: 210889 - DNA, 16 bp, P. troglodytes
atattttctttgaaaa

SEQ ID NO: 210890 - DNA, 16 bp, P. troglodytes
atattttctttgaaga

SEQ ID NO: 210891 - DNA, 16 bp, P. troglodytes
atattttgaaaaacaa

SEQ ID NO: 210892 - DNA, 16 bp, P. troglodytes
atattttgaaacattt

SEQ ID NO: 210893 - DNA, 16 bp, P. troglodytes
atattttgaaagaatt

SEQ ID NO: 210894 - DNA, 16 bp, P. troglodytes
atattttgaaagataa

SEQ ID NO: 210895 - DNA, 16 bp, P. troglodytes
atattttgaaatctgg

SEQ ID NO: 210896 - DNA, 16 bp, P. troglodytes
atattttgaaatggaa

SEQ ID NO: 210897 - DNA, 16 bp, P. troglodytes
atattttgaaatggtc

SEQ ID NO: 210898 - DNA, 16 bp, P. troglodytes
atattttgaagaaata

SEQ ID NO: 210899 - DNA, 16 bp, P. troglodytes
atattttgaagtcttt

SEQ ID NO: 210900 - DNA, 16 bp, P. troglodytes
atattttgaatacatt

SEQ ID NO: 210901 - DNA, 16 bp, P. troglodytes
atattttgaatatgaa

SEQ ID NO: 210902 - DNA, 16 bp, P. troglodytes
atattttgacatatat

SEQ ID NO: 210903 - DNA, 16 bp, P. troglodytes
atattttgagttcttt

SEQ ID NO: 210904 - DNA, 16 bp, P. troglodytes
atattttgagttgatt

SEQ ID NO: 210905 - DNA, 16 bp, P. troglodytes
atattttgatgcatgt

SEQ ID NO: 210906 - DNA, 16 bp, P. troglodytes
atattttgcaaatttt

SEQ ID NO: 210907 - DNA, 16 bp, P. troglodytes
atattttgcatttaaa

SEQ ID NO: 210908 - DNA, 16 bp, P. troglodytes
atattttgctgtattt

SEQ ID NO: 210909 - DNA, 16 bp, P. troglodytes
atattttgctttttaa

SEQ ID NO: 210910 - DNA, 16 bp, P. troglodytes
atattttggaagaaat

SEQ ID NO: 210911 - DNA, 16 bp, P. troglodytes
atattttgggaaaaaa

SEQ ID NO: 210912 - DNA, 16 bp, P. troglodytes
atattttggggtgaaa

SEQ ID NO: 210913 - DNA, 16 bp, P. troglodytes
atattttgtcatagca

SEQ ID NO: 210914 - DNA, 16 bp, P. troglodytes
atattttgtgcttcct

SEQ ID NO: 210915 - DNA, 16 bp, P. troglodytes
atattttgtttagaaa

SEQ ID NO: 210916 - DNA, 16 bp, P. troglodytes
atattttgtttttccc

SEQ ID NO: 210917 - DNA, 16 bp, P. troglodytes
atatttttaaaaactc

SEQ ID NO: 210918 - DNA, 16 bp, P. troglodytes
atatttttaaaatgca

SEQ ID NO: 210919 - DNA, 16 bp, P. troglodytes
atatttttaaagaagt

SEQ ID NO: 210920 - DNA, 16 bp, P. troglodytes
atatttttaaagatct

SEQ ID NO: 210921 - DNA, 16 bp, P. troglodytes
atatttttaaatgaca

SEQ ID NO: 210922 - DNA, 16 bp, P. troglodytes
atatttttaaatgcag

SEQ ID NO: 210923 - DNA, 16 bp, P. troglodytes
atatttttaacaaatg

SEQ ID NO: 210924 - DNA, 16 bp, P. troglodytes
atatttttaactgaaa

SEQ ID NO: 210925 - DNA, 16 bp, P. troglodytes
atatttttaagatgtc

SEQ ID NO: 210926 - DNA, 16 bp, P. troglodytes
atatttttaatggaaa

SEQ ID NO: 210927 - DNA, 16 bp, P. troglodytes
atatttttactatacc

SEQ ID NO: 210928 - DNA, 16 bp, P. troglodytes
atatttttagaagaga

SEQ ID NO: 210929 - DNA, 16 bp, P. troglodytes
atatttttagtacaga

SEQ ID NO: 210930 - DNA, 16 bp, P. troglodytes
atatttttagtagaca

SEQ ID NO: 210931 - DNA, 16 bp, P. troglodytes
atatttttagtagaga

SEQ ID NO: 210932 - DNA, 16 bp, P. troglodytes
atatttttatgtcatt

SEQ ID NO: 210933 - DNA, 16 bp, P. troglodytes
atatttttatgttcat

SEQ ID NO: 210934 - DNA, 16 bp, P. troglodytes
atatttttcaaagaaa

SEQ ID NO: 210935 - DNA, 16 bp, P. troglodytes
atatttttcaaatgtt

SEQ ID NO: 210936 - DNA, 16 bp, P. troglodytes
atatttttcacaaaat

SEQ ID NO: 210937 - DNA, 16 bp, P. troglodytes
atatttttctagaaaa

SEQ ID NO: 210938 - DNA, 16 bp, P. troglodytes
atatttttcttagaaa

SEQ ID NO: 210939 - DNA, 16 bp, P. troglodytes
atatttttcttcttgc

SEQ ID NO: 210940 - DNA, 16 bp, P. troglodytes
atatttttgaatttct

SEQ ID NO: 210941 - DNA, 16 bp, P. troglodytes
atatttttgcagttgt

SEQ ID NO: 210942 - DNA, 16 bp, P. troglodytes
atatttttgctttcat

SEQ ID NO: 210943 - DNA, 16 bp, P. troglodytes
atatttttggaaaatt

SEQ ID NO: 210944 - DNA, 16 bp, P. troglodytes
atatttttggaatgaa

SEQ ID NO: 210945 - DNA, 16 bp, P. troglodytes
atatttttgtagagac

SEQ ID NO: 210946 - DNA, 16 bp, P. troglodytes
atatttttgtttccca

SEQ ID NO: 210947 - DNA, 16 bp, P. troglodytes
atattttttaaactgt

SEQ ID NO: 210948 - DNA, 16 bp, P. troglodytes
atattttttagagatg

SEQ ID NO: 210949 - DNA, 16 bp, P. troglodytes
atattttttcagaaat

SEQ ID NO: 210950 - DNA, 16 bp, P. troglodytes
atattttttccagaaa

SEQ ID NO: 210951 - DNA, 16 bp, P. troglodytes
atattttttctcaaaa

SEQ ID NO: 210952 - DNA, 16 bp, P. troglodytes
atattttttctctcca

SEQ ID NO: 210953 - DNA, 16 bp, P. troglodytes
atattttttctgaata

SEQ ID NO: 210954 - DNA, 16 bp, P. troglodytes
atattttttgacatat

SEQ ID NO: 210955 - DNA, 16 bp, P. troglodytes
atattttttgagatga

SEQ ID NO: 210956 - DNA, 16 bp, P. troglodytes
atatttttttaaaagc

SEQ ID NO: 210957 - DNA, 16 bp, P. troglodytes
atatttttttgtagag

SEQ ID NO: 210958 - DNA, 16 bp, P. troglodytes
atcaaaaagtttgaaa

SEQ ID NO: 210959 - DNA, 16 bp, P. troglodytes
atcaaaacatcaaatt

SEQ ID NO: 210960 - DNA, 16 bp, P. troglodytes
atcaaaacatcatgtc

SEQ ID NO: 210961 - DNA, 16 bp, P. troglodytes
atcaaaaccacaatag

SEQ ID NO: 210962 - DNA, 16 bp, P. troglodytes
atcaaaaccacactga

SEQ ID NO: 210963 - DNA, 16 bp, P. troglodytes
atcaaaactacaagga

SEQ ID NO: 210964 - DNA, 16 bp, P. troglodytes
atcaaaacttatcaaa

SEQ ID NO: 210965 - DNA, 16 bp, P. troglodytes
atcaaaagaaaattta

SEQ ID NO: 210966 - DNA, 16 bp, P. troglodytes
atcaaaagaaaggatt

SEQ ID NO: 210967 - DNA, 16 bp, P. troglodytes
atcaaaagaaaggttt

SEQ ID NO: 210968 - DNA, 16 bp, P. troglodytes
atcaaaagaaagttag

SEQ ID NO: 210969 - DNA, 16 bp, P. troglodytes
atcaaaagaatatttt

SEQ ID NO: 210970 - DNA, 16 bp, P. troglodytes
atcaaaagcaagttat

SEQ ID NO: 210971 - DNA, 16 bp, P. troglodytes
atcaaaagcctttttt

SEQ ID NO: 210972 - DNA, 16 bp, P. troglodytes
atcaaaataccaaaga

SEQ ID NO: 210973 - DNA, 16 bp, P. troglodytes
atcaaaatcaagaaat

SEQ ID NO: 210974 - DNA, 16 bp, P. troglodytes
atcaaaatcacctgga

SEQ ID NO: 210975 - DNA, 16 bp, P. troglodytes
atcaaaatgaaaaact

SEQ ID NO: 210976 - DNA, 16 bp, P. troglodytes
atcaaaatgtgtggga

SEQ ID NO: 210977 - DNA, 16 bp, P. troglodytes
atcaaaattgattaaa

SEQ ID NO: 210978 - DNA, 16 bp, P. troglodytes
atcaaaccagccacag

SEQ ID NO: 210979 - DNA, 16 bp, P. troglodytes
atcaaacctgaggagg

SEQ ID NO: 210980 - DNA, 16 bp, P. troglodytes
atcaaagaagaaatca

SEQ ID NO: 210981 - DNA, 16 bp, P. troglodytes
atcaaagaagaaatga

SEQ ID NO: 210982 - DNA, 16 bp, P. troglodytes
atcaaagaagaggaaa

SEQ ID NO: 210983 - DNA, 16 bp, P. troglodytes
atcaaagacataaatg

SEQ ID NO: 210984 - DNA, 16 bp, P. troglodytes
atcaaagacttaagtc

SEQ ID NO: 210985 - DNA, 16 bp, P. troglodytes
atcaaaggcctaaatg

SEQ ID NO: 210986 - DNA, 16 bp, P. troglodytes
atcaaagtaaaacaat

SEQ ID NO: 210987 - DNA, 16 bp, P. troglodytes
atcaaagttttaaaaa

SEQ ID NO: 210988 - DNA, 16 bp, P. troglodytes
atcaaataaccaggaa

SEQ ID NO: 210989 - DNA, 16 bp, P. troglodytes
atcaaatacattttaa

SEQ ID NO: 210990 - DNA, 16 bp, P. troglodytes
atcaaatactgcatgt

SEQ ID NO: 210991 - DNA, 16 bp, P. troglodytes
atcaaatagatgtaat

SEQ ID NO: 210992 - DNA, 16 bp, P. troglodytes
atcaaatatttactga

SEQ ID NO: 210993 - DNA, 16 bp, P. troglodytes
atcaaatatttattga

SEQ ID NO: 210994 - DNA, 16 bp, P. troglodytes
atcaaatcaaaatgga

SEQ ID NO: 210995 - DNA, 16 bp, P. troglodytes
atcaaatcaagatgga

SEQ ID NO: 210996 - DNA, 16 bp, P. troglodytes
atcaaatcagaactca

SEQ ID NO: 210997 - DNA, 16 bp, P. troglodytes
atcaaatcagggtaat

SEQ ID NO: 210998 - DNA, 16 bp, P. troglodytes
atcaaatgaaataata

SEQ ID NO: 210999 - DNA, 16 bp, P. troglodytes
atcaaatgaaatgaaa

SEQ ID NO: 211000 - DNA, 16 bp, P. troglodytes
atcaaatgaatgaatg

SEQ ID NO: 211001 - DNA, 16 bp, P. troglodytes
atcaaatgaattaata

SEQ ID NO: 211002 - DNA, 16 bp, P. troglodytes
atcaaatgagataaca

SEQ ID NO: 211003 - DNA, 16 bp, P. troglodytes
atcaaatggaagaaag

SEQ ID NO: 211004 - DNA, 19 bp, P. troglodytes
atcaaattactctgagcta

SEQ ID NO: 211005 - DNA, 16 bp, P. troglodytes
atcaaattgcttaaaa

SEQ ID NO: 211006 - DNA, 16 bp, P. troglodytes
atcaaattgtacactt

SEQ ID NO: 211007 - DNA, 16 bp, P. troglodytes
atcaaattttatttca

SEQ ID NO: 211008 - DNA, 16 bp, P. troglodytes
atcaacaaaaagcaca

SEQ ID NO: 211009 - DNA, 16 bp, P. troglodytes
atcaacaaagaaatat

SEQ ID NO: 211010 - DNA, 16 bp, P. troglodytes
atcaacaagacagaaa

SEQ ID NO: 211011 - DNA, 16 bp, P. troglodytes
atcaacaagacagaag

SEQ ID NO: 211012 - DNA, 16 bp, P. troglodytes
atcaacaaggcagaaa

SEQ ID NO: 211013 - DNA, 16 bp, P. troglodytes
atcaacaataaggctg

SEQ ID NO: 211014 - DNA, 16 bp, P. troglodytes
atcaacacaattgata

SEQ ID NO: 211015 - DNA, 16 bp, P. troglodytes
atcaacactatgaaga

SEQ ID NO: 211016 - DNA, 16 bp, P. troglodytes
atcaacagaagaataa

SEQ ID NO: 211017 - DNA, 16 bp, P. troglodytes
atcaacagactaaaga

SEQ ID NO: 211018 - DNA, 16 bp, P. troglodytes
atcaacagatgcagaa

SEQ ID NO: 211019 - DNA, 16 bp, P. troglodytes
atcaacatagaaaaat

SEQ ID NO: 211020 - DNA, 16 bp, P. troglodytes
atcaacatatgtaaga

SEQ ID NO: 211021 - DNA, 16 bp, P. troglodytes
atcaacatcatcatca

SEQ ID NO: 211022 - DNA, 16 bp, P. troglodytes
atcaacatttattgaa

SEQ ID NO: 211023 - DNA, 16 bp, P. troglodytes
atcaaccaaaaaaagt

SEQ ID NO: 211024 - DNA, 16 bp, P. troglodytes
atcaacccatcatcta

SEQ ID NO: 211025 - DNA, 16 bp, P. troglodytes
atcaacctgtcaccta

SEQ ID NO: 211026 - DNA, 16 bp, P. troglodytes
atcaacctgtcatcta

SEQ ID NO: 211027 - DNA, 16 bp, P. troglodytes
atcaactaaaaatgga

SEQ ID NO: 211028 - DNA, 16 bp, P. troglodytes
atcaactaacaagcaa

SEQ ID NO: 211029 - DNA, 16 bp, P. troglodytes
atcaactagaagaaag

SEQ ID NO: 211030 - DNA, 16 bp, P. troglodytes
atcaactcaagatgta

SEQ ID NO: 211031 - DNA, 16 bp, P. troglodytes
atcaactgtttatgtt

SEQ ID NO: 211032 - DNA, 17 bp, P. troglodytes
atcaacttaaggagatt

SEQ ID NO: 211033 - DNA, 16 bp, P. troglodytes
atcaacttgtcaattt

SEQ ID NO: 211034 - DNA, 16 bp, P. troglodytes
atcaacttttttagct

SEQ ID NO: 211035 - DNA, 16 bp, P. troglodytes
atcaagaaactgaaaa

SEQ ID NO: 211036 - DNA, 16 bp, P. troglodytes
atcaagaaatagaaca

SEQ ID NO: 211037 - DNA, 16 bp, P. troglodytes
atcaagaacaaaccaa

SEQ ID NO: 211038 - DNA, 16 bp, P. troglodytes
atcaagaagaaattct

SEQ ID NO: 211039 - DNA, 16 bp, P. troglodytes
atcaagaagaagaaag

SEQ ID NO: 211040 - DNA, 16 bp, P. troglodytes
atcaagaaggtgaaaa

SEQ ID NO: 211041 - DNA, 16 bp, P. troglodytes
atcaagacacagaaca

SEQ ID NO: 211042 - DNA, 16 bp, P. troglodytes
atcaagagaaatgaaa

SEQ ID NO: 211043 - DNA, 16 bp, P. troglodytes
atcaagagccttaaaa

SEQ ID NO: 211044 - DNA, 16 bp, P. troglodytes
atcaagaggtcaagag

SEQ ID NO: 211045 - DNA, 16 bp, P. troglodytes
atcaagaggtcaggag

SEQ ID NO: 211046 - DNA, 16 bp, P. troglodytes
atcaagatcctgaagc

SEQ ID NO: 211047 - DNA, 16 bp, P. troglodytes
atcaagatgcagaaca

SEQ ID NO: 211048 - DNA, 16 bp, P. troglodytes
atcaagcagaaggaag

SEQ ID NO: 211049 - DNA, 16 bp, P. troglodytes
atcaagcaggagaaag

SEQ ID NO: 211050 - DNA, 16 bp, P. troglodytes
atcaagcatcttctct

SEQ ID NO: 211051 - DNA, 16 bp, P. troglodytes
atcaagcattttctct

SEQ ID NO: 211052 - DNA, 16 bp, P. troglodytes
atcaagcccagcaggc

SEQ ID NO: 211053 - DNA, 20 bp, P. troglodytes
atcaagctaccattgacttt

SEQ ID NO: 211054 - DNA, 16 bp, P. troglodytes
atcaaggaaaacttcc

SEQ ID NO: 211055 - DNA, 16 bp, P. troglodytes
atcaaggaaatgaaaa

SEQ ID NO: 211056 - DNA, 16 bp, P. troglodytes
atcaaggaaatgcaaa

SEQ ID NO: 211057 - DNA, 16 bp, P. troglodytes
atcaaggaaggcttcc

SEQ ID NO: 211058 - DNA, 16 bp, P. troglodytes
atcaaggactcaaaag

SEQ ID NO: 211059 - DNA, 16 bp, P. troglodytes
atcaaggatgcagtga

SEQ ID NO: 211060 - DNA, 16 bp, P. troglodytes
atcaaggcagaaggtg

SEQ ID NO: 211061 - DNA, 16 bp, P. troglodytes
atcaaggcgtcagcag

SEQ ID NO: 211062 - DNA, 17 bp, P. troglodytes
atcaaggctgcagtgaa

SEQ ID NO: 211063 - DNA, 16 bp, P. troglodytes
atcaagggtacatact

SEQ ID NO: 211064 - DNA, 16 bp, P. troglodytes
atcaaggtatcagcag

SEQ ID NO: 211065 - DNA, 16 bp, P. troglodytes
atcaaggtgctggaag

SEQ ID NO: 211066 - DNA, 16 bp, P. troglodytes
atcaaggtggcagcag

SEQ ID NO: 211067 - DNA, 16 bp, P. troglodytes
atcaaggtggtggttg

SEQ ID NO: 211068 - DNA, 16 bp, P. troglodytes
atcaaggtgtcagcag

SEQ ID NO: 211069 - DNA, 16 bp, P. troglodytes
atcaaggtgtgggcag

SEQ ID NO: 211070 - DNA, 16 bp, P. troglodytes
atcaaggtgttggcat

SEQ ID NO: 211071 - DNA, 16 bp, P. troglodytes
atcaaggttgcagtga

SEQ ID NO: 211072 - DNA, 16 bp, P. troglodytes
atcaaggtttcagcag

SEQ ID NO: 211073 - DNA, 16 bp, P. troglodytes
atcaagtgacctgaaa

SEQ ID NO: 211074 - DNA, 16 bp, P. troglodytes
atcaagtggaagaaag

SEQ ID NO: 211075 - DNA, 16 bp, P. troglodytes
atcaagtggacctgat

SEQ ID NO: 211076 - DNA, 16 bp, P. troglodytes
atcaagtggacttcat

SEQ ID NO: 211077 - DNA, 16 bp, P. troglodytes
atcaagttaattaaca

SEQ ID NO: 211078 - DNA, 16 bp, P. troglodytes
atcaagttgggaagaa

SEQ ID NO: 211079 - DNA, 16 bp, P. troglodytes
atcaataaaaaggaat

SEQ ID NO: 211080 - DNA, 16 bp, P. troglodytes
atcaataaaattgaaa

SEQ ID NO: 211081 - DNA, 16 bp, P. troglodytes
atcaataaatttgaaa

SEQ ID NO: 211082 - DNA, 16 bp, P. troglodytes
atcaataagaaaaagg

SEQ ID NO: 211083 - DNA, 16 bp, P. troglodytes
atcaatatgcaaaaat

SEQ ID NO: 211084 - DNA, 16 bp, P. troglodytes
atcaatatttttcaaa

SEQ ID NO: 211085 - DNA, 16 bp, P. troglodytes
atcaatcagaagaaag

SEQ ID NO: 211086 - DNA, 16 bp, P. troglodytes
atcaatcttttccttt

SEQ ID NO: 211087 - DNA, 16 bp, P. troglodytes
atcaatgaaacagaag

SEQ ID NO: 211088 - DNA, 16 bp, P. troglodytes
atcaatgaaatgaaaa

SEQ ID NO: 211089 - DNA, 16 bp, P. troglodytes
atcaatgaaattgata

SEQ ID NO: 211090 - DNA, 16 bp, P. troglodytes
atcaatgacattaagt

SEQ ID NO: 211091 - DNA, 16 bp, P. troglodytes
atcaatggacatttgg

SEQ ID NO: 211092 - DNA, 16 bp, P. troglodytes
atcaatgtatttctta

SEQ ID NO: 211093 - DNA, 16 bp, P. troglodytes
atcaatttggggagta

SEQ ID NO: 211094 - DNA, 16 bp, P. troglodytes
atcaattttaaaacat

SEQ ID NO: 211095 - DNA, 16 bp, P. troglodytes
atcacaaagaaatgat

SEQ ID NO: 211096 - DNA, 16 bp, P. troglodytes
atcacaaagctgtttc

SEQ ID NO: 211097 - DNA, 16 bp, P. troglodytes
atcacaaatcagtttc

SEQ ID NO: 211098 - DNA, 16 bp, P. troglodytes
atcacaacactgcact

SEQ ID NO: 211099 - DNA, 16 bp, P. troglodytes
atcacaactccttgcc

SEQ ID NO: 211100 - DNA, 19 bp, P. troglodytes
atcacaagatcaggagttt

SEQ ID NO: 211101 - DNA, 16 bp, P. troglodytes
atcacaagatgaagtc

SEQ ID NO: 211102 - DNA, 16 bp, P. troglodytes
atcacaagctcaggag

SEQ ID NO: 211103 - DNA, 16 bp, P. troglodytes
atcacaagggcaggag

SEQ ID NO: 211104 - DNA, 16 bp, P. troglodytes
atcacaaggtcaggaa

SEQ ID NO: 211105 - DNA, 16 bp, P. troglodytes
atcacaaggtcaggac

SEQ ID NO: 211106 - DNA, 16 bp, P. troglodytes
atcacaaggtcgggag

SEQ ID NO: 211107 - DNA, 16 bp, P. troglodytes
atcacaaggtctggag

SEQ ID NO: 211108 - DNA, 16 bp, P. troglodytes
atcacaaggttaagag

SEQ ID NO: 211109 - DNA, 16 bp, P. troglodytes
atcacaaggttaggag

SEQ ID NO: 211110 - DNA, 16 bp, P. troglodytes
atcacaatggaataaa

SEQ ID NO: 211111 - DNA, 16 bp, P. troglodytes
atcacaattctaaata

SEQ ID NO: 211112 - DNA, 16 bp, P. troglodytes
atcacacaggctggag

SEQ ID NO: 211113 - DNA, 16 bp, P. troglodytes
atcacacataacaata

SEQ ID NO: 211114 - DNA, 16 bp, P. troglodytes
atcacaccactgcact

SEQ ID NO: 211115 - DNA, 17 bp, P. troglodytes
atcacaccactgcacta

SEQ ID NO: 211116 - DNA, 21 bp, P. troglodytes
atcacaccactgcactccagt

SEQ ID NO: 211117 - DNA, 16 bp, P. troglodytes
atcacaccattacact

SEQ ID NO: 211118 - DNA, 19 bp, P. troglodytes
atcacacccagctaatttt

SEQ ID NO: 211119 - DNA, 17 bp, P. troglodytes
atcacacccggctaatt

SEQ ID NO: 211120 - DNA, 19 bp, P. troglodytes
atcacactctggggactgt

SEQ ID NO: 211121 - DNA, 17 bp, P. troglodytes
atcacactggtccatta

SEQ ID NO: 211122 - DNA, 16 bp, P. troglodytes
atcacactgtggtttt

SEQ ID NO: 211123 - DNA, 16 bp, P. troglodytes
atcacagagctcttca

SEQ ID NO: 211124 - DNA, 16 bp, P. troglodytes
atcacagctcaatgca

SEQ ID NO: 211125 - DNA, 16 bp, P. troglodytes
atcacagctcactgca

SEQ ID NO: 211126 - DNA, 16 bp, P. troglodytes
atcacaggactctttg

SEQ ID NO: 211127 - DNA, 16 bp, P. troglodytes
atcacaggatcaaatt

SEQ ID NO: 211128 - DNA, 16 bp, P. troglodytes
atcacaggcatgagct

SEQ ID NO: 211129 - DNA, 16 bp, P. troglodytes
atcacaggcccagaag

SEQ ID NO: 211130 - DNA, 16 bp, P. troglodytes
atcacagtgctattca

SEQ ID NO: 211131 - DNA, 16 bp, P. troglodytes
atcacagtttttaaaa

SEQ ID NO: 211132 - DNA, 17 bp, P. troglodytes
atcacatcaagttaaaa

SEQ ID NO: 211133 - DNA, 16 bp, P. troglodytes
atcacatcactgcact

SEQ ID NO: 211134 - DNA, 16 bp, P. troglodytes
atcacatcatgaagaa

SEQ ID NO: 211135 - DNA, 16 bp, P. troglodytes
atcacatgagcccagg

SEQ ID NO: 211136 - DNA, 16 bp, P. troglodytes
atcacatgaggtcagg

SEQ ID NO: 211137 - DNA, 16 bp, P. troglodytes
atcacatggcaaaagc

SEQ ID NO: 211138 - DNA, 16 bp, P. troglodytes
atcacatggtttttgt

SEQ ID NO: 211139 - DNA, 17 bp, P. troglodytes
atcacattacctgactt

SEQ ID NO: 211140 - DNA, 16 bp, P. troglodytes
atcaccaagcctggct

SEQ ID NO: 211141 - DNA, 16 bp, P. troglodytes
atcaccaccaccacta

SEQ ID NO: 211142 - DNA, 16 bp, P. troglodytes
atcaccaccaccatca

SEQ ID NO: 211143 - DNA, 16 bp, P. troglodytes
atcaccaccaccatta

SEQ ID NO: 211144 - DNA, 16 bp, P. troglodytes
atcaccaccatcacta

SEQ ID NO: 211145 - DNA, 16 bp, P. troglodytes
atcaccacgcctggct

SEQ ID NO: 211146 - DNA, 16 bp, P. troglodytes
atcaccactaccacca

SEQ ID NO: 211147 - DNA, 16 bp, P. troglodytes
atcaccagtgttggag

SEQ ID NO: 211148 - DNA, 16 bp, P. troglodytes
atcaccatcaccatca

SEQ ID NO: 211149 - DNA, 16 bp, P. troglodytes
atcaccatcttcatca

SEQ ID NO: 211150 - DNA, 16 bp, P. troglodytes
atcaccatgcctagct

SEQ ID NO: 211151 - DNA, 16 bp, P. troglodytes
atcaccattaaaagaa

SEQ ID NO: 211152 - DNA, 16 bp, P. troglodytes
atcacccacctcagcc

SEQ ID NO: 211153 - DNA, 16 bp, P. troglodytes
atcacccagactggag

SEQ ID NO: 211154 - DNA, 16 bp, P. troglodytes
atcacccaggagcttg

SEQ ID NO: 211155 - DNA, 16 bp, P. troglodytes
atcacccaggctgaag

SEQ ID NO: 211156 - DNA, 16 bp, P. troglodytes
atcacccagtctggag

SEQ ID NO: 211157 - DNA, 16 bp, P. troglodytes
atcaccctaatatcaa

SEQ ID NO: 211158 - DNA, 16 bp, P. troglodytes
atcaccgctcactgca

SEQ ID NO: 211159 - DNA, 20 bp, P. troglodytes
atcacctaaggtcaggagtt

SEQ ID NO: 211160 - DNA, 16 bp, P. troglodytes
atcacctatgtattaa

SEQ ID NO: 211161 - DNA, 16 bp, P. troglodytes
atcacctcacatagtt

SEQ ID NO: 211162 - DNA, 16 bp, P. troglodytes
atcacctcagacattt

SEQ ID NO: 211163 - DNA, 16 bp, P. troglodytes
atcacctcagcccagg

SEQ ID NO: 211164 - DNA, 20 bp, P. troglodytes
atcacctcaggtcaggagtt

SEQ ID NO: 211165 - DNA, 16 bp, P. troglodytes
atcacctcctccaaga

SEQ ID NO: 211166 - DNA, 16 bp, P. troglodytes
atcacctcctccagga

SEQ ID NO: 211167 - DNA, 16 bp, P. troglodytes
atcacctcttaaaggc

SEQ ID NO: 211168 - DNA, 16 bp, P. troglodytes
atcacctgaactcagg

SEQ ID NO: 211169 - DNA, 16 bp, P. troglodytes
atcacctgaagtcaga

SEQ ID NO: 211170 - DNA, 20 bp, P. troglodytes
atcacctgaagtcaggagtt

SEQ ID NO: 211171 - DNA, 17 bp, P. troglodytes
atcacctgacgtcagga

SEQ ID NO: 211172 - DNA, 16 bp, P. troglodytes
atcacctgagaaacct

SEQ ID NO: 211173 - DNA, 20 bp, P. troglodytes
atcacctgagatcaggagtt

SEQ ID NO: 211174 - DNA, 16 bp, P. troglodytes
atcacctgagatcagt

SEQ ID NO: 211175 - DNA, 16 bp, P. troglodytes
atcacctgagcagtgt

SEQ ID NO: 211176 - DNA, 17 bp, P. troglodytes
atcacctgagcccaggg

SEQ ID NO: 211177 - DNA, 16 bp, P. troglodytes
atcacctgagccctgg

SEQ ID NO: 211178 - DNA, 16 bp, P. troglodytes
atcacctgagcttggg

SEQ ID NO: 211179 - DNA, 20 bp, P. troglodytes
atcacctgaggtcaagagtt

SEQ ID NO: 211180 - DNA, 16 bp, P. troglodytes
atcacctgaggtcaga

SEQ ID NO: 211181 - DNA, 20 bp, P. troglodytes
atcacctgaggtcagaagtt

SEQ ID NO: 211182 - DNA, 20 bp, P. troglodytes
atcacctgaggtcaggaatt

SEQ ID NO: 211183 - DNA, 20 bp, P. troglodytes
atcacctgaggtcaggactt

SEQ ID NO: 211184 - DNA, 20 bp, P. troglodytes
atcacctgaggtcaggagtt

SEQ ID NO: 211185 - DNA, 17 bp, P. troglodytes
atcacctgaggtcaggg

SEQ ID NO: 211186 - DNA, 17 bp, P. troglodytes
atcacctgaggtcaggt

SEQ ID NO: 211187 - DNA, 16 bp, P. troglodytes
atcacctgaggtcagt

SEQ ID NO: 211188 - DNA, 20 bp, P. troglodytes
atcacctgaggtcgggagtt

SEQ ID NO: 211189 - DNA, 20 bp, P. troglodytes
atcacctgaggtctggagtt

SEQ ID NO: 211190 - DNA, 20 bp, P. troglodytes
atcacctgaggttaggagtt

SEQ ID NO: 211191 - DNA, 16 bp, P. troglodytes
atcacctgaggttgag

SEQ ID NO: 211192 - DNA, 20 bp, P. troglodytes
atcacctgaggttgggagtt

SEQ ID NO: 211193 - DNA, 16 bp, P. troglodytes
atcacctgagtccaag

SEQ ID NO: 211194 - DNA, 20 bp, P. troglodytes
atcacctgatgtcaggagtt

SEQ ID NO: 211195 - DNA, 16 bp, P. troglodytes
atcacctggaggactt

SEQ ID NO: 211196 - DNA, 16 bp, P. troglodytes
atcacctggggagttt

SEQ ID NO: 211197 - DNA, 16 bp, P. troglodytes
atcacctgtcaggagt

SEQ ID NO: 211198 - DNA, 16 bp, P. troglodytes
atcaccttaaatattt

SEQ ID NO: 211199 - DNA, 16 bp, P. troglodytes
atcacgaccctctcac

SEQ ID NO: 211200 - DNA, 16 bp, P. troglodytes
atcacgactcactgca

SEQ ID NO: 211201 - DNA, 16 bp, P. troglodytes
atcacgaggtctggag

SEQ ID NO: 211202 - DNA, 17 bp, P. troglodytes
atcacgccactgcactt

SEQ ID NO: 211203 - DNA, 16 bp, P. troglodytes
atcacgccactgctct

SEQ ID NO: 211204 - DNA, 16 bp, P. troglodytes
atcacgcccggctaat

SEQ ID NO: 211205 - DNA, 17 bp, P. troglodytes
atcacgcccggctaatt

SEQ ID NO: 211206 - DNA, 19 bp, P. troglodytes
atcacgcccggctaatttt

SEQ ID NO: 211207 - DNA, 19 bp, P. troglodytes
atcacgctgcctgacttca

SEQ ID NO: 211208 - DNA, 16 bp, P. troglodytes
atcacggctcacagca

SEQ ID NO: 211209 - DNA, 16 bp, P. troglodytes
atcacggctcactgca

SEQ ID NO: 211210 - DNA, 16 bp, P. troglodytes
atcacgtaaacagaac

SEQ ID NO: 211211 - DNA, 17 bp, P. troglodytes
atcacgtgaggtcggga

SEQ ID NO: 211212 - DNA, 16 bp, P. troglodytes
atcactaaggaaaact

SEQ ID NO: 211213 - DNA, 16 bp, P. troglodytes
atcactacaaagagaa

SEQ ID NO: 211214 - DNA, 16 bp, P. troglodytes
atcactaggtcaggag

SEQ ID NO: 211215 - DNA, 16 bp, P. troglodytes
atcactagtcatcaga

SEQ ID NO: 211216 - DNA, 16 bp, P. troglodytes
atcactatcaccatca

SEQ ID NO: 211217 - DNA, 16 bp, P. troglodytes
atcactatcatcatca

SEQ ID NO: 211218 - DNA, 16 bp, P. troglodytes
atcactatgcctggct

SEQ ID NO: 211219 - DNA, 16 bp, P. troglodytes
atcactcaaatagtga

SEQ ID NO: 211220 - DNA, 16 bp, P. troglodytes
atcactcaaggtcagg

SEQ ID NO: 211221 - DNA, 16 bp, P. troglodytes
atcactccagtctctg

SEQ ID NO: 211222 - DNA, 16 bp, P. troglodytes
atcactcgagcccagg

SEQ ID NO: 211223 - DNA, 16 bp, P. troglodytes
atcactctgtgattct

SEQ ID NO: 211224 - DNA, 16 bp, P. troglodytes
atcactgcagaaagtt

SEQ ID NO: 211225 - DNA, 16 bp, P. troglodytes
atcactgcattttttt

SEQ ID NO: 211226 - DNA, 16 bp, P. troglodytes
atcactgctgattatt

SEQ ID NO: 211227 - DNA, 16 bp, P. troglodytes
atcactggaaggccca

SEQ ID NO: 211228 - DNA, 16 bp, P. troglodytes
atcactggatcatatg

SEQ ID NO: 211229 - DNA, 16 bp, P. troglodytes
atcactgtggaaaaca

SEQ ID NO: 211230 - DNA, 17 bp, P. troglodytes
atcacttaaacccagga

SEQ ID NO: 211231 - DNA, 16 bp, P. troglodytes
atcacttaaacctgga

SEQ ID NO: 211232 - DNA, 16 bp, P. troglodytes
atcacttcagcccagg

SEQ ID NO: 211233 - DNA, 16 bp, P. troglodytes
atcacttccctccctt

SEQ ID NO: 211234 - DNA, 16 bp, P. troglodytes
atcacttgaacatgga

SEQ ID NO: 211235 - DNA, 17 bp, P. troglodytes
atcacttgaaccaagga

SEQ ID NO: 211236 - DNA, 17 bp, P. troglodytes
atcacttgaaccaggag

SEQ ID NO: 211237 - DNA, 17 bp, P. troglodytes
atcacttgagatcagga

SEQ ID NO: 211238 - DNA, 18 bp, P. troglodytes
atcacttgagcccaggag

SEQ ID NO: 211239 - DNA, 17 bp, P. troglodytes
atcacttgagcccggga

SEQ ID NO: 211240 - DNA, 17 bp, P. troglodytes
atcacttgagcctagga

SEQ ID NO: 211241 - DNA, 16 bp, P. troglodytes
atcacttgaggctgag

SEQ ID NO: 211242 - DNA, 18 bp, P. troglodytes
atcacttgaggtcaggac

SEQ ID NO: 211243 - DNA, 17 bp, P. troglodytes
atcacttgaggtcaggc

SEQ ID NO: 211244 - DNA, 17 bp, P. troglodytes
atcacttgaggtcaggg

SEQ ID NO: 211245 - DNA, 16 bp, P. troglodytes
atcacttgggcccaga

SEQ ID NO: 211246 - DNA, 16 bp, P. troglodytes
atcacttggtcaggag

SEQ ID NO: 211247 - DNA, 16 bp, P. troglodytes
atcactttgggaggcc

SEQ ID NO: 211248 - DNA, 16 bp, P. troglodytes
atcagaaaaaaatgat

SEQ ID NO: 211249 - DNA, 16 bp, P. troglodytes
atcagaaaaacaaatt

SEQ ID NO: 211250 - DNA, 16 bp, P. troglodytes
atcagaaaaataattc

SEQ ID NO: 211251 - DNA, 16 bp, P. troglodytes
atcagaaaataaaatt

SEQ ID NO: 211252 - DNA, 16 bp, P. troglodytes
atcagaaaccaccaac

SEQ ID NO: 211253 - DNA, 16 bp, P. troglodytes
atcagaaacctgcatt

SEQ ID NO: 211254 - DNA, 16 bp, P. troglodytes
atcagaaagaaaagga

SEQ ID NO: 211255 - DNA, 16 bp, P. troglodytes
atcagaaagaaataga

SEQ ID NO: 211256 - DNA, 16 bp, P. troglodytes
atcagaaagaaattga

SEQ ID NO: 211257 - DNA, 16 bp, P. troglodytes
atcagaaagcagtttc

SEQ ID NO: 211258 - DNA, 16 bp, P. troglodytes
atcagaaatgaaacag

SEQ ID NO: 211259 - DNA, 16 bp, P. troglodytes
atcagaaatgaaagag

SEQ ID NO: 211260 - DNA, 16 bp, P. troglodytes
atcagaaatgacaaat

SEQ ID NO: 211261 - DNA, 16 bp, P. troglodytes
atcagaaatgataaaa

SEQ ID NO: 211262 - DNA, 16 bp, P. troglodytes
atcagaaatgcaaatt

SEQ ID NO: 211263 - DNA, 16 bp, P. troglodytes
atcagaacatcacatt

SEQ ID NO: 211264 - DNA, 16 bp, P. troglodytes
atcagaatggccttta

SEQ ID NO: 211265 - DNA, 16 bp, P. troglodytes
atcagacaaacccaaa

SEQ ID NO: 211266 - DNA, 16 bp, P. troglodytes
atcagacaccaatgga

SEQ ID NO: 211267 - DNA, 22 bp, P. troglodytes
atcagacactaaccccaaatga

SEQ ID NO: 211268 - DNA, 16 bp, P. troglodytes
atcagaccaacagcag

SEQ ID NO: 211269 - DNA, 17 bp, P. troglodytes
atcagactaacagcaga

SEQ ID NO: 211270 - DNA, 16 bp, P. troglodytes
atcagactccaagttt

SEQ ID NO: 211271 - DNA, 16 bp, P. troglodytes
atcagactggcaaaaa

SEQ ID NO: 211272 - DNA, 16 bp, P. troglodytes
atcagacttttttttt

SEQ ID NO: 211273 - DNA, 16 bp, P. troglodytes
atcagagaagacacaa

SEQ ID NO: 211274 - DNA, 16 bp, P. troglodytes
atcagagaagagaaaa

SEQ ID NO: 211275 - DNA, 16 bp, P. troglodytes
atcagagaagagaaag

SEQ ID NO: 211276 - DNA, 16 bp, P. troglodytes
atcagagaatattata

SEQ ID NO: 211277 - DNA, 16 bp, P. troglodytes
atcagagacagctgct

SEQ ID NO: 211278 - DNA, 16 bp, P. troglodytes
atcagagactcaaaag

SEQ ID NO: 211279 - DNA, 16 bp, P. troglodytes
atcagagcaatgcaaa

SEQ ID NO: 211280 - DNA, 20 bp, P. troglodytes
atcagagcagaactgaagga

SEQ ID NO: 211281 - DNA, 16 bp, P. troglodytes
atcagagctcactgca

SEQ ID NO: 211282 - DNA, 16 bp, P. troglodytes
atcagagtagaaataa

SEQ ID NO: 211283 - DNA, 16 bp, P. troglodytes
atcagatatgtatttt

SEQ ID NO: 211284 - DNA, 16 bp, P. troglodytes
atcagatcaaggagct

SEQ ID NO: 211285 - DNA, 16 bp, P. troglodytes
atcagatctcatgaga

SEQ ID NO: 211286 - DNA, 16 bp, P. troglodytes
atcagatcttgtgaga

SEQ ID NO: 211287 - DNA, 16 bp, P. troglodytes
atcagattattagttt

SEQ ID NO: 211288 - DNA, 16 bp, P. troglodytes
atcagattttgtgaga

SEQ ID NO: 211289 - DNA, 16 bp, P. troglodytes
atcagattttttaaaa

SEQ ID NO: 211290 - DNA, 16 bp, P. troglodytes
atcagattttttttat

SEQ ID NO: 211291 - DNA, 16 bp, P. troglodytes
atcagcaaagggaaaa

SEQ ID NO: 211292 - DNA, 16 bp, P. troglodytes
atcagcaataaggttg

SEQ ID NO: 211293 - DNA, 16 bp, P. troglodytes
atcagcaccatttttc

SEQ ID NO: 211294 - DNA, 16 bp, P. troglodytes
atcagcagcagcatca

SEQ ID NO: 211295 - DNA, 16 bp, P. troglodytes
atcagcagtggaggct

SEQ ID NO: 211296 - DNA, 16 bp, P. troglodytes
atcagcagtggtggct

SEQ ID NO: 211297 - DNA, 17 bp, P. troglodytes
atcagcatgacctggat

SEQ ID NO: 211298 - DNA, 16 bp, P. troglodytes
atcagcattttgatca

SEQ ID NO: 211299 - DNA, 16 bp, P. troglodytes
atcagcattttttttt

SEQ ID NO: 211300 - DNA, 16 bp, P. troglodytes
atcagccagacgtggt

SEQ ID NO: 211301 - DNA, 16 bp, P. troglodytes
atcagccatttcttca

SEQ ID NO: 211302 - DNA, 16 bp, P. troglodytes
atcagcctggccaacg

SEQ ID NO: 211303 - DNA, 16 bp, P. troglodytes
atcagcctggccatca

SEQ ID NO: 211304 - DNA, 16 bp, P. troglodytes
atcagcctggtgtggt

SEQ ID NO: 211305 - DNA, 16 bp, P. troglodytes
atcagcctgtgcaaca

SEQ ID NO: 211306 - DNA, 17 bp, P. troglodytes
atcagccttatgttccc

SEQ ID NO: 211307 - DNA, 16 bp, P. troglodytes
atcagctatcattagt

SEQ ID NO: 211308 - DNA, 18 bp, P. troglodytes
atcagctatcgttagtgt

SEQ ID NO: 211309 - DNA, 16 bp, P. troglodytes
atcagctgatggacat

SEQ ID NO: 211310 - DNA, 16 bp, P. troglodytes
atcagctggaggagct

SEQ ID NO: 211311 - DNA, 16 bp, P. troglodytes
atcagcttaaggagac

SEQ ID NO: 211312 - DNA, 16 bp, P. troglodytes
atcaggaaaaatagct

SEQ ID NO: 211313 - DNA, 16 bp, P. troglodytes
atcaggaaaatgcaaa

SEQ ID NO: 211314 - DNA, 16 bp, P. troglodytes
atcaggaaagaagaaa

SEQ ID NO: 211315 - DNA, 16 bp, P. troglodytes
atcaggaaagagaaag

SEQ ID NO: 211316 - DNA, 16 bp, P. troglodytes
atcaggaaatctttga

SEQ ID NO: 211317 - DNA, 16 bp, P. troglodytes
atcaggaacaaaacaa

SEQ ID NO: 211318 - DNA, 16 bp, P. troglodytes
atcaggaacaaagcaa

SEQ ID NO: 211319 - DNA, 16 bp, P. troglodytes
atcaggaacaaggaaa

SEQ ID NO: 211320 - DNA, 16 bp, P. troglodytes
atcaggaagaaatgga

SEQ ID NO: 211321 - DNA, 16 bp, P. troglodytes
atcaggaagaaggcaa

SEQ ID NO: 211322 - DNA, 16 bp, P. troglodytes
atcaggaagttctttg

SEQ ID NO: 211323 - DNA, 16 bp, P. troglodytes
atcaggagaacagcaa

SEQ ID NO: 211324 - DNA, 16 bp, P. troglodytes
atcaggaggcatgggg

SEQ ID NO: 211325 - DNA, 16 bp, P. troglodytes
atcaggagttcaagat

SEQ ID NO: 211326 - DNA, 18 bp, P. troglodytes
atcaggagtttgagacca

SEQ ID NO: 211327 - DNA, 16 bp, P. troglodytes
atcaggatacaaaatc

SEQ ID NO: 211328 - DNA, 16 bp, P. troglodytes
atcaggcaagagaaaa

SEQ ID NO: 211329 - DNA, 16 bp, P. troglodytes
atcaggcatttccagc

SEQ ID NO: 211330 - DNA, 16 bp, P. troglodytes
atcaggccgggcacag

SEQ ID NO: 211331 - DNA, 16 bp, P. troglodytes
atcagggaaattcaaa

SEQ ID NO: 211332 - DNA, 16 bp, P. troglodytes
atcagggaggtggagg

SEQ ID NO: 211333 - DNA, 16 bp, P. troglodytes
atcaggggctgaagtg

SEQ ID NO: 211334 - DNA, 16 bp, P. troglodytes
atcagggttctctaga

SEQ ID NO: 211335 - DNA, 16 bp, P. troglodytes
atcaggtggcagaaaa

SEQ ID NO: 211336 - DNA, 16 bp, P. troglodytes
atcagtaacagaaaaa

SEQ ID NO: 211337 - DNA, 16 bp, P. troglodytes
atcagtaagaaaaaga

SEQ ID NO: 211338 - DNA, 16 bp, P. troglodytes
atcagtaataataaaa

SEQ ID NO: 211339 - DNA, 16 bp, P. troglodytes
atcagtaatgaaaaaa

SEQ ID NO: 211340 - DNA, 16 bp, P. troglodytes
atcagtactttttaaa

SEQ ID NO: 211341 - DNA, 16 bp, P. troglodytes
atcagtatatggaaga

SEQ ID NO: 211342 - DNA, 16 bp, P. troglodytes
atcagtatcacctggg

SEQ ID NO: 211343 - DNA, 16 bp, P. troglodytes
atcagtatgacctgga

SEQ ID NO: 211344 - DNA, 16 bp, P. troglodytes
atcagtcaatacatgt

SEQ ID NO: 211345 - DNA, 16 bp, P. troglodytes
atcagtctcagcaaac

SEQ ID NO: 211346 - DNA, 16 bp, P. troglodytes
atcagtctccctgaag

SEQ ID NO: 211347 - DNA, 16 bp, P. troglodytes
atcagtctttttcttt

SEQ ID NO: 211348 - DNA, 16 bp, P. troglodytes
atcagtgaaggagaaa

SEQ ID NO: 211349 - DNA, 16 bp, P. troglodytes
atcagtgatgatgagc

SEQ ID NO: 211350 - DNA, 16 bp, P. troglodytes
atcagtgcccttataa

SEQ ID NO: 211351 - DNA, 16 bp, P. troglodytes
atcagtggagccttct

SEQ ID NO: 211352 - DNA, 16 bp, P. troglodytes
atcagtggtgatatct

SEQ ID NO: 211353 - DNA, 16 bp, P. troglodytes
atcagtgttttatttt

SEQ ID NO: 211354 - DNA, 18 bp, P. troglodytes
atcagttaaggcaggaac

SEQ ID NO: 211355 - DNA, 16 bp, P. troglodytes
atcagttcaacaagaa

SEQ ID NO: 211356 - DNA, 16 bp, P. troglodytes
atcagttcaagaagtt

SEQ ID NO: 211357 - DNA, 16 bp, P. troglodytes
atcagttgtatttcta

SEQ ID NO: 211358 - DNA, 16 bp, P. troglodytes
atcagtttggggagaa

SEQ ID NO: 211359 - DNA, 16 bp, P. troglodytes
atcagtttttcctttt

SEQ ID NO: 211360 - DNA, 16 bp, P. troglodytes
atcataaagtcaaaaa

SEQ ID NO: 211361 - DNA, 16 bp, P. troglodytes
atcataaagttgaaaa

SEQ ID NO: 211362 - DNA, 16 bp, P. troglodytes
atcataatgacagcat

SEQ ID NO: 211363 - DNA, 24 bp, P. troglodytes
atcataatgacaggatcaaattca

SEQ ID NO: 211364 - DNA, 16 bp, P. troglodytes
atcataattaaatttc

SEQ ID NO: 211365 - DNA, 16 bp, P. troglodytes
atcatacaatatgtag

SEQ ID NO: 211366 - DNA, 16 bp, P. troglodytes
atcatacacacacaca

SEQ ID NO: 211367 - DNA, 16 bp, P. troglodytes
atcataccactgtact

SEQ ID NO: 211368 - DNA, 16 bp, P. troglodytes
atcatagctcactaca

SEQ ID NO: 211369 - DNA, 16 bp, P. troglodytes
atcatagctcactata

SEQ ID NO: 211370 - DNA, 16 bp, P. troglodytes
atcatagctcactgta

SEQ ID NO: 211371 - DNA, 16 bp, P. troglodytes
atcatagctcattgca

SEQ ID NO: 211372 - DNA, 16 bp, P. troglodytes
atcatagctcattgta

SEQ ID NO: 211373 - DNA, 16 bp, P. troglodytes
atcatagcttactgaa

SEQ ID NO: 211374 - DNA, 16 bp, P. troglodytes
atcatagcttactgca

SEQ ID NO: 211375 - DNA, 16 bp, P. troglodytes
atcatagcttgctgca

SEQ ID NO: 211376 - DNA, 16 bp, P. troglodytes
atcatagttcactgca

SEQ ID NO: 211377 - DNA, 16 bp, P. troglodytes
atcatataaatgaaat

SEQ ID NO: 211378 - DNA, 16 bp, P. troglodytes
atcatatagcctccag

SEQ ID NO: 211379 - DNA, 16 bp, P. troglodytes
atcatatatatgtgta

SEQ ID NO: 211380 - DNA, 16 bp, P. troglodytes
atcatatatgatatat

SEQ ID NO: 211381 - DNA, 16 bp, P. troglodytes
atcatatcatctgaaa

SEQ ID NO: 211382 - DNA, 16 bp, P. troglodytes
atcatcaaaggccaaa

SEQ ID NO: 211383 - DNA, 16 bp, P. troglodytes
atcatcaacatcactg

SEQ ID NO: 211384 - DNA, 16 bp, P. troglodytes
atcatcaagcattaga

SEQ ID NO: 211385 - DNA, 16 bp, P. troglodytes
atcatcaatggatgct

SEQ ID NO: 211386 - DNA, 16 bp, P. troglodytes
atcatcaccatcacca

SEQ ID NO: 211387 - DNA, 16 bp, P. troglodytes
atcatcactgtcatca

SEQ ID NO: 211388 - DNA, 16 bp, P. troglodytes
atcatcagattcttca

SEQ ID NO: 211389 - DNA, 16 bp, P. troglodytes
atcatcagcagcagca

SEQ ID NO: 211390 - DNA, 16 bp, P. troglodytes
atcatcaggcattagt

SEQ ID NO: 211391 - DNA, 16 bp, P. troglodytes
atcatcataaagttct

SEQ ID NO: 211392 - DNA, 16 bp, P. troglodytes
atcatcatcaccacca

SEQ ID NO: 211393 - DNA, 16 bp, P. troglodytes
atcatcatcatcactt

SEQ ID NO: 211394 - DNA, 16 bp, P. troglodytes
atcatcatcatcatca

SEQ ID NO: 211395 - DNA, 16 bp, P. troglodytes
atcatcatcatcatcc

SEQ ID NO: 211396 - DNA, 16 bp, P. troglodytes
atcatcatcatcccca

SEQ ID NO: 211397 - DNA, 16 bp, P. troglodytes
atcatcatcatcctca

SEQ ID NO: 211398 - DNA, 16 bp, P. troglodytes
atcatcatcatcgtca

SEQ ID NO: 211399 - DNA, 16 bp, P. troglodytes
atcatcatcattatta

SEQ ID NO: 211400 - DNA, 16 bp, P. troglodytes
atcatcatcattttct

SEQ ID NO: 211401 - DNA, 16 bp, P. troglodytes
atcatcatcttcatca

SEQ ID NO: 211402 - DNA, 16 bp, P. troglodytes
atcatccaaagtccat

SEQ ID NO: 211403 - DNA, 16 bp, P. troglodytes
atcatcccactctctc

SEQ ID NO: 211404 - DNA, 16 bp, P. troglodytes
atcatccttctactct

SEQ ID NO: 211405 - DNA, 17 bp, P. troglodytes
atcatctcagcccaaaa

SEQ ID NO: 211406 - DNA, 16 bp, P. troglodytes
atcatctccatttcac

SEQ ID NO: 211407 - DNA, 16 bp, P. troglodytes
atcatctcctttgcag

SEQ ID NO: 211408 - DNA, 16 bp, P. troglodytes
atcatctgaatcatca

SEQ ID NO: 211409 - DNA, 16 bp, P. troglodytes
atcatctgagcccagg

SEQ ID NO: 211410 - DNA, 20 bp, P. troglodytes
atcatctgaggtcaggagtt

SEQ ID NO: 211411 - DNA, 16 bp, P. troglodytes
atcatcttcatcatca

SEQ ID NO: 211412 - DNA, 16 bp, P. troglodytes
atcatcttgggggtta

SEQ ID NO: 211413 - DNA, 16 bp, P. troglodytes
atcatgaaaatgaaaa

SEQ ID NO: 211414 - DNA, 16 bp, P. troglodytes
atcatgaagaaatgtt

SEQ ID NO: 211415 - DNA, 16 bp, P. troglodytes
atcatgaatgttctta

SEQ ID NO: 211416 - DNA, 16 bp, P. troglodytes
atcatgaccatcctgg

SEQ ID NO: 211417 - DNA, 16 bp, P. troglodytes
atcatgagtgagctcc

SEQ ID NO: 211418 - DNA, 16 bp, P. troglodytes
atcatgatcatgccac

SEQ ID NO: 211419 - DNA, 16 bp, P. troglodytes
atcatgatggaaggtg

SEQ ID NO: 211420 - DNA, 16 bp, P. troglodytes
atcatgcagtgtttgt

SEQ ID NO: 211421 - DNA, 16 bp, P. troglodytes
atcatgccaccgcact

SEQ ID NO: 211422 - DNA, 16 bp, P. troglodytes
atcatgccactacact

SEQ ID NO: 211423 - DNA, 16 bp, P. troglodytes
atcatgccactgccct

SEQ ID NO: 211424 - DNA, 16 bp, P. troglodytes
atcatgcccagccaac

SEQ ID NO: 211425 - DNA, 18 bp, P. troglodytes
atcatgcccagctaattt

SEQ ID NO: 211426 - DNA, 16 bp, P. troglodytes
atcatgccctcccaac

SEQ ID NO: 211427 - DNA, 18 bp, P. troglodytes
atcatgcctggctaattt

SEQ ID NO: 211428 - DNA, 16 bp, P. troglodytes
atcatgcctgtgaata

SEQ ID NO: 211429 - DNA, 16 bp, P. troglodytes
atcatgctcactgcag

SEQ ID NO: 211430 - DNA, 16 bp, P. troglodytes
atcatgctgttttgct

SEQ ID NO: 211431 - DNA, 16 bp, P. troglodytes
atcatggaacttctca

SEQ ID NO: 211432 - DNA, 16 bp, P. troglodytes
atcatggaatactgtg

SEQ ID NO: 211433 - DNA, 16 bp, P. troglodytes
atcatggaggcggttt

SEQ ID NO: 211434 - DNA, 16 bp, P. troglodytes
atcatggcagaaggaa

SEQ ID NO: 211435 - DNA, 16 bp, P. troglodytes
atcatggcagaaggag

SEQ ID NO: 211436 - DNA, 16 bp, P. troglodytes
atcatggctcactaca

SEQ ID NO: 211437 - DNA, 16 bp, P. troglodytes
atcatggctcattgca

SEQ ID NO: 211438 - DNA, 16 bp, P. troglodytes
atcatggcttattgca

SEQ ID NO: 211439 - DNA, 16 bp, P. troglodytes
atcatgggggtggttt

SEQ ID NO: 211440 - DNA, 16 bp, P. troglodytes
atcatgggtgtggttt

SEQ ID NO: 211441 - DNA, 16 bp, P. troglodytes
atcatggtggaagagg

SEQ ID NO: 211442 - DNA, 16 bp, P. troglodytes
atcatggtggagaagc

SEQ ID NO: 211443 - DNA, 16 bp, P. troglodytes
atcatggtggataagg

SEQ ID NO: 211444 - DNA, 16 bp, P. troglodytes
atcatggtggatggca

SEQ ID NO: 211445 - DNA, 16 bp, P. troglodytes
atcatggtgtataatt

SEQ ID NO: 211446 - DNA, 16 bp, P. troglodytes
atcatgtaattttttt

SEQ ID NO: 211447 - DNA, 16 bp, P. troglodytes
atcatgtcactgcatt

SEQ ID NO: 211448 - DNA, 17 bp, P. troglodytes
atcatgtcatctgcaaa

SEQ ID NO: 211449 - DNA, 16 bp, P. troglodytes
atcatgtctggctaat

SEQ ID NO: 211450 - DNA, 16 bp, P. troglodytes
atcatgtgagaactca

SEQ ID NO: 211451 - DNA, 16 bp, P. troglodytes
atcatgtgatctgcaa

SEQ ID NO: 211452 - DNA, 16 bp, P. troglodytes
atcatgtgcctggaaa

SEQ ID NO: 211453 - DNA, 16 bp, P. troglodytes
atcatgttatttttct

SEQ ID NO: 211454 - DNA, 16 bp, P. troglodytes
atcatgtttttttcct

SEQ ID NO: 211455 - DNA, 16 bp, P. troglodytes
atcattaaaaaggaaa

SEQ ID NO: 211456 - DNA, 26 bp, P. troglodytes
atcattaaaaagtcaggaaacaacag

SEQ ID NO: 211457 - DNA, 26 bp, P. troglodytes
atcattaaaaagtcaggaagcaacag

SEQ ID NO: 211458 - DNA, 16 bp, P. troglodytes
atcattaaaatgtcaa

SEQ ID NO: 211459 - DNA, 16 bp, P. troglodytes
atcattaaaatgtcag

SEQ ID NO: 211460 - DNA, 16 bp, P. troglodytes
atcattaaatatgatg

SEQ ID NO: 211461 - DNA, 16 bp, P. troglodytes
atcattacacaatata

SEQ ID NO: 211462 - DNA, 16 bp, P. troglodytes
atcattatataatgcc

SEQ ID NO: 211463 - DNA, 16 bp, P. troglodytes
atcattatcatcatca

SEQ ID NO: 211464 - DNA, 16 bp, P. troglodytes
atcattatcatcatta

SEQ ID NO: 211465 - DNA, 16 bp, P. troglodytes
atcattatctccattt

SEQ ID NO: 211466 - DNA, 16 bp, P. troglodytes
atcattatgcattgta

SEQ ID NO: 211467 - DNA, 16 bp, P. troglodytes
atcattattttttgag

SEQ ID NO: 211468 - DNA, 16 bp, P. troglodytes
atcattcatttactca

SEQ ID NO: 211469 - DNA, 16 bp, P. troglodytes
atcattccaacctctg

SEQ ID NO: 211470 - DNA, 16 bp, P. troglodytes
atcattccttctacat

SEQ ID NO: 211471 - DNA, 16 bp, P. troglodytes
atcattctacaaaaaa

SEQ ID NO: 211472 - DNA, 16 bp, P. troglodytes
atcattctgcccctgg

SEQ ID NO: 211473 - DNA, 18 bp, P. troglodytes
atcattcttagcaaacta

SEQ ID NO: 211474 - DNA, 16 bp, P. troglodytes
atcattgaaagaaatt

SEQ ID NO: 211475 - DNA, 16 bp, P. troglodytes
atcattgattttattt

SEQ ID NO: 211476 - DNA, 16 bp, P. troglodytes
atcattgtggaaggca

SEQ ID NO: 211477 - DNA, 16 bp, P. troglodytes
atcatttaaaacattt

SEQ ID NO: 211478 - DNA, 16 bp, P. troglodytes
atcatttataatcctt

SEQ ID NO: 211479 - DNA, 16 bp, P. troglodytes
atcatttatttaaaag

SEQ ID NO: 211480 - DNA, 16 bp, P. troglodytes
atcatttccctttccc

SEQ ID NO: 211481 - DNA, 16 bp, P. troglodytes
atcatttgaccatata

SEQ ID NO: 211482 - DNA, 16 bp, P. troglodytes
atcatttgtgcccagg

SEQ ID NO: 211483 - DNA, 16 bp, P. troglodytes
atcattttacaaatga

SEQ ID NO: 211484 - DNA, 16 bp, P. troglodytes
atcattttcccatttt

SEQ ID NO: 211485 - DNA, 16 bp, P. troglodytes
atcattttctattgtg

SEQ ID NO: 211486 - DNA, 16 bp, P. troglodytes
atcattttgcattcct

SEQ ID NO: 211487 - DNA, 16 bp, P. troglodytes
atcattttggaatttt

SEQ ID NO: 211488 - DNA, 16 bp, P. troglodytes
atcatttttattgtgt

SEQ ID NO: 211489 - DNA, 16 bp, P. troglodytes
atcatttttcatagaa

SEQ ID NO: 211490 - DNA, 16 bp, P. troglodytes
atcatttttgttttaa

SEQ ID NO: 211491 - DNA, 16 bp, P. troglodytes
atcattttttattgaa

SEQ ID NO: 211492 - DNA, 16 bp, P. troglodytes
atccaaaaagctccta

SEQ ID NO: 211493 - DNA, 16 bp, P. troglodytes
atccaaaaatcagaaa

SEQ ID NO: 211494 - DNA, 16 bp, P. troglodytes
atccaaaaatgtggaa

SEQ ID NO: 211495 - DNA, 16 bp, P. troglodytes
atccaaaagaagtgaa

SEQ ID NO: 211496 - DNA, 16 bp, P. troglodytes
atccaaaagacaggca

SEQ ID NO: 211497 - DNA, 16 bp, P. troglodytes
atccaaaagaccacca

SEQ ID NO: 211498 - DNA, 16 bp, P. troglodytes
atccaaaagatttgaa

SEQ ID NO: 211499 - DNA, 16 bp, P. troglodytes
atccaaaagtgaaatt

SEQ ID NO: 211500 - DNA, 16 bp, P. troglodytes
atccaaaatatttaag

SEQ ID NO: 211501 - DNA, 16 bp, P. troglodytes
atccaaaatgctccag

SEQ ID NO: 211502 - DNA, 16 bp, P. troglodytes
atccaaaatgtcaata

SEQ ID NO: 211503 - DNA, 17 bp, P. troglodytes
atccaaaccaagaagaa

SEQ ID NO: 211504 - DNA, 16 bp, P. troglodytes
atccaaagaaaagttt

SEQ ID NO: 211505 - DNA, 16 bp, P. troglodytes
atccaaaggtcagcaa

SEQ ID NO: 211506 - DNA, 16 bp, P. troglodytes
atccaaaggtcatcag

SEQ ID NO: 211507 - DNA, 16 bp, P. troglodytes
atccaaatacaagaag

SEQ ID NO: 211508 - DNA, 16 bp, P. troglodytes
atccaaatgaataaaa

SEQ ID NO: 211509 - DNA, 16 bp, P. troglodytes
atccaacaaacattta

SEQ ID NO: 211510 - DNA, 16 bp, P. troglodytes
atccaacaaatgttta

SEQ ID NO: 211511 - DNA, 16 bp, P. troglodytes
atccaacagaaataca

SEQ ID NO: 211512 - DNA, 16 bp, P. troglodytes
atccaagctggagtgc

SEQ ID NO: 211513 - DNA, 16 bp, P. troglodytes
atccaatctatcattg

SEQ ID NO: 211514 - DNA, 16 bp, P. troglodytes
atccaatgcaaggaag

SEQ ID NO: 211515 - DNA, 16 bp, P. troglodytes
atccaattagttgaag

SEQ ID NO: 211516 - DNA, 16 bp, P. troglodytes
atccaattttaaaatg

SEQ ID NO: 211517 - DNA, 16 bp, P. troglodytes
atccacaatctacaaa

SEQ ID NO: 211518 - DNA, 17 bp, P. troglodytes
atccacaatgatcaagt

SEQ ID NO: 211519 - DNA, 16 bp, P. troglodytes
atccacacatcacaaa

SEQ ID NO: 211520 - DNA, 16 bp, P. troglodytes
atccacacatcataaa

SEQ ID NO: 211521 - DNA, 16 bp, P. troglodytes
atccacagccaacatt

SEQ ID NO: 211522 - DNA, 16 bp, P. troglodytes
atccacaggcagacag

SEQ ID NO: 211523 - DNA, 16 bp, P. troglodytes
atccacagttggttga

SEQ ID NO: 211524 - DNA, 17 bp, P. troglodytes
atccaccatgatcaagt

SEQ ID NO: 211525 - DNA, 16 bp, P. troglodytes
atccaccattgctgag

SEQ ID NO: 211526 - DNA, 16 bp, P. troglodytes
atccacccaccacagc

SEQ ID NO: 211527 - DNA, 16 bp, P. troglodytes
atccacccacctaggc

SEQ ID NO: 211528 - DNA, 16 bp, P. troglodytes
atccacccacctcagt

SEQ ID NO: 211529 - DNA, 16 bp, P. troglodytes
atccacccacctcgac

SEQ ID NO: 211530 - DNA, 17 bp, P. troglodytes
atccacccacctcggct

SEQ ID NO: 211531 - DNA, 16 bp, P. troglodytes
atccacccaccttgac

SEQ ID NO: 211532 - DNA, 16 bp, P. troglodytes
atccacccaccttggc

SEQ ID NO: 211533 - DNA, 23 bp, P. troglodytes
atccacccaccttggcttcccaa

SEQ ID NO: 211534 - DNA, 16 bp, P. troglodytes
atccacccacttcagc

SEQ ID NO: 211535 - DNA, 16 bp, P. troglodytes
atccacccactttggt

SEQ ID NO: 211536 - DNA, 16 bp, P. troglodytes
atccacccattcatcc

SEQ ID NO: 211537 - DNA, 16 bp, P. troglodytes
atccacccatttcagc

SEQ ID NO: 211538 - DNA, 17 bp, P. troglodytes
atccacccgcctcagcc

SEQ ID NO: 211539 - DNA, 17 bp, P. troglodytes
atccacccgcctcagtc

SEQ ID NO: 211540 - DNA, 16 bp, P. troglodytes
atccacccgcctcggt

SEQ ID NO: 211541 - DNA, 16 bp, P. troglodytes
atccacccgcctgggt

SEQ ID NO: 211542 - DNA, 16 bp, P. troglodytes
atccacccgtcttggc

SEQ ID NO: 211543 - DNA, 16 bp, P. troglodytes
atccaccctcagcctc

SEQ ID NO: 211544 - DNA, 16 bp, P. troglodytes
atccaccctccttggc

SEQ ID NO: 211545 - DNA, 17 bp, P. troglodytes
atccaccggcctcagcc

SEQ ID NO: 211546 - DNA, 17 bp, P. troglodytes
atccaccggcctcggcc

SEQ ID NO: 211547 - DNA, 17 bp, P. troglodytes
atccacctacctcggcc

SEQ ID NO: 211548 - DNA, 16 bp, P. troglodytes
atccacctatgacctg

SEQ ID NO: 211549 - DNA, 16 bp, P. troglodytes
atccacctcccttggc

SEQ ID NO: 211550 - DNA, 16 bp, P. troglodytes
atccacctgccccagc

SEQ ID NO: 211551 - DNA, 16 bp, P. troglodytes
atccacctgcctcaga

SEQ ID NO: 211552 - DNA, 17 bp, P. troglodytes
atccacctgcctcggcc

SEQ ID NO: 211553 - DNA, 16 bp, P. troglodytes
atccacctgcctcggt

SEQ ID NO: 211554 - DNA, 17 bp, P. troglodytes
atccacctgccttagcc

SEQ ID NO: 211555 - DNA, 16 bp, P. troglodytes
atccacctgccttgcc

SEQ ID NO: 211556 - DNA, 16 bp, P. troglodytes
atccacctggctcagc

SEQ ID NO: 211557 - DNA, 17 bp, P. troglodytes
atccacgcacctcagcc

SEQ ID NO: 211558 - DNA, 16 bp, P. troglodytes
atccactatgatcaag

SEQ ID NO: 211559 - DNA, 16 bp, P. troglodytes
atccactcacctccca

SEQ ID NO: 211560 - DNA, 17 bp, P. troglodytes
atccactcacctcggcc

SEQ ID NO: 211561 - DNA, 17 bp, P. troglodytes
atccactggccttggcc

SEQ ID NO: 211562 - DNA, 16 bp, P. troglodytes
atccacttccacttaa

SEQ ID NO: 211563 - DNA, 16 bp, P. troglodytes
atccacttgcctctgc

SEQ ID NO: 211564 - DNA, 16 bp, P. troglodytes
atccagaaaaataaca

SEQ ID NO: 211565 - DNA, 16 bp, P. troglodytes
atccagaaataaagcc

SEQ ID NO: 211566 - DNA, 16 bp, P. troglodytes
atccagaagaattgaa

SEQ ID NO: 211567 - DNA, 16 bp, P. troglodytes
atccagaccatcttgg

SEQ ID NO: 211568 - DNA, 17 bp, P. troglodytes
atccagaccccaagaga

SEQ ID NO: 211569 - DNA, 16 bp, P. troglodytes
atccagatcacaggag

SEQ ID NO: 211570 - DNA, 16 bp, P. troglodytes
atccagcaatcatgct

SEQ ID NO: 211571 - DNA, 16 bp, P. troglodytes
atccagcagaagaaaa

SEQ ID NO: 211572 - DNA, 16 bp, P. troglodytes
atccagcagtgcatca

SEQ ID NO: 211573 - DNA, 16 bp, P. troglodytes
atccagcatgagagaa

SEQ ID NO: 211574 - DNA, 16 bp, P. troglodytes
atccagccatgcctga

SEQ ID NO: 211575 - DNA, 17 bp, P. troglodytes
atccagcctgggcgaca

SEQ ID NO: 211576 - DNA, 17 bp, P. troglodytes
atccagcctgggtgaca

SEQ ID NO: 211577 - DNA, 16 bp, P. troglodytes
atccaggaaatacaga

SEQ ID NO: 211578 - DNA, 16 bp, P. troglodytes
atccaggaacagaaaa

SEQ ID NO: 211579 - DNA, 16 bp, P. troglodytes
atccaggacttgaatt

SEQ ID NO: 211580 - DNA, 20 bp, P. troglodytes
atccaggagaacttccccaa

SEQ ID NO: 211581 - DNA, 16 bp, P. troglodytes
atccaggagaagttcc

SEQ ID NO: 211582 - DNA, 16 bp, P. troglodytes
atccaggaggcaaagg

SEQ ID NO: 211583 - DNA, 16 bp, P. troglodytes
atccaggaggcagagg

SEQ ID NO: 211584 - DNA, 16 bp, P. troglodytes
atccaggaggtggaag

SEQ ID NO: 211585 - DNA, 16 bp, P. troglodytes
atccaggaggtggagt

SEQ ID NO: 211586 - DNA, 16 bp, P. troglodytes
atccaggagttcaagg

SEQ ID NO: 211587 - DNA, 16 bp, P. troglodytes
atccaggcatggtggt

SEQ ID NO: 211588 - DNA, 18 bp, P. troglodytes
atccaggccatcaccaat

SEQ ID NO: 211589 - DNA, 16 bp, P. troglodytes
atccaggctatcattg

SEQ ID NO: 211590 - DNA, 16 bp, P. troglodytes
atccaggctgagatgg

SEQ ID NO: 211591 - DNA, 16 bp, P. troglodytes
atccagggagccaagc

SEQ ID NO: 211592 - DNA, 16 bp, P. troglodytes
atccaggttttttttt

SEQ ID NO: 211593 - DNA, 16 bp, P. troglodytes
atccagtccatcactg

SEQ ID NO: 211594 - DNA, 16 bp, P. troglodytes
atccagtctatcattg

SEQ ID NO: 211595 - DNA, 16 bp, P. troglodytes
atccagtctatcgttg

SEQ ID NO: 211596 - DNA, 16 bp, P. troglodytes
atccagtctgtggtat

SEQ ID NO: 211597 - DNA, 16 bp, P. troglodytes
atccagtgaaaatatt

SEQ ID NO: 211598 - DNA, 16 bp, P. troglodytes
atccagtgaaattatc

SEQ ID NO: 211599 - DNA, 16 bp, P. troglodytes
atccagtgaatttttt

SEQ ID NO: 211600 - DNA, 16 bp, P. troglodytes
atccagtgaggcaccc

SEQ ID NO: 211601 - DNA, 16 bp, P. troglodytes
atccagtgtatcattg

SEQ ID NO: 211602 - DNA, 16 bp, P. troglodytes
atccagttccttcaaa

SEQ ID NO: 211603 - DNA, 16 bp, P. troglodytes
atccagtttcaatttt

SEQ ID NO: 211604 - DNA, 16 bp, P. troglodytes
atccagtttctgtttt

SEQ ID NO: 211605 - DNA, 16 bp, P. troglodytes
atccatactgatataa

SEQ ID NO: 211606 - DNA, 16 bp, P. troglodytes
atccatatatcctctt

SEQ ID NO: 211607 - DNA, 16 bp, P. troglodytes
atccatatccctacaa

SEQ ID NO: 211608 - DNA, 16 bp, P. troglodytes
atccatcaatcaatca

SEQ ID NO: 211609 - DNA, 16 bp, P. troglodytes
atccatccatctctcc

SEQ ID NO: 211610 - DNA, 16 bp, P. troglodytes
atccatccatgtccct

SEQ ID NO: 211611 - DNA, 16 bp, P. troglodytes
atccatctggtctggg

SEQ ID NO: 211612 - DNA, 16 bp, P. troglodytes
atccatcttgctgcaa

SEQ ID NO: 211613 - DNA, 16 bp, P. troglodytes
atccatgaaaatgaaa

SEQ ID NO: 211614 - DNA, 16 bp, P. troglodytes
atccatgacaaaccca

SEQ ID NO: 211615 - DNA, 16 bp, P. troglodytes
atccatgagcatggaa

SEQ ID NO: 211616 - DNA, 16 bp, P. troglodytes
atccatgagcattgga

SEQ ID NO: 211617 - DNA, 16 bp, P. troglodytes
atccatgatgaacatc

SEQ ID NO: 211618 - DNA, 16 bp, P. troglodytes
atccatggattttggt

SEQ ID NO: 211619 - DNA, 16 bp, P. troglodytes
atccatgggggtcctg

SEQ ID NO: 211620 - DNA, 16 bp, P. troglodytes
atccatgtaaccaaaa

SEQ ID NO: 211621 - DNA, 16 bp, P. troglodytes
atccatgtcccctgca

SEQ ID NO: 211622 - DNA, 17 bp, P. troglodytes
atccatgtccctgaaaa

SEQ ID NO: 211623 - DNA, 17 bp, P. troglodytes
atccatgtccctgcaaa

SEQ ID NO: 211624 - DNA, 16 bp, P. troglodytes
atccatgtgtctgttt

SEQ ID NO: 211625 - DNA, 16 bp, P. troglodytes
atccattatagccatc

SEQ ID NO: 211626 - DNA, 16 bp, P. troglodytes
atccattcaaccctga

SEQ ID NO: 211627 - DNA, 16 bp, P. troglodytes
atccattcatccttcc

SEQ ID NO: 211628 - DNA, 16 bp, P. troglodytes
atccattcatctgtca

SEQ ID NO: 211629 - DNA, 16 bp, P. troglodytes
atccattgagcccagg

SEQ ID NO: 211630 - DNA, 16 bp, P. troglodytes
atccatttccttgcct

SEQ ID NO: 211631 - DNA, 16 bp, P. troglodytes
atccatttcttttaga

SEQ ID NO: 211632 - DNA, 16 bp, P. troglodytes
atccatttgtttcttt

SEQ ID NO: 211633 - DNA, 16 bp, P. troglodytes
atcccaaagaaataaa

SEQ ID NO: 211634 - DNA, 16 bp, P. troglodytes
atcccaaatcagatag

SEQ ID NO: 211635 - DNA, 16 bp, P. troglodytes
atcccaaatctgaaaa

SEQ ID NO: 211636 - DNA, 16 bp, P. troglodytes
atcccaacaacagcaa

SEQ ID NO: 211637 - DNA, 16 bp, P. troglodytes
atcccaacactttaga

SEQ ID NO: 211638 - DNA, 16 bp, P. troglodytes
atcccaacattttgga

SEQ ID NO: 211639 - DNA, 16 bp, P. troglodytes
atcccaattactctga

SEQ ID NO: 211640 - DNA, 16 bp, P. troglodytes
atcccacccatgaggg

SEQ ID NO: 211641 - DNA, 16 bp, P. troglodytes
atcccacctcagcctc

SEQ ID NO: 211642 - DNA, 16 bp, P. troglodytes
atcccacctcggcctc

SEQ ID NO: 211643 - DNA, 16 bp, P. troglodytes
atcccactactcggga

SEQ ID NO: 211644 - DNA, 16 bp, P. troglodytes
atcccactcatgaggg

SEQ ID NO: 211645 - DNA, 16 bp, P. troglodytes
atcccagaactttgag

SEQ ID NO: 211646 - DNA, 16 bp, P. troglodytes
atcccagacctttggg

SEQ ID NO: 211647 - DNA, 16 bp, P. troglodytes
atcccagcacctggga

SEQ ID NO: 211648 - DNA, 16 bp, P. troglodytes
atcccagcaccttgga

SEQ ID NO: 211649 - DNA, 16 bp, P. troglodytes
atcccagcaccttgtg

SEQ ID NO: 211650 - DNA, 16 bp, P. troglodytes
atcccagcactgaggg

SEQ ID NO: 211651 - DNA, 16 bp, P. troglodytes
atcccagcactgggga

SEQ ID NO: 211652 - DNA, 16 bp, P. troglodytes
atcccagcacttcaga

SEQ ID NO: 211653 - DNA, 16 bp, P. troglodytes
atcccagcagtttgtg

SEQ ID NO: 211654 - DNA, 24 bp, P. troglodytes
atcccagcatgttgggaggccgag

SEQ ID NO: 211655 - DNA, 16 bp, P. troglodytes
atcccagccactccgg

SEQ ID NO: 211656 - DNA, 16 bp, P. troglodytes
atcccagcctcctgag

SEQ ID NO: 211657 - DNA, 16 bp, P. troglodytes
atcccagcctctcttc

SEQ ID NO: 211658 - DNA, 16 bp, P. troglodytes
atcccagcctgggtga

SEQ ID NO: 211659 - DNA, 16 bp, P. troglodytes
atcccagctactcagt

SEQ ID NO: 211660 - DNA, 16 bp, P. troglodytes
atcccagctactccag

SEQ ID NO: 211661 - DNA, 16 bp, P. troglodytes
atcccagctactgcag

SEQ ID NO: 211662 - DNA, 16 bp, P. troglodytes
atcccagctcactgca

SEQ ID NO: 211663 - DNA, 16 bp, P. troglodytes
atcccagctccagagc

SEQ ID NO: 211664 - DNA, 16 bp, P. troglodytes
atcccagctcctcggg

SEQ ID NO: 211665 - DNA, 16 bp, P. troglodytes
atcccagctcctctgg

SEQ ID NO: 211666 - DNA, 16 bp, P. troglodytes
atcccagctctgcccc

SEQ ID NO: 211667 - DNA, 16 bp, P. troglodytes
atcccagctctgtcat

SEQ ID NO: 211668 - DNA, 16 bp, P. troglodytes
atcccagctgcctggg

SEQ ID NO: 211669 - DNA, 16 bp, P. troglodytes
atcccagctgctgagg

SEQ ID NO: 211670 - DNA, 16 bp, P. troglodytes
atcccaggaagcagag

SEQ ID NO: 211671 - DNA, 16 bp, P. troglodytes
atcccaggaatacaag

SEQ ID NO: 211672 - DNA, 16 bp, P. troglodytes
atcccaggacttttgg

SEQ ID NO: 211673 - DNA, 16 bp, P. troglodytes
atcccaggcagaggaa

SEQ ID NO: 211674 - DNA, 16 bp, P. troglodytes
atcccaggcagaggga

SEQ ID NO: 211675 - DNA, 16 bp, P. troglodytes
atcccagggatggagc

SEQ ID NO: 211676 - DNA, 16 bp, P. troglodytes
atcccagggattcaag

SEQ ID NO: 211677 - DNA, 16 bp, P. troglodytes
atcccagggtctccag

SEQ ID NO: 211678 - DNA, 16 bp, P. troglodytes
atcccagtgcttcagg

SEQ ID NO: 211679 - DNA, 16 bp, P. troglodytes
atcccagttctgccat

SEQ ID NO: 211680 - DNA, 16 bp, P. troglodytes
atcccatctctactag

SEQ ID NO: 211681 - DNA, 16 bp, P. troglodytes
atcccatggacattaa

SEQ ID NO: 211682 - DNA, 17 bp, P. troglodytes
atcccattactaggtat

SEQ ID NO: 211683 - DNA, 26 bp, P. troglodytes
atcccattactgggtatatacccaaa

SEQ ID NO: 211684 - DNA, 16 bp, P. troglodytes
atcccattctcctgcc

SEQ ID NO: 211685 - DNA, 16 bp, P. troglodytes
atcccattggccagaa

SEQ ID NO: 211686 - DNA, 16 bp, P. troglodytes
atcccatttctaaaaa

SEQ ID NO: 211687 - DNA, 16 bp, P. troglodytes
atcccatttgccaatt

SEQ ID NO: 211688 - DNA, 16 bp, P. troglodytes
atcccatttgcctatt

SEQ ID NO: 211689 - DNA, 16 bp, P. troglodytes
atcccattttaaagat

SEQ ID NO: 211690 - DNA, 16 bp, P. troglodytes
atcccattttctcctg

SEQ ID NO: 211691 - DNA, 16 bp, P. troglodytes
atccccaaacctaaaa

SEQ ID NO: 211692 - DNA, 16 bp, P. troglodytes
atccccaaatccaaaa

SEQ ID NO: 211693 - DNA, 16 bp, P. troglodytes
atccccaaatctgaaa

SEQ ID NO: 211694 - DNA, 16 bp, P. troglodytes
atccccaatgttggtg

SEQ ID NO: 211695 - DNA, 16 bp, P. troglodytes
atccccagcacccagc

SEQ ID NO: 211696 - DNA, 16 bp, P. troglodytes
atccccagtgtgatga

SEQ ID NO: 211697 - DNA, 18 bp, P. troglodytes
atccccatcaagctacca

SEQ ID NO: 211698 - DNA, 16 bp, P. troglodytes
atccccatgtgttaag

SEQ ID NO: 211699 - DNA, 16 bp, P. troglodytes
atccccatttaacaga

SEQ ID NO: 211700 - DNA, 16 bp, P. troglodytes
atccccattttataga

SEQ ID NO: 211701 - DNA, 16 bp, P. troglodytes
atcccctcaagcattt

SEQ ID NO: 211702 - DNA, 16 bp, P. troglodytes
atcccctctctgctga

SEQ ID NO: 211703 - DNA, 16 bp, P. troglodytes
atcccctttggcaaca

SEQ ID NO: 211704 - DNA, 16 bp, P. troglodytes
atcccggtactttggg

SEQ ID NO: 211705 - DNA, 16 bp, P. troglodytes
atccctaatccaaaaa

SEQ ID NO: 211706 - DNA, 16 bp, P. troglodytes
atccctaatctgaaaa

SEQ ID NO: 211707 - DNA, 16 bp, P. troglodytes
atccctcatgaatggg

SEQ ID NO: 211708 - DNA, 16 bp, P. troglodytes
atccctccagggatgc

SEQ ID NO: 211709 - DNA, 16 bp, P. troglodytes
atccctcccctagcct

SEQ ID NO: 211710 - DNA, 16 bp, P. troglodytes
atccctcccctgtccc

SEQ ID NO: 211711 - DNA, 16 bp, P. troglodytes
atccctctgccttggc

SEQ ID NO: 211712 - DNA, 16 bp, P. troglodytes
atccctgagcatggaa

SEQ ID NO: 211713 - DNA, 16 bp, P. troglodytes
atccctgcactctcag

SEQ ID NO: 211714 - DNA, 16 bp, P. troglodytes
atccctgccctcaagg

SEQ ID NO: 211715 - DNA, 16 bp, P. troglodytes
atccctgcccttgtgg

SEQ ID NO: 211716 - DNA, 16 bp, P. troglodytes
atccctgccttcatgg

SEQ ID NO: 211717 - DNA, 16 bp, P. troglodytes
atccctgctttcaatt

SEQ ID NO: 211718 - DNA, 16 bp, P. troglodytes
atccctggcctcaagt

SEQ ID NO: 211719 - DNA, 16 bp, P. troglodytes
atccctgggatgcaaa

SEQ ID NO: 211720 - DNA, 16 bp, P. troglodytes
atccctgtaattccag

SEQ ID NO: 211721 - DNA, 16 bp, P. troglodytes
atcccttccccattgc

SEQ ID NO: 211722 - DNA, 16 bp, P. troglodytes
atcccttcctctacat

SEQ ID NO: 211723 - DNA, 16 bp, P. troglodytes
atcccttgtaagttgt

SEQ ID NO: 211724 - DNA, 16 bp, P. troglodytes
atccgcatcaagctac

SEQ ID NO: 211725 - DNA, 17 bp, P. troglodytes
atccgcccacctcgacc

SEQ ID NO: 211726 - DNA, 20 bp, P. troglodytes
atccgcccaccttggcctcc

SEQ ID NO: 211727 - DNA, 16 bp, P. troglodytes
atccgcctggctcagc

SEQ ID NO: 211728 - DNA, 16 bp, P. troglodytes
atccgctcacctcagc

SEQ ID NO: 211729 - DNA, 17 bp, P. troglodytes
atccgctcacctcggcc

SEQ ID NO: 211730 - DNA, 17 bp, P. troglodytes
atccgctcaccttggcc

SEQ ID NO: 211731 - DNA, 16 bp, P. troglodytes
atccgggaggtgaagg

SEQ ID NO: 211732 - DNA, 16 bp, P. troglodytes
atccgtccaccttggc

SEQ ID NO: 211733 - DNA, 16 bp, P. troglodytes
atcctaaaatgtatat

SEQ ID NO: 211734 - DNA, 16 bp, P. troglodytes
atcctaaaattcctat

SEQ ID NO: 211735 - DNA, 16 bp, P. troglodytes
atcctaaataaatatg

SEQ ID NO: 211736 - DNA, 16 bp, P. troglodytes
atcctaaatatatatc

SEQ ID NO: 211737 - DNA, 16 bp, P. troglodytes
atcctaaattttatat

SEQ ID NO: 211738 - DNA, 16 bp, P. troglodytes
atcctaagcaaaacaa

SEQ ID NO: 211739 - DNA, 16 bp, P. troglodytes
atcctaatggatgtga

SEQ ID NO: 211740 - DNA, 16 bp, P. troglodytes
atcctacaatgcacag

SEQ ID NO: 211741 - DNA, 16 bp, P. troglodytes
atcctacagaaataca

SEQ ID NO: 211742 - DNA, 17 bp, P. troglodytes
atcctagcactttggga

SEQ ID NO: 211743 - DNA, 16 bp, P. troglodytes
atcctaggagaaaacc

SEQ ID NO: 211744 - DNA, 16 bp, P. troglodytes
atcctattgtgaactg

SEQ ID NO: 211745 - DNA, 16 bp, P. troglodytes
atcctcacaacaatcc

SEQ ID NO: 211746 - DNA, 16 bp, P. troglodytes
atcctcacaacagccc

SEQ ID NO: 211747 - DNA, 16 bp, P. troglodytes
atcctcacaaccacct

SEQ ID NO: 211748 - DNA, 16 bp, P. troglodytes
atcctcacatgacaga

SEQ ID NO: 211749 - DNA, 16 bp, P. troglodytes
atcctcaccagcatcc

SEQ ID NO: 211750 - DNA, 16 bp, P. troglodytes
atcctcaccagcattt

SEQ ID NO: 211751 - DNA, 16 bp, P. troglodytes
atcctcagaacctgtg

SEQ ID NO: 211752 - DNA, 16 bp, P. troglodytes
atcctcagactttgct

SEQ ID NO: 211753 - DNA, 16 bp, P. troglodytes
atcctcagcaaactaa

SEQ ID NO: 211754 - DNA, 16 bp, P. troglodytes
atcctcatcaacactt

SEQ ID NO: 211755 - DNA, 16 bp, P. troglodytes
atcctcattttaaaaa

SEQ ID NO: 211756 - DNA, 16 bp, P. troglodytes
atcctcatttttcaga

SEQ ID NO: 211757 - DNA, 16 bp, P. troglodytes
atcctccaacctcagt

SEQ ID NO: 211758 - DNA, 16 bp, P. troglodytes
atcctccagccccagc

SEQ ID NO: 211759 - DNA, 16 bp, P. troglodytes
atcctcccaccccagc

SEQ ID NO: 211760 - DNA, 16 bp, P. troglodytes
atcctcccacctcagc

SEQ ID NO: 211761 - DNA, 16 bp, P. troglodytes
atcctcccacctcgac

SEQ ID NO: 211762 - DNA, 16 bp, P. troglodytes
atcctcccacctcggc

SEQ ID NO: 211763 - DNA, 16 bp, P. troglodytes
atcctcccaccttggc

SEQ ID NO: 211764 - DNA, 16 bp, P. troglodytes
atcctcccatctaagc

SEQ ID NO: 211765 - DNA, 16 bp, P. troglodytes
atcctcccatctcagc

SEQ ID NO: 211766 - DNA, 16 bp, P. troglodytes
atcctcccatcttggt

SEQ ID NO: 211767 - DNA, 16 bp, P. troglodytes
atcctccccaccttgg

SEQ ID NO: 211768 - DNA, 16 bp, P. troglodytes
atcctcccgccacagc

SEQ ID NO: 211769 - DNA, 16 bp, P. troglodytes
atcctcccgcctcagc

SEQ ID NO: 211770 - DNA, 16 bp, P. troglodytes
atcctcccgcctcatc

SEQ ID NO: 211771 - DNA, 16 bp, P. troglodytes
atcctccctcctcagc

SEQ ID NO: 211772 - DNA, 16 bp, P. troglodytes
atcctccggcctcagc

SEQ ID NO: 211773 - DNA, 16 bp, P. troglodytes
atcctcctacctcagc

SEQ ID NO: 211774 - DNA, 16 bp, P. troglodytes
atcctcctcagcttac

SEQ ID NO: 211775 - DNA, 16 bp, P. troglodytes
atcctcctgccccagc

SEQ ID NO: 211776 - DNA, 16 bp, P. troglodytes
atcctcctgcctcagc

SEQ ID NO: 211777 - DNA, 16 bp, P. troglodytes
atcctcctgcctccct

SEQ ID NO: 211778 - DNA, 16 bp, P. troglodytes
atcctcctgcctctga

SEQ ID NO: 211779 - DNA, 16 bp, P. troglodytes
atcctcctgccttagc

SEQ ID NO: 211780 - DNA, 16 bp, P. troglodytes
atcctcctgccttggc

SEQ ID NO: 211781 - DNA, 16 bp, P. troglodytes
atcctcctgccttggg

SEQ ID NO: 211782 - DNA, 16 bp, P. troglodytes
atcctcctgctccagc

SEQ ID NO: 211783 - DNA, 16 bp, P. troglodytes
atcctcctgtctcagc

SEQ ID NO: 211784 - DNA, 16 bp, P. troglodytes
atcctccttggcctcc

SEQ ID NO: 211785 - DNA, 16 bp, P. troglodytes
atcctcgacctcctgg

SEQ ID NO: 211786 - DNA, 16 bp, P. troglodytes
atcctctacagcatct

SEQ ID NO: 211787 - DNA, 16 bp, P. troglodytes
atcctctcacttcagc

SEQ ID NO: 211788 - DNA, 16 bp, P. troglodytes
atcctctccagaatct

SEQ ID NO: 211789 - DNA, 16 bp, P. troglodytes
atcctctcccctcagc

SEQ ID NO: 211790 - DNA, 16 bp, P. troglodytes
atcctctccctgctcc

SEQ ID NO: 211791 - DNA, 16 bp, P. troglodytes
atcctctgtccagttc

SEQ ID NO: 211792 - DNA, 16 bp, P. troglodytes
atcctcttgtatactt

SEQ ID NO: 211793 - DNA, 16 bp, P. troglodytes
atcctcttgtctcagc

SEQ ID NO: 211794 - DNA, 16 bp, P. troglodytes
atcctgaaatatattt

SEQ ID NO: 211795 - DNA, 16 bp, P. troglodytes
atcctgaaattttgct

SEQ ID NO: 211796 - DNA, 16 bp, P. troglodytes
atcctgaagacaaagc

SEQ ID NO: 211797 - DNA, 16 bp, P. troglodytes
atcctgaagcagctgg

SEQ ID NO: 211798 - DNA, 16 bp, P. troglodytes
atcctgaagtgttttc

SEQ ID NO: 211799 - DNA, 16 bp, P. troglodytes
atcctgacaaaaacaa

SEQ ID NO: 211800 - DNA, 18 bp, P. troglodytes
atcctgacctcaggtgat

SEQ ID NO: 211801 - DNA, 16 bp, P. troglodytes
atcctgacttcaggtg

SEQ ID NO: 211802 - DNA, 16 bp, P. troglodytes
atcctgagcaaaagaa

SEQ ID NO: 211803 - DNA, 16 bp, P. troglodytes
atcctgagtgtgtctg

SEQ ID NO: 211804 - DNA, 16 bp, P. troglodytes
atcctgcacacgtacc

SEQ ID NO: 211805 - DNA, 16 bp, P. troglodytes
atcctgcacatgtacc

SEQ ID NO: 211806 - DNA, 16 bp, P. troglodytes
atcctgcaccagcaac

SEQ ID NO: 211807 - DNA, 16 bp, P. troglodytes
atcctgccactgctct

SEQ ID NO: 211808 - DNA, 16 bp, P. troglodytes
atcctgcctcagcctc

SEQ ID NO: 211809 - DNA, 16 bp, P. troglodytes
atcctgctgggatttt

SEQ ID NO: 211810 - DNA, 16 bp, P. troglodytes
atcctggaacagaaaa

SEQ ID NO: 211811 - DNA, 16 bp, P. troglodytes
atcctggaactttaaa

SEQ ID NO: 211812 - DNA, 16 bp, P. troglodytes
atcctggagaaacaga

SEQ ID NO: 211813 - DNA, 16 bp, P. troglodytes
atcctggccaacattg

SEQ ID NO: 211814 - DNA, 16 bp, P. troglodytes
atcctggccaagatgg

SEQ ID NO: 211815 - DNA, 16 bp, P. troglodytes
atcctggcccactgca

SEQ ID NO: 211816 - DNA, 16 bp, P. troglodytes
atcctggctaacaaga

SEQ ID NO: 211817 - DNA, 25 bp, P. troglodytes
atcctggctaacacgatgaaacccc

SEQ ID NO: 211818 - DNA, 16 bp, P. troglodytes
atcctggctactctgg

SEQ ID NO: 211819 - DNA, 16 bp, P. troglodytes
atcctggctccatcac

SEQ ID NO: 211820 - DNA, 18 bp, P. troglodytes
atcctgggctcaagtgat

SEQ ID NO: 211821 - DNA, 18 bp, P. troglodytes
atcctgggttcaagtgat

SEQ ID NO: 211822 - DNA, 16 bp, P. troglodytes
atcctggtgaaacccc

SEQ ID NO: 211823 - DNA, 16 bp, P. troglodytes
atcctggtgaacatgg

SEQ ID NO: 211824 - DNA, 16 bp, P. troglodytes
atcctggttctgccat

SEQ ID NO: 211825 - DNA, 16 bp, P. troglodytes
atcctgtccctcctcc

SEQ ID NO: 211826 - DNA, 16 bp, P. troglodytes
atcctgtctcaaaaaa

SEQ ID NO: 211827 - DNA, 16 bp, P. troglodytes
atcctgtctctaagaa

SEQ ID NO: 211828 - DNA, 16 bp, P. troglodytes
atcctgtgaccttgct

SEQ ID NO: 211829 - DNA, 16 bp, P. troglodytes
atcctgtgcctataaa

SEQ ID NO: 211830 - DNA, 16 bp, P. troglodytes
atcctgtgttcatgga

SEQ ID NO: 211831 - DNA, 16 bp, P. troglodytes
atcctgtttctcatca

SEQ ID NO: 211832 - DNA, 16 bp, P. troglodytes
atccttatgacctcat

SEQ ID NO: 211833 - DNA, 16 bp, P. troglodytes
atccttcaaatatgaa

SEQ ID NO: 211834 - DNA, 16 bp, P. troglodytes
atccttcaccagcaac

SEQ ID NO: 211835 - DNA, 16 bp, P. troglodytes
atccttccacctcggc

SEQ ID NO: 211836 - DNA, 16 bp, P. troglodytes
atccttccaccttagc

SEQ ID NO: 211837 - DNA, 16 bp, P. troglodytes
atccttccagactttc

SEQ ID NO: 211838 - DNA, 16 bp, P. troglodytes
atccttccgcctcagc

SEQ ID NO: 211839 - DNA, 16 bp, P. troglodytes
atccttctcaacacag

SEQ ID NO: 211840 - DNA, 16 bp, P. troglodytes
atccttctgcctcagc

SEQ ID NO: 211841 - DNA, 16 bp, P. troglodytes
atccttctgcctcagt

SEQ ID NO: 211842 - DNA, 16 bp, P. troglodytes
atccttgccagcactt

SEQ ID NO: 211843 - DNA, 16 bp, P. troglodytes
atcctttcaaaaaaac

SEQ ID NO: 211844 - DNA, 16 bp, P. troglodytes
atcctttgatggacac

SEQ ID NO: 211845 - DNA, 16 bp, P. troglodytes
atcctttggagaagaa

SEQ ID NO: 211846 - DNA, 16 bp, P. troglodytes
atcctttgtattacaa

SEQ ID NO: 211847 - DNA, 16 bp, P. troglodytes
atccttttcagacaaa

SEQ ID NO: 211848 - DNA, 16 bp, P. troglodytes
atccttttcagacaag

SEQ ID NO: 211849 - DNA, 16 bp, P. troglodytes
atcctttttatatgtt

SEQ ID NO: 211850 - DNA, 16 bp, P. troglodytes
atcgagagcatcctgg

SEQ ID NO: 211851 - DNA, 16 bp, P. troglodytes
atcgagccattgcact

SEQ ID NO: 211852 - DNA, 16 bp, P. troglodytes
atcgaggccatcctgg

SEQ ID NO: 211853 - DNA, 16 bp, P. troglodytes
atcgcacactggggcc

SEQ ID NO: 211854 - DNA, 20 bp, P. troglodytes
atcgcaccactgcactccaa

SEQ ID NO: 211855 - DNA, 17 bp, P. troglodytes
atcgcaccactgcactt

SEQ ID NO: 211856 - DNA, 16 bp, P. troglodytes
atcgccacaccgtctt

SEQ ID NO: 211857 - DNA, 16 bp, P. troglodytes
atcgcctgagcccggg

SEQ ID NO: 211858 - DNA, 25 bp, P. troglodytes
atcgcgccactgcactccagcctga

SEQ ID NO: 211859 - DNA, 16 bp, P. troglodytes
atcgcttcagcctggg

SEQ ID NO: 211860 - DNA, 18 bp, P. troglodytes
atcgcttgaacccaggaa

SEQ ID NO: 211861 - DNA, 16 bp, P. troglodytes
atcgcttgagcccatg

SEQ ID NO: 211862 - DNA, 16 bp, P. troglodytes
atcgcttgagccccgg

SEQ ID NO: 211863 - DNA, 17 bp, P. troglodytes
atcgcttgagcctagga

SEQ ID NO: 211864 - DNA, 16 bp, P. troglodytes
atcgcttgagcctggt

SEQ ID NO: 211865 - DNA, 16 bp, P. troglodytes
atcggccaggcacagt

SEQ ID NO: 211866 - DNA, 17 bp, P. troglodytes
atcggcctgcctcggcc

SEQ ID NO: 211867 - DNA, 16 bp, P. troglodytes
atcgggcagcccccag

SEQ ID NO: 211868 - DNA, 16 bp, P. troglodytes
atcgtgaccatcctgg

SEQ ID NO: 211869 - DNA, 16 bp, P. troglodytes
atcgtgaggcctcccc

SEQ ID NO: 211870 - DNA, 16 bp, P. troglodytes
atcgtgccactgcaca

SEQ ID NO: 211871 - DNA, 20 bp, P. troglodytes
atcgtgccactggactccag

SEQ ID NO: 211872 - DNA, 16 bp, P. troglodytes
atcgtgccactgtact

SEQ ID NO: 211873 - DNA, 16 bp, P. troglodytes
atcgtggtgcacacct

SEQ ID NO: 211874 - DNA, 16 bp, P. troglodytes
atcgtggttcactgca

SEQ ID NO: 211875 - DNA, 16 bp, P. troglodytes
atctaaaataaaggtt

SEQ ID NO: 211876 - DNA, 16 bp, P. troglodytes
atctaaaattgacaca

SEQ ID NO: 211877 - DNA, 16 bp, P. troglodytes
atctaaacacagaaaa

SEQ ID NO: 211878 - DNA, 16 bp, P. troglodytes
atctaaacatagaaaa

SEQ ID NO: 211879 - DNA, 16 bp, P. troglodytes
atctaagcaaaaagaa

SEQ ID NO: 211880 - DNA, 16 bp, P. troglodytes
atctaataaagttgaa

SEQ ID NO: 211881 - DNA, 16 bp, P. troglodytes
atctaataaatgaatt

SEQ ID NO: 211882 - DNA, 16 bp, P. troglodytes
atctaataagggactt

SEQ ID NO: 211883 - DNA, 16 bp, P. troglodytes
atctaatcagctgcca

SEQ ID NO: 211884 - DNA, 16 bp, P. troglodytes
atctaatcttcaacaa

SEQ ID NO: 211885 - DNA, 16 bp, P. troglodytes
atctaatttattggca

SEQ ID NO: 211886 - DNA, 16 bp, P. troglodytes
atctacaaaatacctt

SEQ ID NO: 211887 - DNA, 16 bp, P. troglodytes
atctacaaattcagtg

SEQ ID NO: 211888 - DNA, 17 bp, P. troglodytes
atctacaactgtctgat

SEQ ID NO: 211889 - DNA, 16 bp, P. troglodytes
atctacaagccaagga

SEQ ID NO: 211890 - DNA, 16 bp, P. troglodytes
atctacaggaaaaagt

SEQ ID NO: 211891 - DNA, 16 bp, P. troglodytes
atctacatctgtatct

SEQ ID NO: 211892 - DNA, 16 bp, P. troglodytes
atctacatgtatttta

SEQ ID NO: 211893 - DNA, 16 bp, P. troglodytes
atctacccagaggaaa

SEQ ID NO: 211894 - DNA, 16 bp, P. troglodytes
atctacctgcctcagc

SEQ ID NO: 211895 - DNA, 17 bp, P. troglodytes
atctacctgcctcggcc

SEQ ID NO: 211896 - DNA, 16 bp, P. troglodytes
atctacctgccttggc

SEQ ID NO: 211897 - DNA, 16 bp, P. troglodytes
atctactaaaaataca

SEQ ID NO: 211898 - DNA, 16 bp, P. troglodytes
atctactaaaatacaa

SEQ ID NO: 211899 - DNA, 16 bp, P. troglodytes
atctactatgtgccag

SEQ ID NO: 211900 - DNA, 16 bp, P. troglodytes
atctactctcttagca

SEQ ID NO: 211901 - DNA, 16 bp, P. troglodytes
atctactttaggtatt

SEQ ID NO: 211902 - DNA, 16 bp, P. troglodytes
atctagaactttcata

SEQ ID NO: 211903 - DNA, 16 bp, P. troglodytes
atctagaatttatttt

SEQ ID NO: 211904 - DNA, 16 bp, P. troglodytes
atctagagacattttt

SEQ ID NO: 211905 - DNA, 16 bp, P. troglodytes
atctagcaaggcaggc

SEQ ID NO: 211906 - DNA, 16 bp, P. troglodytes
atctaggagcttttgg

SEQ ID NO: 211907 - DNA, 16 bp, P. troglodytes
atctaggtggaggttt

SEQ ID NO: 211908 - DNA, 16 bp, P. troglodytes
atctaggtttgtgtaa

SEQ ID NO: 211909 - DNA, 16 bp, P. troglodytes
atctagtctactgttg

SEQ ID NO: 211910 - DNA, 16 bp, P. troglodytes
atctagtggggacttg

SEQ ID NO: 211911 - DNA, 16 bp, P. troglodytes
atctagtttcaggaaa

SEQ ID NO: 211912 - DNA, 16 bp, P. troglodytes
atctagtttttaaaat

SEQ ID NO: 211913 - DNA, 16 bp, P. troglodytes
atctataaaaggaaaa

SEQ ID NO: 211914 - DNA, 16 bp, P. troglodytes
atctataaaatagaaa

SEQ ID NO: 211915 - DNA, 16 bp, P. troglodytes
atctataaggaactta

SEQ ID NO: 211916 - DNA, 16 bp, P. troglodytes
atctataatctatcta

SEQ ID NO: 211917 - DNA, 16 bp, P. troglodytes
atctatacattacctt

SEQ ID NO: 211918 - DNA, 16 bp, P. troglodytes
atctatagattcaata

SEQ ID NO: 211919 - DNA, 16 bp, P. troglodytes
atctatatctatagat

SEQ ID NO: 211920 - DNA, 16 bp, P. troglodytes
atctatatctgtatct

SEQ ID NO: 211921 - DNA, 16 bp, P. troglodytes
atctatatgtatatat

SEQ ID NO: 211922 - DNA, 16 bp, P. troglodytes
atctatatgtctgtct

SEQ ID NO: 211923 - DNA, 16 bp, P. troglodytes
atctatatgtgtgtat

SEQ ID NO: 211924 - DNA, 16 bp, P. troglodytes
atctatcaatctatct

SEQ ID NO: 211925 - DNA, 16 bp, P. troglodytes
atctatccatccttcc

SEQ ID NO: 211926 - DNA, 16 bp, P. troglodytes
atctatccatctctct

SEQ ID NO: 211927 - DNA, 16 bp, P. troglodytes
atctatgacaaagcca

SEQ ID NO: 211928 - DNA, 16 bp, P. troglodytes
atctatgcagcaaacc

SEQ ID NO: 211929 - DNA, 16 bp, P. troglodytes
atctatggaaataaaa

SEQ ID NO: 211930 - DNA, 16 bp, P. troglodytes
atctatgtaaccaaaa

SEQ ID NO: 211931 - DNA, 16 bp, P. troglodytes
atctatgtacatatat

SEQ ID NO: 211932 - DNA, 16 bp, P. troglodytes
atctatgtatgtatgt

SEQ ID NO: 211933 - DNA, 16 bp, P. troglodytes
atctatgtatttattt

SEQ ID NO: 211934 - DNA, 16 bp, P. troglodytes
atctattctgttccat

SEQ ID NO: 211935 - DNA, 16 bp, P. troglodytes
atctattgagcaccta

SEQ ID NO: 211936 - DNA, 16 bp, P. troglodytes
atctatttggggatct

SEQ ID NO: 211937 - DNA, 16 bp, P. troglodytes
atctatttgtctgtct

SEQ ID NO: 211938 - DNA, 16 bp, P. troglodytes
atctatttgtctgttc

SEQ ID NO: 211939 - DNA, 16 bp, P. troglodytes
atctattttgtcttat

SEQ ID NO: 211940 - DNA, 16 bp, P. troglodytes
atctcaaaaaaaagga

SEQ ID NO: 211941 - DNA, 16 bp, P. troglodytes
atctcaaaaacataat

SEQ ID NO: 211942 - DNA, 16 bp, P. troglodytes
atctcaaaagaaaaga

SEQ ID NO: 211943 - DNA, 16 bp, P. troglodytes
atctcaaaataattac

SEQ ID NO: 211944 - DNA, 16 bp, P. troglodytes
atctcaaaataattgt

SEQ ID NO: 211945 - DNA, 16 bp, P. troglodytes
atctcaaactcctgat

SEQ ID NO: 211946 - DNA, 16 bp, P. troglodytes
atctcaaagaaagaaa

SEQ ID NO: 211947 - DNA, 16 bp, P. troglodytes
atctcaaagagaaaaa

SEQ ID NO: 211948 - DNA, 16 bp, P. troglodytes
atctcaagaaaaaaag

SEQ ID NO: 211949 - DNA, 16 bp, P. troglodytes
atctcaagaaaaaata

SEQ ID NO: 211950 - DNA, 16 bp, P. troglodytes
atctcaagaaaaataa

SEQ ID NO: 211951 - DNA, 16 bp, P. troglodytes
atctcaagaagaaaaa

SEQ ID NO: 211952 - DNA, 16 bp, P. troglodytes
atctcaaggaactaga

SEQ ID NO: 211953 - DNA, 16 bp, P. troglodytes
atctcaataaaacttt

SEQ ID NO: 211954 - DNA, 20 bp, P. troglodytes
atctcaatagatgcagaaaa

SEQ ID NO: 211955 - DNA, 16 bp, P. troglodytes
atctcacagaattgaa

SEQ ID NO: 211956 - DNA, 16 bp, P. troglodytes
atctcacagatgagga

SEQ ID NO: 211957 - DNA, 16 bp, P. troglodytes
atctcacatggtggga

SEQ ID NO: 211958 - DNA, 16 bp, P. troglodytes
atctcaccttactgca

SEQ ID NO: 211959 - DNA, 16 bp, P. troglodytes
atctcactatgttgcc

SEQ ID NO: 211960 - DNA, 17 bp, P. troglodytes
atctcactccattgccc

SEQ ID NO: 211961 - DNA, 16 bp, P. troglodytes
atctcactctgtcgcc

SEQ ID NO: 211962 - DNA, 16 bp, P. troglodytes
atctcactgtggtctt

SEQ ID NO: 211963 - DNA, 16 bp, P. troglodytes
atctcacttaaatgtg

SEQ ID NO: 211964 - DNA, 16 bp, P. troglodytes
atctcacttaattctc

SEQ ID NO: 211965 - DNA, 16 bp, P. troglodytes
atctcagaaaccacca

SEQ ID NO: 211966 - DNA, 16 bp, P. troglodytes
atctcagaaataaaaa

SEQ ID NO: 211967 - DNA, 16 bp, P. troglodytes
atctcagaacttaaaa

SEQ ID NO: 211968 - DNA, 16 bp, P. troglodytes
atctcagactactgtg

SEQ ID NO: 211969 - DNA, 16 bp, P. troglodytes
atctcagagtttgaag

SEQ ID NO: 211970 - DNA, 16 bp, P. troglodytes
atctcagatcactgca

SEQ ID NO: 211971 - DNA, 16 bp, P. troglodytes
atctcagcaagaggaa

SEQ ID NO: 211972 - DNA, 16 bp, P. troglodytes
atctcagcccaccgca

SEQ ID NO: 211973 - DNA, 16 bp, P. troglodytes
atctcagcccactgca

SEQ ID NO: 211974 - DNA, 16 bp, P. troglodytes
atctcagctcaccaca

SEQ ID NO: 211975 - DNA, 16 bp, P. troglodytes
atctcagctcaccgca

SEQ ID NO: 211976 - DNA, 16 bp, P. troglodytes
atctcagctcactaca

SEQ ID NO: 211977 - DNA, 16 bp, P. troglodytes
atctcagctcactgaa

SEQ ID NO: 211978 - DNA, 16 bp, P. troglodytes
atctcagctcactgca

SEQ ID NO: 211979 - DNA, 16 bp, P. troglodytes
atctcagctcactgcc

SEQ ID NO: 211980 - DNA, 18 bp, P. troglodytes
atctcagctcactgccac

SEQ ID NO: 211981 - DNA, 16 bp, P. troglodytes
atctcagctcactgga

SEQ ID NO: 211982 - DNA, 16 bp, P. troglodytes
atctcagctcagtgca

SEQ ID NO: 211983 - DNA, 16 bp, P. troglodytes
atctcagctcattgca

SEQ ID NO: 211984 - DNA, 16 bp, P. troglodytes
atctcagctcgctgca

SEQ ID NO: 211985 - DNA, 16 bp, P. troglodytes
atctcagcttactgca

SEQ ID NO: 211986 - DNA, 16 bp, P. troglodytes
atctcaggtcactgca

SEQ ID NO: 211987 - DNA, 16 bp, P. troglodytes
atctcagttcactgca

SEQ ID NO: 211988 - DNA, 16 bp, P. troglodytes
atctcagttcagtgca

SEQ ID NO: 211989 - DNA, 16 bp, P. troglodytes
atctcagttttttaaa

SEQ ID NO: 211990 - DNA, 16 bp, P. troglodytes
atctcataggattgtt

SEQ ID NO: 211991 - DNA, 16 bp, P. troglodytes
atctcatagggttgtt

SEQ ID NO: 211992 - DNA, 16 bp, P. troglodytes
atctcatataagtgga

SEQ ID NO: 211993 - DNA, 16 bp, P. troglodytes
atctcatctaatcctc

SEQ ID NO: 211994 - DNA, 16 bp, P. troglodytes
atctcatctgaaaaat

SEQ ID NO: 211995 - DNA, 16 bp, P. troglodytes
atctcatgtcatcaca

SEQ ID NO: 211996 - DNA, 16 bp, P. troglodytes
atctcatgtgacttat

SEQ ID NO: 211997 - DNA, 16 bp, P. troglodytes
atctcattggccagaa

SEQ ID NO: 211998 - DNA, 16 bp, P. troglodytes
atctcattgtgatttt

SEQ ID NO: 211999 - DNA, 16 bp, P. troglodytes
atctcatttaatcctc

SEQ ID NO: 212000 - DNA, 16 bp, P. troglodytes
atctccaaatacagtc

SEQ ID NO: 212001 - DNA, 16 bp, P. troglodytes
atctccaagcctcagt

SEQ ID NO: 212002 - DNA, 16 bp, P. troglodytes
atctccacaaaaaaat

SEQ ID NO: 212003 - DNA, 21 bp, P. troglodytes
atctccactcactgcaagctc

SEQ ID NO: 212004 - DNA, 16 bp, P. troglodytes
atctccagaacatttt

SEQ ID NO: 212005 - DNA, 16 bp, P. troglodytes
atctccagaacttttt

SEQ ID NO: 212006 - DNA, 16 bp, P. troglodytes
atctccaggaaaaaaa

SEQ ID NO: 212007 - DNA, 16 bp, P. troglodytes
atctccatcagagacc

SEQ ID NO: 212008 - DNA, 16 bp, P. troglodytes
atctccattttataaa

SEQ ID NO: 212009 - DNA, 16 bp, P. troglodytes
atctcccaacctcagg

SEQ ID NO: 212010 - DNA, 16 bp, P. troglodytes
atctcccaccagttcc

SEQ ID NO: 212011 - DNA, 16 bp, P. troglodytes
atctcccacctggtcc

SEQ ID NO: 212012 - DNA, 16 bp, P. troglodytes
atctcccagaattccc

SEQ ID NO: 212013 - DNA, 16 bp, P. troglodytes
atctcccaggctcaag

SEQ ID NO: 212014 - DNA, 16 bp, P. troglodytes
atctcccctgcccaga

SEQ ID NO: 212015 - DNA, 16 bp, P. troglodytes
atctccgctcactgca

SEQ ID NO: 212016 - DNA, 16 bp, P. troglodytes
atctcctctggcaaca

SEQ ID NO: 212017 - DNA, 16 bp, P. troglodytes
atctcctctttttata

SEQ ID NO: 212018 - DNA, 16 bp, P. troglodytes
atctcctgaacctggg

SEQ ID NO: 212019 - DNA, 16 bp, P. troglodytes
atctcctgaccacgtg

SEQ ID NO: 212020 - DNA, 17 bp, P. troglodytes
atctcctgacctcatga

SEQ ID NO: 212021 - DNA, 17 bp, P. troglodytes
atctcctgacctcatgg

SEQ ID NO: 212022 - DNA, 17 bp, P. troglodytes
atctcctgaccttgtga

SEQ ID NO: 212023 - DNA, 19 bp, P. troglodytes
atctcctgacgtcgtgatc

SEQ ID NO: 212024 - DNA, 16 bp, P. troglodytes
atctcctgagaactcc

SEQ ID NO: 212025 - DNA, 16 bp, P. troglodytes
atctcctgcctcagcc

SEQ ID NO: 212026 - DNA, 16 bp, P. troglodytes
atctcctggcctcaag

SEQ ID NO: 212027 - DNA, 16 bp, P. troglodytes
atctcctggccttgtg

SEQ ID NO: 212028 - DNA, 16 bp, P. troglodytes
atctcctgggatcaag

SEQ ID NO: 212029 - DNA, 16 bp, P. troglodytes
atctcctgggctcaag

SEQ ID NO: 212030 - DNA, 16 bp, P. troglodytes
atctcctggtctgctg

SEQ ID NO: 212031 - DNA, 16 bp, P. troglodytes
atctcctgtttctttt

SEQ ID NO: 212032 - DNA, 16 bp, P. troglodytes
atctcctttgactcca

SEQ ID NO: 212033 - DNA, 16 bp, P. troglodytes
atctcgacctcccaaa

SEQ ID NO: 212034 - DNA, 16 bp, P. troglodytes
atctcgccctgtcacc

SEQ ID NO: 212035 - DNA, 16 bp, P. troglodytes
atctcgctctgttgcc

SEQ ID NO: 212036 - DNA, 16 bp, P. troglodytes
atctcggctcacagca

SEQ ID NO: 212037 - DNA, 17 bp, P. troglodytes
atctcggctcaccgcaa

SEQ ID NO: 212038 - DNA, 16 bp, P. troglodytes
atctcggctcactaca

SEQ ID NO: 212039 - DNA, 16 bp, P. troglodytes
atctcggctcactgct

SEQ ID NO: 212040 - DNA, 16 bp, P. troglodytes
atctcggctccctgca

SEQ ID NO: 212041 - DNA, 16 bp, P. troglodytes
atctcggctcgctgca

SEQ ID NO: 212042 - DNA, 16 bp, P. troglodytes
atctcggcttactgca

SEQ ID NO: 212043 - DNA, 19 bp, P. troglodytes
atctcggcttactgcaagc

SEQ ID NO: 212044 - DNA, 16 bp, P. troglodytes
atctcgggtcactgca

SEQ ID NO: 212045 - DNA, 16 bp, P. troglodytes
atctcggttcactgca

SEQ ID NO: 212046 - DNA, 16 bp, P. troglodytes
atctctaaaaaagaaa

SEQ ID NO: 212047 - DNA, 16 bp, P. troglodytes
atctctaatgaaaata

SEQ ID NO: 212048 - DNA, 16 bp, P. troglodytes
atctctaatgaacata

SEQ ID NO: 212049 - DNA, 16 bp, P. troglodytes
atctctaatttttaaa

SEQ ID NO: 212050 - DNA, 17 bp, P. troglodytes
atctctacaaaaaaatt

SEQ ID NO: 212051 - DNA, 16 bp, P. troglodytes
atctctacaaaaaatt

SEQ ID NO: 212052 - DNA, 16 bp, P. troglodytes
atctctacaacaagaa

SEQ ID NO: 212053 - DNA, 17 bp, P. troglodytes
atctctaccaaaaatag

SEQ ID NO: 212054 - DNA, 17 bp, P. troglodytes
atctctaccaaaaatat

SEQ ID NO: 212055 - DNA, 16 bp, P. troglodytes
atctctactaaaaatt

SEQ ID NO: 212056 - DNA, 16 bp, P. troglodytes
atctctagattactta

SEQ ID NO: 212057 - DNA, 16 bp, P. troglodytes
atctctagattgctta

SEQ ID NO: 212058 - DNA, 16 bp, P. troglodytes
atctctatttaaaaaa

SEQ ID NO: 212059 - DNA, 16 bp, P. troglodytes
atctctcaaaactaca

SEQ ID NO: 212060 - DNA, 16 bp, P. troglodytes
atctctccaaaaataa

SEQ ID NO: 212061 - DNA, 23 bp, P. troglodytes
atctctcccactctaggttccca

SEQ ID NO: 212062 - DNA, 16 bp, P. troglodytes
atctctcctgctttct

SEQ ID NO: 212063 - DNA, 16 bp, P. troglodytes
atctctctaaaataat

SEQ ID NO: 212064 - DNA, 16 bp, P. troglodytes
atctctctcatgttca

SEQ ID NO: 212065 - DNA, 16 bp, P. troglodytes
atctctctctctctat

SEQ ID NO: 212066 - DNA, 16 bp, P. troglodytes
atctctctgaatctca

SEQ ID NO: 212067 - DNA, 16 bp, P. troglodytes
atctctctgacctcat

SEQ ID NO: 212068 - DNA, 16 bp, P. troglodytes
atctctctttaaaaaa

SEQ ID NO: 212069 - DNA, 16 bp, P. troglodytes
atctctctttgcagat

SEQ ID NO: 212070 - DNA, 16 bp, P. troglodytes
atctctgaattttttt

SEQ ID NO: 212071 - DNA, 16 bp, P. troglodytes
atctctgagatgcagc

SEQ ID NO: 212072 - DNA, 16 bp, P. troglodytes
atctctgcaaggagaa

SEQ ID NO: 212073 - DNA, 16 bp, P. troglodytes
atctctgccccctggg

SEQ ID NO: 212074 - DNA, 16 bp, P. troglodytes
atctctgcccctgtgg

SEQ ID NO: 212075 - DNA, 16 bp, P. troglodytes
atctctgcctcctgga

SEQ ID NO: 212076 - DNA, 16 bp, P. troglodytes
atctctgccttcatct

SEQ ID NO: 212077 - DNA, 16 bp, P. troglodytes
atctctgctcaccaca

SEQ ID NO: 212078 - DNA, 17 bp, P. troglodytes
atctctgctcaccgcaa

SEQ ID NO: 212079 - DNA, 16 bp, P. troglodytes
atctctgctcactgca

SEQ ID NO: 212080 - DNA, 16 bp, P. troglodytes
atctctgggtgctggg

SEQ ID NO: 212081 - DNA, 16 bp, P. troglodytes
atctctgtcaggtttt

SEQ ID NO: 212082 - DNA, 16 bp, P. troglodytes
atctctgtgacacagc

SEQ ID NO: 212083 - DNA, 16 bp, P. troglodytes
atctctgttcactgca

SEQ ID NO: 212084 - DNA, 16 bp, P. troglodytes
atctctgttctgttcc

SEQ ID NO: 212085 - DNA, 16 bp, P. troglodytes
atctctgtttcttcag

SEQ ID NO: 212086 - DNA, 16 bp, P. troglodytes
atctcttaaaaataat

SEQ ID NO: 212087 - DNA, 16 bp, P. troglodytes
atctcttaacaggttg

SEQ ID NO: 212088 - DNA, 16 bp, P. troglodytes
atctcttccagaaaaa

SEQ ID NO: 212089 - DNA, 16 bp, P. troglodytes
atctcttctgaaaaca

SEQ ID NO: 212090 - DNA, 16 bp, P. troglodytes
atctcttgagcccaag

SEQ ID NO: 212091 - DNA, 16 bp, P. troglodytes
atctcttgaggccaga

SEQ ID NO: 212092 - DNA, 16 bp, P. troglodytes
atctctttaaaaaaat

SEQ ID NO: 212093 - DNA, 16 bp, P. troglodytes
atctctttaatgtctg

SEQ ID NO: 212094 - DNA, 16 bp, P. troglodytes
atctctttattgatat

SEQ ID NO: 212095 - DNA, 16 bp, P. troglodytes
atctcttttctttgta

SEQ ID NO: 212096 - DNA, 16 bp, P. troglodytes
atctctttttaaaaaa

SEQ ID NO: 212097 - DNA, 16 bp, P. troglodytes
atctgaaaaaaaatct

SEQ ID NO: 212098 - DNA, 16 bp, P. troglodytes
atctgaaaaacatctt

SEQ ID NO: 212099 - DNA, 16 bp, P. troglodytes
atctgaaaaatgagaa

SEQ ID NO: 212100 - DNA, 16 bp, P. troglodytes
atctgaaacaaacaaa

SEQ ID NO: 212101 - DNA, 16 bp, P. troglodytes
atctgaaagacaaaac

SEQ ID NO: 212102 - DNA, 16 bp, P. troglodytes
atctgaaataaaaata

SEQ ID NO: 212103 - DNA, 16 bp, P. troglodytes
atctgaaattttaaaa

SEQ ID NO: 212104 - DNA, 16 bp, P. troglodytes
atctgaaatttttttt

SEQ ID NO: 212105 - DNA, 16 bp, P. troglodytes
atctgaagattatgtg

SEQ ID NO: 212106 - DNA, 16 bp, P. troglodytes
atctgaaggaaaaaaa

SEQ ID NO: 212107 - DNA, 16 bp, P. troglodytes
atctgaatacatattt

SEQ ID NO: 212108 - DNA, 16 bp, P. troglodytes
atctgaatttttaaaa

SEQ ID NO: 212109 - DNA, 16 bp, P. troglodytes
atctgacaaagatcta

SEQ ID NO: 212110 - DNA, 16 bp, P. troglodytes
atctgacaaaggactc

SEQ ID NO: 212111 - DNA, 32 bp, P. troglodytes
atctgacaaagggctaatatccagaatctaca

SEQ ID NO: 212112 - DNA, 16 bp, P. troglodytes
atctgacaaagtacta

SEQ ID NO: 212113 - DNA, 32 bp, P. troglodytes
atctgacatggagagatataatgttactgcta

SEQ ID NO: 212114 - DNA, 17 bp, P. troglodytes
atctgacctcgtgatcc

SEQ ID NO: 212115 - DNA, 16 bp, P. troglodytes
atctgacctttctctc

SEQ ID NO: 212116 - DNA, 16 bp, P. troglodytes
atctgacctttttttt

SEQ ID NO: 212117 - DNA, 16 bp, P. troglodytes
atctgactggtgtcct

SEQ ID NO: 212118 - DNA, 16 bp, P. troglodytes
atctgagatcatgcca

SEQ ID NO: 212119 - DNA, 17 bp, P. troglodytes
atctgagcactttggga

SEQ ID NO: 212120 - DNA, 16 bp, P. troglodytes
atctgaggtggaagag

SEQ ID NO: 212121 - DNA, 16 bp, P. troglodytes
atctgaggtggagctg

SEQ ID NO: 212122 - DNA, 16 bp, P. troglodytes
atctgatctgtgacaa

SEQ ID NO: 212123 - DNA, 22 bp, P. troglodytes
atctgatctttgacaaacctga

SEQ ID NO: 212124 - DNA, 16 bp, P. troglodytes
atctgattgtggtttt

SEQ ID NO: 212125 - DNA, 16 bp, P. troglodytes
atctgatttatatttt

SEQ ID NO: 212126 - DNA, 16 bp, P. troglodytes
atctgatttttaaatg

SEQ ID NO: 212127 - DNA, 16 bp, P. troglodytes
atctgcaaaatggaga

SEQ ID NO: 212128 - DNA, 16 bp, P. troglodytes
atctgcaaaatgggat

SEQ ID NO: 212129 - DNA, 16 bp, P. troglodytes
atctgcaaaatgggga

SEQ ID NO: 212130 - DNA, 16 bp, P. troglodytes
atctgcaaaggccctt

SEQ ID NO: 212131 - DNA, 16 bp, P. troglodytes
atctgcaaagtgcaat

SEQ ID NO: 212132 - DNA, 16 bp, P. troglodytes
atctgcaagaaaaaaa

SEQ ID NO: 212133 - DNA, 16 bp, P. troglodytes
atctgcactgccatgt

SEQ ID NO: 212134 - DNA, 16 bp, P. troglodytes
atctgcagaggtttct

SEQ ID NO: 212135 - DNA, 16 bp, P. troglodytes
atctgcagcttttcca

SEQ ID NO: 212136 - DNA, 16 bp, P. troglodytes
atctgcatcttaacaa

SEQ ID NO: 212137 - DNA, 16 bp, P. troglodytes
atctgcatttctaaca

SEQ ID NO: 212138 - DNA, 16 bp, P. troglodytes
atctgcattttagaaa

SEQ ID NO: 212139 - DNA, 18 bp, P. troglodytes
atctgccagcctcagcct

SEQ ID NO: 212140 - DNA, 16 bp, P. troglodytes
atctgccatgatcaag

SEQ ID NO: 212141 - DNA, 16 bp, P. troglodytes
atctgcccaaggtcac

SEQ ID NO: 212142 - DNA, 16 bp, P. troglodytes
atctgcccacctcacc

SEQ ID NO: 212143 - DNA, 17 bp, P. troglodytes
atctgcccacctcggcc

SEQ ID NO: 212144 - DNA, 17 bp, P. troglodytes
atctgcccaccttggct

SEQ ID NO: 212145 - DNA, 16 bp, P. troglodytes
atctgcccccatgacc

SEQ ID NO: 212146 - DNA, 17 bp, P. troglodytes
atctgcccgcctcagcc

SEQ ID NO: 212147 - DNA, 16 bp, P. troglodytes
atctgccctcaatgtg

SEQ ID NO: 212148 - DNA, 16 bp, P. troglodytes
atctgccggccttggc

SEQ ID NO: 212149 - DNA, 17 bp, P. troglodytes
atctgcctaccttggcc

SEQ ID NO: 212150 - DNA, 16 bp, P. troglodytes
atctgcctgccccagc

SEQ ID NO: 212151 - DNA, 16 bp, P. troglodytes
atctgcctgcctcagc

SEQ ID NO: 212152 - DNA, 18 bp, P. troglodytes
atctgcctgccttagcct

SEQ ID NO: 212153 - DNA, 16 bp, P. troglodytes
atctgcctgcgtcagc

SEQ ID NO: 212154 - DNA, 16 bp, P. troglodytes
atctgcctgggcatgg

SEQ ID NO: 212155 - DNA, 16 bp, P. troglodytes
atctgctatacaacat

SEQ ID NO: 212156 - DNA, 16 bp, P. troglodytes
atctgctcacctcagc

SEQ ID NO: 212157 - DNA, 16 bp, P. troglodytes
atctgctctcctcagc

SEQ ID NO: 212158 - DNA, 16 bp, P. troglodytes
atctgctgagagctac

SEQ ID NO: 212159 - DNA, 16 bp, P. troglodytes
atctgctggagccttg

SEQ ID NO: 212160 - DNA, 16 bp, P. troglodytes
atctgctggcctcggc

SEQ ID NO: 212161 - DNA, 16 bp, P. troglodytes
atctgcttcagcctcc

SEQ ID NO: 212162 - DNA, 16 bp, P. troglodytes
atctgcttccctgact

SEQ ID NO: 212163 - DNA, 16 bp, P. troglodytes
atctgctttattcaaa

SEQ ID NO: 212164 - DNA, 16 bp, P. troglodytes
atctgctttctgcctc

SEQ ID NO: 212165 - DNA, 16 bp, P. troglodytes
atctgctttctgtctc

SEQ ID NO: 212166 - DNA, 16 bp, P. troglodytes
atctggatttgaattc

SEQ ID NO: 212167 - DNA, 16 bp, P. troglodytes
atctggccactgggcc

SEQ ID NO: 212168 - DNA, 16 bp, P. troglodytes
atctggcccaaaatgt

SEQ ID NO: 212169 - DNA, 16 bp, P. troglodytes
atctggccctacccac

SEQ ID NO: 212170 - DNA, 16 bp, P. troglodytes
atctggccctggactt

SEQ ID NO: 212171 - DNA, 16 bp, P. troglodytes
atctggccctttgcag

SEQ ID NO: 212172 - DNA, 16 bp, P. troglodytes
atctgggaaagtcttt

SEQ ID NO: 212173 - DNA, 16 bp, P. troglodytes
atctgggactacaagc

SEQ ID NO: 212174 - DNA, 16 bp, P. troglodytes
atctgggaggcagaga

SEQ ID NO: 212175 - DNA, 16 bp, P. troglodytes
atctgggaggtggaag

SEQ ID NO: 212176 - DNA, 16 bp, P. troglodytes
atctgggaggtggagg

SEQ ID NO: 212177 - DNA, 17 bp, P. troglodytes
atctgggattacaggca

SEQ ID NO: 212178 - DNA, 16 bp, P. troglodytes
atctgggcatgctcag

SEQ ID NO: 212179 - DNA, 16 bp, P. troglodytes
atctgggcatggtggc

SEQ ID NO: 212180 - DNA, 16 bp, P. troglodytes
atctgggctgccccag

SEQ ID NO: 212181 - DNA, 16 bp, P. troglodytes
atctggggaaaaaaaa

SEQ ID NO: 212182 - DNA, 16 bp, P. troglodytes
atctgggtgacagagc

SEQ ID NO: 212183 - DNA, 16 bp, P. troglodytes
atctggtagaagaaat

SEQ ID NO: 212184 - DNA, 16 bp, P. troglodytes
atctggttatttaaaa

SEQ ID NO: 212185 - DNA, 16 bp, P. troglodytes
atctggttgtttaaaa

SEQ ID NO: 212186 - DNA, 16 bp, P. troglodytes
atctggtttggctgtg

SEQ ID NO: 212187 - DNA, 16 bp, P. troglodytes
atctgtaaaaggaaaa

SEQ ID NO: 212188 - DNA, 16 bp, P. troglodytes
atctgtaaaatacaga

SEQ ID NO: 212189 - DNA, 16 bp, P. troglodytes
atctgtaaaatgaagg

SEQ ID NO: 212190 - DNA, 16 bp, P. troglodytes
atctgtaaaatgagaa

SEQ ID NO: 212191 - DNA, 16 bp, P. troglodytes
atctgtaaaatgggga

SEQ ID NO: 212192 - DNA, 16 bp, P. troglodytes
atctgtaaattatttt

SEQ ID NO: 212193 - DNA, 16 bp, P. troglodytes
atctgtaattttcttt

SEQ ID NO: 212194 - DNA, 16 bp, P. troglodytes
atctgtacaacaaacc

SEQ ID NO: 212195 - DNA, 16 bp, P. troglodytes
atctgtacaagaaacc

SEQ ID NO: 212196 - DNA, 16 bp, P. troglodytes
atctgtacaatggaat

SEQ ID NO: 212197 - DNA, 16 bp, P. troglodytes
atctgtactaagaaaa

SEQ ID NO: 212198 - DNA, 16 bp, P. troglodytes
atctgtatatcaccat

SEQ ID NO: 212199 - DNA, 16 bp, P. troglodytes
atctgtatattgcttt

SEQ ID NO: 212200 - DNA, 16 bp, P. troglodytes
atctgtatctgtatct

SEQ ID NO: 212201 - DNA, 16 bp, P. troglodytes
atctgtcaatgaacat

SEQ ID NO: 212202 - DNA, 16 bp, P. troglodytes
atctgtccacctcggc

SEQ ID NO: 212203 - DNA, 16 bp, P. troglodytes
atctgtctcctccact

SEQ ID NO: 212204 - DNA, 16 bp, P. troglodytes
atctgtctgatattga

SEQ ID NO: 212205 - DNA, 18 bp, P. troglodytes
atctgtctgcctcggcct

SEQ ID NO: 212206 - DNA, 16 bp, P. troglodytes
atctgtctttttgatt

SEQ ID NO: 212207 - DNA, 16 bp, P. troglodytes
atctgtgaaacaggaa

SEQ ID NO: 212208 - DNA, 16 bp, P. troglodytes
atctgtgaaatgggag

SEQ ID NO: 212209 - DNA, 16 bp, P. troglodytes
atctgtgaataatgag

SEQ ID NO: 212210 - DNA, 16 bp, P. troglodytes
atctgtgaattcaacc

SEQ ID NO: 212211 - DNA, 16 bp, P. troglodytes
atctgtgcagcaaaca

SEQ ID NO: 212212 - DNA, 16 bp, P. troglodytes
atctgtgtccccatcc

SEQ ID NO: 212213 - DNA, 16 bp, P. troglodytes
atctgtgtcctcaccc

SEQ ID NO: 212214 - DNA, 16 bp, P. troglodytes
atctgtgtgtgcgtgt

SEQ ID NO: 212215 - DNA, 16 bp, P. troglodytes
atctgtgtgtgtatgt

SEQ ID NO: 212216 - DNA, 16 bp, P. troglodytes
atctgtgtgtttgtgt

SEQ ID NO: 212217 - DNA, 16 bp, P. troglodytes
atctgtgttttttaaa

SEQ ID NO: 212218 - DNA, 16 bp, P. troglodytes
atctgttactttttga

SEQ ID NO: 212219 - DNA, 16 bp, P. troglodytes
atctgttcagatattt

SEQ ID NO: 212220 - DNA, 16 bp, P. troglodytes
atctgttgatggacac

SEQ ID NO: 212221 - DNA, 16 bp, P. troglodytes
atctgttggaagaaat

SEQ ID NO: 212222 - DNA, 16 bp, P. troglodytes
atctgttgtttcctaa

SEQ ID NO: 212223 - DNA, 16 bp, P. troglodytes
atctgttgtttcttaa

SEQ ID NO: 212224 - DNA, 16 bp, P. troglodytes
atctgtttactctgct

SEQ ID NO: 212225 - DNA, 16 bp, P. troglodytes
atctgtttatccattc

SEQ ID NO: 212226 - DNA, 16 bp, P. troglodytes
atctgtttctttgcct

SEQ ID NO: 212227 - DNA, 16 bp, P. troglodytes
atcttaaagaactaga

SEQ ID NO: 212228 - DNA, 16 bp, P. troglodytes
atcttaaatttcatat

SEQ ID NO: 212229 - DNA, 16 bp, P. troglodytes
atcttaagtgttctta

SEQ ID NO: 212230 - DNA, 16 bp, P. troglodytes
atcttaagttttacaa

SEQ ID NO: 212231 - DNA, 17 bp, P. troglodytes
atcttacagctagacct

SEQ ID NO: 212232 - DNA, 16 bp, P. troglodytes
atcttacataaccata

SEQ ID NO: 212233 - DNA, 16 bp, P. troglodytes
atcttacatggcaaca

SEQ ID NO: 212234 - DNA, 16 bp, P. troglodytes
atcttataaaaagaaa

SEQ ID NO: 212235 - DNA, 16 bp, P. troglodytes
atcttatgggaccact

SEQ ID NO: 212236 - DNA, 16 bp, P. troglodytes
atcttatttggaaatg

SEQ ID NO: 212237 - DNA, 16 bp, P. troglodytes
atcttcaaaatatttt

SEQ ID NO: 212238 - DNA, 16 bp, P. troglodytes
atcttcacagcaaccc

SEQ ID NO: 212239 - DNA, 16 bp, P. troglodytes
atcttcattatgaaat

SEQ ID NO: 212240 - DNA, 16 bp, P. troglodytes
atcttcattatttcct

SEQ ID NO: 212241 - DNA, 16 bp, P. troglodytes
atcttcattttacagg

SEQ ID NO: 212242 - DNA, 16 bp, P. troglodytes
atcttcatttttaaaa

SEQ ID NO: 212243 - DNA, 16 bp, P. troglodytes
atcttccagagttttt

SEQ ID NO: 212244 - DNA, 16 bp, P. troglodytes
atcttccagcctcagc

SEQ ID NO: 212245 - DNA, 16 bp, P. troglodytes
atcttccagccttggc

SEQ ID NO: 212246 - DNA, 16 bp, P. troglodytes
atcttcccactgcact

SEQ ID NO: 212247 - DNA, 16 bp, P. troglodytes
atcttcccactttggc

SEQ ID NO: 212248 - DNA, 16 bp, P. troglodytes
atcttcctaaaatgca

SEQ ID NO: 212249 - DNA, 16 bp, P. troglodytes
atcttcctgatgaatt

SEQ ID NO: 212250 - DNA, 16 bp, P. troglodytes
atcttcctgccttggc

SEQ ID NO: 212251 - DNA, 16 bp, P. troglodytes
atcttcctttctctga

SEQ ID NO: 212252 - DNA, 16 bp, P. troglodytes
atcttctcccactctg

SEQ ID NO: 212253 - DNA, 16 bp, P. troglodytes
atcttctcctgccttt

SEQ ID NO: 212254 - DNA, 16 bp, P. troglodytes
atcttctgatttttca

SEQ ID NO: 212255 - DNA, 16 bp, P. troglodytes
atcttctggaattttt

SEQ ID NO: 212256 - DNA, 16 bp, P. troglodytes
atcttctttgatgaga

SEQ ID NO: 212257 - DNA, 16 bp, P. troglodytes
atcttgaaaaagaaaa

SEQ ID NO: 212258 - DNA, 16 bp, P. troglodytes
atcttgaaaaataaaa

SEQ ID NO: 212259 - DNA, 16 bp, P. troglodytes
atcttgaaaaggaaaa

SEQ ID NO: 212260 - DNA, 16 bp, P. troglodytes
atcttgaaacaaaagg

SEQ ID NO: 212261 - DNA, 16 bp, P. troglodytes
atcttgaaattctcaa

SEQ ID NO: 212262 - DNA, 16 bp, P. troglodytes
atcttgaagaagaaaa

SEQ ID NO: 212263 - DNA, 16 bp, P. troglodytes
atcttgaaggatgagt

SEQ ID NO: 212264 - DNA, 16 bp, P. troglodytes
atcttgaatttctttg

SEQ ID NO: 212265 - DNA, 16 bp, P. troglodytes
atcttgactcactgca

SEQ ID NO: 212266 - DNA, 16 bp, P. troglodytes
atcttgagttattttt

SEQ ID NO: 212267 - DNA, 16 bp, P. troglodytes
atcttgattattgtga

SEQ ID NO: 212268 - DNA, 16 bp, P. troglodytes
atcttgattgtggtgg

SEQ ID NO: 212269 - DNA, 16 bp, P. troglodytes
atcttgatttttaaaa

SEQ ID NO: 212270 - DNA, 16 bp, P. troglodytes
atcttgcaaatatttt

SEQ ID NO: 212271 - DNA, 16 bp, P. troglodytes
atcttgcataactata

SEQ ID NO: 212272 - DNA, 16 bp, P. troglodytes
atcttgcctcactgca

SEQ ID NO: 212273 - DNA, 16 bp, P. troglodytes
atcttgctactgctca

SEQ ID NO: 212274 - DNA, 16 bp, P. troglodytes
atcttgctgctgctga

SEQ ID NO: 212275 - DNA, 16 bp, P. troglodytes
atcttgcttctaacct

SEQ ID NO: 212276 - DNA, 16 bp, P. troglodytes
atcttggaacagaaaa

SEQ ID NO: 212277 - DNA, 16 bp, P. troglodytes
atcttggagaaattca

SEQ ID NO: 212278 - DNA, 16 bp, P. troglodytes
atcttggctaattgca

SEQ ID NO: 212279 - DNA, 16 bp, P. troglodytes
atcttggctattggga

SEQ ID NO: 212280 - DNA, 16 bp, P. troglodytes
atcttggctattgtga

SEQ ID NO: 212281 - DNA, 16 bp, P. troglodytes
atcttggctcacggca

SEQ ID NO: 212282 - DNA, 16 bp, P. troglodytes
atcttggctcactaca

SEQ ID NO: 212283 - DNA, 16 bp, P. troglodytes
atcttggctcactcca

SEQ ID NO: 212284 - DNA, 16 bp, P. troglodytes
atcttggctcactgga

SEQ ID NO: 212285 - DNA, 16 bp, P. troglodytes
atcttggctcacttca

SEQ ID NO: 212286 - DNA, 16 bp, P. troglodytes
atcttggctctctgca

SEQ ID NO: 212287 - DNA, 16 bp, P. troglodytes
atcttggctgactgca

SEQ ID NO: 212288 - DNA, 16 bp, P. troglodytes
atcttggggggaaaaa

SEQ ID NO: 212289 - DNA, 16 bp, P. troglodytes
atcttgggtatgtctt

SEQ ID NO: 212290 - DNA, 16 bp, P. troglodytes
atcttgggttactgca

SEQ ID NO: 212291 - DNA, 16 bp, P. troglodytes
atcttggtctgtcacc

SEQ ID NO: 212292 - DNA, 16 bp, P. troglodytes
atcttggttatttctt

SEQ ID NO: 212293 - DNA, 16 bp, P. troglodytes
atcttggttgcttcca

SEQ ID NO: 212294 - DNA, 16 bp, P. troglodytes
atcttgtatatatttt

SEQ ID NO: 212295 - DNA, 16 bp, P. troglodytes
atcttgtattttccct

SEQ ID NO: 212296 - DNA, 16 bp, P. troglodytes
atcttgttttatgtcc

SEQ ID NO: 212297 - DNA, 16 bp, P. troglodytes
atctttaaaaaataga

SEQ ID NO: 212298 - DNA, 16 bp, P. troglodytes
atctttaaaaagaaaa

SEQ ID NO: 212299 - DNA, 16 bp, P. troglodytes
atctttaaaaatgaat

SEQ ID NO: 212300 - DNA, 16 bp, P. troglodytes
atctttaaatccacct

SEQ ID NO: 212301 - DNA, 16 bp, P. troglodytes
atctttaaccaggccc

SEQ ID NO: 212302 - DNA, 16 bp, P. troglodytes
atctttaacctccttg

SEQ ID NO: 212303 - DNA, 16 bp, P. troglodytes
atctttacagcagcat

SEQ ID NO: 212304 - DNA, 17 bp, P. troglodytes
atctttactaaaaatat

SEQ ID NO: 212305 - DNA, 16 bp, P. troglodytes
atctttatagcagtgc

SEQ ID NO: 212306 - DNA, 16 bp, P. troglodytes
atctttatctatatct

SEQ ID NO: 212307 - DNA, 16 bp, P. troglodytes
atctttattacttcct

SEQ ID NO: 212308 - DNA, 16 bp, P. troglodytes
atctttcaaaagcaaa

SEQ ID NO: 212309 - DNA, 16 bp, P. troglodytes
atctttcaaaagtgaa

SEQ ID NO: 212310 - DNA, 16 bp, P. troglodytes
atctttcagaaataaa

SEQ ID NO: 212311 - DNA, 16 bp, P. troglodytes
atctttcatgaaagga

SEQ ID NO: 212312 - DNA, 16 bp, P. troglodytes
atctttcccactttct

SEQ ID NO: 212313 - DNA, 16 bp, P. troglodytes
atctttcctgttttct

SEQ ID NO: 212314 - DNA, 16 bp, P. troglodytes
atctttctaaaataca

SEQ ID NO: 212315 - DNA, 16 bp, P. troglodytes
atctttctaaaatgca

SEQ ID NO: 212316 - DNA, 16 bp, P. troglodytes
atctttctgtgcctgg

SEQ ID NO: 212317 - DNA, 16 bp, P. troglodytes
atctttgacagacctg

SEQ ID NO: 212318 - DNA, 16 bp, P. troglodytes
atctttgatgctgatg

SEQ ID NO: 212319 - DNA, 16 bp, P. troglodytes
atctttgccaacattt

SEQ ID NO: 212320 - DNA, 16 bp, P. troglodytes
atctttgccagttcct

SEQ ID NO: 212321 - DNA, 16 bp, P. troglodytes
atctttgcctgtgcct

SEQ ID NO: 212322 - DNA, 16 bp, P. troglodytes
atctttgctaaaaata

SEQ ID NO: 212323 - DNA, 16 bp, P. troglodytes
atctttgctaattttc

SEQ ID NO: 212324 - DNA, 16 bp, P. troglodytes
atctttgctgtttcac

SEQ ID NO: 212325 - DNA, 16 bp, P. troglodytes
atctttgggaaaaaaa

SEQ ID NO: 212326 - DNA, 16 bp, P. troglodytes
atctttgtgacattct

SEQ ID NO: 212327 - DNA, 16 bp, P. troglodytes
atctttgtggctttct

SEQ ID NO: 212328 - DNA, 16 bp, P. troglodytes
atctttgttttaaagt

SEQ ID NO: 212329 - DNA, 16 bp, P. troglodytes
atcttttaaaaaatct

SEQ ID NO: 212330 - DNA, 16 bp, P. troglodytes
atcttttaaatacatt

SEQ ID NO: 212331 - DNA, 16 bp, P. troglodytes
atcttttatatttctg

SEQ ID NO: 212332 - DNA, 16 bp, P. troglodytes
atcttttcaaaataca

SEQ ID NO: 212333 - DNA, 16 bp, P. troglodytes
atcttttcaaaattta

SEQ ID NO: 212334 - DNA, 16 bp, P. troglodytes
atcttttcacgtgctt

SEQ ID NO: 212335 - DNA, 16 bp, P. troglodytes
atcttttcatgtgctt

SEQ ID NO: 212336 - DNA, 16 bp, P. troglodytes
atcttttcttctgctt

SEQ ID NO: 212337 - DNA, 16 bp, P. troglodytes
atcttttgaaataatc

SEQ ID NO: 212338 - DNA, 16 bp, P. troglodytes
atcttttgagacttat

SEQ ID NO: 212339 - DNA, 16 bp, P. troglodytes
atcttttgcctttttg

SEQ ID NO: 212340 - DNA, 16 bp, P. troglodytes
atcttttggctgcata

SEQ ID NO: 212341 - DNA, 16 bp, P. troglodytes
atcttttgtatttcag

SEQ ID NO: 212342 - DNA, 16 bp, P. troglodytes
atcttttgtgtttctg

SEQ ID NO: 212343 - DNA, 16 bp, P. troglodytes
atctttttaaagattt

SEQ ID NO: 212344 - DNA, 16 bp, P. troglodytes
atctttttgaaaatgt

SEQ ID NO: 212345 - DNA, 16 bp, P. troglodytes
atctttttgtgataaa

SEQ ID NO: 212346 - DNA, 16 bp, P. troglodytes
atcttttttgtgtgtg

SEQ ID NO: 212347 - DNA, 16 bp, P. troglodytes
atctttttttttgaga

SEQ ID NO: 212348 - DNA, 16 bp, P. troglodytes
atgaaaaaaagctaat

SEQ ID NO: 212349 - DNA, 16 bp, P. troglodytes
atgaaaaaaatcatta

SEQ ID NO: 212350 - DNA, 16 bp, P. troglodytes
atgaaaaaaatgcatt

SEQ ID NO: 212351 - DNA, 16 bp, P. troglodytes
atgaaaaaacactcaa

SEQ ID NO: 212352 - DNA, 16 bp, P. troglodytes
atgaaaaaagagacat

SEQ ID NO: 212353 - DNA, 16 bp, P. troglodytes
atgaaaaaatactgaa

SEQ ID NO: 212354 - DNA, 16 bp, P. troglodytes
atgaaaaaatgttcaa

SEQ ID NO: 212355 - DNA, 16 bp, P. troglodytes
atgaaaaaattgtttt

SEQ ID NO: 212356 - DNA, 16 bp, P. troglodytes
atgaaaaacaaatttt

SEQ ID NO: 212357 - DNA, 16 bp, P. troglodytes
atgaaaaacagaatgg

SEQ ID NO: 212358 - DNA, 16 bp, P. troglodytes
atgaaaaaccattcaa

SEQ ID NO: 212359 - DNA, 16 bp, P. troglodytes
atgaaaaactacctat

SEQ ID NO: 212360 - DNA, 16 bp, P. troglodytes
atgaaaaactggaaac

SEQ ID NO: 212361 - DNA, 16 bp, P. troglodytes
atgaaaaacttctgga

SEQ ID NO: 212362 - DNA, 16 bp, P. troglodytes
atgaaaaagatactta

SEQ ID NO: 212363 - DNA, 16 bp, P. troglodytes
atgaaaaagcaaagga

SEQ ID NO: 212364 - DNA, 16 bp, P. troglodytes
atgaaaaagcttgaaa

SEQ ID NO: 212365 - DNA, 16 bp, P. troglodytes
atgaaaaagtcctgga

SEQ ID NO: 212366 - DNA, 16 bp, P. troglodytes
atgaaaaagtgctcaa

SEQ ID NO: 212367 - DNA, 16 bp, P. troglodytes
atgaaaaagtgctcat

SEQ ID NO: 212368 - DNA, 16 bp, P. troglodytes
atgaaaaagttctgga

SEQ ID NO: 212369 - DNA, 16 bp, P. troglodytes
atgaaaaagttggaaa

SEQ ID NO: 212370 - DNA, 16 bp, P. troglodytes
atgaaaaataatttct

SEQ ID NO: 212371 - DNA, 16 bp, P. troglodytes
atgaaaaatatgcaaa

SEQ ID NO: 212372 - DNA, 16 bp, P. troglodytes
atgaaaaatgtgtttt

SEQ ID NO: 212373 - DNA, 16 bp, P. troglodytes
atgaaaacaaaattat

SEQ ID NO: 212374 - DNA, 16 bp, P. troglodytes
atgaaaacaaagacat

SEQ ID NO: 212375 - DNA, 16 bp, P. troglodytes
atgaaaacaaatgaga

SEQ ID NO: 212376 - DNA, 16 bp, P. troglodytes
atgaaaacaaatggaa

SEQ ID NO: 212377 - DNA, 16 bp, P. troglodytes
atgaaaacaacatgaa

SEQ ID NO: 212378 - DNA, 16 bp, P. troglodytes
atgaaaacaagctcaa

SEQ ID NO: 212379 - DNA, 16 bp, P. troglodytes
atgaaaacaatgaaat

SEQ ID NO: 212380 - DNA, 16 bp, P. troglodytes
atgaaaacaatgtttt

SEQ ID NO: 212381 - DNA, 16 bp, P. troglodytes
atgaaaacaatttttt

SEQ ID NO: 212382 - DNA, 16 bp, P. troglodytes
atgaaaacagattctt

SEQ ID NO: 212383 - DNA, 16 bp, P. troglodytes
atgaaaacatcaaaag

SEQ ID NO: 212384 - DNA, 16 bp, P. troglodytes
atgaaaacatgtgaaa

SEQ ID NO: 212385 - DNA, 16 bp, P. troglodytes
atgaaaacatttcatt

SEQ ID NO: 212386 - DNA, 16 bp, P. troglodytes
atgaaaacattttcat

SEQ ID NO: 212387 - DNA, 16 bp, P. troglodytes
atgaaaacattttcta

SEQ ID NO: 212388 - DNA, 16 bp, P. troglodytes
atgaaaaccatatgat

SEQ ID NO: 212389 - DNA, 16 bp, P. troglodytes
atgaaaacctttatga

SEQ ID NO: 212390 - DNA, 16 bp, P. troglodytes
atgaaaactatgaaaa

SEQ ID NO: 212391 - DNA, 16 bp, P. troglodytes
atgaaaagaaattcaa

SEQ ID NO: 212392 - DNA, 16 bp, P. troglodytes
atgaaaagaattttca

SEQ ID NO: 212393 - DNA, 16 bp, P. troglodytes
atgaaaagacaaagga

SEQ ID NO: 212394 - DNA, 16 bp, P. troglodytes
atgaaaagacacagac

SEQ ID NO: 212395 - DNA, 16 bp, P. troglodytes
atgaaaagacatttca

SEQ ID NO: 212396 - DNA, 16 bp, P. troglodytes
atgaaaagatgtccaa

SEQ ID NO: 212397 - DNA, 16 bp, P. troglodytes
atgaaaagatgttcaa

SEQ ID NO: 212398 - DNA, 16 bp, P. troglodytes
atgaaaagcaggaaaa

SEQ ID NO: 212399 - DNA, 16 bp, P. troglodytes
atgaaaaggaaaattt

SEQ ID NO: 212400 - DNA, 16 bp, P. troglodytes
atgaaaaggagaaatt

SEQ ID NO: 212401 - DNA, 16 bp, P. troglodytes
atgaaaagtttttaaa

SEQ ID NO: 212402 - DNA, 16 bp, P. troglodytes
atgaaaataattcaaa

SEQ ID NO: 212403 - DNA, 16 bp, P. troglodytes
atgaaaatacaagcca

SEQ ID NO: 212404 - DNA, 16 bp, P. troglodytes
atgaaaatatacttaa

SEQ ID NO: 212405 - DNA, 16 bp, P. troglodytes
atgaaaatatattcaa

SEQ ID NO: 212406 - DNA, 16 bp, P. troglodytes
atgaaaatatgttcaa

SEQ ID NO: 212407 - DNA, 16 bp, P. troglodytes
atgaaaatattctctt

SEQ ID NO: 212408 - DNA, 16 bp, P. troglodytes
atgaaaatattctgaa

SEQ ID NO: 212409 - DNA, 16 bp, P. troglodytes
atgaaaatatttctca

SEQ ID NO: 212410 - DNA, 16 bp, P. troglodytes
atgaaaatcaaagcca

SEQ ID NO: 212411 - DNA, 16 bp, P. troglodytes
atgaaaatctaaaaat

SEQ ID NO: 212412 - DNA, 16 bp, P. troglodytes
atgaaaatgaaacaat

SEQ ID NO: 212413 - DNA, 16 bp, P. troglodytes
atgaaaatgaaacaca

SEQ ID NO: 212414 - DNA, 16 bp, P. troglodytes
atgaaaatgaaagcaa

SEQ ID NO: 212415 - DNA, 16 bp, P. troglodytes
atgaaaatgaagacaa

SEQ ID NO: 212416 - DNA, 16 bp, P. troglodytes
atgaaaatgaagatac

SEQ ID NO: 212417 - DNA, 16 bp, P. troglodytes
atgaaaatgatgatga

SEQ ID NO: 212418 - DNA, 16 bp, P. troglodytes
atgaaaatgcaaagga

SEQ ID NO: 212419 - DNA, 16 bp, P. troglodytes
atgaaaatgcaaatca

SEQ ID NO: 212420 - DNA, 16 bp, P. troglodytes
atgaaaatgccaaaag

SEQ ID NO: 212421 - DNA, 16 bp, P. troglodytes
atgaaaatgctttgta

SEQ ID NO: 212422 - DNA, 16 bp, P. troglodytes
atgaaaatggagacat

SEQ ID NO: 212423 - DNA, 16 bp, P. troglodytes
atgaaaatggcatttt

SEQ ID NO: 212424 - DNA, 16 bp, P. troglodytes
atgaaaatggtcatac

SEQ ID NO: 212425 - DNA, 16 bp, P. troglodytes
atgaaaatgtgctcaa

SEQ ID NO: 212426 - DNA, 16 bp, P. troglodytes
atgaaaatgttttcaa

SEQ ID NO: 212427 - DNA, 16 bp, P. troglodytes
atgaaaatgttttgaa

SEQ ID NO: 212428 - DNA, 16 bp, P. troglodytes
atgaaaattacttaaa

SEQ ID NO: 212429 - DNA, 16 bp, P. troglodytes
atgaaaattctaagaa

SEQ ID NO: 212430 - DNA, 16 bp, P. troglodytes
atgaaaatttacattt

SEQ ID NO: 212431 - DNA, 16 bp, P. troglodytes
atgaaaatttatattc

SEQ ID NO: 212432 - DNA, 16 bp, P. troglodytes
atgaaaatttctccaa

SEQ ID NO: 212433 - DNA, 16 bp, P. troglodytes
atgaaacaaaaaactg

SEQ ID NO: 212434 - DNA, 16 bp, P. troglodytes
atgaaacaaaaaatgt

SEQ ID NO: 212435 - DNA, 16 bp, P. troglodytes
atgaaacaaagtttgt

SEQ ID NO: 212436 - DNA, 16 bp, P. troglodytes
atgaaacaaccagaaa

SEQ ID NO: 212437 - DNA, 16 bp, P. troglodytes
atgaaacatattttaa

SEQ ID NO: 212438 - DNA, 16 bp, P. troglodytes
atgaaacattctccag

SEQ ID NO: 212439 - DNA, 16 bp, P. troglodytes
atgaaacatttaaaaa

SEQ ID NO: 212440 - DNA, 16 bp, P. troglodytes
atgaaacattttaaaa

SEQ ID NO: 212441 - DNA, 16 bp, P. troglodytes
atgaaaccaaaaagag

SEQ ID NO: 212442 - DNA, 16 bp, P. troglodytes
atgaaaccaggaagaa

SEQ ID NO: 212443 - DNA, 16 bp, P. troglodytes
atgaaaccagttcctg

SEQ ID NO: 212444 - DNA, 16 bp, P. troglodytes
atgaaaccataaaaga

SEQ ID NO: 212445 - DNA, 19 bp, P. troglodytes
atgaaaccccatctctacc

SEQ ID NO: 212446 - DNA, 16 bp, P. troglodytes
atgaaactcaaaaaca

SEQ ID NO: 212447 - DNA, 16 bp, P. troglodytes
atgaaactggaaacta

SEQ ID NO: 212448 - DNA, 16 bp, P. troglodytes
atgaaactggaagaca

SEQ ID NO: 212449 - DNA, 16 bp, P. troglodytes
atgaaactttatttat

SEQ ID NO: 212450 - DNA, 16 bp, P. troglodytes
atgaaacttttaaaat

SEQ ID NO: 212451 - DNA, 16 bp, P. troglodytes
atgaaagaaaatacat

SEQ ID NO: 212452 - DNA, 16 bp, P. troglodytes
atgaaagaaatgcaaa

SEQ ID NO: 212453 - DNA, 16 bp, P. troglodytes
atgaaagaagccaatc

SEQ ID NO: 212454 - DNA, 16 bp, P. troglodytes
atgaaagacaattttt

SEQ ID NO: 212455 - DNA, 16 bp, P. troglodytes
atgaaagagtgaatga

SEQ ID NO: 212456 - DNA, 16 bp, P. troglodytes
atgaaagcataatttt

SEQ ID NO: 212457 - DNA, 16 bp, P. troglodytes
atgaaagccagaagac

SEQ ID NO: 212458 - DNA, 16 bp, P. troglodytes
atgaaaggaattgaag

SEQ ID NO: 212459 - DNA, 16 bp, P. troglodytes
atgaaaggatcaaatt

SEQ ID NO: 212460 - DNA, 16 bp, P. troglodytes
atgaaagtgagaactc

SEQ ID NO: 212461 - DNA, 16 bp, P. troglodytes
atgaaataaaaatgca

SEQ ID NO: 212462 - DNA, 16 bp, P. troglodytes
atgaaataaaatgtgt

SEQ ID NO: 212463 - DNA, 16 bp, P. troglodytes
atgaaataatgaattt

SEQ ID NO: 212464 - DNA, 16 bp, P. troglodytes
atgaaatactttaaaa

SEQ ID NO: 212465 - DNA, 16 bp, P. troglodytes
atgaaatattcaaaat

SEQ ID NO: 212466 - DNA, 16 bp, P. troglodytes
atgaaatcaaaatgga

SEQ ID NO: 212467 - DNA, 16 bp, P. troglodytes
atgaaatcaacctaaa

SEQ ID NO: 212468 - DNA, 16 bp, P. troglodytes
atgaaatcaaggttta

SEQ ID NO: 212469 - DNA, 16 bp, P. troglodytes
atgaaatcatacaaca

SEQ ID NO: 212470 - DNA, 16 bp, P. troglodytes
atgaaatcatgttttt

SEQ ID NO: 212471 - DNA, 16 bp, P. troglodytes
atgaaatcctgtctct

SEQ ID NO: 212472 - DNA, 16 bp, P. troglodytes
atgaaatcttgtgcca

SEQ ID NO: 212473 - DNA, 16 bp, P. troglodytes
atgaaatcttgttatt

SEQ ID NO: 212474 - DNA, 16 bp, P. troglodytes
atgaaatctttaaaat

SEQ ID NO: 212475 - DNA, 16 bp, P. troglodytes
atgaaatgaaatattt

SEQ ID NO: 212476 - DNA, 16 bp, P. troglodytes
atgaaatgaatgaatt

SEQ ID NO: 212477 - DNA, 16 bp, P. troglodytes
atgaaatggacagatt

SEQ ID NO: 212478 - DNA, 16 bp, P. troglodytes
atgaaatggggaaagg

SEQ ID NO: 212479 - DNA, 16 bp, P. troglodytes
atgaaatgtattattt

SEQ ID NO: 212480 - DNA, 16 bp, P. troglodytes
atgaaatgtgaaataa

SEQ ID NO: 212481 - DNA, 16 bp, P. troglodytes
atgaaatgttctggaa

SEQ ID NO: 212482 - DNA, 16 bp, P. troglodytes
atgaaattaaactaga

SEQ ID NO: 212483 - DNA, 16 bp, P. troglodytes
atgaaattaagacaga

SEQ ID NO: 212484 - DNA, 16 bp, P. troglodytes
atgaaattaaggtaga

SEQ ID NO: 212485 - DNA, 16 bp, P. troglodytes
atgaaattatttctct

SEQ ID NO: 212486 - DNA, 16 bp, P. troglodytes
atgaaattcaaattta

SEQ ID NO: 212487 - DNA, 16 bp, P. troglodytes
atgaaattctaaaaaa

SEQ ID NO: 212488 - DNA, 16 bp, P. troglodytes
atgaaattctggaaaa

SEQ ID NO: 212489 - DNA, 16 bp, P. troglodytes
atgaaattcttgaagt

SEQ ID NO: 212490 - DNA, 16 bp, P. troglodytes
atgaaattgaggcaat

SEQ ID NO: 212491 - DNA, 16 bp, P. troglodytes
atgaaattgccatttt

SEQ ID NO: 212492 - DNA, 16 bp, P. troglodytes
atgaaattgtgaagaa

SEQ ID NO: 212493 - DNA, 16 bp, P. troglodytes
atgaaatttaaagtat

SEQ ID NO: 212494 - DNA, 16 bp, P. troglodytes
atgaaattttatttca

SEQ ID NO: 212495 - DNA, 16 bp, P. troglodytes
atgaaattttattttc

SEQ ID NO: 212496 - DNA, 16 bp, P. troglodytes
atgaacaaaattattt

SEQ ID NO: 212497 - DNA, 16 bp, P. troglodytes
atgaacaaattcagta

SEQ ID NO: 212498 - DNA, 16 bp, P. troglodytes
atgaacaagtctagag

SEQ ID NO: 212499 - DNA, 16 bp, P. troglodytes
atgaacaatttgaaaa

SEQ ID NO: 212500 - DNA, 16 bp, P. troglodytes
atgaacacaatgcagc

SEQ ID NO: 212501 - DNA, 16 bp, P. troglodytes
atgaacacttttcaaa

SEQ ID NO: 212502 - DNA, 16 bp, P. troglodytes
atgaacagaatataca

SEQ ID NO: 212503 - DNA, 19 bp, P. troglodytes
atgaacagacacttctcaa

SEQ ID NO: 212504 - DNA, 16 bp, P. troglodytes
atgaacatacacatac

SEQ ID NO: 212505 - DNA, 16 bp, P. troglodytes
atgaacatctgtgtac

SEQ ID NO: 212506 - DNA, 16 bp, P. troglodytes
atgaacatgaatgcaa

SEQ ID NO: 212507 - DNA, 16 bp, P. troglodytes
atgaacatgcaagtgc

SEQ ID NO: 212508 - DNA, 16 bp, P. troglodytes
atgaacatgcatgtgc

SEQ ID NO: 212509 - DNA, 16 bp, P. troglodytes
atgaacatttaggttg

SEQ ID NO: 212510 - DNA, 16 bp, P. troglodytes
atgaacatttatttct

SEQ ID NO: 212511 - DNA, 16 bp, P. troglodytes
atgaacatttgagtca

SEQ ID NO: 212512 - DNA, 16 bp, P. troglodytes
atgaaccaatattaat

SEQ ID NO: 212513 - DNA, 16 bp, P. troglodytes
atgaaccaggaaatgg

SEQ ID NO: 212514 - DNA, 16 bp, P. troglodytes
atgaaccagggaggca

SEQ ID NO: 212515 - DNA, 16 bp, P. troglodytes
atgaactaaataaaag

SEQ ID NO: 212516 - DNA, 16 bp, P. troglodytes
atgaactatctgaaaa

SEQ ID NO: 212517 - DNA, 16 bp, P. troglodytes
atgaactattgataca

SEQ ID NO: 212518 - DNA, 16 bp, P. troglodytes
atgaacttcaaaaaca

SEQ ID NO: 212519 - DNA, 16 bp, P. troglodytes
atgaactttaaaaaat

SEQ ID NO: 212520 - DNA, 16 bp, P. troglodytes
atgaactttaaagaag

SEQ ID NO: 212521 - DNA, 16 bp, P. troglodytes
atgaacttttttcttt

SEQ ID NO: 212522 - DNA, 16 bp, P. troglodytes
atgaagaaaaaaatct

SEQ ID NO: 212523 - DNA, 16 bp, P. troglodytes
atgaagaaaaatgtga

SEQ ID NO: 212524 - DNA, 16 bp, P. troglodytes
atgaagaaaactgaaa

SEQ ID NO: 212525 - DNA, 16 bp, P. troglodytes
atgaagaaaaggcctt

SEQ ID NO: 212526 - DNA, 16 bp, P. troglodytes
atgaagaaaagttgaa

SEQ ID NO: 212527 - DNA, 16 bp, P. troglodytes
atgaagaaaatgaagc

SEQ ID NO: 212528 - DNA, 16 bp, P. troglodytes
atgaagaaaatgatat

SEQ ID NO: 212529 - DNA, 16 bp, P. troglodytes
atgaagaaaatgttaa

SEQ ID NO: 212530 - DNA, 16 bp, P. troglodytes
atgaagaaacacctga

SEQ ID NO: 212531 - DNA, 16 bp, P. troglodytes
atgaagaaacagagaa

SEQ ID NO: 212532 - DNA, 16 bp, P. troglodytes
atgaagaaacagaggt

SEQ ID NO: 212533 - DNA, 16 bp, P. troglodytes
atgaagaaaccaaagc

SEQ ID NO: 212534 - DNA, 16 bp, P. troglodytes
atgaagaaaccaagac

SEQ ID NO: 212535 - DNA, 16 bp, P. troglodytes
atgaagaaactaaaac

SEQ ID NO: 212536 - DNA, 16 bp, P. troglodytes
atgaagaaactgaagc

SEQ ID NO: 212537 - DNA, 16 bp, P. troglodytes
atgaagaaactgaggc

SEQ ID NO: 212538 - DNA, 17 bp, P. troglodytes
atgaagaaagcctccaa

SEQ ID NO: 212539 - DNA, 16 bp, P. troglodytes
atgaagaaatactcaa

SEQ ID NO: 212540 - DNA, 16 bp, P. troglodytes
atgaagaaatatttta

SEQ ID NO: 212541 - DNA, 16 bp, P. troglodytes
atgaagaaatgcctga

SEQ ID NO: 212542 - DNA, 16 bp, P. troglodytes
atgaagaaatggaaat

SEQ ID NO: 212543 - DNA, 16 bp, P. troglodytes
atgaagaaatgttgaa

SEQ ID NO: 212544 - DNA, 16 bp, P. troglodytes
atgaagaaattgaagt

SEQ ID NO: 212545 - DNA, 16 bp, P. troglodytes
atgaagaaattgaggc

SEQ ID NO: 212546 - DNA, 16 bp, P. troglodytes
atgaagaactacctga

SEQ ID NO: 212547 - DNA, 16 bp, P. troglodytes
atgaagaactttatga

SEQ ID NO: 212548 - DNA, 16 bp, P. troglodytes
atgaagaagaagcaaa

SEQ ID NO: 212549 - DNA, 16 bp, P. troglodytes
atgaagaagtaaaact

SEQ ID NO: 212550 - DNA, 16 bp, P. troglodytes
atgaagaatatcattg

SEQ ID NO: 212551 - DNA, 16 bp, P. troglodytes
atgaagaatttcaaga

SEQ ID NO: 212552 - DNA, 16 bp, P. troglodytes
atgaagaattttattt

SEQ ID NO: 212553 - DNA, 16 bp, P. troglodytes
atgaagacaaagacaa

SEQ ID NO: 212554 - DNA, 16 bp, P. troglodytes
atgaagacacagggag

SEQ ID NO: 212555 - DNA, 16 bp, P. troglodytes
atgaagacagaaaata

SEQ ID NO: 212556 - DNA, 16 bp, P. troglodytes
atgaagacccaaagat

SEQ ID NO: 212557 - DNA, 16 bp, P. troglodytes
atgaagacttttatga

SEQ ID NO: 212558 - DNA, 16 bp, P. troglodytes
atgaagagaaacattt

SEQ ID NO: 212559 - DNA, 16 bp, P. troglodytes
atgaagagcatttttt

SEQ ID NO: 212560 - DNA, 16 bp, P. troglodytes
atgaagaggcatgaag

SEQ ID NO: 212561 - DNA, 16 bp, P. troglodytes
atgaagaggtgttgaa

SEQ ID NO: 212562 - DNA, 16 bp, P. troglodytes
atgaagatattctcct

SEQ ID NO: 212563 - DNA, 16 bp, P. troglodytes
atgaagatatttgtgt

SEQ ID NO: 212564 - DNA, 16 bp, P. troglodytes
atgaagatatttttat

SEQ ID NO: 212565 - DNA, 16 bp, P. troglodytes
atgaagatcattgaga

SEQ ID NO: 212566 - DNA, 16 bp, P. troglodytes
atgaagatgaaaatga

SEQ ID NO: 212567 - DNA, 16 bp, P. troglodytes
atgaagatgaagatga

SEQ ID NO: 212568 - DNA, 16 bp, P. troglodytes
atgaagatgatgataa

SEQ ID NO: 212569 - DNA, 16 bp, P. troglodytes
atgaagatggcttctt

SEQ ID NO: 212570 - DNA, 16 bp, P. troglodytes
atgaagatttcatgga

SEQ ID NO: 212571 - DNA, 16 bp, P. troglodytes
atgaagatttttttcc

SEQ ID NO: 212572 - DNA, 16 bp, P. troglodytes
atgaagcaaaaacaga

SEQ ID NO: 212573 - DNA, 16 bp, P. troglodytes
atgaagcaacaaaaga

SEQ ID NO: 212574 - DNA, 16 bp, P. troglodytes
atgaagccagaagcca

SEQ ID NO: 212575 - DNA, 16 bp, P. troglodytes
atgaagcctacttgat

SEQ ID NO: 212576 - DNA, 16 bp, P. troglodytes
atgaagcctccataaa

SEQ ID NO: 212577 - DNA, 16 bp, P. troglodytes
atgaagctaaaataaa

SEQ ID NO: 212578 - DNA, 16 bp, P. troglodytes
atgaagctaacttgat

SEQ ID NO: 212579 - DNA, 16 bp, P. troglodytes
atgaagctcagagagg

SEQ ID NO: 212580 - DNA, 17 bp, P. troglodytes
atgaagctggaagccat

SEQ ID NO: 212581 - DNA, 16 bp, P. troglodytes
atgaagctggaagcta

SEQ ID NO: 212582 - DNA, 16 bp, P. troglodytes
atgaagctggagacca

SEQ ID NO: 212583 - DNA, 16 bp, P. troglodytes
atgaagcttttcccct

SEQ ID NO: 212584 - DNA, 16 bp, P. troglodytes
atgaaggaaaaatgtt

SEQ ID NO: 212585 - DNA, 16 bp, P. troglodytes
atgaaggacaaaaacc

SEQ ID NO: 212586 - DNA, 36 bp, P. troglodytes
atgaaggcagaaataaagatgttctttgaaaccaac

SEQ ID NO: 212587 - DNA, 16 bp, P. troglodytes
atgaaggccttttaaa

SEQ ID NO: 212588 - DNA, 16 bp, P. troglodytes
atgaagggtttttttt

SEQ ID NO: 212589 - DNA, 16 bp, P. troglodytes
atgaaggtgccagcag

SEQ ID NO: 212590 - DNA, 16 bp, P. troglodytes
atgaagtaacagaaga

SEQ ID NO: 212591 - DNA, 16 bp, P. troglodytes
atgaagtactgatgca

SEQ ID NO: 212592 - DNA, 16 bp, P. troglodytes
atgaagtctcactgtg

SEQ ID NO: 212593 - DNA, 16 bp, P. troglodytes
atgaagtcttgctctt

SEQ ID NO: 212594 - DNA, 16 bp, P. troglodytes
atgaagtgtttggttt

SEQ ID NO: 212595 - DNA, 16 bp, P. troglodytes
atgaagttattttaaa

SEQ ID NO: 212596 - DNA, 16 bp, P. troglodytes
atgaagttggaagcca

SEQ ID NO: 212597 - DNA, 16 bp, P. troglodytes
atgaagtttaagaaaa

SEQ ID NO: 212598 - DNA, 16 bp, P. troglodytes
atgaagtttttaaaaa

SEQ ID NO: 212599 - DNA, 16 bp, P. troglodytes
atgaataaatcttaaa

SEQ ID NO: 212600 - DNA, 16 bp, P. troglodytes
atgaataaatgaatga

SEQ ID NO: 212601 - DNA, 16 bp, P. troglodytes
atgaatacataaaatt

SEQ ID NO: 212602 - DNA, 16 bp, P. troglodytes
atgaatactttgcaaa

SEQ ID NO: 212603 - DNA, 16 bp, P. troglodytes
atgaatactttttttt

SEQ ID NO: 212604 - DNA, 16 bp, P. troglodytes
atgaatagaaatttat

SEQ ID NO: 212605 - DNA, 16 bp, P. troglodytes
atgaatagaccacatt

SEQ ID NO: 212606 - DNA, 16 bp, P. troglodytes
atgaatagattaatgc

SEQ ID NO: 212607 - DNA, 16 bp, P. troglodytes
atgaatataccacagt

SEQ ID NO: 212608 - DNA, 16 bp, P. troglodytes
atgaatataccatatt

SEQ ID NO: 212609 - DNA, 16 bp, P. troglodytes
atgaatatataaacaa

SEQ ID NO: 212610 - DNA, 16 bp, P. troglodytes
atgaatatatatgtgt

SEQ ID NO: 212611 - DNA, 16 bp, P. troglodytes
atgaatatatattcat

SEQ ID NO: 212612 - DNA, 16 bp, P. troglodytes
atgaatatgaatatga

SEQ ID NO: 212613 - DNA, 16 bp, P. troglodytes
atgaatatggaatatc

SEQ ID NO: 212614 - DNA, 16 bp, P. troglodytes
atgaatatgttacctt

SEQ ID NO: 212615 - DNA, 16 bp, P. troglodytes
atgaatattcatgaaa

SEQ ID NO: 212616 - DNA, 16 bp, P. troglodytes
atgaatatttaatgaa

SEQ ID NO: 212617 - DNA, 16 bp, P. troglodytes
atgaatatttcatttt

SEQ ID NO: 212618 - DNA, 16 bp, P. troglodytes
atgaatcacatttttt

SEQ ID NO: 212619 - DNA, 16 bp, P. troglodytes
atgaatccacacataa

SEQ ID NO: 212620 - DNA, 16 bp, P. troglodytes
atgaatccatacatca

SEQ ID NO: 212621 - DNA, 16 bp, P. troglodytes
atgaatcctggctatg

SEQ ID NO: 212622 - DNA, 16 bp, P. troglodytes
atgaatgaaataattt

SEQ ID NO: 212623 - DNA, 16 bp, P. troglodytes
atgaatgaaatgaaga

SEQ ID NO: 212624 - DNA, 16 bp, P. troglodytes
atgaatgaaatggaaa

SEQ ID NO: 212625 - DNA, 16 bp, P. troglodytes
atgaatgaaattattt

SEQ ID NO: 212626 - DNA, 16 bp, P. troglodytes
atgaatgaacaaagaa

SEQ ID NO: 212627 - DNA, 16 bp, P. troglodytes
atgaatgaagaaaatg

SEQ ID NO: 212628 - DNA, 16 bp, P. troglodytes
atgaatgaatgaatgg

SEQ ID NO: 212629 - DNA, 16 bp, P. troglodytes
atgaatgaatgagagt

SEQ ID NO: 212630 - DNA, 16 bp, P. troglodytes
atgaatgaatgcattt

SEQ ID NO: 212631 - DNA, 16 bp, P. troglodytes
atgaatgaattaatta

SEQ ID NO: 212632 - DNA, 16 bp, P. troglodytes
atgaatgagaaaatga

SEQ ID NO: 212633 - DNA, 16 bp, P. troglodytes
atgaatgatagactgg

SEQ ID NO: 212634 - DNA, 16 bp, P. troglodytes
atgaatgcacatatca

SEQ ID NO: 212635 - DNA, 16 bp, P. troglodytes
atgaatgcatacatca

SEQ ID NO: 212636 - DNA, 16 bp, P. troglodytes
atgaatggaaaaacaa

SEQ ID NO: 212637 - DNA, 16 bp, P. troglodytes
atgaatggacaaatga

SEQ ID NO: 212638 - DNA, 16 bp, P. troglodytes
atgaatggatgaagaa

SEQ ID NO: 212639 - DNA, 16 bp, P. troglodytes
atgaatggatgaatga

SEQ ID NO: 212640 - DNA, 16 bp, P. troglodytes
atgaatggcctggtgc

SEQ ID NO: 212641 - DNA, 16 bp, P. troglodytes
atgaatgtaaggaatg

SEQ ID NO: 212642 - DNA, 16 bp, P. troglodytes
atgaatgtaagtttcc

SEQ ID NO: 212643 - DNA, 16 bp, P. troglodytes
atgaatgtgtgtgtgt

SEQ ID NO: 212644 - DNA, 16 bp, P. troglodytes
atgaattaataaatgt

SEQ ID NO: 212645 - DNA, 16 bp, P. troglodytes
atgaattagaaattat

SEQ ID NO: 212646 - DNA, 16 bp, P. troglodytes
atgaattcaacaaagt

SEQ ID NO: 212647 - DNA, 16 bp, P. troglodytes
atgaattcatgtcctt

SEQ ID NO: 212648 - DNA, 16 bp, P. troglodytes
atgaattcattcaaca

SEQ ID NO: 212649 - DNA, 16 bp, P. troglodytes
atgaattctttgccca

SEQ ID NO: 212650 - DNA, 16 bp, P. troglodytes
atgaattggaagaatt

SEQ ID NO: 212651 - DNA, 16 bp, P. troglodytes
atgaattgttctttgc

SEQ ID NO: 212652 - DNA, 16 bp, P. troglodytes
atgaatttaaaaatgt

SEQ ID NO: 212653 - DNA, 16 bp, P. troglodytes
atgaatttaaagtgag

SEQ ID NO: 212654 - DNA, 16 bp, P. troglodytes
atgaatttcaggattt

SEQ ID NO: 212655 - DNA, 16 bp, P. troglodytes
atgaatttcatttatt

SEQ ID NO: 212656 - DNA, 16 bp, P. troglodytes
atgaatttggaaatat

SEQ ID NO: 212657 - DNA, 16 bp, P. troglodytes
atgaattttaaaatct

SEQ ID NO: 212658 - DNA, 16 bp, P. troglodytes
atgaattttaaagtat

SEQ ID NO: 212659 - DNA, 16 bp, P. troglodytes
atgaattttagaatag

SEQ ID NO: 212660 - DNA, 16 bp, P. troglodytes
atgaattttaggactg

SEQ ID NO: 212661 - DNA, 16 bp, P. troglodytes
atgaattttcttttct

SEQ ID NO: 212662 - DNA, 16 bp, P. troglodytes
atgaatttttacaaat

SEQ ID NO: 212663 - DNA, 16 bp, P. troglodytes
atgaatttttctgttt

SEQ ID NO: 212664 - DNA, 16 bp, P. troglodytes
atgaattttttatttc

SEQ ID NO: 212665 - DNA, 16 bp, P. troglodytes
atgacaaaaaccacac

SEQ ID NO: 212666 - DNA, 16 bp, P. troglodytes
atgacaaaggggtcaa

SEQ ID NO: 212667 - DNA, 16 bp, P. troglodytes
atgacaacaaagaatt

SEQ ID NO: 212668 - DNA, 16 bp, P. troglodytes
atgacaacaacaacaa

SEQ ID NO: 212669 - DNA, 16 bp, P. troglodytes
atgacacaaatggaaa

SEQ ID NO: 212670 - DNA, 16 bp, P. troglodytes
atgacacagccctcag

SEQ ID NO: 212671 - DNA, 16 bp, P. troglodytes
atgacactgtcacccc

SEQ ID NO: 212672 - DNA, 16 bp, P. troglodytes
atgacagaaatataat

SEQ ID NO: 212673 - DNA, 16 bp, P. troglodytes
atgacagcccctccca

SEQ ID NO: 212674 - DNA, 25 bp, P. troglodytes
atgacaggatcaaattcacacataa

SEQ ID NO: 212675 - DNA, 16 bp, P. troglodytes
atgacagtgagaaaaa

SEQ ID NO: 212676 - DNA, 16 bp, P. troglodytes
atgacagttttttttt

SEQ ID NO: 212677 - DNA, 16 bp, P. troglodytes
atgacataaaatttac

SEQ ID NO: 212678 - DNA, 16 bp, P. troglodytes
atgacatcaaaggcac

SEQ ID NO: 212679 - DNA, 16 bp, P. troglodytes
atgacatcactgcact

SEQ ID NO: 212680 - DNA, 16 bp, P. troglodytes
atgacatgacatgaca

SEQ ID NO: 212681 - DNA, 16 bp, P. troglodytes
atgacatgtgggaatt

SEQ ID NO: 212682 - DNA, 16 bp, P. troglodytes
atgacattaaaaaaat

SEQ ID NO: 212683 - DNA, 16 bp, P. troglodytes
atgacattcaaaggaa

SEQ ID NO: 212684 - DNA, 16 bp, P. troglodytes
atgacattctggaaaa

SEQ ID NO: 212685 - DNA, 16 bp, P. troglodytes
atgacattgataattt

SEQ ID NO: 212686 - DNA, 16 bp, P. troglodytes
atgacatttaaaaaaa

SEQ ID NO: 212687 - DNA, 16 bp, P. troglodytes
atgacatttaaaaata

SEQ ID NO: 212688 - DNA, 16 bp, P. troglodytes
atgacatttgcagcaa

SEQ ID NO: 212689 - DNA, 16 bp, P. troglodytes
atgacattttcatttt

SEQ ID NO: 212690 - DNA, 16 bp, P. troglodytes
atgaccaaggtcctgg

SEQ ID NO: 212691 - DNA, 16 bp, P. troglodytes
atgaccaatatggtga

SEQ ID NO: 212692 - DNA, 16 bp, P. troglodytes
atgaccagctaatttt

SEQ ID NO: 212693 - DNA, 16 bp, P. troglodytes
atgaccagctcagtgg

SEQ ID NO: 212694 - DNA, 16 bp, P. troglodytes
atgaccatcttctccc

SEQ ID NO: 212695 - DNA, 16 bp, P. troglodytes
atgacccaaaagttac

SEQ ID NO: 212696 - DNA, 16 bp, P. troglodytes
atgacctaatcacctc

SEQ ID NO: 212697 - DNA, 16 bp, P. troglodytes
atgacctcatttaacc

SEQ ID NO: 212698 - DNA, 16 bp, P. troglodytes
atgacctgaaggagct

SEQ ID NO: 212699 - DNA, 16 bp, P. troglodytes
atgacctgcctgcaga

SEQ ID NO: 212700 - DNA, 16 bp, P. troglodytes
atgacctggaagccct

SEQ ID NO: 212701 - DNA, 16 bp, P. troglodytes
atgacctgttctgtgg

SEQ ID NO: 212702 - DNA, 16 bp, P. troglodytes
atgaccttatctaatc

SEQ ID NO: 212703 - DNA, 16 bp, P. troglodytes
atgaccttgggcaagt

SEQ ID NO: 212704 - DNA, 16 bp, P. troglodytes
atgactataatcaaaa

SEQ ID NO: 212705 - DNA, 16 bp, P. troglodytes
atgactatttttccct

SEQ ID NO: 212706 - DNA, 16 bp, P. troglodytes
atgactcacacctgta

SEQ ID NO: 212707 - DNA, 16 bp, P. troglodytes
atgactcagtttcttc

SEQ ID NO: 212708 - DNA, 16 bp, P. troglodytes
atgactgcatagtatt

SEQ ID NO: 212709 - DNA, 16 bp, P. troglodytes
atgactggctaatttt

SEQ ID NO: 212710 - DNA, 16 bp, P. troglodytes
atgactgtaaatttcc

SEQ ID NO: 212711 - DNA, 16 bp, P. troglodytes
atgactgtaattccag

SEQ ID NO: 212712 - DNA, 16 bp, P. troglodytes
atgactgtattctctc

SEQ ID NO: 212713 - DNA, 16 bp, P. troglodytes
atgactgtatttaaaa

SEQ ID NO: 212714 - DNA, 16 bp, P. troglodytes
atgacttcaccctgca

SEQ ID NO: 212715 - DNA, 16 bp, P. troglodytes
atgacttccagctcca

SEQ ID NO: 212716 - DNA, 16 bp, P. troglodytes
atgacttccagttcca

SEQ ID NO: 212717 - DNA, 16 bp, P. troglodytes
atgactttcttcccag

SEQ ID NO: 212718 - DNA, 16 bp, P. troglodytes
atgactttgaggggtt

SEQ ID NO: 212719 - DNA, 18 bp, P. troglodytes
atgactttgatgagctga

SEQ ID NO: 212720 - DNA, 16 bp, P. troglodytes
atgactttggacaagt

SEQ ID NO: 212721 - DNA, 16 bp, P. troglodytes
atgactttttaaatgt

SEQ ID NO: 212722 - DNA, 16 bp, P. troglodytes
atgagaaaacaggctt

SEQ ID NO: 212723 - DNA, 16 bp, P. troglodytes
atgagaaaaccaagat

SEQ ID NO: 212724 - DNA, 16 bp, P. troglodytes
atgagaaaagacaagt

SEQ ID NO: 212725 - DNA, 16 bp, P. troglodytes
atgagaaaatatatgt

SEQ ID NO: 212726 - DNA, 16 bp, P. troglodytes
atgagaaaatgctcat

SEQ ID NO: 212727 - DNA, 16 bp, P. troglodytes
atgagaaaattgaagt

SEQ ID NO: 212728 - DNA, 16 bp, P. troglodytes
atgagaaacatttaca

SEQ ID NO: 212729 - DNA, 16 bp, P. troglodytes
atgagaaactgaggca

SEQ ID NO: 212730 - DNA, 16 bp, P. troglodytes
atgagaaactttaaaa

SEQ ID NO: 212731 - DNA, 16 bp, P. troglodytes
atgagaaagctgagac

SEQ ID NO: 212732 - DNA, 16 bp, P. troglodytes
atgagaaaggagacat

SEQ ID NO: 212733 - DNA, 16 bp, P. troglodytes
atgagaaagttctgga

SEQ ID NO: 212734 - DNA, 16 bp, P. troglodytes
atgagaacaataaaca

SEQ ID NO: 212735 - DNA, 16 bp, P. troglodytes
atgagaacacaaaggc

SEQ ID NO: 212736 - DNA, 16 bp, P. troglodytes
atgagaacagcatgga

SEQ ID NO: 212737 - DNA, 16 bp, P. troglodytes
atgagaactacatgat

SEQ ID NO: 212738 - DNA, 16 bp, P. troglodytes
atgagaactcatgaac

SEQ ID NO: 212739 - DNA, 16 bp, P. troglodytes
atgagaagccactgga

SEQ ID NO: 212740 - DNA, 16 bp, P. troglodytes
atgagaatatatatat

SEQ ID NO: 212741 - DNA, 16 bp, P. troglodytes
atgagaatgagaatga

SEQ ID NO: 212742 - DNA, 16 bp, P. troglodytes
atgagaatggagccct

SEQ ID NO: 212743 - DNA, 16 bp, P. troglodytes
atgagaatgttttaaa

SEQ ID NO: 212744 - DNA, 16 bp, P. troglodytes
atgagaattaaatgat

SEQ ID NO: 212745 - DNA, 16 bp, P. troglodytes
atgagaattataaaac

SEQ ID NO: 212746 - DNA, 16 bp, P. troglodytes
atgagaattcctgaca

SEQ ID NO: 212747 - DNA, 16 bp, P. troglodytes
atgagacagcaaagac

SEQ ID NO: 212748 - DNA, 16 bp, P. troglodytes
atgagacatcaatcaa

SEQ ID NO: 212749 - DNA, 17 bp, P. troglodytes
atgagacatggagtcaa

SEQ ID NO: 212750 - DNA, 16 bp, P. troglodytes
atgagaccagcctggg

SEQ ID NO: 212751 - DNA, 16 bp, P. troglodytes
atgagaccccatctct

SEQ ID NO: 212752 - DNA, 16 bp, P. troglodytes
atgagaccctgtctca

SEQ ID NO: 212753 - DNA, 16 bp, P. troglodytes
atgagaccctgtgtca

SEQ ID NO: 212754 - DNA, 16 bp, P. troglodytes
atgagagaaaatatct

SEQ ID NO: 212755 - DNA, 16 bp, P. troglodytes
atgagagaaattgaag

SEQ ID NO: 212756 - DNA, 16 bp, P. troglodytes
atgagagaagacacaa

SEQ ID NO: 212757 - DNA, 16 bp, P. troglodytes
atgagagaatactata

SEQ ID NO: 212758 - DNA, 16 bp, P. troglodytes
atgagagagacagaga

SEQ ID NO: 212759 - DNA, 16 bp, P. troglodytes
atgagagcagaaataa

SEQ ID NO: 212760 - DNA, 16 bp, P. troglodytes
atgagaggaatgagca

SEQ ID NO: 212761 - DNA, 16 bp, P. troglodytes
atgagagggacccagt

SEQ ID NO: 212762 - DNA, 16 bp, P. troglodytes
atgagagtgagtgagt

SEQ ID NO: 212763 - DNA, 16 bp, P. troglodytes
atgagagttccagttg

SEQ ID NO: 212764 - DNA, 16 bp, P. troglodytes
atgagataatgtcctt

SEQ ID NO: 212765 - DNA, 16 bp, P. troglodytes
atgagatactatctca

SEQ ID NO: 212766 - DNA, 16 bp, P. troglodytes
atgagatagacagcaa

SEQ ID NO: 212767 - DNA, 16 bp, P. troglodytes
atgagatataatctca

SEQ ID NO: 212768 - DNA, 16 bp, P. troglodytes
atgagatatcttggga

SEQ ID NO: 212769 - DNA, 16 bp, P. troglodytes
atgagatattactaca

SEQ ID NO: 212770 - DNA, 16 bp, P. troglodytes
atgagatattttgtta

SEQ ID NO: 212771 - DNA, 16 bp, P. troglodytes
atgagatcatcctgga

SEQ ID NO: 212772 - DNA, 16 bp, P. troglodytes
atgagatctggttgtt

SEQ ID NO: 212773 - DNA, 16 bp, P. troglodytes
atgagatcttggctca

SEQ ID NO: 212774 - DNA, 16 bp, P. troglodytes
atgagatctttttttt

SEQ ID NO: 212775 - DNA, 16 bp, P. troglodytes
atgagattgaagccat

SEQ ID NO: 212776 - DNA, 16 bp, P. troglodytes
atgagatttgggcagg

SEQ ID NO: 212777 - DNA, 16 bp, P. troglodytes
atgagattttgagggg

SEQ ID NO: 212778 - DNA, 16 bp, P. troglodytes
atgagcaaaataaaca

SEQ ID NO: 212779 - DNA, 16 bp, P. troglodytes
atgagcaaagaaatga

SEQ ID NO: 212780 - DNA, 16 bp, P. troglodytes
atgagcaactacatgc

SEQ ID NO: 212781 - DNA, 16 bp, P. troglodytes
atgagcaagaaataaa

SEQ ID NO: 212782 - DNA, 16 bp, P. troglodytes
atgagcagcagcaaga

SEQ ID NO: 212783 - DNA, 16 bp, P. troglodytes
atgagcaggagacaga

SEQ ID NO: 212784 - DNA, 16 bp, P. troglodytes
atgagcagtgatgatg

SEQ ID NO: 212785 - DNA, 16 bp, P. troglodytes
atgagcattaaaaaaa

SEQ ID NO: 212786 - DNA, 16 bp, P. troglodytes
atgagccaccacgcca

SEQ ID NO: 212787 - DNA, 20 bp, P. troglodytes
atgagccaccacgcctggcc

SEQ ID NO: 212788 - DNA, 20 bp, P. troglodytes
atgagccaccatgcccagcc

SEQ ID NO: 212789 - DNA, 17 bp, P. troglodytes
atgagccaccatgcccg

SEQ ID NO: 212790 - DNA, 16 bp, P. troglodytes
atgagccaccatgcct

SEQ ID NO: 212791 - DNA, 21 bp, P. troglodytes
atgagccaccgtgcccggccc

SEQ ID NO: 212792 - DNA, 16 bp, P. troglodytes
atgagccacctcacct

SEQ ID NO: 212793 - DNA, 20 bp, P. troglodytes
atgagccactgcgcctggct

SEQ ID NO: 212794 - DNA, 16 bp, P. troglodytes
atgagccactgtgtcc

SEQ ID NO: 212795 - DNA, 19 bp, P. troglodytes
atgagccgagatggcgcca

SEQ ID NO: 212796 - DNA, 16 bp, P. troglodytes
atgagccgtgattgca

SEQ ID NO: 212797 - DNA, 16 bp, P. troglodytes
atgagcctggaggaca

SEQ ID NO: 212798 - DNA, 16 bp, P. troglodytes
atgagctaccacgcct

SEQ ID NO: 212799 - DNA, 16 bp, P. troglodytes
atgagctccttgaggg

SEQ ID NO: 212800 - DNA, 19 bp, P. troglodytes
atgagctgagatcgtgcca

SEQ ID NO: 212801 - DNA, 19 bp, P. troglodytes
atgagctgagattgtgcca

SEQ ID NO: 212802 - DNA, 16 bp, P. troglodytes
atgagctgcaacactc

SEQ ID NO: 212803 - DNA, 16 bp, P. troglodytes
atgagctgctgcacct

SEQ ID NO: 212804 - DNA, 16 bp, P. troglodytes
atgagcttaaaaaaaa

SEQ ID NO: 212805 - DNA, 16 bp, P. troglodytes
atgagcttttaaaaat

SEQ ID NO: 212806 - DNA, 16 bp, P. troglodytes
atgaggaaaaaacagc

SEQ ID NO: 212807 - DNA, 16 bp, P. troglodytes
atgaggaaaaaccagc

SEQ ID NO: 212808 - DNA, 16 bp, P. troglodytes
atgaggaaacaaaggc

SEQ ID NO: 212809 - DNA, 16 bp, P. troglodytes
atgaggaaacagaggc

SEQ ID NO: 212810 - DNA, 16 bp, P. troglodytes
atgaggaaacatcaga

SEQ ID NO: 212811 - DNA, 16 bp, P. troglodytes
atgaggaaaccagggc

SEQ ID NO: 212812 - DNA, 16 bp, P. troglodytes
atgaggaaacccaggc

SEQ ID NO: 212813 - DNA, 16 bp, P. troglodytes
atgaggaaactgaaat

SEQ ID NO: 212814 - DNA, 16 bp, P. troglodytes
atgaggaaactgaaga

SEQ ID NO: 212815 - DNA, 16 bp, P. troglodytes
atgaggaaactgaatc

SEQ ID NO: 212816 - DNA, 16 bp, P. troglodytes
atgaggaaactgagcc

SEQ ID NO: 212817 - DNA, 16 bp, P. troglodytes
atgaggaaactgaggt

SEQ ID NO: 212818 - DNA, 16 bp, P. troglodytes
atgaggaaactgcagc

SEQ ID NO: 212819 - DNA, 16 bp, P. troglodytes
atgaggaaaggattcc

SEQ ID NO: 212820 - DNA, 16 bp, P. troglodytes
atgaggaaatggaggc

SEQ ID NO: 212821 - DNA, 16 bp, P. troglodytes
atgaggaagctgaggc

SEQ ID NO: 212822 - DNA, 16 bp, P. troglodytes
atgaggaatttgaggc

SEQ ID NO: 212823 - DNA, 16 bp, P. troglodytes
atgaggacagcatcat

SEQ ID NO: 212824 - DNA, 16 bp, P. troglodytes
atgaggaccctgggcc

SEQ ID NO: 212825 - DNA, 16 bp, P. troglodytes
atgaggagaaaaatca

SEQ ID NO: 212826 - DNA, 16 bp, P. troglodytes
atgaggagttcaagac

SEQ ID NO: 212827 - DNA, 16 bp, P. troglodytes
atgaggataataataa

SEQ ID NO: 212828 - DNA, 16 bp, P. troglodytes
atgaggatgaggatga

SEQ ID NO: 212829 - DNA, 16 bp, P. troglodytes
atgaggcaaaaagaaa

SEQ ID NO: 212830 - DNA, 16 bp, P. troglodytes
atgaggcaaaactttg

SEQ ID NO: 212831 - DNA, 31 bp, P. troglodytes; identical to SEQ ID NO: 50830

SEQ ID NO: 212832 - DNA, 16 bp, P. troglodytes
atgaggccattggtgc

SEQ ID NO: 212833 - DNA, 16 bp, P. troglodytes
atgaggcccatccaca

SEQ ID NO: 212834 - DNA, 17 bp, P. troglodytes
atgaggccgggtgcagt

SEQ ID NO: 212835 - DNA, 16 bp, P. troglodytes
atgagggaactgaggt

SEQ ID NO: 212836 - DNA, 16 bp, P. troglodytes
atgagggccccgcccc

SEQ ID NO: 212837 - DNA, 16 bp, P. troglodytes
atgagggtcttcaagg

SEQ ID NO: 212838 - DNA, 16 bp, P. troglodytes
atgagggttccaattt

SEQ ID NO: 212839 - DNA, 16 bp, P. troglodytes
atgaggtcagagaagt

SEQ ID NO: 212840 - DNA, 16 bp, P. troglodytes
atgaggtgtgtgtgtg

SEQ ID NO: 212841 - DNA, 16 bp, P. troglodytes
atgaggtttaagggaa

SEQ ID NO: 212842 - DNA, 16 bp, P. troglodytes
atgaggtttcatcatg

SEQ ID NO: 212843 - DNA, 16 bp, P. troglodytes
atgagtaaactgagac

SEQ ID NO: 212844 - DNA, 16 bp, P. troglodytes
atgagtaagaacatac

SEQ ID NO: 212845 - DNA, 16 bp, P. troglodytes
atgagtagaatcaata

SEQ ID NO: 212846 - DNA, 16 bp, P. troglodytes
atgagtcactgcacct

SEQ ID NO: 212847 - DNA, 16 bp, P. troglodytes
atgagtgagaagatgc

SEQ ID NO: 212848 - DNA, 16 bp, P. troglodytes
atgagtgagagagaga

SEQ ID NO: 212849 - DNA, 16 bp, P. troglodytes
atgagtgtggctgtgt

SEQ ID NO: 212850 - DNA, 16 bp, P. troglodytes
atgagttcaagaccaa

SEQ ID NO: 212851 - DNA, 16 bp, P. troglodytes
atgagttcaagaccag

SEQ ID NO: 212852 - DNA, 18 bp, P. troglodytes
atgagttcatgtcctttg

SEQ ID NO: 212853 - DNA, 16 bp, P. troglodytes
atgagttcatgtgctt

SEQ ID NO: 212854 - DNA, 17 bp, P. troglodytes
atgagttcatgttcttt

SEQ ID NO: 212855 - DNA, 16 bp, P. troglodytes
atgagttctcatcatt

SEQ ID NO: 212856 - DNA, 16 bp, P. troglodytes
atgagtttacctgtgt

SEQ ID NO: 212857 - DNA, 16 bp, P. troglodytes
atgagttttccaggaa

SEQ ID NO: 212858 - DNA, 16 bp, P. troglodytes
atgagttttgggtggg

SEQ ID NO: 212859 - DNA, 16 bp, P. troglodytes
atgagtttttaaaaaa

SEQ ID NO: 212860 - DNA, 16 bp, P. troglodytes
atgataaaaaccctca

SEQ ID NO: 212861 - DNA, 16 bp, P. troglodytes
atgataaaaactctca

SEQ ID NO: 212862 - DNA, 16 bp, P. troglodytes
atgataaatttgtgtt

SEQ ID NO: 212863 - DNA, 16 bp, P. troglodytes
atgataataataacta

SEQ ID NO: 212864 - DNA, 16 bp, P. troglodytes
atgataatgacaatga

SEQ ID NO: 212865 - DNA, 16 bp, P. troglodytes
atgatactagctgtgg

SEQ ID NO: 212866 - DNA, 16 bp, P. troglodytes
atgatatatttcattt

SEQ ID NO: 212867 - DNA, 16 bp, P. troglodytes
atgatatgatataata

SEQ ID NO: 212868 - DNA, 16 bp, P. troglodytes
atgatatggacaatga

SEQ ID NO: 212869 - DNA, 16 bp, P. troglodytes
atgatattagctggtt

SEQ ID NO: 212870 - DNA, 16 bp, P. troglodytes
atgatattctgaaata

SEQ ID NO: 212871 - DNA, 16 bp, P. troglodytes
atgatattgatgatga

SEQ ID NO: 212872 - DNA, 16 bp, P. troglodytes
atgatattgtctgtgg

SEQ ID NO: 212873 - DNA, 16 bp, P. troglodytes
atgatattttcaattt

SEQ ID NO: 212874 - DNA, 16 bp, P. troglodytes
atgatattttgaaata

SEQ ID NO: 212875 - DNA, 16 bp, P. troglodytes
atgatattttgttaca

SEQ ID NO: 212876 - DNA, 16 bp, P. troglodytes
atgatcaagtgggttt

SEQ ID NO: 212877 - DNA, 16 bp, P. troglodytes
atgatcacagatcact

SEQ ID NO: 212878 - DNA, 16 bp, P. troglodytes
atgatcacgccactgc

SEQ ID NO: 212879 - DNA, 16 bp, P. troglodytes
atgatcagcatttttt

SEQ ID NO: 212880 - DNA, 16 bp, P. troglodytes
atgatcagtgttgttg

SEQ ID NO: 212881 - DNA, 16 bp, P. troglodytes
atgatcatatattttt

SEQ ID NO: 212882 - DNA, 16 bp, P. troglodytes
atgatcatatcaattg

SEQ ID NO: 212883 - DNA, 16 bp, P. troglodytes
atgatcatatcatcag

SEQ ID NO: 212884 - DNA, 16 bp, P. troglodytes
atgatcatctcaacag

SEQ ID NO: 212885 - DNA, 21 bp, P. troglodytes
atgatcatgccactgcactct

SEQ ID NO: 212886 - DNA, 16 bp, P. troglodytes
atgatcatggctcact

SEQ ID NO: 212887 - DNA, 16 bp, P. troglodytes
atgatcatggtggaag

SEQ ID NO: 212888 - DNA, 16 bp, P. troglodytes
atgatcatggttcact

SEQ ID NO: 212889 - DNA, 16 bp, P. troglodytes
atgatccaaacacttc

SEQ ID NO: 212890 - DNA, 16 bp, P. troglodytes
atgatccaatcacatc

SEQ ID NO: 212891 - DNA, 20 bp, P. troglodytes
atgatccacccgccttggcc

SEQ ID NO: 212892 - DNA, 16 bp, P. troglodytes
atgatccagaaattcc

SEQ ID NO: 212893 - DNA, 16 bp, P. troglodytes
atgatcccgccactgc

SEQ ID NO: 212894 - DNA, 20 bp, P. troglodytes
atgatccgcccacctcggcc

SEQ ID NO: 212895 - DNA, 16 bp, P. troglodytes
atgatccgcccgcctc

SEQ ID NO: 212896 - DNA, 16 bp, P. troglodytes
atgatccgcctgcctc

SEQ ID NO: 212897 - DNA, 16 bp, P. troglodytes
atgatcctcccacctc

SEQ ID NO: 212898 - DNA, 16 bp, P. troglodytes
atgatcctctcacctc

SEQ ID NO: 212899 - DNA, 16 bp, P. troglodytes
atgatctcctggtgaa

SEQ ID NO: 212900 - DNA, 16 bp, P. troglodytes
atgatctctattttaa

SEQ ID NO: 212901 - DNA, 18 bp, P. troglodytes
atgatctgcccacctcag

SEQ ID NO: 212902 - DNA, 20 bp, P. troglodytes
atgatctgcccgcctcagct

SEQ ID NO: 212903 - DNA, 16 bp, P. troglodytes
atgatctgcctgcctt

SEQ ID NO: 212904 - DNA, 16 bp, P. troglodytes
atgatctgcctgcttt

SEQ ID NO: 212905 - DNA, 16 bp, P. troglodytes
atgatctgtctaatgt

SEQ ID NO: 212906 - DNA, 16 bp, P. troglodytes
atgatgaaaaactgaa

SEQ ID NO: 212907 - DNA, 16 bp, P. troglodytes
atgatgaaaactctca

SEQ ID NO: 212908 - DNA, 16 bp, P. troglodytes
atgatgaaaatgccaa

SEQ ID NO: 212909 - DNA, 16 bp, P. troglodytes
atgatgaaaattattt

SEQ ID NO: 212910 - DNA, 16 bp, P. troglodytes
atgatgaaaccctctc

SEQ ID NO: 212911 - DNA, 16 bp, P. troglodytes
atgatgaaaccctgta

SEQ ID NO: 212912 - DNA, 16 bp, P. troglodytes
atgatgaaacctcatc

SEQ ID NO: 212913 - DNA, 16 bp, P. troglodytes
atgatgaaagactgaa

SEQ ID NO: 212914 - DNA, 16 bp, P. troglodytes
atgatgaagaaactga

SEQ ID NO: 212915 - DNA, 16 bp, P. troglodytes
atgatgaagacatcaa

SEQ ID NO: 212916 - DNA, 16 bp, P. troglodytes
atgatgaagatgacaa

SEQ ID NO: 212917 - DNA, 16 bp, P. troglodytes
atgatgaagatgataa

SEQ ID NO: 212918 - DNA, 16 bp, P. troglodytes
atgatgaattacattt

SEQ ID NO: 212919 - DNA, 16 bp, P. troglodytes
atgatgacaatgataa

SEQ ID NO: 212920 - DNA, 16 bp, P. troglodytes
atgatgacagtgatga

SEQ ID NO: 212921 - DNA, 16 bp, P. troglodytes
atgatgacttccagct

SEQ ID NO: 212922 - DNA, 16 bp, P. troglodytes
atgatgagattttttt

SEQ ID NO: 212923 - DNA, 16 bp, P. troglodytes
atgatgagcatttttc

SEQ ID NO: 212924 - DNA, 16 bp, P. troglodytes
atgatgagcttttttt

SEQ ID NO: 212925 - DNA, 16 bp, P. troglodytes
atgatgaggaggagga

SEQ ID NO: 212926 - DNA, 16 bp, P. troglodytes
atgatgaggataaaga

SEQ ID NO: 212927 - DNA, 16 bp, P. troglodytes
atgatgaggatttttt

SEQ ID NO: 212928 - DNA, 16 bp, P. troglodytes
atgatgaggtcaagag

SEQ ID NO: 212929 - DNA, 16 bp, P. troglodytes
atgatgagttactggg

SEQ ID NO: 212930 - DNA, 16 bp, P. troglodytes
atgatgataatgacaa

SEQ ID NO: 212931 - DNA, 16 bp, P. troglodytes
atgatgatgaagaaga

SEQ ID NO: 212932 - DNA, 16 bp, P. troglodytes
atgatgatgaagatga

SEQ ID NO: 212933 - DNA, 16 bp, P. troglodytes
atgatgatgacaacaa

SEQ ID NO: 212934 - DNA, 16 bp, P. troglodytes
atgatgatgacaatga

SEQ ID NO: 212935 - DNA, 16 bp, P. troglodytes
atgatgatgataaata

SEQ ID NO: 212936 - DNA, 16 bp, P. troglodytes
atgatgatgataatgg

SEQ ID NO: 212937 - DNA, 16 bp, P. troglodytes
atgatgatgatgaagt

SEQ ID NO: 212938 - DNA, 16 bp, P. troglodytes
atgatgatgatgacga

SEQ ID NO: 212939 - DNA, 16 bp, P. troglodytes
atgatgatgatgatta

SEQ ID NO: 212940 - DNA, 16 bp, P. troglodytes
atgatgatgatgattt

SEQ ID NO: 212941 - DNA, 16 bp, P. troglodytes
atgatgatgcatgcct

SEQ ID NO: 212942 - DNA, 16 bp, P. troglodytes
atgatgatggaaggca

SEQ ID NO: 212943 - DNA, 16 bp, P. troglodytes
atgatgatgttgatga

SEQ ID NO: 212944 - DNA, 16 bp, P. troglodytes
atgatgcaaagatgaa

SEQ ID NO: 212945 - DNA, 16 bp, P. troglodytes
atgatgcagcagaggc

SEQ ID NO: 212946 - DNA, 16 bp, P. troglodytes
atgatgcctccacctt

SEQ ID NO: 212947 - DNA, 16 bp, P. troglodytes
atgatgcctccagcat

SEQ ID NO: 212948 - DNA, 16 bp, P. troglodytes
atgatgctgctgtgaa

SEQ ID NO: 212949 - DNA, 34 bp, P. troglodytes; identical to SEQ ID NO: 51038

SEQ ID NO: 212950 - DNA, 16 bp, P. troglodytes
atgatggaaaggaaat

SEQ ID NO: 212951 - DNA, 16 bp, P. troglodytes
atgatggaaatatttt

SEQ ID NO: 212952 - DNA, 16 bp, P. troglodytes
atgatggaaatgctct

SEQ ID NO: 212953 - DNA, 16 bp, P. troglodytes
atgatggagccactgc

SEQ ID NO: 212954 - DNA, 16 bp, P. troglodytes
atgatggccaggctgg

SEQ ID NO: 212955 - DNA, 16 bp, P. troglodytes
atgatggcgccactgc

SEQ ID NO: 212956 - DNA, 16 bp, P. troglodytes
atgatggcgggcgcct

SEQ ID NO: 212957 - DNA, 16 bp, P. troglodytes
atgatggcgtgtgcct

SEQ ID NO: 212958 - DNA, 16 bp, P. troglodytes
atgatggctcatgcct

SEQ ID NO: 212959 - DNA, 18 bp, P. troglodytes
atgatggggaacatggta

SEQ ID NO: 212960 - DNA, 16 bp, P. troglodytes
atgatggtaataataa

SEQ ID NO: 212961 - DNA, 16 bp, P. troglodytes
atgatggtgacaatga

SEQ ID NO: 212962 - DNA, 16 bp, P. troglodytes
atgatggtgatgataa

SEQ ID NO: 212963 - DNA, 16 bp, P. troglodytes
atgatggtgatgatga

SEQ ID NO: 212964 - DNA, 16 bp, P. troglodytes
atgatggtggataagg

SEQ ID NO: 212965 - DNA, 16 bp, P. troglodytes
atgatgtcttgctctg

SEQ ID NO: 212966 - DNA, 16 bp, P. troglodytes
atgatgtggacaatga

SEQ ID NO: 212967 - DNA, 16 bp, P. troglodytes
atgatgttagctggct

SEQ ID NO: 212968 - DNA, 16 bp, P. troglodytes
atgatgttagctgtgg

SEQ ID NO: 212969 - DNA, 16 bp, P. troglodytes
atgatgttgaacattt

SEQ ID NO: 212970 - DNA, 16 bp, P. troglodytes
atgatgttgaagatga

SEQ ID NO: 212971 - DNA, 16 bp, P. troglodytes
atgatgttgaccatct

SEQ ID NO: 212972 - DNA, 16 bp, P. troglodytes
atgatgttgatgatga

SEQ ID NO: 212973 - DNA, 16 bp, P. troglodytes
atgattaaaattctca

SEQ ID NO: 212974 - DNA, 16 bp, P. troglodytes
atgattatgaataaag

SEQ ID NO: 212975 - DNA, 16 bp, P. troglodytes
atgattatttttctaa

SEQ ID NO: 212976 - DNA, 16 bp, P. troglodytes
atgattcaattttctc

SEQ ID NO: 212977 - DNA, 16 bp, P. troglodytes
atgattcacccacctc

SEQ ID NO: 212978 - DNA, 16 bp, P. troglodytes
atgattcaggaaaaaa

SEQ ID NO: 212979 - DNA, 16 bp, P. troglodytes
atgattcagttgtctc

SEQ ID NO: 212980 - DNA, 16 bp, P. troglodytes
atgattccatttatat

SEQ ID NO: 212981 - DNA, 16 bp, P. troglodytes
atgattcctgccctca

SEQ ID NO: 212982 - DNA, 16 bp, P. troglodytes
atgattctaaaataaa

SEQ ID NO: 212983 - DNA, 16 bp, P. troglodytes
atgattctcctgcccc

SEQ ID NO: 212984 - DNA, 16 bp, P. troglodytes
atgattctgaaagcaa

SEQ ID NO: 212985 - DNA, 16 bp, P. troglodytes
atgattgtaagtttcc

SEQ ID NO: 212986 - DNA, 16 bp, P. troglodytes
atgattgtattttgaa

SEQ ID NO: 212987 - DNA, 16 bp, P. troglodytes
atgattgtcctgcctc

SEQ ID NO: 212988 - DNA, 16 bp, P. troglodytes
atgattgtgaggcctc

SEQ ID NO: 212989 - DNA, 25 bp, P. troglodytes
atgattgtgccactgcactccagcc

SEQ ID NO: 212990 - DNA, 16 bp, P. troglodytes
atgattgtgcctctgc

SEQ ID NO: 212991 - DNA, 16 bp, P. troglodytes
atgattgtgctgctgc

SEQ ID NO: 212992 - DNA, 16 bp, P. troglodytes
atgattgttgttttaa

SEQ ID NO: 212993 - DNA, 16 bp, P. troglodytes
atgatttaaagtattt

SEQ ID NO: 212994 - DNA, 16 bp, P. troglodytes
atgatttaatatatgt

SEQ ID NO: 212995 - DNA, 16 bp, P. troglodytes
atgatttaatcaacca

SEQ ID NO: 212996 - DNA, 16 bp, P. troglodytes
atgatttagaaatatt

SEQ ID NO: 212997 - DNA, 16 bp, P. troglodytes
atgatttagctcccac

SEQ ID NO: 212998 - DNA, 16 bp, P. troglodytes
atgatttagggtatct

SEQ ID NO: 212999 - DNA, 17 bp, P. troglodytes
atgatttatattccttt

SEQ ID NO: 213000 - DNA, 16 bp, P. troglodytes
atgatttatatttctc

SEQ ID NO: 213001 - DNA, 16 bp, P. troglodytes
atgatttcattttgtt

SEQ ID NO: 213002 - DNA, 16 bp, P. troglodytes
atgatttccttctttt

SEQ ID NO: 213003 - DNA, 16 bp, P. troglodytes
atgatttcctttcttt

SEQ ID NO: 213004 - DNA, 16 bp, P. troglodytes
atgatttctttgagca

SEQ ID NO: 213005 - DNA, 16 bp, P. troglodytes
atgatttgcctgcctt

SEQ ID NO: 213006 - DNA, 16 bp, P. troglodytes
atgatttgtgtgtgtg

SEQ ID NO: 213007 - DNA, 16 bp, P. troglodytes
atgattttaaaacatt

SEQ ID NO: 213008 - DNA, 16 bp, P. troglodytes
atgattttaggaaatt

SEQ ID NO: 213009 - DNA, 16 bp, P. troglodytes
atgattttcattttat

SEQ ID NO: 213010 - DNA, 16 bp, P. troglodytes
atgattttccttcttt

SEQ ID NO: 213011 - DNA, 16 bp, P. troglodytes
atgattttctctttat

SEQ ID NO: 213012 - DNA, 16 bp, P. troglodytes
atgattttcttttaaa

SEQ ID NO: 213013 - DNA, 16 bp, P. troglodytes
atgatttttaaaagca

SEQ ID NO: 213014 - DNA, 16 bp, P. troglodytes
atgatttttctccttt

SEQ ID NO: 213015 - DNA, 16 bp, P. troglodytes
atgatttttcttttca

SEQ ID NO: 213016 - DNA, 16 bp, P. troglodytes
atgatttttgaaaaat

SEQ ID NO: 213017 - DNA, 16 bp, P. troglodytes
atgattttttaaaagt

SEQ ID NO: 213018 - DNA, 16 bp, P. troglodytes
atgattttttatggct

SEQ ID NO: 213019 - DNA, 16 bp, P. troglodytes
atgattttttttctca

SEQ ID NO: 213020 - DNA, 16 bp, P. troglodytes
atgcaaaaacattcca

SEQ ID NO: 213021 - DNA, 16 bp, P. troglodytes
atgcaaaaatattcaa

SEQ ID NO: 213022 - DNA, 16 bp, P. troglodytes
atgcaaaaattagcag

SEQ ID NO: 213023 - DNA, 16 bp, P. troglodytes
atgcaaaaggaaagaa

SEQ ID NO: 213024 - DNA, 16 bp, P. troglodytes
atgcaaaatagtacaa

SEQ ID NO: 213025 - DNA, 16 bp, P. troglodytes
atgcaaaatattgatc

SEQ ID NO: 213026 - DNA, 16 bp, P. troglodytes
atgcaaaatgaaaatg

SEQ ID NO: 213027 - DNA, 16 bp, P. troglodytes
atgcaaaatgaaataa

SEQ ID NO: 213028 - DNA, 16 bp, P. troglodytes
atgcaaaatggtatag

SEQ ID NO: 213029 - DNA, 16 bp, P. troglodytes
atgcaaacagaaacca

SEQ ID NO: 213030 - DNA, 16 bp, P. troglodytes
atgcaaagaaggaaaa

SEQ ID NO: 213031 - DNA, 16 bp, P. troglodytes
atgcaaaggccctgag

SEQ ID NO: 213032 - DNA, 16 bp, P. troglodytes
atgcaaagtattgatt

SEQ ID NO: 213033 - DNA, 16 bp, P. troglodytes
atgcaaagtatttttc

SEQ ID NO: 213034 - DNA, 16 bp, P. troglodytes
atgcaaataaacacaa

SEQ ID NO: 213035 - DNA, 16 bp, P. troglodytes
atgcaaataaataaat

SEQ ID NO: 213036 - DNA, 16 bp, P. troglodytes
atgcaaataccatgcc

SEQ ID NO: 213037 - DNA, 16 bp, P. troglodytes
atgcaaatactccaaa

SEQ ID NO: 213038 - DNA, 16 bp, P. troglodytes
atgcaaatattccaaa

SEQ ID NO: 213039 - DNA, 16 bp, P. troglodytes
atgcaaatcaataaat

SEQ ID NO: 213040 - DNA, 16 bp, P. troglodytes
atgcaaatgaaaagca

SEQ ID NO: 213041 - DNA, 16 bp, P. troglodytes
atgcaaatgaactaga

SEQ ID NO: 213042 - DNA, 16 bp, P. troglodytes
atgcaaattaaaacta

SEQ ID NO: 213043 - DNA, 16 bp, P. troglodytes
atgcaaattttttaaa

SEQ ID NO: 213044 - DNA, 16 bp, P. troglodytes
atgcaacaaaagcagt

SEQ ID NO: 213045 - DNA, 16 bp, P. troglodytes
atgcaacagaaaagaa

SEQ ID NO: 213046 - DNA, 16 bp, P. troglodytes
atgcaacagaaacaaa

SEQ ID NO: 213047 - DNA, 16 bp, P. troglodytes
atgcaaccaccaccac

SEQ ID NO: 213048 - DNA, 16 bp, P. troglodytes
atgcaaccatcaccac

SEQ ID NO: 213049 - DNA, 16 bp, P. troglodytes
atgcaaggatggaaga

SEQ ID NO: 213050 - DNA, 16 bp, P. troglodytes
atgcaaggcttgttca

SEQ ID NO: 213051 - DNA, 16 bp, P. troglodytes
atgcaaggttggttaa

SEQ ID NO: 213052 - DNA, 16 bp, P. troglodytes
atgcaagtgatgggga

SEQ ID NO: 213053 - DNA, 16 bp, P. troglodytes
atgcaataaaatatga

SEQ ID NO: 213054 - DNA, 16 bp, P. troglodytes
atgcaatcaactggaa

SEQ ID NO: 213055 - DNA, 16 bp, P. troglodytes
atgcaatgcctatcaa

SEQ ID NO: 213056 - DNA, 16 bp, P. troglodytes
atgcaatggaaaagaa

SEQ ID NO: 213057 - DNA, 16 bp, P. troglodytes
atgcaatggaatacta

SEQ ID NO: 213058 - DNA, 17 bp, P. troglodytes
atgcaatggcgtgatct

SEQ ID NO: 213059 - DNA, 16 bp, P. troglodytes
atgcaattaaaaataa

SEQ ID NO: 213060 - DNA, 16 bp, P. troglodytes
atgcaattaaaataaa

SEQ ID NO: 213061 - DNA, 16 bp, P. troglodytes
atgcaattatggaggc

SEQ ID NO: 213062 - DNA, 16 bp, P. troglodytes
atgcaattctcatcaa

SEQ ID NO: 213063 - DNA, 16 bp, P. troglodytes
atgcacaaaaagcatt

SEQ ID NO: 213064 - DNA, 16 bp, P. troglodytes
atgcacaaaaatcact

SEQ ID NO: 213065 - DNA, 16 bp, P. troglodytes
atgcacacaagagaaa

SEQ ID NO: 213066 - DNA, 16 bp, P. troglodytes
atgcacacacacacac

SEQ ID NO: 213067 - DNA, 16 bp, P. troglodytes
atgcacacacaccaca

SEQ ID NO: 213068 - DNA, 16 bp, P. troglodytes
atgcacacacatatat

SEQ ID NO: 213069 - DNA, 16 bp, P. troglodytes
atgcacacacatgtgt

SEQ ID NO: 213070 - DNA, 16 bp, P. troglodytes
atgcacacacgtgcac

SEQ ID NO: 213071 - DNA, 16 bp, P. troglodytes
atgcacacatacacag

SEQ ID NO: 213072 - DNA, 16 bp, P. troglodytes
atgcacacatatacat

SEQ ID NO: 213073 - DNA, 16 bp, P. troglodytes
atgcacacatgtgcac

SEQ ID NO: 213074 - DNA, 16 bp, P. troglodytes
atgcacacatgtgcat

SEQ ID NO: 213075 - DNA, 16 bp, P. troglodytes
atgcacacattacaaa

SEQ ID NO: 213076 - DNA, 16 bp, P. troglodytes
atgcacacgcacgcac

SEQ ID NO: 213077 - DNA, 16 bp, P. troglodytes
atgcacacgcgcacac

SEQ ID NO: 213078 - DNA, 20 bp, P. troglodytes
atgcacacgtatatttattg

SEQ ID NO: 213079 - DNA, 16 bp, P. troglodytes
atgcacagcctcccca

SEQ ID NO: 213080 - DNA, 16 bp, P. troglodytes
atgcacatacacatgt

SEQ ID NO: 213081 - DNA, 16 bp, P. troglodytes
atgcacatatatgttt

SEQ ID NO: 213082 - DNA, 16 bp, P. troglodytes
atgcacatgtacatat

SEQ ID NO: 213083 - DNA, 16 bp, P. troglodytes
atgcacatgtgtcttt

SEQ ID NO: 213084 - DNA, 16 bp, P. troglodytes
atgcaccacaatgccc

SEQ ID NO: 213085 - DNA, 17 bp, P. troglodytes
atgcaccaccacaccca

SEQ ID NO: 213086 - DNA, 16 bp, P. troglodytes
atgcaccaccacgcct

SEQ ID NO: 213087 - DNA, 16 bp, P. troglodytes
atgcaccaccatggcc

SEQ ID NO: 213088 - DNA, 16 bp, P. troglodytes
atgcacccctgaacct

SEQ ID NO: 213089 - DNA, 17 bp, P. troglodytes
atgcacctgtagttcca

SEQ ID NO: 213090 - DNA, 16 bp, P. troglodytes
atgcacgcgcacacac

SEQ ID NO: 213091 - DNA, 16 bp, P. troglodytes
atgcacgtgtgtgtgt

SEQ ID NO: 213092 - DNA, 16 bp, P. troglodytes
atgcagaaaaactgaa

SEQ ID NO: 213093 - DNA, 16 bp, P. troglodytes
atgcagaaaaagcatt

SEQ ID NO: 213094 - DNA, 16 bp, P. troglodytes
atgcagaaaaaggcat

SEQ ID NO: 213095 - DNA, 16 bp, P. troglodytes
atgcagaaaaatgaaa

SEQ ID NO: 213096 - DNA, 16 bp, P. troglodytes
atgcagaaaacagaaa

SEQ ID NO: 213097 - DNA, 16 bp, P. troglodytes
atgcagaaaaggactt

SEQ ID NO: 213098 - DNA, 16 bp, P. troglodytes
atgcagaaaagtcttt

SEQ ID NO: 213099 - DNA, 16 bp, P. troglodytes
atgcagaaaataattt

SEQ ID NO: 213100 - DNA, 16 bp, P. troglodytes
atgcagaaaatgcttt

SEQ ID NO: 213101 - DNA, 16 bp, P. troglodytes
atgcagaaacatgaaa

SEQ ID NO: 213102 - DNA, 16 bp, P. troglodytes
atgcagaaactgaggc

SEQ ID NO: 213103 - DNA, 16 bp, P. troglodytes
atgcagaaataatggc

SEQ ID NO: 213104 - DNA, 16 bp, P. troglodytes
atgcagaaatttgcat

SEQ ID NO: 213105 - DNA, 16 bp, P. troglodytes
atgcagaactgtgagc

SEQ ID NO: 213106 - DNA, 16 bp, P. troglodytes
atgcagaagaaggaaa

SEQ ID NO: 213107 - DNA, 16 bp, P. troglodytes
atgcagaagaatgaaa

SEQ ID NO: 213108 - DNA, 16 bp, P. troglodytes
atgcagaagattttta

SEQ ID NO: 213109 - DNA, 16 bp, P. troglodytes
atgcagaagggaaatg

SEQ ID NO: 213110 - DNA, 16 bp, P. troglodytes
atgcagagaaaagaga

SEQ ID NO: 213111 - DNA, 16 bp, P. troglodytes
atgcagagaaagcatt

SEQ ID NO: 213112 - DNA, 16 bp, P. troglodytes
atgcagagccggctgt

SEQ ID NO: 213113 - DNA, 16 bp, P. troglodytes
atgcagattcccaggt

SEQ ID NO: 213114 - DNA, 16 bp, P. troglodytes
atgcagattcctgggc

SEQ ID NO: 213115 - DNA, 16 bp, P. troglodytes
atgcagattttaaaat

SEQ ID NO: 213116 - DNA, 16 bp, P. troglodytes
atgcagcaaacttcat

SEQ ID NO: 213117 - DNA, 16 bp, P. troglodytes
atgcagcaatcccact

SEQ ID NO: 213118 - DNA, 16 bp, P. troglodytes
atgcagcaggtgctca

SEQ ID NO: 213119 - DNA, 16 bp, P. troglodytes
atgcagccaagaaaca

SEQ ID NO: 213120 - DNA, 16 bp, P. troglodytes
atgcagccagcaaaca

SEQ ID NO: 213121 - DNA, 16 bp, P. troglodytes
atgcagccagcagaca

SEQ ID NO: 213122 - DNA, 16 bp, P. troglodytes
atgcagccaggaggaa

SEQ ID NO: 213123 - DNA, 16 bp, P. troglodytes
atgcagccataaaagg

SEQ ID NO: 213124 - DNA, 16 bp, P. troglodytes
atgcagccatcaaaag

SEQ ID NO: 213125 - DNA, 16 bp, P. troglodytes
atgcagcctctgcctc

SEQ ID NO: 213126 - DNA, 16 bp, P. troglodytes
atgcagctacaagcca

SEQ ID NO: 213127 - DNA, 16 bp, P. troglodytes
atgcagctgaaaaaca

SEQ ID NO: 213128 - DNA, 16 bp, P. troglodytes
atgcagctgaaggcca

SEQ ID NO: 213129 - DNA, 16 bp, P. troglodytes
atgcagctgcaagcca

SEQ ID NO: 213130 - DNA, 16 bp, P. troglodytes
atgcagctggaagcca

SEQ ID NO: 213131 - DNA, 16 bp, P. troglodytes
atgcagctggagatct

SEQ ID NO: 213132 - DNA, 16 bp, P. troglodytes
atgcagctgggcatgg

SEQ ID NO: 213133 - DNA, 16 bp, P. troglodytes
atgcaggaatggttta

SEQ ID NO: 213134 - DNA, 16 bp, P. troglodytes
atgcaggagctggttt

SEQ ID NO: 213135 - DNA, 16 bp, P. troglodytes
atgcaggaggctgaga

SEQ ID NO: 213136 - DNA, 16 bp, P. troglodytes
atgcaggaggtggagg

SEQ ID NO: 213137 - DNA, 16 bp, P. troglodytes
atgcaggcaacagaca

SEQ ID NO: 213138 - DNA, 16 bp, P. troglodytes
atgcaggctgggcatg

SEQ ID NO: 213139 - DNA, 16 bp, P. troglodytes
atgcagtaaaaacaaa

SEQ ID NO: 213140 - DNA, 16 bp, P. troglodytes
atgcagtaagtgctca

SEQ ID NO: 213141 - DNA, 16 bp, P. troglodytes
atgcagtgagccaaga

SEQ ID NO: 213142 - DNA, 16 bp, P. troglodytes
atgcagtggcatgatc

SEQ ID NO: 213143 - DNA, 18 bp, P. troglodytes
atgcagtggcatgatctt

SEQ ID NO: 213144 - DNA, 16 bp, P. troglodytes
atgcagtggtgcaatc

SEQ ID NO: 213145 - DNA, 16 bp, P. troglodytes
atgcagtttctagggc

SEQ ID NO: 213146 - DNA, 16 bp, P. troglodytes
atgcagttttcttttt

SEQ ID NO: 213147 - DNA, 16 bp, P. troglodytes
atgcagtttttaaaaa

SEQ ID NO: 213148 - DNA, 16 bp, P. troglodytes
atgcatacattaaaaa

SEQ ID NO: 213149 - DNA, 16 bp, P. troglodytes
atgcatatatacatat

SEQ ID NO: 213150 - DNA, 17 bp, P. troglodytes
atgcatatatatatata

SEQ ID NO: 213151 - DNA, 16 bp, P. troglodytes
atgcatattttaatat

SEQ ID NO: 213152 - DNA, 16 bp, P. troglodytes
atgcatatttttattt

SEQ ID NO: 213153 - DNA, 16 bp, P. troglodytes
atgcatatttttttaa

SEQ ID NO: 213154 - DNA, 16 bp, P. troglodytes
atgcatcaccacaccc

SEQ ID NO: 213155 - DNA, 16 bp, P. troglodytes
atgcatccaaatagga

SEQ ID NO: 213156 - DNA, 16 bp, P. troglodytes
atgcatctttaactta

SEQ ID NO: 213157 - DNA, 16 bp, P. troglodytes
atgcatgaatttattt

SEQ ID NO: 213158 - DNA, 16 bp, P. troglodytes
atgcatgagcaaagaa

SEQ ID NO: 213159 - DNA, 16 bp, P. troglodytes
atgcatgattttgtaa

SEQ ID NO: 213160 - DNA, 16 bp, P. troglodytes
atgcatgcacacacat

SEQ ID NO: 213161 - DNA, 16 bp, P. troglodytes
atgcatgcgtgtgtgt

SEQ ID NO: 213162 - DNA, 16 bp, P. troglodytes
atgcatggctaatttt

SEQ ID NO: 213163 - DNA, 16 bp, P. troglodytes
atgcatgtaaaatata

SEQ ID NO: 213164 - DNA, 16 bp, P. troglodytes
atgcatgtgcctttat

SEQ ID NO: 213165 - DNA, 16 bp, P. troglodytes
atgcatgtgtatacac

SEQ ID NO: 213166 - DNA, 16 bp, P. troglodytes
atgcatgtgtgtgcgt

SEQ ID NO: 213167 - DNA, 16 bp, P. troglodytes
atgcatgttcattgca

SEQ ID NO: 213168 - DNA, 16 bp, P. troglodytes
atgcatgtttatatat

SEQ ID NO: 213169 - DNA, 16 bp, P. troglodytes
atgcattatattttat

SEQ ID NO: 213170 - DNA, 16 bp, P. troglodytes
atgcattatttgattt

SEQ ID NO: 213171 - DNA, 16 bp, P. troglodytes
atgcattcattcattt

SEQ ID NO: 213172 - DNA, 16 bp, P. troglodytes
atgcattcatttattc

SEQ ID NO: 213173 - DNA, 16 bp, P. troglodytes
atgcattcctgttttc

SEQ ID NO: 213174 - DNA, 16 bp, P. troglodytes
atgcattgctggtggg

SEQ ID NO: 213175 - DNA, 16 bp, P. troglodytes
atgcatttaaaaataa

SEQ ID NO: 213176 - DNA, 16 bp, P. troglodytes
atgcatttaacaaata

SEQ ID NO: 213177 - DNA, 16 bp, P. troglodytes
atgcatttatcaaaac

SEQ ID NO: 213178 - DNA, 16 bp, P. troglodytes
atgcatttattcattc

SEQ ID NO: 213179 - DNA, 16 bp, P. troglodytes
atgcatttctttttct

SEQ ID NO: 213180 - DNA, 16 bp, P. troglodytes
atgcatttgaaaatat

SEQ ID NO: 213181 - DNA, 16 bp, P. troglodytes
atgcatttgtaatttt

SEQ ID NO: 213182 - DNA, 16 bp, P. troglodytes
atgcatttgtttttat

SEQ ID NO: 213183 - DNA, 16 bp, P. troglodytes
atgcattttaaaactt

SEQ ID NO: 213184 - DNA, 16 bp, P. troglodytes
atgcattttatattat

SEQ ID NO: 213185 - DNA, 16 bp, P. troglodytes
atgcattttattcttt

SEQ ID NO: 213186 - DNA, 16 bp, P. troglodytes
atgcatttttcaaaac

SEQ ID NO: 213187 - DNA, 16 bp, P. troglodytes
atgcattttttttcta

SEQ ID NO: 213188 - DNA, 16 bp, P. troglodytes
atgccaaaatcctcaa

SEQ ID NO: 213189 - DNA, 16 bp, P. troglodytes
atgccaacaaactgga

SEQ ID NO: 213190 - DNA, 16 bp, P. troglodytes
atgccaaggtgggcag

SEQ ID NO: 213191 - DNA, 16 bp, P. troglodytes
atgccaagtgaaataa

SEQ ID NO: 213192 - DNA, 16 bp, P. troglodytes
atgccacattttattt

SEQ ID NO: 213193 - DNA, 16 bp, P. troglodytes
atgccaccacactggg

SEQ ID NO: 213194 - DNA, 16 bp, P. troglodytes
atgccaccacagccag

SEQ ID NO: 213195 - DNA, 18 bp, P. troglodytes
atgccaccacgcctggct

SEQ ID NO: 213196 - DNA, 16 bp, P. troglodytes
atgccaccatacctgg

SEQ ID NO: 213197 - DNA, 16 bp, P. troglodytes
atgccaccatccccag

SEQ ID NO: 213198 - DNA, 16 bp, P. troglodytes
atgccaccatgcatgg

SEQ ID NO: 213199 - DNA, 16 bp, P. troglodytes
atgccactacactcca

SEQ ID NO: 213200 - DNA, 16 bp, P. troglodytes
atgccactgtattcca

SEQ ID NO: 213201 - DNA, 16 bp, P. troglodytes
atgccagcacttcctt

SEQ ID NO: 213202 - DNA, 16 bp, P. troglodytes
atgccagcagcatgct

SEQ ID NO: 213203 - DNA, 16 bp, P. troglodytes
atgccagcatcatgct

SEQ ID NO: 213204 - DNA, 16 bp, P. troglodytes
atgccagcgccatgct

SEQ ID NO: 213205 - DNA, 16 bp, P. troglodytes
atgccaggcactgttt

SEQ ID NO: 213206 - DNA, 16 bp, P. troglodytes
atgccaggccctgtgc

SEQ ID NO: 213207 - DNA, 16 bp, P. troglodytes
atgccagtgccatgct

SEQ ID NO: 213208 - DNA, 16 bp, P. troglodytes
atgccatattttcttt

SEQ ID NO: 213209 - DNA, 16 bp, P. troglodytes
atgccatattttgggg

SEQ ID NO: 213210 - DNA, 16 bp, P. troglodytes
atgccatcacatctgg

SEQ ID NO: 213211 - DNA, 16 bp, P. troglodytes
atgccatctccatcaa

SEQ ID NO: 213212 - DNA, 16 bp, P. troglodytes
atgccattaagaacat

SEQ ID NO: 213213 - DNA, 16 bp, P. troglodytes
atgccattattttgtt

SEQ ID NO: 213214 - DNA, 16 bp, P. troglodytes
atgccattcctatcaa

SEQ ID NO: 213215 - DNA, 16 bp, P. troglodytes
atgccattctggaaaa

SEQ ID NO: 213216 - DNA, 16 bp, P. troglodytes
atgccatttatttatt

SEQ ID NO: 213217 - DNA, 16 bp, P. troglodytes
atgcccaaaagaaagg

SEQ ID NO: 213218 - DNA, 16 bp, P. troglodytes
atgcccactctcacca

SEQ ID NO: 213219 - DNA, 16 bp, P. troglodytes
atgcccactgtcacca

SEQ ID NO: 213220 - DNA, 16 bp, P. troglodytes
atgcccagataatttt

SEQ ID NO: 213221 - DNA, 16 bp, P. troglodytes
atgcccagcacatttt

SEQ ID NO: 213222 - DNA, 16 bp, P. troglodytes
atgcccagcctgaaat

SEQ ID NO: 213223 - DNA, 16 bp, P. troglodytes
atgcccagctaatctt

SEQ ID NO: 213224 - DNA, 16 bp, P. troglodytes
atgcccagttaaattt

SEQ ID NO: 213225 - DNA, 16 bp, P. troglodytes
atgcccatttgtttac

SEQ ID NO: 213226 - DNA, 16 bp, P. troglodytes
atgcccattttaaaga

SEQ ID NO: 213227 - DNA, 16 bp, P. troglodytes
atgccccaccctgctt

SEQ ID NO: 213228 - DNA, 16 bp, P. troglodytes
atgccccacctccaac

SEQ ID NO: 213229 - DNA, 16 bp, P. troglodytes
atgccccagtgtgtga

SEQ ID NO: 213230 - DNA, 16 bp, P. troglodytes
atgcccccaaatctca

SEQ ID NO: 213231 - DNA, 16 bp, P. troglodytes
atgcccccatgcctgg

SEQ ID NO: 213232 - DNA, 16 bp, P. troglodytes
atgccccgccctgctt

SEQ ID NO: 213233 - DNA, 16 bp, P. troglodytes
atgcccctcccccagc

SEQ ID NO: 213234 - DNA, 16 bp, P. troglodytes
atgccctccagttcca

SEQ ID NO: 213235 - DNA, 16 bp, P. troglodytes
atgccctctctcagca

SEQ ID NO: 213236 - DNA, 16 bp, P. troglodytes
atgccctgccctgctt

SEQ ID NO: 213237 - DNA, 16 bp, P. troglodytes
atgccctgctaatttt

SEQ ID NO: 213238 - DNA, 16 bp, P. troglodytes
atgccctggagacact

SEQ ID NO: 213239 - DNA, 16 bp, P. troglodytes
atgcccttctcctgcc

SEQ ID NO: 213240 - DNA, 16 bp, P. troglodytes
atgcccttctttgtat

SEQ ID NO: 213241 - DNA, 16 bp, P. troglodytes
atgcccttttcttttt

SEQ ID NO: 213242 - DNA, 16 bp, P. troglodytes
atgccgggctaatttt

SEQ ID NO: 213243 - DNA, 16 bp, P. troglodytes
atgccgtctctacaaa

SEQ ID NO: 213244 - DNA, 16 bp, P. troglodytes
atgcctacaccaaaaa

SEQ ID NO: 213245 - DNA, 16 bp, P. troglodytes
atgcctagctaatttt

SEQ ID NO: 213246 - DNA, 16 bp, P. troglodytes
atgcctaggaataaat

SEQ ID NO: 213247 - DNA, 16 bp, P. troglodytes
atgcctataatcccaa

SEQ ID NO: 213248 - DNA, 16 bp, P. troglodytes
atgcctataatctgag

SEQ ID NO: 213249 - DNA, 16 bp, P. troglodytes
atgcctcaataaacat

SEQ ID NO: 213250 - DNA, 16 bp, P. troglodytes
atgcctcaccctgctt

SEQ ID NO: 213251 - DNA, 16 bp, P. troglodytes
atgcctcagccacttg

SEQ ID NO: 213252 - DNA, 16 bp, P. troglodytes
atgcctcagtttcccc

SEQ ID NO: 213253 - DNA, 16 bp, P. troglodytes
atgcctctgctgatct

SEQ ID NO: 213254 - DNA, 16 bp, P. troglodytes
atgcctctggttttgt

SEQ ID NO: 213255 - DNA, 16 bp, P. troglodytes
atgcctctttaataaa

SEQ ID NO: 213256 - DNA, 16 bp, P. troglodytes
atgcctgaaactgcag

SEQ ID NO: 213257 - DNA, 16 bp, P. troglodytes
atgcctgcagtcccag

SEQ ID NO: 213258 - DNA, 16 bp, P. troglodytes
atgcctggaattccag

SEQ ID NO: 213259 - DNA, 16 bp, P. troglodytes
atgcctggcacacagt

SEQ ID NO: 213260 - DNA, 16 bp, P. troglodytes
atgcctggcacatagc

SEQ ID NO: 213261 - DNA, 16 bp, P. troglodytes
atgcctggccaaaaac

SEQ ID NO: 213262 - DNA, 16 bp, P. troglodytes
atgcctggctaacttc

SEQ ID NO: 213263 - DNA, 16 bp, P. troglodytes
atgcctggctagtttt

SEQ ID NO: 213264 - DNA, 16 bp, P. troglodytes
atgcctggctcagcag

SEQ ID NO: 213265 - DNA, 16 bp, P. troglodytes
atgcctggctcagtgg

SEQ ID NO: 213266 - DNA, 16 bp, P. troglodytes
atgcctgggtcccacc

SEQ ID NO: 213267 - DNA, 16 bp, P. troglodytes
atgcctgtaactccag

SEQ ID NO: 213268 - DNA, 16 bp, P. troglodytes
atgcctgtaattacag

SEQ ID NO: 213269 - DNA, 16 bp, P. troglodytes
atgcctgtagtgccag

SEQ ID NO: 213270 - DNA, 16 bp, P. troglodytes
atgcctgtttgctatt

SEQ ID NO: 213271 - DNA, 16 bp, P. troglodytes
atgccttcctaacagt

SEQ ID NO: 213272 - DNA, 16 bp, P. troglodytes
atgccttctgccatgt

SEQ ID NO: 213273 - DNA, 16 bp, P. troglodytes
atgccttgtatttctt

SEQ ID NO: 213274 - DNA, 16 bp, P. troglodytes
atgccttttaaaaata

SEQ ID NO: 213275 - DNA, 16 bp, P. troglodytes
atgccttttatttctt

SEQ ID NO: 213276 - DNA, 16 bp, P. troglodytes
atgccttttccatctt

SEQ ID NO: 213277 - DNA, 16 bp, P. troglodytes
atgccttttttccccc

SEQ ID NO: 213278 - DNA, 16 bp, P. troglodytes
atgcgggctccttttt

SEQ ID NO: 213279 - DNA, 16 bp, P. troglodytes
atgcggtggtgtgatc

SEQ ID NO: 213280 - DNA, 16 bp, P. troglodytes
atgcggtgtttggttt

SEQ ID NO: 213281 - DNA, 16 bp, P. troglodytes
atgctaaataaatatt

SEQ ID NO: 213282 - DNA, 16 bp, P. troglodytes
atgctaaatgtgacat

SEQ ID NO: 213283 - DNA, 16 bp, P. troglodytes
atgctaacattaatca

SEQ ID NO: 213284 - DNA, 16 bp, P. troglodytes
atgctaatttaaaaat

SEQ ID NO: 213285 - DNA, 16 bp, P. troglodytes
atgctacaaggctaca

SEQ ID NO: 213286 - DNA, 16 bp, P. troglodytes
atgctacagggaaatc

SEQ ID NO: 213287 - DNA, 16 bp, P. troglodytes
atgctaccatgcctgg

SEQ ID NO: 213288 - DNA, 17 bp, P. troglodytes
atgctactgcactccag

SEQ ID NO: 213289 - DNA, 16 bp, P. troglodytes
atgctattctcatcaa

SEQ ID NO: 213290 - DNA, 16 bp, P. troglodytes
atgctattgtgaatgg

SEQ ID NO: 213291 - DNA, 16 bp, P. troglodytes
atgctatttccatcaa

SEQ ID NO: 213292 - DNA, 16 bp, P. troglodytes
atgctatttctttctg

SEQ ID NO: 213293 - DNA, 16 bp, P. troglodytes
atgctattttttaaat

SEQ ID NO: 213294 - DNA, 16 bp, P. troglodytes
atgctcaacatcattg

SEQ ID NO: 213295 - DNA, 16 bp, P. troglodytes
atgctcaaggaaataa

SEQ ID NO: 213296 - DNA, 16 bp, P. troglodytes
atgctcaataaatgtt

SEQ ID NO: 213297 - DNA, 16 bp, P. troglodytes
atgctcatcatcattg

SEQ ID NO: 213298 - DNA, 16 bp, P. troglodytes
atgctcatcttcactg

SEQ ID NO: 213299 - DNA, 16 bp, P. troglodytes
atgctcccagcttttg

SEQ ID NO: 213300 - DNA, 16 bp, P. troglodytes
atgctctccctcccct

SEQ ID NO: 213301 - DNA, 16 bp, P. troglodytes
atgctctgcttccctt

SEQ ID NO: 213302 - DNA, 16 bp, P. troglodytes
atgctctgtcacctct

SEQ ID NO: 213303 - DNA, 16 bp, P. troglodytes
atgctcttcttgtgat

SEQ ID NO: 213304 - DNA, 16 bp, P. troglodytes
atgctgaaaaagtatt

SEQ ID NO: 213305 - DNA, 16 bp, P. troglodytes
atgctgaaaatgatga

SEQ ID NO: 213306 - DNA, 16 bp, P. troglodytes
atgctgaactgtgagt

SEQ ID NO: 213307 - DNA, 16 bp, P. troglodytes
atgctgaatgaaaaaa

SEQ ID NO: 213308 - DNA, 16 bp, P. troglodytes
atgctgaattttattg

SEQ ID NO: 213309 - DNA, 16 bp, P. troglodytes
atgctgagatttgggg

SEQ ID NO: 213310 - DNA, 16 bp, P. troglodytes
atgctgagctaatttt

SEQ ID NO: 213311 - DNA, 16 bp, P. troglodytes
atgctgaggctgctgg

SEQ ID NO: 213312 - DNA, 16 bp, P. troglodytes
atgctgagggaattca

SEQ ID NO: 213313 - DNA, 16 bp, P. troglodytes
atgctgagggattttg

SEQ ID NO: 213314 - DNA, 16 bp, P. troglodytes
atgctgaggtttggag

SEQ ID NO: 213315 - DNA, 16 bp, P. troglodytes
atgctgatgaagatgt

SEQ ID NO: 213316 - DNA, 16 bp, P. troglodytes
atgctgatgcaagaga

SEQ ID NO: 213317 - DNA, 16 bp, P. troglodytes
atgctgatgctgctgg

SEQ ID NO: 213318 - DNA, 16 bp, P. troglodytes
atgctgcaaattttcc

SEQ ID NO: 213319 - DNA, 16 bp, P. troglodytes
atgctgcagtaacaaa

SEQ ID NO: 213320 - DNA, 16 bp, P. troglodytes
atgctgcagtcttgag

SEQ ID NO: 213321 - DNA, 16 bp, P. troglodytes
atgctgccacaagcca

SEQ ID NO: 213322 - DNA, 16 bp, P. troglodytes
atgctgccaggcctgg

SEQ ID NO: 213323 - DNA, 16 bp, P. troglodytes
atgctgccatgcctgg

SEQ ID NO: 213324 - DNA, 16 bp, P. troglodytes
atgctgctatgaacat

SEQ ID NO: 213325 - DNA, 16 bp, P. troglodytes
atgctgctgataaaaa

SEQ ID NO: 213326 - DNA, 16 bp, P. troglodytes
atgctgctgctgctgg

SEQ ID NO: 213327 - DNA, 16 bp, P. troglodytes
atgctgctggcctggg

SEQ ID NO: 213328 - DNA, 16 bp, P. troglodytes
atgctgctggtctggg

SEQ ID NO: 213329 - DNA, 16 bp, P. troglodytes
atgctgctgtgaacat

SEQ ID NO: 213330 - DNA, 16 bp, P. troglodytes
atgctggccaggctgt

SEQ ID NO: 213331 - DNA, 17 bp, P. troglodytes
atgctgggattacagga

SEQ ID NO: 213332 - DNA, 16 bp, P. troglodytes
atgctgggattccagg

SEQ ID NO: 213333 - DNA, 16 bp, P. troglodytes
atgctgggtgcagtgg

SEQ ID NO: 213334 - DNA, 16 bp, P. troglodytes
atgctggtgcacacct

SEQ ID NO: 213335 - DNA, 16 bp, P. troglodytes
atgctggtgtaaacaa

SEQ ID NO: 213336 - DNA, 16 bp, P. troglodytes
atgctgtacaggtttt

SEQ ID NO: 213337 - DNA, 16 bp, P. troglodytes
atgctgtatgatttca

SEQ ID NO: 213338 - DNA, 16 bp, P. troglodytes
atgctgtattttaaaa

SEQ ID NO: 213339 - DNA, 16 bp, P. troglodytes
atgctgtatttttact

SEQ ID NO: 213340 - DNA, 16 bp, P. troglodytes
atgctgtggctggttt

SEQ ID NO: 213341 - DNA, 16 bp, P. troglodytes
atgctgtggtttgaat

SEQ ID NO: 213342 - DNA, 16 bp, P. troglodytes
atgctgtgtggaatac

SEQ ID NO: 213343 - DNA, 16 bp, P. troglodytes
atgctgtgtttggttt

SEQ ID NO: 213344 - DNA, 16 bp, P. troglodytes
atgctgttgggaaaac

SEQ ID NO: 213345 - DNA, 16 bp, P. troglodytes
atgctgtttatttatt

SEQ ID NO: 213346 - DNA, 16 bp, P. troglodytes
atgctgttttaattac

SEQ ID NO: 213347 - DNA, 16 bp, P. troglodytes
atgctgttttcatgat

SEQ ID NO: 213348 - DNA, 16 bp, P. troglodytes
atgctgttttggttat

SEQ ID NO: 213349 - DNA, 16 bp, P. troglodytes
atgctgttttgtttac

SEQ ID NO: 213350 - DNA, 16 bp, P. troglodytes
atgcttaataaatgtt

SEQ ID NO: 213351 - DNA, 16 bp, P. troglodytes
atgcttacaatcccag

SEQ ID NO: 213352 - DNA, 16 bp, P. troglodytes
atgcttatgtataagt

SEQ ID NO: 213353 - DNA, 16 bp, P. troglodytes
atgcttatgttagaaa

SEQ ID NO: 213354 - DNA, 16 bp, P. troglodytes
atgcttattgtaaaaa

SEQ ID NO: 213355 - DNA, 16 bp, P. troglodytes
atgcttccaggtttgt

SEQ ID NO: 213356 - DNA, 16 bp, P. troglodytes
atgcttcccagcctct

SEQ ID NO: 213357 - DNA, 16 bp, P. troglodytes
atgcttcctgtccttg

SEQ ID NO: 213358 - DNA, 16 bp, P. troglodytes
atgcttctgataaaga

SEQ ID NO: 213359 - DNA, 16 bp, P. troglodytes
atgcttgaggggatgg

SEQ ID NO: 213360 - DNA, 16 bp, P. troglodytes
atgcttgatatgattt

SEQ ID NO: 213361 - DNA, 16 bp, P. troglodytes
atgcttgttggccacg

SEQ ID NO: 213362 - DNA, 16 bp, P. troglodytes
atgctttaaggaagtt

SEQ ID NO: 213363 - DNA, 16 bp, P. troglodytes
atgctttcatttttat

SEQ ID NO: 213364 - DNA, 16 bp, P. troglodytes
atgctttccctccccc

SEQ ID NO: 213365 - DNA, 16 bp, P. troglodytes
atgctttcctgcttag

SEQ ID NO: 213366 - DNA, 16 bp, P. troglodytes
atgctttgaaaatatt

SEQ ID NO: 213367 - DNA, 16 bp, P. troglodytes
atgctttgaatttctg

SEQ ID NO: 213368 - DNA, 16 bp, P. troglodytes
atgctttgctaatttt

SEQ ID NO: 213369 - DNA, 16 bp, P. troglodytes
atgctttgcttcctct

SEQ ID NO: 213370 - DNA, 16 bp, P. troglodytes
atgcttttaaaaagat

SEQ ID NO: 213371 - DNA, 16 bp, P. troglodytes
atgcttttaaaaatat

SEQ ID NO: 213372 - DNA, 16 bp, P. troglodytes
atgcttttctcttgct

SEQ ID NO: 213373 - DNA, 16 bp, P. troglodytes
atgcttttgaaattca

SEQ ID NO: 213374 - DNA, 16 bp, P. troglodytes
atgcttttgataaaat

SEQ ID NO: 213375 - DNA, 16 bp, P. troglodytes
atgctttttaaaaaat

SEQ ID NO: 213376 - DNA, 16 bp, P. troglodytes
atgctttttaaaataa

SEQ ID NO: 213377 - DNA, 16 bp, P. troglodytes
atgcttttttctgcat

SEQ ID NO: 213378 - DNA, 16 bp, P. troglodytes
atgctttttttgcatc

SEQ ID NO: 213379 - DNA, 16 bp, P. troglodytes
atggaaaaaaatagtt

SEQ ID NO: 213380 - DNA, 16 bp, P. troglodytes
atggaaaaacaaattt

SEQ ID NO: 213381 - DNA, 16 bp, P. troglodytes
atggaaaaactgaata

SEQ ID NO: 213382 - DNA, 16 bp, P. troglodytes
atggaaaaatattttt

SEQ ID NO: 213383 - DNA, 16 bp, P. troglodytes
atggaaaaatcaagaa

SEQ ID NO: 213384 - DNA, 16 bp, P. troglodytes
atggaaaaattcaaag

SEQ ID NO: 213385 - DNA, 16 bp, P. troglodytes
atggaaaacagtatgg

SEQ ID NO: 213386 - DNA, 16 bp, P. troglodytes
atggaaaacatttaaa

SEQ ID NO: 213387 - DNA, 16 bp, P. troglodytes
atggaaaaccaaaaat

SEQ ID NO: 213388 - DNA, 16 bp, P. troglodytes
atggaaaaccaagcat

SEQ ID NO: 213389 - DNA, 16 bp, P. troglodytes
atggaaaactacaaca

SEQ ID NO: 213390 - DNA, 16 bp, P. troglodytes
atggaaaagaaaatct

SEQ ID NO: 213391 - DNA, 16 bp, P. troglodytes
atggaaaagcaaaata

SEQ ID NO: 213392 - DNA, 16 bp, P. troglodytes
atggaaaagcaaagaa

SEQ ID NO: 213393 - DNA, 16 bp, P. troglodytes
atggaaaatacatttt

SEQ ID NO: 213394 - DNA, 16 bp, P. troglodytes
atggaaaatcaaacat

SEQ ID NO: 213395 - DNA, 16 bp, P. troglodytes
atggaaaatgaaatga

SEQ ID NO: 213396 - DNA, 16 bp, P. troglodytes
atggaaaattatttaa

SEQ ID NO: 213397 - DNA, 16 bp, P. troglodytes
atggaaacaatagata

SEQ ID NO: 213398 - DNA, 16 bp, P. troglodytes
atggaaacaatcaaca

SEQ ID NO: 213399 - DNA, 16 bp, P. troglodytes
atggaaacaatttaaa

SEQ ID NO: 213400 - DNA, 16 bp, P. troglodytes
atggaaacatctggat

SEQ ID NO: 213401 - DNA, 16 bp, P. troglodytes
atggaaaccaaaagca

SEQ ID NO: 213402 - DNA, 16 bp, P. troglodytes
atggaaactcctggat

SEQ ID NO: 213403 - DNA, 16 bp, P. troglodytes
atggaaactgaacagc

SEQ ID NO: 213404 - DNA, 16 bp, P. troglodytes
atggaaagacaaagga

SEQ ID NO: 213405 - DNA, 16 bp, P. troglodytes
atggaaaggaaaaact

SEQ ID NO: 213406 - DNA, 16 bp, P. troglodytes
atggaaaggaagaacc

SEQ ID NO: 213407 - DNA, 16 bp, P. troglodytes
atggaaaggcaaagaa

SEQ ID NO: 213408 - DNA, 16 bp, P. troglodytes
atggaaagtttttcca

SEQ ID NO: 213409 - DNA, 16 bp, P. troglodytes
atggaaatacaaagga

SEQ ID NO: 213410 - DNA, 16 bp, P. troglodytes
atggaaatatttaatt

SEQ ID NO: 213411 - DNA, 16 bp, P. troglodytes
atggaaatatttttaa

SEQ ID NO: 213412 - DNA, 16 bp, P. troglodytes
atggaaatcaataaat

SEQ ID NO: 213413 - DNA, 16 bp, P. troglodytes
atggaaatcagaaaat

SEQ ID NO: 213414 - DNA, 16 bp, P. troglodytes
atggaaatgaaaacca

SEQ ID NO: 213415 - DNA, 16 bp, P. troglodytes
atggaaatgaaagaat

SEQ ID NO: 213416 - DNA, 16 bp, P. troglodytes
atggaaatgagaaact

SEQ ID NO: 213417 - DNA, 16 bp, P. troglodytes
atggaaatggaaataa

SEQ ID NO: 213418 - DNA, 16 bp, P. troglodytes
atggaaatgtctggat

SEQ ID NO: 213419 - DNA, 16 bp, P. troglodytes
atggaaatgttcttta

SEQ ID NO: 213420 - DNA, 16 bp, P. troglodytes
atggaaattattttat

SEQ ID NO: 213421 - DNA, 16 bp, P. troglodytes
atggaaattcctggat

SEQ ID NO: 213422 - DNA, 16 bp, P. troglodytes
atggaacaaaaaagag

SEQ ID NO: 213423 - DNA, 16 bp, P. troglodytes
atggaacagaacggag

SEQ ID NO: 213424 - DNA, 16 bp, P. troglodytes
atggaacaggatagaa

SEQ ID NO: 213425 - DNA, 18 bp, P. troglodytes
atggaaccaaaaaagagc

SEQ ID NO: 213426 - DNA, 16 bp, P. troglodytes
atggaaccacaaaaga

SEQ ID NO: 213427 - DNA, 16 bp, P. troglodytes
atggaaccacaaaagg

SEQ ID NO: 213428 - DNA, 16 bp, P. troglodytes
atggaacggaatagag

SEQ ID NO: 213429 - DNA, 16 bp, P. troglodytes
atggaactcctgggct

SEQ ID NO: 213430 - DNA, 16 bp, P. troglodytes
atggaactgaaaacca

SEQ ID NO: 213431 - DNA, 16 bp, P. troglodytes
atggaactggagaaca

SEQ ID NO: 213432 - DNA, 16 bp, P. troglodytes
atggaacttctcagcc

SEQ ID NO: 213433 - DNA, 16 bp, P. troglodytes
atggaagaaaattcca

SEQ ID NO: 213434 - DNA, 16 bp, P. troglodytes
atggaagaaattgaag

SEQ ID NO: 213435 - DNA, 16 bp, P. troglodytes
atggaagaagattcca

SEQ ID NO: 213436 - DNA, 16 bp, P. troglodytes
atggaagactttttat

SEQ ID NO: 213437 - DNA, 16 bp, P. troglodytes
atggaagccagaagac

SEQ ID NO: 213438 - DNA, 16 bp, P. troglodytes
atggaagctgctaagg

SEQ ID NO: 213439 - DNA, 16 bp, P. troglodytes
atggaagtggaagtgg

SEQ ID NO: 213440 - DNA, 16 bp, P. troglodytes
atggaataatagacat

SEQ ID NO: 213441 - DNA, 25 bp, P. troglodytes
atggaatactatgcagccataaaaa

SEQ ID NO: 213442 - DNA, 16 bp, P. troglodytes
atggaatactgtgcag

SEQ ID NO: 213443 - DNA, 16 bp, P. troglodytes
atggaatactgtgtag

SEQ ID NO: 213444 - DNA, 16 bp, P. troglodytes
atggaatatcattttt

SEQ ID NO: 213445 - DNA, 16 bp, P. troglodytes
atggaatatgtttcca

SEQ ID NO: 213446 - DNA, 16 bp, P. troglodytes
atggaatattatataa

SEQ ID NO: 213447 - DNA, 16 bp, P. troglodytes
atggaatcaacccaaa

SEQ ID NO: 213448 - DNA, 16 bp, P. troglodytes
atggaatcaatctagg

SEQ ID NO: 213449 - DNA, 16 bp, P. troglodytes
atggaatcagtaataa

SEQ ID NO: 213450 - DNA, 16 bp, P. troglodytes
atggaatcatgcagta

SEQ ID NO: 213451 - DNA, 16 bp, P. troglodytes
atggaatcatgtcatc

SEQ ID NO: 213452 - DNA, 16 bp, P. troglodytes
atggaatgaaactaga

SEQ ID NO: 213453 - DNA, 16 bp, P. troglodytes
atggaatgaatatatt

SEQ ID NO: 213454 - DNA, 16 bp, P. troglodytes
atggaatgtttctcca

SEQ ID NO: 213455 - DNA, 16 bp, P. troglodytes
atggaattggaaaaaa

SEQ ID NO: 213456 - DNA, 16 bp, P. troglodytes
atggaattggaggtca

SEQ ID NO: 213457 - DNA, 16 bp, P. troglodytes
atggaattgttttctt

SEQ ID NO: 213458 - DNA, 16 bp, P. troglodytes
atggaatttttttctt

SEQ ID NO: 213459 - DNA, 16 bp, P. troglodytes
atggaattttttttcc

SEQ ID NO: 213460 - DNA, 16 bp, P. troglodytes
atggacaaataaaaat

SEQ ID NO: 213461 - DNA, 16 bp, P. troglodytes
atggacacaaagaaga

SEQ ID NO: 213462 - DNA, 16 bp, P. troglodytes
atggacacagagaagg

SEQ ID NO: 213463 - DNA, 16 bp, P. troglodytes
atggacacatcattat

SEQ ID NO: 213464 - DNA, 16 bp, P. troglodytes
atggacacttacattg

SEQ ID NO: 213465 - DNA, 16 bp, P. troglodytes
atggacagagggaggg

SEQ ID NO: 213466 - DNA, 16 bp, P. troglodytes
atggacagatgaatgg

SEQ ID NO: 213467 - DNA, 16 bp, P. troglodytes
atggacaggaggcagg

SEQ ID NO: 213468 - DNA, 16 bp, P. troglodytes
atggacatggatggag

SEQ ID NO: 213469 - DNA, 16 bp, P. troglodytes
atggacatttggtttg

SEQ ID NO: 213470 - DNA, 16 bp, P. troglodytes
atggacattttaataa

SEQ ID NO: 213471 - DNA, 16 bp, P. troglodytes
atggacctctctgagt

SEQ ID NO: 213472 - DNA, 16 bp, P. troglodytes
atggactaaagattta

SEQ ID NO: 213473 - DNA, 16 bp, P. troglodytes
atggactaatacatcc

SEQ ID NO: 213474 - DNA, 16 bp, P. troglodytes
atggactctttttttt

SEQ ID NO: 213475 - DNA, 16 bp, P. troglodytes
atggacttcctcctca

SEQ ID NO: 213476 - DNA, 16 bp, P. troglodytes
atggactttggggact

SEQ ID NO: 213477 - DNA, 16 bp, P. troglodytes
atggagaaaagggaat

SEQ ID NO: 213478 - DNA, 16 bp, P. troglodytes
atggagaaacagaaaa

SEQ ID NO: 213479 - DNA, 16 bp, P. troglodytes
atggagaaacccatct

SEQ ID NO: 213480 - DNA, 16 bp, P. troglodytes
atggagaaaccccatt

SEQ ID NO: 213481 - DNA, 16 bp, P. troglodytes
atggagaaactgcatc

SEQ ID NO: 213482 - DNA, 16 bp, P. troglodytes
atggagaaagatattc

SEQ ID NO: 213483 - DNA, 16 bp, P. troglodytes
atggagaaattaagaa

SEQ ID NO: 213484 - DNA, 16 bp, P. troglodytes
atggagaatgaatttg

SEQ ID NO: 213485 - DNA, 16 bp, P. troglodytes
atggagaatgagattg

SEQ ID NO: 213486 - DNA, 16 bp, P. troglodytes
atggagaatgaggtat

SEQ ID NO: 213487 - DNA, 17 bp, P. troglodytes
atggagaatgagtttga

SEQ ID NO: 213488 - DNA, 16 bp, P. troglodytes
atggagaatttttttt

SEQ ID NO: 213489 - DNA, 16 bp, P. troglodytes
atggagactatcctgg

SEQ ID NO: 213490 - DNA, 16 bp, P. troglodytes
atggagagaaatggaa

SEQ ID NO: 213491 - DNA, 16 bp, P. troglodytes
atggagagtgactgct

SEQ ID NO: 213492 - DNA, 16 bp, P. troglodytes
atggagataataatac

SEQ ID NO: 213493 - DNA, 16 bp, P. troglodytes
atggagatagcattga

SEQ ID NO: 213494 - DNA, 16 bp, P. troglodytes
atggagatggggtctt

SEQ ID NO: 213495 - DNA, 16 bp, P. troglodytes
atggagatgtacaaag

SEQ ID NO: 213496 - DNA, 16 bp, P. troglodytes
atggagcccaccacag

SEQ ID NO: 213497 - DNA, 16 bp, P. troglodytes
atggagcccagcaagc

SEQ ID NO: 213498 - DNA, 16 bp, P. troglodytes
atggagctgccatttt

SEQ ID NO: 213499 - DNA, 16 bp, P. troglodytes
atggagctggaaacca

SEQ ID NO: 213500 - DNA, 16 bp, P. troglodytes
atggagctggaagctg

SEQ ID NO: 213501 - DNA, 16 bp, P. troglodytes
atggagctggaggcca

SEQ ID NO: 213502 - DNA, 16 bp, P. troglodytes
atggagcttagtttgg

SEQ ID NO: 213503 - DNA, 16 bp, P. troglodytes
atggaggccagaagac

SEQ ID NO: 213504 - DNA, 16 bp, P. troglodytes
atggaggctgaggcag

SEQ ID NO: 213505 - DNA, 16 bp, P. troglodytes
atggaggctgcaatga

SEQ ID NO: 213506 - DNA, 16 bp, P. troglodytes
atggaggctgggcaca

SEQ ID NO: 213507 - DNA, 16 bp, P. troglodytes
atggaggtttgttaca

SEQ ID NO: 213508 - DNA, 16 bp, P. troglodytes
atggagtatttgtctt

SEQ ID NO: 213509 - DNA, 16 bp, P. troglodytes
atggagtctcactcta

SEQ ID NO: 213510 - DNA, 16 bp, P. troglodytes
atggagtctcccactg

SEQ ID NO: 213511 - DNA, 16 bp, P. troglodytes
atggagtctcgctctc

SEQ ID NO: 213512 - DNA, 16 bp, P. troglodytes
atggagtctctctgtg

SEQ ID NO: 213513 - DNA, 16 bp, P. troglodytes
atggagtcttgctctt

SEQ ID NO: 213514 - DNA, 16 bp, P. troglodytes
atggagtcttgttttg

SEQ ID NO: 213515 - DNA, 16 bp, P. troglodytes
atggagtgcaatggtg

SEQ ID NO: 213516 - DNA, 16 bp, P. troglodytes
atggagtgcagtggca

SEQ ID NO: 213517 - DNA, 16 bp, P. troglodytes
atggagtgctgctgtg

SEQ ID NO: 213518 - DNA, 16 bp, P. troglodytes
atggagtgggcaagtt

SEQ ID NO: 213519 - DNA, 16 bp, P. troglodytes
atggagtgttctataa

SEQ ID NO: 213520 - DNA, 16 bp, P. troglodytes
atggagttccactctt

SEQ ID NO: 213521 - DNA, 16 bp, P. troglodytes
atggagttggaagcca

SEQ ID NO: 213522 - DNA, 16 bp, P. troglodytes
atggagtttcacaatg

SEQ ID NO: 213523 - DNA, 16 bp, P. troglodytes
atggagtttcactctg

SEQ ID NO: 213524 - DNA, 16 bp, P. troglodytes
atggagtttcctcaaa

SEQ ID NO: 213525 - DNA, 16 bp, P. troglodytes
atggagtttctttttg

SEQ ID NO: 213526 - DNA, 16 bp, P. troglodytes
atggagtttgcagtga

SEQ ID NO: 213527 - DNA, 16 bp, P. troglodytes
atggagttttgctcgt

SEQ ID NO: 213528 - DNA, 16 bp, P. troglodytes
atggagtttttgcatg

SEQ ID NO: 213529 - DNA, 16 bp, P. troglodytes
atggataaagaaaatg

SEQ ID NO: 213530 - DNA, 16 bp, P. troglodytes
atggataaagaaattg

SEQ ID NO: 213531 - DNA, 17 bp, P. troglodytes
atggataaattcctgga

SEQ ID NO: 213532 - DNA, 16 bp, P. troglodytes
atggatacagctggaa

SEQ ID NO: 213533 - DNA, 16 bp, P. troglodytes
atggatacataaaatg

SEQ ID NO: 213534 - DNA, 16 bp, P. troglodytes
atggatatatgtatat

SEQ ID NO: 213535 - DNA, 16 bp, P. troglodytes
atggatatattaatta

SEQ ID NO: 213536 - DNA, 16 bp, P. troglodytes
atggatatattgtgtg

SEQ ID NO: 213537 - DNA, 16 bp, P. troglodytes
atggatattcaatttt

SEQ ID NO: 213538 - DNA, 16 bp, P. troglodytes
atggatatttgggtta

SEQ ID NO: 213539 - DNA, 16 bp, P. troglodytes
atggatcaaagatcta

SEQ ID NO: 213540 - DNA, 16 bp, P. troglodytes
atggatcaatctcaaa

SEQ ID NO: 213541 - DNA, 16 bp, P. troglodytes
atggatcacttgaggc

SEQ ID NO: 213542 - DNA, 16 bp, P. troglodytes
atggatgaagttggaa

SEQ ID NO: 213543 - DNA, 16 bp, P. troglodytes
atggatgaataaatat

SEQ ID NO: 213544 - DNA, 16 bp, P. troglodytes
atggatgacacaaaca

SEQ ID NO: 213545 - DNA, 16 bp, P. troglodytes
atggatgagaaaacag

SEQ ID NO: 213546 - DNA, 16 bp, P. troglodytes
atggatgaggaaactg

SEQ ID NO: 213547 - DNA, 16 bp, P. troglodytes
atggatgaggagactg

SEQ ID NO: 213548 - DNA, 16 bp, P. troglodytes
atggatgatgatgatg

SEQ ID NO: 213549 - DNA, 16 bp, P. troglodytes
atggatgcacaactct

SEQ ID NO: 213550 - DNA, 16 bp, P. troglodytes
atggatgcagctggaa

SEQ ID NO: 213551 - DNA, 16 bp, P. troglodytes
atggatgctgagctta

SEQ ID NO: 213552 - DNA, 16 bp, P. troglodytes
atggatggaaatggag

SEQ ID NO: 213553 - DNA, 16 bp, P. troglodytes
atggatggaattggaa

SEQ ID NO: 213554 - DNA, 16 bp, P. troglodytes
atggatggacagacag

SEQ ID NO: 213555 - DNA, 16 bp, P. troglodytes
atggatggagctggaa

SEQ ID NO: 213556 - DNA, 16 bp, P. troglodytes
atggatggatcacttg

SEQ ID NO: 213557 - DNA, 16 bp, P. troglodytes
atggatggatgaatgg

SEQ ID NO: 213558 - DNA, 16 bp, P. troglodytes
atggatggatggactg

SEQ ID NO: 213559 - DNA, 16 bp, P. troglodytes
atggatggatggagaa

SEQ ID NO: 213560 - DNA, 16 bp, P. troglodytes
atggatggatggctgg

SEQ ID NO: 213561 - DNA, 16 bp, P. troglodytes
atggatggtggtgaca

SEQ ID NO: 213562 - DNA, 16 bp, P. troglodytes
atggattaaaaatgtg

SEQ ID NO: 213563 - DNA, 16 bp, P. troglodytes
atggattaaagactta

SEQ ID NO: 213564 - DNA, 16 bp, P. troglodytes
atggattaatggatta

SEQ ID NO: 213565 - DNA, 16 bp, P. troglodytes
atggattcaaaggaga

SEQ ID NO: 213566 - DNA, 16 bp, P. troglodytes
atggattctggagtca

SEQ ID NO: 213567 - DNA, 16 bp, P. troglodytes
atggatttgggcaaag

SEQ ID NO: 213568 - DNA, 16 bp, P. troglodytes
atggatttttaaaaat

SEQ ID NO: 213569 - DNA, 16 bp, P. troglodytes
atggatttttaaataa

SEQ ID NO: 213570 - DNA, 16 bp, P. troglodytes
atggattttttttcaa

SEQ ID NO: 213571 - DNA, 16 bp, P. troglodytes
atggcaaaaaagtgaa

SEQ ID NO: 213572 - DNA, 25 bp, P. troglodytes
atggcaaaaccccatctctaccaaa

SEQ ID NO: 213573 - DNA, 16 bp, P. troglodytes
atggcaaaaggaacag

SEQ ID NO: 213574 - DNA, 16 bp, P. troglodytes
atggcaaagacttgga

SEQ ID NO: 213575 - DNA, 16 bp, P. troglodytes
atggcaaattttatgt

SEQ ID NO: 213576 - DNA, 16 bp, P. troglodytes
atggcaacacctggaa

SEQ ID NO: 213577 - DNA, 16 bp, P. troglodytes
atggcaacactgcact

SEQ ID NO: 213578 - DNA, 16 bp, P. troglodytes
atggcaacatcaggaa

SEQ ID NO: 213579 - DNA, 16 bp, P. troglodytes
atggcaaggaactgag

SEQ ID NO: 213580 - DNA, 17 bp, P. troglodytes
atggcacaatctcggct

SEQ ID NO: 213581 - DNA, 16 bp, P. troglodytes
atggcacacacctgtg

SEQ ID NO: 213582 - DNA, 16 bp, P. troglodytes
atggcaccagcatctg

SEQ ID NO: 213583 - DNA, 16 bp, P. troglodytes
atggcaccatcttggc

SEQ ID NO: 213584 - DNA, 16 bp, P. troglodytes
atggcacccaggctgt

SEQ ID NO: 213585 - DNA, 16 bp, P. troglodytes
atggcacctctgcact

SEQ ID NO: 213586 - DNA, 21 bp, P. troglodytes
atggcacgatctcagctcacc

SEQ ID NO: 213587 - DNA, 16 bp, P. troglodytes
atggcactactgcact

SEQ ID NO: 213588 - DNA, 16 bp, P. troglodytes
atggcagaaaaggaag

SEQ ID NO: 213589 - DNA, 16 bp, P. troglodytes
atggcagaagacaaaa

SEQ ID NO: 213590 - DNA, 16 bp, P. troglodytes
atggcagaattttctt

SEQ ID NO: 213591 - DNA, 16 bp, P. troglodytes
atggcagacatcacta

SEQ ID NO: 213592 - DNA, 16 bp, P. troglodytes
atggcagagccaggac

SEQ ID NO: 213593 - DNA, 16 bp, P. troglodytes
atggcagaggtggaag

SEQ ID NO: 213594 - DNA, 16 bp, P. troglodytes
atggcagcaggaggca

SEQ ID NO: 213595 - DNA, 16 bp, P. troglodytes
atggcaggaaggagaa

SEQ ID NO: 213596 - DNA, 16 bp, P. troglodytes
atggcaggagtaaatc

SEQ ID NO: 213597 - DNA, 16 bp, P. troglodytes
atggcagggctgaaag

SEQ ID NO: 213598 - DNA, 16 bp, P. troglodytes
atggcagggctgggat

SEQ ID NO: 213599 - DNA, 16 bp, P. troglodytes
atggcagtgagccaag

SEQ ID NO: 213600 - DNA, 16 bp, P. troglodytes
atggcagttcctcaaa

SEQ ID NO: 213601 - DNA, 16 bp, P. troglodytes
atggcatcttcaatgg

SEQ ID NO: 213602 - DNA, 16 bp, P. troglodytes
atggcatgaacccggt

SEQ ID NO: 213603 - DNA, 16 bp, P. troglodytes
atggcattaatttatt

SEQ ID NO: 213604 - DNA, 16 bp, P. troglodytes
atggcattttttaaaa

SEQ ID NO: 213605 - DNA, 16 bp, P. troglodytes
atggccaacaggtata

SEQ ID NO: 213606 - DNA, 22 bp, P. troglodytes
atggccaacatggtgaaacccc

SEQ ID NO: 213607 - DNA, 16 bp, P. troglodytes
atggccaagatggtga

SEQ ID NO: 213608 - DNA, 16 bp, P. troglodytes
atggccaatcttgttt

SEQ ID NO: 213609 - DNA, 17 bp, P. troglodytes
atggccacctgagggaa

SEQ ID NO: 213610 - DNA, 16 bp, P. troglodytes
atggccaggcgcagtg

SEQ ID NO: 213611 - DNA, 16 bp, P. troglodytes
atggccagggaggcct

SEQ ID NO: 213612 - DNA, 16 bp, P. troglodytes
atggccagggcaggag

SEQ ID NO: 213613 - DNA, 16 bp, P. troglodytes
atggccataatgccca

SEQ ID NO: 213614 - DNA, 19 bp, P. troglodytes
atggccatactgcccaaag

SEQ ID NO: 213615 - DNA, 16 bp, P. troglodytes
atggccatctgcaagc

SEQ ID NO: 213616 - DNA, 16 bp, P. troglodytes
atggcccacaaagcct

SEQ ID NO: 213617 - DNA, 16 bp, P. troglodytes
atggcccttgcagtga

SEQ ID NO: 213618 - DNA, 16 bp, P. troglodytes
atggccgggcgcagtg

SEQ ID NO: 213619 - DNA, 16 bp, P. troglodytes
atggcctacaaagcct

SEQ ID NO: 213620 - DNA, 26 bp, P. troglodytes
atggcctcatgggaagggaaagacct

SEQ ID NO: 213621 - DNA, 16 bp, P. troglodytes
atggcctccagctcca

SEQ ID NO: 213622 - DNA, 16 bp, P. troglodytes
atggcctccagctgca

SEQ ID NO: 213623 - DNA, 16 bp, P. troglodytes
atggcctccatctcca

SEQ ID NO: 213624 - DNA, 16 bp, P. troglodytes
atggcctcccctgagg

SEQ ID NO: 213625 - DNA, 16 bp, P. troglodytes
atggcctctggctcca

SEQ ID NO: 213626 - DNA, 16 bp, P. troglodytes
atggcgaaaccccgtc

SEQ ID NO: 213627 - DNA, 19 bp, P. troglodytes
atggcgctatctcggctca

SEQ ID NO: 213628 - DNA, 16 bp, P. troglodytes
atggcgctggcatctg

SEQ ID NO: 213629 - DNA, 16 bp, P. troglodytes
atggcggaaagcaaag

SEQ ID NO: 213630 - DNA, 16 bp, P. troglodytes
atggcggaaggagaag

SEQ ID NO: 213631 - DNA, 16 bp, P. troglodytes
atggcggcagacaaga

SEQ ID NO: 213632 - DNA, 18 bp, P. troglodytes
atggcgtgaacccaggag

SEQ ID NO: 213633 - DNA, 16 bp, P. troglodytes
atggcgtgaacctggg

SEQ ID NO: 213634 - DNA, 17 bp, P. troglodytes
atggcgtgatctcggcc

SEQ ID NO: 213635 - DNA, 16 bp, P. troglodytes
atggctaaaataagaa

SEQ ID NO: 213636 - DNA, 16 bp, P. troglodytes
atggctagccagtaat

SEQ ID NO: 213637 - DNA, 16 bp, P. troglodytes
atggctatcatcaaaa

SEQ ID NO: 213638 - DNA, 16 bp, P. troglodytes
atggctatttttattt

SEQ ID NO: 213639 - DNA, 18 bp, P. troglodytes
atggctcacacctataat

SEQ ID NO: 213640 - DNA, 17 bp, P. troglodytes
atggctcacgcctgtaa

SEQ ID NO: 213641 - DNA, 17 bp, P. troglodytes
atggctcactgcagcca

SEQ ID NO: 213642 - DNA, 16 bp, P. troglodytes
atggctcagcctcctg

SEQ ID NO: 213643 - DNA, 16 bp, P. troglodytes
atggctcatgccttta

SEQ ID NO: 213644 - DNA, 16 bp, P. troglodytes
atggctctggaggctg

SEQ ID NO: 213645 - DNA, 16 bp, P. troglodytes
atggctgaaggtgaag

SEQ ID NO: 213646 - DNA, 16 bp, P. troglodytes
atggctgaggcaggag

SEQ ID NO: 213647 - DNA, 16 bp, P. troglodytes
atggctgcaccatttt

SEQ ID NO: 213648 - DNA, 16 bp, P. troglodytes
atggctgctgactgac

SEQ ID NO: 213649 - DNA, 16 bp, P. troglodytes
atggctgctgtaacaa

SEQ ID NO: 213650 - DNA, 16 bp, P. troglodytes
atggctggatcacatg

SEQ ID NO: 213651 - DNA, 16 bp, P. troglodytes
atggcttaaaacaaca

SEQ ID NO: 213652 - DNA, 16 bp, P. troglodytes
atggcttaaacaacag

SEQ ID NO: 213653 - DNA, 16 bp, P. troglodytes
atggcttcaaagagaa

SEQ ID NO: 213654 - DNA, 16 bp, P. troglodytes
atggcttcatagctca

SEQ ID NO: 213655 - DNA, 16 bp, P. troglodytes
atggcttccaactcca

SEQ ID NO: 213656 - DNA, 16 bp, P. troglodytes
atggcttccagtttca

SEQ ID NO: 213657 - DNA, 16 bp, P. troglodytes
atggcttccatttggc

SEQ ID NO: 213658 - DNA, 16 bp, P. troglodytes
atggcttctagcttca

SEQ ID NO: 213659 - DNA, 16 bp, P. troglodytes
atggcttgaaaatatt

SEQ ID NO: 213660 - DNA, 17 bp, P. troglodytes
atggcttgaggccagga

SEQ ID NO: 213661 - DNA, 16 bp, P. troglodytes
atggctttaaaaaaaa

SEQ ID NO: 213662 - DNA, 16 bp, P. troglodytes
atggctttggcagtgt

SEQ ID NO: 213663 - DNA, 16 bp, P. troglodytes
atgggaaaaatagaca

SEQ ID NO: 213664 - DNA, 16 bp, P. troglodytes
atgggaaaaatatttg

SEQ ID NO: 213665 - DNA, 16 bp, P. troglodytes
atgggaaaacattcca

SEQ ID NO: 213666 - DNA, 16 bp, P. troglodytes
atgggaaaagaacagt

SEQ ID NO: 213667 - DNA, 16 bp, P. troglodytes
atgggaaaccactgga

SEQ ID NO: 213668 - DNA, 16 bp, P. troglodytes
atgggaactcactcac

SEQ ID NO: 213669 - DNA, 16 bp, P. troglodytes
atgggaagcccatcag

SEQ ID NO: 213670 - DNA, 16 bp, P. troglodytes
atgggaattttaaaaa

SEQ ID NO: 213671 - DNA, 16 bp, P. troglodytes
atgggaccatctagtt

SEQ ID NO: 213672 - DNA, 16 bp, P. troglodytes
atgggactgtttgttt

SEQ ID NO: 213673 - DNA, 16 bp, P. troglodytes
atgggactttggactt

SEQ ID NO: 213674 - DNA, 16 bp, P. troglodytes
atgggagaaaatatat

SEQ ID NO: 213675 - DNA, 16 bp, P. troglodytes
atgggagaaaattttc

SEQ ID NO: 213676 - DNA, 16 bp, P. troglodytes
atgggagatacaattc

SEQ ID NO: 213677 - DNA, 20 bp, P. troglodytes
atgggaggatcacttgaggc

SEQ ID NO: 213678 - DNA, 16 bp, P. troglodytes
atgggaggcaggacta

SEQ ID NO: 213679 - DNA, 16 bp, P. troglodytes
atgggagggacccagt

SEQ ID NO: 213680 - DNA, 16 bp, P. troglodytes
atgggagggaggaatt

SEQ ID NO: 213681 - DNA, 16 bp, P. troglodytes
atgggatcttgctgtg

SEQ ID NO: 213682 - DNA, 16 bp, P. troglodytes
atgggatggcatcctg

SEQ ID NO: 213683 - DNA, 16 bp, P. troglodytes
atgggatgtgaaggac

SEQ ID NO: 213684 - DNA, 16 bp, P. troglodytes
atgggattgctgggac

SEQ ID NO: 213685 - DNA, 16 bp, P. troglodytes
atgggattgctgtgtc

SEQ ID NO: 213686 - DNA, 16 bp, P. troglodytes
atgggatttaaaaaaa

SEQ ID NO: 213687 - DNA, 16 bp, P. troglodytes
atgggatttctccatg

SEQ ID NO: 213688 - DNA, 16 bp, P. troglodytes
atgggatttttaaaaa

SEQ ID NO: 213689 - DNA, 16 bp, P. troglodytes
atgggcacagagaggg

SEQ ID NO: 213690 - DNA, 16 bp, P. troglodytes
atgggcagcacagcag

SEQ ID NO: 213691 - DNA, 16 bp, P. troglodytes
atgggcagccaggcag

SEQ ID NO: 213692 - DNA, 16 bp, P. troglodytes
atgggcagggagaaga

SEQ ID NO: 213693 - DNA, 16 bp, P. troglodytes
atgggcatactgccca

SEQ ID NO: 213694 - DNA, 16 bp, P. troglodytes
atgggccaggcatggt

SEQ ID NO: 213695 - DNA, 16 bp, P. troglodytes
atgggccagggccagg

SEQ ID NO: 213696 - DNA, 16 bp, P. troglodytes
atgggccttgggctct

SEQ ID NO: 213697 - DNA, 16 bp, P. troglodytes
atgggctagcattgag

SEQ ID NO: 213698 - DNA, 16 bp, P. troglodytes
atgggctcagaaatgt

SEQ ID NO: 213699 - DNA, 16 bp, P. troglodytes
atgggctccatctcct

SEQ ID NO: 213700 - DNA, 16 bp, P. troglodytes
atgggctctggagcca

SEQ ID NO: 213701 - DNA, 16 bp, P. troglodytes
atgggctgctcaactg

SEQ ID NO: 213702 - DNA, 16 bp, P. troglodytes
atgggctgtagaatgg

SEQ ID NO: 213703 - DNA, 16 bp, P. troglodytes
atggggaaaaaaatca

SEQ ID NO: 213704 - DNA, 16 bp, P. troglodytes
atggggaaaaaacaga

SEQ ID NO: 213705 - DNA, 16 bp, P. troglodytes
atggggaaaagctgaa

SEQ ID NO: 213706 - DNA, 16 bp, P. troglodytes
atggggaaaatctgaa

SEQ ID NO: 213707 - DNA, 16 bp, P. troglodytes
atggggaaaatgcctt

SEQ ID NO: 213708 - DNA, 16 bp, P. troglodytes
atggggaaacggaggc

SEQ ID NO: 213709 - DNA, 16 bp, P. troglodytes
atggggaaactgagac

SEQ ID NO: 213710 - DNA, 16 bp, P. troglodytes
atggggaaactgaggt

SEQ ID NO: 213711 - DNA, 16 bp, P. troglodytes
atggggaaagaattcc

SEQ ID NO: 213712 - DNA, 16 bp, P. troglodytes
atggggaaatggaggc

SEQ ID NO: 213713 - DNA, 16 bp, P. troglodytes
atggggacatggagaa

SEQ ID NO: 213714 - DNA, 16 bp, P. troglodytes
atggggacttggagaa

SEQ ID NO: 213715 - DNA, 16 bp, P. troglodytes
atggggagactgaggc

SEQ ID NO: 213716 - DNA, 16 bp, P. troglodytes
atggggagctctggag

SEQ ID NO: 213717 - DNA, 16 bp, P. troglodytes
atggggattattacaa

SEQ ID NO: 213718 - DNA, 16 bp, P. troglodytes
atggggccactgcact

SEQ ID NO: 213719 - DNA, 16 bp, P. troglodytes
atggggcctcactctg

SEQ ID NO: 213720 - DNA, 16 bp, P. troglodytes
atgggggaaaaaaatc

SEQ ID NO: 213721 - DNA, 16 bp, P. troglodytes
atgggggcaggtcttt

SEQ ID NO: 213722 - DNA, 16 bp, P. troglodytes
atgggggccccaccct

SEQ ID NO: 213723 - DNA, 16 bp, P. troglodytes
atgggggcgggttttt

SEQ ID NO: 213724 - DNA, 16 bp, P. troglodytes
atggggggaaccaccc

SEQ ID NO: 213725 - DNA, 16 bp, P. troglodytes
atgggggtggtttcct

SEQ ID NO: 213726 - DNA, 16 bp, P. troglodytes
atggggtcttgctatg

SEQ ID NO: 213727 - DNA, 16 bp, P. troglodytes
atggggttgttgtgag

SEQ ID NO: 213728 - DNA, 16 bp, P. troglodytes
atggggtttcaccata

SEQ ID NO: 213729 - DNA, 16 bp, P. troglodytes
atggggtttcactatc

SEQ ID NO: 213730 - DNA, 16 bp, P. troglodytes
atggggtttcgtcatg

SEQ ID NO: 213731 - DNA, 16 bp, P. troglodytes
atggggtttctccaag

SEQ ID NO: 213732 - DNA, 16 bp, P. troglodytes
atggggtttctccatg

SEQ ID NO: 213733 - DNA, 16 bp, P. troglodytes
atggggtttcttcatg

SEQ ID NO: 213734 - DNA, 16 bp, P. troglodytes
atggggtttcttttgg

SEQ ID NO: 213735 - DNA, 16 bp, P. troglodytes
atggggttttcaaaat

SEQ ID NO: 213736 - DNA, 16 bp, P. troglodytes
atggggttttcccatg

SEQ ID NO: 213737 - DNA, 16 bp, P. troglodytes
atggggttttgccatg

SEQ ID NO: 213738 - DNA, 16 bp, P. troglodytes
atggggttttgccctg

SEQ ID NO: 213739 - DNA, 16 bp, P. troglodytes
atgggtcagggagggg

SEQ ID NO: 213740 - DNA, 16 bp, P. troglodytes
atgggtgaaattggaa

SEQ ID NO: 213741 - DNA, 16 bp, P. troglodytes
atgggtgaactgtatg

SEQ ID NO: 213742 - DNA, 16 bp, P. troglodytes
atgggtgaaggtcctg

SEQ ID NO: 213743 - DNA, 16 bp, P. troglodytes
atgggtgaattttata

SEQ ID NO: 213744 - DNA, 16 bp, P. troglodytes
atgggtgacagaacaa

SEQ ID NO: 213745 - DNA, 16 bp, P. troglodytes
atgggtgaggaaaaga

SEQ ID NO: 213746 - DNA, 17 bp, P. troglodytes
atgggtgcagcaaacca

SEQ ID NO: 213747 - DNA, 16 bp, P. troglodytes
atgggtggagctggag

SEQ ID NO: 213748 - DNA, 16 bp, P. troglodytes
atgggttttcaccatg

SEQ ID NO: 213749 - DNA, 16 bp, P. troglodytes
atggtaaaaacaaaca

SEQ ID NO: 213750 - DNA, 16 bp, P. troglodytes
atggtaaaatatatat

SEQ ID NO: 213751 - DNA, 16 bp, P. troglodytes
atggtaaaattggttt

SEQ ID NO: 213752 - DNA, 16 bp, P. troglodytes
atggtaaagagatcaa

SEQ ID NO: 213753 - DNA, 16 bp, P. troglodytes
atggtaaatatataca

SEQ ID NO: 213754 - DNA, 16 bp, P. troglodytes
atggtaaatgttatgt

SEQ ID NO: 213755 - DNA, 16 bp, P. troglodytes
atggtaaattttatat

SEQ ID NO: 213756 - DNA, 16 bp, P. troglodytes
atggtacatttgttac

SEQ ID NO: 213757 - DNA, 16 bp, P. troglodytes
atggtacattttatgt

SEQ ID NO: 213758 - DNA, 16 bp, P. troglodytes
atggtagaaatagcaa

SEQ ID NO: 213759 - DNA, 16 bp, P. troglodytes
atggtagagagcagtc

SEQ ID NO: 213760 - DNA, 16 bp, P. troglodytes
atggtagcacacacct

SEQ ID NO: 213761 - DNA, 16 bp, P. troglodytes
atggtagctgtatttt

SEQ ID NO: 213762 - DNA, 16 bp, P. troglodytes
atggtagttctttttt

SEQ ID NO: 213763 - DNA, 16 bp, P. troglodytes
atggtatagcctacca

SEQ ID NO: 213764 - DNA, 16 bp, P. troglodytes
atggtatatatgtata

SEQ ID NO: 213765 - DNA, 16 bp, P. troglodytes
atggtatctaattgtg

SEQ ID NO: 213766 - DNA, 16 bp, P. troglodytes
atggtattgctgggtt

SEQ ID NO: 213767 - DNA, 16 bp, P. troglodytes
atggtatttcccaggt

SEQ ID NO: 213768 - DNA, 16 bp, P. troglodytes
atggtcaggctgcaaa

SEQ ID NO: 213769 - DNA, 16 bp, P. troglodytes
atggtcaggctggtct

SEQ ID NO: 213770 - DNA, 16 bp, P. troglodytes
atggtcccagctacta

SEQ ID NO: 213771 - DNA, 18 bp, P. troglodytes
atggtctcaaactcctgg

SEQ ID NO: 213772 - DNA, 16 bp, P. troglodytes
atggtctccctctccc

SEQ ID NO: 213773 - DNA, 16 bp, P. troglodytes
atggtcttctttgtct

SEQ ID NO: 213774 - DNA, 17 bp, P. troglodytes
atggtctttacaatttg

SEQ ID NO: 213775 - DNA, 16 bp, P. troglodytes
atggtctttattgtgt

SEQ ID NO: 213776 - DNA, 16 bp, P. troglodytes
atggtcttttaaaaac

SEQ ID NO: 213777 - DNA, 16 bp, P. troglodytes
atggtgaaaaagtaaa

SEQ ID NO: 213778 - DNA, 16 bp, P. troglodytes
atggtgaaacccatct

SEQ ID NO: 213779 - DNA, 16 bp, P. troglodytes
atggtgaaaccccatc

SEQ ID NO: 213780 - DNA, 16 bp, P. troglodytes
atggtgaaaccccgtc

SEQ ID NO: 213781 - DNA, 18 bp, P. troglodytes
atggtgaaaccccgtctt

SEQ ID NO: 213782 - DNA, 16 bp, P. troglodytes
atggtgaaaccctgtc

SEQ ID NO: 213783 - DNA, 16 bp, P. troglodytes
atggtgaaaccctgtt

SEQ ID NO: 213784 - DNA, 16 bp, P. troglodytes
atggtgaaacctgttt

SEQ ID NO: 213785 - DNA, 20 bp, P. troglodytes
atggtgaaactccgtctcta

SEQ ID NO: 213786 - DNA, 16 bp, P. troglodytes
atggtgaaactctgtc

SEQ ID NO: 213787 - DNA, 16 bp, P. troglodytes
atggtgacaccccgtc

SEQ ID NO: 213788 - DNA, 16 bp, P. troglodytes
atggtgacctcctggg

SEQ ID NO: 213789 - DNA, 16 bp, P. troglodytes
atggtgatgaagatga

SEQ ID NO: 213790 - DNA, 16 bp, P. troglodytes
atggtgatgatggttg

SEQ ID NO: 213791 - DNA, 19 bp, P. troglodytes
atggtgcaatcttggctca

SEQ ID NO: 213792 - DNA, 16 bp, P. troglodytes
atggtgccaatgcact

SEQ ID NO: 213793 - DNA, 16 bp, P. troglodytes
atggtgccactgcacc

SEQ ID NO: 213794 - DNA, 16 bp, P. troglodytes
atggtgcccactcaga

SEQ ID NO: 213795 - DNA, 16 bp, P. troglodytes
atggtgctaaaccatt

SEQ ID NO: 213796 - DNA, 16 bp, P. troglodytes
atggtgctgaaaaaaa

SEQ ID NO: 213797 - DNA, 16 bp, P. troglodytes
atggtgctgaaccatt

SEQ ID NO: 213798 - DNA, 16 bp, P. troglodytes
atggtggaaaaggaaa

SEQ ID NO: 213799 - DNA, 16 bp, P. troglodytes
atggtggaaagcaaag

SEQ ID NO: 213800 - DNA, 16 bp, P. troglodytes
atggtggaagatgaaa

SEQ ID NO: 213801 - DNA, 16 bp, P. troglodytes
atggtggaaggagaag

SEQ ID NO: 213802 - DNA, 16 bp, P. troglodytes
atggtggaaggcaaaa

SEQ ID NO: 213803 - DNA, 16 bp, P. troglodytes
atggtggcacattcct

SEQ ID NO: 213804 - DNA, 16 bp, P. troglodytes
atggtggcacctgcct

SEQ ID NO: 213805 - DNA, 16 bp, P. troglodytes
atggtggcacgcgcct

SEQ ID NO: 213806 - DNA, 16 bp, P. troglodytes
atggtggcagcagcag

SEQ ID NO: 213807 - DNA, 16 bp, P. troglodytes
atggtggcaggcactt

SEQ ID NO: 213808 - DNA, 16 bp, P. troglodytes
atggtggcagtcaaga

SEQ ID NO: 213809 - DNA, 16 bp, P. troglodytes
atggtggcagtcacct

SEQ ID NO: 213810 - DNA, 16 bp, P. troglodytes
atggtggcagtggtgg

SEQ ID NO: 213811 - DNA, 16 bp, P. troglodytes
atggtggcatggacct

SEQ ID NO: 213812 - DNA, 17 bp, P. troglodytes
atggtggctcacgccta

SEQ ID NO: 213813 - DNA, 16 bp, P. troglodytes
atggtggctgccaggg

SEQ ID NO: 213814 - DNA, 16 bp, P. troglodytes
atggtggctggtgcct

SEQ ID NO: 213815 - DNA, 16 bp, P. troglodytes
atggtggctgtcttct

SEQ ID NO: 213816 - DNA, 16 bp, P. troglodytes
atggtgggggagttct

SEQ ID NO: 213817 - DNA, 16 bp, P. troglodytes
atggtggtacatgcct

SEQ ID NO: 213818 - DNA, 16 bp, P. troglodytes
atggtggtgcaggcct

SEQ ID NO: 213819 - DNA, 16 bp, P. troglodytes
atggtggtgcatgtct

SEQ ID NO: 213820 - DNA, 16 bp, P. troglodytes
atggtggtggtatttt

SEQ ID NO: 213821 - DNA, 16 bp, P. troglodytes
atggtggttaccagga

SEQ ID NO: 213822 - DNA, 16 bp, P. troglodytes
atggtggttgtcaggg

SEQ ID NO: 213823 - DNA, 16 bp, P. troglodytes
atggtgtaaatacttc

SEQ ID NO: 213824 - DNA, 16 bp, P. troglodytes
atggtgtcttattgtg

SEQ ID NO: 213825 - DNA, 16 bp, P. troglodytes
atggtgtgaactcggg

SEQ ID NO: 213826 - DNA, 19 bp, P. troglodytes
atggtgtggtcttggctca

SEQ ID NO: 213827 - DNA, 16 bp, P. troglodytes
atggtgttggggaaac

SEQ ID NO: 213828 - DNA, 16 bp, P. troglodytes
atggttaaatctagct

SEQ ID NO: 213829 - DNA, 16 bp, P. troglodytes
atggttaatttcatgt

SEQ ID NO: 213830 - DNA, 16 bp, P. troglodytes
atggttataattaaaa

SEQ ID NO: 213831 - DNA, 16 bp, P. troglodytes
atggttattttaaaaa

SEQ ID NO: 213832 - DNA, 16 bp, P. troglodytes
atggttccacttacat

SEQ ID NO: 213833 - DNA, 16 bp, P. troglodytes
atggttgaagctggaa

SEQ ID NO: 213834 - DNA, 16 bp, P. troglodytes
atggttgccaggggct

SEQ ID NO: 213835 - DNA, 16 bp, P. troglodytes
atggttgtaatcccag

SEQ ID NO: 213836 - DNA, 16 bp, P. troglodytes
atggttgtgaggatta

SEQ ID NO: 213837 - DNA, 16 bp, P. troglodytes
atggtttcagaaggaa

SEQ ID NO: 213838 - DNA, 16 bp, P. troglodytes
atggtttccagcctca

SEQ ID NO: 213839 - DNA, 16 bp, P. troglodytes
atggtttccagctcca

SEQ ID NO: 213840 - DNA, 16 bp, P. troglodytes
atggtttcgccatgtt

SEQ ID NO: 213841 - DNA, 16 bp, P. troglodytes
atggtttgaatgcttg

SEQ ID NO: 213842 - DNA, 16 bp, P. troglodytes
atggtttgaatgtgtc

SEQ ID NO: 213843 - DNA, 16 bp, P. troglodytes
atggtttgctcagaat

SEQ ID NO: 213844 - DNA, 16 bp, P. troglodytes
atggttttaaaaagag

SEQ ID NO: 213845 - DNA, 16 bp, P. troglodytes
atggttttaagtctaa

SEQ ID NO: 213846 - DNA, 16 bp, P. troglodytes
atggttttacaagggg

SEQ ID NO: 213847 - DNA, 16 bp, P. troglodytes
atggtttttaaaatgg

SEQ ID NO: 213848 - DNA, 16 bp, P. troglodytes
atgtaaaaatacataa

SEQ ID NO: 213849 - DNA, 16 bp, P. troglodytes
atgtaaaaatgctcaa

SEQ ID NO: 213850 - DNA, 16 bp, P. troglodytes
atgtaaaacacaaaat

SEQ ID NO: 213851 - DNA, 16 bp, P. troglodytes
atgtaaaagccaaaac

SEQ ID NO: 213852 - DNA, 16 bp, P. troglodytes
atgtaaaatcattttt

SEQ ID NO: 213853 - DNA, 16 bp, P. troglodytes
atgtaaaatggtgcag

SEQ ID NO: 213854 - DNA, 16 bp, P. troglodytes
atgtaaaatgtacatt

SEQ ID NO: 213855 - DNA, 16 bp, P. troglodytes
atgtaaaatgtgaaac

SEQ ID NO: 213856 - DNA, 16 bp, P. troglodytes
atgtaaaatgtggatt

SEQ ID NO: 213857 - DNA, 16 bp, P. troglodytes
atgtaaacagattaaa

SEQ ID NO: 213858 - DNA, 16 bp, P. troglodytes
atgtaaacttattttt

SEQ ID NO: 213859 - DNA, 16 bp, P. troglodytes
atgtaaagaaactgaa

SEQ ID NO: 213860 - DNA, 16 bp, P. troglodytes
atgtaaagcaaccaaa

SEQ ID NO: 213861 - DNA, 16 bp, P. troglodytes
atgtaaagcacttagt

SEQ ID NO: 213862 - DNA, 16 bp, P. troglodytes
atgtaaagcccaaaac

SEQ ID NO: 213863 - DNA, 16 bp, P. troglodytes
atgtaaataaatacat

SEQ ID NO: 213864 - DNA, 16 bp, P. troglodytes
atgtaaatacatggaa

SEQ ID NO: 213865 - DNA, 16 bp, P. troglodytes
atgtaaatagttgtta

SEQ ID NO: 213866 - DNA, 16 bp, P. troglodytes
atgtaaatatatgtaa

SEQ ID NO: 213867 - DNA, 16 bp, P. troglodytes
atgtaaatattttatg

SEQ ID NO: 213868 - DNA, 16 bp, P. troglodytes
atgtaaatattttgta

SEQ ID NO: 213869 - DNA, 16 bp, P. troglodytes
atgtaaatcaaaacca

SEQ ID NO: 213870 - DNA, 16 bp, P. troglodytes
atgtaaatgatgggtt

SEQ ID NO: 213871 - DNA, 16 bp, P. troglodytes
atgtaaatggaatcat

SEQ ID NO: 213872 - DNA, 16 bp, P. troglodytes
atgtaaatggaccaaa

SEQ ID NO: 213873 - DNA, 16 bp, P. troglodytes
atgtaaatggtagttt

SEQ ID NO: 213874 - DNA, 16 bp, P. troglodytes
atgtaaatgtaaatgt

SEQ ID NO: 213875 - DNA, 16 bp, P. troglodytes
atgtaaattaaaacca

SEQ ID NO: 213876 - DNA, 16 bp, P. troglodytes
atgtaaattagtccag

SEQ ID NO: 213877 - DNA, 16 bp, P. troglodytes
atgtaaatttatttct

SEQ ID NO: 213878 - DNA, 16 bp, P. troglodytes
atgtaacaaaactgca

SEQ ID NO: 213879 - DNA, 16 bp, P. troglodytes
atgtaacaaaccagca

SEQ ID NO: 213880 - DNA, 16 bp, P. troglodytes
atgtaacaaacctgca

SEQ ID NO: 213881 - DNA, 16 bp, P. troglodytes
atgtaacaaacttgca

SEQ ID NO: 213882 - DNA, 16 bp, P. troglodytes
atgtaaccaaacacca

SEQ ID NO: 213883 - DNA, 16 bp, P. troglodytes
atgtaaccctgaactt

SEQ ID NO: 213884 - DNA, 16 bp, P. troglodytes
atgtaacttttatatg

SEQ ID NO: 213885 - DNA, 16 bp, P. troglodytes
atgtaagaaaacattt

SEQ ID NO: 213886 - DNA, 16 bp, P. troglodytes
atgtaagaaacctgca

SEQ ID NO: 213887 - DNA, 16 bp, P. troglodytes
atgtaagaaggacatg

SEQ ID NO: 213888 - DNA, 16 bp, P. troglodytes
atgtaagtggaatcat

SEQ ID NO: 213889 - DNA, 16 bp, P. troglodytes
atgtaatattttcaaa

SEQ ID NO: 213890 - DNA, 16 bp, P. troglodytes
atgtaatattttgaaa

SEQ ID NO: 213891 - DNA, 16 bp, P. troglodytes
atgtaatattttgata

SEQ ID NO: 213892 - DNA, 16 bp, P. troglodytes
atgtaatcaatatttt

SEQ ID NO: 213893 - DNA, 16 bp, P. troglodytes
atgtaatcccagctac

SEQ ID NO: 213894 - DNA, 16 bp, P. troglodytes
atgtaatcctcccacc

SEQ ID NO: 213895 - DNA, 16 bp, P. troglodytes
atgtaatgtggtatcc

SEQ ID NO: 213896 - DNA, 16 bp, P. troglodytes
atgtaattataaaaca

SEQ ID NO: 213897 - DNA, 16 bp, P. troglodytes
atgtacaaatatatgt

SEQ ID NO: 213898 - DNA, 16 bp, P. troglodytes
atgtacaattattatt

SEQ ID NO: 213899 - DNA, 16 bp, P. troglodytes
atgtacacacacacaa

SEQ ID NO: 213900 - DNA, 16 bp, P. troglodytes
atgtacacacacattt

SEQ ID NO: 213901 - DNA, 16 bp, P. troglodytes
atgtacaccatgaaat

SEQ ID NO: 213902 - DNA, 16 bp, P. troglodytes
atgtacagaaatcaca

SEQ ID NO: 213903 - DNA, 16 bp, P. troglodytes
atgtacagaaatcaga

SEQ ID NO: 213904 - DNA, 16 bp, P. troglodytes
atgtacagaactctcc

SEQ ID NO: 213905 - DNA, 16 bp, P. troglodytes
atgtacagcatgatga

SEQ ID NO: 213906 - DNA, 16 bp, P. troglodytes
atgtacatacacacac

SEQ ID NO: 213907 - DNA, 16 bp, P. troglodytes
atgtacatatgcatat

SEQ ID NO: 213908 - DNA, 16 bp, P. troglodytes
atgtacatgtatatat

SEQ ID NO: 213909 - DNA, 16 bp, P. troglodytes
atgtacatgtatatgt

SEQ ID NO: 213910 - DNA, 16 bp, P. troglodytes
atgtacatgtatcttt

SEQ ID NO: 213911 - DNA, 16 bp, P. troglodytes
atgtacattaattttg

SEQ ID NO: 213912 - DNA, 16 bp, P. troglodytes
atgtacattatatatt

SEQ ID NO: 213913 - DNA, 16 bp, P. troglodytes
atgtacattttcatat

SEQ ID NO: 213914 - DNA, 16 bp, P. troglodytes
atgtaccacatcttct

SEQ ID NO: 213915 - DNA, 16 bp, P. troglodytes
atgtaccacattttgt

SEQ ID NO: 213916 - DNA, 16 bp, P. troglodytes
atgtactgaatgccac

SEQ ID NO: 213917 - DNA, 16 bp, P. troglodytes
atgtagaaaatctcaa

SEQ ID NO: 213918 - DNA, 16 bp, P. troglodytes
atgtagaaagctggaa

SEQ ID NO: 213919 - DNA, 16 bp, P. troglodytes
atgtagaatgattaaa

SEQ ID NO: 213920 - DNA, 16 bp, P. troglodytes
atgtagcatatataca

SEQ ID NO: 213921 - DNA, 16 bp, P. troglodytes
atgtagcctctggaaa

SEQ ID NO: 213922 - DNA, 17 bp, P. troglodytes
atgtagctgggactaca

SEQ ID NO: 213923 - DNA, 16 bp, P. troglodytes
atgtaggctttttcta

SEQ ID NO: 213924 - DNA, 16 bp, P. troglodytes
atgtaggtatttattg

SEQ ID NO: 213925 - DNA, 16 bp, P. troglodytes
atgtagtatatatatt

SEQ ID NO: 213926 - DNA, 16 bp, P. troglodytes
atgtagtcaaaggaga

SEQ ID NO: 213927 - DNA, 17 bp, P. troglodytes
atgtagtcccagctact

SEQ ID NO: 213928 - DNA, 16 bp, P. troglodytes
atgtagttgaatttat

SEQ ID NO: 213929 - DNA, 16 bp, P. troglodytes
atgtataaaaatgcct

SEQ ID NO: 213930 - DNA, 16 bp, P. troglodytes
atgtataaaatacata

SEQ ID NO: 213931 - DNA, 16 bp, P. troglodytes
atgtataaaatcatat

SEQ ID NO: 213932 - DNA, 16 bp, P. troglodytes
atgtataaatgtatat

SEQ ID NO: 213933 - DNA, 16 bp, P. troglodytes
atgtataaatgtattt

SEQ ID NO: 213934 - DNA, 16 bp, P. troglodytes
atgtataacaaaacca

SEQ ID NO: 213935 - DNA, 16 bp, P. troglodytes
atgtataacttttgac

SEQ ID NO: 213936 - DNA, 16 bp, P. troglodytes
atgtataagaatgctt

SEQ ID NO: 213937 - DNA, 16 bp, P. troglodytes
atgtataagtttttgt

SEQ ID NO: 213938 - DNA, 16 bp, P. troglodytes
atgtatacaaataaaa

SEQ ID NO: 213939 - DNA, 16 bp, P. troglodytes
atgtatacaaatatat

SEQ ID NO: 213940 - DNA, 16 bp, P. troglodytes
atgtatacacacatgt

SEQ ID NO: 213941 - DNA, 16 bp, P. troglodytes
atgtatacacatatgt

SEQ ID NO: 213942 - DNA, 16 bp, P. troglodytes
atgtatacacatgtaa

SEQ ID NO: 213943 - DNA, 16 bp, P. troglodytes
atgtatacactgggaa

SEQ ID NO: 213944 - DNA, 16 bp, P. troglodytes
atgtatacagatgtaa

SEQ ID NO: 213945 - DNA, 16 bp, P. troglodytes
atgtatacatatacac

SEQ ID NO: 213946 - DNA, 16 bp, P. troglodytes
atgtatacatttatgt

SEQ ID NO: 213947 - DNA, 16 bp, P. troglodytes
atgtatacattttaaa

SEQ ID NO: 213948 - DNA, 16 bp, P. troglodytes
atgtatagatacatat

SEQ ID NO: 213949 - DNA, 16 bp, P. troglodytes
atgtatataaaatgtg

SEQ ID NO: 213950 - DNA, 16 bp, P. troglodytes
atgtatataagatata

SEQ ID NO: 213951 - DNA, 16 bp, P. troglodytes
atgtatatacaaatgt

SEQ ID NO: 213952 - DNA, 16 bp, P. troglodytes
atgtatatacatttat

SEQ ID NO: 213953 - DNA, 16 bp, P. troglodytes
atgtatatataaagca

SEQ ID NO: 213954 - DNA, 18 bp, P. troglodytes
atgtatatatacatatac

SEQ ID NO: 213955 - DNA, 16 bp, P. troglodytes
atgtatatatacatgt

SEQ ID NO: 213956 - DNA, 16 bp, P. troglodytes
atgtatatatatgata

SEQ ID NO: 213957 - DNA, 16 bp, P. troglodytes
atgtatatatgaaagg

SEQ ID NO: 213958 - DNA, 16 bp, P. troglodytes
atgtatatatgtatag

SEQ ID NO: 213959 - DNA, 16 bp, P. troglodytes
atgtatatatttctct

SEQ ID NO: 213960 - DNA, 16 bp, P. troglodytes
atgtatatatttcttt

SEQ ID NO: 213961 - DNA, 16 bp, P. troglodytes
atgtatatatttgaga

SEQ ID NO: 213962 - DNA, 16 bp, P. troglodytes
atgtatatattttctt

SEQ ID NO: 213963 - DNA, 16 bp, P. troglodytes
atgtatatcaaaacat

SEQ ID NO: 213964 - DNA, 16 bp, P. troglodytes
atgtatatcaaaatat

SEQ ID NO: 213965 - DNA, 16 bp, P. troglodytes
atgtatatcatatata

SEQ ID NO: 213966 - DNA, 16 bp, P. troglodytes
atgtatatgcatgtat

SEQ ID NO: 213967 - DNA, 16 bp, P. troglodytes
atgtatatgtacacac

SEQ ID NO: 213968 - DNA, 16 bp, P. troglodytes
atgtatatgtgtaaat

SEQ ID NO: 213969 - DNA, 16 bp, P. troglodytes
atgtatatgtgtgtga

SEQ ID NO: 213970 - DNA, 16 bp, P. troglodytes
atgtatatgtttgtgt

SEQ ID NO: 213971 - DNA, 16 bp, P. troglodytes
atgtatattacatata

SEQ ID NO: 213972 - DNA, 16 bp, P. troglodytes
atgtatattatatatc

SEQ ID NO: 213973 - DNA, 16 bp, P. troglodytes
atgtatatttcttatt

SEQ ID NO: 213974 - DNA, 16 bp, P. troglodytes
atgtatatttgtacat

SEQ ID NO: 213975 - DNA, 16 bp, P. troglodytes
atgtatattttaaatg

SEQ ID NO: 213976 - DNA, 16 bp, P. troglodytes
atgtatattttattct

SEQ ID NO: 213977 - DNA, 16 bp, P. troglodytes
atgtatcaattaaaaa

SEQ ID NO: 213978 - DNA, 16 bp, P. troglodytes
atgtatcacattttct

SEQ ID NO: 213979 - DNA, 16 bp, P. troglodytes
atgtatcagaatttct

SEQ ID NO: 213980 - DNA, 16 bp, P. troglodytes
atgtatcatttttatt

SEQ ID NO: 213981 - DNA, 16 bp, P. troglodytes
atgtatccaccattat

SEQ ID NO: 213982 - DNA, 16 bp, P. troglodytes
atgtatcccagaattt

SEQ ID NO: 213983 - DNA, 16 bp, P. troglodytes
atgtatctataaatat

SEQ ID NO: 213984 - DNA, 16 bp, P. troglodytes
atgtatctatatgtat

SEQ ID NO: 213985 - DNA, 16 bp, P. troglodytes
atgtatctatttttgt

SEQ ID NO: 213986 - DNA, 16 bp, P. troglodytes
atgtatctgttaagtc

SEQ ID NO: 213987 - DNA, 16 bp, P. troglodytes
atgtatctttatagta

SEQ ID NO: 213988 - DNA, 16 bp, P. troglodytes
atgtatgaatgtatat

SEQ ID NO: 213989 - DNA, 16 bp, P. troglodytes
atgtatgcatatataa

SEQ ID NO: 213990 - DNA, 16 bp, P. troglodytes
atgtatgcatttatat

SEQ ID NO: 213991 - DNA, 16 bp, P. troglodytes
atgtatgcgtgtgtgt

SEQ ID NO: 213992 - DNA, 16 bp, P. troglodytes
atgtatggaaatgcct

SEQ ID NO: 213993 - DNA, 16 bp, P. troglodytes
atgtatgtatacatgt

SEQ ID NO: 213994 - DNA, 16 bp, P. troglodytes
atgtatgtatatatat

SEQ ID NO: 213995 - DNA, 16 bp, P. troglodytes
atgtatgtatgtaata

SEQ ID NO: 213996 - DNA, 16 bp, P. troglodytes
atgtatgtatgtataa

SEQ ID NO: 213997 - DNA, 16 bp, P. troglodytes
atgtatgtatgtgtgt

SEQ ID NO: 213998 - DNA, 16 bp, P. troglodytes
atgtatgtatttaaaa

SEQ ID NO: 213999 - DNA, 16 bp, P. troglodytes
atgtatgtatttgaga

SEQ ID NO: 214000 - DNA, 16 bp, P. troglodytes
atgtatgtctgctttt

SEQ ID NO: 214001 - DNA, 16 bp, P. troglodytes
atgtatgtgcacatat

SEQ ID NO: 214002 - DNA, 16 bp, P. troglodytes
atgtatgtgcatgcat

SEQ ID NO: 214003 - DNA, 16 bp, P. troglodytes
atgtatgtgtacatat

SEQ ID NO: 214004 - DNA, 16 bp, P. troglodytes
atgtatgtgtatatat

SEQ ID NO: 214005 - DNA, 16 bp, P. troglodytes
atgtatgtgtatatgt

SEQ ID NO: 214006 - DNA, 16 bp, P. troglodytes
atgtatgtgtgcgtgt

SEQ ID NO: 214007 - DNA, 16 bp, P. troglodytes
atgtatgtgtgtctat

SEQ ID NO: 214008 - DNA, 16 bp, P. troglodytes
atgtatgtgtgtgtgt

SEQ ID NO: 214009 - DNA, 16 bp, P. troglodytes
atgtatgttttaaaaa

SEQ ID NO: 214010 - DNA, 16 bp, P. troglodytes
atgtattactttattt

SEQ ID NO: 214011 - DNA, 16 bp, P. troglodytes
atgtattatacacaca

SEQ ID NO: 214012 - DNA, 16 bp, P. troglodytes
atgtattcaataaata

SEQ ID NO: 214013 - DNA, 16 bp, P. troglodytes
atgtattcattcattc

SEQ ID NO: 214014 - DNA, 16 bp, P. troglodytes
atgtattccagaactt

SEQ ID NO: 214015 - DNA, 16 bp, P. troglodytes
atgtattcctttatag

SEQ ID NO: 214016 - DNA, 16 bp, P. troglodytes
atgtattgaagagact

SEQ ID NO: 214017 - DNA, 16 bp, P. troglodytes
atgtattgctggattt

SEQ ID NO: 214018 - DNA, 16 bp, P. troglodytes
atgtatttaccacatt

SEQ ID NO: 214019 - DNA, 16 bp, P. troglodytes
atgtatttacttattt

SEQ ID NO: 214020 - DNA, 16 bp, P. troglodytes
atgtatttatgtgtat

SEQ ID NO: 214021 - DNA, 16 bp, P. troglodytes
atgtatttatttacat

SEQ ID NO: 214022 - DNA, 16 bp, P. troglodytes
atgtatttgtatgtgt

SEQ ID NO: 214023 - DNA, 16 bp, P. troglodytes
atgtatttgttggcca

SEQ ID NO: 214024 - DNA, 16 bp, P. troglodytes
atgtattttaaaagtt

SEQ ID NO: 214025 - DNA, 16 bp, P. troglodytes
atgtattttaaagaaa

SEQ ID NO: 214026 - DNA, 16 bp, P. troglodytes
atgtattttaatgtaa

SEQ ID NO: 214027 - DNA, 16 bp, P. troglodytes
atgtattttacatttt

SEQ ID NO: 214028 - DNA, 16 bp, P. troglodytes
atgtattttcaaatag

SEQ ID NO: 214029 - DNA, 16 bp, P. troglodytes
atgtattttctgttga

SEQ ID NO: 214030 - DNA, 16 bp, P. troglodytes
atgtattttctttaaa

SEQ ID NO: 214031 - DNA, 16 bp, P. troglodytes
atgtatttttagtaga

SEQ ID NO: 214032 - DNA, 16 bp, P. troglodytes
atgtatttttctatat

SEQ ID NO: 214033 - DNA, 16 bp, P. troglodytes
atgtatttttttcatg

SEQ ID NO: 214034 - DNA, 16 bp, P. troglodytes
atgtcaaagaagaaat

SEQ ID NO: 214035 - DNA, 17 bp, P. troglodytes
atgtcaaatcctagaaa

SEQ ID NO: 214036 - DNA, 16 bp, P. troglodytes
atgtcaatggcagttt

SEQ ID NO: 214037 - DNA, 16 bp, P. troglodytes
atgtcacaggggtttg

SEQ ID NO: 214038 - DNA, 16 bp, P. troglodytes
atgtcacatttagcat

SEQ ID NO: 214039 - DNA, 16 bp, P. troglodytes
atgtcaccatgcccag

SEQ ID NO: 214040 - DNA, 16 bp, P. troglodytes
atgtcactctgtcacc

SEQ ID NO: 214041 - DNA, 16 bp, P. troglodytes
atgtcactctgttgcc

SEQ ID NO: 214042 - DNA, 16 bp, P. troglodytes
atgtcactgcacttca

SEQ ID NO: 214043 - DNA, 16 bp, P. troglodytes
atgtcactgtggtcct

SEQ ID NO: 214044 - DNA, 16 bp, P. troglodytes
atgtcacttctgagat

SEQ ID NO: 214045 - DNA, 16 bp, P. troglodytes
atgtcactttctaaca

SEQ ID NO: 214046 - DNA, 16 bp, P. troglodytes
atgtcagaaggcaaag

SEQ ID NO: 214047 - DNA, 16 bp, P. troglodytes
atgtcagagctggaag

SEQ ID NO: 214048 - DNA, 16 bp, P. troglodytes
atgtcagaggtcttca

SEQ ID NO: 214049 - DNA, 16 bp, P. troglodytes
atgtcagatggtgata

SEQ ID NO: 214050 - DNA, 16 bp, P. troglodytes
atgtcagatttttttt

SEQ ID NO: 214051 - DNA, 16 bp, P. troglodytes
atgtcagcactcaaaa

SEQ ID NO: 214052 - DNA, 16 bp, P. troglodytes
atgtcagccaggctga

SEQ ID NO: 214053 - DNA, 16 bp, P. troglodytes
atgtcagctcactgca

SEQ ID NO: 214054 - DNA, 17 bp, P. troglodytes
atgtcaggccctccaca

SEQ ID NO: 214055 - DNA, 16 bp, P. troglodytes
atgtcatccaggagct

SEQ ID NO: 214056 - DNA, 16 bp, P. troglodytes
atgtcatgggggtttg

SEQ ID NO: 214057 - DNA, 16 bp, P. troglodytes
atgtcattaaacatct

SEQ ID NO: 214058 - DNA, 16 bp, P. troglodytes
atgtcattataatttt

SEQ ID NO: 214059 - DNA, 16 bp, P. troglodytes
atgtcattattttaaa

SEQ ID NO: 214060 - DNA, 16 bp, P. troglodytes
atgtcattgaaatttt

SEQ ID NO: 214061 - DNA, 16 bp, P. troglodytes
atgtcattgctattgt

SEQ ID NO: 214062 - DNA, 16 bp, P. troglodytes
atgtcattggtacttt

SEQ ID NO: 214063 - DNA, 16 bp, P. troglodytes
atgtcattttccttct

SEQ ID NO: 214064 - DNA, 16 bp, P. troglodytes
atgtcatttttttcct

SEQ ID NO: 214065 - DNA, 16 bp, P. troglodytes
atgtccacatcctaat

SEQ ID NO: 214066 - DNA, 16 bp, P. troglodytes
atgtccagaatgggca

SEQ ID NO: 214067 - DNA, 16 bp, P. troglodytes
atgtccagaatgttat

SEQ ID NO: 214068 - DNA, 16 bp, P. troglodytes
atgtccagctaatttt

SEQ ID NO: 214069 - DNA, 16 bp, P. troglodytes
atgtccaggagagttt

SEQ ID NO: 214070 - DNA, 16 bp, P. troglodytes
atgtccagttttccca

SEQ ID NO: 214071 - DNA, 16 bp, P. troglodytes
atgtccattctcacca

SEQ ID NO: 214072 - DNA, 16 bp, P. troglodytes
atgtcccagcttgaag

SEQ ID NO: 214073 - DNA, 16 bp, P. troglodytes
atgtccccattccaag

SEQ ID NO: 214074 - DNA, 17 bp, P. troglodytes
atgtccccttcaagctg

SEQ ID NO: 214075 - DNA, 16 bp, P. troglodytes
atgtccggagtttgtt

SEQ ID NO: 214076 - DNA, 16 bp, P. troglodytes
atgtccgtgtgaagag

SEQ ID NO: 214077 - DNA, 16 bp, P. troglodytes
atgtcctaaagcattt

SEQ ID NO: 214078 - DNA, 16 bp, P. troglodytes
atgtcctcaaggttta

SEQ ID NO: 214079 - DNA, 16 bp, P. troglodytes
atgtcctcacttataa

SEQ ID NO: 214080 - DNA, 16 bp, P. troglodytes
atgtcctccagtttca

SEQ ID NO: 214081 - DNA, 16 bp, P. troglodytes
atgtcctcttttattt

SEQ ID NO: 214082 - DNA, 16 bp, P. troglodytes
atgtcctgacctcgtg

SEQ ID NO: 214083 - DNA, 16 bp, P. troglodytes
atgtcctgcccagaga

SEQ ID NO: 214084 - DNA, 16 bp, P. troglodytes
atgtcctggagagttt

SEQ ID NO: 214085 - DNA, 16 bp, P. troglodytes
atgtccttaaggcaca

SEQ ID NO: 214086 - DNA, 16 bp, P. troglodytes
atgtccttctttgtcc

SEQ ID NO: 214087 - DNA, 16 bp, P. troglodytes
atgtcctttccagcaa

SEQ ID NO: 214088 - DNA, 16 bp, P. troglodytes
atgtccttttctggtt

SEQ ID NO: 214089 - DNA, 16 bp, P. troglodytes
atgtctacatatatat

SEQ ID NO: 214090 - DNA, 16 bp, P. troglodytes
atgtctacatgtgcca

SEQ ID NO: 214091 - DNA, 16 bp, P. troglodytes
atgtctagagacattt

SEQ ID NO: 214092 - DNA, 16 bp, P. troglodytes
atgtctagttttcaac

SEQ ID NO: 214093 - DNA, 16 bp, P. troglodytes
atgtctatttttaaaa

SEQ ID NO: 214094 - DNA, 16 bp, P. troglodytes
atgtctccagacatgg

SEQ ID NO: 214095 - DNA, 16 bp, P. troglodytes
atgtctccagacattt

SEQ ID NO: 214096 - DNA, 16 bp, P. troglodytes
atgtctgcctcccagg

SEQ ID NO: 214097 - DNA, 16 bp, P. troglodytes
atgtctgtctgtgtgt

SEQ ID NO: 214098 - DNA, 16 bp, P. troglodytes
atgtctgtgtatgtgt

SEQ ID NO: 214099 - DNA, 16 bp, P. troglodytes
atgtctgtgtcctaat

SEQ ID NO: 214100 - DNA, 16 bp, P. troglodytes
atgtctgtgtgtatgt

SEQ ID NO: 214101 - DNA, 16 bp, P. troglodytes
atgtctgtgtgtgtgt

SEQ ID NO: 214102 - DNA, 16 bp, P. troglodytes
atgtcttcactgctga

SEQ ID NO: 214103 - DNA, 16 bp, P. troglodytes
atgtcttcagctttgt

SEQ ID NO: 214104 - DNA, 16 bp, P. troglodytes
atgtcttcatctataa

SEQ ID NO: 214105 - DNA, 16 bp, P. troglodytes
atgtcttcatttattt

SEQ ID NO: 214106 - DNA, 16 bp, P. troglodytes
atgtcttcattttatt

SEQ ID NO: 214107 - DNA, 16 bp, P. troglodytes
atgtcttctaaaaata

SEQ ID NO: 214108 - DNA, 17 bp, P. troglodytes
atgtcttctttgtagca

SEQ ID NO: 214109 - DNA, 16 bp, P. troglodytes
atgtcttcttttgaaa

SEQ ID NO: 214110 - DNA, 17 bp, P. troglodytes
atgtcttcttttgagaa

SEQ ID NO: 214111 - DNA, 16 bp, P. troglodytes
atgtcttgaaaagtta

SEQ ID NO: 214112 - DNA, 16 bp, P. troglodytes
atgtctttaaacagaa

SEQ ID NO: 214113 - DNA, 16 bp, P. troglodytes
atgtctttaacagcac

SEQ ID NO: 214114 - DNA, 16 bp, P. troglodytes
atgtctttggtatttt

SEQ ID NO: 214115 - DNA, 16 bp, P. troglodytes
atgtcttttctgtttg

SEQ ID NO: 214116 - DNA, 16 bp, P. troglodytes
atgtctttttaaattt

SEQ ID NO: 214117 - DNA, 16 bp, P. troglodytes
atgtcttttttaaaaa

SEQ ID NO: 214118 - DNA, 16 bp, P. troglodytes
atgtgaaaaaaaatct

SEQ ID NO: 214119 - DNA, 16 bp, P. troglodytes
atgtgaaaataatttt

SEQ ID NO: 214120 - DNA, 16 bp, P. troglodytes
atgtgaaaatcttcaa

SEQ ID NO: 214121 - DNA, 16 bp, P. troglodytes
atgtgaaaattatttt

SEQ ID NO: 214122 - DNA, 16 bp, P. troglodytes
atgtgaaaccctgtct

SEQ ID NO: 214123 - DNA, 16 bp, P. troglodytes
atgtgaaagcatgtga

SEQ ID NO: 214124 - DNA, 16 bp, P. troglodytes
atgtgaaataatttta

SEQ ID NO: 214125 - DNA, 16 bp, P. troglodytes
atgtgaaatattttat

SEQ ID NO: 214126 - DNA, 16 bp, P. troglodytes
atgtgaagaatgtcat

SEQ ID NO: 214127 - DNA, 16 bp, P. troglodytes
atgtgaagacagaggc

SEQ ID NO: 214128 - DNA, 16 bp, P. troglodytes
atgtgaagacagaggt

SEQ ID NO: 214129 - DNA, 16 bp, P. troglodytes
atgtgaagatatttgc

SEQ ID NO: 214130 - DNA, 16 bp, P. troglodytes
atgtgaagatatttgt

SEQ ID NO: 214131 - DNA, 16 bp, P. troglodytes
atgtgaagattaaatg

SEQ ID NO: 214132 - DNA, 16 bp, P. troglodytes
atgtgaaggagctctt

SEQ ID NO: 214133 - DNA, 16 bp, P. troglodytes
atgtgaatatatttaa

SEQ ID NO: 214134 - DNA, 16 bp, P. troglodytes
atgtgaatgtacttaa

SEQ ID NO: 214135 - DNA, 16 bp, P. troglodytes
atgtgaatttaaaaat

SEQ ID NO: 214136 - DNA, 16 bp, P. troglodytes
atgtgaattttaaaat

SEQ ID NO: 214137 - DNA, 16 bp, P. troglodytes
atgtgaatttttaaat

SEQ ID NO: 214138 - DNA, 16 bp, P. troglodytes
atgtgacaaagaagaa

SEQ ID NO: 214139 - DNA, 16 bp, P. troglodytes
atgtgacatgcctgct

SEQ ID NO: 214140 - DNA, 16 bp, P. troglodytes
atgtgaccttggccaa

SEQ ID NO: 214141 - DNA, 16 bp, P. troglodytes
atgtgactgtatttgg

SEQ ID NO: 214142 - DNA, 16 bp, P. troglodytes
atgtgactgtgtgtgt

SEQ ID NO: 214143 - DNA, 16 bp, P. troglodytes
atgtgacttctgaggc

SEQ ID NO: 214144 - DNA, 16 bp, P. troglodytes
atgtgagaaaacattt

SEQ ID NO: 214145 - DNA, 16 bp, P. troglodytes
atgtgagaaagtttgg

SEQ ID NO: 214146 - DNA, 16 bp, P. troglodytes
atgtgagatatggagt

SEQ ID NO: 214147 - DNA, 16 bp, P. troglodytes
atgtgagatgggtgtc

SEQ ID NO: 214148 - DNA, 16 bp, P. troglodytes
atgtgagatgttttga

SEQ ID NO: 214149 - DNA, 18 bp, P. troglodytes
atgtgagccactgtgcct

SEQ ID NO: 214150 - DNA, 16 bp, P. troglodytes
atgtgaggaaatgaga

SEQ ID NO: 214151 - DNA, 16 bp, P. troglodytes
atgtgagtggaagtga

SEQ ID NO: 214152 - DNA, 16 bp, P. troglodytes
atgtgagtgggcatca

SEQ ID NO: 214153 - DNA, 16 bp, P. troglodytes
atgtgagtgtgtgtga

SEQ ID NO: 214154 - DNA, 16 bp, P. troglodytes
atgtgataaatcacat

SEQ ID NO: 214155 - DNA, 16 bp, P. troglodytes
atgtgataaatcatat

SEQ ID NO: 214156 - DNA, 16 bp, P. troglodytes
atgtgatatatacaaa

SEQ ID NO: 214157 - DNA, 16 bp, P. troglodytes
atgtgatatatatgta

SEQ ID NO: 214158 - DNA, 16 bp, P. troglodytes
atgtgatatatcacat

SEQ ID NO: 214159 - DNA, 16 bp, P. troglodytes
atgtgatatttgcttt

SEQ ID NO: 214160 - DNA, 16 bp, P. troglodytes
atgtgatattttgata

SEQ ID NO: 214161 - DNA, 16 bp, P. troglodytes
atgtgatctctttgca

SEQ ID NO: 214162 - DNA, 16 bp, P. troglodytes
atgtgatgctgtttga

SEQ ID NO: 214163 - DNA, 16 bp, P. troglodytes
atgtgatggcacatgc

SEQ ID NO: 214164 - DNA, 16 bp, P. troglodytes
atgtgatgtctggagc

SEQ ID NO: 214165 - DNA, 16 bp, P. troglodytes
atgtgatgttttgata

SEQ ID NO: 214166 - DNA, 16 bp, P. troglodytes
atgtgatgtttttctt

SEQ ID NO: 214167 - DNA, 16 bp, P. troglodytes
atgtgattaaagttaa

SEQ ID NO: 214168 - DNA, 16 bp, P. troglodytes
atgtgattattaatat

SEQ ID NO: 214169 - DNA, 16 bp, P. troglodytes
atgtgattccatttgt

SEQ ID NO: 214170 - DNA, 16 bp, P. troglodytes
atgtgattttcaaata

SEQ ID NO: 214171 - DNA, 16 bp, P. troglodytes
atgtgattttttaaaa

SEQ ID NO: 214172 - DNA, 16 bp, P. troglodytes
atgtgattttttcccc

SEQ ID NO: 214173 - DNA, 16 bp, P. troglodytes
atgtgcaaaaactgga

SEQ ID NO: 214174 - DNA, 16 bp, P. troglodytes
atgtgcaaaatcacaa

SEQ ID NO: 214175 - DNA, 16 bp, P. troglodytes
atgtgcaatctaaaaa

SEQ ID NO: 214176 - DNA, 16 bp, P. troglodytes
atgtgcacatacacac

SEQ ID NO: 214177 - DNA, 16 bp, P. troglodytes
atgtgcacccagagga

SEQ ID NO: 214178 - DNA, 16 bp, P. troglodytes
atgtgcagattttttt

SEQ ID NO: 214179 - DNA, 16 bp, P. troglodytes
atgtgcaggatgtgca

SEQ ID NO: 214180 - DNA, 16 bp, P. troglodytes
atgtgcaggtttgata

SEQ ID NO: 214181 - DNA, 16 bp, P. troglodytes
atgtgcatatatcttt

SEQ ID NO: 214182 - DNA, 16 bp, P. troglodytes
atgtgcatatatttat

SEQ ID NO: 214183 - DNA, 17 bp, P. troglodytes
atgtgcatgtgtgtgtg

SEQ ID NO: 214184 - DNA, 16 bp, P. troglodytes
atgtgcattttaaatg

SEQ ID NO: 214185 - DNA, 16 bp, P. troglodytes
atgtgcatttttctga

SEQ ID NO: 214186 - DNA, 16 bp, P. troglodytes
atgtgccacaacaccc

SEQ ID NO: 214187 - DNA, 16 bp, P. troglodytes
atgtgccacacacttt

SEQ ID NO: 214188 - DNA, 16 bp, P. troglodytes
atgtgccaggcacagt

SEQ ID NO: 214189 - DNA, 16 bp, P. troglodytes
atgtgccaggcactct

SEQ ID NO: 214190 - DNA, 16 bp, P. troglodytes
atgtgccaggcactga

SEQ ID NO: 214191 - DNA, 16 bp, P. troglodytes
atgtgccaggcactgc

SEQ ID NO: 214192 - DNA, 16 bp, P. troglodytes
atgtgccatgcactgt

SEQ ID NO: 214193 - DNA, 16 bp, P. troglodytes
atgtgccatgtgggtg

SEQ ID NO: 214194 - DNA, 16 bp, P. troglodytes
atgtgcccaccttggc

SEQ ID NO: 214195 - DNA, 17 bp, P. troglodytes
atgtgcctgtggtccca

SEQ ID NO: 214196 - DNA, 16 bp, P. troglodytes
atgtgcgtgcgtgtgt

SEQ ID NO: 214197 - DNA, 16 bp, P. troglodytes
atgtgcgtgtgcgtgt

SEQ ID NO: 214198 - DNA, 16 bp, P. troglodytes
atgtgcgtgtgtgcgt

SEQ ID NO: 214199 - DNA, 16 bp, P. troglodytes
atgtgcgtgtgtgtgt

SEQ ID NO: 214200 - DNA, 16 bp, P. troglodytes
atgtgctacattttct

SEQ ID NO: 214201 - DNA, 16 bp, P. troglodytes
atgtgctggaaactta

SEQ ID NO: 214202 - DNA, 16 bp, P. troglodytes
atgtgctgggtgtggt

SEQ ID NO: 214203 - DNA, 16 bp, P. troglodytes
atgtgcttatttgcta

SEQ ID NO: 214204 - DNA, 16 bp, P. troglodytes
atgtgcttgcttctcc

SEQ ID NO: 214205 - DNA, 16 bp, P. troglodytes
atgtgcttggaaaagc

SEQ ID NO: 214206 - DNA, 16 bp, P. troglodytes
atgtgctttaaaaaaa

SEQ ID NO: 214207 - DNA, 16 bp, P. troglodytes
atgtgctttgaagatg

SEQ ID NO: 214208 - DNA, 16 bp, P. troglodytes
atgtggaaaatatatt

SEQ ID NO: 214209 - DNA, 16 bp, P. troglodytes
atgtggaagcaaccaa

SEQ ID NO: 214210 - DNA, 16 bp, P. troglodytes
atgtggaagtagcttt

SEQ ID NO: 214211 - DNA, 16 bp, P. troglodytes
atgtggaattttatca

SEQ ID NO: 214212 - DNA, 16 bp, P. troglodytes
atgtggacatatgttt

SEQ ID NO: 214213 - DNA, 16 bp, P. troglodytes
atgtggagaaaaagga

SEQ ID NO: 214214 - DNA, 16 bp, P. troglodytes
atgtggagaaactgaa

SEQ ID NO: 214215 - DNA, 16 bp, P. troglodytes
atgtggagaaagtgga

SEQ ID NO: 214216 - DNA, 16 bp, P. troglodytes
atgtggagaaccaagg

SEQ ID NO: 214217 - DNA, 16 bp, P. troglodytes
atgtggagaagctgga

SEQ ID NO: 214218 - DNA, 16 bp, P. troglodytes
atgtggagcaaccaga

SEQ ID NO: 214219 - DNA, 16 bp, P. troglodytes
atgtggagcaactgga

SEQ ID NO: 214220 - DNA, 16 bp, P. troglodytes
atgtggaggtggaaga

SEQ ID NO: 214221 - DNA, 16 bp, P. troglodytes
atgtggatatccagct

SEQ ID NO: 214222 - DNA, 16 bp, P. troglodytes
atgtggatatcctgtt

SEQ ID NO: 214223 - DNA, 16 bp, P. troglodytes
atgtggatgcccttta

SEQ ID NO: 214224 - DNA, 16 bp, P. troglodytes
atgtggatggtctgct

SEQ ID NO: 214225 - DNA, 16 bp, P. troglodytes
atgtggcacattttct

SEQ ID NO: 214226 - DNA, 16 bp, P. troglodytes
atgtggcagagctggg

SEQ ID NO: 214227 - DNA, 16 bp, P. troglodytes
atgtggccaataaaca

SEQ ID NO: 214228 - DNA, 16 bp, P. troglodytes
atgtggccacaagcca

SEQ ID NO: 214229 - DNA, 16 bp, P. troglodytes
atgtggccttttgtga

SEQ ID NO: 214230 - DNA, 16 bp, P. troglodytes
atgtggctgaattgct

SEQ ID NO: 214231 - DNA, 16 bp, P. troglodytes
atgtggctgtgctgga

SEQ ID NO: 214232 - DNA, 16 bp, P. troglodytes
atgtgggaatttgatc

SEQ ID NO: 214233 - DNA, 16 bp, P. troglodytes
atgtgggaggctgagg

SEQ ID NO: 214234 - DNA, 16 bp, P. troglodytes
atgtgggcattcatct

SEQ ID NO: 214235 - DNA, 16 bp, P. troglodytes
atgtgggccaggatgg

SEQ ID NO: 214236 - DNA, 16 bp, P. troglodytes
atgtgggccaggtgca

SEQ ID NO: 214237 - DNA, 16 bp, P. troglodytes
atgtgggccaggtgtg

SEQ ID NO: 214238 - DNA, 16 bp, P. troglodytes
atgtggggaaaagaga

SEQ ID NO: 214239 - DNA, 16 bp, P. troglodytes
atgtggtattttgtta

SEQ ID NO: 214240 - DNA, 16 bp, P. troglodytes
atgtggtcacttttgg

SEQ ID NO: 214241 - DNA, 16 bp, P. troglodytes
atgtggtccctgccct

SEQ ID NO: 214242 - DNA, 16 bp, P. troglodytes
atgtggtgacacacac

SEQ ID NO: 214243 - DNA, 16 bp, P. troglodytes
atgtggtgacacatgc

SEQ ID NO: 214244 - DNA, 16 bp, P. troglodytes
atgtggtggcacatgc

SEQ ID NO: 214245 - DNA, 16 bp, P. troglodytes
atgtggtggcaggtgc

SEQ ID NO: 214246 - DNA, 16 bp, P. troglodytes
atgtggtggtgggcgc

SEQ ID NO: 214247 - DNA, 16 bp, P. troglodytes
atgtggtgtatcacat

SEQ ID NO: 214248 - DNA, 16 bp, P. troglodytes
atgtggtgttaagcct

SEQ ID NO: 214249 - DNA, 16 bp, P. troglodytes
atgtggtttttgcttt

SEQ ID NO: 214250 - DNA, 16 bp, P. troglodytes
atgtgtacacccatgt

SEQ ID NO: 214251 - DNA, 16 bp, P. troglodytes
atgtgtacatacatgt

SEQ ID NO: 214252 - DNA, 16 bp, P. troglodytes
atgtgtacatatatat

SEQ ID NO: 214253 - DNA, 16 bp, P. troglodytes
atgtgtacatatgtaa

SEQ ID NO: 214254 - DNA, 16 bp, P. troglodytes
atgtgtacatgtgtat

SEQ ID NO: 214255 - DNA, 16 bp, P. troglodytes
atgtgtaccaccatgc

SEQ ID NO: 214256 - DNA, 16 bp, P. troglodytes
atgtgtacgtgtgtgt

SEQ ID NO: 214257 - DNA, 16 bp, P. troglodytes
atgtgtagattcatgt

SEQ ID NO: 214258 - DNA, 16 bp, P. troglodytes
atgtgtagtattttat

SEQ ID NO: 214259 - DNA, 16 bp, P. troglodytes
atgtgtagtgtgtgtg

SEQ ID NO: 214260 - DNA, 16 bp, P. troglodytes
atgtgtatatatatga

SEQ ID NO: 214261 - DNA, 16 bp, P. troglodytes
atgtgtatatattata

SEQ ID NO: 214262 - DNA, 16 bp, P. troglodytes
atgtgtatatatttgt

SEQ ID NO: 214263 - DNA, 16 bp, P. troglodytes
atgtgtatatgtacat

SEQ ID NO: 214264 - DNA, 16 bp, P. troglodytes
atgtgtatatgtatat

SEQ ID NO: 214265 - DNA, 16 bp, P. troglodytes
atgtgtatatttgtgt

SEQ ID NO: 214266 - DNA, 16 bp, P. troglodytes
atgtgtatctgtgtgt

SEQ ID NO: 214267 - DNA, 16 bp, P. troglodytes
atgtgtatgcatatat

SEQ ID NO: 214268 - DNA, 16 bp, P. troglodytes
atgtgtatgcctgtgt

SEQ ID NO: 214269 - DNA, 16 bp, P. troglodytes
atgtgtatgtttatgt

SEQ ID NO: 214270 - DNA, 16 bp, P. troglodytes
atgtgtatttttaaaa

SEQ ID NO: 214271 - DNA, 16 bp, P. troglodytes
atgtgtcaatttggct

SEQ ID NO: 214272 - DNA, 16 bp, P. troglodytes
atgtgtcagaatttca

SEQ ID NO: 214273 - DNA, 16 bp, P. troglodytes
atgtgtcaggcacagt

SEQ ID NO: 214274 - DNA, 16 bp, P. troglodytes
atgtgtcaggcatttt

SEQ ID NO: 214275 - DNA, 16 bp, P. troglodytes
atgtgtccaaggtcac

SEQ ID NO: 214276 - DNA, 16 bp, P. troglodytes
atgtgtccagaaatgt

SEQ ID NO: 214277 - DNA, 16 bp, P. troglodytes
atgtgtctgtgtatat

SEQ ID NO: 214278 - DNA, 16 bp, P. troglodytes
atgtgtctgtgtatgt

SEQ ID NO: 214279 - DNA, 16 bp, P. troglodytes
atgtgtcttggggttc

SEQ ID NO: 214280 - DNA, 16 bp, P. troglodytes
atgtgtctttatggaa

SEQ ID NO: 214281 - DNA, 16 bp, P. troglodytes
atgtgtgaatttaatc

SEQ ID NO: 214282 - DNA, 16 bp, P. troglodytes
atgtgtgaccatgagg

SEQ ID NO: 214283 - DNA, 16 bp, P. troglodytes
atgtgtgagaacatgc

SEQ ID NO: 214284 - DNA, 16 bp, P. troglodytes
atgtgtgagtgcatgt

SEQ ID NO: 214285 - DNA, 16 bp, P. troglodytes
atgtgtgatatatata

SEQ ID NO: 214286 - DNA, 16 bp, P. troglodytes
atgtgtgatgtgtgtg

SEQ ID NO: 214287 - DNA, 16 bp, P. troglodytes
atgtgtgcatatgtct

SEQ ID NO: 214288 - DNA, 16 bp, P. troglodytes
atgtgtgcatgtacat

SEQ ID NO: 214289 - DNA, 16 bp, P. troglodytes
atgtgtgcatgtgagt

SEQ ID NO: 214290 - DNA, 16 bp, P. troglodytes
atgtgtgcatgtgtgt

SEQ ID NO: 214291 - DNA, 16 bp, P. troglodytes
atgtgtgcatttgtgt

SEQ ID NO: 214292 - DNA, 16 bp, P. troglodytes
atgtgtgccttcatct

SEQ ID NO: 214293 - DNA, 16 bp, P. troglodytes
atgtgtgcgtgtgtgt

SEQ ID NO: 214294 - DNA, 16 bp, P. troglodytes
atgtgtggcccaaaac

SEQ ID NO: 214295 - DNA, 16 bp, P. troglodytes
atgtgtgtaaagtgct

SEQ ID NO: 214296 - DNA, 16 bp, P. troglodytes
atgtgtgtaatctcag

SEQ ID NO: 214297 - DNA, 16 bp, P. troglodytes
atgtgtgtatgtgtat

SEQ ID NO: 214298 - DNA, 16 bp, P. troglodytes
atgtgtgtctatatac

SEQ ID NO: 214299 - DNA, 16 bp, P. troglodytes
atgtgtgtctgtatgt

SEQ ID NO: 214300 - DNA, 16 bp, P. troglodytes
atgtgtgtctgtgtgt

SEQ ID NO: 214301 - DNA, 16 bp, P. troglodytes
atgtgtgtgagtgtga

SEQ ID NO: 214302 - DNA, 16 bp, P. troglodytes
atgtgtgtgatgtgtg

SEQ ID NO: 214303 - DNA, 17 bp, P. troglodytes
atgtgtgtgcgtgcgtg

SEQ ID NO: 214304 - DNA, 16 bp, P. troglodytes
atgtgtgtggtatgtg

SEQ ID NO: 214305 - DNA, 16 bp, P. troglodytes
atgtgtgtgtatatat

SEQ ID NO: 214306 - DNA, 16 bp, P. troglodytes
atgtgtgtgtatatgt

SEQ ID NO: 214307 - DNA, 18 bp, P. troglodytes
atgtgtgtgtatgtgtat

SEQ ID NO: 214308 - DNA, 16 bp, P. troglodytes
atgtgtgtgtgaatgt

SEQ ID NO: 214309 - DNA, 16 bp, P. troglodytes
atgtgtgtgtgatgtg

SEQ ID NO: 214310 - DNA, 16 bp, P. troglodytes
atgtgtgtgtgcatgt

SEQ ID NO: 214311 - DNA, 16 bp, P. troglodytes
atgtgtgtgtgtatat

SEQ ID NO: 214312 - DNA, 16 bp, P. troglodytes
atgtgtgtgtgtgcct

SEQ ID NO: 214313 - DNA, 16 bp, P. troglodytes
atgtgtgtgtgtgtat

SEQ ID NO: 214314 - DNA, 16 bp, P. troglodytes
atgtgtgtgtgtgtgc

SEQ ID NO: 214315 - DNA, 16 bp, P. troglodytes
atgtgttcatttattt

SEQ ID NO: 214316 - DNA, 16 bp, P. troglodytes
atgtgttcattttatt

SEQ ID NO: 214317 - DNA, 16 bp, P. troglodytes
atgtgttcttattgtt

SEQ ID NO: 214318 - DNA, 16 bp, P. troglodytes
atgtgttgaaccaacc

SEQ ID NO: 214319 - DNA, 16 bp, P. troglodytes
atgtgttgtcattgtt

SEQ ID NO: 214320 - DNA, 16 bp, P. troglodytes
atgtgtttccatttgt

SEQ ID NO: 214321 - DNA, 16 bp, P. troglodytes
atgtgtttgtcaaaac

SEQ ID NO: 214322 - DNA, 16 bp, P. troglodytes
atgtgtttgtgtgtct

SEQ ID NO: 214323 - DNA, 16 bp, P. troglodytes
atgtgttttcatcatt

SEQ ID NO: 214324 - DNA, 16 bp, P. troglodytes
atgtgttttcatttct

SEQ ID NO: 214325 - DNA, 16 bp, P. troglodytes
atgttaaaatttgaga

SEQ ID NO: 214326 - DNA, 16 bp, P. troglodytes
atgttaaatacatttt

SEQ ID NO: 214327 - DNA, 16 bp, P. troglodytes
atgttaaatatctttt

SEQ ID NO: 214328 - DNA, 16 bp, P. troglodytes
atgttaaattatatgg

SEQ ID NO: 214329 - DNA, 16 bp, P. troglodytes
atgttaaattgttgta

SEQ ID NO: 214330 - DNA, 16 bp, P. troglodytes
atgttaacattttaat

SEQ ID NO: 214331 - DNA, 16 bp, P. troglodytes
atgttaactattatta

SEQ ID NO: 214332 - DNA, 16 bp, P. troglodytes
atgttaagtaaaacaa

SEQ ID NO: 214333 - DNA, 16 bp, P. troglodytes
atgttaagtattctta

SEQ ID NO: 214334 - DNA, 16 bp, P. troglodytes
atgttaataaacttgt

SEQ ID NO: 214335 - DNA, 16 bp, P. troglodytes
atgttaatatttcaaa

SEQ ID NO: 214336 - DNA, 16 bp, P. troglodytes
atgttaatccccaaga

SEQ ID NO: 214337 - DNA, 16 bp, P. troglodytes
atgttaatgaatcaac

SEQ ID NO: 214338 - DNA, 16 bp, P. troglodytes
atgttaattctgtttt

SEQ ID NO: 214339 - DNA, 16 bp, P. troglodytes
atgttaatttgctcaa

SEQ ID NO: 214340 - DNA, 16 bp, P. troglodytes
atgttaatttgtttca

SEQ ID NO: 214341 - DNA, 16 bp, P. troglodytes
atgttacccaggctgg

SEQ ID NO: 214342 - DNA, 16 bp, P. troglodytes
atgttactattattat

SEQ ID NO: 214343 - DNA, 16 bp, P. troglodytes
atgttagggtattgat

SEQ ID NO: 214344 - DNA, 16 bp, P. troglodytes
atgttataacatggat

SEQ ID NO: 214345 - DNA, 16 bp, P. troglodytes
atgttatcaaacagca

SEQ ID NO: 214346 - DNA, 16 bp, P. troglodytes
atgttatctccatttt

SEQ ID NO: 214347 - DNA, 16 bp, P. troglodytes
atgttattactattat

SEQ ID NO: 214348 - DNA, 16 bp, P. troglodytes
atgttatttacaaaaa

SEQ ID NO: 214349 - DNA, 16 bp, P. troglodytes
atgttatttctgtaaa

SEQ ID NO: 214350 - DNA, 16 bp, P. troglodytes
atgttatttgaaacca

SEQ ID NO: 214351 - DNA, 16 bp, P. troglodytes
atgttatttgcctttt

SEQ ID NO: 214352 - DNA, 16 bp, P. troglodytes
atgttatttggaaata

SEQ ID NO: 214353 - DNA, 16 bp, P. troglodytes
atgttcaacctgtatt

SEQ ID NO: 214354 - DNA, 16 bp, P. troglodytes
atgttcaagcaattct

SEQ ID NO: 214355 - DNA, 16 bp, P. troglodytes
atgttcaagggcagga

SEQ ID NO: 214356 - DNA, 16 bp, P. troglodytes
atgttcaataaatatt

SEQ ID NO: 214357 - DNA, 16 bp, P. troglodytes
atgttcaatttacaga

SEQ ID NO: 214358 - DNA, 16 bp, P. troglodytes
atgttcacattttaaa

SEQ ID NO: 214359 - DNA, 16 bp, P. troglodytes
atgttcactttggggt

SEQ ID NO: 214360 - DNA, 16 bp, P. troglodytes
atgttcatcaggaata

SEQ ID NO: 214361 - DNA, 16 bp, P. troglodytes
atgttcattttaaaaa

SEQ ID NO: 214362 - DNA, 16 bp, P. troglodytes
atgttccaattaaaag

SEQ ID NO: 214363 - DNA, 16 bp, P. troglodytes
atgttcccctcctgtg

SEQ ID NO: 214364 - DNA, 16 bp, P. troglodytes
atgttctaataaaact

SEQ ID NO: 214365 - DNA, 16 bp, P. troglodytes
atgttctattttttaa

SEQ ID NO: 214366 - DNA, 16 bp, P. troglodytes
atgttctcactcatca

SEQ ID NO: 214367 - DNA, 16 bp, P. troglodytes
atgttctcatttattt

SEQ ID NO: 214368 - DNA, 16 bp, P. troglodytes
atgttctcatttttaa

SEQ ID NO: 214369 - DNA, 16 bp, P. troglodytes
atgttctccaggttca

SEQ ID NO: 214370 - DNA, 16 bp, P. troglodytes
atgttctgcatatgta

SEQ ID NO: 214371 - DNA, 16 bp, P. troglodytes
atgttctgcttcctct

SEQ ID NO: 214372 - DNA, 16 bp, P. troglodytes
atgttcttctgcctgc

SEQ ID NO: 214373 - DNA, 16 bp, P. troglodytes
atgttctttgaaaaca

SEQ ID NO: 214374 - DNA, 16 bp, P. troglodytes
atgttgaaaaaggaaa

SEQ ID NO: 214375 - DNA, 16 bp, P. troglodytes
atgttgaaatgtgatt

SEQ ID NO: 214376 - DNA, 16 bp, P. troglodytes
atgttgaacatatttt

SEQ ID NO: 214377 - DNA, 16 bp, P. troglodytes
atgttgaacatctttt

SEQ ID NO: 214378 - DNA, 16 bp, P. troglodytes
atgttgaacttttttc

SEQ ID NO: 214379 - DNA, 16 bp, P. troglodytes
atgttgaagccccaac

SEQ ID NO: 214380 - DNA, 16 bp, P. troglodytes
atgttgaagccctaaa

SEQ ID NO: 214381 - DNA, 16 bp, P. troglodytes
atgttgaagtcctaat

SEQ ID NO: 214382 - DNA, 16 bp, P. troglodytes
atgttgaataaaagtg

SEQ ID NO: 214383 - DNA, 16 bp, P. troglodytes
atgttgaatattatca

SEQ ID NO: 214384 - DNA, 16 bp, P. troglodytes
atgttgaatattttct

SEQ ID NO: 214385 - DNA, 16 bp, P. troglodytes
atgttgaattttgtca

SEQ ID NO: 214386 - DNA, 16 bp, P. troglodytes
atgttgaccaggctgt

SEQ ID NO: 214387 - DNA, 16 bp, P. troglodytes
atgttgagcaaaataa

SEQ ID NO: 214388 - DNA, 16 bp, P. troglodytes
atgttgagcattcttt

SEQ ID NO: 214389 - DNA, 16 bp, P. troglodytes
atgttgatgagaaaaa

SEQ ID NO: 214390 - DNA, 16 bp, P. troglodytes
atgttgcaggaagtca

SEQ ID NO: 214391 - DNA, 16 bp, P. troglodytes
atgttgcattttcatt

SEQ ID NO: 214392 - DNA, 16 bp, P. troglodytes
atgttgcattttccaa

SEQ ID NO: 214393 - DNA, 16 bp, P. troglodytes
atgttgccaaggctgg

SEQ ID NO: 214394 - DNA, 16 bp, P. troglodytes
atgttgccaggctggt

SEQ ID NO: 214395 - DNA, 16 bp, P. troglodytes
atgttgccagtctctt

SEQ ID NO: 214396 - DNA, 16 bp, P. troglodytes
atgttgcccagaatgg

SEQ ID NO: 214397 - DNA, 16 bp, P. troglodytes
atgttgcccagactgt

SEQ ID NO: 214398 - DNA, 16 bp, P. troglodytes
atgttgcccaggctct

SEQ ID NO: 214399 - DNA, 17 bp, P. troglodytes
atgttgcccaggctggg

SEQ ID NO: 214400 - DNA, 16 bp, P. troglodytes
atgttgcccaggcttg

SEQ ID NO: 214401 - DNA, 16 bp, P. troglodytes
atgttgctcagggtgg

SEQ ID NO: 214402 - DNA, 16 bp, P. troglodytes
atgttgctcaggttgg

SEQ ID NO: 214403 - DNA, 16 bp, P. troglodytes
atgttgctgaagctgg

SEQ ID NO: 214404 - DNA, 16 bp, P. troglodytes
atgttgcttccacatt

SEQ ID NO: 214405 - DNA, 16 bp, P. troglodytes
atgttggctcactgca

SEQ ID NO: 214406 - DNA, 16 bp, P. troglodytes
atgttggctgtgggct

SEQ ID NO: 214407 - DNA, 16 bp, P. troglodytes
atgttggtgaccttca

SEQ ID NO: 214408 - DNA, 16 bp, P. troglodytes
atgttggtggaaatgt

SEQ ID NO: 214409 - DNA, 16 bp, P. troglodytes
atgttggttttgtatc

SEQ ID NO: 214410 - DNA, 16 bp, P. troglodytes
atgttgtacaacagat

SEQ ID NO: 214411 - DNA, 16 bp, P. troglodytes
atgttgtacagtagat

SEQ ID NO: 214412 - DNA, 16 bp, P. troglodytes
atgttgtataaaatta

SEQ ID NO: 214413 - DNA, 16 bp, P. troglodytes
atgttgtataaatgga

SEQ ID NO: 214414 - DNA, 16 bp, P. troglodytes
atgttgtatatataca

SEQ ID NO: 214415 - DNA, 16 bp, P. troglodytes
atgttgtatgattcca

SEQ ID NO: 214416 - DNA, 16 bp, P. troglodytes
atgttgtcacttattt

SEQ ID NO: 214417 - DNA, 16 bp, P. troglodytes
atgttgtccagactga

SEQ ID NO: 214418 - DNA, 16 bp, P. troglodytes
atgttgtctctacaaa

SEQ ID NO: 214419 - DNA, 16 bp, P. troglodytes
atgttgtgaaaattaa

SEQ ID NO: 214420 - DNA, 16 bp, P. troglodytes
atgttgtgtttctgtt

SEQ ID NO: 214421 - DNA, 16 bp, P. troglodytes
atgttgttggaaaaat

SEQ ID NO: 214422 - DNA, 16 bp, P. troglodytes
atgtttaaaaacattt

SEQ ID NO: 214423 - DNA, 16 bp, P. troglodytes
atgtttaaaaataaca

SEQ ID NO: 214424 - DNA, 16 bp, P. troglodytes
atgtttaaaatggtaa

SEQ ID NO: 214425 - DNA, 16 bp, P. troglodytes
atgtttaaattcacct

SEQ ID NO: 214426 - DNA, 16 bp, P. troglodytes
atgtttaaatttttct

SEQ ID NO: 214427 - DNA, 16 bp, P. troglodytes
atgtttaacattttaa

SEQ ID NO: 214428 - DNA, 16 bp, P. troglodytes
atgtttaacttttaaa

SEQ ID NO: 214429 - DNA, 16 bp, P. troglodytes
atgtttaagaaaatat

SEQ ID NO: 214430 - DNA, 16 bp, P. troglodytes
atgtttaagtctttga

SEQ ID NO: 214431 - DNA, 16 bp, P. troglodytes
atgtttaagtgtttaa

SEQ ID NO: 214432 - DNA, 16 bp, P. troglodytes
atgtttaattttctaa

SEQ ID NO: 214433 - DNA, 16 bp, P. troglodytes
atgtttacagcagttt

SEQ ID NO: 214434 - DNA, 16 bp, P. troglodytes
atgtttacattaaaaa

SEQ ID NO: 214435 - DNA, 16 bp, P. troglodytes
atgtttactttaaaaa

SEQ ID NO: 214436 - DNA, 16 bp, P. troglodytes
atgtttagaaacacaa

SEQ ID NO: 214437 - DNA, 16 bp, P. troglodytes
atgtttagcagtatcc

SEQ ID NO: 214438 - DNA, 16 bp, P. troglodytes
atgtttataccacatt

SEQ ID NO: 214439 - DNA, 16 bp, P. troglodytes
atgtttatatataaac

SEQ ID NO: 214440 - DNA, 16 bp, P. troglodytes
atgtttatgtatataa

SEQ ID NO: 214441 - DNA, 16 bp, P. troglodytes
atgtttattttaacat

SEQ ID NO: 214442 - DNA, 16 bp, P. troglodytes
atgtttattttccatt

SEQ ID NO: 214443 - DNA, 16 bp, P. troglodytes
atgtttcatgtctccc

SEQ ID NO: 214444 - DNA, 16 bp, P. troglodytes
atgtttccagcttttg

SEQ ID NO: 214445 - DNA, 16 bp, P. troglodytes
atgtttccaggatttg

SEQ ID NO: 214446 - DNA, 16 bp, P. troglodytes
atgtttccattttttg

SEQ ID NO: 214447 - DNA, 16 bp, P. troglodytes
atgtttccttttttaa

SEQ ID NO: 214448 - DNA, 16 bp, P. troglodytes
atgtttctaattttaa

SEQ ID NO: 214449 - DNA, 16 bp, P. troglodytes
atgtttctatatattt

SEQ ID NO: 214450 - DNA, 16 bp, P. troglodytes
atgtttctattttaaa

SEQ ID NO: 214451 - DNA, 16 bp, P. troglodytes
atgtttctctctctct

SEQ ID NO: 214452 - DNA, 16 bp, P. troglodytes
atgtttctgcaaagaa

SEQ ID NO: 214453 - DNA, 16 bp, P. troglodytes
atgtttctgttgttta

SEQ ID NO: 214454 - DNA, 16 bp, P. troglodytes
atgtttgaaaattttc

SEQ ID NO: 214455 - DNA, 16 bp, P. troglodytes
atgtttgagaaatatt

SEQ ID NO: 214456 - DNA, 16 bp, P. troglodytes
atgtttgatatatgta

SEQ ID NO: 214457 - DNA, 16 bp, P. troglodytes
atgtttgcaaaccata

SEQ ID NO: 214458 - DNA, 16 bp, P. troglodytes
atgtttgcaaatattt

SEQ ID NO: 214459 - DNA, 16 bp, P. troglodytes
atgtttgccagactgg

SEQ ID NO: 214460 - DNA, 16 bp, P. troglodytes
atgtttgctggttatt

SEQ ID NO: 214461 - DNA, 16 bp, P. troglodytes
atgtttgcttctcctt

SEQ ID NO: 214462 - DNA, 16 bp, P. troglodytes
atgtttggagacattt

SEQ ID NO: 214463 - DNA, 16 bp, P. troglodytes
atgtttggcagcatcc

SEQ ID NO: 214464 - DNA, 16 bp, P. troglodytes
atgtttggttacatga

SEQ ID NO: 214465 - DNA, 16 bp, P. troglodytes
atgtttgtgaattttc

SEQ ID NO: 214466 - DNA, 16 bp, P. troglodytes
atgtttgtgccactgc

SEQ ID NO: 214467 - DNA, 16 bp, P. troglodytes
atgtttgttaaatgaa

SEQ ID NO: 214468 - DNA, 16 bp, P. troglodytes
atgtttgttgactgaa

SEQ ID NO: 214469 - DNA, 16 bp, P. troglodytes
atgttttaaaaacaca

SEQ ID NO: 214470 - DNA, 16 bp, P. troglodytes
atgttttaaaaagata

SEQ ID NO: 214471 - DNA, 16 bp, P. troglodytes
atgttttaaaaatgtt

SEQ ID NO: 214472 - DNA, 16 bp, P. troglodytes
atgttttaaaacataa

SEQ ID NO: 214473 - DNA, 16 bp, P. troglodytes
atgttttaaaagtttg

SEQ ID NO: 214474 - DNA, 16 bp, P. troglodytes
atgttttaaaataaca

SEQ ID NO: 214475 - DNA, 16 bp, P. troglodytes
atgttttaaaatctat

SEQ ID NO: 214476 - DNA, 16 bp, P. troglodytes
atgttttaaaattgat

SEQ ID NO: 214477 - DNA, 16 bp, P. troglodytes
atgttttaaagaatat

SEQ ID NO: 214478 - DNA, 16 bp, P. troglodytes
atgttttaaatgcttt

SEQ ID NO: 214479 - DNA, 16 bp, P. troglodytes
atgttttacatttagg

SEQ ID NO: 214480 - DNA, 16 bp, P. troglodytes
atgttttagcaataaa

SEQ ID NO: 214481 - DNA, 16 bp, P. troglodytes
atgttttatcatggtt

SEQ ID NO: 214482 - DNA, 16 bp, P. troglodytes
atgttttatgaaaaaa

SEQ ID NO: 214483 - DNA, 16 bp, P. troglodytes
atgttttcaataaata

SEQ ID NO: 214484 - DNA, 16 bp, P. troglodytes
atgttttcatatactt

SEQ ID NO: 214485 - DNA, 16 bp, P. troglodytes
atgttttcatgtgttt

SEQ ID NO: 214486 - DNA, 16 bp, P. troglodytes
atgttttcatttatct

SEQ ID NO: 214487 - DNA, 16 bp, P. troglodytes
atgttttcctctaaga

SEQ ID NO: 214488 - DNA, 16 bp, P. troglodytes
atgttttcctggatgg

SEQ ID NO: 214489 - DNA, 16 bp, P. troglodytes
atgttttccttgttcc

SEQ ID NO: 214490 - DNA, 16 bp, P. troglodytes
atgttttctcccattc

SEQ ID NO: 214491 - DNA, 16 bp, P. troglodytes
atgttttcttaaaatt

SEQ ID NO: 214492 - DNA, 16 bp, P. troglodytes
atgttttcttctggga

SEQ ID NO: 214493 - DNA, 16 bp, P. troglodytes
atgttttctttaaaaa

SEQ ID NO: 214494 - DNA, 16 bp, P. troglodytes
atgttttctttaaaga

SEQ ID NO: 214495 - DNA, 16 bp, P. troglodytes
atgttttgaaatgtga

SEQ ID NO: 214496 - DNA, 16 bp, P. troglodytes
atgttttgatatacat

SEQ ID NO: 214497 - DNA, 16 bp, P. troglodytes
atgttttggaaactta

SEQ ID NO: 214498 - DNA, 16 bp, P. troglodytes
atgttttggtcaatga

SEQ ID NO: 214499 - DNA, 16 bp, P. troglodytes
atgttttggtttccca

SEQ ID NO: 214500 - DNA, 16 bp, P. troglodytes
atgtttttaaagaaaa

SEQ ID NO: 214501 - DNA, 16 bp, P. troglodytes
atgtttttaaggttca

SEQ ID NO: 214502 - DNA, 16 bp, P. troglodytes
atgtttttaatggcat

SEQ ID NO: 214503 - DNA, 16 bp, P. troglodytes
atgtttttacagtggc

SEQ ID NO: 214504 - DNA, 16 bp, P. troglodytes
atgtttttatatgctt

SEQ ID NO: 214505 - DNA, 16 bp, P. troglodytes
atgtttttccatctgt

SEQ ID NO: 214506 - DNA, 16 bp, P. troglodytes
atgtttttccttgaaa

SEQ ID NO: 214507 - DNA, 16 bp, P. troglodytes
atgtttttgaatgaat

SEQ ID NO: 214508 - DNA, 16 bp, P. troglodytes
atgtttttgagattta

SEQ ID NO: 214509 - DNA, 16 bp, P. troglodytes
atgtttttgaggttca

SEQ ID NO: 214510 - DNA, 16 bp, P. troglodytes
atgtttttgcatattt

SEQ ID NO: 214511 - DNA, 16 bp, P. troglodytes
atgtttttgtacccat

SEQ ID NO: 214512 - DNA, 16 bp, P. troglodytes
atgttttttaaaacat

SEQ ID NO: 214513 - DNA, 16 bp, P. troglodytes
attaaaaaaatgctca

SEQ ID NO: 214514 - DNA, 16 bp, P. troglodytes
attaaaaaatgctcaa

SEQ ID NO: 214515 - DNA, 16 bp, P. troglodytes
attaaaaacaatgaag

SEQ ID NO: 214516 - DNA, 16 bp, P. troglodytes
attaaaaaccactgaa

SEQ ID NO: 214517 - DNA, 16 bp, P. troglodytes
attaaaaactgaaaat

SEQ ID NO: 214518 - DNA, 16 bp, P. troglodytes
attaaaaacttttgct

SEQ ID NO: 214519 - DNA, 16 bp, P. troglodytes
attaaaaataaagctt

SEQ ID NO: 214520 - DNA, 16 bp, P. troglodytes
attaaaaatacattgt

SEQ ID NO: 214521 - DNA, 16 bp, P. troglodytes
attaaaaatgagattt

SEQ ID NO: 214522 - DNA, 16 bp, P. troglodytes
attaaaaatggcaaaa

SEQ ID NO: 214523 - DNA, 16 bp, P. troglodytes
attaaaaattaggcaa

SEQ ID NO: 214524 - DNA, 16 bp, P. troglodytes
attaaaaattcaaatg

SEQ ID NO: 214525 - DNA, 16 bp, P. troglodytes
attaaaaattccattt

SEQ ID NO: 214526 - DNA, 16 bp, P. troglodytes
attaaaacaaaaatgt

SEQ ID NO: 214527 - DNA, 16 bp, P. troglodytes
attaaaacatgtaaaa

SEQ ID NO: 214528 - DNA, 16 bp, P. troglodytes
attaaaaccacaatga

SEQ ID NO: 214529 - DNA, 16 bp, P. troglodytes
attaaaaccctcagca

SEQ ID NO: 214530 - DNA, 16 bp, P. troglodytes
attaaaagaaagctct

SEQ ID NO: 214531 - DNA, 16 bp, P. troglodytes
attaaaagacagattt

SEQ ID NO: 214532 - DNA, 16 bp, P. troglodytes
attaaaagactgaaaa

SEQ ID NO: 214533 - DNA, 16 bp, P. troglodytes
attaaaagatgctcaa

SEQ ID NO: 214534 - DNA, 16 bp, P. troglodytes
attaaaagctgaaaga

SEQ ID NO: 214535 - DNA, 16 bp, P. troglodytes
attaaaagtaaatgga

SEQ ID NO: 214536 - DNA, 16 bp, P. troglodytes
attaaaataaaatgct

SEQ ID NO: 214537 - DNA, 16 bp, P. troglodytes
attaaaatactgtttt

SEQ ID NO: 214538 - DNA, 16 bp, P. troglodytes
attaaaatattagcca

SEQ ID NO: 214539 - DNA, 16 bp, P. troglodytes
attaaaatgatcaaaa

SEQ ID NO: 214540 - DNA, 16 bp, P. troglodytes
attaaaatgatcatat

SEQ ID NO: 214541 - DNA, 16 bp, P. troglodytes
attaaaatggctttta

SEQ ID NO: 214542 - DNA, 16 bp, P. troglodytes
attaaaatgtacaaaa

SEQ ID NO: 214543 - DNA, 16 bp, P. troglodytes
attaaaatgtatgttt

SEQ ID NO: 214544 - DNA, 16 bp, P. troglodytes
attaaaatgtgtattt

SEQ ID NO: 214545 - DNA, 16 bp, P. troglodytes
attaaaatgttcaaaa

SEQ ID NO: 214546 - DNA, 16 bp, P. troglodytes
attaaaatgttcattt

SEQ ID NO: 214547 - DNA, 16 bp, P. troglodytes
attaaaatgttctaaa

SEQ ID NO: 214548 - DNA, 16 bp, P. troglodytes
attaaaatgtttatct

SEQ ID NO: 214549 - DNA, 16 bp, P. troglodytes
attaaaatgttttctt

SEQ ID NO: 214550 - DNA, 16 bp, P. troglodytes
attaaaattgtctttt

SEQ ID NO: 214551 - DNA, 16 bp, P. troglodytes
attaaacaactcccca

SEQ ID NO: 214552 - DNA, 16 bp, P. troglodytes
attaaacacttaaaca

SEQ ID NO: 214553 - DNA, 16 bp, P. troglodytes
attaaacctctttttc

SEQ ID NO: 214554 - DNA, 16 bp, P. troglodytes
attaaacttcttttct

SEQ ID NO: 214555 - DNA, 16 bp, P. troglodytes
attaaactttatcatg

SEQ ID NO: 214556 - DNA, 16 bp, P. troglodytes
attaaagaaatacatt

SEQ ID NO: 214557 - DNA, 16 bp, P. troglodytes
attaaagagtgctatg

SEQ ID NO: 214558 - DNA, 16 bp, P. troglodytes
attaaagagtttctgc

SEQ ID NO: 214559 - DNA, 16 bp, P. troglodytes
attaaagatctaaata

SEQ ID NO: 214560 - DNA, 17 bp, P. troglodytes
attaaaggcatgagcca

SEQ ID NO: 214561 - DNA, 16 bp, P. troglodytes
attaaaggtttaaaac

SEQ ID NO: 214562 - DNA, 16 bp, P. troglodytes
attaaagtcaatggaa

SEQ ID NO: 214563 - DNA, 16 bp, P. troglodytes
attaaagtttgagaag

SEQ ID NO: 214564 - DNA, 16 bp, P. troglodytes
attaaataacacattt

SEQ ID NO: 214565 - DNA, 16 bp, P. troglodytes
attaaataatgcattt

SEQ ID NO: 214566 - DNA, 16 bp, P. troglodytes
attaaatatttcagaa

SEQ ID NO: 214567 - DNA, 16 bp, P. troglodytes
attaaatgaatcaata

SEQ ID NO: 214568 - DNA, 16 bp, P. troglodytes
attaaatgagaagatg

SEQ ID NO: 214569 - DNA, 16 bp, P. troglodytes
attaaatgagataaca

SEQ ID NO: 214570 - DNA, 16 bp, P. troglodytes
attaaatgagatatat

SEQ ID NO: 214571 - DNA, 16 bp, P. troglodytes
attaaatgaggtaatg

SEQ ID NO: 214572 - DNA, 16 bp, P. troglodytes
attaaatgagtttata

SEQ ID NO: 214573 - DNA, 16 bp, P. troglodytes
attaaatgatttttct

SEQ ID NO: 214574 - DNA, 16 bp, P. troglodytes
attaaatgcattttta

SEQ ID NO: 214575 - DNA, 16 bp, P. troglodytes
attaaatgttaaagct

SEQ ID NO: 214576 - DNA, 16 bp, P. troglodytes
attaaattatgcattt

SEQ ID NO: 214577 - DNA, 16 bp, P. troglodytes
attaacaaaatagact

SEQ ID NO: 214578 - DNA, 16 bp, P. troglodytes
attaacagaatcaagg

SEQ ID NO: 214579 - DNA, 16 bp, P. troglodytes
attaacagcagaaaca

SEQ ID NO: 214580 - DNA, 16 bp, P. troglodytes
attaacagcatctcaa

SEQ ID NO: 214581 - DNA, 16 bp, P. troglodytes
attaacagcatctcag

SEQ ID NO: 214582 - DNA, 16 bp, P. troglodytes
attaacagtataaatt

SEQ ID NO: 214583 - DNA, 16 bp, P. troglodytes
attaacatatacatta

SEQ ID NO: 214584 - DNA, 16 bp, P. troglodytes
attaacatttaaatca

SEQ ID NO: 214585 - DNA, 16 bp, P. troglodytes
attaacattttccatt

SEQ ID NO: 214586 - DNA, 16 bp, P. troglodytes
attaaccacttatcag

SEQ ID NO: 214587 - DNA, 16 bp, P. troglodytes
attaacctgaaatgta

SEQ ID NO: 214588 - DNA, 16 bp, P. troglodytes
attaactaaaaatgga

SEQ ID NO: 214589 - DNA, 16 bp, P. troglodytes
attaactcaaaagttc

SEQ ID NO: 214590 - DNA, 16 bp, P. troglodytes
attaactcgtcatttc

SEQ ID NO: 214591 - DNA, 17 bp, P. troglodytes
attaactgaagatggat

SEQ ID NO: 214592 - DNA, 16 bp, P. troglodytes
attaacttgttattta

SEQ ID NO: 214593 - DNA, 16 bp, P. troglodytes
attaagaaactggcaa

SEQ ID NO: 214594 - DNA, 16 bp, P. troglodytes
attaagaaactgtggc

SEQ ID NO: 214595 - DNA, 16 bp, P. troglodytes
attaagcaaaaggaaa

SEQ ID NO: 214596 - DNA, 16 bp, P. troglodytes
attaagcatttattat

SEQ ID NO: 214597 - DNA, 16 bp, P. troglodytes
attaagcattttaaaa

SEQ ID NO: 214598 - DNA, 16 bp, P. troglodytes
attaagcctcagtttc

SEQ ID NO: 214599 - DNA, 16 bp, P. troglodytes
attaaggaatcagaga

SEQ ID NO: 214600 - DNA, 16 bp, P. troglodytes
attaaggacttaaata

SEQ ID NO: 214601 - DNA, 16 bp, P. troglodytes
attaaggattttgaaa

SEQ ID NO: 214602 - DNA, 16 bp, P. troglodytes
attaagtaaatggatg

SEQ ID NO: 214603 - DNA, 16 bp, P. troglodytes
attaagtaacttgcca

SEQ ID NO: 214604 - DNA, 16 bp, P. troglodytes
attaagtagaagtgga

SEQ ID NO: 214605 - DNA, 16 bp, P. troglodytes
attaagtttccaacac

SEQ ID NO: 214606 - DNA, 16 bp, P. troglodytes
attaataacatgaaaa

SEQ ID NO: 214607 - DNA, 16 bp, P. troglodytes
attaataaccttccaa

SEQ ID NO: 214608 - DNA, 16 bp, P. troglodytes
attaatagagacaggg

SEQ ID NO: 214609 - DNA, 16 bp, P. troglodytes
attaatagatctgaag

SEQ ID NO: 214610 - DNA, 16 bp, P. troglodytes
attaatcaatcaatca

SEQ ID NO: 214611 - DNA, 16 bp, P. troglodytes
attaatcaatgagtgg

SEQ ID NO: 214612 - DNA, 16 bp, P. troglodytes
attaatcatcaaggaa

SEQ ID NO: 214613 - DNA, 16 bp, P. troglodytes
attaatcatcagagaa

SEQ ID NO: 214614 - DNA, 16 bp, P. troglodytes
attaatcattaaggaa

SEQ ID NO: 214615 - DNA, 16 bp, P. troglodytes
attaatgaattaatga

SEQ ID NO: 214616 - DNA, 16 bp, P. troglodytes
attaatgatgttgaat

SEQ ID NO: 214617 - DNA, 16 bp, P. troglodytes
attaatgcaaaagaaa

SEQ ID NO: 214618 - DNA, 16 bp, P. troglodytes
attaatgcagtaacag

SEQ ID NO: 214619 - DNA, 16 bp, P. troglodytes
attaatgcattttttt

SEQ ID NO: 214620 - DNA, 16 bp, P. troglodytes
attaatggatgctaaa

SEQ ID NO: 214621 - DNA, 16 bp, P. troglodytes
attaatgggaaaaata

SEQ ID NO: 214622 - DNA, 16 bp, P. troglodytes
attaatgtattcatta

SEQ ID NO: 214623 - DNA, 16 bp, P. troglodytes
attaatgtattcattt

SEQ ID NO: 214624 - DNA, 16 bp, P. troglodytes
attaatgttattttca

SEQ ID NO: 214625 - DNA, 16 bp, P. troglodytes
attaatgtttgttaaa

SEQ ID NO: 214626 - DNA, 16 bp, P. troglodytes
attaattcaagaaata

SEQ ID NO: 214627 - DNA, 16 bp, P. troglodytes
attaattcatcaaata

SEQ ID NO: 214628 - DNA, 16 bp, P. troglodytes
attaattcattaattc

SEQ ID NO: 214629 - DNA, 16 bp, P. troglodytes
attaattcattcatct

SEQ ID NO: 214630 - DNA, 16 bp, P. troglodytes
attaattctttaaatg

SEQ ID NO: 214631 - DNA, 16 bp, P. troglodytes
attaattgcattttaa

SEQ ID NO: 214632 - DNA, 16 bp, P. troglodytes
attaattggaattctt

SEQ ID NO: 214633 - DNA, 16 bp, P. troglodytes
attaattgtaacaaat

SEQ ID NO: 214634 - DNA, 16 bp, P. troglodytes
attaatttagaaagtt

SEQ ID NO: 214635 - DNA, 16 bp, P. troglodytes
attaatttcacctttt

SEQ ID NO: 214636 - DNA, 16 bp, P. troglodytes
attaatttgctagaat

SEQ ID NO: 214637 - DNA, 16 bp, P. troglodytes
attaattttgaaaatg

SEQ ID NO: 214638 - DNA, 16 bp, P. troglodytes
attacaaaacagaaat

SEQ ID NO: 214639 - DNA, 16 bp, P. troglodytes
attacaaaagtaaaat

SEQ ID NO: 214640 - DNA, 16 bp, P. troglodytes
attacaaaatacattt

SEQ ID NO: 214641 - DNA, 16 bp, P. troglodytes
attacaaaggggaaaa

SEQ ID NO: 214642 - DNA, 16 bp, P. troglodytes
attacaaataatactg

SEQ ID NO: 214643 - DNA, 16 bp, P. troglodytes
attacaacaaatttag

SEQ ID NO: 214644 - DNA, 17 bp, P. troglodytes
attacaagcatgagcca

SEQ ID NO: 214645 - DNA, 16 bp, P. troglodytes
attacaagcatgtgcc

SEQ ID NO: 214646 - DNA, 20 bp, P. troglodytes
attacaagcgtgagccacca

SEQ ID NO: 214647 - DNA, 18 bp, P. troglodytes
attacaaggtcaggagat

SEQ ID NO: 214648 - DNA, 19 bp, P. troglodytes
attacaagtgtgagccact

SEQ ID NO: 214649 - DNA, 16 bp, P. troglodytes
attacaatggctaaaa

SEQ ID NO: 214650 - DNA, 16 bp, P. troglodytes
attacacattttaaaa

SEQ ID NO: 214651 - DNA, 16 bp, P. troglodytes
attacagaagaaaata

SEQ ID NO: 214652 - DNA, 16 bp, P. troglodytes
attacagaatattgtt

SEQ ID NO: 214653 - DNA, 16 bp, P. troglodytes
attacagacatgaacc

SEQ ID NO: 214654 - DNA, 17 bp, P. troglodytes
attacagacattagcca

SEQ ID NO: 214655 - DNA, 20 bp, P. troglodytes
attacagacgtgagccaccg

SEQ ID NO: 214656 - DNA, 19 bp, P. troglodytes
attacagacgtgagccact

SEQ ID NO: 214657 - DNA, 17 bp, P. troglodytes
attacagatgtgagcca

SEQ ID NO: 214658 - DNA, 16 bp, P. troglodytes
attacagattattttt

SEQ ID NO: 214659 - DNA, 16 bp, P. troglodytes
attacagattcaattt

SEQ ID NO: 214660 - DNA, 16 bp, P. troglodytes
attacaggcaagaacc

SEQ ID NO: 214661 - DNA, 16 bp, P. troglodytes
attacaggcacccacc

SEQ ID NO: 214662 - DNA, 17 bp, P. troglodytes
attacaggcatcagcca

SEQ ID NO: 214663 - DNA, 19 bp, P. troglodytes
attacaggcatgagccaca

SEQ ID NO: 214664 - DNA, 19 bp, P. troglodytes
attacaggcatgagccact

SEQ ID NO: 214665 - DNA, 18 bp, P. troglodytes
attacaggcatgagccag

SEQ ID NO: 214666 - DNA, 22 bp, P. troglodytes
attacaggcatgagccatcaca

SEQ ID NO: 214667 - DNA, 21 bp, P. troglodytes
attacaggcatgagccattgt

SEQ ID NO: 214668 - DNA, 17 bp, P. troglodytes
attacaggcatgagctg

SEQ ID NO: 214669 - DNA, 20 bp, P. troglodytes
attacaggcatgagtcactg

SEQ ID NO: 214670 - DNA, 17 bp, P. troglodytes
attacaggcatgctcca

SEQ ID NO: 214671 - DNA, 18 bp, P. troglodytes
attacaggcgcatgccat

SEQ ID NO: 214672 - DNA, 18 bp, P. troglodytes
attacaggcgtgagccaa

SEQ ID NO: 214673 - DNA, 20 bp, P. troglodytes
attacaggcgtgagccacca

SEQ ID NO: 214674 - DNA, 20 bp, P. troglodytes
attacaggcgtgagccacct

SEQ ID NO: 214675 - DNA, 18 bp, P. troglodytes
attacaggcgtgagccat

SEQ ID NO: 214676 - DNA, 20 bp, P. troglodytes
attacaggcgtgagccattg

SEQ ID NO: 214677 - DNA, 17 bp, P. troglodytes
attacaggcgtgagcct

SEQ ID NO: 214678 - DNA, 18 bp, P. troglodytes
attacaggcgtgagctat

SEQ ID NO: 214679 - DNA, 17 bp, P. troglodytes
attacaggcgtgcgcca

SEQ ID NO: 214680 - DNA, 16 bp, P. troglodytes
attacaggctcacacc

SEQ ID NO: 214681 - DNA, 16 bp, P. troglodytes
attacagggtcctgag

SEQ ID NO: 214682 - DNA, 17 bp, P. troglodytes
attacaggtatgagcca

SEQ ID NO: 214683 - DNA, 21 bp, P. troglodytes
attacaggtgcctgccaccat

SEQ ID NO: 214684 - DNA, 16 bp, P. troglodytes
attacaggtgcctgct

SEQ ID NO: 214685 - DNA, 20 bp, P. troglodytes
attacaggtgtaagccaccg

SEQ ID NO: 214686 - DNA, 16 bp, P. troglodytes
attacaggtgtgagca

SEQ ID NO: 214687 - DNA, 20 bp, P. troglodytes
attacaggtgtgagccacca

SEQ ID NO: 214688 - DNA, 18 bp, P. troglodytes
attacaggtgtgagtcat

SEQ ID NO: 214689 - DNA, 16 bp, P. troglodytes
attacagtatattatt

SEQ ID NO: 214690 - DNA, 16 bp, P. troglodytes
attacagtatttttaa

SEQ ID NO: 214691 - DNA, 16 bp, P. troglodytes
attacataatgacaaa

SEQ ID NO: 214692 - DNA, 16 bp, P. troglodytes
attacatatatatgta

SEQ ID NO: 214693 - DNA, 16 bp, P. troglodytes
attacatatatgtaat

SEQ ID NO: 214694 - DNA, 16 bp, P. troglodytes
attacatgaaaatatt

SEQ ID NO: 214695 - DNA, 16 bp, P. troglodytes
attacatgtaaattaa

SEQ ID NO: 214696 - DNA, 16 bp, P. troglodytes
attacattaagtaaaa

SEQ ID NO: 214697 - DNA, 16 bp, P. troglodytes
attacatttacaatag

SEQ ID NO: 214698 - DNA, 16 bp, P. troglodytes
attacattttctgatt

SEQ ID NO: 214699 - DNA, 16 bp, P. troglodytes
attacattttctgttt

SEQ ID NO: 214700 - DNA, 16 bp, P. troglodytes
attacattttctttgt

SEQ ID NO: 214701 - DNA, 16 bp, P. troglodytes
attaccaaatccatta

SEQ ID NO: 214702 - DNA, 16 bp, P. troglodytes
attaccacctgagctc

SEQ ID NO: 214703 - DNA, 16 bp, P. troglodytes
attaccagtttattat

SEQ ID NO: 214704 - DNA, 16 bp, P. troglodytes
attaccatttgttgaa

SEQ ID NO: 214705 - DNA, 16 bp, P. troglodytes
attacccagactggtc

SEQ ID NO: 214706 - DNA, 16 bp, P. troglodytes
attacccagatttgat

SEQ ID NO: 214707 - DNA, 16 bp, P. troglodytes
attacccaggctcagg

SEQ ID NO: 214708 - DNA, 16 bp, P. troglodytes
attaccctgatctgat

SEQ ID NO: 214709 - DNA, 16 bp, P. troglodytes
attaccctgatttggt

SEQ ID NO: 214710 - DNA, 16 bp, P. troglodytes
attacctcacatactt

SEQ ID NO: 214711 - DNA, 16 bp, P. troglodytes
attacctctgtaaaga

SEQ ID NO: 214712 - DNA, 16 bp, P. troglodytes
attacctgacttcaaa

SEQ ID NO: 214713 - DNA, 20 bp, P. troglodytes
attacctgaggtcaggagtt

SEQ ID NO: 214714 - DNA, 20 bp, P. troglodytes
attacctgaggttgggagtt

SEQ ID NO: 214715 - DNA, 21 bp, P. troglodytes
attacctgctccaccctgact

SEQ ID NO: 214716 - DNA, 16 bp, P. troglodytes
attaccttgtgaagca

SEQ ID NO: 214717 - DNA, 16 bp, P. troglodytes
attacctttctaaaat

SEQ ID NO: 214718 - DNA, 16 bp, P. troglodytes
attacctttttgatgt

SEQ ID NO: 214719 - DNA, 16 bp, P. troglodytes
attactattgttaaaa

SEQ ID NO: 214720 - DNA, 16 bp, P. troglodytes
attactccaaaattta

SEQ ID NO: 214721 - DNA, 16 bp, P. troglodytes
attactcccaatatag

SEQ ID NO: 214722 - DNA, 16 bp, P. troglodytes
attactgaactgtaca

SEQ ID NO: 214723 - DNA, 16 bp, P. troglodytes
attactgaagaaagaa

SEQ ID NO: 214724 - DNA, 16 bp, P. troglodytes
attactgaatatttta

SEQ ID NO: 214725 - DNA, 16 bp, P. troglodytes
attactgagagaaatt

SEQ ID NO: 214726 - DNA, 16 bp, P. troglodytes
attactgattcaattt

SEQ ID NO: 214727 - DNA, 16 bp, P. troglodytes
attactgatttaattt

SEQ ID NO: 214728 - DNA, 16 bp, P. troglodytes
attactgccttctttt

SEQ ID NO: 214729 - DNA, 16 bp, P. troglodytes
attactggcacctgcc

SEQ ID NO: 214730 - DNA, 17 bp, P. troglodytes
attactggcatgagcca

SEQ ID NO: 214731 - DNA, 16 bp, P. troglodytes
attactggttatatac

SEQ ID NO: 214732 - DNA, 16 bp, P. troglodytes
attactgtagctttct

SEQ ID NO: 214733 - DNA, 16 bp, P. troglodytes
attactgtatactact

SEQ ID NO: 214734 - DNA, 16 bp, P. troglodytes
attactgtattttaaa

SEQ ID NO: 214735 - DNA, 16 bp, P. troglodytes
attactgttattattg

SEQ ID NO: 214736 - DNA, 16 bp, P. troglodytes
attactgttatttatt

SEQ ID NO: 214737 - DNA, 16 bp, P. troglodytes
attacttaaacccagg

SEQ ID NO: 214738 - DNA, 16 bp, P. troglodytes
attacttcagccattg

SEQ ID NO: 214739 - DNA, 16 bp, P. troglodytes
attacttgagcttggg

SEQ ID NO: 214740 - DNA, 16 bp, P. troglodytes
attacttgttattggt

SEQ ID NO: 214741 - DNA, 16 bp, P. troglodytes
attacttttctaaaat

SEQ ID NO: 214742 - DNA, 16 bp, P. troglodytes
attacttttctggttc

SEQ ID NO: 214743 - DNA, 16 bp, P. troglodytes
attacttttgcaccaa

SEQ ID NO: 214744 - DNA, 16 bp, P. troglodytes
attacttttgtaatta

SEQ ID NO: 214745 - DNA, 16 bp, P. troglodytes
attacttttgtaccaa

SEQ ID NO: 214746 - DNA, 16 bp, P. troglodytes
attactttttaaatgt

SEQ ID NO: 214747 - DNA, 16 bp, P. troglodytes
attagaaaactgaagc

SEQ ID NO: 214748 - DNA, 16 bp, P. troglodytes
attagaaaatgtattt

SEQ ID NO: 214749 - DNA, 16 bp, P. troglodytes
attagaaattaaaaca

SEQ ID NO: 214750 - DNA, 16 bp, P. troglodytes
attagaaattaataac

SEQ ID NO: 214751 - DNA, 16 bp, P. troglodytes
attagaaattatagtt

SEQ ID NO: 214752 - DNA, 16 bp, P. troglodytes
attagaagaatcaata

SEQ ID NO: 214753 - DNA, 16 bp, P. troglodytes
attagaatatcaccat

SEQ ID NO: 214754 - DNA, 16 bp, P. troglodytes
attagaatattttcat

SEQ ID NO: 214755 - DNA, 16 bp, P. troglodytes
attagaattacctggg

SEQ ID NO: 214756 - DNA, 16 bp, P. troglodytes
attagacaaaattatt

SEQ ID NO: 214757 - DNA, 16 bp, P. troglodytes
attagacagatcaaag

SEQ ID NO: 214758 - DNA, 16 bp, P. troglodytes
attagacagatcaatg

SEQ ID NO: 214759 - DNA, 16 bp, P. troglodytes
attagacccaaaaatg

SEQ ID NO: 214760 - DNA, 16 bp, P. troglodytes
attagagaaatgcaaa

SEQ ID NO: 214761 - DNA, 17 bp, P. troglodytes
attagagaaatgcaaat

SEQ ID NO: 214762 - DNA, 16 bp, P. troglodytes
attagagaatgcaaat

SEQ ID NO: 214763 - DNA, 16 bp, P. troglodytes
attagagaccattatt

SEQ ID NO: 214764 - DNA, 16 bp, P. troglodytes
attagagatgtgagcc

SEQ ID NO: 214765 - DNA, 16 bp, P. troglodytes
attagagatttttaaa

SEQ ID NO: 214766 - DNA, 16 bp, P. troglodytes
attagaggtgtgagcc

SEQ ID NO: 214767 - DNA, 16 bp, P. troglodytes
attagagtcctgcctt

SEQ ID NO: 214768 - DNA, 16 bp, P. troglodytes
attagatttcaacaca

SEQ ID NO: 214769 - DNA, 16 bp, P. troglodytes
attagatttgcatttt

SEQ ID NO: 214770 - DNA, 16 bp, P. troglodytes
attagcaaattaaatc

SEQ ID NO: 214771 - DNA, 16 bp, P. troglodytes
attagcagagtgagaa

SEQ ID NO: 214772 - DNA, 16 bp, P. troglodytes
attagcatttttattt

SEQ ID NO: 214773 - DNA, 16 bp, P. troglodytes
attagcatttttcttt

SEQ ID NO: 214774 - DNA, 17 bp, P. troglodytes
attagccaggatggtct

SEQ ID NO: 214775 - DNA, 16 bp, P. troglodytes
attagccagggcgtgg

SEQ ID NO: 214776 - DNA, 16 bp, P. troglodytes
attagccggatgtggt

SEQ ID NO: 214777 - DNA, 17 bp, P. troglodytes
attagccgggcatggtg

SEQ ID NO: 214778 - DNA, 16 bp, P. troglodytes
attagccgggcgtggt

SEQ ID NO: 214779 - DNA, 16 bp, P. troglodytes
attagccgggggtggt

SEQ ID NO: 214780 - DNA, 17 bp, P. troglodytes
attagcctggcgtggtg

SEQ ID NO: 214781 - DNA, 16 bp, P. troglodytes
attagctgagcatagt

SEQ ID NO: 214782 - DNA, 16 bp, P. troglodytes
attagctgggaccaca

SEQ ID NO: 214783 - DNA, 16 bp, P. troglodytes
attagctgggcgtggt

SEQ ID NO: 214784 - DNA, 16 bp, P. troglodytes
attagctgtgtgacct

SEQ ID NO: 214785 - DNA, 16 bp, P. troglodytes
attagctgtgtggcct

SEQ ID NO: 214786 - DNA, 16 bp, P. troglodytes
attagctgtgtgtagt

SEQ ID NO: 214787 - DNA, 16 bp, P. troglodytes
attagctgtgtgtgat

SEQ ID NO: 214788 - DNA, 16 bp, P. troglodytes
attaggaaaatggaaa

SEQ ID NO: 214789 - DNA, 18 bp, P. troglodytes
attaggacaaggaaattc

SEQ ID NO: 214790 - DNA, 16 bp, P. troglodytes
attaggcatttctcct

SEQ ID NO: 214791 - DNA, 17 bp, P. troglodytes
attaggctgccttcagc

SEQ ID NO: 214792 - DNA, 17 bp, P. troglodytes
attagggagtttcaaaa

SEQ ID NO: 214793 - DNA, 16 bp, P. troglodytes
attagggatttttgtt

SEQ ID NO: 214794 - DNA, 16 bp, P. troglodytes
attaggtaacttgccc

SEQ ID NO: 214795 - DNA, 16 bp, P. troglodytes
attaggtattataaat

SEQ ID NO: 214796 - DNA, 19 bp, P. troglodytes
attaggtatttcccctaat

SEQ ID NO: 214797 - DNA, 16 bp, P. troglodytes
attaggtcatgaggga

SEQ ID NO: 214798 - DNA, 16 bp, P. troglodytes
attaggtcatgagggt

SEQ ID NO: 214799 - DNA, 16 bp, P. troglodytes
attaggttaatttata

SEQ ID NO: 214800 - DNA, 16 bp, P. troglodytes
attaggttttcaacat

SEQ ID NO: 214801 - DNA, 16 bp, P. troglodytes
attagtaaaagaggaa

SEQ ID NO: 214802 - DNA, 16 bp, P. troglodytes
attagtaatattgagc

SEQ ID NO: 214803 - DNA, 16 bp, P. troglodytes
attagtcaggtgtggc

SEQ ID NO: 214804 - DNA, 16 bp, P. troglodytes
attagtcatttaaaaa

SEQ ID NO: 214805 - DNA, 16 bp, P. troglodytes
attagtctcttctcac

SEQ ID NO: 214806 - DNA, 16 bp, P. troglodytes
attagtgatgatgaac

SEQ ID NO: 214807 - DNA, 16 bp, P. troglodytes
attagtgatgatgagc

SEQ ID NO: 214808 - DNA, 16 bp, P. troglodytes
attagtgatgtctgcc

SEQ ID NO: 214809 - DNA, 16 bp, P. troglodytes
attagtgcccttataa

SEQ ID NO: 214810 - DNA, 16 bp, P. troglodytes
attagtgcctttataa

SEQ ID NO: 214811 - DNA, 16 bp, P. troglodytes
attagttaagatgagg

SEQ ID NO: 214812 - DNA, 16 bp, P. troglodytes
attagttcagctactg

SEQ ID NO: 214813 - DNA, 16 bp, P. troglodytes
attagttcattctcac

SEQ ID NO: 214814 - DNA, 16 bp, P. troglodytes
attagttggtgcagtt

SEQ ID NO: 214815 - DNA, 16 bp, P. troglodytes
attagttttctattgt

SEQ ID NO: 214816 - DNA, 16 bp, P. troglodytes
attagttttctgttgc

SEQ ID NO: 214817 - DNA, 16 bp, P. troglodytes
attagttttgaaatgt

SEQ ID NO: 214818 - DNA, 16 bp, P. troglodytes
attataaaagtaatgc

SEQ ID NO: 214819 - DNA, 16 bp, P. troglodytes
attataaagaatacaa

SEQ ID NO: 214820 - DNA, 16 bp, P. troglodytes
attataaagaccatca

SEQ ID NO: 214821 - DNA, 16 bp, P. troglodytes
attataaataacattg

SEQ ID NO: 214822 - DNA, 16 bp, P. troglodytes
attataatcctcattt

SEQ ID NO: 214823 - DNA, 16 bp, P. troglodytes
attataatgaaaacaa

SEQ ID NO: 214824 - DNA, 16 bp, P. troglodytes
attataatgatgatga

SEQ ID NO: 214825 - DNA, 16 bp, P. troglodytes
attataatgcaataaa

SEQ ID NO: 214826 - DNA, 16 bp, P. troglodytes
attataatttcaacat

SEQ ID NO: 214827 - DNA, 16 bp, P. troglodytes
attatacctcaagaaa

SEQ ID NO: 214828 - DNA, 16 bp, P. troglodytes
attatacttaagttct

SEQ ID NO: 214829 - DNA, 16 bp, P. troglodytes
attatagaaaatttag

SEQ ID NO: 214830 - DNA, 16 bp, P. troglodytes
attatagcaacagaaa

SEQ ID NO: 214831 - DNA, 16 bp, P. troglodytes
attatagccattctag

SEQ ID NO: 214832 - DNA, 16 bp, P. troglodytes
attatagctcactgta

SEQ ID NO: 214833 - DNA, 17 bp, P. troglodytes
attataggcacgtgcca

SEQ ID NO: 214834 - DNA, 17 bp, P. troglodytes
attataggcatgagcca

SEQ ID NO: 214835 - DNA, 17 bp, P. troglodytes
attataggcgtgaacca

SEQ ID NO: 214836 - DNA, 21 bp, P. troglodytes
attataggcgtgagccaccat

SEQ ID NO: 214837 - DNA, 21 bp, P. troglodytes
attataggtgtgagccaccgt

SEQ ID NO: 214838 - DNA, 16 bp, P. troglodytes
attatagtatcataca

SEQ ID NO: 214839 - DNA, 16 bp, P. troglodytes
attatatactatgtat

SEQ ID NO: 214840 - DNA, 16 bp, P. troglodytes
attatatagtatgtat

SEQ ID NO: 214841 - DNA, 16 bp, P. troglodytes
attatatatcatgtat

SEQ ID NO: 214842 - DNA, 16 bp, P. troglodytes
attatatatgacatat

SEQ ID NO: 214843 - DNA, 16 bp, P. troglodytes
attatatcaaatgctt

SEQ ID NO: 214844 - DNA, 16 bp, P. troglodytes
attatatcctcttgct

SEQ ID NO: 214845 - DNA, 16 bp, P. troglodytes
attatatgccaggcat

SEQ ID NO: 214846 - DNA, 16 bp, P. troglodytes
attatattaacagaat

SEQ ID NO: 214847 - DNA, 16 bp, P. troglodytes
attatattgattcttc

SEQ ID NO: 214848 - DNA, 16 bp, P. troglodytes
attatattttcagttt

SEQ ID NO: 214849 - DNA, 16 bp, P. troglodytes
attatattttccaaag

SEQ ID NO: 214850 - DNA, 16 bp, P. troglodytes
attatcaaaagtcaaa

SEQ ID NO: 214851 - DNA, 16 bp, P. troglodytes
attatcagaaataaag

SEQ ID NO: 214852 - DNA, 16 bp, P. troglodytes
attatcagattttttt

SEQ ID NO: 214853 - DNA, 16 bp, P. troglodytes
attatcagcttaaaat

SEQ ID NO: 214854 - DNA, 16 bp, P. troglodytes
attatcagttttattt

SEQ ID NO: 214855 - DNA, 16 bp, P. troglodytes
attatcatcaccacca

SEQ ID NO: 214856 - DNA, 16 bp, P. troglodytes
attatcatcatcatca

SEQ ID NO: 214857 - DNA, 16 bp, P. troglodytes
attatccagccccaaa

SEQ ID NO: 214858 - DNA, 16 bp, P. troglodytes
attatccaggtgtggt

SEQ ID NO: 214859 - DNA, 16 bp, P. troglodytes
attatccccatttcat

SEQ ID NO: 214860 - DNA, 16 bp, P. troglodytes
attatccctttaaata

SEQ ID NO: 214861 - DNA, 16 bp, P. troglodytes
attatcctgcctcacc

SEQ ID NO: 214862 - DNA, 17 bp, P. troglodytes
attatcctgcctcagcc

SEQ ID NO: 214863 - DNA, 16 bp, P. troglodytes
attatcctttgaattt

SEQ ID NO: 214864 - DNA, 16 bp, P. troglodytes
attatctcatttcatt

SEQ ID NO: 214865 - DNA, 16 bp, P. troglodytes
attatctgtgtgacct

SEQ ID NO: 214866 - DNA, 16 bp, P. troglodytes
attatcttcaaaataa

SEQ ID NO: 214867 - DNA, 16 bp, P. troglodytes
attatcttccatgaaa

SEQ ID NO: 214868 - DNA, 16 bp, P. troglodytes
attatgaaaatgttaa

SEQ ID NO: 214869 - DNA, 16 bp, P. troglodytes
attatgaaattatgaa

SEQ ID NO: 214870 - DNA, 16 bp, P. troglodytes
attatgaaattcttgt

SEQ ID NO: 214871 - DNA, 16 bp, P. troglodytes
attatgaacaattcta

SEQ ID NO: 214872 - DNA, 16 bp, P. troglodytes
attatgaagattttct

SEQ ID NO: 214873 - DNA, 16 bp, P. troglodytes
attatgaataaaattg

SEQ ID NO: 214874 - DNA, 16 bp, P. troglodytes
attatgaataatgcta

SEQ ID NO: 214875 - DNA, 16 bp, P. troglodytes
attatgatgtgccttg

SEQ ID NO: 214876 - DNA, 17 bp, P. troglodytes
attatgatgttagctga

SEQ ID NO: 214877 - DNA, 16 bp, P. troglodytes
attatgctaagttaaa

SEQ ID NO: 214878 - DNA, 16 bp, P. troglodytes
attatgctacatgaaa

SEQ ID NO: 214879 - DNA, 16 bp, P. troglodytes
attatgctgattggac

SEQ ID NO: 214880 - DNA, 16 bp, P. troglodytes
attatggaaaacacta

SEQ ID NO: 214881 - DNA, 16 bp, P. troglodytes
attatggctgcttctg

SEQ ID NO: 214882 - DNA, 16 bp, P. troglodytes
attatggcttccagct

SEQ ID NO: 214883 - DNA, 16 bp, P. troglodytes
attatgtaaaacattt

SEQ ID NO: 214884 - DNA, 16 bp, P. troglodytes
attatgtaaaattgtt

SEQ ID NO: 214885 - DNA, 16 bp, P. troglodytes
attatgtacaatacat

SEQ ID NO: 214886 - DNA, 16 bp, P. troglodytes
attatgtacagtacat

SEQ ID NO: 214887 - DNA, 16 bp, P. troglodytes
attatgtggcacatga

SEQ ID NO: 214888 - DNA, 16 bp, P. troglodytes
attatgttaagagaaa

SEQ ID NO: 214889 - DNA, 16 bp, P. troglodytes
attatgttttctaaaa

SEQ ID NO: 214890 - DNA, 16 bp, P. troglodytes
attatgtttttaaaga

SEQ ID NO: 214891 - DNA, 16 bp, P. troglodytes
attatgtttttgagat

SEQ ID NO: 214892 - DNA, 16 bp, P. troglodytes
attattaaaaaggcaa

SEQ ID NO: 214893 - DNA, 16 bp, P. troglodytes
attattaaaaagtcaa

SEQ ID NO: 214894 - DNA, 16 bp, P. troglodytes
attattaaagtcaaaa

SEQ ID NO: 214895 - DNA, 16 bp, P. troglodytes
attattatgtcttctt

SEQ ID NO: 214896 - DNA, 16 bp, P. troglodytes
attattatgtgtcaat

SEQ ID NO: 214897 - DNA, 16 bp, P. troglodytes
attattatgttagctg

SEQ ID NO: 214898 - DNA, 16 bp, P. troglodytes
attattattagagata

SEQ ID NO: 214899 - DNA, 16 bp, P. troglodytes
attattattttagaca

SEQ ID NO: 214900 - DNA, 16 bp, P. troglodytes
attattatttttcagt

SEQ ID NO: 214901 - DNA, 16 bp, P. troglodytes
attattatttttgagg

SEQ ID NO: 214902 - DNA, 16 bp, P. troglodytes
attattcaaagtgaag

SEQ ID NO: 214903 - DNA, 16 bp, P. troglodytes
attattcaggtgatgg

SEQ ID NO: 214904 - DNA, 16 bp, P. troglodytes
attattcatggattct

SEQ ID NO: 214905 - DNA, 16 bp, P. troglodytes
attattcattcttaaa

SEQ ID NO: 214906 - DNA, 16 bp, P. troglodytes
attattccactctcta

SEQ ID NO: 214907 - DNA, 16 bp, P. troglodytes
attattccatttgtat

SEQ ID NO: 214908 - DNA, 16 bp, P. troglodytes
attattctgtctacca

SEQ ID NO: 214909 - DNA, 16 bp, P. troglodytes
attattgactatagcc

SEQ ID NO: 214910 - DNA, 16 bp, P. troglodytes
attattgattcattaa

SEQ ID NO: 214911 - DNA, 16 bp, P. troglodytes
attattgcctgaattt

SEQ ID NO: 214912 - DNA, 16 bp, P. troglodytes
attattggcattcctg

SEQ ID NO: 214913 - DNA, 16 bp, P. troglodytes
attattgtattggagt

SEQ ID NO: 214914 - DNA, 16 bp, P. troglodytes
attattgtctgtcttt

SEQ ID NO: 214915 - DNA, 16 bp, P. troglodytes
attattgtgaaaatta

SEQ ID NO: 214916 - DNA, 16 bp, P. troglodytes
attattgtgaggcctc

SEQ ID NO: 214917 - DNA, 16 bp, P. troglodytes
attattgtgtgggatt

SEQ ID NO: 214918 - DNA, 16 bp, P. troglodytes
attatttaaaaatcag

SEQ ID NO: 214919 - DNA, 16 bp, P. troglodytes
attatttaaagacaaa

SEQ ID NO: 214920 - DNA, 16 bp, P. troglodytes
attatttacccagaag

SEQ ID NO: 214921 - DNA, 16 bp, P. troglodytes
attatttagaaatgaa

SEQ ID NO: 214922 - DNA, 16 bp, P. troglodytes
attatttaggaaataa

SEQ ID NO: 214923 - DNA, 16 bp, P. troglodytes
attatttaggtgcacc

SEQ ID NO: 214924 - DNA, 16 bp, P. troglodytes
attatttatgaaaact

SEQ ID NO: 214925 - DNA, 16 bp, P. troglodytes
attatttcaacttttc

SEQ ID NO: 214926 - DNA, 16 bp, P. troglodytes
attatttcagaaaaat

SEQ ID NO: 214927 - DNA, 16 bp, P. troglodytes
attatttcagtatttt

SEQ ID NO: 214928 - DNA, 16 bp, P. troglodytes
attatttcattaccca

SEQ ID NO: 214929 - DNA, 16 bp, P. troglodytes
attatttcattatatg

SEQ ID NO: 214930 - DNA, 16 bp, P. troglodytes
attatttcattatgta

SEQ ID NO: 214931 - DNA, 16 bp, P. troglodytes
attatttcatttgaaa

SEQ ID NO: 214932 - DNA, 16 bp, P. troglodytes
attatttccaaataat

SEQ ID NO: 214933 - DNA, 16 bp, P. troglodytes
attatttccaaatatt

SEQ ID NO: 214934 - DNA, 16 bp, P. troglodytes
attatttccagttttt

SEQ ID NO: 214935 - DNA, 16 bp, P. troglodytes
attatttccatctttg

SEQ ID NO: 214936 - DNA, 16 bp, P. troglodytes
attatttctaacactt

SEQ ID NO: 214937 - DNA, 16 bp, P. troglodytes
attatttctcaaataa

SEQ ID NO: 214938 - DNA, 16 bp, P. troglodytes
attatttctgaaaaat

SEQ ID NO: 214939 - DNA, 16 bp, P. troglodytes
attatttctgattatt

SEQ ID NO: 214940 - DNA, 16 bp, P. troglodytes
attatttctgttttac

SEQ ID NO: 214941 - DNA, 16 bp, P. troglodytes
attatttcttcaaaat

SEQ ID NO: 214942 - DNA, 16 bp, P. troglodytes
attatttcttcaaata

SEQ ID NO: 214943 - DNA, 16 bp, P. troglodytes
attatttcttcaagta

SEQ ID NO: 214944 - DNA, 16 bp, P. troglodytes
attatttctttgaaat

SEQ ID NO: 214945 - DNA, 16 bp, P. troglodytes
attatttggaaataat

SEQ ID NO: 214946 - DNA, 16 bp, P. troglodytes
attatttggggaaaaa

SEQ ID NO: 214947 - DNA, 16 bp, P. troglodytes
attatttgtaacacaa

SEQ ID NO: 214948 - DNA, 16 bp, P. troglodytes
attattttaaaagtgt

SEQ ID NO: 214949 - DNA, 16 bp, P. troglodytes
attattttaaaggaaa

SEQ ID NO: 214950 - DNA, 16 bp, P. troglodytes
attattttaagccact

SEQ ID NO: 214951 - DNA, 16 bp, P. troglodytes
attattttacagaaaa

SEQ ID NO: 214952 - DNA, 16 bp, P. troglodytes
attattttatattctg

SEQ ID NO: 214953 - DNA, 16 bp, P. troglodytes
attattttcaaaatga

SEQ ID NO: 214954 - DNA, 16 bp, P. troglodytes
attattttcaaacatt

SEQ ID NO: 214955 - DNA, 16 bp, P. troglodytes
attattttcagtattt

SEQ ID NO: 214956 - DNA, 16 bp, P. troglodytes
attattttcatgaaaa

SEQ ID NO: 214957 - DNA, 16 bp, P. troglodytes
attattttccaaagtg

SEQ ID NO: 214958 - DNA, 16 bp, P. troglodytes
attattttccattttg

SEQ ID NO: 214959 - DNA, 16 bp, P. troglodytes
attattttctgcattt

SEQ ID NO: 214960 - DNA, 16 bp, P. troglodytes
attattttctttgaat

SEQ ID NO: 214961 - DNA, 16 bp, P. troglodytes
attattttgaagtgtg

SEQ ID NO: 214962 - DNA, 16 bp, P. troglodytes
attattttgaataaac

SEQ ID NO: 214963 - DNA, 16 bp, P. troglodytes
attattttgaattctt

SEQ ID NO: 214964 - DNA, 16 bp, P. troglodytes
attattttgagataga

SEQ ID NO: 214965 - DNA, 16 bp, P. troglodytes
attattttgagattca

SEQ ID NO: 214966 - DNA, 16 bp, P. troglodytes
attattttgaggaaaa

SEQ ID NO: 214967 - DNA, 16 bp, P. troglodytes
attattttgaggcaga

SEQ ID NO: 214968 - DNA, 16 bp, P. troglodytes
attattttggctattt

SEQ ID NO: 214969 - DNA, 16 bp, P. troglodytes
attatttttaaaagct

SEQ ID NO: 214970 - DNA, 16 bp, P. troglodytes
attatttttaatgaca

SEQ ID NO: 214971 - DNA, 16 bp, P. troglodytes
attatttttaatgact

SEQ ID NO: 214972 - DNA, 16 bp, P. troglodytes
attatttttacaatga

SEQ ID NO: 214973 - DNA, 16 bp, P. troglodytes
attatttttacagaaa

SEQ ID NO: 214974 - DNA, 16 bp, P. troglodytes
attatttttacattgt

SEQ ID NO: 214975 - DNA, 18 bp, P. troglodytes
attatttttagtagagac

SEQ ID NO: 214976 - DNA, 16 bp, P. troglodytes
attatttttatcattg

SEQ ID NO: 214977 - DNA, 16 bp, P. troglodytes
attatttttatgactt

SEQ ID NO: 214978 - DNA, 16 bp, P. troglodytes
attatttttgagactg

SEQ ID NO: 214979 - DNA, 16 bp, P. troglodytes
attattttttccaaaa

SEQ ID NO: 214980 - DNA, 16 bp, P. troglodytes
attcaaaaatgaataa

SEQ ID NO: 214981 - DNA, 16 bp, P. troglodytes
attcaaaacctagcag

SEQ ID NO: 214982 - DNA, 16 bp, P. troglodytes
attcaaaactttttga

SEQ ID NO: 214983 - DNA, 16 bp, P. troglodytes
attcaaaatagtattg

SEQ ID NO: 214984 - DNA, 16 bp, P. troglodytes
attcaaaatatggatt

SEQ ID NO: 214985 - DNA, 16 bp, P. troglodytes
attcaaaatgctccaa

SEQ ID NO: 214986 - DNA, 16 bp, P. troglodytes
attcaaacaaatattt

SEQ ID NO: 214987 - DNA, 16 bp, P. troglodytes
attcaaacattttaaa

SEQ ID NO: 214988 - DNA, 16 bp, P. troglodytes
attcaaacattttatt

SEQ ID NO: 214989 - DNA, 16 bp, P. troglodytes
attcaaacttcagaaa

SEQ ID NO: 214990 - DNA, 16 bp, P. troglodytes
attcaaagaaacagaa

SEQ ID NO: 214991 - DNA, 16 bp, P. troglodytes
attcaaagaattggta

SEQ ID NO: 214992 - DNA, 16 bp, P. troglodytes
attcaaagatttcctg

SEQ ID NO: 214993 - DNA, 16 bp, P. troglodytes
attcaaataaaaagag

SEQ ID NO: 214994 - DNA, 16 bp, P. troglodytes
attcaaataaaatctt

SEQ ID NO: 214995 - DNA, 16 bp, P. troglodytes
attcaaatacaggaaa

SEQ ID NO: 214996 - DNA, 16 bp, P. troglodytes
attcaaatccagatct

SEQ ID NO: 214997 - DNA, 16 bp, P. troglodytes
attcaaatgctagcag

SEQ ID NO: 214998 - DNA, 16 bp, P. troglodytes
attcaaattatttccc

SEQ ID NO: 214999 - DNA, 16 bp, P. troglodytes
attcaaattcagaaaa

SEQ ID NO: 215000 - DNA, 16 bp, P. troglodytes
attcaaattcaggact

SEQ ID NO: 215001 - DNA, 16 bp, P. troglodytes
attcaaattcatgaaa

SEQ ID NO: 215002 - DNA, 16 bp, P. troglodytes
attcaaatttaactag

SEQ ID NO: 215003 - DNA, 16 bp, P. troglodytes
attcaaatttaactgg

SEQ ID NO: 215004 - DNA, 16 bp, P. troglodytes
attcaacaaaaatgta

SEQ ID NO: 215005 - DNA, 16 bp, P. troglodytes
attcaacaaagtattg

SEQ ID NO: 215006 - DNA, 16 bp, P. troglodytes
attcaacaaatattta

SEQ ID NO: 215007 - DNA, 16 bp, P. troglodytes
attcaacaaatatttg

SEQ ID NO: 215008 - DNA, 16 bp, P. troglodytes
attcaacaaatgtttg

SEQ ID NO: 215009 - DNA, 16 bp, P. troglodytes
attcaacacattttta

SEQ ID NO: 215010 - DNA, 17 bp, P. troglodytes
attcaacagtccttcat

SEQ ID NO: 215011 - DNA, 17 bp, P. troglodytes
attcaaccattgtggaa

SEQ ID NO: 215012 - DNA, 16 bp, P. troglodytes
attcaactcccactta

SEQ ID NO: 215013 - DNA, 16 bp, P. troglodytes
attcaactgtgaatct

SEQ ID NO: 215014 - DNA, 16 bp, P. troglodytes
attcaactgttgatgg

SEQ ID NO: 215015 - DNA, 17 bp, P. troglodytes
attcaagaccagcctga

SEQ ID NO: 215016 - DNA, 16 bp, P. troglodytes
attcaagagatattta

SEQ ID NO: 215017 - DNA, 16 bp, P. troglodytes
attcaagatagtattg

SEQ ID NO: 215018 - DNA, 16 bp, P. troglodytes
attcaagatgtgacct

SEQ ID NO: 215019 - DNA, 16 bp, P. troglodytes
attcaagattaatatt

SEQ ID NO: 215020 - DNA, 16 bp, P. troglodytes
attcaagattttaaaa

SEQ ID NO: 215021 - DNA, 16 bp, P. troglodytes
attcaagatttttttt

SEQ ID NO: 215022 - DNA, 16 bp, P. troglodytes
attcaaggacctgctg

SEQ ID NO: 215023 - DNA, 16 bp, P. troglodytes
attcaaggagagggga

SEQ ID NO: 215024 - DNA, 16 bp, P. troglodytes
attcaaggccaggcac

SEQ ID NO: 215025 - DNA, 16 bp, P. troglodytes
attcaagtcctggctc

SEQ ID NO: 215026 - DNA, 16 bp, P. troglodytes
attcaagttttctttt

SEQ ID NO: 215027 - DNA, 16 bp, P. troglodytes
attcaataaagttgca

SEQ ID NO: 215028 - DNA, 16 bp, P. troglodytes
attcaataaatactta

SEQ ID NO: 215029 - DNA, 16 bp, P. troglodytes
attcaataaatattgg

SEQ ID NO: 215030 - DNA, 16 bp, P. troglodytes
attcaataaatatttg

SEQ ID NO: 215031 - DNA, 16 bp, P. troglodytes
attcaataaatgttag

SEQ ID NO: 215032 - DNA, 16 bp, P. troglodytes
attcaatatgactggt

SEQ ID NO: 215033 - DNA, 16 bp, P. troglodytes
attcaatgatttttta

SEQ ID NO: 215034 - DNA, 16 bp, P. troglodytes
attcaattcagcaaat

SEQ ID NO: 215035 - DNA, 16 bp, P. troglodytes
attcaatttttaatgt

SEQ ID NO: 215036 - DNA, 16 bp, P. troglodytes
attcacaatagcatca

SEQ ID NO: 215037 - DNA, 16 bp, P. troglodytes
attcacaattgccata

SEQ ID NO: 215038 - DNA, 18 bp, P. troglodytes
attcacaattgctacaaa

SEQ ID NO: 215039 - DNA, 16 bp, P. troglodytes
attcacacccttgtgt

SEQ ID NO: 215040 - DNA, 16 bp, P. troglodytes
attcacagaagcagag

SEQ ID NO: 215041 - DNA, 16 bp, P. troglodytes
attcacaggcaaattc

SEQ ID NO: 215042 - DNA, 16 bp, P. troglodytes
attcacagtagccaca

SEQ ID NO: 215043 - DNA, 16 bp, P. troglodytes
attcacatcctgggtg

SEQ ID NO: 215044 - DNA, 16 bp, P. troglodytes
attcacatggttcaaa

SEQ ID NO: 215045 - DNA, 16 bp, P. troglodytes
attcaccaagacagac

SEQ ID NO: 215046 - DNA, 16 bp, P. troglodytes
attcaccatgaccaag

SEQ ID NO: 215047 - DNA, 16 bp, P. troglodytes
attcaccattaccaag

SEQ ID NO: 215048 - DNA, 16 bp, P. troglodytes
attcaccattttaaag

SEQ ID NO: 215049 - DNA, 16 bp, P. troglodytes
attcacccacctcagc

SEQ ID NO: 215050 - DNA, 16 bp, P. troglodytes
attcacccactgaagg

SEQ ID NO: 215051 - DNA, 16 bp, P. troglodytes
attcacctgcctcagc

SEQ ID NO: 215052 - DNA, 16 bp, P. troglodytes
attcacctgccttggc

SEQ ID NO: 215053 - DNA, 16 bp, P. troglodytes
attcactcaacaagta

SEQ ID NO: 215054 - DNA, 16 bp, P. troglodytes
attcacttaacaaata

SEQ ID NO: 215055 - DNA, 16 bp, P. troglodytes
attcacttgacaaata

SEQ ID NO: 215056 - DNA, 16 bp, P. troglodytes
attcactttttaaaaa

SEQ ID NO: 215057 - DNA, 16 bp, P. troglodytes
attcactttttcacca

SEQ ID NO: 215058 - DNA, 16 bp, P. troglodytes
attcagaaaaaaaatt

SEQ ID NO: 215059 - DNA, 16 bp, P. troglodytes
attcagaaaacattta

SEQ ID NO: 215060 - DNA, 16 bp, P. troglodytes
attcagaaaatgcaga

SEQ ID NO: 215061 - DNA, 16 bp, P. troglodytes
attcagaaaattaaaa

SEQ ID NO: 215062 - DNA, 16 bp, P. troglodytes
attcagaaaattttaa

SEQ ID NO: 215063 - DNA, 16 bp, P. troglodytes
attcagaaaattttca

SEQ ID NO: 215064 - DNA, 16 bp, P. troglodytes
attcagaaataaaatt

SEQ ID NO: 215065 - DNA, 16 bp, P. troglodytes
attcagaaatggaaaa

SEQ ID NO: 215066 - DNA, 16 bp, P. troglodytes
attcagaaattcaact

SEQ ID NO: 215067 - DNA, 16 bp, P. troglodytes
attcagaagaataaaa

SEQ ID NO: 215068 - DNA, 16 bp, P. troglodytes
attcagaataaaattt

SEQ ID NO: 215069 - DNA, 16 bp, P. troglodytes
attcagaatatgaata

SEQ ID NO: 215070 - DNA, 16 bp, P. troglodytes
attcagaattttattt

SEQ ID NO: 215071 - DNA, 16 bp, P. troglodytes
attcagaatttttttt

SEQ ID NO: 215072 - DNA, 16 bp, P. troglodytes
attcagagaaacttct

SEQ ID NO: 215073 - DNA, 16 bp, P. troglodytes
attcagagattcttta

SEQ ID NO: 215074 - DNA, 16 bp, P. troglodytes
attcagagcttgaaga

SEQ ID NO: 215075 - DNA, 16 bp, P. troglodytes
attcagaggaagaaaa

SEQ ID NO: 215076 - DNA, 16 bp, P. troglodytes
attcagagggaaaaaa

SEQ ID NO: 215077 - DNA, 16 bp, P. troglodytes
attcagcaaataaaaa

SEQ ID NO: 215078 - DNA, 16 bp, P. troglodytes
attcagcaaatattta

SEQ ID NO: 215079 - DNA, 16 bp, P. troglodytes
attcagcaattttttt

SEQ ID NO: 215080 - DNA, 16 bp, P. troglodytes
attcagcagattggaa

SEQ ID NO: 215081 - DNA, 16 bp, P. troglodytes
attcagcagcatatca

SEQ ID NO: 215082 - DNA, 16 bp, P. troglodytes
attcagcatagtcctg

SEQ ID NO: 215083 - DNA, 16 bp, P. troglodytes
attcagcatttaaaaa

SEQ ID NO: 215084 - DNA, 16 bp, P. troglodytes
attcagcctctttttt

SEQ ID NO: 215085 - DNA, 16 bp, P. troglodytes
attcagctcactgcaa

SEQ ID NO: 215086 - DNA, 16 bp, P. troglodytes
attcagctgtgaattc

SEQ ID NO: 215087 - DNA, 16 bp, P. troglodytes
attcagctttttaaaa

SEQ ID NO: 215088 - DNA, 16 bp, P. troglodytes
attcaggaaaaacaga

SEQ ID NO: 215089 - DNA, 19 bp, P. troglodytes
attcaggaaacccatctca

SEQ ID NO: 215090 - DNA, 19 bp, P. troglodytes
attcaggaaatacagagaa

SEQ ID NO: 215091 - DNA, 16 bp, P. troglodytes
attcaggaaatatgga

SEQ ID NO: 215092 - DNA, 16 bp, P. troglodytes
attcaggaaatccaga

SEQ ID NO: 215093 - DNA, 16 bp, P. troglodytes
attcaggaaatgcaaa

SEQ ID NO: 215094 - DNA, 16 bp, P. troglodytes
attcaggaaattcaga

SEQ ID NO: 215095 - DNA, 16 bp, P. troglodytes
attcaggacaaaggca

SEQ ID NO: 215096 - DNA, 16 bp, P. troglodytes
attcaggaccagcctg

SEQ ID NO: 215097 - DNA, 16 bp, P. troglodytes
attcaggagacccagc

SEQ ID NO: 215098 - DNA, 16 bp, P. troglodytes
attcaggagcatgtta

SEQ ID NO: 215099 - DNA, 16 bp, P. troglodytes
attcaggaggctgagc

SEQ ID NO: 215100 - DNA, 16 bp, P. troglodytes
attcaggagttcaaga

SEQ ID NO: 215101 - DNA, 16 bp, P. troglodytes
attcaggataatctcc

SEQ ID NO: 215102 - DNA, 16 bp, P. troglodytes
attcaggccataggca

SEQ ID NO: 215103 - DNA, 16 bp, P. troglodytes
attcaggctgtttttt

SEQ ID NO: 215104 - DNA, 16 bp, P. troglodytes
attcagtaaatgttaa

SEQ ID NO: 215105 - DNA, 16 bp, P. troglodytes
attcagtacattcaca

SEQ ID NO: 215106 - DNA, 16 bp, P. troglodytes
attcagtattttcttt

SEQ ID NO: 215107 - DNA, 16 bp, P. troglodytes
attcagtctcaaaaaa

SEQ ID NO: 215108 - DNA, 16 bp, P. troglodytes
attcagtgaatattta

SEQ ID NO: 215109 - DNA, 16 bp, P. troglodytes
attcagtgggggaaaa

SEQ ID NO: 215110 - DNA, 16 bp, P. troglodytes
attcagtttctcagtc

SEQ ID NO: 215111 - DNA, 16 bp, P. troglodytes
attcagtttgaagaat

SEQ ID NO: 215112 - DNA, 16 bp, P. troglodytes
attcagttttggaact

SEQ ID NO: 215113 - DNA, 16 bp, P. troglodytes
attcagtttttaaaaa

SEQ ID NO: 215114 - DNA, 16 bp, P. troglodytes
attcataagggatctg

SEQ ID NO: 215115 - DNA, 16 bp, P. troglodytes
attcataagttttaaa

SEQ ID NO: 215116 - DNA, 16 bp, P. troglodytes
attcataatagccaaa

SEQ ID NO: 215117 - DNA, 16 bp, P. troglodytes
attcatacaacagaat

SEQ ID NO: 215118 - DNA, 16 bp, P. troglodytes
attcatagacacagaa

SEQ ID NO: 215119 - DNA, 16 bp, P. troglodytes
attcatatggaactga

SEQ ID NO: 215120 - DNA, 16 bp, P. troglodytes
attcatatgttgaaaa

SEQ ID NO: 215121 - DNA, 16 bp, P. troglodytes
attcatatgttgatgg

SEQ ID NO: 215122 - DNA, 16 bp, P. troglodytes
attcatattttgaaat

SEQ ID NO: 215123 - DNA, 16 bp, P. troglodytes
attcatcaaatattta

SEQ ID NO: 215124 - DNA, 16 bp, P. troglodytes
attcatcaagctgtac

SEQ ID NO: 215125 - DNA, 16 bp, P. troglodytes
attcatcaccaccagg

SEQ ID NO: 215126 - DNA, 16 bp, P. troglodytes
attcatcagagaaatg

SEQ ID NO: 215127 - DNA, 16 bp, P. troglodytes
attcatcattttaaaa

SEQ ID NO: 215128 - DNA, 16 bp, P. troglodytes
attcatccttcaaaac

SEQ ID NO: 215129 - DNA, 16 bp, P. troglodytes
attcatctattaaaaa

SEQ ID NO: 215130 - DNA, 16 bp, P. troglodytes
attcatctgacaaaga

SEQ ID NO: 215131 - DNA, 16 bp, P. troglodytes
attcatctttgtattc

SEQ ID NO: 215132 - DNA, 16 bp, P. troglodytes
attcatgaaaaagaaa

SEQ ID NO: 215133 - DNA, 16 bp, P. troglodytes
attcatgagagatcca

SEQ ID NO: 215134 - DNA, 16 bp, P. troglodytes
attcatgaggaatctg

SEQ ID NO: 215135 - DNA, 16 bp, P. troglodytes
attcatgatgagattt

SEQ ID NO: 215136 - DNA, 16 bp, P. troglodytes
attcatgcagagccag

SEQ ID NO: 215137 - DNA, 16 bp, P. troglodytes
attcatggaaaaaaat

SEQ ID NO: 215138 - DNA, 16 bp, P. troglodytes
attcatgtaacaaaac

SEQ ID NO: 215139 - DNA, 16 bp, P. troglodytes
attcatgtacaatttt

SEQ ID NO: 215140 - DNA, 16 bp, P. troglodytes
attcatgtattattta

SEQ ID NO: 215141 - DNA, 16 bp, P. troglodytes
attcatgtgcaggttt

SEQ ID NO: 215142 - DNA, 16 bp, P. troglodytes
attcatgttatttatt

SEQ ID NO: 215143 - DNA, 16 bp, P. troglodytes
attcatgttttcaaaa

SEQ ID NO: 215144 - DNA, 16 bp, P. troglodytes
attcatgtttttaaaa

SEQ ID NO: 215145 - DNA, 16 bp, P. troglodytes
attcattaaaaagaaa

SEQ ID NO: 215146 - DNA, 16 bp, P. troglodytes
attcattaaaagaaaa

SEQ ID NO: 215147 - DNA, 16 bp, P. troglodytes
attcattaaagttgca

SEQ ID NO: 215148 - DNA, 16 bp, P. troglodytes
attcattaaatgtttg

SEQ ID NO: 215149 - DNA, 16 bp, P. troglodytes
attcattaacattgaa

SEQ ID NO: 215150 - DNA, 16 bp, P. troglodytes
attcattcaacaaaat

SEQ ID NO: 215151 - DNA, 16 bp, P. troglodytes
attcattcaacaagca

SEQ ID NO: 215152 - DNA, 16 bp, P. troglodytes
attcattcaacacaca

SEQ ID NO: 215153 - DNA, 16 bp, P. troglodytes
attcattcaacttttg

SEQ ID NO: 215154 - DNA, 16 bp, P. troglodytes
attcattcacttaaaa

SEQ ID NO: 215155 - DNA, 16 bp, P. troglodytes
attcattcagcaaata

SEQ ID NO: 215156 - DNA, 16 bp, P. troglodytes
attcattcatccatct

SEQ ID NO: 215157 - DNA, 16 bp, P. troglodytes
attcattcattcaata

SEQ ID NO: 215158 - DNA, 16 bp, P. troglodytes
attcattcattcagca

SEQ ID NO: 215159 - DNA, 16 bp, P. troglodytes
attcattcattcatgt

SEQ ID NO: 215160 - DNA, 16 bp, P. troglodytes
attcattcatttaaaa

SEQ ID NO: 215161 - DNA, 16 bp, P. troglodytes
attcattcatttcatt

SEQ ID NO: 215162 - DNA, 16 bp, P. troglodytes
attcattcatttgcat

SEQ ID NO: 215163 - DNA, 16 bp, P. troglodytes
attcattccttcatct

SEQ ID NO: 215164 - DNA, 16 bp, P. troglodytes
attcattctctcattt

SEQ ID NO: 215165 - DNA, 16 bp, P. troglodytes
attcattctgtatttt

SEQ ID NO: 215166 - DNA, 16 bp, P. troglodytes
attcattgaacaaata

SEQ ID NO: 215167 - DNA, 16 bp, P. troglodytes
attcattgaataaatg

SEQ ID NO: 215168 - DNA, 16 bp, P. troglodytes
attcattgaatttttg

SEQ ID NO: 215169 - DNA, 16 bp, P. troglodytes
attcattgagcaccta

SEQ ID NO: 215170 - DNA, 16 bp, P. troglodytes
attcattgagcactta

SEQ ID NO: 215171 - DNA, 16 bp, P. troglodytes
attcattgatttattt

SEQ ID NO: 215172 - DNA, 16 bp, P. troglodytes
attcatttaaatgaat

SEQ ID NO: 215173 - DNA, 16 bp, P. troglodytes
attcatttaatcaaca

SEQ ID NO: 215174 - DNA, 16 bp, P. troglodytes
attcatttacattcaa

SEQ ID NO: 215175 - DNA, 16 bp, P. troglodytes
attcatttatttgaca

SEQ ID NO: 215176 - DNA, 16 bp, P. troglodytes
attcatttatttgaga

SEQ ID NO: 215177 - DNA, 16 bp, P. troglodytes
attcatttcttcaaca

SEQ ID NO: 215178 - DNA, 16 bp, P. troglodytes
attcattttaacaaat

SEQ ID NO: 215179 - DNA, 16 bp, P. troglodytes
attcattttctgattt

SEQ ID NO: 215180 - DNA, 16 bp, P. troglodytes
attcattttgaattga

SEQ ID NO: 215181 - DNA, 16 bp, P. troglodytes
attcattttttcaaaa

SEQ ID NO: 215182 - DNA, 16 bp, P. troglodytes
attccaaaacattttt

SEQ ID NO: 215183 - DNA, 16 bp, P. troglodytes
attccaaaatccaaaa

SEQ ID NO: 215184 - DNA, 16 bp, P. troglodytes
attccaaaatttatat

SEQ ID NO: 215185 - DNA, 16 bp, P. troglodytes
attccaaatgtgagaa

SEQ ID NO: 215186 - DNA, 16 bp, P. troglodytes
attccaacatgagatt

SEQ ID NO: 215187 - DNA, 16 bp, P. troglodytes
attccaagggcttaga

SEQ ID NO: 215188 - DNA, 16 bp, P. troglodytes
attccaagggttttag

SEQ ID NO: 215189 - DNA, 16 bp, P. troglodytes
attccaataaaatttt

SEQ ID NO: 215190 - DNA, 16 bp, P. troglodytes
attccaattacctgct

SEQ ID NO: 215191 - DNA, 16 bp, P. troglodytes
attccacatatgaatg

SEQ ID NO: 215192 - DNA, 16 bp, P. troglodytes
attccaccaaatattt

SEQ ID NO: 215193 - DNA, 16 bp, P. troglodytes
attccacctcaaaaaa

SEQ ID NO: 215194 - DNA, 16 bp, P. troglodytes
attccactggtctatg

SEQ ID NO: 215195 - DNA, 16 bp, P. troglodytes
attccacttcttcctg

SEQ ID NO: 215196 - DNA, 16 bp, P. troglodytes
attccagaaaattgaa

SEQ ID NO: 215197 - DNA, 16 bp, P. troglodytes
attccagaaataaaca

SEQ ID NO: 215198 - DNA, 16 bp, P. troglodytes
attccagaagaagaca

SEQ ID NO: 215199 - DNA, 16 bp, P. troglodytes
attccagacattgtat

SEQ ID NO: 215200 - DNA, 16 bp, P. troglodytes
attccagactgggtga

SEQ ID NO: 215201 - DNA, 16 bp, P. troglodytes
attccagccactcggg

SEQ ID NO: 215202 - DNA, 16 bp, P. troglodytes
attccagcccaggtga

SEQ ID NO: 215203 - DNA, 16 bp, P. troglodytes
attccagcctgagcaa

SEQ ID NO: 215204 - DNA, 16 bp, P. troglodytes
attccagcctgtgtga

SEQ ID NO: 215205 - DNA, 16 bp, P. troglodytes
attccagctgcttggg

SEQ ID NO: 215206 - DNA, 16 bp, P. troglodytes
attccagctttttttt

SEQ ID NO: 215207 - DNA, 16 bp, P. troglodytes
attccaggagacccaa

SEQ ID NO: 215208 - DNA, 16 bp, P. troglodytes
attccaggcacccacc

SEQ ID NO: 215209 - DNA, 16 bp, P. troglodytes
attccaggtgtgagcc

SEQ ID NO: 215210 - DNA, 16 bp, P. troglodytes
attccagtggttctca

SEQ ID NO: 215211 - DNA, 16 bp, P. troglodytes
attccataaacattta

SEQ ID NO: 215212 - DNA, 16 bp, P. troglodytes
attccatatctttgtt

SEQ ID NO: 215213 - DNA, 16 bp, P. troglodytes
attccatatttttgct

SEQ ID NO: 215214 - DNA, 16 bp, P. troglodytes
attccatcctcatgaa

SEQ ID NO: 215215 - DNA, 16 bp, P. troglodytes
attccatctcaaaaca

SEQ ID NO: 215216 - DNA, 16 bp, P. troglodytes
attccatcttaaaaaa

SEQ ID NO: 215217 - DNA, 16 bp, P. troglodytes
attccatgatgcatat

SEQ ID NO: 215218 - DNA, 16 bp, P. troglodytes
attccatggggtatat

SEQ ID NO: 215219 - DNA, 16 bp, P. troglodytes
attccatgtcaaaaaa

SEQ ID NO: 215220 - DNA, 16 bp, P. troglodytes
attccatgtgtttgct

SEQ ID NO: 215221 - DNA, 16 bp, P. troglodytes
attccatgttcatgga

SEQ ID NO: 215222 - DNA, 16 bp, P. troglodytes
attccattcatgaagg

SEQ ID NO: 215223 - DNA, 16 bp, P. troglodytes
attccattgaatggat

SEQ ID NO: 215224 - DNA, 16 bp, P. troglodytes
attccattgtgttcag

SEQ ID NO: 215225 - DNA, 16 bp, P. troglodytes
attccatttcaagaaa

SEQ ID NO: 215226 - DNA, 16 bp, P. troglodytes
attccatttgtttatt

SEQ ID NO: 215227 - DNA, 16 bp, P. troglodytes
attccattttatgact

SEQ ID NO: 215228 - DNA, 16 bp, P. troglodytes
attccattttcttctg

SEQ ID NO: 215229 - DNA, 16 bp, P. troglodytes
attcccaaacctcaat

SEQ ID NO: 215230 - DNA, 16 bp, P. troglodytes
attcccacatgtcatg

SEQ ID NO: 215231 - DNA, 16 bp, P. troglodytes
attcccagaacctgtg

SEQ ID NO: 215232 - DNA, 16 bp, P. troglodytes
attcccaggttcaagc

SEQ ID NO: 215233 - DNA, 16 bp, P. troglodytes
attcccagtgctggag

SEQ ID NO: 215234 - DNA, 16 bp, P. troglodytes
attcccattcccattc

SEQ ID NO: 215235 - DNA, 16 bp, P. troglodytes
attcccatttcacaga

SEQ ID NO: 215236 - DNA, 16 bp, P. troglodytes
attcccattttgcaaa

SEQ ID NO: 215237 - DNA, 26 bp, P. troglodytes
attccccacaggccagcaggcagttc

SEQ ID NO: 215238 - DNA, 16 bp, P. troglodytes
attcccctgcttcagc

SEQ ID NO: 215239 - DNA, 16 bp, P. troglodytes
attcccgttttacaga

SEQ ID NO: 215240 - DNA, 16 bp, P. troglodytes
attccctatttaagaa

SEQ ID NO: 215241 - DNA, 18 bp, P. troglodytes
attccctatttaataaac

SEQ ID NO: 215242 - DNA, 44 bp, P. troglodytes; identical to SEQ ID NO: 54692

SEQ ID NO: 215243 - DNA, 16 bp, P. troglodytes
attccctcctcctcaa

SEQ ID NO: 215244 - DNA, 16 bp, P. troglodytes
attccctctttttctg

SEQ ID NO: 215245 - DNA, 16 bp, P. troglodytes
attcccttcatcattt

SEQ ID NO: 215246 - DNA, 16 bp, P. troglodytes
attcccttggtggcaa

SEQ ID NO: 215247 - DNA, 16 bp, P. troglodytes
attccctttcctagcc

SEQ ID NO: 215248 - DNA, 16 bp, P. troglodytes
attccggacacaccat

SEQ ID NO: 215249 - DNA, 16 bp, P. troglodytes
attccgtctcaaaaaa

SEQ ID NO: 215250 - DNA, 16 bp, P. troglodytes
attcctaagtatttta

SEQ ID NO: 215251 - DNA, 16 bp, P. troglodytes
attcctaagtattttt

SEQ ID NO: 215252 - DNA, 16 bp, P. troglodytes
attcctactcatcctt

SEQ ID NO: 215253 - DNA, 18 bp, P. troglodytes
attcctaggtattttatt

SEQ ID NO: 215254 - DNA, 16 bp, P. troglodytes
attcctagtttgctaa

SEQ ID NO: 215255 - DNA, 17 bp, P. troglodytes
attcctatttctccaca

SEQ ID NO: 215256 - DNA, 16 bp, P. troglodytes
attcctcaaagaccca

SEQ ID NO: 215257 - DNA, 19 bp, P. troglodytes
attcctcaaggatctagaa

SEQ ID NO: 215258 - DNA, 16 bp, P. troglodytes
attcctcacagaatta

SEQ ID NO: 215259 - DNA, 21 bp, P. troglodytes
attcctcagggatctagaact

SEQ ID NO: 215260 - DNA, 16 bp, P. troglodytes
attcctgacccacaga

SEQ ID NO: 215261 - DNA, 16 bp, P. troglodytes
attcctgactcacaga

SEQ ID NO: 215262 - DNA, 17 bp, P. troglodytes
attcctgagttacttca

SEQ ID NO: 215263 - DNA, 16 bp, P. troglodytes
attcctgcattagttt

SEQ ID NO: 215264 - DNA, 16 bp, P. troglodytes
attcctgcttgctttt

SEQ ID NO: 215265 - DNA, 16 bp, P. troglodytes
attcctggaataaacc

SEQ ID NO: 215266 - DNA, 17 bp, P. troglodytes
attcctggacccgtgaa

SEQ ID NO: 215267 - DNA, 16 bp, P. troglodytes
attcctgggatgcaag

SEQ ID NO: 215268 - DNA, 16 bp, P. troglodytes
attcctgggctccacc

SEQ ID NO: 215269 - DNA, 16 bp, P. troglodytes
attcctgggttcaaat

SEQ ID NO: 215270 - DNA, 16 bp, P. troglodytes
attcctgttgtttata

SEQ ID NO: 215271 - DNA, 16 bp, P. troglodytes
attcctgttttacaga

SEQ ID NO: 215272 - DNA, 16 bp, P. troglodytes
attccttaaaataaat

SEQ ID NO: 215273 - DNA, 16 bp, P. troglodytes
attccttacaggaaac

SEQ ID NO: 215274 - DNA, 16 bp, P. troglodytes
attccttctaactgaa

SEQ ID NO: 215275 - DNA, 16 bp, P. troglodytes
attccttctgaaagta

SEQ ID NO: 215276 - DNA, 16 bp, P. troglodytes
attccttcttatggct

SEQ ID NO: 215277 - DNA, 16 bp, P. troglodytes
attccttcttgctcag

SEQ ID NO: 215278 - DNA, 16 bp, P. troglodytes
attccttgaggccagg

SEQ ID NO: 215279 - DNA, 16 bp, P. troglodytes
attccttgcaataaat

SEQ ID NO: 215280 - DNA, 16 bp, P. troglodytes
attccttggctcatgg

SEQ ID NO: 215281 - DNA, 16 bp, P. troglodytes
attcctttaaaaacta

SEQ ID NO: 215282 - DNA, 16 bp, P. troglodytes
attcctttataacaat

SEQ ID NO: 215283 - DNA, 16 bp, P. troglodytes
attcctttattttcaa

SEQ ID NO: 215284 - DNA, 16 bp, P. troglodytes
attcctttccctttag

SEQ ID NO: 215285 - DNA, 16 bp, P. troglodytes
attccttttaaaaatt

SEQ ID NO: 215286 - DNA, 16 bp, P. troglodytes
attcctttttaaagct

SEQ ID NO: 215287 - DNA, 16 bp, P. troglodytes
attccttttttaaaaa

SEQ ID NO: 215288 - DNA, 16 bp, P. troglodytes
attccttttttgtgtg

SEQ ID NO: 215289 - DNA, 18 bp, P. troglodytes
attcgagaccagcctggg

SEQ ID NO: 215290 - DNA, 17 bp, P. troglodytes
attcgcctgcctcagcc

SEQ ID NO: 215291 - DNA, 16 bp, P. troglodytes
attcgggctctttttt

SEQ ID NO: 215292 - DNA, 16 bp, P. troglodytes
attctaaaagataagt

SEQ ID NO: 215293 - DNA, 16 bp, P. troglodytes
attctaaaatccaaaa

SEQ ID NO: 215294 - DNA, 16 bp, P. troglodytes
attctaaaattcaaat

SEQ ID NO: 215295 - DNA, 16 bp, P. troglodytes
attctaaataaatgtt

SEQ ID NO: 215296 - DNA, 16 bp, P. troglodytes
attctaaatattttgt

SEQ ID NO: 215297 - DNA, 16 bp, P. troglodytes
attctaaggaaataat

SEQ ID NO: 215298 - DNA, 19 bp, P. troglodytes
attctaagtcacaggatga

SEQ ID NO: 215299 - DNA, 16 bp, P. troglodytes
attctaataggtatgt

SEQ ID NO: 215300 - DNA, 16 bp, P. troglodytes
attctaatggaagaga

SEQ ID NO: 215301 - DNA, 16 bp, P. troglodytes
attctacaaaatacct

SEQ ID NO: 215302 - DNA, 16 bp, P. troglodytes
attctacaaaatagaa

SEQ ID NO: 215303 - DNA, 16 bp, P. troglodytes
attctacagaaagagt

SEQ ID NO: 215304 - DNA, 16 bp, P. troglodytes
attctacagaagtaaa

SEQ ID NO: 215305 - DNA, 16 bp, P. troglodytes
attctacattacggtg

SEQ ID NO: 215306 - DNA, 16 bp, P. troglodytes
attctactgaaattat

SEQ ID NO: 215307 - DNA, 16 bp, P. troglodytes
attctacttctaagaa

SEQ ID NO: 215308 - DNA, 16 bp, P. troglodytes
attctacttttcttga

SEQ ID NO: 215309 - DNA, 16 bp, P. troglodytes
attctagaaattaaaa

SEQ ID NO: 215310 - DNA, 16 bp, P. troglodytes
attctagaagaaatgg

SEQ ID NO: 215311 - DNA, 16 bp, P. troglodytes
attctagaatcaggca

SEQ ID NO: 215312 - DNA, 16 bp, P. troglodytes
attctagagttgaaaa

SEQ ID NO: 215313 - DNA, 16 bp, P. troglodytes
attctaggttgaaaat

SEQ ID NO: 215314 - DNA, 16 bp, P. troglodytes
attctagtgcctcagc

SEQ ID NO: 215315 - DNA, 16 bp, P. troglodytes
attctataaaacattt

SEQ ID NO: 215316 - DNA, 16 bp, P. troglodytes
attctataggttgtct

SEQ ID NO: 215317 - DNA, 16 bp, P. troglodytes
attctatctcaataaa

SEQ ID NO: 215318 - DNA, 16 bp, P. troglodytes
attctatttatttggg

SEQ ID NO: 215319 - DNA, 16 bp, P. troglodytes
attctatttctagaaa

SEQ ID NO: 215320 - DNA, 16 bp, P. troglodytes
attctattttgattta

SEQ ID NO: 215321 - DNA, 16 bp, P. troglodytes
attctcaaatatgaaa

SEQ ID NO: 215322 - DNA, 16 bp, P. troglodytes
attctcaaatatttat

SEQ ID NO: 215323 - DNA, 16 bp, P. troglodytes
attctcaaatattttc

SEQ ID NO: 215324 - DNA, 16 bp, P. troglodytes
attctcaagcctcagc

SEQ ID NO: 215325 - DNA, 16 bp, P. troglodytes
attctcagcaaacaca

SEQ ID NO: 215326 - DNA, 16 bp, P. troglodytes
attctcagcaaaccaa

SEQ ID NO: 215327 - DNA, 16 bp, P. troglodytes
attctcagcttacaaa

SEQ ID NO: 215328 - DNA, 16 bp, P. troglodytes
attctcagcttacgaa

SEQ ID NO: 215329 - DNA, 16 bp, P. troglodytes
attctcaggtctggag

SEQ ID NO: 215330 - DNA, 16 bp, P. troglodytes
attctcatcatttagc

SEQ ID NO: 215331 - DNA, 16 bp, P. troglodytes
attctcatctataaaa

SEQ ID NO: 215332 - DNA, 16 bp, P. troglodytes
attctcatgatagtga

SEQ ID NO: 215333 - DNA, 16 bp, P. troglodytes
attctcatgcctcagc

SEQ ID NO: 215334 - DNA, 16 bp, P. troglodytes
attctcatgtctcagc

SEQ ID NO: 215335 - DNA, 16 bp, P. troglodytes
attctcattttgcaaa

SEQ ID NO: 215336 - DNA, 16 bp, P. troglodytes
attctccaaagcagtg

SEQ ID NO: 215337 - DNA, 16 bp, P. troglodytes
attctccaagcccagg

SEQ ID NO: 215338 - DNA, 16 bp, P. troglodytes
attctccacacagcag

SEQ ID NO: 215339 - DNA, 16 bp, P. troglodytes
attctccaggacagat

SEQ ID NO: 215340 - DNA, 16 bp, P. troglodytes
attctccagtctcagc

SEQ ID NO: 215341 - DNA, 16 bp, P. troglodytes
attctcccacctcagg

SEQ ID NO: 215342 - DNA, 16 bp, P. troglodytes
attctcccctggagcc

SEQ ID NO: 215343 - DNA, 18 bp, P. troglodytes
attctcccgcctcagcct

SEQ ID NO: 215344 - DNA, 19 bp, P. troglodytes
attctcctacctcagcctc

SEQ ID NO: 215345 - DNA, 16 bp, P. troglodytes
attctcctcctgcctc

SEQ ID NO: 215346 - DNA, 18 bp, P. troglodytes
attctcctgactcagcct

SEQ ID NO: 215347 - DNA, 16 bp, P. troglodytes
attctcctgcattagc

SEQ ID NO: 215348 - DNA, 17 bp, P. troglodytes
attctcctgccacagcc

SEQ ID NO: 215349 - DNA, 16 bp, P. troglodytes
attctcctgccctggc

SEQ ID NO: 215350 - DNA, 16 bp, P. troglodytes
attctcctgcctcacc

SEQ ID NO: 215351 - DNA, 16 bp, P. troglodytes
attctcctgcctcaga

SEQ ID NO: 215352 - DNA, 17 bp, P. troglodytes
attctcctgcctcagca

SEQ ID NO: 215353 - DNA, 18 bp, P. troglodytes
attctcctgcctcagccc

SEQ ID NO: 215354 - DNA, 19 bp, P. troglodytes
attctcctgcctcagccta

SEQ ID NO: 215355 - DNA, 19 bp, P. troglodytes
attctcctgcctcagcctc

SEQ ID NO: 215356 - DNA, 19 bp, P. troglodytes
attctcctgcctcagcctt

SEQ ID NO: 215357 - DNA, 17 bp, P. troglodytes
attctcctgcctcagcg

SEQ ID NO: 215358 - DNA, 17 bp, P. troglodytes
attctcctgcctcagct

SEQ ID NO: 215359 - DNA, 16 bp, P. troglodytes
attctcctgcctcagg

SEQ ID NO: 215360 - DNA, 16 bp, P. troglodytes
attctcctgcctccgc

SEQ ID NO: 215361 - DNA, 18 bp, P. troglodytes
attctcctgcctcggcct

SEQ ID NO: 215362 - DNA, 16 bp, P. troglodytes
attctcctgcgtcagc

SEQ ID NO: 215363 - DNA, 17 bp, P. troglodytes
attctcctgtctcagct

SEQ ID NO: 215364 - DNA, 16 bp, P. troglodytes
attctcctgtctcatc

SEQ ID NO: 215365 - DNA, 16 bp, P. troglodytes
attctcgggcctcagc

SEQ ID NO: 215366 - DNA, 16 bp, P. troglodytes
attctcgtgcctcagc

SEQ ID NO: 215367 - DNA, 16 bp, P. troglodytes
attctctacttctatg

SEQ ID NO: 215368 - DNA, 16 bp, P. troglodytes
attctctcctggcctg

SEQ ID NO: 215369 - DNA, 16 bp, P. troglodytes
attctctctcctgcct

SEQ ID NO: 215370 - DNA, 16 bp, P. troglodytes
attctctgaccccttg

SEQ ID NO: 215371 - DNA, 16 bp, P. troglodytes
attctctgctcactgc

SEQ ID NO: 215372 - DNA, 16 bp, P. troglodytes
attctctgtgcctcag

SEQ ID NO: 215373 - DNA, 16 bp, P. troglodytes
attctctttgaagaaa

SEQ ID NO: 215374 - DNA, 16 bp, P. troglodytes
attctctttgccttca

SEQ ID NO: 215375 - DNA, 18 bp, P. troglodytes
attctctttgtagtaatt

SEQ ID NO: 215376 - DNA, 16 bp, P. troglodytes
attctgaaaaaaagaa

SEQ ID NO: 215377 - DNA, 16 bp, P. troglodytes
attctgaaaaagaaaa

SEQ ID NO: 215378 - DNA, 16 bp, P. troglodytes
attctgaaaaataaag

SEQ ID NO: 215379 - DNA, 16 bp, P. troglodytes
attctgaaataatttc

SEQ ID NO: 215380 - DNA, 16 bp, P. troglodytes
attctgaaataatttt

SEQ ID NO: 215381 - DNA, 16 bp, P. troglodytes
attctgaaatgaaaaa

SEQ ID NO: 215382 - DNA, 16 bp, P. troglodytes
attctgaacattttat

SEQ ID NO: 215383 - DNA, 16 bp, P. troglodytes
attctgaagatatttt

SEQ ID NO: 215384 - DNA, 16 bp, P. troglodytes
attctgaagttgaaaa

SEQ ID NO: 215385 - DNA, 16 bp, P. troglodytes
attctgaatatttcat

SEQ ID NO: 215386 - DNA, 16 bp, P. troglodytes
attctgaatggtgtga

SEQ ID NO: 215387 - DNA, 16 bp, P. troglodytes
attctgaattctctgt

SEQ ID NO: 215388 - DNA, 16 bp, P. troglodytes
attctgacaaacttct

SEQ ID NO: 215389 - DNA, 16 bp, P. troglodytes
attctgactgctgtga

SEQ ID NO: 215390 - DNA, 16 bp, P. troglodytes
attctgagaaatgcat

SEQ ID NO: 215391 - DNA, 16 bp, P. troglodytes
attctgaggttctgag

SEQ ID NO: 215392 - DNA, 16 bp, P. troglodytes
attctgattcagaagg

SEQ ID NO: 215393 - DNA, 16 bp, P. troglodytes
attctgattggtgtga

SEQ ID NO: 215394 - DNA, 16 bp, P. troglodytes
attctgcagatgagaa

SEQ ID NO: 215395 - DNA, 16 bp, P. troglodytes
attctgcagcctcagc

SEQ ID NO: 215396 - DNA, 16 bp, P. troglodytes
attctgcagctgttag

SEQ ID NO: 215397 - DNA, 16 bp, P. troglodytes
attctgcattgaaaat

SEQ ID NO: 215398 - DNA, 16 bp, P. troglodytes
attctgcccctggacc

SEQ ID NO: 215399 - DNA, 16 bp, P. troglodytes
attctgcctaccacag

SEQ ID NO: 215400 - DNA, 16 bp, P. troglodytes
attctgctgcccaggc

SEQ ID NO: 215401 - DNA, 16 bp, P. troglodytes
attctggaaaacagtt

SEQ ID NO: 215402 - DNA, 16 bp, P. troglodytes
attctggaaaagacaa

SEQ ID NO: 215403 - DNA, 16 bp, P. troglodytes
attctggaactgaaga

SEQ ID NO: 215404 - DNA, 16 bp, P. troglodytes
attctggaatatttgc

SEQ ID NO: 215405 - DNA, 16 bp, P. troglodytes
attctggaggctggaa

SEQ ID NO: 215406 - DNA, 16 bp, P. troglodytes
attctggatatatttt

SEQ ID NO: 215407 - DNA, 16 bp, P. troglodytes
attctggctatcagct

SEQ ID NO: 215408 - DNA, 16 bp, P. troglodytes
attctggctgcactgg

SEQ ID NO: 215409 - DNA, 16 bp, P. troglodytes
attctggcttttgttg

SEQ ID NO: 215410 - DNA, 16 bp, P. troglodytes
attctgggctgggcat

SEQ ID NO: 215411 - DNA, 16 bp, P. troglodytes
attctgggggaaaaaa

SEQ ID NO: 215412 - DNA, 16 bp, P. troglodytes
attctggtcaacatgg

SEQ ID NO: 215413 - DNA, 16 bp, P. troglodytes
attctggtctcctaca

SEQ ID NO: 215414 - DNA, 16 bp, P. troglodytes
attctgtaggttgtct

SEQ ID NO: 215415 - DNA, 16 bp, P. troglodytes
attctgtatatatata

SEQ ID NO: 215416 - DNA, 16 bp, P. troglodytes
attctgtatgcctttg

SEQ ID NO: 215417 - DNA, 16 bp, P. troglodytes
attctgtattttttaa

SEQ ID NO: 215418 - DNA, 16 bp, P. troglodytes
attctgtcacctcagc

SEQ ID NO: 215419 - DNA, 16 bp, P. troglodytes
attctgtcatttgtaa

SEQ ID NO: 215420 - DNA, 16 bp, P. troglodytes
attctgtcttgtctgc

SEQ ID NO: 215421 - DNA, 16 bp, P. troglodytes
attctgtgaagaatgt

SEQ ID NO: 215422 - DNA, 16 bp, P. troglodytes
attctgtgagtccatg

SEQ ID NO: 215423 - DNA, 16 bp, P. troglodytes
attctgttaaatattt

SEQ ID NO: 215424 - DNA, 16 bp, P. troglodytes
attctgttaatgtaat

SEQ ID NO: 215425 - DNA, 16 bp, P. troglodytes
attctgttacagcagc

SEQ ID NO: 215426 - DNA, 16 bp, P. troglodytes
attctgttattattat

SEQ ID NO: 215427 - DNA, 16 bp, P. troglodytes
attctgttgtatgaat

SEQ ID NO: 215428 - DNA, 16 bp, P. troglodytes
attctgttttatttaa

SEQ ID NO: 215429 - DNA, 16 bp, P. troglodytes
attctgtttttaaaaa

SEQ ID NO: 215430 - DNA, 16 bp, P. troglodytes
attctgtttttagtag

SEQ ID NO: 215431 - DNA, 16 bp, P. troglodytes
attctgtttttcacat

SEQ ID NO: 215432 - DNA, 16 bp, P. troglodytes
attcttaaatatgaat

SEQ ID NO: 215433 - DNA, 16 bp, P. troglodytes
attcttaatcacatct

SEQ ID NO: 215434 - DNA, 16 bp, P. troglodytes
attcttacagaaaaga

SEQ ID NO: 215435 - DNA, 16 bp, P. troglodytes
attcttaccagcagtg

SEQ ID NO: 215436 - DNA, 16 bp, P. troglodytes
attcttagctcacagg

SEQ ID NO: 215437 - DNA, 16 bp, P. troglodytes
attcttatactttaag

SEQ ID NO: 215438 - DNA, 16 bp, P. troglodytes
attcttcaaagaaata

SEQ ID NO: 215439 - DNA, 16 bp, P. troglodytes
attcttcaaagaacta

SEQ ID NO: 215440 - DNA, 16 bp, P. troglodytes
attcttcaaggtcaaa

SEQ ID NO: 215441 - DNA, 16 bp, P. troglodytes
attcttcacagaaaaa

SEQ ID NO: 215442 - DNA, 16 bp, P. troglodytes
attcttcatctctgtt

SEQ ID NO: 215443 - DNA, 16 bp, P. troglodytes
attcttccaaatattt

SEQ ID NO: 215444 - DNA, 16 bp, P. troglodytes
attcttccatcccttt

SEQ ID NO: 215445 - DNA, 16 bp, P. troglodytes
attcttccatttgttt

SEQ ID NO: 215446 - DNA, 16 bp, P. troglodytes
attcttctaaactttt

SEQ ID NO: 215447 - DNA, 16 bp, P. troglodytes
attcttctcagcacca

SEQ ID NO: 215448 - DNA, 16 bp, P. troglodytes
attcttctcatcacca

SEQ ID NO: 215449 - DNA, 16 bp, P. troglodytes
attcttctccttgctg

SEQ ID NO: 215450 - DNA, 16 bp, P. troglodytes
attcttctctgatctt

SEQ ID NO: 215451 - DNA, 16 bp, P. troglodytes
attcttctgccttagc

SEQ ID NO: 215452 - DNA, 16 bp, P. troglodytes
attcttctgccttggc

SEQ ID NO: 215453 - DNA, 16 bp, P. troglodytes
attcttctggacattg

SEQ ID NO: 215454 - DNA, 16 bp, P. troglodytes
attcttcttggcttct

SEQ ID NO: 215455 - DNA, 16 bp, P. troglodytes
attcttgaatattttt

SEQ ID NO: 215456 - DNA, 16 bp, P. troglodytes
attcttgcaacttttt

SEQ ID NO: 215457 - DNA, 16 bp, P. troglodytes
attcttgcacctcagc

SEQ ID NO: 215458 - DNA, 16 bp, P. troglodytes
attcttgcatccctgg

SEQ ID NO: 215459 - DNA, 16 bp, P. troglodytes
attcttgcgcctcagc

SEQ ID NO: 215460 - DNA, 16 bp, P. troglodytes
attcttgctgtacttt

SEQ ID NO: 215461 - DNA, 16 bp, P. troglodytes
attcttggtgcctttg

SEQ ID NO: 215462 - DNA, 16 bp, P. troglodytes
attcttgtctgcatgt

SEQ ID NO: 215463 - DNA, 16 bp, P. troglodytes
attcttgtgcctcagc

SEQ ID NO: 215464 - DNA, 17 bp, P. troglodytes
attcttgtgcttcagcc

SEQ ID NO: 215465 - DNA, 16 bp, P. troglodytes
attcttgtgtctcagc

SEQ ID NO: 215466 - DNA, 16 bp, P. troglodytes
attctttaaatttctg

SEQ ID NO: 215467 - DNA, 16 bp, P. troglodytes
attctttatacattct

SEQ ID NO: 215468 - DNA, 16 bp, P. troglodytes
attctttcaaactatt

SEQ ID NO: 215469 - DNA, 16 bp, P. troglodytes
attctttcaataaata

SEQ ID NO: 215470 - DNA, 16 bp, P. troglodytes
attctttcacccaggc

SEQ ID NO: 215471 - DNA, 16 bp, P. troglodytes
attctttcagattttc

SEQ ID NO: 215472 - DNA, 16 bp, P. troglodytes
attctttcagttgtga

SEQ ID NO: 215473 - DNA, 16 bp, P. troglodytes
attctttcagtttttg

SEQ ID NO: 215474 - DNA, 16 bp, P. troglodytes
attctttcatgttaaa

SEQ ID NO: 215475 - DNA, 16 bp, P. troglodytes
attctttccagttttt

SEQ ID NO: 215476 - DNA, 16 bp, P. troglodytes
attctttctctgtgtt

SEQ ID NO: 215477 - DNA, 16 bp, P. troglodytes
attctttcttctgcct

SEQ ID NO: 215478 - DNA, 16 bp, P. troglodytes
attctttgaaaaaaaa

SEQ ID NO: 215479 - DNA, 16 bp, P. troglodytes
attctttgaaatattt

SEQ ID NO: 215480 - DNA, 16 bp, P. troglodytes
attctttgaacatatt

SEQ ID NO: 215481 - DNA, 16 bp, P. troglodytes
attctttgaagaatgt

SEQ ID NO: 215482 - DNA, 16 bp, P. troglodytes
attctttgcaataaat

SEQ ID NO: 215483 - DNA, 16 bp, P. troglodytes
attctttgtccatttt

SEQ ID NO: 215484 - DNA, 16 bp, P. troglodytes
attctttgtgtgtgtg

SEQ ID NO: 215485 - DNA, 16 bp, P. troglodytes
attcttttaaaaaaga

SEQ ID NO: 215486 - DNA, 16 bp, P. troglodytes
attcttttgaatgtgg

SEQ ID NO: 215487 - DNA, 16 bp, P. troglodytes
attcttttgaatttct

SEQ ID NO: 215488 - DNA, 16 bp, P. troglodytes
attcttttgcctcagc

SEQ ID NO: 215489 - DNA, 16 bp, P. troglodytes
attctttttaaagtat

SEQ ID NO: 215490 - DNA, 16 bp, P. troglodytes
attgaaaaagagggac

SEQ ID NO: 215491 - DNA, 16 bp, P. troglodytes
attgaaaagatagttt

SEQ ID NO: 215492 - DNA, 16 bp, P. troglodytes
attgaaaatattcaaa

SEQ ID NO: 215493 - DNA, 16 bp, P. troglodytes
attgaaaattcttttc

SEQ ID NO: 215494 - DNA, 16 bp, P. troglodytes
attgaaactggacccc

SEQ ID NO: 215495 - DNA, 16 bp, P. troglodytes
attgaaacttcaacca

SEQ ID NO: 215496 - DNA, 16 bp, P. troglodytes
attgaaagcagggtct

SEQ ID NO: 215497 - DNA, 16 bp, P. troglodytes
attgaaataaaaaact

SEQ ID NO: 215498 - DNA, 16 bp, P. troglodytes
attgaaataaaataca

SEQ ID NO: 215499 - DNA, 16 bp, P. troglodytes
attgaaatatttttct

SEQ ID NO: 215500 - DNA, 16 bp, P. troglodytes
attgaaatgaatgaaa

SEQ ID NO: 215501 - DNA, 16 bp, P. troglodytes
attgaaatgatatttt

SEQ ID NO: 215502 - DNA, 16 bp, P. troglodytes
attgaacactagaact

SEQ ID NO: 215503 - DNA, 16 bp, P. troglodytes
attgaacacttaaaat

SEQ ID NO: 215504 - DNA, 16 bp, P. troglodytes
attgaacatgagattt

SEQ ID NO: 215505 - DNA, 16 bp, P. troglodytes
attgaacccaggaggc

SEQ ID NO: 215506 - DNA, 16 bp, P. troglodytes
attgaacctgggaggc

SEQ ID NO: 215507 - DNA, 16 bp, P. troglodytes
attgaagaaaatattt

SEQ ID NO: 215508 - DNA, 16 bp, P. troglodytes
attgaagaaatgcaaa

SEQ ID NO: 215509 - DNA, 16 bp, P. troglodytes
attgaagaggactgat

SEQ ID NO: 215510 - DNA, 16 bp, P. troglodytes
attgaaggacattcta

SEQ ID NO: 215511 - DNA, 16 bp, P. troglodytes
attgaatcagaaactc

SEQ ID NO: 215512 - DNA, 16 bp, P. troglodytes
attgaatcaggaagaa

SEQ ID NO: 215513 - DNA, 16 bp, P. troglodytes
attgaatcatgggggc

SEQ ID NO: 215514 - DNA, 16 bp, P. troglodytes
attgaatctacaaatt

SEQ ID NO: 215515 - DNA, 16 bp, P. troglodytes
attgaatctgtacatc

SEQ ID NO: 215516 - DNA, 16 bp, P. troglodytes
attgaatgggaaaaag

SEQ ID NO: 215517 - DNA, 16 bp, P. troglodytes
attgaattattcattt

SEQ ID NO: 215518 - DNA, 16 bp, P. troglodytes
attgaattcttcagct

SEQ ID NO: 215519 - DNA, 16 bp, P. troglodytes
attgaattgtacaatt

SEQ ID NO: 215520 - DNA, 16 bp, P. troglodytes
attgaattgtacattt

SEQ ID NO: 215521 - DNA, 16 bp, P. troglodytes
attgaatttatagatt

SEQ ID NO: 215522 - DNA, 16 bp, P. troglodytes
attgaatttgtaggtt

SEQ ID NO: 215523 - DNA, 16 bp, P. troglodytes
attgaattttgttgaa

SEQ ID NO: 215524 - DNA, 16 bp, P. troglodytes
attgacaaaaacaagc

SEQ ID NO: 215525 - DNA, 16 bp, P. troglodytes
attgacaaagaagttt

SEQ ID NO: 215526 - DNA, 16 bp, P. troglodytes
attgacatttataaaa

SEQ ID NO: 215527 - DNA, 16 bp, P. troglodytes
attgacatttttgaag

SEQ ID NO: 215528 - DNA, 16 bp, P. troglodytes
attgaccatttgtatg

SEQ ID NO: 215529 - DNA, 16 bp, P. troglodytes
attgacctttttatca

SEQ ID NO: 215530 - DNA, 16 bp, P. troglodytes
attgactgattgactg

SEQ ID NO: 215531 - DNA, 16 bp, P. troglodytes
attgactggaagcctt

SEQ ID NO: 215532 - DNA, 16 bp, P. troglodytes
attgacttggcaaatg

SEQ ID NO: 215533 - DNA, 16 bp, P. troglodytes
attgacttggccatgc

SEQ ID NO: 215534 - DNA, 16 bp, P. troglodytes
attgagaaaaaaatgt

SEQ ID NO: 215535 - DNA, 16 bp, P. troglodytes
attgagaaagcaagca

SEQ ID NO: 215536 - DNA, 16 bp, P. troglodytes
attgagaaataattca

SEQ ID NO: 215537 - DNA, 16 bp, P. troglodytes
attgagaaccactgtt

SEQ ID NO: 215538 - DNA, 16 bp, P. troglodytes
attgagaacctactat

SEQ ID NO: 215539 - DNA, 16 bp, P. troglodytes
attgagaacctgtctt

SEQ ID NO: 215540 - DNA, 16 bp, P. troglodytes
attgagaccattctgg

SEQ ID NO: 215541 - DNA, 16 bp, P. troglodytes
attgagaccctgtctc

SEQ ID NO: 215542 - DNA, 16 bp, P. troglodytes
attgagatgaaattca

SEQ ID NO: 215543 - DNA, 16 bp, P. troglodytes
attgagatgtaattca

SEQ ID NO: 215544 - DNA, 16 bp, P. troglodytes
attgagcaacagaaca

SEQ ID NO: 215545 - DNA, 17 bp, P. troglodytes
attgagcacattaagca

SEQ ID NO: 215546 - DNA, 16 bp, P. troglodytes
attgagcacttgctgt

SEQ ID NO: 215547 - DNA, 16 bp, P. troglodytes
attgagcatttgaaat

SEQ ID NO: 215548 - DNA, 16 bp, P. troglodytes
attgagctgtgattgt

SEQ ID NO: 215549 - DNA, 16 bp, P. troglodytes
attgagctttttaaaa

SEQ ID NO: 215550 - DNA, 16 bp, P. troglodytes
attgaggaccccaaag

SEQ ID NO: 215551 - DNA, 16 bp, P. troglodytes
attgaggaggagggat

SEQ ID NO: 215552 - DNA, 16 bp, P. troglodytes
attgaggagttttgca

SEQ ID NO: 215553 - DNA, 16 bp, P. troglodytes
attgaggtcaggagtt

SEQ ID NO: 215554 - DNA, 16 bp, P. troglodytes
attgaggtccagagag

SEQ ID NO: 215555 - DNA, 16 bp, P. troglodytes
attgaggtgggaggat

SEQ ID NO: 215556 - DNA, 16 bp, P. troglodytes
attgagtaaagtatac

SEQ ID NO: 215557 - DNA, 16 bp, P. troglodytes
attgagtcacagttct

SEQ ID NO: 215558 - DNA, 16 bp, P. troglodytes
attgagtcttcttatc

SEQ ID NO: 215559 - DNA, 16 bp, P. troglodytes
attgataattcttggg

SEQ ID NO: 215560 - DNA, 16 bp, P. troglodytes
attgataggcatttgg

SEQ ID NO: 215561 - DNA, 16 bp, P. troglodytes
attgatattcttcaca

SEQ ID NO: 215562 - DNA, 16 bp, P. troglodytes
attgatcatcagagaa

SEQ ID NO: 215563 - DNA, 23 bp, P. troglodytes
attgatcattcttgggtgtttct

SEQ ID NO: 215564 - DNA, 16 bp, P. troglodytes
attgatcccaggtctt

SEQ ID NO: 215565 - DNA, 26 bp, P. troglodytes
attgatccctttaccattatgtaatg

SEQ ID NO: 215566 - DNA, 16 bp, P. troglodytes
attgatctatatctct

SEQ ID NO: 215567 - DNA, 16 bp, P. troglodytes
attgatctgggtggtg

SEQ ID NO: 215568 - DNA, 16 bp, P. troglodytes
attgatcttttgtgtt

SEQ ID NO: 215569 - DNA, 16 bp, P. troglodytes
attgatgaagaaattg

SEQ ID NO: 215570 - DNA, 16 bp, P. troglodytes
attgatgatgatgata

SEQ ID NO: 215571 - DNA, 16 bp, P. troglodytes
attgatggacagttgg

SEQ ID NO: 215572 - DNA, 16 bp, P. troglodytes
attgatgtgcaaaaat

SEQ ID NO: 215573 - DNA, 16 bp, P. troglodytes
attgattaaattattg

SEQ ID NO: 215574 - DNA, 16 bp, P. troglodytes
attgattcaaatgcta

SEQ ID NO: 215575 - DNA, 16 bp, P. troglodytes
attgattctacattat

SEQ ID NO: 215576 - DNA, 16 bp, P. troglodytes
attgattgattgattc

SEQ ID NO: 215577 - DNA, 16 bp, P. troglodytes
attgattgattgattg

SEQ ID NO: 215578 - DNA, 16 bp, P. troglodytes
attgattgattttctt

SEQ ID NO: 215579 - DNA, 16 bp, P. troglodytes
attgatttctaatttt

SEQ ID NO: 215580 - DNA, 16 bp, P. troglodytes
attgatttctgctttt

SEQ ID NO: 215581 - DNA, 16 bp, P. troglodytes
attgatttctgttcta

SEQ ID NO: 215582 - DNA, 16 bp, P. troglodytes
attgattttaaaatgt

SEQ ID NO: 215583 - DNA, 16 bp, P. troglodytes
attgattttctacaaa

SEQ ID NO: 215584 - DNA, 16 bp, P. troglodytes
attgattttcttatgt

SEQ ID NO: 215585 - DNA, 16 bp, P. troglodytes
attgatttttccattt

SEQ ID NO: 215586 - DNA, 16 bp, P. troglodytes
attgatttttctataa

SEQ ID NO: 215587 - DNA, 16 bp, P. troglodytes
attgatttttttccct

SEQ ID NO: 215588 - DNA, 16 bp, P. troglodytes
attgatttttttcctc

SEQ ID NO: 215589 - DNA, 16 bp, P. troglodytes
attgatttttttgaag

SEQ ID NO: 215590 - DNA, 16 bp, P. troglodytes
attgcaaaataaaata

SEQ ID NO: 215591 - DNA, 16 bp, P. troglodytes
attgcaaatttcctga

SEQ ID NO: 215592 - DNA, 16 bp, P. troglodytes
attgcaacagagaaag

SEQ ID NO: 215593 - DNA, 16 bp, P. troglodytes
attgcaacattattta

SEQ ID NO: 215594 - DNA, 16 bp, P. troglodytes
attgcaacctttgcct

SEQ ID NO: 215595 - DNA, 16 bp, P. troglodytes
attgcaagaccccatc

SEQ ID NO: 215596 - DNA, 16 bp, P. troglodytes
attgcaatagagaaag

SEQ ID NO: 215597 - DNA, 16 bp, P. troglodytes
attgcacctgtgaata

SEQ ID NO: 215598 - DNA, 16 bp, P. troglodytes
attgcactatgatgtt

SEQ ID NO: 215599 - DNA, 16 bp, P. troglodytes
attgcactccaggcta

SEQ ID NO: 215600 - DNA, 16 bp, P. troglodytes
attgcactgcagtctg

SEQ ID NO: 215601 - DNA, 16 bp, P. troglodytes
attgcactgtgctctg

SEQ ID NO: 215602 - DNA, 16 bp, P. troglodytes
attgcagatttttttt

SEQ ID NO: 215603 - DNA, 16 bp, P. troglodytes
attgcagcattattaa

SEQ ID NO: 215604 - DNA, 16 bp, P. troglodytes
attgcagcctctgcct

SEQ ID NO: 215605 - DNA, 16 bp, P. troglodytes
attgcagccttgacct

SEQ ID NO: 215606 - DNA, 16 bp, P. troglodytes
attgcagctttattca

SEQ ID NO: 215607 - DNA, 17 bp, P. troglodytes
attgcaggcatgagcca

SEQ ID NO: 215608 - DNA, 17 bp, P. troglodytes
attgcagtgagccaaga

SEQ ID NO: 215609 - DNA, 16 bp, P. troglodytes
attgcagttttcattt

SEQ ID NO: 215610 - DNA, 16 bp, P. troglodytes
attgcatatatttatg

SEQ ID NO: 215611 - DNA, 16 bp, P. troglodytes
attgcatccagcctgg

SEQ ID NO: 215612 - DNA, 16 bp, P. troglodytes
attgcatctttatttt

SEQ ID NO: 215613 - DNA, 16 bp, P. troglodytes
attgcattgaatatat

SEQ ID NO: 215614 - DNA, 16 bp, P. troglodytes
attgcattgaatttat

SEQ ID NO: 215615 - DNA, 16 bp, P. troglodytes
attgcatttaatttat

SEQ ID NO: 215616 - DNA, 16 bp, P. troglodytes
attgcatttattttct

SEQ ID NO: 215617 - DNA, 16 bp, P. troglodytes
attgcatttcttttgg

SEQ ID NO: 215618 - DNA, 16 bp, P. troglodytes
attgcatttgcttttg

SEQ ID NO: 215619 - DNA, 16 bp, P. troglodytes
attgcattttatttta

SEQ ID NO: 215620 - DNA, 16 bp, P. troglodytes
attgcatttttcattt

SEQ ID NO: 215621 - DNA, 16 bp, P. troglodytes
attgccaaatccaatg

SEQ ID NO: 215622 - DNA, 16 bp, P. troglodytes
attgccaaattgctct

SEQ ID NO: 215623 - DNA, 16 bp, P. troglodytes
attgccaagtaatatt

SEQ ID NO: 215624 - DNA, 16 bp, P. troglodytes
attgccagataaaata

SEQ ID NO: 215625 - DNA, 16 bp, P. troglodytes
attgccatactgcttt

SEQ ID NO: 215626 - DNA, 16 bp, P. troglodytes
attgccatgaattaag

SEQ ID NO: 215627 - DNA, 16 bp, P. troglodytes
attgcccagcctggag

SEQ ID NO: 215628 - DNA, 17 bp, P. troglodytes
attgcccaggctgttct

SEQ ID NO: 215629 - DNA, 19 bp, P. troglodytes
attgccctggccagaactc

SEQ ID NO: 215630 - DNA, 23 bp, P. troglodytes
attgccctggccagaacttccaa

SEQ ID NO: 215631 - DNA, 16 bp, P. troglodytes
attgccctggccagga

SEQ ID NO: 215632 - DNA, 16 bp, P. troglodytes
attgcctcccaccagg

SEQ ID NO: 215633 - DNA, 16 bp, P. troglodytes
attgcctgaggttggg

SEQ ID NO: 215634 - DNA, 16 bp, P. troglodytes
attgcctgggctcagg

SEQ ID NO: 215635 - DNA, 16 bp, P. troglodytes
attgccttttcactct

SEQ ID NO: 215636 - DNA, 21 bp, P. troglodytes
attgcgccactgtactccagc

SEQ ID NO: 215637 - DNA, 16 bp, P. troglodytes
attgcggctcactgca

SEQ ID NO: 215638 - DNA, 16 bp, P. troglodytes
attgctaaattctttt

SEQ ID NO: 215639 - DNA, 16 bp, P. troglodytes
attgctaagtgaaaaa

SEQ ID NO: 215640 - DNA, 16 bp, P. troglodytes
attgctacaaagggaa

SEQ ID NO: 215641 - DNA, 16 bp, P. troglodytes
attgctagaacctggg

SEQ ID NO: 215642 - DNA, 16 bp, P. troglodytes
attgctataaagaaat

SEQ ID NO: 215643 - DNA, 16 bp, P. troglodytes
attgctatgaagaact

SEQ ID NO: 215644 - DNA, 16 bp, P. troglodytes
attgctattattatta

SEQ ID NO: 215645 - DNA, 16 bp, P. troglodytes
attgctcaataaatgt

SEQ ID NO: 215646 - DNA, 16 bp, P. troglodytes
attgctcactgcagcc

SEQ ID NO: 215647 - DNA, 16 bp, P. troglodytes
attgctctagctggga

SEQ ID NO: 215648 - DNA, 16 bp, P. troglodytes
attgctctggctagca

SEQ ID NO: 215649 - DNA, 16 bp, P. troglodytes
attgctgaattatttt

SEQ ID NO: 215650 - DNA, 16 bp, P. troglodytes
attgctgagcagtatt

SEQ ID NO: 215651 - DNA, 16 bp, P. troglodytes
attgctgagttgaatg

SEQ ID NO: 215652 - DNA, 16 bp, P. troglodytes
attgctgatgaagttt

SEQ ID NO: 215653 - DNA, 16 bp, P. troglodytes
attgctgatgtggaga

SEQ ID NO: 215654 - DNA, 16 bp, P. troglodytes
attgctgctgctgctg

SEQ ID NO: 215655 - DNA, 16 bp, P. troglodytes
attgctgctgtaataa

SEQ ID NO: 215656 - DNA, 16 bp, P. troglodytes
attgctggaattacag

SEQ ID NO: 215657 - DNA, 16 bp, P. troglodytes
attgctggattatatg

SEQ ID NO: 215658 - DNA, 16 bp, P. troglodytes
attgctggattgtatg

SEQ ID NO: 215659 - DNA, 16 bp, P. troglodytes
attgctggggaggcct

SEQ ID NO: 215660 - DNA, 16 bp, P. troglodytes
attgctgggtatatac

SEQ ID NO: 215661 - DNA, 16 bp, P. troglodytes
attgctggtgagaatg

SEQ ID NO: 215662 - DNA, 16 bp, P. troglodytes
attgctgtgtaatatt

SEQ ID NO: 215663 - DNA, 16 bp, P. troglodytes
attgcttaaacccaag

SEQ ID NO: 215664 - DNA, 16 bp, P. troglodytes
attgcttaacaacagg

SEQ ID NO: 215665 - DNA, 16 bp, P. troglodytes
attgcttaagcccggg

SEQ ID NO: 215666 - DNA, 16 bp, P. troglodytes
attgcttaattctgat

SEQ ID NO: 215667 - DNA, 16 bp, P. troglodytes
attgcttcagcccaag

SEQ ID NO: 215668 - DNA, 16 bp, P. troglodytes
attgcttcatctgtaa

SEQ ID NO: 215669 - DNA, 16 bp, P. troglodytes
attgcttgaaccagga

SEQ ID NO: 215670 - DNA, 16 bp, P. troglodytes
attgcttgaacccagg

SEQ ID NO: 215671 - DNA, 17 bp, P. troglodytes
attgcttgaacccaggc

SEQ ID NO: 215672 - DNA, 16 bp, P. troglodytes
attgcttgaacgcagg

SEQ ID NO: 215673 - DNA, 16 bp, P. troglodytes
attgcttgaagccaga

SEQ ID NO: 215674 - DNA, 16 bp, P. troglodytes
attgcttgagaccagc

SEQ ID NO: 215675 - DNA, 16 bp, P. troglodytes
attgcttgagcccagc

SEQ ID NO: 215676 - DNA, 17 bp, P. troglodytes
attgcttgagcccaggc

SEQ ID NO: 215677 - DNA, 16 bp, P. troglodytes
attgcttgagcctggc

SEQ ID NO: 215678 - DNA, 16 bp, P. troglodytes
attgcttgagtccagc

SEQ ID NO: 215679 - DNA, 17 bp, P. troglodytes
attgcttggacctggga

SEQ ID NO: 215680 - DNA, 16 bp, P. troglodytes
attgcttgtgctcagg

SEQ ID NO: 215681 - DNA, 16 bp, P. troglodytes
attgctttatttttaa

SEQ ID NO: 215682 - DNA, 16 bp, P. troglodytes
attgctttcttgattt

SEQ ID NO: 215683 - DNA, 16 bp, P. troglodytes
attgctttctttttaa

SEQ ID NO: 215684 - DNA, 16 bp, P. troglodytes
attgctttgggtaata

SEQ ID NO: 215685 - DNA, 16 bp, P. troglodytes
attgctttgtgatgtg

SEQ ID NO: 215686 - DNA, 16 bp, P. troglodytes
attgcttttgaagtct

SEQ ID NO: 215687 - DNA, 16 bp, P. troglodytes
attgcttttgctgcat

SEQ ID NO: 215688 - DNA, 16 bp, P. troglodytes
attgcttttggaagta

SEQ ID NO: 215689 - DNA, 16 bp, P. troglodytes
attgcttttgtaattt

SEQ ID NO: 215690 - DNA, 16 bp, P. troglodytes
attggaaaaccaaaaa

SEQ ID NO: 215691 - DNA, 16 bp, P. troglodytes
attggaaaggggacag

SEQ ID NO: 215692 - DNA, 16 bp, P. troglodytes
attggaagaaaatgcc

SEQ ID NO: 215693 - DNA, 16 bp, P. troglodytes
attggaagaagaatta

SEQ ID NO: 215694 - DNA, 16 bp, P. troglodytes
attggaagcttcctga

SEQ ID NO: 215695 - DNA, 16 bp, P. troglodytes
attggaatcacctgag

SEQ ID NO: 215696 - DNA, 16 bp, P. troglodytes
attggaatttctggcc

SEQ ID NO: 215697 - DNA, 16 bp, P. troglodytes
attggacttacatttc

SEQ ID NO: 215698 - DNA, 16 bp, P. troglodytes
attggagaaattggtt

SEQ ID NO: 215699 - DNA, 16 bp, P. troglodytes
attggagagaaaaaca

SEQ ID NO: 215700 - DNA, 16 bp, P. troglodytes
attggagatcacattt

SEQ ID NO: 215701 - DNA, 16 bp, P. troglodytes
attggataaaattcaa

SEQ ID NO: 215702 - DNA, 16 bp, P. troglodytes
attggatcatggggga

SEQ ID NO: 215703 - DNA, 16 bp, P. troglodytes
attggattgtcttttt

SEQ ID NO: 215704 - DNA, 16 bp, P. troglodytes
attggattttgtcaaa

SEQ ID NO: 215705 - DNA, 16 bp, P. troglodytes
attggcatgagccacc

SEQ ID NO: 215706 - DNA, 16 bp, P. troglodytes
attggccatcagagaa

SEQ ID NO: 215707 - DNA, 19 bp, P. troglodytes
attggctcacacctgtaat

SEQ ID NO: 215708 - DNA, 16 bp, P. troglodytes
attggctcactgcaaa

SEQ ID NO: 215709 - DNA, 16 bp, P. troglodytes
attggctcatgtaact

SEQ ID NO: 215710 - DNA, 16 bp, P. troglodytes
attggctgtgggtttt

SEQ ID NO: 215711 - DNA, 16 bp, P. troglodytes
attggcttacatgatt

SEQ ID NO: 215712 - DNA, 16 bp, P. troglodytes
attggcttatagtttt

SEQ ID NO: 215713 - DNA, 16 bp, P. troglodytes
attggctttgctggaa

SEQ ID NO: 215714 - DNA, 16 bp, P. troglodytes
attggctttgggttgc

SEQ ID NO: 215715 - DNA, 16 bp, P. troglodytes
attgggaaaactggat

SEQ ID NO: 215716 - DNA, 17 bp, P. troglodytes
attgggaccaatttgac

SEQ ID NO: 215717 - DNA, 16 bp, P. troglodytes
attggggaaaatattt

SEQ ID NO: 215718 - DNA, 16 bp, P. troglodytes
attggggaaatttgaa

SEQ ID NO: 215719 - DNA, 16 bp, P. troglodytes
attggggctgggcatg

SEQ ID NO: 215720 - DNA, 16 bp, P. troglodytes
attggggttggttcca

SEQ ID NO: 215721 - DNA, 16 bp, P. troglodytes
attgggtaaatacagc

SEQ ID NO: 215722 - DNA, 16 bp, P. troglodytes
attgggtaataaaatg

SEQ ID NO: 215723 - DNA, 16 bp, P. troglodytes
attggtaaagggatca

SEQ ID NO: 215724 - DNA, 16 bp, P. troglodytes
attggtatcttgatgg

SEQ ID NO: 215725 - DNA, 16 bp, P. troglodytes
attggtatttgttctt

SEQ ID NO: 215726 - DNA, 16 bp, P. troglodytes
attggtctatatattt

SEQ ID NO: 215727 - DNA, 16 bp, P. troglodytes
attggtctattcaaag

SEQ ID NO: 215728 - DNA, 18 bp, P. troglodytes
attggtgcgtttttacag

SEQ ID NO: 215729 - DNA, 16 bp, P. troglodytes
attggtggacatttgg

SEQ ID NO: 215730 - DNA, 16 bp, P. troglodytes
attggtgggcatttgg

SEQ ID NO: 215731 - DNA, 16 bp, P. troglodytes
attggtgtgttttaca

SEQ ID NO: 215732 - DNA, 16 bp, P. troglodytes
attggttattctagtt

SEQ ID NO: 215733 - DNA, 16 bp, P. troglodytes
attggtttaatgaaaa

SEQ ID NO: 215734 - DNA, 16 bp, P. troglodytes
attggtttcattatac

SEQ ID NO: 215735 - DNA, 16 bp, P. troglodytes
attggtttgcctggaa

SEQ ID NO: 215736 - DNA, 16 bp, P. troglodytes
attggttttgaaatgt

SEQ ID NO: 215737 - DNA, 16 bp, P. troglodytes
attgtaaaatacatat

SEQ ID NO: 215738 - DNA, 16 bp, P. troglodytes
attgtaaataatgcta

SEQ ID NO: 215739 - DNA, 16 bp, P. troglodytes
attgtaaatagtattt

SEQ ID NO: 215740 - DNA, 16 bp, P. troglodytes
attgtaaatatttctt

SEQ ID NO: 215741 - DNA, 16 bp, P. troglodytes
attgtaaatcattcta

SEQ ID NO: 215742 - DNA, 16 bp, P. troglodytes
attgtaaatgcactaa

SEQ ID NO: 215743 - DNA, 16 bp, P. troglodytes
attgtaaatggcattg

SEQ ID NO: 215744 - DNA, 16 bp, P. troglodytes
attgtaaatgtttctt

SEQ ID NO: 215745 - DNA, 16 bp, P. troglodytes
attgtaacaaaaacaa

SEQ ID NO: 215746 - DNA, 16 bp, P. troglodytes
attgtaagtgaagtaa

SEQ ID NO: 215747 - DNA, 16 bp, P. troglodytes
attgtaagttccctga

SEQ ID NO: 215748 - DNA, 16 bp, P. troglodytes
attgtacactttattt

SEQ ID NO: 215749 - DNA, 16 bp, P. troglodytes
attgtacattctatgg

SEQ ID NO: 215750 - DNA, 16 bp, P. troglodytes
attgtacatttagaaa

SEQ ID NO: 215751 - DNA, 16 bp, P. troglodytes
attgtacatttgttca

SEQ ID NO: 215752 - DNA, 16 bp, P. troglodytes
attgtaccaatgtcaa

SEQ ID NO: 215753 - DNA, 16 bp, P. troglodytes
attgtactaagtgaaa

SEQ ID NO: 215754 - DNA, 16 bp, P. troglodytes
attgtacttttaaaaa

SEQ ID NO: 215755 - DNA, 16 bp, P. troglodytes
attgtatacatatgta

SEQ ID NO: 215756 - DNA, 16 bp, P. troglodytes
attgtatacatgtatt

SEQ ID NO: 215757 - DNA, 17 bp, P. troglodytes
attgtatacctagaaaa

SEQ ID NO: 215758 - DNA, 16 bp, P. troglodytes
attgtatagctgtaca

SEQ ID NO: 215759 - DNA, 16 bp, P. troglodytes
attgtatatatatgtg

SEQ ID NO: 215760 - DNA, 16 bp, P. troglodytes
attgtatattacaatg

SEQ ID NO: 215761 - DNA, 16 bp, P. troglodytes
attgtatatttagaaa

SEQ ID NO: 215762 - DNA, 16 bp, P. troglodytes
attgtatatttgaaaa

SEQ ID NO: 215763 - DNA, 16 bp, P. troglodytes
attgtattagatatta

SEQ ID NO: 215764 - DNA, 16 bp, P. troglodytes
attgtattaggtgtta

SEQ ID NO: 215765 - DNA, 16 bp, P. troglodytes
attgtattccatggtg

SEQ ID NO: 215766 - DNA, 16 bp, P. troglodytes
attgtattcttgaaaa

SEQ ID NO: 215767 - DNA, 16 bp, P. troglodytes
attgtattgtactgta

SEQ ID NO: 215768 - DNA, 16 bp, P. troglodytes
attgtatttaggaagt

SEQ ID NO: 215769 - DNA, 16 bp, P. troglodytes
attgtattttcaaaat

SEQ ID NO: 215770 - DNA, 16 bp, P. troglodytes
attgtatttttagaaa

SEQ ID NO: 215771 - DNA, 16 bp, P. troglodytes
attgtcagccaagaat

SEQ ID NO: 215772 - DNA, 16 bp, P. troglodytes
attgtccaaaacaaag

SEQ ID NO: 215773 - DNA, 16 bp, P. troglodytes
attgtccagaagaaga

SEQ ID NO: 215774 - DNA, 16 bp, P. troglodytes
attgtccatgaaaatt

SEQ ID NO: 215775 - DNA, 16 bp, P. troglodytes
attgtctatttctcct

SEQ ID NO: 215776 - DNA, 16 bp, P. troglodytes
attgtctccattttat

SEQ ID NO: 215777 - DNA, 16 bp, P. troglodytes
attgtctctacaaaaa

SEQ ID NO: 215778 - DNA, 16 bp, P. troglodytes
attgtcttaaatattt

SEQ ID NO: 215779 - DNA, 16 bp, P. troglodytes
attgtcttcttgattt

SEQ ID NO: 215780 - DNA, 16 bp, P. troglodytes
attgtcttgggccaca

SEQ ID NO: 215781 - DNA, 31 bp, P. troglodytes; identical to SEQ ID NO: 55525

SEQ ID NO: 215782 - DNA, 16 bp, P. troglodytes
attgtcttttaaaata

SEQ ID NO: 215783 - DNA, 16 bp, P. troglodytes
attgtcttttaaattt

SEQ ID NO: 215784 - DNA, 16 bp, P. troglodytes
attgtgaaaggaaaat

SEQ ID NO: 215785 - DNA, 16 bp, P. troglodytes
attgtgaacttttgct

SEQ ID NO: 215786 - DNA, 16 bp, P. troglodytes
attgtgaagattttat

SEQ ID NO: 215787 - DNA, 16 bp, P. troglodytes
attgtgaatactgcta

SEQ ID NO: 215788 - DNA, 16 bp, P. troglodytes
attgtgaatgcaaagg

SEQ ID NO: 215789 - DNA, 16 bp, P. troglodytes
attgtgagtccattaa

SEQ ID NO: 215790 - DNA, 16 bp, P. troglodytes
attgtgagtgggagtt

SEQ ID NO: 215791 - DNA, 16 bp, P. troglodytes
attgtgatggttaata

SEQ ID NO: 215792 - DNA, 16 bp, P. troglodytes
attgtgattttaaaat

SEQ ID NO: 215793 - DNA, 16 bp, P. troglodytes
attgtgcagcacctct

SEQ ID NO: 215794 - DNA, 16 bp, P. troglodytes
attgtgccactaaact

SEQ ID NO: 215795 - DNA, 16 bp, P. troglodytes
attgtgccactgaact

SEQ ID NO: 215796 - DNA, 16 bp, P. troglodytes
attgtgcctggcctgt

SEQ ID NO: 215797 - DNA, 16 bp, P. troglodytes
attgtgcttcacttta

SEQ ID NO: 215798 - DNA, 16 bp, P. troglodytes
attgtgcttttgattt

SEQ ID NO: 215799 - DNA, 16 bp, P. troglodytes
attgtggaaaaacaaa

SEQ ID NO: 215800 - DNA, 16 bp, P. troglodytes
attgtggaaatcagtg

SEQ ID NO: 215801 - DNA, 17 bp, P. troglodytes
attgtggaagagagtgt

SEQ ID NO: 215802 - DNA, 16 bp, P. troglodytes
attgtggaagatggtg

SEQ ID NO: 215803 - DNA, 16 bp, P. troglodytes
attgtggattctggat

SEQ ID NO: 215804 - DNA, 16 bp, P. troglodytes
attgtggcaggccagg

SEQ ID NO: 215805 - DNA, 16 bp, P. troglodytes
attgtgggacttctca

SEQ ID NO: 215806 - DNA, 16 bp, P. troglodytes
attgtgtagtggtgaa

SEQ ID NO: 215807 - DNA, 16 bp, P. troglodytes
attgtgtataggtacc

SEQ ID NO: 215808 - DNA, 16 bp, P. troglodytes
attgtgtatatgtact

SEQ ID NO: 215809 - DNA, 16 bp, P. troglodytes
attgtgtccggaattg

SEQ ID NO: 215810 - DNA, 16 bp, P. troglodytes
attgtgtctttgttct

SEQ ID NO: 215811 - DNA, 16 bp, P. troglodytes
attgtgtgaacatcat

SEQ ID NO: 215812 - DNA, 16 bp, P. troglodytes
attgtgtgagccaatt

SEQ ID NO: 215813 - DNA, 16 bp, P. troglodytes
attgtgtgcctggaaa

SEQ ID NO: 215814 - DNA, 16 bp, P. troglodytes
attgtgtgtatgtgtg

SEQ ID NO: 215815 - DNA, 16 bp, P. troglodytes
attgtgtgtgtatata

SEQ ID NO: 215816 - DNA, 16 bp, P. troglodytes
attgttaaaatgcaga

SEQ ID NO: 215817 - DNA, 16 bp, P. troglodytes
attgttaacttgagat

SEQ ID NO: 215818 - DNA, 16 bp, P. troglodytes
attgttaatttgagat

SEQ ID NO: 215819 - DNA, 16 bp, P. troglodytes
attgttacattttatt

SEQ ID NO: 215820 - DNA, 16 bp, P. troglodytes
attgttcctttctttg

SEQ ID NO: 215821 - DNA, 16 bp, P. troglodytes
attgttcttttttaaa

SEQ ID NO: 215822 - DNA, 16 bp, P. troglodytes
attgttgccattgaaa

SEQ ID NO: 215823 - DNA, 16 bp, P. troglodytes
attgttggtgaggatg

SEQ ID NO: 215824 - DNA, 16 bp, P. troglodytes
attgttgttgttaatc

SEQ ID NO: 215825 - DNA, 16 bp, P. troglodytes
attgtttataaaacaa

SEQ ID NO: 215826 - DNA, 16 bp, P. troglodytes
attgtttcaaaataaa

SEQ ID NO: 215827 - DNA, 16 bp, P. troglodytes
attgtttcatatgttt

SEQ ID NO: 215828 - DNA, 16 bp, P. troglodytes
attgtttcatgtattt

SEQ ID NO: 215829 - DNA, 16 bp, P. troglodytes
attgtttgaaaatatt

SEQ ID NO: 215830 - DNA, 16 bp, P. troglodytes
attgtttgtaaaacat

SEQ ID NO: 215831 - DNA, 16 bp, P. troglodytes
attgttttaaaaagca

SEQ ID NO: 215832 - DNA, 16 bp, P. troglodytes
attgttttacttttaa

SEQ ID NO: 215833 - DNA, 16 bp, P. troglodytes
attgttttatgaatct

SEQ ID NO: 215834 - DNA, 16 bp, P. troglodytes
attgttttatggctga

SEQ ID NO: 215835 - DNA, 16 bp, P. troglodytes
attgttttcaacaatg

SEQ ID NO: 215836 - DNA, 16 bp, P. troglodytes
attgttttccacaatg

SEQ ID NO: 215837 - DNA, 16 bp, P. troglodytes
attgttttctttaaat

SEQ ID NO: 215838 - DNA, 16 bp, P. troglodytes
attgttttctttcctg

SEQ ID NO: 215839 - DNA, 16 bp, P. troglodytes
attgttttgaaagaaa

SEQ ID NO: 215840 - DNA, 16 bp, P. troglodytes
attgttttgaaatgtg

SEQ ID NO: 215841 - DNA, 16 bp, P. troglodytes
attgttttggctattt

SEQ ID NO: 215842 - DNA, 16 bp, P. troglodytes
attgtttttgaaaata

SEQ ID NO: 215843 - DNA, 16 bp, P. troglodytes
attgttttttctaact

SEQ ID NO: 215844 - DNA, 16 bp, P. troglodytes
atttaaaaaaatcagt

SEQ ID NO: 215845 - DNA, 16 bp, P. troglodytes
atttaaaaaaatcctt

SEQ ID NO: 215846 - DNA, 16 bp, P. troglodytes
atttaaaaaatactgt

SEQ ID NO: 215847 - DNA, 16 bp, P. troglodytes
atttaaaaacagaaag

SEQ ID NO: 215848 - DNA, 16 bp, P. troglodytes
atttaaaaacagattt

SEQ ID NO: 215849 - DNA, 16 bp, P. troglodytes
atttaaaaaccaagaa

SEQ ID NO: 215850 - DNA, 16 bp, P. troglodytes
atttaaaaagaaaact

SEQ ID NO: 215851 - DNA, 16 bp, P. troglodytes
atttaaaaagacaaag

SEQ ID NO: 215852 - DNA, 16 bp, P. troglodytes
atttaaaaagacagaa

SEQ ID NO: 215853 - DNA, 16 bp, P. troglodytes
atttaaaaagtgtttt

SEQ ID NO: 215854 - DNA, 16 bp, P. troglodytes
atttaaaaatcaagtt

SEQ ID NO: 215855 - DNA, 16 bp, P. troglodytes
atttaaaaatcacatt

SEQ ID NO: 215856 - DNA, 16 bp, P. troglodytes
atttaaaaatcagtaa

SEQ ID NO: 215857 - DNA, 16 bp, P. troglodytes
atttaaaaatgcatgt

SEQ ID NO: 215858 - DNA, 16 bp, P. troglodytes
atttaaaaatgtgcaa

SEQ ID NO: 215859 - DNA, 16 bp, P. troglodytes
atttaaaaatgtgttt

SEQ ID NO: 215860 - DNA, 16 bp, P. troglodytes
atttaaaaattacttg

SEQ ID NO: 215861 - DNA, 16 bp, P. troglodytes
atttaaaaattcactg

SEQ ID NO: 215862 - DNA, 16 bp, P. troglodytes
atttaaaacatgaatt

SEQ ID NO: 215863 - DNA, 16 bp, P. troglodytes
atttaaaacttctgta

SEQ ID NO: 215864 - DNA, 16 bp, P. troglodytes
atttaaaacttttttg

SEQ ID NO: 215865 - DNA, 16 bp, P. troglodytes
atttaaaagatgtttt

SEQ ID NO: 215866 - DNA, 16 bp, P. troglodytes
atttaaaaggggaaaa

SEQ ID NO: 215867 - DNA, 16 bp, P. troglodytes
atttaaaagtgaacaa

SEQ ID NO: 215868 - DNA, 16 bp, P. troglodytes
atttaaaatacagaaa

SEQ ID NO: 215869 - DNA, 16 bp, P. troglodytes
atttaaaatactgtat

SEQ ID NO: 215870 - DNA, 16 bp, P. troglodytes
atttaaaatagcaaag

SEQ ID NO: 215871 - DNA, 16 bp, P. troglodytes
atttaaaatagcatca

SEQ ID NO: 215872 - DNA, 16 bp, P. troglodytes
atttaaaatatcttga

SEQ ID NO: 215873 - DNA, 16 bp, P. troglodytes
atttaaaatatttctc

SEQ ID NO: 215874 - DNA, 16 bp, P. troglodytes
atttaaaatgagagac

SEQ ID NO: 215875 - DNA, 16 bp, P. troglodytes
atttaaaatgcaaatt

SEQ ID NO: 215876 - DNA, 16 bp, P. troglodytes
atttaaaatgctactt

SEQ ID NO: 215877 - DNA, 16 bp, P. troglodytes
atttaaaatgcttatt

SEQ ID NO: 215878 - DNA, 16 bp, P. troglodytes
atttaaaatgctttta

SEQ ID NO: 215879 - DNA, 16 bp, P. troglodytes
atttaaaatggaattt

SEQ ID NO: 215880 - DNA, 16 bp, P. troglodytes
atttaaaatggctttt

SEQ ID NO: 215881 - DNA, 16 bp, P. troglodytes
atttaaaatgttgata

SEQ ID NO: 215882 - DNA, 16 bp, P. troglodytes
atttaaaattctgaat

SEQ ID NO: 215883 - DNA, 16 bp, P. troglodytes
atttaaacatgtaaaa

SEQ ID NO: 215884 - DNA, 16 bp, P. troglodytes
atttaaacatttatca

SEQ ID NO: 215885 - DNA, 16 bp, P. troglodytes
atttaaacctgggagg

SEQ ID NO: 215886 - DNA, 16 bp, P. troglodytes
atttaaagaaaaacat

SEQ ID NO: 215887 - DNA, 16 bp, P. troglodytes
atttaaagaagaaatg

SEQ ID NO: 215888 - DNA, 16 bp, P. troglodytes
atttaaagaagaatga

SEQ ID NO: 215889 - DNA, 16 bp, P. troglodytes
atttaaagacattttt

SEQ ID NO: 215890 - DNA, 16 bp, P. troglodytes
atttaaagagacagaa

SEQ ID NO: 215891 - DNA, 16 bp, P. troglodytes
atttaaagagataatg

SEQ ID NO: 215892 - DNA, 16 bp, P. troglodytes
atttaaagcaaatttt

SEQ ID NO: 215893 - DNA, 16 bp, P. troglodytes
atttaaagtgtataat

SEQ ID NO: 215894 - DNA, 16 bp, P. troglodytes
atttaaagttcctcca

SEQ ID NO: 215895 - DNA, 16 bp, P. troglodytes
atttaaatggattaaa

SEQ ID NO: 215896 - DNA, 16 bp, P. troglodytes
atttaaattttgtttc

SEQ ID NO: 215897 - DNA, 16 bp, P. troglodytes
atttaacaaaatatgt

SEQ ID NO: 215898 - DNA, 16 bp, P. troglodytes
atttaacaaaatccag

SEQ ID NO: 215899 - DNA, 16 bp, P. troglodytes
atttaacaaatacatt

SEQ ID NO: 215900 - DNA, 16 bp, P. troglodytes
atttaacagaagaaaa

SEQ ID NO: 215901 - DNA, 16 bp, P. troglodytes
atttaacagatgaaaa

SEQ ID NO: 215902 - DNA, 16 bp, P. troglodytes
atttaacatttgtttt

SEQ ID NO: 215903 - DNA, 16 bp, P. troglodytes
atttaactgtacattt

SEQ ID NO: 215904 - DNA, 16 bp, P. troglodytes
atttaacttcttaaaa

SEQ ID NO: 215905 - DNA, 16 bp, P. troglodytes
atttaacttgtatttt

SEQ ID NO: 215906 - DNA, 16 bp, P. troglodytes
atttaagaaaacattg

SEQ ID NO: 215907 - DNA, 16 bp, P. troglodytes
atttaagaaaacattt

SEQ ID NO: 215908 - DNA, 16 bp, P. troglodytes
atttaagaaaatgttg

SEQ ID NO: 215909 - DNA, 16 bp, P. troglodytes
atttaagaaatacatt

SEQ ID NO: 215910 - DNA, 16 bp, P. troglodytes
atttaagaaatgtttt

SEQ ID NO: 215911 - DNA, 16 bp, P. troglodytes
atttaagaatgttgaa

SEQ ID NO: 215912 - DNA, 16 bp, P. troglodytes
atttaagagtttaaaa

SEQ ID NO: 215913 - DNA, 16 bp, P. troglodytes
atttaagatttttctt

SEQ ID NO: 215914 - DNA, 16 bp, P. troglodytes
atttaagggagaaaaa

SEQ ID NO: 215915 - DNA, 16 bp, P. troglodytes
atttaagtctatgatc

SEQ ID NO: 215916 - DNA, 16 bp, P. troglodytes
atttaagtctttgatc

SEQ ID NO: 215917 - DNA, 16 bp, P. troglodytes
atttaataaaatgtgt

SEQ ID NO: 215918 - DNA, 16 bp, P. troglodytes
atttaataaacatgta

SEQ ID NO: 215919 - DNA, 16 bp, P. troglodytes
atttaataaatggtat

SEQ ID NO: 215920 - DNA, 16 bp, P. troglodytes
atttaataaatggttc

SEQ ID NO: 215921 - DNA, 16 bp, P. troglodytes
atttaatagatgagga

SEQ ID NO: 215922 - DNA, 16 bp, P. troglodytes
atttaatccaaagaag

SEQ ID NO: 215923 - DNA, 16 bp, P. troglodytes
atttaatcctcacaac

SEQ ID NO: 215924 - DNA, 16 bp, P. troglodytes
atttaatccttaaaat

SEQ ID NO: 215925 - DNA, 16 bp, P. troglodytes
atttaatctttacaat

SEQ ID NO: 215926 - DNA, 16 bp, P. troglodytes
atttaatgaaaaacat

SEQ ID NO: 215927 - DNA, 16 bp, P. troglodytes
atttaatgactgtcct

SEQ ID NO: 215928 - DNA, 16 bp, P. troglodytes
atttaatgagcattta

SEQ ID NO: 215929 - DNA, 16 bp, P. troglodytes
atttaatgcattttaa

SEQ ID NO: 215930 - DNA, 16 bp, P. troglodytes
atttaatggattcaca

SEQ ID NO: 215931 - DNA, 16 bp, P. troglodytes
atttaatgtcttctct

SEQ ID NO: 215932 - DNA, 16 bp, P. troglodytes
atttaattctcacaac

SEQ ID NO: 215933 - DNA, 16 bp, P. troglodytes
atttaattctgctctg

SEQ ID NO: 215934 - DNA, 16 bp, P. troglodytes
atttaatttggctaaa

SEQ ID NO: 215935 - DNA, 16 bp, P. troglodytes
atttaattttagccat

SEQ ID NO: 215936 - DNA, 16 bp, P. troglodytes
atttaattttcacaac

SEQ ID NO: 215937 - DNA, 16 bp, P. troglodytes
atttaattttctcagc

SEQ ID NO: 215938 - DNA, 16 bp, P. troglodytes
atttacaaaaacaagt

SEQ ID NO: 215939 - DNA, 16 bp, P. troglodytes
atttacaaaaataagt

SEQ ID NO: 215940 - DNA, 16 bp, P. troglodytes
atttacaaaaatgtaa

SEQ ID NO: 215941 - DNA, 16 bp, P. troglodytes
atttacaaaaggaaga

SEQ ID NO: 215942 - DNA, 16 bp, P. troglodytes
atttacaaatgtttta

SEQ ID NO: 215943 - DNA, 16 bp, P. troglodytes
atttacaacagcaaag

SEQ ID NO: 215944 - DNA, 16 bp, P. troglodytes
atttacaagaaaaaca

SEQ ID NO: 215945 - DNA, 16 bp, P. troglodytes
atttacaagaaagaaa

SEQ ID NO: 215946 - DNA, 16 bp, P. troglodytes
atttacaagttaattt

SEQ ID NO: 215947 - DNA, 21 bp, P. troglodytes
atttacaatcctttagctaga

SEQ ID NO: 215948 - DNA, 16 bp, P. troglodytes
atttacaccatggaaa

SEQ ID NO: 215949 - DNA, 16 bp, P. troglodytes
atttacacttccacca

SEQ ID NO: 215950 - DNA, 16 bp, P. troglodytes
atttacagaaaaatta

SEQ ID NO: 215951 - DNA, 16 bp, P. troglodytes
atttacagaagagaaa

SEQ ID NO: 215952 - DNA, 16 bp, P. troglodytes
atttacagaatattct

SEQ ID NO: 215953 - DNA, 16 bp, P. troglodytes
atttacagacaagcaa

SEQ ID NO: 215954 - DNA, 16 bp, P. troglodytes
atttacagattcaaag

SEQ ID NO: 215955 - DNA, 16 bp, P. troglodytes
atttacagatttaatg

SEQ ID NO: 215956 - DNA, 16 bp, P. troglodytes
atttacataccataaa

SEQ ID NO: 215957 - DNA, 16 bp, P. troglodytes
atttacatattacata

SEQ ID NO: 215958 - DNA, 16 bp, P. troglodytes
atttacattcaatatt

SEQ ID NO: 215959 - DNA, 16 bp, P. troglodytes
atttacattgccatgg

SEQ ID NO: 215960 - DNA, 16 bp, P. troglodytes
atttacatttacaaaa

SEQ ID NO: 215961 - DNA, 16 bp, P. troglodytes
atttacatttacatat

SEQ ID NO: 215962 - DNA, 16 bp, P. troglodytes
atttacatttaggtat

SEQ ID NO: 215963 - DNA, 16 bp, P. troglodytes
atttacatttcctcca

SEQ ID NO: 215964 - DNA, 16 bp, P. troglodytes
atttacattttaagtt

SEQ ID NO: 215965 - DNA, 16 bp, P. troglodytes
atttaccaattcaaaa

SEQ ID NO: 215966 - DNA, 16 bp, P. troglodytes
atttaccagtttttaa

SEQ ID NO: 215967 - DNA, 16 bp, P. troglodytes
atttacccaaaggagc

SEQ ID NO: 215968 - DNA, 16 bp, P. troglodytes
atttaccctaaaactt

SEQ ID NO: 215969 - DNA, 16 bp, P. troglodytes
atttacctaaaagaaa

SEQ ID NO: 215970 - DNA, 16 bp, P. troglodytes
atttacctttttaaaa

SEQ ID NO: 215971 - DNA, 16 bp, P. troglodytes
atttactacctggccc

SEQ ID NO: 215972 - DNA, 16 bp, P. troglodytes
atttactactttaaaa

SEQ ID NO: 215973 - DNA, 16 bp, P. troglodytes
atttactatatgccag

SEQ ID NO: 215974 - DNA, 16 bp, P. troglodytes
atttactcacagttct

SEQ ID NO: 215975 - DNA, 16 bp, P. troglodytes
atttactctgttgata

SEQ ID NO: 215976 - DNA, 16 bp, P. troglodytes
atttactgagcattta

SEQ ID NO: 215977 - DNA, 16 bp, P. troglodytes
atttactgagtgccag

SEQ ID NO: 215978 - DNA, 16 bp, P. troglodytes
atttactgagtgccta

SEQ ID NO: 215979 - DNA, 16 bp, P. troglodytes
atttactgtattattc

SEQ ID NO: 215980 - DNA, 16 bp, P. troglodytes
atttactttaaaagaa

SEQ ID NO: 215981 - DNA, 16 bp, P. troglodytes
atttactttgaaaaaa

SEQ ID NO: 215982 - DNA, 16 bp, P. troglodytes
atttacttttcaaaat

SEQ ID NO: 215983 - DNA, 16 bp, P. troglodytes
atttagaaaaacaaat

SEQ ID NO: 215984 - DNA, 16 bp, P. troglodytes
atttagaaaaagaaca

SEQ ID NO: 215985 - DNA, 16 bp, P. troglodytes
atttagaaaatacaga

SEQ ID NO: 215986 - DNA, 16 bp, P. troglodytes
atttagaaaatgtttt

SEQ ID NO: 215987 - DNA, 16 bp, P. troglodytes
atttagaaaattcaag

SEQ ID NO: 215988 - DNA, 16 bp, P. troglodytes
atttagaaacaaaaat

SEQ ID NO: 215989 - DNA, 16 bp, P. troglodytes
atttagaaacagaaaa

SEQ ID NO: 215990 - DNA, 16 bp, P. troglodytes
atttagaaaccaagat

SEQ ID NO: 215991 - DNA, 16 bp, P. troglodytes
atttagaaactaaaat

SEQ ID NO: 215992 - DNA, 16 bp, P. troglodytes
atttagaaagatattt

SEQ ID NO: 215993 - DNA, 16 bp, P. troglodytes
atttagaaatttctgt

SEQ ID NO: 215994 - DNA, 16 bp, P. troglodytes
atttagaactcctttt

SEQ ID NO: 215995 - DNA, 16 bp, P. troglodytes
atttagaagaaaacat

SEQ ID NO: 215996 - DNA, 16 bp, P. troglodytes
atttagaagaaatgaa

SEQ ID NO: 215997 - DNA, 16 bp, P. troglodytes
atttagaataatgttt

SEQ ID NO: 215998 - DNA, 16 bp, P. troglodytes
atttagaatattacat

SEQ ID NO: 215999 - DNA, 16 bp, P. troglodytes
atttagaatgttacat

SEQ ID NO: 216000 - DNA, 16 bp, P. troglodytes
atttagaatttagaat

SEQ ID NO: 216001 - DNA, 16 bp, P. troglodytes
atttagactttttaaa

SEQ ID NO: 216002 - DNA, 16 bp, P. troglodytes
atttagaggaagaaaa

SEQ ID NO: 216003 - DNA, 16 bp, P. troglodytes
atttagagggtacaag

SEQ ID NO: 216004 - DNA, 16 bp, P. troglodytes
atttagagtttaaaaa

SEQ ID NO: 216005 - DNA, 16 bp, P. troglodytes
atttagcaaaatattt

SEQ ID NO: 216006 - DNA, 16 bp, P. troglodytes
atttagcaaataaaaa

SEQ ID NO: 216007 - DNA, 16 bp, P. troglodytes
atttagcaaatattta

SEQ ID NO: 216008 - DNA, 16 bp, P. troglodytes
atttagcagcatccct

SEQ ID NO: 216009 - DNA, 16 bp, P. troglodytes
atttagccaaaatgat

SEQ ID NO: 216010 - DNA, 16 bp, P. troglodytes
atttagcttccattta

SEQ ID NO: 216011 - DNA, 16 bp, P. troglodytes
atttagctttaaaaaa

SEQ ID NO: 216012 - DNA, 16 bp, P. troglodytes
atttagctttttaaat

SEQ ID NO: 216013 - DNA, 16 bp, P. troglodytes
atttaggaaaacaaaa

SEQ ID NO: 216014 - DNA, 16 bp, P. troglodytes
atttaggaagtaaaat

SEQ ID NO: 216015 - DNA, 16 bp, P. troglodytes
atttaggatatctggc

SEQ ID NO: 216016 - DNA, 16 bp, P. troglodytes
atttaggttgattcca

SEQ ID NO: 216017 - DNA, 16 bp, P. troglodytes
atttaggttgtttcta

SEQ ID NO: 216018 - DNA, 16 bp, P. troglodytes
atttagtagagacagg

SEQ ID NO: 216019 - DNA, 16 bp, P. troglodytes
atttagtgcaataaat

SEQ ID NO: 216020 - DNA, 16 bp, P. troglodytes
atttagtggcataaaa

SEQ ID NO: 216021 - DNA, 16 bp, P. troglodytes
atttagtggcttaaaa

SEQ ID NO: 216022 - DNA, 16 bp, P. troglodytes
atttagttacctccca

SEQ ID NO: 216023 - DNA, 16 bp, P. troglodytes
atttagttcatttgtt

SEQ ID NO: 216024 - DNA, 16 bp, P. troglodytes
atttagttttataaga

SEQ ID NO: 216025 - DNA, 16 bp, P. troglodytes
atttataaaaacagat

SEQ ID NO: 216026 - DNA, 16 bp, P. troglodytes
atttataaaaccatca

SEQ ID NO: 216027 - DNA, 16 bp, P. troglodytes
atttataaacaaaaga

SEQ ID NO: 216028 - DNA, 16 bp, P. troglodytes
atttataaagaaagag

SEQ ID NO: 216029 - DNA, 16 bp, P. troglodytes
atttataaagagaaga

SEQ ID NO: 216030 - DNA, 16 bp, P. troglodytes
atttataaatcaccca

SEQ ID NO: 216031 - DNA, 16 bp, P. troglodytes
atttataagagaaaga

SEQ ID NO: 216032 - DNA, 16 bp, P. troglodytes
atttataatagctttt

SEQ ID NO: 216033 - DNA, 16 bp, P. troglodytes
atttataatgaacaga

SEQ ID NO: 216034 - DNA, 16 bp, P. troglodytes
atttataattgcaaaa

SEQ ID NO: 216035 - DNA, 16 bp, P. troglodytes
atttataatttgcttt

SEQ ID NO: 216036 - DNA, 16 bp, P. troglodytes
atttatacacatatat

SEQ ID NO: 216037 - DNA, 16 bp, P. troglodytes
atttatacattttcct

SEQ ID NO: 216038 - DNA, 16 bp, P. troglodytes
atttatagagaaaaag

SEQ ID NO: 216039 - DNA, 16 bp, P. troglodytes
atttatagattcattt

SEQ ID NO: 216040 - DNA, 16 bp, P. troglodytes
atttatagtcctttga

SEQ ID NO: 216041 - DNA, 16 bp, P. troglodytes
atttatataaatacag

SEQ ID NO: 216042 - DNA, 16 bp, P. troglodytes
atttatatacatatgt

SEQ ID NO: 216043 - DNA, 16 bp, P. troglodytes
atttatatatgttgaa

SEQ ID NO: 216044 - DNA, 16 bp, P. troglodytes
atttatatcagaaaaa

SEQ ID NO: 216045 - DNA, 16 bp, P. troglodytes
atttatatgaaatatc

SEQ ID NO: 216046 - DNA, 16 bp, P. troglodytes
atttatatgaaattca

SEQ ID NO: 216047 - DNA, 16 bp, P. troglodytes
atttatatggaaacac

SEQ ID NO: 216048 - DNA, 16 bp, P. troglodytes
atttatatgtaaatgt

SEQ ID NO: 216049 - DNA, 16 bp, P. troglodytes
atttatattactttgg

SEQ ID NO: 216050 - DNA, 16 bp, P. troglodytes
atttatattcagtgtt

SEQ ID NO: 216051 - DNA, 16 bp, P. troglodytes
atttatatttaaaagg

SEQ ID NO: 216052 - DNA, 16 bp, P. troglodytes
atttatatttacatgt

SEQ ID NO: 216053 - DNA, 16 bp, P. troglodytes
atttatatttgaaatg

SEQ ID NO: 216054 - DNA, 16 bp, P. troglodytes
atttatatttggcttt

SEQ ID NO: 216055 - DNA, 16 bp, P. troglodytes
atttatatttgtttca

SEQ ID NO: 216056 - DNA, 16 bp, P. troglodytes
atttatcaaaaaagaa

SEQ ID NO: 216057 - DNA, 16 bp, P. troglodytes
atttatcaagacagag

SEQ ID NO: 216058 - DNA, 16 bp, P. troglodytes
atttatcaagcattta

SEQ ID NO: 216059 - DNA, 18 bp, P. troglodytes
atttatcaattttggctt

SEQ ID NO: 216060 - DNA, 16 bp, P. troglodytes
atttatcacctgctaa

SEQ ID NO: 216061 - DNA, 16 bp, P. troglodytes
atttatccaaaggaaa

SEQ ID NO: 216062 - DNA, 16 bp, P. troglodytes
atttatccattctact

SEQ ID NO: 216063 - DNA, 16 bp, P. troglodytes
atttatccatttatct

SEQ ID NO: 216064 - DNA, 16 bp, P. troglodytes
atttatccatttcttg

SEQ ID NO: 216065 - DNA, 16 bp, P. troglodytes
atttatccctgagatg

SEQ ID NO: 216066 - DNA, 16 bp, P. troglodytes
atttatcctttgcatt

SEQ ID NO: 216067 - DNA, 16 bp, P. troglodytes
atttatctcttttgta

SEQ ID NO: 216068 - DNA, 16 bp, P. troglodytes
atttatctgtaaatat

SEQ ID NO: 216069 - DNA, 16 bp, P. troglodytes
atttatctttgtttcc

SEQ ID NO: 216070 - DNA, 16 bp, P. troglodytes
atttatgaagaagaga

SEQ ID NO: 216071 - DNA, 16 bp, P. troglodytes
atttatgaattttctt

SEQ ID NO: 216072 - DNA, 16 bp, P. troglodytes
atttatgactttgcct

SEQ ID NO: 216073 - DNA, 16 bp, P. troglodytes
atttatgaggcctctg

SEQ ID NO: 216074 - DNA, 16 bp, P. troglodytes
atttatgatttttcaa

SEQ ID NO: 216075 - DNA, 16 bp, P. troglodytes
atttatgcaaaaatat

SEQ ID NO: 216076 - DNA, 16 bp, P. troglodytes
atttatgcaggcaaaa

SEQ ID NO: 216077 - DNA, 16 bp, P. troglodytes
atttatgcatttattt

SEQ ID NO: 216078 - DNA, 16 bp, P. troglodytes
atttatggaaaatatt

SEQ ID NO: 216079 - DNA, 16 bp, P. troglodytes
atttatggggtacagt

SEQ ID NO: 216080 - DNA, 16 bp, P. troglodytes
atttatgtaaaaatgt

SEQ ID NO: 216081 - DNA, 16 bp, P. troglodytes
atttatgtgggtctat

SEQ ID NO: 216082 - DNA, 16 bp, P. troglodytes
atttatgtgtatatgt

SEQ ID NO: 216083 - DNA, 16 bp, P. troglodytes
atttatgtgttcattt

SEQ ID NO: 216084 - DNA, 16 bp, P. troglodytes
atttatgttttctaat

SEQ ID NO: 216085 - DNA, 16 bp, P. troglodytes
atttattaagcaccta

SEQ ID NO: 216086 - DNA, 16 bp, P. troglodytes
atttattaagcacctg

SEQ ID NO: 216087 - DNA, 16 bp, P. troglodytes
atttattaagcacctt

SEQ ID NO: 216088 - DNA, 16 bp, P. troglodytes
atttattaagcattta

SEQ ID NO: 216089 - DNA, 16 bp, P. troglodytes
atttattaagtaccta

SEQ ID NO: 216090 - DNA, 16 bp, P. troglodytes
atttattaagtgaaaa

SEQ ID NO: 216091 - DNA, 16 bp, P. troglodytes
atttattaagtgtcta

SEQ ID NO: 216092 - DNA, 16 bp, P. troglodytes
atttattagagaaagt

SEQ ID NO: 216093 - DNA, 16 bp, P. troglodytes
atttattagctgaaat

SEQ ID NO: 216094 - DNA, 16 bp, P. troglodytes
atttattcaaaggaaa

SEQ ID NO: 216095 - DNA, 16 bp, P. troglodytes
atttattcaagagaaa

SEQ ID NO: 216096 - DNA, 16 bp, P. troglodytes
atttattcatgtgttt

SEQ ID NO: 216097 - DNA, 16 bp, P. troglodytes
atttattcattcaaca

SEQ ID NO: 216098 - DNA, 16 bp, P. troglodytes
atttattcattcacct

SEQ ID NO: 216099 - DNA, 16 bp, P. troglodytes
atttattcattcagtg

SEQ ID NO: 216100 - DNA, 16 bp, P. troglodytes
atttattcatttaaca

SEQ ID NO: 216101 - DNA, 16 bp, P. troglodytes
atttattccaaaattg

SEQ ID NO: 216102 - DNA, 16 bp, P. troglodytes
atttattctgagccaa

SEQ ID NO: 216103 - DNA, 16 bp, P. troglodytes
atttattcttcaaaac

SEQ ID NO: 216104 - DNA, 16 bp, P. troglodytes
atttattctttaacaa

SEQ ID NO: 216105 - DNA, 16 bp, P. troglodytes
atttattgaaaaacat

SEQ ID NO: 216106 - DNA, 16 bp, P. troglodytes
atttattgaaaagggt

SEQ ID NO: 216107 - DNA, 16 bp, P. troglodytes
atttattgaaagctta

SEQ ID NO: 216108 - DNA, 16 bp, P. troglodytes
atttattgaaatgaaa

SEQ ID NO: 216109 - DNA, 16 bp, P. troglodytes
atttattgaacaaatg

SEQ ID NO: 216110 - DNA, 16 bp, P. troglodytes
atttattgaagaaact

SEQ ID NO: 216111 - DNA, 16 bp, P. troglodytes
atttattgaagaccta

SEQ ID NO: 216112 - DNA, 16 bp, P. troglodytes
atttattgaagaggct

SEQ ID NO: 216113 - DNA, 16 bp, P. troglodytes
atttattgaatacatt

SEQ ID NO: 216114 - DNA, 16 bp, P. troglodytes
atttattgaatgccta

SEQ ID NO: 216115 - DNA, 16 bp, P. troglodytes
atttattgaattccta

SEQ ID NO: 216116 - DNA, 16 bp, P. troglodytes
atttattgacttttta

SEQ ID NO: 216117 - DNA, 16 bp, P. troglodytes
atttattgagaaaata

SEQ ID NO: 216118 - DNA, 17 bp, P. troglodytes
atttattgagacggagt

SEQ ID NO: 216119 - DNA, 16 bp, P. troglodytes
atttattgagcacctt

SEQ ID NO: 216120 - DNA, 16 bp, P. troglodytes
atttattgagcacttg

SEQ ID NO: 216121 - DNA, 16 bp, P. troglodytes
atttattgagcatcta

SEQ ID NO: 216122 - DNA, 16 bp, P. troglodytes
atttattgagggccta

SEQ ID NO: 216123 - DNA, 16 bp, P. troglodytes
atttattgagtgccaa

SEQ ID NO: 216124 - DNA, 16 bp, P. troglodytes
atttattgagtgctta

SEQ ID NO: 216125 - DNA, 16 bp, P. troglodytes
atttattgagtgtctt

SEQ ID NO: 216126 - DNA, 16 bp, P. troglodytes
atttattgagttctta

SEQ ID NO: 216127 - DNA, 16 bp, P. troglodytes
atttattgatgagact

SEQ ID NO: 216128 - DNA, 16 bp, P. troglodytes
atttattgatttcctt

SEQ ID NO: 216129 - DNA, 16 bp, P. troglodytes
atttattgcaaagagc

SEQ ID NO: 216130 - DNA, 16 bp, P. troglodytes
atttattgcagcacta

SEQ ID NO: 216131 - DNA, 16 bp, P. troglodytes
atttattgcagtacta

SEQ ID NO: 216132 - DNA, 16 bp, P. troglodytes
atttattgcagtcttc

SEQ ID NO: 216133 - DNA, 16 bp, P. troglodytes
atttattgcatattta

SEQ ID NO: 216134 - DNA, 16 bp, P. troglodytes
atttattgcatgctta

SEQ ID NO: 216135 - DNA, 16 bp, P. troglodytes
atttattgcggcacta

SEQ ID NO: 216136 - DNA, 16 bp, P. troglodytes
atttattggacaccta

SEQ ID NO: 216137 - DNA, 16 bp, P. troglodytes
atttattggctatttg

SEQ ID NO: 216138 - DNA, 16 bp, P. troglodytes
atttattgtgtatttc

SEQ ID NO: 216139 - DNA, 16 bp, P. troglodytes
atttatttaaaaaagg

SEQ ID NO: 216140 - DNA, 16 bp, P. troglodytes
atttatttaaaagatc

SEQ ID NO: 216141 - DNA, 16 bp, P. troglodytes
atttatttaaaatgca

SEQ ID NO: 216142 - DNA, 16 bp, P. troglodytes
atttatttaatgaatg

SEQ ID NO: 216143 - DNA, 16 bp, P. troglodytes
atttatttagactttt

SEQ ID NO: 216144 - DNA, 16 bp, P. troglodytes
atttatttagctcatg

SEQ ID NO: 216145 - DNA, 16 bp, P. troglodytes
atttatttatacatgt

SEQ ID NO: 216146 - DNA, 16 bp, P. troglodytes
atttatttatatgaga

SEQ ID NO: 216147 - DNA, 16 bp, P. troglodytes
atttatttatggagac

SEQ ID NO: 216148 - DNA, 16 bp, P. troglodytes
atttatttatgtcaat

SEQ ID NO: 216149 - DNA, 16 bp, P. troglodytes
atttatttattcagca

SEQ ID NO: 216150 - DNA, 16 bp, P. troglodytes
atttatttatttgaca

SEQ ID NO: 216151 - DNA, 16 bp, P. troglodytes
atttatttattttgac

SEQ ID NO: 216152 - DNA, 16 bp, P. troglodytes
atttatttcaaaacaa

SEQ ID NO: 216153 - DNA, 16 bp, P. troglodytes
atttatttcaaaacat

SEQ ID NO: 216154 - DNA, 16 bp, P. troglodytes
atttatttcagagaaa

SEQ ID NO: 216155 - DNA, 16 bp, P. troglodytes
atttatttcatgttta

SEQ ID NO: 216156 - DNA, 16 bp, P. troglodytes
atttatttccctttca

SEQ ID NO: 216157 - DNA, 16 bp, P. troglodytes
atttatttctagaaaa

SEQ ID NO: 216158 - DNA, 16 bp, P. troglodytes
atttatttctgaataa

SEQ ID NO: 216159 - DNA, 16 bp, P. troglodytes
atttatttgacatatt

SEQ ID NO: 216160 - DNA, 16 bp, P. troglodytes
atttatttggaaaaaa

SEQ ID NO: 216161 - DNA, 16 bp, P. troglodytes
atttatttgggagaaa

SEQ ID NO: 216162 - DNA, 16 bp, P. troglodytes
atttatttgggaggtg

SEQ ID NO: 216163 - DNA, 16 bp, P. troglodytes
atttatttggggaaaa

SEQ ID NO: 216164 - DNA, 16 bp, P. troglodytes
atttatttgtatttca

SEQ ID NO: 216165 - DNA, 16 bp, P. troglodytes
atttatttgtgtcttc

SEQ ID NO: 216166 - DNA, 16 bp, P. troglodytes
atttattttcatggct

SEQ ID NO: 216167 - DNA, 16 bp, P. troglodytes
atttattttctgaaga

SEQ ID NO: 216168 - DNA, 16 bp, P. troglodytes
atttattttctggaaa

SEQ ID NO: 216169 - DNA, 16 bp, P. troglodytes
atttattttcttcctg

SEQ ID NO: 216170 - DNA, 16 bp, P. troglodytes
atttattttgagacac

SEQ ID NO: 216171 - DNA, 16 bp, P. troglodytes
atttattttgcaaata

SEQ ID NO: 216172 - DNA, 16 bp, P. troglodytes
atttattttgcatatt

SEQ ID NO: 216173 - DNA, 16 bp, P. troglodytes
atttatttttaggaaa

SEQ ID NO: 216174 - DNA, 16 bp, P. troglodytes
atttatttttatgtca

SEQ ID NO: 216175 - DNA, 16 bp, P. troglodytes
atttatttttcagttc

SEQ ID NO: 216176 - DNA, 16 bp, P. troglodytes
atttatttttcataga

SEQ ID NO: 216177 - DNA, 16 bp, P. troglodytes
atttatttttccattg

SEQ ID NO: 216178 - DNA, 16 bp, P. troglodytes
atttatttttgaaaca

SEQ ID NO: 216179 - DNA, 16 bp, P. troglodytes
atttatttttgaagaa

SEQ ID NO: 216180 - DNA, 16 bp, P. troglodytes
atttattttttcaaga

SEQ ID NO: 216181 - DNA, 16 bp, P. troglodytes
atttattttttgctga

SEQ ID NO: 216182 - DNA, 16 bp, P. troglodytes
atttcaaaaaagaaat

SEQ ID NO: 216183 - DNA, 16 bp, P. troglodytes
atttcaaaaaagaaga

SEQ ID NO: 216184 - DNA, 16 bp, P. troglodytes
atttcaaaaactgaaa

SEQ ID NO: 216185 - DNA, 16 bp, P. troglodytes
atttcaaaaagaagaa

SEQ ID NO: 216186 - DNA, 16 bp, P. troglodytes
atttcaaaacacatta

SEQ ID NO: 216187 - DNA, 16 bp, P. troglodytes
atttcaaaacagaaat

SEQ ID NO: 216188 - DNA, 16 bp, P. troglodytes
atttcaaaacatttaa

SEQ ID NO: 216189 - DNA, 16 bp, P. troglodytes
atttcaaaactaatca

SEQ ID NO: 216190 - DNA, 16 bp, P. troglodytes
atttcaaaagaaaatt

SEQ ID NO: 216191 - DNA, 16 bp, P. troglodytes
atttcaaaagaaataa

SEQ ID NO: 216192 - DNA, 16 bp, P. troglodytes
atttcaaaaggaaaaa

SEQ ID NO: 216193 - DNA, 16 bp, P. troglodytes
atttcaaaataaagat

SEQ ID NO: 216194 - DNA, 16 bp, P. troglodytes
atttcaaaataaagtt

SEQ ID NO: 216195 - DNA, 16 bp, P. troglodytes
atttcaaaatcaaatt

SEQ ID NO: 216196 - DNA, 16 bp, P. troglodytes
atttcaaaatgtaaaa

SEQ ID NO: 216197 - DNA, 16 bp, P. troglodytes
atttcaaaattgctaa

SEQ ID NO: 216198 - DNA, 16 bp, P. troglodytes
atttcaaagaaaaatg

SEQ ID NO: 216199 - DNA, 16 bp, P. troglodytes
atttcaaagaatttta

SEQ ID NO: 216200 - DNA, 16 bp, P. troglodytes
atttcaaagacttggt

SEQ ID NO: 216201 - DNA, 16 bp, P. troglodytes
atttcaaagactttta

SEQ ID NO: 216202 - DNA, 16 bp, P. troglodytes
atttcaaagataaaat

SEQ ID NO: 216203 - DNA, 16 bp, P. troglodytes
atttcaaagtctttca

SEQ ID NO: 216204 - DNA, 16 bp, P. troglodytes
atttcaaagttaattt

SEQ ID NO: 216205 - DNA, 16 bp, P. troglodytes
atttcaaataagaaat

SEQ ID NO: 216206 - DNA, 16 bp, P. troglodytes
atttcaaataatctgt

SEQ ID NO: 216207 - DNA, 16 bp, P. troglodytes
atttcaaatatatttg

SEQ ID NO: 216208 - DNA, 16 bp, P. troglodytes
atttcaaatattctca

SEQ ID NO: 216209 - DNA, 16 bp, P. troglodytes
atttcaaatatttaca

SEQ ID NO: 216210 - DNA, 16 bp, P. troglodytes
atttcaaatgaatgaa

SEQ ID NO: 216211 - DNA, 16 bp, P. troglodytes
atttcaaatgttttca

SEQ ID NO: 216212 - DNA, 16 bp, P. troglodytes
atttcaaatttgaaaa

SEQ ID NO: 216213 - DNA, 16 bp, P. troglodytes
atttcaaattttcaga

SEQ ID NO: 216214 - DNA, 16 bp, P. troglodytes
atttcaacttctattt

SEQ ID NO: 216215 - DNA, 16 bp, P. troglodytes
atttcaagaaaacaaa

SEQ ID NO: 216216 - DNA, 16 bp, P. troglodytes
atttcaagaaagaaaa

SEQ ID NO: 216217 - DNA, 16 bp, P. troglodytes
atttcaagaaggaaaa

SEQ ID NO: 216218 - DNA, 16 bp, P. troglodytes
atttcaagaatattat

SEQ ID NO: 216219 - DNA, 16 bp, P. troglodytes
atttcaagaattatta

SEQ ID NO: 216220 - DNA, 16 bp, P. troglodytes
atttcaagataaatta

SEQ ID NO: 216221 - DNA, 16 bp, P. troglodytes
atttcaatatgtaatt

SEQ ID NO: 216222 - DNA, 16 bp, P. troglodytes
atttcaatctctttgt

SEQ ID NO: 216223 - DNA, 16 bp, P. troglodytes
atttcaatcttttaaa

SEQ ID NO: 216224 - DNA, 16 bp, P. troglodytes
atttcaatttccaatt

SEQ ID NO: 216225 - DNA, 16 bp, P. troglodytes
atttcacaaaattcaa

SEQ ID NO: 216226 - DNA, 16 bp, P. troglodytes
atttcacaaatgaaaa

SEQ ID NO: 216227 - DNA, 16 bp, P. troglodytes
atttcacaaatgagga

SEQ ID NO: 216228 - DNA, 16 bp, P. troglodytes
atttcacaaattttaa

SEQ ID NO: 216229 - DNA, 16 bp, P. troglodytes
atttcacaatgtatat

SEQ ID NO: 216230 - DNA, 16 bp, P. troglodytes
atttcacagaggaaga

SEQ ID NO: 216231 - DNA, 16 bp, P. troglodytes
atttcacagatgagaa

SEQ ID NO: 216232 - DNA, 16 bp, P. troglodytes
atttcacagatgatga

SEQ ID NO: 216233 - DNA, 16 bp, P. troglodytes
atttcacaggtgagga

SEQ ID NO: 216234 - DNA, 16 bp, P. troglodytes
atttcacatacattat

SEQ ID NO: 216235 - DNA, 16 bp, P. troglodytes
atttcacattgtatgc

SEQ ID NO: 216236 - DNA, 16 bp, P. troglodytes
atttcacatttttaaa

SEQ ID NO: 216237 - DNA, 16 bp, P. troglodytes
atttcactgaagaaaa

SEQ ID NO: 216238 - DNA, 16 bp, P. troglodytes
atttcacttaatcctc

SEQ ID NO: 216239 - DNA, 16 bp, P. troglodytes
atttcacttatatgtg

SEQ ID NO: 216240 - DNA, 16 bp, P. troglodytes
atttcacttcacataa

SEQ ID NO: 216241 - DNA, 16 bp, P. troglodytes
atttcacttcatttta

SEQ ID NO: 216242 - DNA, 16 bp, P. troglodytes
atttcactttcattta

SEQ ID NO: 216243 - DNA, 16 bp, P. troglodytes
atttcactttttaaaa

SEQ ID NO: 216244 - DNA, 16 bp, P. troglodytes
atttcagaaaaaaatt

SEQ ID NO: 216245 - DNA, 16 bp, P. troglodytes
atttcagaaaaataat

SEQ ID NO: 216246 - DNA, 16 bp, P. troglodytes
atttcagaaaaatatt

SEQ ID NO: 216247 - DNA, 16 bp, P. troglodytes
atttcagaaaaattaa

SEQ ID NO: 216248 - DNA, 16 bp, P. troglodytes
atttcagaaaataaaa

SEQ ID NO: 216249 - DNA, 16 bp, P. troglodytes
atttcagaaaatcaaa

SEQ ID NO: 216250 - DNA, 16 bp, P. troglodytes
atttcagaaacatttt

SEQ ID NO: 216251 - DNA, 16 bp, P. troglodytes
atttcagaaagaaaaa

SEQ ID NO: 216252 - DNA, 16 bp, P. troglodytes
atttcagaaagaaaga

SEQ ID NO: 216253 - DNA, 16 bp, P. troglodytes
atttcagaaagaaata

SEQ ID NO: 216254 - DNA, 16 bp, P. troglodytes
atttcagaaagagaaa

SEQ ID NO: 216255 - DNA, 16 bp, P. troglodytes
atttcagaaatattaa

SEQ ID NO: 216256 - DNA, 16 bp, P. troglodytes
atttcagaaatgattt

SEQ ID NO: 216257 - DNA, 16 bp, P. troglodytes
atttcagaagaaaatt

SEQ ID NO: 216258 - DNA, 16 bp, P. troglodytes
atttcagaatttaaaa

SEQ ID NO: 216259 - DNA, 16 bp, P. troglodytes
atttcagaattttaaa

SEQ ID NO: 216260 - DNA, 16 bp, P. troglodytes
atttcagacttacaaa

SEQ ID NO: 216261 - DNA, 16 bp, P. troglodytes
atttcagacttctgac

SEQ ID NO: 216262 - DNA, 16 bp, P. troglodytes
atttcagagaagaaaa

SEQ ID NO: 216263 - DNA, 16 bp, P. troglodytes
atttcagagaaggaaa

SEQ ID NO: 216264 - DNA, 16 bp, P. troglodytes
atttcagagacagaaa

SEQ ID NO: 216265 - DNA, 16 bp, P. troglodytes
atttcagagctcattg

SEQ ID NO: 216266 - DNA, 21 bp, P. troglodytes
atttcagaggatgtatggaaa

SEQ ID NO: 216267 - DNA, 16 bp, P. troglodytes
atttcagatatatttt

SEQ ID NO: 216268 - DNA, 16 bp, P. troglodytes
atttcagattttggaa

SEQ ID NO: 216269 - DNA, 16 bp, P. troglodytes
atttcagcaaacattt

SEQ ID NO: 216270 - DNA, 16 bp, P. troglodytes
atttcagcagagaaat

SEQ ID NO: 216271 - DNA, 16 bp, P. troglodytes
atttcagctcactgca

SEQ ID NO: 216272 - DNA, 16 bp, P. troglodytes
atttcaggaaaaaata

SEQ ID NO: 216273 - DNA, 16 bp, P. troglodytes
atttcaggaaacaaaa

SEQ ID NO: 216274 - DNA, 16 bp, P. troglodytes
atttcaggacaagaat

SEQ ID NO: 216275 - DNA, 16 bp, P. troglodytes
atttcagggttttttt

SEQ ID NO: 216276 - DNA, 16 bp, P. troglodytes
atttcaggtcactgca

SEQ ID NO: 216277 - DNA, 16 bp, P. troglodytes
atttcagtgtccataa

SEQ ID NO: 216278 - DNA, 16 bp, P. troglodytes
atttcagtttcttaaa

SEQ ID NO: 216279 - DNA, 16 bp, P. troglodytes
atttcagtttgatttt

SEQ ID NO: 216280 - DNA, 16 bp, P. troglodytes
atttcagtttttaaaa

SEQ ID NO: 216281 - DNA, 16 bp, P. troglodytes
atttcatacaaatttt

SEQ ID NO: 216282 - DNA, 16 bp, P. troglodytes
atttcatacacacaca

SEQ ID NO: 216283 - DNA, 16 bp, P. troglodytes
atttcatatgattttc

SEQ ID NO: 216284 - DNA, 16 bp, P. troglodytes
atttcatatgcatttt

SEQ ID NO: 216285 - DNA, 16 bp, P. troglodytes
atttcatatggagcca

SEQ ID NO: 216286 - DNA, 16 bp, P. troglodytes
atttcatatgtaaata

SEQ ID NO: 216287 - DNA, 16 bp, P. troglodytes
atttcatatgtatata

SEQ ID NO: 216288 - DNA, 16 bp, P. troglodytes
atttcatattaaaatg

SEQ ID NO: 216289 - DNA, 16 bp, P. troglodytes
atttcatatttgtatt

SEQ ID NO: 216290 - DNA, 16 bp, P. troglodytes
atttcatcacccagtt

SEQ ID NO: 216291 - DNA, 16 bp, P. troglodytes
atttcatcactgtgca

SEQ ID NO: 216292 - DNA, 16 bp, P. troglodytes
atttcatcatccaggt

SEQ ID NO: 216293 - DNA, 16 bp, P. troglodytes
atttcatcattgtgtg

SEQ ID NO: 216294 - DNA, 16 bp, P. troglodytes
atttcatccaaaaaca

SEQ ID NO: 216295 - DNA, 16 bp, P. troglodytes
atttcatctatttctg

SEQ ID NO: 216296 - DNA, 16 bp, P. troglodytes
atttcatctgtatttt

SEQ ID NO: 216297 - DNA, 16 bp, P. troglodytes
atttcatcttgaattt

SEQ ID NO: 216298 - DNA, 16 bp, P. troglodytes
atttcatctttgaaaa

SEQ ID NO: 216299 - DNA, 16 bp, P. troglodytes
atttcatgaaaaaaat

SEQ ID NO: 216300 - DNA, 16 bp, P. troglodytes
atttcatgaagaaaat

SEQ ID NO: 216301 - DNA, 16 bp, P. troglodytes
atttcatgagaaaaat

SEQ ID NO: 216302 - DNA, 16 bp, P. troglodytes
atttcatggacatttg

SEQ ID NO: 216303 - DNA, 16 bp, P. troglodytes
atttcatgtaaatttt

SEQ ID NO: 216304 - DNA, 16 bp, P. troglodytes
atttcatgtatttatt

SEQ ID NO: 216305 - DNA, 16 bp, P. troglodytes
atttcatgttatatat

SEQ ID NO: 216306 - DNA, 16 bp, P. troglodytes
atttcattaatttctg

SEQ ID NO: 216307 - DNA, 16 bp, P. troglodytes
atttcattaatttgaa

SEQ ID NO: 216308 - DNA, 16 bp, P. troglodytes
atttcattcaacagct

SEQ ID NO: 216309 - DNA, 16 bp, P. troglodytes
atttcattcttttgaa

SEQ ID NO: 216310 - DNA, 16 bp, P. troglodytes
atttcattgagttgat

SEQ ID NO: 216311 - DNA, 16 bp, P. troglodytes
atttcattgtatgaat

SEQ ID NO: 216312 - DNA, 16 bp, P. troglodytes
atttcatttaattctg

SEQ ID NO: 216313 - DNA, 16 bp, P. troglodytes
atttcatttcatttgg

SEQ ID NO: 216314 - DNA, 16 bp, P. troglodytes
atttcattttgaaatt

SEQ ID NO: 216315 - DNA, 16 bp, P. troglodytes
atttcatttttctaca

SEQ ID NO: 216316 - DNA, 16 bp, P. troglodytes
atttcatttttgaaaa

SEQ ID NO: 216317 - DNA, 16 bp, P. troglodytes
atttccaaaatatttt

SEQ ID NO: 216318 - DNA, 16 bp, P. troglodytes
atttccaaagaagaaa

SEQ ID NO: 216319 - DNA, 16 bp, P. troglodytes
atttccaaaggaaatg

SEQ ID NO: 216320 - DNA, 16 bp, P. troglodytes
atttccaaatatttgt

SEQ ID NO: 216321 - DNA, 16 bp, P. troglodytes
atttccaaattataaa

SEQ ID NO: 216322 - DNA, 16 bp, P. troglodytes
atttccaataaaaatt

SEQ ID NO: 216323 - DNA, 16 bp, P. troglodytes
atttccacataaattt

SEQ ID NO: 216324 - DNA, 16 bp, P. troglodytes
atttccacatgcagaa

SEQ ID NO: 216325 - DNA, 16 bp, P. troglodytes
atttccagaactcttt

SEQ ID NO: 216326 - DNA, 16 bp, P. troglodytes
atttccagaacttttt

SEQ ID NO: 216327 - DNA, 16 bp, P. troglodytes
atttccagaatatttt

SEQ ID NO: 216328 - DNA, 16 bp, P. troglodytes
atttccagataaacaa

SEQ ID NO: 216329 - DNA, 16 bp, P. troglodytes
atttccagctgaggta

SEQ ID NO: 216330 - DNA, 16 bp, P. troglodytes
atttccagttaatttt

SEQ ID NO: 216331 - DNA, 16 bp, P. troglodytes
atttccagtttctctt

SEQ ID NO: 216332 - DNA, 16 bp, P. troglodytes
atttccagtttttaaa

SEQ ID NO: 216333 - DNA, 16 bp, P. troglodytes
atttccatcaccctaa

SEQ ID NO: 216334 - DNA, 16 bp, P. troglodytes
atttccatcatcccca

SEQ ID NO: 216335 - DNA, 16 bp, P. troglodytes
atttccatgtcttctt

SEQ ID NO: 216336 - DNA, 16 bp, P. troglodytes
atttccattaaaaata

SEQ ID NO: 216337 - DNA, 16 bp, P. troglodytes
atttccattcttctgc

SEQ ID NO: 216338 - DNA, 16 bp, P. troglodytes
atttccatttataaaa

SEQ ID NO: 216339 - DNA, 16 bp, P. troglodytes
atttccatttatttca

SEQ ID NO: 216340 - DNA, 16 bp, P. troglodytes
atttccatttcctcat

SEQ ID NO: 216341 - DNA, 16 bp, P. troglodytes
atttccatttggttat

SEQ ID NO: 216342 - DNA, 16 bp, P. troglodytes
atttccattttacaga

SEQ ID NO: 216343 - DNA, 16 bp, P. troglodytes
atttccattttgaaag

SEQ ID NO: 216344 - DNA, 16 bp, P. troglodytes
atttccattttgaaga

SEQ ID NO: 216345 - DNA, 16 bp, P. troglodytes
atttccatttttaaaa

SEQ ID NO: 216346 - DNA, 16 bp, P. troglodytes
atttcccaaatcatca

SEQ ID NO: 216347 - DNA, 16 bp, P. troglodytes
atttcccaaatttctt

SEQ ID NO: 216348 - DNA, 16 bp, P. troglodytes
atttcccagtgcatat

SEQ ID NO: 216349 - DNA, 16 bp, P. troglodytes
atttccccatctgtaa

SEQ ID NO: 216350 - DNA, 21 bp, P. troglodytes
atttccccatttcttgttttt

SEQ ID NO: 216351 - DNA, 16 bp, P. troglodytes
atttcccctatatttt

SEQ ID NO: 216352 - DNA, 16 bp, P. troglodytes
atttccctgagcagtg

SEQ ID NO: 216353 - DNA, 16 bp, P. troglodytes
atttccctttcaattt

SEQ ID NO: 216354 - DNA, 16 bp, P. troglodytes
atttccgttcttttgc

SEQ ID NO: 216355 - DNA, 16 bp, P. troglodytes
atttcctaatttcaaa

SEQ ID NO: 216356 - DNA, 16 bp, P. troglodytes
atttcctaattttgat

SEQ ID NO: 216357 - DNA, 16 bp, P. troglodytes
atttcctattttaaaa

SEQ ID NO: 216358 - DNA, 16 bp, P. troglodytes
atttcctcagcttttg

SEQ ID NO: 216359 - DNA, 16 bp, P. troglodytes
atttcctcatctgtaa

SEQ ID NO: 216360 - DNA, 16 bp, P. troglodytes
atttcctcattggtaa

SEQ ID NO: 216361 - DNA, 16 bp, P. troglodytes
atttcctcatttctaa

SEQ ID NO: 216362 - DNA, 16 bp, P. troglodytes
atttcctctaggcttt

SEQ ID NO: 216363 - DNA, 16 bp, P. troglodytes
atttcctctaggtttt

SEQ ID NO: 216364 - DNA, 16 bp, P. troglodytes
atttcctcttaaaaag

SEQ ID NO: 216365 - DNA, 16 bp, P. troglodytes
atttcctgaaaataaa

SEQ ID NO: 216366 - DNA, 16 bp, P. troglodytes
atttcctgaaatattt

SEQ ID NO: 216367 - DNA, 16 bp, P. troglodytes
atttcctgaattttaa

SEQ ID NO: 216368 - DNA, 16 bp, P. troglodytes
atttcctgtacagcct

SEQ ID NO: 216369 - DNA, 16 bp, P. troglodytes
atttccttaagcagtg

SEQ ID NO: 216370 - DNA, 16 bp, P. troglodytes
atttccttcagcaatg

SEQ ID NO: 216371 - DNA, 16 bp, P. troglodytes
atttccttctgtcttt

SEQ ID NO: 216372 - DNA, 16 bp, P. troglodytes
atttccttctgtttta

SEQ ID NO: 216373 - DNA, 16 bp, P. troglodytes
atttccttcttccctg

SEQ ID NO: 216374 - DNA, 16 bp, P. troglodytes
atttccttgagtagtg

SEQ ID NO: 216375 - DNA, 16 bp, P. troglodytes
atttccttgatcagtg

SEQ ID NO: 216376 - DNA, 16 bp, P. troglodytes
atttccttgccatacc

SEQ ID NO: 216377 - DNA, 16 bp, P. troglodytes
atttccttgtgagcaa

SEQ ID NO: 216378 - DNA, 16 bp, P. troglodytes
atttcctttaaaaata

SEQ ID NO: 216379 - DNA, 16 bp, P. troglodytes
atttcctttgagaact

SEQ ID NO: 216380 - DNA, 16 bp, P. troglodytes
atttccttttctaaaa

SEQ ID NO: 216381 - DNA, 16 bp, P. troglodytes
atttccttttctctgc

SEQ ID NO: 216382 - DNA, 16 bp, P. troglodytes
atttccttttcttgcc

SEQ ID NO: 216383 - DNA, 16 bp, P. troglodytes
atttcctttttaaaaa

SEQ ID NO: 216384 - DNA, 16 bp, P. troglodytes
atttcgggaggccaag

SEQ ID NO: 216385 - DNA, 16 bp, P. troglodytes
atttctaaaagaaata

SEQ ID NO: 216386 - DNA, 16 bp, P. troglodytes
atttctaaagtaaaat

SEQ ID NO: 216387 - DNA, 16 bp, P. troglodytes
atttctaaataaaagt

SEQ ID NO: 216388 - DNA, 16 bp, P. troglodytes
atttctaaatgatttt

SEQ ID NO: 216389 - DNA, 16 bp, P. troglodytes
atttctaagaatttat

SEQ ID NO: 216390 - DNA, 16 bp, P. troglodytes
atttctaagagctctt

SEQ ID NO: 216391 - DNA, 16 bp, P. troglodytes
atttctaagcaacaaa

SEQ ID NO: 216392 - DNA, 16 bp, P. troglodytes
atttctaatcttgtag

SEQ ID NO: 216393 - DNA, 16 bp, P. troglodytes
atttctacaaataaat

SEQ ID NO: 216394 - DNA, 16 bp, P. troglodytes
atttctacaatgagaa

SEQ ID NO: 216395 - DNA, 16 bp, P. troglodytes
atttctacacacacac

SEQ ID NO: 216396 - DNA, 16 bp, P. troglodytes
atttctacagaaaaat

SEQ ID NO: 216397 - DNA, 16 bp, P. troglodytes
atttctacgaaaaata

SEQ ID NO: 216398 - DNA, 16 bp, P. troglodytes
atttctagacacatcc

SEQ ID NO: 216399 - DNA, 16 bp, P. troglodytes
atttctaggtattttt

SEQ ID NO: 216400 - DNA, 16 bp, P. troglodytes
atttctagtttatttc

SEQ ID NO: 216401 - DNA, 16 bp, P. troglodytes
atttctataaatgttt

SEQ ID NO: 216402 - DNA, 16 bp, P. troglodytes
atttctatattttgta

SEQ ID NO: 216403 - DNA, 16 bp, P. troglodytes
atttctatcaccccag

SEQ ID NO: 216404 - DNA, 16 bp, P. troglodytes
atttctatgaagaaat

SEQ ID NO: 216405 - DNA, 16 bp, P. troglodytes
atttctatgtgtgtgt

SEQ ID NO: 216406 - DNA, 16 bp, P. troglodytes
atttctatgtgtttgt

SEQ ID NO: 216407 - DNA, 16 bp, P. troglodytes
atttctatgttgaaat

SEQ ID NO: 216408 - DNA, 16 bp, P. troglodytes
atttctattcaacatt

SEQ ID NO: 216409 - DNA, 16 bp, P. troglodytes
atttctattttagaaa

SEQ ID NO: 216410 - DNA, 16 bp, P. troglodytes
atttctattttgaaaa

SEQ ID NO: 216411 - DNA, 16 bp, P. troglodytes
atttctcaaaaggaga

SEQ ID NO: 216412 - DNA, 16 bp, P. troglodytes
atttctcaagaaattt

SEQ ID NO: 216413 - DNA, 16 bp, P. troglodytes
atttctcaaggatcta

SEQ ID NO: 216414 - DNA, 16 bp, P. troglodytes
atttctcaatttcaaa

SEQ ID NO: 216415 - DNA, 16 bp, P. troglodytes
atttctcagaagaaga

SEQ ID NO: 216416 - DNA, 16 bp, P. troglodytes
atttctcagaatgtat

SEQ ID NO: 216417 - DNA, 16 bp, P. troglodytes
atttctcaggtgttct

SEQ ID NO: 216418 - DNA, 16 bp, P. troglodytes
atttctcatcttctgc

SEQ ID NO: 216419 - DNA, 16 bp, P. troglodytes
atttctccaaagaaaa

SEQ ID NO: 216420 - DNA, 16 bp, P. troglodytes
atttctccaagaaaaa

SEQ ID NO: 216421 - DNA, 16 bp, P. troglodytes
atttctccactgtaaa

SEQ ID NO: 216422 - DNA, 16 bp, P. troglodytes
atttctccatttgtaa

SEQ ID NO: 216423 - DNA, 16 bp, P. troglodytes
atttctcccaagaaga

SEQ ID NO: 216424 - DNA, 16 bp, P. troglodytes
atttctcccacctcct

SEQ ID NO: 216425 - DNA, 16 bp, P. troglodytes
atttctccccaggaaa

SEQ ID NO: 216426 - DNA, 16 bp, P. troglodytes
atttctcctatctagc

SEQ ID NO: 216427 - DNA, 16 bp, P. troglodytes
atttctccttcctgcc

SEQ ID NO: 216428 - DNA, 16 bp, P. troglodytes
atttctccttgcagtt

SEQ ID NO: 216429 - DNA, 16 bp, P. troglodytes
atttctcctttgcttg

SEQ ID NO: 216430 - DNA, 16 bp, P. troglodytes
atttctcctttttaaa

SEQ ID NO: 216431 - DNA, 16 bp, P. troglodytes
atttctctaatggcta

SEQ ID NO: 216432 - DNA, 16 bp, P. troglodytes
atttctctctctgtgt

SEQ ID NO: 216433 - DNA, 16 bp, P. troglodytes
atttctctgataattt

SEQ ID NO: 216434 - DNA, 16 bp, P. troglodytes
atttctctgatgatta

SEQ ID NO: 216435 - DNA, 16 bp, P. troglodytes
atttctctgatgattt

SEQ ID NO: 216436 - DNA, 16 bp, P. troglodytes
atttctcttcagaaaa

SEQ ID NO: 216437 - DNA, 16 bp, P. troglodytes
atttctcttctgattt

SEQ ID NO: 216438 - DNA, 16 bp, P. troglodytes
atttctcttgggtata

SEQ ID NO: 216439 - DNA, 16 bp, P. troglodytes
atttctcttggttaaa

SEQ ID NO: 216440 - DNA, 16 bp, P. troglodytes
atttctcttgtgattt

SEQ ID NO: 216441 - DNA, 16 bp, P. troglodytes
atttctctttcaaaaa

SEQ ID NO: 216442 - DNA, 16 bp, P. troglodytes
atttctgaaaaccaaa

SEQ ID NO: 216443 - DNA, 16 bp, P. troglodytes
atttctgaaaatttaa

SEQ ID NO: 216444 - DNA, 16 bp, P. troglodytes
atttctgcagccaact

SEQ ID NO: 216445 - DNA, 16 bp, P. troglodytes
atttctgcatctatgt

SEQ ID NO: 216446 - DNA, 16 bp, P. troglodytes
atttctgcatttcttt

SEQ ID NO: 216447 - DNA, 16 bp, P. troglodytes
atttctgccacattct

SEQ ID NO: 216448 - DNA, 16 bp, P. troglodytes
atttctgccttaactt

SEQ ID NO: 216449 - DNA, 16 bp, P. troglodytes
atttctgctgttttaa

SEQ ID NO: 216450 - DNA, 16 bp, P. troglodytes
atttctggaaaaaaaa

SEQ ID NO: 216451 - DNA, 16 bp, P. troglodytes
atttctggaaacatac

SEQ ID NO: 216452 - DNA, 16 bp, P. troglodytes
atttctggaaatgaaa

SEQ ID NO: 216453 - DNA, 16 bp, P. troglodytes
atttctggactctcag

SEQ ID NO: 216454 - DNA, 16 bp, P. troglodytes
atttctggactcttta

SEQ ID NO: 216455 - DNA, 16 bp, P. troglodytes
atttctggattctcta

SEQ ID NO: 216456 - DNA, 16 bp, P. troglodytes
atttctggcttctctc

SEQ ID NO: 216457 - DNA, 16 bp, P. troglodytes
atttctggcttctctt

SEQ ID NO: 216458 - DNA, 16 bp, P. troglodytes
atttctgggctctctg

SEQ ID NO: 216459 - DNA, 16 bp, P. troglodytes
atttctggtttctctt

SEQ ID NO: 216460 - DNA, 16 bp, P. troglodytes
atttctgtaaaataaa

SEQ ID NO: 216461 - DNA, 16 bp, P. troglodytes
atttctgtaatcccag

SEQ ID NO: 216462 - DNA, 16 bp, P. troglodytes
atttctgtaatgatta

SEQ ID NO: 216463 - DNA, 16 bp, P. troglodytes
atttctgtagtcccag

SEQ ID NO: 216464 - DNA, 16 bp, P. troglodytes
atttctgtatttatct

SEQ ID NO: 216465 - DNA, 16 bp, P. troglodytes
atttctgtccattttt

SEQ ID NO: 216466 - DNA, 16 bp, P. troglodytes
atttctgtctttttaa

SEQ ID NO: 216467 - DNA, 16 bp, P. troglodytes
atttctgtgaagaatg

SEQ ID NO: 216468 - DNA, 16 bp, P. troglodytes
atttctgtgccatttt

SEQ ID NO: 216469 - DNA, 16 bp, P. troglodytes
atttctgttaaaataa

SEQ ID NO: 216470 - DNA, 16 bp, P. troglodytes
atttctgttgctttaa

SEQ ID NO: 216471 - DNA, 16 bp, P. troglodytes
atttctgttgttttaa

SEQ ID NO: 216472 - DNA, 16 bp, P. troglodytes
atttctgttttaaaat

SEQ ID NO: 216473 - DNA, 16 bp, P. troglodytes
atttctgttttttaag

SEQ ID NO: 216474 - DNA, 16 bp, P. troglodytes
atttcttaaaatgaaa

SEQ ID NO: 216475 - DNA, 16 bp, P. troglodytes
atttcttaaaggaaaa

SEQ ID NO: 216476 - DNA, 16 bp, P. troglodytes
atttcttaaatatgac

SEQ ID NO: 216477 - DNA, 16 bp, P. troglodytes
atttcttaaatgaata

SEQ ID NO: 216478 - DNA, 16 bp, P. troglodytes
atttcttaagaaaata

SEQ ID NO: 216479 - DNA, 16 bp, P. troglodytes
atttcttacatggcag

SEQ ID NO: 216480 - DNA, 16 bp, P. troglodytes
atttcttacttttcaa

SEQ ID NO: 216481 - DNA, 16 bp, P. troglodytes
atttcttagcagaaac

SEQ ID NO: 216482 - DNA, 16 bp, P. troglodytes
atttcttagttttcat

SEQ ID NO: 216483 - DNA, 16 bp, P. troglodytes
atttcttattttccaa

SEQ ID NO: 216484 - DNA, 16 bp, P. troglodytes
atttcttcaaaaattt

SEQ ID NO: 216485 - DNA, 16 bp, P. troglodytes
atttcttcaaagaaga

SEQ ID NO: 216486 - DNA, 16 bp, P. troglodytes
atttcttcaaataagc

SEQ ID NO: 216487 - DNA, 16 bp, P. troglodytes
atttcttcaacatttt

SEQ ID NO: 216488 - DNA, 16 bp, P. troglodytes
atttcttcacatcctc

SEQ ID NO: 216489 - DNA, 16 bp, P. troglodytes
atttcttcagatattt

SEQ ID NO: 216490 - DNA, 16 bp, P. troglodytes
atttcttcagattttt

SEQ ID NO: 216491 - DNA, 16 bp, P. troglodytes
atttcttcagtatttt

SEQ ID NO: 216492 - DNA, 16 bp, P. troglodytes
atttcttcattaaaat

SEQ ID NO: 216493 - DNA, 16 bp, P. troglodytes
atttcttcattgattt

SEQ ID NO: 216494 - DNA, 16 bp, P. troglodytes
atttcttccaacagat

SEQ ID NO: 216495 - DNA, 16 bp, P. troglodytes
atttcttccaccaaat

SEQ ID NO: 216496 - DNA, 16 bp, P. troglodytes
atttcttcctgtttca

SEQ ID NO: 216497 - DNA, 16 bp, P. troglodytes
atttcttctaggtttt

SEQ ID NO: 216498 - DNA, 16 bp, P. troglodytes
atttcttctatttctg

SEQ ID NO: 216499 - DNA, 16 bp, P. troglodytes
atttcttctttaaatg

SEQ ID NO: 216500 - DNA, 16 bp, P. troglodytes
atttcttctttgctta

SEQ ID NO: 216501 - DNA, 16 bp, P. troglodytes
atttcttgaagatttt

SEQ ID NO: 216502 - DNA, 16 bp, P. troglodytes
atttcttgaagccagg

SEQ ID NO: 216503 - DNA, 16 bp, P. troglodytes
atttcttgttcttgtc

SEQ ID NO: 216504 - DNA, 16 bp, P. troglodytes
atttcttgttttaaaa

SEQ ID NO: 216505 - DNA, 16 bp, P. troglodytes
atttctttaaaaaaca

SEQ ID NO: 216506 - DNA, 16 bp, P. troglodytes
atttctttaaaaatga

SEQ ID NO: 216507 - DNA, 16 bp, P. troglodytes
atttctttaaaagaat

SEQ ID NO: 216508 - DNA, 16 bp, P. troglodytes
atttctttaaaagata

SEQ ID NO: 216509 - DNA, 16 bp, P. troglodytes
atttctttaaaagcca

SEQ ID NO: 216510 - DNA, 16 bp, P. troglodytes
atttctttaaagaaat

SEQ ID NO: 216511 - DNA, 16 bp, P. troglodytes
atttctttaggaaaaa

SEQ ID NO: 216512 - DNA, 16 bp, P. troglodytes
atttctttatagcaat

SEQ ID NO: 216513 - DNA, 16 bp, P. troglodytes
atttctttatagcact

SEQ ID NO: 216514 - DNA, 16 bp, P. troglodytes
atttctttatagtaac

SEQ ID NO: 216515 - DNA, 16 bp, P. troglodytes
atttctttcaaataaa

SEQ ID NO: 216516 - DNA, 16 bp, P. troglodytes
atttctttcaatgatg

SEQ ID NO: 216517 - DNA, 16 bp, P. troglodytes
atttctttcagctttt

SEQ ID NO: 216518 - DNA, 16 bp, P. troglodytes
atttctttcatcagag

SEQ ID NO: 216519 - DNA, 16 bp, P. troglodytes
atttctttcctctgct

SEQ ID NO: 216520 - DNA, 16 bp, P. troglodytes
atttctttgaggtttt

SEQ ID NO: 216521 - DNA, 16 bp, P. troglodytes
atttctttgattttaa

SEQ ID NO: 216522 - DNA, 16 bp, P. troglodytes
atttctttgccttttc

SEQ ID NO: 216523 - DNA, 16 bp, P. troglodytes
atttctttggaatttt

SEQ ID NO: 216524 - DNA, 16 bp, P. troglodytes
atttctttgggtattt

SEQ ID NO: 216525 - DNA, 16 bp, P. troglodytes
atttctttgtgattta

SEQ ID NO: 216526 - DNA, 16 bp, P. troglodytes
atttctttgtgtgtgt

SEQ ID NO: 216527 - DNA, 16 bp, P. troglodytes
atttctttgttttcaa

SEQ ID NO: 216528 - DNA, 16 bp, P. troglodytes
atttcttttcctctgc

SEQ ID NO: 216529 - DNA, 16 bp, P. troglodytes
atttcttttctcctgc

SEQ ID NO: 216530 - DNA, 16 bp, P. troglodytes
atttcttttgccagat

SEQ ID NO: 216531 - DNA, 16 bp, P. troglodytes
atttcttttggaaaaa

SEQ ID NO: 216532 - DNA, 16 bp, P. troglodytes
atttcttttgtttaaa

SEQ ID NO: 216533 - DNA, 16 bp, P. troglodytes
atttctttttagtaat

SEQ ID NO: 216534 - DNA, 16 bp, P. troglodytes
atttctttttcaccat

SEQ ID NO: 216535 - DNA, 16 bp, P. troglodytes
atttgaaaaaaataca

SEQ ID NO: 216536 - DNA, 16 bp, P. troglodytes
atttgaaaaaaatgct

SEQ ID NO: 216537 - DNA, 16 bp, P. troglodytes
atttgaaaaaacattt

SEQ ID NO: 216538 - DNA, 16 bp, P. troglodytes
atttgaaaaacagttt

SEQ ID NO: 216539 - DNA, 16 bp, P. troglodytes
atttgaaaaagaaatg

SEQ ID NO: 216540 - DNA, 16 bp, P. troglodytes
atttgaaaaatacttt

SEQ ID NO: 216541 - DNA, 16 bp, P. troglodytes
atttgaaaaatgaaga

SEQ ID NO: 216542 - DNA, 16 bp, P. troglodytes
atttgaaaaatgtaga

SEQ ID NO: 216543 - DNA, 16 bp, P. troglodytes
atttgaaaacaaaaat

SEQ ID NO: 216544 - DNA, 16 bp, P. troglodytes
atttgaaaacaaaatc

SEQ ID NO: 216545 - DNA, 16 bp, P. troglodytes
atttgaaaaccactga

SEQ ID NO: 216546 - DNA, 16 bp, P. troglodytes
atttgaaaaggaaatt

SEQ ID NO: 216547 - DNA, 16 bp, P. troglodytes
atttgaaaaggaagaa

SEQ ID NO: 216548 - DNA, 16 bp, P. troglodytes
atttgaaaatgaattt

SEQ ID NO: 216549 - DNA, 16 bp, P. troglodytes
atttgaaaatgtattt

SEQ ID NO: 216550 - DNA, 16 bp, P. troglodytes
atttgaaaattcattt

SEQ ID NO: 216551 - DNA, 16 bp, P. troglodytes
atttgaaaatttgaaa

SEQ ID NO: 216552 - DNA, 16 bp, P. troglodytes
atttgaaacaaaagaa

SEQ ID NO: 216553 - DNA, 16 bp, P. troglodytes
atttgaaacattttct

SEQ ID NO: 216554 - DNA, 16 bp, P. troglodytes
atttgaaagaaattat

SEQ ID NO: 216555 - DNA, 16 bp, P. troglodytes
atttgaaagggaaaaa

SEQ ID NO: 216556 - DNA, 16 bp, P. troglodytes
atttgaaatatatttg

SEQ ID NO: 216557 - DNA, 16 bp, P. troglodytes
atttgaaatatttcat

SEQ ID NO: 216558 - DNA, 16 bp, P. troglodytes
atttgaaatgaaaatt

SEQ ID NO: 216559 - DNA, 16 bp, P. troglodytes
atttgaaatgtataaa

SEQ ID NO: 216560 - DNA, 16 bp, P. troglodytes
atttgaaatgtatatt

SEQ ID NO: 216561 - DNA, 16 bp, P. troglodytes
atttgaaattaaaagt

SEQ ID NO: 216562 - DNA, 16 bp, P. troglodytes
atttgaaatttgaaat

SEQ ID NO: 216563 - DNA, 16 bp, P. troglodytes
atttgaaattttgata

SEQ ID NO: 216564 - DNA, 16 bp, P. troglodytes
atttgaaattttttct

SEQ ID NO: 216565 - DNA, 16 bp, P. troglodytes
atttgaacatttattt

SEQ ID NO: 216566 - DNA, 16 bp, P. troglodytes
atttgaacccagatct

SEQ ID NO: 216567 - DNA, 16 bp, P. troglodytes
atttgaactcaggcag

SEQ ID NO: 216568 - DNA, 16 bp, P. troglodytes
atttgaagaaaaattt

SEQ ID NO: 216569 - DNA, 16 bp, P. troglodytes
atttgaagaaataaag

SEQ ID NO: 216570 - DNA, 16 bp, P. troglodytes
atttgaagacaaaaaa

SEQ ID NO: 216571 - DNA, 16 bp, P. troglodytes
atttgaagagatttat

SEQ ID NO: 216572 - DNA, 16 bp, P. troglodytes
atttgaagatattaaa

SEQ ID NO: 216573 - DNA, 16 bp, P. troglodytes
atttgaagatatttct

SEQ ID NO: 216574 - DNA, 16 bp, P. troglodytes
atttgaagatgctaca

SEQ ID NO: 216575 - DNA, 16 bp, P. troglodytes
atttgaagtaattatt

SEQ ID NO: 216576 - DNA, 16 bp, P. troglodytes
atttgaagtctttcta

SEQ ID NO: 216577 - DNA, 16 bp, P. troglodytes
atttgaataaaatctt

SEQ ID NO: 216578 - DNA, 16 bp, P. troglodytes
atttgaatagccctat

SEQ ID NO: 216579 - DNA, 16 bp, P. troglodytes
atttgaatatgttgaa

SEQ ID NO: 216580 - DNA, 16 bp, P. troglodytes
atttgaatattttgaa

SEQ ID NO: 216581 - DNA, 16 bp, P. troglodytes
atttgaatcttctttt

SEQ ID NO: 216582 - DNA, 16 bp, P. troglodytes
atttgaatgccattta

SEQ ID NO: 216583 - DNA, 16 bp, P. troglodytes
atttgaattaaatgaa

SEQ ID NO: 216584 - DNA, 16 bp, P. troglodytes
atttgaattattttct

SEQ ID NO: 216585 - DNA, 16 bp, P. troglodytes
atttgaatttccctga

SEQ ID NO: 216586 - DNA, 16 bp, P. troglodytes
atttgaatttgaaaaa

SEQ ID NO: 216587 - DNA, 16 bp, P. troglodytes
atttgaattttttcct

SEQ ID NO: 216588 - DNA, 16 bp, P. troglodytes
atttgacaaaaattca

SEQ ID NO: 216589 - DNA, 16 bp, P. troglodytes
atttgacaaaatctaa

SEQ ID NO: 216590 - DNA, 16 bp, P. troglodytes
atttgacccagcaacc

SEQ ID NO: 216591 - DNA, 16 bp, P. troglodytes
atttgactatattaaa

SEQ ID NO: 216592 - DNA, 16 bp, P. troglodytes
atttgactttttaaaa

SEQ ID NO: 216593 - DNA, 16 bp, P. troglodytes
atttgagaaaatgaaa

SEQ ID NO: 216594 - DNA, 16 bp, P. troglodytes
atttgagaaattattt

SEQ ID NO: 216595 - DNA, 16 bp, P. troglodytes
atttgagaaattttca

SEQ ID NO: 216596 - DNA, 16 bp, P. troglodytes
atttgagaagttttca

SEQ ID NO: 216597 - DNA, 16 bp, P. troglodytes
atttgagaataagaaa

SEQ ID NO: 216598 - DNA, 16 bp, P. troglodytes
atttgagacatactta

SEQ ID NO: 216599 - DNA, 18 bp, P. troglodytes
atttgagaccagcctggt

SEQ ID NO: 216600 - DNA, 16 bp, P. troglodytes
atttgagactgagctc

SEQ ID NO: 216601 - DNA, 16 bp, P. troglodytes
atttgaggggaaaaaa

SEQ ID NO: 216602 - DNA, 16 bp, P. troglodytes
atttgaggtgaatcca

SEQ ID NO: 216603 - DNA, 16 bp, P. troglodytes
atttgataaatttcaa

SEQ ID NO: 216604 - DNA, 16 bp, P. troglodytes
atttgatattatttca

SEQ ID NO: 216605 - DNA, 16 bp, P. troglodytes
atttgatcttcacaac

SEQ ID NO: 216606 - DNA, 16 bp, P. troglodytes
atttgatcttccatca

SEQ ID NO: 216607 - DNA, 16 bp, P. troglodytes
atttgatctttttaaa

SEQ ID NO: 216608 - DNA, 16 bp, P. troglodytes
atttgatgatgaaatg

SEQ ID NO: 216609 - DNA, 16 bp, P. troglodytes
atttgatgatgatgat

SEQ ID NO: 216610 - DNA, 16 bp, P. troglodytes
atttgattatatgaat

SEQ ID NO: 216611 - DNA, 16 bp, P. troglodytes
atttgattctctttgt

SEQ ID NO: 216612 - DNA, 16 bp, P. troglodytes
atttgattgcactgtt

SEQ ID NO: 216613 - DNA, 16 bp, P. troglodytes
atttgatttgctagta

SEQ ID NO: 216614 - DNA, 16 bp, P. troglodytes
atttgatttggggaag

SEQ ID NO: 216615 - DNA, 16 bp, P. troglodytes
atttgattttcaacaa

SEQ ID NO: 216616 - DNA, 16 bp, P. troglodytes
atttgattttcatttc

SEQ ID NO: 216617 - DNA, 16 bp, P. troglodytes
atttgatttttcaaaa

SEQ ID NO: 216618 - DNA, 16 bp, P. troglodytes
atttgatttttttcaa

SEQ ID NO: 216619 - DNA, 16 bp, P. troglodytes
atttgcaaaaagaaaa

SEQ ID NO: 216620 - DNA, 16 bp, P. troglodytes
atttgcaaaaattaaa

SEQ ID NO: 216621 - DNA, 16 bp, P. troglodytes
atttgcaaatgtttta

SEQ ID NO: 216622 - DNA, 16 bp, P. troglodytes
atttgcaatagccaag

SEQ ID NO: 216623 - DNA, 16 bp, P. troglodytes
atttgcaattgcaaat

SEQ ID NO: 216624 - DNA, 16 bp, P. troglodytes
atttgcacacaaatgt

SEQ ID NO: 216625 - DNA, 16 bp, P. troglodytes
atttgcagcatgagaa

SEQ ID NO: 216626 - DNA, 16 bp, P. troglodytes
atttgcataataagat

SEQ ID NO: 216627 - DNA, 16 bp, P. troglodytes
atttgcatatattgaa

SEQ ID NO: 216628 - DNA, 16 bp, P. troglodytes
atttgcatatttattt

SEQ ID NO: 216629 - DNA, 16 bp, P. troglodytes
atttgcattgttttaa

SEQ ID NO: 216630 - DNA, 16 bp, P. troglodytes
atttgcattttaaaag

SEQ ID NO: 216631 - DNA, 16 bp, P. troglodytes
atttgcattttactga

SEQ ID NO: 216632 - DNA, 16 bp, P. troglodytes
atttgcattttactta

SEQ ID NO: 216633 - DNA, 16 bp, P. troglodytes
atttgcattttattat

SEQ ID NO: 216634 - DNA, 16 bp, P. troglodytes
atttgcatttttaaaa

SEQ ID NO: 216635 - DNA, 16 bp, P. troglodytes
atttgcatttttagca

SEQ ID NO: 216636 - DNA, 16 bp, P. troglodytes
atttgccagcagcaga

SEQ ID NO: 216637 - DNA, 16 bp, P. troglodytes
atttgccatctatata

SEQ ID NO: 216638 - DNA, 16 bp, P. troglodytes
atttgccattttaatt

SEQ ID NO: 216639 - DNA, 16 bp, P. troglodytes
atttgcccaatgtcac

SEQ ID NO: 216640 - DNA, 16 bp, P. troglodytes
atttgcccacctcggc

SEQ ID NO: 216641 - DNA, 17 bp, P. troglodytes
atttgcccgcctcggcc

SEQ ID NO: 216642 - DNA, 16 bp, P. troglodytes
atttgcctattctgga

SEQ ID NO: 216643 - DNA, 16 bp, P. troglodytes
atttgcctcttctgga

SEQ ID NO: 216644 - DNA, 16 bp, P. troglodytes
atttgcctgcctcagc

SEQ ID NO: 216645 - DNA, 16 bp, P. troglodytes
atttgcctgcctcggc

SEQ ID NO: 216646 - DNA, 17 bp, P. troglodytes
atttgcctgccttggcc

SEQ ID NO: 216647 - DNA, 16 bp, P. troglodytes
atttgccttttataaa

SEQ ID NO: 216648 - DNA, 16 bp, P. troglodytes
atttgccttttctgga

SEQ ID NO: 216649 - DNA, 16 bp, P. troglodytes
atttgcctttttctct

SEQ ID NO: 216650 - DNA, 16 bp, P. troglodytes
atttgctacaacatgg

SEQ ID NO: 216651 - DNA, 16 bp, P. troglodytes
atttgctatggtctga

SEQ ID NO: 216652 - DNA, 16 bp, P. troglodytes
atttgctattgtaaat

SEQ ID NO: 216653 - DNA, 16 bp, P. troglodytes
atttgctcctgaatga

SEQ ID NO: 216654 - DNA, 16 bp, P. troglodytes
atttgctgaagttgct

SEQ ID NO: 216655 - DNA, 16 bp, P. troglodytes
atttgctgaagttgtt

SEQ ID NO: 216656 - DNA, 16 bp, P. troglodytes
atttgctgaattaaaa

SEQ ID NO: 216657 - DNA, 19 bp, P. troglodytes
atttgctgaggagtgtttt

SEQ ID NO: 216658 - DNA, 16 bp, P. troglodytes
atttgctgaggatgat

SEQ ID NO: 216659 - DNA, 16 bp, P. troglodytes
atttgctgtgaaccta

SEQ ID NO: 216660 - DNA, 16 bp, P. troglodytes
atttgcttatgtattt

SEQ ID NO: 216661 - DNA, 16 bp, P. troglodytes
atttgctttatatatc

SEQ ID NO: 216662 - DNA, 16 bp, P. troglodytes
atttgcttttctattc

SEQ ID NO: 216663 - DNA, 19 bp, P. troglodytes
atttgcttttgaaagaaga

SEQ ID NO: 216664 - DNA, 16 bp, P. troglodytes
atttgcttttttcccc

SEQ ID NO: 216665 - DNA, 16 bp, P. troglodytes
atttggaaaaaaatgt

SEQ ID NO: 216666 - DNA, 16 bp, P. troglodytes
atttggaaaaaaattt

SEQ ID NO: 216667 - DNA, 16 bp, P. troglodytes
atttggaaaaacctaa

SEQ ID NO: 216668 - DNA, 16 bp, P. troglodytes
atttggaaaaacctga

SEQ ID NO: 216669 - DNA, 16 bp, P. troglodytes
atttggaaaaacttaa

SEQ ID NO: 216670 - DNA, 16 bp, P. troglodytes
atttggaaaaatgaaa

SEQ ID NO: 216671 - DNA, 16 bp, P. troglodytes
atttggaaaacagaaa

SEQ ID NO: 216672 - DNA, 16 bp, P. troglodytes
atttggaaaacattta

SEQ ID NO: 216673 - DNA, 16 bp, P. troglodytes
atttggaaaacctaaa

SEQ ID NO: 216674 - DNA, 16 bp, P. troglodytes
atttggaaaatacaga

SEQ ID NO: 216675 - DNA, 16 bp, P. troglodytes
atttggaaaatgcaaa

SEQ ID NO: 216676 - DNA, 16 bp, P. troglodytes
atttggaaactaaaca

SEQ ID NO: 216677 - DNA, 16 bp, P. troglodytes
atttggaaaggacaaa

SEQ ID NO: 216678 - DNA, 16 bp, P. troglodytes
atttggaaataaaatt

SEQ ID NO: 216679 - DNA, 16 bp, P. troglodytes
atttggaaataggatc

SEQ ID NO: 216680 - DNA, 16 bp, P. troglodytes
atttggaaattaaaca

SEQ ID NO: 216681 - DNA, 16 bp, P. troglodytes
atttggaaatttttct

SEQ ID NO: 216682 - DNA, 16 bp, P. troglodytes
atttggaagaaaaaga

SEQ ID NO: 216683 - DNA, 16 bp, P. troglodytes
atttggaagcaacgta

SEQ ID NO: 216684 - DNA, 16 bp, P. troglodytes
atttggaattattctg

SEQ ID NO: 216685 - DNA, 16 bp, P. troglodytes
atttggaatttaaaaa

SEQ ID NO: 216686 - DNA, 16 bp, P. troglodytes
atttggaatttatcct

SEQ ID NO: 216687 - DNA, 16 bp, P. troglodytes
atttggagaaaattaa

SEQ ID NO: 216688 - DNA, 16 bp, P. troglodytes
atttggagaagaggca

SEQ ID NO: 216689 - DNA, 16 bp, P. troglodytes
atttggagaatatttt

SEQ ID NO: 216690 - DNA, 16 bp, P. troglodytes
atttggagatggggcc

SEQ ID NO: 216691 - DNA, 16 bp, P. troglodytes
atttggaggaaaaaaa

SEQ ID NO: 216692 - DNA, 16 bp, P. troglodytes
atttggaggaaagaga

SEQ ID NO: 216693 - DNA, 16 bp, P. troglodytes
atttggaggggaaaaa

SEQ ID NO: 216694 - DNA, 16 bp, P. troglodytes
atttggaggggacaaa

SEQ ID NO: 216695 - DNA, 16 bp, P. troglodytes
atttggatgcttttta

SEQ ID NO: 216696 - DNA, 16 bp, P. troglodytes
atttggattcccttta

SEQ ID NO: 216697 - DNA, 16 bp, P. troglodytes
atttggcaacatctgg

SEQ ID NO: 216698 - DNA, 17 bp, P. troglodytes
atttggctcagaataaa

SEQ ID NO: 216699 - DNA, 16 bp, P. troglodytes
atttggctcttagctt

SEQ ID NO: 216700 - DNA, 16 bp, P. troglodytes
atttggctcttggttt

SEQ ID NO: 216701 - DNA, 16 bp, P. troglodytes
atttggctttctgtct

SEQ ID NO: 216702 - DNA, 16 bp, P. troglodytes
atttgggaagaattga

SEQ ID NO: 216703 - DNA, 16 bp, P. troglodytes
atttgggagaggccag

SEQ ID NO: 216704 - DNA, 16 bp, P. troglodytes
atttgggaggccgagg

SEQ ID NO: 216705 - DNA, 16 bp, P. troglodytes
atttgggaggcctagg

SEQ ID NO: 216706 - DNA, 16 bp, P. troglodytes
atttgggaggctgagg

SEQ ID NO: 216707 - DNA, 21 bp, P. troglodytes
atttgggaggctgaggcaggc

SEQ ID NO: 216708 - DNA, 18 bp, P. troglodytes
atttgggaggctgaggcg

SEQ ID NO: 216709 - DNA, 16 bp, P. troglodytes
atttgggatatatttt

SEQ ID NO: 216710 - DNA, 16 bp, P. troglodytes
atttgggatgatgaaa

SEQ ID NO: 216711 - DNA, 16 bp, P. troglodytes
atttgggctctctttt

SEQ ID NO: 216712 - DNA, 16 bp, P. troglodytes
atttgggctgggctca

SEQ ID NO: 216713 - DNA, 16 bp, P. troglodytes
atttgggctggtttca

SEQ ID NO: 216714 - DNA, 16 bp, P. troglodytes
atttggggaaaaaaag

SEQ ID NO: 216715 - DNA, 16 bp, P. troglodytes
atttggggaaaaaaat

SEQ ID NO: 216716 - DNA, 16 bp, P. troglodytes
atttggggaatttttt

SEQ ID NO: 216717 - DNA, 16 bp, P. troglodytes
atttggggtggggaca

SEQ ID NO: 216718 - DNA, 16 bp, P. troglodytes
atttgggtgggagtgt

SEQ ID NO: 216719 - DNA, 16 bp, P. troglodytes
atttgggttcattcca

SEQ ID NO: 216720 - DNA, 16 bp, P. troglodytes
atttgggttgattcca

SEQ ID NO: 216721 - DNA, 16 bp, P. troglodytes
atttgggttgcttcca

SEQ ID NO: 216722 - DNA, 16 bp, P. troglodytes
atttgggtttttaaaa

SEQ ID NO: 216723 - DNA, 16 bp, P. troglodytes
atttggtatcagggta

SEQ ID NO: 216724 - DNA, 16 bp, P. troglodytes
atttggtgaaagacat

SEQ ID NO: 216725 - DNA, 16 bp, P. troglodytes
atttggtggcttaaaa

SEQ ID NO: 216726 - DNA, 16 bp, P. troglodytes
atttggttttctgtct

SEQ ID NO: 216727 - DNA, 16 bp, P. troglodytes
atttggttttctgtgt

SEQ ID NO: 216728 - DNA, 16 bp, P. troglodytes
atttgtaaaacaaaaa

SEQ ID NO: 216729 - DNA, 16 bp, P. troglodytes
atttgtaaaataagca

SEQ ID NO: 216730 - DNA, 16 bp, P. troglodytes
atttgtaaaatattga

SEQ ID NO: 216731 - DNA, 16 bp, P. troglodytes
atttgtaaaatgaaga

SEQ ID NO: 216732 - DNA, 16 bp, P. troglodytes
atttgtaaaatgagga

SEQ ID NO: 216733 - DNA, 16 bp, P. troglodytes
atttgtaaaatgcaaa

SEQ ID NO: 216734 - DNA, 16 bp, P. troglodytes
atttgtaaaatgtgaa

SEQ ID NO: 216735 - DNA, 16 bp, P. troglodytes
atttgtaagaattctt

SEQ ID NO: 216736 - DNA, 16 bp, P. troglodytes
atttgtaagtcttctt

SEQ ID NO: 216737 - DNA, 16 bp, P. troglodytes
atttgtaatagctaaa

SEQ ID NO: 216738 - DNA, 16 bp, P. troglodytes
atttgtaatttgtaaa

SEQ ID NO: 216739 - DNA, 16 bp, P. troglodytes
atttgtacaaatgtat

SEQ ID NO: 216740 - DNA, 16 bp, P. troglodytes
atttgtacacacacac

SEQ ID NO: 216741 - DNA, 16 bp, P. troglodytes
atttgtacatattttt

SEQ ID NO: 216742 - DNA, 16 bp, P. troglodytes
atttgtacatgaatgt

SEQ ID NO: 216743 - DNA, 16 bp, P. troglodytes
atttgtaggaaaaaaa

SEQ ID NO: 216744 - DNA, 16 bp, P. troglodytes
atttgtagtaatttgt

SEQ ID NO: 216745 - DNA, 16 bp, P. troglodytes
atttgtagtgtttgcc

SEQ ID NO: 216746 - DNA, 16 bp, P. troglodytes
atttgtagtttaaaaa

SEQ ID NO: 216747 - DNA, 16 bp, P. troglodytes
atttgtatatacacac

SEQ ID NO: 216748 - DNA, 16 bp, P. troglodytes
atttgtatatgttgaa

SEQ ID NO: 216749 - DNA, 16 bp, P. troglodytes
atttgtatcttcttca

SEQ ID NO: 216750 - DNA, 16 bp, P. troglodytes
atttgtatgtcatttt

SEQ ID NO: 216751 - DNA, 16 bp, P. troglodytes
atttgtattgtttcca

SEQ ID NO: 216752 - DNA, 16 bp, P. troglodytes
atttgtatttggaaaa

SEQ ID NO: 216753 - DNA, 16 bp, P. troglodytes
atttgtattttagtag

SEQ ID NO: 216754 - DNA, 16 bp, P. troglodytes
atttgtcaaaactcag

SEQ ID NO: 216755 - DNA, 16 bp, P. troglodytes
atttgtcaaatatttt

SEQ ID NO: 216756 - DNA, 16 bp, P. troglodytes
atttgtcaattaaaaa

SEQ ID NO: 216757 - DNA, 16 bp, P. troglodytes
atttgtcagcctcttt

SEQ ID NO: 216758 - DNA, 16 bp, P. troglodytes
atttgtcatattttct

SEQ ID NO: 216759 - DNA, 16 bp, P. troglodytes
atttgtcattttaacc

SEQ ID NO: 216760 - DNA, 16 bp, P. troglodytes
atttgtcatttttaaa

SEQ ID NO: 216761 - DNA, 16 bp, P. troglodytes
atttgtcattttttaa

SEQ ID NO: 216762 - DNA, 16 bp, P. troglodytes
atttgtcccctccaaa

SEQ ID NO: 216763 - DNA, 16 bp, P. troglodytes
atttgtctaaaattct

SEQ ID NO: 216764 - DNA, 16 bp, P. troglodytes
atttgtctaaaatttt

SEQ ID NO: 216765 - DNA, 16 bp, P. troglodytes
atttgtctattattgg

SEQ ID NO: 216766 - DNA, 16 bp, P. troglodytes
atttgtctttaataaa

SEQ ID NO: 216767 - DNA, 16 bp, P. troglodytes
atttgtctttctgttc

SEQ ID NO: 216768 - DNA, 16 bp, P. troglodytes
atttgtcttttctgga

SEQ ID NO: 216769 - DNA, 16 bp, P. troglodytes
atttgtcttttttaaa

SEQ ID NO: 216770 - DNA, 16 bp, P. troglodytes
atttgtgaataaaatt

SEQ ID NO: 216771 - DNA, 16 bp, P. troglodytes
atttgtgaatgttgaa

SEQ ID NO: 216772 - DNA, 16 bp, P. troglodytes
atttgtgattttaaaa

SEQ ID NO: 216773 - DNA, 16 bp, P. troglodytes
atttgtgcattttact

SEQ ID NO: 216774 - DNA, 16 bp, P. troglodytes
atttgtgcattttatt

SEQ ID NO: 216775 - DNA, 16 bp, P. troglodytes
atttgtggaaaagact

SEQ ID NO: 216776 - DNA, 16 bp, P. troglodytes
atttgtggaactttaa

SEQ ID NO: 216777 - DNA, 16 bp, P. troglodytes
atttgtggaatgaatg

SEQ ID NO: 216778 - DNA, 16 bp, P. troglodytes
atttgtggttttaaaa

SEQ ID NO: 216779 - DNA, 16 bp, P. troglodytes
atttgtgtacaaattt

SEQ ID NO: 216780 - DNA, 16 bp, P. troglodytes
atttgtgtacaagttt

SEQ ID NO: 216781 - DNA, 16 bp, P. troglodytes
atttgtgtatataaac

SEQ ID NO: 216782 - DNA, 16 bp, P. troglodytes
atttgtgtatgtggaa

SEQ ID NO: 216783 - DNA, 16 bp, P. troglodytes
atttgtgtatttctct

SEQ ID NO: 216784 - DNA, 16 bp, P. troglodytes
atttgtgttgctttaa

SEQ ID NO: 216785 - DNA, 16 bp, P. troglodytes
atttgtgttgtttgaa

SEQ ID NO: 216786 - DNA, 16 bp, P. troglodytes
atttgtgtttcagaaa

SEQ ID NO: 216787 - DNA, 16 bp, P. troglodytes
atttgtgtttctaaac

SEQ ID NO: 216788 - DNA, 16 bp, P. troglodytes
atttgtgttttgaaaa

SEQ ID NO: 216789 - DNA, 16 bp, P. troglodytes
atttgttaaacatttt

SEQ ID NO: 216790 - DNA, 16 bp, P. troglodytes
atttgttaagcaccta

SEQ ID NO: 216791 - DNA, 16 bp, P. troglodytes
atttgttacagcagca

SEQ ID NO: 216792 - DNA, 16 bp, P. troglodytes
atttgttcaaaataat

SEQ ID NO: 216793 - DNA, 16 bp, P. troglodytes
atttgttcatttaaaa

SEQ ID NO: 216794 - DNA, 16 bp, P. troglodytes
atttgttgaaaatact

SEQ ID NO: 216795 - DNA, 16 bp, P. troglodytes
atttgttgaagtccta

SEQ ID NO: 216796 - DNA, 16 bp, P. troglodytes
atttgttgaatgagtt

SEQ ID NO: 216797 - DNA, 16 bp, P. troglodytes
atttgttgactgaata

SEQ ID NO: 216798 - DNA, 16 bp, P. troglodytes
atttgttgagcactta

SEQ ID NO: 216799 - DNA, 16 bp, P. troglodytes
atttgttgattaaaaa

SEQ ID NO: 216800 - DNA, 16 bp, P. troglodytes
atttgttgcatgaata

SEQ ID NO: 216801 - DNA, 16 bp, P. troglodytes
atttgttgcatgaatg

SEQ ID NO: 216802 - DNA, 16 bp, P. troglodytes
atttgttgcatttgtt

SEQ ID NO: 216803 - DNA, 16 bp, P. troglodytes
atttgtttaaaaatgt

SEQ ID NO: 216804 - DNA, 16 bp, P. troglodytes
atttgtttaaagaaat

SEQ ID NO: 216805 - DNA, 16 bp, P. troglodytes
atttgtttaataaatg

SEQ ID NO: 216806 - DNA, 16 bp, P. troglodytes
atttgtttacatattg

SEQ ID NO: 216807 - DNA, 16 bp, P. troglodytes
atttgtttatttcatc

SEQ ID NO: 216808 - DNA, 16 bp, P. troglodytes
atttgtttattttaca

SEQ ID NO: 216809 - DNA, 16 bp, P. troglodytes
atttgtttcaggggaa

SEQ ID NO: 216810 - DNA, 16 bp, P. troglodytes
atttgtttctctctgc

SEQ ID NO: 216811 - DNA, 16 bp, P. troglodytes
atttgtttcttacagt

SEQ ID NO: 216812 - DNA, 16 bp, P. troglodytes
atttgtttgagacaga

SEQ ID NO: 216813 - DNA, 16 bp, P. troglodytes
atttgtttgcatattt

SEQ ID NO: 216814 - DNA, 16 bp, P. troglodytes
atttgtttggaaaaaa

SEQ ID NO: 216815 - DNA, 16 bp, P. troglodytes
atttgttttaaagaaa

SEQ ID NO: 216816 - DNA, 16 bp, P. troglodytes
atttgttttattatac

SEQ ID NO: 216817 - DNA, 16 bp, P. troglodytes
atttgttttcttgctg

SEQ ID NO: 216818 - DNA, 16 bp, P. troglodytes
atttgttttgaaatgt

SEQ ID NO: 216819 - DNA, 16 bp, P. troglodytes
atttgtttttaaaaac

SEQ ID NO: 216820 - DNA, 16 bp, P. troglodytes
atttgtttttcagttc

SEQ ID NO: 216821 - DNA, 16 bp, P. troglodytes
atttgtttttctgaaa

SEQ ID NO: 216822 - DNA, 16 bp, P. troglodytes
attttaaaaaacaaga

SEQ ID NO: 216823 - DNA, 16 bp, P. troglodytes
attttaaaaaacagtt

SEQ ID NO: 216824 - DNA, 16 bp, P. troglodytes
attttaaaaaaccatt

SEQ ID NO: 216825 - DNA, 16 bp, P. troglodytes
attttaaaaaatcagt

SEQ ID NO: 216826 - DNA, 16 bp, P. troglodytes
attttaaaaacagaat

SEQ ID NO: 216827 - DNA, 16 bp, P. troglodytes
attttaaaaaccacca

SEQ ID NO: 216828 - DNA, 16 bp, P. troglodytes
attttaaaaagaaaca

SEQ ID NO: 216829 - DNA, 16 bp, P. troglodytes
attttaaaaagaagca

SEQ ID NO: 216830 - DNA, 16 bp, P. troglodytes
attttaaaaagacaaa

SEQ ID NO: 216831 - DNA, 16 bp, P. troglodytes
attttaaaaagcattt

SEQ ID NO: 216832 - DNA, 16 bp, P. troglodytes
attttaaaaagtcaca

SEQ ID NO: 216833 - DNA, 16 bp, P. troglodytes
attttaaaaagtgata

SEQ ID NO: 216834 - DNA, 16 bp, P. troglodytes
attttaaaaatacctt

SEQ ID NO: 216835 - DNA, 16 bp, P. troglodytes
attttaaaaatggaat

SEQ ID NO: 216836 - DNA, 16 bp, P. troglodytes
attttaaaaattcctt

SEQ ID NO: 216837 - DNA, 16 bp, P. troglodytes
attttaaaacagttaa

SEQ ID NO: 216838 - DNA, 16 bp, P. troglodytes
attttaaaacatgatt

SEQ ID NO: 216839 - DNA, 16 bp, P. troglodytes
attttaaaactctatt

SEQ ID NO: 216840 - DNA, 16 bp, P. troglodytes
attttaaaacttcaaa

SEQ ID NO: 216841 - DNA, 16 bp, P. troglodytes
attttaaaagagagaa

SEQ ID NO: 216842 - DNA, 16 bp, P. troglodytes
attttaaaagatgcaa

SEQ ID NO: 216843 - DNA, 16 bp, P. troglodytes
attttaaaagatttca

SEQ ID NO: 216844 - DNA, 16 bp, P. troglodytes
attttaaaagcaatta

SEQ ID NO: 216845 - DNA, 16 bp, P. troglodytes
attttaaaagcagttt

SEQ ID NO: 216846 - DNA, 16 bp, P. troglodytes
attttaaaagccaaaa

SEQ ID NO: 216847 - DNA, 16 bp, P. troglodytes
attttaaaagctataa

SEQ ID NO: 216848 - DNA, 16 bp, P. troglodytes
attttaaaaggatgaa

SEQ ID NO: 216849 - DNA, 16 bp, P. troglodytes
attttaaaaggggaaa

SEQ ID NO: 216850 - DNA, 16 bp, P. troglodytes
attttaaaaggttaaa

SEQ ID NO: 216851 - DNA, 16 bp, P. troglodytes
attttaaaagtagttt

SEQ ID NO: 216852 - DNA, 16 bp, P. troglodytes
attttaaaagtttaca

SEQ ID NO: 216853 - DNA, 16 bp, P. troglodytes
attttaaaataaagca

SEQ ID NO: 216854 - DNA, 16 bp, P. troglodytes
attttaaaatatcagt

SEQ ID NO: 216855 - DNA, 16 bp, P. troglodytes
attttaaaatatgcaa

SEQ ID NO: 216856 - DNA, 16 bp, P. troglodytes
attttaaaatctacct

SEQ ID NO: 216857 - DNA, 16 bp, P. troglodytes
attttaaaatgcatat

SEQ ID NO: 216858 - DNA, 16 bp, P. troglodytes
attttaaaatggaata

SEQ ID NO: 216859 - DNA, 16 bp, P. troglodytes
attttaaaatgtatgt

SEQ ID NO: 216860 - DNA, 16 bp, P. troglodytes
attttaaaatgtgaca

SEQ ID NO: 216861 - DNA, 16 bp, P. troglodytes
attttaaaatgtgcta

SEQ ID NO: 216862 - DNA, 16 bp, P. troglodytes
attttaaaattcagaa

SEQ ID NO: 216863 - DNA, 16 bp, P. troglodytes
attttaaaattctgta

SEQ ID NO: 216864 - DNA, 16 bp, P. troglodytes
attttaaaattctgtg

SEQ ID NO: 216865 - DNA, 16 bp, P. troglodytes
attttaaaattgtctt

SEQ ID NO: 216866 - DNA, 16 bp, P. troglodytes
attttaaaattttgct

SEQ ID NO: 216867 - DNA, 16 bp, P. troglodytes
attttaaacatggaaa

SEQ ID NO: 216868 - DNA, 16 bp, P. troglodytes
attttaaagaaaaacc

SEQ ID NO: 216869 - DNA, 16 bp, P. troglodytes
attttaaagaaattga

SEQ ID NO: 216870 - DNA, 16 bp, P. troglodytes
attttaaagaactcaa

SEQ ID NO: 216871 - DNA, 16 bp, P. troglodytes
attttaaagaataaca

SEQ ID NO: 216872 - DNA, 16 bp, P. troglodytes
attttaaagacaaaga

SEQ ID NO: 216873 - DNA, 16 bp, P. troglodytes
attttaaagataatgt

SEQ ID NO: 216874 - DNA, 16 bp, P. troglodytes
attttaaagcagccat

SEQ ID NO: 216875 - DNA, 16 bp, P. troglodytes
attttaaagctgggca

SEQ ID NO: 216876 - DNA, 16 bp, P. troglodytes
attttaaaggtattat

SEQ ID NO: 216877 - DNA, 16 bp, P. troglodytes
attttaaagtaaacat

SEQ ID NO: 216878 - DNA, 16 bp, P. troglodytes
attttaaagtacacaa

SEQ ID NO: 216879 - DNA, 16 bp, P. troglodytes
attttaaagtactttt

SEQ ID NO: 216880 - DNA, 16 bp, P. troglodytes
attttaaagtgaaatt

SEQ ID NO: 216881 - DNA, 16 bp, P. troglodytes
attttaaagttgaaaa

SEQ ID NO: 216882 - DNA, 16 bp, P. troglodytes
attttaaataaagaca

SEQ ID NO: 216883 - DNA, 16 bp, P. troglodytes
attttaaatactgttt

SEQ ID NO: 216884 - DNA, 16 bp, P. troglodytes
attttaaatatcagaa

SEQ ID NO: 216885 - DNA, 16 bp, P. troglodytes
attttaaatatgaaga

SEQ ID NO: 216886 - DNA, 16 bp, P. troglodytes
attttaaatatgtgaa

SEQ ID NO: 216887 - DNA, 16 bp, P. troglodytes
attttaaatattctca

SEQ ID NO: 216888 - DNA, 16 bp, P. troglodytes
attttaaatgaaaaca

SEQ ID NO: 216889 - DNA, 16 bp, P. troglodytes
attttaaatgctgaaa

SEQ ID NO: 216890 - DNA, 16 bp, P. troglodytes
attttaaatgcttatt

SEQ ID NO: 216891 - DNA, 16 bp, P. troglodytes
attttaaatgcttttt

SEQ ID NO: 216892 - DNA, 16 bp, P. troglodytes
attttaaatgtaaatg

SEQ ID NO: 216893 - DNA, 16 bp, P. troglodytes
attttaaatgtgtaca

SEQ ID NO: 216894 - DNA, 16 bp, P. troglodytes
attttaaatgtgttca

SEQ ID NO: 216895 - DNA, 16 bp, P. troglodytes
attttaaatgttcaca

SEQ ID NO: 216896 - DNA, 16 bp, P. troglodytes
attttaaatgttcata

SEQ ID NO: 216897 - DNA, 16 bp, P. troglodytes
attttaaatgttcttt

SEQ ID NO: 216898 - DNA, 16 bp, P. troglodytes
attttaaatttactga

SEQ ID NO: 216899 - DNA, 16 bp, P. troglodytes
attttaacaaatgtac

SEQ ID NO: 216900 - DNA, 16 bp, P. troglodytes
attttaacaccaaaaa

SEQ ID NO: 216901 - DNA, 16 bp, P. troglodytes
attttaacagagagaa

SEQ ID NO: 216902 - DNA, 16 bp, P. troglodytes
attttaactggagtaa

SEQ ID NO: 216903 - DNA, 16 bp, P. troglodytes
attttaactggggtga

SEQ ID NO: 216904 - DNA, 16 bp, P. troglodytes
attttaagaaaaacaa

SEQ ID NO: 216905 - DNA, 16 bp, P. troglodytes
attttaagaaaacttt

SEQ ID NO: 216906 - DNA, 16 bp, P. troglodytes
attttaagaaataatg

SEQ ID NO: 216907 - DNA, 16 bp, P. troglodytes
attttaagaaatgttt

SEQ ID NO: 216908 - DNA, 16 bp, P. troglodytes
attttaagaagaaaag

SEQ ID NO: 216909 - DNA, 16 bp, P. troglodytes
attttaagaagcaaaa

SEQ ID NO: 216910 - DNA, 16 bp, P. troglodytes
attttaagaaggaaaa

SEQ ID NO: 216911 - DNA, 16 bp, P. troglodytes
attttaagacattttt

SEQ ID NO: 216912 - DNA, 16 bp, P. troglodytes
attttaagacttatta

SEQ ID NO: 216913 - DNA, 16 bp, P. troglodytes
attttaagacttttaa

SEQ ID NO: 216914 - DNA, 16 bp, P. troglodytes
attttaagatgaggaa

SEQ ID NO: 216915 - DNA, 16 bp, P. troglodytes
attttaagatggagtc

SEQ ID NO: 216916 - DNA, 16 bp, P. troglodytes
attttaagattttctt

SEQ ID NO: 216917 - DNA, 16 bp, P. troglodytes
attttaagcatttaaa

SEQ ID NO: 216918 - DNA, 16 bp, P. troglodytes
attttaagtaaacaaa

SEQ ID NO: 216919 - DNA, 16 bp, P. troglodytes
attttaagtggatttt

SEQ ID NO: 216920 - DNA, 16 bp, P. troglodytes
attttaagtttgaaaa

SEQ ID NO: 216921 - DNA, 16 bp, P. troglodytes
attttaataaacagaa

SEQ ID NO: 216922 - DNA, 16 bp, P. troglodytes
attttaatagagattg

SEQ ID NO: 216923 - DNA, 16 bp, P. troglodytes
attttaatataccaaa

SEQ ID NO: 216924 - DNA, 16 bp, P. troglodytes
attttaatgatttttc

SEQ ID NO: 216925 - DNA, 16 bp, P. troglodytes
attttaatgcaaaata

SEQ ID NO: 216926 - DNA, 16 bp, P. troglodytes
attttaatgcacattt

SEQ ID NO: 216927 - DNA, 16 bp, P. troglodytes
attttaatggctatat

SEQ ID NO: 216928 - DNA, 16 bp, P. troglodytes
attttaatgggaaaat

SEQ ID NO: 216929 - DNA, 16 bp, P. troglodytes
attttaatgtctttct

SEQ ID NO: 216930 - DNA, 16 bp, P. troglodytes
attttaatgtgaaaat

SEQ ID NO: 216931 - DNA, 16 bp, P. troglodytes
attttaatgtttgaaa

SEQ ID NO: 216932 - DNA, 16 bp, P. troglodytes
attttaatgttttcat

SEQ ID NO: 216933 - DNA, 16 bp, P. troglodytes
attttaattcagtttt

SEQ ID NO: 216934 - DNA, 16 bp, P. troglodytes
attttaattgcaaaaa

SEQ ID NO: 216935 - DNA, 16 bp, P. troglodytes
attttaatttctgtgt

SEQ ID NO: 216936 - DNA, 16 bp, P. troglodytes
attttaatttgcttta

SEQ ID NO: 216937 - DNA, 16 bp, P. troglodytes
attttaattttagaga

SEQ ID NO: 216938 - DNA, 16 bp, P. troglodytes
attttaattttgcatt

SEQ ID NO: 216939 - DNA, 16 bp, P. troglodytes
attttaatttttgaca

SEQ ID NO: 216940 - DNA, 16 bp, P. troglodytes
attttacaaaagagaa

SEQ ID NO: 216941 - DNA, 16 bp, P. troglodytes
attttacaaaagagga

SEQ ID NO: 216942 - DNA, 16 bp, P. troglodytes
attttacaaagaaaaa

SEQ ID NO: 216943 - DNA, 16 bp, P. troglodytes
attttacaaagatttt

SEQ ID NO: 216944 - DNA, 16 bp, P. troglodytes
attttacaaataatga

SEQ ID NO: 216945 - DNA, 16 bp, P. troglodytes
attttacaaataggaa

SEQ ID NO: 216946 - DNA, 16 bp, P. troglodytes
attttacaaatgagca

SEQ ID NO: 216947 - DNA, 16 bp, P. troglodytes
attttacaaatgtaaa

SEQ ID NO: 216948 - DNA, 16 bp, P. troglodytes
attttacaagaaaaat

SEQ ID NO: 216949 - DNA, 16 bp, P. troglodytes
attttacaagaaaatg

SEQ ID NO: 216950 - DNA, 16 bp, P. troglodytes
attttacaagtgagaa

SEQ ID NO: 216951 - DNA, 16 bp, P. troglodytes
attttacaatgaaaaa

SEQ ID NO: 216952 - DNA, 16 bp, P. troglodytes
attttacacacacaca

SEQ ID NO: 216953 - DNA, 16 bp, P. troglodytes
attttacagaaaataa

SEQ ID NO: 216954 - DNA, 16 bp, P. troglodytes
attttacagaagaaac

SEQ ID NO: 216955 - DNA, 16 bp, P. troglodytes
attttacagaatgctg

SEQ ID NO: 216956 - DNA, 16 bp, P. troglodytes
attttacagagtactg

SEQ ID NO: 216957 - DNA, 16 bp, P. troglodytes
attttacagagtttaa

SEQ ID NO: 216958 - DNA, 16 bp, P. troglodytes
attttacagatgaaaa

SEQ ID NO: 216959 - DNA, 16 bp, P. troglodytes
attttacagatttaaa

SEQ ID NO: 216960 - DNA, 16 bp, P. troglodytes
attttacatgcatttt

SEQ ID NO: 216961 - DNA, 16 bp, P. troglodytes
attttacatgtaaata

SEQ ID NO: 216962 - DNA, 16 bp, P. troglodytes
attttacatgtatttt

SEQ ID NO: 216963 - DNA, 16 bp, P. troglodytes
attttacatttcaaaa

SEQ ID NO: 216964 - DNA, 16 bp, P. troglodytes
attttacatttctacc

SEQ ID NO: 216965 - DNA, 16 bp, P. troglodytes
attttaccaaaaatat

SEQ ID NO: 216966 - DNA, 16 bp, P. troglodytes
attttaccaaacattt

SEQ ID NO: 216967 - DNA, 16 bp, P. troglodytes
attttaccaacaattt

SEQ ID NO: 216968 - DNA, 16 bp, P. troglodytes
attttaccaagacttt

SEQ ID NO: 216969 - DNA, 16 bp, P. troglodytes
attttaccaaggtttt

SEQ ID NO: 216970 - DNA, 16 bp, P. troglodytes
attttaccaatattaa

SEQ ID NO: 216971 - DNA, 16 bp, P. troglodytes
attttacccattttaa

SEQ ID NO: 216972 - DNA, 16 bp, P. troglodytes
attttaccttcattat

SEQ ID NO: 216973 - DNA, 16 bp, P. troglodytes
attttactaaagaaga

SEQ ID NO: 216974 - DNA, 16 bp, P. troglodytes
attttactacataaaa

SEQ ID NO: 216975 - DNA, 16 bp, P. troglodytes
attttactacttaaaa

SEQ ID NO: 216976 - DNA, 16 bp, P. troglodytes
attttactagagatgg

SEQ ID NO: 216977 - DNA, 16 bp, P. troglodytes
attttactccagcctg

SEQ ID NO: 216978 - DNA, 16 bp, P. troglodytes
attttactgaaataaa

SEQ ID NO: 216979 - DNA, 16 bp, P. troglodytes
attttactgatataaa

SEQ ID NO: 216980 - DNA, 16 bp, P. troglodytes
attttactgatgaaga

SEQ ID NO: 216981 - DNA, 16 bp, P. troglodytes
attttactgtttaaaa

SEQ ID NO: 216982 - DNA, 16 bp, P. troglodytes
attttacttaggataa

SEQ ID NO: 216983 - DNA, 16 bp, P. troglodytes
attttactttgtaatt

SEQ ID NO: 216984 - DNA, 16 bp, P. troglodytes
attttacttttgaaat

SEQ ID NO: 216985 - DNA, 16 bp, P. troglodytes
attttacttttgtaaa

SEQ ID NO: 216986 - DNA, 16 bp, P. troglodytes
attttagaaaaacaaa

SEQ ID NO: 216987 - DNA, 16 bp, P. troglodytes
attttagaaaaagaag

SEQ ID NO: 216988 - DNA, 16 bp, P. troglodytes
attttagaaaatcaaa

SEQ ID NO: 216989 - DNA, 16 bp, P. troglodytes
attttagaaagagaaa

SEQ ID NO: 216990 - DNA, 16 bp, P. troglodytes
attttagaaatacatt

SEQ ID NO: 216991 - DNA, 16 bp, P. troglodytes
attttagaaattcttt

SEQ ID NO: 216992 - DNA, 16 bp, P. troglodytes
attttagaacaatttt

SEQ ID NO: 216993 - DNA, 16 bp, P. troglodytes
attttagaataaaatg

SEQ ID NO: 216994 - DNA, 16 bp, P. troglodytes
attttagaataagtat

SEQ ID NO: 216995 - DNA, 16 bp, P. troglodytes
attttagaattgaaaa

SEQ ID NO: 216996 - DNA, 16 bp, P. troglodytes
attttagacttgccag

SEQ ID NO: 216997 - DNA, 16 bp, P. troglodytes
attttagactttaaaa

SEQ ID NO: 216998 - DNA, 16 bp, P. troglodytes
attttagagaaaacaa

SEQ ID NO: 216999 - DNA, 16 bp, P. troglodytes
attttagagaaaagaa

SEQ ID NO: 217000 - DNA, 16 bp, P. troglodytes
attttagagatgagaa

SEQ ID NO: 217001 - DNA, 16 bp, P. troglodytes
attttagagctggaag

SEQ ID NO: 217002 - DNA, 16 bp, P. troglodytes
attttagaggaaaagc

SEQ ID NO: 217003 - DNA, 16 bp, P. troglodytes
attttagcaattttaa

SEQ ID NO: 217004 - DNA, 16 bp, P. troglodytes
attttagcactgaata

SEQ ID NO: 217005 - DNA, 16 bp, P. troglodytes
attttagccattctaa

SEQ ID NO: 217006 - DNA, 16 bp, P. troglodytes
attttagccattctag

SEQ ID NO: 217007 - DNA, 16 bp, P. troglodytes
attttaggatattttc

SEQ ID NO: 217008 - DNA, 16 bp, P. troglodytes
attttaggatttcttt

SEQ ID NO: 217009 - DNA, 16 bp, P. troglodytes
attttaggccaggagt

SEQ ID NO: 217010 - DNA, 16 bp, P. troglodytes
attttagggaaaaaaa

SEQ ID NO: 217011 - DNA, 16 bp, P. troglodytes
attttagtcatgaaat

SEQ ID NO: 217012 - DNA, 16 bp, P. troglodytes
attttagtgctataaa

SEQ ID NO: 217013 - DNA, 16 bp, P. troglodytes
attttagttttctcat

SEQ ID NO: 217014 - DNA, 16 bp, P. troglodytes
attttataaaatgcat

SEQ ID NO: 217015 - DNA, 16 bp, P. troglodytes
attttataaacaaaga

SEQ ID NO: 217016 - DNA, 16 bp, P. troglodytes
attttataaacactgt

SEQ ID NO: 217017 - DNA, 16 bp, P. troglodytes
attttataaatgtctt

SEQ ID NO: 217018 - DNA, 16 bp, P. troglodytes
attttataatgatgaa

SEQ ID NO: 217019 - DNA, 16 bp, P. troglodytes
attttataattgagaa

SEQ ID NO: 217020 - DNA, 16 bp, P. troglodytes
attttatacataaaga

SEQ ID NO: 217021 - DNA, 16 bp, P. troglodytes
attttatacatacaca

SEQ ID NO: 217022 - DNA, 16 bp, P. troglodytes
attttatacattttag

SEQ ID NO: 217023 - DNA, 16 bp, P. troglodytes
attttatacttgaaaa

SEQ ID NO: 217024 - DNA, 16 bp, P. troglodytes
attttatagataaaga

SEQ ID NO: 217025 - DNA, 16 bp, P. troglodytes
attttatagcatttat

SEQ ID NO: 217026 - DNA, 16 bp, P. troglodytes
attttatatacatgta

SEQ ID NO: 217027 - DNA, 16 bp, P. troglodytes
attttatatccagaaa

SEQ ID NO: 217028 - DNA, 16 bp, P. troglodytes
attttatatgaacttt

SEQ ID NO: 217029 - DNA, 16 bp, P. troglodytes
attttatatgaagata

SEQ ID NO: 217030 - DNA, 16 bp, P. troglodytes
attttatatgattcca

SEQ ID NO: 217031 - DNA, 16 bp, P. troglodytes
attttatatggaaaaa

SEQ ID NO: 217032 - DNA, 16 bp, P. troglodytes
attttatatgtagaaa

SEQ ID NO: 217033 - DNA, 16 bp, P. troglodytes
attttatattaatgga

SEQ ID NO: 217034 - DNA, 16 bp, P. troglodytes
attttatattctgaaa

SEQ ID NO: 217035 - DNA, 16 bp, P. troglodytes
attttatattctgtgt

SEQ ID NO: 217036 - DNA, 16 bp, P. troglodytes
attttatatttcagat

SEQ ID NO: 217037 - DNA, 16 bp, P. troglodytes
attttatatttgacaa

SEQ ID NO: 217038 - DNA, 16 bp, P. troglodytes
attttatatttgagtg

SEQ ID NO: 217039 - DNA, 16 bp, P. troglodytes
attttatcacattttc

SEQ ID NO: 217040 - DNA, 16 bp, P. troglodytes
attttatcagcatttt

SEQ ID NO: 217041 - DNA, 16 bp, P. troglodytes
attttatcatgtatat

SEQ ID NO: 217042 - DNA, 16 bp, P. troglodytes
attttatcattatgta

SEQ ID NO: 217043 - DNA, 16 bp, P. troglodytes
attttatcatttgtaa

SEQ ID NO: 217044 - DNA, 16 bp, P. troglodytes
attttatcttcaaaaa

SEQ ID NO: 217045 - DNA, 16 bp, P. troglodytes
attttatcttgaaaaa

SEQ ID NO: 217046 - DNA, 16 bp, P. troglodytes
attttatcttttgaaa

SEQ ID NO: 217047 - DNA, 16 bp, P. troglodytes
attttatgaaaaaatg

SEQ ID NO: 217048 - DNA, 16 bp, P. troglodytes
attttatgaaaatgga

SEQ ID NO: 217049 - DNA, 16 bp, P. troglodytes
attttatgacaagaat

SEQ ID NO: 217050 - DNA, 16 bp, P. troglodytes
attttatgactttatt

SEQ ID NO: 217051 - DNA, 16 bp, P. troglodytes
attttatgcaaatata

SEQ ID NO: 217052 - DNA, 16 bp, P. troglodytes
attttatgcaatattt

SEQ ID NO: 217053 - DNA, 16 bp, P. troglodytes
attttatgcatgtatc

SEQ ID NO: 217054 - DNA, 16 bp, P. troglodytes
attttatgcatttata

SEQ ID NO: 217055 - DNA, 16 bp, P. troglodytes
attttatgcttaaaaa

SEQ ID NO: 217056 - DNA, 16 bp, P. troglodytes
attttatggaagagaa

SEQ ID NO: 217057 - DNA, 16 bp, P. troglodytes
attttatggatgaaga

SEQ ID NO: 217058 - DNA, 16 bp, P. troglodytes
attttatggatgagga

SEQ ID NO: 217059 - DNA, 16 bp, P. troglodytes
attttatgtaattttc

SEQ ID NO: 217060 - DNA, 16 bp, P. troglodytes
attttatgtcatgtat

SEQ ID NO: 217061 - DNA, 16 bp, P. troglodytes
attttatgtgtataaa

SEQ ID NO: 217062 - DNA, 16 bp, P. troglodytes
attttatgtgtcaaat

SEQ ID NO: 217063 - DNA, 16 bp, P. troglodytes
attttatgtgtgtgta

SEQ ID NO: 217064 - DNA, 16 bp, P. troglodytes
attttattaaaatgca

SEQ ID NO: 217065 - DNA, 16 bp, P. troglodytes
attttattaaatgcat

SEQ ID NO: 217066 - DNA, 16 bp, P. troglodytes
attttattacagaaat

SEQ ID NO: 217067 - DNA, 16 bp, P. troglodytes
attttattatttcaag

SEQ ID NO: 217068 - DNA, 16 bp, P. troglodytes
attttattcattagaa

SEQ ID NO: 217069 - DNA, 16 bp, P. troglodytes
attttattcccaaata

SEQ ID NO: 217070 - DNA, 16 bp, P. troglodytes
attttattgaaagaaa

SEQ ID NO: 217071 - DNA, 16 bp, P. troglodytes
attttattgagtgatg

SEQ ID NO: 217072 - DNA, 16 bp, P. troglodytes
attttattgatgaaaa

SEQ ID NO: 217073 - DNA, 16 bp, P. troglodytes
attttattggcatttt

SEQ ID NO: 217074 - DNA, 16 bp, P. troglodytes
attttattgtgaaaaa

SEQ ID NO: 217075 - DNA, 16 bp, P. troglodytes
attttattgttcatat

SEQ ID NO: 217076 - DNA, 16 bp, P. troglodytes
attttatttaacccag

SEQ ID NO: 217077 - DNA, 16 bp, P. troglodytes
attttatttacaatag

SEQ ID NO: 217078 - DNA, 16 bp, P. troglodytes
attttatttaccaaaa

SEQ ID NO: 217079 - DNA, 16 bp, P. troglodytes
attttatttagcattt

SEQ ID NO: 217080 - DNA, 16 bp, P. troglodytes
attttatttcagaatt

SEQ ID NO: 217081 - DNA, 16 bp, P. troglodytes
attttatttccaaaaa

SEQ ID NO: 217082 - DNA, 16 bp, P. troglodytes
attttatttccaactt

SEQ ID NO: 217083 - DNA, 16 bp, P. troglodytes
attttatttctccatc

SEQ ID NO: 217084 - DNA, 16 bp, P. troglodytes
attttatttgaacaaa

SEQ ID NO: 217085 - DNA, 16 bp, P. troglodytes
attttatttgaagaaa

SEQ ID NO: 217086 - DNA, 16 bp, P. troglodytes
attttatttgcaaaat

SEQ ID NO: 217087 - DNA, 16 bp, P. troglodytes
attttatttggagaaa

SEQ ID NO: 217088 - DNA, 16 bp, P. troglodytes
attttatttggcattt

SEQ ID NO: 217089 - DNA, 16 bp, P. troglodytes
attttatttgtagcta

SEQ ID NO: 217090 - DNA, 16 bp, P. troglodytes
attttatttgtgagaa

SEQ ID NO: 217091 - DNA, 16 bp, P. troglodytes
attttattttactgaa

SEQ ID NO: 217092 - DNA, 16 bp, P. troglodytes
attttattttcaagat

SEQ ID NO: 217093 - DNA, 16 bp, P. troglodytes
attttattttctctag

SEQ ID NO: 217094 - DNA, 16 bp, P. troglodytes
attttattttgtagct

SEQ ID NO: 217095 - DNA, 16 bp, P. troglodytes
attttatttttacaga

SEQ ID NO: 217096 - DNA, 16 bp, P. troglodytes
attttcaaaaaagaaa

SEQ ID NO: 217097 - DNA, 16 bp, P. troglodytes
attttcaaaaactatt

SEQ ID NO: 217098 - DNA, 16 bp, P. troglodytes
attttcaaaaagataa

SEQ ID NO: 217099 - DNA, 16 bp, P. troglodytes
attttcaaaaatcatt

SEQ ID NO: 217100 - DNA, 16 bp, P. troglodytes
attttcaaaacattta

SEQ ID NO: 217101 - DNA, 16 bp, P. troglodytes
attttcaaaaggaaaa

SEQ ID NO: 217102 - DNA, 16 bp, P. troglodytes
attttcaaaagtcaaa

SEQ ID NO: 217103 - DNA, 16 bp, P. troglodytes
attttcaaaataaagt

SEQ ID NO: 217104 - DNA, 16 bp, P. troglodytes
attttcaaaatggaaa

SEQ ID NO: 217105 - DNA, 16 bp, P. troglodytes
attttcaaacattaaa

SEQ ID NO: 217106 - DNA, 16 bp, P. troglodytes
attttcaaactacaga

SEQ ID NO: 217107 - DNA, 16 bp, P. troglodytes
attttcaaactgaaaa

SEQ ID NO: 217108 - DNA, 16 bp, P. troglodytes
attttcaaagaaaaca

SEQ ID NO: 217109 - DNA, 16 bp, P. troglodytes
attttcaaagaaaact

SEQ ID NO: 217110 - DNA, 16 bp, P. troglodytes
attttcaaaggaaata

SEQ ID NO: 217111 - DNA, 16 bp, P. troglodytes
attttcaaataaaatg

SEQ ID NO: 217112 - DNA, 16 bp, P. troglodytes
attttcaaatatatga

SEQ ID NO: 217113 - DNA, 16 bp, P. troglodytes
attttcaaatatatgt

SEQ ID NO: 217114 - DNA, 16 bp, P. troglodytes
attttcaaatgatttt

SEQ ID NO: 217115 - DNA, 16 bp, P. troglodytes
attttcaaatgcaaat

SEQ ID NO: 217116 - DNA, 16 bp, P. troglodytes
attttcaaattgaatt

SEQ ID NO: 217117 - DNA, 16 bp, P. troglodytes
attttcaacaagagtg

SEQ ID NO: 217118 - DNA, 16 bp, P. troglodytes
attttcaacacagaat

SEQ ID NO: 217119 - DNA, 16 bp, P. troglodytes
attttcaagaatacaa

SEQ ID NO: 217120 - DNA, 16 bp, P. troglodytes
attttcaagacatttt

SEQ ID NO: 217121 - DNA, 16 bp, P. troglodytes
attttcaagtttaaaa

SEQ ID NO: 217122 - DNA, 16 bp, P. troglodytes
attttcaataaaatgt

SEQ ID NO: 217123 - DNA, 16 bp, P. troglodytes
attttcaatgatattt

SEQ ID NO: 217124 - DNA, 16 bp, P. troglodytes
attttcaatgtttatt

SEQ ID NO: 217125 - DNA, 16 bp, P. troglodytes
attttcacaaactgaa

SEQ ID NO: 217126 - DNA, 16 bp, P. troglodytes
attttcacagtattga

SEQ ID NO: 217127 - DNA, 16 bp, P. troglodytes
attttcacattcattt

SEQ ID NO: 217128 - DNA, 16 bp, P. troglodytes
attttcacatttaaat

SEQ ID NO: 217129 - DNA, 16 bp, P. troglodytes
attttcaccaacactt

SEQ ID NO: 217130 - DNA, 16 bp, P. troglodytes
attttcagaaaaacaa

SEQ ID NO: 217131 - DNA, 16 bp, P. troglodytes
attttcagaaagaaaa

SEQ ID NO: 217132 - DNA, 16 bp, P. troglodytes
attttcagaaattatt

SEQ ID NO: 217133 - DNA, 16 bp, P. troglodytes
attttcagaagaaaaa

SEQ ID NO: 217134 - DNA, 16 bp, P. troglodytes
attttcagaagaaata

SEQ ID NO: 217135 - DNA, 16 bp, P. troglodytes
attttcagaagaggaa

SEQ ID NO: 217136 - DNA, 16 bp, P. troglodytes
attttcagaatggtaa

SEQ ID NO: 217137 - DNA, 16 bp, P. troglodytes
attttcagacaaaaaa

SEQ ID NO: 217138 - DNA, 16 bp, P. troglodytes
attttcagaccacagt

SEQ ID NO: 217139 - DNA, 16 bp, P. troglodytes
attttcagaggaaaaa

SEQ ID NO: 217140 - DNA, 16 bp, P. troglodytes
attttcagatatgttc

SEQ ID NO: 217141 - DNA, 16 bp, P. troglodytes
attttcagatattttc

SEQ ID NO: 217142 - DNA, 16 bp, P. troglodytes
attttcagatattttt

SEQ ID NO: 217143 - DNA, 16 bp, P. troglodytes
attttcagatgaagaa

SEQ ID NO: 217144 - DNA, 16 bp, P. troglodytes
attttcagatttggga

SEQ ID NO: 217145 - DNA, 16 bp, P. troglodytes
attttcagatttttaa

SEQ ID NO: 217146 - DNA, 16 bp, P. troglodytes
attttcagcagagacg

SEQ ID NO: 217147 - DNA, 16 bp, P. troglodytes
attttcagcttctctg

SEQ ID NO: 217148 - DNA, 16 bp, P. troglodytes
attttcagctttaaaa

SEQ ID NO: 217149 - DNA, 16 bp, P. troglodytes
attttcagctttgcag

SEQ ID NO: 217150 - DNA, 16 bp, P. troglodytes
attttcagctttgtgg

SEQ ID NO: 217151 - DNA, 16 bp, P. troglodytes
attttcagcttttaaa

SEQ ID NO: 217152 - DNA, 16 bp, P. troglodytes
attttcaggaaaaaaa

SEQ ID NO: 217153 - DNA, 16 bp, P. troglodytes
attttcaggaagaaaa

SEQ ID NO: 217154 - DNA, 16 bp, P. troglodytes
attttcaggaatttat

SEQ ID NO: 217155 - DNA, 16 bp, P. troglodytes
attttcaggattttga

SEQ ID NO: 217156 - DNA, 17 bp, P. troglodytes
attttcagggaacaagg

SEQ ID NO: 217157 - DNA, 16 bp, P. troglodytes
attttcagttgatttt

SEQ ID NO: 217158 - DNA, 16 bp, P. troglodytes
attttcagtttctatt

SEQ ID NO: 217159 - DNA, 16 bp, P. troglodytes
attttcagtttttaaa

SEQ ID NO: 217160 - DNA, 16 bp, P. troglodytes
attttcagtttttaat

SEQ ID NO: 217161 - DNA, 16 bp, P. troglodytes
attttcagtttttact

SEQ ID NO: 217162 - DNA, 16 bp, P. troglodytes
attttcagtttttcct

SEQ ID NO: 217163 - DNA, 16 bp, P. troglodytes
attttcataaagtgaa

SEQ ID NO: 217164 - DNA, 16 bp, P. troglodytes
attttcataagacatt

SEQ ID NO: 217165 - DNA, 16 bp, P. troglodytes
attttcataagtaaca

SEQ ID NO: 217166 - DNA, 16 bp, P. troglodytes
attttcatactgctga

SEQ ID NO: 217167 - DNA, 16 bp, P. troglodytes
attttcatcaggaata

SEQ ID NO: 217168 - DNA, 16 bp, P. troglodytes
attttcatcatcccaa

SEQ ID NO: 217169 - DNA, 16 bp, P. troglodytes
attttcatctataaaa

SEQ ID NO: 217170 - DNA, 16 bp, P. troglodytes
attttcatgctgctaa

SEQ ID NO: 217171 - DNA, 16 bp, P. troglodytes
attttcatgtaaaata

SEQ ID NO: 217172 - DNA, 16 bp, P. troglodytes
attttcatgtgcttat

SEQ ID NO: 217173 - DNA, 16 bp, P. troglodytes
attttcattccaaaag

SEQ ID NO: 217174 - DNA, 16 bp, P. troglodytes
attttcattcccacca

SEQ ID NO: 217175 - DNA, 16 bp, P. troglodytes
attttcatttaattgt

SEQ ID NO: 217176 - DNA, 16 bp, P. troglodytes
attttcatttagttaa

SEQ ID NO: 217177 - DNA, 16 bp, P. troglodytes
attttcatttccaaaa

SEQ ID NO: 217178 - DNA, 16 bp, P. troglodytes
attttcatttctaaca

SEQ ID NO: 217179 - DNA, 16 bp, P. troglodytes
attttcatttctagaa

SEQ ID NO: 217180 - DNA, 16 bp, P. troglodytes
attttcatttgctaaa

SEQ ID NO: 217181 - DNA, 16 bp, P. troglodytes
attttcattttaagtt

SEQ ID NO: 217182 - DNA, 16 bp, P. troglodytes
attttcattttagaaa

SEQ ID NO: 217183 - DNA, 16 bp, P. troglodytes
attttcattttcctaa

SEQ ID NO: 217184 - DNA, 16 bp, P. troglodytes
attttcatttttgaaa

SEQ ID NO: 217185 - DNA, 16 bp, P. troglodytes
attttccaaaaatgtt

SEQ ID NO: 217186 - DNA, 16 bp, P. troglodytes
attttccaaaatgaat

SEQ ID NO: 217187 - DNA, 16 bp, P. troglodytes
attttccaaagaaaat

SEQ ID NO: 217188 - DNA, 16 bp, P. troglodytes
attttccaaatgtttt

SEQ ID NO: 217189 - DNA, 16 bp, P. troglodytes
attttccacaataaaa

SEQ ID NO: 217190 - DNA, 16 bp, P. troglodytes
attttccacaatttca

SEQ ID NO: 217191 - DNA, 16 bp, P. troglodytes
attttccacattttct

SEQ ID NO: 217192 - DNA, 16 bp, P. troglodytes
attttccaggctggtc

SEQ ID NO: 217193 - DNA, 16 bp, P. troglodytes
attttccagtcttttt

SEQ ID NO: 217194 - DNA, 16 bp, P. troglodytes
attttccagtttattt

SEQ ID NO: 217195 - DNA, 16 bp, P. troglodytes
attttccataataaaa

SEQ ID NO: 217196 - DNA, 16 bp, P. troglodytes
attttccatttgcttt

SEQ ID NO: 217197 - DNA, 16 bp, P. troglodytes
attttccatttttgaa

SEQ ID NO: 217198 - DNA, 16 bp, P. troglodytes
attttcccaacacaaa

SEQ ID NO: 217199 - DNA, 16 bp, P. troglodytes
attttcccaatattga

SEQ ID NO: 217200 - DNA, 18 bp, P. troglodytes
attttcccagcaccattt

SEQ ID NO: 217201 - DNA, 16 bp, P. troglodytes
attttcccatctgtaa

SEQ ID NO: 217202 - DNA, 16 bp, P. troglodytes
attttcccatttatta

SEQ ID NO: 217203 - DNA, 16 bp, P. troglodytes
attttcccatttttaa

SEQ ID NO: 217204 - DNA, 16 bp, P. troglodytes
attttccccaaattga

SEQ ID NO: 217205 - DNA, 16 bp, P. troglodytes
attttcctaaaaataa

SEQ ID NO: 217206 - DNA, 16 bp, P. troglodytes
attttcctgcttcttt

SEQ ID NO: 217207 - DNA, 16 bp, P. troglodytes
attttcctgtcctctt

SEQ ID NO: 217208 - DNA, 16 bp, P. troglodytes
attttccttaaaaaat

SEQ ID NO: 217209 - DNA, 16 bp, P. troglodytes
attttccttatccaat

SEQ ID NO: 217210 - DNA, 16 bp, P. troglodytes
attttccttgagaaaa

SEQ ID NO: 217211 - DNA, 16 bp, P. troglodytes
attttcctttcacatt

SEQ ID NO: 217212 - DNA, 16 bp, P. troglodytes
attttcctttctctgt

SEQ ID NO: 217213 - DNA, 16 bp, P. troglodytes
attttcctttgagaaa

SEQ ID NO: 217214 - DNA, 16 bp, P. troglodytes
attttcctttggaaaa

SEQ ID NO: 217215 - DNA, 16 bp, P. troglodytes
attttcctttgtgtat

SEQ ID NO: 217216 - DNA, 16 bp, P. troglodytes
attttcctttgtttca

SEQ ID NO: 217217 - DNA, 16 bp, P. troglodytes
attttccttttagaaa

SEQ ID NO: 217218 - DNA, 17 bp, P. troglodytes
attttcgtagagacggg

SEQ ID NO: 217219 - DNA, 16 bp, P. troglodytes
attttctaaaacatat

SEQ ID NO: 217220 - DNA, 16 bp, P. troglodytes
attttctaaaagcttt

SEQ ID NO: 217221 - DNA, 16 bp, P. troglodytes
attttctaaaattaca

SEQ ID NO: 217222 - DNA, 16 bp, P. troglodytes
attttctaaataaaca

SEQ ID NO: 217223 - DNA, 16 bp, P. troglodytes
attttctaaatatgtt

SEQ ID NO: 217224 - DNA, 16 bp, P. troglodytes
attttctaaatttcaa

SEQ ID NO: 217225 - DNA, 16 bp, P. troglodytes
attttctacaaatatt

SEQ ID NO: 217226 - DNA, 16 bp, P. troglodytes
attttctacatagaaa

SEQ ID NO: 217227 - DNA, 16 bp, P. troglodytes
attttctacatagata

SEQ ID NO: 217228 - DNA, 16 bp, P. troglodytes
attttctacataggca

SEQ ID NO: 217229 - DNA, 16 bp, P. troglodytes
attttctagaaataaa

SEQ ID NO: 217230 - DNA, 16 bp, P. troglodytes
attttctagtttgtgc

SEQ ID NO: 217231 - DNA, 16 bp, P. troglodytes
attttctatccttaga

SEQ ID NO: 217232 - DNA, 16 bp, P. troglodytes
attttctatgtagaca

SEQ ID NO: 217233 - DNA, 16 bp, P. troglodytes
attttctatttcaaaa

SEQ ID NO: 217234 - DNA, 16 bp, P. troglodytes
attttctcaaaatatt

SEQ ID NO: 217235 - DNA, 16 bp, P. troglodytes
attttctcaaataaaa

SEQ ID NO: 217236 - DNA, 16 bp, P. troglodytes
attttctcacagttat

SEQ ID NO: 217237 - DNA, 16 bp, P. troglodytes
attttctcacctataa

SEQ ID NO: 217238 - DNA, 16 bp, P. troglodytes
attttctcagtgaagt

SEQ ID NO: 217239 - DNA, 16 bp, P. troglodytes
attttctcatctaaaa

SEQ ID NO: 217240 - DNA, 16 bp, P. troglodytes
attttctcatttaatc

SEQ ID NO: 217241 - DNA, 16 bp, P. troglodytes
attttctcccactttg

SEQ ID NO: 217242 - DNA, 16 bp, P. troglodytes
attttctcccattgtg

SEQ ID NO: 217243 - DNA, 16 bp, P. troglodytes
attttctctaaaataa

SEQ ID NO: 217244 - DNA, 16 bp, P. troglodytes
attttctctcttgtct

SEQ ID NO: 217245 - DNA, 16 bp, P. troglodytes
attttctctgcctttt

SEQ ID NO: 217246 - DNA, 16 bp, P. troglodytes
attttctctgtaaggc

SEQ ID NO: 217247 - DNA, 16 bp, P. troglodytes
attttctgaaaaaatt

SEQ ID NO: 217248 - DNA, 16 bp, P. troglodytes
attttctgaaatgaaa

SEQ ID NO: 217249 - DNA, 16 bp, P. troglodytes
attttctgaagaaaat

SEQ ID NO: 217250 - DNA, 16 bp, P. troglodytes
attttctgaagaattt

SEQ ID NO: 217251 - DNA, 16 bp, P. troglodytes
attttctgaagagaaa

SEQ ID NO: 217252 - DNA, 16 bp, P. troglodytes
attttctgaatctgaa

SEQ ID NO: 217253 - DNA, 16 bp, P. troglodytes
attttctgaggagaaa

SEQ ID NO: 217254 - DNA, 16 bp, P. troglodytes
attttctgatatattt

SEQ ID NO: 217255 - DNA, 16 bp, P. troglodytes
attttctgatttctgt

SEQ ID NO: 217256 - DNA, 16 bp, P. troglodytes
attttctgattttaaa

SEQ ID NO: 217257 - DNA, 16 bp, P. troglodytes
attttctgcctcagcc

SEQ ID NO: 217258 - DNA, 16 bp, P. troglodytes
attttctggaaaatat

SEQ ID NO: 217259 - DNA, 16 bp, P. troglodytes
attttctggatattaa

SEQ ID NO: 217260 - DNA, 16 bp, P. troglodytes
attttctgggttcaca

SEQ ID NO: 217261 - DNA, 16 bp, P. troglodytes
attttctgtactttta

SEQ ID NO: 217262 - DNA, 16 bp, P. troglodytes
attttctgtatttgta

SEQ ID NO: 217263 - DNA, 16 bp, P. troglodytes
attttctgtcatttaa

SEQ ID NO: 217264 - DNA, 16 bp, P. troglodytes
attttctgtcatttta

SEQ ID NO: 217265 - DNA, 16 bp, P. troglodytes
attttctgtctacttg

SEQ ID NO: 217266 - DNA, 16 bp, P. troglodytes
attttctgtgatgatg

SEQ ID NO: 217267 - DNA, 16 bp, P. troglodytes
attttctgtgcctcag

SEQ ID NO: 217268 - DNA, 16 bp, P. troglodytes
attttctgttgctata

SEQ ID NO: 217269 - DNA, 16 bp, P. troglodytes
attttctgtttcaatt

SEQ ID NO: 217270 - DNA, 16 bp, P. troglodytes
attttctgttttaaaa

SEQ ID NO: 217271 - DNA, 16 bp, P. troglodytes
attttctgttttaaag

SEQ ID NO: 217272 - DNA, 16 bp, P. troglodytes
attttctgttttataa

SEQ ID NO: 217273 - DNA, 16 bp, P. troglodytes
attttctgttttccat

SEQ ID NO: 217274 - DNA, 16 bp, P. troglodytes
attttcttaaaaaatg

SEQ ID NO: 217275 - DNA, 16 bp, P. troglodytes
attttcttaaaatcat

SEQ ID NO: 217276 - DNA, 16 bp, P. troglodytes
attttcttacagttct

SEQ ID NO: 217277 - DNA, 16 bp, P. troglodytes
attttcttacagtttt

SEQ ID NO: 217278 - DNA, 16 bp, P. troglodytes
attttcttagaaaata

SEQ ID NO: 217279 - DNA, 16 bp, P. troglodytes
attttcttatgaaaat

SEQ ID NO: 217280 - DNA, 16 bp, P. troglodytes
attttcttatgttgaa

SEQ ID NO: 217281 - DNA, 16 bp, P. troglodytes
attttcttattgttga

SEQ ID NO: 217282 - DNA, 16 bp, P. troglodytes
attttcttcaaaatat

SEQ ID NO: 217283 - DNA, 16 bp, P. troglodytes
attttcttccatttgt

SEQ ID NO: 217284 - DNA, 16 bp, P. troglodytes
attttcttctagaaat

SEQ ID NO: 217285 - DNA, 16 bp, P. troglodytes
attttcttctccaaaa

SEQ ID NO: 217286 - DNA, 16 bp, P. troglodytes
attttcttctgcattt

SEQ ID NO: 217287 - DNA, 16 bp, P. troglodytes
attttcttctggaaaa

SEQ ID NO: 217288 - DNA, 16 bp, P. troglodytes
attttcttctttcctg

SEQ ID NO: 217289 - DNA, 16 bp, P. troglodytes
attttcttcttttcag

SEQ ID NO: 217290 - DNA, 16 bp, P. troglodytes
attttcttgaaacaaa

SEQ ID NO: 217291 - DNA, 16 bp, P. troglodytes
attttcttgaagattt

SEQ ID NO: 217292 - DNA, 16 bp, P. troglodytes
attttcttgaattatt

SEQ ID NO: 217293 - DNA, 16 bp, P. troglodytes
attttctttaaccagt

SEQ ID NO: 217294 - DNA, 16 bp, P. troglodytes
attttctttaatgaaa

SEQ ID NO: 217295 - DNA, 16 bp, P. troglodytes
attttctttatctgta

SEQ ID NO: 217296 - DNA, 16 bp, P. troglodytes
attttctttcagcact

SEQ ID NO: 217297 - DNA, 16 bp, P. troglodytes
attttctttctaaaaa

SEQ ID NO: 217298 - DNA, 16 bp, P. troglodytes
attttctttgaagaaa

SEQ ID NO: 217299 - DNA, 16 bp, P. troglodytes
attttctttgccttct

SEQ ID NO: 217300 - DNA, 16 bp, P. troglodytes
attttctttgctgtgc

SEQ ID NO: 217301 - DNA, 16 bp, P. troglodytes
attttctttggaaatt

SEQ ID NO: 217302 - DNA, 16 bp, P. troglodytes
attttctttgtgaatt

SEQ ID NO: 217303 - DNA, 16 bp, P. troglodytes
attttcttttagaatt

SEQ ID NO: 217304 - DNA, 16 bp, P. troglodytes
attttcttttagatat

SEQ ID NO: 217305 - DNA, 16 bp, P. troglodytes
attttctttttccagt

SEQ ID NO: 217306 - DNA, 16 bp, P. troglodytes
attttgaaaaaacaaa

SEQ ID NO: 217307 - DNA, 16 bp, P. troglodytes
attttgaaaaaagttt

SEQ ID NO: 217308 - DNA, 16 bp, P. troglodytes
attttgaaaaatatag

SEQ ID NO: 217309 - DNA, 16 bp, P. troglodytes
attttgaaaaatgtaa

SEQ ID NO: 217310 - DNA, 16 bp, P. troglodytes
attttgaaaaatgttt

SEQ ID NO: 217311 - DNA, 16 bp, P. troglodytes
attttgaaaacagcaa

SEQ ID NO: 217312 - DNA, 16 bp, P. troglodytes
attttgaaaactgtat

SEQ ID NO: 217313 - DNA, 16 bp, P. troglodytes
attttgaaaagaagaa

SEQ ID NO: 217314 - DNA, 16 bp, P. troglodytes
attttgaaaagtaaat

SEQ ID NO: 217315 - DNA, 16 bp, P. troglodytes
attttgaaaataatct

SEQ ID NO: 217316 - DNA, 16 bp, P. troglodytes
attttgaaaatcattt

SEQ ID NO: 217317 - DNA, 16 bp, P. troglodytes
attttgaaaatgagaa

SEQ ID NO: 217318 - DNA, 16 bp, P. troglodytes
attttgaaaatggaaa

SEQ ID NO: 217319 - DNA, 16 bp, P. troglodytes
attttgaaacatataa

SEQ ID NO: 217320 - DNA, 16 bp, P. troglodytes
attttgaaactgaagt

SEQ ID NO: 217321 - DNA, 16 bp, P. troglodytes
attttgaaagaaaatt

SEQ ID NO: 217322 - DNA, 16 bp, P. troglodytes
attttgaaagaaatct

SEQ ID NO: 217323 - DNA, 16 bp, P. troglodytes
attttgaaagaagaaa

SEQ ID NO: 217324 - DNA, 16 bp, P. troglodytes
attttgaaagacattt

SEQ ID NO: 217325 - DNA, 16 bp, P. troglodytes
attttgaaagagaaaa

SEQ ID NO: 217326 - DNA, 16 bp, P. troglodytes
attttgaaagattaaa

SEQ ID NO: 217327 - DNA, 16 bp, P. troglodytes
attttgaaaggaatcc

SEQ ID NO: 217328 - DNA, 16 bp, P. troglodytes
attttgaaaggaatct

SEQ ID NO: 217329 - DNA, 16 bp, P. troglodytes
attttgaaagtgtttt

SEQ ID NO: 217330 - DNA, 16 bp, P. troglodytes
attttgaaataaaatg

SEQ ID NO: 217331 - DNA, 16 bp, P. troglodytes
attttgaaataatctt

SEQ ID NO: 217332 - DNA, 16 bp, P. troglodytes
attttgaaatatcaaa

SEQ ID NO: 217333 - DNA, 16 bp, P. troglodytes
attttgaaatatgcaa

SEQ ID NO: 217334 - DNA, 16 bp, P. troglodytes
attttgaaatgtacaa

SEQ ID NO: 217335 - DNA, 16 bp, P. troglodytes
attttgaaatgtttca

SEQ ID NO: 217336 - DNA, 16 bp, P. troglodytes
attttgaaatttcaaa

SEQ ID NO: 217337 - DNA, 16 bp, P. troglodytes
attttgaacacatttt

SEQ ID NO: 217338 - DNA, 16 bp, P. troglodytes
attttgaagaaaatga

SEQ ID NO: 217339 - DNA, 16 bp, P. troglodytes
attttgaagacatttt

SEQ ID NO: 217340 - DNA, 16 bp, P. troglodytes
attttgaagatgaaat

SEQ ID NO: 217341 - DNA, 16 bp, P. troglodytes
attttgaagatgtttt

SEQ ID NO: 217342 - DNA, 16 bp, P. troglodytes
attttgaagtaaatcc

SEQ ID NO: 217343 - DNA, 16 bp, P. troglodytes
attttgaagtagtttt

SEQ ID NO: 217344 - DNA, 16 bp, P. troglodytes
attttgaagtcagaaa

SEQ ID NO: 217345 - DNA, 16 bp, P. troglodytes
attttgaagtttaaaa

SEQ ID NO: 217346 - DNA, 16 bp, P. troglodytes
attttgaagttttctt

SEQ ID NO: 217347 - DNA, 16 bp, P. troglodytes
attttgaatatgaaaa

SEQ ID NO: 217348 - DNA, 16 bp, P. troglodytes
attttgaatattccca

SEQ ID NO: 217349 - DNA, 16 bp, P. troglodytes
attttgaatcaaaatt

SEQ ID NO: 217350 - DNA, 16 bp, P. troglodytes
attttgaattctctga

SEQ ID NO: 217351 - DNA, 16 bp, P. troglodytes
attttgaattcttttc

SEQ ID NO: 217352 - DNA, 16 bp, P. troglodytes
attttgaatttttgga

SEQ ID NO: 217353 - DNA, 16 bp, P. troglodytes
attttgacaaaatttt

SEQ ID NO: 217354 - DNA, 16 bp, P. troglodytes
attttgacatatgttc

SEQ ID NO: 217355 - DNA, 16 bp, P. troglodytes
attttgacatttaaaa

SEQ ID NO: 217356 - DNA, 16 bp, P. troglodytes
attttgacattttctt

SEQ ID NO: 217357 - DNA, 16 bp, P. troglodytes
attttgactttaaaaa

SEQ ID NO: 217358 - DNA, 16 bp, P. troglodytes
attttgagaagcactg

SEQ ID NO: 217359 - DNA, 16 bp, P. troglodytes
attttgagaatttaaa

SEQ ID NO: 217360 - DNA, 16 bp, P. troglodytes
attttgagtagagaca

SEQ ID NO: 217361 - DNA, 16 bp, P. troglodytes
attttgataaaattca

SEQ ID NO: 217362 - DNA, 16 bp, P. troglodytes
attttgatagaaattg

SEQ ID NO: 217363 - DNA, 16 bp, P. troglodytes
attttgatatattgtg

SEQ ID NO: 217364 - DNA, 16 bp, P. troglodytes
attttgatatattttc

SEQ ID NO: 217365 - DNA, 16 bp, P. troglodytes
attttgatatttcatt

SEQ ID NO: 217366 - DNA, 16 bp, P. troglodytes
attttgatatttgaaa

SEQ ID NO: 217367 - DNA, 16 bp, P. troglodytes
attttgatgaagttca

SEQ ID NO: 217368 - DNA, 16 bp, P. troglodytes
attttgatggaaattg

SEQ ID NO: 217369 - DNA, 16 bp, P. troglodytes
attttgattggaattg

SEQ ID NO: 217370 - DNA, 16 bp, P. troglodytes
attttgattttcaagt

SEQ ID NO: 217371 - DNA, 16 bp, P. troglodytes
attttgcaaaacaaaa

SEQ ID NO: 217372 - DNA, 16 bp, P. troglodytes
attttgcaaaagaaga

SEQ ID NO: 217373 - DNA, 16 bp, P. troglodytes
attttgcaaatataaa

SEQ ID NO: 217374 - DNA, 16 bp, P. troglodytes
attttgcaaatatttg

SEQ ID NO: 217375 - DNA, 16 bp, P. troglodytes
attttgcaaatgaaga

SEQ ID NO: 217376 - DNA, 16 bp, P. troglodytes
attttgcaaatgtttt

SEQ ID NO: 217377 - DNA, 16 bp, P. troglodytes
attttgcaattctcta

SEQ ID NO: 217378 - DNA, 16 bp, P. troglodytes
attttgcactttattt

SEQ ID NO: 217379 - DNA, 16 bp, P. troglodytes
attttgcagataaaga

SEQ ID NO: 217380 - DNA, 16 bp, P. troglodytes
attttgcagctgagaa

SEQ ID NO: 217381 - DNA, 16 bp, P. troglodytes
attttgcatcaatgtt

SEQ ID NO: 217382 - DNA, 16 bp, P. troglodytes
attttgcatgttttca

SEQ ID NO: 217383 - DNA, 16 bp, P. troglodytes
attttgccttcatttt

SEQ ID NO: 217384 - DNA, 16 bp, P. troglodytes
attttgctaaaaataa

SEQ ID NO: 217385 - DNA, 16 bp, P. troglodytes
attttgctattgtaaa

SEQ ID NO: 217386 - DNA, 16 bp, P. troglodytes
attttgctcatctttt

SEQ ID NO: 217387 - DNA, 20 bp, P. troglodytes
attttgctcattagttgatg

SEQ ID NO: 217388 - DNA, 16 bp, P. troglodytes
attttgctcattttta

SEQ ID NO: 217389 - DNA, 16 bp, P. troglodytes
attttgctcttgtcac

SEQ ID NO: 217390 - DNA, 16 bp, P. troglodytes
attttgctctttagtt

SEQ ID NO: 217391 - DNA, 16 bp, P. troglodytes
attttgctgaggattt

SEQ ID NO: 217392 - DNA, 16 bp, P. troglodytes
attttgctgaggtttt

SEQ ID NO: 217393 - DNA, 16 bp, P. troglodytes
attttgctgattgttt

SEQ ID NO: 217394 - DNA, 16 bp, P. troglodytes
attttgctgattttta

SEQ ID NO: 217395 - DNA, 16 bp, P. troglodytes
attttgctgcaaatga

SEQ ID NO: 217396 - DNA, 16 bp, P. troglodytes
attttgcttagaaatt

SEQ ID NO: 217397 - DNA, 16 bp, P. troglodytes
attttgctttaaattt

SEQ ID NO: 217398 - DNA, 16 bp, P. troglodytes
attttgctttggaaaa

SEQ ID NO: 217399 - DNA, 16 bp, P. troglodytes
attttgcttttaaaat

SEQ ID NO: 217400 - DNA, 16 bp, P. troglodytes
attttggaaaatatag

SEQ ID NO: 217401 - DNA, 16 bp, P. troglodytes
attttggaaactatat

SEQ ID NO: 217402 - DNA, 16 bp, P. troglodytes
attttggaaattataa

SEQ ID NO: 217403 - DNA, 16 bp, P. troglodytes
attttggaactctgga

SEQ ID NO: 217404 - DNA, 16 bp, P. troglodytes
attttggaactggaag

SEQ ID NO: 217405 - DNA, 16 bp, P. troglodytes
attttggaactgggta

SEQ ID NO: 217406 - DNA, 16 bp, P. troglodytes
attttggaagatattt

SEQ ID NO: 217407 - DNA, 16 bp, P. troglodytes
attttggaagttttca

SEQ ID NO: 217408 - DNA, 16 bp, P. troglodytes
attttggaatatctgc

SEQ ID NO: 217409 - DNA, 16 bp, P. troglodytes
attttggaattatgtt

SEQ ID NO: 217410 - DNA, 16 bp, P. troglodytes
attttggagaaacaca

SEQ ID NO: 217411 - DNA, 16 bp, P. troglodytes
attttggagaagaaaa

SEQ ID NO: 217412 - DNA, 16 bp, P. troglodytes
attttggagatgagga

SEQ ID NO: 217413 - DNA, 16 bp, P. troglodytes
attttggagctttaag

SEQ ID NO: 217414 - DNA, 16 bp, P. troglodytes
attttggataagggat

SEQ ID NO: 217415 - DNA, 16 bp, P. troglodytes
attttggattttgaat

SEQ ID NO: 217416 - DNA, 16 bp, P. troglodytes
attttggcaattacaa

SEQ ID NO: 217417 - DNA, 16 bp, P. troglodytes
attttggcatttattt

SEQ ID NO: 217418 - DNA, 16 bp, P. troglodytes
attttggccatgctgg

SEQ ID NO: 217419 - DNA, 16 bp, P. troglodytes
attttggccattttaa

SEQ ID NO: 217420 - DNA, 16 bp, P. troglodytes
attttggcttcatttt

SEQ ID NO: 217421 - DNA, 16 bp, P. troglodytes
attttggctttggttg

SEQ ID NO: 217422 - DNA, 16 bp, P. troglodytes
attttgggagtccaag

SEQ ID NO: 217423 - DNA, 16 bp, P. troglodytes
attttgggctggatga

SEQ ID NO: 217424 - DNA, 16 bp, P. troglodytes
attttggggaaaaatt

SEQ ID NO: 217425 - DNA, 16 bp, P. troglodytes
attttgggggaaaaaa

SEQ ID NO: 217426 - DNA, 16 bp, P. troglodytes
attttgggggaacagg

SEQ ID NO: 217427 - DNA, 16 bp, P. troglodytes
attttgggggcatttt

SEQ ID NO: 217428 - DNA, 16 bp, P. troglodytes
attttggtcaaagcca

SEQ ID NO: 217429 - DNA, 16 bp, P. troglodytes
attttggttattgtga

SEQ ID NO: 217430 - DNA, 16 bp, P. troglodytes
attttggtttcattga

SEQ ID NO: 217431 - DNA, 16 bp, P. troglodytes
attttgtaaaatatgt

SEQ ID NO: 217432 - DNA, 16 bp, P. troglodytes
attttgtaaaatgtaa

SEQ ID NO: 217433 - DNA, 16 bp, P. troglodytes
attttgtaacttaaaa

SEQ ID NO: 217434 - DNA, 16 bp, P. troglodytes
attttgtacaatattt

SEQ ID NO: 217435 - DNA, 16 bp, P. troglodytes
attttgtaccttttga

SEQ ID NO: 217436 - DNA, 16 bp, P. troglodytes
attttgtagagatagg

SEQ ID NO: 217437 - DNA, 19 bp, P. troglodytes
attttgtagagatggggtc

SEQ ID NO: 217438 - DNA, 16 bp, P. troglodytes
attttgtataaatgaa

SEQ ID NO: 217439 - DNA, 16 bp, P. troglodytes
attttgtatacagaat

SEQ ID NO: 217440 - DNA, 16 bp, P. troglodytes
attttgtatcctaaaa

SEQ ID NO: 217441 - DNA, 16 bp, P. troglodytes
attttgtatcctgaaa

SEQ ID NO: 217442 - DNA, 16 bp, P. troglodytes
attttgtatccttaga

SEQ ID NO: 217443 - DNA, 16 bp, P. troglodytes
attttgtatccttcaa

SEQ ID NO: 217444 - DNA, 16 bp, P. troglodytes
attttgtatcttgtaa

SEQ ID NO: 217445 - DNA, 16 bp, P. troglodytes
attttgtatcttttaa

SEQ ID NO: 217446 - DNA, 16 bp, P. troglodytes
attttgtattaaaatg

SEQ ID NO: 217447 - DNA, 16 bp, P. troglodytes
attttgtatttggaaa

SEQ ID NO: 217448 - DNA, 16 bp, P. troglodytes
attttgtattttcata

SEQ ID NO: 217449 - DNA, 16 bp, P. troglodytes
attttgtcaaatttat

SEQ ID NO: 217450 - DNA, 16 bp, P. troglodytes
attttgtcagattttt

SEQ ID NO: 217451 - DNA, 16 bp, P. troglodytes
attttgtcatccaggt

SEQ ID NO: 217452 - DNA, 16 bp, P. troglodytes
attttgtcatctataa

SEQ ID NO: 217453 - DNA, 16 bp, P. troglodytes
attttgtctgaaatta

SEQ ID NO: 217454 - DNA, 16 bp, P. troglodytes
attttgtctttctgtg

SEQ ID NO: 217455 - DNA, 16 bp, P. troglodytes
attttgtgaaaaataa

SEQ ID NO: 217456 - DNA, 16 bp, P. troglodytes
attttgtgaagaaagt

SEQ ID NO: 217457 - DNA, 16 bp, P. troglodytes
attttgtgacttttta

SEQ ID NO: 217458 - DNA, 16 bp, P. troglodytes
attttgtgattaaaaa

SEQ ID NO: 217459 - DNA, 16 bp, P. troglodytes
attttgtgcatgaaat

SEQ ID NO: 217460 - DNA, 16 bp, P. troglodytes
attttgtggaaaaaaa

SEQ ID NO: 217461 - DNA, 16 bp, P. troglodytes
attttgtggagaattt

SEQ ID NO: 217462 - DNA, 16 bp, P. troglodytes
attttgtggaggattt

SEQ ID NO: 217463 - DNA, 16 bp, P. troglodytes
attttgtggctggttt

SEQ ID NO: 217464 - DNA, 16 bp, P. troglodytes
attttgtgggtacata

SEQ ID NO: 217465 - DNA, 16 bp, P. troglodytes
attttgtggtaatttg

SEQ ID NO: 217466 - DNA, 16 bp, P. troglodytes
attttgtgtacatttt

SEQ ID NO: 217467 - DNA, 16 bp, P. troglodytes
attttgtgtatccatt

SEQ ID NO: 217468 - DNA, 16 bp, P. troglodytes
attttgtgtcttttaa

SEQ ID NO: 217469 - DNA, 16 bp, P. troglodytes
attttgtgtcttttga

SEQ ID NO: 217470 - DNA, 16 bp, P. troglodytes
attttgtgtggacata

SEQ ID NO: 217471 - DNA, 16 bp, P. troglodytes
attttgttaaagcagc

SEQ ID NO: 217472 - DNA, 16 bp, P. troglodytes
attttgttaatcattt

SEQ ID NO: 217473 - DNA, 16 bp, P. troglodytes
attttgttacagcagc

SEQ ID NO: 217474 - DNA, 16 bp, P. troglodytes
attttgttatagaagc

SEQ ID NO: 217475 - DNA, 16 bp, P. troglodytes
attttgttatagcagc

SEQ ID NO: 217476 - DNA, 16 bp, P. troglodytes
attttgttcactgcta

SEQ ID NO: 217477 - DNA, 16 bp, P. troglodytes
attttgttcagttttg

SEQ ID NO: 217478 - DNA, 16 bp, P. troglodytes
attttgttcatttaaa

SEQ ID NO: 217479 - DNA, 16 bp, P. troglodytes
attttgttccttttca

SEQ ID NO: 217480 - DNA, 16 bp, P. troglodytes
attttgttcttttcaa

SEQ ID NO: 217481 - DNA, 16 bp, P. troglodytes
attttgtttaaaatga

SEQ ID NO: 217482 - DNA, 16 bp, P. troglodytes
attttgtttaaccatt

SEQ ID NO: 217483 - DNA, 16 bp, P. troglodytes
attttgtttacttaaa

SEQ ID NO: 217484 - DNA, 16 bp, P. troglodytes
attttgtttcaatatt

SEQ ID NO: 217485 - DNA, 16 bp, P. troglodytes
attttgtttcatttaa

SEQ ID NO: 217486 - DNA, 16 bp, P. troglodytes
attttgtttcctttgg

SEQ ID NO: 217487 - DNA, 16 bp, P. troglodytes
attttgtttctaaaat

SEQ ID NO: 217488 - DNA, 16 bp, P. troglodytes
attttgtttcttaaaa

SEQ ID NO: 217489 - DNA, 16 bp, P. troglodytes
attttgtttctttgaa

SEQ ID NO: 217490 - DNA, 16 bp, P. troglodytes
attttgttttaaagag

SEQ ID NO: 217491 - DNA, 16 bp, P. troglodytes
attttgttttctgaaa

SEQ ID NO: 217492 - DNA, 16 bp, P. troglodytes
attttgttttgagaca

SEQ ID NO: 217493 - DNA, 16 bp, P. troglodytes
attttgtttttagaga

SEQ ID NO: 217494 - DNA, 16 bp, P. troglodytes
attttgtttttcaaaa

SEQ ID NO: 217495 - DNA, 16 bp, P. troglodytes
attttgttttttcaaa

SEQ ID NO: 217496 - DNA, 16 bp, P. troglodytes
atttttaaaaaatgca

SEQ ID NO: 217497 - DNA, 16 bp, P. troglodytes
atttttaaaaacacat

SEQ ID NO: 217498 - DNA, 16 bp, P. troglodytes
atttttaaaaaggata

SEQ ID NO: 217499 - DNA, 16 bp, P. troglodytes
atttttaaaaagtaga

SEQ ID NO: 217500 - DNA, 16 bp, P. troglodytes
atttttaaaaagtcat

SEQ ID NO: 217501 - DNA, 16 bp, P. troglodytes
atttttaaaaagtgtt

SEQ ID NO: 217502 - DNA, 16 bp, P. troglodytes
atttttaaaaatctgt

SEQ ID NO: 217503 - DNA, 16 bp, P. troglodytes
atttttaaaaatgtga

SEQ ID NO: 217504 - DNA, 16 bp, P. troglodytes
atttttaaaaattgct

SEQ ID NO: 217505 - DNA, 16 bp, P. troglodytes
atttttaaaaattggg

SEQ ID NO: 217506 - DNA, 16 bp, P. troglodytes
atttttaaaactacat

SEQ ID NO: 217507 - DNA, 16 bp, P. troglodytes
atttttaaaacttcaa

SEQ ID NO: 217508 - DNA, 16 bp, P. troglodytes
atttttaaaagagatg

SEQ ID NO: 217509 - DNA, 16 bp, P. troglodytes
atttttaaaagccaaa

SEQ ID NO: 217510 - DNA, 16 bp, P. troglodytes
atttttaaaagccaga

SEQ ID NO: 217511 - DNA, 16 bp, P. troglodytes
atttttaaaagccttt

SEQ ID NO: 217512 - DNA, 16 bp, P. troglodytes
atttttaaaagctata

SEQ ID NO: 217513 - DNA, 16 bp, P. troglodytes
atttttaaaaggattt

SEQ ID NO: 217514 - DNA, 16 bp, P. troglodytes
atttttaaaagggaaa

SEQ ID NO: 217515 - DNA, 16 bp, P. troglodytes
atttttaaaaggtaga

SEQ ID NO: 217516 - DNA, 16 bp, P. troglodytes
atttttaaaagtgaaa

SEQ ID NO: 217517 - DNA, 16 bp, P. troglodytes
atttttaaaatagtgt

SEQ ID NO: 217518 - DNA, 16 bp, P. troglodytes
atttttaaaatccaaa

SEQ ID NO: 217519 - DNA, 16 bp, P. troglodytes
atttttaaaatccagt

SEQ ID NO: 217520 - DNA, 16 bp, P. troglodytes
atttttaaaatgacta

SEQ ID NO: 217521 - DNA, 16 bp, P. troglodytes
atttttaaaatgcttt

SEQ ID NO: 217522 - DNA, 16 bp, P. troglodytes
atttttaaaatgtaca

SEQ ID NO: 217523 - DNA, 16 bp, P. troglodytes
atttttaaaatgtgat

SEQ ID NO: 217524 - DNA, 16 bp, P. troglodytes
atttttaaaattagga

SEQ ID NO: 217525 - DNA, 16 bp, P. troglodytes
atttttaaaccaaata

SEQ ID NO: 217526 - DNA, 16 bp, P. troglodytes
atttttaaactggaaa

SEQ ID NO: 217527 - DNA, 16 bp, P. troglodytes
atttttaaactgtaaa

SEQ ID NO: 217528 - DNA, 16 bp, P. troglodytes
atttttaaagaaaagt

SEQ ID NO: 217529 - DNA, 16 bp, P. troglodytes
atttttaaagaaatac

SEQ ID NO: 217530 - DNA, 16 bp, P. troglodytes
atttttaaagaaatga

SEQ ID NO: 217531 - DNA, 16 bp, P. troglodytes
atttttaaagaatcaa

SEQ ID NO: 217532 - DNA, 16 bp, P. troglodytes
atttttaaagagattt

SEQ ID NO: 217533 - DNA, 16 bp, P. troglodytes
atttttaaagagtaaa

SEQ ID NO: 217534 - DNA, 16 bp, P. troglodytes
atttttaaagatgaaa

SEQ ID NO: 217535 - DNA, 16 bp, P. troglodytes
atttttaaagatgaga

SEQ ID NO: 217536 - DNA, 16 bp, P. troglodytes
atttttaaagcagcaa

SEQ ID NO: 217537 - DNA, 16 bp, P. troglodytes
atttttaaagccatca

SEQ ID NO: 217538 - DNA, 16 bp, P. troglodytes
atttttaaagctcttt

SEQ ID NO: 217539 - DNA, 16 bp, P. troglodytes
atttttaaagcttttg

SEQ ID NO: 217540 - DNA, 16 bp, P. troglodytes
atttttaaaggacaaa

SEQ ID NO: 217541 - DNA, 16 bp, P. troglodytes
atttttaaaggcaaaa

SEQ ID NO: 217542 - DNA, 16 bp, P. troglodytes
atttttaaaggctgaa

SEQ ID NO: 217543 - DNA, 16 bp, P. troglodytes
atttttaaaggtgaaa

SEQ ID NO: 217544 - DNA, 16 bp, P. troglodytes
atttttaaagtaaaca

SEQ ID NO: 217545 - DNA, 16 bp, P. troglodytes
atttttaaatatactg

SEQ ID NO: 217546 - DNA, 16 bp, P. troglodytes
atttttaaatatgaag

SEQ ID NO: 217547 - DNA, 16 bp, P. troglodytes
atttttaaatattctg

SEQ ID NO: 217548 - DNA, 16 bp, P. troglodytes
atttttaaatgattca

SEQ ID NO: 217549 - DNA, 16 bp, P. troglodytes
atttttaaatgcttat

SEQ ID NO: 217550 - DNA, 16 bp, P. troglodytes
atttttaaatggataa

SEQ ID NO: 217551 - DNA, 16 bp, P. troglodytes
atttttaaatggtaaa

SEQ ID NO: 217552 - DNA, 16 bp, P. troglodytes
atttttaaatgtccat

SEQ ID NO: 217553 - DNA, 16 bp, P. troglodytes
atttttaacaaaagta

SEQ ID NO: 217554 - DNA, 16 bp, P. troglodytes
atttttaacagaaaag

SEQ ID NO: 217555 - DNA, 16 bp, P. troglodytes
atttttaacagttttt

SEQ ID NO: 217556 - DNA, 16 bp, P. troglodytes
atttttaacttgaaaa

SEQ ID NO: 217557 - DNA, 16 bp, P. troglodytes
atttttaactttatga

SEQ ID NO: 217558 - DNA, 16 bp, P. troglodytes
atttttaagaaaagag

SEQ ID NO: 217559 - DNA, 16 bp, P. troglodytes
atttttaagcaaaaga

SEQ ID NO: 217560 - DNA, 16 bp, P. troglodytes
atttttaaggtaaaaa

SEQ ID NO: 217561 - DNA, 16 bp, P. troglodytes
atttttaagtgaaaaa

SEQ ID NO: 217562 - DNA, 16 bp, P. troglodytes
atttttaagtgtacaa

SEQ ID NO: 217563 - DNA, 16 bp, P. troglodytes
atttttaataaacaca

SEQ ID NO: 217564 - DNA, 16 bp, P. troglodytes
atttttaatagctaaa

SEQ ID NO: 217565 - DNA, 16 bp, P. troglodytes
atttttaatgaaagaa

SEQ ID NO: 217566 - DNA, 16 bp, P. troglodytes
atttttaatgaacatt

SEQ ID NO: 217567 - DNA, 16 bp, P. troglodytes
atttttaatttctgaa

SEQ ID NO: 217568 - DNA, 16 bp, P. troglodytes
atttttaatttgcatt

SEQ ID NO: 217569 - DNA, 16 bp, P. troglodytes
atttttacaaagaaaa

SEQ ID NO: 217570 - DNA, 16 bp, P. troglodytes
atttttacaatattga

SEQ ID NO: 217571 - DNA, 16 bp, P. troglodytes
atttttacaatgaaaa

SEQ ID NO: 217572 - DNA, 16 bp, P. troglodytes
atttttacacaaaata

SEQ ID NO: 217573 - DNA, 16 bp, P. troglodytes
atttttacatgtaaat

SEQ ID NO: 217574 - DNA, 16 bp, P. troglodytes
atttttacatttatgt

SEQ ID NO: 217575 - DNA, 16 bp, P. troglodytes
atttttacatttttag

SEQ ID NO: 217576 - DNA, 16 bp, P. troglodytes
atttttactgtattta

SEQ ID NO: 217577 - DNA, 16 bp, P. troglodytes
atttttagaaaataca

SEQ ID NO: 217578 - DNA, 16 bp, P. troglodytes
atttttagaaacaaaa

SEQ ID NO: 217579 - DNA, 16 bp, P. troglodytes
atttttagaaggaaaa

SEQ ID NO: 217580 - DNA, 16 bp, P. troglodytes
atttttagacattttt

SEQ ID NO: 217581 - DNA, 16 bp, P. troglodytes
atttttagagacaagg

SEQ ID NO: 217582 - DNA, 16 bp, P. troglodytes
atttttagagtaaaaa

SEQ ID NO: 217583 - DNA, 16 bp, P. troglodytes
atttttagatgaaaaa

SEQ ID NO: 217584 - DNA, 16 bp, P. troglodytes
atttttagatgaagaa

SEQ ID NO: 217585 - DNA, 16 bp, P. troglodytes
atttttagcatatttt

SEQ ID NO: 217586 - DNA, 16 bp, P. troglodytes
atttttagcattaaaa

SEQ ID NO: 217587 - DNA, 16 bp, P. troglodytes
atttttaggctgggcg

SEQ ID NO: 217588 - DNA, 16 bp, P. troglodytes
atttttaggggaaaaa

SEQ ID NO: 217589 - DNA, 16 bp, P. troglodytes
atttttagtaaagaag

SEQ ID NO: 217590 - DNA, 16 bp, P. troglodytes
atttttagtacagacc

SEQ ID NO: 217591 - DNA, 18 bp, P. troglodytes
atttttagtagagacaaa

SEQ ID NO: 217592 - DNA, 24 bp, P. troglodytes
atttttagtagagacagggtttcg

SEQ ID NO: 217593 - DNA, 16 bp, P. troglodytes
atttttagtaggcaca

SEQ ID NO: 217594 - DNA, 16 bp, P. troglodytes
atttttagtagtgaaa

SEQ ID NO: 217595 - DNA, 16 bp, P. troglodytes
atttttagtgaaaaat

SEQ ID NO: 217596 - DNA, 16 bp, P. troglodytes
atttttagtggaaatg

SEQ ID NO: 217597 - DNA, 16 bp, P. troglodytes
atttttagtggagttg

SEQ ID NO: 217598 - DNA, 16 bp, P. troglodytes
atttttagttctttga

SEQ ID NO: 217599 - DNA, 16 bp, P. troglodytes
atttttagtttgctga

SEQ ID NO: 217600 - DNA, 16 bp, P. troglodytes
atttttataaagatgg

SEQ ID NO: 217601 - DNA, 16 bp, P. troglodytes
atttttataaatggaa

SEQ ID NO: 217602 - DNA, 16 bp, P. troglodytes
atttttatagagatgg

SEQ ID NO: 217603 - DNA, 16 bp, P. troglodytes
atttttatagctattt

SEQ ID NO: 217604 - DNA, 16 bp, P. troglodytes
atttttataggaattg

SEQ ID NO: 217605 - DNA, 16 bp, P. troglodytes
atttttatagtcattt

SEQ ID NO: 217606 - DNA, 16 bp, P. troglodytes
atttttatataccaat

SEQ ID NO: 217607 - DNA, 16 bp, P. troglodytes
atttttatatctgctt

SEQ ID NO: 217608 - DNA, 16 bp, P. troglodytes
atttttatatgcatgt

SEQ ID NO: 217609 - DNA, 16 bp, P. troglodytes
atttttatatgccaat

SEQ ID NO: 217610 - DNA, 16 bp, P. troglodytes
atttttatcaaatgtt

SEQ ID NO: 217611 - DNA, 16 bp, P. troglodytes
atttttatcacctcaa

SEQ ID NO: 217612 - DNA, 16 bp, P. troglodytes
atttttatcatgaatt

SEQ ID NO: 217613 - DNA, 16 bp, P. troglodytes
atttttatccaaaata

SEQ ID NO: 217614 - DNA, 16 bp, P. troglodytes
atttttatgaaagaaa

SEQ ID NO: 217615 - DNA, 16 bp, P. troglodytes
atttttatgactttta

SEQ ID NO: 217616 - DNA, 16 bp, P. troglodytes
atttttatgtacagaa

SEQ ID NO: 217617 - DNA, 16 bp, P. troglodytes
atttttatgtcatatt

SEQ ID NO: 217618 - DNA, 16 bp, P. troglodytes
atttttatgtgaaaat

SEQ ID NO: 217619 - DNA, 16 bp, P. troglodytes
atttttattagcaaaa

SEQ ID NO: 217620 - DNA, 16 bp, P. troglodytes
atttttattagcattt

SEQ ID NO: 217621 - DNA, 16 bp, P. troglodytes
atttttatttcctgta

SEQ ID NO: 217622 - DNA, 16 bp, P. troglodytes
atttttatttctgcca

SEQ ID NO: 217623 - DNA, 16 bp, P. troglodytes
atttttatttctgcct

SEQ ID NO: 217624 - DNA, 16 bp, P. troglodytes
atttttatttgcaaaa

SEQ ID NO: 217625 - DNA, 16 bp, P. troglodytes
atttttattttgcact

SEQ ID NO: 217626 - DNA, 16 bp, P. troglodytes
atttttcaaaagacaa

SEQ ID NO: 217627 - DNA, 16 bp, P. troglodytes
atttttcaaaagcaaa

SEQ ID NO: 217628 - DNA, 16 bp, P. troglodytes
atttttcaaaatgttt

SEQ ID NO: 217629 - DNA, 16 bp, P. troglodytes
atttttcaaagaaaaa

SEQ ID NO: 217630 - DNA, 16 bp, P. troglodytes
atttttcaaagaaaat

SEQ ID NO: 217631 - DNA, 16 bp, P. troglodytes
atttttcaaagatttt

SEQ ID NO: 217632 - DNA, 16 bp, P. troglodytes
atttttcaaataaaca

SEQ ID NO: 217633 - DNA, 16 bp, P. troglodytes
atttttcaaatgagaa

SEQ ID NO: 217634 - DNA, 16 bp, P. troglodytes
atttttcaacaaatat

SEQ ID NO: 217635 - DNA, 16 bp, P. troglodytes
atttttcaactttatg

SEQ ID NO: 217636 - DNA, 16 bp, P. troglodytes
atttttcaagagaagc

SEQ ID NO: 217637 - DNA, 16 bp, P. troglodytes
atttttcaagttttct

SEQ ID NO: 217638 - DNA, 16 bp, P. troglodytes
atttttcaatgttatt

SEQ ID NO: 217639 - DNA, 16 bp, P. troglodytes
atttttcaattccaga

SEQ ID NO: 217640 - DNA, 16 bp, P. troglodytes
atttttcacaaaattt

SEQ ID NO: 217641 - DNA, 16 bp, P. troglodytes
atttttcacattaaaa

SEQ ID NO: 217642 - DNA, 16 bp, P. troglodytes
atttttcacatttttg

SEQ ID NO: 217643 - DNA, 16 bp, P. troglodytes
atttttcaccaaaaaa

SEQ ID NO: 217644 - DNA, 16 bp, P. troglodytes
atttttcactgctctg

SEQ ID NO: 217645 - DNA, 16 bp, P. troglodytes
atttttcagaattttt

SEQ ID NO: 217646 - DNA, 16 bp, P. troglodytes
atttttcagacaaaaa

SEQ ID NO: 217647 - DNA, 16 bp, P. troglodytes
atttttcagataagga

SEQ ID NO: 217648 - DNA, 16 bp, P. troglodytes
atttttcagatatttt

SEQ ID NO: 217649 - DNA, 16 bp, P. troglodytes
atttttcagatgaaga

SEQ ID NO: 217650 - DNA, 16 bp, P. troglodytes
atttttcagatgagga

SEQ ID NO: 217651 - DNA, 16 bp, P. troglodytes
atttttcagatgtttt

SEQ ID NO: 217652 - DNA, 16 bp, P. troglodytes
atttttcagattgttt

SEQ ID NO: 217653 - DNA, 16 bp, P. troglodytes
atttttcagcttcaga

SEQ ID NO: 217654 - DNA, 16 bp, P. troglodytes
atttttcagtgtttct

SEQ ID NO: 217655 - DNA, 16 bp, P. troglodytes
atttttcataaagaca

SEQ ID NO: 217656 - DNA, 16 bp, P. troglodytes
atttttcatagtttta

SEQ ID NO: 217657 - DNA, 16 bp, P. troglodytes
atttttcatcaatgtt

SEQ ID NO: 217658 - DNA, 16 bp, P. troglodytes
atttttcatcagaaac

SEQ ID NO: 217659 - DNA, 16 bp, P. troglodytes
atttttcatctctttg

SEQ ID NO: 217660 - DNA, 16 bp, P. troglodytes
atttttcattaaacat

SEQ ID NO: 217661 - DNA, 16 bp, P. troglodytes
atttttcattgaaaaa

SEQ ID NO: 217662 - DNA, 16 bp, P. troglodytes
atttttcattgtcaca

SEQ ID NO: 217663 - DNA, 16 bp, P. troglodytes
atttttcatttcagtt

SEQ ID NO: 217664 - DNA, 16 bp, P. troglodytes
atttttcatttgaaat

SEQ ID NO: 217665 - DNA, 16 bp, P. troglodytes
atttttccaaaaaaga

SEQ ID NO: 217666 - DNA, 16 bp, P. troglodytes
atttttccaaaaatga

SEQ ID NO: 217667 - DNA, 16 bp, P. troglodytes
atttttccaaagaaga

SEQ ID NO: 217668 - DNA, 16 bp, P. troglodytes
atttttccatataaat

SEQ ID NO: 217669 - DNA, 16 bp, P. troglodytes
atttttccatatgctt

SEQ ID NO: 217670 - DNA, 16 bp, P. troglodytes
atttttccatggacag

SEQ ID NO: 217671 - DNA, 16 bp, P. troglodytes
atttttccatgtttat

SEQ ID NO: 217672 - DNA, 16 bp, P. troglodytes
atttttcctgaaaaaa

SEQ ID NO: 217673 - DNA, 16 bp, P. troglodytes
atttttccttaaaata

SEQ ID NO: 217674 - DNA, 16 bp, P. troglodytes
atttttccttcctctg

SEQ ID NO: 217675 - DNA, 16 bp, P. troglodytes
atttttctaaaagttt

SEQ ID NO: 217676 - DNA, 16 bp, P. troglodytes
atttttctaaaataca

SEQ ID NO: 217677 - DNA, 16 bp, P. troglodytes
atttttctaaagaaaa

SEQ ID NO: 217678 - DNA, 16 bp, P. troglodytes
atttttctaagagaaa

SEQ ID NO: 217679 - DNA, 16 bp, P. troglodytes
atttttctaagtattt

SEQ ID NO: 217680 - DNA, 16 bp, P. troglodytes
atttttctagtagaga

SEQ ID NO: 217681 - DNA, 16 bp, P. troglodytes
atttttctattagatt

SEQ ID NO: 217682 - DNA, 16 bp, P. troglodytes
atttttctcaaaaata

SEQ ID NO: 217683 - DNA, 16 bp, P. troglodytes
atttttctcaacttta

SEQ ID NO: 217684 - DNA, 16 bp, P. troglodytes
atttttctcatctgta

SEQ ID NO: 217685 - DNA, 16 bp, P. troglodytes
atttttctctgaaatt

SEQ ID NO: 217686 - DNA, 16 bp, P. troglodytes
atttttctctgtttca

SEQ ID NO: 217687 - DNA, 16 bp, P. troglodytes
atttttctcttaaaaa

SEQ ID NO: 217688 - DNA, 16 bp, P. troglodytes
atttttctcttgctgc

SEQ ID NO: 217689 - DNA, 16 bp, P. troglodytes
atttttctgaaatatt

SEQ ID NO: 217690 - DNA, 16 bp, P. troglodytes
atttttctgaactttt

SEQ ID NO: 217691 - DNA, 16 bp, P. troglodytes
atttttctgacaaaat

SEQ ID NO: 217692 - DNA, 16 bp, P. troglodytes
atttttctgacatttt

SEQ ID NO: 217693 - DNA, 16 bp, P. troglodytes
atttttctgatgatca

SEQ ID NO: 217694 - DNA, 16 bp, P. troglodytes
atttttctgattacta

SEQ ID NO: 217695 - DNA, 16 bp, P. troglodytes
atttttctgcctttta

SEQ ID NO: 217696 - DNA, 16 bp, P. troglodytes
atttttctgtatatat

SEQ ID NO: 217697 - DNA, 16 bp, P. troglodytes
atttttcttaagaaat

SEQ ID NO: 217698 - DNA, 16 bp, P. troglodytes
atttttcttagagaca

SEQ ID NO: 217699 - DNA, 16 bp, P. troglodytes
atttttcttcataaca

SEQ ID NO: 217700 - DNA, 16 bp, P. troglodytes
atttttcttgaacttt

SEQ ID NO: 217701 - DNA, 16 bp, P. troglodytes
atttttcttggaaaaa

SEQ ID NO: 217702 - DNA, 16 bp, P. troglodytes
atttttctttaaatga

SEQ ID NO: 217703 - DNA, 16 bp, P. troglodytes
atttttctttaaatgt

SEQ ID NO: 217704 - DNA, 16 bp, P. troglodytes
atttttctttaacaaa

SEQ ID NO: 217705 - DNA, 16 bp, P. troglodytes
atttttctttaatgaa

SEQ ID NO: 217706 - DNA, 16 bp, P. troglodytes
atttttctttcctcaa

SEQ ID NO: 217707 - DNA, 16 bp, P. troglodytes
atttttgaaaaacaaa

SEQ ID NO: 217708 - DNA, 16 bp, P. troglodytes
atttttgaaaaataca

SEQ ID NO: 217709 - DNA, 16 bp, P. troglodytes
atttttgaaaaatatg

SEQ ID NO: 217710 - DNA, 16 bp, P. troglodytes
atttttgaaaaatgaa

SEQ ID NO: 217711 - DNA, 16 bp, P. troglodytes
atttttgaaaaatgta

SEQ ID NO: 217712 - DNA, 16 bp, P. troglodytes
atttttgaaaacattt

SEQ ID NO: 217713 - DNA, 16 bp, P. troglodytes
atttttgaaaaggaaa

SEQ ID NO: 217714 - DNA, 16 bp, P. troglodytes
atttttgaaaatgtct

SEQ ID NO: 217715 - DNA, 16 bp, P. troglodytes
atttttgaaagtggta

SEQ ID NO: 217716 - DNA, 16 bp, P. troglodytes
atttttgaatgaaaaa

SEQ ID NO: 217717 - DNA, 16 bp, P. troglodytes
atttttgacaagaatg

SEQ ID NO: 217718 - DNA, 16 bp, P. troglodytes
atttttgacacatttt

SEQ ID NO: 217719 - DNA, 16 bp, P. troglodytes
atttttgacagtttga

SEQ ID NO: 217720 - DNA, 16 bp, P. troglodytes
atttttgagaaaagaa

SEQ ID NO: 217721 - DNA, 16 bp, P. troglodytes
atttttgagacagaat

SEQ ID NO: 217722 - DNA, 16 bp, P. troglodytes
atttttgagacagggc

SEQ ID NO: 217723 - DNA, 16 bp, P. troglodytes
atttttgagacagggt

SEQ ID NO: 217724 - DNA, 16 bp, P. troglodytes
atttttgagatagggt

SEQ ID NO: 217725 - DNA, 16 bp, P. troglodytes
atttttgagtcagggt

SEQ ID NO: 217726 - DNA, 16 bp, P. troglodytes
atttttgatgcatttt

SEQ ID NO: 217727 - DNA, 16 bp, P. troglodytes
atttttgattggatta

SEQ ID NO: 217728 - DNA, 16 bp, P. troglodytes
atttttgcaaaaaaaa

SEQ ID NO: 217729 - DNA, 16 bp, P. troglodytes
atttttgcaaagatgg

SEQ ID NO: 217730 - DNA, 16 bp, P. troglodytes
atttttgcaattaaaa

SEQ ID NO: 217731 - DNA, 17 bp, P. troglodytes
atttttgcacactgatt

SEQ ID NO: 217732 - DNA, 16 bp, P. troglodytes
atttttgcatatggtg

SEQ ID NO: 217733 - DNA, 16 bp, P. troglodytes
atttttgcatcaacat

SEQ ID NO: 217734 - DNA, 16 bp, P. troglodytes
atttttgcatgttgat

SEQ ID NO: 217735 - DNA, 16 bp, P. troglodytes
atttttgcatttaaaa

SEQ ID NO: 217736 - DNA, 16 bp, P. troglodytes
atttttgcatttaaat

SEQ ID NO: 217737 - DNA, 16 bp, P. troglodytes
atttttgccagcattt

SEQ ID NO: 217738 - DNA, 16 bp, P. troglodytes
atttttgccagtctga

SEQ ID NO: 217739 - DNA, 16 bp, P. troglodytes
atttttgccatcttta

SEQ ID NO: 217740 - DNA, 16 bp, P. troglodytes
atttttgccattttaa

SEQ ID NO: 217741 - DNA, 16 bp, P. troglodytes
atttttgccttcattt

SEQ ID NO: 217742 - DNA, 16 bp, P. troglodytes
atttttgctatttaaa

SEQ ID NO: 217743 - DNA, 16 bp, P. troglodytes
atttttgctattttaa

SEQ ID NO: 217744 - DNA, 16 bp, P. troglodytes
atttttgctttcattg

SEQ ID NO: 217745 - DNA, 16 bp, P. troglodytes
atttttgcttttgatg

SEQ ID NO: 217746 - DNA, 16 bp, P. troglodytes
atttttgcttttgtga

SEQ ID NO: 217747 - DNA, 16 bp, P. troglodytes
atttttggaaaattct

SEQ ID NO: 217748 - DNA, 16 bp, P. troglodytes
atttttggaattttct

SEQ ID NO: 217749 - DNA, 16 bp, P. troglodytes
atttttggaggaaaaa

SEQ ID NO: 217750 - DNA, 16 bp, P. troglodytes
atttttgggaatagtt

SEQ ID NO: 217751 - DNA, 16 bp, P. troglodytes
atttttggtaaagatg

SEQ ID NO: 217752 - DNA, 16 bp, P. troglodytes
atttttgtaaaatgta

SEQ ID NO: 217753 - DNA, 16 bp, P. troglodytes
atttttgtacatattt

SEQ ID NO: 217754 - DNA, 16 bp, P. troglodytes
atttttgtacatttat

SEQ ID NO: 217755 - DNA, 16 bp, P. troglodytes
atttttgtacatttta

SEQ ID NO: 217756 - DNA, 16 bp, P. troglodytes
atttttgtacattttg

SEQ ID NO: 217757 - DNA, 16 bp, P. troglodytes
atttttgtacttttaa

SEQ ID NO: 217758 - DNA, 16 bp, P. troglodytes
atttttgtagcatttt

SEQ ID NO: 217759 - DNA, 16 bp, P. troglodytes
atttttgtataagctg

SEQ ID NO: 217760 - DNA, 22 bp, P. troglodytes
atttttgtataaggtgtaagga

SEQ ID NO: 217761 - DNA, 16 bp, P. troglodytes
atttttgtatatagtg

SEQ ID NO: 217762 - DNA, 16 bp, P. troglodytes
atttttgtatatggaa

SEQ ID NO: 217763 - DNA, 16 bp, P. troglodytes
atttttgtatatggtg

SEQ ID NO: 217764 - DNA, 16 bp, P. troglodytes
atttttgtcaaatttt

SEQ ID NO: 217765 - DNA, 16 bp, P. troglodytes
atttttgtcattgatt

SEQ ID NO: 217766 - DNA, 16 bp, P. troglodytes
atttttgtctactttg

SEQ ID NO: 217767 - DNA, 16 bp, P. troglodytes
atttttgtctatggtg

SEQ ID NO: 217768 - DNA, 16 bp, P. troglodytes
atttttgtcttaaaaa

SEQ ID NO: 217769 - DNA, 16 bp, P. troglodytes
atttttgtgaacattt

SEQ ID NO: 217770 - DNA, 16 bp, P. troglodytes
atttttgtgaagggta

SEQ ID NO: 217771 - DNA, 16 bp, P. troglodytes
atttttgtgacagagt

SEQ ID NO: 217772 - DNA, 16 bp, P. troglodytes
atttttgtgcatatat

SEQ ID NO: 217773 - DNA, 16 bp, P. troglodytes
atttttgtggctgcat

SEQ ID NO: 217774 - DNA, 16 bp, P. troglodytes
atttttgtgtatgctg

SEQ ID NO: 217775 - DNA, 16 bp, P. troglodytes
atttttgtgtgttgaa

SEQ ID NO: 217776 - DNA, 16 bp, P. troglodytes
atttttgttatagcag

SEQ ID NO: 217777 - DNA, 16 bp, P. troglodytes
atttttgttgaaaaat

SEQ ID NO: 217778 - DNA, 16 bp, P. troglodytes
atttttgttgtcattg

SEQ ID NO: 217779 - DNA, 16 bp, P. troglodytes
atttttgtttcatata

SEQ ID NO: 217780 - DNA, 16 bp, P. troglodytes
atttttgtttgagaaa

SEQ ID NO: 217781 - DNA, 16 bp, P. troglodytes
atttttgttttaaact

SEQ ID NO: 217782 - DNA, 16 bp, P. troglodytes
atttttgttttcaaaa

SEQ ID NO: 217783 - DNA, 16 bp, P. troglodytes
atttttgttttcctaa

SEQ ID NO: 217784 - DNA, 16 bp, P. troglodytes
atttttgtttttaaca

SEQ ID NO: 217785 - DNA, 16 bp, P. troglodytes
attttttaaaaaagca

SEQ ID NO: 217786 - DNA, 16 bp, P. troglodytes
attttttaaaaaccaa

SEQ ID NO: 217787 - DNA, 16 bp, P. troglodytes
attttttaaaaactgt

SEQ ID NO: 217788 - DNA, 16 bp, P. troglodytes
attttttaaaaagaag

SEQ ID NO: 217789 - DNA, 16 bp, P. troglodytes
attttttaaaaagcaa

SEQ ID NO: 217790 - DNA, 16 bp, P. troglodytes
attttttaaaaagctc

SEQ ID NO: 217791 - DNA, 16 bp, P. troglodytes
attttttaaaaatgga

SEQ ID NO: 217792 - DNA, 16 bp, P. troglodytes
attttttaaaagagaa

SEQ ID NO: 217793 - DNA, 16 bp, P. troglodytes
attttttaaaagagta

SEQ ID NO: 217794 - DNA, 16 bp, P. troglodytes
attttttaaaagccta

SEQ ID NO: 217795 - DNA, 16 bp, P. troglodytes
attttttaaaaggatt

SEQ ID NO: 217796 - DNA, 16 bp, P. troglodytes
attttttaaaatacca

SEQ ID NO: 217797 - DNA, 16 bp, P. troglodytes
attttttaaaatcaca

SEQ ID NO: 217798 - DNA, 16 bp, P. troglodytes
attttttaaaatctca

SEQ ID NO: 217799 - DNA, 16 bp, P. troglodytes
attttttaaaatgcca

SEQ ID NO: 217800 - DNA, 16 bp, P. troglodytes
attttttaaagtactg

SEQ ID NO: 217801 - DNA, 16 bp, P. troglodytes
attttttaaatgcctt

SEQ ID NO: 217802 - DNA, 16 bp, P. troglodytes
attttttaaatggcta

SEQ ID NO: 217803 - DNA, 16 bp, P. troglodytes
attttttaaatgtcta

SEQ ID NO: 217804 - DNA, 16 bp, P. troglodytes
attttttaaatgtctg

SEQ ID NO: 217805 - DNA, 16 bp, P. troglodytes
attttttaaattgaca

SEQ ID NO: 217806 - DNA, 16 bp, P. troglodytes
attttttaactgaaaa

SEQ ID NO: 217807 - DNA, 16 bp, P. troglodytes
attttttaagaaaaca

SEQ ID NO: 217808 - DNA, 16 bp, P. troglodytes
attttttaagagacag

SEQ ID NO: 217809 - DNA, 16 bp, P. troglodytes
attttttaatcaggtt

SEQ ID NO: 217810 - DNA, 16 bp, P. troglodytes
attttttaatgaaact

SEQ ID NO: 217811 - DNA, 16 bp, P. troglodytes
attttttaatgatcac

SEQ ID NO: 217812 - DNA, 16 bp, P. troglodytes
attttttaatgcaaaa

SEQ ID NO: 217813 - DNA, 16 bp, P. troglodytes
attttttaatgttcaa

SEQ ID NO: 217814 - DNA, 16 bp, P. troglodytes
attttttagagataga

SEQ ID NO: 217815 - DNA, 16 bp, P. troglodytes
attttttatagcagcc

SEQ ID NO: 217816 - DNA, 16 bp, P. troglodytes
attttttattcagaaa

SEQ ID NO: 217817 - DNA, 16 bp, P. troglodytes
attttttcaaaacaaa

SEQ ID NO: 217818 - DNA, 16 bp, P. troglodytes
attttttcaaagaaaa

SEQ ID NO: 217819 - DNA, 16 bp, P. troglodytes
attttttcaaagaatt

SEQ ID NO: 217820 - DNA, 16 bp, P. troglodytes
attttttcacagaatt

SEQ ID NO: 217821 - DNA, 16 bp, P. troglodytes
attttttcagattttg

SEQ ID NO: 217822 - DNA, 16 bp, P. troglodytes
attttttcatatgtat

SEQ ID NO: 217823 - DNA, 16 bp, P. troglodytes
attttttccaaaaatt

SEQ ID NO: 217824 - DNA, 16 bp, P. troglodytes
attttttccaaaatat

SEQ ID NO: 217825 - DNA, 16 bp, P. troglodytes
attttttccccttttg

SEQ ID NO: 217826 - DNA, 16 bp, P. troglodytes
attttttccttctaaa

SEQ ID NO: 217827 - DNA, 16 bp, P. troglodytes
attttttccttttggc

SEQ ID NO: 217828 - DNA, 16 bp, P. troglodytes
attttttctctgaatt

SEQ ID NO: 217829 - DNA, 16 bp, P. troglodytes
attttttcttgcaaat

SEQ ID NO: 217830 - DNA, 16 bp, P. troglodytes
attttttcttttgaaa

SEQ ID NO: 217831 - DNA, 16 bp, P. troglodytes
attttttgaagaaatt

SEQ ID NO: 217832 - DNA, 16 bp, P. troglodytes
attttttgaagtaaaa

SEQ ID NO: 217833 - DNA, 17 bp, P. troglodytes
attttttgagatggagt

SEQ ID NO: 217834 - DNA, 16 bp, P. troglodytes
attttttgaggaaact

SEQ ID NO: 217835 - DNA, 16 bp, P. troglodytes
attttttgaggaaatt

SEQ ID NO: 217836 - DNA, 16 bp, P. troglodytes
attttttgatacattt

SEQ ID NO: 217837 - DNA, 16 bp, P. troglodytes
attttttgcattaatt

SEQ ID NO: 217838 - DNA, 16 bp, P. troglodytes
attttttggaggcttt

SEQ ID NO: 217839 - DNA, 16 bp, P. troglodytes
attttttggggaaaaa

SEQ ID NO: 217840 - DNA, 16 bp, P. troglodytes
attttttgtagacaca

SEQ ID NO: 217841 - DNA, 21 bp, P. troglodytes
attttttgtagagacagggtc

SEQ ID NO: 217842 - DNA, 16 bp, P. troglodytes
attttttgtgtgtgaa

SEQ ID NO: 217843 - DNA, 16 bp, P. troglodytes
atttttttaaaaaacc

SEQ ID NO: 217844 - DNA, 16 bp, P. troglodytes
atttttttaaaaagcc

SEQ ID NO: 217845 - DNA, 16 bp, P. troglodytes
atttttttaaaaaggg

SEQ ID NO: 217846 - DNA, 16 bp, P. troglodytes
atttttttaaaaatgg

SEQ ID NO: 217847 - DNA, 16 bp, P. troglodytes
atttttttaaagaaac

SEQ ID NO: 217848 - DNA, 16 bp, P. troglodytes
atttttttaaagaaag

SEQ ID NO: 217849 - DNA, 16 bp, P. troglodytes
atttttttaaagagca

SEQ ID NO: 217850 - DNA, 16 bp, P. troglodytes
atttttttaaatgtct

SEQ ID NO: 217851 - DNA, 16 bp, P. troglodytes
atttttttaaggaaaa

SEQ ID NO: 217852 - DNA, 16 bp, P. troglodytes
atttttttaagggaag

SEQ ID NO: 217853 - DNA, 16 bp, P. troglodytes
atttttttaattactg

SEQ ID NO: 217854 - DNA, 16 bp, P. troglodytes
atttttttagagacag

SEQ ID NO: 217855 - DNA, 16 bp, P. troglodytes
atttttttatcctgca

SEQ ID NO: 217856 - DNA, 16 bp, P. troglodytes
atttttttcaaatgat

SEQ ID NO: 217857 - DNA, 16 bp, P. troglodytes
atttttttcaagttat

SEQ ID NO: 217858 - DNA, 16 bp, P. troglodytes
atttttttcagaaatt

SEQ ID NO: 217859 - DNA, 16 bp, P. troglodytes
atttttttcaggaaaa

SEQ ID NO: 217860 - DNA, 16 bp, P. troglodytes
atttttttccccaaaa

SEQ ID NO: 217861 - DNA, 16 bp, P. troglodytes
atttttttccccacaa

SEQ ID NO: 217862 - DNA, 16 bp, P. troglodytes
atttttttcctctaaa

SEQ ID NO: 217863 - DNA, 16 bp, P. troglodytes
atttttttcctgtgga

SEQ ID NO: 217864 - DNA, 16 bp, P. troglodytes
atttttttctagatta

SEQ ID NO: 217865 - DNA, 16 bp, P. troglodytes
atttttttctaggaaa

SEQ ID NO: 217866 - DNA, 16 bp, P. troglodytes
atttttttctatgaaa

SEQ ID NO: 217867 - DNA, 16 bp, P. troglodytes
atttttttctcagatt

SEQ ID NO: 217868 - DNA, 16 bp, P. troglodytes
atttttttctccaaag

SEQ ID NO: 217869 - DNA, 16 bp, P. troglodytes
atttttttctgcatct

SEQ ID NO: 217870 - DNA, 16 bp, P. troglodytes
atttttttcttagaaa

SEQ ID NO: 217871 - DNA, 16 bp, P. troglodytes
atttttttcttccaca

SEQ ID NO: 217872 - DNA, 16 bp, P. troglodytes
atttttttgaaaatga

SEQ ID NO: 217873 - DNA, 16 bp, P. troglodytes
atttttttgaaatgtg

SEQ ID NO: 217874 - DNA, 16 bp, P. troglodytes
atttttttgagaagga

SEQ ID NO: 217875 - DNA, 16 bp, P. troglodytes
atttttttgctttcca

SEQ ID NO: 217876 - DNA, 16 bp, P. troglodytes
atttttttgtagagag

SEQ ID NO: 217877 - DNA, 16 bp, P. troglodytes
atttttttgtggagac

SEQ ID NO: 217878 - DNA, 16 bp, P. troglodytes
attttttttaaaaagc

SEQ ID NO: 217879 - DNA, 16 bp, P. troglodytes
attttttttaaagctc

SEQ ID NO: 217880 - DNA, 16 bp, P. troglodytes
attttttttaattagc

SEQ ID NO: 217881 - DNA, 16 bp, P. troglodytes
attttttttcccaaaa

SEQ ID NO: 217882 - DNA, 16 bp, P. troglodytes
attttttttcccacaa

SEQ ID NO: 217883 - DNA, 16 bp, P. troglodytes
attttttttcccccag

SEQ ID NO: 217884 - DNA, 16 bp, P. troglodytes
attttttttctcagca

SEQ ID NO: 217885 - DNA, 16 bp, P. troglodytes
attttttttctccaaa

SEQ ID NO: 217886 - DNA, 16 bp, P. troglodytes
attttttttcttagaa

SEQ ID NO: 217887 - DNA, 16 bp, P. troglodytes
attttttttgagatgg

SEQ ID NO: 217888 - DNA, 16 bp, P. troglodytes
atttttttttaagtac

SEQ ID NO: 217889 - DNA, 16 bp, P. troglodytes
atttttttttcaaagt

SEQ ID NO: 217890 - DNA, 16 bp, P. troglodytes
atttttttttccagaa

SEQ ID NO: 217891 - DNA, 16 bp, P. troglodytes
atttttttttccccag

SEQ ID NO: 217892 - DNA, 16 bp, P. troglodytes
attttttttttaagac

SEQ ID NO: 217893 - DNA, 16 bp, P. troglodytes
caaaaaaaaattgttt

SEQ ID NO: 217894 - DNA, 16 bp, P. troglodytes
caaaaaaaccctgaaa

SEQ ID NO: 217895 - DNA, 16 bp, P. troglodytes
caaaaaaactgaagag

SEQ ID NO: 217896 - DNA, 16 bp, P. troglodytes
caaaaaaattgaagag

SEQ ID NO: 217897 - DNA, 16 bp, P. troglodytes
caaaaaaattgtgtga

SEQ ID NO: 217898 - DNA, 16 bp, P. troglodytes
caaaaaacagaatttt

SEQ ID NO: 217899 - DNA, 16 bp, P. troglodytes
caaaaaagccttcaaa

SEQ ID NO: 217900 - DNA, 16 bp, P. troglodytes
caaaaaaggagaattt

SEQ ID NO: 217901 - DNA, 16 bp, P. troglodytes
caaaaaataaatgctt

SEQ ID NO: 217902 - DNA, 16 bp, P. troglodytes
caaaaaattatctgga

SEQ ID NO: 217903 - DNA, 16 bp, P. troglodytes
caaaaacaaaaccttt

SEQ ID NO: 217904 - DNA, 16 bp, P. troglodytes
caaaaacactgtttcc

SEQ ID NO: 217905 - DNA, 16 bp, P. troglodytes
caaaaacagatatata

SEQ ID NO: 217906 - DNA, 16 bp, P. troglodytes
caaaaacaggcagtgg

SEQ ID NO: 217907 - DNA, 16 bp, P. troglodytes
caaaaacattccaaat

SEQ ID NO: 217908 - DNA, 16 bp, P. troglodytes
caaaaacattttttaa

SEQ ID NO: 217909 - DNA, 16 bp, P. troglodytes
caaaaactcctgataa

SEQ ID NO: 217910 - DNA, 16 bp, P. troglodytes
caaaaactgaagatat

SEQ ID NO: 217911 - DNA, 16 bp, P. troglodytes
caaaaactggaagaat

SEQ ID NO: 217912 - DNA, 16 bp, P. troglodytes
caaaaactggaggcat

SEQ ID NO: 217913 - DNA, 16 bp, P. troglodytes
caaaaacttgaaaata

SEQ ID NO: 217914 - DNA, 16 bp, P. troglodytes
caaaaactttttttaa

SEQ ID NO: 217915 - DNA, 16 bp, P. troglodytes
caaaaagaacagagct

SEQ ID NO: 217916 - DNA, 16 bp, P. troglodytes
caaaaagaataaagct

SEQ ID NO: 217917 - DNA, 16 bp, P. troglodytes
caaaaagaattttaaa

SEQ ID NO: 217918 - DNA, 16 bp, P. troglodytes
caaaaagactggcagc

SEQ ID NO: 217919 - DNA, 16 bp, P. troglodytes
caaaaagagcaaaact

SEQ ID NO: 217920 - DNA, 16 bp, P. troglodytes
caaaaagatggggaaa

SEQ ID NO: 217921 - DNA, 16 bp, P. troglodytes
caaaaagattataact

SEQ ID NO: 217922 - DNA, 16 bp, P. troglodytes
caaaaagcaaaacttg

SEQ ID NO: 217923 - DNA, 16 bp, P. troglodytes
caaaaagcagcccaag

SEQ ID NO: 217924 - DNA, 16 bp, P. troglodytes
caaaaagctattagaa

SEQ ID NO: 217925 - DNA, 16 bp, P. troglodytes
caaaaaggaaaacatt

SEQ ID NO: 217926 - DNA, 16 bp, P. troglodytes
caaaaaggaatgaatt

SEQ ID NO: 217927 - DNA, 16 bp, P. troglodytes
caaaaaggattttttt

SEQ ID NO: 217928 - DNA, 16 bp, P. troglodytes
caaaaagtagaaagat

SEQ ID NO: 217929 - DNA, 16 bp, P. troglodytes
caaaaagtatttttaa

SEQ ID NO: 217930 - DNA, 16 bp, P. troglodytes
caaaaagtgtctgaga

SEQ ID NO: 217931 - DNA, 16 bp, P. troglodytes
caaaaagttcctcatc

SEQ ID NO: 217932 - DNA, 16 bp, P. troglodytes
caaaaagtttcagatt

SEQ ID NO: 217933 - DNA, 16 bp, P. troglodytes
caaaaagtttgagaac

SEQ ID NO: 217934 - DNA, 16 bp, P. troglodytes
caaaaagttttaaaaa

SEQ ID NO: 217935 - DNA, 16 bp, P. troglodytes
caaaaagttttggatt

SEQ ID NO: 217936 - DNA, 16 bp, P. troglodytes
caaaaataaatgaatg

SEQ ID NO: 217937 - DNA, 16 bp, P. troglodytes
caaaaataattttaag

SEQ ID NO: 217938 - DNA, 16 bp, P. troglodytes
caaaaatacaaaagtt

SEQ ID NO: 217939 - DNA, 16 bp, P. troglodytes
caaaaatacagtattc

SEQ ID NO: 217940 - DNA, 16 bp, P. troglodytes
caaaaatatatatgta

SEQ ID NO: 217941 - DNA, 16 bp, P. troglodytes
caaaaatatctttttt

SEQ ID NO: 217942 - DNA, 16 bp, P. troglodytes
caaaaatatgaaatta

SEQ ID NO: 217943 - DNA, 16 bp, P. troglodytes
caaaaatatgtttaaa

SEQ ID NO: 217944 - DNA, 16 bp, P. troglodytes
caaaaatatgtttata

SEQ ID NO: 217945 - DNA, 16 bp, P. troglodytes
caaaaatattacaaga

SEQ ID NO: 217946 - DNA, 16 bp, P. troglodytes
caaaaatattgtaaaa

SEQ ID NO: 217947 - DNA, 16 bp, P. troglodytes
caaaaatatttgttga

SEQ ID NO: 217948 - DNA, 16 bp, P. troglodytes
caaaaatattttccta

SEQ ID NO: 217949 - DNA, 16 bp, P. troglodytes
caaaaatattttcctt

SEQ ID NO: 217950 - DNA, 16 bp, P. troglodytes
caaaaatattttgcaa

SEQ ID NO: 217951 - DNA, 16 bp, P. troglodytes
caaaaatcaagaaatt

SEQ ID NO: 217952 - DNA, 16 bp, P. troglodytes
caaaaatcaatagctt

SEQ ID NO: 217953 - DNA, 18 bp, P. troglodytes
caaaaatcacaagcattc

SEQ ID NO: 217954 - DNA, 18 bp, P. troglodytes
caaaaatcacaagcattg

SEQ ID NO: 217955 - DNA, 16 bp, P. troglodytes
caaaaatcactagcat

SEQ ID NO: 217956 - DNA, 16 bp, P. troglodytes
caaaaatcagcatttc

SEQ ID NO: 217957 - DNA, 16 bp, P. troglodytes
caaaaatcattaagaa

SEQ ID NO: 217958 - DNA, 16 bp, P. troglodytes
caaaaatctcatcttg

SEQ ID NO: 217959 - DNA, 16 bp, P. troglodytes
caaaaatctgtacaca

SEQ ID NO: 217960 - DNA, 16 bp, P. troglodytes
caaaaatcttcagtaa

SEQ ID NO: 217961 - DNA, 16 bp, P. troglodytes
caaaaatgaattcaag

SEQ ID NO: 217962 - DNA, 16 bp, P. troglodytes
caaaaatgaatttttt

SEQ ID NO: 217963 - DNA, 16 bp, P. troglodytes
caaaaatgagctgagc

SEQ ID NO: 217964 - DNA, 16 bp, P. troglodytes
caaaaatgcaaattaa

SEQ ID NO: 217965 - DNA, 16 bp, P. troglodytes
caaaaatgcccacttt

SEQ ID NO: 217966 - DNA, 16 bp, P. troglodytes
caaaaatgtaaatata

SEQ ID NO: 217967 - DNA, 16 bp, P. troglodytes
caaaaatgtccccaga

SEQ ID NO: 217968 - DNA, 16 bp, P. troglodytes
caaaaatgtctccaaa

SEQ ID NO: 217969 - DNA, 16 bp, P. troglodytes
caaaaatgtctctaga

SEQ ID NO: 217970 - DNA, 16 bp, P. troglodytes
caaaaatgtcttcaga

SEQ ID NO: 217971 - DNA, 16 bp, P. troglodytes
caaaaatgtgaagaaa

SEQ ID NO: 217972 - DNA, 16 bp, P. troglodytes
caaaaatgtgattttt

SEQ ID NO: 217973 - DNA, 16 bp, P. troglodytes
caaaaatgtggagaaa

SEQ ID NO: 217974 - DNA, 16 bp, P. troglodytes
caaaaatgtttgaaga

SEQ ID NO: 217975 - DNA, 16 bp, P. troglodytes
caaaaatgttttaaaa

SEQ ID NO: 217976 - DNA, 16 bp, P. troglodytes
caaaaatgtttttaaa

SEQ ID NO: 217977 - DNA, 16 bp, P. troglodytes
caaaaattaactgggc

SEQ ID NO: 217978 - DNA, 18 bp, P. troglodytes
caaaaattagctgggcac

SEQ ID NO: 217979 - DNA, 16 bp, P. troglodytes
caaaaattaggcaggt

SEQ ID NO: 217980 - DNA, 16 bp, P. troglodytes
caaaaattatccagac

SEQ ID NO: 217981 - DNA, 16 bp, P. troglodytes
caaaaattgacaagtg

SEQ ID NO: 217982 - DNA, 16 bp, P. troglodytes
caaaaattggaagcaa

SEQ ID NO: 217983 - DNA, 16 bp, P. troglodytes
caaaaattgggctaag

SEQ ID NO: 217984 - DNA, 16 bp, P. troglodytes
caaaaatttattcaag

SEQ ID NO: 217985 - DNA, 16 bp, P. troglodytes
caaaaatttgtacatg

SEQ ID NO: 217986 - DNA, 16 bp, P. troglodytes
caaaaattttccaaat

SEQ ID NO: 217987 - DNA, 16 bp, P. troglodytes
caaaacaaaaacctga

SEQ ID NO: 217988 - DNA, 16 bp, P. troglodytes
caaaacaaatgtttaa

SEQ ID NO: 217989 - DNA, 16 bp, P. troglodytes
caaaacaagtctttaa

SEQ ID NO: 217990 - DNA, 16 bp, P. troglodytes
caaaacaatcctttaa

SEQ ID NO: 217991 - DNA, 16 bp, P. troglodytes
caaaacacaatgagat

SEQ ID NO: 217992 - DNA, 16 bp, P. troglodytes
caaaacacagctgaaa

SEQ ID NO: 217993 - DNA, 16 bp, P. troglodytes
caaaacacatgaaata

SEQ ID NO: 217994 - DNA, 16 bp, P. troglodytes
caaaacactgctcaac

SEQ ID NO: 217995 - DNA, 16 bp, P. troglodytes
caaaacactttcataa

SEQ ID NO: 217996 - DNA, 16 bp, P. troglodytes
caaaacagacaaaatc

SEQ ID NO: 217997 - DNA, 16 bp, P. troglodytes
caaaacagagcctgaa

SEQ ID NO: 217998 - DNA, 16 bp, P. troglodytes
caaaacaggcaaaact

SEQ ID NO: 217999 - DNA, 16 bp, P. troglodytes
caaaacagtatggcac

SEQ ID NO: 218000 - DNA, 16 bp, P. troglodytes
caaaacagtctttaaa

SEQ ID NO: 218001 - DNA, 16 bp, P. troglodytes
caaaacatcattgaaa

SEQ ID NO: 218002 - DNA, 16 bp, P. troglodytes
caaaacatgtttttaa

SEQ ID NO: 218003 - DNA, 16 bp, P. troglodytes
caaaacattgatgaaa

SEQ ID NO: 218004 - DNA, 16 bp, P. troglodytes
caaaacattgctgaaa

SEQ ID NO: 218005 - DNA, 16 bp, P. troglodytes
caaaacattgttatgt

SEQ ID NO: 218006 - DNA, 16 bp, P. troglodytes
caaaaccacaatgaaa

SEQ ID NO: 218007 - DNA, 16 bp, P. troglodytes
caaaaccacagtgagg

SEQ ID NO: 218008 - DNA, 16 bp, P. troglodytes
caaaaccacatctgta

SEQ ID NO: 218009 - DNA, 16 bp, P. troglodytes
caaaaccaccctgggc

SEQ ID NO: 218010 - DNA, 16 bp, P. troglodytes
caaaaccagacaagga

SEQ ID NO: 218011 - DNA, 16 bp, P. troglodytes
caaaacccactgttct

SEQ ID NO: 218012 - DNA, 16 bp, P. troglodytes
caaaaccccatctctt

SEQ ID NO: 218013 - DNA, 16 bp, P. troglodytes
caaaaccccattttta

SEQ ID NO: 218014 - DNA, 16 bp, P. troglodytes
caaaaccctatctcaa

SEQ ID NO: 218015 - DNA, 22 bp, P. troglodytes
caaaaccctgtttctactaaaa

SEQ ID NO: 218016 - DNA, 16 bp, P. troglodytes
caaaacctcatctcta

SEQ ID NO: 218017 - DNA, 16 bp, P. troglodytes
caaaacctctgggata

SEQ ID NO: 218018 - DNA, 16 bp, P. troglodytes
caaaacctggaaacaa

SEQ ID NO: 218019 - DNA, 16 bp, P. troglodytes
caaaactaagaaatta

SEQ ID NO: 218020 - DNA, 16 bp, P. troglodytes
caaaactagccaggca

SEQ ID NO: 218021 - DNA, 16 bp, P. troglodytes
caaaactattttttta

SEQ ID NO: 218022 - DNA, 16 bp, P. troglodytes
caaaactcactcaaga

SEQ ID NO: 218023 - DNA, 16 bp, P. troglodytes
caaaactctgatgaaa

SEQ ID NO: 218024 - DNA, 16 bp, P. troglodytes
caaaactgaaggagat

SEQ ID NO: 218025 - DNA, 16 bp, P. troglodytes
caaaactgagcagaag

SEQ ID NO: 218026 - DNA, 16 bp, P. troglodytes
caaaactgatttaaaa

SEQ ID NO: 218027 - DNA, 16 bp, P. troglodytes
caaaacttaaaagcaa

SEQ ID NO: 218028 - DNA, 16 bp, P. troglodytes
caaaacttactacaag

SEQ ID NO: 218029 - DNA, 16 bp, P. troglodytes
caaaacttcaaaagta

SEQ ID NO: 218030 - DNA, 16 bp, P. troglodytes
caaaacttgctacaaa

SEQ ID NO: 218031 - DNA, 16 bp, P. troglodytes
caaaacttggaaacaa

SEQ ID NO: 218032 - DNA, 16 bp, P. troglodytes
caaaactttcttttct

SEQ ID NO: 218033 - DNA, 16 bp, P. troglodytes
caaaacttttcttttt

SEQ ID NO: 218034 - DNA, 16 bp, P. troglodytes
caaaagaaaaaggttt

SEQ ID NO: 218035 - DNA, 16 bp, P. troglodytes
caaaagaaaaatggat

SEQ ID NO: 218036 - DNA, 16 bp, P. troglodytes
caaaagaaaacattta

SEQ ID NO: 218037 - DNA, 16 bp, P. troglodytes
caaaagaaaagaagtc

SEQ ID NO: 218038 - DNA, 16 bp, P. troglodytes
caaaagaaaagacctt

SEQ ID NO: 218039 - DNA, 16 bp, P. troglodytes
caaaagaaaatgaatt

SEQ ID NO: 218040 - DNA, 16 bp, P. troglodytes
caaaagaaaatttcaa

SEQ ID NO: 218041 - DNA, 16 bp, P. troglodytes
caaaagaaactatgaa

SEQ ID NO: 218042 - DNA, 16 bp, P. troglodytes
caaaagaaagaatttg

SEQ ID NO: 218043 - DNA, 16 bp, P. troglodytes
caaaagaaagctgaag

SEQ ID NO: 218044 - DNA, 16 bp, P. troglodytes
caaaagaaaggtttaa

SEQ ID NO: 218045 - DNA, 16 bp, P. troglodytes
caaaagaaatacctaa

SEQ ID NO: 218046 - DNA, 16 bp, P. troglodytes
caaaagaaatcagaga

SEQ ID NO: 218047 - DNA, 16 bp, P. troglodytes
caaaagaaattaattt

SEQ ID NO: 218048 - DNA, 16 bp, P. troglodytes
caaaagaacacattta

SEQ ID NO: 218049 - DNA, 16 bp, P. troglodytes
caaaagaagacacatg

SEQ ID NO: 218050 - DNA, 16 bp, P. troglodytes
caaaagaagacatttt

SEQ ID NO: 218051 - DNA, 16 bp, P. troglodytes
caaaagaatatatata

SEQ ID NO: 218052 - DNA, 16 bp, P. troglodytes
caaaagaatgaaattg

SEQ ID NO: 218053 - DNA, 16 bp, P. troglodytes
caaaagaatgaatttg

SEQ ID NO: 218054 - DNA, 16 bp, P. troglodytes
caaaagaatggcgtga

SEQ ID NO: 218055 - DNA, 16 bp, P. troglodytes
caaaagaatggctact

SEQ ID NO: 218056 - DNA, 16 bp, P. troglodytes
caaaagaattgaaaat

SEQ ID NO: 218057 - DNA, 16 bp, P. troglodytes
caaaagaattgaaatc

SEQ ID NO: 218058 - DNA, 16 bp, P. troglodytes
caaaagacactatcaa

SEQ ID NO: 218059 - DNA, 16 bp, P. troglodytes
caaaagacataatttt

SEQ ID NO: 218060 - DNA, 16 bp, P. troglodytes
caaaagacatatgaaa

SEQ ID NO: 218061 - DNA, 16 bp, P. troglodytes
caaaagaccacatatt

SEQ ID NO: 218062 - DNA, 16 bp, P. troglodytes
caaaagacttgaacag

SEQ ID NO: 218063 - DNA, 16 bp, P. troglodytes
caaaagagaaatttta

SEQ ID NO: 218064 - DNA, 16 bp, P. troglodytes
caaaagagtgaaaaga

SEQ ID NO: 218065 - DNA, 16 bp, P. troglodytes
caaaagatgcagaaaa

SEQ ID NO: 218066 - DNA, 16 bp, P. troglodytes
caaaagattaatgaaa

SEQ ID NO: 218067 - DNA, 16 bp, P. troglodytes
caaaagcaaatggaaa

SEQ ID NO: 218068 - DNA, 16 bp, P. troglodytes
caaaagcaagaaatgg

SEQ ID NO: 218069 - DNA, 16 bp, P. troglodytes
caaaagcaatgctaag

SEQ ID NO: 218070 - DNA, 16 bp, P. troglodytes
caaaagcaatttttaa

SEQ ID NO: 218071 - DNA, 16 bp, P. troglodytes
caaaagcagaagctgc

SEQ ID NO: 218072 - DNA, 16 bp, P. troglodytes
caaaagcaggaacaag

SEQ ID NO: 218073 - DNA, 16 bp, P. troglodytes
caaaagcataattcat

SEQ ID NO: 218074 - DNA, 16 bp, P. troglodytes
caaaagcattaaaaat

SEQ ID NO: 218075 - DNA, 16 bp, P. troglodytes
caaaagccaaaatgga

SEQ ID NO: 218076 - DNA, 16 bp, P. troglodytes
caaaagctagaaataa

SEQ ID NO: 218077 - DNA, 16 bp, P. troglodytes
caaaagctagaaatga

SEQ ID NO: 218078 - DNA, 16 bp, P. troglodytes
caaaaggaaaaacatt

SEQ ID NO: 218079 - DNA, 16 bp, P. troglodytes
caaaaggaaaatatca

SEQ ID NO: 218080 - DNA, 16 bp, P. troglodytes
caaaaggaaatgaaat

SEQ ID NO: 218081 - DNA, 16 bp, P. troglodytes
caaaaggaagagtcag

SEQ ID NO: 218082 - DNA, 16 bp, P. troglodytes
caaaaggacacagaag

SEQ ID NO: 218083 - DNA, 16 bp, P. troglodytes
caaaaggagaccctgt

SEQ ID NO: 218084 - DNA, 16 bp, P. troglodytes
caaaaggattttaaaa

SEQ ID NO: 218085 - DNA, 16 bp, P. troglodytes
caaaaggcagaggaag

SEQ ID NO: 218086 - DNA, 16 bp, P. troglodytes
caaaaggcatgtctta

SEQ ID NO: 218087 - DNA, 16 bp, P. troglodytes
caaaagggaaaataat

SEQ ID NO: 218088 - DNA, 16 bp, P. troglodytes
caaaagggactttaca

SEQ ID NO: 218089 - DNA, 16 bp, P. troglodytes
caaaagggagaaattg

SEQ ID NO: 218090 - DNA, 16 bp, P. troglodytes
caaaagtaaatgcaac

SEQ ID NO: 218091 - DNA, 16 bp, P. troglodytes
caaaagtagagaaaat

SEQ ID NO: 218092 - DNA, 16 bp, P. troglodytes
caaaagtcagctgggc

SEQ ID NO: 218093 - DNA, 16 bp, P. troglodytes
caaaagtgagcagaag

SEQ ID NO: 218094 - DNA, 16 bp, P. troglodytes
caaaagttgaaagcat

SEQ ID NO: 218095 - DNA, 16 bp, P. troglodytes
caaaagttgacaaatg

SEQ ID NO: 218096 - DNA, 16 bp, P. troglodytes
caaaagtttccttgtg

SEQ ID NO: 218097 - DNA, 16 bp, P. troglodytes
caaaagttttcatttt

SEQ ID NO: 218098 - DNA, 16 bp, P. troglodytes
caaaataaaaagcttc

SEQ ID NO: 218099 - DNA, 16 bp, P. troglodytes
caaaataaaaagtttt

SEQ ID NO: 218100 - DNA, 16 bp, P. troglodytes
caaaataaaaatgttt

SEQ ID NO: 218101 - DNA, 16 bp, P. troglodytes
caaaataaaagttttt

SEQ ID NO: 218102 - DNA, 16 bp, P. troglodytes
caaaataaacctgtct

SEQ ID NO: 218103 - DNA, 16 bp, P. troglodytes
caaaataaactgtcaa

SEQ ID NO: 218104 - DNA, 16 bp, P. troglodytes
caaaataaacttttta

SEQ ID NO: 218105 - DNA, 16 bp, P. troglodytes
caaaataaagatattt

SEQ ID NO: 218106 - DNA, 16 bp, P. troglodytes
caaaataaagccaaat

SEQ ID NO: 218107 - DNA, 16 bp, P. troglodytes
caaaataaattgtttt

SEQ ID NO: 218108 - DNA, 16 bp, P. troglodytes
caaaataaatttcaga

SEQ ID NO: 218109 - DNA, 16 bp, P. troglodytes
caaaataataatgagg

SEQ ID NO: 218110 - DNA, 16 bp, P. troglodytes
caaaataatactgaaa

SEQ ID NO: 218111 - DNA, 16 bp, P. troglodytes
caaaataatattgaaa

SEQ ID NO: 218112 - DNA, 16 bp, P. troglodytes
caaaataatattttca

SEQ ID NO: 218113 - DNA, 16 bp, P. troglodytes
caaaataatggaaaat

SEQ ID NO: 218114 - DNA, 16 bp, P. troglodytes
caaaataatggcattt

SEQ ID NO: 218115 - DNA, 16 bp, P. troglodytes
caaaataattcttttt

SEQ ID NO: 218116 - DNA, 16 bp, P. troglodytes
caaaatacacaaagca

SEQ ID NO: 218117 - DNA, 16 bp, P. troglodytes
caaaatacacattctt

SEQ ID NO: 218118 - DNA, 16 bp, P. troglodytes
caaaatacatgaagta

SEQ ID NO: 218119 - DNA, 16 bp, P. troglodytes
caaaatagaattcaag

SEQ ID NO: 218120 - DNA, 16 bp, P. troglodytes
caaaatagcaagaaga

SEQ ID NO: 218121 - DNA, 16 bp, P. troglodytes
caaaatagctgggatt

SEQ ID NO: 218122 - DNA, 16 bp, P. troglodytes
caaaatataaagacca

SEQ ID NO: 218123 - DNA, 16 bp, P. troglodytes
caaaatatactacaga

SEQ ID NO: 218124 - DNA, 16 bp, P. troglodytes
caaaatatatgaagta

SEQ ID NO: 218125 - DNA, 16 bp, P. troglodytes
caaaatatatgagaaa

SEQ ID NO: 218126 - DNA, 16 bp, P. troglodytes
caaaatatattaggaa

SEQ ID NO: 218127 - DNA, 16 bp, P. troglodytes
caaaatatcaatgata

SEQ ID NO: 218128 - DNA, 16 bp, P. troglodytes
caaaatatctgaatag

SEQ ID NO: 218129 - DNA, 16 bp, P. troglodytes
caaaatatgaaatact

SEQ ID NO: 218130 - DNA, 16 bp, P. troglodytes
caaaatatgtaagaaa

SEQ ID NO: 218131 - DNA, 16 bp, P. troglodytes
caaaatattaaaaatg

SEQ ID NO: 218132 - DNA, 16 bp, P. troglodytes
caaaatattagcaaat

SEQ ID NO: 218133 - DNA, 16 bp, P. troglodytes
caaaatattctacaaa

SEQ ID NO: 218134 - DNA, 16 bp, P. troglodytes
caaaatattgaaagaa

SEQ ID NO: 218135 - DNA, 16 bp, P. troglodytes
caaaatattttacatt

SEQ ID NO: 218136 - DNA, 16 bp, P. troglodytes
caaaatattttatcat

SEQ ID NO: 218137 - DNA, 16 bp, P. troglodytes
caaaatattttcttat

SEQ ID NO: 218138 - DNA, 16 bp, P. troglodytes
caaaatatttttccaa

SEQ ID NO: 218139 - DNA, 16 bp, P. troglodytes
caaaatcaaagccaaa

SEQ ID NO: 218140 - DNA, 16 bp, P. troglodytes
caaaatcaagatgtca

SEQ ID NO: 218141 - DNA, 16 bp, P. troglodytes
caaaatcactaagcca

SEQ ID NO: 218142 - DNA, 16 bp, P. troglodytes
caaaatcagaaatgaa

SEQ ID NO: 218143 - DNA, 16 bp, P. troglodytes
caaaatcagctgggcg

SEQ ID NO: 218144 - DNA, 16 bp, P. troglodytes
caaaatcatctctctc

SEQ ID NO: 218145 - DNA, 16 bp, P. troglodytes
caaaatcatctggcaa

SEQ ID NO: 218146 - DNA, 16 bp, P. troglodytes
caaaatcatttctttt

SEQ ID NO: 218147 - DNA, 16 bp, P. troglodytes
caaaatccacagatgc

SEQ ID NO: 218148 - DNA, 16 bp, P. troglodytes
caaaatccagaacact

SEQ ID NO: 218149 - DNA, 16 bp, P. troglodytes
caaaatctcaaaagta

SEQ ID NO: 218150 - DNA, 16 bp, P. troglodytes
caaaatctcatcttga

SEQ ID NO: 218151 - DNA, 16 bp, P. troglodytes
caaaatctcctttgac

SEQ ID NO: 218152 - DNA, 16 bp, P. troglodytes
caaaatctctgagcat

SEQ ID NO: 218153 - DNA, 16 bp, P. troglodytes
caaaatctgaaaaaat

SEQ ID NO: 218154 - DNA, 16 bp, P. troglodytes
caaaatctgaaacttt

SEQ ID NO: 218155 - DNA, 16 bp, P. troglodytes
caaaatctgaaatgct

SEQ ID NO: 218156 - DNA, 16 bp, P. troglodytes
caaaatgaaaatgtag

SEQ ID NO: 218157 - DNA, 16 bp, P. troglodytes
caaaatgaaaccctgt

SEQ ID NO: 218158 - DNA, 16 bp, P. troglodytes
caaaatgaaatgattt

SEQ ID NO: 218159 - DNA, 16 bp, P. troglodytes
caaaatgaagacattt

SEQ ID NO: 218160 - DNA, 16 bp, P. troglodytes
caaaatgaaggaagaa

SEQ ID NO: 218161 - DNA, 16 bp, P. troglodytes
caaaatgaatgcaaaa

SEQ ID NO: 218162 - DNA, 16 bp, P. troglodytes
caaaatgagaataata

SEQ ID NO: 218163 - DNA, 16 bp, P. troglodytes
caaaatgatgaaaccc

SEQ ID NO: 218164 - DNA, 16 bp, P. troglodytes
caaaatgatttccttt

SEQ ID NO: 218165 - DNA, 16 bp, P. troglodytes
caaaatgatttttaat

SEQ ID NO: 218166 - DNA, 16 bp, P. troglodytes
caaaatgcacaaagca

SEQ ID NO: 218167 - DNA, 16 bp, P. troglodytes
caaaatgcattcattt

SEQ ID NO: 218168 - DNA, 16 bp, P. troglodytes
caaaatgccaatagtg

SEQ ID NO: 218169 - DNA, 16 bp, P. troglodytes
caaaatgccacagact

SEQ ID NO: 218170 - DNA, 16 bp, P. troglodytes
caaaatgctccagtga

SEQ ID NO: 218171 - DNA, 16 bp, P. troglodytes
caaaatgctgagatta

SEQ ID NO: 218172 - DNA, 16 bp, P. troglodytes
caaaatgctgataatg

SEQ ID NO: 218173 - DNA, 16 bp, P. troglodytes
caaaatgctgggactg

SEQ ID NO: 218174 - DNA, 16 bp, P. troglodytes
caaaatgctgggattg

SEQ ID NO: 218175 - DNA, 16 bp, P. troglodytes
caaaatgctgggattt

SEQ ID NO: 218176 - DNA, 16 bp, P. troglodytes
caaaatgcttttaaaa

SEQ ID NO: 218177 - DNA, 16 bp, P. troglodytes
caaaatggatttaaaa

SEQ ID NO: 218178 - DNA, 16 bp, P. troglodytes
caaaatggcaattatt

SEQ ID NO: 218179 - DNA, 16 bp, P. troglodytes
caaaatggcggctcca

SEQ ID NO: 218180 - DNA, 16 bp, P. troglodytes
caaaatgggagaaaac

SEQ ID NO: 218181 - DNA, 16 bp, P. troglodytes
caaaatggggagaaaa

SEQ ID NO: 218182 - DNA, 16 bp, P. troglodytes
caaaatggtgattttt

SEQ ID NO: 218183 - DNA, 16 bp, P. troglodytes
caaaatggttaagatg

SEQ ID NO: 218184 - DNA, 16 bp, P. troglodytes
caaaatgtagggatta

SEQ ID NO: 218185 - DNA, 16 bp, P. troglodytes
caaaatgtataaggaa

SEQ ID NO: 218186 - DNA, 16 bp, P. troglodytes
caaaatgtattttaaa

SEQ ID NO: 218187 - DNA, 16 bp, P. troglodytes
caaaatgtctccagac

SEQ ID NO: 218188 - DNA, 16 bp, P. troglodytes
caaaatgttaacaact

SEQ ID NO: 218189 - DNA, 16 bp, P. troglodytes
caaaatgttaacagtg

SEQ ID NO: 218190 - DNA, 16 bp, P. troglodytes
caaaatgttgctgaaa

SEQ ID NO: 218191 - DNA, 16 bp, P. troglodytes
caaaatgttttcaagg

SEQ ID NO: 218192 - DNA, 16 bp, P. troglodytes
caaaatgttttccaaa

SEQ ID NO: 218193 - DNA, 16 bp, P. troglodytes
caaaatgttttggatt

SEQ ID NO: 218194 - DNA, 16 bp, P. troglodytes
caaaattaaaatcttt

SEQ ID NO: 218195 - DNA, 16 bp, P. troglodytes
caaaattaaacatttt

SEQ ID NO: 218196 - DNA, 16 bp, P. troglodytes
caaaattagccagcca

SEQ ID NO: 218197 - DNA, 16 bp, P. troglodytes
caaaattagctaggca

SEQ ID NO: 218198 - DNA, 16 bp, P. troglodytes
caaaattagttttaaa

SEQ ID NO: 218199 - DNA, 16 bp, P. troglodytes
caaaattatagagaca

SEQ ID NO: 218200 - DNA, 16 bp, P. troglodytes
caaaattatcctttaa

SEQ ID NO: 218201 - DNA, 16 bp, P. troglodytes
caaaattatctttcaa

SEQ ID NO: 218202 - DNA, 16 bp, P. troglodytes
caaaattattttcagt

SEQ ID NO: 218203 - DNA, 16 bp, P. troglodytes
caaaattcatctgttg

SEQ ID NO: 218204 - DNA, 16 bp, P. troglodytes
caaaattcatgtgttg

SEQ ID NO: 218205 - DNA, 16 bp, P. troglodytes
caaaattcatttatgt

SEQ ID NO: 218206 - DNA, 16 bp, P. troglodytes
caaaattcctaaaaat

SEQ ID NO: 218207 - DNA, 16 bp, P. troglodytes
caaaattgaaaggaag

SEQ ID NO: 218208 - DNA, 16 bp, P. troglodytes
caaaattgacaaaatg

SEQ ID NO: 218209 - DNA, 16 bp, P. troglodytes
caaaattgcccctggt

SEQ ID NO: 218210 - DNA, 16 bp, P. troglodytes
caaaattgttttaaaa

SEQ ID NO: 218211 - DNA, 16 bp, P. troglodytes
caaaattgttttggtt

SEQ ID NO: 218212 - DNA, 16 bp, P. troglodytes
caaaatttacaaagaa

SEQ ID NO: 218213 - DNA, 16 bp, P. troglodytes
caaaatttctgaaaat

SEQ ID NO: 218214 - DNA, 16 bp, P. troglodytes
caaaatttgtatgttg

SEQ ID NO: 218215 - DNA, 16 bp, P. troglodytes
caaaatttttgtattt

SEQ ID NO: 218216 - DNA, 16 bp, P. troglodytes
caaacaaaaaaatgtt

SEQ ID NO: 218217 - DNA, 16 bp, P. troglodytes
caaacaaaaaacactg

SEQ ID NO: 218218 - DNA, 16 bp, P. troglodytes
caaacaaaaaacagtt

SEQ ID NO: 218219 - DNA, 16 bp, P. troglodytes
caaacaaaaatgcatt

SEQ ID NO: 218220 - DNA, 16 bp, P. troglodytes
caaacaaaagttgagg

SEQ ID NO: 218221 - DNA, 16 bp, P. troglodytes
caaacaaacaaaactg

SEQ ID NO: 218222 - DNA, 16 bp, P. troglodytes
caaacaaacaaacagt

SEQ ID NO: 218223 - DNA, 16 bp, P. troglodytes
caaacaaacaaagtat

SEQ ID NO: 218224 - DNA, 16 bp, P. troglodytes
caaacaaatgctgaaa

SEQ ID NO: 218225 - DNA, 16 bp, P. troglodytes
caaacaaatggaagag

SEQ ID NO: 218226 - DNA, 16 bp, P. troglodytes
caaacaacagacattt

SEQ ID NO: 218227 - DNA, 16 bp, P. troglodytes
caaacaaccccatgaa

SEQ ID NO: 218228 - DNA, 16 bp, P. troglodytes
caaacaactggaaaaa

SEQ ID NO: 218229 - DNA, 16 bp, P. troglodytes
caaacaactggaagaa

SEQ ID NO: 218230 - DNA, 16 bp, P. troglodytes
caaacaacttcagcaa

SEQ ID NO: 218231 - DNA, 16 bp, P. troglodytes
caaacaattagaaaat

SEQ ID NO: 218232 - DNA, 16 bp, P. troglodytes
caaacacacacatgca

SEQ ID NO: 218233 - DNA, 16 bp, P. troglodytes
caaacacatgaaaaga

SEQ ID NO: 218234 - DNA, 16 bp, P. troglodytes
caaacacatttatttt

SEQ ID NO: 218235 - DNA, 16 bp, P. troglodytes
caaacactagtctaga

SEQ ID NO: 218236 - DNA, 16 bp, P. troglodytes
caaacactgtggaagg

SEQ ID NO: 218237 - DNA, 16 bp, P. troglodytes
caaacactttggaaaa

SEQ ID NO: 218238 - DNA, 16 bp, P. troglodytes
caaacagaattttaaa

SEQ ID NO: 218239 - DNA, 16 bp, P. troglodytes
caaacagagagccaca

SEQ ID NO: 218240 - DNA, 16 bp, P. troglodytes
caaacagattaagaca

SEQ ID NO: 218241 - DNA, 16 bp, P. troglodytes
caaacagcaaatattt

SEQ ID NO: 218242 - DNA, 16 bp, P. troglodytes
caaacagggtctagag

SEQ ID NO: 218243 - DNA, 16 bp, P. troglodytes
caaacagggtctgcag

SEQ ID NO: 218244 - DNA, 16 bp, P. troglodytes
caaacaggtatttgta

SEQ ID NO: 218245 - DNA, 16 bp, P. troglodytes
caaacagttccaacct

SEQ ID NO: 218246 - DNA, 16 bp, P. troglodytes
caaacataatgttgaa

SEQ ID NO: 218247 - DNA, 16 bp, P. troglodytes
caaacatacatatata

SEQ ID NO: 218248 - DNA, 16 bp, P. troglodytes
caaacatcatactgaa

SEQ ID NO: 218249 - DNA, 16 bp, P. troglodytes
caaacatcatagctta

SEQ ID NO: 218250 - DNA, 16 bp, P. troglodytes
caaacatggcaaaatc

SEQ ID NO: 218251 - DNA, 16 bp, P. troglodytes
caaacattcagacaat

SEQ ID NO: 218252 - DNA, 16 bp, P. troglodytes
caaacattctcaacaa

SEQ ID NO: 218253 - DNA, 16 bp, P. troglodytes
caaacatttatcattt

SEQ ID NO: 218254 - DNA, 16 bp, P. troglodytes
caaacatttattattt

SEQ ID NO: 218255 - DNA, 16 bp, P. troglodytes
caaaccaaatccaaag

SEQ ID NO: 218256 - DNA, 16 bp, P. troglodytes
caaaccaagaagaaat

SEQ ID NO: 218257 - DNA, 16 bp, P. troglodytes
caaaccactgcactcc

SEQ ID NO: 218258 - DNA, 16 bp, P. troglodytes
caaaccagaaaatcta

SEQ ID NO: 218259 - DNA, 16 bp, P. troglodytes
caaaccagaatggagt

SEQ ID NO: 218260 - DNA, 16 bp, P. troglodytes
caaaccatatcagata

SEQ ID NO: 218261 - DNA, 16 bp, P. troglodytes
caaaccatatcataaa

SEQ ID NO: 218262 - DNA, 16 bp, P. troglodytes
caaaccatcctttgct

SEQ ID NO: 218263 - DNA, 16 bp, P. troglodytes
caaacccaaggtcatc

SEQ ID NO: 218264 - DNA, 16 bp, P. troglodytes
caaacccagcactttg

SEQ ID NO: 218265 - DNA, 16 bp, P. troglodytes
caaacctagagaaaga

SEQ ID NO: 218266 - DNA, 16 bp, P. troglodytes
caaacctcagcaacat

SEQ ID NO: 218267 - DNA, 16 bp, P. troglodytes
caaacctgagaaaagc

SEQ ID NO: 218268 - DNA, 16 bp, P. troglodytes
caaaccttttattttt

SEQ ID NO: 218269 - DNA, 16 bp, P. troglodytes
caaactaagcttcaca

SEQ ID NO: 218270 - DNA, 16 bp, P. troglodytes
caaactaatgaaggaa

SEQ ID NO: 218271 - DNA, 17 bp, P. troglodytes
caaactacaatcagaga

SEQ ID NO: 218272 - DNA, 16 bp, P. troglodytes
caaactataagaatcc

SEQ ID NO: 218273 - DNA, 16 bp, P. troglodytes
caaactatactgcagg

SEQ ID NO: 218274 - DNA, 16 bp, P. troglodytes
caaactattgatacac

SEQ ID NO: 218275 - DNA, 16 bp, P. troglodytes
caaactccaccttctg

SEQ ID NO: 218276 - DNA, 16 bp, P. troglodytes
caaactccatctccca

SEQ ID NO: 218277 - DNA, 16 bp, P. troglodytes
caaactcccaacctca

SEQ ID NO: 218278 - DNA, 16 bp, P. troglodytes
caaactcccggcctca

SEQ ID NO: 218279 - DNA, 16 bp, P. troglodytes
caaactcctaggttca

SEQ ID NO: 218280 - DNA, 16 bp, P. troglodytes
caaactcctgagctcg

SEQ ID NO: 218281 - DNA, 16 bp, P. troglodytes
caaactcctgtgttca

SEQ ID NO: 218282 - DNA, 16 bp, P. troglodytes
caaactctgcttccca

SEQ ID NO: 218283 - DNA, 16 bp, P. troglodytes
caaactcttgagctca

SEQ ID NO: 218284 - DNA, 16 bp, P. troglodytes
caaactgaaatgcaaa

SEQ ID NO: 218285 - DNA, 16 bp, P. troglodytes
caaactgaatccagca

SEQ ID NO: 218286 - DNA, 16 bp, P. troglodytes
caaactgaattcagca

SEQ ID NO: 218287 - DNA, 16 bp, P. troglodytes
caaactgcctgggttc

SEQ ID NO: 218288 - DNA, 16 bp, P. troglodytes
caaactgctggaatta

SEQ ID NO: 218289 - DNA, 16 bp, P. troglodytes
caaactgctgggatta

SEQ ID NO: 218290 - DNA, 16 bp, P. troglodytes
caaactggaaacaatc

SEQ ID NO: 218291 - DNA, 16 bp, P. troglodytes
caaactggatttgtct

SEQ ID NO: 218292 - DNA, 16 bp, P. troglodytes
caaactggtgggatta

SEQ ID NO: 218293 - DNA, 16 bp, P. troglodytes
caaactgtatcattct

SEQ ID NO: 218294 - DNA, 16 bp, P. troglodytes
caaactgtcttttctc

SEQ ID NO: 218295 - DNA, 16 bp, P. troglodytes
caaactgttttccaaa

SEQ ID NO: 218296 - DNA, 16 bp, P. troglodytes
caaactgttttccaca

SEQ ID NO: 218297 - DNA, 16 bp, P. troglodytes
caaacttctgacctca

SEQ ID NO: 218298 - DNA, 16 bp, P. troglodytes
caaacttggcctccca

SEQ ID NO: 218299 - DNA, 16 bp, P. troglodytes
caaactttaaaaagaa

SEQ ID NO: 218300 - DNA, 16 bp, P. troglodytes
caaactttgcctcccg

SEQ ID NO: 218301 - DNA, 16 bp, P. troglodytes
caaacttttggcctca

SEQ ID NO: 218302 - DNA, 16 bp, P. troglodytes
caaactttttaaataa

SEQ ID NO: 218303 - DNA, 16 bp, P. troglodytes
caaactttttctgtga

SEQ ID NO: 218304 - DNA, 16 bp, P. troglodytes
caaactttttgtattt

SEQ ID NO: 218305 - DNA, 16 bp, P. troglodytes
caaactttttttgtaa

SEQ ID NO: 218306 - DNA, 16 bp, P. troglodytes
caaagaaaacaatcag

SEQ ID NO: 218307 - DNA, 16 bp, P. troglodytes
caaagaaaacttcagg

SEQ ID NO: 218308 - DNA, 16 bp, P. troglodytes
caaagaaaagctgagg

SEQ ID NO: 218309 - DNA, 16 bp, P. troglodytes
caaagaaaatcccagg

SEQ ID NO: 218310 - DNA, 16 bp, P. troglodytes
caaagaaaatgaaatg

SEQ ID NO: 218311 - DNA, 16 bp, P. troglodytes
caaagaaacaactttt

SEQ ID NO: 218312 - DNA, 16 bp, P. troglodytes
caaagaaacactggac

SEQ ID NO: 218313 - DNA, 16 bp, P. troglodytes
caaagaaacatgtttt

SEQ ID NO: 218314 - DNA, 16 bp, P. troglodytes
caaagaaatcagaggt

SEQ ID NO: 218315 - DNA, 16 bp, P. troglodytes
caaagaaatgacaagt

SEQ ID NO: 218316 - DNA, 16 bp, P. troglodytes
caaagaaatgataagt

SEQ ID NO: 218317 - DNA, 16 bp, P. troglodytes
caaagaaatggaaatt

SEQ ID NO: 218318 - DNA, 16 bp, P. troglodytes
caaagaaattaaagat

SEQ ID NO: 218319 - DNA, 16 bp, P. troglodytes
caaagaaattgaagat

SEQ ID NO: 218320 - DNA, 16 bp, P. troglodytes
caaagaacaaagcttc

SEQ ID NO: 218321 - DNA, 16 bp, P. troglodytes
caaagaacacctggaa

SEQ ID NO: 218322 - DNA, 16 bp, P. troglodytes
caaagaacacctggga

SEQ ID NO: 218323 - DNA, 16 bp, P. troglodytes
caaagaaccagcattt

SEQ ID NO: 218324 - DNA, 16 bp, P. troglodytes
caaagaactaaaaatt

SEQ ID NO: 218325 - DNA, 16 bp, P. troglodytes
caaagaactgaaaata

SEQ ID NO: 218326 - DNA, 16 bp, P. troglodytes
caaagaactgaaagca

SEQ ID NO: 218327 - DNA, 16 bp, P. troglodytes
caaagaacttttaaaa

SEQ ID NO: 218328 - DNA, 16 bp, P. troglodytes
caaagaacttttgttt

SEQ ID NO: 218329 - DNA, 16 bp, P. troglodytes
caaagaagaaattgaa

SEQ ID NO: 218330 - DNA, 16 bp, P. troglodytes
caaagaagacatatga

SEQ ID NO: 218331 - DNA, 16 bp, P. troglodytes
caaagaagaccaccag

SEQ ID NO: 218332 - DNA, 16 bp, P. troglodytes
caaagaaggacaattt

SEQ ID NO: 218333 - DNA, 16 bp, P. troglodytes
caaagaaggcaatcag

SEQ ID NO: 218334 - DNA, 16 bp, P. troglodytes
caaagaagggccagat

SEQ ID NO: 218335 - DNA, 16 bp, P. troglodytes
caaagaagtgaaaaat

SEQ ID NO: 218336 - DNA, 16 bp, P. troglodytes
caaagaataagaaact

SEQ ID NO: 218337 - DNA, 16 bp, P. troglodytes
caaagaatataaatat

SEQ ID NO: 218338 - DNA, 16 bp, P. troglodytes
caaagaatcaggaaaa

SEQ ID NO: 218339 - DNA, 16 bp, P. troglodytes
caaagaatgcagtttc

SEQ ID NO: 218340 - DNA, 16 bp, P. troglodytes
caaagaattatctagc

SEQ ID NO: 218341 - DNA, 16 bp, P. troglodytes
caaagaattcttaaaa

SEQ ID NO: 218342 - DNA, 16 bp, P. troglodytes
caaagaattcttagac

SEQ ID NO: 218343 - DNA, 16 bp, P. troglodytes
caaagaatttaaaata

SEQ ID NO: 218344 - DNA, 16 bp, P. troglodytes
caaagaattttaaaaa

SEQ ID NO: 218345 - DNA, 16 bp, P. troglodytes
caaagaattttttttt

SEQ ID NO: 218346 - DNA, 16 bp, P. troglodytes
caaagacagcaccaag

SEQ ID NO: 218347 - DNA, 16 bp, P. troglodytes
caaagacagcctgaag

SEQ ID NO: 218348 - DNA, 16 bp, P. troglodytes
caaagacatggaatta

SEQ ID NO: 218349 - DNA, 21 bp, P. troglodytes
caaagaccaaaggtagataaa

SEQ ID NO: 218350 - DNA, 16 bp, P. troglodytes
caaagaccctatttcc

SEQ ID NO: 218351 - DNA, 16 bp, P. troglodytes
caaagacttaaatgtt

SEQ ID NO: 218352 - DNA, 16 bp, P. troglodytes
caaagacttcatgatc

SEQ ID NO: 218353 - DNA, 16 bp, P. troglodytes
caaagacttggagcca

SEQ ID NO: 218354 - DNA, 16 bp, P. troglodytes
caaagactttatgacc

SEQ ID NO: 218355 - DNA, 16 bp, P. troglodytes
caaagagaaaactgaa

SEQ ID NO: 218356 - DNA, 16 bp, P. troglodytes
caaagagaatacagaa

SEQ ID NO: 218357 - DNA, 16 bp, P. troglodytes
caaagagagagccccg

SEQ ID NO: 218358 - DNA, 16 bp, P. troglodytes
caaagagatatttgaa

SEQ ID NO: 218359 - DNA, 16 bp, P. troglodytes
caaagagcttaaaaca

SEQ ID NO: 218360 - DNA, 16 bp, P. troglodytes
caaagaggagctgata

SEQ ID NO: 218361 - DNA, 16 bp, P. troglodytes
caaagaggagctggca

SEQ ID NO: 218362 - DNA, 16 bp, P. troglodytes
caaagaggcctgcctg

SEQ ID NO: 218363 - DNA, 16 bp, P. troglodytes
caaagagttattagca

SEQ ID NO: 218364 - DNA, 16 bp, P. troglodytes
caaagatattcctcaa

SEQ ID NO: 218365 - DNA, 16 bp, P. troglodytes
caaagatattgaaata

SEQ ID NO: 218366 - DNA, 16 bp, P. troglodytes
caaagatcattcaaga

SEQ ID NO: 218367 - DNA, 16 bp, P. troglodytes
caaagatccaaagaga

SEQ ID NO: 218368 - DNA, 16 bp, P. troglodytes
caaagatgaagagaaa

SEQ ID NO: 218369 - DNA, 16 bp, P. troglodytes
caaagatgagaagaaa

SEQ ID NO: 218370 - DNA, 16 bp, P. troglodytes
caaagatgattttgag

SEQ ID NO: 218371 - DNA, 16 bp, P. troglodytes
caaagatgcagagaaa

SEQ ID NO: 218372 - DNA, 16 bp, P. troglodytes
caaagatgccaagaac

SEQ ID NO: 218373 - DNA, 16 bp, P. troglodytes
caaagatggagagaaa

SEQ ID NO: 218374 - DNA, 16 bp, P. troglodytes
caaagatgggaagaaa

SEQ ID NO: 218375 - DNA, 16 bp, P. troglodytes
caaagatgttaagtga

SEQ ID NO: 218376 - DNA, 16 bp, P. troglodytes
caaagattcaacttct

SEQ ID NO: 218377 - DNA, 16 bp, P. troglodytes
caaagatttaatgaca

SEQ ID NO: 218378 - DNA, 16 bp, P. troglodytes
caaagatttggaacca

SEQ ID NO: 218379 - DNA, 16 bp, P. troglodytes
caaagattttatgact

SEQ ID NO: 218380 - DNA, 16 bp, P. troglodytes
caaagcaaaaccctgt

SEQ ID NO: 218381 - DNA, 16 bp, P. troglodytes
caaagcaaaatcagca

SEQ ID NO: 218382 - DNA, 16 bp, P. troglodytes
caaagcaaatcacatg

SEQ ID NO: 218383 - DNA, 16 bp, P. troglodytes
caaagcaagaccctgc

SEQ ID NO: 218384 - DNA, 16 bp, P. troglodytes
caaagcaagatgctgt

SEQ ID NO: 218385 - DNA, 16 bp, P. troglodytes
caaagcaagtcacaca

SEQ ID NO: 218386 - DNA, 16 bp, P. troglodytes
caaagcaatctataaa

SEQ ID NO: 218387 - DNA, 16 bp, P. troglodytes
caaagcaatgggatta

SEQ ID NO: 218388 - DNA, 16 bp, P. troglodytes
caaagcactgggatta

SEQ ID NO: 218389 - DNA, 16 bp, P. troglodytes
caaagcacttcccaaa

SEQ ID NO: 218390 - DNA, 16 bp, P. troglodytes
caaagcagccaggaag

SEQ ID NO: 218391 - DNA, 16 bp, P. troglodytes
caaagcaggaggaaga

SEQ ID NO: 218392 - DNA, 16 bp, P. troglodytes
caaagcaggaggatcg

SEQ ID NO: 218393 - DNA, 16 bp, P. troglodytes
caaagcaggtggaaga

SEQ ID NO: 218394 - DNA, 16 bp, P. troglodytes
caaagcagttgctgct

SEQ ID NO: 218395 - DNA, 16 bp, P. troglodytes
caaagccacaatgaaa

SEQ ID NO: 218396 - DNA, 16 bp, P. troglodytes
caaagccagacaaaga

SEQ ID NO: 218397 - DNA, 16 bp, P. troglodytes
caaagccagaccctgt

SEQ ID NO: 218398 - DNA, 16 bp, P. troglodytes
caaagccagactccat

SEQ ID NO: 218399 - DNA, 16 bp, P. troglodytes
caaagccagcaacagc

SEQ ID NO: 218400 - DNA, 16 bp, P. troglodytes
caaagccagcaacagt

SEQ ID NO: 218401 - DNA, 16 bp, P. troglodytes
caaagccatcaaaaag

SEQ ID NO: 218402 - DNA, 16 bp, P. troglodytes
caaagccatcctggac

SEQ ID NO: 218403 - DNA, 16 bp, P. troglodytes
caaagccattcaacaa

SEQ ID NO: 218404 - DNA, 16 bp, P. troglodytes
caaagccattcatgag

SEQ ID NO: 218405 - DNA, 16 bp, P. troglodytes
caaagccctaggaaag

SEQ ID NO: 218406 - DNA, 16 bp, P. troglodytes
caaagccgctgggaag

SEQ ID NO: 218407 - DNA, 16 bp, P. troglodytes
caaagcctaatccaga

SEQ ID NO: 218408 - DNA, 16 bp, P. troglodytes
caaagcctccaagaac

SEQ ID NO: 218409 - DNA, 16 bp, P. troglodytes
caaagcctccttcaca

SEQ ID NO: 218410 - DNA, 16 bp, P. troglodytes
caaagcctctgggaag

SEQ ID NO: 218411 - DNA, 16 bp, P. troglodytes
caaagcctgcaagaaa

SEQ ID NO: 218412 - DNA, 16 bp, P. troglodytes
caaagcctggcacaca

SEQ ID NO: 218413 - DNA, 16 bp, P. troglodytes
caaagcgagattctgt

SEQ ID NO: 218414 - DNA, 16 bp, P. troglodytes
caaagctgaaactgga

SEQ ID NO: 218415 - DNA, 16 bp, P. troglodytes
caaagctgaaggcatc

SEQ ID NO: 218416 - DNA, 16 bp, P. troglodytes
caaagctgcctggaag

SEQ ID NO: 218417 - DNA, 16 bp, P. troglodytes
caaagctgcctttgct

SEQ ID NO: 218418 - DNA, 16 bp, P. troglodytes
caaagctggagctatt

SEQ ID NO: 218419 - DNA, 16 bp, P. troglodytes
caaagctggaggcacc

SEQ ID NO: 218420 - DNA, 16 bp, P. troglodytes
caaagctggaggcagc

SEQ ID NO: 218421 - DNA, 16 bp, P. troglodytes
caaagctggagggaga

SEQ ID NO: 218422 - DNA, 16 bp, P. troglodytes
caaagctgtctgggcc

SEQ ID NO: 218423 - DNA, 16 bp, P. troglodytes
caaagcttcaaaggat

SEQ ID NO: 218424 - DNA, 16 bp, P. troglodytes
caaagcttccacagcc

SEQ ID NO: 218425 - DNA, 16 bp, P. troglodytes
caaaggaaaacaaatc

SEQ ID NO: 218426 - DNA, 16 bp, P. troglodytes
caaaggaaaagaaatc

SEQ ID NO: 218427 - DNA, 16 bp, P. troglodytes
caaaggaaaatagatc

SEQ ID NO: 218428 - DNA, 16 bp, P. troglodytes
caaaggaaacaatcca

SEQ ID NO: 218429 - DNA, 16 bp, P. troglodytes
caaaggaaagaatcaa

SEQ ID NO: 218430 - DNA, 16 bp, P. troglodytes
caaaggaaataaatca

SEQ ID NO: 218431 - DNA, 16 bp, P. troglodytes
caaaggaaatgaagtc

SEQ ID NO: 218432 - DNA, 16 bp, P. troglodytes
caaaggaaatgttcat

SEQ ID NO: 218433 - DNA, 16 bp, P. troglodytes
caaaggaaattaagaa

SEQ ID NO: 218434 - DNA, 16 bp, P. troglodytes
caaaggaatagaaatt

SEQ ID NO: 218435 - DNA, 16 bp, P. troglodytes
caaaggaatctacaga

SEQ ID NO: 218436 - DNA, 16 bp, P. troglodytes
caaaggaatgattcat

SEQ ID NO: 218437 - DNA, 16 bp, P. troglodytes
caaaggaattcttttg

SEQ ID NO: 218438 - DNA, 16 bp, P. troglodytes
caaaggacacaatctc

SEQ ID NO: 218439 - DNA, 16 bp, P. troglodytes
caaaggacagacagaa

SEQ ID NO: 218440 - DNA, 16 bp, P. troglodytes
caaaggacatcatcaa

SEQ ID NO: 218441 - DNA, 16 bp, P. troglodytes
caaaggacatgatttc

SEQ ID NO: 218442 - DNA, 16 bp, P. troglodytes
caaaggacattatttc

SEQ ID NO: 218443 - DNA, 16 bp, P. troglodytes
caaaggacctgaataa

SEQ ID NO: 218444 - DNA, 16 bp, P. troglodytes
caaaggagaaaataat

SEQ ID NO: 218445 - DNA, 16 bp, P. troglodytes
caaaggagatgaaatc

SEQ ID NO: 218446 - DNA, 16 bp, P. troglodytes
caaaggagatgaacag

SEQ ID NO: 218447 - DNA, 16 bp, P. troglodytes
caaaggagattatttc

SEQ ID NO: 218448 - DNA, 16 bp, P. troglodytes
caaaggagattttttt

SEQ ID NO: 218449 - DNA, 16 bp, P. troglodytes
caaaggagggagaggt

SEQ ID NO: 218450 - DNA, 16 bp, P. troglodytes
caaaggatacaaacag

SEQ ID NO: 218451 - DNA, 16 bp, P. troglodytes
caaaggcaaaattaga

SEQ ID NO: 218452 - DNA, 16 bp, P. troglodytes
caaaggcaataaaata

SEQ ID NO: 218453 - DNA, 16 bp, P. troglodytes
caaaggcacaagaatg

SEQ ID NO: 218454 - DNA, 16 bp, P. troglodytes
caaaggcacagagatg

SEQ ID NO: 218455 - DNA, 16 bp, P. troglodytes
caaaggcacagaggtg

SEQ ID NO: 218456 - DNA, 16 bp, P. troglodytes
caaaggccctgaggct

SEQ ID NO: 218457 - DNA, 16 bp, P. troglodytes
caaaggccctgtggca

SEQ ID NO: 218458 - DNA, 16 bp, P. troglodytes
caaaggcctcaccttc

SEQ ID NO: 218459 - DNA, 16 bp, P. troglodytes
caaaggcctgagaacc

SEQ ID NO: 218460 - DNA, 16 bp, P. troglodytes
caaaggctgaggagtg

SEQ ID NO: 218461 - DNA, 16 bp, P. troglodytes
caaaggctgggtgcag

SEQ ID NO: 218462 - DNA, 16 bp, P. troglodytes
caaaggcttcacctcc

SEQ ID NO: 218463 - DNA, 20 bp, P. troglodytes
caaagggaagcccatcacac

SEQ ID NO: 218464 - DNA, 16 bp, P. troglodytes
caaagggaaggcttcc

SEQ ID NO: 218465 - DNA, 16 bp, P. troglodytes
caaagggagactctgt

SEQ ID NO: 218466 - DNA, 16 bp, P. troglodytes
caaagggatatttctg

SEQ ID NO: 218467 - DNA, 16 bp, P. troglodytes
caaagggattgcttcc

SEQ ID NO: 218468 - DNA, 16 bp, P. troglodytes
caaagggcatccaaat

SEQ ID NO: 218469 - DNA, 16 bp, P. troglodytes
caaagggctgcagctc

SEQ ID NO: 218470 - DNA, 16 bp, P. troglodytes
caaagggctgggatta

SEQ ID NO: 218471 - DNA, 16 bp, P. troglodytes
caaaggggaaacaagg

SEQ ID NO: 218472 - DNA, 16 bp, P. troglodytes
caaaggggaagcaggc

SEQ ID NO: 218473 - DNA, 16 bp, P. troglodytes
caaaggtgacattaca

SEQ ID NO: 218474 - DNA, 16 bp, P. troglodytes
caaaggtgccaagaac

SEQ ID NO: 218475 - DNA, 16 bp, P. troglodytes
caaaggtgccaagagc

SEQ ID NO: 218476 - DNA, 16 bp, P. troglodytes
caaaggttttaaatgt

SEQ ID NO: 218477 - DNA, 16 bp, P. troglodytes
caaagtaatttacaga

SEQ ID NO: 218478 - DNA, 16 bp, P. troglodytes
caaagtacagctcagg

SEQ ID NO: 218479 - DNA, 16 bp, P. troglodytes
caaagtatcatctgag

SEQ ID NO: 218480 - DNA, 16 bp, P. troglodytes
caaagtattcaagagg

SEQ ID NO: 218481 - DNA, 16 bp, P. troglodytes
caaagtattgagatta

SEQ ID NO: 218482 - DNA, 16 bp, P. troglodytes
caaagtatttttaaaa

SEQ ID NO: 218483 - DNA, 16 bp, P. troglodytes
caaagtcaacatatga

SEQ ID NO: 218484 - DNA, 16 bp, P. troglodytes
caaagtcacccagctg

SEQ ID NO: 218485 - DNA, 16 bp, P. troglodytes
caaagtccctgccctc

SEQ ID NO: 218486 - DNA, 16 bp, P. troglodytes
caaagtgaaagaagcc

SEQ ID NO: 218487 - DNA, 16 bp, P. troglodytes
caaagtgaagcagcaa

SEQ ID NO: 218488 - DNA, 16 bp, P. troglodytes
caaagtgagaccctgg

SEQ ID NO: 218489 - DNA, 16 bp, P. troglodytes
caaagtgccgggatca

SEQ ID NO: 218490 - DNA, 16 bp, P. troglodytes
caaagtgctagaatta

SEQ ID NO: 218491 - DNA, 16 bp, P. troglodytes
caaagtgctaggattg

SEQ ID NO: 218492 - DNA, 16 bp, P. troglodytes
caaagtgctgaaatta

SEQ ID NO: 218493 - DNA, 16 bp, P. troglodytes
caaagtgctgagataa

SEQ ID NO: 218494 - DNA, 16 bp, P. troglodytes
caaagtgctggagatt

SEQ ID NO: 218495 - DNA, 16 bp, P. troglodytes
caaagtgctgggacta

SEQ ID NO: 218496 - DNA, 16 bp, P. troglodytes
caaagtgctgggattg

SEQ ID NO: 218497 - DNA, 16 bp, P. troglodytes
caaagtgctggtatta

SEQ ID NO: 218498 - DNA, 16 bp, P. troglodytes
caaagtggtaggatta

SEQ ID NO: 218499 - DNA, 16 bp, P. troglodytes
caaagtggtgtctgag

SEQ ID NO: 218500 - DNA, 16 bp, P. troglodytes
caaagtgttgagacta

SEQ ID NO: 218501 - DNA, 16 bp, P. troglodytes
caaagtgttggaatta

SEQ ID NO: 218502 - DNA, 16 bp, P. troglodytes
caaagtgttgggattc

SEQ ID NO: 218503 - DNA, 16 bp, P. troglodytes
caaagtgttgggattg

SEQ ID NO: 218504 - DNA, 16 bp, P. troglodytes
caaagtgttgggattt

SEQ ID NO: 218505 - DNA, 16 bp, P. troglodytes
caaagttcttagcttc

SEQ ID NO: 218506 - DNA, 16 bp, P. troglodytes
caaagttgaaatgaaa

SEQ ID NO: 218507 - DNA, 16 bp, P. troglodytes
caaataaaaatggatt

SEQ ID NO: 218508 - DNA, 16 bp, P. troglodytes
caaataaaagccaatt

SEQ ID NO: 218509 - DNA, 16 bp, P. troglodytes
caaataaaatgtataa

SEQ ID NO: 218510 - DNA, 16 bp, P. troglodytes
caaataaacagaacca

SEQ ID NO: 218511 - DNA, 16 bp, P. troglodytes
caaataaacagcctaa

SEQ ID NO: 218512 - DNA, 16 bp, P. troglodytes
caaataaacatatgaa

SEQ ID NO: 218513 - DNA, 16 bp, P. troglodytes
caaataaactagaaca

SEQ ID NO: 218514 - DNA, 16 bp, P. troglodytes
caaataaactctttaa

SEQ ID NO: 218515 - DNA, 16 bp, P. troglodytes
caaataaagtcacatt

SEQ ID NO: 218516 - DNA, 16 bp, P. troglodytes
caaataaagttttatt

SEQ ID NO: 218517 - DNA, 16 bp, P. troglodytes
caaataaatatatgta

SEQ ID NO: 218518 - DNA, 16 bp, P. troglodytes
caaataaatgagaaca

SEQ ID NO: 218519 - DNA, 16 bp, P. troglodytes
caaataaatggaaata

SEQ ID NO: 218520 - DNA, 16 bp, P. troglodytes
caaataaatggatgaa

SEQ ID NO: 218521 - DNA, 16 bp, P. troglodytes
caaataacaaaatggc

SEQ ID NO: 218522 - DNA, 16 bp, P. troglodytes
caaataacagaaattt

SEQ ID NO: 218523 - DNA, 16 bp, P. troglodytes
caaataaggaaattga

SEQ ID NO: 218524 - DNA, 16 bp, P. troglodytes
caaataaggtaacatt

SEQ ID NO: 218525 - DNA, 16 bp, P. troglodytes
caaataataagagcta

SEQ ID NO: 218526 - DNA, 16 bp, P. troglodytes
caaataatactcttat

SEQ ID NO: 218527 - DNA, 16 bp, P. troglodytes
caaataatgacaattt

SEQ ID NO: 218528 - DNA, 16 bp, P. troglodytes
caaataatgctgcagt

SEQ ID NO: 218529 - DNA, 16 bp, P. troglodytes
caaataatgttttaaa

SEQ ID NO: 218530 - DNA, 16 bp, P. troglodytes
caaataattatttctt

SEQ ID NO: 218531 - DNA, 16 bp, P. troglodytes
caaatacaaattgtat

SEQ ID NO: 218532 - DNA, 16 bp, P. troglodytes
caaatacaccatggaa

SEQ ID NO: 218533 - DNA, 16 bp, P. troglodytes
caaatacactagaaaa

SEQ ID NO: 218534 - DNA, 16 bp, P. troglodytes
caaatactgcttgttc

SEQ ID NO: 218535 - DNA, 16 bp, P. troglodytes
caaatacttctttttt

SEQ ID NO: 218536 - DNA, 16 bp, P. troglodytes
caaatagagataattt

SEQ ID NO: 218537 - DNA, 16 bp, P. troglodytes
caaatagccaaatcaa

SEQ ID NO: 218538 - DNA, 16 bp, P. troglodytes
caaatagccaaggcaa

SEQ ID NO: 218539 - DNA, 16 bp, P. troglodytes
caaatagcccaattaa

SEQ ID NO: 218540 - DNA, 16 bp, P. troglodytes
caaatagcctatcttc

SEQ ID NO: 218541 - DNA, 16 bp, P. troglodytes
caaatagctgggactg

SEQ ID NO: 218542 - DNA, 16 bp, P. troglodytes
caaatagtagttctgt

SEQ ID NO: 218543 - DNA, 16 bp, P. troglodytes
caaatatatatttgtg

SEQ ID NO: 218544 - DNA, 16 bp, P. troglodytes
caaatatatgaaaaga

SEQ ID NO: 218545 - DNA, 16 bp, P. troglodytes
caaatatattctccta

SEQ ID NO: 218546 - DNA, 16 bp, P. troglodytes
caaatatattttctca

SEQ ID NO: 218547 - DNA, 16 bp, P. troglodytes
caaatatccacttcca

SEQ ID NO: 218548 - DNA, 16 bp, P. troglodytes
caaatatctctttgag

SEQ ID NO: 218549 - DNA, 16 bp, P. troglodytes
caaatatgcacatgta

SEQ ID NO: 218550 - DNA, 16 bp, P. troglodytes
caaatatgtaaagcaa

SEQ ID NO: 218551 - DNA, 16 bp, P. troglodytes
caaatatgtattgaat

SEQ ID NO: 218552 - DNA, 16 bp, P. troglodytes
caaatatgtatttgtt

SEQ ID NO: 218553 - DNA, 16 bp, P. troglodytes
caaatattaatagatc

SEQ ID NO: 218554 - DNA, 16 bp, P. troglodytes
caaatatttaaaagaa

SEQ ID NO: 218555 - DNA, 16 bp, P. troglodytes
caaatatttacatatt

SEQ ID NO: 218556 - DNA, 16 bp, P. troglodytes
caaatatttacatttt

SEQ ID NO: 218557 - DNA, 16 bp, P. troglodytes
caaatatttactgagt

SEQ ID NO: 218558 - DNA, 16 bp, P. troglodytes
caaatatttactgtgt

SEQ ID NO: 218559 - DNA, 16 bp, P. troglodytes
caaatatttcaaaatc

SEQ ID NO: 218560 - DNA, 16 bp, P. troglodytes
caaatatttgaatttt

SEQ ID NO: 218561 - DNA, 16 bp, P. troglodytes
caaatatttgtatatt

SEQ ID NO: 218562 - DNA, 16 bp, P. troglodytes
caaatatttgttgagt

SEQ ID NO: 218563 - DNA, 16 bp, P. troglodytes
caaatattttctccct

SEQ ID NO: 218564 - DNA, 16 bp, P. troglodytes
caaatattttctttca

SEQ ID NO: 218565 - DNA, 16 bp, P. troglodytes
caaatattttgaaatt

SEQ ID NO: 218566 - DNA, 16 bp, P. troglodytes
caaatattttgtattt

SEQ ID NO: 218567 - DNA, 16 bp, P. troglodytes
caaatattttgtctca

SEQ ID NO: 218568 - DNA, 16 bp, P. troglodytes
caaatatttttgtttt

SEQ ID NO: 218569 - DNA, 16 bp, P. troglodytes
caaatattttttccca

SEQ ID NO: 218570 - DNA, 16 bp, P. troglodytes
caaatcaaaccacagt

SEQ ID NO: 218571 - DNA, 16 bp, P. troglodytes
caaatcaagaccacaa

SEQ ID NO: 218572 - DNA, 16 bp, P. troglodytes
caaatcaattttattt

SEQ ID NO: 218573 - DNA, 16 bp, P. troglodytes
caaatcacatcttgaa

SEQ ID NO: 218574 - DNA, 16 bp, P. troglodytes
caaatcaggaacaaac

SEQ ID NO: 218575 - DNA, 16 bp, P. troglodytes
caaatcaggaagaaaa

SEQ ID NO: 218576 - DNA, 16 bp, P. troglodytes
caaatcagtctcccca

SEQ ID NO: 218577 - DNA, 16 bp, P. troglodytes
caaatccagcagaaga

SEQ ID NO: 218578 - DNA, 16 bp, P. troglodytes
caaatcccagctctac

SEQ ID NO: 218579 - DNA, 16 bp, P. troglodytes
caaatcctcaccaaca

SEQ ID NO: 218580 - DNA, 16 bp, P. troglodytes
caaatcctggctccat

SEQ ID NO: 218581 - DNA, 16 bp, P. troglodytes
caaatccttgtctcag

SEQ ID NO: 218582 - DNA, 16 bp, P. troglodytes
caaatctatctccctg

SEQ ID NO: 218583 - DNA, 16 bp, P. troglodytes
caaatctatgtttgat

SEQ ID NO: 218584 - DNA, 16 bp, P. troglodytes
caaatctcacattgaa

SEQ ID NO: 218585 - DNA, 16 bp, P. troglodytes
caaatctcatctcaat

SEQ ID NO: 218586 - DNA, 16 bp, P. troglodytes
caaatctcatgttgaa

SEQ ID NO: 218587 - DNA, 16 bp, P. troglodytes
caaatctgcctttgaa

SEQ ID NO: 218588 - DNA, 16 bp, P. troglodytes
caaatcttaacttgaa

SEQ ID NO: 218589 - DNA, 16 bp, P. troglodytes
caaatgaaaatgagaa

SEQ ID NO: 218590 - DNA, 16 bp, P. troglodytes
caaatgaaaattttaa

SEQ ID NO: 218591 - DNA, 16 bp, P. troglodytes
caaatgaaataatgaa

SEQ ID NO: 218592 - DNA, 16 bp, P. troglodytes
caaatgaagaaataga

SEQ ID NO: 218593 - DNA, 16 bp, P. troglodytes
caaatgaatacatttt

SEQ ID NO: 218594 - DNA, 16 bp, P. troglodytes
caaatgaatttcatgt

SEQ ID NO: 218595 - DNA, 16 bp, P. troglodytes
caaatgaattttttaa

SEQ ID NO: 218596 - DNA, 16 bp, P. troglodytes
caaatgaatttttttt

SEQ ID NO: 218597 - DNA, 16 bp, P. troglodytes
caaatgacagaatctc

SEQ ID NO: 218598 - DNA, 16 bp, P. troglodytes
caaatgacagaatttc

SEQ ID NO: 218599 - DNA, 16 bp, P. troglodytes
caaatgacagaatttt

SEQ ID NO: 218600 - DNA, 16 bp, P. troglodytes
caaatgacatgatctt

SEQ ID NO: 218601 - DNA, 16 bp, P. troglodytes
caaatgacattatttt

SEQ ID NO: 218602 - DNA, 16 bp, P. troglodytes
caaatgaccacaacac

SEQ ID NO: 218603 - DNA, 16 bp, P. troglodytes
caaatgacttttaaaa

SEQ ID NO: 218604 - DNA, 16 bp, P. troglodytes
caaatgagaaaaatga

SEQ ID NO: 218605 - DNA, 16 bp, P. troglodytes
caaatgagaaaaccaa

SEQ ID NO: 218606 - DNA, 16 bp, P. troglodytes
caaatgagaaaactga

SEQ ID NO: 218607 - DNA, 16 bp, P. troglodytes
caaatgagaacatgtg

SEQ ID NO: 218608 - DNA, 16 bp, P. troglodytes
caaatgagaagaatgt

SEQ ID NO: 218609 - DNA, 16 bp, P. troglodytes
caaatgagattatttt

SEQ ID NO: 218610 - DNA, 16 bp, P. troglodytes
caaatgaggaagctga

SEQ ID NO: 218611 - DNA, 16 bp, P. troglodytes
caaatgataagaaagt

SEQ ID NO: 218612 - DNA, 16 bp, P. troglodytes
caaatgattctccttc

SEQ ID NO: 218613 - DNA, 16 bp, P. troglodytes
caaatgatttttctgt

SEQ ID NO: 218614 - DNA, 16 bp, P. troglodytes
caaatgattttttttt

SEQ ID NO: 218615 - DNA, 16 bp, P. troglodytes
caaatgcaatgaaaac

SEQ ID NO: 218616 - DNA, 16 bp, P. troglodytes
caaatgcaattttaaa

SEQ ID NO: 218617 - DNA, 16 bp, P. troglodytes
caaatgcattacctca

SEQ ID NO: 218618 - DNA, 16 bp, P. troglodytes
caaatgcattttattt

SEQ ID NO: 218619 - DNA, 16 bp, P. troglodytes
caaatgccacctcttc

SEQ ID NO: 218620 - DNA, 16 bp, P. troglodytes
caaatgcccatcagct

SEQ ID NO: 218621 - DNA, 16 bp, P. troglodytes
caaatgcctttttctc

SEQ ID NO: 218622 - DNA, 16 bp, P. troglodytes
caaatgctatttctgc

SEQ ID NO: 218623 - DNA, 16 bp, P. troglodytes
caaatgctgaaagatt

SEQ ID NO: 218624 - DNA, 16 bp, P. troglodytes
caaatgctgatgagaa

SEQ ID NO: 218625 - DNA, 16 bp, P. troglodytes
caaatgctttttttgt

SEQ ID NO: 218626 - DNA, 16 bp, P. troglodytes
caaatggaaaagcatc

SEQ ID NO: 218627 - DNA, 16 bp, P. troglodytes
caaatggaaacatatc

SEQ ID NO: 218628 - DNA, 16 bp, P. troglodytes
caaatggaaagcaaag

SEQ ID NO: 218629 - DNA, 16 bp, P. troglodytes
caaatggaaagtaaaa

SEQ ID NO: 218630 - DNA, 16 bp, P. troglodytes
caaatggaaatacatc

SEQ ID NO: 218631 - DNA, 16 bp, P. troglodytes
caaatggaagaaattg

SEQ ID NO: 218632 - DNA, 16 bp, P. troglodytes
caaatggaagaatatt

SEQ ID NO: 218633 - DNA, 16 bp, P. troglodytes
caaatggaatggaatg

SEQ ID NO: 218634 - DNA, 16 bp, P. troglodytes
caaatggactaagaca

SEQ ID NO: 218635 - DNA, 16 bp, P. troglodytes
caaatggattaaagac

SEQ ID NO: 218636 - DNA, 16 bp, P. troglodytes
caaatgggagaacatt

SEQ ID NO: 218637 - DNA, 16 bp, P. troglodytes
caaatggtatttctgc

SEQ ID NO: 218638 - DNA, 17 bp, P. troglodytes
caaatggtatttctggt

SEQ ID NO: 218639 - DNA, 16 bp, P. troglodytes
caaatggtgaaaccct

SEQ ID NO: 218640 - DNA, 16 bp, P. troglodytes
caaatgtaaaagaata

SEQ ID NO: 218641 - DNA, 16 bp, P. troglodytes
caaatgtaaaatgaca

SEQ ID NO: 218642 - DNA, 16 bp, P. troglodytes
caaatgtaaagaatgt

SEQ ID NO: 218643 - DNA, 16 bp, P. troglodytes
caaatgtagcaaaatg

SEQ ID NO: 218644 - DNA, 16 bp, P. troglodytes
caaatgtataatgaca

SEQ ID NO: 218645 - DNA, 16 bp, P. troglodytes
caaatgtatttatttt

SEQ ID NO: 218646 - DNA, 16 bp, P. troglodytes
caaatgtcctctgggg

SEQ ID NO: 218647 - DNA, 16 bp, P. troglodytes
caaatgtggaaactga

SEQ ID NO: 218648 - DNA, 16 bp, P. troglodytes
caaatgtgtttatttt

SEQ ID NO: 218649 - DNA, 16 bp, P. troglodytes
caaatgttaatctttt

SEQ ID NO: 218650 - DNA, 16 bp, P. troglodytes
caaatgttattttaaa

SEQ ID NO: 218651 - DNA, 16 bp, P. troglodytes
caaatgttatttttaa

SEQ ID NO: 218652 - DNA, 16 bp, P. troglodytes
caaatgtttgttgagt

SEQ ID NO: 218653 - DNA, 16 bp, P. troglodytes
caaatgttttcattat

SEQ ID NO: 218654 - DNA, 16 bp, P. troglodytes
caaatgtttttcattt

SEQ ID NO: 218655 - DNA, 26 bp, P. troglodytes
caaattaaaatagacctaggtaaatt

SEQ ID NO: 218656 - DNA, 16 bp, P. troglodytes
caaattactaaaatca

SEQ ID NO: 218657 - DNA, 16 bp, P. troglodytes
caaattactgataaac

SEQ ID NO: 218658 - DNA, 16 bp, P. troglodytes
caaattacttttaaaa

SEQ ID NO: 218659 - DNA, 16 bp, P. troglodytes
caaattagctgggcat

SEQ ID NO: 218660 - DNA, 16 bp, P. troglodytes
caaattagctgggtgt

SEQ ID NO: 218661 - DNA, 16 bp, P. troglodytes
caaattatccttattt

SEQ ID NO: 218662 - DNA, 16 bp, P. troglodytes
caaattatttctaaat

SEQ ID NO: 218663 - DNA, 16 bp, P. troglodytes
caaattattttctaaa

SEQ ID NO: 218664 - DNA, 16 bp, P. troglodytes
caaattcaatttcttt

SEQ ID NO: 218665 - DNA, 16 bp, P. troglodytes
caaattcagtaaattt

SEQ ID NO: 218666 - DNA, 16 bp, P. troglodytes
caaattcatagagaca

SEQ ID NO: 218667 - DNA, 16 bp, P. troglodytes
caaattcatttttttc

SEQ ID NO: 218668 - DNA, 16 bp, P. troglodytes
caaattcctgggatta

SEQ ID NO: 218669 - DNA, 16 bp, P. troglodytes
caaattctggttctgc

SEQ ID NO: 218670 - DNA, 16 bp, P. troglodytes
caaattctttttctgt

SEQ ID NO: 218671 - DNA, 16 bp, P. troglodytes
caaattgagatgtgct

SEQ ID NO: 218672 - DNA, 16 bp, P. troglodytes
caaattgctttccaaa

SEQ ID NO: 218673 - DNA, 16 bp, P. troglodytes
caaattgctttccaca

SEQ ID NO: 218674 - DNA, 16 bp, P. troglodytes
caaattggaaaagaga

SEQ ID NO: 218675 - DNA, 16 bp, P. troglodytes
caaattggattaaaaa

SEQ ID NO: 218676 - DNA, 16 bp, P. troglodytes
caaatttaggaaatac

SEQ ID NO: 218677 - DNA, 16 bp, P. troglodytes
caaatttcagacttgc

SEQ ID NO: 218678 - DNA, 16 bp, P. troglodytes
caaatttcagtggctt

SEQ ID NO: 218679 - DNA, 16 bp, P. troglodytes
caaatttccacaaact

SEQ ID NO: 218680 - DNA, 16 bp, P. troglodytes
caaatttctgcaactg

SEQ ID NO: 218681 - DNA, 16 bp, P. troglodytes
caaatttctgggctca

SEQ ID NO: 218682 - DNA, 16 bp, P. troglodytes
caaatttgaaaaatgt

SEQ ID NO: 218683 - DNA, 16 bp, P. troglodytes
caaatttgaaaatata

SEQ ID NO: 218684 - DNA, 16 bp, P. troglodytes
caaatttgcaagaaaa

SEQ ID NO: 218685 - DNA, 16 bp, P. troglodytes
caaatttggaaaaaat

SEQ ID NO: 218686 - DNA, 16 bp, P. troglodytes
caaatttgtgaaaatt

SEQ ID NO: 218687 - DNA, 16 bp, P. troglodytes
caaatttgttttcaaa

SEQ ID NO: 218688 - DNA, 16 bp, P. troglodytes
caaatttgttttttaa

SEQ ID NO: 218689 - DNA, 16 bp, P. troglodytes
caaattttaaggaaaa

SEQ ID NO: 218690 - DNA, 16 bp, P. troglodytes
caaattttactaaaat

SEQ ID NO: 218691 - DNA, 16 bp, P. troglodytes
caaattttcctgtctt

SEQ ID NO: 218692 - DNA, 16 bp, P. troglodytes
caaattttctacaatg

SEQ ID NO: 218693 - DNA, 16 bp, P. troglodytes
caaattttctatttct

SEQ ID NO: 218694 - DNA, 16 bp, P. troglodytes
caacaaaaatttattg

SEQ ID NO: 218695 - DNA, 16 bp, P. troglodytes
caacaaaaccccatga

SEQ ID NO: 218696 - DNA, 16 bp, P. troglodytes
caacaaaagcagaaat

SEQ ID NO: 218697 - DNA, 16 bp, P. troglodytes
caacaaaagtcaaaat

SEQ ID NO: 218698 - DNA, 16 bp, P. troglodytes
caacaaaatgaaaagg

SEQ ID NO: 218699 - DNA, 16 bp, P. troglodytes
caacaaaatggaaaat

SEQ ID NO: 218700 - DNA, 16 bp, P. troglodytes
caacaaaattaaggca

SEQ ID NO: 218701 - DNA, 16 bp, P. troglodytes
caacaaactagaaata

SEQ ID NO: 218702 - DNA, 16 bp, P. troglodytes
caacaaagagcacaat

SEQ ID NO: 218703 - DNA, 16 bp, P. troglodytes
caacaaagatcacagg

SEQ ID NO: 218704 - DNA, 16 bp, P. troglodytes
caacaaagtaaacaga

SEQ ID NO: 218705 - DNA, 16 bp, P. troglodytes
caacaaagtaaagaga

SEQ ID NO: 218706 - DNA, 16 bp, P. troglodytes
caacaaagtgaagaga

SEQ ID NO: 218707 - DNA, 16 bp, P. troglodytes
caacaaatatatggaa

SEQ ID NO: 218708 - DNA, 16 bp, P. troglodytes
caacaaatattgactg

SEQ ID NO: 218709 - DNA, 16 bp, P. troglodytes
caacaacaaaaagcct

SEQ ID NO: 218710 - DNA, 16 bp, P. troglodytes
caacaacaaaaaggat

SEQ ID NO: 218711 - DNA, 16 bp, P. troglodytes
caacaacaaaacattt

SEQ ID NO: 218712 - DNA, 16 bp, P. troglodytes
caacaacagcaaaact

SEQ ID NO: 218713 - DNA, 16 bp, P. troglodytes
caacaacagtcaagcc

SEQ ID NO: 218714 - DNA, 16 bp, P. troglodytes
caacaaccctgtgagg

SEQ ID NO: 218715 - DNA, 16 bp, P. troglodytes
caacaactccagccag

SEQ ID NO: 218716 - DNA, 16 bp, P. troglodytes
caacaagaagaactaa

SEQ ID NO: 218717 - DNA, 20 bp, P. troglodytes
caacaagaagagctaactat

SEQ ID NO: 218718 - DNA, 16 bp, P. troglodytes
caacaagaagatatta

SEQ ID NO: 218719 - DNA, 16 bp, P. troglodytes
caacaagaatgaaact

SEQ ID NO: 218720 - DNA, 16 bp, P. troglodytes
caacaagagcaaaact

SEQ ID NO: 218721 - DNA, 16 bp, P. troglodytes
caacaagagccaaact

SEQ ID NO: 218722 - DNA, 16 bp, P. troglodytes
caacaagagcgaaact

SEQ ID NO: 218723 - DNA, 16 bp, P. troglodytes
caacaagagcgaaatt

SEQ ID NO: 218724 - DNA, 16 bp, P. troglodytes
caacaagaggaaaact

SEQ ID NO: 218725 - DNA, 16 bp, P. troglodytes
caacaagagggaaact

SEQ ID NO: 218726 - DNA, 16 bp, P. troglodytes
caacaagagtaaaact

SEQ ID NO: 218727 - DNA, 16 bp, P. troglodytes
caacaagagtgaaacc

SEQ ID NO: 218728 - DNA, 16 bp, P. troglodytes
caacaagagtgaaacg

SEQ ID NO: 218729 - DNA, 16 bp, P. troglodytes
caacaagagtgaaact

SEQ ID NO: 218730 - DNA, 16 bp, P. troglodytes
caacaagagtgacctc

SEQ ID NO: 218731 - DNA, 16 bp, P. troglodytes
caacaaggagaaaccc

SEQ ID NO: 218732 - DNA, 16 bp, P. troglodytes
caacaagttcttcatc

SEQ ID NO: 218733 - DNA, 16 bp, P. troglodytes
caacaatatgaatata

SEQ ID NO: 218734 - DNA, 16 bp, P. troglodytes
caacaatttcacttct

SEQ ID NO: 218735 - DNA, 16 bp, P. troglodytes
caacaatttgggaggc

SEQ ID NO: 218736 - DNA, 16 bp, P. troglodytes
caacacaaagaaatga

SEQ ID NO: 218737 - DNA, 16 bp, P. troglodytes
caacacacatatacac

SEQ ID NO: 218738 - DNA, 16 bp, P. troglodytes
caacacacccagctaa

SEQ ID NO: 218739 - DNA, 16 bp, P. troglodytes
caacacaggagaaaga

SEQ ID NO: 218740 - DNA, 16 bp, P. troglodytes
caacacagggagactc

SEQ ID NO: 218741 - DNA, 16 bp, P. troglodytes
caacacagtgagaccc

SEQ ID NO: 218742 - DNA, 16 bp, P. troglodytes
caacaccaagagtgag

SEQ ID NO: 218743 - DNA, 16 bp, P. troglodytes
caacaccatccaggaa

SEQ ID NO: 218744 - DNA, 16 bp, P. troglodytes
caacacgatgttttga

SEQ ID NO: 218745 - DNA, 16 bp, P. troglodytes
caacacgctgaaaccc

SEQ ID NO: 218746 - DNA, 16 bp, P. troglodytes
caacactgccctccag

SEQ ID NO: 218747 - DNA, 16 bp, P. troglodytes
caacactgttgcattg

SEQ ID NO: 218748 - DNA, 16 bp, P. troglodytes
caacacttattttctg

SEQ ID NO: 218749 - DNA, 16 bp, P. troglodytes
caacactttgagaggc

SEQ ID NO: 218750 - DNA, 16 bp, P. troglodytes
caacacttttggaggc

SEQ ID NO: 218751 - DNA, 16 bp, P. troglodytes
caacagaaaatggaca

SEQ ID NO: 218752 - DNA, 16 bp, P. troglodytes
caacagaacaagactc

SEQ ID NO: 218753 - DNA, 16 bp, P. troglodytes
caacagaatcacctgg

SEQ ID NO: 218754 - DNA, 16 bp, P. troglodytes
caacagaatgagactc

SEQ ID NO: 218755 - DNA, 16 bp, P. troglodytes
caacagaatgagactg

SEQ ID NO: 218756 - DNA, 16 bp, P. troglodytes
caacagacaaatgaaa

SEQ ID NO: 218757 - DNA, 16 bp, P. troglodytes
caacagacactgggaa

SEQ ID NO: 218758 - DNA, 16 bp, P. troglodytes
caacagacatttattt

SEQ ID NO: 218759 - DNA, 16 bp, P. troglodytes
caacagagaccatatg

SEQ ID NO: 218760 - DNA, 16 bp, P. troglodytes
caacagagactctgtc

SEQ ID NO: 218761 - DNA, 16 bp, P. troglodytes
caacagagcaaacaga

SEQ ID NO: 218762 - DNA, 16 bp, P. troglodytes
caacagagcaagacac

SEQ ID NO: 218763 - DNA, 16 bp, P. troglodytes
caacagagcaagactt

SEQ ID NO: 218764 - DNA, 16 bp, P. troglodytes
caacagagcaagattt

SEQ ID NO: 218765 - DNA, 16 bp, P. troglodytes
caacagagcaaggctc

SEQ ID NO: 218766 - DNA, 16 bp, P. troglodytes
caacagagcgagaacc

SEQ ID NO: 218767 - DNA, 16 bp, P. troglodytes
caacagagcgagacac

SEQ ID NO: 218768 - DNA, 17 bp, P. troglodytes
caacagagcgagacccc

SEQ ID NO: 218769 - DNA, 16 bp, P. troglodytes
caacagagcgagacct

SEQ ID NO: 218770 - DNA, 16 bp, P. troglodytes
caacagagcgagactt

SEQ ID NO: 218771 - DNA, 16 bp, P. troglodytes
caacagagcgagagtc

SEQ ID NO: 218772 - DNA, 16 bp, P. troglodytes
caacagagctgcaaaa

SEQ ID NO: 218773 - DNA, 16 bp, P. troglodytes
caacagaggcagagat

SEQ ID NO: 218774 - DNA, 16 bp, P. troglodytes
caacagagtaagatcc

SEQ ID NO: 218775 - DNA, 16 bp, P. troglodytes
caacagagtgagacta

SEQ ID NO: 218776 - DNA, 16 bp, P. troglodytes
caacagatgaacggat

SEQ ID NO: 218777 - DNA, 16 bp, P. troglodytes
caacagatgctggaga

SEQ ID NO: 218778 - DNA, 16 bp, P. troglodytes
caacagatgtttgtga

SEQ ID NO: 218779 - DNA, 16 bp, P. troglodytes
caacagcaaaataaat

SEQ ID NO: 218780 - DNA, 16 bp, P. troglodytes
caacagcaaaataata

SEQ ID NO: 218781 - DNA, 16 bp, P. troglodytes
caacagcaacagcatc

SEQ ID NO: 218782 - DNA, 16 bp, P. troglodytes
caacagcacataaaaa

SEQ ID NO: 218783 - DNA, 16 bp, P. troglodytes
caacagcacattgaaa

SEQ ID NO: 218784 - DNA, 16 bp, P. troglodytes
caacagcagcaacaat

SEQ ID NO: 218785 - DNA, 16 bp, P. troglodytes
caacagcagcagaata

SEQ ID NO: 218786 - DNA, 16 bp, P. troglodytes
caacagcagcagcagt

SEQ ID NO: 218787 - DNA, 16 bp, P. troglodytes
caacagcatcaacaaa

SEQ ID NO: 218788 - DNA, 16 bp, P. troglodytes
caacagccaagccaag

SEQ ID NO: 218789 - DNA, 27 bp, P. troglodytes
caacagctcattgagaacgggccatga

SEQ ID NO: 218790 - DNA, 16 bp, P. troglodytes
caacaggatgaaaccc

SEQ ID NO: 218791 - DNA, 16 bp, P. troglodytes
caacaggccctgatgt

SEQ ID NO: 218792 - DNA, 16 bp, P. troglodytes
caacaggctgggtgca

SEQ ID NO: 218793 - DNA, 16 bp, P. troglodytes
caacagggagaaaccc

SEQ ID NO: 218794 - DNA, 16 bp, P. troglodytes
caacagggcgagactc

SEQ ID NO: 218795 - DNA, 16 bp, P. troglodytes
caacaggtaatttttc

SEQ ID NO: 218796 - DNA, 16 bp, P. troglodytes
caacaggtgctagaga

SEQ ID NO: 218797 - DNA, 16 bp, P. troglodytes
caacaggtttttctta

SEQ ID NO: 218798 - DNA, 16 bp, P. troglodytes
caacagtaagctatta

SEQ ID NO: 218799 - DNA, 16 bp, P. troglodytes
caacagtgggcccagg

SEQ ID NO: 218800 - DNA, 16 bp, P. troglodytes
caacagtggttctcaa

SEQ ID NO: 218801 - DNA, 16 bp, P. troglodytes
caacagtgtacaagag

SEQ ID NO: 218802 - DNA, 16 bp, P. troglodytes
caacagtgtgaatgta

SEQ ID NO: 218803 - DNA, 16 bp, P. troglodytes
caacagttagaatggc

SEQ ID NO: 218804 - DNA, 16 bp, P. troglodytes
caacataccagattct

SEQ ID NO: 218805 - DNA, 16 bp, P. troglodytes
caacatagcaaaaacc

SEQ ID NO: 218806 - DNA, 16 bp, P. troglodytes
caacatagcaagactt

SEQ ID NO: 218807 - DNA, 16 bp, P. troglodytes
caacatagcgaaaccc

SEQ ID NO: 218808 - DNA, 16 bp, P. troglodytes
caacatagcgagactc

SEQ ID NO: 218809 - DNA, 16 bp, P. troglodytes
caacatagctagactc

SEQ ID NO: 218810 - DNA, 16 bp, P. troglodytes
caacatagtaaaaccc

SEQ ID NO: 218811 - DNA, 16 bp, P. troglodytes
caacatagtaaagatg

SEQ ID NO: 218812 - DNA, 16 bp, P. troglodytes
caacatagtgaaaccc

SEQ ID NO: 218813 - DNA, 16 bp, P. troglodytes
caacatagtgagtccc

SEQ ID NO: 218814 - DNA, 16 bp, P. troglodytes
caacatataaatttga

SEQ ID NO: 218815 - DNA, 16 bp, P. troglodytes
caacatataaattttt

SEQ ID NO: 218816 - DNA, 16 bp, P. troglodytes
caacatatcagaaaga

SEQ ID NO: 218817 - DNA, 16 bp, P. troglodytes
caacatatgaatttta

SEQ ID NO: 218818 - DNA, 16 bp, P. troglodytes
caacatatgggaatta

SEQ ID NO: 218819 - DNA, 16 bp, P. troglodytes
caacatatgtaaatca

SEQ ID NO: 218820 - DNA, 16 bp, P. troglodytes
caacatcactgaccat

SEQ ID NO: 218821 - DNA, 16 bp, P. troglodytes
caacatcagcatcacc

SEQ ID NO: 218822 - DNA, 16 bp, P. troglodytes
caacatcagcctggcc

SEQ ID NO: 218823 - DNA, 16 bp, P. troglodytes
caacatcatgagaccc

SEQ ID NO: 218824 - DNA, 16 bp, P. troglodytes
caacatcccactgaca

SEQ ID NO: 218825 - DNA, 16 bp, P. troglodytes
caacatccctggcctc

SEQ ID NO: 218826 - DNA, 16 bp, P. troglodytes
caacatctgcttctgg

SEQ ID NO: 218827 - DNA, 16 bp, P. troglodytes
caacatctgttatttt

SEQ ID NO: 218828 - DNA, 16 bp, P. troglodytes
caacatgaatgaatct

SEQ ID NO: 218829 - DNA, 16 bp, P. troglodytes
caacatgaattttgaa

SEQ ID NO: 218830 - DNA, 16 bp, P. troglodytes
caacatgagatctggg

SEQ ID NO: 218831 - DNA, 16 bp, P. troglodytes
caacatgataaaaccc

SEQ ID NO: 218832 - DNA, 16 bp, P. troglodytes
caacatgatatttggg

SEQ ID NO: 218833 - DNA, 16 bp, P. troglodytes
caacatgatgaaatcc

SEQ ID NO: 218834 - DNA, 16 bp, P. troglodytes
caacatgatgttttga

SEQ ID NO: 218835 - DNA, 16 bp, P. troglodytes
caacatgctaaaaccc

SEQ ID NO: 218836 - DNA, 16 bp, P. troglodytes
caacatggaaaaatcc

SEQ ID NO: 218837 - DNA, 16 bp, P. troglodytes
caacatggaatactac

SEQ ID NO: 218838 - DNA, 16 bp, P. troglodytes
caacatggacaacatg

SEQ ID NO: 218839 - DNA, 16 bp, P. troglodytes
caacatggagaaaccc

SEQ ID NO: 218840 - DNA, 16 bp, P. troglodytes
caacatggatgagcct

SEQ ID NO: 218841 - DNA, 16 bp, P. troglodytes
caacatggcaaaatcc

SEQ ID NO: 218842 - DNA, 16 bp, P. troglodytes
caacatggcagatgta

SEQ ID NO: 218843 - DNA, 16 bp, P. troglodytes
caacatggcaggaccc

SEQ ID NO: 218844 - DNA, 16 bp, P. troglodytes
caacatggcgaaacca

SEQ ID NO: 218845 - DNA, 16 bp, P. troglodytes
caacatggggaaaccc

SEQ ID NO: 218846 - DNA, 16 bp, P. troglodytes
caacatggtcaaacct

SEQ ID NO: 218847 - DNA, 16 bp, P. troglodytes
caacatggtgaaacct

SEQ ID NO: 218848 - DNA, 16 bp, P. troglodytes
caacatggtgaaactt

SEQ ID NO: 218849 - DNA, 16 bp, P. troglodytes
caacatggtgaaatcc

SEQ ID NO: 218850 - DNA, 20 bp, P. troglodytes
caacattcaaattcaggaaa

SEQ ID NO: 218851 - DNA, 16 bp, P. troglodytes
caacattcccttaagc

SEQ ID NO: 218852 - DNA, 16 bp, P. troglodytes
caacattctttaaaaa

SEQ ID NO: 218853 - DNA, 18 bp, P. troglodytes
caacattgagcactgagt

SEQ ID NO: 218854 - DNA, 16 bp, P. troglodytes
caacattgatggaact

SEQ ID NO: 218855 - DNA, 16 bp, P. troglodytes
caacattggaccaaat

SEQ ID NO: 218856 - DNA, 16 bp, P. troglodytes
caacatttgggcagga

SEQ ID NO: 218857 - DNA, 16 bp, P. troglodytes
caacattttaaaatta

SEQ ID NO: 218858 - DNA, 16 bp, P. troglodytes
caacattttaaacaaa

SEQ ID NO: 218859 - DNA, 16 bp, P. troglodytes
caacattttacattcc

SEQ ID NO: 218860 - DNA, 16 bp, P. troglodytes
caacattttcatcaac

SEQ ID NO: 218861 - DNA, 16 bp, P. troglodytes
caacattttcttttct

SEQ ID NO: 218862 - DNA, 16 bp, P. troglodytes
caacatttttttaaaa

SEQ ID NO: 218863 - DNA, 16 bp, P. troglodytes
caaccaactgccaatc

SEQ ID NO: 218864 - DNA, 16 bp, P. troglodytes
caaccaatcagcattc

SEQ ID NO: 218865 - DNA, 16 bp, P. troglodytes
caaccaccacatgttc

SEQ ID NO: 218866 - DNA, 16 bp, P. troglodytes
caaccaccattttatt

SEQ ID NO: 218867 - DNA, 16 bp, P. troglodytes
caaccactaatctatt

SEQ ID NO: 218868 - DNA, 16 bp, P. troglodytes
caaccactatggaaga

SEQ ID NO: 218869 - DNA, 16 bp, P. troglodytes
caaccactctcttgga

SEQ ID NO: 218870 - DNA, 16 bp, P. troglodytes
caaccactgatctgct

SEQ ID NO: 218871 - DNA, 16 bp, P. troglodytes
caaccactgggatggg

SEQ ID NO: 218872 - DNA, 16 bp, P. troglodytes
caaccactgtctccca

SEQ ID NO: 218873 - DNA, 16 bp, P. troglodytes
caaccactgtggaaaa

SEQ ID NO: 218874 - DNA, 16 bp, P. troglodytes
caaccagagcaaaact

SEQ ID NO: 218875 - DNA, 16 bp, P. troglodytes
caaccagaggctgaag

SEQ ID NO: 218876 - DNA, 16 bp, P. troglodytes
caaccagcagccctca

SEQ ID NO: 218877 - DNA, 16 bp, P. troglodytes
caaccagttctcctgc

SEQ ID NO: 218878 - DNA, 16 bp, P. troglodytes
caaccatcaccactat

SEQ ID NO: 218879 - DNA, 16 bp, P. troglodytes
caaccatcactgccat

SEQ ID NO: 218880 - DNA, 16 bp, P. troglodytes
caaccatggatcaaaa

SEQ ID NO: 218881 - DNA, 16 bp, P. troglodytes
caaccatgtgattaga

SEQ ID NO: 218882 - DNA, 16 bp, P. troglodytes
caaccatttaaaaatg

SEQ ID NO: 218883 - DNA, 16 bp, P. troglodytes
caaccattttgttttt

SEQ ID NO: 218884 - DNA, 16 bp, P. troglodytes
caacccaaagccaatc

SEQ ID NO: 218885 - DNA, 16 bp, P. troglodytes
caacccacagactggg

SEQ ID NO: 218886 - DNA, 16 bp, P. troglodytes
caacccatcatctaga

SEQ ID NO: 218887 - DNA, 16 bp, P. troglodytes
caaccccaaggcacat

SEQ ID NO: 218888 - DNA, 16 bp, P. troglodytes
caaccccatgaaaaag

SEQ ID NO: 218889 - DNA, 16 bp, P. troglodytes
caacccccacctccag

SEQ ID NO: 218890 - DNA, 16 bp, P. troglodytes
caacccccgcctcctg

SEQ ID NO: 218891 - DNA, 16 bp, P. troglodytes
caacccctactatgcc

SEQ ID NO: 218892 - DNA, 16 bp, P. troglodytes
caaccctatgaagtaa

SEQ ID NO: 218893 - DNA, 16 bp, P. troglodytes
caaccctcctgccttg

SEQ ID NO: 218894 - DNA, 16 bp, P. troglodytes
caacctaaatgcccat

SEQ ID NO: 218895 - DNA, 16 bp, P. troglodytes
caacctacaaagattg

SEQ ID NO: 218896 - DNA, 16 bp, P. troglodytes
caacctacagaatgag

SEQ ID NO: 218897 - DNA, 16 bp, P. troglodytes
caacctagaattctgt

SEQ ID NO: 218898 - DNA, 16 bp, P. troglodytes
caacctagattccttg

SEQ ID NO: 218899 - DNA, 16 bp, P. troglodytes
caacctcacaggctca

SEQ ID NO: 218900 - DNA, 16 bp, P. troglodytes
caacctcacctcccgg

SEQ ID NO: 218901 - DNA, 16 bp, P. troglodytes
caacctcagcctccag

SEQ ID NO: 218902 - DNA, 16 bp, P. troglodytes
caacctcagccttctg

SEQ ID NO: 218903 - DNA, 16 bp, P. troglodytes
caacctcaggtgaccc

SEQ ID NO: 218904 - DNA, 16 bp, P. troglodytes
caacctcattttaact

SEQ ID NO: 218905 - DNA, 16 bp, P. troglodytes
caacctccaccacctg

SEQ ID NO: 218906 - DNA, 16 bp, P. troglodytes
caacctccacctcgcg

SEQ ID NO: 218907 - DNA, 16 bp, P. troglodytes
caacctccagagtagc

SEQ ID NO: 218908 - DNA, 16 bp, P. troglodytes
caacctcccaaagtat

SEQ ID NO: 218909 - DNA, 16 bp, P. troglodytes
caacctcccactcctg

SEQ ID NO: 218910 - DNA, 16 bp, P. troglodytes
caacctcccaggctcc

SEQ ID NO: 218911 - DNA, 16 bp, P. troglodytes
caacctccgccccctg

SEQ ID NO: 218912 - DNA, 16 bp, P. troglodytes
caacctccgcctgcct

SEQ ID NO: 218913 - DNA, 16 bp, P. troglodytes
caacctcctgggctct

SEQ ID NO: 218914 - DNA, 16 bp, P. troglodytes
caacctcctgggcttc

SEQ ID NO: 218915 - DNA, 16 bp, P. troglodytes
caacctcctggggctc

SEQ ID NO: 218916 - DNA, 16 bp, P. troglodytes
caacctcggcctcctg

SEQ ID NO: 218917 - DNA, 16 bp, P. troglodytes
caacctctacctccct

SEQ ID NO: 218918 - DNA, 16 bp, P. troglodytes
caacctctacttcctg

SEQ ID NO: 218919 - DNA, 16 bp, P. troglodytes
caacctctccctcctg

SEQ ID NO: 218920 - DNA, 16 bp, P. troglodytes
caacctctctctccca

SEQ ID NO: 218921 - DNA, 16 bp, P. troglodytes
caacctctgccccttg

SEQ ID NO: 218922 - DNA, 16 bp, P. troglodytes
caacctctgcctgtca

SEQ ID NO: 218923 - DNA, 16 bp, P. troglodytes
caacctctgctcccca

SEQ ID NO: 218924 - DNA, 16 bp, P. troglodytes
caacctctggctccca

SEQ ID NO: 218925 - DNA, 16 bp, P. troglodytes
caacctcttcctcctg

SEQ ID NO: 218926 - DNA, 16 bp, P. troglodytes
caacctgagtgacaga

SEQ ID NO: 218927 - DNA, 16 bp, P. troglodytes
caacctgcctcagcct

SEQ ID NO: 218928 - DNA, 16 bp, P. troglodytes
caacctgcctcccatt

SEQ ID NO: 218929 - DNA, 16 bp, P. troglodytes
caacctggatcccttg

SEQ ID NO: 218930 - DNA, 16 bp, P. troglodytes
caacctggccaacata

SEQ ID NO: 218931 - DNA, 16 bp, P. troglodytes
caacctggccaacatg

SEQ ID NO: 218932 - DNA, 16 bp, P. troglodytes
caacctgggcaacaca

SEQ ID NO: 218933 - DNA, 16 bp, P. troglodytes
caacctgggcaacatg

SEQ ID NO: 218934 - DNA, 16 bp, P. troglodytes
caacctgggctacaga

SEQ ID NO: 218935 - DNA, 16 bp, P. troglodytes
caacctgggggacaag

SEQ ID NO: 218936 - DNA, 16 bp, P. troglodytes
caacctgggtgacaag

SEQ ID NO: 218937 - DNA, 16 bp, P. troglodytes
caacctgttttatcag

SEQ ID NO: 218938 - DNA, 16 bp, P. troglodytes
caaccttactgaattt

SEQ ID NO: 218939 - DNA, 16 bp, P. troglodytes
caaccttcacttcctg

SEQ ID NO: 218940 - DNA, 16 bp, P. troglodytes
caaccttggtgacaga

SEQ ID NO: 218941 - DNA, 16 bp, P. troglodytes
caacctttctctctgg

SEQ ID NO: 218942 - DNA, 16 bp, P. troglodytes
caacctttttggcatc

SEQ ID NO: 218943 - DNA, 16 bp, P. troglodytes
caacgagagcaaaact

SEQ ID NO: 218944 - DNA, 16 bp, P. troglodytes
caacgagtgaaactcc

SEQ ID NO: 218945 - DNA, 16 bp, P. troglodytes
caacgctttgggaggc

SEQ ID NO: 218946 - DNA, 17 bp, P. troglodytes
caacgtggagaaaccct

SEQ ID NO: 218947 - DNA, 16 bp, P. troglodytes
caacgtggtaaaaccc

SEQ ID NO: 218948 - DNA, 16 bp, P. troglodytes
caactaaattttgtat

SEQ ID NO: 218949 - DNA, 16 bp, P. troglodytes
caactacattaggtat

SEQ ID NO: 218950 - DNA, 16 bp, P. troglodytes
caactataaaaaggaa

SEQ ID NO: 218951 - DNA, 16 bp, P. troglodytes
caactatactacaagg

SEQ ID NO: 218952 - DNA, 16 bp, P. troglodytes
caactattatttgtca

SEQ ID NO: 218953 - DNA, 16 bp, P. troglodytes
caactattttttaaat

SEQ ID NO: 218954 - DNA, 16 bp, P. troglodytes
caactcaaaatggatt

SEQ ID NO: 218955 - DNA, 16 bp, P. troglodytes
caactcactgcagcct

SEQ ID NO: 218956 - DNA, 16 bp, P. troglodytes
caactcagcctccaga

SEQ ID NO: 218957 - DNA, 16 bp, P. troglodytes
caactcagcttcctga

SEQ ID NO: 218958 - DNA, 16 bp, P. troglodytes
caactccaaaaggaac

SEQ ID NO: 218959 - DNA, 16 bp, P. troglodytes
caactccagacctcag

SEQ ID NO: 218960 - DNA, 16 bp, P. troglodytes
caactcccacttagga

SEQ ID NO: 218961 - DNA, 16 bp, P. troglodytes
caactcccaggttcaa

SEQ ID NO: 218962 - DNA, 17 bp, P. troglodytes
caactcctgaccttgtg

SEQ ID NO: 218963 - DNA, 16 bp, P. troglodytes
caactctacaaaaatt

SEQ ID NO: 218964 - DNA, 16 bp, P. troglodytes
caactctgtgaagaaa

SEQ ID NO: 218965 - DNA, 16 bp, P. troglodytes
caactgaagaactgaa

SEQ ID NO: 218966 - DNA, 16 bp, P. troglodytes
caactgtgaggaaaca

SEQ ID NO: 218967 - DNA, 23 bp, P. troglodytes
caacttacaagggatgtgaagga

SEQ ID NO: 218968 - DNA, 16 bp, P. troglodytes
caacttacaagtgatg

SEQ ID NO: 218969 - DNA, 16 bp, P. troglodytes
caacttcaccagcatc

SEQ ID NO: 218970 - DNA, 16 bp, P. troglodytes
caacttccacctccca

SEQ ID NO: 218971 - DNA, 16 bp, P. troglodytes
caacttcctgggctca

SEQ ID NO: 218972 - DNA, 16 bp, P. troglodytes
caacttctgcctcctg

SEQ ID NO: 218973 - DNA, 16 bp, P. troglodytes
caacttctggactcaa

SEQ ID NO: 218974 - DNA, 16 bp, P. troglodytes
caacttcttcctgatt

SEQ ID NO: 218975 - DNA, 16 bp, P. troglodytes
caacttcttcctggtg

SEQ ID NO: 218976 - DNA, 16 bp, P. troglodytes
caacttctttcatcag

SEQ ID NO: 218977 - DNA, 16 bp, P. troglodytes
caacttgctgaaggct

SEQ ID NO: 218978 - DNA, 16 bp, P. troglodytes
caacttgctgtgtgac

SEQ ID NO: 218979 - DNA, 18 bp, P. troglodytes
caactttcaagggatgtg

SEQ ID NO: 218980 - DNA, 16 bp, P. troglodytes
caactttctggcagac

SEQ ID NO: 218981 - DNA, 16 bp, P. troglodytes
caactttgctccaaaa

SEQ ID NO: 218982 - DNA, 16 bp, P. troglodytes
caactttgtgtgtgtg

SEQ ID NO: 218983 - DNA, 16 bp, P. troglodytes
caacttttattataga

SEQ ID NO: 218984 - DNA, 16 bp, P. troglodytes
caacttttgtttttgt

SEQ ID NO: 218985 - DNA, 16 bp, P. troglodytes
caactttttaaaaaag

SEQ ID NO: 218986 - DNA, 16 bp, P. troglodytes
caactttttattttga

SEQ ID NO: 218987 - DNA, 16 bp, P. troglodytes
caacttttttgtaaat

SEQ ID NO: 218988 - DNA, 16 bp, P. troglodytes
caagaaaaaaatgtta

SEQ ID NO: 218989 - DNA, 16 bp, P. troglodytes
caagaaaagcaaaact

SEQ ID NO: 218990 - DNA, 16 bp, P. troglodytes
caagaaaagctggcaa

SEQ ID NO: 218991 - DNA, 16 bp, P. troglodytes
caagaaaaggaaaatt

SEQ ID NO: 218992 - DNA, 16 bp, P. troglodytes
caagaaaataatccca

SEQ ID NO: 218993 - DNA, 16 bp, P. troglodytes
caagaaaatgctgagg

SEQ ID NO: 218994 - DNA, 16 bp, P. troglodytes
caagaaacaacagata

SEQ ID NO: 218995 - DNA, 16 bp, P. troglodytes
caagaaacacacttta

SEQ ID NO: 218996 - DNA, 16 bp, P. troglodytes
caagaaacacatgaaa

SEQ ID NO: 218997 - DNA, 16 bp, P. troglodytes
caagaaaccactttat

SEQ ID NO: 218998 - DNA, 16 bp, P. troglodytes
caagaaactcaaagaa

SEQ ID NO: 218999 - DNA, 16 bp, P. troglodytes
caagaaactgcctttc

SEQ ID NO: 219000 - DNA, 16 bp, P. troglodytes
caagaaagaattcagg

SEQ ID NO: 219001 - DNA, 16 bp, P. troglodytes
caagaaataatgaaat

SEQ ID NO: 219002 - DNA, 16 bp, P. troglodytes
caagaaatacagagaa

SEQ ID NO: 219003 - DNA, 16 bp, P. troglodytes
caagaaatacatgaaa

SEQ ID NO: 219004 - DNA, 16 bp, P. troglodytes
caagaaatatatattt

SEQ ID NO: 219005 - DNA, 16 bp, P. troglodytes
caagaaatattttatt

SEQ ID NO: 219006 - DNA, 16 bp, P. troglodytes
caagaaatcaggagag

SEQ ID NO: 219007 - DNA, 16 bp, P. troglodytes
caagaaatcctgaact

SEQ ID NO: 219008 - DNA, 16 bp, P. troglodytes
caagaaatggaatcaa

SEQ ID NO: 219009 - DNA, 16 bp, P. troglodytes
caagaaatggagaaag

SEQ ID NO: 219010 - DNA, 16 bp, P. troglodytes
caagaaatggataaat

SEQ ID NO: 219011 - DNA, 16 bp, P. troglodytes
caagaaatgtaatcca

SEQ ID NO: 219012 - DNA, 16 bp, P. troglodytes
caagaaattagctggg

SEQ ID NO: 219013 - DNA, 16 bp, P. troglodytes
caagaaatttaacatt

SEQ ID NO: 219014 - DNA, 16 bp, P. troglodytes
caagaacaacctggcc

SEQ ID NO: 219015 - DNA, 16 bp, P. troglodytes
caagaacacacactgg

SEQ ID NO: 219016 - DNA, 16 bp, P. troglodytes
caagaacacacattgg

SEQ ID NO: 219017 - DNA, 16 bp, P. troglodytes
caagaacagcaaggga

SEQ ID NO: 219018 - DNA, 16 bp, P. troglodytes
caagaacatcctggcc

SEQ ID NO: 219019 - DNA, 16 bp, P. troglodytes
caagaacctggacacc

SEQ ID NO: 219020 - DNA, 16 bp, P. troglodytes
caagaactacatgaag

SEQ ID NO: 219021 - DNA, 17 bp, P. troglodytes
caagaactacgtgaaga

SEQ ID NO: 219022 - DNA, 16 bp, P. troglodytes
caagaactacgtgacg

SEQ ID NO: 219023 - DNA, 16 bp, P. troglodytes
caagaactacgtgatg

SEQ ID NO: 219024 - DNA, 16 bp, P. troglodytes
caagaactcaaacaaa

SEQ ID NO: 219025 - DNA, 16 bp, P. troglodytes
caagaactttcccttt

SEQ ID NO: 219026 - DNA, 16 bp, P. troglodytes
caagaacttttctttt

SEQ ID NO: 219027 - DNA, 16 bp, P. troglodytes
caagaagaaaaatatg

SEQ ID NO: 219028 - DNA, 16 bp, P. troglodytes
caagaagaactacaaa

SEQ ID NO: 219029 - DNA, 16 bp, P. troglodytes
caagaagaacttgttt

SEQ ID NO: 219030 - DNA, 16 bp, P. troglodytes
caagaagaatgaggat

SEQ ID NO: 219031 - DNA, 16 bp, P. troglodytes
caagaagacagaaaat

SEQ ID NO: 219032 - DNA, 16 bp, P. troglodytes
caagaagagaaatatg

SEQ ID NO: 219033 - DNA, 16 bp, P. troglodytes
caagaagagagtgggg

SEQ ID NO: 219034 - DNA, 16 bp, P. troglodytes
caagaagagcgaaact

SEQ ID NO: 219035 - DNA, 16 bp, P. troglodytes
caagaagagctaccta

SEQ ID NO: 219036 - DNA, 16 bp, P. troglodytes
caagaagatataacaa

SEQ ID NO: 219037 - DNA, 16 bp, P. troglodytes
caagaagattctgtat

SEQ ID NO: 219038 - DNA, 16 bp, P. troglodytes
caagaagcacatgaaa

SEQ ID NO: 219039 - DNA, 16 bp, P. troglodytes
caagaagcagatgctg

SEQ ID NO: 219040 - DNA, 16 bp, P. troglodytes
caagaagcggaggttg

SEQ ID NO: 219041 - DNA, 16 bp, P. troglodytes
caagaagctcaaagaa

SEQ ID NO: 219042 - DNA, 16 bp, P. troglodytes
caagaagctgagcaaa

SEQ ID NO: 219043 - DNA, 16 bp, P. troglodytes
caagaagctggaatta

SEQ ID NO: 219044 - DNA, 16 bp, P. troglodytes
caagaagctggtggag

SEQ ID NO: 219045 - DNA, 16 bp, P. troglodytes
caagaaggaaactcca

SEQ ID NO: 219046 - DNA, 16 bp, P. troglodytes
caagaaggaaatgaaa

SEQ ID NO: 219047 - DNA, 16 bp, P. troglodytes
caagaaggcccttgcc

SEQ ID NO: 219048 - DNA, 16 bp, P. troglodytes
caagaaggcggccatc

SEQ ID NO: 219049 - DNA, 16 bp, P. troglodytes
caagaaggttaaaaat

SEQ ID NO: 219050 - DNA, 16 bp, P. troglodytes
caagaagtggaaacaa

SEQ ID NO: 219051 - DNA, 16 bp, P. troglodytes
caagaagtgggcaaag

SEQ ID NO: 219052 - DNA, 16 bp, P. troglodytes
caagaagttcaacaaa

SEQ ID NO: 219053 - DNA, 16 bp, P. troglodytes
caagaagttgcaaaaa

SEQ ID NO: 219054 - DNA, 16 bp, P. troglodytes
caagaatacagaaaat

SEQ ID NO: 219055 - DNA, 16 bp, P. troglodytes
caagaatgcagagaaa

SEQ ID NO: 219056 - DNA, 16 bp, P. troglodytes
caagaatgtgaagaaa

SEQ ID NO: 219057 - DNA, 16 bp, P. troglodytes
caagaattttccaaaa

SEQ ID NO: 219058 - DNA, 16 bp, P. troglodytes
caagaatttttaaaaa

SEQ ID NO: 219059 - DNA, 16 bp, P. troglodytes
caagacaaggatgccc

SEQ ID NO: 219060 - DNA, 16 bp, P. troglodytes
caagacaatggagaaa

SEQ ID NO: 219061 - DNA, 16 bp, P. troglodytes
caagacaattcttcca

SEQ ID NO: 219062 - DNA, 16 bp, P. troglodytes
caagacacaaaattgt

SEQ ID NO: 219063 - DNA, 16 bp, P. troglodytes
caagacagaccacatt

SEQ ID NO: 219064 - DNA, 16 bp, P. troglodytes
caagacagaggaattg

SEQ ID NO: 219065 - DNA, 16 bp, P. troglodytes
caagacagctattttg

SEQ ID NO: 219066 - DNA, 16 bp, P. troglodytes
caagacaggccaacat

SEQ ID NO: 219067 - DNA, 16 bp, P. troglodytes
caagacaggcctgggc

SEQ ID NO: 219068 - DNA, 16 bp, P. troglodytes
caagaccaacatggtg

SEQ ID NO: 219069 - DNA, 16 bp, P. troglodytes
caagaccacaccattg

SEQ ID NO: 219070 - DNA, 16 bp, P. troglodytes
caagaccagccagacc

SEQ ID NO: 219071 - DNA, 16 bp, P. troglodytes
caagaccagccgggcc

SEQ ID NO: 219072 - DNA, 16 bp, P. troglodytes
caagaccagcctgatg

SEQ ID NO: 219073 - DNA, 16 bp, P. troglodytes
caagaccagcctggtc

SEQ ID NO: 219074 - DNA, 16 bp, P. troglodytes
caagaccagcctggtg

SEQ ID NO: 219075 - DNA, 16 bp, P. troglodytes
caagaccagcgtgacc

SEQ ID NO: 219076 - DNA, 16 bp, P. troglodytes
caagaccatcaaggtg

SEQ ID NO: 219077 - DNA, 16 bp, P. troglodytes
caagaccatgggaacc

SEQ ID NO: 219078 - DNA, 16 bp, P. troglodytes
caagacccacctggcc

SEQ ID NO: 219079 - DNA, 16 bp, P. troglodytes
caagacccagcctggg

SEQ ID NO: 219080 - DNA, 16 bp, P. troglodytes
caagacccccgtctct

SEQ ID NO: 219081 - DNA, 16 bp, P. troglodytes
caagaccctcatctct

SEQ ID NO: 219082 - DNA, 16 bp, P. troglodytes
caagaccctgcctctt

SEQ ID NO: 219083 - DNA, 16 bp, P. troglodytes
caagaccctgtctata

SEQ ID NO: 219084 - DNA, 16 bp, P. troglodytes
caagacctcatctctt

SEQ ID NO: 219085 - DNA, 16 bp, P. troglodytes
caagactagcctggct

SEQ ID NO: 219086 - DNA, 16 bp, P. troglodytes
caagactaggaagaaa

SEQ ID NO: 219087 - DNA, 16 bp, P. troglodytes
caagactctcaaaaaa

SEQ ID NO: 219088 - DNA, 16 bp, P. troglodytes
caagactctgccttaa

SEQ ID NO: 219089 - DNA, 16 bp, P. troglodytes
caagactctttcaaaa

SEQ ID NO: 219090 - DNA, 16 bp, P. troglodytes
caagacttcatcttaa

SEQ ID NO: 219091 - DNA, 16 bp, P. troglodytes
caagagaaaaatgaag

SEQ ID NO: 219092 - DNA, 16 bp, P. troglodytes
caagagaaaatgaaga

SEQ ID NO: 219093 - DNA, 16 bp, P. troglodytes
caagagaaactaccat

SEQ ID NO: 219094 - DNA, 16 bp, P. troglodytes
caagagaaatgaaaat

SEQ ID NO: 219095 - DNA, 16 bp, P. troglodytes
caagagaaatgagaac

SEQ ID NO: 219096 - DNA, 16 bp, P. troglodytes
caagagaactgaaaat

SEQ ID NO: 219097 - DNA, 16 bp, P. troglodytes
caagagaactggaatt

SEQ ID NO: 219098 - DNA, 16 bp, P. troglodytes
caagagaatgaaataa

SEQ ID NO: 219099 - DNA, 16 bp, P. troglodytes
caagagaattaaggag

SEQ ID NO: 219100 - DNA, 16 bp, P. troglodytes
caagagacacatctca

SEQ ID NO: 219101 - DNA, 16 bp, P. troglodytes
caagagactcacttca

SEQ ID NO: 219102 - DNA, 16 bp, P. troglodytes
caagagactgaaggca

SEQ ID NO: 219103 - DNA, 16 bp, P. troglodytes
caagagagaatgagag

SEQ ID NO: 219104 - DNA, 16 bp, P. troglodytes
caagagagagaggtgg

SEQ ID NO: 219105 - DNA, 16 bp, P. troglodytes
caagagagcgagaccc

SEQ ID NO: 219106 - DNA, 16 bp, P. troglodytes
caagagcaagagagag

SEQ ID NO: 219107 - DNA, 16 bp, P. troglodytes
caagagcaggagcaag

SEQ ID NO: 219108 - DNA, 16 bp, P. troglodytes
caagagccaagtcctg

SEQ ID NO: 219109 - DNA, 16 bp, P. troglodytes
caagagctggagacca

SEQ ID NO: 219110 - DNA, 16 bp, P. troglodytes
caagaggaaaatatca

SEQ ID NO: 219111 - DNA, 16 bp, P. troglodytes
caagaggaagcagagt

SEQ ID NO: 219112 - DNA, 16 bp, P. troglodytes
caagaggattgcctga

SEQ ID NO: 219113 - DNA, 16 bp, P. troglodytes
caagaggattgtaaaa

SEQ ID NO: 219114 - DNA, 16 bp, P. troglodytes
caagaggcagagccag

SEQ ID NO: 219115 - DNA, 16 bp, P. troglodytes
caagaggcagaggtgg

SEQ ID NO: 219116 - DNA, 16 bp, P. troglodytes
caagaggcccagcttt

SEQ ID NO: 219117 - DNA, 16 bp, P. troglodytes
caagaggtcaaggctg

SEQ ID NO: 219118 - DNA, 16 bp, P. troglodytes
caagaggtctagcttt

SEQ ID NO: 219119 - DNA, 19 bp, P. troglodytes
caagagtgagactccatct

SEQ ID NO: 219120 - DNA, 16 bp, P. troglodytes
caagagtgagatcctg

SEQ ID NO: 219121 - DNA, 16 bp, P. troglodytes
caagagtgcagtggtg

SEQ ID NO: 219122 - DNA, 17 bp, P. troglodytes
caagagttcaagaccaa

SEQ ID NO: 219123 - DNA, 16 bp, P. troglodytes
caagagttcgggacca

SEQ ID NO: 219124 - DNA, 16 bp, P. troglodytes
caagataatttataga

SEQ ID NO: 219125 - DNA, 16 bp, P. troglodytes
caagatacaaaattaa

SEQ ID NO: 219126 - DNA, 16 bp, P. troglodytes
caagatacattttttt

SEQ ID NO: 219127 - DNA, 16 bp, P. troglodytes
caagatacctcattat

SEQ ID NO: 219128 - DNA, 16 bp, P. troglodytes
caagatatggaaacag

SEQ ID NO: 219129 - DNA, 16 bp, P. troglodytes
caagatatttttcaga

SEQ ID NO: 219130 - DNA, 16 bp, P. troglodytes
caagatcaaatccaca

SEQ ID NO: 219131 - DNA, 16 bp, P. troglodytes
caagatcaagccactg

SEQ ID NO: 219132 - DNA, 16 bp, P. troglodytes
caagatcaaggtgtct

SEQ ID NO: 219133 - DNA, 16 bp, P. troglodytes
caagatcacacagctg

SEQ ID NO: 219134 - DNA, 16 bp, P. troglodytes
caagatcacaccagtg

SEQ ID NO: 219135 - DNA, 16 bp, P. troglodytes
caagatcacgccactc

SEQ ID NO: 219136 - DNA, 16 bp, P. troglodytes
caagatcagcctgagc

SEQ ID NO: 219137 - DNA, 16 bp, P. troglodytes
caagatcatacagcta

SEQ ID NO: 219138 - DNA, 16 bp, P. troglodytes
caagatcatcctggcc

SEQ ID NO: 219139 - DNA, 16 bp, P. troglodytes
caagatcatgaaagac

SEQ ID NO: 219140 - DNA, 16 bp, P. troglodytes
caagatcctgcctcta

SEQ ID NO: 219141 - DNA, 16 bp, P. troglodytes
caagatcgcaccaatg

SEQ ID NO: 219142 - DNA, 16 bp, P. troglodytes
caagatctggaagcaa

SEQ ID NO: 219143 - DNA, 16 bp, P. troglodytes
caagatctggtcattt

SEQ ID NO: 219144 - DNA, 16 bp, P. troglodytes
caagatcttggctcat

SEQ ID NO: 219145 - DNA, 16 bp, P. troglodytes
caagatgaaaagaatt

SEQ ID NO: 219146 - DNA, 16 bp, P. troglodytes
caagatgagatatggg

SEQ ID NO: 219147 - DNA, 16 bp, P. troglodytes
caagatgccagcagat

SEQ ID NO: 219148 - DNA, 16 bp, P. troglodytes
caagatggagaaaccc

SEQ ID NO: 219149 - DNA, 16 bp, P. troglodytes
caagatgggaggattg

SEQ ID NO: 219150 - DNA, 17 bp, P. troglodytes
caagatggtgaaactcc

SEQ ID NO: 219151 - DNA, 16 bp, P. troglodytes
caagatgtggagatgg

SEQ ID NO: 219152 - DNA, 16 bp, P. troglodytes
caagattcaaacccag

SEQ ID NO: 219153 - DNA, 16 bp, P. troglodytes
caagattcaaattcag

SEQ ID NO: 219154 - DNA, 16 bp, P. troglodytes
caagattcaattatct

SEQ ID NO: 219155 - DNA, 16 bp, P. troglodytes
caagattctgaccctc

SEQ ID NO: 219156 - DNA, 16 bp, P. troglodytes
caagattctgtcttta

SEQ ID NO: 219157 - DNA, 16 bp, P. troglodytes
caagattgaaccagaa

SEQ ID NO: 219158 - DNA, 16 bp, P. troglodytes
caagattgtgctgctg

SEQ ID NO: 219159 - DNA, 16 bp, P. troglodytes
caagatttcaagacca

SEQ ID NO: 219160 - DNA, 16 bp, P. troglodytes
caagatttcatttttt

SEQ ID NO: 219161 - DNA, 16 bp, P. troglodytes
caagatttgaaaacaa

SEQ ID NO: 219162 - DNA, 16 bp, P. troglodytes
caagattttgttcttt

SEQ ID NO: 219163 - DNA, 16 bp, P. troglodytes
caagatttttagcttc

SEQ ID NO: 219164 - DNA, 16 bp, P. troglodytes
caagattttttaaaaa

SEQ ID NO: 219165 - DNA, 16 bp, P. troglodytes
caagattttttctttg

SEQ ID NO: 219166 - DNA, 16 bp, P. troglodytes
caagcaaaaaacaatc

SEQ ID NO: 219167 - DNA, 16 bp, P. troglodytes
caagcaaatggaaagc

SEQ ID NO: 219168 - DNA, 16 bp, P. troglodytes
caagcaacttcagcaa

SEQ ID NO: 219169 - DNA, 16 bp, P. troglodytes
caagcaacttggaaaa

SEQ ID NO: 219170 - DNA, 16 bp, P. troglodytes
caagcaagactctgtc

SEQ ID NO: 219171 - DNA, 16 bp, P. troglodytes
caagcaatcttccttc

SEQ ID NO: 219172 - DNA, 16 bp, P. troglodytes
caagcaccagatcaaa

SEQ ID NO: 219173 - DNA, 16 bp, P. troglodytes
caagcactgcaatacc

SEQ ID NO: 219174 - DNA, 16 bp, P. troglodytes
caagcagaaggagttt

SEQ ID NO: 219175 - DNA, 16 bp, P. troglodytes
caagcagagagagaga

SEQ ID NO: 219176 - DNA, 16 bp, P. troglodytes
caagcagagggagctg

SEQ ID NO: 219177 - DNA, 16 bp, P. troglodytes
caagcagatgctggca

SEQ ID NO: 219178 - DNA, 16 bp, P. troglodytes
caagcaggaaaacagg

SEQ ID NO: 219179 - DNA, 16 bp, P. troglodytes
caagcaggcaggcagg

SEQ ID NO: 219180 - DNA, 16 bp, P. troglodytes
caagcagttcttttca

SEQ ID NO: 219181 - DNA, 16 bp, P. troglodytes
caagcatcaacaccat

SEQ ID NO: 219182 - DNA, 16 bp, P. troglodytes
caagcatgtggagaaa

SEQ ID NO: 219183 - DNA, 16 bp, P. troglodytes
caagcatttactgagc

SEQ ID NO: 219184 - DNA, 16 bp, P. troglodytes
caagcatttatacttt

SEQ ID NO: 219185 - DNA, 16 bp, P. troglodytes
caagcattttagataa

SEQ ID NO: 219186 - DNA, 16 bp, P. troglodytes
caagcattttggataa

SEQ ID NO: 219187 - DNA, 16 bp, P. troglodytes
caagccaagatcatgc

SEQ ID NO: 219188 - DNA, 16 bp, P. troglodytes
caagccaaggaaagcc

SEQ ID NO: 219189 - DNA, 16 bp, P. troglodytes
caagccaaggagagag

SEQ ID NO: 219190 - DNA, 16 bp, P. troglodytes
caagccaagtcccttc

SEQ ID NO: 219191 - DNA, 16 bp, P. troglodytes
caagccaccaatgact

SEQ ID NO: 219192 - DNA, 16 bp, P. troglodytes
caagccaccctcctgc

SEQ ID NO: 219193 - DNA, 16 bp, P. troglodytes
caagccagcagcagca

SEQ ID NO: 219194 - DNA, 16 bp, P. troglodytes
caagccaggcagatca

SEQ ID NO: 219195 - DNA, 16 bp, P. troglodytes
caagccatctgcctgc

SEQ ID NO: 219196 - DNA, 16 bp, P. troglodytes
caagccattcatgaag

SEQ ID NO: 219197 - DNA, 16 bp, P. troglodytes
caagccattctccagc

SEQ ID NO: 219198 - DNA, 16 bp, P. troglodytes
caagcccagctaattt

SEQ ID NO: 219199 - DNA, 16 bp, P. troglodytes
caagcccaggcactgt

SEQ ID NO: 219200 - DNA, 16 bp, P. troglodytes
caagcccatgcccacc

SEQ ID NO: 219201 - DNA, 16 bp, P. troglodytes
caagccccgcctcccg

SEQ ID NO: 219202 - DNA, 16 bp, P. troglodytes
caagccctgcctcctg

SEQ ID NO: 219203 - DNA, 16 bp, P. troglodytes
caagccctgcctctgg

SEQ ID NO: 219204 - DNA, 16 bp, P. troglodytes
caagcctcaagccttg

SEQ ID NO: 219205 - DNA, 16 bp, P. troglodytes
caagcctcaattcttg

SEQ ID NO: 219206 - DNA, 16 bp, P. troglodytes
caagcctcagcctccc

SEQ ID NO: 219207 - DNA, 16 bp, P. troglodytes
caagcctcagcctcct

SEQ ID NO: 219208 - DNA, 16 bp, P. troglodytes
caagcctctggtcaca

SEQ ID NO: 219209 - DNA, 16 bp, P. troglodytes
caagcctgggccacag

SEQ ID NO: 219210 - DNA, 16 bp, P. troglodytes
caagccttggcagctt

SEQ ID NO: 219211 - DNA, 16 bp, P. troglodytes
caagcctttaatccca

SEQ ID NO: 219212 - DNA, 16 bp, P. troglodytes
caagcgcagtggctca

SEQ ID NO: 219213 - DNA, 16 bp, P. troglodytes
caagcgccaccacgcc

SEQ ID NO: 219214 - DNA, 16 bp, P. troglodytes
caagcgtgagccaccg

SEQ ID NO: 219215 - DNA, 16 bp, P. troglodytes
caagcgtgagccactg

SEQ ID NO: 219216 - DNA, 16 bp, P. troglodytes
caagctaaggaaagaa

SEQ ID NO: 219217 - DNA, 16 bp, P. troglodytes
caagctagaaggaatt

SEQ ID NO: 219218 - DNA, 16 bp, P. troglodytes
caagctcagcctcctg

SEQ ID NO: 219219 - DNA, 16 bp, P. troglodytes
caagctccaccttcca

SEQ ID NO: 219220 - DNA, 16 bp, P. troglodytes
caagctccactggcag

SEQ ID NO: 219221 - DNA, 16 bp, P. troglodytes
caagctccagcatccc

SEQ ID NO: 219222 - DNA, 18 bp, P. troglodytes
caagctccgcctcctgga

SEQ ID NO: 219223 - DNA, 16 bp, P. troglodytes
caagctccgccttctg

SEQ ID NO: 219224 - DNA, 16 bp, P. troglodytes
caagctctccctcctg

SEQ ID NO: 219225 - DNA, 16 bp, P. troglodytes
caagctctgccccctg

SEQ ID NO: 219226 - DNA, 16 bp, P. troglodytes
caagctctgcctcttg

SEQ ID NO: 219227 - DNA, 16 bp, P. troglodytes
caagctctgcctgcca

SEQ ID NO: 219228 - DNA, 16 bp, P. troglodytes
caagctgaaatgcagt

SEQ ID NO: 219229 - DNA, 16 bp, P. troglodytes
caagctgagaaacaaa

SEQ ID NO: 219230 - DNA, 16 bp, P. troglodytes
caagctgaggagcagg

SEQ ID NO: 219231 - DNA, 16 bp, P. troglodytes
caagctgctcaatcaa

SEQ ID NO: 219232 - DNA, 16 bp, P. troglodytes
caagctgctgctgctg

SEQ ID NO: 219233 - DNA, 16 bp, P. troglodytes
caagctggaggcccag

SEQ ID NO: 219234 - DNA, 16 bp, P. troglodytes
caagctggagtgcaga

SEQ ID NO: 219235 - DNA, 16 bp, P. troglodytes
caagctggccttgaac

SEQ ID NO: 219236 - DNA, 16 bp, P. troglodytes
caagctggttttgaac

SEQ ID NO: 219237 - DNA, 16 bp, P. troglodytes
caagctgtacaagaag

SEQ ID NO: 219238 - DNA, 16 bp, P. troglodytes
caagctgtcagtgggt

SEQ ID NO: 219239 - DNA, 16 bp, P. troglodytes
caagctgtgccccgac

SEQ ID NO: 219240 - DNA, 16 bp, P. troglodytes
caagcttcagtttcct

SEQ ID NO: 219241 - DNA, 16 bp, P. troglodytes
caagcttccaggtgat

SEQ ID NO: 219242 - DNA, 16 bp, P. troglodytes
caagcttgtccaaccc

SEQ ID NO: 219243 - DNA, 16 bp, P. troglodytes
caagcttgtcttgaac

SEQ ID NO: 219244 - DNA, 16 bp, P. troglodytes
caaggaaaatctgaga

SEQ ID NO: 219245 - DNA, 16 bp, P. troglodytes
caaggaaaatgaaaac

SEQ ID NO: 219246 - DNA, 16 bp, P. troglodytes
caaggaaacagattct

SEQ ID NO: 219247 - DNA, 16 bp, P. troglodytes
caaggaaaggaaataa

SEQ ID NO: 219248 - DNA, 16 bp, P. troglodytes
caaggaaataaaaatt

SEQ ID NO: 219249 - DNA, 16 bp, P. troglodytes
caaggaaatagaaaat

SEQ ID NO: 219250 - DNA, 16 bp, P. troglodytes
caaggaaatcatggag

SEQ ID NO: 219251 - DNA, 16 bp, P. troglodytes
caaggaactagagaag

SEQ ID NO: 219252 - DNA, 16 bp, P. troglodytes
caaggaagaaattgaa

SEQ ID NO: 219253 - DNA, 16 bp, P. troglodytes
caaggaagaagtcaaa

SEQ ID NO: 219254 - DNA, 16 bp, P. troglodytes
caaggaagctaaaaac

SEQ ID NO: 219255 - DNA, 16 bp, P. troglodytes
caaggaaggcttcctg

SEQ ID NO: 219256 - DNA, 27 bp, P. troglodytes
caaggaagtaaaaccaaagacaggcag

SEQ ID NO: 219257 - DNA, 16 bp, P. troglodytes
caaggaataattttga

SEQ ID NO: 219258 - DNA, 16 bp, P. troglodytes
caaggaatgcctggag

SEQ ID NO: 219259 - DNA, 16 bp, P. troglodytes
caaggaatggaatctt

SEQ ID NO: 219260 - DNA, 16 bp, P. troglodytes
caaggaatgtgggcag

SEQ ID NO: 219261 - DNA, 16 bp, P. troglodytes
caaggaccctcacaga

SEQ ID NO: 219262 - DNA, 16 bp, P. troglodytes
caaggactctcacaga

SEQ ID NO: 219263 - DNA, 16 bp, P. troglodytes
caaggagaactataaa

SEQ ID NO: 219264 - DNA, 16 bp, P. troglodytes
caaggagagctacaaa

SEQ ID NO: 219265 - DNA, 16 bp, P. troglodytes
caaggagataaaagat

SEQ ID NO: 219266 - DNA, 16 bp, P. troglodytes
caaggagatctacaaa

SEQ ID NO: 219267 - DNA, 16 bp, P. troglodytes
caaggaggagctggca

SEQ ID NO: 219268 - DNA, 16 bp, P. troglodytes
caaggaggcctgactg

SEQ ID NO: 219269 - DNA, 16 bp, P. troglodytes
caaggagtttacagtc

SEQ ID NO: 219270 - DNA, 16 bp, P. troglodytes
caaggataaagaaaag

SEQ ID NO: 219271 - DNA, 16 bp, P. troglodytes
caaggatagactggat

SEQ ID NO: 219272 - DNA, 16 bp, P. troglodytes
caaggatatagagaaa

SEQ ID NO: 219273 - DNA, 16 bp, P. troglodytes
caaggatgcagagaaa

SEQ ID NO: 219274 - DNA, 16 bp, P. troglodytes
caaggatgcagggatg

SEQ ID NO: 219275 - DNA, 16 bp, P. troglodytes
caaggatggttcaaca

SEQ ID NO: 219276 - DNA, 16 bp, P. troglodytes
caaggatgtccactct

SEQ ID NO: 219277 - DNA, 16 bp, P. troglodytes
caaggatgtgaaacaa

SEQ ID NO: 219278 - DNA, 16 bp, P. troglodytes
caaggcaaagcagctt

SEQ ID NO: 219279 - DNA, 16 bp, P. troglodytes
caaggcaagtcccttc

SEQ ID NO: 219280 - DNA, 16 bp, P. troglodytes
caaggcaatcctaagc

SEQ ID NO: 219281 - DNA, 16 bp, P. troglodytes
caaggcaatggggaaa

SEQ ID NO: 219282 - DNA, 37 bp, P. troglodytes; identical to SEQ ID NO: 61001

SEQ ID NO: 219283 - DNA, 16 bp, P. troglodytes
caaggcagacggatca

SEQ ID NO: 219284 - DNA, 16 bp, P. troglodytes
caaggcagcccctccc

SEQ ID NO: 219285 - DNA, 16 bp, P. troglodytes
caaggcaggagggtca

SEQ ID NO: 219286 - DNA, 16 bp, P. troglodytes
caaggcaggcggatta

SEQ ID NO: 219287 - DNA, 16 bp, P. troglodytes
caaggcaggtgaatca

SEQ ID NO: 219288 - DNA, 16 bp, P. troglodytes
caaggcaggtggatct

SEQ ID NO: 219289 - DNA, 16 bp, P. troglodytes
caaggccaaaggcctg

SEQ ID NO: 219290 - DNA, 16 bp, P. troglodytes
caaggccaggtgtggt

SEQ ID NO: 219291 - DNA, 16 bp, P. troglodytes
caaggccatcaagcta

SEQ ID NO: 219292 - DNA, 16 bp, P. troglodytes
caaggccccacctcca

SEQ ID NO: 219293 - DNA, 16 bp, P. troglodytes
caaggccctgtctcta

SEQ ID NO: 219294 - DNA, 16 bp, P. troglodytes
caaggccttgggcatc

SEQ ID NO: 219295 - DNA, 16 bp, P. troglodytes
caaggcgggtgaatca

SEQ ID NO: 219296 - DNA, 16 bp, P. troglodytes
caaggcgggtggatcc

SEQ ID NO: 219297 - DNA, 16 bp, P. troglodytes
caaggctacagtaagc

SEQ ID NO: 219298 - DNA, 16 bp, P. troglodytes
caaggctactatgaat

SEQ ID NO: 219299 - DNA, 16 bp, P. troglodytes
caaggctcagctcagg

SEQ ID NO: 219300 - DNA, 16 bp, P. troglodytes
caaggctcttcaacac

SEQ ID NO: 219301 - DNA, 16 bp, P. troglodytes
caaggctgcagagagc

SEQ ID NO: 219302 - DNA, 16 bp, P. troglodytes
caaggctgcagtaacc

SEQ ID NO: 219303 - DNA, 16 bp, P. troglodytes
caaggctgcagtgaac

SEQ ID NO: 219304 - DNA, 17 bp, P. troglodytes
caaggctgcagtgaatt

SEQ ID NO: 219305 - DNA, 16 bp, P. troglodytes
caaggctgcagtgagc

SEQ ID NO: 219306 - DNA, 16 bp, P. troglodytes
caaggctgcagtgagt

SEQ ID NO: 219307 - DNA, 16 bp, P. troglodytes
caaggctgctgtgagc

SEQ ID NO: 219308 - DNA, 16 bp, P. troglodytes
caaggctggtgaatca

SEQ ID NO: 219309 - DNA, 16 bp, P. troglodytes
caaggctgtggctgga

SEQ ID NO: 219310 - DNA, 16 bp, P. troglodytes
caaggcttcagtgaac

SEQ ID NO: 219311 - DNA, 16 bp, P. troglodytes
caaggcttgaggcttc

SEQ ID NO: 219312 - DNA, 16 bp, P. troglodytes
caaggcttgggtcttg

SEQ ID NO: 219313 - DNA, 16 bp, P. troglodytes
caagggaaagacctgc

SEQ ID NO: 219314 - DNA, 16 bp, P. troglodytes
caagggaaatgaaatc

SEQ ID NO: 219315 - DNA, 16 bp, P. troglodytes
caagggacatacctta

SEQ ID NO: 219316 - DNA, 16 bp, P. troglodytes
caagggacccagaata

SEQ ID NO: 219317 - DNA, 16 bp, P. troglodytes
caagggagtctgggaa

SEQ ID NO: 219318 - DNA, 16 bp, P. troglodytes
caagggatcgagacca

SEQ ID NO: 219319 - DNA, 16 bp, P. troglodytes
caagggcaagagaaga

SEQ ID NO: 219320 - DNA, 16 bp, P. troglodytes
caagggcaggagaaga

SEQ ID NO: 219321 - DNA, 16 bp, P. troglodytes
caagggctgaggaatg

SEQ ID NO: 219322 - DNA, 16 bp, P. troglodytes
caagggctgctggttg

SEQ ID NO: 219323 - DNA, 16 bp, P. troglodytes
caagggtcaactgtac

SEQ ID NO: 219324 - DNA, 16 bp, P. troglodytes
caagggtcaactgtat

SEQ ID NO: 219325 - DNA, 16 bp, P. troglodytes
caagggttccaatttt

SEQ ID NO: 219326 - DNA, 16 bp, P. troglodytes
caaggtcaaacagcta

SEQ ID NO: 219327 - DNA, 16 bp, P. troglodytes
caaggtcaaggtgctg

SEQ ID NO: 219328 - DNA, 16 bp, P. troglodytes
caaggtcacacagctg

SEQ ID NO: 219329 - DNA, 16 bp, P. troglodytes
caaggtcacacagtga

SEQ ID NO: 219330 - DNA, 16 bp, P. troglodytes
caaggtcacaccactg

SEQ ID NO: 219331 - DNA, 16 bp, P. troglodytes
caaggtcacagagcaa

SEQ ID NO: 219332 - DNA, 16 bp, P. troglodytes
caaggtcaggagactg

SEQ ID NO: 219333 - DNA, 16 bp, P. troglodytes
caaggtcatgcagctg

SEQ ID NO: 219334 - DNA, 16 bp, P. troglodytes
caaggtccctgccctc

SEQ ID NO: 219335 - DNA, 16 bp, P. troglodytes
caaggtctcatctgag

SEQ ID NO: 219336 - DNA, 16 bp, P. troglodytes
caaggtctcgctctgt

SEQ ID NO: 219337 - DNA, 16 bp, P. troglodytes
caaggtctcttaagtc

SEQ ID NO: 219338 - DNA, 16 bp, P. troglodytes
caaggtcttactctgt

SEQ ID NO: 219339 - DNA, 16 bp, P. troglodytes
caaggtgaaacagcaa

SEQ ID NO: 219340 - DNA, 16 bp, P. troglodytes
caaggtgatggtatta

SEQ ID NO: 219341 - DNA, 16 bp, P. troglodytes
caaggtggaaaacact

SEQ ID NO: 219342 - DNA, 16 bp, P. troglodytes
caaggtggccaaatag

SEQ ID NO: 219343 - DNA, 24 bp, P. troglodytes
caaggtgggaggattgcttgagcc

SEQ ID NO: 219344 - DNA, 19 bp, P. troglodytes
caaggtgggtggatcatct

SEQ ID NO: 219345 - DNA, 16 bp, P. troglodytes
caaggtgtcagctggg

SEQ ID NO: 219346 - DNA, 16 bp, P. troglodytes
caaggttctttaacac

SEQ ID NO: 219347 - DNA, 16 bp, P. troglodytes
caaggttggttcaaca

SEQ ID NO: 219348 - DNA, 22 bp, P. troglodytes
caaggtttcaccatgttggtca

SEQ ID NO: 219349 - DNA, 16 bp, P. troglodytes
caaggttttattaaaa

SEQ ID NO: 219350 - DNA, 16 bp, P. troglodytes
caaggttttgtttgtt

SEQ ID NO: 219351 - DNA, 16 bp, P. troglodytes
caaggtttttatcttc

SEQ ID NO: 219352 - DNA, 16 bp, P. troglodytes
caagtaactcttattt

SEQ ID NO: 219353 - DNA, 16 bp, P. troglodytes
caagtaactgggacta

SEQ ID NO: 219354 - DNA, 16 bp, P. troglodytes
caagtaatcctcccac

SEQ ID NO: 219355 - DNA, 16 bp, P. troglodytes
caagtacctggaacta

SEQ ID NO: 219356 - DNA, 16 bp, P. troglodytes
caagtactgcatgttc

SEQ ID NO: 219357 - DNA, 16 bp, P. troglodytes
caagtagcctgtcttc

SEQ ID NO: 219358 - DNA, 16 bp, P. troglodytes
caagtagctgagatta

SEQ ID NO: 219359 - DNA, 16 bp, P. troglodytes
caagtagctgggacag

SEQ ID NO: 219360 - DNA, 16 bp, P. troglodytes
caagtagggaagatat

SEQ ID NO: 219361 - DNA, 16 bp, P. troglodytes
caagtatctttttcat

SEQ ID NO: 219362 - DNA, 16 bp, P. troglodytes
caagtatttactgaat

SEQ ID NO: 219363 - DNA, 16 bp, P. troglodytes
caagtatttattgagg

SEQ ID NO: 219364 - DNA, 16 bp, P. troglodytes
caagtatttgttgaat

SEQ ID NO: 219365 - DNA, 16 bp, P. troglodytes
caagtattttcttcca

SEQ ID NO: 219366 - DNA, 16 bp, P. troglodytes
caagtcatttaacttc

SEQ ID NO: 219367 - DNA, 16 bp, P. troglodytes
caagtccaaagtctca

SEQ ID NO: 219368 - DNA, 16 bp, P. troglodytes
caagtccaaagtttca

SEQ ID NO: 219369 - DNA, 16 bp, P. troglodytes
caagtccagcctgggc

SEQ ID NO: 219370 - DNA, 16 bp, P. troglodytes
caagtcctgctgatct

SEQ ID NO: 219371 - DNA, 16 bp, P. troglodytes
caagtcctttatcaaa

SEQ ID NO: 219372 - DNA, 16 bp, P. troglodytes
caagtcctttccacct

SEQ ID NO: 219373 - DNA, 16 bp, P. troglodytes
caagtctcagttttct

SEQ ID NO: 219374 - DNA, 16 bp, P. troglodytes
caagtctccaggaagt

SEQ ID NO: 219375 - DNA, 16 bp, P. troglodytes
caagtctcctgcctca

SEQ ID NO: 219376 - DNA, 16 bp, P. troglodytes
caagtctttagacaaa

SEQ ID NO: 219377 - DNA, 16 bp, P. troglodytes
caagtctttgctactg

SEQ ID NO: 219378 - DNA, 16 bp, P. troglodytes
caagtctttttctttt

SEQ ID NO: 219379 - DNA, 16 bp, P. troglodytes
caagtgaaagaaagga

SEQ ID NO: 219380 - DNA, 16 bp, P. troglodytes
caagtgaaagaaataa

SEQ ID NO: 219381 - DNA, 16 bp, P. troglodytes
caagtgaaaggaggag

SEQ ID NO: 219382 - DNA, 16 bp, P. troglodytes
caagtgaaggagaaat

SEQ ID NO: 219383 - DNA, 16 bp, P. troglodytes
caagtgacagaaaacc

SEQ ID NO: 219384 - DNA, 16 bp, P. troglodytes
caagtgacaggatttc

SEQ ID NO: 219385 - DNA, 16 bp, P. troglodytes
caagtgaccctcctgc

SEQ ID NO: 219386 - DNA, 16 bp, P. troglodytes
caagtgacttgtccaa

SEQ ID NO: 219387 - DNA, 16 bp, P. troglodytes
caagtgagagctaaac

SEQ ID NO: 219388 - DNA, 16 bp, P. troglodytes
caagtgatcaaaatta

SEQ ID NO: 219389 - DNA, 16 bp, P. troglodytes
caagtgatcctctctc

SEQ ID NO: 219390 - DNA, 16 bp, P. troglodytes
caagtgatctgctcgc

SEQ ID NO: 219391 - DNA, 16 bp, P. troglodytes
caagtgattctgatgc

SEQ ID NO: 219392 - DNA, 16 bp, P. troglodytes
caagtgattcttcttc

SEQ ID NO: 219393 - DNA, 16 bp, P. troglodytes
caagtgcaattttgtt

SEQ ID NO: 219394 - DNA, 16 bp, P. troglodytes
caagtgcagtggctca

SEQ ID NO: 219395 - DNA, 16 bp, P. troglodytes
caagtgcatgccacca

SEQ ID NO: 219396 - DNA, 24 bp, P. troglodytes
caagtgctgggattacaggcgtga

SEQ ID NO: 219397 - DNA, 16 bp, P. troglodytes
caagtggcagagctgg

SEQ ID NO: 219398 - DNA, 16 bp, P. troglodytes
caagtggctgggacca

SEQ ID NO: 219399 - DNA, 16 bp, P. troglodytes
caagtgggtccttgac

SEQ ID NO: 219400 - DNA, 16 bp, P. troglodytes
caagtgtgagccaccg

SEQ ID NO: 219401 - DNA, 16 bp, P. troglodytes
caagtgtgagccactg

SEQ ID NO: 219402 - DNA, 16 bp, P. troglodytes
caagtgtgaggcactg

SEQ ID NO: 219403 - DNA, 16 bp, P. troglodytes
caagtgtggtggcagg

SEQ ID NO: 219404 - DNA, 16 bp, P. troglodytes
caagtgtggtggcgtg

SEQ ID NO: 219405 - DNA, 16 bp, P. troglodytes
caagtgtgtgtatgtg

SEQ ID NO: 219406 - DNA, 16 bp, P. troglodytes
caagtgttcctcctgc

SEQ ID NO: 219407 - DNA, 16 bp, P. troglodytes
caagtgttgatgagaa

SEQ ID NO: 219408 - DNA, 16 bp, P. troglodytes
caagttaataaatgtg

SEQ ID NO: 219409 - DNA, 16 bp, P. troglodytes
caagttatccagaaaa

SEQ ID NO: 219410 - DNA, 16 bp, P. troglodytes
caagttatttactttc

SEQ ID NO: 219411 - DNA, 16 bp, P. troglodytes
caagttctccaggtga

SEQ ID NO: 219412 - DNA, 16 bp, P. troglodytes
caagttcttcagcttc

SEQ ID NO: 219413 - DNA, 16 bp, P. troglodytes
caagttgaaaaacact

SEQ ID NO: 219414 - DNA, 16 bp, P. troglodytes
caagttgacttcatcc

SEQ ID NO: 219415 - DNA, 16 bp, P. troglodytes
caagttgagatttgag

SEQ ID NO: 219416 - DNA, 16 bp, P. troglodytes
caagttggaaaacagt

SEQ ID NO: 219417 - DNA, 16 bp, P. troglodytes
caagttggattaaaaa

SEQ ID NO: 219418 - DNA, 16 bp, P. troglodytes
caagtttaaaaagaaa

SEQ ID NO: 219419 - DNA, 16 bp, P. troglodytes
caagtttaaagagaag

SEQ ID NO: 219420 - DNA, 16 bp, P. troglodytes
caagtttactaagaaa

SEQ ID NO: 219421 - DNA, 16 bp, P. troglodytes
caagtttatcaagaaa

SEQ ID NO: 219422 - DNA, 16 bp, P. troglodytes
caagtttattttttaa

SEQ ID NO: 219423 - DNA, 16 bp, P. troglodytes
caagtttgcagagaaa

SEQ ID NO: 219424 - DNA, 16 bp, P. troglodytes
caagttttggtatcag

SEQ ID NO: 219425 - DNA, 16 bp, P. troglodytes
caagtttttagacaaa

SEQ ID NO: 219426 - DNA, 16 bp, P. troglodytes
caataaaaatagaagt

SEQ ID NO: 219427 - DNA, 16 bp, P. troglodytes
caataaaaatgtttaa

SEQ ID NO: 219428 - DNA, 16 bp, P. troglodytes
caataaaagcccagga

SEQ ID NO: 219429 - DNA, 16 bp, P. troglodytes
caataaaaggaaccag

SEQ ID NO: 219430 - DNA, 16 bp, P. troglodytes
caataaaaggaatgaa

SEQ ID NO: 219431 - DNA, 16 bp, P. troglodytes
caataaaagttatttt

SEQ ID NO: 219432 - DNA, 16 bp, P. troglodytes
caataaaattttaaag

SEQ ID NO: 219433 - DNA, 16 bp, P. troglodytes
caataaacatttgttg

SEQ ID NO: 219434 - DNA, 16 bp, P. troglodytes
caataaacattttatt

SEQ ID NO: 219435 - DNA, 16 bp, P. troglodytes
caataaacatttttta

SEQ ID NO: 219436 - DNA, 16 bp, P. troglodytes
caataaaccaggtatt

SEQ ID NO: 219437 - DNA, 16 bp, P. troglodytes
caataaacttttattt

SEQ ID NO: 219438 - DNA, 16 bp, P. troglodytes
caataaagtatatttt

SEQ ID NO: 219439 - DNA, 16 bp, P. troglodytes
caataaagtattttta

SEQ ID NO: 219440 - DNA, 16 bp, P. troglodytes
caataaagtatttttt

SEQ ID NO: 219441 - DNA, 16 bp, P. troglodytes
caataaagtgttttta

SEQ ID NO: 219442 - DNA, 16 bp, P. troglodytes
caataaagttgtaaaa

SEQ ID NO: 219443 - DNA, 16 bp, P. troglodytes
caataaatatcttttt

SEQ ID NO: 219444 - DNA, 16 bp, P. troglodytes
caataaatattaactg

SEQ ID NO: 219445 - DNA, 16 bp, P. troglodytes
caataaatattggttg

SEQ ID NO: 219446 - DNA, 16 bp, P. troglodytes
caataaatgcaaacaa

SEQ ID NO: 219447 - DNA, 16 bp, P. troglodytes
caataaatgtaataca

SEQ ID NO: 219448 - DNA, 16 bp, P. troglodytes
caataaatgtctgttg

SEQ ID NO: 219449 - DNA, 16 bp, P. troglodytes
caataaatgtgataca

SEQ ID NO: 219450 - DNA, 16 bp, P. troglodytes
caataaatgtggtaca

SEQ ID NO: 219451 - DNA, 16 bp, P. troglodytes
caataaatgttagcca

SEQ ID NO: 219452 - DNA, 16 bp, P. troglodytes
caataaatgttgattg

SEQ ID NO: 219453 - DNA, 16 bp, P. troglodytes
caataaatgtttgtgg

SEQ ID NO: 219454 - DNA, 16 bp, P. troglodytes
caataaatgtttgtta

SEQ ID NO: 219455 - DNA, 16 bp, P. troglodytes
caataaatttaagaaa

SEQ ID NO: 219456 - DNA, 16 bp, P. troglodytes
caataaccttgatgaa

SEQ ID NO: 219457 - DNA, 16 bp, P. troglodytes
caataactgaaattaa

SEQ ID NO: 219458 - DNA, 16 bp, P. troglodytes
caataagaaacatttt

SEQ ID NO: 219459 - DNA, 16 bp, P. troglodytes
caataagaacaaaact

SEQ ID NO: 219460 - DNA, 16 bp, P. troglodytes
caataataaaatgaca

SEQ ID NO: 219461 - DNA, 16 bp, P. troglodytes
caataatcccagctac

SEQ ID NO: 219462 - DNA, 16 bp, P. troglodytes
caataattcataggtt

SEQ ID NO: 219463 - DNA, 16 bp, P. troglodytes
caataattttttgtat

SEQ ID NO: 219464 - DNA, 16 bp, P. troglodytes
caatacagtgaaaccc

SEQ ID NO: 219465 - DNA, 16 bp, P. troglodytes
caatacatagaaatga

SEQ ID NO: 219466 - DNA, 16 bp, P. troglodytes
caatacatggaggtta

SEQ ID NO: 219467 - DNA, 16 bp, P. troglodytes
caatacatttctgttc

SEQ ID NO: 219468 - DNA, 16 bp, P. troglodytes
caataccaaatgctgg

SEQ ID NO: 219469 - DNA, 16 bp, P. troglodytes
caataccacactgtct

SEQ ID NO: 219470 - DNA, 16 bp, P. troglodytes
caataccacatggaag

SEQ ID NO: 219471 - DNA, 16 bp, P. troglodytes
caatacctggctaatt

SEQ ID NO: 219472 - DNA, 16 bp, P. troglodytes
caatactacattgaat

SEQ ID NO: 219473 - DNA, 16 bp, P. troglodytes
caatactttgcatcct

SEQ ID NO: 219474 - DNA, 16 bp, P. troglodytes
caatagaaatataata

SEQ ID NO: 219475 - DNA, 16 bp, P. troglodytes
caatagaaatataatg

SEQ ID NO: 219476 - DNA, 16 bp, P. troglodytes
caatagagcaagactc

SEQ ID NO: 219477 - DNA, 16 bp, P. troglodytes
caatagagtgagactc

SEQ ID NO: 219478 - DNA, 16 bp, P. troglodytes
caatagcaataataat

SEQ ID NO: 219479 - DNA, 16 bp, P. troglodytes
caatagcagcagaata

SEQ ID NO: 219480 - DNA, 16 bp, P. troglodytes
caatagccaagatgtg

SEQ ID NO: 219481 - DNA, 16 bp, P. troglodytes
caatagctcacacctg

SEQ ID NO: 219482 - DNA, 16 bp, P. troglodytes
caatagcttcctaact

SEQ ID NO: 219483 - DNA, 16 bp, P. troglodytes
caatatagcaagactc

SEQ ID NO: 219484 - DNA, 16 bp, P. troglodytes
caatatatacatatat

SEQ ID NO: 219485 - DNA, 16 bp, P. troglodytes
caatatatctgatgaa

SEQ ID NO: 219486 - DNA, 16 bp, P. troglodytes
caatatattgtatatt

SEQ ID NO: 219487 - DNA, 16 bp, P. troglodytes
caatatatttttgtta

SEQ ID NO: 219488 - DNA, 16 bp, P. troglodytes
caatatcactgataaa

SEQ ID NO: 219489 - DNA, 16 bp, P. troglodytes
caatatccctgatgaa

SEQ ID NO: 219490 - DNA, 16 bp, P. troglodytes
caatatctgtgatgaa

SEQ ID NO: 219491 - DNA, 16 bp, P. troglodytes
caatatggagaaaccc

SEQ ID NO: 219492 - DNA, 16 bp, P. troglodytes
caatatggagaaacct

SEQ ID NO: 219493 - DNA, 16 bp, P. troglodytes
caatatggtgaaactc

SEQ ID NO: 219494 - DNA, 16 bp, P. troglodytes
caatatggtgaaatcc

SEQ ID NO: 219495 - DNA, 16 bp, P. troglodytes
caatattaaatcttct

SEQ ID NO: 219496 - DNA, 16 bp, P. troglodytes
caatattaactttgaa

SEQ ID NO: 219497 - DNA, 16 bp, P. troglodytes
caatattcacaaaata

SEQ ID NO: 219498 - DNA, 16 bp, P. troglodytes
caatattgtgaaaatg

SEQ ID NO: 219499 - DNA, 16 bp, P. troglodytes
caatatttattcttcc

SEQ ID NO: 219500 - DNA, 16 bp, P. troglodytes
caatatttgtcatttt

SEQ ID NO: 219501 - DNA, 16 bp, P. troglodytes
caatatttgtctttct

SEQ ID NO: 219502 - DNA, 16 bp, P. troglodytes
caatattttacagttt

SEQ ID NO: 219503 - DNA, 16 bp, P. troglodytes
caatattttattttgt

SEQ ID NO: 219504 - DNA, 16 bp, P. troglodytes
caatattttcaataaa

SEQ ID NO: 219505 - DNA, 16 bp, P. troglodytes
caatattttgtatttt

SEQ ID NO: 219506 - DNA, 16 bp, P. troglodytes
caatcaaaaatgataa

SEQ ID NO: 219507 - DNA, 16 bp, P. troglodytes
caatcaaaatcccaga

SEQ ID NO: 219508 - DNA, 16 bp, P. troglodytes
caatcaaatggaaaaa

SEQ ID NO: 219509 - DNA, 16 bp, P. troglodytes
caatcaaatttcaaca

SEQ ID NO: 219510 - DNA, 16 bp, P. troglodytes
caatcaatcaataaga

SEQ ID NO: 219511 - DNA, 16 bp, P. troglodytes
caatcaatcaatcaaa

SEQ ID NO: 219512 - DNA, 16 bp, P. troglodytes
caatcaatcaatcaat

SEQ ID NO: 219513 - DNA, 16 bp, P. troglodytes
caatcacaactcactg

SEQ ID NO: 219514 - DNA, 16 bp, P. troglodytes
caatcacaagtgtcct

SEQ ID NO: 219515 - DNA, 16 bp, P. troglodytes
caatcacagctcactg

SEQ ID NO: 219516 - DNA, 16 bp, P. troglodytes
caatcacaggctgcca

SEQ ID NO: 219517 - DNA, 16 bp, P. troglodytes
caatcactatggagaa

SEQ ID NO: 219518 - DNA, 16 bp, P. troglodytes
caatcactgtgctctc

SEQ ID NO: 219519 - DNA, 16 bp, P. troglodytes
caatcactttttaaaa

SEQ ID NO: 219520 - DNA, 16 bp, P. troglodytes
caatcagaaaatattt

SEQ ID NO: 219521 - DNA, 16 bp, P. troglodytes
caatcagagaagaaaa

SEQ ID NO: 219522 - DNA, 16 bp, P. troglodytes
caatcaggcagcagca

SEQ ID NO: 219523 - DNA, 16 bp, P. troglodytes
caatcagtcaggagaa

SEQ ID NO: 219524 - DNA, 16 bp, P. troglodytes
caatcatagctcactg

SEQ ID NO: 219525 - DNA, 16 bp, P. troglodytes
caatcatcagagaata

SEQ ID NO: 219526 - DNA, 16 bp, P. troglodytes
caatcatgaaaaagaa

SEQ ID NO: 219527 - DNA, 16 bp, P. troglodytes
caatcatgcccagcta

SEQ ID NO: 219528 - DNA, 16 bp, P. troglodytes
caatcatggcagaaag

SEQ ID NO: 219529 - DNA, 16 bp, P. troglodytes
caatcatggcagaagg

SEQ ID NO: 219530 - DNA, 16 bp, P. troglodytes
caatcatttattcatt

SEQ ID NO: 219531 - DNA, 16 bp, P. troglodytes
caatcattttcttaca

SEQ ID NO: 219532 - DNA, 16 bp, P. troglodytes
caatccacccacctct

SEQ ID NO: 219533 - DNA, 16 bp, P. troglodytes
caatccagcaattcca

SEQ ID NO: 219534 - DNA, 16 bp, P. troglodytes
caatccatgttgctgc

SEQ ID NO: 219535 - DNA, 16 bp, P. troglodytes
caatcccaacactttg

SEQ ID NO: 219536 - DNA, 16 bp, P. troglodytes
caatcccaagccaaaa

SEQ ID NO: 219537 - DNA, 18 bp, P. troglodytes
caatcccagcactttgga

SEQ ID NO: 219538 - DNA, 19 bp, P. troglodytes
caatcccagcactttggga

SEQ ID NO: 219539 - DNA, 17 bp, P. troglodytes
caatcccagctactcaa

SEQ ID NO: 219540 - DNA, 16 bp, P. troglodytes
caatcccagtgctttg

SEQ ID NO: 219541 - DNA, 16 bp, P. troglodytes
caatcccattaaaaaa

SEQ ID NO: 219542 - DNA, 16 bp, P. troglodytes
caatcctaacactttg

SEQ ID NO: 219543 - DNA, 16 bp, P. troglodytes
caatcctaagcaaaaa

SEQ ID NO: 219544 - DNA, 16 bp, P. troglodytes
caatcctaagctaaaa

SEQ ID NO: 219545 - DNA, 16 bp, P. troglodytes
caatcctcctgccaca

SEQ ID NO: 219546 - DNA, 16 bp, P. troglodytes
caatcctctcatcttg

SEQ ID NO: 219547 - DNA, 16 bp, P. troglodytes
caatcctgaaaaagaa

SEQ ID NO: 219548 - DNA, 16 bp, P. troglodytes
caatcctgggctcaag

SEQ ID NO: 219549 - DNA, 16 bp, P. troglodytes
caatcctgtgaggcag

SEQ ID NO: 219550 - DNA, 16 bp, P. troglodytes
caatcgtggcggaagg

SEQ ID NO: 219551 - DNA, 19 bp, P. troglodytes
caatctcagcactttggga

SEQ ID NO: 219552 - DNA, 16 bp, P. troglodytes
caatctcagctactcg

SEQ ID NO: 219553 - DNA, 16 bp, P. troglodytes
caatctcctaaccttg

SEQ ID NO: 219554 - DNA, 16 bp, P. troglodytes
caatctcctgaccctg

SEQ ID NO: 219555 - DNA, 16 bp, P. troglodytes
caatctcctgacctca

SEQ ID NO: 219556 - DNA, 16 bp, P. troglodytes
caatctcctgagctca

SEQ ID NO: 219557 - DNA, 16 bp, P. troglodytes
caatctcctgggctca

SEQ ID NO: 219558 - DNA, 16 bp, P. troglodytes
caatctctgtctcctg

SEQ ID NO: 219559 - DNA, 16 bp, P. troglodytes
caatctcttgaaccca

SEQ ID NO: 219560 - DNA, 16 bp, P. troglodytes
caatctcttgatctcg

SEQ ID NO: 219561 - DNA, 16 bp, P. troglodytes
caatctgtcacccaga

SEQ ID NO: 219562 - DNA, 16 bp, P. troglodytes
caatcttatttacaat

SEQ ID NO: 219563 - DNA, 16 bp, P. troglodytes
caatcttcccacccca

SEQ ID NO: 219564 - DNA, 16 bp, P. troglodytes
caatgaaaaagaaatt

SEQ ID NO: 219565 - DNA, 16 bp, P. troglodytes
caatgaaacaaaagtt

SEQ ID NO: 219566 - DNA, 16 bp, P. troglodytes
caatgaaagaaaaatg

SEQ ID NO: 219567 - DNA, 16 bp, P. troglodytes
caatgaaagaaatcaa

SEQ ID NO: 219568 - DNA, 16 bp, P. troglodytes
caatgaaataaattat

SEQ ID NO: 219569 - DNA, 16 bp, P. troglodytes
caatgaaatagaaaac

SEQ ID NO: 219570 - DNA, 16 bp, P. troglodytes
caatgaaatcaggaaa

SEQ ID NO: 219571 - DNA, 16 bp, P. troglodytes
caatgaaatgaaaata

SEQ ID NO: 219572 - DNA, 16 bp, P. troglodytes
caatgaaatgaagaaa

SEQ ID NO: 219573 - DNA, 16 bp, P. troglodytes
caatgaacaactggaa

SEQ ID NO: 219574 - DNA, 16 bp, P. troglodytes
caatgaacaagtggaa

SEQ ID NO: 219575 - DNA, 16 bp, P. troglodytes
caatgaacttgaagat

SEQ ID NO: 219576 - DNA, 16 bp, P. troglodytes
caatgaatatttattt

SEQ ID NO: 219577 - DNA, 16 bp, P. troglodytes
caatgaatatttgctg

SEQ ID NO: 219578 - DNA, 16 bp, P. troglodytes
caatgacaaaatcatc

SEQ ID NO: 219579 - DNA, 16 bp, P. troglodytes
caatgacatccttcac

SEQ ID NO: 219580 - DNA, 16 bp, P. troglodytes
caatgaccttatttcc

SEQ ID NO: 219581 - DNA, 16 bp, P. troglodytes
caatgagaaaaggata

SEQ ID NO: 219582 - DNA, 16 bp, P. troglodytes
caatgagaatgaacaa

SEQ ID NO: 219583 - DNA, 16 bp, P. troglodytes
caatgagaattacaaa

SEQ ID NO: 219584 - DNA, 16 bp, P. troglodytes
caatgagatactacct

SEQ ID NO: 219585 - DNA, 16 bp, P. troglodytes
caatgagcatttcctt

SEQ ID NO: 219586 - DNA, 16 bp, P. troglodytes
caatgagctatgatca

SEQ ID NO: 219587 - DNA, 16 bp, P. troglodytes
caatgaggaaaatgtc

SEQ ID NO: 219588 - DNA, 16 bp, P. troglodytes
caatgaggcctgcctg

SEQ ID NO: 219589 - DNA, 16 bp, P. troglodytes
caatgagttaccatct

SEQ ID NO: 219590 - DNA, 16 bp, P. troglodytes
caatgatagactggat

SEQ ID NO: 219591 - DNA, 16 bp, P. troglodytes
caatgatattcttcat

SEQ ID NO: 219592 - DNA, 16 bp, P. troglodytes
caatgatttaatcaat

SEQ ID NO: 219593 - DNA, 16 bp, P. troglodytes
caatgatttattggat

SEQ ID NO: 219594 - DNA, 16 bp, P. troglodytes
caatgcaatagaaaag

SEQ ID NO: 219595 - DNA, 16 bp, P. troglodytes
caatgcagaaggcggg

SEQ ID NO: 219596 - DNA, 16 bp, P. troglodytes
caatgcagcctcaaac

SEQ ID NO: 219597 - DNA, 16 bp, P. troglodytes
caatgccacccctccc

SEQ ID NO: 219598 - DNA, 16 bp, P. troglodytes
caatgccactcttctc

SEQ ID NO: 219599 - DNA, 16 bp, P. troglodytes
caatgccatcaccatc

SEQ ID NO: 219600 - DNA, 18 bp, P. troglodytes
caatgccatcgccatcaa

SEQ ID NO: 219601 - DNA, 17 bp, P. troglodytes
caatgccattcccatca

SEQ ID NO: 219602 - DNA, 16 bp, P. troglodytes
caatgcccaggctgga

SEQ ID NO: 219603 - DNA, 16 bp, P. troglodytes
caatgcctatacctcc

SEQ ID NO: 219604 - DNA, 16 bp, P. troglodytes
caatgccttctggaat

SEQ ID NO: 219605 - DNA, 16 bp, P. troglodytes
caatgctggaagtggg

SEQ ID NO: 219606 - DNA, 16 bp, P. troglodytes
caatgcttggctaatt

SEQ ID NO: 219607 - DNA, 16 bp, P. troglodytes
caatggaacaaagctg

SEQ ID NO: 219608 - DNA, 18 bp, P. troglodytes
caatggaacagaacagag

SEQ ID NO: 219609 - DNA, 16 bp, P. troglodytes
caatggaatactgttc

SEQ ID NO: 219610 - DNA, 16 bp, P. troglodytes
caatggagaaaatgtc

SEQ ID NO: 219611 - DNA, 16 bp, P. troglodytes
caatggagaaaggaaa

SEQ ID NO: 219612 - DNA, 16 bp, P. troglodytes
caatggatgtgaagga

SEQ ID NO: 219613 - DNA, 16 bp, P. troglodytes
caatggcagtagcagt

SEQ ID NO: 219614 - DNA, 16 bp, P. troglodytes
caatggcgagatctca

SEQ ID NO: 219615 - DNA, 16 bp, P. troglodytes
caatggcgggtgcccc

SEQ ID NO: 219616 - DNA, 16 bp, P. troglodytes
caatggcgtgatctcc

SEQ ID NO: 219617 - DNA, 16 bp, P. troglodytes
caatggctcacacctg

SEQ ID NO: 219618 - DNA, 16 bp, P. troglodytes
caatggctcacgcctg

SEQ ID NO: 219619 - DNA, 16 bp, P. troglodytes
caatggctcatgcctg

SEQ ID NO: 219620 - DNA, 16 bp, P. troglodytes
caatggctgagctaat

SEQ ID NO: 219621 - DNA, 16 bp, P. troglodytes
caatgggaaaagaaca

SEQ ID NO: 219622 - DNA, 16 bp, P. troglodytes
caatgggaaaaggact

SEQ ID NO: 219623 - DNA, 16 bp, P. troglodytes
caatggggaaatgact

SEQ ID NO: 219624 - DNA, 16 bp, P. troglodytes
caatgggggtacaggt

SEQ ID NO: 219625 - DNA, 16 bp, P. troglodytes
caatggtgagagcaca

SEQ ID NO: 219626 - DNA, 16 bp, P. troglodytes
caatggtgtgattttg

SEQ ID NO: 219627 - DNA, 16 bp, P. troglodytes
caatggttttcaagac

SEQ ID NO: 219628 - DNA, 16 bp, P. troglodytes
caatgtacactgtacc

SEQ ID NO: 219629 - DNA, 16 bp, P. troglodytes
caatgtattgtattct

SEQ ID NO: 219630 - DNA, 16 bp, P. troglodytes
caatgtatttcttttt

SEQ ID NO: 219631 - DNA, 16 bp, P. troglodytes
caatgtcattagtcat

SEQ ID NO: 219632 - DNA, 16 bp, P. troglodytes
caatgtcattttttca

SEQ ID NO: 219633 - DNA, 16 bp, P. troglodytes
caatgtccagaaaagt

SEQ ID NO: 219634 - DNA, 16 bp, P. troglodytes
caatgtctgcctcctg

SEQ ID NO: 219635 - DNA, 16 bp, P. troglodytes
caatgtgacacatcat

SEQ ID NO: 219636 - DNA, 16 bp, P. troglodytes
caatgtgactttgcag

SEQ ID NO: 219637 - DNA, 16 bp, P. troglodytes
caatgtgaggacacag

SEQ ID NO: 219638 - DNA, 16 bp, P. troglodytes
caatgtgatagtatta

SEQ ID NO: 219639 - DNA, 16 bp, P. troglodytes
caatgtgatggcattt

SEQ ID NO: 219640 - DNA, 16 bp, P. troglodytes
caatgtgattgtattt

SEQ ID NO: 219641 - DNA, 16 bp, P. troglodytes
caatgtgatttatggt

SEQ ID NO: 219642 - DNA, 16 bp, P. troglodytes
caatgtgctgtattca

SEQ ID NO: 219643 - DNA, 16 bp, P. troglodytes
caatgtggatgaactt

SEQ ID NO: 219644 - DNA, 16 bp, P. troglodytes
caatgtggatgcagct

SEQ ID NO: 219645 - DNA, 16 bp, P. troglodytes
caatgtggcccaggaa

SEQ ID NO: 219646 - DNA, 16 bp, P. troglodytes
caatgttaaagaaaaa

SEQ ID NO: 219647 - DNA, 16 bp, P. troglodytes
caatgttcagaagagt

SEQ ID NO: 219648 - DNA, 16 bp, P. troglodytes
caatgttgatggctgc

SEQ ID NO: 219649 - DNA, 16 bp, P. troglodytes
caatgttgtgaaaatg

SEQ ID NO: 219650 - DNA, 16 bp, P. troglodytes
caatgtttacagcatc

SEQ ID NO: 219651 - DNA, 16 bp, P. troglodytes
caatgtttgaggtgat

SEQ ID NO: 219652 - DNA, 16 bp, P. troglodytes
caatgttttatacttt

SEQ ID NO: 219653 - DNA, 16 bp, P. troglodytes
caatgttttatagttt

SEQ ID NO: 219654 - DNA, 16 bp, P. troglodytes
caatgttttcttgtaa

SEQ ID NO: 219655 - DNA, 16 bp, P. troglodytes
caatgttttgcagttt

SEQ ID NO: 219656 - DNA, 16 bp, P. troglodytes
caatgttttgtttttg

SEQ ID NO: 219657 - DNA, 16 bp, P. troglodytes
caattaaaagtaatgg

SEQ ID NO: 219658 - DNA, 16 bp, P. troglodytes
caattaaacctccttc

SEQ ID NO: 219659 - DNA, 16 bp, P. troglodytes
caattaaacctctctt

SEQ ID NO: 219660 - DNA, 16 bp, P. troglodytes
caattaaacctctttt

SEQ ID NO: 219661 - DNA, 16 bp, P. troglodytes
caattaaatatctttt

SEQ ID NO: 219662 - DNA, 16 bp, P. troglodytes
caattaatgtttgttg

SEQ ID NO: 219663 - DNA, 16 bp, P. troglodytes
caattacaacaaaagc

SEQ ID NO: 219664 - DNA, 16 bp, P. troglodytes
caattactttttattc

SEQ ID NO: 219665 - DNA, 16 bp, P. troglodytes
caattagccaggcatg

SEQ ID NO: 219666 - DNA, 16 bp, P. troglodytes
caattatatgaaaaaa

SEQ ID NO: 219667 - DNA, 16 bp, P. troglodytes
caattatcttcacctg

SEQ ID NO: 219668 - DNA, 16 bp, P. troglodytes
caattatggctcactg

SEQ ID NO: 219669 - DNA, 16 bp, P. troglodytes
caattatgtaaaaagt

SEQ ID NO: 219670 - DNA, 16 bp, P. troglodytes
caattatgtggttgat

SEQ ID NO: 219671 - DNA, 16 bp, P. troglodytes
caattattccctcaaa

SEQ ID NO: 219672 - DNA, 16 bp, P. troglodytes
caattcaaaatgaaat

SEQ ID NO: 219673 - DNA, 16 bp, P. troglodytes
caattcaagatgaatt

SEQ ID NO: 219674 - DNA, 16 bp, P. troglodytes
caattcaatagagaaa

SEQ ID NO: 219675 - DNA, 16 bp, P. troglodytes
caattcaggatatgaa

SEQ ID NO: 219676 - DNA, 16 bp, P. troglodytes
caattcagtgattttt

SEQ ID NO: 219677 - DNA, 16 bp, P. troglodytes
caattccacttccagg

SEQ ID NO: 219678 - DNA, 16 bp, P. troglodytes
caattccatatgaatt

SEQ ID NO: 219679 - DNA, 16 bp, P. troglodytes
caattccatgtggctg

SEQ ID NO: 219680 - DNA, 17 bp, P. troglodytes
caattcccagctatgag

SEQ ID NO: 219681 - DNA, 16 bp, P. troglodytes
caattcccctgcctca

SEQ ID NO: 219682 - DNA, 17 bp, P. troglodytes
caattcccctgcctcag

SEQ ID NO: 219683 - DNA, 16 bp, P. troglodytes
caattccggacacagt

SEQ ID NO: 219684 - DNA, 16 bp, P. troglodytes
caattcctggcctcaa

SEQ ID NO: 219685 - DNA, 16 bp, P. troglodytes
caattctcctacctca

SEQ ID NO: 219686 - DNA, 16 bp, P. troglodytes
caattctctgccccag

SEQ ID NO: 219687 - DNA, 16 bp, P. troglodytes
caattctcttgcctca

SEQ ID NO: 219688 - DNA, 16 bp, P. troglodytes
caattctttgaagaaa

SEQ ID NO: 219689 - DNA, 16 bp, P. troglodytes
caattgattttcaata

SEQ ID NO: 219690 - DNA, 16 bp, P. troglodytes
caattgatttttgaaa

SEQ ID NO: 219691 - DNA, 16 bp, P. troglodytes
caattgcttttggggt

SEQ ID NO: 219692 - DNA, 16 bp, P. troglodytes
caattgcttttgttta

SEQ ID NO: 219693 - DNA, 16 bp, P. troglodytes
caattgtcattttcaa

SEQ ID NO: 219694 - DNA, 16 bp, P. troglodytes
caatttaaaaaatggg

SEQ ID NO: 219695 - DNA, 16 bp, P. troglodytes
caatttacattccttt

SEQ ID NO: 219696 - DNA, 16 bp, P. troglodytes
caatttactttttaaa

SEQ ID NO: 219697 - DNA, 16 bp, P. troglodytes
caatttagaaagttta

SEQ ID NO: 219698 - DNA, 16 bp, P. troglodytes
caatttagccattcca

SEQ ID NO: 219699 - DNA, 16 bp, P. troglodytes
caatttatccatctga

SEQ ID NO: 219700 - DNA, 16 bp, P. troglodytes
caatttatctttgttt

SEQ ID NO: 219701 - DNA, 16 bp, P. troglodytes
caatttattgtacatt

SEQ ID NO: 219702 - DNA, 16 bp, P. troglodytes
caatttcaaaaagaaa

SEQ ID NO: 219703 - DNA, 16 bp, P. troglodytes
caatttccacctccca

SEQ ID NO: 219704 - DNA, 16 bp, P. troglodytes
caatttcctgcctcag

SEQ ID NO: 219705 - DNA, 16 bp, P. troglodytes
caatttcctggccctc

SEQ ID NO: 219706 - DNA, 16 bp, P. troglodytes
caatttcttaaaataa

SEQ ID NO: 219707 - DNA, 16 bp, P. troglodytes
caatttgaaaagaaaa

SEQ ID NO: 219708 - DNA, 16 bp, P. troglodytes
caatttgaaaaggcta

SEQ ID NO: 219709 - DNA, 16 bp, P. troglodytes
caatttgacttcctca

SEQ ID NO: 219710 - DNA, 16 bp, P. troglodytes
caatttgagaacattt

SEQ ID NO: 219711 - DNA, 16 bp, P. troglodytes
caatttgtgaaaaaca

SEQ ID NO: 219712 - DNA, 16 bp, P. troglodytes
caattttaaatctttc

SEQ ID NO: 219713 - DNA, 16 bp, P. troglodytes
caattttaatttcacc

SEQ ID NO: 219714 - DNA, 16 bp, P. troglodytes
caattttacaagaaaa

SEQ ID NO: 219715 - DNA, 16 bp, P. troglodytes
caattttacttctagg

SEQ ID NO: 219716 - DNA, 16 bp, P. troglodytes
caattttctggaagag

SEQ ID NO: 219717 - DNA, 16 bp, P. troglodytes
caattttgaaaatata

SEQ ID NO: 219718 - DNA, 16 bp, P. troglodytes
caattttgaaagaagt

SEQ ID NO: 219719 - DNA, 16 bp, P. troglodytes
caattttgaatctttc

SEQ ID NO: 219720 - DNA, 16 bp, P. troglodytes
caattttgattttctt

SEQ ID NO: 219721 - DNA, 16 bp, P. troglodytes
caattttgcttttgtt

SEQ ID NO: 219722 - DNA, 16 bp, P. troglodytes
caattttggaacaggt

SEQ ID NO: 219723 - DNA, 16 bp, P. troglodytes
caattttggattttgt

SEQ ID NO: 219724 - DNA, 16 bp, P. troglodytes
caattttgttcccttg

SEQ ID NO: 219725 - DNA, 16 bp, P. troglodytes
caatttttataaatgt

SEQ ID NO: 219726 - DNA, 16 bp, P. troglodytes
caatttttcaacttta

SEQ ID NO: 219727 - DNA, 16 bp, P. troglodytes
caatttttcatttcat

SEQ ID NO: 219728 - DNA, 16 bp, P. troglodytes
caatttttcttctgca

SEQ ID NO: 219729 - DNA, 16 bp, P. troglodytes
caattttttaaaaaag

SEQ ID NO: 219730 - DNA, 16 bp, P. troglodytes
caattttttaaagaaa

SEQ ID NO: 219731 - DNA, 16 bp, P. troglodytes
caattttttgcatttt

SEQ ID NO: 219732 - DNA, 16 bp, P. troglodytes
caatttttttcccatt

SEQ ID NO: 219733 - DNA, 16 bp, P. troglodytes
caattttttttctgaa

SEQ ID NO: 219734 - DNA, 16 bp, P. troglodytes
cacaaaaaaatgttaa

SEQ ID NO: 219735 - DNA, 16 bp, P. troglodytes
cacaaaaaacccttcc

SEQ ID NO: 219736 - DNA, 16 bp, P. troglodytes
cacaaaaacatgtaca

SEQ ID NO: 219737 - DNA, 16 bp, P. troglodytes
cacaaaaacttgtata

SEQ ID NO: 219738 - DNA, 16 bp, P. troglodytes
cacaaaaaggcaaata

SEQ ID NO: 219739 - DNA, 16 bp, P. troglodytes
cacaaaaattaaaagt

SEQ ID NO: 219740 - DNA, 16 bp, P. troglodytes
cacaaaaattagctgg

SEQ ID NO: 219741 - DNA, 16 bp, P. troglodytes
cacaaaaccacttttt

SEQ ID NO: 219742 - DNA, 16 bp, P. troglodytes
cacaaaaccatttttc

SEQ ID NO: 219743 - DNA, 16 bp, P. troglodytes
cacaaaagagcacata

SEQ ID NO: 219744 - DNA, 16 bp, P. troglodytes
cacaaaagccaaaagg

SEQ ID NO: 219745 - DNA, 16 bp, P. troglodytes
cacaaaaggaaaaatt

SEQ ID NO: 219746 - DNA, 16 bp, P. troglodytes
cacaaaaggaaatgag

SEQ ID NO: 219747 - DNA, 16 bp, P. troglodytes
cacaaaaggaagccca

SEQ ID NO: 219748 - DNA, 16 bp, P. troglodytes
cacaaaaggcctttga

SEQ ID NO: 219749 - DNA, 16 bp, P. troglodytes
cacaaaattattttaa

SEQ ID NO: 219750 - DNA, 16 bp, P. troglodytes
cacaaacaaatgtaaa

SEQ ID NO: 219751 - DNA, 16 bp, P. troglodytes
cacaaacactgaatta

SEQ ID NO: 219752 - DNA, 16 bp, P. troglodytes
cacaaacatacatata

SEQ ID NO: 219753 - DNA, 16 bp, P. troglodytes
cacaaactatgcatcc

SEQ ID NO: 219754 - DNA, 16 bp, P. troglodytes
cacaaacttttttttt

SEQ ID NO: 219755 - DNA, 16 bp, P. troglodytes
cacaaagatggaaaca

SEQ ID NO: 219756 - DNA, 16 bp, P. troglodytes
cacaaaggacagcttt

SEQ ID NO: 219757 - DNA, 16 bp, P. troglodytes
cacaaataaatgataa

SEQ ID NO: 219758 - DNA, 16 bp, P. troglodytes
cacaaataagtgagaa

SEQ ID NO: 219759 - DNA, 16 bp, P. troglodytes
cacaaataggttgaaa

SEQ ID NO: 219760 - DNA, 16 bp, P. troglodytes
cacaaatattttattt

SEQ ID NO: 219761 - DNA, 16 bp, P. troglodytes
cacaaatatttttaaa

SEQ ID NO: 219762 - DNA, 16 bp, P. troglodytes
cacaaatctctagagc

SEQ ID NO: 219763 - DNA, 16 bp, P. troglodytes
cacaaatcttcaattt

SEQ ID NO: 219764 - DNA, 16 bp, P. troglodytes
cacaaatggactaaaa

SEQ ID NO: 219765 - DNA, 16 bp, P. troglodytes
cacaaattcattatct

SEQ ID NO: 219766 - DNA, 16 bp, P. troglodytes
cacaaattctacaaaa

SEQ ID NO: 219767 - DNA, 16 bp, P. troglodytes
cacaacacaaagaaat

SEQ ID NO: 219768 - DNA, 16 bp, P. troglodytes
cacaacacttctgaca

SEQ ID NO: 219769 - DNA, 16 bp, P. troglodytes
cacaacacttgagctc

SEQ ID NO: 219770 - DNA, 16 bp, P. troglodytes
cacaacagtcctgtga

SEQ ID NO: 219771 - DNA, 16 bp, P. troglodytes
cacaaccacatggaaa

SEQ ID NO: 219772 - DNA, 16 bp, P. troglodytes
cacaaccatgcccagc

SEQ ID NO: 219773 - DNA, 16 bp, P. troglodytes
cacaaccatgctcatt

SEQ ID NO: 219774 - DNA, 16 bp, P. troglodytes
cacaacctcatcagca

SEQ ID NO: 219775 - DNA, 17 bp, P. troglodytes
cacaaccttccagtgtg

SEQ ID NO: 219776 - DNA, 16 bp, P. troglodytes
cacaactacttggaaa

SEQ ID NO: 219777 - DNA, 16 bp, P. troglodytes
cacaactggctaattt

SEQ ID NO: 219778 - DNA, 16 bp, P. troglodytes
cacaacttcaccagca

SEQ ID NO: 219779 - DNA, 16 bp, P. troglodytes
cacaacttctgcctcc

SEQ ID NO: 219780 - DNA, 16 bp, P. troglodytes
cacaagaaagaattca

SEQ ID NO: 219781 - DNA, 16 bp, P. troglodytes
cacaagaacagaaagc

SEQ ID NO: 219782 - DNA, 16 bp, P. troglodytes
cacaagaagaaataga

SEQ ID NO: 219783 - DNA, 16 bp, P. troglodytes
cacaagaagatcaacc

SEQ ID NO: 219784 - DNA, 16 bp, P. troglodytes
cacaagactgggtaat

SEQ ID NO: 219785 - DNA, 16 bp, P. troglodytes
cacaagagaaagcagc

SEQ ID NO: 219786 - DNA, 16 bp, P. troglodytes
cacaagagtgaaactc

SEQ ID NO: 219787 - DNA, 16 bp, P. troglodytes
cacaagatacaggtca

SEQ ID NO: 219788 - DNA, 16 bp, P. troglodytes
cacaagctgtacagga

SEQ ID NO: 219789 - DNA, 16 bp, P. troglodytes
cacaagcttggctcac

SEQ ID NO: 219790 - DNA, 16 bp, P. troglodytes
cacaaggaaattccta

SEQ ID NO: 219791 - DNA, 16 bp, P. troglodytes
cacaaggactgcaatt

SEQ ID NO: 219792 - DNA, 16 bp, P. troglodytes
cacaaggtcaggatca

SEQ ID NO: 219793 - DNA, 16 bp, P. troglodytes
cacaaggttgttgtga

SEQ ID NO: 219794 - DNA, 16 bp, P. troglodytes
cacaagtgactccatt

SEQ ID NO: 219795 - DNA, 16 bp, P. troglodytes
cacaataaaatatgat

SEQ ID NO: 219796 - DNA, 16 bp, P. troglodytes
cacaataaccaagata

SEQ ID NO: 219797 - DNA, 16 bp, P. troglodytes
cacaatacattgttat

SEQ ID NO: 219798 - DNA, 16 bp, P. troglodytes
cacaatattggttctt

SEQ ID NO: 219799 - DNA, 16 bp, P. troglodytes
cacaatcatagcacac

SEQ ID NO: 219800 - DNA, 16 bp, P. troglodytes
cacaatcatagcttat

SEQ ID NO: 219801 - DNA, 16 bp, P. troglodytes
cacaatctcctgacct

SEQ ID NO: 219802 - DNA, 16 bp, P. troglodytes
cacaatgacaaaatcg

SEQ ID NO: 219803 - DNA, 20 bp, P. troglodytes
cacaatgagataccatctca

SEQ ID NO: 219804 - DNA, 16 bp, P. troglodytes
cacaatgattgaacta

SEQ ID NO: 219805 - DNA, 16 bp, P. troglodytes
cacaatgcaagcctcc

SEQ ID NO: 219806 - DNA, 16 bp, P. troglodytes
cacaatgcctggcaca

SEQ ID NO: 219807 - DNA, 16 bp, P. troglodytes
cacaatgcttggcaca

SEQ ID NO: 219808 - DNA, 17 bp, P. troglodytes
cacaatggctcatgcct

SEQ ID NO: 219809 - DNA, 16 bp, P. troglodytes
cacaatggctgaatta

SEQ ID NO: 219810 - DNA, 16 bp, P. troglodytes
cacaatgtatacatat

SEQ ID NO: 219811 - DNA, 16 bp, P. troglodytes
cacaattaaaagagct

SEQ ID NO: 219812 - DNA, 16 bp, P. troglodytes
cacaattaattttgca

SEQ ID NO: 219813 - DNA, 16 bp, P. troglodytes
cacaattatttttaaa

SEQ ID NO: 219814 - DNA, 16 bp, P. troglodytes
cacaattcagtccata

SEQ ID NO: 219815 - DNA, 16 bp, P. troglodytes
cacaatttcagatcct

SEQ ID NO: 219816 - DNA, 16 bp, P. troglodytes
cacaatttcatggaaa

SEQ ID NO: 219817 - DNA, 16 bp, P. troglodytes
cacaatttgttgaaaa

SEQ ID NO: 219818 - DNA, 16 bp, P. troglodytes
cacacaaaaacttgta

SEQ ID NO: 219819 - DNA, 16 bp, P. troglodytes
cacacaaacacatact

SEQ ID NO: 219820 - DNA, 16 bp, P. troglodytes
cacacaaatacactca

SEQ ID NO: 219821 - DNA, 16 bp, P. troglodytes
cacacaaatggaatca

SEQ ID NO: 219822 - DNA, 16 bp, P. troglodytes
cacacaacatttatca

SEQ ID NO: 219823 - DNA, 16 bp, P. troglodytes
cacacaaccagtaagt

SEQ ID NO: 219824 - DNA, 16 bp, P. troglodytes
cacacaatgaaatatt

SEQ ID NO: 219825 - DNA, 16 bp, P. troglodytes
cacacaatgatgaaat

SEQ ID NO: 219826 - DNA, 16 bp, P. troglodytes
cacacacaaaaaatga

SEQ ID NO: 219827 - DNA, 16 bp, P. troglodytes
cacacacaaaaagata

SEQ ID NO: 219828 - DNA, 16 bp, P. troglodytes
cacacacacaaaatct

SEQ ID NO: 219829 - DNA, 16 bp, P. troglodytes
cacacacacaaagatg

SEQ ID NO: 219830 - DNA, 16 bp, P. troglodytes
cacacacacacaatta

SEQ ID NO: 219831 - DNA, 17 bp, P. troglodytes
cacacacacacacaggt

SEQ ID NO: 219832 - DNA, 16 bp, P. troglodytes
cacacacacacacctg

SEQ ID NO: 219833 - DNA, 16 bp, P. troglodytes
cacacacacacactga

SEQ ID NO: 219834 - DNA, 16 bp, P. troglodytes
cacacacacacagaat

SEQ ID NO: 219835 - DNA, 16 bp, P. troglodytes
cacacacacacagagt

SEQ ID NO: 219836 - DNA, 16 bp, P. troglodytes
cacacacacacaggca

SEQ ID NO: 219837 - DNA, 16 bp, P. troglodytes
cacacacacacatcta

SEQ ID NO: 219838 - DNA, 16 bp, P. troglodytes
cacacacacacattag

SEQ ID NO: 219839 - DNA, 16 bp, P. troglodytes
cacacacacaccagag

SEQ ID NO: 219840 - DNA, 16 bp, P. troglodytes
cacacacacaccaggc

SEQ ID NO: 219841 - DNA, 16 bp, P. troglodytes
cacacacacaccctgt

SEQ ID NO: 219842 - DNA, 16 bp, P. troglodytes
cacacacacacctgta

SEQ ID NO: 219843 - DNA, 16 bp, P. troglodytes
cacacacacacgatgg

SEQ ID NO: 219844 - DNA, 16 bp, P. troglodytes
cacacacacacgtgca

SEQ ID NO: 219845 - DNA, 16 bp, P. troglodytes
cacacacacacgttta

SEQ ID NO: 219846 - DNA, 16 bp, P. troglodytes
cacacacacactccat

SEQ ID NO: 219847 - DNA, 16 bp, P. troglodytes
cacacacacactctca

SEQ ID NO: 219848 - DNA, 16 bp, P. troglodytes
cacacacacactgaag

SEQ ID NO: 219849 - DNA, 16 bp, P. troglodytes
cacacacacagaaaat

SEQ ID NO: 219850 - DNA, 16 bp, P. troglodytes
cacacacacagaagga

SEQ ID NO: 219851 - DNA, 16 bp, P. troglodytes
cacacacacagagaca

SEQ ID NO: 219852 - DNA, 16 bp, P. troglodytes
cacacacacagagata

SEQ ID NO: 219853 - DNA, 16 bp, P. troglodytes
cacacacacagatgct

SEQ ID NO: 219854 - DNA, 16 bp, P. troglodytes
cacacacacagcctct

SEQ ID NO: 219855 - DNA, 16 bp, P. troglodytes
cacacacacaggcacc

SEQ ID NO: 219856 - DNA, 16 bp, P. troglodytes
cacacacacagtcaca

SEQ ID NO: 219857 - DNA, 16 bp, P. troglodytes
cacacacacagtcccc

SEQ ID NO: 219858 - DNA, 16 bp, P. troglodytes
cacacacacatacatg

SEQ ID NO: 219859 - DNA, 16 bp, P. troglodytes
cacacacacatacatt

SEQ ID NO: 219860 - DNA, 16 bp, P. troglodytes
cacacacacataccat

SEQ ID NO: 219861 - DNA, 16 bp, P. troglodytes
cacacacacatactcc

SEQ ID NO: 219862 - DNA, 17 bp, P. troglodytes
cacacacacatatgtac

SEQ ID NO: 219863 - DNA, 16 bp, P. troglodytes
cacacacacatcccta

SEQ ID NO: 219864 - DNA, 16 bp, P. troglodytes
cacacacacatctcac

SEQ ID NO: 219865 - DNA, 16 bp, P. troglodytes
cacacacacatgcact

SEQ ID NO: 219866 - DNA, 16 bp, P. troglodytes
cacacacacatttatg

SEQ ID NO: 219867 - DNA, 16 bp, P. troglodytes
cacacacaccatggaa

SEQ ID NO: 219868 - DNA, 16 bp, P. troglodytes
cacacacacccctcag

SEQ ID NO: 219869 - DNA, 16 bp, P. troglodytes
cacacacacccctgca

SEQ ID NO: 219870 - DNA, 16 bp, P. troglodytes
cacacacacgcacgta

SEQ ID NO: 219871 - DNA, 16 bp, P. troglodytes
cacacacacgcactct

SEQ ID NO: 219872 - DNA, 16 bp, P. troglodytes
cacacacactcctaca

SEQ ID NO: 219873 - DNA, 16 bp, P. troglodytes
cacacacactcttaca

SEQ ID NO: 219874 - DNA, 16 bp, P. troglodytes
cacacacacttgtgca

SEQ ID NO: 219875 - DNA, 16 bp, P. troglodytes
cacacacagagagaaa

SEQ ID NO: 219876 - DNA, 16 bp, P. troglodytes
cacacacagagatgca

SEQ ID NO: 219877 - DNA, 16 bp, P. troglodytes
cacacacagaggaaga

SEQ ID NO: 219878 - DNA, 16 bp, P. troglodytes
cacacacagaggagag

SEQ ID NO: 219879 - DNA, 16 bp, P. troglodytes
cacacacagaggcaca

SEQ ID NO: 219880 - DNA, 16 bp, P. troglodytes
cacacacagctaattt

SEQ ID NO: 219881 - DNA, 16 bp, P. troglodytes
cacacacaggcacaca

SEQ ID NO: 219882 - DNA, 16 bp, P. troglodytes
cacacacatacaattt

SEQ ID NO: 219883 - DNA, 16 bp, P. troglodytes
cacacacatacacact

SEQ ID NO: 219884 - DNA, 16 bp, P. troglodytes
cacacacatacacaga

SEQ ID NO: 219885 - DNA, 16 bp, P. troglodytes
cacacacatacactca

SEQ ID NO: 219886 - DNA, 16 bp, P. troglodytes
cacacacatacactcc

SEQ ID NO: 219887 - DNA, 16 bp, P. troglodytes
cacacacatacatacc

SEQ ID NO: 219888 - DNA, 16 bp, P. troglodytes
cacacacatacatgaa

SEQ ID NO: 219889 - DNA, 16 bp, P. troglodytes
cacacacatatgtgtg

SEQ ID NO: 219890 - DNA, 16 bp, P. troglodytes
cacacacatgcacaca

SEQ ID NO: 219891 - DNA, 16 bp, P. troglodytes
cacacacatgcccaca

SEQ ID NO: 219892 - DNA, 16 bp, P. troglodytes
cacacacatggacaca

SEQ ID NO: 219893 - DNA, 16 bp, P. troglodytes
cacacacatgtgcaca

SEQ ID NO: 219894 - DNA, 16 bp, P. troglodytes
cacacacattcacaca

SEQ ID NO: 219895 - DNA, 16 bp, P. troglodytes
cacacaccacacctgg

SEQ ID NO: 219896 - DNA, 16 bp, P. troglodytes
cacacaccaccacgct

SEQ ID NO: 219897 - DNA, 16 bp, P. troglodytes
cacacaccaccttgcc

SEQ ID NO: 219898 - DNA, 16 bp, P. troglodytes
cacacacctgtaatcg

SEQ ID NO: 219899 - DNA, 16 bp, P. troglodytes
cacacacctgtaggcc

SEQ ID NO: 219900 - DNA, 16 bp, P. troglodytes
cacacacctgttatcc

SEQ ID NO: 219901 - DNA, 16 bp, P. troglodytes
cacacacgcatgcatg

SEQ ID NO: 219902 - DNA, 16 bp, P. troglodytes
cacacacgcgcgcaca

SEQ ID NO: 219903 - DNA, 16 bp, P. troglodytes
cacacacgcgcgcgcg

SEQ ID NO: 219904 - DNA, 16 bp, P. troglodytes
cacacacgtgcacaca

SEQ ID NO: 219905 - DNA, 16 bp, P. troglodytes
cacacacgtgcacatg

SEQ ID NO: 219906 - DNA, 16 bp, P. troglodytes
cacacactcgcacaca

SEQ ID NO: 219907 - DNA, 16 bp, P. troglodytes
cacacagaaacctgta

SEQ ID NO: 219908 - DNA, 16 bp, P. troglodytes
cacacagacacagaca

SEQ ID NO: 219909 - DNA, 16 bp, P. troglodytes
cacacagacatgggga

SEQ ID NO: 219910 - DNA, 16 bp, P. troglodytes
cacacagactgaaagt

SEQ ID NO: 219911 - DNA, 16 bp, P. troglodytes
cacacagccaggaagg

SEQ ID NO: 219912 - DNA, 16 bp, P. troglodytes
cacacagctgataaat

SEQ ID NO: 219913 - DNA, 16 bp, P. troglodytes
cacacaggagagaaac

SEQ ID NO: 219914 - DNA, 16 bp, P. troglodytes
cacacaggcacacaca

SEQ ID NO: 219915 - DNA, 16 bp, P. troglodytes
cacacaggcacacgca

SEQ ID NO: 219916 - DNA, 16 bp, P. troglodytes
cacacagggacacaca

SEQ ID NO: 219917 - DNA, 17 bp, P. troglodytes
cacacagggcgggtgtg

SEQ ID NO: 219918 - DNA, 16 bp, P. troglodytes
cacacagtggctcaca

SEQ ID NO: 219919 - DNA, 16 bp, P. troglodytes
cacacatacacacacg

SEQ ID NO: 219920 - DNA, 16 bp, P. troglodytes
cacacatacacacact

SEQ ID NO: 219921 - DNA, 16 bp, P. troglodytes
cacacatacacacatg

SEQ ID NO: 219922 - DNA, 16 bp, P. troglodytes
cacacatacaggcaca

SEQ ID NO: 219923 - DNA, 17 bp, P. troglodytes
cacacatacatacacat

SEQ ID NO: 219924 - DNA, 16 bp, P. troglodytes
cacacatacgcacaca

SEQ ID NO: 219925 - DNA, 16 bp, P. troglodytes
cacacatactcacata

SEQ ID NO: 219926 - DNA, 16 bp, P. troglodytes
cacacatatacatgta

SEQ ID NO: 219927 - DNA, 16 bp, P. troglodytes
cacacatatatatagt

SEQ ID NO: 219928 - DNA, 16 bp, P. troglodytes
cacacatatgtgtatt

SEQ ID NO: 219929 - DNA, 16 bp, P. troglodytes
cacacatccatgcaca

SEQ ID NO: 219930 - DNA, 16 bp, P. troglodytes
cacacatctgtagtcc

SEQ ID NO: 219931 - DNA, 16 bp, P. troglodytes
cacacatgaaaaaatg

SEQ ID NO: 219932 - DNA, 16 bp, P. troglodytes
cacacatgcacactca

SEQ ID NO: 219933 - DNA, 16 bp, P. troglodytes
cacacatgcacataaa

SEQ ID NO: 219934 - DNA, 16 bp, P. troglodytes
cacacatgcaggcaca

SEQ ID NO: 219935 - DNA, 16 bp, P. troglodytes
cacacatgcatgcaca

SEQ ID NO: 219936 - DNA, 16 bp, P. troglodytes
cacacatgcatgcata

SEQ ID NO: 219937 - DNA, 16 bp, P. troglodytes
cacacatgcgtacaca

SEQ ID NO: 219938 - DNA, 16 bp, P. troglodytes
cacacatggctaattt

SEQ ID NO: 219939 - DNA, 16 bp, P. troglodytes
cacacatggctagtgg

SEQ ID NO: 219940 - DNA, 16 bp, P. troglodytes
cacacatgggcacaca

SEQ ID NO: 219941 - DNA, 16 bp, P. troglodytes
cacacatgtatacaca

SEQ ID NO: 219942 - DNA, 16 bp, P. troglodytes
cacacatgtatgtgta

SEQ ID NO: 219943 - DNA, 16 bp, P. troglodytes
cacacatgtgcacaca

SEQ ID NO: 219944 - DNA, 16 bp, P. troglodytes
cacacattgctggtgg

SEQ ID NO: 219945 - DNA, 16 bp, P. troglodytes
cacacatttaaaaaat

SEQ ID NO: 219946 - DNA, 16 bp, P. troglodytes
cacacatttctttcag

SEQ ID NO: 219947 - DNA, 16 bp, P. troglodytes
cacacatttttaaaat

SEQ ID NO: 219948 - DNA, 16 bp, P. troglodytes
cacaccaacctgggtg

SEQ ID NO: 219949 - DNA, 16 bp, P. troglodytes
cacaccaattagaatg

SEQ ID NO: 219950 - DNA, 16 bp, P. troglodytes
cacaccaccatgccca

SEQ ID NO: 219951 - DNA, 16 bp, P. troglodytes
cacaccagccccctgc

SEQ ID NO: 219952 - DNA, 16 bp, P. troglodytes
cacaccagggtctgtc

SEQ ID NO: 219953 - DNA, 16 bp, P. troglodytes
cacaccagtctgggtg

SEQ ID NO: 219954 - DNA, 16 bp, P. troglodytes
cacaccatgcactcca

SEQ ID NO: 219955 - DNA, 16 bp, P. troglodytes
cacaccattgcactct

SEQ ID NO: 219956 - DNA, 16 bp, P. troglodytes
cacacccaagggggcc

SEQ ID NO: 219957 - DNA, 16 bp, P. troglodytes
cacacccagaaggaag

SEQ ID NO: 219958 - DNA, 16 bp, P. troglodytes
cacacccagccaacag

SEQ ID NO: 219959 - DNA, 16 bp, P. troglodytes
cacacccagccccttt

SEQ ID NO: 219960 - DNA, 16 bp, P. troglodytes
cacacccagctaactt

SEQ ID NO: 219961 - DNA, 16 bp, P. troglodytes
cacacccagctacttt

SEQ ID NO: 219962 - DNA, 16 bp, P. troglodytes
cacacccagctctttt

SEQ ID NO: 219963 - DNA, 16 bp, P. troglodytes
cacacccaggctggag

SEQ ID NO: 219964 - DNA, 16 bp, P. troglodytes
cacacccaggtaattt

SEQ ID NO: 219965 - DNA, 16 bp, P. troglodytes
cacaccccgctaattt

SEQ ID NO: 219966 - DNA, 16 bp, P. troglodytes
cacaccctgctaattt

SEQ ID NO: 219967 - DNA, 16 bp, P. troglodytes
cacaccctggggcctg

SEQ ID NO: 219968 - DNA, 16 bp, P. troglodytes
cacacctagctgcaag

SEQ ID NO: 219969 - DNA, 16 bp, P. troglodytes
cacacctattcacaca

SEQ ID NO: 219970 - DNA, 16 bp, P. troglodytes
cacacctctgtatttc

SEQ ID NO: 219971 - DNA, 16 bp, P. troglodytes
cacacctgcaatctca

SEQ ID NO: 219972 - DNA, 16 bp, P. troglodytes
cacacctgcggtccca

SEQ ID NO: 219973 - DNA, 16 bp, P. troglodytes
cacacctggcctattt

SEQ ID NO: 219974 - DNA, 16 bp, P. troglodytes
cacacctggcctctgt

SEQ ID NO: 219975 - DNA, 16 bp, P. troglodytes
cacacctggcctgaat

SEQ ID NO: 219976 - DNA, 16 bp, P. troglodytes
cacacctggctaattt

SEQ ID NO: 219977 - DNA, 16 bp, P. troglodytes
cacacctgtaactcca

SEQ ID NO: 219978 - DNA, 16 bp, P. troglodytes
cacacctgtaatccta

SEQ ID NO: 219979 - DNA, 16 bp, P. troglodytes
cacacctgtacagcat

SEQ ID NO: 219980 - DNA, 16 bp, P. troglodytes
cacacctgtgcacaca

SEQ ID NO: 219981 - DNA, 16 bp, P. troglodytes
cacacctgtggcccca

SEQ ID NO: 219982 - DNA, 19 bp, P. troglodytes
cacacctgtgggtgtttct

SEQ ID NO: 219983 - DNA, 16 bp, P. troglodytes
cacacgcacacgcaca

SEQ ID NO: 219984 - DNA, 16 bp, P. troglodytes
cacacgcgcgcgcaca

SEQ ID NO: 219985 - DNA, 16 bp, P. troglodytes
cacacgcgtgcacaca

SEQ ID NO: 219986 - DNA, 16 bp, P. troglodytes
cacacgctgccacgcc

SEQ ID NO: 219987 - DNA, 16 bp, P. troglodytes
cacacgtgtatgtgtg

SEQ ID NO: 219988 - DNA, 16 bp, P. troglodytes
cacacgtgtgcacaca

SEQ ID NO: 219989 - DNA, 16 bp, P. troglodytes
cacactcaagtttgag

SEQ ID NO: 219990 - DNA, 16 bp, P. troglodytes
cacactcacacactca

SEQ ID NO: 219991 - DNA, 16 bp, P. troglodytes
cacactcacacgcaca

SEQ ID NO: 219992 - DNA, 16 bp, P. troglodytes
cacactcactcactgc

SEQ ID NO: 219993 - DNA, 16 bp, P. troglodytes
cacactcagctaattt

SEQ ID NO: 219994 - DNA, 16 bp, P. troglodytes
cacactcagtgggctg

SEQ ID NO: 219995 - DNA, 16 bp, P. troglodytes
cacactcatgcacaca

SEQ ID NO: 219996 - DNA, 16 bp, P. troglodytes
cacactcatttgttta

SEQ ID NO: 219997 - DNA, 16 bp, P. troglodytes
cacactccagcctggg

SEQ ID NO: 219998 - DNA, 16 bp, P. troglodytes
cacactgaagaatgca

SEQ ID NO: 219999 - DNA, 16 bp, P. troglodytes
cacactgatgagtctt

SEQ ID NO: 220000 - DNA, 16 bp, P. troglodytes
cacactgccttaatta

SEQ ID NO: 220001 - DNA, 16 bp, P. troglodytes
cacactgctaattttt

SEQ ID NO: 220002 - DNA, 16 bp, P. troglodytes
cacactggagagaaac

SEQ ID NO: 220003 - DNA, 16 bp, P. troglodytes
cacactggagagaagc

SEQ ID NO: 220004 - DNA, 16 bp, P. troglodytes
cacactggcctccctg

SEQ ID NO: 220005 - DNA, 16 bp, P. troglodytes
cacactggggagggca

SEQ ID NO: 220006 - DNA, 16 bp, P. troglodytes
cacactggtgagaaac

SEQ ID NO: 220007 - DNA, 16 bp, P. troglodytes
cacactgtcaatatta

SEQ ID NO: 220008 - DNA, 16 bp, P. troglodytes
cacactgtggaagggg

SEQ ID NO: 220009 - DNA, 16 bp, P. troglodytes
cacactgttttttttt

SEQ ID NO: 220010 - DNA, 16 bp, P. troglodytes
cacacttaagcacata

SEQ ID NO: 220011 - DNA, 16 bp, P. troglodytes
cacactttatttttat

SEQ ID NO: 220012 - DNA, 16 bp, P. troglodytes
cacactttgagaacca

SEQ ID NO: 220013 - DNA, 16 bp, P. troglodytes
cacactttgggaacca

SEQ ID NO: 220014 - DNA, 16 bp, P. troglodytes
cacagaaaaagcattc

SEQ ID NO: 220015 - DNA, 16 bp, P. troglodytes
cacagaaaagcacaga

SEQ ID NO: 220016 - DNA, 16 bp, P. troglodytes
cacagaaaagttgaaa

SEQ ID NO: 220017 - DNA, 16 bp, P. troglodytes
cacagaaacatacaca

SEQ ID NO: 220018 - DNA, 16 bp, P. troglodytes
cacagaaagaaaatat

SEQ ID NO: 220019 - DNA, 16 bp, P. troglodytes
cacagaaagacaaata

SEQ ID NO: 220020 - DNA, 16 bp, P. troglodytes
cacagaaagccagtca

SEQ ID NO: 220021 - DNA, 30 bp, P. troglodytes
cacagaaatacaaactaccatcagagaata

SEQ ID NO: 220022 - DNA, 16 bp, P. troglodytes
cacagaaatacaaata

SEQ ID NO: 220023 - DNA, 16 bp, P. troglodytes
cacagaaatataaaca

SEQ ID NO: 220024 - DNA, 16 bp, P. troglodytes
cacagaaatcaagaat

SEQ ID NO: 220025 - DNA, 16 bp, P. troglodytes
cacagaaatggaaaat

SEQ ID NO: 220026 - DNA, 16 bp, P. troglodytes
cacagaacaggagaaa

SEQ ID NO: 220027 - DNA, 16 bp, P. troglodytes
cacagaacgggagaaa

SEQ ID NO: 220028 - DNA, 16 bp, P. troglodytes
cacagaactagagaaa

SEQ ID NO: 220029 - DNA, 16 bp, P. troglodytes
cacagaacttaaagta

SEQ ID NO: 220030 - DNA, 16 bp, P. troglodytes
cacagaagaaaatatt

SEQ ID NO: 220031 - DNA, 16 bp, P. troglodytes
cacagaagcagaaaac

SEQ ID NO: 220032 - DNA, 16 bp, P. troglodytes
cacagaagcagaaagt

SEQ ID NO: 220033 - DNA, 16 bp, P. troglodytes
cacagaaggaaaaata

SEQ ID NO: 220034 - DNA, 16 bp, P. troglodytes
cacagaatcacagaat

SEQ ID NO: 220035 - DNA, 16 bp, P. troglodytes
cacagaatcagaacat

SEQ ID NO: 220036 - DNA, 16 bp, P. troglodytes
cacagaatgggataaa

SEQ ID NO: 220037 - DNA, 16 bp, P. troglodytes
cacagaattagaagaa

SEQ ID NO: 220038 - DNA, 16 bp, P. troglodytes
cacagaattggaaaac

SEQ ID NO: 220039 - DNA, 16 bp, P. troglodytes
cacagacacaaaaata

SEQ ID NO: 220040 - DNA, 16 bp, P. troglodytes
cacagacacacacacg

SEQ ID NO: 220041 - DNA, 16 bp, P. troglodytes
cacagacacacacata

SEQ ID NO: 220042 - DNA, 16 bp, P. troglodytes
cacagacacacaggca

SEQ ID NO: 220043 - DNA, 16 bp, P. troglodytes
cacagacacagacaca

SEQ ID NO: 220044 - DNA, 16 bp, P. troglodytes
cacagacacagacaga

SEQ ID NO: 220045 - DNA, 16 bp, P. troglodytes
cacagacacatacaca

SEQ ID NO: 220046 - DNA, 16 bp, P. troglodytes
cacagacacatatgca

SEQ ID NO: 220047 - DNA, 16 bp, P. troglodytes
cacagacagggagaaa

SEQ ID NO: 220048 - DNA, 16 bp, P. troglodytes
cacagacatgtacaca

SEQ ID NO: 220049 - DNA, 16 bp, P. troglodytes
cacagacatttaaaaa

SEQ ID NO: 220050 - DNA, 16 bp, P. troglodytes
cacagacccaaaccat

SEQ ID NO: 220051 - DNA, 16 bp, P. troglodytes
cacagaccctccatcc

SEQ ID NO: 220052 - DNA, 16 bp, P. troglodytes
cacagacgcacacaca

SEQ ID NO: 220053 - DNA, 16 bp, P. troglodytes
cacagactaggtggct

SEQ ID NO: 220054 - DNA, 16 bp, P. troglodytes
cacagagacacagagg

SEQ ID NO: 220055 - DNA, 16 bp, P. troglodytes
cacagagacagaaagt

SEQ ID NO: 220056 - DNA, 16 bp, P. troglodytes
cacagagacagagaga

SEQ ID NO: 220057 - DNA, 16 bp, P. troglodytes
cacagagacatacaca

SEQ ID NO: 220058 - DNA, 16 bp, P. troglodytes
cacagagagagagaga

SEQ ID NO: 220059 - DNA, 16 bp, P. troglodytes
cacagagagagcaggg

SEQ ID NO: 220060 - DNA, 16 bp, P. troglodytes
cacagagagctgattg

SEQ ID NO: 220061 - DNA, 16 bp, P. troglodytes
cacagagatgcacaca

SEQ ID NO: 220062 - DNA, 16 bp, P. troglodytes
cacagagcaagaccct

SEQ ID NO: 220063 - DNA, 16 bp, P. troglodytes
cacagagccagaccct

SEQ ID NO: 220064 - DNA, 16 bp, P. troglodytes
cacagagccagccagc

SEQ ID NO: 220065 - DNA, 16 bp, P. troglodytes
cacagagccagctgtg

SEQ ID NO: 220066 - DNA, 16 bp, P. troglodytes
cacagagcctagcaca

SEQ ID NO: 220067 - DNA, 16 bp, P. troglodytes
cacagagcgagactcc

SEQ ID NO: 220068 - DNA, 16 bp, P. troglodytes
cacagagctcttcaag

SEQ ID NO: 220069 - DNA, 16 bp, P. troglodytes
cacagagctgggaaaa

SEQ ID NO: 220070 - DNA, 16 bp, P. troglodytes
cacagagctgtcatct

SEQ ID NO: 220071 - DNA, 16 bp, P. troglodytes
cacagaggaaagacca

SEQ ID NO: 220072 - DNA, 16 bp, P. troglodytes
cacagaggagaaggcc

SEQ ID NO: 220073 - DNA, 16 bp, P. troglodytes
cacagaggagaaggtg

SEQ ID NO: 220074 - DNA, 16 bp, P. troglodytes
cacagaggtgttcata

SEQ ID NO: 220075 - DNA, 16 bp, P. troglodytes
cacagagtccttactg

SEQ ID NO: 220076 - DNA, 16 bp, P. troglodytes
cacagagtgggaaaaa

SEQ ID NO: 220077 - DNA, 16 bp, P. troglodytes
cacagagtgggagaag

SEQ ID NO: 220078 - DNA, 16 bp, P. troglodytes
cacagagttaaatttt

SEQ ID NO: 220079 - DNA, 16 bp, P. troglodytes
cacagagttggagaaa

SEQ ID NO: 220080 - DNA, 16 bp, P. troglodytes
cacagatacacataca

SEQ ID NO: 220081 - DNA, 18 bp, P. troglodytes
cacagatcaacaggatcc

SEQ ID NO: 220082 - DNA, 16 bp, P. troglodytes
cacagatgagaaactg

SEQ ID NO: 220083 - DNA, 16 bp, P. troglodytes
cacagatgcaaaaatt

SEQ ID NO: 220084 - DNA, 16 bp, P. troglodytes
cacagatgctcaagtc

SEQ ID NO: 220085 - DNA, 16 bp, P. troglodytes
cacagatggcagaaga

SEQ ID NO: 220086 - DNA, 16 bp, P. troglodytes
cacagatgtcttcttt

SEQ ID NO: 220087 - DNA, 16 bp, P. troglodytes
cacagattcttttttt

SEQ ID NO: 220088 - DNA, 16 bp, P. troglodytes
cacagatttattgaaa

SEQ ID NO: 220089 - DNA, 16 bp, P. troglodytes
cacagcaaaagaaatg

SEQ ID NO: 220090 - DNA, 16 bp, P. troglodytes
cacagcaaagggaaca

SEQ ID NO: 220091 - DNA, 16 bp, P. troglodytes
cacagcaaccctgtga

SEQ ID NO: 220092 - DNA, 16 bp, P. troglodytes
cacagcaagaaggcac

SEQ ID NO: 220093 - DNA, 16 bp, P. troglodytes
cacagcaagacccctg

SEQ ID NO: 220094 - DNA, 16 bp, P. troglodytes
cacagcaagggaaaca

SEQ ID NO: 220095 - DNA, 16 bp, P. troglodytes
cacagcaatagaaact

SEQ ID NO: 220096 - DNA, 16 bp, P. troglodytes
cacagcaatcctatga

SEQ ID NO: 220097 - DNA, 16 bp, P. troglodytes
cacagcaatgtgaatg

SEQ ID NO: 220098 - DNA, 16 bp, P. troglodytes
cacagcacacagcagc

SEQ ID NO: 220099 - DNA, 16 bp, P. troglodytes
cacagcaccaaatttc

SEQ ID NO: 220100 - DNA, 16 bp, P. troglodytes
cacagcacgagaactt

SEQ ID NO: 220101 - DNA, 16 bp, P. troglodytes
cacagcactccagcct

SEQ ID NO: 220102 - DNA, 16 bp, P. troglodytes
cacagcagacactgtg

SEQ ID NO: 220103 - DNA, 16 bp, P. troglodytes
cacagcagcaggggcc

SEQ ID NO: 220104 - DNA, 16 bp, P. troglodytes
cacagcagccccccag

SEQ ID NO: 220105 - DNA, 16 bp, P. troglodytes
cacagcagcccctctc

SEQ ID NO: 220106 - DNA, 16 bp, P. troglodytes
cacagcagccccttcc

SEQ ID NO: 220107 - DNA, 16 bp, P. troglodytes
cacagcagcctccacc

SEQ ID NO: 220108 - DNA, 16 bp, P. troglodytes
cacagcagcctgggca

SEQ ID NO: 220109 - DNA, 21 bp, P. troglodytes
cacagcagctgctggcccagg

SEQ ID NO: 220110 - DNA, 16 bp, P. troglodytes
cacagcaggaggggag

SEQ ID NO: 220111 - DNA, 16 bp, P. troglodytes
cacagcaggaggtgag

SEQ ID NO: 220112 - DNA, 16 bp, P. troglodytes
cacagcatcttcatca

SEQ ID NO: 220113 - DNA, 16 bp, P. troglodytes
cacagcatgtgggaat

SEQ ID NO: 220114 - DNA, 16 bp, P. troglodytes
cacagcattccagcct

SEQ ID NO: 220115 - DNA, 16 bp, P. troglodytes
cacagcattcccttaa

SEQ ID NO: 220116 - DNA, 16 bp, P. troglodytes
cacagccaaagaaata

SEQ ID NO: 220117 - DNA, 16 bp, P. troglodytes
cacagccacagccaca

SEQ ID NO: 220118 - DNA, 16 bp, P. troglodytes
cacagccactatcata

SEQ ID NO: 220119 - DNA, 16 bp, P. troglodytes
cacagccactcaggag

SEQ ID NO: 220120 - DNA, 16 bp, P. troglodytes
cacagcccactgcagc

SEQ ID NO: 220121 - DNA, 16 bp, P. troglodytes
cacagcccctgccctc

SEQ ID NO: 220122 - DNA, 16 bp, P. troglodytes
cacagccctcaggaag

SEQ ID NO: 220123 - DNA, 16 bp, P. troglodytes
cacagccctgccagca

SEQ ID NO: 220124 - DNA, 16 bp, P. troglodytes
cacagccctggttccc

SEQ ID NO: 220125 - DNA, 16 bp, P. troglodytes
cacagcctcacagaga

SEQ ID NO: 220126 - DNA, 16 bp, P. troglodytes
cacagcctcagaagga

SEQ ID NO: 220127 - DNA, 16 bp, P. troglodytes
cacagcctcagcctca

SEQ ID NO: 220128 - DNA, 16 bp, P. troglodytes
cacagcctccgcctcc

SEQ ID NO: 220129 - DNA, 16 bp, P. troglodytes
cacagcctcctgagta

SEQ ID NO: 220130 - DNA, 16 bp, P. troglodytes
cacagcctggagctat

SEQ ID NO: 220131 - DNA, 16 bp, P. troglodytes
cacagcgcctggcctc

SEQ ID NO: 220132 - DNA, 16 bp, P. troglodytes
cacagctaaagaagtg

SEQ ID NO: 220133 - DNA, 16 bp, P. troglodytes
cacagctaaagcaatg

SEQ ID NO: 220134 - DNA, 16 bp, P. troglodytes
cacagctaattttttt

SEQ ID NO: 220135 - DNA, 16 bp, P. troglodytes
cacagctactccagag

SEQ ID NO: 220136 - DNA, 16 bp, P. troglodytes
cacagctagaaagtag

SEQ ID NO: 220137 - DNA, 16 bp, P. troglodytes
cacagctagtaaatgg

SEQ ID NO: 220138 - DNA, 16 bp, P. troglodytes
cacagctagtgagtga

SEQ ID NO: 220139 - DNA, 16 bp, P. troglodytes
cacagctagtgagtgg

SEQ ID NO: 220140 - DNA, 16 bp, P. troglodytes
cacagctcactgcagc

SEQ ID NO: 220141 - DNA, 16 bp, P. troglodytes
cacagctcagcaaagc

SEQ ID NO: 220142 - DNA, 16 bp, P. troglodytes
cacagctctccagcct

SEQ ID NO: 220143 - DNA, 16 bp, P. troglodytes
cacagctgaattctgc

SEQ ID NO: 220144 - DNA, 16 bp, P. troglodytes
cacagctgagaatgtg

SEQ ID NO: 220145 - DNA, 16 bp, P. troglodytes
cacagctgcagccacc

SEQ ID NO: 220146 - DNA, 16 bp, P. troglodytes
cacagctgctgctgct

SEQ ID NO: 220147 - DNA, 16 bp, P. troglodytes
cacagctggagcagct

SEQ ID NO: 220148 - DNA, 16 bp, P. troglodytes
cacagctggaggtgag

SEQ ID NO: 220149 - DNA, 16 bp, P. troglodytes
cacagctggcaagtgg

SEQ ID NO: 220150 - DNA, 16 bp, P. troglodytes
cacagctggcactggg

SEQ ID NO: 220151 - DNA, 16 bp, P. troglodytes
cacagctggctaattt

SEQ ID NO: 220152 - DNA, 16 bp, P. troglodytes
cacagctggggaggcc

SEQ ID NO: 220153 - DNA, 16 bp, P. troglodytes
cacagctggtaaatgg

SEQ ID NO: 220154 - DNA, 16 bp, P. troglodytes
cacagcttgtggctcc

SEQ ID NO: 220155 - DNA, 16 bp, P. troglodytes
cacagctttgggatgt

SEQ ID NO: 220156 - DNA, 16 bp, P. troglodytes
cacaggaaattgcaaa

SEQ ID NO: 220157 - DNA, 16 bp, P. troglodytes
cacaggaaggaattca

SEQ ID NO: 220158 - DNA, 16 bp, P. troglodytes
cacaggaatggaaaac

SEQ ID NO: 220159 - DNA, 16 bp, P. troglodytes
cacaggacaaggatgc

SEQ ID NO: 220160 - DNA, 16 bp, P. troglodytes
cacaggacagggaaca

SEQ ID NO: 220161 - DNA, 16 bp, P. troglodytes
cacaggacctggcaca

SEQ ID NO: 220162 - DNA, 16 bp, P. troglodytes
cacaggagccttcaga

SEQ ID NO: 220163 - DNA, 16 bp, P. troglodytes
cacaggatcagaaaac

SEQ ID NO: 220164 - DNA, 16 bp, P. troglodytes
cacaggatttttaggg

SEQ ID NO: 220165 - DNA, 16 bp, P. troglodytes
cacaggcaaccaaggc

SEQ ID NO: 220166 - DNA, 16 bp, P. troglodytes
cacaggcacacacatg

SEQ ID NO: 220167 - DNA, 16 bp, P. troglodytes
cacaggcagaagggac

SEQ ID NO: 220168 - DNA, 16 bp, P. troglodytes
cacaggcagaggagcc

SEQ ID NO: 220169 - DNA, 16 bp, P. troglodytes
cacaggcaggcaggcc

SEQ ID NO: 220170 - DNA, 16 bp, P. troglodytes
cacaggccaggaggcc

SEQ ID NO: 220171 - DNA, 16 bp, P. troglodytes
cacaggccaggtgcag

SEQ ID NO: 220172 - DNA, 16 bp, P. troglodytes
cacaggccccacctcc

SEQ ID NO: 220173 - DNA, 16 bp, P. troglodytes
cacaggcctggaggca

SEQ ID NO: 220174 - DNA, 16 bp, P. troglodytes
cacaggctggagtgca

SEQ ID NO: 220175 - DNA, 16 bp, P. troglodytes
cacaggctggagtgct

SEQ ID NO: 220176 - DNA, 16 bp, P. troglodytes
cacaggctgggcgtgg

SEQ ID NO: 220177 - DNA, 16 bp, P. troglodytes
cacagggaaaggaaga

SEQ ID NO: 220178 - DNA, 16 bp, P. troglodytes
cacagggaagagagac

SEQ ID NO: 220179 - DNA, 16 bp, P. troglodytes
cacagggacacaaaga

SEQ ID NO: 220180 - DNA, 16 bp, P. troglodytes
cacagggagaagatgg

SEQ ID NO: 220181 - DNA, 16 bp, P. troglodytes
cacagggagagaaaca

SEQ ID NO: 220182 - DNA, 16 bp, P. troglodytes
cacagggagggcaaca

SEQ ID NO: 220183 - DNA, 16 bp, P. troglodytes
cacagggaggggaata

SEQ ID NO: 220184 - DNA, 16 bp, P. troglodytes
cacagggaggggagca

SEQ ID NO: 220185 - DNA, 16 bp, P. troglodytes
cacagggatgggaaca

SEQ ID NO: 220186 - DNA, 16 bp, P. troglodytes
cacagggcagagctgc

SEQ ID NO: 220187 - DNA, 16 bp, P. troglodytes
cacagggcagccccca

SEQ ID NO: 220188 - DNA, 16 bp, P. troglodytes
cacagggcctgacaca

SEQ ID NO: 220189 - DNA, 16 bp, P. troglodytes
cacagggcctggcact

SEQ ID NO: 220190 - DNA, 16 bp, P. troglodytes
cacagggcctggccca

SEQ ID NO: 220191 - DNA, 16 bp, P. troglodytes
cacagggtggcaggaa

SEQ ID NO: 220192 - DNA, 16 bp, P. troglodytes
cacagggttgttgtga

SEQ ID NO: 220193 - DNA, 16 bp, P. troglodytes
cacagggtttcaccat

SEQ ID NO: 220194 - DNA, 16 bp, P. troglodytes
cacaggtatacacatg

SEQ ID NO: 220195 - DNA, 16 bp, P. troglodytes
cacaggtgggaattga

SEQ ID NO: 220196 - DNA, 16 bp, P. troglodytes
cacaggtgtgagccac

SEQ ID NO: 220197 - DNA, 16 bp, P. troglodytes
cacagtaaacactcaa

SEQ ID NO: 220198 - DNA, 16 bp, P. troglodytes
cacagtaaatatttgt

SEQ ID NO: 220199 - DNA, 16 bp, P. troglodytes
cacagtaggtgttcaa

SEQ ID NO: 220200 - DNA, 16 bp, P. troglodytes
cacagtaggtgttcag

SEQ ID NO: 220201 - DNA, 16 bp, P. troglodytes
cacagtattttaaaaa

SEQ ID NO: 220202 - DNA, 16 bp, P. troglodytes
cacagtcctggaggct

SEQ ID NO: 220203 - DNA, 17 bp, P. troglodytes
cacagtctaaagtctca

SEQ ID NO: 220204 - DNA, 16 bp, P. troglodytes
cacagtctctgcccaa

SEQ ID NO: 220205 - DNA, 16 bp, P. troglodytes
cacagtctctgtcaca

SEQ ID NO: 220206 - DNA, 18 bp, P. troglodytes
cacagtcttgctctgttg

SEQ ID NO: 220207 - DNA, 18 bp, P. troglodytes
cacagtgaaactccatct

SEQ ID NO: 220208 - DNA, 16 bp, P. troglodytes
cacagtgagacccctg

SEQ ID NO: 220209 - DNA, 16 bp, P. troglodytes
cacagtgagatattac

SEQ ID NO: 220210 - DNA, 16 bp, P. troglodytes
cacagtgagctgtgat

SEQ ID NO: 220211 - DNA, 16 bp, P. troglodytes
cacagtgcctgccaca

SEQ ID NO: 220212 - DNA, 16 bp, P. troglodytes
cacagtgcctggcaca

SEQ ID NO: 220213 - DNA, 17 bp, P. troglodytes
cacagtgcctggcacat

SEQ ID NO: 220214 - DNA, 16 bp, P. troglodytes
cacagtgcctggccca

SEQ ID NO: 220215 - DNA, 16 bp, P. troglodytes
cacagtgcctggctca

SEQ ID NO: 220216 - DNA, 16 bp, P. troglodytes
cacagtgcctgggaca

SEQ ID NO: 220217 - DNA, 16 bp, P. troglodytes
cacagtgccttgcaca

SEQ ID NO: 220218 - DNA, 16 bp, P. troglodytes
cacagtgctaagtgct

SEQ ID NO: 220219 - DNA, 16 bp, P. troglodytes
cacagtgctgggatta

SEQ ID NO: 220220 - DNA, 16 bp, P. troglodytes
cacagtggaatattat

SEQ ID NO: 220221 - DNA, 16 bp, P. troglodytes
cacagtggctcacaca

SEQ ID NO: 220222 - DNA, 16 bp, P. troglodytes
cacagtggcttatgcc

SEQ ID NO: 220223 - DNA, 16 bp, P. troglodytes
cacagtggtgtgatca

SEQ ID NO: 220224 - DNA, 16 bp, P. troglodytes
cacagtgtctgctgtg

SEQ ID NO: 220225 - DNA, 16 bp, P. troglodytes
cacagtgtctggtaca

SEQ ID NO: 220226 - DNA, 16 bp, P. troglodytes
cacagtgtgggagcag

SEQ ID NO: 220227 - DNA, 16 bp, P. troglodytes
cacagttcctggcaca

SEQ ID NO: 220228 - DNA, 16 bp, P. troglodytes
cacagttctggaggat

SEQ ID NO: 220229 - DNA, 16 bp, P. troglodytes
cacagttgtaatccca

SEQ ID NO: 220230 - DNA, 16 bp, P. troglodytes
cacagtttatccattc

SEQ ID NO: 220231 - DNA, 16 bp, P. troglodytes
cacagtttctttattc

SEQ ID NO: 220232 - DNA, 16 bp, P. troglodytes
cacagtttcttttttt

SEQ ID NO: 220233 - DNA, 16 bp, P. troglodytes
cacagttttatttctt

SEQ ID NO: 220234 - DNA, 16 bp, P. troglodytes
cacataaaaattattt

SEQ ID NO: 220235 - DNA, 16 bp, P. troglodytes
cacataaactagaaaa

SEQ ID NO: 220236 - DNA, 16 bp, P. troglodytes
cacataaactttgggg

SEQ ID NO: 220237 - DNA, 16 bp, P. troglodytes
cacataaatatatttt

SEQ ID NO: 220238 - DNA, 16 bp, P. troglodytes
cacataacataaaatt

SEQ ID NO: 220239 - DNA, 16 bp, P. troglodytes
cacataagaactcaca

SEQ ID NO: 220240 - DNA, 16 bp, P. troglodytes
cacatacaaaatacat

SEQ ID NO: 220241 - DNA, 16 bp, P. troglodytes
cacatacaaatggaaa

SEQ ID NO: 220242 - DNA, 16 bp, P. troglodytes
cacatacaattatgta

SEQ ID NO: 220243 - DNA, 16 bp, P. troglodytes
cacatacacacacata

SEQ ID NO: 220244 - DNA, 16 bp, P. troglodytes
cacatacacacattca

SEQ ID NO: 220245 - DNA, 16 bp, P. troglodytes
cacatacacatatata

SEQ ID NO: 220246 - DNA, 16 bp, P. troglodytes
cacatacagaaaaatg

SEQ ID NO: 220247 - DNA, 16 bp, P. troglodytes
cacatacatacactca

SEQ ID NO: 220248 - DNA, 16 bp, P. troglodytes
cacatacatgcacaca

SEQ ID NO: 220249 - DNA, 16 bp, P. troglodytes
cacatagacacaggga

SEQ ID NO: 220250 - DNA, 16 bp, P. troglodytes
cacatagtagatgctc

SEQ ID NO: 220251 - DNA, 16 bp, P. troglodytes
cacatagtaggtactc

SEQ ID NO: 220252 - DNA, 16 bp, P. troglodytes
cacatagttatctttt

SEQ ID NO: 220253 - DNA, 16 bp, P. troglodytes
cacatatacaatggtg

SEQ ID NO: 220254 - DNA, 16 bp, P. troglodytes
cacatatacatatact

SEQ ID NO: 220255 - DNA, 16 bp, P. troglodytes
cacatatacattttta

SEQ ID NO: 220256 - DNA, 16 bp, P. troglodytes
cacatataccaaaatc

SEQ ID NO: 220257 - DNA, 16 bp, P. troglodytes
cacatatatacacaca

SEQ ID NO: 220258 - DNA, 16 bp, P. troglodytes
cacatatatacatatg

SEQ ID NO: 220259 - DNA, 16 bp, P. troglodytes
cacatatatagtgtgt

SEQ ID NO: 220260 - DNA, 16 bp, P. troglodytes
cacatatatgtgtgtg

SEQ ID NO: 220261 - DNA, 16 bp, P. troglodytes
cacatatcatataatt

SEQ ID NO: 220262 - DNA, 16 bp, P. troglodytes
cacatatctctgtttt

SEQ ID NO: 220263 - DNA, 16 bp, P. troglodytes
cacatatgcacacaga

SEQ ID NO: 220264 - DNA, 16 bp, P. troglodytes
cacatatgcacataca

SEQ ID NO: 220265 - DNA, 16 bp, P. troglodytes
cacatatgcatatgtg

SEQ ID NO: 220266 - DNA, 16 bp, P. troglodytes
cacatatttaaaatgt

SEQ ID NO: 220267 - DNA, 16 bp, P. troglodytes
cacatatttaaaattt

SEQ ID NO: 220268 - DNA, 16 bp, P. troglodytes
cacatatttatataca

SEQ ID NO: 220269 - DNA, 16 bp, P. troglodytes
cacatatttattttct

SEQ ID NO: 220270 - DNA, 16 bp, P. troglodytes
cacatatttttctctt

SEQ ID NO: 220271 - DNA, 16 bp, P. troglodytes
cacatcaaagagctta

SEQ ID NO: 220272 - DNA, 16 bp, P. troglodytes
cacatcaataaatgtg

SEQ ID NO: 220273 - DNA, 16 bp, P. troglodytes
cacatcacaaaccagt

SEQ ID NO: 220274 - DNA, 16 bp, P. troglodytes
cacatcacatcacatc

SEQ ID NO: 220275 - DNA, 16 bp, P. troglodytes
cacatcagagtaaatg

SEQ ID NO: 220276 - DNA, 16 bp, P. troglodytes
cacatcagcagaggaa

SEQ ID NO: 220277 - DNA, 16 bp, P. troglodytes
cacatcagcctcccaa

SEQ ID NO: 220278 - DNA, 16 bp, P. troglodytes
cacatccacatccaca

SEQ ID NO: 220279 - DNA, 16 bp, P. troglodytes
cacatcccaaagaagt

SEQ ID NO: 220280 - DNA, 16 bp, P. troglodytes
cacatcctcacatttc

SEQ ID NO: 220281 - DNA, 16 bp, P. troglodytes
cacatcctcatcagca

SEQ ID NO: 220282 - DNA, 16 bp, P. troglodytes
cacatcctctgcagca

SEQ ID NO: 220283 - DNA, 16 bp, P. troglodytes
cacatcctcttgtata

SEQ ID NO: 220284 - DNA, 16 bp, P. troglodytes
cacatcctggccagca

SEQ ID NO: 220285 - DNA, 16 bp, P. troglodytes
cacatccttgtcaaca

SEQ ID NO: 220286 - DNA, 19 bp, P. troglodytes
cacatctacaactatctga

SEQ ID NO: 220287 - DNA, 16 bp, P. troglodytes
cacatctcaaagaagt

SEQ ID NO: 220288 - DNA, 16 bp, P. troglodytes
cacatctgaagccagc

SEQ ID NO: 220289 - DNA, 16 bp, P. troglodytes
cacatcttacacggtg

SEQ ID NO: 220290 - DNA, 16 bp, P. troglodytes
cacatcttctccaaca

SEQ ID NO: 220291 - DNA, 16 bp, P. troglodytes
cacatctttgtcaaca

SEQ ID NO: 220292 - DNA, 16 bp, P. troglodytes
cacatgaagtccttgc

SEQ ID NO: 220293 - DNA, 16 bp, P. troglodytes
cacatgacagcaggag

SEQ ID NO: 220294 - DNA, 16 bp, P. troglodytes
cacatgatattttgat

SEQ ID NO: 220295 - DNA, 16 bp, P. troglodytes
cacatgcaaaatacat

SEQ ID NO: 220296 - DNA, 16 bp, P. troglodytes
cacatgcaaacataca

SEQ ID NO: 220297 - DNA, 16 bp, P. troglodytes
cacatgcacacaaaca

SEQ ID NO: 220298 - DNA, 16 bp, P. troglodytes
cacatgcacacacaac

SEQ ID NO: 220299 - DNA, 16 bp, P. troglodytes
cacatgcacacaggaa

SEQ ID NO: 220300 - DNA, 16 bp, P. troglodytes
cacatgcacacccaca

SEQ ID NO: 220301 - DNA, 16 bp, P. troglodytes
cacatgcacactcaca

SEQ ID NO: 220302 - DNA, 16 bp, P. troglodytes
cacatgcacatatatg

SEQ ID NO: 220303 - DNA, 16 bp, P. troglodytes
cacatgcacatgtatt

SEQ ID NO: 220304 - DNA, 16 bp, P. troglodytes
cacatgcaccccagaa

SEQ ID NO: 220305 - DNA, 16 bp, P. troglodytes
cacatgcagacacaca

SEQ ID NO: 220306 - DNA, 16 bp, P. troglodytes
cacatgccaccaggcc

SEQ ID NO: 220307 - DNA, 16 bp, P. troglodytes
cacatgccatggtagt

SEQ ID NO: 220308 - DNA, 16 bp, P. troglodytes
cacatgccgccatgcc

SEQ ID NO: 220309 - DNA, 16 bp, P. troglodytes
cacatgctcacacaca

SEQ ID NO: 220310 - DNA, 17 bp, P. troglodytes
cacatgctctacaaaca

SEQ ID NO: 220311 - DNA, 16 bp, P. troglodytes
cacatgctcttccctc

SEQ ID NO: 220312 - DNA, 16 bp, P. troglodytes
cacatgctgttgggaa

SEQ ID NO: 220313 - DNA, 16 bp, P. troglodytes
cacatggaactgtaag

SEQ ID NO: 220314 - DNA, 16 bp, P. troglodytes
cacatggaatcaacct

SEQ ID NO: 220315 - DNA, 16 bp, P. troglodytes
cacatggacacaagga

SEQ ID NO: 220316 - DNA, 16 bp, P. troglodytes
cacatggacacacgga

SEQ ID NO: 220317 - DNA, 16 bp, P. troglodytes
cacatggacactggga

SEQ ID NO: 220318 - DNA, 17 bp, P. troglodytes
cacatggacataggaag

SEQ ID NO: 220319 - DNA, 16 bp, P. troglodytes
cacatggatgaaggcc

SEQ ID NO: 220320 - DNA, 16 bp, P. troglodytes
cacatggccttctccc

SEQ ID NO: 220321 - DNA, 16 bp, P. troglodytes
cacatggccttctctc

SEQ ID NO: 220322 - DNA, 16 bp, P. troglodytes
cacatggctggagagg

SEQ ID NO: 220323 - DNA, 16 bp, P. troglodytes
cacatggctgggcagg

SEQ ID NO: 220324 - DNA, 16 bp, P. troglodytes
cacatgggacattctc

SEQ ID NO: 220325 - DNA, 16 bp, P. troglodytes
cacatgggctcagcaa

SEQ ID NO: 220326 - DNA, 16 bp, P. troglodytes
cacatggtgaaagggg

SEQ ID NO: 220327 - DNA, 16 bp, P. troglodytes
cacatggtgagagtgg

SEQ ID NO: 220328 - DNA, 16 bp, P. troglodytes
cacatggtggaagaga

SEQ ID NO: 220329 - DNA, 17 bp, P. troglodytes
cacatggtgttgagcct

SEQ ID NO: 220330 - DNA, 16 bp, P. troglodytes
cacatggttgaactag

SEQ ID NO: 220331 - DNA, 16 bp, P. troglodytes
cacatgtacacacaca

SEQ ID NO: 220332 - DNA, 16 bp, P. troglodytes
cacatgtacaccctga

SEQ ID NO: 220333 - DNA, 16 bp, P. troglodytes
cacatgtatacacaca

SEQ ID NO: 220334 - DNA, 16 bp, P. troglodytes
cacatgtattccaaaa

SEQ ID NO: 220335 - DNA, 16 bp, P. troglodytes
cacatgtcatcaggac

SEQ ID NO: 220336 - DNA, 16 bp, P. troglodytes
cacatgtctacctatg

SEQ ID NO: 220337 - DNA, 16 bp, P. troglodytes
cacatgtgcacacaca

SEQ ID NO: 220338 - DNA, 16 bp, P. troglodytes
cacatgtggctagtga

SEQ ID NO: 220339 - DNA, 16 bp, P. troglodytes
cacatgtgtatgcaca

SEQ ID NO: 220340 - DNA, 16 bp, P. troglodytes
cacatgtgtctgtgtg

SEQ ID NO: 220341 - DNA, 16 bp, P. troglodytes
cacatgtgtgtgcaca

SEQ ID NO: 220342 - DNA, 16 bp, P. troglodytes
cacatgtgtgtgcatg

SEQ ID NO: 220343 - DNA, 16 bp, P. troglodytes
cacatgttgaaatcct

SEQ ID NO: 220344 - DNA, 16 bp, P. troglodytes
cacattacatttagtc

SEQ ID NO: 220345 - DNA, 16 bp, P. troglodytes
cacattacctgatttt

SEQ ID NO: 220346 - DNA, 16 bp, P. troglodytes
cacattcacacacaca

SEQ ID NO: 220347 - DNA, 16 bp, P. troglodytes
cacattcacacatgca

SEQ ID NO: 220348 - DNA, 16 bp, P. troglodytes
cacattcagaccatag

SEQ ID NO: 220349 - DNA, 16 bp, P. troglodytes
cacattcctcatttgg

SEQ ID NO: 220350 - DNA, 16 bp, P. troglodytes
cacattctacaaaaag

SEQ ID NO: 220351 - DNA, 16 bp, P. troglodytes
cacattctcccatata

SEQ ID NO: 220352 - DNA, 16 bp, P. troglodytes
cacattcttctgccat

SEQ ID NO: 220353 - DNA, 16 bp, P. troglodytes
cacattgattttgaat

SEQ ID NO: 220354 - DNA, 16 bp, P. troglodytes
cacattgcaaagcagt

SEQ ID NO: 220355 - DNA, 16 bp, P. troglodytes
cacattggaagaagaa

SEQ ID NO: 220356 - DNA, 16 bp, P. troglodytes
cacattgtcttaatta

SEQ ID NO: 220357 - DNA, 16 bp, P. troglodytes
cacattgtcttccaca

SEQ ID NO: 220358 - DNA, 16 bp, P. troglodytes
cacatttaaaatgatt

SEQ ID NO: 220359 - DNA, 16 bp, P. troglodytes
cacatttaaagcagtg

SEQ ID NO: 220360 - DNA, 16 bp, P. troglodytes
cacatttcaacatgag

SEQ ID NO: 220361 - DNA, 16 bp, P. troglodytes
cacatttcaagtgctt

SEQ ID NO: 220362 - DNA, 16 bp, P. troglodytes
cacatttctcatttgg

SEQ ID NO: 220363 - DNA, 16 bp, P. troglodytes
cacatttgaaaacaca

SEQ ID NO: 220364 - DNA, 16 bp, P. troglodytes
cacattttaaattctt

SEQ ID NO: 220365 - DNA, 16 bp, P. troglodytes
cacattttaaatttta

SEQ ID NO: 220366 - DNA, 16 bp, P. troglodytes
cacattttaagtgctt

SEQ ID NO: 220367 - DNA, 16 bp, P. troglodytes
cacattttacatgtga

SEQ ID NO: 220368 - DNA, 16 bp, P. troglodytes
cacattttcctctctt

SEQ ID NO: 220369 - DNA, 16 bp, P. troglodytes
cacattttgagaacca

SEQ ID NO: 220370 - DNA, 16 bp, P. troglodytes
cacattttgtttgttt

SEQ ID NO: 220371 - DNA, 16 bp, P. troglodytes
cacatttttgtgcttt

SEQ ID NO: 220372 - DNA, 16 bp, P. troglodytes
cacattttttgttgtt

SEQ ID NO: 220373 - DNA, 16 bp, P. troglodytes
cacatttttttttcca

SEQ ID NO: 220374 - DNA, 16 bp, P. troglodytes
caccaaaaactggaaa

SEQ ID NO: 220375 - DNA, 16 bp, P. troglodytes
caccaaacaacagatt

SEQ ID NO: 220376 - DNA, 16 bp, P. troglodytes
caccaaagaagataaa

SEQ ID NO: 220377 - DNA, 16 bp, P. troglodytes
caccaaagcaatggca

SEQ ID NO: 220378 - DNA, 16 bp, P. troglodytes
caccaacagtgaacaa

SEQ ID NO: 220379 - DNA, 16 bp, P. troglodytes
caccaacatggtgaaa

SEQ ID NO: 220380 - DNA, 17 bp, P. troglodytes
caccaacttaaaaagga

SEQ ID NO: 220381 - DNA, 16 bp, P. troglodytes
caccaagaacagcacc

SEQ ID NO: 220382 - DNA, 16 bp, P. troglodytes
caccaagcagcagaca

SEQ ID NO: 220383 - DNA, 16 bp, P. troglodytes
caccaagccattcatg

SEQ ID NO: 220384 - DNA, 18 bp, P. troglodytes
caccaagcccggctaatt

SEQ ID NO: 220385 - DNA, 16 bp, P. troglodytes
caccaagcctggcctc

SEQ ID NO: 220386 - DNA, 16 bp, P. troglodytes
caccaagctcaagtgt

SEQ ID NO: 220387 - DNA, 16 bp, P. troglodytes
caccaaggattgccag

SEQ ID NO: 220388 - DNA, 16 bp, P. troglodytes
caccaaggcaagaacc

SEQ ID NO: 220389 - DNA, 16 bp, P. troglodytes
caccaaggctgcagtg

SEQ ID NO: 220390 - DNA, 16 bp, P. troglodytes
caccaaggctggaggg

SEQ ID NO: 220391 - DNA, 16 bp, P. troglodytes
caccaagggaagactg

SEQ ID NO: 220392 - DNA, 16 bp, P. troglodytes
caccaaggtggaaatg

SEQ ID NO: 220393 - DNA, 18 bp, P. troglodytes
caccaatcagcaccctgt

SEQ ID NO: 220394 - DNA, 17 bp, P. troglodytes
caccaatcagcgccctg

SEQ ID NO: 220395 - DNA, 16 bp, P. troglodytes
caccaatggcctcatg

SEQ ID NO: 220396 - DNA, 16 bp, P. troglodytes
caccacaacctccagc

SEQ ID NO: 220397 - DNA, 16 bp, P. troglodytes
caccacaacctctgct

SEQ ID NO: 220398 - DNA, 16 bp, P. troglodytes
caccacaatgcccggc

SEQ ID NO: 220399 - DNA, 16 bp, P. troglodytes
caccacacacagctaa

SEQ ID NO: 220400 - DNA, 16 bp, P. troglodytes
caccacaccactgcac

SEQ ID NO: 220401 - DNA, 16 bp, P. troglodytes
caccacacccagcagt

SEQ ID NO: 220402 - DNA, 16 bp, P. troglodytes
caccacacccagccat

SEQ ID NO: 220403 - DNA, 16 bp, P. troglodytes
caccacacccagctaa

SEQ ID NO: 220404 - DNA, 16 bp, P. troglodytes
caccacacccagctat

SEQ ID NO: 220405 - DNA, 16 bp, P. troglodytes
caccacacccagcttc

SEQ ID NO: 220406 - DNA, 16 bp, P. troglodytes
caccacaccctgccag

SEQ ID NO: 220407 - DNA, 16 bp, P. troglodytes
caccacacctggcaaa

SEQ ID NO: 220408 - DNA, 16 bp, P. troglodytes
caccacacctggcatg

SEQ ID NO: 220409 - DNA, 16 bp, P. troglodytes
caccacacctggctga

SEQ ID NO: 220410 - DNA, 16 bp, P. troglodytes
caccacacctggctta

SEQ ID NO: 220411 - DNA, 16 bp, P. troglodytes
caccacactcagccct

SEQ ID NO: 220412 - DNA, 16 bp, P. troglodytes
caccacactgtcttcc

SEQ ID NO: 220413 - DNA, 20 bp, P. troglodytes
caccacagccggctaatttt

SEQ ID NO: 220414 - DNA, 16 bp, P. troglodytes
caccacagcctccact

SEQ ID NO: 220415 - DNA, 16 bp, P. troglodytes
caccacagcctctgcc

SEQ ID NO: 220416 - DNA, 16 bp, P. troglodytes
caccacagctcaagaa

SEQ ID NO: 220417 - DNA, 16 bp, P. troglodytes
caccacagctggccaa

SEQ ID NO: 220418 - DNA, 16 bp, P. troglodytes
caccacagctggctaa

SEQ ID NO: 220419 - DNA, 16 bp, P. troglodytes
caccacatctggacaa

SEQ ID NO: 220420 - DNA, 16 bp, P. troglodytes
caccacatggcacata

SEQ ID NO: 220421 - DNA, 16 bp, P. troglodytes
caccacattggccaag

SEQ ID NO: 220422 - DNA, 16 bp, P. troglodytes
caccaccaagccctgc

SEQ ID NO: 220423 - DNA, 16 bp, P. troglodytes
caccaccaagcctggc

SEQ ID NO: 220424 - DNA, 16 bp, P. troglodytes
caccaccaagcctggt

SEQ ID NO: 220425 - DNA, 16 bp, P. troglodytes
caccaccaagctcagc

SEQ ID NO: 220426 - DNA, 16 bp, P. troglodytes
caccaccacacttggc

SEQ ID NO: 220427 - DNA, 16 bp, P. troglodytes
caccaccaccatgcct

SEQ ID NO: 220428 - DNA, 16 bp, P. troglodytes
caccaccacgcccagg

SEQ ID NO: 220429 - DNA, 16 bp, P. troglodytes
caccaccacgcttggc

SEQ ID NO: 220430 - DNA, 16 bp, P. troglodytes
caccaccagcagcagc

SEQ ID NO: 220431 - DNA, 16 bp, P. troglodytes
caccaccagccctgcc

SEQ ID NO: 220432 - DNA, 16 bp, P. troglodytes
caccaccagctctcct

SEQ ID NO: 220433 - DNA, 16 bp, P. troglodytes
caccaccaggcctggc

SEQ ID NO: 220434 - DNA, 16 bp, P. troglodytes
caccaccaggtccagc

SEQ ID NO: 220435 - DNA, 16 bp, P. troglodytes
caccaccatcatcact

SEQ ID NO: 220436 - DNA, 16 bp, P. troglodytes
caccaccatcatcatc

SEQ ID NO: 220437 - DNA, 16 bp, P. troglodytes
caccaccatccagctc

SEQ ID NO: 220438 - DNA, 16 bp, P. troglodytes
caccaccatccatctc

SEQ ID NO: 220439 - DNA, 16 bp, P. troglodytes
caccaccatgcccagt

SEQ ID NO: 220440 - DNA, 16 bp, P. troglodytes
caccaccatgtccagc

SEQ ID NO: 220441 - DNA, 16 bp, P. troglodytes
caccaccccagctaat

SEQ ID NO: 220442 - DNA, 16 bp, P. troglodytes
caccacccctggctaa

SEQ ID NO: 220443 - DNA, 16 bp, P. troglodytes
caccacccgggttcaa

SEQ ID NO: 220444 - DNA, 16 bp, P. troglodytes
caccaccctgtcttcc

SEQ ID NO: 220445 - DNA, 16 bp, P. troglodytes
caccaccgtgcccggc

SEQ ID NO: 220446 - DNA, 16 bp, P. troglodytes
caccacctccaccaga

SEQ ID NO: 220447 - DNA, 16 bp, P. troglodytes
caccacctcctccagc

SEQ ID NO: 220448 - DNA, 16 bp, P. troglodytes
caccacctcctccagg

SEQ ID NO: 220449 - DNA, 16 bp, P. troglodytes
caccacctgacaggcc

SEQ ID NO: 220450 - DNA, 16 bp, P. troglodytes
caccacctgctcccca

SEQ ID NO: 220451 - DNA, 16 bp, P. troglodytes
caccacctgttcccaa

SEQ ID NO: 220452 - DNA, 16 bp, P. troglodytes
caccacctgtttccca

SEQ ID NO: 220453 - DNA, 16 bp, P. troglodytes
caccacgaccagctaa

SEQ ID NO: 220454 - DNA, 16 bp, P. troglodytes
caccacgcccagctaa

SEQ ID NO: 220455 - DNA, 16 bp, P. troglodytes
caccacgcccagctac

SEQ ID NO: 220456 - DNA, 16 bp, P. troglodytes
caccacgcccagctag

SEQ ID NO: 220457 - DNA, 16 bp, P. troglodytes
caccacgcccagctga

SEQ ID NO: 220458 - DNA, 16 bp, P. troglodytes
caccacgcccagtcaa

SEQ ID NO: 220459 - DNA, 16 bp, P. troglodytes
caccacgcccggctga

SEQ ID NO: 220460 - DNA, 17 bp, P. troglodytes
caccacgcccggctgag

SEQ ID NO: 220461 - DNA, 16 bp, P. troglodytes
caccacgcccggcttc

SEQ ID NO: 220462 - DNA, 16 bp, P. troglodytes
caccacgccctgcctg

SEQ ID NO: 220463 - DNA, 16 bp, P. troglodytes
caccacgcctagccca

SEQ ID NO: 220464 - DNA, 16 bp, P. troglodytes
caccacgcctggcaat

SEQ ID NO: 220465 - DNA, 16 bp, P. troglodytes
caccacgcctggcaca

SEQ ID NO: 220466 - DNA, 17 bp, P. troglodytes
caccacgcctggctaaa

SEQ ID NO: 220467 - DNA, 17 bp, P. troglodytes
caccacgcctggctaat

SEQ ID NO: 220468 - DNA, 16 bp, P. troglodytes
caccacgcctggctac

SEQ ID NO: 220469 - DNA, 16 bp, P. troglodytes
caccacgcctggctga

SEQ ID NO: 220470 - DNA, 16 bp, P. troglodytes
caccacgcctggctgg

SEQ ID NO: 220471 - DNA, 16 bp, P. troglodytes
caccacgcctggctta

SEQ ID NO: 220472 - DNA, 16 bp, P. troglodytes
caccacgctcagcctg

SEQ ID NO: 220473 - DNA, 18 bp, P. troglodytes
caccacgctggctaattt

SEQ ID NO: 220474 - DNA, 16 bp, P. troglodytes
caccacggcactccag

SEQ ID NO: 220475 - DNA, 16 bp, P. troglodytes
caccactaggcctggc

SEQ ID NO: 220476 - DNA, 16 bp, P. troglodytes
caccactcccggccct

SEQ ID NO: 220477 - DNA, 16 bp, P. troglodytes
caccactgacattttg

SEQ ID NO: 220478 - DNA, 16 bp, P. troglodytes
caccactgcactaaag

SEQ ID NO: 220479 - DNA, 16 bp, P. troglodytes
caccactgcactccac

SEQ ID NO: 220480 - DNA, 21 bp, P. troglodytes
caccactgcactccagcctgt

SEQ ID NO: 220481 - DNA, 16 bp, P. troglodytes
caccactgcactctgg

SEQ ID NO: 220482 - DNA, 16 bp, P. troglodytes
caccactgcactgtgg

SEQ ID NO: 220483 - DNA, 16 bp, P. troglodytes
caccactgcatgccag

SEQ ID NO: 220484 - DNA, 16 bp, P. troglodytes
caccactgctctccaa

SEQ ID NO: 220485 - DNA, 16 bp, P. troglodytes
caccactgctctccag

SEQ ID NO: 220486 - DNA, 16 bp, P. troglodytes
caccactgctgaggct

SEQ ID NO: 220487 - DNA, 16 bp, P. troglodytes
caccactggacttcag

SEQ ID NO: 220488 - DNA, 16 bp, P. troglodytes
caccactgtaccccag

SEQ ID NO: 220489 - DNA, 16 bp, P. troglodytes
caccactgtattccag

SEQ ID NO: 220490 - DNA, 16 bp, P. troglodytes
caccactgtccttcca

SEQ ID NO: 220491 - DNA, 16 bp, P. troglodytes
caccactgtgccaggc

SEQ ID NO: 220492 - DNA, 16 bp, P. troglodytes
caccacttgttgaaaa

SEQ ID NO: 220493 - DNA, 16 bp, P. troglodytes
caccagaagcaaatgc

SEQ ID NO: 220494 - DNA, 16 bp, P. troglodytes
caccagaagcagatgc

SEQ ID NO: 220495 - DNA, 16 bp, P. troglodytes
caccagaatctcagaa

SEQ ID NO: 220496 - DNA, 16 bp, P. troglodytes
caccagaggccaggag

SEQ ID NO: 220497 - DNA, 16 bp, P. troglodytes
caccagagtgaacagg

SEQ ID NO: 220498 - DNA, 16 bp, P. troglodytes
caccagatgcagatgc

SEQ ID NO: 220499 - DNA, 16 bp, P. troglodytes
caccagcaatgtataa

SEQ ID NO: 220500 - DNA, 16 bp, P. troglodytes
caccagcaatgtatga

SEQ ID NO: 220501 - DNA, 16 bp, P. troglodytes
caccagcagaggctac

SEQ ID NO: 220502 - DNA, 16 bp, P. troglodytes
caccagcagcagcagc

SEQ ID NO: 220503 - DNA, 16 bp, P. troglodytes
caccagcaggcctgcc

SEQ ID NO: 220504 - DNA, 16 bp, P. troglodytes
caccagcatctgcttc

SEQ ID NO: 220505 - DNA, 16 bp, P. troglodytes
caccagccccctgctg

SEQ ID NO: 220506 - DNA, 16 bp, P. troglodytes
caccagcctgagcaac

SEQ ID NO: 220507 - DNA, 16 bp, P. troglodytes
caccagcctgcccaac

SEQ ID NO: 220508 - DNA, 19 bp, P. troglodytes
caccagcctggccaacgtg

SEQ ID NO: 220509 - DNA, 16 bp, P. troglodytes
caccagcctgggcgac

SEQ ID NO: 220510 - DNA, 16 bp, P. troglodytes
caccagcctgggctac

SEQ ID NO: 220511 - DNA, 16 bp, P. troglodytes
caccaggaccctgggt

SEQ ID NO: 220512 - DNA, 18 bp, P. troglodytes
caccaggagattatatcc

SEQ ID NO: 220513 - DNA, 16 bp, P. troglodytes
caccaggcagtgcccc

SEQ ID NO: 220514 - DNA, 18 bp, P. troglodytes
caccaggcccggctaatt

SEQ ID NO: 220515 - DNA, 16 bp, P. troglodytes
caccaggcctggccag

SEQ ID NO: 220516 - DNA, 16 bp, P. troglodytes
caccaggcctggccca

SEQ ID NO: 220517 - DNA, 16 bp, P. troglodytes
caccaggcctggcccc

SEQ ID NO: 220518 - DNA, 16 bp, P. troglodytes
caccaggcctggcctc

SEQ ID NO: 220519 - DNA, 16 bp, P. troglodytes
caccaggctccacctc

SEQ ID NO: 220520 - DNA, 16 bp, P. troglodytes
caccaggctgcagcct

SEQ ID NO: 220521 - DNA, 16 bp, P. troglodytes
caccagggacctgttt

SEQ ID NO: 220522 - DNA, 16 bp, P. troglodytes
caccagggactgttgt

SEQ ID NO: 220523 - DNA, 16 bp, P. troglodytes
caccagggatcagttt

SEQ ID NO: 220524 - DNA, 16 bp, P. troglodytes
caccagggcctgtcaa

SEQ ID NO: 220525 - DNA, 16 bp, P. troglodytes
caccagggcctgttgc

SEQ ID NO: 220526 - DNA, 16 bp, P. troglodytes
caccaggtccagctaa

SEQ ID NO: 220527 - DNA, 16 bp, P. troglodytes
caccagtcagaacagc

SEQ ID NO: 220528 - DNA, 16 bp, P. troglodytes
caccagtcccactccc

SEQ ID NO: 220529 - DNA, 16 bp, P. troglodytes
caccagtgatttgcca

SEQ ID NO: 220530 - DNA, 16 bp, P. troglodytes
caccagttagaatggc

SEQ ID NO: 220531 - DNA, 16 bp, P. troglodytes
caccatacccagccca

SEQ ID NO: 220532 - DNA, 16 bp, P. troglodytes
caccatacccagcccc

SEQ ID NO: 220533 - DNA, 16 bp, P. troglodytes
caccatacccagctac

SEQ ID NO: 220534 - DNA, 16 bp, P. troglodytes
caccatacctggcccc

SEQ ID NO: 220535 - DNA, 16 bp, P. troglodytes
caccatagctcactgc

SEQ ID NO: 220536 - DNA, 16 bp, P. troglodytes
caccatatacaataat

SEQ ID NO: 220537 - DNA, 16 bp, P. troglodytes
caccatatgaggacac

SEQ ID NO: 220538 - DNA, 16 bp, P. troglodytes
caccatcatcaaacac

SEQ ID NO: 220539 - DNA, 16 bp, P. troglodytes
caccatcatcaagtgg

SEQ ID NO: 220540 - DNA, 16 bp, P. troglodytes
caccatcatcatcttc

SEQ ID NO: 220541 - DNA, 16 bp, P. troglodytes
caccatcatctcttgc

SEQ ID NO: 220542 - DNA, 16 bp, P. troglodytes
caccatcatcttcatc

SEQ ID NO: 220543 - DNA, 16 bp, P. troglodytes
caccatccctcatggc

SEQ ID NO: 220544 - DNA, 16 bp, P. troglodytes
caccatccctggcctc

SEQ ID NO: 220545 - DNA, 16 bp, P. troglodytes
caccatcctccagact

SEQ ID NO: 220546 - DNA, 16 bp, P. troglodytes
caccatcctgactgaa

SEQ ID NO: 220547 - DNA, 17 bp, P. troglodytes
caccatcctggctaaca

SEQ ID NO: 220548 - DNA, 16 bp, P. troglodytes
caccatctcagcccaa

SEQ ID NO: 220549 - DNA, 16 bp, P. troglodytes
caccatctgttcccca

SEQ ID NO: 220550 - DNA, 16 bp, P. troglodytes
caccatcttcttggtt

SEQ ID NO: 220551 - DNA, 16 bp, P. troglodytes
caccatcttgctgatg

SEQ ID NO: 220552 - DNA, 16 bp, P. troglodytes
caccatcttggaagca

SEQ ID NO: 220553 - DNA, 16 bp, P. troglodytes
caccatcttggcctgg

SEQ ID NO: 220554 - DNA, 16 bp, P. troglodytes
caccatgaagaaactg

SEQ ID NO: 220555 - DNA, 16 bp, P. troglodytes
caccatgactggcctg

SEQ ID NO: 220556 - DNA, 16 bp, P. troglodytes
caccatgatcttggac

SEQ ID NO: 220557 - DNA, 16 bp, P. troglodytes
caccatgatgaccagg

SEQ ID NO: 220558 - DNA, 16 bp, P. troglodytes
caccatgattgtgttt

SEQ ID NO: 220559 - DNA, 16 bp, P. troglodytes
caccatgcacacacac

SEQ ID NO: 220560 - DNA, 16 bp, P. troglodytes
caccatgccaggccca

SEQ ID NO: 220561 - DNA, 16 bp, P. troglodytes
caccatgccaggctaa

SEQ ID NO: 220562 - DNA, 16 bp, P. troglodytes
caccatgcccaaccag

SEQ ID NO: 220563 - DNA, 16 bp, P. troglodytes
caccatgcccagcaat

SEQ ID NO: 220564 - DNA, 16 bp, P. troglodytes
caccatgcccagcatt

SEQ ID NO: 220565 - DNA, 16 bp, P. troglodytes
caccatgcccagccac

SEQ ID NO: 220566 - DNA, 16 bp, P. troglodytes
caccatgcccagcccc

SEQ ID NO: 220567 - DNA, 16 bp, P. troglodytes
caccatgcccagcctg

SEQ ID NO: 220568 - DNA, 16 bp, P. troglodytes
caccatgcccagctaa

SEQ ID NO: 220569 - DNA, 16 bp, P. troglodytes
caccatgcccagctac

SEQ ID NO: 220570 - DNA, 16 bp, P. troglodytes
caccatgcccagctag

SEQ ID NO: 220571 - DNA, 16 bp, P. troglodytes
caccatgcccaggcta

SEQ ID NO: 220572 - DNA, 17 bp, P. troglodytes
caccatgcccggccagt

SEQ ID NO: 220573 - DNA, 17 bp, P. troglodytes
caccatgcccggctaat

SEQ ID NO: 220574 - DNA, 18 bp, P. troglodytes
caccatgcccggctaatt

SEQ ID NO: 220575 - DNA, 16 bp, P. troglodytes
caccatgcccggctac

SEQ ID NO: 220576 - DNA, 16 bp, P. troglodytes
caccatgccctgctaa

SEQ ID NO: 220577 - DNA, 16 bp, P. troglodytes
caccatgccctggcta

SEQ ID NO: 220578 - DNA, 16 bp, P. troglodytes
caccatgcctagccct

SEQ ID NO: 220579 - DNA, 16 bp, P. troglodytes
caccatgcctggataa

SEQ ID NO: 220580 - DNA, 16 bp, P. troglodytes
caccatgcctggctaa

SEQ ID NO: 220581 - DNA, 16 bp, P. troglodytes
caccatgcctggctac

SEQ ID NO: 220582 - DNA, 16 bp, P. troglodytes
caccatgcctggctag

SEQ ID NO: 220583 - DNA, 16 bp, P. troglodytes
caccatgcctggctat

SEQ ID NO: 220584 - DNA, 16 bp, P. troglodytes
caccatgcctggctgc

SEQ ID NO: 220585 - DNA, 17 bp, P. troglodytes
caccatgcctggcttaa

SEQ ID NO: 220586 - DNA, 16 bp, P. troglodytes
caccatgctcagccct

SEQ ID NO: 220587 - DNA, 16 bp, P. troglodytes
caccatggagaacagt

SEQ ID NO: 220588 - DNA, 16 bp, P. troglodytes
caccatggcatatgta

SEQ ID NO: 220589 - DNA, 16 bp, P. troglodytes
caccatgtcctgaggc

SEQ ID NO: 220590 - DNA, 16 bp, P. troglodytes
caccatgtgaagaagg

SEQ ID NO: 220591 - DNA, 16 bp, P. troglodytes
caccatgtggcccagg

SEQ ID NO: 220592 - DNA, 16 bp, P. troglodytes
caccatgttagccaag

SEQ ID NO: 220593 - DNA, 16 bp, P. troglodytes
caccatgttcatcagg

SEQ ID NO: 220594 - DNA, 16 bp, P. troglodytes
caccattcctggccta

SEQ ID NO: 220595 - DNA, 16 bp, P. troglodytes
caccattctaatttct

SEQ ID NO: 220596 - DNA, 16 bp, P. troglodytes
caccattctactttct

SEQ ID NO: 220597 - DNA, 16 bp, P. troglodytes
caccattctcctctct

SEQ ID NO: 220598 - DNA, 17 bp, P. troglodytes
caccattgctgaggctt

SEQ ID NO: 220599 - DNA, 16 bp, P. troglodytes
caccatttattaaatg

SEQ ID NO: 220600 - DNA, 16 bp, P. troglodytes
caccatttggcaagtt

SEQ ID NO: 220601 - DNA, 16 bp, P. troglodytes
caccattttatgttcc

SEQ ID NO: 220602 - DNA, 16 bp, P. troglodytes
cacccaaaggaaaaga

SEQ ID NO: 220603 - DNA, 16 bp, P. troglodytes
cacccaaatcaagaaa

SEQ ID NO: 220604 - DNA, 16 bp, P. troglodytes
cacccaaatcacatct

SEQ ID NO: 220605 - DNA, 16 bp, P. troglodytes
cacccaacactggaac

SEQ ID NO: 220606 - DNA, 16 bp, P. troglodytes
cacccaagccagcagc

SEQ ID NO: 220607 - DNA, 16 bp, P. troglodytes
cacccaaggccctcaa

SEQ ID NO: 220608 - DNA, 16 bp, P. troglodytes
cacccacagctgcccc

SEQ ID NO: 220609 - DNA, 16 bp, P. troglodytes
cacccacatgcacaca

SEQ ID NO: 220610 - DNA, 16 bp, P. troglodytes
cacccacattcccttg

SEQ ID NO: 220611 - DNA, 16 bp, P. troglodytes
cacccaccaccatgct

SEQ ID NO: 220612 - DNA, 16 bp, P. troglodytes
cacccacctcagcctt

SEQ ID NO: 220613 - DNA, 17 bp, P. troglodytes
cacccacctcgacctcc

SEQ ID NO: 220614 - DNA, 16 bp, P. troglodytes
cacccacctcgacttc

SEQ ID NO: 220615 - DNA, 18 bp, P. troglodytes
cacccacctcggcctcct

SEQ ID NO: 220616 - DNA, 17 bp, P. troglodytes
cacccacctcggcctct

SEQ ID NO: 220617 - DNA, 17 bp, P. troglodytes
cacccacctcgggctcc

SEQ ID NO: 220618 - DNA, 16 bp, P. troglodytes
cacccacctctgcttc

SEQ ID NO: 220619 - DNA, 16 bp, P. troglodytes
cacccacctggaactc

SEQ ID NO: 220620 - DNA, 16 bp, P. troglodytes
cacccactcattcatc

SEQ ID NO: 220621 - DNA, 16 bp, P. troglodytes
cacccagaactccagc

SEQ ID NO: 220622 - DNA, 16 bp, P. troglodytes
cacccagactggagtc

SEQ ID NO: 220623 - DNA, 16 bp, P. troglodytes
cacccagaggaccacc

SEQ ID NO: 220624 - DNA, 16 bp, P. troglodytes
cacccagcagccagag

SEQ ID NO: 220625 - DNA, 16 bp, P. troglodytes
cacccagccaaaaata

SEQ ID NO: 220626 - DNA, 16 bp, P. troglodytes
cacccagcccagtgcc

SEQ ID NO: 220627 - DNA, 16 bp, P. troglodytes
cacccagcctattctt

SEQ ID NO: 220628 - DNA, 16 bp, P. troglodytes
cacccagcctcctttt

SEQ ID NO: 220629 - DNA, 16 bp, P. troglodytes
cacccagcctcttctt

SEQ ID NO: 220630 - DNA, 16 bp, P. troglodytes
cacccagctaacttct

SEQ ID NO: 220631 - DNA, 16 bp, P. troglodytes
cacccagctaattttt

SEQ ID NO: 220632 - DNA, 16 bp, P. troglodytes
cacccagctgattttt

SEQ ID NO: 220633 - DNA, 16 bp, P. troglodytes
cacccaggatcaatac

SEQ ID NO: 220634 - DNA, 16 bp, P. troglodytes
cacccaggcctggagt

SEQ ID NO: 220635 - DNA, 16 bp, P. troglodytes
cacccaggctctggag

SEQ ID NO: 220636 - DNA, 16 bp, P. troglodytes
cacccaggctgcagca

SEQ ID NO: 220637 - DNA, 16 bp, P. troglodytes
cacccaggctggaatc

SEQ ID NO: 220638 - DNA, 16 bp, P. troglodytes
cacccaggctggaggc

SEQ ID NO: 220639 - DNA, 16 bp, P. troglodytes
cacccaggtgccaagg

SEQ ID NO: 220640 - DNA, 16 bp, P. troglodytes
cacccaggtgggagtg

SEQ ID NO: 220641 - DNA, 16 bp, P. troglodytes
cacccagtccatggta

SEQ ID NO: 220642 - DNA, 16 bp, P. troglodytes
cacccagtgcagtggc

SEQ ID NO: 220643 - DNA, 16 bp, P. troglodytes
cacccatcacccgagt

SEQ ID NO: 220644 - DNA, 21 bp, P. troglodytes
cacccatctcggcctcccaaa

SEQ ID NO: 220645 - DNA, 16 bp, P. troglodytes
cacccatctgtccatc

SEQ ID NO: 220646 - DNA, 16 bp, P. troglodytes
cacccattttacagat

SEQ ID NO: 220647 - DNA, 16 bp, P. troglodytes
caccccaaagatcctg

SEQ ID NO: 220648 - DNA, 16 bp, P. troglodytes
caccccaccacacctg

SEQ ID NO: 220649 - DNA, 16 bp, P. troglodytes
caccccacccagcctg

SEQ ID NO: 220650 - DNA, 16 bp, P. troglodytes
caccccacctggccaa

SEQ ID NO: 220651 - DNA, 16 bp, P. troglodytes
caccccactcctggta

SEQ ID NO: 220652 - DNA, 16 bp, P. troglodytes
caccccagacctgctg

SEQ ID NO: 220653 - DNA, 16 bp, P. troglodytes
caccccagccagggca

SEQ ID NO: 220654 - DNA, 16 bp, P. troglodytes
caccccagcctgggaa

SEQ ID NO: 220655 - DNA, 16 bp, P. troglodytes
caccccagcctgggga

SEQ ID NO: 220656 - DNA, 16 bp, P. troglodytes
caccccagccttcagc

SEQ ID NO: 220657 - DNA, 16 bp, P. troglodytes
cacccccacgcctggc

SEQ ID NO: 220658 - DNA, 16 bp, P. troglodytes
cacccccagatgggac

SEQ ID NO: 220659 - DNA, 16 bp, P. troglodytes
cacccccagccaaggg

SEQ ID NO: 220660 - DNA, 16 bp, P. troglodytes
cacccccagcctgggc

SEQ ID NO: 220661 - DNA, 16 bp, P. troglodytes
caccccccagcagggg

SEQ ID NO: 220662 - DNA, 17 bp, P. troglodytes
cacccccggaggcccag

SEQ ID NO: 220663 - DNA, 16 bp, P. troglodytes
caccccctccatgggc

SEQ ID NO: 220664 - DNA, 16 bp, P. troglodytes
caccccctgacaggcc

SEQ ID NO: 220665 - DNA, 16 bp, P. troglodytes
caccccctgctccagg

SEQ ID NO: 220666 - DNA, 16 bp, P. troglodytes
caccccgcccagcctg

SEQ ID NO: 220667 - DNA, 16 bp, P. troglodytes
cacccctataatccca

SEQ ID NO: 220668 - DNA, 16 bp, P. troglodytes
cacccctcagcaaatg

SEQ ID NO: 220669 - DNA, 16 bp, P. troglodytes
cacccctctcagcctc

SEQ ID NO: 220670 - DNA, 16 bp, P. troglodytes
cacccctgcaccccag

SEQ ID NO: 220671 - DNA, 16 bp, P. troglodytes
cacccctgccagccag

SEQ ID NO: 220672 - DNA, 16 bp, P. troglodytes
cacccctgtcatccca

SEQ ID NO: 220673 - DNA, 16 bp, P. troglodytes
cacccctgtggctttt

SEQ ID NO: 220674 - DNA, 16 bp, P. troglodytes
cacccgccctggcctc

SEQ ID NO: 220675 - DNA, 16 bp, P. troglodytes
cacccgcctcagcatc

SEQ ID NO: 220676 - DNA, 16 bp, P. troglodytes
cacccgcctcggactc

SEQ ID NO: 220677 - DNA, 16 bp, P. troglodytes
cacccgccttgtcctc

SEQ ID NO: 220678 - DNA, 16 bp, P. troglodytes
cacccgctaccacacc

SEQ ID NO: 220679 - DNA, 16 bp, P. troglodytes
cacccggcccattttt

SEQ ID NO: 220680 - DNA, 16 bp, P. troglodytes
cacccgtaatcccagc

SEQ ID NO: 220681 - DNA, 16 bp, P. troglodytes
cacccgtcaccacgcc

SEQ ID NO: 220682 - DNA, 16 bp, P. troglodytes
cacccgtctcagcctc

SEQ ID NO: 220683 - DNA, 16 bp, P. troglodytes
caccctagcctgggca

SEQ ID NO: 220684 - DNA, 16 bp, P. troglodytes
caccctcaaagacaca

SEQ ID NO: 220685 - DNA, 16 bp, P. troglodytes
caccctcacagagccc

SEQ ID NO: 220686 - DNA, 16 bp, P. troglodytes
caccctcaccaacatt

SEQ ID NO: 220687 - DNA, 16 bp, P. troglodytes
caccctccaccctctg

SEQ ID NO: 220688 - DNA, 16 bp, P. troglodytes
caccctccatctcctg

SEQ ID NO: 220689 - DNA, 16 bp, P. troglodytes
caccctctgaagccac

SEQ ID NO: 220690 - DNA, 16 bp, P. troglodytes
caccctctgcagccac

SEQ ID NO: 220691 - DNA, 16 bp, P. troglodytes
caccctctgccatgat

SEQ ID NO: 220692 - DNA, 16 bp, P. troglodytes
caccctgaccaatatg

SEQ ID NO: 220693 - DNA, 16 bp, P. troglodytes
caccctgactcattct

SEQ ID NO: 220694 - DNA, 16 bp, P. troglodytes
caccctgcaaccccca

SEQ ID NO: 220695 - DNA, 16 bp, P. troglodytes
caccctgcccagccag

SEQ ID NO: 220696 - DNA, 16 bp, P. troglodytes
caccctgccctgccac

SEQ ID NO: 220697 - DNA, 16 bp, P. troglodytes
caccctgccctgccct

SEQ ID NO: 220698 - DNA, 16 bp, P. troglodytes
caccctgccctgcttc

SEQ ID NO: 220699 - DNA, 16 bp, P. troglodytes
caccctgcttctgctt

SEQ ID NO: 220700 - DNA, 16 bp, P. troglodytes
caccctggcaacagag

SEQ ID NO: 220701 - DNA, 16 bp, P. troglodytes
caccctggccaagatg

SEQ ID NO: 220702 - DNA, 16 bp, P. troglodytes
caccctgggagacaga

SEQ ID NO: 220703 - DNA, 16 bp, P. troglodytes
caccctgtcaccaggc

SEQ ID NO: 220704 - DNA, 17 bp, P. troglodytes
caccctgtgtctagctc

SEQ ID NO: 220705 - DNA, 16 bp, P. troglodytes
cacccttaagaaggta

SEQ ID NO: 220706 - DNA, 16 bp, P. troglodytes
cacccttccccccaag

SEQ ID NO: 220707 - DNA, 16 bp, P. troglodytes
cacccttttcaacaaa

SEQ ID NO: 220708 - DNA, 16 bp, P. troglodytes
caccgaggcctgttgt

SEQ ID NO: 220709 - DNA, 16 bp, P. troglodytes
caccgcacccagccag

SEQ ID NO: 220710 - DNA, 16 bp, P. troglodytes
caccgcacctgacctg

SEQ ID NO: 220711 - DNA, 16 bp, P. troglodytes
caccgcacctggccta

SEQ ID NO: 220712 - DNA, 16 bp, P. troglodytes
caccgcactccatcct

SEQ ID NO: 220713 - DNA, 16 bp, P. troglodytes
caccgcagcctccacc

SEQ ID NO: 220714 - DNA, 16 bp, P. troglodytes
caccgccaaggtctgc

SEQ ID NO: 220715 - DNA, 16 bp, P. troglodytes
caccgcctatcccaaa

SEQ ID NO: 220716 - DNA, 16 bp, P. troglodytes
caccgcctcctccagc

SEQ ID NO: 220717 - DNA, 16 bp, P. troglodytes
caccgcgccaggccaa

SEQ ID NO: 220718 - DNA, 16 bp, P. troglodytes
caccgcgccccggcct

SEQ ID NO: 220719 - DNA, 16 bp, P. troglodytes
caccgcgcccggcaaa

SEQ ID NO: 220720 - DNA, 16 bp, P. troglodytes
caccgcgcctggctgc

SEQ ID NO: 220721 - DNA, 16 bp, P. troglodytes
caccgctcctggcccc

SEQ ID NO: 220722 - DNA, 16 bp, P. troglodytes
caccggcctcggcctc

SEQ ID NO: 220723 - DNA, 16 bp, P. troglodytes
caccgggcctggccca

SEQ ID NO: 220724 - DNA, 16 bp, P. troglodytes
caccgtgcccaaccta

SEQ ID NO: 220725 - DNA, 16 bp, P. troglodytes
caccgtgcccaacctg

SEQ ID NO: 220726 - DNA, 16 bp, P. troglodytes
caccgtgcccagcacc

SEQ ID NO: 220727 - DNA, 16 bp, P. troglodytes
caccgtgcccggcaac

SEQ ID NO: 220728 - DNA, 16 bp, P. troglodytes
caccgtgcccggccag

SEQ ID NO: 220729 - DNA, 16 bp, P. troglodytes
caccgtgcctggctga

SEQ ID NO: 220730 - DNA, 16 bp, P. troglodytes
caccgtgcctggctgg

SEQ ID NO: 220731 - DNA, 16 bp, P. troglodytes
caccgtggcacacgtt

SEQ ID NO: 220732 - DNA, 16 bp, P. troglodytes
caccgtggctcatgcc

SEQ ID NO: 220733 - DNA, 16 bp, P. troglodytes
caccgtgtctggccaa

SEQ ID NO: 220734 - DNA, 16 bp, P. troglodytes
caccgttctggaggct

SEQ ID NO: 220735 - DNA, 16 bp, P. troglodytes
cacctaccatgcacca

SEQ ID NO: 220736 - DNA, 16 bp, P. troglodytes
cacctactgtatacca

SEQ ID NO: 220737 - DNA, 16 bp, P. troglodytes
cacctactgtgtgccc

SEQ ID NO: 220738 - DNA, 16 bp, P. troglodytes
cacctaggttaattcc

SEQ ID NO: 220739 - DNA, 16 bp, P. troglodytes
cacctattatcccagc

SEQ ID NO: 220740 - DNA, 16 bp, P. troglodytes
cacctcaagcatgtat

SEQ ID NO: 220741 - DNA, 16 bp, P. troglodytes
cacctcagaatgtgac

SEQ ID NO: 220742 - DNA, 16 bp, P. troglodytes
cacctcagactctcaa

SEQ ID NO: 220743 - DNA, 16 bp, P. troglodytes
cacctcagatcatcag

SEQ ID NO: 220744 - DNA, 16 bp, P. troglodytes
cacctcagccctctga

SEQ ID NO: 220745 - DNA, 16 bp, P. troglodytes
cacctcagcctccctg

SEQ ID NO: 220746 - DNA, 19 bp, P. troglodytes
cacctcagcctcctgagta

SEQ ID NO: 220747 - DNA, 24 bp, P. troglodytes
cacctcagcctcctgagtagctgg

SEQ ID NO: 220748 - DNA, 16 bp, P. troglodytes
cacctcagcctctcac

SEQ ID NO: 220749 - DNA, 16 bp, P. troglodytes
cacctcagcctgccaa

SEQ ID NO: 220750 - DNA, 16 bp, P. troglodytes
cacctcagcctggacc

SEQ ID NO: 220751 - DNA, 16 bp, P. troglodytes
cacctcagcctgggca

SEQ ID NO: 220752 - DNA, 16 bp, P. troglodytes
cacctcagcttccctg

SEQ ID NO: 220753 - DNA, 16 bp, P. troglodytes
cacctcagcttcctca

SEQ ID NO: 220754 - DNA, 16 bp, P. troglodytes
cacctcagtcccctga

SEQ ID NO: 220755 - DNA, 16 bp, P. troglodytes
cacctcatcctcccaa

SEQ ID NO: 220756 - DNA, 16 bp, P. troglodytes
cacctccaaaaggccc

SEQ ID NO: 220757 - DNA, 16 bp, P. troglodytes
cacctccaaaggaaca

SEQ ID NO: 220758 - DNA, 16 bp, P. troglodytes
cacctccacctccagg

SEQ ID NO: 220759 - DNA, 16 bp, P. troglodytes
cacctccagcccctgg

SEQ ID NO: 220760 - DNA, 16 bp, P. troglodytes
cacctcccaaagtgct

SEQ ID NO: 220761 - DNA, 16 bp, P. troglodytes
cacctcccacactggg

SEQ ID NO: 220762 - DNA, 16 bp, P. troglodytes
cacctcccaccatgcc

SEQ ID NO: 220763 - DNA, 16 bp, P. troglodytes
cacctcccacctggcc

SEQ ID NO: 220764 - DNA, 16 bp, P. troglodytes
cacctcccagcaggcc

SEQ ID NO: 220765 - DNA, 16 bp, P. troglodytes
cacctcccagcccctg

SEQ ID NO: 220766 - DNA, 16 bp, P. troglodytes
cacctcccccaggaag

SEQ ID NO: 220767 - DNA, 17 bp, P. troglodytes
cacctccccgcaagctg

SEQ ID NO: 220768 - DNA, 16 bp, P. troglodytes
cacctcccgagttcag

SEQ ID NO: 220769 - DNA, 16 bp, P. troglodytes
cacctcccggacgggg

SEQ ID NO: 220770 - DNA, 16 bp, P. troglodytes
cacctcccgggttcag

SEQ ID NO: 220771 - DNA, 16 bp, P. troglodytes
cacctccctcagcctc

SEQ ID NO: 220772 - DNA, 16 bp, P. troglodytes
cacctccctccaggcc

SEQ ID NO: 220773 - DNA, 16 bp, P. troglodytes
cacctccctcctggac

SEQ ID NO: 220774 - DNA, 16 bp, P. troglodytes
cacctccctcctggat

SEQ ID NO: 220775 - DNA, 16 bp, P. troglodytes
cacctccctgctgcag

SEQ ID NO: 220776 - DNA, 16 bp, P. troglodytes
cacctcctaacaccat

SEQ ID NO: 220777 - DNA, 16 bp, P. troglodytes
cacctcctcagagaag

SEQ ID NO: 220778 - DNA, 16 bp, P. troglodytes
cacctcctccaggcag

SEQ ID NO: 220779 - DNA, 16 bp, P. troglodytes
cacctcctctgagaag

SEQ ID NO: 220780 - DNA, 16 bp, P. troglodytes
cacctcctgccaggcc

SEQ ID NO: 220781 - DNA, 16 bp, P. troglodytes
cacctccttcaggaag

SEQ ID NO: 220782 - DNA, 16 bp, P. troglodytes
cacctcgcccagcctc

SEQ ID NO: 220783 - DNA, 16 bp, P. troglodytes
cacctcggccacccaa

SEQ ID NO: 220784 - DNA, 16 bp, P. troglodytes
cacctcgtgatccgcc

SEQ ID NO: 220785 - DNA, 16 bp, P. troglodytes
cacctctagattactt

SEQ ID NO: 220786 - DNA, 16 bp, P. troglodytes
cacctctcagagcctc

SEQ ID NO: 220787 - DNA, 16 bp, P. troglodytes
cacctctgccctccag

SEQ ID NO: 220788 - DNA, 16 bp, P. troglodytes
cacctctgcctcccaa

SEQ ID NO: 220789 - DNA, 16 bp, P. troglodytes
cacctctgcctcccag

SEQ ID NO: 220790 - DNA, 16 bp, P. troglodytes
cacctctggaggcagg

SEQ ID NO: 220791 - DNA, 16 bp, P. troglodytes
cacctctggctgacct

SEQ ID NO: 220792 - DNA, 16 bp, P. troglodytes
cacctctgtaatccca

SEQ ID NO: 220793 - DNA, 16 bp, P. troglodytes
cacctctgtggccacc

SEQ ID NO: 220794 - DNA, 16 bp, P. troglodytes
cacctcttacatcagt

SEQ ID NO: 220795 - DNA, 16 bp, P. troglodytes
cacctgaaagtggaca

SEQ ID NO: 220796 - DNA, 16 bp, P. troglodytes
cacctgaacctggaag

SEQ ID NO: 220797 - DNA, 16 bp, P. troglodytes
cacctgaagggaaagg

SEQ ID NO: 220798 - DNA, 17 bp, P. troglodytes
cacctgacattcacccc

SEQ ID NO: 220799 - DNA, 16 bp, P. troglodytes
cacctgagactgggta

SEQ ID NO: 220800 - DNA, 16 bp, P. troglodytes
cacctgagatcagcag

SEQ ID NO: 220801 - DNA, 16 bp, P. troglodytes
cacctgagcagctggg

SEQ ID NO: 220802 - DNA, 16 bp, P. troglodytes
cacctgagccagcagt

SEQ ID NO: 220803 - DNA, 16 bp, P. troglodytes
cacctgagcccaggag

SEQ ID NO: 220804 - DNA, 16 bp, P. troglodytes
cacctgagcctggaga

SEQ ID NO: 220805 - DNA, 16 bp, P. troglodytes
cacctgagctgcaaaa

SEQ ID NO: 220806 - DNA, 16 bp, P. troglodytes
cacctgaggtcaagaa

SEQ ID NO: 220807 - DNA, 16 bp, P. troglodytes
cacctgaggtcaagga

SEQ ID NO: 220808 - DNA, 16 bp, P. troglodytes
cacctgaggtcaagtg

SEQ ID NO: 220809 - DNA, 16 bp, P. troglodytes
cacctgatggagctga

SEQ ID NO: 220810 - DNA, 16 bp, P. troglodytes
cacctgcacacacaca

SEQ ID NO: 220811 - DNA, 16 bp, P. troglodytes
cacctgcagtaccagc

SEQ ID NO: 220812 - DNA, 16 bp, P. troglodytes
cacctgcattggcctc

SEQ ID NO: 220813 - DNA, 16 bp, P. troglodytes
cacctgccaccatgcc

SEQ ID NO: 220814 - DNA, 16 bp, P. troglodytes
cacctgccaccatgtc

SEQ ID NO: 220815 - DNA, 16 bp, P. troglodytes
cacctgccacctcacc

SEQ ID NO: 220816 - DNA, 16 bp, P. troglodytes
cacctgccacggcctc

SEQ ID NO: 220817 - DNA, 16 bp, P. troglodytes
cacctgccagcatgcc

SEQ ID NO: 220818 - DNA, 16 bp, P. troglodytes
cacctgccattgccca

SEQ ID NO: 220819 - DNA, 16 bp, P. troglodytes
cacctgccccagcctc

SEQ ID NO: 220820 - DNA, 16 bp, P. troglodytes
cacctgcctaattttt

SEQ ID NO: 220821 - DNA, 16 bp, P. troglodytes
cacctgcctcaccttc

SEQ ID NO: 220822 - DNA, 16 bp, P. troglodytes
cacctgcctcgacctc

SEQ ID NO: 220823 - DNA, 16 bp, P. troglodytes
cacctgcctcgtcctc

SEQ ID NO: 220824 - DNA, 16 bp, P. troglodytes
cacctgcctctacctc

SEQ ID NO: 220825 - DNA, 16 bp, P. troglodytes
cacctgcctctgtctc

SEQ ID NO: 220826 - DNA, 16 bp, P. troglodytes
cacctgcctgcctgcc

SEQ ID NO: 220827 - DNA, 16 bp, P. troglodytes
cacctgcctgggcctc

SEQ ID NO: 220828 - DNA, 21 bp, P. troglodytes
cacctgccttggcctcccaaa

SEQ ID NO: 220829 - DNA, 16 bp, P. troglodytes
cacctgctaccacaaa

SEQ ID NO: 220830 - DNA, 16 bp, P. troglodytes
cacctgctgctcacct

SEQ ID NO: 220831 - DNA, 16 bp, P. troglodytes
cacctgctgctgtgtg

SEQ ID NO: 220832 - DNA, 16 bp, P. troglodytes
cacctgctgtcccagc

SEQ ID NO: 220833 - DNA, 16 bp, P. troglodytes
cacctgctgtgcagcc

SEQ ID NO: 220834 - DNA, 16 bp, P. troglodytes
cacctgcttgggaggc

SEQ ID NO: 220835 - DNA, 26 bp, P. troglodytes
cacctggaaaatcgggtcactcccac

SEQ ID NO: 220836 - DNA, 16 bp, P. troglodytes
cacctggaatcccagc

SEQ ID NO: 220837 - DNA, 16 bp, P. troglodytes
cacctggacctgccaa

SEQ ID NO: 220838 - DNA, 16 bp, P. troglodytes
cacctggagtcaggag

SEQ ID NO: 220839 - DNA, 16 bp, P. troglodytes
cacctggatgatccag

SEQ ID NO: 220840 - DNA, 16 bp, P. troglodytes
cacctggccaagattt

SEQ ID NO: 220841 - DNA, 16 bp, P. troglodytes
cacctggccaggcaca

SEQ ID NO: 220842 - DNA, 16 bp, P. troglodytes
cacctggccctgccct

SEQ ID NO: 220843 - DNA, 16 bp, P. troglodytes
cacctggcctttttct

SEQ ID NO: 220844 - DNA, 16 bp, P. troglodytes
cacctggccttttttt

SEQ ID NO: 220845 - DNA, 16 bp, P. troglodytes
cacctggctaatatat

SEQ ID NO: 220846 - DNA, 16 bp, P. troglodytes
cacctggctgggaggg

SEQ ID NO: 220847 - DNA, 16 bp, P. troglodytes
cacctgggctcaagtg

SEQ ID NO: 220848 - DNA, 16 bp, P. troglodytes
cacctggggccaggag

SEQ ID NO: 220849 - DNA, 16 bp, P. troglodytes
cacctgggttcaagtg

SEQ ID NO: 220850 - DNA, 16 bp, P. troglodytes
cacctggtccagctgc

SEQ ID NO: 220851 - DNA, 16 bp, P. troglodytes
cacctggtctttccct

SEQ ID NO: 220852 - DNA, 16 bp, P. troglodytes
cacctgtaaacccagc

SEQ ID NO: 220853 - DNA, 16 bp, P. troglodytes
cacctgtaataccagc

SEQ ID NO: 220854 - DNA, 16 bp, P. troglodytes
cacctgtaatcacagc

SEQ ID NO: 220855 - DNA, 16 bp, P. troglodytes
cacctgtaatcccaac

SEQ ID NO: 220856 - DNA, 16 bp, P. troglodytes
cacctgtaatcccatc

SEQ ID NO: 220857 - DNA, 16 bp, P. troglodytes
cacctgtactcccagc

SEQ ID NO: 220858 - DNA, 16 bp, P. troglodytes
cacctgtagccccagt

SEQ ID NO: 220859 - DNA, 16 bp, P. troglodytes
cacctgtagtccgagc

SEQ ID NO: 220860 - DNA, 16 bp, P. troglodytes
cacctgtcacccaggc

SEQ ID NO: 220861 - DNA, 16 bp, P. troglodytes
cacctgtcagaatggc

SEQ ID NO: 220862 - DNA, 16 bp, P. troglodytes
cacctgtcttggcctc

SEQ ID NO: 220863 - DNA, 16 bp, P. troglodytes
cacctgtgatcccagg

SEQ ID NO: 220864 - DNA, 16 bp, P. troglodytes
cacctgtgattccagc

SEQ ID NO: 220865 - DNA, 16 bp, P. troglodytes
cacctgtgctgccccc

SEQ ID NO: 220866 - DNA, 16 bp, P. troglodytes
cacctgtggtcctggc

SEQ ID NO: 220867 - DNA, 16 bp, P. troglodytes
cacctgttatcccagt

SEQ ID NO: 220868 - DNA, 16 bp, P. troglodytes
cacctgttatgtgcca

SEQ ID NO: 220869 - DNA, 16 bp, P. troglodytes
cacctgttgtcccagc

SEQ ID NO: 220870 - DNA, 16 bp, P. troglodytes
cacctgtttgccattt

SEQ ID NO: 220871 - DNA, 16 bp, P. troglodytes
caccttaaatatttat

SEQ ID NO: 220872 - DNA, 16 bp, P. troglodytes
caccttaaccaagtga

SEQ ID NO: 220873 - DNA, 16 bp, P. troglodytes
caccttaggaggccaa

SEQ ID NO: 220874 - DNA, 16 bp, P. troglodytes
caccttatacaaaaat

SEQ ID NO: 220875 - DNA, 17 bp, P. troglodytes
caccttcatccatgtcc

SEQ ID NO: 220876 - DNA, 16 bp, P. troglodytes
caccttccacctcctg

SEQ ID NO: 220877 - DNA, 16 bp, P. troglodytes
caccttcctcagcctc

SEQ ID NO: 220878 - DNA, 16 bp, P. troglodytes
caccttcctgtcttct

SEQ ID NO: 220879 - DNA, 16 bp, P. troglodytes
caccttccttacacct

SEQ ID NO: 220880 - DNA, 16 bp, P. troglodytes
caccttctaataccat

SEQ ID NO: 220881 - DNA, 16 bp, P. troglodytes
caccttctaccatgag

SEQ ID NO: 220882 - DNA, 16 bp, P. troglodytes
caccttctcagtgagg

SEQ ID NO: 220883 - DNA, 16 bp, P. troglodytes
caccttctccaggaag

SEQ ID NO: 220884 - DNA, 16 bp, P. troglodytes
caccttctgggttcag

SEQ ID NO: 220885 - DNA, 16 bp, P. troglodytes
caccttcttgctatgt

SEQ ID NO: 220886 - DNA, 16 bp, P. troglodytes
caccttgatctttgac

SEQ ID NO: 220887 - DNA, 16 bp, P. troglodytes
caccttgattttggcc

SEQ ID NO: 220888 - DNA, 16 bp, P. troglodytes
caccttgcccagccaa

SEQ ID NO: 220889 - DNA, 16 bp, P. troglodytes
caccttgcccggcctc

SEQ ID NO: 220890 - DNA, 16 bp, P. troglodytes
caccttgcctggcccc

SEQ ID NO: 220891 - DNA, 16 bp, P. troglodytes
caccttgcctggctga

SEQ ID NO: 220892 - DNA, 17 bp, P. troglodytes
caccttggccaggctgg

SEQ ID NO: 220893 - DNA, 16 bp, P. troglodytes
caccttggcctcccac

SEQ ID NO: 220894 - DNA, 17 bp, P. troglodytes
caccttggcctctcaaa

SEQ ID NO: 220895 - DNA, 16 bp, P. troglodytes
caccttgggcacatgt

SEQ ID NO: 220896 - DNA, 16 bp, P. troglodytes
caccttggtcttggac

SEQ ID NO: 220897 - DNA, 16 bp, P. troglodytes
caccttgtgatcatgt

SEQ ID NO: 220898 - DNA, 16 bp, P. troglodytes
cacctttgtcagaaat

SEQ ID NO: 220899 - DNA, 16 bp, P. troglodytes
cacctttttaagagta

SEQ ID NO: 220900 - DNA, 17 bp, P. troglodytes
cacgaagtccttgccca

SEQ ID NO: 220901 - DNA, 16 bp, P. troglodytes
cacgaccacacctggc

SEQ ID NO: 220902 - DNA, 16 bp, P. troglodytes
cacgactggctaattt

SEQ ID NO: 220903 - DNA, 16 bp, P. troglodytes
cacgaggacagcacca

SEQ ID NO: 220904 - DNA, 16 bp, P. troglodytes
cacgaggtcagcagtt

SEQ ID NO: 220905 - DNA, 16 bp, P. troglodytes
cacgaggtccagagat

SEQ ID NO: 220906 - DNA, 16 bp, P. troglodytes
cacgcacacacacacg

SEQ ID NO: 220907 - DNA, 16 bp, P. troglodytes
cacgcacacacacata

SEQ ID NO: 220908 - DNA, 16 bp, P. troglodytes
cacgcacacgcgcaca

SEQ ID NO: 220909 - DNA, 17 bp, P. troglodytes
cacgcacagctaatttt

SEQ ID NO: 220910 - DNA, 16 bp, P. troglodytes
cacgcaccagggcctg

SEQ ID NO: 220911 - DNA, 16 bp, P. troglodytes
cacgcactcacacaca

SEQ ID NO: 220912 - DNA, 16 bp, P. troglodytes
cacgccaagctaattt

SEQ ID NO: 220913 - DNA, 16 bp, P. troglodytes
cacgccactgcattct

SEQ ID NO: 220914 - DNA, 17 bp, P. troglodytes
cacgccagactaatttt

SEQ ID NO: 220915 - DNA, 16 bp, P. troglodytes
cacgcccagccaacaa

SEQ ID NO: 220916 - DNA, 17 bp, P. troglodytes
cacgccccactaatttt

SEQ ID NO: 220917 - DNA, 16 bp, P. troglodytes
cacgcctggccaagtt

SEQ ID NO: 220918 - DNA, 16 bp, P. troglodytes
cacgcctgtaatcctc

SEQ ID NO: 220919 - DNA, 16 bp, P. troglodytes
cacgcctgtagtccag

SEQ ID NO: 220920 - DNA, 16 bp, P. troglodytes
cacgcgcctgtggtcc

SEQ ID NO: 220921 - DNA, 16 bp, P. troglodytes
cacgcgcgcgtgcaca

SEQ ID NO: 220922 - DNA, 16 bp, P. troglodytes
cacgcgtgagccacca

SEQ ID NO: 220923 - DNA, 16 bp, P. troglodytes
cacgctcggctaattt

SEQ ID NO: 220924 - DNA, 16 bp, P. troglodytes
cacgctgctatgaaga

SEQ ID NO: 220925 - DNA, 16 bp, P. troglodytes
cacgctggagtgcagc

SEQ ID NO: 220926 - DNA, 16 bp, P. troglodytes
cacgctggatgcttcc

SEQ ID NO: 220927 - DNA, 16 bp, P. troglodytes
cacgcttggctaattt

SEQ ID NO: 220928 - DNA, 16 bp, P. troglodytes
cacggagcccagcaag

SEQ ID NO: 220929 - DNA, 16 bp, P. troglodytes
cacggcacttcagcct

SEQ ID NO: 220930 - DNA, 16 bp, P. troglodytes
cacgggaggtggaggt

SEQ ID NO: 220931 - DNA, 16 bp, P. troglodytes
cacggtctctgctcac

SEQ ID NO: 220932 - DNA, 16 bp, P. troglodytes
cacggtgagactctgt

SEQ ID NO: 220933 - DNA, 16 bp, P. troglodytes
cacggtgcccagcctc

SEQ ID NO: 220934 - DNA, 25 bp, P. troglodytes
cacggtggctcacgcctgtaatcct

SEQ ID NO: 220935 - DNA, 16 bp, P. troglodytes
cacggtggctcctgcc

SEQ ID NO: 220936 - DNA, 17 bp, P. troglodytes
cacggtggcttacgcct

SEQ ID NO: 220937 - DNA, 16 bp, P. troglodytes
cacggtggtgcacgcc

SEQ ID NO: 220938 - DNA, 16 bp, P. troglodytes
cacgtctggctaattt

SEQ ID NO: 220939 - DNA, 16 bp, P. troglodytes
cacgtctgtgatccca

SEQ ID NO: 220940 - DNA, 16 bp, P. troglodytes
cacgtgagcccaggaa

SEQ ID NO: 220941 - DNA, 16 bp, P. troglodytes
cacgtgcacacacaca

SEQ ID NO: 220942 - DNA, 16 bp, P. troglodytes
cacgtgcacacacacg

SEQ ID NO: 220943 - DNA, 16 bp, P. troglodytes
cacgtgcacacataca

SEQ ID NO: 220944 - DNA, 16 bp, P. troglodytes
cacgtgcaggtttgtt

SEQ ID NO: 220945 - DNA, 16 bp, P. troglodytes
cacgtgcatacctatg

SEQ ID NO: 220946 - DNA, 16 bp, P. troglodytes
cacgtggacacaggga

SEQ ID NO: 220947 - DNA, 16 bp, P. troglodytes
cacgtgggccaggctg

SEQ ID NO: 220948 - DNA, 16 bp, P. troglodytes
cacgtgtgcacacaca

SEQ ID NO: 220949 - DNA, 16 bp, P. troglodytes
cacgttgggaagctga

SEQ ID NO: 220950 - DNA, 16 bp, P. troglodytes
cactaaaagaaaacat

SEQ ID NO: 220951 - DNA, 16 bp, P. troglodytes
cactaaagaactcatc

SEQ ID NO: 220952 - DNA, 16 bp, P. troglodytes
cactaaatttgtggta

SEQ ID NO: 220953 - DNA, 16 bp, P. troglodytes
cactaagtgaaaaaag

SEQ ID NO: 220954 - DNA, 20 bp, P. troglodytes
cactaagttgtgactgggga

SEQ ID NO: 220955 - DNA, 16 bp, P. troglodytes
cactaatctactttct

SEQ ID NO: 220956 - DNA, 16 bp, P. troglodytes
cactaatgatcagaga

SEQ ID NO: 220957 - DNA, 16 bp, P. troglodytes
cactaatttactactg

SEQ ID NO: 220958 - DNA, 16 bp, P. troglodytes
cactacaaagaaatga

SEQ ID NO: 220959 - DNA, 16 bp, P. troglodytes
cactacacatggaaag

SEQ ID NO: 220960 - DNA, 16 bp, P. troglodytes
cactacacctggctaa

SEQ ID NO: 220961 - DNA, 16 bp, P. troglodytes
cactacactccagcca

SEQ ID NO: 220962 - DNA, 16 bp, P. troglodytes
cactaccaccaacagt

SEQ ID NO: 220963 - DNA, 16 bp, P. troglodytes
cactaccaggcccagc

SEQ ID NO: 220964 - DNA, 16 bp, P. troglodytes
cactaccaggcctgcc

SEQ ID NO: 220965 - DNA, 16 bp, P. troglodytes
cactaccaggcctggc

SEQ ID NO: 220966 - DNA, 16 bp, P. troglodytes
cactaccatgaaaaca

SEQ ID NO: 220967 - DNA, 16 bp, P. troglodytes
cactacctgagtgaca

SEQ ID NO: 220968 - DNA, 16 bp, P. troglodytes
cactacctgatttcaa

SEQ ID NO: 220969 - DNA, 17 bp, P. troglodytes
cactacgcccagctaat

SEQ ID NO: 220970 - DNA, 18 bp, P. troglodytes
cactacgcccggctaatt

SEQ ID NO: 220971 - DNA, 16 bp, P. troglodytes
cactacgcctggctaa

SEQ ID NO: 220972 - DNA, 16 bp, P. troglodytes
cactacgtctggctaa

SEQ ID NO: 220973 - DNA, 16 bp, P. troglodytes
cactactcacaatagc

SEQ ID NO: 220974 - DNA, 16 bp, P. troglodytes
cactactggatatcta

SEQ ID NO: 220975 - DNA, 16 bp, P. troglodytes
cactactgggcatata

SEQ ID NO: 220976 - DNA, 16 bp, P. troglodytes
cactactgtagacttt

SEQ ID NO: 220977 - DNA, 16 bp, P. troglodytes
cactagccttggcctc

SEQ ID NO: 220978 - DNA, 16 bp, P. troglodytes
cactagctgtgtgacc

SEQ ID NO: 220979 - DNA, 16 bp, P. troglodytes
cactaggtatatctcc

SEQ ID NO: 220980 - DNA, 16 bp, P. troglodytes
cactatagttttgcct

SEQ ID NO: 220981 - DNA, 16 bp, P. troglodytes
cactatatatatatat

SEQ ID NO: 220982 - DNA, 16 bp, P. troglodytes
cactatattgcccagc

SEQ ID NO: 220983 - DNA, 16 bp, P. troglodytes
cactatgagcattttg

SEQ ID NO: 220984 - DNA, 16 bp, P. troglodytes
cactatgcaatctatg

SEQ ID NO: 220985 - DNA, 16 bp, P. troglodytes
cactatggagaacagt

SEQ ID NO: 220986 - DNA, 16 bp, P. troglodytes
cactatgggaggctga

SEQ ID NO: 220987 - DNA, 16 bp, P. troglodytes
cactatgttggccatg

SEQ ID NO: 220988 - DNA, 16 bp, P. troglodytes
cactattaatattttg

SEQ ID NO: 220989 - DNA, 16 bp, P. troglodytes
cactatttgtctttct

SEQ ID NO: 220990 - DNA, 16 bp, P. troglodytes
cactcaacaccagccc

SEQ ID NO: 220991 - DNA, 16 bp, P. troglodytes
cactcaactcacagag

SEQ ID NO: 220992 - DNA, 16 bp, P. troglodytes
cactcaataaatgctg

SEQ ID NO: 220993 - DNA, 16 bp, P. troglodytes
cactcacacacacatg

SEQ ID NO: 220994 - DNA, 16 bp, P. troglodytes
cactcacatgcacaca

SEQ ID NO: 220995 - DNA, 16 bp, P. troglodytes
cactcaccacttccct

SEQ ID NO: 220996 - DNA, 16 bp, P. troglodytes
cactcaccgtgaaggt

SEQ ID NO: 220997 - DNA, 16 bp, P. troglodytes
cactcacgcacacaca

SEQ ID NO: 220998 - DNA, 16 bp, P. troglodytes
cactcactctgctcca

SEQ ID NO: 220999 - DNA, 16 bp, P. troglodytes
cactcactgcagcctt

SEQ ID NO: 221000 - DNA, 16 bp, P. troglodytes
cactcactgcagtctc

SEQ ID NO: 221001 - DNA, 16 bp, P. troglodytes
cactcagaacagtgcc

SEQ ID NO: 221002 - DNA, 16 bp, P. troglodytes
cactcagagcagccgg

SEQ ID NO: 221003 - DNA, 16 bp, P. troglodytes
cactcagcaggctgag

SEQ ID NO: 221004 - DNA, 16 bp, P. troglodytes
cactcaggataatggc

SEQ ID NO: 221005 - DNA, 16 bp, P. troglodytes
cactcaggctgggagc

SEQ ID NO: 221006 - DNA, 16 bp, P. troglodytes
cactcagggggctgag

SEQ ID NO: 221007 - DNA, 16 bp, P. troglodytes
cactcagtttgtggta

SEQ ID NO: 221008 - DNA, 16 bp, P. troglodytes
cactcatctcctgctg

SEQ ID NO: 221009 - DNA, 16 bp, P. troglodytes
cactccagcatggggg

SEQ ID NO: 221010 - DNA, 16 bp, P. troglodytes
cactccagccatggct

SEQ ID NO: 221011 - DNA, 16 bp, P. troglodytes
cactccagcccgggcg

SEQ ID NO: 221012 - DNA, 16 bp, P. troglodytes
cactccagccctggga

SEQ ID NO: 221013 - DNA, 16 bp, P. troglodytes
cactccagcctcagag

SEQ ID NO: 221014 - DNA, 16 bp, P. troglodytes
cactccagcctccatc

SEQ ID NO: 221015 - DNA, 16 bp, P. troglodytes
cactccagcctctgct

SEQ ID NO: 221016 - DNA, 16 bp, P. troglodytes
cactccagcctgcagc

SEQ ID NO: 221017 - DNA, 16 bp, P. troglodytes
cactccagcctgctga

SEQ ID NO: 221018 - DNA, 16 bp, P. troglodytes
cactccagcctggcag

SEQ ID NO: 221019 - DNA, 16 bp, P. troglodytes
cactccagcctggctg

SEQ ID NO: 221020 - DNA, 16 bp, P. troglodytes
cactccagcctgtgag

SEQ ID NO: 221021 - DNA, 16 bp, P. troglodytes
cactccagcgtgggca

SEQ ID NO: 221022 - DNA, 23 bp, P. troglodytes
cactccagcttgggcaacagagt

SEQ ID NO: 221023 - DNA, 16 bp, P. troglodytes
cactccatcctgctgc

SEQ ID NO: 221024 - DNA, 16 bp, P. troglodytes
cactccatgatgttca

SEQ ID NO: 221025 - DNA, 16 bp, P. troglodytes
cactcccaccaatggt

SEQ ID NO: 221026 - DNA, 16 bp, P. troglodytes
cactcccaccagcagc

SEQ ID NO: 221027 - DNA, 16 bp, P. troglodytes
cactcccaccagcgcc

SEQ ID NO: 221028 - DNA, 16 bp, P. troglodytes
cactcccagagcagcc

SEQ ID NO: 221029 - DNA, 16 bp, P. troglodytes
cactcccatctctgcc

SEQ ID NO: 221030 - DNA, 16 bp, P. troglodytes
cactccccagcaaatg

SEQ ID NO: 221031 - DNA, 16 bp, P. troglodytes
cactcccggctaattt

SEQ ID NO: 221032 - DNA, 16 bp, P. troglodytes
cactcctaggtatata

SEQ ID NO: 221033 - DNA, 18 bp, P. troglodytes
cactcctattcaacatac

SEQ ID NO: 221034 - DNA, 18 bp, P. troglodytes
cactcctcagcccttggg

SEQ ID NO: 221035 - DNA, 16 bp, P. troglodytes
cactcctcagcctccc

SEQ ID NO: 221036 - DNA, 22 bp, P. troglodytes
cactcctgagccagcaagacca

SEQ ID NO: 221037 - DNA, 16 bp, P. troglodytes
cactcctgagctcaag

SEQ ID NO: 221038 - DNA, 16 bp, P. troglodytes
cactcctgcctccctc

SEQ ID NO: 221039 - DNA, 16 bp, P. troglodytes
cactcctgcctggaca

SEQ ID NO: 221040 - DNA, 16 bp, P. troglodytes
cactcctgcctgggag

SEQ ID NO: 221041 - DNA, 16 bp, P. troglodytes
cactcctgggcattta

SEQ ID NO: 221042 - DNA, 16 bp, P. troglodytes
cactcctgggctcaag

SEQ ID NO: 221043 - DNA, 16 bp, P. troglodytes
cactcctgtaatctca

SEQ ID NO: 221044 - DNA, 16 bp, P. troglodytes
cactcctgtaattcca

SEQ ID NO: 221045 - DNA, 16 bp, P. troglodytes
cactcctgtcatccca

SEQ ID NO: 221046 - DNA, 16 bp, P. troglodytes
cactcctgtggccacc

SEQ ID NO: 221047 - DNA, 16 bp, P. troglodytes
cactcggagcagctgg

SEQ ID NO: 221048 - DNA, 17 bp, P. troglodytes
cactcggagcggccggc

SEQ ID NO: 221049 - DNA, 16 bp, P. troglodytes
cactctaaaataatga

SEQ ID NO: 221050 - DNA, 16 bp, P. troglodytes
cactctatgatgttca

SEQ ID NO: 221051 - DNA, 16 bp, P. troglodytes
cactctattgtgctat

SEQ ID NO: 221052 - DNA, 16 bp, P. troglodytes
cactctcagctcactg

SEQ ID NO: 221053 - DNA, 16 bp, P. troglodytes
cactctctcctggcct

SEQ ID NO: 221054 - DNA, 16 bp, P. troglodytes
cactctgctccagcca

SEQ ID NO: 221055 - DNA, 16 bp, P. troglodytes
cactctgcttcccttt

SEQ ID NO: 221056 - DNA, 16 bp, P. troglodytes
cactctgcttcctctg

SEQ ID NO: 221057 - DNA, 16 bp, P. troglodytes
cactctggaaaacaat

SEQ ID NO: 221058 - DNA, 16 bp, P. troglodytes
cactctggcctggatg

SEQ ID NO: 221059 - DNA, 16 bp, P. troglodytes
cactctgtatctagct

SEQ ID NO: 221060 - DNA, 16 bp, P. troglodytes
cactctgtatctagtt

SEQ ID NO: 221061 - DNA, 16 bp, P. troglodytes
cactctgtcaccagac

SEQ ID NO: 221062 - DNA, 16 bp, P. troglodytes
cactctgtcccaggct

SEQ ID NO: 221063 - DNA, 16 bp, P. troglodytes
cactctgtgtgtgtgt

SEQ ID NO: 221064 - DNA, 16 bp, P. troglodytes
cactcttctggtctgt

SEQ ID NO: 221065 - DNA, 16 bp, P. troglodytes
cactctttctctcctg

SEQ ID NO: 221066 - DNA, 16 bp, P. troglodytes
cactctttttaaaaaa

SEQ ID NO: 221067 - DNA, 16 bp, P. troglodytes
cactgaaaatacaaaa

SEQ ID NO: 221068 - DNA, 16 bp, P. troglodytes
cactgaaagaagcact

SEQ ID NO: 221069 - DNA, 16 bp, P. troglodytes
cactgaaagtaatggc

SEQ ID NO: 221070 - DNA, 16 bp, P. troglodytes
cactgaactccagcct

SEQ ID NO: 221071 - DNA, 16 bp, P. troglodytes
cactgaagaaataaaa

SEQ ID NO: 221072 - DNA, 16 bp, P. troglodytes
cactgaagtcttgaac

SEQ ID NO: 221073 - DNA, 16 bp, P. troglodytes
cactgaatttattttt

SEQ ID NO: 221074 - DNA, 16 bp, P. troglodytes
cactgacaacaccaaa

SEQ ID NO: 221075 - DNA, 16 bp, P. troglodytes
cactgacaacatcaaa

SEQ ID NO: 221076 - DNA, 16 bp, P. troglodytes
cactgaccacacagaa

SEQ ID NO: 221077 - DNA, 16 bp, P. troglodytes
cactgaccccaaagaa

SEQ ID NO: 221078 - DNA, 16 bp, P. troglodytes
cactgacttccacaat

SEQ ID NO: 221079 - DNA, 16 bp, P. troglodytes
cactgactttttttct

SEQ ID NO: 221080 - DNA, 16 bp, P. troglodytes
cactgacttttttttt

SEQ ID NO: 221081 - DNA, 16 bp, P. troglodytes
cactgagacctccacc

SEQ ID NO: 221082 - DNA, 16 bp, P. troglodytes
cactgagcacctgctg

SEQ ID NO: 221083 - DNA, 16 bp, P. troglodytes
cactgagcccagcctc

SEQ ID NO: 221084 - DNA, 16 bp, P. troglodytes
cactgagcctccagca

SEQ ID NO: 221085 - DNA, 16 bp, P. troglodytes
cactgagctgccctca

SEQ ID NO: 221086 - DNA, 16 bp, P. troglodytes
cactgatcatcaaaga

SEQ ID NO: 221087 - DNA, 16 bp, P. troglodytes
cactgatgggcaccta

SEQ ID NO: 221088 - DNA, 16 bp, P. troglodytes
cactgatgttcatcaa

SEQ ID NO: 221089 - DNA, 16 bp, P. troglodytes
cactgattttattttt

SEQ ID NO: 221090 - DNA, 16 bp, P. troglodytes
cactgatttttttgaa

SEQ ID NO: 221091 - DNA, 16 bp, P. troglodytes
cactgcaaaagaaact

SEQ ID NO: 221092 - DNA, 16 bp, P. troglodytes
cactgcaaactcaacc

SEQ ID NO: 221093 - DNA, 16 bp, P. troglodytes
cactgcaaactcggcc

SEQ ID NO: 221094 - DNA, 16 bp, P. troglodytes
cactgcaaccccaacc

SEQ ID NO: 221095 - DNA, 17 bp, P. troglodytes
cactgcaacctccacca

SEQ ID NO: 221096 - DNA, 16 bp, P. troglodytes
cactgcaacctcctct

SEQ ID NO: 221097 - DNA, 16 bp, P. troglodytes
cactgcaacctccttt

SEQ ID NO: 221098 - DNA, 16 bp, P. troglodytes
cactgcaacctgtgtc

SEQ ID NO: 221099 - DNA, 16 bp, P. troglodytes
cactgcaagcaccacc

SEQ ID NO: 221100 - DNA, 16 bp, P. troglodytes
cactgcaagctcctcc

SEQ ID NO: 221101 - DNA, 16 bp, P. troglodytes
cactgcacaactccag

SEQ ID NO: 221102 - DNA, 16 bp, P. troglodytes
cactgcacagcctggg

SEQ ID NO: 221103 - DNA, 16 bp, P. troglodytes
cactgcacccagacag

SEQ ID NO: 221104 - DNA, 16 bp, P. troglodytes
cactgcacccagcttg

SEQ ID NO: 221105 - DNA, 16 bp, P. troglodytes
cactgcacccccagcc

SEQ ID NO: 221106 - DNA, 16 bp, P. troglodytes
cactgcacccggccac

SEQ ID NO: 221107 - DNA, 16 bp, P. troglodytes
cactgcacccggcctc

SEQ ID NO: 221108 - DNA, 16 bp, P. troglodytes
cactgcaccctccact

SEQ ID NO: 221109 - DNA, 16 bp, P. troglodytes
cactgcaccctgcccc

SEQ ID NO: 221110 - DNA, 16 bp, P. troglodytes
cactgcacctcagcct

SEQ ID NO: 221111 - DNA, 16 bp, P. troglodytes
cactgcacctggccat

SEQ ID NO: 221112 - DNA, 16 bp, P. troglodytes
cactgcacctggcccc

SEQ ID NO: 221113 - DNA, 16 bp, P. troglodytes
cactgcacctggctgt

SEQ ID NO: 221114 - DNA, 16 bp, P. troglodytes
cactgcacctggcttg

SEQ ID NO: 221115 - DNA, 16 bp, P. troglodytes
cactgcactatagcct

SEQ ID NO: 221116 - DNA, 16 bp, P. troglodytes
cactgcactcatgcct

SEQ ID NO: 221117 - DNA, 16 bp, P. troglodytes
cactgcactccaattt

SEQ ID NO: 221118 - DNA, 16 bp, P. troglodytes
cactgcactccagcca

SEQ ID NO: 221119 - DNA, 16 bp, P. troglodytes
cactgcactccagccc

SEQ ID NO: 221120 - DNA, 17 bp, P. troglodytes
cactgcactccagcctc

SEQ ID NO: 221121 - DNA, 16 bp, P. troglodytes
cactgcactccagctt

SEQ ID NO: 221122 - DNA, 16 bp, P. troglodytes
cactgcactccagtcc

SEQ ID NO: 221123 - DNA, 22 bp, P. troglodytes
cactgcactccatcctgggcga

SEQ ID NO: 221124 - DNA, 16 bp, P. troglodytes
cactgcactccatgct

SEQ ID NO: 221125 - DNA, 16 bp, P. troglodytes
cactgcactccattct

SEQ ID NO: 221126 - DNA, 16 bp, P. troglodytes
cactgcactcctgcct

SEQ ID NO: 221127 - DNA, 16 bp, P. troglodytes
cactgcactcggcctc

SEQ ID NO: 221128 - DNA, 16 bp, P. troglodytes
cactgcactgctgcct

SEQ ID NO: 221129 - DNA, 16 bp, P. troglodytes
cactgcactgtagcct

SEQ ID NO: 221130 - DNA, 16 bp, P. troglodytes
cactgcagactccacc

SEQ ID NO: 221131 - DNA, 16 bp, P. troglodytes
cactgcagccacaaac

SEQ ID NO: 221132 - DNA, 16 bp, P. troglodytes
cactgcagccatgacc

SEQ ID NO: 221133 - DNA, 16 bp, P. troglodytes
cactgcagcccaggag

SEQ ID NO: 221134 - DNA, 16 bp, P. troglodytes
cactgcagccccaatc

SEQ ID NO: 221135 - DNA, 16 bp, P. troglodytes
cactgcagcctcaaca

SEQ ID NO: 221136 - DNA, 16 bp, P. troglodytes
cactgcagcctcaccc

SEQ ID NO: 221137 - DNA, 16 bp, P. troglodytes
cactgcagcctcagcc

SEQ ID NO: 221138 - DNA, 16 bp, P. troglodytes
cactgcagcctcccac

SEQ ID NO: 221139 - DNA, 16 bp, P. troglodytes
cactgcagcctccctg

SEQ ID NO: 221140 - DNA, 16 bp, P. troglodytes
cactgcagcctccgac

SEQ ID NO: 221141 - DNA, 16 bp, P. troglodytes
cactgcagcctcctgc

SEQ ID NO: 221142 - DNA, 16 bp, P. troglodytes
cactgcagcctctccc

SEQ ID NO: 221143 - DNA, 16 bp, P. troglodytes
cactgcagcctggatc

SEQ ID NO: 221144 - DNA, 16 bp, P. troglodytes
cactgcagcctgggag

SEQ ID NO: 221145 - DNA, 16 bp, P. troglodytes
cactgcagcctgggcc

SEQ ID NO: 221146 - DNA, 20 bp, P. troglodytes
cactgcagcctgggtgacag

SEQ ID NO: 221147 - DNA, 16 bp, P. troglodytes
cactgcagctggccta

SEQ ID NO: 221148 - DNA, 16 bp, P. troglodytes
cactgcagcttcctcc

SEQ ID NO: 221149 - DNA, 16 bp, P. troglodytes
cactgcagcttctacc

SEQ ID NO: 221150 - DNA, 16 bp, P. troglodytes
cactgcagtctccgcc

SEQ ID NO: 221151 - DNA, 16 bp, P. troglodytes
cactgcagtctctgtc

SEQ ID NO: 221152 - DNA, 16 bp, P. troglodytes
cactgcattccaacct

SEQ ID NO: 221153 - DNA, 16 bp, P. troglodytes
cactgcattccagcca

SEQ ID NO: 221154 - DNA, 16 bp, P. troglodytes
cactgcattccagccg

SEQ ID NO: 221155 - DNA, 16 bp, P. troglodytes
cactgcattccaggct

SEQ ID NO: 221156 - DNA, 16 bp, P. troglodytes
cactgcatttaatgtt

SEQ ID NO: 221157 - DNA, 16 bp, P. troglodytes
cactgcatttccagcc

SEQ ID NO: 221158 - DNA, 16 bp, P. troglodytes
cactgccaaatccaag

SEQ ID NO: 221159 - DNA, 16 bp, P. troglodytes
cactgccacctctgct

SEQ ID NO: 221160 - DNA, 16 bp, P. troglodytes
cactgccaccttgcag

SEQ ID NO: 221161 - DNA, 16 bp, P. troglodytes
cactgccactgccacc

SEQ ID NO: 221162 - DNA, 16 bp, P. troglodytes
cactgccactgccact

SEQ ID NO: 221163 - DNA, 16 bp, P. troglodytes
cactgccagctctgcc

SEQ ID NO: 221164 - DNA, 16 bp, P. troglodytes
cactgcccagggccgg

SEQ ID NO: 221165 - DNA, 16 bp, P. troglodytes
cactgccccaggccca

SEQ ID NO: 221166 - DNA, 16 bp, P. troglodytes
cactgcccccagcctg

SEQ ID NO: 221167 - DNA, 16 bp, P. troglodytes
cactgccctccaggct

SEQ ID NO: 221168 - DNA, 16 bp, P. troglodytes
cactgccctctgctgg

SEQ ID NO: 221169 - DNA, 16 bp, P. troglodytes
cactgccctgaaggat

SEQ ID NO: 221170 - DNA, 16 bp, P. troglodytes
cactgcctcctcctcc

SEQ ID NO: 221171 - DNA, 16 bp, P. troglodytes
cactgcctctggcctc

SEQ ID NO: 221172 - DNA, 16 bp, P. troglodytes
cactgcctggagttgg

SEQ ID NO: 221173 - DNA, 16 bp, P. troglodytes
cactgcctggggccag

SEQ ID NO: 221174 - DNA, 16 bp, P. troglodytes
cactgcctgtttttgt

SEQ ID NO: 221175 - DNA, 16 bp, P. troglodytes
cactgcgcccagcccc

SEQ ID NO: 221176 - DNA, 16 bp, P. troglodytes
cactgcgcctggccag

SEQ ID NO: 221177 - DNA, 16 bp, P. troglodytes
cactgcgcctggctgc

SEQ ID NO: 221178 - DNA, 16 bp, P. troglodytes
cactgcgcctggctta

SEQ ID NO: 221179 - DNA, 16 bp, P. troglodytes
cactgctactgccatt

SEQ ID NO: 221180 - DNA, 16 bp, P. troglodytes
cactgctataaataaa

SEQ ID NO: 221181 - DNA, 16 bp, P. troglodytes
cactgctcactgcaac

SEQ ID NO: 221182 - DNA, 16 bp, P. troglodytes
cactgctcctggctaa

SEQ ID NO: 221183 - DNA, 16 bp, P. troglodytes
cactgctcttcagcct

SEQ ID NO: 221184 - DNA, 16 bp, P. troglodytes
cactgctgaaggaaat

SEQ ID NO: 221185 - DNA, 16 bp, P. troglodytes
cactgctgagtgccca

SEQ ID NO: 221186 - DNA, 16 bp, P. troglodytes
cactgctgattattca

SEQ ID NO: 221187 - DNA, 16 bp, P. troglodytes
cactgctgcccaggct

SEQ ID NO: 221188 - DNA, 16 bp, P. troglodytes
cactgctgcctccacc

SEQ ID NO: 221189 - DNA, 16 bp, P. troglodytes
cactgctgctgatacc

SEQ ID NO: 221190 - DNA, 17 bp, P. troglodytes
cactgctgctggtaccc

SEQ ID NO: 221191 - DNA, 16 bp, P. troglodytes
cactgctggctggggt

SEQ ID NO: 221192 - DNA, 16 bp, P. troglodytes
cactgcttcagctgtg

SEQ ID NO: 221193 - DNA, 16 bp, P. troglodytes
cactgcttcctgggtt

SEQ ID NO: 221194 - DNA, 16 bp, P. troglodytes
cactggaaagtctcag

SEQ ID NO: 221195 - DNA, 16 bp, P. troglodytes
cactggaaatgtggct

SEQ ID NO: 221196 - DNA, 16 bp, P. troglodytes
cactggaacccgggag

SEQ ID NO: 221197 - DNA, 16 bp, P. troglodytes
cactggaagaaaatat

SEQ ID NO: 221198 - DNA, 16 bp, P. troglodytes
cactggaccccagcct

SEQ ID NO: 221199 - DNA, 16 bp, P. troglodytes
cactggactccatcct

SEQ ID NO: 221200 - DNA, 16 bp, P. troglodytes
cactggactctagcct

SEQ ID NO: 221201 - DNA, 16 bp, P. troglodytes
cactggactgtgagct

SEQ ID NO: 221202 - DNA, 16 bp, P. troglodytes
cactggaggtcacatt

SEQ ID NO: 221203 - DNA, 16 bp, P. troglodytes
cactggatcccaggag

SEQ ID NO: 221204 - DNA, 16 bp, P. troglodytes
cactggcaaactgaat

SEQ ID NO: 221205 - DNA, 16 bp, P. troglodytes
cactggcatggccttc

SEQ ID NO: 221206 - DNA, 18 bp, P. troglodytes
cactggccaggtgtggtg

SEQ ID NO: 221207 - DNA, 16 bp, P. troglodytes
cactggcctctgcctc

SEQ ID NO: 221208 - DNA, 16 bp, P. troglodytes
cactgggaaaactgga

SEQ ID NO: 221209 - DNA, 16 bp, P. troglodytes
cactgggaactgcaga

SEQ ID NO: 221210 - DNA, 16 bp, P. troglodytes
cactgggcagggcctc

SEQ ID NO: 221211 - DNA, 16 bp, P. troglodytes
cactgggcccctccca

SEQ ID NO: 221212 - DNA, 16 bp, P. troglodytes
cactgggcctggccca

SEQ ID NO: 221213 - DNA, 16 bp, P. troglodytes
cactgggcctggccta

SEQ ID NO: 221214 - DNA, 16 bp, P. troglodytes
cactggggaaaaaaaa

SEQ ID NO: 221215 - DNA, 16 bp, P. troglodytes
cactggggattaagtt

SEQ ID NO: 221216 - DNA, 16 bp, P. troglodytes
cactggggcactgcct

SEQ ID NO: 221217 - DNA, 16 bp, P. troglodytes
cactggggcctgctgg

SEQ ID NO: 221218 - DNA, 16 bp, P. troglodytes
cactggggcctgtcac

SEQ ID NO: 221219 - DNA, 16 bp, P. troglodytes
cactggggttacaggt

SEQ ID NO: 221220 - DNA, 16 bp, P. troglodytes
cactgtaagctccacc

SEQ ID NO: 221221 - DNA, 16 bp, P. troglodytes
cactgtaatttaaaaa

SEQ ID NO: 221222 - DNA, 16 bp, P. troglodytes
cactgtacccagccca

SEQ ID NO: 221223 - DNA, 16 bp, P. troglodytes
cactgtacccagctgg

SEQ ID NO: 221224 - DNA, 16 bp, P. troglodytes
cactgtactccaacct

SEQ ID NO: 221225 - DNA, 16 bp, P. troglodytes
cactgtactcctgcct

SEQ ID NO: 221226 - DNA, 16 bp, P. troglodytes
cactgtagcctcaact

SEQ ID NO: 221227 - DNA, 16 bp, P. troglodytes
cactgtagcctggatg

SEQ ID NO: 221228 - DNA, 16 bp, P. troglodytes
cactgtagtccagcct

SEQ ID NO: 221229 - DNA, 16 bp, P. troglodytes
cactgtccaatagaaa

SEQ ID NO: 221230 - DNA, 16 bp, P. troglodytes
cactgtcctaggtgct

SEQ ID NO: 221231 - DNA, 16 bp, P. troglodytes
cactgtctcatttaat

SEQ ID NO: 221232 - DNA, 16 bp, P. troglodytes
cactgtcttccatcac

SEQ ID NO: 221233 - DNA, 16 bp, P. troglodytes
cactgtgacctctgcc

SEQ ID NO: 221234 - DNA, 16 bp, P. troglodytes
cactgtgaccttgaac

SEQ ID NO: 221235 - DNA, 16 bp, P. troglodytes
cactgtgattttaatt

SEQ ID NO: 221236 - DNA, 16 bp, P. troglodytes
cactgtgccaggccat

SEQ ID NO: 221237 - DNA, 16 bp, P. troglodytes
cactgtgccaggcctt

SEQ ID NO: 221238 - DNA, 16 bp, P. troglodytes
cactgtgcccggcaag

SEQ ID NO: 221239 - DNA, 16 bp, P. troglodytes
cactgtgcccggccac

SEQ ID NO: 221240 - DNA, 17 bp, P. troglodytes
cactgtgcccggcccat

SEQ ID NO: 221241 - DNA, 17 bp, P. troglodytes
cactgtgcccggcctcc

SEQ ID NO: 221242 - DNA, 16 bp, P. troglodytes
cactgtgcccggcctt

SEQ ID NO: 221243 - DNA, 16 bp, P. troglodytes
cactgtgcctggccag

SEQ ID NO: 221244 - DNA, 16 bp, P. troglodytes
cactgtgcctggccta

SEQ ID NO: 221245 - DNA, 16 bp, P. troglodytes
cactgtgcctggcctg

SEQ ID NO: 221246 - DNA, 16 bp, P. troglodytes
cactgtgcctggcctt

SEQ ID NO: 221247 - DNA, 16 bp, P. troglodytes
cactgtgcctggctcc

SEQ ID NO: 221248 - DNA, 16 bp, P. troglodytes
cactgtgcctggctgc

SEQ ID NO: 221249 - DNA, 16 bp, P. troglodytes
cactgtgctccaacct

SEQ ID NO: 221250 - DNA, 16 bp, P. troglodytes
cactgtgctctagcct

SEQ ID NO: 221251 - DNA, 16 bp, P. troglodytes
cactgtgctgagtgct

SEQ ID NO: 221252 - DNA, 16 bp, P. troglodytes
cactgtgctgcagcct

SEQ ID NO: 221253 - DNA, 16 bp, P. troglodytes
cactgtgctgggagaa

SEQ ID NO: 221254 - DNA, 16 bp, P. troglodytes
cactgtgctgggtact

SEQ ID NO: 221255 - DNA, 16 bp, P. troglodytes
cactgtgctgtgtgct

SEQ ID NO: 221256 - DNA, 16 bp, P. troglodytes
cactgtgcttggccat

SEQ ID NO: 221257 - DNA, 16 bp, P. troglodytes
cactgtggaaaactgt

SEQ ID NO: 221258 - DNA, 16 bp, P. troglodytes
cactgtggaaatcagt

SEQ ID NO: 221259 - DNA, 16 bp, P. troglodytes
cactgtggtcctccag

SEQ ID NO: 221260 - DNA, 16 bp, P. troglodytes
cactgtgtccagccca

SEQ ID NO: 221261 - DNA, 16 bp, P. troglodytes
cactgtgtccagctaa

SEQ ID NO: 221262 - DNA, 16 bp, P. troglodytes
cactgtgtgccaagca

SEQ ID NO: 221263 - DNA, 16 bp, P. troglodytes
cactgtgtgttgttcc

SEQ ID NO: 221264 - DNA, 16 bp, P. troglodytes
cactgtgttgctgagg

SEQ ID NO: 221265 - DNA, 16 bp, P. troglodytes
cactgttcctcacagc

SEQ ID NO: 221266 - DNA, 16 bp, P. troglodytes
cactgttctaagtgct

SEQ ID NO: 221267 - DNA, 16 bp, P. troglodytes
cactgttctaggcact

SEQ ID NO: 221268 - DNA, 16 bp, P. troglodytes
cactgttctaggtgct

SEQ ID NO: 221269 - DNA, 16 bp, P. troglodytes
cactgttctgggcact

SEQ ID NO: 221270 - DNA, 16 bp, P. troglodytes
cactgttgagttttct

SEQ ID NO: 221271 - DNA, 16 bp, P. troglodytes
cactgttgccctggct

SEQ ID NO: 221272 - DNA, 16 bp, P. troglodytes
cactgttggaggtggg

SEQ ID NO: 221273 - DNA, 16 bp, P. troglodytes
cactgttggtgggaac

SEQ ID NO: 221274 - DNA, 16 bp, P. troglodytes
cactgttgttgcccag

SEQ ID NO: 221275 - DNA, 16 bp, P. troglodytes
cactgttttccacaat

SEQ ID NO: 221276 - DNA, 16 bp, P. troglodytes
cactgtttttaaaaaa

SEQ ID NO: 221277 - DNA, 16 bp, P. troglodytes
cacttaaaaatatgtt

SEQ ID NO: 221278 - DNA, 16 bp, P. troglodytes
cacttaaaaatgatta

SEQ ID NO: 221279 - DNA, 16 bp, P. troglodytes
cacttaacattatatt

SEQ ID NO: 221280 - DNA, 16 bp, P. troglodytes
cacttaattctcacaa

SEQ ID NO: 221281 - DNA, 16 bp, P. troglodytes
cacttacaaatgagaa

SEQ ID NO: 221282 - DNA, 16 bp, P. troglodytes
cacttacaagtgagaa

SEQ ID NO: 221283 - DNA, 16 bp, P. troglodytes
cacttactagctgtat

SEQ ID NO: 221284 - DNA, 16 bp, P. troglodytes
cacttactagttgtgt

SEQ ID NO: 221285 - DNA, 16 bp, P. troglodytes
cacttagcataattct

SEQ ID NO: 221286 - DNA, 16 bp, P. troglodytes
cacttagcctctctga

SEQ ID NO: 221287 - DNA, 17 bp, P. troglodytes
cacttagggaggccgag

SEQ ID NO: 221288 - DNA, 16 bp, P. troglodytes
cacttaggttgatttc

SEQ ID NO: 221289 - DNA, 16 bp, P. troglodytes
cacttataaaaccatt

SEQ ID NO: 221290 - DNA, 16 bp, P. troglodytes
cacttataagtgagaa

SEQ ID NO: 221291 - DNA, 16 bp, P. troglodytes
cacttatcactatctg

SEQ ID NO: 221292 - DNA, 16 bp, P. troglodytes
cacttatgagtgagaa

SEQ ID NO: 221293 - DNA, 16 bp, P. troglodytes
cacttcacacttggag

SEQ ID NO: 221294 - DNA, 16 bp, P. troglodytes
cacttcagccagggtg

SEQ ID NO: 221295 - DNA, 17 bp, P. troglodytes
cacttcagcctcccaag

SEQ ID NO: 221296 - DNA, 16 bp, P. troglodytes
cacttcagcctctcca

SEQ ID NO: 221297 - DNA, 16 bp, P. troglodytes
cacttcagcctctgcc

SEQ ID NO: 221298 - DNA, 16 bp, P. troglodytes
cacttcagcctgtgca

SEQ ID NO: 221299 - DNA, 16 bp, P. troglodytes
cacttcaggaagctga

SEQ ID NO: 221300 - DNA, 16 bp, P. troglodytes
cacttccaagcctgtg

SEQ ID NO: 221301 - DNA, 16 bp, P. troglodytes
cacttccaatttctgt

SEQ ID NO: 221302 - DNA, 16 bp, P. troglodytes
cacttccatggcacct

SEQ ID NO: 221303 - DNA, 16 bp, P. troglodytes
cacttcccaaagtgct

SEQ ID NO: 221304 - DNA, 16 bp, P. troglodytes
cacttcccaactcatt

SEQ ID NO: 221305 - DNA, 16 bp, P. troglodytes
cacttcccaattcatt

SEQ ID NO: 221306 - DNA, 16 bp, P. troglodytes
cacttcccagatgggg

SEQ ID NO: 221307 - DNA, 16 bp, P. troglodytes
cacttcccctctctga

SEQ ID NO: 221308 - DNA, 16 bp, P. troglodytes
cacttcccgggtgagg

SEQ ID NO: 221309 - DNA, 16 bp, P. troglodytes
cacttccctgcttaaa

SEQ ID NO: 221310 - DNA, 16 bp, P. troglodytes
cacttcctccatgaag

SEQ ID NO: 221311 - DNA, 16 bp, P. troglodytes
cacttcctcctctctg

SEQ ID NO: 221312 - DNA, 16 bp, P. troglodytes
cacttccttctggcct

SEQ ID NO: 221313 - DNA, 16 bp, P. troglodytes
cacttcgggaggctga

SEQ ID NO: 221314 - DNA, 16 bp, P. troglodytes
cacttctcaaaagcag

SEQ ID NO: 221315 - DNA, 16 bp, P. troglodytes
cacttctcaccatctc

SEQ ID NO: 221316 - DNA, 16 bp, P. troglodytes
cacttctcagtaccaa

SEQ ID NO: 221317 - DNA, 16 bp, P. troglodytes
cacttctccctcctgc

SEQ ID NO: 221318 - DNA, 16 bp, P. troglodytes
cacttctgcctcccag

SEQ ID NO: 221319 - DNA, 16 bp, P. troglodytes
cacttctgtgaagaaa

SEQ ID NO: 221320 - DNA, 16 bp, P. troglodytes
cacttgaaaagaatat

SEQ ID NO: 221321 - DNA, 16 bp, P. troglodytes
cacttgaaatgtggct

SEQ ID NO: 221322 - DNA, 16 bp, P. troglodytes
cacttgaacacaggag

SEQ ID NO: 221323 - DNA, 16 bp, P. troglodytes
cacttgaaccaggcag

SEQ ID NO: 221324 - DNA, 16 bp, P. troglodytes
cacttgaaccccggag

SEQ ID NO: 221325 - DNA, 16 bp, P. troglodytes
cacttgaacccgagag

SEQ ID NO: 221326 - DNA, 16 bp, P. troglodytes
cacttgaacctggcag

SEQ ID NO: 221327 - DNA, 16 bp, P. troglodytes
cacttgaacctgggac

SEQ ID NO: 221328 - DNA, 17 bp, P. troglodytes
cacttgaacctgggaga

SEQ ID NO: 221329 - DNA, 16 bp, P. troglodytes
cacttgaactctggag

SEQ ID NO: 221330 - DNA, 18 bp, P. troglodytes
cacttgaacttgggaggt

SEQ ID NO: 221331 - DNA, 16 bp, P. troglodytes
cacttgaagccgggag

SEQ ID NO: 221332 - DNA, 16 bp, P. troglodytes
cacttgaatccagaag

SEQ ID NO: 221333 - DNA, 16 bp, P. troglodytes
cacttgagcacagaag

SEQ ID NO: 221334 - DNA, 16 bp, P. troglodytes
cacttgagccaagagt

SEQ ID NO: 221335 - DNA, 16 bp, P. troglodytes
cacttgagccagagag

SEQ ID NO: 221336 - DNA, 16 bp, P. troglodytes
cacttgagcccaggac

SEQ ID NO: 221337 - DNA, 16 bp, P. troglodytes
cacttgagcccaggga

SEQ ID NO: 221338 - DNA, 16 bp, P. troglodytes
cacttgagccccagag

SEQ ID NO: 221339 - DNA, 16 bp, P. troglodytes
cacttgagcctgggaa

SEQ ID NO: 221340 - DNA, 16 bp, P. troglodytes
cacttgagtttgagac

SEQ ID NO: 221341 - DNA, 16 bp, P. troglodytes
cacttgcaaccaaaag

SEQ ID NO: 221342 - DNA, 16 bp, P. troglodytes
cacttgctcaaggtca

SEQ ID NO: 221343 - DNA, 16 bp, P. troglodytes
cacttgctgtgtgact

SEQ ID NO: 221344 - DNA, 16 bp, P. troglodytes
cacttgcttggtaaat

SEQ ID NO: 221345 - DNA, 16 bp, P. troglodytes
cacttggagcagccag

SEQ ID NO: 221346 - DNA, 16 bp, P. troglodytes
cacttggctctctggc

SEQ ID NO: 221347 - DNA, 16 bp, P. troglodytes
cacttgggagcctgag

SEQ ID NO: 221348 - DNA, 16 bp, P. troglodytes
cacttggggattatta

SEQ ID NO: 221349 - DNA, 16 bp, P. troglodytes
cacttggtcataatga

SEQ ID NO: 221350 - DNA, 16 bp, P. troglodytes
cacttgtaactgctgc

SEQ ID NO: 221351 - DNA, 16 bp, P. troglodytes
cacttgtaatcctagc

SEQ ID NO: 221352 - DNA, 16 bp, P. troglodytes
cacttgtacccccaaa

SEQ ID NO: 221353 - DNA, 16 bp, P. troglodytes
cacttgtgaatgggag

SEQ ID NO: 221354 - DNA, 16 bp, P. troglodytes
cacttgtggtcctagc

SEQ ID NO: 221355 - DNA, 16 bp, P. troglodytes
cacttgttttcttttg

SEQ ID NO: 221356 - DNA, 16 bp, P. troglodytes
cactttaagaggctga

SEQ ID NO: 221357 - DNA, 16 bp, P. troglodytes
cactttacatacatta

SEQ ID NO: 221358 - DNA, 16 bp, P. troglodytes
cactttacctctctga

SEQ ID NO: 221359 - DNA, 16 bp, P. troglodytes
cactttatacaaaaat

SEQ ID NO: 221360 - DNA, 16 bp, P. troglodytes
cactttatgaggctga

SEQ ID NO: 221361 - DNA, 16 bp, P. troglodytes
cactttcaaacaacca

SEQ ID NO: 221362 - DNA, 16 bp, P. troglodytes
cactttcacattttta

SEQ ID NO: 221363 - DNA, 16 bp, P. troglodytes
cactttcatgttcctc

SEQ ID NO: 221364 - DNA, 16 bp, P. troglodytes
cactttccagaaagca

SEQ ID NO: 221365 - DNA, 16 bp, P. troglodytes
cactttccaggttcaa

SEQ ID NO: 221366 - DNA, 16 bp, P. troglodytes
cactttccccttcact

SEQ ID NO: 221367 - DNA, 16 bp, P. troglodytes
cactttcggaggccaa

SEQ ID NO: 221368 - DNA, 16 bp, P. troglodytes
cactttgagaggccaa

SEQ ID NO: 221369 - DNA, 16 bp, P. troglodytes
cactttgagagggtga

SEQ ID NO: 221370 - DNA, 16 bp, P. troglodytes
cactttgaggctgagg

SEQ ID NO: 221371 - DNA, 16 bp, P. troglodytes
cactttgagtagcact

SEQ ID NO: 221372 - DNA, 16 bp, P. troglodytes
cactttgattttggac

SEQ ID NO: 221373 - DNA, 16 bp, P. troglodytes
cactttggaaaatagt

SEQ ID NO: 221374 - DNA, 16 bp, P. troglodytes
cactttggcctcctga

SEQ ID NO: 221375 - DNA, 16 bp, P. troglodytes
cactttgggaaacagt

SEQ ID NO: 221376 - DNA, 16 bp, P. troglodytes
cactttgggaacctga

SEQ ID NO: 221377 - DNA, 16 bp, P. troglodytes
cactttgggaagctaa

SEQ ID NO: 221378 - DNA, 19 bp, P. troglodytes
cactttgggaagctgaggt

SEQ ID NO: 221379 - DNA, 16 bp, P. troglodytes
cactttgggacgctga

SEQ ID NO: 221380 - DNA, 16 bp, P. troglodytes
cactttgggaggccca

SEQ ID NO: 221381 - DNA, 16 bp, P. troglodytes
cactttggggactgtt

SEQ ID NO: 221382 - DNA, 16 bp, P. troglodytes
cactttggggagggag

SEQ ID NO: 221383 - DNA, 16 bp, P. troglodytes
cactttggggggccaa

SEQ ID NO: 221384 - DNA, 16 bp, P. troglodytes
cactttggggggccga

SEQ ID NO: 221385 - DNA, 16 bp, P. troglodytes
cactttgggtggctga

SEQ ID NO: 221386 - DNA, 16 bp, P. troglodytes
cactttgtcacccagc

SEQ ID NO: 221387 - DNA, 16 bp, P. troglodytes
cactttgtgaggccaa

SEQ ID NO: 221388 - DNA, 16 bp, P. troglodytes
cactttgtgcacatgt

SEQ ID NO: 221389 - DNA, 16 bp, P. troglodytes
cactttgttccccagg

SEQ ID NO: 221390 - DNA, 16 bp, P. troglodytes
cactttgttgcccatg

SEQ ID NO: 221391 - DNA, 16 bp, P. troglodytes
cacttttaaaaagaag

SEQ ID NO: 221392 - DNA, 16 bp, P. troglodytes
cacttttaaaagaaaa

SEQ ID NO: 221393 - DNA, 16 bp, P. troglodytes
cacttttaaaatttca

SEQ ID NO: 221394 - DNA, 16 bp, P. troglodytes
cacttttaaataacca

SEQ ID NO: 221395 - DNA, 16 bp, P. troglodytes
cacttttagaaatgca

SEQ ID NO: 221396 - DNA, 16 bp, P. troglodytes
cacttttatttaacat

SEQ ID NO: 221397 - DNA, 16 bp, P. troglodytes
cacttttccttcctgc

SEQ ID NO: 221398 - DNA, 16 bp, P. troglodytes
cacttttgagaatgaa

SEQ ID NO: 221399 - DNA, 16 bp, P. troglodytes
cacttttgctttctga

SEQ ID NO: 221400 - DNA, 16 bp, P. troglodytes
cacttttgtcatttct

SEQ ID NO: 221401 - DNA, 16 bp, P. troglodytes
cactttttaaaaagta

SEQ ID NO: 221402 - DNA, 16 bp, P. troglodytes
cactttttactgtgat

SEQ ID NO: 221403 - DNA, 16 bp, P. troglodytes
cactttttcacccagg

SEQ ID NO: 221404 - DNA, 16 bp, P. troglodytes
cacttttttttgagat

SEQ ID NO: 221405 - DNA, 16 bp, P. troglodytes
cagaaaaaaaattcag

SEQ ID NO: 221406 - DNA, 16 bp, P. troglodytes
cagaaaaaaaatttga

SEQ ID NO: 221407 - DNA, 16 bp, P. troglodytes
cagaaaaaaaattttt

SEQ ID NO: 221408 - DNA, 16 bp, P. troglodytes
cagaaaaaaatgtttt

SEQ ID NO: 221409 - DNA, 16 bp, P. troglodytes
cagaaaaaacatttga

SEQ ID NO: 221410 - DNA, 16 bp, P. troglodytes
cagaaaaactcttcta

SEQ ID NO: 221411 - DNA, 19 bp, P. troglodytes
cagaaaaactggaaactct

SEQ ID NO: 221412 - DNA, 23 bp, P. troglodytes
cagaaaaactggaaactctaaaa

SEQ ID NO: 221413 - DNA, 16 bp, P. troglodytes
cagaaaaactggaaat

SEQ ID NO: 221414 - DNA, 16 bp, P. troglodytes
cagaaaaagaaaatct

SEQ ID NO: 221415 - DNA, 16 bp, P. troglodytes
cagaaaaagaaactat

SEQ ID NO: 221416 - DNA, 16 bp, P. troglodytes
cagaaaaagataattt

SEQ ID NO: 221417 - DNA, 16 bp, P. troglodytes
cagaaaaagcatctga

SEQ ID NO: 221418 - DNA, 16 bp, P. troglodytes
cagaaaaagcttgctg

SEQ ID NO: 221419 - DNA, 16 bp, P. troglodytes
cagaaaaaggaaaatg

SEQ ID NO: 221420 - DNA, 16 bp, P. troglodytes
cagaaaaaggatttga

SEQ ID NO: 221421 - DNA, 16 bp, P. troglodytes
cagaaaaagtaactat

SEQ ID NO: 221422 - DNA, 16 bp, P. troglodytes
cagaaaaagtagattt

SEQ ID NO: 221423 - DNA, 16 bp, P. troglodytes
cagaaaaagtatttaa

SEQ ID NO: 221424 - DNA, 16 bp, P. troglodytes
cagaaaaataattctg

SEQ ID NO: 221425 - DNA, 16 bp, P. troglodytes
cagaaaaatagaaact

SEQ ID NO: 221426 - DNA, 16 bp, P. troglodytes
cagaaaaatagaaatt

SEQ ID NO: 221427 - DNA, 16 bp, P. troglodytes
cagaaaaatatctgaa

SEQ ID NO: 221428 - DNA, 16 bp, P. troglodytes
cagaaaaatattttaa

SEQ ID NO: 221429 - DNA, 16 bp, P. troglodytes
cagaaaaatctgaaaa

SEQ ID NO: 221430 - DNA, 16 bp, P. troglodytes
cagaaaaatgtgaaaa

SEQ ID NO: 221431 - DNA, 16 bp, P. troglodytes
cagaaaaattgaaaat

SEQ ID NO: 221432 - DNA, 16 bp, P. troglodytes
cagaaaacaaaagtga

SEQ ID NO: 221433 - DNA, 16 bp, P. troglodytes
cagaaaacagtttggc

SEQ ID NO: 221434 - DNA, 16 bp, P. troglodytes
cagaaaaccaaaaact

SEQ ID NO: 221435 - DNA, 16 bp, P. troglodytes
cagaaaaccaaatatt

SEQ ID NO: 221436 - DNA, 16 bp, P. troglodytes
cagaaaaccaagtatc

SEQ ID NO: 221437 - DNA, 16 bp, P. troglodytes
cagaaaacccacagag

SEQ ID NO: 221438 - DNA, 16 bp, P. troglodytes
cagaaaactaaagaca

SEQ ID NO: 221439 - DNA, 16 bp, P. troglodytes
cagaaaactcaacagt

SEQ ID NO: 221440 - DNA, 16 bp, P. troglodytes
cagaaaactccagcag

SEQ ID NO: 221441 - DNA, 16 bp, P. troglodytes
cagaaaactggtacca

SEQ ID NO: 221442 - DNA, 16 bp, P. troglodytes
cagaaaacttttagac

SEQ ID NO: 221443 - DNA, 16 bp, P. troglodytes
cagaaaactttttttt

SEQ ID NO: 221444 - DNA, 16 bp, P. troglodytes
cagaaaagaaatggaa

SEQ ID NO: 221445 - DNA, 16 bp, P. troglodytes
cagaaaagaagaaatg

SEQ ID NO: 221446 - DNA, 16 bp, P. troglodytes
cagaaaagacctgccc

SEQ ID NO: 221447 - DNA, 16 bp, P. troglodytes
cagaaaagagaaatga

SEQ ID NO: 221448 - DNA, 16 bp, P. troglodytes
cagaaaagatgaaaat

SEQ ID NO: 221449 - DNA, 16 bp, P. troglodytes
cagaaaagcaaatgct

SEQ ID NO: 221450 - DNA, 16 bp, P. troglodytes
cagaaaagcaagagca

SEQ ID NO: 221451 - DNA, 16 bp, P. troglodytes
cagaaaaggacaaata

SEQ ID NO: 221452 - DNA, 16 bp, P. troglodytes
cagaaaaggccttgga

SEQ ID NO: 221453 - DNA, 16 bp, P. troglodytes
cagaaaagggctccca

SEQ ID NO: 221454 - DNA, 16 bp, P. troglodytes
cagaaaagtagaaaga

SEQ ID NO: 221455 - DNA, 16 bp, P. troglodytes
cagaaaagtttcagga

SEQ ID NO: 221456 - DNA, 16 bp, P. troglodytes
cagaaaataaaatatt

SEQ ID NO: 221457 - DNA, 16 bp, P. troglodytes
cagaaaataaaggaag

SEQ ID NO: 221458 - DNA, 16 bp, P. troglodytes
cagaaaatacattctt

SEQ ID NO: 221459 - DNA, 16 bp, P. troglodytes
cagaaaatagaaaagg

SEQ ID NO: 221460 - DNA, 16 bp, P. troglodytes
cagaaaatccaaaata

SEQ ID NO: 221461 - DNA, 16 bp, P. troglodytes
cagaaaatgaaagtga

SEQ ID NO: 221462 - DNA, 16 bp, P. troglodytes
cagaaaatgcaaatta

SEQ ID NO: 221463 - DNA, 16 bp, P. troglodytes
cagaaaatggaaatga

SEQ ID NO: 221464 - DNA, 16 bp, P. troglodytes
cagaaaatggaagaga

SEQ ID NO: 221465 - DNA, 16 bp, P. troglodytes
cagaaaatggaagtga

SEQ ID NO: 221466 - DNA, 16 bp, P. troglodytes
cagaaaatgtttaaat

SEQ ID NO: 221467 - DNA, 16 bp, P. troglodytes
cagaaaattcattttt

SEQ ID NO: 221468 - DNA, 16 bp, P. troglodytes
cagaaaattgaaactg

SEQ ID NO: 221469 - DNA, 16 bp, P. troglodytes
cagaaaattttctttt

SEQ ID NO: 221470 - DNA, 16 bp, P. troglodytes
cagaaacaaatggaag

SEQ ID NO: 221471 - DNA, 16 bp, P. troglodytes
cagaaacacaaaggat

SEQ ID NO: 221472 - DNA, 16 bp, P. troglodytes
cagaaacacacagaga

SEQ ID NO: 221473 - DNA, 16 bp, P. troglodytes
cagaaacagaacattg

SEQ ID NO: 221474 - DNA, 16 bp, P. troglodytes
cagaaacagaaccaat

SEQ ID NO: 221475 - DNA, 16 bp, P. troglodytes
cagaaacagacacata

SEQ ID NO: 221476 - DNA, 16 bp, P. troglodytes
cagaaacagacacttc

SEQ ID NO: 221477 - DNA, 16 bp, P. troglodytes
cagaaacagctggatt

SEQ ID NO: 221478 - DNA, 16 bp, P. troglodytes
cagaaacatggatgga

SEQ ID NO: 221479 - DNA, 16 bp, P. troglodytes
cagaaacattttagtt

SEQ ID NO: 221480 - DNA, 16 bp, P. troglodytes
cagaaaccctacaacc

SEQ ID NO: 221481 - DNA, 16 bp, P. troglodytes
cagaaacctgcagttg

SEQ ID NO: 221482 - DNA, 16 bp, P. troglodytes
cagaaactatgagata

SEQ ID NO: 221483 - DNA, 16 bp, P. troglodytes
cagaaactcaaaagaa

SEQ ID NO: 221484 - DNA, 16 bp, P. troglodytes
cagaaactcagttgta

SEQ ID NO: 221485 - DNA, 16 bp, P. troglodytes
cagaaactgtaaaact

SEQ ID NO: 221486 - DNA, 16 bp, P. troglodytes
cagaaacttctgcaga

SEQ ID NO: 221487 - DNA, 16 bp, P. troglodytes
cagaaagaaaatgata

SEQ ID NO: 221488 - DNA, 16 bp, P. troglodytes
cagaaagaaatccaca

SEQ ID NO: 221489 - DNA, 16 bp, P. troglodytes
cagaaagacaaatatc

SEQ ID NO: 221490 - DNA, 16 bp, P. troglodytes
cagaaagacagagaca

SEQ ID NO: 221491 - DNA, 16 bp, P. troglodytes
cagaaagaggaaataa

SEQ ID NO: 221492 - DNA, 16 bp, P. troglodytes
cagaaagagtgtttca

SEQ ID NO: 221493 - DNA, 16 bp, P. troglodytes
cagaaagataacagga

SEQ ID NO: 221494 - DNA, 16 bp, P. troglodytes
cagaaagatcaaagac

SEQ ID NO: 221495 - DNA, 16 bp, P. troglodytes
cagaaagcaaagggga

SEQ ID NO: 221496 - DNA, 16 bp, P. troglodytes
cagaaagccaaatact

SEQ ID NO: 221497 - DNA, 16 bp, P. troglodytes
cagaaagccagtcttc

SEQ ID NO: 221498 - DNA, 16 bp, P. troglodytes
cagaaaggaaaaagta

SEQ ID NO: 221499 - DNA, 16 bp, P. troglodytes
cagaaaggccctggga

SEQ ID NO: 221500 - DNA, 16 bp, P. troglodytes
cagaaagtaaagaagt

SEQ ID NO: 221501 - DNA, 16 bp, P. troglodytes
cagaaagtctgaaaga

SEQ ID NO: 221502 - DNA, 16 bp, P. troglodytes
cagaaagtctttgaat

SEQ ID NO: 221503 - DNA, 16 bp, P. troglodytes
cagaaataaaaaggat

SEQ ID NO: 221504 - DNA, 16 bp, P. troglodytes
cagaaataaaatttga

SEQ ID NO: 221505 - DNA, 16 bp, P. troglodytes
cagaaataaagatctt

SEQ ID NO: 221506 - DNA, 16 bp, P. troglodytes
cagaaataaaggcaaa

SEQ ID NO: 221507 - DNA, 16 bp, P. troglodytes
cagaaataaatatatt

SEQ ID NO: 221508 - DNA, 16 bp, P. troglodytes
cagaaataaatccaaa

SEQ ID NO: 221509 - DNA, 16 bp, P. troglodytes
cagaaataaatcctca

SEQ ID NO: 221510 - DNA, 16 bp, P. troglodytes
cagaaataaatctatg

SEQ ID NO: 221511 - DNA, 16 bp, P. troglodytes
cagaaataaattaaat

SEQ ID NO: 221512 - DNA, 16 bp, P. troglodytes
cagaaataagatcaca

SEQ ID NO: 221513 - DNA, 16 bp, P. troglodytes
cagaaataagtgaaat

SEQ ID NO: 221514 - DNA, 16 bp, P. troglodytes
cagaaataataccaca

SEQ ID NO: 221515 - DNA, 16 bp, P. troglodytes
cagaaatacatgaaat

SEQ ID NO: 221516 - DNA, 16 bp, P. troglodytes
cagaaatagaaaacta

SEQ ID NO: 221517 - DNA, 16 bp, P. troglodytes
cagaaatagaaaatga

SEQ ID NO: 221518 - DNA, 16 bp, P. troglodytes
cagaaatagaagaaat

SEQ ID NO: 221519 - DNA, 16 bp, P. troglodytes
cagaaatagatgaaat

SEQ ID NO: 221520 - DNA, 16 bp, P. troglodytes
cagaaatcaacaaaat

SEQ ID NO: 221521 - DNA, 16 bp, P. troglodytes
cagaaatcaagaaatt

SEQ ID NO: 221522 - DNA, 16 bp, P. troglodytes
cagaaatcaagatgtt

SEQ ID NO: 221523 - DNA, 16 bp, P. troglodytes
cagaaatcacaacaaa

SEQ ID NO: 221524 - DNA, 16 bp, P. troglodytes
cagaaatcacccatct

SEQ ID NO: 221525 - DNA, 16 bp, P. troglodytes
cagaaatcagtagcat

SEQ ID NO: 221526 - DNA, 16 bp, P. troglodytes
cagaaatccaagccag

SEQ ID NO: 221527 - DNA, 16 bp, P. troglodytes
cagaaatctatttctc

SEQ ID NO: 221528 - DNA, 16 bp, P. troglodytes
cagaaatctgaatttt

SEQ ID NO: 221529 - DNA, 16 bp, P. troglodytes
cagaaatctttttaaa

SEQ ID NO: 221530 - DNA, 16 bp, P. troglodytes
cagaaatgaaagggaa

SEQ ID NO: 221531 - DNA, 16 bp, P. troglodytes
cagaaatgaagaagaa

SEQ ID NO: 221532 - DNA, 16 bp, P. troglodytes
cagaaatgaagaccca

SEQ ID NO: 221533 - DNA, 16 bp, P. troglodytes
cagaaatgaattattt

SEQ ID NO: 221534 - DNA, 16 bp, P. troglodytes
cagaaatgacaaaagt

SEQ ID NO: 221535 - DNA, 16 bp, P. troglodytes
cagaaatgacaaagaa

SEQ ID NO: 221536 - DNA, 16 bp, P. troglodytes
cagaaatgacacaaac

SEQ ID NO: 221537 - DNA, 16 bp, P. troglodytes
cagaaatgtattctct

SEQ ID NO: 221538 - DNA, 16 bp, P. troglodytes
cagaaatgtatttatt

SEQ ID NO: 221539 - DNA, 16 bp, P. troglodytes
cagaaatgtctccaga

SEQ ID NO: 221540 - DNA, 16 bp, P. troglodytes
cagaaatgttttaaaa

SEQ ID NO: 221541 - DNA, 16 bp, P. troglodytes
cagaaattatttttct

SEQ ID NO: 221542 - DNA, 16 bp, P. troglodytes
cagaaatttaaaaagt

SEQ ID NO: 221543 - DNA, 16 bp, P. troglodytes
cagaaatttaaaataa

SEQ ID NO: 221544 - DNA, 16 bp, P. troglodytes
cagaaatttattttct

SEQ ID NO: 221545 - DNA, 16 bp, P. troglodytes
cagaacaaatctcaaa

SEQ ID NO: 221546 - DNA, 16 bp, P. troglodytes
cagaacaagaacctgt

SEQ ID NO: 221547 - DNA, 16 bp, P. troglodytes
cagaacaagactccac

SEQ ID NO: 221548 - DNA, 16 bp, P. troglodytes
cagaacacagaggatt

SEQ ID NO: 221549 - DNA, 16 bp, P. troglodytes
cagaacagaggcctca

SEQ ID NO: 221550 - DNA, 16 bp, P. troglodytes
cagaacagcaaagatt

SEQ ID NO: 221551 - DNA, 16 bp, P. troglodytes
cagaacaggacagaga

SEQ ID NO: 221552 - DNA, 16 bp, P. troglodytes
cagaacataggcatgg

SEQ ID NO: 221553 - DNA, 16 bp, P. troglodytes
cagaacattccatcca

SEQ ID NO: 221554 - DNA, 16 bp, P. troglodytes
cagaacattttcatta

SEQ ID NO: 221555 - DNA, 16 bp, P. troglodytes
cagaacattttttttt

SEQ ID NO: 221556 - DNA, 16 bp, P. troglodytes
cagaaccagtccatgg

SEQ ID NO: 221557 - DNA, 16 bp, P. troglodytes
cagaaccatgagccaa

SEQ ID NO: 221558 - DNA, 16 bp, P. troglodytes
cagaacctctgggaca

SEQ ID NO: 221559 - DNA, 16 bp, P. troglodytes
cagaacgagaccctgt

SEQ ID NO: 221560 - DNA, 16 bp, P. troglodytes
cagaactagaaaaagc

SEQ ID NO: 221561 - DNA, 16 bp, P. troglodytes
cagaactcaaagtcat

SEQ ID NO: 221562 - DNA, 16 bp, P. troglodytes
cagaactccccacccc

SEQ ID NO: 221563 - DNA, 17 bp, P. troglodytes
cagaactcgcgctggcc

SEQ ID NO: 221564 - DNA, 16 bp, P. troglodytes
cagaactctccatccc

SEQ ID NO: 221565 - DNA, 16 bp, P. troglodytes
cagaactcttcatctt

SEQ ID NO: 221566 - DNA, 16 bp, P. troglodytes
cagaactgaaggagat

SEQ ID NO: 221567 - DNA, 16 bp, P. troglodytes
cagaactgaaggagct

SEQ ID NO: 221568 - DNA, 16 bp, P. troglodytes
cagaactgaatgaaat

SEQ ID NO: 221569 - DNA, 16 bp, P. troglodytes
cagaactgcaagaaat

SEQ ID NO: 221570 - DNA, 16 bp, P. troglodytes
cagaactgcagctgag

SEQ ID NO: 221571 - DNA, 16 bp, P. troglodytes
cagaactggaaaaaaa

SEQ ID NO: 221572 - DNA, 16 bp, P. troglodytes
cagaactggaaaaaac

SEQ ID NO: 221573 - DNA, 16 bp, P. troglodytes
cagaactggaagaaaa

SEQ ID NO: 221574 - DNA, 16 bp, P. troglodytes
cagaactggacagagg

SEQ ID NO: 221575 - DNA, 16 bp, P. troglodytes
cagaactgggagagaa

SEQ ID NO: 221576 - DNA, 16 bp, P. troglodytes
cagaactggttgagcc

SEQ ID NO: 221577 - DNA, 16 bp, P. troglodytes
cagaactgtgagacaa

SEQ ID NO: 221578 - DNA, 16 bp, P. troglodytes
cagaactgtgataaat

SEQ ID NO: 221579 - DNA, 16 bp, P. troglodytes
cagaactgttagccaa

SEQ ID NO: 221580 - DNA, 16 bp, P. troglodytes
cagaacttaaaatgaa

SEQ ID NO: 221581 - DNA, 16 bp, P. troglodytes
cagaacttctttcaaa

SEQ ID NO: 221582 - DNA, 16 bp, P. troglodytes
cagaagaaagaaactg

SEQ ID NO: 221583 - DNA, 16 bp, P. troglodytes
cagaagaaagaattaa

SEQ ID NO: 221584 - DNA, 16 bp, P. troglodytes
cagaagaaagcattgt

SEQ ID NO: 221585 - DNA, 16 bp, P. troglodytes
cagaagaaagtagaaa

SEQ ID NO: 221586 - DNA, 16 bp, P. troglodytes
cagaagaaatatttta

SEQ ID NO: 221587 - DNA, 16 bp, P. troglodytes
cagaagaaatgtctaa

SEQ ID NO: 221588 - DNA, 16 bp, P. troglodytes
cagaagaacataaatt

SEQ ID NO: 221589 - DNA, 16 bp, P. troglodytes
cagaagaacttttctt

SEQ ID NO: 221590 - DNA, 16 bp, P. troglodytes
cagaagaagaaactga

SEQ ID NO: 221591 - DNA, 16 bp, P. troglodytes
cagaagaatgaatttg

SEQ ID NO: 221592 - DNA, 18 bp, P. troglodytes
cagaagaatggcatgaac

SEQ ID NO: 221593 - DNA, 16 bp, P. troglodytes
cagaagacaagaagta

SEQ ID NO: 221594 - DNA, 16 bp, P. troglodytes
cagaagacaaggagga

SEQ ID NO: 221595 - DNA, 16 bp, P. troglodytes
cagaagacacatgaaa

SEQ ID NO: 221596 - DNA, 16 bp, P. troglodytes
cagaagacagaaataa

SEQ ID NO: 221597 - DNA, 16 bp, P. troglodytes
cagaagagaaaactaa

SEQ ID NO: 221598 - DNA, 16 bp, P. troglodytes
cagaagagaaaactga

SEQ ID NO: 221599 - DNA, 16 bp, P. troglodytes
cagaagagagccctca

SEQ ID NO: 221600 - DNA, 16 bp, P. troglodytes
cagaagagaggcctga

SEQ ID NO: 221601 - DNA, 16 bp, P. troglodytes
cagaagaggaaaatga

SEQ ID NO: 221602 - DNA, 16 bp, P. troglodytes
cagaagaggaaacagg

SEQ ID NO: 221603 - DNA, 16 bp, P. troglodytes
cagaagaggaagcagg

SEQ ID NO: 221604 - DNA, 16 bp, P. troglodytes
cagaagatctggctaa

SEQ ID NO: 221605 - DNA, 16 bp, P. troglodytes
cagaagatggatcttt

SEQ ID NO: 221606 - DNA, 16 bp, P. troglodytes
cagaagattgaagctg

SEQ ID NO: 221607 - DNA, 16 bp, P. troglodytes
cagaagcagaaaccac

SEQ ID NO: 221608 - DNA, 16 bp, P. troglodytes
cagaagcagaagctgc

SEQ ID NO: 221609 - DNA, 16 bp, P. troglodytes
cagaagcagaccctga

SEQ ID NO: 221610 - DNA, 16 bp, P. troglodytes
cagaagcagactctga

SEQ ID NO: 221611 - DNA, 16 bp, P. troglodytes
cagaagcagatgctga

SEQ ID NO: 221612 - DNA, 16 bp, P. troglodytes
cagaagcagatgctgg

SEQ ID NO: 221613 - DNA, 16 bp, P. troglodytes
cagaagcaggttgttc

SEQ ID NO: 221614 - DNA, 16 bp, P. troglodytes
cagaagcccagccagc

SEQ ID NO: 221615 - DNA, 16 bp, P. troglodytes
cagaagcctaggagga

SEQ ID NO: 221616 - DNA, 16 bp, P. troglodytes
cagaagctaagagaaa

SEQ ID NO: 221617 - DNA, 16 bp, P. troglodytes
cagaagctcagagaag

SEQ ID NO: 221618 - DNA, 16 bp, P. troglodytes
cagaagctcttagttt

SEQ ID NO: 221619 - DNA, 16 bp, P. troglodytes
cagaagctgcagaaca

SEQ ID NO: 221620 - DNA, 16 bp, P. troglodytes
cagaagctgcagcaag

SEQ ID NO: 221621 - DNA, 16 bp, P. troglodytes
cagaagctggaagaga

SEQ ID NO: 221622 - DNA, 16 bp, P. troglodytes
cagaagctggaggagg

SEQ ID NO: 221623 - DNA, 16 bp, P. troglodytes
cagaagctttttgttt

SEQ ID NO: 221624 - DNA, 16 bp, P. troglodytes
cagaaggaaagaaata

SEQ ID NO: 221625 - DNA, 16 bp, P. troglodytes
cagaaggaacaaattc

SEQ ID NO: 221626 - DNA, 16 bp, P. troglodytes
cagaaggaacacagcc

SEQ ID NO: 221627 - DNA, 16 bp, P. troglodytes
cagaaggaagaaactc

SEQ ID NO: 221628 - DNA, 16 bp, P. troglodytes
cagaaggatagcttga

SEQ ID NO: 221629 - DNA, 16 bp, P. troglodytes
cagaaggatcgtttga

SEQ ID NO: 221630 - DNA, 16 bp, P. troglodytes
cagaaggcaaaagagg

SEQ ID NO: 221631 - DNA, 16 bp, P. troglodytes
cagaaggcaaaggaga

SEQ ID NO: 221632 - DNA, 16 bp, P. troglodytes
cagaaggcagaggtgg

SEQ ID NO: 221633 - DNA, 16 bp, P. troglodytes
cagaaggcgaagggga

SEQ ID NO: 221634 - DNA, 16 bp, P. troglodytes
cagaaggctgaggctg

SEQ ID NO: 221635 - DNA, 16 bp, P. troglodytes
cagaagggaaaaataa

SEQ ID NO: 221636 - DNA, 16 bp, P. troglodytes
cagaagggaaaaggcc

SEQ ID NO: 221637 - DNA, 16 bp, P. troglodytes
cagaagggactttcct

SEQ ID NO: 221638 - DNA, 16 bp, P. troglodytes
cagaagggagaaagtg

SEQ ID NO: 221639 - DNA, 16 bp, P. troglodytes
cagaagggcaagagaa

SEQ ID NO: 221640 - DNA, 16 bp, P. troglodytes
cagaaggtagaggctg

SEQ ID NO: 221641 - DNA, 16 bp, P. troglodytes
cagaaggtcttttctt

SEQ ID NO: 221642 - DNA, 16 bp, P. troglodytes
cagaaggtgaaaagca

SEQ ID NO: 221643 - DNA, 16 bp, P. troglodytes
cagaaggtggagctca

SEQ ID NO: 221644 - DNA, 16 bp, P. troglodytes
cagaaggtggagggtg

SEQ ID NO: 221645 - DNA, 16 bp, P. troglodytes
cagaaggtttttagtt

SEQ ID NO: 221646 - DNA, 16 bp, P. troglodytes
cagaagtaacaccaca

SEQ ID NO: 221647 - DNA, 16 bp, P. troglodytes
cagaagtacaaagagg

SEQ ID NO: 221648 - DNA, 16 bp, P. troglodytes
cagaagtatgattgga

SEQ ID NO: 221649 - DNA, 16 bp, P. troglodytes
cagaagtcagcaaact

SEQ ID NO: 221650 - DNA, 16 bp, P. troglodytes
cagaagtctgttgcag

SEQ ID NO: 221651 - DNA, 16 bp, P. troglodytes
cagaagtggaatttct

SEQ ID NO: 221652 - DNA, 16 bp, P. troglodytes
cagaagtgggaggatc

SEQ ID NO: 221653 - DNA, 16 bp, P. troglodytes
cagaagtggtggcaca

SEQ ID NO: 221654 - DNA, 16 bp, P. troglodytes
cagaagttcaaaatca

SEQ ID NO: 221655 - DNA, 16 bp, P. troglodytes
cagaagttcaaggcca

SEQ ID NO: 221656 - DNA, 16 bp, P. troglodytes
cagaagttcaaggctg

SEQ ID NO: 221657 - DNA, 16 bp, P. troglodytes
cagaagtttaagacca

SEQ ID NO: 221658 - DNA, 16 bp, P. troglodytes
cagaagttttcatttt

SEQ ID NO: 221659 - DNA, 16 bp, P. troglodytes
cagaagttttttttaa

SEQ ID NO: 221660 - DNA, 16 bp, P. troglodytes
cagaataaaatgcaaa

SEQ ID NO: 221661 - DNA, 16 bp, P. troglodytes
cagaataaatttctaa

SEQ ID NO: 221662 - DNA, 16 bp, P. troglodytes
cagaatagtatttcct

SEQ ID NO: 221663 - DNA, 16 bp, P. troglodytes
cagaatagtttcagaa

SEQ ID NO: 221664 - DNA, 16 bp, P. troglodytes
cagaatataaataaat

SEQ ID NO: 221665 - DNA, 16 bp, P. troglodytes
cagaatatacatactt

SEQ ID NO: 221666 - DNA, 16 bp, P. troglodytes
cagaatatatagagaa

SEQ ID NO: 221667 - DNA, 16 bp, P. troglodytes
cagaatatatcaagaa

SEQ ID NO: 221668 - DNA, 16 bp, P. troglodytes
cagaatatgcattatt

SEQ ID NO: 221669 - DNA, 16 bp, P. troglodytes
cagaatcacttgaacc

SEQ ID NO: 221670 - DNA, 16 bp, P. troglodytes
cagaatcagaaaaaac

SEQ ID NO: 221671 - DNA, 16 bp, P. troglodytes
cagaatctacaaaaaa

SEQ ID NO: 221672 - DNA, 16 bp, P. troglodytes
cagaatctccctctgt

SEQ ID NO: 221673 - DNA, 16 bp, P. troglodytes
cagaatctcgctctgt

SEQ ID NO: 221674 - DNA, 16 bp, P. troglodytes
cagaatctctggggca

SEQ ID NO: 221675 - DNA, 16 bp, P. troglodytes
cagaatctgaatttta

SEQ ID NO: 221676 - DNA, 16 bp, P. troglodytes
cagaatctgcatctta

SEQ ID NO: 221677 - DNA, 16 bp, P. troglodytes
cagaatcttggctcac

SEQ ID NO: 221678 - DNA, 16 bp, P. troglodytes
cagaatgaaaatgaaa

SEQ ID NO: 221679 - DNA, 16 bp, P. troglodytes
cagaatgaagaacaaa

SEQ ID NO: 221680 - DNA, 16 bp, P. troglodytes
cagaatgaagaataaa

SEQ ID NO: 221681 - DNA, 16 bp, P. troglodytes
cagaatgaaggaaaaa

SEQ ID NO: 221682 - DNA, 16 bp, P. troglodytes
cagaatgaagggaaaa

SEQ ID NO: 221683 - DNA, 16 bp, P. troglodytes
cagaatgaagggcaaa

SEQ ID NO: 221684 - DNA, 16 bp, P. troglodytes
cagaatgagagccaag

SEQ ID NO: 221685 - DNA, 16 bp, P. troglodytes
cagaatgatgttggcc

SEQ ID NO: 221686 - DNA, 16 bp, P. troglodytes
cagaatgcaagagctg

SEQ ID NO: 221687 - DNA, 16 bp, P. troglodytes
cagaatgcctcttctc

SEQ ID NO: 221688 - DNA, 16 bp, P. troglodytes
cagaatggaacagaac

SEQ ID NO: 221689 - DNA, 16 bp, P. troglodytes
cagaatggaagaaaat

SEQ ID NO: 221690 - DNA, 16 bp, P. troglodytes
cagaatgggaaaatat

SEQ ID NO: 221691 - DNA, 16 bp, P. troglodytes
cagaatgggaagaaat

SEQ ID NO: 221692 - DNA, 16 bp, P. troglodytes
cagaatgggagaaata

SEQ ID NO: 221693 - DNA, 16 bp, P. troglodytes
cagaatgggaggcagg

SEQ ID NO: 221694 - DNA, 16 bp, P. troglodytes
cagaatggtagatcca

SEQ ID NO: 221695 - DNA, 16 bp, P. troglodytes
cagaatggttgtatgg

SEQ ID NO: 221696 - DNA, 16 bp, P. troglodytes
cagaatgtccttcctt

SEQ ID NO: 221697 - DNA, 16 bp, P. troglodytes
cagaatgtgaccttct

SEQ ID NO: 221698 - DNA, 16 bp, P. troglodytes
cagaatgtgacttcat

SEQ ID NO: 221699 - DNA, 16 bp, P. troglodytes
cagaatgtgggacatt

SEQ ID NO: 221700 - DNA, 16 bp, P. troglodytes
cagaattaaagacaaa

SEQ ID NO: 221701 - DNA, 16 bp, P. troglodytes
cagaattaatcaagca

SEQ ID NO: 221702 - DNA, 16 bp, P. troglodytes
cagaattagaagaaaa

SEQ ID NO: 221703 - DNA, 16 bp, P. troglodytes
cagaattagagaaaac

SEQ ID NO: 221704 - DNA, 16 bp, P. troglodytes
cagaattaggaaaaaa

SEQ ID NO: 221705 - DNA, 16 bp, P. troglodytes
cagaattcaaacccag

SEQ ID NO: 221706 - DNA, 16 bp, P. troglodytes
cagaattcatttcttt

SEQ ID NO: 221707 - DNA, 16 bp, P. troglodytes
cagaattcattttctt

SEQ ID NO: 221708 - DNA, 16 bp, P. troglodytes
cagaattcccacgtgt

SEQ ID NO: 221709 - DNA, 16 bp, P. troglodytes
cagaattgaagaaaat

SEQ ID NO: 221710 - DNA, 16 bp, P. troglodytes
cagaattggaagaaaa

SEQ ID NO: 221711 - DNA, 16 bp, P. troglodytes
cagaattgtgaaaaat

SEQ ID NO: 221712 - DNA, 16 bp, P. troglodytes
cagaattgtgagccaa

SEQ ID NO: 221713 - DNA, 16 bp, P. troglodytes
cagaattgtgaggaaa

SEQ ID NO: 221714 - DNA, 16 bp, P. troglodytes
cagaatttctatttgg

SEQ ID NO: 221715 - DNA, 16 bp, P. troglodytes
cagaatttctgtttct

SEQ ID NO: 221716 - DNA, 16 bp, P. troglodytes
cagaatttcttcttct

SEQ ID NO: 221717 - DNA, 16 bp, P. troglodytes
cagaatttgatttttt

SEQ ID NO: 221718 - DNA, 16 bp, P. troglodytes
cagaattttgagaccc

SEQ ID NO: 221719 - DNA, 16 bp, P. troglodytes
cagaatttttaaagaa

SEQ ID NO: 221720 - DNA, 16 bp, P. troglodytes
cagacaaaataaactt

SEQ ID NO: 221721 - DNA, 16 bp, P. troglodytes
cagacaaatgaaagct

SEQ ID NO: 221722 - DNA, 16 bp, P. troglodytes
cagacaaatggaaaaa

SEQ ID NO: 221723 - DNA, 16 bp, P. troglodytes
cagacaaccagtctga

SEQ ID NO: 221724 - DNA, 16 bp, P. troglodytes
cagacaactcacagaa

SEQ ID NO: 221725 - DNA, 16 bp, P. troglodytes
cagacaagaaagaatg

SEQ ID NO: 221726 - DNA, 16 bp, P. troglodytes
cagacaagcaaattct

SEQ ID NO: 221727 - DNA, 16 bp, P. troglodytes
cagacaaggaaaccaa

SEQ ID NO: 221728 - DNA, 16 bp, P. troglodytes
cagacaagggaagaga

SEQ ID NO: 221729 - DNA, 16 bp, P. troglodytes
cagacaagttacttaa

SEQ ID NO: 221730 - DNA, 16 bp, P. troglodytes
cagacaattttcaaaa

SEQ ID NO: 221731 - DNA, 16 bp, P. troglodytes
cagacacacccaggat

SEQ ID NO: 221732 - DNA, 16 bp, P. troglodytes
cagacacactcagaaa

SEQ ID NO: 221733 - DNA, 16 bp, P. troglodytes
cagacacagaaggcca

SEQ ID NO: 221734 - DNA, 16 bp, P. troglodytes
cagacacataaacaca

SEQ ID NO: 221735 - DNA, 16 bp, P. troglodytes
cagacacatatataca

SEQ ID NO: 221736 - DNA, 16 bp, P. troglodytes
cagacaccatctcaaa

SEQ ID NO: 221737 - DNA, 16 bp, P. troglodytes
cagacactcccagagc

SEQ ID NO: 221738 - DNA, 16 bp, P. troglodytes
cagacactgtgctggg

SEQ ID NO: 221739 - DNA, 16 bp, P. troglodytes
cagacacttgaaaaaa

SEQ ID NO: 221740 - DNA, 16 bp, P. troglodytes
cagacacttgccacca

SEQ ID NO: 221741 - DNA, 16 bp, P. troglodytes
cagacactttaccaaa

SEQ ID NO: 221742 - DNA, 16 bp, P. troglodytes
cagacagaaaaatcaa

SEQ ID NO: 221743 - DNA, 16 bp, P. troglodytes
cagacagaagaggaga

SEQ ID NO: 221744 - DNA, 16 bp, P. troglodytes
cagacagacaaacaga

SEQ ID NO: 221745 - DNA, 16 bp, P. troglodytes
cagacagacagacaaa

SEQ ID NO: 221746 - DNA, 16 bp, P. troglodytes
cagacagacagacaca

SEQ ID NO: 221747 - DNA, 16 bp, P. troglodytes
cagacagacagacagc

SEQ ID NO: 221748 - DNA, 16 bp, P. troglodytes
cagacagacagagcag

SEQ ID NO: 221749 - DNA, 16 bp, P. troglodytes
cagacagacagatgga

SEQ ID NO: 221750 - DNA, 16 bp, P. troglodytes
cagacagagacacaga

SEQ ID NO: 221751 - DNA, 16 bp, P. troglodytes
cagacagagagagaca

SEQ ID NO: 221752 - DNA, 16 bp, P. troglodytes
cagacagagtctcgct

SEQ ID NO: 221753 - DNA, 16 bp, P. troglodytes
cagacagatgatagat

SEQ ID NO: 221754 - DNA, 16 bp, P. troglodytes
cagacagcagcattca

SEQ ID NO: 221755 - DNA, 16 bp, P. troglodytes
cagacagggtctcact

SEQ ID NO: 221756 - DNA, 17 bp, P. troglodytes
cagacagtgggcacagg

SEQ ID NO: 221757 - DNA, 16 bp, P. troglodytes
cagacatacatatata

SEQ ID NO: 221758 - DNA, 16 bp, P. troglodytes
cagacatagtggcatg

SEQ ID NO: 221759 - DNA, 16 bp, P. troglodytes
cagacatcctacagaa

SEQ ID NO: 221760 - DNA, 16 bp, P. troglodytes
cagacatgcaagccct

SEQ ID NO: 221761 - DNA, 16 bp, P. troglodytes
cagacatggggagaac

SEQ ID NO: 221762 - DNA, 16 bp, P. troglodytes
cagacattcaaagaaa

SEQ ID NO: 221763 - DNA, 16 bp, P. troglodytes
cagacattcaacttct

SEQ ID NO: 221764 - DNA, 16 bp, P. troglodytes
cagacatttactgagc

SEQ ID NO: 221765 - DNA, 16 bp, P. troglodytes
cagacatttcctttct

SEQ ID NO: 221766 - DNA, 18 bp, P. troglodytes
cagacatttgctaacttg

SEQ ID NO: 221767 - DNA, 16 bp, P. troglodytes
cagacattttttttct

SEQ ID NO: 221768 - DNA, 16 bp, P. troglodytes
cagaccaataacaaat

SEQ ID NO: 221769 - DNA, 16 bp, P. troglodytes
cagaccacagcagaat

SEQ ID NO: 221770 - DNA, 17 bp, P. troglodytes
cagaccagcctggccac

SEQ ID NO: 221771 - DNA, 16 bp, P. troglodytes
cagaccaggaaattcc

SEQ ID NO: 221772 - DNA, 16 bp, P. troglodytes
cagaccaggagattcc

SEQ ID NO: 221773 - DNA, 16 bp, P. troglodytes
cagaccatcaggcatt

SEQ ID NO: 221774 - DNA, 16 bp, P. troglodytes
cagaccatccacatca

SEQ ID NO: 221775 - DNA, 16 bp, P. troglodytes
cagaccctgtgggaaa

SEQ ID NO: 221776 - DNA, 16 bp, P. troglodytes
cagacccttcagaaat

SEQ ID NO: 221777 - DNA, 16 bp, P. troglodytes
cagacctgaagctgag

SEQ ID NO: 221778 - DNA, 16 bp, P. troglodytes
cagacctgagccacca

SEQ ID NO: 221779 - DNA, 16 bp, P. troglodytes
cagacctgcaccacca

SEQ ID NO: 221780 - DNA, 16 bp, P. troglodytes
cagacctgggtttgag

SEQ ID NO: 221781 - DNA, 16 bp, P. troglodytes
cagacgcttataaaac

SEQ ID NO: 221782 - DNA, 16 bp, P. troglodytes
cagacggagtctcact

SEQ ID NO: 221783 - DNA, 17 bp, P. troglodytes
cagacggggcggttgcc

SEQ ID NO: 221784 - DNA, 16 bp, P. troglodytes
cagacggggtggctgc

SEQ ID NO: 221785 - DNA, 16 bp, P. troglodytes
cagacggggtttctcc

SEQ ID NO: 221786 - DNA, 16 bp, P. troglodytes
cagacgtgcaccacca

SEQ ID NO: 221787 - DNA, 19 bp, P. troglodytes
cagactaaaccaggaagaa

SEQ ID NO: 221788 - DNA, 16 bp, P. troglodytes
cagactaacaacagat

SEQ ID NO: 221789 - DNA, 16 bp, P. troglodytes
cagactaataaagaag

SEQ ID NO: 221790 - DNA, 16 bp, P. troglodytes
cagactccatctccaa

SEQ ID NO: 221791 - DNA, 19 bp, P. troglodytes
cagactcccacacaataat

SEQ ID NO: 221792 - DNA, 16 bp, P. troglodytes
cagactcccttgcagc

SEQ ID NO: 221793 - DNA, 16 bp, P. troglodytes
cagactcctgacttca

SEQ ID NO: 221794 - DNA, 16 bp, P. troglodytes
cagactctcactctgt

SEQ ID NO: 221795 - DNA, 16 bp, P. troglodytes
cagactctgcctcaaa

SEQ ID NO: 221796 - DNA, 16 bp, P. troglodytes
cagactctgcctccca

SEQ ID NO: 221797 - DNA, 16 bp, P. troglodytes
cagactctgtctccaa

SEQ ID NO: 221798 - DNA, 16 bp, P. troglodytes
cagactgaaggctgca

SEQ ID NO: 221799 - DNA, 17 bp, P. troglodytes
cagactgaagtgcaatg

SEQ ID NO: 221800 - DNA, 16 bp, P. troglodytes
cagactgacaccccac

SEQ ID NO: 221801 - DNA, 16 bp, P. troglodytes
cagactgcagtgagct

SEQ ID NO: 221802 - DNA, 28 bp, P. troglodytes
cagactgcctcctcaagtgggtccctga

SEQ ID NO: 221803 - DNA, 16 bp, P. troglodytes
cagactgctttccaaa

SEQ ID NO: 221804 - DNA, 16 bp, P. troglodytes
cagactggagtgaaat

SEQ ID NO: 221805 - DNA, 16 bp, P. troglodytes
cagactggcttccttc

SEQ ID NO: 221806 - DNA, 16 bp, P. troglodytes
cagactgggagctccc

SEQ ID NO: 221807 - DNA, 16 bp, P. troglodytes
cagactgggtgcagtg

SEQ ID NO: 221808 - DNA, 16 bp, P. troglodytes
cagactgttttccaca

SEQ ID NO: 221809 - DNA, 16 bp, P. troglodytes
cagacttacagaaaag

SEQ ID NO: 221810 - DNA, 16 bp, P. troglodytes
cagacttctggcctcc

SEQ ID NO: 221811 - DNA, 16 bp, P. troglodytes
cagacttgcatgaggc

SEQ ID NO: 221812 - DNA, 16 bp, P. troglodytes
cagagaaaaaatattt

SEQ ID NO: 221813 - DNA, 16 bp, P. troglodytes
cagagaaaaaggaatg

SEQ ID NO: 221814 - DNA, 16 bp, P. troglodytes
cagagaaaacagattt

SEQ ID NO: 221815 - DNA, 16 bp, P. troglodytes
cagagaaaaggaaata

SEQ ID NO: 221816 - DNA, 16 bp, P. troglodytes
cagagaaaagggagca

SEQ ID NO: 221817 - DNA, 16 bp, P. troglodytes
cagagaaacagaacca

SEQ ID NO: 221818 - DNA, 16 bp, P. troglodytes
cagagaaagccctcag

SEQ ID NO: 221819 - DNA, 16 bp, P. troglodytes
cagagaaaggagcagg

SEQ ID NO: 221820 - DNA, 16 bp, P. troglodytes
cagagaaaggcgaagc

SEQ ID NO: 221821 - DNA, 16 bp, P. troglodytes
cagagaaaggtgaaaa

SEQ ID NO: 221822 - DNA, 16 bp, P. troglodytes
cagagaacaacccctt

SEQ ID NO: 221823 - DNA, 16 bp, P. troglodytes
cagagaacaccacaga

SEQ ID NO: 221824 - DNA, 16 bp, P. troglodytes
cagagaacctggagtt

SEQ ID NO: 221825 - DNA, 16 bp, P. troglodytes
cagagaactccacaaa

SEQ ID NO: 221826 - DNA, 16 bp, P. troglodytes
cagagaactttccaaa

SEQ ID NO: 221827 - DNA, 16 bp, P. troglodytes
cagagaagaaaatgaa

SEQ ID NO: 221828 - DNA, 16 bp, P. troglodytes
cagagaagaatcaaat

SEQ ID NO: 221829 - DNA, 16 bp, P. troglodytes
cagagaagatgcttga

SEQ ID NO: 221830 - DNA, 16 bp, P. troglodytes
cagagaagcttcttct

SEQ ID NO: 221831 - DNA, 16 bp, P. troglodytes
cagagaaggaaactga

SEQ ID NO: 221832 - DNA, 16 bp, P. troglodytes
cagagaagggaagatg

SEQ ID NO: 221833 - DNA, 16 bp, P. troglodytes
cagagaagtaaagtga

SEQ ID NO: 221834 - DNA, 16 bp, P. troglodytes
cagagaagttaaatga

SEQ ID NO: 221835 - DNA, 16 bp, P. troglodytes
cagagaagttaagaaa

SEQ ID NO: 221836 - DNA, 16 bp, P. troglodytes
cagagaatataaagca

SEQ ID NO: 221837 - DNA, 16 bp, P. troglodytes
cagagaatattataaa

SEQ ID NO: 221838 - DNA, 16 bp, P. troglodytes
cagagaatggcatgaa

SEQ ID NO: 221839 - DNA, 16 bp, P. troglodytes
cagagacaaagacaga

SEQ ID NO: 221840 - DNA, 16 bp, P. troglodytes
cagagacacaataaaa

SEQ ID NO: 221841 - DNA, 16 bp, P. troglodytes
cagagacacacaggga

SEQ ID NO: 221842 - DNA, 16 bp, P. troglodytes
cagagacacacataag

SEQ ID NO: 221843 - DNA, 16 bp, P. troglodytes
cagagacacagagaag

SEQ ID NO: 221844 - DNA, 16 bp, P. troglodytes
cagagacacagagaca

SEQ ID NO: 221845 - DNA, 16 bp, P. troglodytes
cagagacactcctcag

SEQ ID NO: 221846 - DNA, 16 bp, P. troglodytes
cagagacagaaacaga

SEQ ID NO: 221847 - DNA, 16 bp, P. troglodytes
cagagacaggaagtga

SEQ ID NO: 221848 - DNA, 16 bp, P. troglodytes
cagagacatacatagg

SEQ ID NO: 221849 - DNA, 16 bp, P. troglodytes
cagagaccagtttcat

SEQ ID NO: 221850 - DNA, 16 bp, P. troglodytes
cagagacccaggagag

SEQ ID NO: 221851 - DNA, 16 bp, P. troglodytes
cagagacccaggagct

SEQ ID NO: 221852 - DNA, 16 bp, P. troglodytes
cagagacccaggagtt

SEQ ID NO: 221853 - DNA, 16 bp, P. troglodytes
cagagactgggaaggg

SEQ ID NO: 221854 - DNA, 16 bp, P. troglodytes
cagagactgttatgaa

SEQ ID NO: 221855 - DNA, 16 bp, P. troglodytes
cagagagaacagcaag

SEQ ID NO: 221856 - DNA, 16 bp, P. troglodytes
cagagagacaaatacc

SEQ ID NO: 221857 - DNA, 16 bp, P. troglodytes
cagagagacagagaca

SEQ ID NO: 221858 - DNA, 16 bp, P. troglodytes
cagagagacagatttg

SEQ ID NO: 221859 - DNA, 16 bp, P. troglodytes
cagagagaccccatct

SEQ ID NO: 221860 - DNA, 16 bp, P. troglodytes
cagagagagacagaga

SEQ ID NO: 221861 - DNA, 16 bp, P. troglodytes
cagagagaggctctct

SEQ ID NO: 221862 - DNA, 16 bp, P. troglodytes
cagagagatgaagtaa

SEQ ID NO: 221863 - DNA, 16 bp, P. troglodytes
cagagagatttgaaga

SEQ ID NO: 221864 - DNA, 16 bp, P. troglodytes
cagagagccaaaacat

SEQ ID NO: 221865 - DNA, 16 bp, P. troglodytes
cagagagctatgattg

SEQ ID NO: 221866 - DNA, 16 bp, P. troglodytes
cagagagctgccttgc

SEQ ID NO: 221867 - DNA, 16 bp, P. troglodytes
cagagagcttaaataa

SEQ ID NO: 221868 - DNA, 16 bp, P. troglodytes
cagagagcttctgggt

SEQ ID NO: 221869 - DNA, 16 bp, P. troglodytes
cagagaggagctaccc

SEQ ID NO: 221870 - DNA, 16 bp, P. troglodytes
cagagaggaggaagtg

SEQ ID NO: 221871 - DNA, 16 bp, P. troglodytes
cagagaggatgtggag

SEQ ID NO: 221872 - DNA, 16 bp, P. troglodytes
cagagaggcctgactg

SEQ ID NO: 221873 - DNA, 16 bp, P. troglodytes
cagagaggcctttcct

SEQ ID NO: 221874 - DNA, 16 bp, P. troglodytes
cagagagggacagaga

SEQ ID NO: 221875 - DNA, 16 bp, P. troglodytes
cagagagggctgcctg

SEQ ID NO: 221876 - DNA, 16 bp, P. troglodytes
cagagaggggaagtga

SEQ ID NO: 221877 - DNA, 16 bp, P. troglodytes
cagagagggttcttgg

SEQ ID NO: 221878 - DNA, 16 bp, P. troglodytes
cagagaggtaaaatga

SEQ ID NO: 221879 - DNA, 16 bp, P. troglodytes
cagagaggtcttccct

SEQ ID NO: 221880 - DNA, 16 bp, P. troglodytes
cagagaggtgatgtga

SEQ ID NO: 221881 - DNA, 16 bp, P. troglodytes
cagagaggttaagaaa

SEQ ID NO: 221882 - DNA, 16 bp, P. troglodytes
cagagaggttaagaga

SEQ ID NO: 221883 - DNA, 16 bp, P. troglodytes
cagagaggttaagtaa

SEQ ID NO: 221884 - DNA, 16 bp, P. troglodytes
cagagaggttgagcaa

SEQ ID NO: 221885 - DNA, 16 bp, P. troglodytes
cagagaggttgagtaa

SEQ ID NO: 221886 - DNA, 16 bp, P. troglodytes
cagagagtcaaatcat

SEQ ID NO: 221887 - DNA, 16 bp, P. troglodytes
cagagatacagatcaa

SEQ ID NO: 221888 - DNA, 16 bp, P. troglodytes
cagagatcctgaagag

SEQ ID NO: 221889 - DNA, 16 bp, P. troglodytes
cagagatgaaaaagac

SEQ ID NO: 221890 - DNA, 16 bp, P. troglodytes
cagagatggagacaga

SEQ ID NO: 221891 - DNA, 16 bp, P. troglodytes
cagagatggggtttca

SEQ ID NO: 221892 - DNA, 16 bp, P. troglodytes
cagagattctgctatg

SEQ ID NO: 221893 - DNA, 16 bp, P. troglodytes
cagagattgcagtgaa

SEQ ID NO: 221894 - DNA, 16 bp, P. troglodytes
cagagatttatttatt

SEQ ID NO: 221895 - DNA, 16 bp, P. troglodytes
cagagatttcccatat

SEQ ID NO: 221896 - DNA, 16 bp, P. troglodytes
cagagatttttgtctg

SEQ ID NO: 221897 - DNA, 16 bp, P. troglodytes
cagagcaaaaaggctg

SEQ ID NO: 221898 - DNA, 16 bp, P. troglodytes
cagagcaaaaataaat

SEQ ID NO: 221899 - DNA, 16 bp, P. troglodytes
cagagcaaagactcca

SEQ ID NO: 221900 - DNA, 16 bp, P. troglodytes
cagagcaagacagtgt

SEQ ID NO: 221901 - DNA, 16 bp, P. troglodytes
cagagcaagactttct

SEQ ID NO: 221902 - DNA, 16 bp, P. troglodytes
cagagcaagagagaga

SEQ ID NO: 221903 - DNA, 16 bp, P. troglodytes
cagagcaagatcctgt

SEQ ID NO: 221904 - DNA, 16 bp, P. troglodytes
cagagcaagcctctgt

SEQ ID NO: 221905 - DNA, 16 bp, P. troglodytes
cagagcaaggccctgt

SEQ ID NO: 221906 - DNA, 16 bp, P. troglodytes
cagagcaagtctccgt

SEQ ID NO: 221907 - DNA, 16 bp, P. troglodytes
cagagcaattccatct

SEQ ID NO: 221908 - DNA, 16 bp, P. troglodytes
cagagcaccaagtccc

SEQ ID NO: 221909 - DNA, 16 bp, P. troglodytes
cagagcacctctcctc

SEQ ID NO: 221910 - DNA, 16 bp, P. troglodytes
cagagcacctggggga

SEQ ID NO: 221911 - DNA, 16 bp, P. troglodytes
cagagcacgaccctgt

SEQ ID NO: 221912 - DNA, 16 bp, P. troglodytes
cagagcagcagcagca

SEQ ID NO: 221913 - DNA, 16 bp, P. troglodytes
cagagcagcccctccc

SEQ ID NO: 221914 - DNA, 16 bp, P. troglodytes
cagagcagcctggcca

SEQ ID NO: 221915 - DNA, 16 bp, P. troglodytes
cagagcagcctgggca

SEQ ID NO: 221916 - DNA, 16 bp, P. troglodytes
cagagcaggagagaga

SEQ ID NO: 221917 - DNA, 16 bp, P. troglodytes
cagagcaggaggcccc

SEQ ID NO: 221918 - DNA, 16 bp, P. troglodytes
cagagcaggagggaga

SEQ ID NO: 221919 - DNA, 16 bp, P. troglodytes
cagagcaggatcctgt

SEQ ID NO: 221920 - DNA, 16 bp, P. troglodytes
cagagcagtgcctggc

SEQ ID NO: 221921 - DNA, 16 bp, P. troglodytes
cagagcagtgtgtgga

SEQ ID NO: 221922 - DNA, 16 bp, P. troglodytes
cagagcatgtcagagg

SEQ ID NO: 221923 - DNA, 16 bp, P. troglodytes
cagagccagagccaga

SEQ ID NO: 221924 - DNA, 16 bp, P. troglodytes
cagagccagcagcagc

SEQ ID NO: 221925 - DNA, 16 bp, P. troglodytes
cagagccagctgtgtg

SEQ ID NO: 221926 - DNA, 16 bp, P. troglodytes
cagagccaggactaga

SEQ ID NO: 221927 - DNA, 16 bp, P. troglodytes
cagagccaggatttaa

SEQ ID NO: 221928 - DNA, 16 bp, P. troglodytes
cagagccatgagccaa

SEQ ID NO: 221929 - DNA, 16 bp, P. troglodytes
cagagcccaaggccca

SEQ ID NO: 221930 - DNA, 16 bp, P. troglodytes
cagagcccatcccttt

SEQ ID NO: 221931 - DNA, 17 bp, P. troglodytes
cagagccggctgtgtgg

SEQ ID NO: 221932 - DNA, 16 bp, P. troglodytes
cagagcctgaggcagg

SEQ ID NO: 221933 - DNA, 16 bp, P. troglodytes
cagagcctgttgtggg

SEQ ID NO: 221934 - DNA, 16 bp, P. troglodytes
cagagccttactctgt

SEQ ID NO: 221935 - DNA, 16 bp, P. troglodytes
cagagccttctcctgt

SEQ ID NO: 221936 - DNA, 16 bp, P. troglodytes
cagagctccttggaga

SEQ ID NO: 221937 - DNA, 16 bp, P. troglodytes
cagagctgagttcaag

SEQ ID NO: 221938 - DNA, 16 bp, P. troglodytes
cagagctgcccaagat

SEQ ID NO: 221939 - DNA, 16 bp, P. troglodytes
cagagctgctcaaggc

SEQ ID NO: 221940 - DNA, 16 bp, P. troglodytes
cagagctgctgtaaca

SEQ ID NO: 221941 - DNA, 16 bp, P. troglodytes
cagagctggaaggggc

SEQ ID NO: 221942 - DNA, 16 bp, P. troglodytes
cagagctggagtgcag

SEQ ID NO: 221943 - DNA, 16 bp, P. troglodytes
cagagctggctgtgtg

SEQ ID NO: 221944 - DNA, 16 bp, P. troglodytes
cagagctgggaccaga

SEQ ID NO: 221945 - DNA, 16 bp, P. troglodytes
cagagctgggacttga

SEQ ID NO: 221946 - DNA, 16 bp, P. troglodytes
cagagctgggatggga

SEQ ID NO: 221947 - DNA, 16 bp, P. troglodytes
cagagctgggcctggg

SEQ ID NO: 221948 - DNA, 16 bp, P. troglodytes
cagagctggggaggcc

SEQ ID NO: 221949 - DNA, 16 bp, P. troglodytes
cagagctggggctgga

SEQ ID NO: 221950 - DNA, 16 bp, P. troglodytes
cagagctggggcttga

SEQ ID NO: 221951 - DNA, 16 bp, P. troglodytes
cagagctgtgcagatt

SEQ ID NO: 221952 - DNA, 16 bp, P. troglodytes
cagagcttcaaaggac

SEQ ID NO: 221953 - DNA, 16 bp, P. troglodytes
cagagcttccagaagg

SEQ ID NO: 221954 - DNA, 16 bp, P. troglodytes
cagagcttgcagagag

SEQ ID NO: 221955 - DNA, 16 bp, P. troglodytes
cagaggaaaagaaata

SEQ ID NO: 221956 - DNA, 16 bp, P. troglodytes
cagaggaaaagaagcc

SEQ ID NO: 221957 - DNA, 16 bp, P. troglodytes
cagaggaagaaactaa

SEQ ID NO: 221958 - DNA, 16 bp, P. troglodytes
cagaggaagagaagac

SEQ ID NO: 221959 - DNA, 16 bp, P. troglodytes
cagaggaagagactga

SEQ ID NO: 221960 - DNA, 16 bp, P. troglodytes
cagaggaagcatggcc

SEQ ID NO: 221961 - DNA, 16 bp, P. troglodytes
cagaggaaggaacagg

SEQ ID NO: 221962 - DNA, 16 bp, P. troglodytes
cagaggaaggagcaga

SEQ ID NO: 221963 - DNA, 16 bp, P. troglodytes
cagaggaaggatcaga

SEQ ID NO: 221964 - DNA, 16 bp, P. troglodytes
cagaggaaggatcagg

SEQ ID NO: 221965 - DNA, 16 bp, P. troglodytes
cagaggaaggggaaca

SEQ ID NO: 221966 - DNA, 16 bp, P. troglodytes
cagaggaatgtggaag

SEQ ID NO: 221967 - DNA, 16 bp, P. troglodytes
cagaggacccagctaa

SEQ ID NO: 221968 - DNA, 16 bp, P. troglodytes
cagaggactttttttt

SEQ ID NO: 221969 - DNA, 16 bp, P. troglodytes
cagaggagaaggccac

SEQ ID NO: 221970 - DNA, 16 bp, P. troglodytes
cagaggagactgacat

SEQ ID NO: 221971 - DNA, 16 bp, P. troglodytes
cagaggagcagcagca

SEQ ID NO: 221972 - DNA, 16 bp, P. troglodytes
cagaggaggaaacaga

SEQ ID NO: 221973 - DNA, 16 bp, P. troglodytes
cagaggaggaagctga

SEQ ID NO: 221974 - DNA, 16 bp, P. troglodytes
cagaggagttaagtaa

SEQ ID NO: 221975 - DNA, 16 bp, P. troglodytes
cagaggcacagagaga

SEQ ID NO: 221976 - DNA, 16 bp, P. troglodytes
cagaggcagaagttgc

SEQ ID NO: 221977 - DNA, 16 bp, P. troglodytes
cagaggcagagactga

SEQ ID NO: 221978 - DNA, 16 bp, P. troglodytes
cagaggcagagattag

SEQ ID NO: 221979 - DNA, 16 bp, P. troglodytes
cagaggcagagcctgg

SEQ ID NO: 221980 - DNA, 16 bp, P. troglodytes
cagaggcagaggaaaa

SEQ ID NO: 221981 - DNA, 16 bp, P. troglodytes
cagaggcagaggctgc

SEQ ID NO: 221982 - DNA, 16 bp, P. troglodytes
cagaggcagagggaga

SEQ ID NO: 221983 - DNA, 16 bp, P. troglodytes
cagaggcaggaagatc

SEQ ID NO: 221984 - DNA, 16 bp, P. troglodytes
cagaggcaggatttga

SEQ ID NO: 221985 - DNA, 21 bp, P. troglodytes
cagaggcaggcaggcctcctt

SEQ ID NO: 221986 - DNA, 16 bp, P. troglodytes
cagaggcaggcagtcc

SEQ ID NO: 221987 - DNA, 16 bp, P. troglodytes
cagaggcagggggatc

SEQ ID NO: 221988 - DNA, 16 bp, P. troglodytes
cagaggcagtggctca

SEQ ID NO: 221989 - DNA, 16 bp, P. troglodytes
cagaggcatgagaatc

SEQ ID NO: 221990 - DNA, 16 bp, P. troglodytes
cagaggccaaggagga

SEQ ID NO: 221991 - DNA, 16 bp, P. troglodytes
cagaggccacagtgag

SEQ ID NO: 221992 - DNA, 16 bp, P. troglodytes
cagaggccagagatgc

SEQ ID NO: 221993 - DNA, 16 bp, P. troglodytes
cagaggccaggcatgg

SEQ ID NO: 221994 - DNA, 16 bp, P. troglodytes
cagaggcccagaaagg

SEQ ID NO: 221995 - DNA, 16 bp, P. troglodytes
cagaggcccagagagg

SEQ ID NO: 221996 - DNA, 16 bp, P. troglodytes
cagaggcctaggaagg

SEQ ID NO: 221997 - DNA, 16 bp, P. troglodytes
cagaggcctggcctgg

SEQ ID NO: 221998 - DNA, 16 bp, P. troglodytes
cagaggcggaggttgc

SEQ ID NO: 221999 - DNA, 16 bp, P. troglodytes
cagaggctacagtgag

SEQ ID NO: 222000 - DNA, 16 bp, P. troglodytes
cagaggctgagaagag

SEQ ID NO: 222001 - DNA, 16 bp, P. troglodytes
cagaggctgaggcacg

SEQ ID NO: 222002 - DNA, 16 bp, P. troglodytes
cagaggctgcaggagg

SEQ ID NO: 222003 - DNA, 16 bp, P. troglodytes
cagaggctgcagggag

SEQ ID NO: 222004 - DNA, 16 bp, P. troglodytes
cagaggctggaaagag

SEQ ID NO: 222005 - DNA, 16 bp, P. troglodytes
cagaggctggaattag

SEQ ID NO: 222006 - DNA, 16 bp, P. troglodytes
cagaggctggaggagg

SEQ ID NO: 222007 - DNA, 16 bp, P. troglodytes
cagaggctgggcaggg

SEQ ID NO: 222008 - DNA, 16 bp, P. troglodytes
cagaggctgggcctgg

SEQ ID NO: 222009 - DNA, 16 bp, P. troglodytes
cagaggctggggaaag

SEQ ID NO: 222010 - DNA, 16 bp, P. troglodytes
cagaggctggggcagg

SEQ ID NO: 222011 - DNA, 16 bp, P. troglodytes
cagaggcttggaaggg

SEQ ID NO: 222012 - DNA, 16 bp, P. troglodytes
cagagggaagacaatg

SEQ ID NO: 222013 - DNA, 16 bp, P. troglodytes
cagagggaagacacag

SEQ ID NO: 222014 - DNA, 16 bp, P. troglodytes
cagagggaagagacaa

SEQ ID NO: 222015 - DNA, 16 bp, P. troglodytes
cagagggaccagctgg

SEQ ID NO: 222016 - DNA, 16 bp, P. troglodytes
cagagggagacccagt

SEQ ID NO: 222017 - DNA, 16 bp, P. troglodytes
cagagggagaccttgt

SEQ ID NO: 222018 - DNA, 16 bp, P. troglodytes
cagagggagactgtgt

SEQ ID NO: 222019 - DNA, 16 bp, P. troglodytes
cagagggagcatggcc

SEQ ID NO: 222020 - DNA, 16 bp, P. troglodytes
cagagggagccagctc

SEQ ID NO: 222021 - DNA, 16 bp, P. troglodytes
cagagggagctcgtcc

SEQ ID NO: 222022 - DNA, 16 bp, P. troglodytes
cagagggaggctctgt

SEQ ID NO: 222023 - DNA, 16 bp, P. troglodytes
cagagggcaaggagga

SEQ ID NO: 222024 - DNA, 16 bp, P. troglodytes
cagagggcaggagaag

SEQ ID NO: 222025 - DNA, 16 bp, P. troglodytes
cagagggctgactgta

SEQ ID NO: 222026 - DNA, 16 bp, P. troglodytes
cagagggctgaggtgg

SEQ ID NO: 222027 - DNA, 16 bp, P. troglodytes
cagaggggcacccgcc

SEQ ID NO: 222028 - DNA, 16 bp, P. troglodytes
cagagggtgggaaggg

SEQ ID NO: 222029 - DNA, 16 bp, P. troglodytes
cagaggtcagaggtca

SEQ ID NO: 222030 - DNA, 16 bp, P. troglodytes
cagaggtccctgtggc

SEQ ID NO: 222031 - DNA, 16 bp, P. troglodytes
cagaggtggaaggatt

SEQ ID NO: 222032 - DNA, 16 bp, P. troglodytes
cagaggtggagctgcc

SEQ ID NO: 222033 - DNA, 16 bp, P. troglodytes
cagaggtggctgggga

SEQ ID NO: 222034 - DNA, 16 bp, P. troglodytes
cagaggtgggaggatc

SEQ ID NO: 222035 - DNA, 16 bp, P. troglodytes
cagaggtgggatttga

SEQ ID NO: 222036 - DNA, 16 bp, P. troglodytes
cagaggttgaaagagt

SEQ ID NO: 222037 - DNA, 16 bp, P. troglodytes
cagaggttgcagaaag

SEQ ID NO: 222038 - DNA, 16 bp, P. troglodytes
cagaggttgcagcaag

SEQ ID NO: 222039 - DNA, 16 bp, P. troglodytes
cagaggttggaagagt

SEQ ID NO: 222040 - DNA, 16 bp, P. troglodytes
cagaggtttgagacca

SEQ ID NO: 222041 - DNA, 16 bp, P. troglodytes
cagagtaaatggacaa

SEQ ID NO: 222042 - DNA, 16 bp, P. troglodytes
cagagtagaatggtgg

SEQ ID NO: 222043 - DNA, 16 bp, P. troglodytes
cagagtagagaaccca

SEQ ID NO: 222044 - DNA, 16 bp, P. troglodytes
cagagtagcagctcag

SEQ ID NO: 222045 - DNA, 16 bp, P. troglodytes
cagagtagctgggagt

SEQ ID NO: 222046 - DNA, 16 bp, P. troglodytes
cagagtcaaagccaag

SEQ ID NO: 222047 - DNA, 16 bp, P. troglodytes
cagagtcagagaaaga

SEQ ID NO: 222048 - DNA, 16 bp, P. troglodytes
cagagtcatgctctgt

SEQ ID NO: 222049 - DNA, 16 bp, P. troglodytes
cagagtccaaaggctg

SEQ ID NO: 222050 - DNA, 16 bp, P. troglodytes
cagagtccatgagagg

SEQ ID NO: 222051 - DNA, 16 bp, P. troglodytes
cagagtctacaaggaa

SEQ ID NO: 222052 - DNA, 17 bp, P. troglodytes
cagagtctcactctgtt

SEQ ID NO: 222053 - DNA, 16 bp, P. troglodytes
cagagtctcactgtgt

SEQ ID NO: 222054 - DNA, 16 bp, P. troglodytes
cagagtctcgttctgc

SEQ ID NO: 222055 - DNA, 16 bp, P. troglodytes
cagagtctctctttgt

SEQ ID NO: 222056 - DNA, 16 bp, P. troglodytes
cagagtcttgctctgc

SEQ ID NO: 222057 - DNA, 16 bp, P. troglodytes
cagagtcttgctctgt

SEQ ID NO: 222058 - DNA, 16 bp, P. troglodytes
cagagtcttgctgtgt

SEQ ID NO: 222059 - DNA, 16 bp, P. troglodytes
cagagtcttgtgctgt

SEQ ID NO: 222060 - DNA, 16 bp, P. troglodytes
cagagtctttctctgt

SEQ ID NO: 222061 - DNA, 16 bp, P. troglodytes
cagagtcttttttttt

SEQ ID NO: 222062 - DNA, 16 bp, P. troglodytes
cagagtgaaaaggcaa

SEQ ID NO: 222063 - DNA, 16 bp, P. troglodytes
cagagtgaaactctgt

SEQ ID NO: 222064 - DNA, 16 bp, P. troglodytes
cagagtgaagagaaaa

SEQ ID NO: 222065 - DNA, 16 bp, P. troglodytes
cagagtgactccatct

SEQ ID NO: 222066 - DNA, 16 bp, P. troglodytes
cagagtgagaactcac

SEQ ID NO: 222067 - DNA, 16 bp, P. troglodytes
cagagtgagaatttgt

SEQ ID NO: 222068 - DNA, 16 bp, P. troglodytes
cagagtgagaccccaa

SEQ ID NO: 222069 - DNA, 16 bp, P. troglodytes
cagagtgagaccctgg

SEQ ID NO: 222070 - DNA, 16 bp, P. troglodytes
cagagtgagactcatc

SEQ ID NO: 222071 - DNA, 16 bp, P. troglodytes
cagagtgagactccag

SEQ ID NO: 222072 - DNA, 16 bp, P. troglodytes
cagagtgagactctct

SEQ ID NO: 222073 - DNA, 16 bp, P. troglodytes
cagagtgagattctgc

SEQ ID NO: 222074 - DNA, 16 bp, P. troglodytes
cagagtgaggccttgt

SEQ ID NO: 222075 - DNA, 16 bp, P. troglodytes
cagagtgccgactggt

SEQ ID NO: 222076 - DNA, 16 bp, P. troglodytes
cagagtgcctcttcag

SEQ ID NO: 222077 - DNA, 16 bp, P. troglodytes
cagagtgcctcttctc

SEQ ID NO: 222078 - DNA, 16 bp, P. troglodytes
cagagtgctaggatta

SEQ ID NO: 222079 - DNA, 16 bp, P. troglodytes
cagagtgctgattggt

SEQ ID NO: 222080 - DNA, 16 bp, P. troglodytes
cagagtgttgggatta

SEQ ID NO: 222081 - DNA, 16 bp, P. troglodytes
cagagtgtttcaaaac

SEQ ID NO: 222082 - DNA, 16 bp, P. troglodytes
cagagttctgggatta

SEQ ID NO: 222083 - DNA, 16 bp, P. troglodytes
cagagttgagtagttt

SEQ ID NO: 222084 - DNA, 16 bp, P. troglodytes
cagagttgagtggttg

SEQ ID NO: 222085 - DNA, 16 bp, P. troglodytes
cagagtttccttcttt

SEQ ID NO: 222086 - DNA, 16 bp, P. troglodytes
cagagtttctatttct

SEQ ID NO: 222087 - DNA, 16 bp, P. troglodytes
cagagttttgctctgt

SEQ ID NO: 222088 - DNA, 16 bp, P. troglodytes
cagagtttttccatgt

SEQ ID NO: 222089 - DNA, 16 bp, P. troglodytes
cagagttttttgtttg

SEQ ID NO: 222090 - DNA, 16 bp, P. troglodytes
cagataaaaaatattt

SEQ ID NO: 222091 - DNA, 16 bp, P. troglodytes
cagataaaaactagaa

SEQ ID NO: 222092 - DNA, 16 bp, P. troglodytes
cagataaaacacagga

SEQ ID NO: 222093 - DNA, 16 bp, P. troglodytes
cagataaacaaattgt

SEQ ID NO: 222094 - DNA, 16 bp, P. troglodytes
cagataaactcaagtc

SEQ ID NO: 222095 - DNA, 16 bp, P. troglodytes
cagataaagaaaatat

SEQ ID NO: 222096 - DNA, 16 bp, P. troglodytes
cagataaagaaataga

SEQ ID NO: 222097 - DNA, 16 bp, P. troglodytes
cagataaatgtaacaa

SEQ ID NO: 222098 - DNA, 16 bp, P. troglodytes
cagataaatttaacag

SEQ ID NO: 222099 - DNA, 16 bp, P. troglodytes
cagataaattttagaa

SEQ ID NO: 222100 - DNA, 16 bp, P. troglodytes
cagataagagaagaga

SEQ ID NO: 222101 - DNA, 16 bp, P. troglodytes
cagataaggaaaatga

SEQ ID NO: 222102 - DNA, 16 bp, P. troglodytes
cagataaggaaactgg

SEQ ID NO: 222103 - DNA, 16 bp, P. troglodytes
cagataaggaaagtga

SEQ ID NO: 222104 - DNA, 16 bp, P. troglodytes
cagataatgaaactga

SEQ ID NO: 222105 - DNA, 16 bp, P. troglodytes
cagataatttctttat

SEQ ID NO: 222106 - DNA, 16 bp, P. troglodytes
cagataatttgttttt

SEQ ID NO: 222107 - DNA, 16 bp, P. troglodytes
cagataattttttttc

SEQ ID NO: 222108 - DNA, 16 bp, P. troglodytes
cagataattttttttt

SEQ ID NO: 222109 - DNA, 16 bp, P. troglodytes
cagatacagtggctca

SEQ ID NO: 222110 - DNA, 16 bp, P. troglodytes
cagatacttctcaaaa

SEQ ID NO: 222111 - DNA, 16 bp, P. troglodytes
cagatactttaaaaat

SEQ ID NO: 222112 - DNA, 16 bp, P. troglodytes
cagataggaagaatca

SEQ ID NO: 222113 - DNA, 16 bp, P. troglodytes
cagatagtaccaaacc

SEQ ID NO: 222114 - DNA, 16 bp, P. troglodytes
cagatataattttttt

SEQ ID NO: 222115 - DNA, 16 bp, P. troglodytes
cagatatatgaaaaat

SEQ ID NO: 222116 - DNA, 16 bp, P. troglodytes
cagatatcctaaatca

SEQ ID NO: 222117 - DNA, 16 bp, P. troglodytes
cagatattatttttaa

SEQ ID NO: 222118 - DNA, 16 bp, P. troglodytes
cagatattgccaaatt

SEQ ID NO: 222119 - DNA, 16 bp, P. troglodytes
cagatatttattgaac

SEQ ID NO: 222120 - DNA, 16 bp, P. troglodytes
cagatatttattgagt

SEQ ID NO: 222121 - DNA, 16 bp, P. troglodytes
cagatcaaggtgccag

SEQ ID NO: 222122 - DNA, 16 bp, P. troglodytes
cagatcaataagaaaa

SEQ ID NO: 222123 - DNA, 16 bp, P. troglodytes
cagatcacaaggttag

SEQ ID NO: 222124 - DNA, 16 bp, P. troglodytes
cagatcacttgagctt

SEQ ID NO: 222125 - DNA, 16 bp, P. troglodytes
cagatcagcagcatca

SEQ ID NO: 222126 - DNA, 16 bp, P. troglodytes
cagatcagcaggggca

SEQ ID NO: 222127 - DNA, 16 bp, P. troglodytes
cagatcattgagacag

SEQ ID NO: 222128 - DNA, 16 bp, P. troglodytes
cagatcatttgaaatt

SEQ ID NO: 222129 - DNA, 16 bp, P. troglodytes
cagatccacatggctg

SEQ ID NO: 222130 - DNA, 16 bp, P. troglodytes
cagatccaccaacagc

SEQ ID NO: 222131 - DNA, 16 bp, P. troglodytes
cagatccctcagctgc

SEQ ID NO: 222132 - DNA, 16 bp, P. troglodytes
cagatcgcaccattgc

SEQ ID NO: 222133 - DNA, 16 bp, P. troglodytes
cagatctcaaactcca

SEQ ID NO: 222134 - DNA, 16 bp, P. troglodytes
cagatctcatgagacc

SEQ ID NO: 222135 - DNA, 16 bp, P. troglodytes
cagatctcatgagagc

SEQ ID NO: 222136 - DNA, 16 bp, P. troglodytes
cagatctcatgtcctc

SEQ ID NO: 222137 - DNA, 16 bp, P. troglodytes
cagatctctcatgaat

SEQ ID NO: 222138 - DNA, 16 bp, P. troglodytes
cagatctctttcattg

SEQ ID NO: 222139 - DNA, 16 bp, P. troglodytes
cagatctggtgagaac

SEQ ID NO: 222140 - DNA, 16 bp, P. troglodytes
cagatcttaaaggaaa

SEQ ID NO: 222141 - DNA, 16 bp, P. troglodytes
cagatcttctgatttt

SEQ ID NO: 222142 - DNA, 16 bp, P. troglodytes
cagatcttgtccaaga

SEQ ID NO: 222143 - DNA, 16 bp, P. troglodytes
cagatcttttgaaata

SEQ ID NO: 222144 - DNA, 16 bp, P. troglodytes
cagatgaaaaaaactg

SEQ ID NO: 222145 - DNA, 16 bp, P. troglodytes
cagatgaaaaaactga

SEQ ID NO: 222146 - DNA, 16 bp, P. troglodytes
cagatgaaaaactggg

SEQ ID NO: 222147 - DNA, 16 bp, P. troglodytes
cagatgaaactttgga

SEQ ID NO: 222148 - DNA, 16 bp, P. troglodytes
cagatgaacagataaa

SEQ ID NO: 222149 - DNA, 16 bp, P. troglodytes
cagatgaagaaaatga

SEQ ID NO: 222150 - DNA, 16 bp, P. troglodytes
cagatgaagaaacaaa

SEQ ID NO: 222151 - DNA, 16 bp, P. troglodytes
cagatgaagaaacaag

SEQ ID NO: 222152 - DNA, 16 bp, P. troglodytes
cagatgaagaaattga

SEQ ID NO: 222153 - DNA, 16 bp, P. troglodytes
cagatgaagaagctga

SEQ ID NO: 222154 - DNA, 16 bp, P. troglodytes
cagatgaagaatctga

SEQ ID NO: 222155 - DNA, 16 bp, P. troglodytes
cagatgaagatactga

SEQ ID NO: 222156 - DNA, 16 bp, P. troglodytes
cagatgaataaactga

SEQ ID NO: 222157 - DNA, 16 bp, P. troglodytes
cagatgaatggaaaag

SEQ ID NO: 222158 - DNA, 16 bp, P. troglodytes
cagatgaatggataaa

SEQ ID NO: 222159 - DNA, 16 bp, P. troglodytes
cagatgaattgataaa

SEQ ID NO: 222160 - DNA, 16 bp, P. troglodytes
cagatgacatgattat

SEQ ID NO: 222161 - DNA, 16 bp, P. troglodytes
cagatgactgcagccc

SEQ ID NO: 222162 - DNA, 16 bp, P. troglodytes
cagatgagaaaaatga

SEQ ID NO: 222163 - DNA, 16 bp, P. troglodytes
cagatgagaagaatgt

SEQ ID NO: 222164 - DNA, 16 bp, P. troglodytes
cagatgagactgcagc

SEQ ID NO: 222165 - DNA, 16 bp, P. troglodytes
cagatgaggaaaactg

SEQ ID NO: 222166 - DNA, 16 bp, P. troglodytes
cagatgaggaaaataa

SEQ ID NO: 222167 - DNA, 16 bp, P. troglodytes
cagatgaggaaacaca

SEQ ID NO: 222168 - DNA, 16 bp, P. troglodytes
cagatgaggaaacagc

SEQ ID NO: 222169 - DNA, 16 bp, P. troglodytes
cagatgaggaaactag

SEQ ID NO: 222170 - DNA, 16 bp, P. troglodytes
cagatgaggaaagaaa

SEQ ID NO: 222171 - DNA, 16 bp, P. troglodytes
cagatgaggaaataga

SEQ ID NO: 222172 - DNA, 16 bp, P. troglodytes
cagatgaggaaatcaa

SEQ ID NO: 222173 - DNA, 16 bp, P. troglodytes
cagatgaggaaattga

SEQ ID NO: 222174 - DNA, 16 bp, P. troglodytes
cagatgaggaactgag

SEQ ID NO: 222175 - DNA, 16 bp, P. troglodytes
cagatgaggaagcaga

SEQ ID NO: 222176 - DNA, 16 bp, P. troglodytes
cagatgaggatgaaat

SEQ ID NO: 222177 - DNA, 16 bp, P. troglodytes
cagatgagggaactga

SEQ ID NO: 222178 - DNA, 16 bp, P. troglodytes
cagatgagtaaactga

SEQ ID NO: 222179 - DNA, 16 bp, P. troglodytes
cagatgataaaactga

SEQ ID NO: 222180 - DNA, 16 bp, P. troglodytes
cagatgatataatttt

SEQ ID NO: 222181 - DNA, 16 bp, P. troglodytes
cagatgatcctctcac

SEQ ID NO: 222182 - DNA, 16 bp, P. troglodytes
cagatgatgaaattga

SEQ ID NO: 222183 - DNA, 16 bp, P. troglodytes
cagatgatgaggaaga

SEQ ID NO: 222184 - DNA, 16 bp, P. troglodytes
cagatgatgatgatga

SEQ ID NO: 222185 - DNA, 16 bp, P. troglodytes
cagatgatgggcggcc

SEQ ID NO: 222186 - DNA, 16 bp, P. troglodytes
cagatgcaacttaatc

SEQ ID NO: 222187 - DNA, 16 bp, P. troglodytes
cagatgcagtagctca

SEQ ID NO: 222188 - DNA, 16 bp, P. troglodytes
cagatgcattcacagc

SEQ ID NO: 222189 - DNA, 16 bp, P. troglodytes
cagatgcattgtttgc

SEQ ID NO: 222190 - DNA, 16 bp, P. troglodytes
cagatgccagccaagg

SEQ ID NO: 222191 - DNA, 16 bp, P. troglodytes
cagatgcctgccatca

SEQ ID NO: 222192 - DNA, 16 bp, P. troglodytes
cagatgcctgtcacca

SEQ ID NO: 222193 - DNA, 16 bp, P. troglodytes
cagatgctgaagagga

SEQ ID NO: 222194 - DNA, 16 bp, P. troglodytes
cagatgctgcagagga

SEQ ID NO: 222195 - DNA, 16 bp, P. troglodytes
cagatgctgctgctgc

SEQ ID NO: 222196 - DNA, 16 bp, P. troglodytes
cagatgctggaaagga

SEQ ID NO: 222197 - DNA, 16 bp, P. troglodytes
cagatgctggagagaa

SEQ ID NO: 222198 - DNA, 16 bp, P. troglodytes
cagatgctggagatga

SEQ ID NO: 222199 - DNA, 16 bp, P. troglodytes
cagatgctggtgctat

SEQ ID NO: 222200 - DNA, 16 bp, P. troglodytes
cagatggaaatgaaga

SEQ ID NO: 222201 - DNA, 16 bp, P. troglodytes
cagatggaacactgag

SEQ ID NO: 222202 - DNA, 16 bp, P. troglodytes
cagatggagaaactaa

SEQ ID NO: 222203 - DNA, 16 bp, P. troglodytes
cagatggagaaactga

SEQ ID NO: 222204 - DNA, 16 bp, P. troglodytes
cagatggagacagaga

SEQ ID NO: 222205 - DNA, 16 bp, P. troglodytes
cagatggagaccatcc

SEQ ID NO: 222206 - DNA, 16 bp, P. troglodytes
cagatggagctggaag

SEQ ID NO: 222207 - DNA, 16 bp, P. troglodytes
cagatggagctggagg

SEQ ID NO: 222208 - DNA, 16 bp, P. troglodytes
cagatggcaccttctt

SEQ ID NO: 222209 - DNA, 16 bp, P. troglodytes
cagatggcatattgtg

SEQ ID NO: 222210 - DNA, 16 bp, P. troglodytes
cagatggcctattgtg

SEQ ID NO: 222211 - DNA, 16 bp, P. troglodytes
cagatgggaaaacagg

SEQ ID NO: 222212 - DNA, 16 bp, P. troglodytes
cagatggggaaacaga

SEQ ID NO: 222213 - DNA, 16 bp, P. troglodytes
cagatggggcagccgg

SEQ ID NO: 222214 - DNA, 16 bp, P. troglodytes
cagatggggtggctgg

SEQ ID NO: 222215 - DNA, 16 bp, P. troglodytes
cagatgggttttattt

SEQ ID NO: 222216 - DNA, 16 bp, P. troglodytes
cagatggtaaatattt

SEQ ID NO: 222217 - DNA, 16 bp, P. troglodytes
cagatgtcatgagact

SEQ ID NO: 222218 - DNA, 16 bp, P. troglodytes
cagatgtcccctgggg

SEQ ID NO: 222219 - DNA, 16 bp, P. troglodytes
cagatgtgagccacca

SEQ ID NO: 222220 - DNA, 16 bp, P. troglodytes
cagatgtgagccaccg

SEQ ID NO: 222221 - DNA, 16 bp, P. troglodytes
cagatgtgatggaaat

SEQ ID NO: 222222 - DNA, 16 bp, P. troglodytes
cagatgtgcatcacca

SEQ ID NO: 222223 - DNA, 16 bp, P. troglodytes
cagatgtgctgtcacc

SEQ ID NO: 222224 - DNA, 16 bp, P. troglodytes
cagatgtggtggtgca

SEQ ID NO: 222225 - DNA, 16 bp, P. troglodytes
cagattaaaagcacaa

SEQ ID NO: 222226 - DNA, 16 bp, P. troglodytes
cagattaaacattttt

SEQ ID NO: 222227 - DNA, 16 bp, P. troglodytes
cagattaacagcagat

SEQ ID NO: 222228 - DNA, 16 bp, P. troglodytes
cagattaattggagaa

SEQ ID NO: 222229 - DNA, 16 bp, P. troglodytes
cagattagaaaactga

SEQ ID NO: 222230 - DNA, 16 bp, P. troglodytes
cagattaggagaaaat

SEQ ID NO: 222231 - DNA, 16 bp, P. troglodytes
cagattcaacaaaaag

SEQ ID NO: 222232 - DNA, 16 bp, P. troglodytes
cagattcaagaagctg

SEQ ID NO: 222233 - DNA, 16 bp, P. troglodytes
cagattcacacataac

SEQ ID NO: 222234 - DNA, 20 bp, P. troglodytes
cagattcaccaaagctgaaa

SEQ ID NO: 222235 - DNA, 16 bp, P. troglodytes
cagattcaccaatgtt

SEQ ID NO: 222236 - DNA, 16 bp, P. troglodytes
cagattcataaagtaa

SEQ ID NO: 222237 - DNA, 16 bp, P. troglodytes
cagattcatgaaacaa

SEQ ID NO: 222238 - DNA, 16 bp, P. troglodytes
cagattctcaggcccc

SEQ ID NO: 222239 - DNA, 16 bp, P. troglodytes
cagattctgaattcca

SEQ ID NO: 222240 - DNA, 16 bp, P. troglodytes
cagattgtaaatattt

SEQ ID NO: 222241 - DNA, 17 bp, P. troglodytes
cagattgtgccactgca

SEQ ID NO: 222242 - DNA, 16 bp, P. troglodytes
cagatttctgtttata

SEQ ID NO: 222243 - DNA, 16 bp, P. troglodytes
cagatttgccttttct

SEQ ID NO: 222244 - DNA, 16 bp, P. troglodytes
cagatttggagaaaat

SEQ ID NO: 222245 - DNA, 16 bp, P. troglodytes
cagatttggcaaataa

SEQ ID NO: 222246 - DNA, 16 bp, P. troglodytes
cagattttatttttta

SEQ ID NO: 222247 - DNA, 16 bp, P. troglodytes
cagattttcaccatgt

SEQ ID NO: 222248 - DNA, 16 bp, P. troglodytes
cagattttccatttct

SEQ ID NO: 222249 - DNA, 16 bp, P. troglodytes
cagattttcttttctt

SEQ ID NO: 222250 - DNA, 16 bp, P. troglodytes
cagattttggattttc

SEQ ID NO: 222251 - DNA, 16 bp, P. troglodytes
cagattttggattttt

SEQ ID NO: 222252 - DNA, 16 bp, P. troglodytes
cagattttggtttcta

SEQ ID NO: 222253 - DNA, 16 bp, P. troglodytes
cagatttttgttttta

SEQ ID NO: 222254 - DNA, 16 bp, P. troglodytes
cagattttttaaatta

SEQ ID NO: 222255 - DNA, 16 bp, P. troglodytes
cagatttttttcccca

SEQ ID NO: 222256 - DNA, 16 bp, P. troglodytes
cagattttttttaaaa

SEQ ID NO: 222257 - DNA, 16 bp, P. troglodytes
cagattttttttctga

SEQ ID NO: 222258 - DNA, 16 bp, P. troglodytes
cagatttttttttaaa

SEQ ID NO: 222259 - DNA, 16 bp, P. troglodytes
cagcaaaacattcaag

SEQ ID NO: 222260 - DNA, 16 bp, P. troglodytes
cagcaaaagaaaatac

SEQ ID NO: 222261 - DNA, 16 bp, P. troglodytes
cagcaaaagaaagaat

SEQ ID NO: 222262 - DNA, 16 bp, P. troglodytes
cagcaaaatcaccaac

SEQ ID NO: 222263 - DNA, 16 bp, P. troglodytes
cagcaaacagcagcag

SEQ ID NO: 222264 - DNA, 16 bp, P. troglodytes
cagcaaaccaccttgg

SEQ ID NO: 222265 - DNA, 16 bp, P. troglodytes
cagcaaagaattatcc

SEQ ID NO: 222266 - DNA, 16 bp, P. troglodytes
cagcaaagacatggaa

SEQ ID NO: 222267 - DNA, 16 bp, P. troglodytes
cagcaaagttcattat

SEQ ID NO: 222268 - DNA, 16 bp, P. troglodytes
cagcaaataaaacaat

SEQ ID NO: 222269 - DNA, 16 bp, P. troglodytes
cagcaaatacaaaaga

SEQ ID NO: 222270 - DNA, 16 bp, P. troglodytes
cagcaaatatttattt

SEQ ID NO: 222271 - DNA, 16 bp, P. troglodytes
cagcaaatctctagaa

SEQ ID NO: 222272 - DNA, 16 bp, P. troglodytes
cagcaaattatccaga

SEQ ID NO: 222273 - DNA, 16 bp, P. troglodytes
cagcaacaccccactc

SEQ ID NO: 222274 - DNA, 16 bp, P. troglodytes
cagcaacagaaaatga

SEQ ID NO: 222275 - DNA, 16 bp, P. troglodytes
cagcaacagaacaaag

SEQ ID NO: 222276 - DNA, 16 bp, P. troglodytes
cagcaacagagaccaa

SEQ ID NO: 222277 - DNA, 16 bp, P. troglodytes
cagcaacagcagcaac

SEQ ID NO: 222278 - DNA, 16 bp, P. troglodytes
cagcaacagcagcaga

SEQ ID NO: 222279 - DNA, 16 bp, P. troglodytes
cagcaacatagatgaa

SEQ ID NO: 222280 - DNA, 16 bp, P. troglodytes
cagcaacatgaatgaa

SEQ ID NO: 222281 - DNA, 16 bp, P. troglodytes
cagcaacatggatgca

SEQ ID NO: 222282 - DNA, 16 bp, P. troglodytes
cagcaacatggatgga

SEQ ID NO: 222283 - DNA, 16 bp, P. troglodytes
cagcaacatttgctgc

SEQ ID NO: 222284 - DNA, 16 bp, P. troglodytes
cagcaacctcagttct

SEQ ID NO: 222285 - DNA, 16 bp, P. troglodytes
cagcaacctggatgaa

SEQ ID NO: 222286 - DNA, 16 bp, P. troglodytes
cagcaacctggatgga

SEQ ID NO: 222287 - DNA, 16 bp, P. troglodytes
cagcaacttcaaagat

SEQ ID NO: 222288 - DNA, 16 bp, P. troglodytes
cagcaactttgggagg

SEQ ID NO: 222289 - DNA, 16 bp, P. troglodytes
cagcaagaaaacaaat

SEQ ID NO: 222290 - DNA, 16 bp, P. troglodytes
cagcaagaagaaatga

SEQ ID NO: 222291 - DNA, 16 bp, P. troglodytes
cagcaagaagacagct

SEQ ID NO: 222292 - DNA, 16 bp, P. troglodytes
cagcaagaaggcagcc

SEQ ID NO: 222293 - DNA, 16 bp, P. troglodytes
cagcaagacactgtct

SEQ ID NO: 222294 - DNA, 16 bp, P. troglodytes
cagcaagaccaacaca

SEQ ID NO: 222295 - DNA, 16 bp, P. troglodytes
cagcaagacccccatc

SEQ ID NO: 222296 - DNA, 16 bp, P. troglodytes
cagcaagacctcgtct

SEQ ID NO: 222297 - DNA, 16 bp, P. troglodytes
cagcaagcagcaggac

SEQ ID NO: 222298 - DNA, 16 bp, P. troglodytes
cagcaagccaagatgg

SEQ ID NO: 222299 - DNA, 16 bp, P. troglodytes
cagcaagccagcttat

SEQ ID NO: 222300 - DNA, 16 bp, P. troglodytes
cagcaaggccctgtct

SEQ ID NO: 222301 - DNA, 16 bp, P. troglodytes
cagcaagggaacaaaa

SEQ ID NO: 222302 - DNA, 16 bp, P. troglodytes
cagcaagtatttattg

SEQ ID NO: 222303 - DNA, 16 bp, P. troglodytes
cagcaagtgcaaaggc

SEQ ID NO: 222304 - DNA, 16 bp, P. troglodytes
cagcaagttcctcatc

SEQ ID NO: 222305 - DNA, 16 bp, P. troglodytes
cagcaagttttattaa

SEQ ID NO: 222306 - DNA, 16 bp, P. troglodytes
cagcaatagataacca

SEQ ID NO: 222307 - DNA, 16 bp, P. troglodytes
cagcaatattttttaa

SEQ ID NO: 222308 - DNA, 16 bp, P. troglodytes
cagcaatcccattact

SEQ ID NO: 222309 - DNA, 16 bp, P. troglodytes
cagcaatcctacttct

SEQ ID NO: 222310 - DNA, 16 bp, P. troglodytes
cagcaatcttcccacc

SEQ ID NO: 222311 - DNA, 16 bp, P. troglodytes
cagcaatgaaaataaa

SEQ ID NO: 222312 - DNA, 16 bp, P. troglodytes
cagcaatgaatgagaa

SEQ ID NO: 222313 - DNA, 16 bp, P. troglodytes
cagcaattccaccact

SEQ ID NO: 222314 - DNA, 16 bp, P. troglodytes
cagcaattgcactctt

SEQ ID NO: 222315 - DNA, 16 bp, P. troglodytes
cagcacaaaaatagag

SEQ ID NO: 222316 - DNA, 16 bp, P. troglodytes
cagcacaaacagcctg

SEQ ID NO: 222317 - DNA, 16 bp, P. troglodytes
cagcacaagaaagacc

SEQ ID NO: 222318 - DNA, 16 bp, P. troglodytes
cagcacacactcccca

SEQ ID NO: 222319 - DNA, 16 bp, P. troglodytes
cagcacaccaaggacc

SEQ ID NO: 222320 - DNA, 16 bp, P. troglodytes
cagcacaccagcatgg

SEQ ID NO: 222321 - DNA, 16 bp, P. troglodytes
cagcacaccagtgggt

SEQ ID NO: 222322 - DNA, 17 bp, P. troglodytes
cagcacaccatcatggc

SEQ ID NO: 222323 - DNA, 16 bp, P. troglodytes
cagcacagaagaaaga

SEQ ID NO: 222324 - DNA, 16 bp, P. troglodytes
cagcacagaccctcca

SEQ ID NO: 222325 - DNA, 16 bp, P. troglodytes
cagcacagcacctggc

SEQ ID NO: 222326 - DNA, 16 bp, P. troglodytes
cagcacagtgcctggc

SEQ ID NO: 222327 - DNA, 16 bp, P. troglodytes
cagcacagtgtttgag

SEQ ID NO: 222328 - DNA, 16 bp, P. troglodytes
cagcacataaaaaagc

SEQ ID NO: 222329 - DNA, 16 bp, P. troglodytes
cagcacataggcatgg

SEQ ID NO: 222330 - DNA, 16 bp, P. troglodytes
cagcaccaagaagatg

SEQ ID NO: 222331 - DNA, 16 bp, P. troglodytes
cagcaccaagagtgaa

SEQ ID NO: 222332 - DNA, 16 bp, P. troglodytes
cagcaccagctctgat

SEQ ID NO: 222333 - DNA, 16 bp, P. troglodytes
cagcaccatgacagtt

SEQ ID NO: 222334 - DNA, 16 bp, P. troglodytes
cagcaccatgcccagc

SEQ ID NO: 222335 - DNA, 16 bp, P. troglodytes
cagcaccatgcccggc

SEQ ID NO: 222336 - DNA, 16 bp, P. troglodytes
cagcaccatggacagc

SEQ ID NO: 222337 - DNA, 16 bp, P. troglodytes
cagcaccattgttgaa

SEQ ID NO: 222338 - DNA, 16 bp, P. troglodytes
cagcacccaagtcacc

SEQ ID NO: 222339 - DNA, 16 bp, P. troglodytes
cagcacccagcacagg

SEQ ID NO: 222340 - DNA, 16 bp, P. troglodytes
cagcacccagtcccat

SEQ ID NO: 222341 - DNA, 16 bp, P. troglodytes
cagcacccctggcctc

SEQ ID NO: 222342 - DNA, 16 bp, P. troglodytes
cagcacctctggaccc

SEQ ID NO: 222343 - DNA, 16 bp, P. troglodytes
cagcacctctggccag

SEQ ID NO: 222344 - DNA, 16 bp, P. troglodytes
cagcacctgctctgat

SEQ ID NO: 222345 - DNA, 16 bp, P. troglodytes
cagcacctgggaggcc

SEQ ID NO: 222346 - DNA, 16 bp, P. troglodytes
cagcaccttgggaggc

SEQ ID NO: 222347 - DNA, 16 bp, P. troglodytes
cagcactatttattta

SEQ ID NO: 222348 - DNA, 16 bp, P. troglodytes
cagcactccagccttg

SEQ ID NO: 222349 - DNA, 16 bp, P. troglodytes
cagcactctgggagac

SEQ ID NO: 222350 - DNA, 16 bp, P. troglodytes
cagcactctgggagga

SEQ ID NO: 222351 - DNA, 16 bp, P. troglodytes
cagcactctgggaggc

SEQ ID NO: 222352 - DNA, 16 bp, P. troglodytes
cagcactgtccagtag

SEQ ID NO: 222353 - DNA, 16 bp, P. troglodytes
cagcactgtgggaggc

SEQ ID NO: 222354 - DNA, 16 bp, P. troglodytes
cagcacttcaggaggt

SEQ ID NO: 222355 - DNA, 16 bp, P. troglodytes
cagcacttctcaaact

SEQ ID NO: 222356 - DNA, 16 bp, P. troglodytes
cagcacttggagaggc

SEQ ID NO: 222357 - DNA, 16 bp, P. troglodytes
cagcactttacagttt

SEQ ID NO: 222358 - DNA, 16 bp, P. troglodytes
cagcactttgagaagg

SEQ ID NO: 222359 - DNA, 16 bp, P. troglodytes
cagcactttgcggggc

SEQ ID NO: 222360 - DNA, 16 bp, P. troglodytes
cagcactttgggatac

SEQ ID NO: 222361 - DNA, 16 bp, P. troglodytes
cagcactttggggagg

SEQ ID NO: 222362 - DNA, 16 bp, P. troglodytes
cagcactttggggggc

SEQ ID NO: 222363 - DNA, 16 bp, P. troglodytes
cagcactttgtggggg

SEQ ID NO: 222364 - DNA, 16 bp, P. troglodytes
cagcagaaaggccctg

SEQ ID NO: 222365 - DNA, 16 bp, P. troglodytes
cagcagaagaaactac

SEQ ID NO: 222366 - DNA, 16 bp, P. troglodytes
cagcagaagcagatgc

SEQ ID NO: 222367 - DNA, 16 bp, P. troglodytes
cagcagaaggtgaagg

SEQ ID NO: 222368 - DNA, 16 bp, P. troglodytes
cagcagaatctcttga

SEQ ID NO: 222369 - DNA, 16 bp, P. troglodytes
cagcagaatggcttga

SEQ ID NO: 222370 - DNA, 16 bp, P. troglodytes
cagcagacagcttctc

SEQ ID NO: 222371 - DNA, 16 bp, P. troglodytes
cagcagacctgcagaa

SEQ ID NO: 222372 - DNA, 16 bp, P. troglodytes
cagcagagagaagacc

SEQ ID NO: 222373 - DNA, 16 bp, P. troglodytes
cagcagagagaagaga

SEQ ID NO: 222374 - DNA, 16 bp, P. troglodytes
cagcagagagagagag

SEQ ID NO: 222375 - DNA, 16 bp, P. troglodytes
cagcagagaggaggcc

SEQ ID NO: 222376 - DNA, 16 bp, P. troglodytes
cagcagagaggcctga

SEQ ID NO: 222377 - DNA, 16 bp, P. troglodytes
cagcagagcagccact

SEQ ID NO: 222378 - DNA, 16 bp, P. troglodytes
cagcagaggagaaaga

SEQ ID NO: 222379 - DNA, 16 bp, P. troglodytes
cagcagaggctgcaga

SEQ ID NO: 222380 - DNA, 16 bp, P. troglodytes
cagcagaggggccctg

SEQ ID NO: 222381 - DNA, 16 bp, P. troglodytes
cagcagcaacagcaga

SEQ ID NO: 222382 - DNA, 16 bp, P. troglodytes
cagcagcaacagcagc

SEQ ID NO: 222383 - DNA, 16 bp, P. troglodytes
cagcagcaagacttat

SEQ ID NO: 222384 - DNA, 16 bp, P. troglodytes
cagcagcaataggaaa

SEQ ID NO: 222385 - DNA, 16 bp, P. troglodytes
cagcagcaatgtatga

SEQ ID NO: 222386 - DNA, 16 bp, P. troglodytes
cagcagcaccagcagc

SEQ ID NO: 222387 - DNA, 16 bp, P. troglodytes
cagcagcacctgggaa

SEQ ID NO: 222388 - DNA, 16 bp, P. troglodytes
cagcagcagaccatcc

SEQ ID NO: 222389 - DNA, 16 bp, P. troglodytes
cagcagcagaggctgc

SEQ ID NO: 222390 - DNA, 16 bp, P. troglodytes
cagcagcagcaacaac

SEQ ID NO: 222391 - DNA, 16 bp, P. troglodytes
cagcagcagcaacagt

SEQ ID NO: 222392 - DNA, 16 bp, P. troglodytes
cagcagcagcaacatc

SEQ ID NO: 222393 - DNA, 16 bp, P. troglodytes
cagcagcagcaacccg

SEQ ID NO: 222394 - DNA, 16 bp, P. troglodytes
cagcagcagcaacctg

SEQ ID NO: 222395 - DNA, 16 bp, P. troglodytes
cagcagcagcaccacc

SEQ ID NO: 222396 - DNA, 16 bp, P. troglodytes
cagcagcagcaccagc

SEQ ID NO: 222397 - DNA, 16 bp, P. troglodytes
cagcagcagcagaaga

SEQ ID NO: 222398 - DNA, 16 bp, P. troglodytes
cagcagcagcagcaag

SEQ ID NO: 222399 - DNA, 16 bp, P. troglodytes
cagcagcagcagcaca

SEQ ID NO: 222400 - DNA, 16 bp, P. troglodytes
cagcagcagcagcagc

SEQ ID NO: 222401 - DNA, 18 bp, P. troglodytes
cagcagcagcagcagcct

SEQ ID NO: 222402 - DNA, 16 bp, P. troglodytes
cagcagcagcagcccc

SEQ ID NO: 222403 - DNA, 16 bp, P. troglodytes
cagcagcagcagcctg

SEQ ID NO: 222404 - DNA, 16 bp, P. troglodytes
cagcagcagcagctct

SEQ ID NO: 222405 - DNA, 16 bp, P. troglodytes
cagcagcagcagctgg

SEQ ID NO: 222406 - DNA, 16 bp, P. troglodytes
cagcagcagcagctgt

SEQ ID NO: 222407 - DNA, 16 bp, P. troglodytes
cagcagcagcagcttc

SEQ ID NO: 222408 - DNA, 16 bp, P. troglodytes
cagcagcagcaggaga

SEQ ID NO: 222409 - DNA, 16 bp, P. troglodytes
cagcagcagcaggagc

SEQ ID NO: 222410 - DNA, 16 bp, P. troglodytes
cagcagcagcaggagg

SEQ ID NO: 222411 - DNA, 16 bp, P. troglodytes
cagcagcagcaggggc

SEQ ID NO: 222412 - DNA, 16 bp, P. troglodytes
cagcagcagcatcacc

SEQ ID NO: 222413 - DNA, 16 bp, P. troglodytes
cagcagcagcggcagc

SEQ ID NO: 222414 - DNA, 16 bp, P. troglodytes
cagcagcagctgcaga

SEQ ID NO: 222415 - DNA, 17 bp, P. troglodytes
cagcagcagctgctgca

SEQ ID NO: 222416 - DNA, 16 bp, P. troglodytes
cagcagcaggactgag

SEQ ID NO: 222417 - DNA, 16 bp, P. troglodytes
cagcagcagtccccaa

SEQ ID NO: 222418 - DNA, 16 bp, P. troglodytes
cagcagcagtggcagc

SEQ ID NO: 222419 - DNA, 17 bp, P. troglodytes
cagcagcagtggctgca

SEQ ID NO: 222420 - DNA, 16 bp, P. troglodytes
cagcagcatcagcagc

SEQ ID NO: 222421 - DNA, 16 bp, P. troglodytes
cagcagcatccacatc

SEQ ID NO: 222422 - DNA, 16 bp, P. troglodytes
cagcagcatccctggc

SEQ ID NO: 222423 - DNA, 16 bp, P. troglodytes
cagcagcatgaaagca

SEQ ID NO: 222424 - DNA, 16 bp, P. troglodytes
cagcagccacagtgat

SEQ ID NO: 222425 - DNA, 16 bp, P. troglodytes
cagcagccagaatgat

SEQ ID NO: 222426 - DNA, 16 bp, P. troglodytes
cagcagccagagggat

SEQ ID NO: 222427 - DNA, 16 bp, P. troglodytes
cagcagccaggcagag

SEQ ID NO: 222428 - DNA, 16 bp, P. troglodytes
cagcagcccagcagcc

SEQ ID NO: 222429 - DNA, 16 bp, P. troglodytes
cagcagccccagccag

SEQ ID NO: 222430 - DNA, 16 bp, P. troglodytes
cagcagccccaggaaa

SEQ ID NO: 222431 - DNA, 16 bp, P. troglodytes
cagcagccccaggaag

SEQ ID NO: 222432 - DNA, 16 bp, P. troglodytes
cagcagcccctgcccc

SEQ ID NO: 222433 - DNA, 16 bp, P. troglodytes
cagcagcccttgagcc

SEQ ID NO: 222434 - DNA, 16 bp, P. troglodytes
cagcagcctcaacctc

SEQ ID NO: 222435 - DNA, 16 bp, P. troglodytes
cagcagcctcagcatc

SEQ ID NO: 222436 - DNA, 16 bp, P. troglodytes
cagcagcctcagcctc

SEQ ID NO: 222437 - DNA, 16 bp, P. troglodytes
cagcagcctggatgga

SEQ ID NO: 222438 - DNA, 16 bp, P. troglodytes
cagcagcggcagcagc

SEQ ID NO: 222439 - DNA, 16 bp, P. troglodytes
cagcagcggcggcggc

SEQ ID NO: 222440 - DNA, 17 bp, P. troglodytes
cagcagcggtggctgca

SEQ ID NO: 222441 - DNA, 16 bp, P. troglodytes
cagcagctcaaggagg

SEQ ID NO: 222442 - DNA, 16 bp, P. troglodytes
cagcagctcacgcctg

SEQ ID NO: 222443 - DNA, 16 bp, P. troglodytes
cagcagctcaggctcc

SEQ ID NO: 222444 - DNA, 16 bp, P. troglodytes
cagcagctgcagcaag

SEQ ID NO: 222445 - DNA, 16 bp, P. troglodytes
cagcagctgcagcagc

SEQ ID NO: 222446 - DNA, 16 bp, P. troglodytes
cagcagctgcagctgc

SEQ ID NO: 222447 - DNA, 16 bp, P. troglodytes
cagcagctgcctctga

SEQ ID NO: 222448 - DNA, 16 bp, P. troglodytes
cagcagctgctccaga

SEQ ID NO: 222449 - DNA, 16 bp, P. troglodytes
cagcagctgctgctgg

SEQ ID NO: 222450 - DNA, 16 bp, P. troglodytes
cagcagctgctgtgct

SEQ ID NO: 222451 - DNA, 16 bp, P. troglodytes
cagcagctttgccaag

SEQ ID NO: 222452 - DNA, 16 bp, P. troglodytes
cagcaggaaggccctc

SEQ ID NO: 222453 - DNA, 16 bp, P. troglodytes
cagcaggagagagaag

SEQ ID NO: 222454 - DNA, 16 bp, P. troglodytes
cagcaggagagagaca

SEQ ID NO: 222455 - DNA, 16 bp, P. troglodytes
cagcaggagcagcagc

SEQ ID NO: 222456 - DNA, 16 bp, P. troglodytes
cagcaggagccaggaa

SEQ ID NO: 222457 - DNA, 16 bp, P. troglodytes
cagcaggaggcagcca

SEQ ID NO: 222458 - DNA, 16 bp, P. troglodytes
cagcaggaggtgagct

SEQ ID NO: 222459 - DNA, 16 bp, P. troglodytes
cagcaggcaaagagag

SEQ ID NO: 222460 - DNA, 16 bp, P. troglodytes
cagcaggcaagagaaa

SEQ ID NO: 222461 - DNA, 16 bp, P. troglodytes
cagcaggcagagcttg

SEQ ID NO: 222462 - DNA, 16 bp, P. troglodytes
cagcaggcagctgcag

SEQ ID NO: 222463 - DNA, 16 bp, P. troglodytes
cagcagggaggctggg

SEQ ID NO: 222464 - DNA, 16 bp, P. troglodytes
cagcagggcaggcagc

SEQ ID NO: 222465 - DNA, 16 bp, P. troglodytes
cagcagggctggctgg

SEQ ID NO: 222466 - DNA, 16 bp, P. troglodytes
cagcagggctggggga

SEQ ID NO: 222467 - DNA, 16 bp, P. troglodytes
cagcaggggccacgtg

SEQ ID NO: 222468 - DNA, 16 bp, P. troglodytes
cagcaggtcccactcc

SEQ ID NO: 222469 - DNA, 16 bp, P. troglodytes
cagcaggtctggggtg

SEQ ID NO: 222470 - DNA, 16 bp, P. troglodytes
cagcaggtgctcaata

SEQ ID NO: 222471 - DNA, 16 bp, P. troglodytes
cagcaggtggagcttg

SEQ ID NO: 222472 - DNA, 16 bp, P. troglodytes
cagcaggtggaggctg

SEQ ID NO: 222473 - DNA, 16 bp, P. troglodytes
cagcaggtggcaaagc

SEQ ID NO: 222474 - DNA, 16 bp, P. troglodytes
cagcaggtggtgaagc

SEQ ID NO: 222475 - DNA, 16 bp, P. troglodytes
cagcagtaaaaatgaa

SEQ ID NO: 222476 - DNA, 16 bp, P. troglodytes
cagcagtcccagctac

SEQ ID NO: 222477 - DNA, 16 bp, P. troglodytes
cagcagtccccaacat

SEQ ID NO: 222478 - DNA, 16 bp, P. troglodytes
cagcagtgaacaaaac

SEQ ID NO: 222479 - DNA, 16 bp, P. troglodytes
cagcagtgagctgtga

SEQ ID NO: 222480 - DNA, 16 bp, P. troglodytes
cagcagtgaggaggtc

SEQ ID NO: 222481 - DNA, 16 bp, P. troglodytes
cagcagtgctagagga

SEQ ID NO: 222482 - DNA, 16 bp, P. troglodytes
cagcagtgctggggga

SEQ ID NO: 222483 - DNA, 16 bp, P. troglodytes
cagcagtggctcacac

SEQ ID NO: 222484 - DNA, 16 bp, P. troglodytes
cagcagtgggatttct

SEQ ID NO: 222485 - DNA, 16 bp, P. troglodytes
cagcagtggtccccaa

SEQ ID NO: 222486 - DNA, 16 bp, P. troglodytes
cagcagtgtgaaagca

SEQ ID NO: 222487 - DNA, 16 bp, P. troglodytes
cagcagtgtgggaggc

SEQ ID NO: 222488 - DNA, 16 bp, P. troglodytes
cagcagttcaagacca

SEQ ID NO: 222489 - DNA, 16 bp, P. troglodytes
cagcagtttcactcct

SEQ ID NO: 222490 - DNA, 16 bp, P. troglodytes
cagcagtttgggaggc

SEQ ID NO: 222491 - DNA, 16 bp, P. troglodytes
cagcatagcaaaaccc

SEQ ID NO: 222492 - DNA, 16 bp, P. troglodytes
cagcatatgcaaaggc

SEQ ID NO: 222493 - DNA, 16 bp, P. troglodytes
cagcatcacctaggaa

SEQ ID NO: 222494 - DNA, 16 bp, P. troglodytes
cagcatcacctgggaa

SEQ ID NO: 222495 - DNA, 16 bp, P. troglodytes
cagcatcagaatcacc

SEQ ID NO: 222496 - DNA, 16 bp, P. troglodytes
cagcatcagcatcatc

SEQ ID NO: 222497 - DNA, 16 bp, P. troglodytes
cagcatcagtgtcacc

SEQ ID NO: 222498 - DNA, 16 bp, P. troglodytes
cagcatcatcacaaac

SEQ ID NO: 222499 - DNA, 16 bp, P. troglodytes
cagcatcattagttat

SEQ ID NO: 222500 - DNA, 16 bp, P. troglodytes
cagcatccctggcctc

SEQ ID NO: 222501 - DNA, 16 bp, P. troglodytes
cagcatccctggtctc

SEQ ID NO: 222502 - DNA, 16 bp, P. troglodytes
cagcatcctgggtagc

SEQ ID NO: 222503 - DNA, 16 bp, P. troglodytes
cagcatctcctgggaa

SEQ ID NO: 222504 - DNA, 16 bp, P. troglodytes
cagcatctctggacct

SEQ ID NO: 222505 - DNA, 16 bp, P. troglodytes
cagcatctgcttttgg

SEQ ID NO: 222506 - DNA, 16 bp, P. troglodytes
cagcatctgtttcctg

SEQ ID NO: 222507 - DNA, 16 bp, P. troglodytes
cagcatctgttttttg

SEQ ID NO: 222508 - DNA, 16 bp, P. troglodytes
cagcatgacaaaaccc

SEQ ID NO: 222509 - DNA, 16 bp, P. troglodytes
cagcatgagaacttca

SEQ ID NO: 222510 - DNA, 16 bp, P. troglodytes
cagcatgagccaccac

SEQ ID NO: 222511 - DNA, 16 bp, P. troglodytes
cagcatgaggacagac

SEQ ID NO: 222512 - DNA, 16 bp, P. troglodytes
cagcatgccaaagcac

SEQ ID NO: 222513 - DNA, 16 bp, P. troglodytes
cagcatggccaacatg

SEQ ID NO: 222514 - DNA, 16 bp, P. troglodytes
cagcatggcgaaaccc

SEQ ID NO: 222515 - DNA, 16 bp, P. troglodytes
cagcatggctggagag

SEQ ID NO: 222516 - DNA, 16 bp, P. troglodytes
cagcatgggcagcaga

SEQ ID NO: 222517 - DNA, 16 bp, P. troglodytes
cagcatgggggaagcc

SEQ ID NO: 222518 - DNA, 16 bp, P. troglodytes
cagcatggtagtggca

SEQ ID NO: 222519 - DNA, 16 bp, P. troglodytes
cagcattaacccaaaa

SEQ ID NO: 222520 - DNA, 16 bp, P. troglodytes
cagcattaccctgaca

SEQ ID NO: 222521 - DNA, 16 bp, P. troglodytes
cagcattcacggttca

SEQ ID NO: 222522 - DNA, 16 bp, P. troglodytes
cagcattccagcctgg

SEQ ID NO: 222523 - DNA, 16 bp, P. troglodytes
cagcattcgcggttca

SEQ ID NO: 222524 - DNA, 16 bp, P. troglodytes
cagcattgccctgata

SEQ ID NO: 222525 - DNA, 16 bp, P. troglodytes
cagcattgtttgcaat

SEQ ID NO: 222526 - DNA, 16 bp, P. troglodytes
cagcatttcccaaaat

SEQ ID NO: 222527 - DNA, 16 bp, P. troglodytes
cagcatttggtgctgt

SEQ ID NO: 222528 - DNA, 16 bp, P. troglodytes
cagcatttggtggtgt

SEQ ID NO: 222529 - DNA, 16 bp, P. troglodytes
cagcattttaggaagc

SEQ ID NO: 222530 - DNA, 16 bp, P. troglodytes
cagcattttgggaggc

SEQ ID NO: 222531 - DNA, 16 bp, P. troglodytes
cagcattttggtaaaa

SEQ ID NO: 222532 - DNA, 16 bp, P. troglodytes
cagcattttgtccctg

SEQ ID NO: 222533 - DNA, 16 bp, P. troglodytes
cagcattttttctttt

SEQ ID NO: 222534 - DNA, 16 bp, P. troglodytes
cagcatttttttttaa

SEQ ID NO: 222535 - DNA, 16 bp, P. troglodytes
cagccaaaataatttt

SEQ ID NO: 222536 - DNA, 16 bp, P. troglodytes
cagccaaacaccacag

SEQ ID NO: 222537 - DNA, 16 bp, P. troglodytes
cagccaaaccataaca

SEQ ID NO: 222538 - DNA, 16 bp, P. troglodytes
cagccaaaccatatca

SEQ ID NO: 222539 - DNA, 16 bp, P. troglodytes
cagccaaagaaatcat

SEQ ID NO: 222540 - DNA, 16 bp, P. troglodytes
cagccaacaccttgat

SEQ ID NO: 222541 - DNA, 16 bp, P. troglodytes
cagccaacacggtgaa

SEQ ID NO: 222542 - DNA, 16 bp, P. troglodytes
cagccaagatggccga

SEQ ID NO: 222543 - DNA, 16 bp, P. troglodytes
cagccaagcagttttt

SEQ ID NO: 222544 - DNA, 16 bp, P. troglodytes
cagccaagccagccag

SEQ ID NO: 222545 - DNA, 16 bp, P. troglodytes
cagccaaggcaacatg

SEQ ID NO: 222546 - DNA, 16 bp, P. troglodytes
cagccaaggcagagag

SEQ ID NO: 222547 - DNA, 16 bp, P. troglodytes
cagccaagggaagcag

SEQ ID NO: 222548 - DNA, 16 bp, P. troglodytes
cagccaagggagtgct

SEQ ID NO: 222549 - DNA, 16 bp, P. troglodytes
cagccacactggcctt

SEQ ID NO: 222550 - DNA, 16 bp, P. troglodytes
cagccacagaaaagaa

SEQ ID NO: 222551 - DNA, 16 bp, P. troglodytes
cagccacagagaaagg

SEQ ID NO: 222552 - DNA, 16 bp, P. troglodytes
cagccacagcaagccc

SEQ ID NO: 222553 - DNA, 16 bp, P. troglodytes
cagccacagtggcctc

SEQ ID NO: 222554 - DNA, 16 bp, P. troglodytes
cagccacatggagctg

SEQ ID NO: 222555 - DNA, 16 bp, P. troglodytes
cagccacattctgagg

SEQ ID NO: 222556 - DNA, 16 bp, P. troglodytes
cagccaccacgcccag

SEQ ID NO: 222557 - DNA, 16 bp, P. troglodytes
cagccacccaggtagc

SEQ ID NO: 222558 - DNA, 16 bp, P. troglodytes
cagccacgtggagctg

SEQ ID NO: 222559 - DNA, 16 bp, P. troglodytes
cagccactcccagagc

SEQ ID NO: 222560 - DNA, 16 bp, P. troglodytes
cagccactcgggaggt

SEQ ID NO: 222561 - DNA, 16 bp, P. troglodytes
cagccactgctgagtg

SEQ ID NO: 222562 - DNA, 16 bp, P. troglodytes
cagccactgtagaaaa

SEQ ID NO: 222563 - DNA, 16 bp, P. troglodytes
cagccactgtgctgtg

SEQ ID NO: 222564 - DNA, 16 bp, P. troglodytes
cagccactttagaaaa

SEQ ID NO: 222565 - DNA, 16 bp, P. troglodytes
cagccactttgggagg

SEQ ID NO: 222566 - DNA, 16 bp, P. troglodytes
cagccagaataaaagc

SEQ ID NO: 222567 - DNA, 16 bp, P. troglodytes
cagccagagagaaagg

SEQ ID NO: 222568 - DNA, 16 bp, P. troglodytes
cagccagagcagggca

SEQ ID NO: 222569 - DNA, 16 bp, P. troglodytes
cagccagagtgcctct

SEQ ID NO: 222570 - DNA, 16 bp, P. troglodytes
cagccagccagccaag

SEQ ID NO: 222571 - DNA, 16 bp, P. troglodytes
cagccagccagccagc

SEQ ID NO: 222572 - DNA, 16 bp, P. troglodytes
cagccagccatggtgg

SEQ ID NO: 222573 - DNA, 16 bp, P. troglodytes
cagccagcctggccaa

SEQ ID NO: 222574 - DNA, 16 bp, P. troglodytes
cagccagcctgggcaa

SEQ ID NO: 222575 - DNA, 16 bp, P. troglodytes
cagccaggaggaagag

SEQ ID NO: 222576 - DNA, 16 bp, P. troglodytes
cagccaggaggtggtg

SEQ ID NO: 222577 - DNA, 16 bp, P. troglodytes
cagccaggcatggtgg

SEQ ID NO: 222578 - DNA, 16 bp, P. troglodytes
cagccaggccagcctg

SEQ ID NO: 222579 - DNA, 16 bp, P. troglodytes
cagccaggcccagtgg

SEQ ID NO: 222580 - DNA, 19 bp, P. troglodytes
cagccaggcgtggtggcac

SEQ ID NO: 222581 - DNA, 16 bp, P. troglodytes
cagccaggctcagtgg

SEQ ID NO: 222582 - DNA, 17 bp, P. troglodytes
cagccaggctgggggag

SEQ ID NO: 222583 - DNA, 16 bp, P. troglodytes
cagccaggctggtctc

SEQ ID NO: 222584 - DNA, 16 bp, P. troglodytes
cagccaggtgaggtgg

SEQ ID NO: 222585 - DNA, 16 bp, P. troglodytes
cagccaggtgctgtgg

SEQ ID NO: 222586 - DNA, 16 bp, P. troglodytes
cagccaggtgtggtgg

SEQ ID NO: 222587 - DNA, 16 bp, P. troglodytes
cagccagtctgagaaa

SEQ ID NO: 222588 - DNA, 16 bp, P. troglodytes
cagccagtgtgttggg

SEQ ID NO: 222589 - DNA, 16 bp, P. troglodytes
cagccataaaaaagca

SEQ ID NO: 222590 - DNA, 16 bp, P. troglodytes
cagccataaaaaggaa

SEQ ID NO: 222591 - DNA, 16 bp, P. troglodytes
cagccataaaagaatg

SEQ ID NO: 222592 - DNA, 16 bp, P. troglodytes
cagccataaaatgaat

SEQ ID NO: 222593 - DNA, 16 bp, P. troglodytes
cagccataaacaagga

SEQ ID NO: 222594 - DNA, 16 bp, P. troglodytes
cagccataagaaggaa

SEQ ID NO: 222595 - DNA, 16 bp, P. troglodytes
cagccataatcctcct

SEQ ID NO: 222596 - DNA, 16 bp, P. troglodytes
cagccatagaaaagga

SEQ ID NO: 222597 - DNA, 16 bp, P. troglodytes
cagccatcaccactgt

SEQ ID NO: 222598 - DNA, 16 bp, P. troglodytes
cagccatcttgcaacc

SEQ ID NO: 222599 - DNA, 16 bp, P. troglodytes
cagccatctttggaaa

SEQ ID NO: 222600 - DNA, 16 bp, P. troglodytes
cagccatgatcacacc

SEQ ID NO: 222601 - DNA, 16 bp, P. troglodytes
cagccatgcttcctat

SEQ ID NO: 222602 - DNA, 16 bp, P. troglodytes
cagccatgcttcctgt

SEQ ID NO: 222603 - DNA, 16 bp, P. troglodytes
cagccatggtgggagt

SEQ ID NO: 222604 - DNA, 16 bp, P. troglodytes
cagccattattaaaaa

SEQ ID NO: 222605 - DNA, 16 bp, P. troglodytes
cagccattccacttct

SEQ ID NO: 222606 - DNA, 16 bp, P. troglodytes
cagccattctaaatgg

SEQ ID NO: 222607 - DNA, 16 bp, P. troglodytes
cagccattgctgaggc

SEQ ID NO: 222608 - DNA, 16 bp, P. troglodytes
cagccatttctccaag

SEQ ID NO: 222609 - DNA, 16 bp, P. troglodytes
cagcccaaaatttcct

SEQ ID NO: 222610 - DNA, 16 bp, P. troglodytes
cagcccaaatgtccat

SEQ ID NO: 222611 - DNA, 16 bp, P. troglodytes
cagcccaaattctcct

SEQ ID NO: 222612 - DNA, 16 bp, P. troglodytes
cagcccaacacaaatt

SEQ ID NO: 222613 - DNA, 16 bp, P. troglodytes
cagcccaagtgtccat

SEQ ID NO: 222614 - DNA, 16 bp, P. troglodytes
cagcccaatttttaaa

SEQ ID NO: 222615 - DNA, 16 bp, P. troglodytes
cagcccacaggcagcc

SEQ ID NO: 222616 - DNA, 16 bp, P. troglodytes
cagcccacaggccaaa

SEQ ID NO: 222617 - DNA, 16 bp, P. troglodytes
cagcccactgactcaa

SEQ ID NO: 222618 - DNA, 16 bp, P. troglodytes
cagcccactgctgcca

SEQ ID NO: 222619 - DNA, 16 bp, P. troglodytes
cagcccagagcctggc

SEQ ID NO: 222620 - DNA, 16 bp, P. troglodytes
cagcccagcatctgtg

SEQ ID NO: 222621 - DNA, 16 bp, P. troglodytes
cagcccagcccagcct

SEQ ID NO: 222622 - DNA, 16 bp, P. troglodytes
cagcccagcccagctg

SEQ ID NO: 222623 - DNA, 16 bp, P. troglodytes
cagcccagcccctgcc

SEQ ID NO: 222624 - DNA, 16 bp, P. troglodytes
cagcccagccctgcca

SEQ ID NO: 222625 - DNA, 16 bp, P. troglodytes
cagcccagccctgccc

SEQ ID NO: 222626 - DNA, 16 bp, P. troglodytes
cagcccagcctgggca

SEQ ID NO: 222627 - DNA, 16 bp, P. troglodytes
cagcccagcctgggtg

SEQ ID NO: 222628 - DNA, 16 bp, P. troglodytes
cagcccagctcagccc

SEQ ID NO: 222629 - DNA, 16 bp, P. troglodytes
cagcccagctgtaaaa

SEQ ID NO: 222630 - DNA, 16 bp, P. troglodytes
cagcccagcttctgtg

SEQ ID NO: 222631 - DNA, 16 bp, P. troglodytes
cagcccaggaggctga

SEQ ID NO: 222632 - DNA, 16 bp, P. troglodytes
cagcccaggagtgctg

SEQ ID NO: 222633 - DNA, 16 bp, P. troglodytes
cagcccaggagtttga

SEQ ID NO: 222634 - DNA, 16 bp, P. troglodytes
cagcccaggccacaga

SEQ ID NO: 222635 - DNA, 16 bp, P. troglodytes
cagcccaggcccaggc

SEQ ID NO: 222636 - DNA, 16 bp, P. troglodytes
cagcccaggtgataga

SEQ ID NO: 222637 - DNA, 16 bp, P. troglodytes
cagcccagtgtggtgg

SEQ ID NO: 222638 - DNA, 16 bp, P. troglodytes
cagcccatcatctaca

SEQ ID NO: 222639 - DNA, 16 bp, P. troglodytes
cagcccatgccatcac

SEQ ID NO: 222640 - DNA, 16 bp, P. troglodytes
cagccccaaactcctg

SEQ ID NO: 222641 - DNA, 16 bp, P. troglodytes
cagccccaaatcattt

SEQ ID NO: 222642 - DNA, 16 bp, P. troglodytes
cagccccaacctccca

SEQ ID NO: 222643 - DNA, 16 bp, P. troglodytes
cagccccaccctggcc

SEQ ID NO: 222644 - DNA, 16 bp, P. troglodytes
cagccccactcccagc

SEQ ID NO: 222645 - DNA, 16 bp, P. troglodytes
cagccccagccaggcc

SEQ ID NO: 222646 - DNA, 16 bp, P. troglodytes
cagccccagccccagg

SEQ ID NO: 222647 - DNA, 16 bp, P. troglodytes
cagccccagccctggg

SEQ ID NO: 222648 - DNA, 16 bp, P. troglodytes
cagccccagcctccca

SEQ ID NO: 222649 - DNA, 16 bp, P. troglodytes
cagccccagcctcctc

SEQ ID NO: 222650 - DNA, 16 bp, P. troglodytes
cagccccagcctgggc

SEQ ID NO: 222651 - DNA, 16 bp, P. troglodytes
cagccccagctgcacc

SEQ ID NO: 222652 - DNA, 16 bp, P. troglodytes
cagccccaggaggcag

SEQ ID NO: 222653 - DNA, 16 bp, P. troglodytes
cagccccaggccaggc

SEQ ID NO: 222654 - DNA, 16 bp, P. troglodytes
cagccccagtcaagcc

SEQ ID NO: 222655 - DNA, 16 bp, P. troglodytes
cagcccccaaagtgct

SEQ ID NO: 222656 - DNA, 16 bp, P. troglodytes
cagcccccacagctgc

SEQ ID NO: 222657 - DNA, 16 bp, P. troglodytes
cagcccccacctcctg

SEQ ID NO: 222658 - DNA, 16 bp, P. troglodytes
cagcccccagccctgc

SEQ ID NO: 222659 - DNA, 16 bp, P. troglodytes
cagcccccagggctgc

SEQ ID NO: 222660 - DNA, 16 bp, P. troglodytes
cagccccctcaccatg

SEQ ID NO: 222661 - DNA, 16 bp, P. troglodytes
cagccccctctggact

SEQ ID NO: 222662 - DNA, 16 bp, P. troglodytes
cagccccctgccacct

SEQ ID NO: 222663 - DNA, 16 bp, P. troglodytes
cagccccgagggctgc

SEQ ID NO: 222664 - DNA, 16 bp, P. troglodytes
cagccccggttcccgc

SEQ ID NO: 222665 - DNA, 16 bp, P. troglodytes
cagcccctagaactgt

SEQ ID NO: 222666 - DNA, 16 bp, P. troglodytes
cagcccctcttccctc

SEQ ID NO: 222667 - DNA, 16 bp, P. troglodytes
cagcccctgcagcccc

SEQ ID NO: 222668 - DNA, 16 bp, P. troglodytes
cagcccctgcagctgc

SEQ ID NO: 222669 - DNA, 16 bp, P. troglodytes
cagcccctgccaggcc

SEQ ID NO: 222670 - DNA, 16 bp, P. troglodytes
cagcccctgcccagcc

SEQ ID NO: 222671 - DNA, 16 bp, P. troglodytes
cagcccctgcccctgc

SEQ ID NO: 222672 - DNA, 16 bp, P. troglodytes
cagcccctgcccctgg

SEQ ID NO: 222673 - DNA, 16 bp, P. troglodytes
cagcccctgccctcaa

SEQ ID NO: 222674 - DNA, 16 bp, P. troglodytes
cagcccctgccctgcc

SEQ ID NO: 222675 - DNA, 16 bp, P. troglodytes
cagcccctgcctgcct

SEQ ID NO: 222676 - DNA, 16 bp, P. troglodytes
cagccccttctctgct

SEQ ID NO: 222677 - DNA, 16 bp, P. troglodytes
cagccccttgggaggc

SEQ ID NO: 222678 - DNA, 16 bp, P. troglodytes
cagcccgccttggcct

SEQ ID NO: 222679 - DNA, 16 bp, P. troglodytes
cagccctaatttttgt

SEQ ID NO: 222680 - DNA, 16 bp, P. troglodytes
cagccctagccagaag

SEQ ID NO: 222681 - DNA, 16 bp, P. troglodytes
cagccctcacagccct

SEQ ID NO: 222682 - DNA, 16 bp, P. troglodytes
cagccctcagaagaaa

SEQ ID NO: 222683 - DNA, 16 bp, P. troglodytes
cagccctcagcagaga

SEQ ID NO: 222684 - DNA, 16 bp, P. troglodytes
cagccctctgcctccc

SEQ ID NO: 222685 - DNA, 16 bp, P. troglodytes
cagccctgagaaacat

SEQ ID NO: 222686 - DNA, 16 bp, P. troglodytes
cagccctgagggctgc

SEQ ID NO: 222687 - DNA, 16 bp, P. troglodytes
cagccctgccagcatc

SEQ ID NO: 222688 - DNA, 16 bp, P. troglodytes
cagccctgcccacacc

SEQ ID NO: 222689 - DNA, 16 bp, P. troglodytes
cagccctgcccctgcc

SEQ ID NO: 222690 - DNA, 16 bp, P. troglodytes
cagccctgccctccca

SEQ ID NO: 222691 - DNA, 16 bp, P. troglodytes
cagccctgcctcctcc

SEQ ID NO: 222692 - DNA, 16 bp, P. troglodytes
cagccctgctcaccag

SEQ ID NO: 222693 - DNA, 16 bp, P. troglodytes
cagccctgctggcacc

SEQ ID NO: 222694 - DNA, 16 bp, P. troglodytes
cagccctggaggccag

SEQ ID NO: 222695 - DNA, 16 bp, P. troglodytes
cagccctggcctccca

SEQ ID NO: 222696 - DNA, 16 bp, P. troglodytes
cagccctggctcctgc

SEQ ID NO: 222697 - DNA, 16 bp, P. troglodytes
cagccctggcttgggg

SEQ ID NO: 222698 - DNA, 16 bp, P. troglodytes
cagccctgggaggggc

SEQ ID NO: 222699 - DNA, 16 bp, P. troglodytes
cagccctgggccctgg

SEQ ID NO: 222700 - DNA, 16 bp, P. troglodytes
cagccctgggttcaaa

SEQ ID NO: 222701 - DNA, 16 bp, P. troglodytes
cagccctggtgtggga

SEQ ID NO: 222702 - DNA, 16 bp, P. troglodytes
cagccctggttcccgc

SEQ ID NO: 222703 - DNA, 16 bp, P. troglodytes
cagccctgtcctcagg

SEQ ID NO: 222704 - DNA, 16 bp, P. troglodytes
cagccctgtggaactg

SEQ ID NO: 222705 - DNA, 16 bp, P. troglodytes
cagcccttgcccctct

SEQ ID NO: 222706 - DNA, 16 bp, P. troglodytes
cagccgcccatcgtct

SEQ ID NO: 222707 - DNA, 16 bp, P. troglodytes
cagccgccccatctga

SEQ ID NO: 222708 - DNA, 16 bp, P. troglodytes
cagccggacatggtgg

SEQ ID NO: 222709 - DNA, 17 bp, P. troglodytes
cagccggccagccctgc

SEQ ID NO: 222710 - DNA, 18 bp, P. troglodytes
cagccgggcacggtggct

SEQ ID NO: 222711 - DNA, 16 bp, P. troglodytes
cagccgggcctggtgg

SEQ ID NO: 222712 - DNA, 20 bp, P. troglodytes
cagccggggtgacagagcga

SEQ ID NO: 222713 - DNA, 19 bp, P. troglodytes
cagccgggtgtggtggcac

SEQ ID NO: 222714 - DNA, 16 bp, P. troglodytes
cagccgtgagccactg

SEQ ID NO: 222715 - DNA, 16 bp, P. troglodytes
cagcctaaatgcccat

SEQ ID NO: 222716 - DNA, 16 bp, P. troglodytes
cagcctaaccaacgtg

SEQ ID NO: 222717 - DNA, 16 bp, P. troglodytes
cagcctagacaacata

SEQ ID NO: 222718 - DNA, 16 bp, P. troglodytes
cagcctagattttttt

SEQ ID NO: 222719 - DNA, 16 bp, P. troglodytes
cagcctaggcaacaac

SEQ ID NO: 222720 - DNA, 16 bp, P. troglodytes
cagcctaggcaacaat

SEQ ID NO: 222721 - DNA, 16 bp, P. troglodytes
cagcctaggggacaga

SEQ ID NO: 222722 - DNA, 16 bp, P. troglodytes
cagcctcaaaatcctg

SEQ ID NO: 222723 - DNA, 16 bp, P. troglodytes
cagcctcaaacccctg

SEQ ID NO: 222724 - DNA, 16 bp, P. troglodytes
cagcctcaaattccca

SEQ ID NO: 222725 - DNA, 16 bp, P. troglodytes
cagcctcaacctctta

SEQ ID NO: 222726 - DNA, 16 bp, P. troglodytes
cagcctcaagtatttc

SEQ ID NO: 222727 - DNA, 16 bp, P. troglodytes
cagcctcaccaatatg

SEQ ID NO: 222728 - DNA, 16 bp, P. troglodytes
cagcctcaccagcatc

SEQ ID NO: 222729 - DNA, 16 bp, P. troglodytes
cagcctcaccctcctg

SEQ ID NO: 222730 - DNA, 16 bp, P. troglodytes
cagcctcagcaacaga

SEQ ID NO: 222731 - DNA, 16 bp, P. troglodytes
cagcctcagcatcacc

SEQ ID NO: 222732 - DNA, 16 bp, P. troglodytes
cagcctcagcctcagc

SEQ ID NO: 222733 - DNA, 16 bp, P. troglodytes
cagcctcagcctcccg

SEQ ID NO: 222734 - DNA, 16 bp, P. troglodytes
cagcctcagcctccct

SEQ ID NO: 222735 - DNA, 16 bp, P. troglodytes
cagcctcagctcactg

SEQ ID NO: 222736 - DNA, 16 bp, P. troglodytes
cagcctcagcttcctc

SEQ ID NO: 222737 - DNA, 16 bp, P. troglodytes
cagcctcaggaggtcc

SEQ ID NO: 222738 - DNA, 16 bp, P. troglodytes
cagcctcaggcaacca

SEQ ID NO: 222739 - DNA, 16 bp, P. troglodytes
cagcctcaggcagttc

SEQ ID NO: 222740 - DNA, 16 bp, P. troglodytes
cagcctcagtttcccc

SEQ ID NO: 222741 - DNA, 18 bp, P. troglodytes
cagcctcagtttcctcat

SEQ ID NO: 222742 - DNA, 16 bp, P. troglodytes
cagcctccaaaaatgt

SEQ ID NO: 222743 - DNA, 16 bp, P. troglodytes
cagcctccaactccag

SEQ ID NO: 222744 - DNA, 16 bp, P. troglodytes
cagcctccacagcagc

SEQ ID NO: 222745 - DNA, 16 bp, P. troglodytes
cagcctccacctcaca

SEQ ID NO: 222746 - DNA, 16 bp, P. troglodytes
cagcctccacctccag

SEQ ID NO: 222747 - DNA, 16 bp, P. troglodytes
cagcctccacctcctt

SEQ ID NO: 222748 - DNA, 16 bp, P. troglodytes
cagcctccacctctca

SEQ ID NO: 222749 - DNA, 16 bp, P. troglodytes
cagcctccacctgcca

SEQ ID NO: 222750 - DNA, 16 bp, P. troglodytes
cagcctccaccttcca

SEQ ID NO: 222751 - DNA, 16 bp, P. troglodytes
cagcctccagaactgg

SEQ ID NO: 222752 - DNA, 16 bp, P. troglodytes
cagcctccagaactgt

SEQ ID NO: 222753 - DNA, 16 bp, P. troglodytes
cagcctccagagaagc

SEQ ID NO: 222754 - DNA, 16 bp, P. troglodytes
cagcctccagctggga

SEQ ID NO: 222755 - DNA, 16 bp, P. troglodytes
cagcctccatctccca

SEQ ID NO: 222756 - DNA, 16 bp, P. troglodytes
cagcctccatctcctg

SEQ ID NO: 222757 - DNA, 16 bp, P. troglodytes
cagcctccatcttcca

SEQ ID NO: 222758 - DNA, 16 bp, P. troglodytes
cagcctcccaagctgc

SEQ ID NO: 222759 - DNA, 16 bp, P. troglodytes
cagcctcccaaggagc

SEQ ID NO: 222760 - DNA, 16 bp, P. troglodytes
cagcctcccaaggagt

SEQ ID NO: 222761 - DNA, 20 bp, P. troglodytes
cagcctcccaagtagctaga

SEQ ID NO: 222762 - DNA, 16 bp, P. troglodytes
cagcctcccacacagc

SEQ ID NO: 222763 - DNA, 16 bp, P. troglodytes
cagcctcccagactgc

SEQ ID NO: 222764 - DNA, 16 bp, P. troglodytes
cagcctcccagagtag

SEQ ID NO: 222765 - DNA, 16 bp, P. troglodytes
cagcctcccagagtgg

SEQ ID NO: 222766 - DNA, 16 bp, P. troglodytes
cagcctcccagagtgt

SEQ ID NO: 222767 - DNA, 16 bp, P. troglodytes
cagcctcccagcgtgc

SEQ ID NO: 222768 - DNA, 16 bp, P. troglodytes
cagcctccccagcaac

SEQ ID NO: 222769 - DNA, 16 bp, P. troglodytes
cagcctccccagcagc

SEQ ID NO: 222770 - DNA, 16 bp, P. troglodytes
cagcctccccagcagt

SEQ ID NO: 222771 - DNA, 16 bp, P. troglodytes
cagcctccccttcctg

SEQ ID NO: 222772 - DNA, 16 bp, P. troglodytes
cagcctcccgggcagc

SEQ ID NO: 222773 - DNA, 16 bp, P. troglodytes
cagcctccctcccggc

SEQ ID NO: 222774 - DNA, 16 bp, P. troglodytes
cagcctccctccctct

SEQ ID NO: 222775 - DNA, 16 bp, P. troglodytes
cagcctcccttccagc

SEQ ID NO: 222776 - DNA, 16 bp, P. troglodytes
cagcctcctaattagc

SEQ ID NO: 222777 - DNA, 16 bp, P. troglodytes
cagcctcctgccacca

SEQ ID NO: 222778 - DNA, 16 bp, P. troglodytes
cagcctcctgggcagc

SEQ ID NO: 222779 - DNA, 16 bp, P. troglodytes
cagcctcctgggctcc

SEQ ID NO: 222780 - DNA, 16 bp, P. troglodytes
cagcctccttcctgcc

SEQ ID NO: 222781 - DNA, 16 bp, P. troglodytes
cagcctcgagagtagc

SEQ ID NO: 222782 - DNA, 16 bp, P. troglodytes
cagcctcgctgccacc

SEQ ID NO: 222783 - DNA, 17 bp, P. troglodytes
cagcctcgctgccgcct

SEQ ID NO: 222784 - DNA, 16 bp, P. troglodytes
cagcctctacctccca

SEQ ID NO: 222785 - DNA, 16 bp, P. troglodytes
cagcctctacctcctg

SEQ ID NO: 222786 - DNA, 16 bp, P. troglodytes
cagcctctatctcctg

SEQ ID NO: 222787 - DNA, 16 bp, P. troglodytes
cagcctctcctgcctc

SEQ ID NO: 222788 - DNA, 16 bp, P. troglodytes
cagcctctctccttgg

SEQ ID NO: 222789 - DNA, 16 bp, P. troglodytes
cagcctctctgagtct

SEQ ID NO: 222790 - DNA, 16 bp, P. troglodytes
cagcctctctgtgcct

SEQ ID NO: 222791 - DNA, 16 bp, P. troglodytes
cagcctctgccacctg

SEQ ID NO: 222792 - DNA, 16 bp, P. troglodytes
cagcctctgcccggct

SEQ ID NO: 222793 - DNA, 16 bp, P. troglodytes
cagcctctgccctcag

SEQ ID NO: 222794 - DNA, 16 bp, P. troglodytes
cagcctctgcctcaca

SEQ ID NO: 222795 - DNA, 16 bp, P. troglodytes
cagcctctgcctccag

SEQ ID NO: 222796 - DNA, 16 bp, P. troglodytes
cagcctctgcctccca

SEQ ID NO: 222797 - DNA, 16 bp, P. troglodytes
cagcctctgcctcccg

SEQ ID NO: 222798 - DNA, 16 bp, P. troglodytes
cagcctctgcctcctg

SEQ ID NO: 222799 - DNA, 16 bp, P. troglodytes
cagcctctgctcctcc

SEQ ID NO: 222800 - DNA, 19 bp, P. troglodytes
cagcctctgctgctgatac

SEQ ID NO: 222801 - DNA, 16 bp, P. troglodytes
cagcctctgcttcctg

SEQ ID NO: 222802 - DNA, 16 bp, P. troglodytes
cagcctctggcaacca

SEQ ID NO: 222803 - DNA, 16 bp, P. troglodytes
cagcctctggtaacca

SEQ ID NO: 222804 - DNA, 16 bp, P. troglodytes
cagcctctgtctcctg

SEQ ID NO: 222805 - DNA, 16 bp, P. troglodytes
cagcctctgtgacaga

SEQ ID NO: 222806 - DNA, 16 bp, P. troglodytes
cagcctgaagccatgg

SEQ ID NO: 222807 - DNA, 17 bp, P. troglodytes
cagcctgaccaacatga

SEQ ID NO: 222808 - DNA, 16 bp, P. troglodytes
cagcctgaccagcctg

SEQ ID NO: 222809 - DNA, 16 bp, P. troglodytes
cagcctgagaaacaaa

SEQ ID NO: 222810 - DNA, 16 bp, P. troglodytes
cagcctgagaaacaag

SEQ ID NO: 222811 - DNA, 16 bp, P. troglodytes
cagcctgaggaacaga

SEQ ID NO: 222812 - DNA, 16 bp, P. troglodytes
cagcctgcacaactgt

SEQ ID NO: 222813 - DNA, 16 bp, P. troglodytes
cagcctgcacctccca

SEQ ID NO: 222814 - DNA, 16 bp, P. troglodytes
cagcctgcagagctgt

SEQ ID NO: 222815 - DNA, 16 bp, P. troglodytes
cagcctgcagctccag

SEQ ID NO: 222816 - DNA, 16 bp, P. troglodytes
cagcctgcattgccaa

SEQ ID NO: 222817 - DNA, 16 bp, P. troglodytes
cagcctgccagcctgc

SEQ ID NO: 222818 - DNA, 16 bp, P. troglodytes
cagcctgcccaacatg

SEQ ID NO: 222819 - DNA, 16 bp, P. troglodytes
cagcctgcccaatgtg

SEQ ID NO: 222820 - DNA, 16 bp, P. troglodytes
cagcctgcccctcctg

SEQ ID NO: 222821 - DNA, 16 bp, P. troglodytes
cagcctggaaaaaaaa

SEQ ID NO: 222822 - DNA, 16 bp, P. troglodytes
cagcctggaaaacata

SEQ ID NO: 222823 - DNA, 16 bp, P. troglodytes
cagcctggaaacagag

SEQ ID NO: 222824 - DNA, 16 bp, P. troglodytes
cagcctggacaacata

SEQ ID NO: 222825 - DNA, 16 bp, P. troglodytes
cagcctggacaacatc

SEQ ID NO: 222826 - DNA, 16 bp, P. troglodytes
cagcctggacaacctg

SEQ ID NO: 222827 - DNA, 16 bp, P. troglodytes
cagcctggacaccatg

SEQ ID NO: 222828 - DNA, 16 bp, P. troglodytes
cagcctggacttcatt

SEQ ID NO: 222829 - DNA, 16 bp, P. troglodytes
cagcctggagacacag

SEQ ID NO: 222830 - DNA, 16 bp, P. troglodytes
cagcctggagctcctg

SEQ ID NO: 222831 - DNA, 17 bp, P. troglodytes
cagcctggagtgcaatg

SEQ ID NO: 222832 - DNA, 16 bp, P. troglodytes
cagcctggatgacaag

SEQ ID NO: 222833 - DNA, 16 bp, P. troglodytes
cagcctggatgacagg

SEQ ID NO: 222834 - DNA, 16 bp, P. troglodytes
cagcctggcacggtgg

SEQ ID NO: 222835 - DNA, 16 bp, P. troglodytes
cagcctggcagcctgg

SEQ ID NO: 222836 - DNA, 16 bp, P. troglodytes
cagcctggcatcccag

SEQ ID NO: 222837 - DNA, 16 bp, P. troglodytes
cagcctggccaaccaa

SEQ ID NO: 222838 - DNA, 16 bp, P. troglodytes
cagcctggccaagaag

SEQ ID NO: 222839 - DNA, 16 bp, P. troglodytes
cagcctggccaagaca

SEQ ID NO: 222840 - DNA, 16 bp, P. troglodytes
cagcctggccacagag

SEQ ID NO: 222841 - DNA, 16 bp, P. troglodytes
cagcctggccagcaag

SEQ ID NO: 222842 - DNA, 16 bp, P. troglodytes
cagcctggccagcaga

SEQ ID NO: 222843 - DNA, 16 bp, P. troglodytes
cagcctggccagcctg

SEQ ID NO: 222844 - DNA, 16 bp, P. troglodytes
cagcctggccatcatg

SEQ ID NO: 222845 - DNA, 16 bp, P. troglodytes
cagcctggcccacatg

SEQ ID NO: 222846 - DNA, 16 bp, P. troglodytes
cagcctggcccagccc

SEQ ID NO: 222847 - DNA, 16 bp, P. troglodytes
cagcctggcccctgcc

SEQ ID NO: 222848 - DNA, 16 bp, P. troglodytes
cagcctggcctacgtg

SEQ ID NO: 222849 - DNA, 16 bp, P. troglodytes
cagcctggcctctgcc

SEQ ID NO: 222850 - DNA, 16 bp, P. troglodytes
cagcctggctaatgtg

SEQ ID NO: 222851 - DNA, 16 bp, P. troglodytes
cagcctggctgccgcc

SEQ ID NO: 222852 - DNA, 16 bp, P. troglodytes
cagcctggctggccaa

SEQ ID NO: 222853 - DNA, 16 bp, P. troglodytes
cagcctgggaaaaata

SEQ ID NO: 222854 - DNA, 16 bp, P. troglodytes
cagcctgggaaacatg

SEQ ID NO: 222855 - DNA, 16 bp, P. troglodytes
cagcctgggaacatgg

SEQ ID NO: 222856 - DNA, 16 bp, P. troglodytes
cagcctgggactcctg

SEQ ID NO: 222857 - DNA, 16 bp, P. troglodytes
cagcctgggatgacag

SEQ ID NO: 222858 - DNA, 16 bp, P. troglodytes
cagcctgggcaacatg

SEQ ID NO: 222859 - DNA, 16 bp, P. troglodytes
cagcctgggcaacctg

SEQ ID NO: 222860 - DNA, 16 bp, P. troglodytes
cagcctgggcaacgta

SEQ ID NO: 222861 - DNA, 16 bp, P. troglodytes
cagcctgggcaagatg

SEQ ID NO: 222862 - DNA, 16 bp, P. troglodytes
cagcctgggcaaggag

SEQ ID NO: 222863 - DNA, 16 bp, P. troglodytes
cagcctgggcaataaa

SEQ ID NO: 222864 - DNA, 16 bp, P. troglodytes
cagcctgggcagcagc

SEQ ID NO: 222865 - DNA, 16 bp, P. troglodytes
cagcctgggcagcctg

SEQ ID NO: 222866 - DNA, 16 bp, P. troglodytes
cagcctgggcatcaca

SEQ ID NO: 222867 - DNA, 16 bp, P. troglodytes
cagcctgggctacatg

SEQ ID NO: 222868 - DNA, 16 bp, P. troglodytes
cagcctgggctagaga

SEQ ID NO: 222869 - DNA, 16 bp, P. troglodytes
cagcctgggcttcatt

SEQ ID NO: 222870 - DNA, 16 bp, P. troglodytes
cagcctggggaacacg

SEQ ID NO: 222871 - DNA, 16 bp, P. troglodytes
cagcctggggaacaga

SEQ ID NO: 222872 - DNA, 16 bp, P. troglodytes
cagcctggggaatata

SEQ ID NO: 222873 - DNA, 16 bp, P. troglodytes
cagcctggggacagaa

SEQ ID NO: 222874 - DNA, 16 bp, P. troglodytes
cagcctggggcctggg

SEQ ID NO: 222875 - DNA, 16 bp, P. troglodytes
cagcctgggggatgga

SEQ ID NO: 222876 - DNA, 16 bp, P. troglodytes
cagcctgggtaacagg

SEQ ID NO: 222877 - DNA, 16 bp, P. troglodytes
cagcctgggtaacgtg

SEQ ID NO: 222878 - DNA, 16 bp, P. troglodytes
cagcctgggtgacaaa

SEQ ID NO: 222879 - DNA, 16 bp, P. troglodytes
cagcctgggtgacagt

SEQ ID NO: 222880 - DNA, 16 bp, P. troglodytes
cagcctgggtgaccag

SEQ ID NO: 222881 - DNA, 16 bp, P. troglodytes
cagcctgggtgacggt

SEQ ID NO: 222882 - DNA, 16 bp, P. troglodytes
cagcctggtcaacaag

SEQ ID NO: 222883 - DNA, 16 bp, P. troglodytes
cagcctggtcaacatg

SEQ ID NO: 222884 - DNA, 16 bp, P. troglodytes
cagcctggtgacacag

SEQ ID NO: 222885 - DNA, 16 bp, P. troglodytes
cagcctggtgatggag

SEQ ID NO: 222886 - DNA, 16 bp, P. troglodytes
cagcctggtgcagtgg

SEQ ID NO: 222887 - DNA, 16 bp, P. troglodytes
cagcctgtccaacata

SEQ ID NO: 222888 - DNA, 16 bp, P. troglodytes
cagcctgtccaagatg

SEQ ID NO: 222889 - DNA, 16 bp, P. troglodytes
cagcctgtcctttgaa

SEQ ID NO: 222890 - DNA, 17 bp, P. troglodytes
cagcctgtctggctgct

SEQ ID NO: 222891 - DNA, 16 bp, P. troglodytes
cagcctgtgcaacaag

SEQ ID NO: 222892 - DNA, 16 bp, P. troglodytes
cagcctgtgggccaca

SEQ ID NO: 222893 - DNA, 16 bp, P. troglodytes
cagcctgtgtgacaag

SEQ ID NO: 222894 - DNA, 16 bp, P. troglodytes
cagcctgttggccagg

SEQ ID NO: 222895 - DNA, 16 bp, P. troglodytes
cagccttaaaatagaa

SEQ ID NO: 222896 - DNA, 16 bp, P. troglodytes
cagccttaaagaagaa

SEQ ID NO: 222897 - DNA, 16 bp, P. troglodytes
cagccttcagaactgt

SEQ ID NO: 222898 - DNA, 16 bp, P. troglodytes
cagccttccccatctc

SEQ ID NO: 222899 - DNA, 16 bp, P. troglodytes
cagccttccttgcagt

SEQ ID NO: 222900 - DNA, 16 bp, P. troglodytes
cagccttctgagaagc

SEQ ID NO: 222901 - DNA, 16 bp, P. troglodytes
cagccttctggagaac

SEQ ID NO: 222902 - DNA, 16 bp, P. troglodytes
cagccttctttttctt

SEQ ID NO: 222903 - DNA, 16 bp, P. troglodytes
cagccttgaaatcctg

SEQ ID NO: 222904 - DNA, 16 bp, P. troglodytes
cagccttgaattcctc

SEQ ID NO: 222905 - DNA, 16 bp, P. troglodytes
cagccttgcaccccag

SEQ ID NO: 222906 - DNA, 16 bp, P. troglodytes
cagccttgccctccca

SEQ ID NO: 222907 - DNA, 16 bp, P. troglodytes
cagccttgcctcctga

SEQ ID NO: 222908 - DNA, 16 bp, P. troglodytes
cagccttgctgccacc

SEQ ID NO: 222909 - DNA, 16 bp, P. troglodytes
cagccttggggacaga

SEQ ID NO: 222910 - DNA, 16 bp, P. troglodytes
cagccttgtcaaagat

SEQ ID NO: 222911 - DNA, 16 bp, P. troglodytes
cagccttgtgtgtgat

SEQ ID NO: 222912 - DNA, 16 bp, P. troglodytes
cagccttttcagactg

SEQ ID NO: 222913 - DNA, 16 bp, P. troglodytes
cagcgaaactccatct

SEQ ID NO: 222914 - DNA, 17 bp, P. troglodytes
cagcgagactctgtctt

SEQ ID NO: 222915 - DNA, 16 bp, P. troglodytes
cagcgagccgagatcg

SEQ ID NO: 222916 - DNA, 16 bp, P. troglodytes
cagcgctttgggaagc

SEQ ID NO: 222917 - DNA, 16 bp, P. troglodytes
cagcggcagcggcagc

SEQ ID NO: 222918 - DNA, 16 bp, P. troglodytes
cagcggctcacgcctg

SEQ ID NO: 222919 - DNA, 16 bp, P. troglodytes
cagcggctgccgctgc

SEQ ID NO: 222920 - DNA, 16 bp, P. troglodytes
cagcggtggctgcaga

SEQ ID NO: 222921 - DNA, 16 bp, P. troglodytes
cagcgtcttgctctgt

SEQ ID NO: 222922 - DNA, 16 bp, P. troglodytes
cagcgtgctggcagcc

SEQ ID NO: 222923 - DNA, 16 bp, P. troglodytes
cagctaaagcaatgtt

SEQ ID NO: 222924 - DNA, 16 bp, P. troglodytes
cagctaactttttaaa

SEQ ID NO: 222925 - DNA, 16 bp, P. troglodytes
cagctaactttttgtt

SEQ ID NO: 222926 - DNA, 16 bp, P. troglodytes
cagctaataagtgaca

SEQ ID NO: 222927 - DNA, 16 bp, P. troglodytes
cagctaattaaaaaaa

SEQ ID NO: 222928 - DNA, 16 bp, P. troglodytes
cagctaatttatgtat

SEQ ID NO: 222929 - DNA, 16 bp, P. troglodytes
cagctaatttgttttt

SEQ ID NO: 222930 - DNA, 16 bp, P. troglodytes
cagctacaaataaaat

SEQ ID NO: 222931 - DNA, 16 bp, P. troglodytes
cagctacctcgggagg

SEQ ID NO: 222932 - DNA, 16 bp, P. troglodytes
cagctacctggaggct

SEQ ID NO: 222933 - DNA, 16 bp, P. troglodytes
cagctacgtggaactg

SEQ ID NO: 222934 - DNA, 16 bp, P. troglodytes
cagctactacggaggc

SEQ ID NO: 222935 - DNA, 16 bp, P. troglodytes
cagctactcagctctg

SEQ ID NO: 222936 - DNA, 19 bp, P. troglodytes
cagctactcggcaggctga

SEQ ID NO: 222937 - DNA, 16 bp, P. troglodytes
cagctactcgggagct

SEQ ID NO: 222938 - DNA, 16 bp, P. troglodytes
cagctactctggaggc

SEQ ID NO: 222939 - DNA, 16 bp, P. troglodytes
cagctactgcaacctc

SEQ ID NO: 222940 - DNA, 16 bp, P. troglodytes
cagctactgcagaggc

SEQ ID NO: 222941 - DNA, 16 bp, P. troglodytes
cagctacttagaggct

SEQ ID NO: 222942 - DNA, 16 bp, P. troglodytes
cagctacttgggaggg

SEQ ID NO: 222943 - DNA, 16 bp, P. troglodytes
cagctactttgggggc

SEQ ID NO: 222944 - DNA, 16 bp, P. troglodytes
cagctaggaagtggtg

SEQ ID NO: 222945 - DNA, 16 bp, P. troglodytes
cagctagtttttattt

SEQ ID NO: 222946 - DNA, 16 bp, P. troglodytes
cagctatgattgtgcc

SEQ ID NO: 222947 - DNA, 16 bp, P. troglodytes
cagctatgccctgccc

SEQ ID NO: 222948 - DNA, 16 bp, P. troglodytes
cagctatgcgggaggc

SEQ ID NO: 222949 - DNA, 16 bp, P. troglodytes
cagctatgctggaggc

SEQ ID NO: 222950 - DNA, 16 bp, P. troglodytes
cagctattaaaaagaa

SEQ ID NO: 222951 - DNA, 16 bp, P. troglodytes
cagctattccagaggc

SEQ ID NO: 222952 - DNA, 16 bp, P. troglodytes
cagctatttttaaaat

SEQ ID NO: 222953 - DNA, 16 bp, P. troglodytes
cagctatttttttaaa

SEQ ID NO: 222954 - DNA, 16 bp, P. troglodytes
cagctcaaggaggcct

SEQ ID NO: 222955 - DNA, 30 bp, P. troglodytes
cagctcaaggaggcctgcctgcctctgtag

SEQ ID NO: 222956 - DNA, 16 bp, P. troglodytes
cagctcacagcagcct

SEQ ID NO: 222957 - DNA, 18 bp, P. troglodytes
cagctcaccacaacctct

SEQ ID NO: 222958 - DNA, 16 bp, P. troglodytes
cagctcacctcagcct

SEQ ID NO: 222959 - DNA, 16 bp, P. troglodytes
cagctcactgaagtct

SEQ ID NO: 222960 - DNA, 16 bp, P. troglodytes
cagctcactgcaactg

SEQ ID NO: 222961 - DNA, 16 bp, P. troglodytes
cagctcactgtaactt

SEQ ID NO: 222962 - DNA, 16 bp, P. troglodytes
cagctcagaggagacc

SEQ ID NO: 222963 - DNA, 16 bp, P. troglodytes
cagctcagcccagccc

SEQ ID NO: 222964 - DNA, 16 bp, P. troglodytes
cagctcagctcagctc

SEQ ID NO: 222965 - DNA, 16 bp, P. troglodytes
cagctcagctctcagg

SEQ ID NO: 222966 - DNA, 16 bp, P. troglodytes
cagctcaggagttcaa

SEQ ID NO: 222967 - DNA, 16 bp, P. troglodytes
cagctcagggaggcct

SEQ ID NO: 222968 - DNA, 16 bp, P. troglodytes
cagctcagtggttgga

SEQ ID NO: 222969 - DNA, 16 bp, P. troglodytes
cagctcatgaaagcag

SEQ ID NO: 222970 - DNA, 17 bp, P. troglodytes
cagctcatgcctgtaat

SEQ ID NO: 222971 - DNA, 16 bp, P. troglodytes
cagctccaccactgtg

SEQ ID NO: 222972 - DNA, 16 bp, P. troglodytes
cagctccaccaggcag

SEQ ID NO: 222973 - DNA, 16 bp, P. troglodytes
cagctccacccctgtg

SEQ ID NO: 222974 - DNA, 16 bp, P. troglodytes
cagctccacctcagat

SEQ ID NO: 222975 - DNA, 16 bp, P. troglodytes
cagctccactaggaag

SEQ ID NO: 222976 - DNA, 16 bp, P. troglodytes
cagctccagctccagc

SEQ ID NO: 222977 - DNA, 16 bp, P. troglodytes
cagctccagctgtggc

SEQ ID NO: 222978 - DNA, 16 bp, P. troglodytes
cagctccaggtggctc

SEQ ID NO: 222979 - DNA, 16 bp, P. troglodytes
cagctccatccatgcc

SEQ ID NO: 222980 - DNA, 16 bp, P. troglodytes
cagctccatccatgtc

SEQ ID NO: 222981 - DNA, 16 bp, P. troglodytes
cagctccatccatgtg

SEQ ID NO: 222982 - DNA, 16 bp, P. troglodytes
cagctcccagcctgag

SEQ ID NO: 222983 - DNA, 16 bp, P. troglodytes
cagctcccagctccca

SEQ ID NO: 222984 - DNA, 16 bp, P. troglodytes
cagctccctccagccc

SEQ ID NO: 222985 - DNA, 16 bp, P. troglodytes
cagctccctctgcttg

SEQ ID NO: 222986 - DNA, 17 bp, P. troglodytes
cagctcctcaccagcaa

SEQ ID NO: 222987 - DNA, 16 bp, P. troglodytes
cagctcctcagaaggc

SEQ ID NO: 222988 - DNA, 16 bp, P. troglodytes
cagctcctcagcagca

SEQ ID NO: 222989 - DNA, 16 bp, P. troglodytes
cagctcctcagggggc

SEQ ID NO: 222990 - DNA, 16 bp, P. troglodytes
cagctcctccagctcc

SEQ ID NO: 222991 - DNA, 16 bp, P. troglodytes
cagctcctgattgtgc

SEQ ID NO: 222992 - DNA, 16 bp, P. troglodytes
cagctccttgagggca

SEQ ID NO: 222993 - DNA, 17 bp, P. troglodytes
cagctccttgccagcaa

SEQ ID NO: 222994 - DNA, 16 bp, P. troglodytes
cagctccttgttactt

SEQ ID NO: 222995 - DNA, 16 bp, P. troglodytes
cagctctcaggaagcc

SEQ ID NO: 222996 - DNA, 16 bp, P. troglodytes
cagctctcccaggctg

SEQ ID NO: 222997 - DNA, 16 bp, P. troglodytes
cagctctctgcagcct

SEQ ID NO: 222998 - DNA, 16 bp, P. troglodytes
cagctctgaagaaagc

SEQ ID NO: 222999 - DNA, 16 bp, P. troglodytes
cagctctgcaccaggc

SEQ ID NO: 223000 - DNA, 16 bp, P. troglodytes
cagctctgccactgac

SEQ ID NO: 223001 - DNA, 16 bp, P. troglodytes
cagctctgctcctgtg

SEQ ID NO: 223002 - DNA, 16 bp, P. troglodytes
cagctctggctcaggg

SEQ ID NO: 223003 - DNA, 16 bp, P. troglodytes
cagctctgggagagac

SEQ ID NO: 223004 - DNA, 16 bp, P. troglodytes
cagctctgtgaggaga

SEQ ID NO: 223005 - DNA, 16 bp, P. troglodytes
cagctctgtggccttg

SEQ ID NO: 223006 - DNA, 16 bp, P. troglodytes
cagctctgtgtcccca

SEQ ID NO: 223007 - DNA, 16 bp, P. troglodytes
cagctcttctctcctt

SEQ ID NO: 223008 - DNA, 16 bp, P. troglodytes
cagctgacaccaccca

SEQ ID NO: 223009 - DNA, 16 bp, P. troglodytes
cagctgactttttttt

SEQ ID NO: 223010 - DNA, 16 bp, P. troglodytes
cagctgagactacagg

SEQ ID NO: 223011 - DNA, 17 bp, P. troglodytes
cagctgagattgtgcca

SEQ ID NO: 223012 - DNA, 16 bp, P. troglodytes
cagctgaggtgggaga

SEQ ID NO: 223013 - DNA, 16 bp, P. troglodytes
cagctgatagacattt

SEQ ID NO: 223014 - DNA, 16 bp, P. troglodytes
cagctgatgcactctt

SEQ ID NO: 223015 - DNA, 16 bp, P. troglodytes
cagctgcaccatttta

SEQ ID NO: 223016 - DNA, 16 bp, P. troglodytes
cagctgcagacctggg

SEQ ID NO: 223017 - DNA, 16 bp, P. troglodytes
cagctgcagagaagag

SEQ ID NO: 223018 - DNA, 16 bp, P. troglodytes
cagctgcagagagaag

SEQ ID NO: 223019 - DNA, 16 bp, P. troglodytes
cagctgcagcctcctg

SEQ ID NO: 223020 - DNA, 16 bp, P. troglodytes
cagctgcagccttgca

SEQ ID NO: 223021 - DNA, 16 bp, P. troglodytes
cagctgcagctgccca

SEQ ID NO: 223022 - DNA, 16 bp, P. troglodytes
cagctgcagctgctgc

SEQ ID NO: 223023 - DNA, 16 bp, P. troglodytes
cagctgcaggtttgtt

SEQ ID NO: 223024 - DNA, 16 bp, P. troglodytes
cagctgcagttctgtt

SEQ ID NO: 223025 - DNA, 16 bp, P. troglodytes
cagctgccagcacagc

SEQ ID NO: 223026 - DNA, 16 bp, P. troglodytes
cagctgccagcatggc

SEQ ID NO: 223027 - DNA, 16 bp, P. troglodytes
cagctgcccagctgtg

SEQ ID NO: 223028 - DNA, 16 bp, P. troglodytes
cagctgcccctgcccc

SEQ ID NO: 223029 - DNA, 16 bp, P. troglodytes
cagctgccccttcccc

SEQ ID NO: 223030 - DNA, 16 bp, P. troglodytes
cagctgcctgggaggc

SEQ ID NO: 223031 - DNA, 16 bp, P. troglodytes
cagctgcctgggcacc

SEQ ID NO: 223032 - DNA, 16 bp, P. troglodytes
cagctgccttctcact

SEQ ID NO: 223033 - DNA, 16 bp, P. troglodytes
cagctgctcagaaggc

SEQ ID NO: 223034 - DNA, 16 bp, P. troglodytes
cagctgctcctgcccc

SEQ ID NO: 223035 - DNA, 16 bp, P. troglodytes
cagctgctctaccaaa

SEQ ID NO: 223036 - DNA, 16 bp, P. troglodytes
cagctgctgcctgccc

SEQ ID NO: 223037 - DNA, 16 bp, P. troglodytes
cagctgctgctgctgc

SEQ ID NO: 223038 - DNA, 16 bp, P. troglodytes
cagctgctggagagga

SEQ ID NO: 223039 - DNA, 20 bp, P. troglodytes
cagctgctggcccaggtgct

SEQ ID NO: 223040 - DNA, 16 bp, P. troglodytes
cagctgctggggaagc

SEQ ID NO: 223041 - DNA, 16 bp, P. troglodytes
cagctgctgtgaaaaa

SEQ ID NO: 223042 - DNA, 16 bp, P. troglodytes
cagctgctgtggaaaa

SEQ ID NO: 223043 - DNA, 16 bp, P. troglodytes
cagctgcttggaaggc

SEQ ID NO: 223044 - DNA, 16 bp, P. troglodytes
cagctggacttctggg

SEQ ID NO: 223045 - DNA, 18 bp, P. troglodytes
cagctggagatctgagaa

SEQ ID NO: 223046 - DNA, 16 bp, P. troglodytes
cagctggagatttcct

SEQ ID NO: 223047 - DNA, 16 bp, P. troglodytes
cagctggagctggagc

SEQ ID NO: 223048 - DNA, 16 bp, P. troglodytes
cagctggagtggctgg

SEQ ID NO: 223049 - DNA, 16 bp, P. troglodytes
cagctggagttccggg

SEQ ID NO: 223050 - DNA, 16 bp, P. troglodytes
cagctggccaacatgg

SEQ ID NO: 223051 - DNA, 16 bp, P. troglodytes
cagctggccaatatgg

SEQ ID NO: 223052 - DNA, 16 bp, P. troglodytes
cagctgggacacaagg

SEQ ID NO: 223053 - DNA, 16 bp, P. troglodytes
cagctgggactacagg

SEQ ID NO: 223054 - DNA, 18 bp, P. troglodytes
cagctgggactacaggcg

SEQ ID NO: 223055 - DNA, 17 bp, P. troglodytes
cagctgggactacaggt

SEQ ID NO: 223056 - DNA, 16 bp, P. troglodytes
cagctgggagacctga

SEQ ID NO: 223057 - DNA, 16 bp, P. troglodytes
cagctgggagagaggc

SEQ ID NO: 223058 - DNA, 16 bp, P. troglodytes
cagctgggagcagtgg

SEQ ID NO: 223059 - DNA, 16 bp, P. troglodytes
cagctgggagggtcca

SEQ ID NO: 223060 - DNA, 16 bp, P. troglodytes
cagctgggattacagg

SEQ ID NO: 223061 - DNA, 16 bp, P. troglodytes
cagctgggattatagg

SEQ ID NO: 223062 - DNA, 16 bp, P. troglodytes
cagctgggcaacaaga

SEQ ID NO: 223063 - DNA, 16 bp, P. troglodytes
cagctgggcaccgtgg

SEQ ID NO: 223064 - DNA, 16 bp, P. troglodytes
cagctgggcagaggtg

SEQ ID NO: 223065 - DNA, 16 bp, P. troglodytes
cagctgggccactggg

SEQ ID NO: 223066 - DNA, 16 bp, P. troglodytes
cagctgggccctgggc

SEQ ID NO: 223067 - DNA, 16 bp, P. troglodytes
cagctgggcctccagg

SEQ ID NO: 223068 - DNA, 16 bp, P. troglodytes
cagctgggcctctggg

SEQ ID NO: 223069 - DNA, 16 bp, P. troglodytes
cagctgggcgcagtgg

SEQ ID NO: 223070 - DNA, 16 bp, P. troglodytes
cagctgggcttcctgg

SEQ ID NO: 223071 - DNA, 16 bp, P. troglodytes
cagctggggctacagg

SEQ ID NO: 223072 - DNA, 16 bp, P. troglodytes
cagctggggctggggg

SEQ ID NO: 223073 - DNA, 16 bp, P. troglodytes
cagctggtctcaaact

SEQ ID NO: 223074 - DNA, 16 bp, P. troglodytes
cagctggtctgaagga

SEQ ID NO: 223075 - DNA, 16 bp, P. troglodytes
cagctgtgagcctgtg

SEQ ID NO: 223076 - DNA, 16 bp, P. troglodytes
cagctgtgcacatatt

SEQ ID NO: 223077 - DNA, 16 bp, P. troglodytes
cagctgtgcatggtgg

SEQ ID NO: 223078 - DNA, 16 bp, P. troglodytes
cagctgtgccctgccc

SEQ ID NO: 223079 - DNA, 16 bp, P. troglodytes
cagctgtggagaggag

SEQ ID NO: 223080 - DNA, 16 bp, P. troglodytes
cagctgtggctgcctg

SEQ ID NO: 223081 - DNA, 16 bp, P. troglodytes
cagctgtgtgacttta

SEQ ID NO: 223082 - DNA, 16 bp, P. troglodytes
cagctgtgtgactttg

SEQ ID NO: 223083 - DNA, 16 bp, P. troglodytes
cagctgtgtgaggtgt

SEQ ID NO: 223084 - DNA, 16 bp, P. troglodytes
cagctgtgtggccctg

SEQ ID NO: 223085 - DNA, 16 bp, P. troglodytes
cagctgttgtaaaagg

SEQ ID NO: 223086 - DNA, 16 bp, P. troglodytes
cagctgttttcactta

SEQ ID NO: 223087 - DNA, 16 bp, P. troglodytes
cagcttaagattttgg

SEQ ID NO: 223088 - DNA, 16 bp, P. troglodytes
cagcttacagatggcc

SEQ ID NO: 223089 - DNA, 16 bp, P. troglodytes
cagcttatttttttct

SEQ ID NO: 223090 - DNA, 16 bp, P. troglodytes
cagcttcaaactcctg

SEQ ID NO: 223091 - DNA, 16 bp, P. troglodytes
cagcttcactcctgag

SEQ ID NO: 223092 - DNA, 16 bp, P. troglodytes
cagcttcagccatgtc

SEQ ID NO: 223093 - DNA, 16 bp, P. troglodytes
cagcttcagcctcctg

SEQ ID NO: 223094 - DNA, 16 bp, P. troglodytes
cagcttccacgtggtg

SEQ ID NO: 223095 - DNA, 16 bp, P. troglodytes
cagcttccagaactgt

SEQ ID NO: 223096 - DNA, 16 bp, P. troglodytes
cagcttccaggactgt

SEQ ID NO: 223097 - DNA, 16 bp, P. troglodytes
cagcttcccaaagtgg

SEQ ID NO: 223098 - DNA, 16 bp, P. troglodytes
cagcttccccagcagc

SEQ ID NO: 223099 - DNA, 16 bp, P. troglodytes
cagcttcctcaccttt

SEQ ID NO: 223100 - DNA, 16 bp, P. troglodytes
cagcttcctgagcagc

SEQ ID NO: 223101 - DNA, 16 bp, P. troglodytes
cagcttctagaagctg

SEQ ID NO: 223102 - DNA, 16 bp, P. troglodytes
cagcttctagggaggc

SEQ ID NO: 223103 - DNA, 16 bp, P. troglodytes
cagcttctccagtggg

SEQ ID NO: 223104 - DNA, 16 bp, P. troglodytes
cagcttctctctctct

SEQ ID NO: 223105 - DNA, 16 bp, P. troglodytes
cagcttctcttgaaaa

SEQ ID NO: 223106 - DNA, 16 bp, P. troglodytes
cagcttctgtggaaaa

SEQ ID NO: 223107 - DNA, 16 bp, P. troglodytes
cagcttcttgatctgt

SEQ ID NO: 223108 - DNA, 17 bp, P. troglodytes
cagcttgaccaacatga

SEQ ID NO: 223109 - DNA, 17 bp, P. troglodytes
cagcttggccaacctgg

SEQ ID NO: 223110 - DNA, 16 bp, P. troglodytes
cagcttgggtaacaga

SEQ ID NO: 223111 - DNA, 16 bp, P. troglodytes
cagctttaaaaaggaa

SEQ ID NO: 223112 - DNA, 16 bp, P. troglodytes
cagctttagctgcagc

SEQ ID NO: 223113 - DNA, 16 bp, P. troglodytes
cagctttattcataat

SEQ ID NO: 223114 - DNA, 16 bp, P. troglodytes
cagctttattcttttt

SEQ ID NO: 223115 - DNA, 16 bp, P. troglodytes
cagctttattgagatt

SEQ ID NO: 223116 - DNA, 16 bp, P. troglodytes
cagctttcatctttct

SEQ ID NO: 223117 - DNA, 16 bp, P. troglodytes
cagctttcctgggtct

SEQ ID NO: 223118 - DNA, 16 bp, P. troglodytes
cagctttctacacatg

SEQ ID NO: 223119 - DNA, 16 bp, P. troglodytes
cagctttctcatttgt

SEQ ID NO: 223120 - DNA, 16 bp, P. troglodytes
cagctttctttttttc

SEQ ID NO: 223121 - DNA, 16 bp, P. troglodytes
cagctttgaagagagc

SEQ ID NO: 223122 - DNA, 16 bp, P. troglodytes
cagctttgcagggcta

SEQ ID NO: 223123 - DNA, 16 bp, P. troglodytes
cagctttggaactggg

SEQ ID NO: 223124 - DNA, 16 bp, P. troglodytes
cagctttgggactctt

SEQ ID NO: 223125 - DNA, 16 bp, P. troglodytes
cagctttgttcttttg

SEQ ID NO: 223126 - DNA, 16 bp, P. troglodytes
cagctttgtttttgtt

SEQ ID NO: 223127 - DNA, 16 bp, P. troglodytes
cagcttttaaaatatt

SEQ ID NO: 223128 - DNA, 16 bp, P. troglodytes
cagcttttccaggctc

SEQ ID NO: 223129 - DNA, 16 bp, P. troglodytes
cagcttttctactctg

SEQ ID NO: 223130 - DNA, 16 bp, P. troglodytes
cagcttttctttttct

SEQ ID NO: 223131 - DNA, 16 bp, P. troglodytes
cagcttttgcccattc

SEQ ID NO: 223132 - DNA, 16 bp, P. troglodytes
cagctttttaaaattt

SEQ ID NO: 223133 - DNA, 16 bp, P. troglodytes
cagctttttctttctt

SEQ ID NO: 223134 - DNA, 16 bp, P. troglodytes
cagctttttgtatgtc

SEQ ID NO: 223135 - DNA, 16 bp, P. troglodytes
cagctttttttccccc

SEQ ID NO: 223136 - DNA, 16 bp, P. troglodytes
caggaaaaaaggaaat

SEQ ID NO: 223137 - DNA, 16 bp, P. troglodytes
caggaaaaaatctaat

SEQ ID NO: 223138 - DNA, 16 bp, P. troglodytes
caggaaaaatgaaaat

SEQ ID NO: 223139 - DNA, 16 bp, P. troglodytes
caggaaaacaaactca

SEQ ID NO: 223140 - DNA, 16 bp, P. troglodytes
caggaaaacttttttt

SEQ ID NO: 223141 - DNA, 16 bp, P. troglodytes
caggaaaagaaaacta

SEQ ID NO: 223142 - DNA, 16 bp, P. troglodytes
caggaaaatcacttga

SEQ ID NO: 223143 - DNA, 16 bp, P. troglodytes
caggaaaatgtggaaa

SEQ ID NO: 223144 - DNA, 16 bp, P. troglodytes
caggaaaattacttga

SEQ ID NO: 223145 - DNA, 16 bp, P. troglodytes
caggaaacaaaaggtg

SEQ ID NO: 223146 - DNA, 16 bp, P. troglodytes
caggaaagagtggcat

SEQ ID NO: 223147 - DNA, 16 bp, P. troglodytes
caggaaagctgatggt

SEQ ID NO: 223148 - DNA, 16 bp, P. troglodytes
caggaaagtgaaaaga

SEQ ID NO: 223149 - DNA, 16 bp, P. troglodytes
caggaaatacagaaaa

SEQ ID NO: 223150 - DNA, 16 bp, P. troglodytes
caggaaatacagagag

SEQ ID NO: 223151 - DNA, 16 bp, P. troglodytes
caggaaatatacaaga

SEQ ID NO: 223152 - DNA, 16 bp, P. troglodytes
caggaaatatggagaa

SEQ ID NO: 223153 - DNA, 16 bp, P. troglodytes
caggaaatccagacca

SEQ ID NO: 223154 - DNA, 16 bp, P. troglodytes
caggaaatgcaaaaga

SEQ ID NO: 223155 - DNA, 16 bp, P. troglodytes
caggaaatgcaaagaa

SEQ ID NO: 223156 - DNA, 16 bp, P. troglodytes
caggaacaaatcacaa

SEQ ID NO: 223157 - DNA, 16 bp, P. troglodytes
caggaacaaattcaca

SEQ ID NO: 223158 - DNA, 16 bp, P. troglodytes
caggaacagtggctca

SEQ ID NO: 223159 - DNA, 16 bp, P. troglodytes
caggaaccagccctgg

SEQ ID NO: 223160 - DNA, 16 bp, P. troglodytes
caggaactagtgctca

SEQ ID NO: 223161 - DNA, 16 bp, P. troglodytes
caggaactgaaaacca

SEQ ID NO: 223162 - DNA, 16 bp, P. troglodytes
caggaagaaaacaaat

SEQ ID NO: 223163 - DNA, 16 bp, P. troglodytes
caggaagaaagtgaaa

SEQ ID NO: 223164 - DNA, 16 bp, P. troglodytes
caggaagaaatggaaa

SEQ ID NO: 223165 - DNA, 16 bp, P. troglodytes
caggaagaaattgatt

SEQ ID NO: 223166 - DNA, 16 bp, P. troglodytes
caggaagaagaaaaat

SEQ ID NO: 223167 - DNA, 16 bp, P. troglodytes
caggaagaaggcaagg

SEQ ID NO: 223168 - DNA, 16 bp, P. troglodytes
caggaagaattagaaa

SEQ ID NO: 223169 - DNA, 16 bp, P. troglodytes
caggaagaattagata

SEQ ID NO: 223170 - DNA, 16 bp, P. troglodytes
caggaagagcttctcc

SEQ ID NO: 223171 - DNA, 16 bp, P. troglodytes
caggaagaggaagcag

SEQ ID NO: 223172 - DNA, 16 bp, P. troglodytes
caggaagattgcttga

SEQ ID NO: 223173 - DNA, 16 bp, P. troglodytes
caggaagcaaaggttg

SEQ ID NO: 223174 - DNA, 16 bp, P. troglodytes
caggaagcacaaaggg

SEQ ID NO: 223175 - DNA, 16 bp, P. troglodytes
caggaagcacaagggg

SEQ ID NO: 223176 - DNA, 16 bp, P. troglodytes
caggaagcagagctca

SEQ ID NO: 223177 - DNA, 16 bp, P. troglodytes
caggaagcagaggcag

SEQ ID NO: 223178 - DNA, 16 bp, P. troglodytes
caggaagccaaggcag

SEQ ID NO: 223179 - DNA, 16 bp, P. troglodytes
caggaagccaaggctg

SEQ ID NO: 223180 - DNA, 16 bp, P. troglodytes
caggaagcctgccctg

SEQ ID NO: 223181 - DNA, 16 bp, P. troglodytes
caggaagcggaggctg

SEQ ID NO: 223182 - DNA, 16 bp, P. troglodytes
caggaagctcaaagaa

SEQ ID NO: 223183 - DNA, 16 bp, P. troglodytes
caggaagctcagagat

SEQ ID NO: 223184 - DNA, 16 bp, P. troglodytes
caggaagctcaggcag

SEQ ID NO: 223185 - DNA, 16 bp, P. troglodytes
caggaagctgagaaac

SEQ ID NO: 223186 - DNA, 16 bp, P. troglodytes
caggaagctgaggaag

SEQ ID NO: 223187 - DNA, 16 bp, P. troglodytes
caggaaggaaaagtgc

SEQ ID NO: 223188 - DNA, 16 bp, P. troglodytes
caggaaggagaaaatg

SEQ ID NO: 223189 - DNA, 16 bp, P. troglodytes
caggaaggagccatct

SEQ ID NO: 223190 - DNA, 16 bp, P. troglodytes
caggaaggaggaggca

SEQ ID NO: 223191 - DNA, 16 bp, P. troglodytes
caggaaggaggcagag

SEQ ID NO: 223192 - DNA, 16 bp, P. troglodytes
caggaaggccctcacc

SEQ ID NO: 223193 - DNA, 16 bp, P. troglodytes
caggaaggcttccctg

SEQ ID NO: 223194 - DNA, 16 bp, P. troglodytes
caggaaggggaacctc

SEQ ID NO: 223195 - DNA, 16 bp, P. troglodytes
caggaaggggctccca

SEQ ID NO: 223196 - DNA, 16 bp, P. troglodytes
caggaaggtgaacatc

SEQ ID NO: 223197 - DNA, 16 bp, P. troglodytes
caggaagtcaggcagc

SEQ ID NO: 223198 - DNA, 16 bp, P. troglodytes
caggaagtcctgacaa

SEQ ID NO: 223199 - DNA, 16 bp, P. troglodytes
caggaatctatccatt

SEQ ID NO: 223200 - DNA, 16 bp, P. troglodytes
caggaatctgtatttt

SEQ ID NO: 223201 - DNA, 16 bp, P. troglodytes
caggaatgaaagagaa

SEQ ID NO: 223202 - DNA, 16 bp, P. troglodytes
caggaatgaccaagga

SEQ ID NO: 223203 - DNA, 16 bp, P. troglodytes
caggaatgcagggatg

SEQ ID NO: 223204 - DNA, 16 bp, P. troglodytes
caggaatggaagttta

SEQ ID NO: 223205 - DNA, 16 bp, P. troglodytes
caggaatgtggagaaa

SEQ ID NO: 223206 - DNA, 16 bp, P. troglodytes
caggaattcaagagca

SEQ ID NO: 223207 - DNA, 28 bp, P. troglodytes
caggaattgaactcagctctgcaccaag

SEQ ID NO: 223208 - DNA, 16 bp, P. troglodytes
caggaatttatacatt

SEQ ID NO: 223209 - DNA, 16 bp, P. troglodytes
caggaatttgaggcag

SEQ ID NO: 223210 - DNA, 16 bp, P. troglodytes
caggacaagccacaga

SEQ ID NO: 223211 - DNA, 16 bp, P. troglodytes
caggacacatgggaat

SEQ ID NO: 223212 - DNA, 16 bp, P. troglodytes
caggacactggtctgg

SEQ ID NO: 223213 - DNA, 16 bp, P. troglodytes
caggacagagccctca

SEQ ID NO: 223214 - DNA, 16 bp, P. troglodytes
caggacaggacaggaa

SEQ ID NO: 223215 - DNA, 16 bp, P. troglodytes
caggacatcgagacca

SEQ ID NO: 223216 - DNA, 16 bp, P. troglodytes
caggacattggcctgg

SEQ ID NO: 223217 - DNA, 16 bp, P. troglodytes
caggaccagatggagt

SEQ ID NO: 223218 - DNA, 16 bp, P. troglodytes
caggaccagcctggct

SEQ ID NO: 223219 - DNA, 16 bp, P. troglodytes
caggaccagctaattt

SEQ ID NO: 223220 - DNA, 16 bp, P. troglodytes
caggaccatttcaaaa

SEQ ID NO: 223221 - DNA, 16 bp, P. troglodytes
caggaccctcagcttc

SEQ ID NO: 223222 - DNA, 16 bp, P. troglodytes
caggacctcccaacca

SEQ ID NO: 223223 - DNA, 16 bp, P. troglodytes
caggacggctttgaat

SEQ ID NO: 223224 - DNA, 16 bp, P. troglodytes
caggactccagcctgg

SEQ ID NO: 223225 - DNA, 16 bp, P. troglodytes
caggactctgttacct

SEQ ID NO: 223226 - DNA, 24 bp, P. troglodytes
caggactggcaggcagctccacct

SEQ ID NO: 223227 - DNA, 16 bp, P. troglodytes
caggactgggtccttc

SEQ ID NO: 223228 - DNA, 16 bp, P. troglodytes
caggactggttccttc

SEQ ID NO: 223229 - DNA, 16 bp, P. troglodytes
caggacttgaacccag

SEQ ID NO: 223230 - DNA, 16 bp, P. troglodytes
caggactttgagacca

SEQ ID NO: 223231 - DNA, 16 bp, P. troglodytes
caggagaaaatcagct

SEQ ID NO: 223232 - DNA, 16 bp, P. troglodytes
caggagaaagaaatga

SEQ ID NO: 223233 - DNA, 16 bp, P. troglodytes
caggagaaagatgaaa

SEQ ID NO: 223234 - DNA, 16 bp, P. troglodytes
caggagaacagcatgg

SEQ ID NO: 223235 - DNA, 16 bp, P. troglodytes
caggagaacttaccca

SEQ ID NO: 223236 - DNA, 16 bp, P. troglodytes
caggagaataatttga

SEQ ID NO: 223237 - DNA, 16 bp, P. troglodytes
caggagaatcacttga

SEQ ID NO: 223238 - DNA, 16 bp, P. troglodytes
caggagaatcatttta

SEQ ID NO: 223239 - DNA, 16 bp, P. troglodytes
caggagaatgacctga

SEQ ID NO: 223240 - DNA, 16 bp, P. troglodytes
caggagaatggcatga

SEQ ID NO: 223241 - DNA, 16 bp, P. troglodytes
caggagaatggcatta

SEQ ID NO: 223242 - DNA, 16 bp, P. troglodytes
caggagaatgggatga

SEQ ID NO: 223243 - DNA, 16 bp, P. troglodytes
caggagaattgcctga

SEQ ID NO: 223244 - DNA, 16 bp, P. troglodytes
caggagactgaagcag

SEQ ID NO: 223245 - DNA, 16 bp, P. troglodytes
caggagactgaggaag

SEQ ID NO: 223246 - DNA, 16 bp, P. troglodytes
caggagactgaggagg

SEQ ID NO: 223247 - DNA, 16 bp, P. troglodytes
caggagactgaggcag

SEQ ID NO: 223248 - DNA, 16 bp, P. troglodytes
caggagactgaggctg

SEQ ID NO: 223249 - DNA, 16 bp, P. troglodytes
caggagactggggcag

SEQ ID NO: 223250 - DNA, 16 bp, P. troglodytes
caggagagagaagagt

SEQ ID NO: 223251 - DNA, 16 bp, P. troglodytes
caggagagagagacag

SEQ ID NO: 223252 - DNA, 16 bp, P. troglodytes
caggagagagtggcat

SEQ ID NO: 223253 - DNA, 16 bp, P. troglodytes
caggagagctgatgat

SEQ ID NO: 223254 - DNA, 16 bp, P. troglodytes
caggagaggaggctgg

SEQ ID NO: 223255 - DNA, 16 bp, P. troglodytes
caggagagggctcccc

SEQ ID NO: 223256 - DNA, 16 bp, P. troglodytes
caggagatcaagaaca

SEQ ID NO: 223257 - DNA, 16 bp, P. troglodytes
caggagatcaagagca

SEQ ID NO: 223258 - DNA, 16 bp, P. troglodytes
caggagatcagcctgg

SEQ ID NO: 223259 - DNA, 16 bp, P. troglodytes
caggagatcatgacca

SEQ ID NO: 223260 - DNA, 16 bp, P. troglodytes
caggagatcgagagca

SEQ ID NO: 223261 - DNA, 16 bp, P. troglodytes
caggagatgaaggctg

SEQ ID NO: 223262 - DNA, 16 bp, P. troglodytes
caggagatggagaccc

SEQ ID NO: 223263 - DNA, 16 bp, P. troglodytes
caggagatggagccca

SEQ ID NO: 223264 - DNA, 16 bp, P. troglodytes
caggagatggagctca

SEQ ID NO: 223265 - DNA, 16 bp, P. troglodytes
caggagatggaggcag

SEQ ID NO: 223266 - DNA, 16 bp, P. troglodytes
caggagattcacagca

SEQ ID NO: 223267 - DNA, 16 bp, P. troglodytes
caggagattgagaccc

SEQ ID NO: 223268 - DNA, 16 bp, P. troglodytes
caggagcacaaaccct

SEQ ID NO: 223269 - DNA, 16 bp, P. troglodytes
caggagcacccacatt

SEQ ID NO: 223270 - DNA, 16 bp, P. troglodytes
caggagcagatgctgg

SEQ ID NO: 223271 - DNA, 16 bp, P. troglodytes
caggagcagcagcagc

SEQ ID NO: 223272 - DNA, 16 bp, P. troglodytes
caggagcaggcatgtc

SEQ ID NO: 223273 - DNA, 16 bp, P. troglodytes
caggagcaggggcagg

SEQ ID NO: 223274 - DNA, 16 bp, P. troglodytes
caggagcatattattt

SEQ ID NO: 223275 - DNA, 16 bp, P. troglodytes
caggagcatctcttga

SEQ ID NO: 223276 - DNA, 16 bp, P. troglodytes
caggagcatggcttga

SEQ ID NO: 223277 - DNA, 16 bp, P. troglodytes
caggagccaagcagat

SEQ ID NO: 223278 - DNA, 16 bp, P. troglodytes
caggagccagggtgag

SEQ ID NO: 223279 - DNA, 16 bp, P. troglodytes
caggagccctgccctc

SEQ ID NO: 223280 - DNA, 16 bp, P. troglodytes
caggagcctgaggctg

SEQ ID NO: 223281 - DNA, 16 bp, P. troglodytes
caggagctccaggctg

SEQ ID NO: 223282 - DNA, 16 bp, P. troglodytes
caggagctgaagacca

SEQ ID NO: 223283 - DNA, 16 bp, P. troglodytes
caggagctgaggcagg

SEQ ID NO: 223284 - DNA, 16 bp, P. troglodytes
caggagctggagacca

SEQ ID NO: 223285 - DNA, 16 bp, P. troglodytes
caggagctggagagga

SEQ ID NO: 223286 - DNA, 16 bp, P. troglodytes
caggagctggagcagt

SEQ ID NO: 223287 - DNA, 16 bp, P. troglodytes
caggagctggaggagg

SEQ ID NO: 223288 - DNA, 16 bp, P. troglodytes
caggagctggaggcag

SEQ ID NO: 223289 - DNA, 16 bp, P. troglodytes
caggagctggggcagg

SEQ ID NO: 223290 - DNA, 16 bp, P. troglodytes
caggagctggtgtttt

SEQ ID NO: 223291 - DNA, 16 bp, P. troglodytes
caggagcttctgtccc

SEQ ID NO: 223292 - DNA, 16 bp, P. troglodytes
caggagcttgaggcca

SEQ ID NO: 223293 - DNA, 16 bp, P. troglodytes
caggaggaagagagtg

SEQ ID NO: 223294 - DNA, 16 bp, P. troglodytes
caggaggaggagctca

SEQ ID NO: 223295 - DNA, 16 bp, P. troglodytes
caggaggaggaggatg

SEQ ID NO: 223296 - DNA, 16 bp, P. troglodytes
caggaggaggaggctg

SEQ ID NO: 223297 - DNA, 16 bp, P. troglodytes
caggaggaggaggttg

SEQ ID NO: 223298 - DNA, 16 bp, P. troglodytes
caggaggaggctgagg

SEQ ID NO: 223299 - DNA, 16 bp, P. troglodytes
caggaggaggtggagg

SEQ ID NO: 223300 - DNA, 16 bp, P. troglodytes
caggaggatcacttga

SEQ ID NO: 223301 - DNA, 16 bp, P. troglodytes
caggaggatcagctga

SEQ ID NO: 223302 - DNA, 18 bp, P. troglodytes
caggaggatcgcttgagg

SEQ ID NO: 223303 - DNA, 16 bp, P. troglodytes
caggaggatgaggcag

SEQ ID NO: 223304 - DNA, 16 bp, P. troglodytes
caggaggatgaggtgg

SEQ ID NO: 223305 - DNA, 16 bp, P. troglodytes
caggaggatggctgga

SEQ ID NO: 223306 - DNA, 16 bp, P. troglodytes
caggaggcagaaggtg

SEQ ID NO: 223307 - DNA, 16 bp, P. troglodytes
caggaggcagagaaat

SEQ ID NO: 223308 - DNA, 16 bp, P. troglodytes
caggaggcagaggcag

SEQ ID NO: 223309 - DNA, 16 bp, P. troglodytes
caggaggcagaggcat

SEQ ID NO: 223310 - DNA, 16 bp, P. troglodytes
caggaggcagaggctg

SEQ ID NO: 223311 - DNA, 16 bp, P. troglodytes
caggaggcaggaaaat

SEQ ID NO: 223312 - DNA, 16 bp, P. troglodytes
caggaggcaggcaggg

SEQ ID NO: 223313 - DNA, 16 bp, P. troglodytes
caggaggcagggaaat

SEQ ID NO: 223314 - DNA, 16 bp, P. troglodytes
caggaggccaaggcac

SEQ ID NO: 223315 - DNA, 16 bp, P. troglodytes
caggaggcccaggagg

SEQ ID NO: 223316 - DNA, 16 bp, P. troglodytes
caggaggcccaggtgg

SEQ ID NO: 223317 - DNA, 16 bp, P. troglodytes
caggaggccgaggcgg

SEQ ID NO: 223318 - DNA, 16 bp, P. troglodytes
caggaggcggaggctg

SEQ ID NO: 223319 - DNA, 16 bp, P. troglodytes
caggaggcggggcttg

SEQ ID NO: 223320 - DNA, 16 bp, P. troglodytes
caggaggctgaaatag

SEQ ID NO: 223321 - DNA, 16 bp, P. troglodytes
caggaggctgaagagg

SEQ ID NO: 223322 - DNA, 16 bp, P. troglodytes
caggaggctgaaggag

SEQ ID NO: 223323 - DNA, 16 bp, P. troglodytes
caggaggctgaagggg

SEQ ID NO: 223324 - DNA, 16 bp, P. troglodytes
caggaggctgacacag

SEQ ID NO: 223325 - DNA, 16 bp, P. troglodytes
caggaggctgagaaag

SEQ ID NO: 223326 - DNA, 16 bp, P. troglodytes
caggaggctgagaagg

SEQ ID NO: 223327 - DNA, 16 bp, P. troglodytes
caggaggctgagatga

SEQ ID NO: 223328 - DNA, 16 bp, P. troglodytes
caggaggctgagattg

SEQ ID NO: 223329 - DNA, 16 bp, P. troglodytes
caggaggctgagcggg

SEQ ID NO: 223330 - DNA, 16 bp, P. troglodytes
caggaggctgaggaac

SEQ ID NO: 223331 - DNA, 16 bp, P. troglodytes
caggaggctgaggaat

SEQ ID NO: 223332 - DNA, 16 bp, P. troglodytes
caggaggctgagggca

SEQ ID NO: 223333 - DNA, 16 bp, P. troglodytes
caggaggctgaggtca

SEQ ID NO: 223334 - DNA, 16 bp, P. troglodytes
caggaggctgaggtga

SEQ ID NO: 223335 - DNA, 16 bp, P. troglodytes
caggaggctgaggtgg

SEQ ID NO: 223336 - DNA, 16 bp, P. troglodytes
caggaggctgaggtgt

SEQ ID NO: 223337 - DNA, 16 bp, P. troglodytes
caggaggctgagtgag

SEQ ID NO: 223338 - DNA, 16 bp, P. troglodytes
caggaggctggggagg

SEQ ID NO: 223339 - DNA, 16 bp, P. troglodytes
caggaggctggggcac

SEQ ID NO: 223340 - DNA, 16 bp, P. troglodytes
caggaggctggggctg

SEQ ID NO: 223341 - DNA, 16 bp, P. troglodytes
caggaggctggggtga

SEQ ID NO: 223342 - DNA, 16 bp, P. troglodytes
caggaggctgtggcac

SEQ ID NO: 223343 - DNA, 16 bp, P. troglodytes
caggagggagagcttg

SEQ ID NO: 223344 - DNA, 16 bp, P. troglodytes
caggagggaggccagg

SEQ ID NO: 223345 - DNA, 16 bp, P. troglodytes
caggagggcaagagaa

SEQ ID NO: 223346 - DNA, 16 bp, P. troglodytes
caggagggcagggact

SEQ ID NO: 223347 - DNA, 16 bp, P. troglodytes
caggaggggccaggct

SEQ ID NO: 223348 - DNA, 16 bp, P. troglodytes
caggagggtgaggcat

SEQ ID NO: 223349 - DNA, 16 bp, P. troglodytes
caggagggtggccaga

SEQ ID NO: 223350 - DNA, 16 bp, P. troglodytes
caggagggtggggcag

SEQ ID NO: 223351 - DNA, 16 bp, P. troglodytes
caggaggtaaagaaat

SEQ ID NO: 223352 - DNA, 16 bp, P. troglodytes
caggaggtccagacca

SEQ ID NO: 223353 - DNA, 16 bp, P. troglodytes
caggaggtccaggcta

SEQ ID NO: 223354 - DNA, 16 bp, P. troglodytes
caggaggtgaggctgc

SEQ ID NO: 223355 - DNA, 16 bp, P. troglodytes
caggaggtggaaggtg

SEQ ID NO: 223356 - DNA, 16 bp, P. troglodytes
caggaggtggagctcg

SEQ ID NO: 223357 - DNA, 16 bp, P. troglodytes
caggaggtggaggagg

SEQ ID NO: 223358 - DNA, 16 bp, P. troglodytes
caggaggtggaggccg

SEQ ID NO: 223359 - DNA, 16 bp, P. troglodytes
caggaggtggaggctg

SEQ ID NO: 223360 - DNA, 16 bp, P. troglodytes
caggaggtggaggtca

SEQ ID NO: 223361 - DNA, 16 bp, P. troglodytes
caggaggttgtggctg

SEQ ID NO: 223362 - DNA, 16 bp, P. troglodytes
caggagtcagaggctg

SEQ ID NO: 223363 - DNA, 16 bp, P. troglodytes
caggagtcagccacca

SEQ ID NO: 223364 - DNA, 16 bp, P. troglodytes
caggagtccaaggctg

SEQ ID NO: 223365 - DNA, 16 bp, P. troglodytes
caggagtccaggcccc

SEQ ID NO: 223366 - DNA, 16 bp, P. troglodytes
caggagtctgaggtgg

SEQ ID NO: 223367 - DNA, 16 bp, P. troglodytes
caggagtgagagagag

SEQ ID NO: 223368 - DNA, 16 bp, P. troglodytes
caggagtgagccaccg

SEQ ID NO: 223369 - DNA, 16 bp, P. troglodytes
caggagtgagccactg

SEQ ID NO: 223370 - DNA, 16 bp, P. troglodytes
caggagtggttctaga

SEQ ID NO: 223371 - DNA, 16 bp, P. troglodytes
caggagttaccagcct

SEQ ID NO: 223372 - DNA, 16 bp, P. troglodytes
caggagttagaggctg

SEQ ID NO: 223373 - DNA, 16 bp, P. troglodytes
caggagttcaacatca

SEQ ID NO: 223374 - DNA, 16 bp, P. troglodytes
caggagttcaaccagc

SEQ ID NO: 223375 - DNA, 16 bp, P. troglodytes
caggagttcaagatcg

SEQ ID NO: 223376 - DNA, 16 bp, P. troglodytes
caggagttcaagattg

SEQ ID NO: 223377 - DNA, 16 bp, P. troglodytes
caggagttcaaggcca

SEQ ID NO: 223378 - DNA, 16 bp, P. troglodytes
caggagttcaggaaca

SEQ ID NO: 223379 - DNA, 16 bp, P. troglodytes
caggagttccagaaca

SEQ ID NO: 223380 - DNA, 16 bp, P. troglodytes
caggagttccagactg

SEQ ID NO: 223381 - DNA, 16 bp, P. troglodytes
caggagttccagatca

SEQ ID NO: 223382 - DNA, 16 bp, P. troglodytes
caggagttgaaggcca

SEQ ID NO: 223383 - DNA, 16 bp, P. troglodytes
caggagttggaggtca

SEQ ID NO: 223384 - DNA, 16 bp, P. troglodytes
caggagtttcagacaa

SEQ ID NO: 223385 - DNA, 16 bp, P. troglodytes
caggagtttgaatcca

SEQ ID NO: 223386 - DNA, 16 bp, P. troglodytes
caggagtttgagaaca

SEQ ID NO: 223387 - DNA, 16 bp, P. troglodytes
caggagtttgagagca

SEQ ID NO: 223388 - DNA, 16 bp, P. troglodytes
caggagtttgagatga

SEQ ID NO: 223389 - DNA, 16 bp, P. troglodytes
caggagtttgaggaca

SEQ ID NO: 223390 - DNA, 16 bp, P. troglodytes
caggagtttgagttca

SEQ ID NO: 223391 - DNA, 16 bp, P. troglodytes
caggagtttgtgacca

SEQ ID NO: 223392 - DNA, 16 bp, P. troglodytes
caggagtttgtggctg

SEQ ID NO: 223393 - DNA, 16 bp, P. troglodytes
caggataatttttaaa

SEQ ID NO: 223394 - DNA, 16 bp, P. troglodytes
caggatacaaaaatca

SEQ ID NO: 223395 - DNA, 16 bp, P. troglodytes
caggatacaatatcaa

SEQ ID NO: 223396 - DNA, 16 bp, P. troglodytes
caggatataaaatcaa

SEQ ID NO: 223397 - DNA, 16 bp, P. troglodytes
caggatatcaagacca

SEQ ID NO: 223398 - DNA, 28 bp, P. troglodytes
caggatattatccaggagaacttcccca

SEQ ID NO: 223399 - DNA, 16 bp, P. troglodytes
caggatattttcttga

SEQ ID NO: 223400 - DNA, 17 bp, P. troglodytes
caggatcccaaggcaga

SEQ ID NO: 223401 - DNA, 16 bp, P. troglodytes
caggatcccacattgc

SEQ ID NO: 223402 - DNA, 16 bp, P. troglodytes
caggatctcaaagaga

SEQ ID NO: 223403 - DNA, 16 bp, P. troglodytes
caggatctcatccagg

SEQ ID NO: 223404 - DNA, 16 bp, P. troglodytes
caggatctcattcttt

SEQ ID NO: 223405 - DNA, 16 bp, P. troglodytes
caggatgacctgcctg

SEQ ID NO: 223406 - DNA, 18 bp, P. troglodytes
caggatgatgctgccctc

SEQ ID NO: 223407 - DNA, 16 bp, P. troglodytes
caggatgatttcatct

SEQ ID NO: 223408 - DNA, 16 bp, P. troglodytes
caggatgcccagatat

SEQ ID NO: 223409 - DNA, 16 bp, P. troglodytes
caggatgccctctctc

SEQ ID NO: 223410 - DNA, 16 bp, P. troglodytes
caggatgctgaggcag

SEQ ID NO: 223411 - DNA, 16 bp, P. troglodytes
caggatggagtgcagg

SEQ ID NO: 223412 - DNA, 16 bp, P. troglodytes
caggatggatggggag

SEQ ID NO: 223413 - DNA, 16 bp, P. troglodytes
caggatggctttgaat

SEQ ID NO: 223414 - DNA, 17 bp, P. troglodytes
caggatggtcttgaact

SEQ ID NO: 223415 - DNA, 16 bp, P. troglodytes
caggatgtatggaaat

SEQ ID NO: 223416 - DNA, 25 bp, P. troglodytes
caggattacaggtgtgagccaccac

SEQ ID NO: 223417 - DNA, 16 bp, P. troglodytes
caggattcaaaccagg

SEQ ID NO: 223418 - DNA, 16 bp, P. troglodytes
caggattcaaacccag

SEQ ID NO: 223419 - DNA, 16 bp, P. troglodytes
caggattcaaatccag

SEQ ID NO: 223420 - DNA, 16 bp, P. troglodytes
caggattggtccttgg

SEQ ID NO: 223421 - DNA, 16 bp, P. troglodytes
caggatttcattcatt

SEQ ID NO: 223422 - DNA, 16 bp, P. troglodytes
caggatttcatttttt

SEQ ID NO: 223423 - DNA, 16 bp, P. troglodytes
caggatttcgagacca

SEQ ID NO: 223424 - DNA, 16 bp, P. troglodytes
caggatttgaacccag

SEQ ID NO: 223425 - DNA, 16 bp, P. troglodytes
caggatttgaactcag

SEQ ID NO: 223426 - DNA, 16 bp, P. troglodytes
caggatttgaatccag

SEQ ID NO: 223427 - DNA, 16 bp, P. troglodytes
caggattttgagacca

SEQ ID NO: 223428 - DNA, 16 bp, P. troglodytes
caggattttttttttc

SEQ ID NO: 223429 - DNA, 16 bp, P. troglodytes
caggcaaaatagattt

SEQ ID NO: 223430 - DNA, 16 bp, P. troglodytes
caggcaaagagagaga

SEQ ID NO: 223431 - DNA, 17 bp, P. troglodytes
caggcaaatcgcttgag

SEQ ID NO: 223432 - DNA, 16 bp, P. troglodytes
caggcaaccaccacca

SEQ ID NO: 223433 - DNA, 16 bp, P. troglodytes
caggcaagagccacca

SEQ ID NO: 223434 - DNA, 16 bp, P. troglodytes
caggcaaggtgaaccc

SEQ ID NO: 223435 - DNA, 16 bp, P. troglodytes
caggcaattgtaacac

SEQ ID NO: 223436 - DNA, 16 bp, P. troglodytes
caggcacaatgactca

SEQ ID NO: 223437 - DNA, 16 bp, P. troglodytes
caggcacactggctgc

SEQ ID NO: 223438 - DNA, 16 bp, P. troglodytes
caggcacagaggctca

SEQ ID NO: 223439 - DNA, 16 bp, P. troglodytes
caggcacagctgacca

SEQ ID NO: 223440 - DNA, 16 bp, P. troglodytes
caggcacagctggaag

SEQ ID NO: 223441 - DNA, 16 bp, P. troglodytes
caggcacaggaagaca

SEQ ID NO: 223442 - DNA, 16 bp, P. troglodytes
caggcacagggaacag

SEQ ID NO: 223443 - DNA, 16 bp, P. troglodytes
caggcacagtgccagg

SEQ ID NO: 223444 - DNA, 16 bp, P. troglodytes
caggcacagtggccca

SEQ ID NO: 223445 - DNA, 16 bp, P. troglodytes
caggcacataccactg

SEQ ID NO: 223446 - DNA, 16 bp, P. troglodytes
caggcacatgctgcca

SEQ ID NO: 223447 - DNA, 16 bp, P. troglodytes
caggcaccaaaagaca

SEQ ID NO: 223448 - DNA, 16 bp, P. troglodytes
caggcaccaccaccat

SEQ ID NO: 223449 - DNA, 16 bp, P. troglodytes
caggcaccagtgtgtg

SEQ ID NO: 223450 - DNA, 16 bp, P. troglodytes
caggcaccatgcccag

SEQ ID NO: 223451 - DNA, 16 bp, P. troglodytes
caggcaccatgctagg

SEQ ID NO: 223452 - DNA, 16 bp, P. troglodytes
caggcaccatgctggg

SEQ ID NO: 223453 - DNA, 16 bp, P. troglodytes
caggcaccattctagg

SEQ ID NO: 223454 - DNA, 16 bp, P. troglodytes
caggcacccactgcca

SEQ ID NO: 223455 - DNA, 16 bp, P. troglodytes
caggcacctgccacta

SEQ ID NO: 223456 - DNA, 16 bp, P. troglodytes
caggcacctgccactg

SEQ ID NO: 223457 - DNA, 16 bp, P. troglodytes
caggcaccttccacca

SEQ ID NO: 223458 - DNA, 16 bp, P. troglodytes
caggcacgatggctca

SEQ ID NO: 223459 - DNA, 16 bp, P. troglodytes
caggcacggtggtggg

SEQ ID NO: 223460 - DNA, 16 bp, P. troglodytes
caggcactgggcaggc

SEQ ID NO: 223461 - DNA, 16 bp, P. troglodytes
caggcactggtatcca

SEQ ID NO: 223462 - DNA, 16 bp, P. troglodytes
caggcactgtgctagg

SEQ ID NO: 223463 - DNA, 16 bp, P. troglodytes
caggcactgtgctggg

SEQ ID NO: 223464 - DNA, 16 bp, P. troglodytes
caggcactgtggctca

SEQ ID NO: 223465 - DNA, 16 bp, P. troglodytes
caggcacttttttttt

SEQ ID NO: 223466 - DNA, 16 bp, P. troglodytes
caggcagaagaaaatg

SEQ ID NO: 223467 - DNA, 16 bp, P. troglodytes
caggcagaagaaagtg

SEQ ID NO: 223468 - DNA, 16 bp, P. troglodytes
caggcagaaggaaaat

SEQ ID NO: 223469 - DNA, 16 bp, P. troglodytes
caggcagaatggctat

SEQ ID NO: 223470 - DNA, 16 bp, P. troglodytes
caggcagacaagatta

SEQ ID NO: 223471 - DNA, 16 bp, P. troglodytes
caggcagacagacaga

SEQ ID NO: 223472 - DNA, 16 bp, P. troglodytes
caggcagacagcctgg

SEQ ID NO: 223473 - DNA, 16 bp, P. troglodytes
caggcagaggaaaaag

SEQ ID NO: 223474 - DNA, 16 bp, P. troglodytes
caggcagaggaagcag

SEQ ID NO: 223475 - DNA, 16 bp, P. troglodytes
caggcagaggaggcac

SEQ ID NO: 223476 - DNA, 16 bp, P. troglodytes
caggcagaggctggaa

SEQ ID NO: 223477 - DNA, 16 bp, P. troglodytes
caggcagagggaagag

SEQ ID NO: 223478 - DNA, 16 bp, P. troglodytes
caggcagaggtgtgct

SEQ ID NO: 223479 - DNA, 16 bp, P. troglodytes
caggcagatctcaaac

SEQ ID NO: 223480 - DNA, 16 bp, P. troglodytes
caggcagcacagcaga

SEQ ID NO: 223481 - DNA, 16 bp, P. troglodytes
caggcagccacagctg

SEQ ID NO: 223482 - DNA, 16 bp, P. troglodytes
caggcagcctcctgag

SEQ ID NO: 223483 - DNA, 16 bp, P. troglodytes
caggcagcctctggaa

SEQ ID NO: 223484 - DNA, 16 bp, P. troglodytes
caggcagctgcagctg

SEQ ID NO: 223485 - DNA, 16 bp, P. troglodytes
caggcagctgccacca

SEQ ID NO: 223486 - DNA, 16 bp, P. troglodytes
caggcaggagaaagaa

SEQ ID NO: 223487 - DNA, 16 bp, P. troglodytes
caggcaggagccaggg

SEQ ID NO: 223488 - DNA, 16 bp, P. troglodytes
caggcaggagccctgc

SEQ ID NO: 223489 - DNA, 16 bp, P. troglodytes
caggcaggaggaagag

SEQ ID NO: 223490 - DNA, 16 bp, P. troglodytes
caggcaggcaggcaag

SEQ ID NO: 223491 - DNA, 16 bp, P. troglodytes
caggcaggcccaggcc

SEQ ID NO: 223492 - DNA, 16 bp, P. troglodytes
caggcaggggaaggaa

SEQ ID NO: 223493 - DNA, 16 bp, P. troglodytes
caggcaggggctgggg

SEQ ID NO: 223494 - DNA, 16 bp, P. troglodytes
caggcagtccacctgc

SEQ ID NO: 223495 - DNA, 16 bp, P. troglodytes
caggcagtctgattcc

SEQ ID NO: 223496 - DNA, 16 bp, P. troglodytes
caggcagtggaagcag

SEQ ID NO: 223497 - DNA, 16 bp, P. troglodytes
caggcagtgggagcag

SEQ ID NO: 223498 - DNA, 16 bp, P. troglodytes
caggcagtgggcaagc

SEQ ID NO: 223499 - DNA, 16 bp, P. troglodytes
caggcagtttcagcag

SEQ ID NO: 223500 - DNA, 16 bp, P. troglodytes
caggcataagccacag

SEQ ID NO: 223501 - DNA, 16 bp, P. troglodytes
caggcataagccacca

SEQ ID NO: 223502 - DNA, 16 bp, P. troglodytes
caggcataagccaccg

SEQ ID NO: 223503 - DNA, 16 bp, P. troglodytes
caggcataagccacta

SEQ ID NO: 223504 - DNA, 16 bp, P. troglodytes
caggcataagccactg

SEQ ID NO: 223505 - DNA, 16 bp, P. troglodytes
caggcatatcacatgg

SEQ ID NO: 223506 - DNA, 16 bp, P. troglodytes
caggcatcacctcctc

SEQ ID NO: 223507 - DNA, 16 bp, P. troglodytes
caggcatccctgtgct

SEQ ID NO: 223508 - DNA, 16 bp, P. troglodytes
caggcatgaaccacag

SEQ ID NO: 223509 - DNA, 16 bp, P. troglodytes
caggcatgaaccacca

SEQ ID NO: 223510 - DNA, 16 bp, P. troglodytes
caggcatgaaccaccg

SEQ ID NO: 223511 - DNA, 16 bp, P. troglodytes
caggcatgaaccactg

SEQ ID NO: 223512 - DNA, 16 bp, P. troglodytes
caggcatgaatcacca

SEQ ID NO: 223513 - DNA, 16 bp, P. troglodytes
caggcatgagccaacg

SEQ ID NO: 223514 - DNA, 16 bp, P. troglodytes
caggcatgagccaatg

SEQ ID NO: 223515 - DNA, 16 bp, P. troglodytes
caggcatgagccacca

SEQ ID NO: 223516 - DNA, 16 bp, P. troglodytes
caggcatgagccaccg

SEQ ID NO: 223517 - DNA, 16 bp, P. troglodytes
caggcatgagccacct

SEQ ID NO: 223518 - DNA, 16 bp, P. troglodytes
caggcatgagccacgg

SEQ ID NO: 223519 - DNA, 16 bp, P. troglodytes
caggcatgagccactg

SEQ ID NO: 223520 - DNA, 16 bp, P. troglodytes
caggcatgagccagag

SEQ ID NO: 223521 - DNA, 16 bp, P. troglodytes
caggcatgagccattc

SEQ ID NO: 223522 - DNA, 16 bp, P. troglodytes
caggcatgagccccac

SEQ ID NO: 223523 - DNA, 16 bp, P. troglodytes
caggcatgagccccca

SEQ ID NO: 223524 - DNA, 16 bp, P. troglodytes
caggcatgagcccctg

SEQ ID NO: 223525 - DNA, 16 bp, P. troglodytes
caggcatgagccgccg

SEQ ID NO: 223526 - DNA, 16 bp, P. troglodytes
caggcatgagccgcct

SEQ ID NO: 223527 - DNA, 16 bp, P. troglodytes
caggcatgagcctcag

SEQ ID NO: 223528 - DNA, 16 bp, P. troglodytes
caggcatgagcctctg

SEQ ID NO: 223529 - DNA, 16 bp, P. troglodytes
caggcatgagctactg

SEQ ID NO: 223530 - DNA, 16 bp, P. troglodytes
caggcatgaggcactg

SEQ ID NO: 223531 - DNA, 16 bp, P. troglodytes
caggcatgagtcaccg

SEQ ID NO: 223532 - DNA, 16 bp, P. troglodytes
caggcatgagtcacta

SEQ ID NO: 223533 - DNA, 16 bp, P. troglodytes
caggcatgatggcaga

SEQ ID NO: 223534 - DNA, 16 bp, P. troglodytes
caggcatgatggctca

SEQ ID NO: 223535 - DNA, 16 bp, P. troglodytes
caggcatgcagtacca

SEQ ID NO: 223536 - DNA, 16 bp, P. troglodytes
caggcatgctggcggg

SEQ ID NO: 223537 - DNA, 16 bp, P. troglodytes
caggcatgctggtggg

SEQ ID NO: 223538 - DNA, 16 bp, P. troglodytes
caggcatggaggcaca

SEQ ID NO: 223539 - DNA, 16 bp, P. troglodytes
caggcatggccaccac

SEQ ID NO: 223540 - DNA, 16 bp, P. troglodytes
caggcatggcggcggg

SEQ ID NO: 223541 - DNA, 16 bp, P. troglodytes
caggcatggtggcagg

SEQ ID NO: 223542 - DNA, 16 bp, P. troglodytes
caggcatggtggcgtg

SEQ ID NO: 223543 - DNA, 16 bp, P. troglodytes
caggcatggtggctca

SEQ ID NO: 223544 - DNA, 16 bp, P. troglodytes
caggcatgtgcaccac

SEQ ID NO: 223545 - DNA, 16 bp, P. troglodytes
caggcatttggagcac

SEQ ID NO: 223546 - DNA, 16 bp, P. troglodytes
caggccaaggcaggtg

SEQ ID NO: 223547 - DNA, 17 bp, P. troglodytes
caggccaatgttcagat

SEQ ID NO: 223548 - DNA, 16 bp, P. troglodytes
caggccacatgtggcc

SEQ ID NO: 223549 - DNA, 16 bp, P. troglodytes
caggccactgtgcctg

SEQ ID NO: 223550 - DNA, 16 bp, P. troglodytes
caggccagagtgcagt

SEQ ID NO: 223551 - DNA, 16 bp, P. troglodytes
caggccagctgtggtg

SEQ ID NO: 223552 - DNA, 16 bp, P. troglodytes
caggccaggcacaatg

SEQ ID NO: 223553 - DNA, 16 bp, P. troglodytes
caggccaggcactgtg

SEQ ID NO: 223554 - DNA, 16 bp, P. troglodytes
caggccaggctggtct

SEQ ID NO: 223555 - DNA, 16 bp, P. troglodytes
caggccaggggcagtg

SEQ ID NO: 223556 - DNA, 25 bp, P. troglodytes
caggccatacagagataggagctga

SEQ ID NO: 223557 - DNA, 16 bp, P. troglodytes
caggccatggactggt

SEQ ID NO: 223558 - DNA, 16 bp, P. troglodytes
caggcccagagtgcca

SEQ ID NO: 223559 - DNA, 16 bp, P. troglodytes
caggcccagcccagcc

SEQ ID NO: 223560 - DNA, 16 bp, P. troglodytes
caggcccagcccctcc

SEQ ID NO: 223561 - DNA, 16 bp, P. troglodytes
caggcccagcccctgc

SEQ ID NO: 223562 - DNA, 16 bp, P. troglodytes
caggcccagcctctgc

SEQ ID NO: 223563 - DNA, 16 bp, P. troglodytes
caggcccaggacccca

SEQ ID NO: 223564 - DNA, 16 bp, P. troglodytes
caggcccaggccctgc

SEQ ID NO: 223565 - DNA, 16 bp, P. troglodytes
caggcccagtggctca

SEQ ID NO: 223566 - DNA, 16 bp, P. troglodytes
caggccccacccagac

SEQ ID NO: 223567 - DNA, 16 bp, P. troglodytes
caggccccactccaga

SEQ ID NO: 223568 - DNA, 16 bp, P. troglodytes
caggccccagtggtgg

SEQ ID NO: 223569 - DNA, 16 bp, P. troglodytes
caggccccagtgtttg

SEQ ID NO: 223570 - DNA, 16 bp, P. troglodytes
caggccccatctccag

SEQ ID NO: 223571 - DNA, 16 bp, P. troglodytes
caggccccattgtgtg

SEQ ID NO: 223572 - DNA, 16 bp, P. troglodytes
caggcccccagcccct

SEQ ID NO: 223573 - DNA, 16 bp, P. troglodytes
caggcccccggtgtgt

SEQ ID NO: 223574 - DNA, 16 bp, P. troglodytes
caggccccgcctccaa

SEQ ID NO: 223575 - DNA, 16 bp, P. troglodytes
caggcccctcctccaa

SEQ ID NO: 223576 - DNA, 17 bp, P. troglodytes
caggcccctcttctgca

SEQ ID NO: 223577 - DNA, 16 bp, P. troglodytes
caggcccctgtgtgtg

SEQ ID NO: 223578 - DNA, 16 bp, P. troglodytes
caggccctggagccag

SEQ ID NO: 223579 - DNA, 16 bp, P. troglodytes
caggccctgtcctagg

SEQ ID NO: 223580 - DNA, 16 bp, P. troglodytes
caggccctgtgccagg

SEQ ID NO: 223581 - DNA, 16 bp, P. troglodytes
caggccctgtgctgag

SEQ ID NO: 223582 - DNA, 16 bp, P. troglodytes
caggccgaggcaggag

SEQ ID NO: 223583 - DNA, 16 bp, P. troglodytes
caggccgggcgccgtg

SEQ ID NO: 223584 - DNA, 16 bp, P. troglodytes
caggcctcagccacct

SEQ ID NO: 223585 - DNA, 16 bp, P. troglodytes
caggcctcagctgcct

SEQ ID NO: 223586 - DNA, 16 bp, P. troglodytes
caggcctcagtgtgtg

SEQ ID NO: 223587 - DNA, 16 bp, P. troglodytes
caggcctcagtttctt

SEQ ID NO: 223588 - DNA, 16 bp, P. troglodytes
caggcctcctggagct

SEQ ID NO: 223589 - DNA, 16 bp, P. troglodytes
caggcctgagccacca

SEQ ID NO: 223590 - DNA, 16 bp, P. troglodytes
caggcctgagccacgg

SEQ ID NO: 223591 - DNA, 16 bp, P. troglodytes
caggcctgagccatgg

SEQ ID NO: 223592 - DNA, 16 bp, P. troglodytes
caggcctgcccacagt

SEQ ID NO: 223593 - DNA, 16 bp, P. troglodytes
caggcctggaggacct

SEQ ID NO: 223594 - DNA, 16 bp, P. troglodytes
caggcctggcagcatt

SEQ ID NO: 223595 - DNA, 16 bp, P. troglodytes
caggcctgggccacca

SEQ ID NO: 223596 - DNA, 16 bp, P. troglodytes
caggcctggggtgggg

SEQ ID NO: 223597 - DNA, 16 bp, P. troglodytes
caggcctgtagtccca

SEQ ID NO: 223598 - DNA, 16 bp, P. troglodytes
caggcctgtcctcgga

SEQ ID NO: 223599 - DNA, 16 bp, P. troglodytes
caggccttacatttaa

SEQ ID NO: 223600 - DNA, 16 bp, P. troglodytes
caggcctttcctgggc

SEQ ID NO: 223601 - DNA, 16 bp, P. troglodytes
caggcctttgcacttg

SEQ ID NO: 223602 - DNA, 16 bp, P. troglodytes
caggcctttggcctca

SEQ ID NO: 223603 - DNA, 16 bp, P. troglodytes
caggcgcagtgactca

SEQ ID NO: 223604 - DNA, 16 bp, P. troglodytes
caggcgcccgccagca

SEQ ID NO: 223605 - DNA, 16 bp, P. troglodytes
caggcgcggtggtggg

SEQ ID NO: 223606 - DNA, 16 bp, P. troglodytes
caggcggccaccacca

SEQ ID NO: 223607 - DNA, 16 bp, P. troglodytes
caggcgggagccactg

SEQ ID NO: 223608 - DNA, 16 bp, P. troglodytes
caggcgtaagccaccg

SEQ ID NO: 223609 - DNA, 16 bp, P. troglodytes
caggcgtaagccactg

SEQ ID NO: 223610 - DNA, 16 bp, P. troglodytes
caggcgtaagccatcg

SEQ ID NO: 223611 - DNA, 16 bp, P. troglodytes
caggcgtcagccaccg

SEQ ID NO: 223612 - DNA, 16 bp, P. troglodytes
caggcgtcagccactg

SEQ ID NO: 223613 - DNA, 16 bp, P. troglodytes
caggcgtgaaccaccg

SEQ ID NO: 223614 - DNA, 16 bp, P. troglodytes
caggcgtgagacactg

SEQ ID NO: 223615 - DNA, 16 bp, P. troglodytes
caggcgtgagcaacca

SEQ ID NO: 223616 - DNA, 16 bp, P. troglodytes
caggcgtgagccacag

SEQ ID NO: 223617 - DNA, 16 bp, P. troglodytes
caggcgtgagccacca

SEQ ID NO: 223618 - DNA, 16 bp, P. troglodytes
caggcgtgagccaccc

SEQ ID NO: 223619 - DNA, 16 bp, P. troglodytes
caggcgtgagccaccg

SEQ ID NO: 223620 - DNA, 16 bp, P. troglodytes
caggcgtgagccacgc

SEQ ID NO: 223621 - DNA, 16 bp, P. troglodytes
caggcgtgagccacgg

SEQ ID NO: 223622 - DNA, 16 bp, P. troglodytes
caggcgtgagccacta

SEQ ID NO: 223623 - DNA, 16 bp, P. troglodytes
caggcgtgagccactc

SEQ ID NO: 223624 - DNA, 16 bp, P. troglodytes
caggcgtgagccactg

SEQ ID NO: 223625 - DNA, 16 bp, P. troglodytes
caggcgtgagccagtg

SEQ ID NO: 223626 - DNA, 16 bp, P. troglodytes
caggcgtgagccatca

SEQ ID NO: 223627 - DNA, 16 bp, P. troglodytes
caggcgtgagccatgg

SEQ ID NO: 223628 - DNA, 16 bp, P. troglodytes
caggcgtgagccatta

SEQ ID NO: 223629 - DNA, 16 bp, P. troglodytes
caggcgtgagccattg

SEQ ID NO: 223630 - DNA, 16 bp, P. troglodytes
caggcgtgagccgctg

SEQ ID NO: 223631 - DNA, 16 bp, P. troglodytes
caggcgtgagctaccg

SEQ ID NO: 223632 - DNA, 16 bp, P. troglodytes
caggcgtgagctactg

SEQ ID NO: 223633 - DNA, 16 bp, P. troglodytes
caggcgtgaggcactg

SEQ ID NO: 223634 - DNA, 16 bp, P. troglodytes
caggcgtgagtcacca

SEQ ID NO: 223635 - DNA, 16 bp, P. troglodytes
caggcgtgagtcaccg

SEQ ID NO: 223636 - DNA, 16 bp, P. troglodytes
caggcgtgagtcactg

SEQ ID NO: 223637 - DNA, 16 bp, P. troglodytes
caggcgtgatggcaca

SEQ ID NO: 223638 - DNA, 16 bp, P. troglodytes
caggcgtgcaccactg

SEQ ID NO: 223639 - DNA, 16 bp, P. troglodytes
caggcgtgcgccacca

SEQ ID NO: 223640 - DNA, 17 bp, P. troglodytes
caggcgtgcgccaccac

SEQ ID NO: 223641 - DNA, 16 bp, P. troglodytes
caggcgtgctggcagg

SEQ ID NO: 223642 - DNA, 16 bp, P. troglodytes
caggcgtggcggcgcg

SEQ ID NO: 223643 - DNA, 16 bp, P. troglodytes
caggcgtgggccaccg

SEQ ID NO: 223644 - DNA, 16 bp, P. troglodytes
caggcgtggtagtggg

SEQ ID NO: 223645 - DNA, 16 bp, P. troglodytes
caggcgtgtgccactg

SEQ ID NO: 223646 - DNA, 16 bp, P. troglodytes
caggctaatcttgaac

SEQ ID NO: 223647 - DNA, 16 bp, P. troglodytes
caggctaattttttgt

SEQ ID NO: 223648 - DNA, 16 bp, P. troglodytes
caggctcaagggattc

SEQ ID NO: 223649 - DNA, 16 bp, P. troglodytes
caggctcaataccaca

SEQ ID NO: 223650 - DNA, 16 bp, P. troglodytes
caggctcacagctgga

SEQ ID NO: 223651 - DNA, 16 bp, P. troglodytes
caggctcagaaaagac

SEQ ID NO: 223652 - DNA, 16 bp, P. troglodytes
caggctcaggagatcc

SEQ ID NO: 223653 - DNA, 16 bp, P. troglodytes
caggctcaggctcagg
